United States Patent 11,254,933 (CRISPR/CAS TRANSCRIPTIONAL MODULATION) - sequence listing, part 2

SEQ ID NO: 41719 - DNA, 20 bp, human
gggctccagatgacagcggg

SEQ ID NO: 41720 - DNA, 20 bp, human
gcggcagcatcaggatgggg

SEQ ID NO: 41721 - DNA, 20 bp, human
ggggagtacggtctagacag

SEQ ID NO: 41722 - DNA, 20 bp, human
gttccggcagcatcaggatg

SEQ ID NO: 41723 - DNA, 20 bp, human
gcgggaggccgcaagagggg

SEQ ID NO: 41724 - DNA, 20 bp, human
ggagtttgcgatccgagagc

SEQ ID NO: 41725 - DNA, 20 bp, human
gggagcgcggatcccgctct

SEQ ID NO: 41726 - DNA, 20 bp, human
gagaggccagctgcgaggag

SEQ ID NO: 41727 - DNA, 20 bp, human
gggagatgcgagtaagtggt

SEQ ID NO: 41728 - DNA, 20 bp, human
gtgggaggtggggatatgag

SEQ ID NO: 41729 - DNA, 20 bp, human
gcgagtaagtggttgggtgg

SEQ ID NO: 41730 - DNA, 20 bp, human
gcgggggagatgcgagtaag

SEQ ID NO: 41731 - DNA, 20 bp, human
ggcgcggcttcagggctgaa

SEQ ID NO: 41732 - DNA, 20 bp, human
gatatgagaggccagctgcg

SEQ ID NO: 41733 - DNA, 20 bp, human
gctgaagccgcgccgccatg

SEQ ID NO: 41734 - DNA, 20 bp, human
ggaggtgggggccgggagat

SEQ ID NO: 41735 - DNA, 20 bp, human
gactcaagcaggcggctctc

SEQ ID NO: 41736 - DNA, 20 bp, human
gagaggccagctgcgaggag

SEQ ID NO: 41737 - DNA, 20 bp, human
ggagatgcgagtaagtggtt

SEQ ID NO: 41738 - DNA, 20 bp, human
gtgggaggtggggatatgag

SEQ ID NO: 41739 - DNA, 20 bp, human
gcgagtaagtggttgggtgg

SEQ ID NO: 41740 - DNA, 20 bp, human
gcgggggagatgcgagtaag

SEQ ID NO: 41741 - DNA, 20 bp, human
ggcgcggcttcagggctgaa

SEQ ID NO: 41742 - DNA, 20 bp, human
gatatgagaggccagctgcg

SEQ ID NO: 41743 - DNA, 20 bp, human
ggaggtgggggccgggagat

SEQ ID NO: 41744 - DNA, 20 bp, human
gctgaagccgcgccgccatg

SEQ ID NO: 41745 - DNA, 20 bp, human
gactcaagcaggcggctctc

SEQ ID NO: 41746 - DNA, 20 bp, human
gagggccaggtgcggaaggt

SEQ ID NO: 41747 - DNA, 20 bp, human
gccgtgagacggagacaaca

SEQ ID NO: 41748 - DNA, 20 bp, human
gcaacagggtcaagaggtgg

SEQ ID NO: 41749 - DNA, 20 bp, human
gcggcctcctggccccgcag

SEQ ID NO: 41750 - DNA, 20 bp, human
gcgcttctgcgcaggatgga

SEQ ID NO: 41751 - DNA, 20 bp, human
gaggtggggtttgggagatg

SEQ ID NO: 41752 - DNA, 20 bp, human
gaggatggaaggtgcccctg

SEQ ID NO: 41753 - DNA, 20 bp, human
ggtgccgcttctgcgcagga

SEQ ID NO: 41754 - DNA, 20 bp, human
gtgttctgttctgttctagg

SEQ ID NO: 41755 - DNA, 20 bp, human
gatgggggtaaggggccggg

SEQ ID NO: 41756 - DNA, 20 bp, human
gtaaccctcagccatacctg

SEQ ID NO: 41757 - DNA, 20 bp, human
ggaagacgcagcattccgtt

SEQ ID NO: 41758 - DNA, 20 bp, human
gcctcggccacaacaaacgc

SEQ ID NO: 41759 - DNA, 20 bp, human
ggtcctggagttgctacgca

SEQ ID NO: 41760 - DNA, 20 bp, human
gaacctgttcagcttttcgc

SEQ ID NO: 41761 - DNA, 20 bp, human
gttttagatcagttacgagt

SEQ ID NO: 41762 - DNA, 20 bp, human
gtgatacgtgcagctgttgc

SEQ ID NO: 41763 - DNA, 20 bp, human
ggcggttgctgcagtaacct

SEQ ID NO: 41764 - DNA, 20 bp, human
gagagagaaaaagtttgctg

SEQ ID NO: 41765 - DNA, 20 bp, human
gttttgctgttctcttcttg

SEQ ID NO: 41766 - DNA, 20 bp, human
gtcggggccacaataaacgg

SEQ ID NO: 41767 - DNA, 20 bp, human
ggattcgggttccggaccga

SEQ ID NO: 41768 - DNA, 20 bp, human
gctgtcggggccacaataaa

SEQ ID NO: 41769 - DNA, 20 bp, human
gtcgggacctctgaccacgg

SEQ ID NO: 41770 - DNA, 20 bp, human
gacggttgaggggtaacccc

SEQ ID NO: 41771 - DNA, 20 bp, human
gttgtggccccgacaggccg

SEQ ID NO: 41772 - DNA, 20 bp, human
gccgggcagcagacgaggac

SEQ ID NO: 41773 - DNA, 20 bp, human
gagcgccaaagctgctctcg

SEQ ID NO: 41774 - DNA, 20 bp, human
ggcgaccacgagagcagctt

SEQ ID NO: 41775 - DNA, 20 bp, human
ggggagccgggcagcagacg

SEQ ID NO: 41776 - DNA, 20 bp, human
gtcaacaagggcctgccgct

SEQ ID NO: 41777 - DNA, 20 bp, human
gcgcgcgcggccttaccaag

SEQ ID NO: 41778 - DNA, 20 bp, human
gcagcggcgcggcggagact

SEQ ID NO: 41779 - DNA, 20 bp, human
gggcgctcgcgcacacgcag

SEQ ID NO: 41780 - DNA, 20 bp, human
gcggcggagactcggcacgg

SEQ ID NO: 41781 - DNA, 20 bp, human
ggccgctcgcgcctctcgat

SEQ ID NO: 41782 - DNA, 20 bp, human
ggtgcgagctgcccatcgag

SEQ ID NO: 41783 - DNA, 20 bp, human
gccgtgcaggtgacacaaaa

SEQ ID NO: 41784 - DNA, 20 bp, human
gcggagactcggcacggcgg

SEQ ID NO: 41785 - DNA, 20 bp, human
ggctcgcacttgctcaacaa

SEQ ID NO: 41786 - DNA, 20 bp, human
gtggctgcgcaggagctagg

SEQ ID NO: 41787 - DNA, 20 bp, human
gcagcgggtaccgggagctg

SEQ ID NO: 41788 - DNA, 20 bp, human
gtaggcgggaggcgaggtga

SEQ ID NO: 41789 - DNA, 20 bp, human
gctgcgcagccagcgggtac

SEQ ID NO: 41790 - DNA, 20 bp, human
gagcggcccggaggagccgg

SEQ ID NO: 41791 - DNA, 20 bp, human
gtagctcctgcgcagccagc

SEQ ID NO: 41792 - DNA, 20 bp, human
gaggagcgagggaccgaacc

SEQ ID NO: 41793 - DNA, 20 bp, human
gcgccgcgctcacccccgag

SEQ ID NO: 41794 - DNA, 20 bp, human
gggaattagcatcctctcgg

SEQ ID NO: 41795 - DNA, 20 bp, human
gcgaaaggcgcccaccctgg

SEQ ID NO: 41796 - DNA, 20 bp, human
ggctcggcgggctagagacg

SEQ ID NO: 41797 - DNA, 20 bp, human
ggacatagcagcaggtctag

SEQ ID NO: 41798 - DNA, 20 bp, human
gaggcggtaggaacccactc

SEQ ID NO: 41799 - DNA, 20 bp, human
gggcgccagcgtcgaagctg

SEQ ID NO: 41800 - DNA, 20 bp, human
gaggtctagcgggccggagt

SEQ ID NO: 41801 - DNA, 20 bp, human
gagcctgtaagtgcctgcgt

SEQ ID NO: 41802 - DNA, 20 bp, human
gtggatggtggcgaatcggg

SEQ ID NO: 41803 - DNA, 20 bp, human
gccctgaagcccagacctag

SEQ ID NO: 41804 - DNA, 20 bp, human
gagcagcaggtctagcgggc

SEQ ID NO: 41805 - DNA, 20 bp, human
gccggccgcagcttcgacgc

SEQ ID NO: 41806 - DNA, 20 bp, human
ggagctccggcgcatcatgg

SEQ ID NO: 41807 - DNA, 20 bp, human
ggacgtaatagcagcactca

SEQ ID NO: 41808 - DNA, 20 bp, human
ggagcacctgcccctcccgg

SEQ ID NO: 41809 - DNA, 20 bp, human
ggcggagctccggcgcatca

SEQ ID NO: 41810 - DNA, 20 bp, human
gactcacggaggaagggacc

SEQ ID NO: 41811 - DNA, 20 bp, human
gaggcaaaaagcgccgaaag

SEQ ID NO: 41812 - DNA, 20 bp, human
ggcgggcgccgcgtgaatga

SEQ ID NO: 41813 - DNA, 20 bp, human
gcggagctccgcccccggga

SEQ ID NO: 41814 - DNA, 20 bp, human
gcattcgcagaaccagtaag

SEQ ID NO: 41815 - DNA, 20 bp, human
gacggagctgtaggggaaaa

SEQ ID NO: 41816 - DNA, 20 bp, human
gccggccgggcggcgagtag

SEQ ID NO: 41817 - DNA, 20 bp, human
gtgctgataagggaagggac

SEQ ID NO: 41818 - DNA, 20 bp, human
gcggcctcgagggcagacaa

SEQ ID NO: 41819 - DNA, 20 bp, human
gcagcgcgctaggcctcggg

SEQ ID NO: 41820 - DNA, 20 bp, human
gggccaagaaccggcctcga

SEQ ID NO: 41821 - DNA, 20 bp, human
gtagcgcgctgccaggaggg

SEQ ID NO: 41822 - DNA, 20 bp, human
gcacaggctcagacacaaaa

SEQ ID NO: 41823 - DNA, 20 bp, human
ggccgcagcagggacggtag

SEQ ID NO: 41824 - DNA, 20 bp, human
gccatcgtgacacctagagg

SEQ ID NO: 41825 - DNA, 20 bp, human
gcgcggagctgcttctttgg

SEQ ID NO: 41826 - DNA, 20 bp, human
gaggtgggcttgaccgggac

SEQ ID NO: 41827 - DNA, 20 bp, human
ggtggggggcagggtaaagc

SEQ ID NO: 41828 - DNA, 20 bp, human
gcacaagccaaagacggagt

SEQ ID NO: 41829 - DNA, 20 bp, human
gctgcagcacgcggtgcacg

SEQ ID NO: 41830 - DNA, 20 bp, human
gctggcgcgagagtggaggg

SEQ ID NO: 41831 - DNA, 20 bp, human
gggctgtgggctgcagcacg

SEQ ID NO: 41832 - DNA, 20 bp, human
ggggctggcgcgagagtgga

SEQ ID NO: 41833 - DNA, 20 bp, human
gtctcgcgccagcccggcgg

SEQ ID NO: 41834 - DNA, 20 bp, human
ggtctagaaccgtgcacgag

SEQ ID NO: 41835 - DNA, 20 bp, human
gcccggcggcggccggctgt

SEQ ID NO: 41836 - DNA, 20 bp, human
gaaatggcgcctgtcagagt

SEQ ID NO: 41837 - DNA, 20 bp, human
ggggctgggagtggcaccga

SEQ ID NO: 41838 - DNA, 20 bp, human
ggctgctcgcaggaacgggg

SEQ ID NO: 41839 - DNA, 20 bp, human
gctgggtttcccactctgac

SEQ ID NO: 41840 - DNA, 20 bp, human
ggctgcgcaggcgcgctagg

SEQ ID NO: 41841 - DNA, 20 bp, human
ggcaacctccccgaagccgt

SEQ ID NO: 41842 - DNA, 20 bp, human
ggaacgggcctgcagagcga

SEQ ID NO: 41843 - DNA, 20 bp, human
gagtcctttggacggtaaaa

SEQ ID NO: 41844 - DNA, 20 bp, human
gggggctgctcgcaggaacg

SEQ ID NO: 41845 - DNA, 20 bp, human
gtccccctccccgagctcgg

SEQ ID NO: 41846 - DNA, 20 bp, human
gctaggcgacgggtggaagc

SEQ ID NO: 41847 - DNA, 20 bp, human
ggtcggcgcgggctaggcga

SEQ ID NO: 41848 - DNA, 20 bp, human
gcagagcgcagcgcctaccg

SEQ ID NO: 41849 - DNA, 20 bp, human
gcgcctgggttgtgtcgccg

SEQ ID NO: 41850 - DNA, 20 bp, human
gtaccgcggcgacacaaccc

SEQ ID NO: 41851 - DNA, 20 bp, human
ggcgacgctgtagttcctct

SEQ ID NO: 41852 - DNA, 20 bp, human
ggaggctacacgggactgag

SEQ ID NO: 41853 - DNA, 20 bp, human
gagtcccgtgtagcctccgg

SEQ ID NO: 41854 - DNA, 20 bp, human
gtccactccagcaggcgcag

SEQ ID NO: 41855 - DNA, 20 bp, human
gtccatcgcggacagagggc

SEQ ID NO: 41856 - DNA, 20 bp, human
ggatccccgcgagctccgga

SEQ ID NO: 41857 - DNA, 20 bp, human
gggagagagtttgaactcag

SEQ ID NO: 41858 - DNA, 20 bp, human
gggagcttcgggcacagcta

SEQ ID NO: 41859 - DNA, 20 bp, human
gggggagccaggttctaggg

SEQ ID NO: 41860 - DNA, 20 bp, human
gggaggggagccaggttcta

SEQ ID NO: 41861 - DNA, 20 bp, human
gcgcgagctccggaggggag

SEQ ID NO: 41862 - DNA, 20 bp, human
ggcgaacaggagcgccccaa

SEQ ID NO: 41863 - DNA, 20 bp, human
ggcttcgggcacagctaagg

SEQ ID NO: 41864 - DNA, 20 bp, human
ggggccgggatcttccccag

SEQ ID NO: 41865 - DNA, 20 bp, human
ggccgcgccggtcccagaag

SEQ ID NO: 41866 - DNA, 20 bp, human
gtgctcaccaagcaaggtag

SEQ ID NO: 41867 - DNA, 20 bp, human
gccatgttggacccaaactg

SEQ ID NO: 41868 - DNA, 20 bp, human
gaggtcaagggccgagacct

SEQ ID NO: 41869 - DNA, 20 bp, human
gagcccggagctgccgctgg

SEQ ID NO: 41870 - DNA, 20 bp, human
gtcacagatggagggtccca

SEQ ID NO: 41871 - DNA, 20 bp, human
gagggaggcggcctgtacaa

SEQ ID NO: 41872 - DNA, 20 bp, human
gcagccccgaacccaggtct

SEQ ID NO: 41873 - DNA, 20 bp, human
gaggcggcctgtacaaaggg

SEQ ID NO: 41874 - DNA, 20 bp, human
gcgctccggattctccatgt

SEQ ID NO: 41875 - DNA, 20 bp, human
gggcactcagacctccgtgg

SEQ ID NO: 41876 - DNA, 20 bp, human
ggcccggcagtgaactccag

SEQ ID NO: 41877 - DNA, 20 bp, human
gggcgcgggcgagaaaggtg

SEQ ID NO: 41878 - DNA, 20 bp, human
ggggagagccgcgcacgggg

SEQ ID NO: 41879 - DNA, 20 bp, human
gcgcccgctcccgcttccag

SEQ ID NO: 41880 - DNA, 20 bp, human
gtgccgggcgcgggcgagaa

SEQ ID NO: 41881 - DNA, 20 bp, human
gcaggtgaccaaccccaagg

SEQ ID NO: 41882 - DNA, 20 bp, human
ggcctcgtcaccatgaaccc

SEQ ID NO: 41883 - DNA, 20 bp, human
gggcccggcgccgctggaag

SEQ ID NO: 41884 - DNA, 20 bp, human
gcgccgccgctgggctcgag

SEQ ID NO: 41885 - DNA, 20 bp, human
gcgcgccgcgcacccatgga

SEQ ID NO: 41886 - DNA, 20 bp, human
gggactgagattggaagcag

SEQ ID NO: 41887 - DNA, 20 bp, human
ggggaggagatcccggcaga

SEQ ID NO: 41888 - DNA, 20 bp, human
gtgcggtgcagcaggtcggt

SEQ ID NO: 41889 - DNA, 20 bp, human
gtccgtgcggtgcagcaggt

SEQ ID NO: 41890 - DNA, 20 bp, human
ggtaggcgggaaatggcgac

SEQ ID NO: 41891 - DNA, 20 bp, human
gcggcagacggccctggaag

SEQ ID NO: 41892 - DNA, 20 bp, human
gcaggtcggtaggcgggaaa

SEQ ID NO: 41893 - DNA, 20 bp, human
gtaaagcgttaggagtggag

SEQ ID NO: 41894 - DNA, 20 bp, human
ggaggcggggacccgaagga

SEQ ID NO: 41895 - DNA, 20 bp, human
gacgcaggccgcaacctaag

SEQ ID NO: 41896 - DNA, 20 bp, human
ggggagccgggatcagccag

SEQ ID NO: 41897 - DNA, 20 bp, human
gcaacaggagacgaaagtct

SEQ ID NO: 41898 - DNA, 20 bp, human
ggccagcatgagccggaggg

SEQ ID NO: 41899 - DNA, 20 bp, human
gggggccagcatgagccgga

SEQ ID NO: 41900 - DNA, 20 bp, human
ggagtaagggaaggcagtct

SEQ ID NO: 41901 - DNA, 20 bp, human
gctcgaaaggggggcgtgaa

SEQ ID NO: 41902 - DNA, 20 bp, human
gggagggaagtctgggtaag

SEQ ID NO: 41903 - DNA, 20 bp, human
gtggtgctgggaaacttcgg

SEQ ID NO: 41904 - DNA, 20 bp, human
gtgagaaacagcaggcgcta

SEQ ID NO: 41905 - DNA, 20 bp, human
gcgagactcagtggacgcag

SEQ ID NO: 41906 - DNA, 20 bp, human
gcagctgcttggcgcagacg

SEQ ID NO: 41907 - DNA, 20 bp, human
gctggagggtggagtcgcac

SEQ ID NO: 41908 - DNA, 20 bp, human
gcggctgccgtcgagctgga

SEQ ID NO: 41909 - DNA, 20 bp, human
ggccgcagccgtccagcacg

SEQ ID NO: 41910 - DNA, 20 bp, human
ggcgcggcgccggctcgtcc

SEQ ID NO: 41911 - DNA, 20 bp, human
ggaacgtccatgctgcacag

SEQ ID NO: 41912 - DNA, 20 bp, human
ggcgtgagcctcgtgctgga

SEQ ID NO: 41913 - DNA, 20 bp, human
gactccaccctccagctcga

SEQ ID NO: 41914 - DNA, 20 bp, human
ggaggcggccggacacctag

SEQ ID NO: 41915 - DNA, 20 bp, human
gccgtcggccagaactgcag

SEQ ID NO: 41916 - DNA, 20 bp, human
ggacggcgagcgcactaaag

SEQ ID NO: 41917 - DNA, 20 bp, human
gcggcacacagcgattgttg

SEQ ID NO: 41918 - DNA, 20 bp, human
gagaaggagctaaagcacgc

SEQ ID NO: 41919 - DNA, 20 bp, human
gacagaaggatcaggcgaga

SEQ ID NO: 41920 - DNA, 20 bp, human
gtacggcttatgaatttgaa

SEQ ID NO: 41921 - DNA, 20 bp, human
gagtcgaagccgggtgtccg

SEQ ID NO: 41922 - DNA, 20 bp, human
gtatgacttataaattagga

SEQ ID NO: 41923 - DNA, 20 bp, human
gcacacagcgattgttgggg

SEQ ID NO: 41924 - DNA, 20 bp, human
gggcaggaaaccttgtgagg

SEQ ID NO: 41925 - DNA, 20 bp, human
ggccccttgcttgaacgtgg

SEQ ID NO: 41926 - DNA, 20 bp, human
gctggaggcggaggagaccg

SEQ ID NO: 41927 - DNA, 20 bp, human
ggcgcagctccggcagaggg

SEQ ID NO: 41928 - DNA, 20 bp, human
ggcattgatgcagcctgcgg

SEQ ID NO: 41929 - DNA, 20 bp, human
gagagaggcgcgcgggtgaa

SEQ ID NO: 41930 - DNA, 20 bp, human
gatgcagcctgcggcggcct

SEQ ID NO: 41931 - DNA, 20 bp, human
ggaagcaaaaggcgcagctc

SEQ ID NO: 41932 - DNA, 20 bp, human
gttacaggtgaagaaggacc

SEQ ID NO: 41933 - DNA, 20 bp, human
ggtggacctggtgagtccga

SEQ ID NO: 41934 - DNA, 20 bp, human
gacctggccgcgcgccccac

SEQ ID NO: 41935 - DNA, 20 bp, human
gtgggtctccccgaagtaca

SEQ ID NO: 41936 - DNA, 20 bp, human
gccccaccgagggggaggag

SEQ ID NO: 41937 - DNA, 20 bp, human
ggtgcagttccccaccgagg

SEQ ID NO: 41938 - DNA, 20 bp, human
gacacagggaaagagaatgt

SEQ ID NO: 41939 - DNA, 20 bp, human
gccgaactcgaggcaggagt

SEQ ID NO: 41940 - DNA, 20 bp, human
ggaggagggctgcgtgacgt

SEQ ID NO: 41941 - DNA, 20 bp, human
gggcggccagaggaaccccg

SEQ ID NO: 41942 - DNA, 20 bp, human
gcgcgccaagcccgagtcgg

SEQ ID NO: 41943 - DNA, 20 bp, human
gcagggagggggcgacactg

SEQ ID NO: 41944 - DNA, 20 bp, human
gcgaggagatgctcacctcg

SEQ ID NO: 41945 - DNA, 20 bp, human
gccttggcgccggagctcca

SEQ ID NO: 41946 - DNA, 20 bp, human
gagttgggcggcagcaaata

SEQ ID NO: 41947 - DNA, 20 bp, human
gtggctggctctgtattcca

SEQ ID NO: 41948 - DNA, 20 bp, human
gagcgccaggtatttagtag

SEQ ID NO: 41949 - DNA, 20 bp, human
gcttgtgccgctgaaatcca

SEQ ID NO: 41950 - DNA, 20 bp, human
gacatgtgtaatacatatct

SEQ ID NO: 41951 - DNA, 20 bp, human
gttgaacccacacagaatca

SEQ ID NO: 41952 - DNA, 20 bp, human
gtggtttagtagagagacac

SEQ ID NO: 41953 - DNA, 20 bp, human
ggaacctggctaccaggacc

SEQ ID NO: 41954 - DNA, 20 bp, human
gaaagtccttgattctgtgt

SEQ ID NO: 41955 - DNA, 20 bp, human
gtagcaaagccagaagttaa

SEQ ID NO: 41956 - DNA, 20 bp, human
gccagaggcccgaagcagac

SEQ ID NO: 41957 - DNA, 20 bp, human
gggcgagcgctaaattccag

SEQ ID NO: 41958 - DNA, 20 bp, human
gggaggtacgaagttacctg

SEQ ID NO: 41959 - DNA, 20 bp, human
gtcctcctagccggactgga

SEQ ID NO: 41960 - DNA, 20 bp, human
ggagaccgcgcccgcgagga

SEQ ID NO: 41961 - DNA, 20 bp, human
gccatactcgggccctgcgg

SEQ ID NO: 41962 - DNA, 20 bp, human
gcagcgctcgggaagtcggg

SEQ ID NO: 41963 - DNA, 20 bp, human
gaggccgcggtaacaaagtt

SEQ ID NO: 41964 - DNA, 20 bp, human
ggtctccctccagtccggct

SEQ ID NO: 41965 - DNA, 20 bp, human
gccaggccgagagggtcctt

SEQ ID NO: 41966 - DNA, 20 bp, human
ggaggcggcggcagggacaa

SEQ ID NO: 41967 - DNA, 20 bp, human
gaccgcacctcggccagagg

SEQ ID NO: 41968 - DNA, 20 bp, human
gagtgaggcggagacccagg

SEQ ID NO: 41969 - DNA, 20 bp, human
gagcaggcggcaccgcacct

SEQ ID NO: 41970 - DNA, 20 bp, human
gagtggctgcaaggaagacg

SEQ ID NO: 41971 - DNA, 20 bp, human
gccgagtgaggcggagaccc

SEQ ID NO: 41972 - DNA, 20 bp, human
gcttccagccccgagtgagg

SEQ ID NO: 41973 - DNA, 20 bp, human
gatcacagaagggactggag

SEQ ID NO: 41974 - DNA, 20 bp, human
gggcggagacccaggcgggc

SEQ ID NO: 41975 - DNA, 20 bp, human
ggccgcctctggccgaggtg

SEQ ID NO: 41976 - DNA, 20 bp, human
gaaattgtgagccatgatag

SEQ ID NO: 41977 - DNA, 20 bp, human
ggtcatcctgaaatacacta

SEQ ID NO: 41978 - DNA, 20 bp, human
gggcagattcaattgagcag

SEQ ID NO: 41979 - DNA, 20 bp, human
gaaattcagtgccactatca

SEQ ID NO: 41980 - DNA, 20 bp, human
gatacactagggtgcttgtc

SEQ ID NO: 41981 - DNA, 20 bp, human
gcgagtctgctgtttattag

SEQ ID NO: 41982 - DNA, 20 bp, human
gctcggttagataactttgg

SEQ ID NO: 41983 - DNA, 20 bp, human
gtcagatttagataaaaatg

SEQ ID NO: 41984 - DNA, 20 bp, human
gaaatgcctgctaatatact

SEQ ID NO: 41985 - DNA, 20 bp, human
gcttttccgagtatattagc

SEQ ID NO: 41986 - DNA, 20 bp, human
gctcgggcgggtgggctgac

SEQ ID NO: 41987 - DNA, 20 bp, human
gtcgccgcggcgcggagtcc

SEQ ID NO: 41988 - DNA, 20 bp, human
gcggctgcgggatagaccga

SEQ ID NO: 41989 - DNA, 20 bp, human
gccgtcccggagccccacac

SEQ ID NO: 41990 - DNA, 20 bp, human
gcccgggagccgcagacccg

SEQ ID NO: 41991 - DNA, 20 bp, human
gctccggcggcagggttgag

SEQ ID NO: 41992 - DNA, 20 bp, human
gtgagtggactcggcagcag

SEQ ID NO: 41993 - DNA, 20 bp, human
gtggataatccaaactccgg

SEQ ID NO: 41994 - DNA, 20 bp, human
ggactggataatccaaactc

SEQ ID NO: 41995 - DNA, 20 bp, human
gcggcagggttgagtggact

SEQ ID NO: 41996 - DNA, 20 bp, human
ggctgctgccacagaccgag

SEQ ID NO: 41997 - DNA, 20 bp, human
ggttggcccggccccgggag

SEQ ID NO: 41998 - DNA, 20 bp, human
ggcgcgtacaggagcccgga

SEQ ID NO: 41999 - DNA, 20 bp, human
ggagcagccccggaaggata

SEQ ID NO: 42000 - DNA, 20 bp, human
gccccgggagcggagagcga

SEQ ID NO: 42001 - DNA, 20 bp, human
ggccccggaaggataaggaa

SEQ ID NO: 42002 - DNA, 20 bp, human
gcagaccgagaggcttaaaa

SEQ ID NO: 42003 - DNA, 20 bp, human
gcggtctgtggcagcagcgt

SEQ ID NO: 42004 - DNA, 20 bp, human
gtacgaagtttggctccgag

SEQ ID NO: 42005 - DNA, 20 bp, human
gggagcgcccaagcacctca

SEQ ID NO: 42006 - DNA, 20 bp, human
ggtgaggtgagcaacaaggt

SEQ ID NO: 42007 - DNA, 20 bp, human
gacccccgggcgaagagtca

SEQ ID NO: 42008 - DNA, 20 bp, human
ggcggcgcggacacctgtgg

SEQ ID NO: 42009 - DNA, 20 bp, human
gcgcggtgaggtgagcaaca

SEQ ID NO: 42010 - DNA, 20 bp, human
gcccgggcgaagagtcaggg

SEQ ID NO: 42011 - DNA, 20 bp, human
ggatgacaggcacccggacg

SEQ ID NO: 42012 - DNA, 20 bp, human
gcacctgtggaggcgacccc

SEQ ID NO: 42013 - DNA, 20 bp, human
gaggggcccagaggtcggga

SEQ ID NO: 42014 - DNA, 20 bp, human
gaccgcggtgactctcggag

SEQ ID NO: 42015 - DNA, 20 bp, human
gagggcggacgggcgatgac

SEQ ID NO: 42016 - DNA, 20 bp, human
gggccgggtaccatggacgt

SEQ ID NO: 42017 - DNA, 20 bp, human
ggccgcggctgacgggcccg

SEQ ID NO: 42018 - DNA, 20 bp, human
ggagagcaaagtaaaacgag

SEQ ID NO: 42019 - DNA, 20 bp, human
gcggagccgcagagccaata

SEQ ID NO: 42020 - DNA, 20 bp, human
gcggtctgggcgtgagtgca

SEQ ID NO: 42021 - DNA, 20 bp, human
gcatcacctcaatgactggg

SEQ ID NO: 42022 - DNA, 20 bp, human
gaccgcgggcccgtcagccg

SEQ ID NO: 42023 - DNA, 20 bp, human
gcctccctgcccctcatacc

SEQ ID NO: 42024 - DNA, 20 bp, human
ggctgacgggcccgcggtct

SEQ ID NO: 42025 - DNA, 20 bp, human
ggaatcgaaagggcccagga

SEQ ID NO: 42026 - DNA, 20 bp, human
gggaagttgcacccagccaa

SEQ ID NO: 42027 - DNA, 20 bp, human
gtgcacccagccaaaggcaa

SEQ ID NO: 42028 - DNA, 20 bp, human
gttaggtgttggatctgagg

SEQ ID NO: 42029 - DNA, 20 bp, human
gggaagctgaatagatccag

SEQ ID NO: 42030 - DNA, 20 bp, human
gggctcccttgcctttggct

SEQ ID NO: 42031 - DNA, 20 bp, human
ggagcaggaaagatcccgaa

SEQ ID NO: 42032 - DNA, 20 bp, human
gatgtactgacgggaaaagg

SEQ ID NO: 42033 - DNA, 20 bp, human
ggacctagaaacaaacttct

SEQ ID NO: 42034 - DNA, 20 bp, human
gtcagatccaacacctaaaa

SEQ ID NO: 42035 - DNA, 20 bp, human
ggatccagaggggtaagagc

SEQ ID NO: 42036 - DNA, 20 bp, human
gccccaccagcggcaagagg

SEQ ID NO: 42037 - DNA, 20 bp, human
gagccccgcaactcacccaa

SEQ ID NO: 42038 - DNA, 20 bp, human
ggcgatcgcggtcctccccg

SEQ ID NO: 42039 - DNA, 20 bp, human
gccaaaggcgcggcgcccgg

SEQ ID NO: 42040 - DNA, 20 bp, human
gactgaggagctgtcgccgg

SEQ ID NO: 42041 - DNA, 20 bp, human
gaccttgccctgaagccggg

SEQ ID NO: 42042 - DNA, 20 bp, human
gaggagctgtcgccggcgga

SEQ ID NO: 42043 - DNA, 20 bp, human
gcggactgaggagctgtcgc

SEQ ID NO: 42044 - DNA, 20 bp, human
gttcctcccggggagatggg

SEQ ID NO: 42045 - DNA, 20 bp, human
gagctcctcagtccgggaag

SEQ ID NO: 42046 - DNA, 20 bp, human
gaggctcatgcgtcccgtga

SEQ ID NO: 42047 - DNA, 20 bp, human
gaacgcggtgcattcctgac

SEQ ID NO: 42048 - DNA, 20 bp, human
gctcatgcgtcccgtgaggg

SEQ ID NO: 42049 - DNA, 20 bp, human
gctagccgggcaggggaacg

SEQ ID NO: 42050 - DNA, 20 bp, human
ggagagcgccggttgacgtg

SEQ ID NO: 42051 - DNA, 20 bp, human
gggcggaggtcaggtgacag

SEQ ID NO: 42052 - DNA, 20 bp, human
ggcgacacgggacaaccccc

SEQ ID NO: 42053 - DNA, 20 bp, human
gcccgagcggtggtcagccg

SEQ ID NO: 42054 - DNA, 20 bp, human
gccaaagtctagccgggcag

SEQ ID NO: 42055 - DNA, 20 bp, human
gggcggttcctcgagcctgg

SEQ ID NO: 42056 - DNA, 20 bp, human
gtgcgcccggcagtctttca

SEQ ID NO: 42057 - DNA, 20 bp, human
ggcccggcagtctttcacgg

SEQ ID NO: 42058 - DNA, 20 bp, human
ggcgccgctccactccccta

SEQ ID NO: 42059 - DNA, 20 bp, human
gtgcggtcggggttgttcac

SEQ ID NO: 42060 - DNA, 20 bp, human
gaaagactgccgggcgcatg

SEQ ID NO: 42061 - DNA, 20 bp, human
gctaggctgtgcgcacgcag

SEQ ID NO: 42062 - DNA, 20 bp, human
gctgccgggcgcatgcggtc

SEQ ID NO: 42063 - DNA, 20 bp, human
gcgcagacgaagagcaaggg

SEQ ID NO: 42064 - DNA, 20 bp, human
ggctgtgcgcacgcagaggt

SEQ ID NO: 42065 - DNA, 20 bp, human
gtcagctcggccgggctcgt

SEQ ID NO: 42066 - DNA, 20 bp, human
gagccggcgccatcagagag

SEQ ID NO: 42067 - DNA, 20 bp, human
ggccatcagagagcggacaa

SEQ ID NO: 42068 - DNA, 20 bp, human
gcggccccacaagtgcaccg

SEQ ID NO: 42069 - DNA, 20 bp, human
gctgtgagctagctcctcaa

SEQ ID NO: 42070 - DNA, 20 bp, human
gggagaggccctggggacga

SEQ ID NO: 42071 - DNA, 20 bp, human
gcccagtgcgtccagagcgg

SEQ ID NO: 42072 - DNA, 20 bp, human
gcagccccggtgcacttgtg

SEQ ID NO: 42073 - DNA, 20 bp, human
ggggcccagtgcgtccagag

SEQ ID NO: 42074 - DNA, 20 bp, human
gtgggcggtgggaagatccc

SEQ ID NO: 42075 - DNA, 20 bp, human
gtgcaaagtgagccacggga

SEQ ID NO: 42076 - DNA, 20 bp, human
gccgcttcaggctaatccag

SEQ ID NO: 42077 - DNA, 20 bp, human
gcgcggcgccgctggagctc

SEQ ID NO: 42078 - DNA, 20 bp, human
gcagaggtgagtgacggctc

SEQ ID NO: 42079 - DNA, 20 bp, human
ggtttaagcggctgacggga

SEQ ID NO: 42080 - DNA, 20 bp, human
gcccctccgggacactgacg

SEQ ID NO: 42081 - DNA, 20 bp, human
gagcctgaagcggagactac

SEQ ID NO: 42082 - DNA, 20 bp, human
gggtcttgactgccgccccg

SEQ ID NO: 42083 - DNA, 20 bp, human
gagtcgagcgaagtcggtgg

SEQ ID NO: 42084 - DNA, 20 bp, human
gtcagcccctgtgccctctc

SEQ ID NO: 42085 - DNA, 20 bp, human
gcgttgtttaagcggctgac

SEQ ID NO: 42086 - DNA, 20 bp, human
gccctcaggacagacccctc

SEQ ID NO: 42087 - DNA, 20 bp, human
ggggcaccagcactcaccaa

SEQ ID NO: 42088 - DNA, 20 bp, human
gccaaaggcggcccccacaa

SEQ ID NO: 42089 - DNA, 20 bp, human
ggcaggccccacaccttctg

SEQ ID NO: 42090 - DNA, 20 bp, human
gctcctggagcaggttgtgt

SEQ ID NO: 42091 - DNA, 20 bp, human
gcaggagagggtgcattctg

SEQ ID NO: 42092 - DNA, 20 bp, human
gccgctgcctcagaaggtgt

SEQ ID NO: 42093 - DNA, 20 bp, human
gcaccagcactcaccaaagg

SEQ ID NO: 42094 - DNA, 20 bp, human
ggccatgccgctgcctcaga

SEQ ID NO: 42095 - DNA, 20 bp, human
ggacctcccaaggcctccac

SEQ ID NO: 42096 - DNA, 20 bp, human
gagggcctggcactcaccga

SEQ ID NO: 42097 - DNA, 20 bp, human
gcagtcagcggccccagcac

SEQ ID NO: 42098 - DNA, 20 bp, human
ggcctggcactcaccgaagg

SEQ ID NO: 42099 - DNA, 20 bp, human
gacccctgccagcggcacca

SEQ ID NO: 42100 - DNA, 20 bp, human
ggaaacccccaaacagtcag

SEQ ID NO: 42101 - DNA, 20 bp, human
gaggaaagccatggtgccgc

SEQ ID NO: 42102 - DNA, 20 bp, human
ggccccagcacaggtttggg

SEQ ID NO: 42103 - DNA, 20 bp, human
gtgaggctcgaggttctgaa

SEQ ID NO: 42104 - DNA, 20 bp, human
gagcggccccagcacaggtt

SEQ ID NO: 42105 - DNA, 20 bp, human
gcctctgagctcaggagatg

SEQ ID NO: 42106 - DNA, 20 bp, human
gtggaatggagaatcctcaa

SEQ ID NO: 42107 - DNA, 20 bp, human
gtggcctgtggtaagcggtg

SEQ ID NO: 42108 - DNA, 20 bp, human
gacaggccaagagcgcagcg

SEQ ID NO: 42109 - DNA, 20 bp, human
gaggtcctgcagagaagaag

SEQ ID NO: 42110 - DNA, 20 bp, human
gactggctgaccatcgggat

SEQ ID NO: 42111 - DNA, 20 bp, human
gagtgatgcccaacatggtt

SEQ ID NO: 42112 - DNA, 20 bp, human
ggtccctgggctcctaatct

SEQ ID NO: 42113 - DNA, 20 bp, human
gttcccagattaggagccca

SEQ ID NO: 42114 - DNA, 20 bp, human
gccaccccaccgcttaccac

SEQ ID NO: 42115 - DNA, 20 bp, human
ggtagcatctgaacccacag

SEQ ID NO: 42116 - DNA, 20 bp, human
gtggcaggtaagcctgtgta

SEQ ID NO: 42117 - DNA, 20 bp, human
ggtacctcccagccctacac

SEQ ID NO: 42118 - DNA, 20 bp, human
gctgggaggtacagatagag

SEQ ID NO: 42119 - DNA, 20 bp, human
gcctcaagaacgacacgtgg

SEQ ID NO: 42120 - DNA, 20 bp, human
gacacgtggaggcatacgtg

SEQ ID NO: 42121 - DNA, 20 bp, human
gccactcgggcggataggtt

SEQ ID NO: 42122 - DNA, 20 bp, human
gacagatagagagggtggcg

SEQ ID NO: 42123 - DNA, 20 bp, human
gtatccgcccgagtggtggg

SEQ ID NO: 42124 - DNA, 20 bp, human
gtggagggagatctgcagga

SEQ ID NO: 42125 - DNA, 20 bp, human
gagacctggccatcgtccgg

SEQ ID NO: 42126 - DNA, 20 bp, human
gggaggagccgaggagaacc

SEQ ID NO: 42127 - DNA, 20 bp, human
gtgctcccagggctgaatca

SEQ ID NO: 42128 - DNA, 20 bp, human
gcagatgtaggagaacagca

SEQ ID NO: 42129 - DNA, 20 bp, human
gggacgaaggtggacagagt

SEQ ID NO: 42130 - DNA, 20 bp, human
gcaacatcgtggcagatgtg

SEQ ID NO: 42131 - DNA, 20 bp, human
gaactgttcaggtcgggagg

SEQ ID NO: 42132 - DNA, 20 bp, human
gtaaaccctcccgggctcca

SEQ ID NO: 42133 - DNA, 20 bp, human
ggtagagatggggaacagcg

SEQ ID NO: 42134 - DNA, 20 bp, human
gggtatgaactgttcaggtc

SEQ ID NO: 42135 - DNA, 20 bp, human
gatggggaacagcggggact

SEQ ID NO: 42136 - DNA, 20 bp, human
gagtactccggctacctcaa

SEQ ID NO: 42137 - DNA, 20 bp, human
ggcgcggctcggatcatcta

SEQ ID NO: 42138 - DNA, 20 bp, human
gggctcggatcatctacggg

SEQ ID NO: 42139 - DNA, 20 bp, human
gtctgccgcgcaccgatccc

SEQ ID NO: 42140 - DNA, 20 bp, human
ggccgccagcaactccccgg

SEQ ID NO: 42141 - DNA, 20 bp, human
gcctggagagcaaggacgcg

SEQ ID NO: 42142 - DNA, 20 bp, human
gcacatgacttccagtcccc

SEQ ID NO: 42143 - DNA, 20 bp, human
ggatcggtgcgcggcagagg

SEQ ID NO: 42144 - DNA, 20 bp, human
gcggagtactggcggaaaga

SEQ ID NO: 42145 - DNA, 20 bp, human
ggtgagctggcaccggaggc

SEQ ID NO: 42146 - DNA, 20 bp, human
gagggctccggcaaccgctc

SEQ ID NO: 42147 - DNA, 20 bp, human
gcagcctgcgcgcagcggag

SEQ ID NO: 42148 - DNA, 20 bp, human
gcggccaggaccgccgaggg

SEQ ID NO: 42149 - DNA, 20 bp, human
gggtcccaggcagcagtctc

SEQ ID NO: 42150 - DNA, 20 bp, human
gggaagagctcggccgggtc

SEQ ID NO: 42151 - DNA, 20 bp, human
gcagcccagcctgcgcgcag

SEQ ID NO: 42152 - DNA, 20 bp, human
gccgtcagggacagtcccga

SEQ ID NO: 42153 - DNA, 20 bp, human
gctgcgcgcagcggagcggt

SEQ ID NO: 42154 - DNA, 20 bp, human
gacgcggccaggaccgccga

SEQ ID NO: 42155 - DNA, 20 bp, human
ggcggttggcgttgccggag

SEQ ID NO: 42156 - DNA, 20 bp, human
gtagcggtgagtccaccacg

SEQ ID NO: 42157 - DNA, 20 bp, human
gcaaggcgcgcgcctcgtgg

SEQ ID NO: 42158 - DNA, 20 bp, human
ggggcggcgagcagcaagga

SEQ ID NO: 42159 - DNA, 20 bp, human
ggcccagcacccatgctgca

SEQ ID NO: 42160 - DNA, 20 bp, human
gaaagaggtgaagaattacc

SEQ ID NO: 42161 - DNA, 20 bp, human
gcgctgcgttaggggctcaa

SEQ ID NO: 42162 - DNA, 20 bp, human
gcggggaagaaggtccccaa

SEQ ID NO: 42163 - DNA, 20 bp, human
gggcagaaaggacgacccgg

SEQ ID NO: 42164 - DNA, 20 bp, human
gggccggcgtagctatttca

SEQ ID NO: 42165 - DNA, 20 bp, human
gcgccggcccggaaacccgt

SEQ ID NO: 42166 - DNA, 20 bp, human
ggcggcggccgggtcggaga

SEQ ID NO: 42167 - DNA, 20 bp, human
gcctaggtctccagcaacaa

SEQ ID NO: 42168 - DNA, 20 bp, human
gagggcgagcggcagaaggc

SEQ ID NO: 42169 - DNA, 20 bp, human
ggggaggtagtgctcattcg

SEQ ID NO: 42170 - DNA, 20 bp, human
gggtcagtctgcagtcctca

SEQ ID NO: 42171 - DNA, 20 bp, human
gaacccagggtggcatatgg

SEQ ID NO: 42172 - DNA, 20 bp, human
gcgcagcctccctggagacg

SEQ ID NO: 42173 - DNA, 20 bp, human
gagctgatccggcccaactg

SEQ ID NO: 42174 - DNA, 20 bp, human
ggtcctcaaggtacaaccca

SEQ ID NO: 42175 - DNA, 20 bp, human
gcggaggtgcaggggacccg

SEQ ID NO: 42176 - DNA, 20 bp, human
gcaagggagaagctgctggt

SEQ ID NO: 42177 - DNA, 20 bp, human
ggtcccctggggaagtcctg

SEQ ID NO: 42178 - DNA, 20 bp, human
gtgggaaggcacctccgtgg

SEQ ID NO: 42179 - DNA, 20 bp, human
gggagattaaggccatacac

SEQ ID NO: 42180 - DNA, 20 bp, human
gaagggacagaaaaactctt

SEQ ID NO: 42181 - DNA, 20 bp, human
gtcacgaagggctgatttaa

SEQ ID NO: 42182 - DNA, 20 bp, human
ggattaaggccatacacagg

SEQ ID NO: 42183 - DNA, 20 bp, human
gtgggcaggtctgagagtta

SEQ ID NO: 42184 - DNA, 20 bp, human
ggccatacacaggcggtcac

SEQ ID NO: 42185 - DNA, 20 bp, human
gcagtgatggtcagtcccct

SEQ ID NO: 42186 - DNA, 20 bp, human
gccgcgggctcggtacccgg

SEQ ID NO: 42187 - DNA, 20 bp, human
gggctcggtacccggtgggt

SEQ ID NO: 42188 - DNA, 20 bp, human
ggacgctccaccgacccacc

SEQ ID NO: 42189 - DNA, 20 bp, human
gcgctggacgaaccgatctc

SEQ ID NO: 42190 - DNA, 20 bp, human
gtcggtacccggtgggtcgg

SEQ ID NO: 42191 - DNA, 20 bp, human
gtggccgcgggctcggtacc

SEQ ID NO: 42192 - DNA, 20 bp, human
gtctccagcgcgaagcgggt

SEQ ID NO: 42193 - DNA, 20 bp, human
gggtcggtggagcgtctgtt

SEQ ID NO: 42194 - DNA, 20 bp, human
gctctctccaggcgggtcag

SEQ ID NO: 42195 - DNA, 20 bp, human
gggaatgggcagcgccgcac

SEQ ID NO: 42196 - DNA, 20 bp, human
gtgcctcagccccagtgggt

SEQ ID NO: 42197 - DNA, 20 bp, human
gagcacagcagcaactgact

SEQ ID NO: 42198 - DNA, 20 bp, human
ggcctttctcctacccactg

SEQ ID NO: 42199 - DNA, 20 bp, human
ggtccaattcaagaccacgt

SEQ ID NO: 42200 - DNA, 20 bp, human
gggatgaggtcaggcctctg

SEQ ID NO: 42201 - DNA, 20 bp, human
ggtgtcagaccctacctagg

SEQ ID NO: 42202 - DNA, 20 bp, human
gcatgaggataaaagtataa

SEQ ID NO: 42203 - DNA, 20 bp, human
gtggctgcatctttcctgaa

SEQ ID NO: 42204 - DNA, 20 bp, human
gcatgtgtcagaccctacct

SEQ ID NO: 42205 - DNA, 20 bp, human
gctcctacccactggggctg

SEQ ID NO: 42206 - DNA, 20 bp, human
gttgcgctcagggtccgcgg

SEQ ID NO: 42207 - DNA, 20 bp, human
ggtgctagcaggccctagag

SEQ ID NO: 42208 - DNA, 20 bp, human
gactgggctccggaggaacg

SEQ ID NO: 42209 - DNA, 20 bp, human
gctctgggccgccacctccg

SEQ ID NO: 42210 - DNA, 20 bp, human
gggcctgctagcaccctctc

SEQ ID NO: 42211 - DNA, 20 bp, human
ggggcggcttgtaggaccag

SEQ ID NO: 42212 - DNA, 20 bp, human
ggccgccagcgctgcgatgt

SEQ ID NO: 42213 - DNA, 20 bp, human
gctccagcctagaataccaa

SEQ ID NO: 42214 - DNA, 20 bp, human
gctcttgcgctcagggtccg

SEQ ID NO: 42215 - DNA, 20 bp, human
gcagatgggctgagtgtcca

SEQ ID NO: 42216 - DNA, 20 bp, human
gagtgtgggcacaccatcag

SEQ ID NO: 42217 - DNA, 20 bp, human
gctgatggaaatctgttgtc

SEQ ID NO: 42218 - DNA, 20 bp, human
gctgttgtctggcttcgttt

SEQ ID NO: 42219 - DNA, 20 bp, human
gtaactccttagtgaggagg

SEQ ID NO: 42220 - DNA, 20 bp, human
gggaagtcagctccagtgat

SEQ ID NO: 42221 - DNA, 20 bp, human
gaacggttaactccttagtg

SEQ ID NO: 42222 - DNA, 20 bp, human
gggttaactccttagtgagg

SEQ ID NO: 42223 - DNA, 20 bp, human
gtggccaacaaggatcaaaa

SEQ ID NO: 42224 - DNA, 20 bp, human
gaggccactcttgaaggatg

SEQ ID NO: 42225 - DNA, 20 bp, human
gtgcaaacgttacctgctga

SEQ ID NO: 42226 - DNA, 20 bp, human
ggctgcgcaggcgcactcca

SEQ ID NO: 42227 - DNA, 20 bp, human
gcgacctccgcaaccttgag

SEQ ID NO: 42228 - DNA, 20 bp, human
ggaccgctacagccagtgtg

SEQ ID NO: 42229 - DNA, 20 bp, human
gcgccacacactggctgtag

SEQ ID NO: 42230 - DNA, 20 bp, human
gcaaccttgagcggcatccg

SEQ ID NO: 42231 - DNA, 20 bp, human
gtgacgcctgcgccacacac

SEQ ID NO: 42232 - DNA, 20 bp, human
ggtccccgcacgccagacag

SEQ ID NO: 42233 - DNA, 20 bp, human
gatgccgctcaaggttgcgg

SEQ ID NO: 42234 - DNA, 20 bp, human
gggcctggcccggccagaca

SEQ ID NO: 42235 - DNA, 20 bp, human
gcagggctccaggcgtggca

SEQ ID NO: 42236 - DNA, 20 bp, human
gtggagaacagcatccccag

SEQ ID NO: 42237 - DNA, 20 bp, human
gggaaggcttgacacctctg

SEQ ID NO: 42238 - DNA, 20 bp, human
gacatttgatcacagtttag

SEQ ID NO: 42239 - DNA, 20 bp, human
gggaagagaaaccatggcaa

SEQ ID NO: 42240 - DNA, 20 bp, human
gcacaacagattatacggca

SEQ ID NO: 42241 - DNA, 20 bp, human
gcacttggtgaggatgagtt

SEQ ID NO: 42242 - DNA, 20 bp, human
gtcaaatgttagagtagctg

SEQ ID NO: 42243 - DNA, 20 bp, human
ggccaggactattctttctg

SEQ ID NO: 42244 - DNA, 20 bp, human
ggtggattatgagcacaatg

SEQ ID NO: 42245 - DNA, 20 bp, human
gtctgcagattcacttggtg

SEQ ID NO: 42246 - DNA, 20 bp, human
ggcatgggggagtgacacca

SEQ ID NO: 42247 - DNA, 20 bp, human
gcaccatggcacaaggagag

SEQ ID NO: 42248 - DNA, 20 bp, human
gagacccgggacaggaagtg

SEQ ID NO: 42249 - DNA, 20 bp, human
gggagcagggacagatcccg

SEQ ID NO: 42250 - DNA, 20 bp, human
gagaaaacaggccgcgcggg

SEQ ID NO: 42251 - DNA, 20 bp, human
ggccagtggcaacgatagag

SEQ ID NO: 42252 - DNA, 20 bp, human
gttggttagcaaaggcatgg

SEQ ID NO: 42253 - DNA, 20 bp, human
gggcgccgcaatggacgtgc

SEQ ID NO: 42254 - DNA, 20 bp, human
ggagagctgaccctgctcgt

SEQ ID NO: 42255 - DNA, 20 bp, human
gagaggggattgctaaaagg

SEQ ID NO: 42256 - DNA, 20 bp, human
gtaagagtccttgaattagt

SEQ ID NO: 42257 - DNA, 20 bp, human
gattcaaggactcttactgt

SEQ ID NO: 42258 - DNA, 20 bp, human
gaagagagcccactaattca

SEQ ID NO: 42259 - DNA, 20 bp, human
gttactgtgggagcaactgc

SEQ ID NO: 42260 - DNA, 20 bp, human
ggcgactagctccctcaaac

SEQ ID NO: 42261 - DNA, 20 bp, human
gtgctttcacatctttaggt

SEQ ID NO: 42262 - DNA, 20 bp, human
gcagacatctgtttcaaatg

SEQ ID NO: 42263 - DNA, 20 bp, human
gactgaaacatggctttctt

SEQ ID NO: 42264 - DNA, 20 bp, human
gctgctaggttttaaatctt

SEQ ID NO: 42265 - DNA, 20 bp, human
gctttttaattgaaaacatc

SEQ ID NO: 42266 - DNA, 20 bp, human
gcggcaaaggtgggacggag

SEQ ID NO: 42267 - DNA, 20 bp, human
ggcgaacctgcaccagaccg

SEQ ID NO: 42268 - DNA, 20 bp, human
ggcctcgaggtggggaacgg

SEQ ID NO: 42269 - DNA, 20 bp, human
gtgcagagggcgagagcagg

SEQ ID NO: 42270 - DNA, 20 bp, human
gccgcgccgctggaagccag

SEQ ID NO: 42271 - DNA, 20 bp, human
gggcaggtcagtcatcctgt

SEQ ID NO: 42272 - DNA, 20 bp, human
gggtgcctgcgcagctgcga

SEQ ID NO: 42273 - DNA, 20 bp, human
gcttaagggtgggtgcatca

SEQ ID NO: 42274 - DNA, 20 bp, human
gagggcggttggagacccca

SEQ ID NO: 42275 - DNA, 20 bp, human
gtggtgccggcgcctccctg

SEQ ID NO: 42276 - DNA, 20 bp, human
ggagcccagaaggtatcaca

SEQ ID NO: 42277 - DNA, 20 bp, human
ggcctagcccaaggcatcag

SEQ ID NO: 42278 - DNA, 20 bp, human
gatgccactccagactgcac

SEQ ID NO: 42279 - DNA, 20 bp, human
gatgccggtgcagtctggag

SEQ ID NO: 42280 - DNA, 20 bp, human
gtggtggcaggcctagccca

SEQ ID NO: 42281 - DNA, 20 bp, human
gggtcctggcaaggaaccaa

SEQ ID NO: 42282 - DNA, 20 bp, human
gcagccgctagagctgaaag

SEQ ID NO: 42283 - DNA, 20 bp, human
gtcccagccgtgcaaggact

SEQ ID NO: 42284 - DNA, 20 bp, human
ggtgccctgtgataccttct

SEQ ID NO: 42285 - DNA, 20 bp, human
gcggctggggacctaggtcc

SEQ ID NO: 42286 - DNA, 20 bp, human
gcccgctctggatcccgccc

SEQ ID NO: 42287 - DNA, 20 bp, human
gctgtccccggcggaagtag

SEQ ID NO: 42288 - DNA, 20 bp, human
gaccctggatgtggaagaga

SEQ ID NO: 42289 - DNA, 20 bp, human
gagcgacccccaaaacgaag

SEQ ID NO: 42290 - DNA, 20 bp, human
ggtagcaggtctgtccccgg

SEQ ID NO: 42291 - DNA, 20 bp, human
gggggcccaaagtgcggggt

SEQ ID NO: 42292 - DNA, 20 bp, human
gctgcgtcgccaacaggcct

SEQ ID NO: 42293 - DNA, 20 bp, human
gctggccgccgcagccttaa

SEQ ID NO: 42294 - DNA, 20 bp, human
gctcggagcgggatccggag

SEQ ID NO: 42295 - DNA, 20 bp, human
gcgcagccttaagggccggg

SEQ ID NO: 42296 - DNA, 20 bp, human
ggctggcgcggcggaatcca

SEQ ID NO: 42297 - DNA, 20 bp, human
gcccgggccggaccgacccc

SEQ ID NO: 42298 - DNA, 20 bp, human
gccggaccgaccccaggcgg

SEQ ID NO: 42299 - DNA, 20 bp, human
ggccaggcgacgccacagga

SEQ ID NO: 42300 - DNA, 20 bp, human
gcggaatccagggccgaccc

SEQ ID NO: 42301 - DNA, 20 bp, human
ggggccggaccgaccccagg

SEQ ID NO: 42302 - DNA, 20 bp, human
gattagggcccgagggagag

SEQ ID NO: 42303 - DNA, 20 bp, human
gttggggtatcagctctgag

SEQ ID NO: 42304 - DNA, 20 bp, human
ggctcgctcaccgccgcctg

SEQ ID NO: 42305 - DNA, 20 bp, human
gagggggatgggctccgagg

SEQ ID NO: 42306 - DNA, 20 bp, human
ggcaggaagatggcgacgga

SEQ ID NO: 42307 - DNA, 20 bp, human
gtagagcaggaagatggcga

SEQ ID NO: 42308 - DNA, 20 bp, human
gcagaagcgaccgcagcgga

SEQ ID NO: 42309 - DNA, 20 bp, human
gccgtaagcccgggactctc

SEQ ID NO: 42310 - DNA, 20 bp, human
gagcgagaggtgaacaatgg

SEQ ID NO: 42311 - DNA, 20 bp, human
ggtgggcataggggtcgcac

SEQ ID NO: 42312 - DNA, 20 bp, human
gtccggggcccgggacaagt

SEQ ID NO: 42313 - DNA, 20 bp, human
gatccgctagagcaggaaga

SEQ ID NO: 42314 - DNA, 20 bp, human
gcagcggagggagtgggcat

SEQ ID NO: 42315 - DNA, 20 bp, human
gccgccgtgtgggcatcccg

SEQ ID NO: 42316 - DNA, 20 bp, human
gcggagcgtcgtggaaaggt

SEQ ID NO: 42317 - DNA, 20 bp, human
ggtaggagcaactatccctg

SEQ ID NO: 42318 - DNA, 20 bp, human
gcagccatcaccaagcccca

SEQ ID NO: 42319 - DNA, 20 bp, human
gagcggagcccggagcgtcg

SEQ ID NO: 42320 - DNA, 20 bp, human
gcttggcggagaggactcac

SEQ ID NO: 42321 - DNA, 20 bp, human
ggcctcagccgctgtggatg

SEQ ID NO: 42322 - DNA, 20 bp, human
gagcagggacaggtgtaggg

SEQ ID NO: 42323 - DNA, 20 bp, human
gggcggagcctcagccgctg

SEQ ID NO: 42324 - DNA, 20 bp, human
ggggatgtttggccttccgg

SEQ ID NO: 42325 - DNA, 20 bp, human
gctcccggtattccccgagg

SEQ ID NO: 42326 - DNA, 20 bp, human
ggggccaggcttccgcgtgg

SEQ ID NO: 42327 - DNA, 20 bp, human
gcaggaggaaatactcaccc

SEQ ID NO: 42328 - DNA, 20 bp, human
gcaggcagatagtaacatag

SEQ ID NO: 42329 - DNA, 20 bp, human
gattgaaggtggaactgcag

SEQ ID NO: 42330 - DNA, 20 bp, human
gctcaaagggcagaaatcat

SEQ ID NO: 42331 - DNA, 20 bp, human
gtagtctcggagtcacttcc

SEQ ID NO: 42332 - DNA, 20 bp, human
gaaggtggaactgcaggggt

SEQ ID NO: 42333 - DNA, 20 bp, human
gagagaggccgcggacccca

SEQ ID NO: 42334 - DNA, 20 bp, human
ggagtggcccggtaagagac

SEQ ID NO: 42335 - DNA, 20 bp, human
ggagaccctcaaccctccca

SEQ ID NO: 42336 - DNA, 20 bp, human
ggcgtgcccatgtgtcaggt

SEQ ID NO: 42337 - DNA, 20 bp, human
gcggctcagggggcacataa

SEQ ID NO: 42338 - DNA, 20 bp, human
gcctcgcccacctgacacat

SEQ ID NO: 42339 - DNA, 20 bp, human
ggtcccgtcgcagactgtgg

SEQ ID NO: 42340 - DNA, 20 bp, human
gcgggtcccgtcgcagactg

SEQ ID NO: 42341 - DNA, 20 bp, human
gtcaggtgggcgaggactac

SEQ ID NO: 42342 - DNA, 20 bp, human
ggtctcccaaggctgacacg

SEQ ID NO: 42343 - DNA, 20 bp, human
ggccttgggagactgaaaag

SEQ ID NO: 42344 - DNA, 20 bp, human
gcctagaaaagccggctcag

SEQ ID NO: 42345 - DNA, 20 bp, human
gcagtggctgctaggatgag

SEQ ID NO: 42346 - DNA, 20 bp, human
gccgagaacaaagggagcgg

SEQ ID NO: 42347 - DNA, 20 bp, human
gctcggtctccgccgctcca

SEQ ID NO: 42348 - DNA, 20 bp, human
gccacgcggggacccaactc

SEQ ID NO: 42349 - DNA, 20 bp, human
gctgcgcgcacggccagagt

SEQ ID NO: 42350 - DNA, 20 bp, human
ggcgttcggcctctccccgg

SEQ ID NO: 42351 - DNA, 20 bp, human
gtctccgccgctccaggggc

SEQ ID NO: 42352 - DNA, 20 bp, human
gcgcccgcgcctcggtcccc

SEQ ID NO: 42353 - DNA, 20 bp, human
gccgccgagaacaaagggag

SEQ ID NO: 42354 - DNA, 20 bp, human
ggatccggcgggccgggcat

SEQ ID NO: 42355 - DNA, 20 bp, human
ggtcgccataggaacagccg

SEQ ID NO: 42356 - DNA, 20 bp, human
ggccaggaaagcgctaacca

SEQ ID NO: 42357 - DNA, 20 bp, human
gctggcagccgcatcagcag

SEQ ID NO: 42358 - DNA, 20 bp, human
ggaacctgcgtagagtcaca

SEQ ID NO: 42359 - DNA, 20 bp, human
ggcgtagagtcacagggccc

SEQ ID NO: 42360 - DNA, 20 bp, human
gttggtgagacagaggacgt

SEQ ID NO: 42361 - DNA, 20 bp, human
gggtgggtggaggagccagt

SEQ ID NO: 42362 - DNA, 20 bp, human
gacgctgtcagttaatgcgg

SEQ ID NO: 42363 - DNA, 20 bp, human
ggtcagttaatgcggaggga

SEQ ID NO: 42364 - DNA, 20 bp, human
gagcagtggcgctagcatta

SEQ ID NO: 42365 - DNA, 20 bp, human
gagttaatgcggagggaagg

SEQ ID NO: 42366 - DNA, 20 bp, human
gattctgcttcagcgagtag

SEQ ID NO: 42367 - DNA, 20 bp, human
gacagcgtggtcgggaagaa

SEQ ID NO: 42368 - DNA, 20 bp, human
ggtagacagtggtagctgca

SEQ ID NO: 42369 - DNA, 20 bp, human
gctcaaagaagcagcagtat

SEQ ID NO: 42370 - DNA, 20 bp, human
ggataaagttaagaagcgag

SEQ ID NO: 42371 - DNA, 20 bp, human
ggcagctgatggcacacccc

SEQ ID NO: 42372 - DNA, 20 bp, human
gtgggtcaagtacctggctc

SEQ ID NO: 42373 - DNA, 20 bp, human
ggcccgtcaaagatacaggt

SEQ ID NO: 42374 - DNA, 20 bp, human
gacaggttgggtcaagtacc

SEQ ID NO: 42375 - DNA, 20 bp, human
gttcctggtggaacagttac

SEQ ID NO: 42376 - DNA, 20 bp, human
gcagatgagcaggggcagtt

SEQ ID NO: 42377 - DNA, 20 bp, human
gcatgctcagttggttggag

SEQ ID NO: 42378 - DNA, 20 bp, human
gcaaatagccagataaacaa

SEQ ID NO: 42379 - DNA, 20 bp, human
gacttcagcaaatattaata

SEQ ID NO: 42380 - DNA, 20 bp, human
gaatcccatgctcagttggt

SEQ ID NO: 42381 - DNA, 20 bp, human
gtcactcttacctgccaacc

SEQ ID NO: 42382 - DNA, 20 bp, human
gatcaacctcccaggttggc

SEQ ID NO: 42383 - DNA, 20 bp, human
gtctgtttgcaattgccagg

SEQ ID NO: 42384 - DNA, 20 bp, human
gctatttgggaaaactggtg

SEQ ID NO: 42385 - DNA, 20 bp, human
gaaaaagtggcagatgagca

SEQ ID NO: 42386 - DNA, 20 bp, human
gggcgaggccggcttcctag

SEQ ID NO: 42387 - DNA, 20 bp, human
gaggcggagaaagtgaggcg

SEQ ID NO: 42388 - DNA, 20 bp, human
ggaggggctgcaatccgcag

SEQ ID NO: 42389 - DNA, 20 bp, human
gtccccgggagctccgcgtg

SEQ ID NO: 42390 - DNA, 20 bp, human
gccggggcccgggatgaggt

SEQ ID NO: 42391 - DNA, 20 bp, human
ggaggccggcttcctagcgg

SEQ ID NO: 42392 - DNA, 20 bp, human
gggcgcgcgattagaccggg

SEQ ID NO: 42393 - DNA, 20 bp, human
gtgggcaacgggtcccgaga

SEQ ID NO: 42394 - DNA, 20 bp, human
gaacgggtcccgagaaggtg

SEQ ID NO: 42395 - DNA, 20 bp, human
gccgcccgccgctaggaagc

SEQ ID NO: 42396 - DNA, 20 bp, human
ggccccaccaacgagatcaa

SEQ ID NO: 42397 - DNA, 20 bp, human
ggcgggagcacaaacaggga

SEQ ID NO: 42398 - DNA, 20 bp, human
gtcaggcgggagcacaaaca

SEQ ID NO: 42399 - DNA, 20 bp, human
gcagaccttagaggcaccaa

SEQ ID NO: 42400 - DNA, 20 bp, human
gagggcattgaggggaacaa

SEQ ID NO: 42401 - DNA, 20 bp, human
gccttggaggacacatgacg

SEQ ID NO: 42402 - DNA, 20 bp, human
gaccgcgcgggacaagtcgc

SEQ ID NO: 42403 - DNA, 20 bp, human
gcagagcggttcccttccag

SEQ ID NO: 42404 - DNA, 20 bp, human
gtacccaagtcagaccttag

SEQ ID NO: 42405 - DNA, 20 bp, human
gtcaaaggcggggcccagag

SEQ ID NO: 42406 - DNA, 20 bp, human
gggttgcgtggtgcaggcgg

SEQ ID NO: 42407 - DNA, 20 bp, human
gcgaaagccccgtcccgcca

SEQ ID NO: 42408 - DNA, 20 bp, human
ggagggacgcagctagacct

SEQ ID NO: 42409 - DNA, 20 bp, human
gggacgcagctagaccttgg

SEQ ID NO: 42410 - DNA, 20 bp, human
gtcgcacgcagctccaggcg

SEQ ID NO: 42411 - DNA, 20 bp, human
ggctagaccttggcgggacg

SEQ ID NO: 42412 - DNA, 20 bp, human
ggggcagccccggtagctga

SEQ ID NO: 42413 - DNA, 20 bp, human
ggccctgagtcaccccggac

SEQ ID NO: 42414 - DNA, 20 bp, human
gccaggcctggactacgcac

SEQ ID NO: 42415 - DNA, 20 bp, human
ggccgggccgggggactcgt

SEQ ID NO: 42416 - DNA, 20 bp, human
gcggcctcggcgcacagtaa

SEQ ID NO: 42417 - DNA, 20 bp, human
gatggcagcgctgtgagcag

SEQ ID NO: 42418 - DNA, 20 bp, human
ggggagaggcggccaagatc

SEQ ID NO: 42419 - DNA, 20 bp, human
ggaggcggccaagatcgggt

SEQ ID NO: 42420 - DNA, 20 bp, human
gcctccttcgaaggaaaatg

SEQ ID NO: 42421 - DNA, 20 bp, human
gggcccgggatccagtccag

SEQ ID NO: 42422 - DNA, 20 bp, human
gggagtgaaagacgaagccc

SEQ ID NO: 42423 - DNA, 20 bp, human
gagaaggacgggccgatcac

SEQ ID NO: 42424 - DNA, 20 bp, human
ggcggaagaaggagaccgga

SEQ ID NO: 42425 - DNA, 20 bp, human
ggtgtgttgggcaaagccgg

SEQ ID NO: 42426 - DNA, 20 bp, human
ggactctggcgactccgatg

SEQ ID NO: 42427 - DNA, 20 bp, human
gagccgagccggacgtgagg

SEQ ID NO: 42428 - DNA, 20 bp, human
gcgcggaggagcgcgataaa

SEQ ID NO: 42429 - DNA, 20 bp, human
ggtccccctcacgtccggct

SEQ ID NO: 42430 - DNA, 20 bp, human
gccggaaggacaccaagatg

SEQ ID NO: 42431 - DNA, 20 bp, human
ggcggggtccccctcacgtc

SEQ ID NO: 42432 - DNA, 20 bp, human
ggaggagagactcaccggaa

SEQ ID NO: 42433 - DNA, 20 bp, human
gcgagatccggcccagaggg

SEQ ID NO: 42434 - DNA, 20 bp, human
gcgggctgaagtcccccaac

SEQ ID NO: 42435 - DNA, 20 bp, human
gccatgtcgaatctgagcaa

SEQ ID NO: 42436 - DNA, 20 bp, human
gctacacgcaggacacgtgg

SEQ ID NO: 42437 - DNA, 20 bp, human
gcgctcgtgggccgcaccaa

SEQ ID NO: 42438 - DNA, 20 bp, human
gggagctctaccaggtgagg

SEQ ID NO: 42439 - DNA, 20 bp, human
ggcagcttctcggcgctcgt

SEQ ID NO: 42440 - DNA, 20 bp, human
gccgcggaagggcagcttct

SEQ ID NO: 42441 - DNA, 20 bp, human
gtggcggaagctgcacgagg

SEQ ID NO: 42442 - DNA, 20 bp, human
gtcgaggttgtacctgatgg

SEQ ID NO: 42443 - DNA, 20 bp, human
gcagggccgcgggcttggtg

SEQ ID NO: 42444 - DNA, 20 bp, human
gcaactacacgcaggacacg

SEQ ID NO: 42445 - DNA, 20 bp, human
gggcggttccggcccagcca

SEQ ID NO: 42446 - DNA, 20 bp, human
ggtgctggtattaccatcag

SEQ ID NO: 42447 - DNA, 20 bp, human
ggtcgctcctgcagaaaggg

SEQ ID NO: 42448 - DNA, 20 bp, human
ggagagagatcgaaaagcag

SEQ ID NO: 42449 - DNA, 20 bp, human
ggcagcagctgagggactgg

SEQ ID NO: 42450 - DNA, 20 bp, human
gaaggtagcaatgctagagg

SEQ ID NO: 42451 - DNA, 20 bp, human
gggggggagagcgaatgagg

SEQ ID NO: 42452 - DNA, 20 bp, human
ggcgactcagcgagtctgtg

SEQ ID NO: 42453 - DNA, 20 bp, human
gtagcggggtcaacaggcag

SEQ ID NO: 42454 - DNA, 20 bp, human
gctgagtcgctcctgcagaa

SEQ ID NO: 42455 - DNA, 20 bp, human
gaggagtgagcagaacgagg

SEQ ID NO: 42456 - DNA, 20 bp, human
ggcggcgggtgcaaccacaa

SEQ ID NO: 42457 - DNA, 20 bp, human
gcccaaagagccgaacccgg

SEQ ID NO: 42458 - DNA, 20 bp, human
gagctccggtgaccatgtag

SEQ ID NO: 42459 - DNA, 20 bp, human
ggcgctcaggaagaccggaa

SEQ ID NO: 42460 - DNA, 20 bp, human
gggccgcggaacctgagctg

SEQ ID NO: 42461 - DNA, 20 bp, human
ggagtccaagttaaagaaca

SEQ ID NO: 42462 - DNA, 20 bp, human
ggaggccggagctcccacca

SEQ ID NO: 42463 - DNA, 20 bp, human
gtaatccgaaggagtcgggg

SEQ ID NO: 42464 - DNA, 20 bp, human
ggccacgtcacgtgacgcga

SEQ ID NO: 42465 - DNA, 20 bp, human
gctcccggccaggccttgac

SEQ ID NO: 42466 - DNA, 20 bp, human
ggagggcgccgcgagaccca

SEQ ID NO: 42467 - DNA, 20 bp, human
gcagggtgcacagaccaggt

SEQ ID NO: 42468 - DNA, 20 bp, human
gcgtgagtcggcagccactg

SEQ ID NO: 42469 - DNA, 20 bp, human
ggagctgcacccgcgtgagt

SEQ ID NO: 42470 - DNA, 20 bp, human
gactaggaggaggcactggt

SEQ ID NO: 42471 - DNA, 20 bp, human
ggtgcagctctgttccgcgg

SEQ ID NO: 42472 - DNA, 20 bp, human
gggcgcgatggactaggagg

SEQ ID NO: 42473 - DNA, 20 bp, human
gggggtcgagacggagagac

SEQ ID NO: 42474 - DNA, 20 bp, human
gagggcagggtgcacagacc

SEQ ID NO: 42475 - DNA, 20 bp, human
gcaaggcgcgatggactagg

SEQ ID NO: 42476 - DNA, 20 bp, human
gagccctcgctgggacccag

SEQ ID NO: 42477 - DNA, 20 bp, human
gggccgctgggtcccagcga

SEQ ID NO: 42478 - DNA, 20 bp, human
gtggatgtggacctcaatgg

SEQ ID NO: 42479 - DNA, 20 bp, human
ggaatcggataggaggaggt

SEQ ID NO: 42480 - DNA, 20 bp, human
gtcggataggaggaggtagg

SEQ ID NO: 42481 - DNA, 20 bp, human
gtcgtcagccccatggacag

SEQ ID NO: 42482 - DNA, 20 bp, human
gtggctaaaggaccggggag

SEQ ID NO: 42483 - DNA, 20 bp, human
ggaggtaggaggtgtaacgt

SEQ ID NO: 42484 - DNA, 20 bp, human
gggaagtaaaagaatcggat

SEQ ID NO: 42485 - DNA, 20 bp, human
ggacagtggctaaaggaccg

SEQ ID NO: 42486 - DNA, 20 bp, human
ggctgaagccttatcctcag

SEQ ID NO: 42487 - DNA, 20 bp, human
ggaggaagccactgaggata

SEQ ID NO: 42488 - DNA, 20 bp, human
gccgcacttactgggtgcac

SEQ ID NO: 42489 - DNA, 20 bp, human
gtgaccaggagcagccctag

SEQ ID NO: 42490 - DNA, 20 bp, human
gtcgacaggccgcacttact

SEQ ID NO: 42491 - DNA, 20 bp, human
ggcacaggtgagcctaagag

SEQ ID NO: 42492 - DNA, 20 bp, human
gtataggtctgagatacctg

SEQ ID NO: 42493 - DNA, 20 bp, human
gggactggaatcctatggat

SEQ ID NO: 42494 - DNA, 20 bp, human
gagagtgggatatctgaccc

SEQ ID NO: 42495 - DNA, 20 bp, human
gtcctgggactggaatccta

SEQ ID NO: 42496 - DNA, 20 bp, human
gcccagaggttggccccctg

SEQ ID NO: 42497 - DNA, 20 bp, human
gcccgcaccctaaatcccag

SEQ ID NO: 42498 - DNA, 20 bp, human
gcccaacgagaaggtcgcca

SEQ ID NO: 42499 - DNA, 20 bp, human
gccctacctggcgatctcct

SEQ ID NO: 42500 - DNA, 20 bp, human
gtcgttggggcaagtaacaa

SEQ ID NO: 42501 - DNA, 20 bp, human
gcaccctaaatcccagaggt

SEQ ID NO: 42502 - DNA, 20 bp, human
ggccaaggagatcgccaggt

SEQ ID NO: 42503 - DNA, 20 bp, human
gtccttggcgaccttctcgt

SEQ ID NO: 42504 - DNA, 20 bp, human
gggatttagggtgcgggtag

SEQ ID NO: 42505 - DNA, 20 bp, human
gagggtgcgggtagcggtcg

SEQ ID NO: 42506 - DNA, 20 bp, human
gcggcgggagtcgtagtcag

SEQ ID NO: 42507 - DNA, 20 bp, human
gaaacggagggcgtgacgag

SEQ ID NO: 42508 - DNA, 20 bp, human
gaactgcaggcgcacgaggg

SEQ ID NO: 42509 - DNA, 20 bp, human
ggaccccgggactcgaacct

SEQ ID NO: 42510 - DNA, 20 bp, human
gtcccggggtcccctcataa

SEQ ID NO: 42511 - DNA, 20 bp, human
ggtcgcagggccgttatgag

SEQ ID NO: 42512 - DNA, 20 bp, human
gggaaactgcaggcgcacga

SEQ ID NO: 42513 - DNA, 20 bp, human
gagccaaggttcgagtcccg

SEQ ID NO: 42514 - DNA, 20 bp, human
ggccgttatgaggggacccc

SEQ ID NO: 42515 - DNA, 20 bp, human
gctgctggtgcgggcggtac

SEQ ID NO: 42516 - DNA, 20 bp, human
gtgagcggctgatagagagg

SEQ ID NO: 42517 - DNA, 20 bp, human
gcatattgagacggagtgag

SEQ ID NO: 42518 - DNA, 20 bp, human
gccaccccgggcgccccccc

SEQ ID NO: 42519 - DNA, 20 bp, human
ggagtgagcggctgatagag

SEQ ID NO: 42520 - DNA, 20 bp, human
ggagttcaggagccgccagg

SEQ ID NO: 42521 - DNA, 20 bp, human
gcggctcccggcgccatctt

SEQ ID NO: 42522 - DNA, 20 bp, human
ggtctcaatatgtctcaaga

SEQ ID NO: 42523 - DNA, 20 bp, human
ggcaccgcggggccgagtcg

SEQ ID NO: 42524 - DNA, 20 bp, human
gtcaagcgagtgatcaatgg

SEQ ID NO: 42525 - DNA, 20 bp, human
gtcaatatgtctcaagatgg

SEQ ID NO: 42526 - DNA, 20 bp, human
ggcgcgccctgggcgcattg

SEQ ID NO: 42527 - DNA, 20 bp, human
gggacctccccaatgcgccc

SEQ ID NO: 42528 - DNA, 20 bp, human
gacattggcggccatcttgg

SEQ ID NO: 42529 - DNA, 20 bp, human
gcaccgaccccggacttggg

SEQ ID NO: 42530 - DNA, 20 bp, human
gttggaagcgatttgatcta

SEQ ID NO: 42531 - DNA, 20 bp, human
ggcgccggcgcctctcggag

SEQ ID NO: 42532 - DNA, 20 bp, human
ggtctcgatagcccccaaga

SEQ ID NO: 42533 - DNA, 20 bp, human
gggcacaccgaccccggact

SEQ ID NO: 42534 - DNA, 20 bp, human
gcgaggagcggggaaggcag

SEQ ID NO: 42535 - DNA, 20 bp, human
gacgcgcacacacaagagtt

SEQ ID NO: 42536 - DNA, 20 bp, human
gttggcggagctgacaatgg

SEQ ID NO: 42537 - DNA, 20 bp, human
gtgtttggcggagctgacaa

SEQ ID NO: 42538 - DNA, 20 bp, human
ggcggagctgacaatggcgg

SEQ ID NO: 42539 - DNA, 20 bp, human
gcaaacaggagagaattaag

SEQ ID NO: 42540 - DNA, 20 bp, human
ggcccagcgccttgccaaaa

SEQ ID NO: 42541 - DNA, 20 bp, human
gtactctaatgctcttggag

SEQ ID NO: 42542 - DNA, 20 bp, human
gcttcttacaagctccattt

SEQ ID NO: 42543 - DNA, 20 bp, human
gtccattttggcaaggcgct

SEQ ID NO: 42544 - DNA, 20 bp, human
gaaggcgctgggcagcctta

SEQ ID NO: 42545 - DNA, 20 bp, human
gtaaaaaaaaatgatggctg

SEQ ID NO: 42546 - DNA, 20 bp, human
ggcggaaccgagtgcctgtc

SEQ ID NO: 42547 - DNA, 20 bp, human
gcccctagcccgctgctcca

SEQ ID NO: 42548 - DNA, 20 bp, human
gggacctcggccagtgtgag

SEQ ID NO: 42549 - DNA, 20 bp, human
ggtgtgagcggcaagaggat

SEQ ID NO: 42550 - DNA, 20 bp, human
gggtttctgggagccaagag

SEQ ID NO: 42551 - DNA, 20 bp, human
gcgaggagatcgcagcgtac

SEQ ID NO: 42552 - DNA, 20 bp, human
ggccggagtgataattccgt

SEQ ID NO: 42553 - DNA, 20 bp, human
gatggcgtctgtatgatctt

SEQ ID NO: 42554 - DNA, 20 bp, human
gagcctgctgcatcggacct

SEQ ID NO: 42555 - DNA, 20 bp, human
ggcgctagctctgggcgcag

SEQ ID NO: 42556 - DNA, 20 bp, human
gaggtaattatcgaactccg

SEQ ID NO: 42557 - DNA, 20 bp, human
gtacgctcgggcccgcaaga

SEQ ID NO: 42558 - DNA, 20 bp, human
gtctgcctgcggggactcca

SEQ ID NO: 42559 - DNA, 20 bp, human
ggcgggtcgccggatcgggt

SEQ ID NO: 42560 - DNA, 20 bp, human
gggacccgggcactaggaaa

SEQ ID NO: 42561 - DNA, 20 bp, human
gcgtacgtccggtgtaatgg

SEQ ID NO: 42562 - DNA, 20 bp, human
gaagccccaatggactccag

SEQ ID NO: 42563 - DNA, 20 bp, human
gtgacgtacgtccggtgtaa

SEQ ID NO: 42564 - DNA, 20 bp, human
ggagcctctggagtccattg

SEQ ID NO: 42565 - DNA, 20 bp, human
gactgactgcctgagcggac

SEQ ID NO: 42566 - DNA, 20 bp, human
gccggaagtgacctctagag

SEQ ID NO: 42567 - DNA, 20 bp, human
gcctcgcgggatctagtccc

SEQ ID NO: 42568 - DNA, 20 bp, human
ggaagtgacctctagagcgg

SEQ ID NO: 42569 - DNA, 20 bp, human
gtctagagcggtggtgaaac

SEQ ID NO: 42570 - DNA, 20 bp, human
gacgtagagaaatagttcgg

SEQ ID NO: 42571 - DNA, 20 bp, human
gtggtgaaactggcagttga

SEQ ID NO: 42572 - DNA, 20 bp, human
gctggcagttgacggctcct

SEQ ID NO: 42573 - DNA, 20 bp, human
gtagttcgggggctacctcg

SEQ ID NO: 42574 - DNA, 20 bp, human
gcagggcaacggcctcctcc

SEQ ID NO: 42575 - DNA, 20 bp, human
gctaggaaaggaggtagata

SEQ ID NO: 42576 - DNA, 20 bp, human
gtgcccaaaggagcccctca

SEQ ID NO: 42577 - DNA, 20 bp, human
ggggtccggtaacaacatgg

SEQ ID NO: 42578 - DNA, 20 bp, human
gctcgggtccggtaacaaca

SEQ ID NO: 42579 - DNA, 20 bp, human
gacatggcggcgtccgtgag

SEQ ID NO: 42580 - DNA, 20 bp, human
gccaggagcctcccacgaat

SEQ ID NO: 42581 - DNA, 20 bp, human
gaaacactacccctgcccaa

SEQ ID NO: 42582 - DNA, 20 bp, human
gataggaccggaatgctggt

SEQ ID NO: 42583 - DNA, 20 bp, human
ggagcctcccacgaatggga

SEQ ID NO: 42584 - DNA, 20 bp, human
gggttagcggtgctcgggtc

SEQ ID NO: 42585 - DNA, 20 bp, human
gaaggtgagagcctcatcta

SEQ ID NO: 42586 - DNA, 20 bp, human
gagatagggacccttccctg

SEQ ID NO: 42587 - DNA, 20 bp, human
gcggtcactcacaggcgcag

SEQ ID NO: 42588 - DNA, 20 bp, human
gcccatactattcggacaga

SEQ ID NO: 42589 - DNA, 20 bp, human
gctgcccagggcccatcagt

SEQ ID NO: 42590 - DNA, 20 bp, human
ggccatctgtccgaatagta

SEQ ID NO: 42591 - DNA, 20 bp, human
gagccattgggcccactgat

SEQ ID NO: 42592 - DNA, 20 bp, human
ggtggtggacagagtagata

SEQ ID NO: 42593 - DNA, 20 bp, human
gggagagaggcttccattca

SEQ ID NO: 42594 - DNA, 20 bp, human
gtccattcacggtcactcac

SEQ ID NO: 42595 - DNA, 20 bp, human
gaggcctcctccatcttagg

SEQ ID NO: 42596 - DNA, 20 bp, human
gagagcggaaagaacagacc

SEQ ID NO: 42597 - DNA, 20 bp, human
gacgatggcaacaagtatgg

SEQ ID NO: 42598 - DNA, 20 bp, human
gcaagtatggcggctgctag

SEQ ID NO: 42599 - DNA, 20 bp, human
gctgaggctgcgagacatgc

SEQ ID NO: 42600 - DNA, 20 bp, human
ggagtccttacaagccgcag

SEQ ID NO: 42601 - DNA, 20 bp, human
gcggcttcttagctttacga

SEQ ID NO: 42602 - DNA, 20 bp, human
ggaacagacccggaatgcca

SEQ ID NO: 42603 - DNA, 20 bp, human
gtgcgaagagtatcgaagag

SEQ ID NO: 42604 - DNA, 20 bp, human
gaggtcccctgcggcttgta

SEQ ID NO: 42605 - DNA, 20 bp, human
gtactgacgaggtaagggaa

SEQ ID NO: 42606 - DNA, 20 bp, human
gccagggctgctgggaactc

SEQ ID NO: 42607 - DNA, 20 bp, human
gaacgggacgcgggaacgag

SEQ ID NO: 42608 - DNA, 20 bp, human
gctccttgggcacaatccca

SEQ ID NO: 42609 - DNA, 20 bp, human
gacgcggcggcgggaacctg

SEQ ID NO: 42610 - DNA, 20 bp, human
gacctgggggcgcagggcta

SEQ ID NO: 42611 - DNA, 20 bp, human
ggggcgacggggtctctcgc

SEQ ID NO: 42612 - DNA, 20 bp, human
ggttcggcaagtgggtcagt

SEQ ID NO: 42613 - DNA, 20 bp, human
gcaagtgggtcagttggctg

SEQ ID NO: 42614 - DNA, 20 bp, human
gcagtaggaaaagttcccag

SEQ ID NO: 42615 - DNA, 20 bp, human
gaggttggctgagttcaggt

SEQ ID NO: 42616 - DNA, 20 bp, human
ggcataagggagccaggtgt

SEQ ID NO: 42617 - DNA, 20 bp, human
gtgagggtgggcaagagtcc

SEQ ID NO: 42618 - DNA, 20 bp, human
gtgggcaagagtcccggcgg

SEQ ID NO: 42619 - DNA, 20 bp, human
gcaggcaggcggctagagcc

SEQ ID NO: 42620 - DNA, 20 bp, human
gctcctggcacacccacacc

SEQ ID NO: 42621 - DNA, 20 bp, human
gggtggtgtgggtggcataa

SEQ ID NO: 42622 - DNA, 20 bp, human
ggggtgggcaagagtcccgg

SEQ ID NO: 42623 - DNA, 20 bp, human
ggcagccacgacagagatat

SEQ ID NO: 42624 - DNA, 20 bp, human
gggcttgagggatagacaag

SEQ ID NO: 42625 - DNA, 20 bp, human
gagatctctggcggcggcaa

SEQ ID NO: 42626 - DNA, 20 bp, human
gacctggcgtggactgccaa

SEQ ID NO: 42627 - DNA, 20 bp, human
gggactgccaagggaacctc

SEQ ID NO: 42628 - DNA, 20 bp, human
ggcaggacagggtggctgac

SEQ ID NO: 42629 - DNA, 20 bp, human
ggcagatccagaggttccct

SEQ ID NO: 42630 - DNA, 20 bp, human
gggtaaagtctgagcaggac

SEQ ID NO: 42631 - DNA, 20 bp, human
gaaagggaaatactcgtctc

SEQ ID NO: 42632 - DNA, 20 bp, human
gctagtcctgtgcacctacc

SEQ ID NO: 42633 - DNA, 20 bp, human
gcctgtgcacctacctggcg

SEQ ID NO: 42634 - DNA, 20 bp, human
gtctctggtaaagtctgagc

SEQ ID NO: 42635 - DNA, 20 bp, human
gtaggtgcacaggactagtt

SEQ ID NO: 42636 - DNA, 20 bp, human
ggaaaggcaagcccgcaccg

SEQ ID NO: 42637 - DNA, 20 bp, human
ggctcccgactggctcgcgg

SEQ ID NO: 42638 - DNA, 20 bp, human
gccgccgccgcgagccagtc

SEQ ID NO: 42639 - DNA, 20 bp, human
gaccggggcagagaatgcta

SEQ ID NO: 42640 - DNA, 20 bp, human
gtgcgcggctccctacggga

SEQ ID NO: 42641 - DNA, 20 bp, human
gcgaaggctgacaagggaga

SEQ ID NO: 42642 - DNA, 20 bp, human
gcgccgagggctccgtcccc

SEQ ID NO: 42643 - DNA, 20 bp, human
gctcctggagccgtcccgta

SEQ ID NO: 42644 - DNA, 20 bp, human
gaccgacacgaaggctgaca

SEQ ID NO: 42645 - DNA, 20 bp, human
gcagcacccgcccagcccgg

SEQ ID NO: 42646 - DNA, 20 bp, human
gctggcggctgtgagaggag

SEQ ID NO: 42647 - DNA, 20 bp, human
gagcggaagagctggcgagg

SEQ ID NO: 42648 - DNA, 20 bp, human
ggtgagaggagcggaagagc

SEQ ID NO: 42649 - DNA, 20 bp, human
ggggtctgggaccccggcgg

SEQ ID NO: 42650 - DNA, 20 bp, human
gagagagcagcgcgggccat

SEQ ID NO: 42651 - DNA, 20 bp, human
ggaggaggtgcctgcggccc

SEQ ID NO: 42652 - DNA, 20 bp, human
gactgactgagcgaggctgt

SEQ ID NO: 42653 - DNA, 20 bp, human
ggagcagcagtgccactcgc

SEQ ID NO: 42654 - DNA, 20 bp, human
gggcggcggagagagcagcg

SEQ ID NO: 42655 - DNA, 20 bp, human
gaaaaggggttcgcggatct

SEQ ID NO: 42656 - DNA, 20 bp, human
gctggaggttcctctgctgt

SEQ ID NO: 42657 - DNA, 20 bp, human
gcattgagcttagttaggta

SEQ ID NO: 42658 - DNA, 20 bp, human
gggaatgtctcagaaaacgt

SEQ ID NO: 42659 - DNA, 20 bp, human
gtgattcatggtgctgagac

SEQ ID NO: 42660 - DNA, 20 bp, human
gtggttcattgagcttagtt

SEQ ID NO: 42661 - DNA, 20 bp, human
gtcaaggtaaggaacatcaa

SEQ ID NO: 42662 - DNA, 20 bp, human
gcccttaagcacagttcatg

SEQ ID NO: 42663 - DNA, 20 bp, human
ggaatatgtctaagcaattg

SEQ ID NO: 42664 - DNA, 20 bp, human
gtgactctaagtggcattca

SEQ ID NO: 42665 - DNA, 20 bp, human
ggattaaagagttgattatc

SEQ ID NO: 42666 - DNA, 20 bp, human
ggcacacaatatcacagcca

SEQ ID NO: 42667 - DNA, 20 bp, human
gttgatttggctagaatatc

SEQ ID NO: 42668 - DNA, 20 bp, human
gaacatgagtgtgaagggca

SEQ ID NO: 42669 - DNA, 20 bp, human
gatgaaaggaaattgataat

SEQ ID NO: 42670 - DNA, 20 bp, human
gtgtgtgctacagttgttca

SEQ ID NO: 42671 - DNA, 20 bp, human
gtatcctcaaatattttccc

SEQ ID NO: 42672 - DNA, 20 bp, human
gcttcatggaatttttgatt

SEQ ID NO: 42673 - DNA, 20 bp, human
gatcatgttaacaagcttcc

SEQ ID NO: 42674 - DNA, 20 bp, human
gtatttgaggataaaatcaa

SEQ ID NO: 42675 - DNA, 20 bp, human
gtcagctttgctgctcttct

SEQ ID NO: 42676 - DNA, 20 bp, human
ggaggtcagccgggacaact

SEQ ID NO: 42677 - DNA, 20 bp, human
gggacgccgagcgggcaatg

SEQ ID NO: 42678 - DNA, 20 bp, human
gtgacgcgcgactccctcgg

SEQ ID NO: 42679 - DNA, 20 bp, human
ggagcgggcaatgcggctga

SEQ ID NO: 42680 - DNA, 20 bp, human
gacggagagtgaaagtgcgg

SEQ ID NO: 42681 - DNA, 20 bp, human
ggcccgcgccatgaacgcca

SEQ ID NO: 42682 - DNA, 20 bp, human
gtgtcgggcggcgcaaactg

SEQ ID NO: 42683 - DNA, 20 bp, human
ggcgccgcccgacacagtgg

SEQ ID NO: 42684 - DNA, 20 bp, human
gctgcagccagcttgaggtc

SEQ ID NO: 42685 - DNA, 20 bp, human
gagagtgaaagtgcggcggt

SEQ ID NO: 42686 - DNA, 20 bp, human
gcagccactggagaattggt

SEQ ID NO: 42687 - DNA, 20 bp, human
gactctgctaatgaggtgag

SEQ ID NO: 42688 - DNA, 20 bp, human
gtacccagccactggagaat

SEQ ID NO: 42689 - DNA, 20 bp, human
gaaccctaccaattctccag

SEQ ID NO: 42690 - DNA, 20 bp, human
gctggaagttacccagccac

SEQ ID NO: 42691 - DNA, 20 bp, human
gggatcttcaaggtgctcca

SEQ ID NO: 42692 - DNA, 20 bp, human
gactaaactgagagatggtc

SEQ ID NO: 42693 - DNA, 20 bp, human
gtattattcaatgagaaaca

SEQ ID NO: 42694 - DNA, 20 bp, human
gacctggaagtggatcttca

SEQ ID NO: 42695 - DNA, 20 bp, human
ggaatgatagacattaactc

SEQ ID NO: 42696 - DNA, 20 bp, human
gagccctgggcatccaccga

SEQ ID NO: 42697 - DNA, 20 bp, human
gcgccgtcggtggatgccca

SEQ ID NO: 42698 - DNA, 20 bp, human
ggggcaccaaggtggtcgag

SEQ ID NO: 42699 - DNA, 20 bp, human
ggctccggctgcgccgtcgg

SEQ ID NO: 42700 - DNA, 20 bp, human
ggtcagcatgaggctcctgg

SEQ ID NO: 42701 - DNA, 20 bp, human
gagcctcatgctgaccggag

SEQ ID NO: 42702 - DNA, 20 bp, human
gggcgtgggagcagggacat

SEQ ID NO: 42703 - DNA, 20 bp, human
gcaagacgagacggcgacaa

SEQ ID NO: 42704 - DNA, 20 bp, human
ggagccggaaggcgcgcccc

SEQ ID NO: 42705 - DNA, 20 bp, human
gaatgcaagtgctcccggaa

SEQ ID NO: 42706 - DNA, 20 bp, human
gagtactgagcgcacggtcg

SEQ ID NO: 42707 - DNA, 20 bp, human
gcgcgctgcatgagcctccc

SEQ ID NO: 42708 - DNA, 20 bp, human
ggctgcatgagcctcccggg

SEQ ID NO: 42709 - DNA, 20 bp, human
gcgtccgccgacctgtgagg

SEQ ID NO: 42710 - DNA, 20 bp, human
gtggcggcgactctctccac

SEQ ID NO: 42711 - DNA, 20 bp, human
ggacgcagggaaagccgagg

SEQ ID NO: 42712 - DNA, 20 bp, human
gcgccggggaccggaggaga

SEQ ID NO: 42713 - DNA, 20 bp, human
ggtgcagccgcctcacaggt

SEQ ID NO: 42714 - DNA, 20 bp, human
gctggctcgcgcctcctctc

SEQ ID NO: 42715 - DNA, 20 bp, human
ggtccgcggagccccgagat

SEQ ID NO: 42716 - DNA, 20 bp, human
gggatcaggagcctccagca

SEQ ID NO: 42717 - DNA, 20 bp, human
gctggaggctcctgatccct

SEQ ID NO: 42718 - DNA, 20 bp, human
gatggaaggttccctgctgg

SEQ ID NO: 42719 - DNA, 20 bp, human
gtgagtcatccccagggatc

SEQ ID NO: 42720 - DNA, 20 bp, human
ggactaaagcatagaccacc

SEQ ID NO: 42721 - DNA, 20 bp, human
gcaaggcagggcggattaca

SEQ ID NO: 42722 - DNA, 20 bp, human
gcaggtcaggatactcagcc

SEQ ID NO: 42723 - DNA, 20 bp, human
gcctggggatgactcaggtc

SEQ ID NO: 42724 - DNA, 20 bp, human
gataatggaaggttccctgc

SEQ ID NO: 42725 - DNA, 20 bp, human
gccatggacatcagcattag

SEQ ID NO: 42726 - DNA, 20 bp, human
gcccctccaccccagaggcg

SEQ ID NO: 42727 - DNA, 20 bp, human
gttcgagcggctgtgcgagg

SEQ ID NO: 42728 - DNA, 20 bp, human
ggtggccaggggcgctccta

SEQ ID NO: 42729 - DNA, 20 bp, human
gctctgtggctctccgagaa

SEQ ID NO: 42730 - DNA, 20 bp, human
gagcgcagttcagtggccag

SEQ ID NO: 42731 - DNA, 20 bp, human
gaaaaggggttcgccgttct

SEQ ID NO: 42732 - DNA, 20 bp, human
gtcttccctaggagcgcccc

SEQ ID NO: 42733 - DNA, 20 bp, human
gcagtggcagcggcagcgat

SEQ ID NO: 42734 - DNA, 20 bp, human
ggggctgaggacagggtttg

SEQ ID NO: 42735 - DNA, 20 bp, human
gggacagggtttggggcagc

SEQ ID NO: 42736 - DNA, 20 bp, human
gcgggaagctgtgcgagaag

SEQ ID NO: 42737 - DNA, 20 bp, human
gcggtggcagcggaagcgcg

SEQ ID NO: 42738 - DNA, 20 bp, human
ggcctgcgacccgggctgtg

SEQ ID NO: 42739 - DNA, 20 bp, human
gttggggagccacacagccc

SEQ ID NO: 42740 - DNA, 20 bp, human
ggccacacagcccgggtcgc

SEQ ID NO: 42741 - DNA, 20 bp, human
gggaccttacattcacactt

SEQ ID NO: 42742 - DNA, 20 bp, human
ggtgtgaatgtaaggtcccc

SEQ ID NO: 42743 - DNA, 20 bp, human
gaaccccaagagttagctga

SEQ ID NO: 42744 - DNA, 20 bp, human
gctgaaccatgggggatgcg

SEQ ID NO: 42745 - DNA, 20 bp, human
gcggggaggtgcctgcgacc

SEQ ID NO: 42746 - DNA, 20 bp, human
gggtcgcgggttcctgaact

SEQ ID NO: 42747 - DNA, 20 bp, human
gtggaggatccggagcactg

SEQ ID NO: 42748 - DNA, 20 bp, human
gtgggtggaggagcggagat

SEQ ID NO: 42749 - DNA, 20 bp, human
ggtcaagagagcgctgcgag

SEQ ID NO: 42750 - DNA, 20 bp, human
gagattggaggagcgaagat

SEQ ID NO: 42751 - DNA, 20 bp, human
gagccagggcccatcgccag

SEQ ID NO: 42752 - DNA, 20 bp, human
gagagcgctgcgagcggtcg

SEQ ID NO: 42753 - DNA, 20 bp, human
gcactcgcactcgggcacag

SEQ ID NO: 42754 - DNA, 20 bp, human
ggcgggacgcactcgcactc

SEQ ID NO: 42755 - DNA, 20 bp, human
gccgctcctccacccagttc

SEQ ID NO: 42756 - DNA, 20 bp, human
ggtggaggcgcggagactgg

SEQ ID NO: 42757 - DNA, 20 bp, human
gggacttgcctaagtcacag

SEQ ID NO: 42758 - DNA, 20 bp, human
gggctcatagtggtcaagag

SEQ ID NO: 42759 - DNA, 20 bp, human
gtggtcaagagagggttcgc

SEQ ID NO: 42760 - DNA, 20 bp, human
gacagtggacacagcaacac

SEQ ID NO: 42761 - DNA, 20 bp, human
ggttcgcgggttcctgagct

SEQ ID NO: 42762 - DNA, 20 bp, human
ggagggatgaatgcagataa

SEQ ID NO: 42763 - DNA, 20 bp, human
gcgccagcggtgagagctcc

SEQ ID NO: 42764 - DNA, 20 bp, human
gtggaggatacagagcactt

SEQ ID NO: 42765 - DNA, 20 bp, human
gcgctggcgaggggccccgg

SEQ ID NO: 42766 - DNA, 20 bp, human
gatccaatacaggagtgact

SEQ ID NO: 42767 - DNA, 20 bp, human
gctatcactatgaagaaaag

SEQ ID NO: 42768 - DNA, 20 bp, human
gtattggttggatccttaat

SEQ ID NO: 42769 - DNA, 20 bp, human
ggttctctaaagaatttctc

SEQ ID NO: 42770 - DNA, 20 bp, human
gatctgtggctaaccaatta

SEQ ID NO: 42771 - DNA, 20 bp, human
gatagttagtaaatagatta

SEQ ID NO: 42772 - DNA, 20 bp, human
gctgattggagtgcaaggta

SEQ ID NO: 42773 - DNA, 20 bp, human
gttccaagtcactcctgtat

SEQ ID NO: 42774 - DNA, 20 bp, human
gaaattctctgattattggt

SEQ ID NO: 42775 - DNA, 20 bp, human
gtttttgctaagtatatctg

SEQ ID NO: 42776 - DNA, 20 bp, human
ggccaggtgtgtccaacagt

SEQ ID NO: 42777 - DNA, 20 bp, human
gagaaagtcctagcaaacag

SEQ ID NO: 42778 - DNA, 20 bp, human
gcctggccggtgcttcaggt

SEQ ID NO: 42779 - DNA, 20 bp, human
gaagtcctagcaaacagagg

SEQ ID NO: 42780 - DNA, 20 bp, human
gtgactgcagctcctactgt

SEQ ID NO: 42781 - DNA, 20 bp, human
gcatcatacaccctcaggcc

SEQ ID NO: 42782 - DNA, 20 bp, human
gtttgctaggactttctgtg

SEQ ID NO: 42783 - DNA, 20 bp, human
gtaactccatgtatgagtgg

SEQ ID NO: 42784 - DNA, 20 bp, human
gtgtgaccaccactcataca

SEQ ID NO: 42785 - DNA, 20 bp, human
gggactcatcatacaccctc

SEQ ID NO: 42786 - DNA, 20 bp, human
ggaggagcctaccagtctga

SEQ ID NO: 42787 - DNA, 20 bp, human
gcagttctcaggggcctcag

SEQ ID NO: 42788 - DNA, 20 bp, human
gcctgtctgatggcttctgg

SEQ ID NO: 42789 - DNA, 20 bp, human
ggagcctaccagtctgaagg

SEQ ID NO: 42790 - DNA, 20 bp, human
ggattctgggatgagtgctg

SEQ ID NO: 42791 - DNA, 20 bp, human
gtgaggcacagtgaagacat

SEQ ID NO: 42792 - DNA, 20 bp, human
gtcatcccagaatcactaag

SEQ ID NO: 42793 - DNA, 20 bp, human
gtgactaccacccaaccttg

SEQ ID NO: 42794 - DNA, 20 bp, human
gtgggactttggcccaggac

SEQ ID NO: 42795 - DNA, 20 bp, human
gtcatcaccccagttctcag

SEQ ID NO: 42796 - DNA, 20 bp, human
gcacaagcaccaaagcagag

SEQ ID NO: 42797 - DNA, 20 bp, human
gtacctcaaggaccatggct

SEQ ID NO: 42798 - DNA, 20 bp, human
gggcagcagcacttacctca

SEQ ID NO: 42799 - DNA, 20 bp, human
ggcacttacctcaaggacca

SEQ ID NO: 42800 - DNA, 20 bp, human
gaagtgggggatccccttgt

SEQ ID NO: 42801 - DNA, 20 bp, human
gtccttctcaagctaagtgg

SEQ ID NO: 42802 - DNA, 20 bp, human
gcttccccctccctacactg

SEQ ID NO: 42803 - DNA, 20 bp, human
ggagtagctggaggccgcat

SEQ ID NO: 42804 - DNA, 20 bp, human
gtggaaacctgcagtcacag

SEQ ID NO: 42805 - DNA, 20 bp, human
gtcccccacttagcttgaga

SEQ ID NO: 42806 - DNA, 20 bp, human
gtccccaaggaagagaccgg

SEQ ID NO: 42807 - DNA, 20 bp, human
gcgcgcgcggcgggactcaa

SEQ ID NO: 42808 - DNA, 20 bp, human
gactggagcactcaggccct

SEQ ID NO: 42809 - DNA, 20 bp, human
ggcctcgggactcagaccac

SEQ ID NO: 42810 - DNA, 20 bp, human
gggtagcaaagtgacgccga

SEQ ID NO: 42811 - DNA, 20 bp, human
ggctggttctccagatgcgg

SEQ ID NO: 42812 - DNA, 20 bp, human
gaccgctggttctccagatg

SEQ ID NO: 42813 - DNA, 20 bp, human
ggcagaagcggccaggacat

SEQ ID NO: 42814 - DNA, 20 bp, human
gccacccacccgcactatat

SEQ ID NO: 42815 - DNA, 20 bp, human
ggcgcagcccctctccgagc

SEQ ID NO: 42816 - DNA, 20 bp, human
gcggctgtgagtcaccagac

SEQ ID NO: 42817 - DNA, 20 bp, human
gggacctggtgagtagacac

SEQ ID NO: 42818 - DNA, 20 bp, human
gagcgttagcgggtagttca

SEQ ID NO: 42819 - DNA, 20 bp, human
gccgccaggtgcctctagag

SEQ ID NO: 42820 - DNA, 20 bp, human
gatggacctcgagaacctgg

SEQ ID NO: 42821 - DNA, 20 bp, human
gagcaatgccagcctcctta

SEQ ID NO: 42822 - DNA, 20 bp, human
ggccagagtccgagggagag

SEQ ID NO: 42823 - DNA, 20 bp, human
gattccgaccctaagagaaa

SEQ ID NO: 42824 - DNA, 20 bp, human
gtcggaatatggaactagac

SEQ ID NO: 42825 - DNA, 20 bp, human
gggtccatttccagcgttag

SEQ ID NO: 42826 - DNA, 20 bp, human
gaaccacatcacagaagtag

SEQ ID NO: 42827 - DNA, 20 bp, human
gtcatgagcaagctcatctc

SEQ ID NO: 42828 - DNA, 20 bp, human
ggctcatctctggaacaaac

SEQ ID NO: 42829 - DNA, 20 bp, human
gagacccacccagggagata

SEQ ID NO: 42830 - DNA, 20 bp, human
gactggcaaagcatctctgc

SEQ ID NO: 42831 - DNA, 20 bp, human
gtgagcttgctcatgaagca

SEQ ID NO: 42832 - DNA, 20 bp, human
gctgatggtactgctagtaa

SEQ ID NO: 42833 - DNA, 20 bp, human
ggacagggaggactaacccc

SEQ ID NO: 42834 - DNA, 20 bp, human
gagtgcaaaatgccaggcta

SEQ ID NO: 42835 - DNA, 20 bp, human
gtaacccacacagcagcaaa

SEQ ID NO: 42836 - DNA, 20 bp, human
ggagccataaccggagtctg

SEQ ID NO: 42837 - DNA, 20 bp, human
gggtctgtcggccgactcag

SEQ ID NO: 42838 - DNA, 20 bp, human
gacctgcacagaccactcgg

SEQ ID NO: 42839 - DNA, 20 bp, human
gggacacggactcctcgtca

SEQ ID NO: 42840 - DNA, 20 bp, human
gctgaacggcgggagtctat

SEQ ID NO: 42841 - DNA, 20 bp, human
gcactcggcggcgtcccagg

SEQ ID NO: 42842 - DNA, 20 bp, human
gcttagggcagagggataag

SEQ ID NO: 42843 - DNA, 20 bp, human
gtgggaggcgtgactagaag

SEQ ID NO: 42844 - DNA, 20 bp, human
ggcgtcccaggcggttgcaa

SEQ ID NO: 42845 - DNA, 20 bp, human
ggtccacggatacccggaca

SEQ ID NO: 42846 - DNA, 20 bp, human
gcgggctggggcagacatgt

SEQ ID NO: 42847 - DNA, 20 bp, human
gggcccaaggagccgagtga

SEQ ID NO: 42848 - DNA, 20 bp, human
gccaggcggcagcatggacc

SEQ ID NO: 42849 - DNA, 20 bp, human
gatggccagggtgaaggtgc

SEQ ID NO: 42850 - DNA, 20 bp, human
gactgatggctgcgagacca

SEQ ID NO: 42851 - DNA, 20 bp, human
gggtcccggggaagacatgg

SEQ ID NO: 42852 - DNA, 20 bp, human
gaggggtcccggggaagaca

SEQ ID NO: 42853 - DNA, 20 bp, human
gggaaaccaaactctccatg

SEQ ID NO: 42854 - DNA, 20 bp, human
gcaccctggccatggccgag

SEQ ID NO: 42855 - DNA, 20 bp, human
gcagcgctgcccttggacac

SEQ ID NO: 42856 - DNA, 20 bp, human
ggagagcaacgcgctgggag

SEQ ID NO: 42857 - DNA, 20 bp, human
gcgcacacagcgactggaga

SEQ ID NO: 42858 - DNA, 20 bp, human
ggagagcgcgggtctgttgt

SEQ ID NO: 42859 - DNA, 20 bp, human
ggcagcgtctgcaaattcta

SEQ ID NO: 42860 - DNA, 20 bp, human
gcggacggagagcaacgcgc

SEQ ID NO: 42861 - DNA, 20 bp, human
gagcgcgggtctgttgtcgg

SEQ ID NO: 42862 - DNA, 20 bp, human
gagtcgctgtgtgcgaggga

SEQ ID NO: 42863 - DNA, 20 bp, human
gggagctgccaagacacatc

SEQ ID NO: 42864 - DNA, 20 bp, human
gagtgtatgtgtgagagcgc

SEQ ID NO: 42865 - DNA, 20 bp, human
ggtgatgtgcaactaattaa

SEQ ID NO: 42866 - DNA, 20 bp, human
gccgagccgagcgagaagag

SEQ ID NO: 42867 - DNA, 20 bp, human
ggcagcagaggcggcactgg

SEQ ID NO: 42868 - DNA, 20 bp, human
gagcggggatgtagaggcgg

SEQ ID NO: 42869 - DNA, 20 bp, human
ggccgtggcccgacacctac

SEQ ID NO: 42870 - DNA, 20 bp, human
ggacgactcggagagccggt

SEQ ID NO: 42871 - DNA, 20 bp, human
gccgtcgccgcgaggccgag

SEQ ID NO: 42872 - DNA, 20 bp, human
ggccggagttcgctgcaagt

SEQ ID NO: 42873 - DNA, 20 bp, human
gagcatactgcggcttaggg

SEQ ID NO: 42874 - DNA, 20 bp, human
gggagttcgctgcaagtcgg

SEQ ID NO: 42875 - DNA, 20 bp, human
ggcggccaccaagcgatcac

SEQ ID NO: 42876 - DNA, 20 bp, human
gtactggtctcatcagtgaa

SEQ ID NO: 42877 - DNA, 20 bp, human
gggtaaggaaaggaagtatt

SEQ ID NO: 42878 - DNA, 20 bp, human
gtgcagaagctaaaccagtg

SEQ ID NO: 42879 - DNA, 20 bp, human
gttagaatgtggacacgagg

SEQ ID NO: 42880 - DNA, 20 bp, human
ggtgtggcaattagtgaaag

SEQ ID NO: 42881 - DNA, 20 bp, human
gtcagcgctctcgtgataaa

SEQ ID NO: 42882 - DNA, 20 bp, human
gccaatctgctcatctgatc

SEQ ID NO: 42883 - DNA, 20 bp, human
gtaccatatcagagacaagt

SEQ ID NO: 42884 - DNA, 20 bp, human
gagtttaaacaagcattcag

SEQ ID NO: 42885 - DNA, 20 bp, human
gtgcttagaatgtggacacg

SEQ ID NO: 42886 - DNA, 20 bp, human
gcatggcgagggaacctctg

SEQ ID NO: 42887 - DNA, 20 bp, human
gcagccatgaacacccaaaa

SEQ ID NO: 42888 - DNA, 20 bp, human
gccgggatggagggaggatt

SEQ ID NO: 42889 - DNA, 20 bp, human
gtgttttctggctaccgaga

SEQ ID NO: 42890 - DNA, 20 bp, human
gggtcgtcgacgctaatcct

SEQ ID NO: 42891 - DNA, 20 bp, human
gcgagctatccatatcccgg

SEQ ID NO: 42892 - DNA, 20 bp, human
gtggctcctgccgggatgga

SEQ ID NO: 42893 - DNA, 20 bp, human
gtcaccataaacgtccacag

SEQ ID NO: 42894 - DNA, 20 bp, human
ggaacccctttggatgctca

SEQ ID NO: 42895 - DNA, 20 bp, human
ggccagatgactactccctg

SEQ ID NO: 42896 - DNA, 20 bp, human
gtagagtccatcaagtggga

SEQ ID NO: 42897 - DNA, 20 bp, human
gctcccatgtaactaatcac

SEQ ID NO: 42898 - DNA, 20 bp, human
gctttcttagacggtttaaa

SEQ ID NO: 42899 - DNA, 20 bp, human
gtaggcgagggtttcacatc

SEQ ID NO: 42900 - DNA, 20 bp, human
gaccctcgcctatcaatctt

SEQ ID NO: 42901 - DNA, 20 bp, human
gcaatgctgtctttcttaga

SEQ ID NO: 42902 - DNA, 20 bp, human
gtcctaagattgataggcga

SEQ ID NO: 42903 - DNA, 20 bp, human
ggtgtttagagtccatcaag

SEQ ID NO: 42904 - DNA, 20 bp, human
gattgttttaatactggaag

SEQ ID NO: 42905 - DNA, 20 bp, human
gatttcttcctaagattgat

SEQ ID NO: 42906 - DNA, 20 bp, human
ggccttgaagggaacctcac

SEQ ID NO: 42907 - DNA, 20 bp, human
gcaatcgagcaaggtaagga

SEQ ID NO: 42908 - DNA, 20 bp, human
ggcttggaggccagcaacaa

SEQ ID NO: 42909 - DNA, 20 bp, human
gtagctcaagtaggtctctg

SEQ ID NO: 42910 - DNA, 20 bp, human
gactacatcatggagcgggt

SEQ ID NO: 42911 - DNA, 20 bp, human
gtgctgactacatcatggag

SEQ ID NO: 42912 - DNA, 20 bp, human
gggaagaatgactgaagact

SEQ ID NO: 42913 - DNA, 20 bp, human
gtgccttgctgactacatca

SEQ ID NO: 42914 - DNA, 20 bp, human
gatggagcgggtaggcttgg

SEQ ID NO: 42915 - DNA, 20 bp, human
gtcagcaaggcaatcgagca

SEQ ID NO: 42916 - DNA, 20 bp, human
ggtccaacatgtaaatcaac

SEQ ID NO: 42917 - DNA, 20 bp, human
ggacctgttgatttacatgt

SEQ ID NO: 42918 - DNA, 20 bp, human
gccttctatagtaacttgaa

SEQ ID NO: 42919 - DNA, 20 bp, human
gaatactggggaaaatatca

SEQ ID NO: 42920 - DNA, 20 bp, human
ggatactccacaatttcatc

SEQ ID NO: 42921 - DNA, 20 bp, human
gaccaatttctttaatgaat

SEQ ID NO: 42922 - DNA, 20 bp, human
gaaataggtttgaatgtgag

SEQ ID NO: 42923 - DNA, 20 bp, human
gaaatcaaacaaacgataaa

SEQ ID NO: 42924 - DNA, 20 bp, human
gatactattaattaatactg

SEQ ID NO: 42925 - DNA, 20 bp, human
gagttactatagaaggagaa

SEQ ID NO: 42926 - DNA, 20 bp, human
gtccactcgaggctgtacag

SEQ ID NO: 42927 - DNA, 20 bp, human
gtggagcccagagcccaaga

SEQ ID NO: 42928 - DNA, 20 bp, human
ggcctctggctgtccactcg

SEQ ID NO: 42929 - DNA, 20 bp, human
ggcctctgtacagcctcgag

SEQ ID NO: 42930 - DNA, 20 bp, human
gatcaggatgtaatatgggt

SEQ ID NO: 42931 - DNA, 20 bp, human
gaatggtctgaagttggggt

SEQ ID NO: 42932 - DNA, 20 bp, human
gccaaagaggaagctgtcag

SEQ ID NO: 42933 - DNA, 20 bp, human
ggtggtaatggtctgaagtt

SEQ ID NO: 42934 - DNA, 20 bp, human
gaggaatcaggatgtaatat

SEQ ID NO: 42935 - DNA, 20 bp, human
gctggacatcttcacaagaa

SEQ ID NO: 42936 - DNA, 20 bp, human
gatggtgctgtcggagctag

SEQ ID NO: 42937 - DNA, 20 bp, human
gccaggagggagggacgtcg

SEQ ID NO: 42938 - DNA, 20 bp, human
gctgaggctgaaactacagg

SEQ ID NO: 42939 - DNA, 20 bp, human
gcaacctcctggttccaagt

SEQ ID NO: 42940 - DNA, 20 bp, human
ggcagctgcgcagcagtaac

SEQ ID NO: 42941 - DNA, 20 bp, human
gcagcgcacacctgacactg

SEQ ID NO: 42942 - DNA, 20 bp, human
ggagtacaagaactgggtga

SEQ ID NO: 42943 - DNA, 20 bp, human
ggtggaaggagagcacctcg

SEQ ID NO: 42944 - DNA, 20 bp, human
gaggctgaaactacaggggg

SEQ ID NO: 42945 - DNA, 20 bp, human
gtctcccacttggaaccagg

SEQ ID NO: 42946 - DNA, 20 bp, human
ggctaactccgggaaaccag

SEQ ID NO: 42947 - DNA, 20 bp, human
ggagaccctgccgacagcag

SEQ ID NO: 42948 - DNA, 20 bp, human
ggaccgctaacacctgtcac

SEQ ID NO: 42949 - DNA, 20 bp, human
gggtcgttgccgctaactcc

SEQ ID NO: 42950 - DNA, 20 bp, human
gggccagtgacaggtgttag

SEQ ID NO: 42951 - DNA, 20 bp, human
gagctgctataccagcaggg

SEQ ID NO: 42952 - DNA, 20 bp, human
ggacgggagctgtatgaaag

SEQ ID NO: 42953 - DNA, 20 bp, human
gctcccaagcaaggagacgt

SEQ ID NO: 42954 - DNA, 20 bp, human
gtgtgtgtggagcagtacac

SEQ ID NO: 42955 - DNA, 20 bp, human
gtcttgcggacggtacctga

SEQ ID NO: 42956 - DNA, 20 bp, human
gggccagtgacagatgctag

SEQ ID NO: 42957 - DNA, 20 bp, human
ggagaccatggggagagcaa

SEQ ID NO: 42958 - DNA, 20 bp, human
gcacgactctcagggtccag

SEQ ID NO: 42959 - DNA, 20 bp, human
ggcttactcccggaaaccgg

SEQ ID NO: 42960 - DNA, 20 bp, human
ggagagcaagggacaccaaa

SEQ ID NO: 42961 - DNA, 20 bp, human
gtcctcatgaaagggacgac

SEQ ID NO: 42962 - DNA, 20 bp, human
gggaggggggccgagaccat

SEQ ID NO: 42963 - DNA, 20 bp, human
ggaactgggagaaaccaatg

SEQ ID NO: 42964 - DNA, 20 bp, human
gcacgcgcttagaaggaggg

SEQ ID NO: 42965 - DNA, 20 bp, human
gggcggaggactgtactctg

SEQ ID NO: 42966 - DNA, 20 bp, human
gtgcatggggaggcaacccg

SEQ ID NO: 42967 - DNA, 20 bp, human
gacaggcggtacagacccca

SEQ ID NO: 42968 - DNA, 20 bp, human
ggtgctgtgcgaccacgtgg

SEQ ID NO: 42969 - DNA, 20 bp, human
gccacgtgggggaaaagcac

SEQ ID NO: 42970 - DNA, 20 bp, human
gtcccatgccacagtgtctg

SEQ ID NO: 42971 - DNA, 20 bp, human
gctgaggggggctcactaac

SEQ ID NO: 42972 - DNA, 20 bp, human
ggaggagaacccctattggg

SEQ ID NO: 42973 - DNA, 20 bp, human
gaggctgttgtaactcgggt

SEQ ID NO: 42974 - DNA, 20 bp, human
gccggcctgggcaccgcttg

SEQ ID NO: 42975 - DNA, 20 bp, human
gcgtgggggaaaagcacagg

SEQ ID NO: 42976 - DNA, 20 bp, human
gcgaggcagtcctggcctgt

SEQ ID NO: 42977 - DNA, 20 bp, human
gcacgacgcacagacaggcg

SEQ ID NO: 42978 - DNA, 20 bp, human
gcagacaggcgaggcagtcc

SEQ ID NO: 42979 - DNA, 20 bp, human
ggccggcggtgagtacacgt

SEQ ID NO: 42980 - DNA, 20 bp, human
gagccacatgggccctccca

SEQ ID NO: 42981 - DNA, 20 bp, human
ggtgggacagctgcctgggt

SEQ ID NO: 42982 - DNA, 20 bp, human
gttctccacgacgcacagac

SEQ ID NO: 42983 - DNA, 20 bp, human
gccagacgccatgcaccctc

SEQ ID NO: 42984 - DNA, 20 bp, human
gcgccccaaactcccaactc

SEQ ID NO: 42985 - DNA, 20 bp, human
gccaaactcccaactctgga

SEQ ID NO: 42986 - DNA, 20 bp, human
gcaccccggtggatgaccaa

SEQ ID NO: 42987 - DNA, 20 bp, human
gctgggcggcggcacgatgg

SEQ ID NO: 42988 - DNA, 20 bp, human
gacgctgggcggcggcacga

SEQ ID NO: 42989 - DNA, 20 bp, human
ggtcctggtaacggcgggag

SEQ ID NO: 42990 - DNA, 20 bp, human
gccagccaagcccagctgag

SEQ ID NO: 42991 - DNA, 20 bp, human
gggtgtccctggacgctggg

SEQ ID NO: 42992 - DNA, 20 bp, human
ggtccctggacgctgggcgg

SEQ ID NO: 42993 - DNA, 20 bp, human
ggatgaccaaggggacgttg

SEQ ID NO: 42994 - DNA, 20 bp, human
gcggtcgtcctggtaacggc

SEQ ID NO: 42995 - DNA, 20 bp, human
gtccccttggtcatccaccg

SEQ ID NO: 42996 - DNA, 20 bp, human
gcacgacgcacagacaggcg

SEQ ID NO: 42997 - DNA, 20 bp, human
gcgaggcagtcctggcctgt

SEQ ID NO: 42998 - DNA, 20 bp, human
ggtgggacagctgcctgggt

SEQ ID NO: 42999 - DNA, 20 bp, human
gcagacaggcgaggcagtcc

SEQ ID NO: 43000 - DNA, 20 bp, human
gagccacatgggccctccca

SEQ ID NO: 43001 - DNA, 20 bp, human
ggccggcggtgagtacacgt

SEQ ID NO: 43002 - DNA, 20 bp, human
gccagacgccatgcaccctc

SEQ ID NO: 43003 - DNA, 20 bp, human
gcgccccaaactcccaactc

SEQ ID NO: 43004 - DNA, 20 bp, human
gttctccacgacgcacagac

SEQ ID NO: 43005 - DNA, 20 bp, human
gccaaactcccaactctgga

SEQ ID NO: 43006 - DNA, 20 bp, human
gctgggcggcggcacgatgg

SEQ ID NO: 43007 - DNA, 20 bp, human
gcaccccggtggatgaccaa

SEQ ID NO: 43008 - DNA, 20 bp, human
gacgctgggcggcggcacga

SEQ ID NO: 43009 - DNA, 20 bp, human
gccagccaagcccagctgag

SEQ ID NO: 43010 - DNA, 20 bp, human
ggtcctggtaacggcgggag

SEQ ID NO: 43011 - DNA, 20 bp, human
gggtgtccctggacgctggg

SEQ ID NO: 43012 - DNA, 20 bp, human
ggtccctggacgctgggcgg

SEQ ID NO: 43013 - DNA, 20 bp, human
ggatgaccaaggggacgttg

SEQ ID NO: 43014 - DNA, 20 bp, human
gcggtcgtcctggtaacggc

SEQ ID NO: 43015 - DNA, 20 bp, human
gtccccttggtcatccaccg

SEQ ID NO: 43016 - DNA, 20 bp, human
gactgcgtggtcgttatcac

SEQ ID NO: 43017 - DNA, 20 bp, human
gttggtacttgaggttgatg

SEQ ID NO: 43018 - DNA, 20 bp, human
gccactgggacaattcagta

SEQ ID NO: 43019 - DNA, 20 bp, human
ggaaaacctaagaaagctag

SEQ ID NO: 43020 - DNA, 20 bp, human
gagtgaggcaaggaaaggat

SEQ ID NO: 43021 - DNA, 20 bp, human
gaacctcaagtaccaaaggg

SEQ ID NO: 43022 - DNA, 20 bp, human
gcatcttcattaggcttctg

SEQ ID NO: 43023 - DNA, 20 bp, human
gttaggcttctgtggctcac

SEQ ID NO: 43024 - DNA, 20 bp, human
ggtaccaaagggaggaagaa

SEQ ID NO: 43025 - DNA, 20 bp, human
gggagctcgagccaaaaagc

SEQ ID NO: 43026 - DNA, 20 bp, human
gccactgggacaattcagta

SEQ ID NO: 43027 - DNA, 20 bp, human
gttggtacttgaggttgatg

SEQ ID NO: 43028 - DNA, 20 bp, human
gactgcgtggtcgttatcac

SEQ ID NO: 43029 - DNA, 20 bp, human
gagtgaggcaaggaaaggat

SEQ ID NO: 43030 - DNA, 20 bp, human
gcatcttcattaggcttctg

SEQ ID NO: 43031 - DNA, 20 bp, human
ggaaaacctaagaaagctag

SEQ ID NO: 43032 - DNA, 20 bp, human
gaacctcaagtaccaaaggg

SEQ ID NO: 43033 - DNA, 20 bp, human
gttaggcttctgtggctcac

SEQ ID NO: 43034 - DNA, 20 bp, human
gggagctcgagccaaaaagc

SEQ ID NO: 43035 - DNA, 20 bp, human
gggcgaaaagaccccttcga

SEQ ID NO: 43036 - DNA, 20 bp, human
ggccagatggtcctagtgct

SEQ ID NO: 43037 - DNA, 20 bp, human
gaactgcgggggcgtctgca

SEQ ID NO: 43038 - DNA, 20 bp, human
ggagtagccgggaactgcgg

SEQ ID NO: 43039 - DNA, 20 bp, human
ggtctggatacagagtcaca

SEQ ID NO: 43040 - DNA, 20 bp, human
gtctgcaaggagccagactt

SEQ ID NO: 43041 - DNA, 20 bp, human
ggagttttcagattgctctt

SEQ ID NO: 43042 - DNA, 20 bp, human
gtgcgtagggaggatttagt

SEQ ID NO: 43043 - DNA, 20 bp, human
gcttgaaggcgaatttcctc

SEQ ID NO: 43044 - DNA, 20 bp, human
gccttcaagaacccgaagtc

SEQ ID NO: 43045 - DNA, 20 bp, human
gagtggggcggggatgcgta

SEQ ID NO: 43046 - DNA, 20 bp, human
ggagtcttgcctgtcagcag

SEQ ID NO: 43047 - DNA, 20 bp, human
ggatgtgacgatctcagatg

SEQ ID NO: 43048 - DNA, 20 bp, human
gttgcagcctcgctacgggg

SEQ ID NO: 43049 - DNA, 20 bp, human
gaactgtgctggccgtccag

SEQ ID NO: 43050 - DNA, 20 bp, human
gacaggcaccacctccgagg

SEQ ID NO: 43051 - DNA, 20 bp, human
gagcaataaaggggaggctt

SEQ ID NO: 43052 - DNA, 20 bp, human
ggtccagaggtacctgttag

SEQ ID NO: 43053 - DNA, 20 bp, human
ggtccaggtagcacttctcc

SEQ ID NO: 43054 - DNA, 20 bp, human
gtagtttgccccgtccaaag

SEQ ID NO: 43055 - DNA, 20 bp, human
gcagtgtgtcaccccctcgg

SEQ ID NO: 43056 - DNA, 20 bp, human
gtccaacaacggaagtaggt

SEQ ID NO: 43057 - DNA, 20 bp, human
gccctccaagcgccccctct

SEQ ID NO: 43058 - DNA, 20 bp, human
ggagcagaggctgccgagag

SEQ ID NO: 43059 - DNA, 20 bp, human
gaatccaggccgccaaccgg

SEQ ID NO: 43060 - DNA, 20 bp, human
ggcgcccagcggcgtgtact

SEQ ID NO: 43061 - DNA, 20 bp, human
ggaataaagaacttagatca

SEQ ID NO: 43062 - DNA, 20 bp, human
gctgtgtggacggtacgcgg

SEQ ID NO: 43063 - DNA, 20 bp, human
gaagctttcgaagccgccgg

SEQ ID NO: 43064 - DNA, 20 bp, human
ggtacgcggaggcgcgagga

SEQ ID NO: 43065 - DNA, 20 bp, human
gttcttaacgggaaaaaata

SEQ ID NO: 43066 - DNA, 20 bp, human
gcaggatgcctggtgtaact

SEQ ID NO: 43067 - DNA, 20 bp, human
gcccaaatccaggcggctag

SEQ ID NO: 43068 - DNA, 20 bp, human
gagtaagcggtaaaagtctg

SEQ ID NO: 43069 - DNA, 20 bp, human
gcaggaattgcgggagtaag

SEQ ID NO: 43070 - DNA, 20 bp, human
gaaagtttcccaaatccagg

SEQ ID NO: 43071 - DNA, 20 bp, human
ggcctctagccgcctggatt

SEQ ID NO: 43072 - DNA, 20 bp, human
gcccaaagtttcccaaatcc

SEQ ID NO: 43073 - DNA, 20 bp, human
gggcgcgagacctcacaatt

SEQ ID NO: 43074 - DNA, 20 bp, human
gccctcagccgtacataaag

SEQ ID NO: 43075 - DNA, 20 bp, human
gcagtgggcctctagccgcc

SEQ ID NO: 43076 - DNA, 20 bp, human
gacctagctggcctgttcag

SEQ ID NO: 43077 - DNA, 20 bp, human
gtggagataacccactgaac

SEQ ID NO: 43078 - DNA, 20 bp, human
gtgaggaaattcttactcta

SEQ ID NO: 43079 - DNA, 20 bp, human
ggatcagaatagctttcctg

SEQ ID NO: 43080 - DNA, 20 bp, human
gatccctagtctaaacagtg

SEQ ID NO: 43081 - DNA, 20 bp, human
ggggttatctccaccacctc

SEQ ID NO: 43082 - DNA, 20 bp, human
gaatagctttcctgaggtgg

SEQ ID NO: 43083 - DNA, 20 bp, human
gaagcctctaaagcagaagc

SEQ ID NO: 43084 - DNA, 20 bp, human
ggaaagaagcagttggtccc

SEQ ID NO: 43085 - DNA, 20 bp, human
gggcaactagaatgaagcca

SEQ ID NO: 43086 - DNA, 20 bp, human
gtagggttggtggactagag

SEQ ID NO: 43087 - DNA, 20 bp, human
gagcttagggaggggactaa

SEQ ID NO: 43088 - DNA, 20 bp, human
gcatcaaacatggaggtgag

SEQ ID NO: 43089 - DNA, 20 bp, human
gtggggcaaataggcctata

SEQ ID NO: 43090 - DNA, 20 bp, human
gacaagtgaggagcttaggg

SEQ ID NO: 43091 - DNA, 20 bp, human
ggagataggatgggacacat

SEQ ID NO: 43092 - DNA, 20 bp, human
gggataaccagtatccccag

SEQ ID NO: 43093 - DNA, 20 bp, human
ggcaaataggcctatagggt

SEQ ID NO: 43094 - DNA, 20 bp, human
gaggaagctctaaggatatg

SEQ ID NO: 43095 - DNA, 20 bp, human
gagtctcaggccccacccct

SEQ ID NO: 43096 - DNA, 20 bp, human
ggggacttaacatacagtag

SEQ ID NO: 43097 - DNA, 20 bp, human
gcctgtagtagaagatccat

SEQ ID NO: 43098 - DNA, 20 bp, human
gtagcagtgttaacattagt

SEQ ID NO: 43099 - DNA, 20 bp, human
gatataaatgaatctggcaa

SEQ ID NO: 43100 - DNA, 20 bp, human
gagtagaagatccattggtt

SEQ ID NO: 43101 - DNA, 20 bp, human
gtagtattagctagtttggt

SEQ ID NO: 43102 - DNA, 20 bp, human
gtagtttggtggggacaggt

SEQ ID NO: 43103 - DNA, 20 bp, human
ggacaggttggtatattgag

SEQ ID NO: 43104 - DNA, 20 bp, human
gtggggaagggtggtaaagg

SEQ ID NO: 43105 - DNA, 20 bp, human
gaagattcatgtccgcaact

SEQ ID NO: 43106 - DNA, 20 bp, human
gcgcgttctagagcaaggta

SEQ ID NO: 43107 - DNA, 20 bp, human
ggctgaagggacgctcgggt

SEQ ID NO: 43108 - DNA, 20 bp, human
gggaggctgaagggacgctc

SEQ ID NO: 43109 - DNA, 20 bp, human
ggagaggctcggctccgaga

SEQ ID NO: 43110 - DNA, 20 bp, human
gtccagtgcgcggccgcaag

SEQ ID NO: 43111 - DNA, 20 bp, human
gcctcgcgctcagaagctgg

SEQ ID NO: 43112 - DNA, 20 bp, human
gagggacgctcgggtaggca

SEQ ID NO: 43113 - DNA, 20 bp, human
gacccgcaccctgggcccga

SEQ ID NO: 43114 - DNA, 20 bp, human
gagaaccggccaagcgaccc

SEQ ID NO: 43115 - DNA, 20 bp, human
ggcgccacggcccgcagaac

SEQ ID NO: 43116 - DNA, 20 bp, human
gagccggctgtaggcattca

SEQ ID NO: 43117 - DNA, 20 bp, human
gctcctaggaacctcgggag

SEQ ID NO: 43118 - DNA, 20 bp, human
gggcattgccagccggctgt

SEQ ID NO: 43119 - DNA, 20 bp, human
ggagtcagggatcacccctc

SEQ ID NO: 43120 - DNA, 20 bp, human
ggtgcgaagcgagatagcag

SEQ ID NO: 43121 - DNA, 20 bp, human
gggagccctaagtcagctag

SEQ ID NO: 43122 - DNA, 20 bp, human
ggcacccagcagaggagtca

SEQ ID NO: 43123 - DNA, 20 bp, human
gagtgaagtccggagaccag

SEQ ID NO: 43124 - DNA, 20 bp, human
ggctcgtgccagctaacaat

SEQ ID NO: 43125 - DNA, 20 bp, human
gggccagactggccatagag

SEQ ID NO: 43126 - DNA, 20 bp, human
ggaaccagacctacctccag

SEQ ID NO: 43127 - DNA, 20 bp, human
gcagcccctggaggtaggtc

SEQ ID NO: 43128 - DNA, 20 bp, human
gccatgcagcccctggaggt

SEQ ID NO: 43129 - DNA, 20 bp, human
ggcagccagcgggtcagtct

SEQ ID NO: 43130 - DNA, 20 bp, human
ggaaacaggtcccctgatgg

SEQ ID NO: 43131 - DNA, 20 bp, human
gagggaccccagcagtaaag

SEQ ID NO: 43132 - DNA, 20 bp, human
gtgacccgctggctgcggag

SEQ ID NO: 43133 - DNA, 20 bp, human
gctggagtgtacgggcccgc

SEQ ID NO: 43134 - DNA, 20 bp, human
gcacttctatcctccatcag

SEQ ID NO: 43135 - DNA, 20 bp, human
gcagggatcctggaataatg

SEQ ID NO: 43136 - DNA, 20 bp, human
ggcgcaccgccgctccgtca

SEQ ID NO: 43137 - DNA, 20 bp, human
gaagcggctccgtgacggag

SEQ ID NO: 43138 - DNA, 20 bp, human
ggtcgcacccggaagtaaag

SEQ ID NO: 43139 - DNA, 20 bp, human
gaagtaaagcggctccgtga

SEQ ID NO: 43140 - DNA, 20 bp, human
gttggtaccagttcagacat

SEQ ID NO: 43141 - DNA, 20 bp, human
ggctcgtcccaggaagtcct

SEQ ID NO: 43142 - DNA, 20 bp, human
gtagcgtgggccaggatctc

SEQ ID NO: 43143 - DNA, 20 bp, human
gcaggccgccggccgtcgac

SEQ ID NO: 43144 - DNA, 20 bp, human
ggtcacaacatgccagtcga

SEQ ID NO: 43145 - DNA, 20 bp, human
gaagcccagggccacaaggt

SEQ ID NO: 43146 - DNA, 20 bp, human
ggcgccgggaaccccactgg

SEQ ID NO: 43147 - DNA, 20 bp, human
gcccggcgcggggaatgtcc

SEQ ID NO: 43148 - DNA, 20 bp, human
gggctcgcggcgaaccgaga

SEQ ID NO: 43149 - DNA, 20 bp, human
ggactcagccagctccaccc

SEQ ID NO: 43150 - DNA, 20 bp, human
gcgcaggtgagcgaactcgg

SEQ ID NO: 43151 - DNA, 20 bp, human
gcacctgctagtgtacacct

SEQ ID NO: 43152 - DNA, 20 bp, human
gcggccgcccagcccccagt

SEQ ID NO: 43153 - DNA, 20 bp, human
ggcgctctgctccacccgac

SEQ ID NO: 43154 - DNA, 20 bp, human
ggcgcggggaatgtcccggg

SEQ ID NO: 43155 - DNA, 20 bp, human
gcacctgcgcgctcacacct

SEQ ID NO: 43156 - DNA, 20 bp, human
gctctcaaggaaagtagtcg

SEQ ID NO: 43157 - DNA, 20 bp, human
gatctcagttagcggtggag

SEQ ID NO: 43158 - DNA, 20 bp, human
gggtggagaggcagtatgtc

SEQ ID NO: 43159 - DNA, 20 bp, human
gggcagtatgtccggttcaa

SEQ ID NO: 43160 - DNA, 20 bp, human
gtggcgactgcggaagctag

SEQ ID NO: 43161 - DNA, 20 bp, human
ggcggaatctcagttagcgg

SEQ ID NO: 43162 - DNA, 20 bp, human
ggtcgcggaatctcagttag

SEQ ID NO: 43163 - DNA, 20 bp, human
gtccggttcaatggcgactg

SEQ ID NO: 43164 - DNA, 20 bp, human
gaccagaactcggagctgac

SEQ ID NO: 43165 - DNA, 20 bp, human
gggaagctagcggcagcgat

SEQ ID NO: 43166 - DNA, 20 bp, human
gtcccaggtaagatacccag

SEQ ID NO: 43167 - DNA, 20 bp, human
ggaagggctggcattgacag

SEQ ID NO: 43168 - DNA, 20 bp, human
ggtgtacgacctaacgtcat

SEQ ID NO: 43169 - DNA, 20 bp, human
gcggataaacgctctcccct

SEQ ID NO: 43170 - DNA, 20 bp, human
gggcctgcaacttccacgat

SEQ ID NO: 43171 - DNA, 20 bp, human
gcctcggctcccggacgcga

SEQ ID NO: 43172 - DNA, 20 bp, human
gggtctttggatcaaaccag

SEQ ID NO: 43173 - DNA, 20 bp, human
gaggccaggatatcagccac

SEQ ID NO: 43174 - DNA, 20 bp, human
gaacaggcccgaagacctct

SEQ ID NO: 43175 - DNA, 20 bp, human
gggtggccggaaaaggacaa

SEQ ID NO: 43176 - DNA, 20 bp, human
gcaacctcggaagtgcggag

SEQ ID NO: 43177 - DNA, 20 bp, human
gtcggaagtgcggagcgggt

SEQ ID NO: 43178 - DNA, 20 bp, human
gtcagccccaacaaagatgg

SEQ ID NO: 43179 - DNA, 20 bp, human
gggcggcaacctcggaagtg

SEQ ID NO: 43180 - DNA, 20 bp, human
gtcttagctgtagatagagg

SEQ ID NO: 43181 - DNA, 20 bp, human
gccatcttagctgtagatag

SEQ ID NO: 43182 - DNA, 20 bp, human
gtagatagaggcggcaacct

SEQ ID NO: 43183 - DNA, 20 bp, human
gcaggcccaacaaaagccca

SEQ ID NO: 43184 - DNA, 20 bp, human
gctcgcgccagcggagagaa

SEQ ID NO: 43185 - DNA, 20 bp, human
ggtacaggcccgggtcccct

SEQ ID NO: 43186 - DNA, 20 bp, human
gaccgtctggatccccatga

SEQ ID NO: 43187 - DNA, 20 bp, human
ggatctgtcggcttgtcagg

SEQ ID NO: 43188 - DNA, 20 bp, human
gctgtcggcttgtcaggtgg

SEQ ID NO: 43189 - DNA, 20 bp, human
gcagcgcggaggcatgccaa

SEQ ID NO: 43190 - DNA, 20 bp, human
gcgggacctccgaaccaagt

SEQ ID NO: 43191 - DNA, 20 bp, human
gggtccaggagagtgacctg

SEQ ID NO: 43192 - DNA, 20 bp, human
gggcgcattgtgggatctgt

SEQ ID NO: 43193 - DNA, 20 bp, human
gggaaaaggcgctccgtcat

SEQ ID NO: 43194 - DNA, 20 bp, human
gctggctgtgggctcctact

SEQ ID NO: 43195 - DNA, 20 bp, human
gcagggaggccagcaggacg

SEQ ID NO: 43196 - DNA, 20 bp, human
gctgtcgtggaccagagggt

SEQ ID NO: 43197 - DNA, 20 bp, human
gtccctgtcgggcttgagtt

SEQ ID NO: 43198 - DNA, 20 bp, human
gggagcagggcggccttgta

SEQ ID NO: 43199 - DNA, 20 bp, human
gcccagggtaggcgcccatg

SEQ ID NO: 43200 - DNA, 20 bp, human
ggagcctgtcgtggaccaga

SEQ ID NO: 43201 - DNA, 20 bp, human
ggtcgggcttgagttgggag

SEQ ID NO: 43202 - DNA, 20 bp, human
gcgcaggagcgaggacgcca

SEQ ID NO: 43203 - DNA, 20 bp, human
gtgagactccagtgacccgg

SEQ ID NO: 43204 - DNA, 20 bp, human
gcgtggaccagagggtaggg

SEQ ID NO: 43205 - DNA, 20 bp, human
gactccagtgacccggcggg

SEQ ID NO: 43206 - DNA, 20 bp, human
gccgggcgcgacggtctcgg

SEQ ID NO: 43207 - DNA, 20 bp, human
gtggctgctggagggacccg

SEQ ID NO: 43208 - DNA, 20 bp, human
gggcgcgacggtctcggcgg

SEQ ID NO: 43209 - DNA, 20 bp, human
gcgcggcgcggggccaccat

SEQ ID NO: 43210 - DNA, 20 bp, human
gactgccagggcgtaagtag

SEQ ID NO: 43211 - DNA, 20 bp, human
gggcggcgacagagcgagcg

SEQ ID NO: 43212 - DNA, 20 bp, human
gccgcgtcactccggagcag

SEQ ID NO: 43213 - DNA, 20 bp, human
gggcccgggcgcgacggtct

SEQ ID NO: 43214 - DNA, 20 bp, human
ggcacacacgctcacaacca

SEQ ID NO: 43215 - DNA, 20 bp, human
gcaaggccccacggcggcca

SEQ ID NO: 43216 - DNA, 20 bp, human
gccctggcgaccccggaagt

SEQ ID NO: 43217 - DNA, 20 bp, human
ggaggtgctgtcccgtctgg

SEQ ID NO: 43218 - DNA, 20 bp, human
gcagcgaggggagagactca

SEQ ID NO: 43219 - DNA, 20 bp, human
gatcgcgggaaaggacttgg

SEQ ID NO: 43220 - DNA, 20 bp, human
ggaccccggaagtgggtcgg

SEQ ID NO: 43221 - DNA, 20 bp, human
ggagctcgaaacgcagcgag

SEQ ID NO: 43222 - DNA, 20 bp, human
gctggaggtgctgtcccgtc

SEQ ID NO: 43223 - DNA, 20 bp, human
gtaaaggaccagaaagaaga

SEQ ID NO: 43224 - DNA, 20 bp, human
gccgtctggcggcgatcccc

SEQ ID NO: 43225 - DNA, 20 bp, human
gaacggatagagcgggataa

SEQ ID NO: 43226 - DNA, 20 bp, human
gtgtacaggtgcaacagctt

SEQ ID NO: 43227 - DNA, 20 bp, human
gaggtgaagcgcaggcgagt

SEQ ID NO: 43228 - DNA, 20 bp, human
ggcgcaggcgagtaggtgag

SEQ ID NO: 43229 - DNA, 20 bp, human
gcctggaaaatcctcacgtg

SEQ ID NO: 43230 - DNA, 20 bp, human
gagtaggtgagtggtcgtgg

SEQ ID NO: 43231 - DNA, 20 bp, human
gccccgcctacccagagact

SEQ ID NO: 43232 - DNA, 20 bp, human
ggagagggacagagcgacag

SEQ ID NO: 43233 - DNA, 20 bp, human
ggcgagtaggtgagtggtcg

SEQ ID NO: 43234 - DNA, 20 bp, human
gggcgaattgggaaatccag

SEQ ID NO: 43235 - DNA, 20 bp, human
gctgcgcttcacctcacgtg

SEQ ID NO: 43236 - DNA, 20 bp, human
gaggccagctggctaccgag

SEQ ID NO: 43237 - DNA, 20 bp, human
ggcccactcgatctgcccca

SEQ ID NO: 43238 - DNA, 20 bp, human
ggccatggggcagatcgagt

SEQ ID NO: 43239 - DNA, 20 bp, human
gcagatcgagtgggccatgt

SEQ ID NO: 43240 - DNA, 20 bp, human
gccccatggcgacacgaacc

SEQ ID NO: 43241 - DNA, 20 bp, human
ggtgaccccggaaaccaccg

SEQ ID NO: 43242 - DNA, 20 bp, human
gggaggaagttgcagcgcag

SEQ ID NO: 43243 - DNA, 20 bp, human
ggccatgtgggccaacgaac

SEQ ID NO: 43244 - DNA, 20 bp, human
gtggcgacacgaacccggct

SEQ ID NO: 43245 - DNA, 20 bp, human
gggacctcgggctacttaca

SEQ ID NO: 43246 - DNA, 20 bp, human
gattcaacctctgccaccat

SEQ ID NO: 43247 - DNA, 20 bp, human
ggaagcatagtatagaagaa

SEQ ID NO: 43248 - DNA, 20 bp, human
gctctgccaccatggggaac

SEQ ID NO: 43249 - DNA, 20 bp, human
gttacttctgaattcctagg

SEQ ID NO: 43250 - DNA, 20 bp, human
gtttataacttatctcttgt

SEQ ID NO: 43251 - DNA, 20 bp, human
gagtgtaattactgaaataa

SEQ ID NO: 43252 - DNA, 20 bp, human
gtggctaatttattcctcct

SEQ ID NO: 43253 - DNA, 20 bp, human
gtgacttctcggggttatct

SEQ ID NO: 43254 - DNA, 20 bp, human
gtctgtttacagatagatat

SEQ ID NO: 43255 - DNA, 20 bp, human
gagatagatataggttcaca

SEQ ID NO: 43256 - DNA, 20 bp, human
gccgcccggccactacccag

SEQ ID NO: 43257 - DNA, 20 bp, human
gccacaagaacttggagagg

SEQ ID NO: 43258 - DNA, 20 bp, human
gcccatactccgcaccgcgg

SEQ ID NO: 43259 - DNA, 20 bp, human
gcaagttcttgtggcccccg

SEQ ID NO: 43260 - DNA, 20 bp, human
ggcggcagccctctgggtag

SEQ ID NO: 43261 - DNA, 20 bp, human
gtagtggaggacccagacga

SEQ ID NO: 43262 - DNA, 20 bp, human
gagcgcgcgggaagccaagt

SEQ ID NO: 43263 - DNA, 20 bp, human
ggcccccgcggtgcggagta

SEQ ID NO: 43264 - DNA, 20 bp, human
gccggcttcgtcttcatcca

SEQ ID NO: 43265 - DNA, 20 bp, human
gaagcgccagtagccctcca

SEQ ID NO: 43266 - DNA, 20 bp, human
gctcccgctacggacacctc

SEQ ID NO: 43267 - DNA, 20 bp, human
ggacacctcaggtgagcgct

SEQ ID NO: 43268 - DNA, 20 bp, human
gcagccgcaagagccgtcct

SEQ ID NO: 43269 - DNA, 20 bp, human
gcggccccgcatctccgtga

SEQ ID NO: 43270 - DNA, 20 bp, human
gcaggggccgacgggagtgg

SEQ ID NO: 43271 - DNA, 20 bp, human
gccccaggggccgacgggag

SEQ ID NO: 43272 - DNA, 20 bp, human
ggatcccacacgctcaaggt

SEQ ID NO: 43273 - DNA, 20 bp, human
gccgaatggcgcgcccagga

SEQ ID NO: 43274 - DNA, 20 bp, human
ggctggccgagatcaggctg

SEQ ID NO: 43275 - DNA, 20 bp, human
gagtggcggccgcgcggagg

SEQ ID NO: 43276 - DNA, 20 bp, human
gactaaaaagaggtgagagc

SEQ ID NO: 43277 - DNA, 20 bp, human
gggaggccgcacctggttag

SEQ ID NO: 43278 - DNA, 20 bp, human
ggggcggggagtgaagaccc

SEQ ID NO: 43279 - DNA, 20 bp, human
gccggtacttaagcgcggac

SEQ ID NO: 43280 - DNA, 20 bp, human
ggtccttggacttagagagt

SEQ ID NO: 43281 - DNA, 20 bp, human
gtgtgccagcgactaaaaag

SEQ ID NO: 43282 - DNA, 20 bp, human
ggaccgagctgggcgagtaa

SEQ ID NO: 43283 - DNA, 20 bp, human
gtgcggcggagccctaacta

SEQ ID NO: 43284 - DNA, 20 bp, human
gtctaagtccaaggacacgc

SEQ ID NO: 43285 - DNA, 20 bp, human
ggagtgaagaccctggactg

SEQ ID NO: 43286 - DNA, 20 bp, human
gtcggccaaggaaactccca

SEQ ID NO: 43287 - DNA, 20 bp, human
gcgcgaggcggtgaacgcgg

SEQ ID NO: 43288 - DNA, 20 bp, human
gcgcggaatccgggatccgg

SEQ ID NO: 43289 - DNA, 20 bp, human
gtcctcacctgcgtccgcgg

SEQ ID NO: 43290 - DNA, 20 bp, human
gttggccgagtgagtcactc

SEQ ID NO: 43291 - DNA, 20 bp, human
gccagcccgagtgactcact

SEQ ID NO: 43292 - DNA, 20 bp, human
ggccgccgcggacgcaggtg

SEQ ID NO: 43293 - DNA, 20 bp, human
gggagctgtgccatgtgccg

SEQ ID NO: 43294 - DNA, 20 bp, human
ggcggcggcttgggggtcct

SEQ ID NO: 43295 - DNA, 20 bp, human
gggcacagctccagtggcga

SEQ ID NO: 43296 - DNA, 20 bp, human
gggctctgcggcgggtccag

SEQ ID NO: 43297 - DNA, 20 bp, human
gaccgcagggccccgcgccg

SEQ ID NO: 43298 - DNA, 20 bp, human
ggaggtgacggtggtcacgg

SEQ ID NO: 43299 - DNA, 20 bp, human
gacgcacggtgggtccgagg

SEQ ID NO: 43300 - DNA, 20 bp, human
gggcagagcatcctgcgccc

SEQ ID NO: 43301 - DNA, 20 bp, human
gaggaggcggtgctaatctc

SEQ ID NO: 43302 - DNA, 20 bp, human
gggggcctgaggctaccgca

SEQ ID NO: 43303 - DNA, 20 bp, human
gcggtgctaatctcagggac

SEQ ID NO: 43304 - DNA, 20 bp, human
gcgcttacctggctctgcgg

SEQ ID NO: 43305 - DNA, 20 bp, human
gattagcaccgcctcctccc

SEQ ID NO: 43306 - DNA, 20 bp, human
gagcggctccgggcagagga

SEQ ID NO: 43307 - DNA, 20 bp, human
gagcgaggagctgtccgagg

SEQ ID NO: 43308 - DNA, 20 bp, human
gaatggggccggtccgaggt

SEQ ID NO: 43309 - DNA, 20 bp, human
ggcgaggggtagagcgcgga

SEQ ID NO: 43310 - DNA, 20 bp, human
gtgctccgccgacctcggac

SEQ ID NO: 43311 - DNA, 20 bp, human
gggagctgtccgaggcggag

SEQ ID NO: 43312 - DNA, 20 bp, human
gctcggaccggccccattcg

SEQ ID NO: 43313 - DNA, 20 bp, human
gccaggcttcgttcacccca

SEQ ID NO: 43314 - DNA, 20 bp, human
ggccaactgcgaggacgtgg

SEQ ID NO: 43315 - DNA, 20 bp, human
gtggcgctggagctcggacc

SEQ ID NO: 43316 - DNA, 20 bp, human
gacagcgaaaacaaagatgg

SEQ ID NO: 43317 - DNA, 20 bp, human
gcgggccgggcccactgagg

SEQ ID NO: 43318 - DNA, 20 bp, human
gcgcacagcgaaaacaaaga

SEQ ID NO: 43319 - DNA, 20 bp, human
gcccgcagccgcttcttggg

SEQ ID NO: 43320 - DNA, 20 bp, human
gtcctcggcgccggacatag

SEQ ID NO: 43321 - DNA, 20 bp, human
gcggctgtggggctacgcgc

SEQ ID NO: 43322 - DNA, 20 bp, human
gcctgcgccgccgcctcagt

SEQ ID NO: 43323 - DNA, 20 bp, human
gctgggctcccggacgaggc

SEQ ID NO: 43324 - DNA, 20 bp, human
gaaagatggcggccgtgccg

SEQ ID NO: 43325 - DNA, 20 bp, human
ggccggccggccgctatgtc

SEQ ID NO: 43326 - DNA, 20 bp, human
gctgcgcggtcccaacgcag

SEQ ID NO: 43327 - DNA, 20 bp, human
gcgctcgctcccgcaactgg

SEQ ID NO: 43328 - DNA, 20 bp, human
ggacggcgcaggactccggg

SEQ ID NO: 43329 - DNA, 20 bp, human
gcctccaccagcgagaggag

SEQ ID NO: 43330 - DNA, 20 bp, human
gaggccactgcacacacctg

SEQ ID NO: 43331 - DNA, 20 bp, human
gagcgacggcgcaggactcc

SEQ ID NO: 43332 - DNA, 20 bp, human
gctgctccctgcgttccggg

SEQ ID NO: 43333 - DNA, 20 bp, human
ggaacgcagggagcaggccg

SEQ ID NO: 43334 - DNA, 20 bp, human
gagaggagcggaggctagag

SEQ ID NO: 43335 - DNA, 20 bp, human
gggcgttgtcctgggaaccc

SEQ ID NO: 43336 - DNA, 20 bp, human
gtcaagtccaggcaacgtac

SEQ ID NO: 43337 - DNA, 20 bp, human
gccaggcaacgtacaggcag

SEQ ID NO: 43338 - DNA, 20 bp, human
gaaaagaggacttacaacct

SEQ ID NO: 43339 - DNA, 20 bp, human
gaggggaaatgtctcttcca

SEQ ID NO: 43340 - DNA, 20 bp, human
gtaaacttaattgtatgtgt

SEQ ID NO: 43341 - DNA, 20 bp, human
gacttactatgctcaagtcc

SEQ ID NO: 43342 - DNA, 20 bp, human
ggagcatagtaagttgaaac

SEQ ID NO: 43343 - DNA, 20 bp, human
gaagactttgtatgctagtt

SEQ ID NO: 43344 - DNA, 20 bp, human
gtaaacttactgcactttct

SEQ ID NO: 43345 - DNA, 20 bp, human
gcatcttgttttaggaatca

SEQ ID NO: 43346 - DNA, 20 bp, human
gagtcctggcaagtcataag

SEQ ID NO: 43347 - DNA, 20 bp, human
ggtgtatgtaatagtgactg

SEQ ID NO: 43348 - DNA, 20 bp, human
gaaatttgacttacaatctt

SEQ ID NO: 43349 - DNA, 20 bp, human
gacttacaatacttaagtcc

SEQ ID NO: 43350 - DNA, 20 bp, human
gtgtgactgaattttagagg

SEQ ID NO: 43351 - DNA, 20 bp, human
gtcaaactggtgatgttgaa

SEQ ID NO: 43352 - DNA, 20 bp, human
gaagtattgtaagttcaaac

SEQ ID NO: 43353 - DNA, 20 bp, human
ggttaacctttagtaaaaag

SEQ ID NO: 43354 - DNA, 20 bp, human
gaaaagacttatccaaagcc

SEQ ID NO: 43355 - DNA, 20 bp, human
gtttcagtaaaatagatacc

SEQ ID NO: 43356 - DNA, 20 bp, human
gaggtaaatactagggcggt

SEQ ID NO: 43357 - DNA, 20 bp, human
gcgcgtcggaggtaaatact

SEQ ID NO: 43358 - DNA, 20 bp, human
gtcggaggtaaatactaggg

SEQ ID NO: 43359 - DNA, 20 bp, human
gccaccatcgggacccccag

SEQ ID NO: 43360 - DNA, 20 bp, human
gcccagaggagagaggactt

SEQ ID NO: 43361 - DNA, 20 bp, human
gtcggaggcggggcaggtgg

SEQ ID NO: 43362 - DNA, 20 bp, human
gcgggcccaggtagcaggtt

SEQ ID NO: 43363 - DNA, 20 bp, human
ggcgggcggccggatcccct

SEQ ID NO: 43364 - DNA, 20 bp, human
gtactagggcggtgggtgtg

SEQ ID NO: 43365 - DNA, 20 bp, human
gagcaggtttggctgcgcgg

SEQ ID NO: 43366 - DNA, 20 bp, human
gtgaccaggactgagcgtgg

SEQ ID NO: 43367 - DNA, 20 bp, human
ggggggcactcagaaaggtc

SEQ ID NO: 43368 - DNA, 20 bp, human
gcccccaacaggctgttctc

SEQ ID NO: 43369 - DNA, 20 bp, human
gctagcagtccccgctgaag

SEQ ID NO: 43370 - DNA, 20 bp, human
ggcagagggtgggagccgaa

SEQ ID NO: 43371 - DNA, 20 bp, human
ggagcgtgggggaagaccct

SEQ ID NO: 43372 - DNA, 20 bp, human
gtctgagtgcccccagggag

SEQ ID NO: 43373 - DNA, 20 bp, human
ggtccccgctgaagtggagc

SEQ ID NO: 43374 - DNA, 20 bp, human
gtcccctctcctggtgacaa

SEQ ID NO: 43375 - DNA, 20 bp, human
gtgtacctgctccacttcag

SEQ ID NO: 43376 - DNA, 20 bp, human
gcaggccgggggccacgcta

SEQ ID NO: 43377 - DNA, 20 bp, human
ggtgcgctgggaggaatgct

SEQ ID NO: 43378 - DNA, 20 bp, human
ggggtgaacgcagcgagcga

SEQ ID NO: 43379 - DNA, 20 bp, human
ggctagggcggacccaattt

SEQ ID NO: 43380 - DNA, 20 bp, human
ggccgcgctattccgaaatt

SEQ ID NO: 43381 - DNA, 20 bp, human
gcgagctcacccgagcccac

SEQ ID NO: 43382 - DNA, 20 bp, human
gtgctgcagggccgcaggcc

SEQ ID NO: 43383 - DNA, 20 bp, human
ggtcgcagcgtggtcaagtt

SEQ ID NO: 43384 - DNA, 20 bp, human
ggactgggacctaggacctg

SEQ ID NO: 43385 - DNA, 20 bp, human
ggccgggggccacgctaggg

SEQ ID NO: 43386 - DNA, 20 bp, human
gaggacaacctccctgtgag

SEQ ID NO: 43387 - DNA, 20 bp, human
gcagggaaaggggtttggat

SEQ ID NO: 43388 - DNA, 20 bp, human
gttgggctctgtcgttctca

SEQ ID NO: 43389 - DNA, 20 bp, human
gcattaggatttgaagtctt

SEQ ID NO: 43390 - DNA, 20 bp, human
gcagggcctgctgcacgttg

SEQ ID NO: 43391 - DNA, 20 bp, human
gaatggggggttcctttctg

SEQ ID NO: 43392 - DNA, 20 bp, human
gatccctcttcaacgccctg

SEQ ID NO: 43393 - DNA, 20 bp, human
gaggggtttggatgggcatt

SEQ ID NO: 43394 - DNA, 20 bp, human
gtcctttctgtggaggactc

SEQ ID NO: 43395 - DNA, 20 bp, human
gcaagggaaacaccgtctgc

SEQ ID NO: 43396 - DNA, 20 bp, human
gggattgcagctgaacaggg

SEQ ID NO: 43397 - DNA, 20 bp, human
gccagaccttccaggaacta

SEQ ID NO: 43398 - DNA, 20 bp, human
gacctgttgcctggacgccg

SEQ ID NO: 43399 - DNA, 20 bp, human
gtggagggagcagggttatg

SEQ ID NO: 43400 - DNA, 20 bp, human
ggttccgggcagtcagcaag

SEQ ID NO: 43401 - DNA, 20 bp, human
gcgccggggcatggcttcaa

SEQ ID NO: 43402 - DNA, 20 bp, human
ggaaggtctggtgtacttcc

SEQ ID NO: 43403 - DNA, 20 bp, human
gactgggcacgagagccgcc

SEQ ID NO: 43404 - DNA, 20 bp, human
gaagccatgccccggcgtcc

SEQ ID NO: 43405 - DNA, 20 bp, human
gctggtgtacttccaggtgc

SEQ ID NO: 43406 - DNA, 20 bp, human
gaccgtcctaggggcccgag

SEQ ID NO: 43407 - DNA, 20 bp, human
gccctctctgcagtgagctg

SEQ ID NO: 43408 - DNA, 20 bp, human
gctaaagttgaaaggttcca

SEQ ID NO: 43409 - DNA, 20 bp, human
ggccgctcgggcccctagga

SEQ ID NO: 43410 - DNA, 20 bp, human
gaacggcagcaccgtcctag

SEQ ID NO: 43411 - DNA, 20 bp, human
gctgggcactagagccgctc

SEQ ID NO: 43412 - DNA, 20 bp, human
gacctgttgcctggatgctg

SEQ ID NO: 43413 - DNA, 20 bp, human
gggtgtgcgtggcagcgccc

SEQ ID NO: 43414 - DNA, 20 bp, human
gtagagccgctcgggcccct

SEQ ID NO: 43415 - DNA, 20 bp, human
gggcagcaggggcagggatc

SEQ ID NO: 43416 - DNA, 20 bp, human
gaagagctgtggcaactcta

SEQ ID NO: 43417 - DNA, 20 bp, human
ggccacgagctcccacatgg

SEQ ID NO: 43418 - DNA, 20 bp, human
gcaggcaagatagacagcag

SEQ ID NO: 43419 - DNA, 20 bp, human
ggagctggaagccccattct

SEQ ID NO: 43420 - DNA, 20 bp, human
gtcagaccatgcctagaatg

SEQ ID NO: 43421 - DNA, 20 bp, human
ggcaactctagggcacaagg

SEQ ID NO: 43422 - DNA, 20 bp, human
gactagtgggatgatgtgaa

SEQ ID NO: 43423 - DNA, 20 bp, human
ggaagacctgaacaatccca

SEQ ID NO: 43424 - DNA, 20 bp, human
ggagctcccacatggtggct

SEQ ID NO: 43425 - DNA, 20 bp, human
gccatctattcggttcgtat

SEQ ID NO: 43426 - DNA, 20 bp, human
ggctatccaatggtgaggag

SEQ ID NO: 43427 - DNA, 20 bp, human
gtgaaaggctggctatccaa

SEQ ID NO: 43428 - DNA, 20 bp, human
gggctggctatccaatggtg

SEQ ID NO: 43429 - DNA, 20 bp, human
gtgctctgtctactggatct

SEQ ID NO: 43430 - DNA, 20 bp, human
gcttatcctatcaggacgga

SEQ ID NO: 43431 - DNA, 20 bp, human
gcaggaccttccgtcctgat

SEQ ID NO: 43432 - DNA, 20 bp, human
ggcctttcaaggaaagtagg

SEQ ID NO: 43433 - DNA, 20 bp, human
gtctggaagatcccgagcac

SEQ ID NO: 43434 - DNA, 20 bp, human
ggggttcagggagtttctgg

SEQ ID NO: 43435 - DNA, 20 bp, human
ggagatacatacgcgacgtc

SEQ ID NO: 43436 - DNA, 20 bp, human
gagagtcctgtggaaatcaa

SEQ ID NO: 43437 - DNA, 20 bp, human
gagggcacatcctcaatacc

SEQ ID NO: 43438 - DNA, 20 bp, human
gggggcaatttagagtcctg

SEQ ID NO: 43439 - DNA, 20 bp, human
ggtgttccttgacctcagag

SEQ ID NO: 43440 - DNA, 20 bp, human
gctatagatgaaccttttag

SEQ ID NO: 43441 - DNA, 20 bp, human
gctcttggtgtggaattatg

SEQ ID NO: 43442 - DNA, 20 bp, human
ggtgaggagcaggactggca

SEQ ID NO: 43443 - DNA, 20 bp, human
ggtgttagcaaatgaggact

SEQ ID NO: 43444 - DNA, 20 bp, human
gctctaaattgccccctctg

SEQ ID NO: 43445 - DNA, 20 bp, human
ggaggtcaaggaacacaaga

SEQ ID NO: 43446 - DNA, 20 bp, human
ggcagggagacactcactag

SEQ ID NO: 43447 - DNA, 20 bp, human
gggatcacaaggatcaggga

SEQ ID NO: 43448 - DNA, 20 bp, human
gcttggagcctgggatcaca

SEQ ID NO: 43449 - DNA, 20 bp, human
gcctgggatcacaaggatca

SEQ ID NO: 43450 - DNA, 20 bp, human
gcatcagaaagcctgaggga

SEQ ID NO: 43451 - DNA, 20 bp, human
gggaagccccagggtaggca

SEQ ID NO: 43452 - DNA, 20 bp, human
gtctccttgggtggacaggg

SEQ ID NO: 43453 - DNA, 20 bp, human
gcctgccaggtggccttgat

SEQ ID NO: 43454 - DNA, 20 bp, human
ggccttcaccctcaccctga

SEQ ID NO: 43455 - DNA, 20 bp, human
ggtgtctccctgcctaccct

SEQ ID NO: 43456 - DNA, 20 bp, human
gccaagaaaggtacctgtag

SEQ ID NO: 43457 - DNA, 20 bp, human
gagaggcaggtgcttgagat

SEQ ID NO: 43458 - DNA, 20 bp, human
ggagattggcagggttgtaa

SEQ ID NO: 43459 - DNA, 20 bp, human
gctcaagcacctgcctctac

SEQ ID NO: 43460 - DNA, 20 bp, human
gtggccacctcagtgtcact

SEQ ID NO: 43461 - DNA, 20 bp, human
gtgtaaattggtcccaagaa

SEQ ID NO: 43462 - DNA, 20 bp, human
ggaaaggtacctgtagaggc

SEQ ID NO: 43463 - DNA, 20 bp, human
gcacctcagtgtcactgggt

SEQ ID NO: 43464 - DNA, 20 bp, human
gataccttccatatacccaa

SEQ ID NO: 43465 - DNA, 20 bp, human
gggtcccttgggtatatgga

SEQ ID NO: 43466 - DNA, 20 bp, human
ggagaaggcgtgacactcag

SEQ ID NO: 43467 - DNA, 20 bp, human
gaacgctgcgggcatcgagg

SEQ ID NO: 43468 - DNA, 20 bp, human
gaacggcactcagtccccag

SEQ ID NO: 43469 - DNA, 20 bp, human
ggacgccaagagactcgagt

SEQ ID NO: 43470 - DNA, 20 bp, human
ggacagactgacctgcgggg

SEQ ID NO: 43471 - DNA, 20 bp, human
gcccttgcggctctcacaac

SEQ ID NO: 43472 - DNA, 20 bp, human
ggcgcgctttgactctggag

SEQ ID NO: 43473 - DNA, 20 bp, human
ggtgagagccgcaagggcat

SEQ ID NO: 43474 - DNA, 20 bp, human
gaggtagcgggtggcgtggt

SEQ ID NO: 43475 - DNA, 20 bp, human
gtccatctgaagaggtcgcc

SEQ ID NO: 43476 - DNA, 20 bp, human
gcgcccagggagccacgtct

SEQ ID NO: 43477 - DNA, 20 bp, human
ggagcggccgatccgagacg

SEQ ID NO: 43478 - DNA, 20 bp, human
gctgggcggcagaaccatgt

SEQ ID NO: 43479 - DNA, 20 bp, human
gagggagccacgtctcggat

SEQ ID NO: 43480 - DNA, 20 bp, human
gaacgccagcaagaaggtaa

SEQ ID NO: 43481 - DNA, 20 bp, human
gcaccccgcgccactctcca

SEQ ID NO: 43482 - DNA, 20 bp, human
ggacggcgctcaccggatag

SEQ ID NO: 43483 - DNA, 20 bp, human
gcccgcgccactctccaagg

SEQ ID NO: 43484 - DNA, 20 bp, human
gtgagagccgccttggagag

SEQ ID NO: 43485 - DNA, 20 bp, human
gaggtgagaccggcctgcgg

SEQ ID NO: 43486 - DNA, 20 bp, human
ggtgggagggtacctgaagg

SEQ ID NO: 43487 - DNA, 20 bp, human
gtcggtgggagggtacctga

SEQ ID NO: 43488 - DNA, 20 bp, human
gtacctgaaggtggggtcaa

SEQ ID NO: 43489 - DNA, 20 bp, human
gggccactctgtgggcgggt

SEQ ID NO: 43490 - DNA, 20 bp, human
gctgtgggcgggtcggtggg

SEQ ID NO: 43491 - DNA, 20 bp, human
gggcgggcgccagccagcag

SEQ ID NO: 43492 - DNA, 20 bp, human
gccgcctgctgtggaactgg

SEQ ID NO: 43493 - DNA, 20 bp, human
gtggccctcaccataggagg

SEQ ID NO: 43494 - DNA, 20 bp, human
ggaagccatggtcaaaaagt

SEQ ID NO: 43495 - DNA, 20 bp, human
gtcgctctggccctcaccat

SEQ ID NO: 43496 - DNA, 20 bp, human
ggagccacggggaggtgtca

SEQ ID NO: 43497 - DNA, 20 bp, human
gccgagactggtgacatcta

SEQ ID NO: 43498 - DNA, 20 bp, human
gtccgcaaggctgacctcta

SEQ ID NO: 43499 - DNA, 20 bp, human
gcaggaaggcggcaagcgag

SEQ ID NO: 43500 - DNA, 20 bp, human
ggaggtgctagtgggagtcg

SEQ ID NO: 43501 - DNA, 20 bp, human
ggtccctgggcataggaaca

SEQ ID NO: 43502 - DNA, 20 bp, human
ggagcggggtgaggcgggac

SEQ ID NO: 43503 - DNA, 20 bp, human
gccctgcggccagtgcaagg

SEQ ID NO: 43504 - DNA, 20 bp, human
gcctccttgacacctccccg

SEQ ID NO: 43505 - DNA, 20 bp, human
gaaggctgacctctagggtc

SEQ ID NO: 43506 - DNA, 20 bp, human
gcaggtggcgcgggaggtcg

SEQ ID NO: 43507 - DNA, 20 bp, human
gacgaaggtgcagagcgcac

SEQ ID NO: 43508 - DNA, 20 bp, human
gagcagcagcggcagcacga

SEQ ID NO: 43509 - DNA, 20 bp, human
ggcaatagcatgcctcccgg

SEQ ID NO: 43510 - DNA, 20 bp, human
gtggtactgcaggtaaggga

SEQ ID NO: 43511 - DNA, 20 bp, human
ggaggtcgcggcgcgccatg

SEQ ID NO: 43512 - DNA, 20 bp, human
gagatgaagcgcaggaaata

SEQ ID NO: 43513 - DNA, 20 bp, human
ggccagcgcttcaaacccca

SEQ ID NO: 43514 - DNA, 20 bp, human
ggaacttcctccgctgtggg

SEQ ID NO: 43515 - DNA, 20 bp, human
gcattgccccccgggactat

SEQ ID NO: 43516 - DNA, 20 bp, human
gccacctcgtgagcaccgag

SEQ ID NO: 43517 - DNA, 20 bp, human
gacgtgcgcaagatcctcat

SEQ ID NO: 43518 - DNA, 20 bp, human
gcagagctggaaaaagaagg

SEQ ID NO: 43519 - DNA, 20 bp, human
gtgtggagcaaggcaaggac

SEQ ID NO: 43520 - DNA, 20 bp, human
gttgcggtggatgtcgccaa

SEQ ID NO: 43521 - DNA, 20 bp, human
gcgggtgctgcgaggccact

SEQ ID NO: 43522 - DNA, 20 bp, human
gtcatgggcacccccaacgg

SEQ ID NO: 43523 - DNA, 20 bp, human
gacacggtgtccaattccat

SEQ ID NO: 43524 - DNA, 20 bp, human
gaagcatggtgtgcaaaggg

SEQ ID NO: 43525 - DNA, 20 bp, human
gggaattggacaccgtgttg

SEQ ID NO: 43526 - DNA, 20 bp, human
gtgccacagctgctgcgaca

SEQ ID NO: 43527 - DNA, 20 bp, human
gcccgcggcgcaggttcagg

SEQ ID NO: 43528 - DNA, 20 bp, human
gacccaggcaagtccatctt

SEQ ID NO: 43529 - DNA, 20 bp, human
gacggccagcagcagcgtca

SEQ ID NO: 43530 - DNA, 20 bp, human
gcagcagcgtcacggacacc

SEQ ID NO: 43531 - DNA, 20 bp, human
gcagctcttgtcgcgagtgg

SEQ ID NO: 43532 - DNA, 20 bp, human
gggggttcccggacctgagg

SEQ ID NO: 43533 - DNA, 20 bp, human
gccatccccaagggatccat

SEQ ID NO: 43534 - DNA, 20 bp, human
gtgggagccccctcaggtcc

SEQ ID NO: 43535 - DNA, 20 bp, human
gccatcttgggagccccctc

SEQ ID NO: 43536 - DNA, 20 bp, human
gctcaggctggagcgcgtcg

SEQ ID NO: 43537 - DNA, 20 bp, human
gcactgaagggaacgtccag

SEQ ID NO: 43538 - DNA, 20 bp, human
gatgcgcgcggccatgcgga

SEQ ID NO: 43539 - DNA, 20 bp, human
gccagagtttggggtctcgg

SEQ ID NO: 43540 - DNA, 20 bp, human
gtcgcggcaggcgcgtccca

SEQ ID NO: 43541 - DNA, 20 bp, human
gcacgcgcgccaggacctgt

SEQ ID NO: 43542 - DNA, 20 bp, human
ggtcggactccttcccacag

SEQ ID NO: 43543 - DNA, 20 bp, human
gaggcgtcctgccagtcggt

SEQ ID NO: 43544 - DNA, 20 bp, human
gccttgcgtaggccactgaa

SEQ ID NO: 43545 - DNA, 20 bp, human
gctgccgccgttcccagcag

SEQ ID NO: 43546 - DNA, 20 bp, human
gggcgcgcgagcacaaccca

SEQ ID NO: 43547 - DNA, 20 bp, human
ggactcagcactcgacccaa

SEQ ID NO: 43548 - DNA, 20 bp, human
gcttggctctggccccgtgg

SEQ ID NO: 43549 - DNA, 20 bp, human
gagtgggcaccggaacagag

SEQ ID NO: 43550 - DNA, 20 bp, human
ggctagaggtgagaagacgt

SEQ ID NO: 43551 - DNA, 20 bp, human
gagcgcagctgtcctagacg

SEQ ID NO: 43552 - DNA, 20 bp, human
ggcgaccctcgcgtcctgga

SEQ ID NO: 43553 - DNA, 20 bp, human
gctcgcgtcctggagggaac

SEQ ID NO: 43554 - DNA, 20 bp, human
gtagaggagattccacgtct

SEQ ID NO: 43555 - DNA, 20 bp, human
gagataaacaggacgaggaa

SEQ ID NO: 43556 - DNA, 20 bp, human
gacgcgatggaacactctgg

SEQ ID NO: 43557 - DNA, 20 bp, human
gcggacgcgatggaacactc

SEQ ID NO: 43558 - DNA, 20 bp, human
gctagggaggcgcccaactc

SEQ ID NO: 43559 - DNA, 20 bp, human
ggggcggtgtggctacactc

SEQ ID NO: 43560 - DNA, 20 bp, human
ggagggtctgggtcatggtc

SEQ ID NO: 43561 - DNA, 20 bp, human
gctctgctaagagtcgggac

SEQ ID NO: 43562 - DNA, 20 bp, human
ggcgccctctgctaagagtc

SEQ ID NO: 43563 - DNA, 20 bp, human
gactctggaggcgtacttga

SEQ ID NO: 43564 - DNA, 20 bp, human
gggctacacgagctgcaggt

SEQ ID NO: 43565 - DNA, 20 bp, human
gtactctcggtagcctaggg

SEQ ID NO: 43566 - DNA, 20 bp, human
gccaggagcccaccccgctc

SEQ ID NO: 43567 - DNA, 20 bp, human
gccatggcgctcgtctgcat

SEQ ID NO: 43568 - DNA, 20 bp, human
gtggcgcggatcctgagagc

SEQ ID NO: 43569 - DNA, 20 bp, human
gaggaccctcgccaacctgg

SEQ ID NO: 43570 - DNA, 20 bp, human
ggagcctcgccgccatgccg

SEQ ID NO: 43571 - DNA, 20 bp, human
gccgggctggctccctcccg

SEQ ID NO: 43572 - DNA, 20 bp, human
gctcaggatccgcgccagca

SEQ ID NO: 43573 - DNA, 20 bp, human
ggggcgcgggccgaggacaa

SEQ ID NO: 43574 - DNA, 20 bp, human
gtagcgcgcgccgccccggg

SEQ ID NO: 43575 - DNA, 20 bp, human
gcgcggggttggggagtccc

SEQ ID NO: 43576 - DNA, 20 bp, human
ggggtcctagcaggaaagac

SEQ ID NO: 43577 - DNA, 20 bp, human
gtacatgatatctcagtgct

SEQ ID NO: 43578 - DNA, 20 bp, human
gactgggatgcttcgccccc

SEQ ID NO: 43579 - DNA, 20 bp, human
gtcagcatcagggtcctagc

SEQ ID NO: 43580 - DNA, 20 bp, human
ggcgctcactgatctgttgg

SEQ ID NO: 43581 - DNA, 20 bp, human
ggatgtcagtctggcggcag

SEQ ID NO: 43582 - DNA, 20 bp, human
ggtcttaggaaagggagtct

SEQ ID NO: 43583 - DNA, 20 bp, human
gatagcgctcactgatctgt

SEQ ID NO: 43584 - DNA, 20 bp, human
ggatgatagatggtgatggc

SEQ ID NO: 43585 - DNA, 20 bp, human
gcatgaaggtgtcctaaggc

SEQ ID NO: 43586 - DNA, 20 bp, human
gctggtctgcctgactgtaa

SEQ ID NO: 43587 - DNA, 20 bp, human
gatcagaaagacaggatctt

SEQ ID NO: 43588 - DNA, 20 bp, human
ggcaccgagatgtcatgtgc

SEQ ID NO: 43589 - DNA, 20 bp, human
gaatggtcttgatgtctgtt

SEQ ID NO: 43590 - DNA, 20 bp, human
ggctgggatgcttcgcaccc

SEQ ID NO: 43591 - DNA, 20 bp, human
ggtttcagcatcagaaagac

SEQ ID NO: 43592 - DNA, 20 bp, human
gtgatctgatggaggtgggt

SEQ ID NO: 43593 - DNA, 20 bp, human
gatcccagcacatgacatct

SEQ ID NO: 43594 - DNA, 20 bp, human
ggctggggctttgtggcagg

SEQ ID NO: 43595 - DNA, 20 bp, human
gtcactgatctgatggaggt

SEQ ID NO: 43596 - DNA, 20 bp, human
ggctgggccccattcagagt

SEQ ID NO: 43597 - DNA, 20 bp, human
gcaccgagatgtcaagtact

SEQ ID NO: 43598 - DNA, 20 bp, human
gtgaactgatggaggcgagt

SEQ ID NO: 43599 - DNA, 20 bp, human
gaagatgggtggcacagggt

SEQ ID NO: 43600 - DNA, 20 bp, human
ggtggtagtgagatgacaga

SEQ ID NO: 43601 - DNA, 20 bp, human
gcaggaagatgggtggcaca

SEQ ID NO: 43602 - DNA, 20 bp, human
gggtcctagccaggaaagac

SEQ ID NO: 43603 - DNA, 20 bp, human
gtgagatgacagatggtgat

SEQ ID NO: 43604 - DNA, 20 bp, human
gatcccagtacttgacatct

SEQ ID NO: 43605 - DNA, 20 bp, human
gcagcatccgggtcctagcc

SEQ ID NO: 43606 - DNA, 20 bp, human
gggtgcagggcagtcagacc

SEQ ID NO: 43607 - DNA, 20 bp, human
gatggtcaagtggtatttac

SEQ ID NO: 43608 - DNA, 20 bp, human
gcctggtgggaggcggtcat

SEQ ID NO: 43609 - DNA, 20 bp, human
ggaggcggtcatgggtgtta

SEQ ID NO: 43610 - DNA, 20 bp, human
ggaagcttccccaagtacca

SEQ ID NO: 43611 - DNA, 20 bp, human
gacgctgagttccatggtcc

SEQ ID NO: 43612 - DNA, 20 bp, human
gacacggcagtatggtcaag

SEQ ID NO: 43613 - DNA, 20 bp, human
gccctgctgcagcctccaac

SEQ ID NO: 43614 - DNA, 20 bp, human
gcttcttgccttggtacttg

SEQ ID NO: 43615 - DNA, 20 bp, human
gggtgagctgcttcttgcct

SEQ ID NO: 43616 - DNA, 20 bp, human
gaatcacaggtggattagta

SEQ ID NO: 43617 - DNA, 20 bp, human
ggaagagggaggctcccgtc

SEQ ID NO: 43618 - DNA, 20 bp, human
gccaataatcgggagaggag

SEQ ID NO: 43619 - DNA, 20 bp, human
gttcttagtaagacaactgc

SEQ ID NO: 43620 - DNA, 20 bp, human
gtatttccaataatcgggag

SEQ ID NO: 43621 - DNA, 20 bp, human
gaatacaccttgtacattac

SEQ ID NO: 43622 - DNA, 20 bp, human
gtaaaactttaagaattgtg

SEQ ID NO: 43623 - DNA, 20 bp, human
gccacagctggatccattga

SEQ ID NO: 43624 - DNA, 20 bp, human
gacaccttgtacattactgg

SEQ ID NO: 43625 - DNA, 20 bp, human
ggtttctcctttcactctgg

SEQ ID NO: 43626 - DNA, 20 bp, human
gtggctgagggtaaacagta

SEQ ID NO: 43627 - DNA, 20 bp, human
gaatggctatgaaataaaga

SEQ ID NO: 43628 - DNA, 20 bp, human
gttgtaacattgtacctcta

SEQ ID NO: 43629 - DNA, 20 bp, human
gagccatttgctagaatttt

SEQ ID NO: 43630 - DNA, 20 bp, human
gagagcacaaggaccacaaa

SEQ ID NO: 43631 - DNA, 20 bp, human
gttgtcttaacaagaggaga

SEQ ID NO: 43632 - DNA, 20 bp, human
gtcacggttgtcttaacaag

SEQ ID NO: 43633 - DNA, 20 bp, human
gaatcactgggagaggagta

SEQ ID NO: 43634 - DNA, 20 bp, human
gttgctagaatttttggctg

SEQ ID NO: 43635 - DNA, 20 bp, human
ggctctgtctccagattgaa

SEQ ID NO: 43636 - DNA, 20 bp, human
gaattggctggaggaacata

SEQ ID NO: 43637 - DNA, 20 bp, human
ggagacagagctgtaggaga

SEQ ID NO: 43638 - DNA, 20 bp, human
gaacatcaaagaagttcaga

SEQ ID NO: 43639 - DNA, 20 bp, human
gaaaagagagacacagcacc

SEQ ID NO: 43640 - DNA, 20 bp, human
gatgctacagatagatgtta

SEQ ID NO: 43641 - DNA, 20 bp, human
gaccctttgcaattggctgg

SEQ ID NO: 43642 - DNA, 20 bp, human
gcttaccctttgcaattggc

SEQ ID NO: 43643 - DNA, 20 bp, human
gtcctccagccaattgcaaa

SEQ ID NO: 43644 - DNA, 20 bp, human
gattataatagtgtgcttcc

SEQ ID NO: 43645 - DNA, 20 bp, human
ggggagtgttataaaaactt

SEQ ID NO: 43646 - DNA, 20 bp, human
gtggctgaaggtaaatggta

SEQ ID NO: 43647 - DNA, 20 bp, human
gcttgtaacatgtacctcta

SEQ ID NO: 43648 - DNA, 20 bp, human
gtacatgttacaagaggtaa

SEQ ID NO: 43649 - DNA, 20 bp, human
ggcttcaatggattctcttg

SEQ ID NO: 43650 - DNA, 20 bp, human
gtctctactcacaaaataca

SEQ ID NO: 43651 - DNA, 20 bp, human
gaaccatttgctataatttt

SEQ ID NO: 43652 - DNA, 20 bp, human
gttgtgagtagagaaagatt

SEQ ID NO: 43653 - DNA, 20 bp, human
gaatggttatgaaatgaaga

SEQ ID NO: 43654 - DNA, 20 bp, human
gttggaaatatcctacagat

SEQ ID NO: 43655 - DNA, 20 bp, human
gatttttggctgaaggtaaa

SEQ ID NO: 43656 - DNA, 20 bp, human
gacctgcctcactaccaaat

SEQ ID NO: 43657 - DNA, 20 bp, human
ggcccatttggtagtgaggc

SEQ ID NO: 43658 - DNA, 20 bp, human
gtgtataaatgcccttctcc

SEQ ID NO: 43659 - DNA, 20 bp, human
gtggtagtgaggcaggtatg

SEQ ID NO: 43660 - DNA, 20 bp, human
gtgggggacttcctggagaa

SEQ ID NO: 43661 - DNA, 20 bp, human
gtggccactatcacggccag

SEQ ID NO: 43662 - DNA, 20 bp, human
ggtgcccctggccgtgatag

SEQ ID NO: 43663 - DNA, 20 bp, human
gtgcagcccagcgttggcgc

SEQ ID NO: 43664 - DNA, 20 bp, human
ggggctgcacgctacccacc

SEQ ID NO: 43665 - DNA, 20 bp, human
gaggaagatggccactatca

SEQ ID NO: 43666 - DNA, 20 bp, human
gagggccacggtgactccga

SEQ ID NO: 43667 - DNA, 20 bp, human
gcctgctggtgtccatgtgg

SEQ ID NO: 43668 - DNA, 20 bp, human
gctgcgacgccaggataacc

SEQ ID NO: 43669 - DNA, 20 bp, human
gtctgccctcggagtcaccg

SEQ ID NO: 43670 - DNA, 20 bp, human
gcaggacaaggcaccggcgg

SEQ ID NO: 43671 - DNA, 20 bp, human
gagcccgggagacaatcctg

SEQ ID NO: 43672 - DNA, 20 bp, human
ggcggcaccatgtctgccct

SEQ ID NO: 43673 - DNA, 20 bp, human
gttccacaggattgtctccc

SEQ ID NO: 43674 - DNA, 20 bp, human
ggccgccagcccggttatcc

SEQ ID NO: 43675 - DNA, 20 bp, human
ggaaggccgcccacaccagc

SEQ ID NO: 43676 - DNA, 20 bp, human
gtaaagggccccggtgaggg

SEQ ID NO: 43677 - DNA, 20 bp, human
gaggtaaagggccccggtga

SEQ ID NO: 43678 - DNA, 20 bp, human
gtggtgcttcaccaagtagg

SEQ ID NO: 43679 - DNA, 20 bp, human
gtactggtgcttcaccaagt

SEQ ID NO: 43680 - DNA, 20 bp, human
gtgcaatgcaaccccatggt

SEQ ID NO: 43681 - DNA, 20 bp, human
gagctctgggtgtgcttggg

SEQ ID NO: 43682 - DNA, 20 bp, human
gcagtctcagagacagagat

SEQ ID NO: 43683 - DNA, 20 bp, human
gatcaagtgttgccaaccat

SEQ ID NO: 43684 - DNA, 20 bp, human
gtctctgcaatgcaacccca

SEQ ID NO: 43685 - DNA, 20 bp, human
gagggggtgtctcccaagag

SEQ ID NO: 43686 - DNA, 20 bp, human
gtgcccagtaggagagtccg

SEQ ID NO: 43687 - DNA, 20 bp, human
gaggttcagctggtaggagt

SEQ ID NO: 43688 - DNA, 20 bp, human
gctgggcagtggtccatcct

SEQ ID NO: 43689 - DNA, 20 bp, human
ggacgtctgagccatgctcg

SEQ ID NO: 43690 - DNA, 20 bp, human
gacctggaggttcagctggt

SEQ ID NO: 43691 - DNA, 20 bp, human
gaggacaatcatataaaaga

SEQ ID NO: 43692 - DNA, 20 bp, human
ggtgctgcagaacagagtta

SEQ ID NO: 43693 - DNA, 20 bp, human
gattccacctgcactttcta

SEQ ID NO: 43694 - DNA, 20 bp, human
ggtggaatcatgccagttaa

SEQ ID NO: 43695 - DNA, 20 bp, human
ggagcccatcgccgcgagca

SEQ ID NO: 43696 - DNA, 20 bp, human
ggcaagacgcccgcacctga

SEQ ID NO: 43697 - DNA, 20 bp, human
gtcccctccgcagaatgagg

SEQ ID NO: 43698 - DNA, 20 bp, human
gcaccctggacctgaagtgg

SEQ ID NO: 43699 - DNA, 20 bp, human
gaccaagttggcagtgacag

SEQ ID NO: 43700 - DNA, 20 bp, human
gagagctgaagagggcgcgg

SEQ ID NO: 43701 - DNA, 20 bp, human
gagcgaagtaccgacctcac

SEQ ID NO: 43702 - DNA, 20 bp, human
gcgccgccacttcaggtcca

SEQ ID NO: 43703 - DNA, 20 bp, human
gcataaccagccggtgaggt

SEQ ID NO: 43704 - DNA, 20 bp, human
gtgagggcatgcgtccaccc

SEQ ID NO: 43705 - DNA, 20 bp, human
ggtccaccctggacctgaag

SEQ ID NO: 43706 - DNA, 20 bp, human
gagccgacctgccgagatgg

SEQ ID NO: 43707 - DNA, 20 bp, human
ggtgccggtcgcctccatct

SEQ ID NO: 43708 - DNA, 20 bp, human
gcccgggagagaggatcgtg

SEQ ID NO: 43709 - DNA, 20 bp, human
gctgccgagatggaggcgac

SEQ ID NO: 43710 - DNA, 20 bp, human
gccagccgcgcggagcgcct

SEQ ID NO: 43711 - DNA, 20 bp, human
gatggaggcgaccggcacct

SEQ ID NO: 43712 - DNA, 20 bp, human
gcgcgcggagcgcctgggag

SEQ ID NO: 43713 - DNA, 20 bp, human
ggcgcggctgggctagttag

SEQ ID NO: 43714 - DNA, 20 bp, human
gaggagccgacctgccgaga

SEQ ID NO: 43715 - DNA, 20 bp, human
gcccaggattctgtaggcag

SEQ ID NO: 43716 - DNA, 20 bp, human
gctgcgtgcgcgtctcctcc

SEQ ID NO: 43717 - DNA, 20 bp, human
gtccgccgccggaggaaggg

SEQ ID NO: 43718 - DNA, 20 bp, human
gaggcagcaaggggaacccg

SEQ ID NO: 43719 - DNA, 20 bp, human
ggtctcctccaggcagcaag

SEQ ID NO: 43720 - DNA, 20 bp, human
ggcacctggagactcatccg

SEQ ID NO: 43721 - DNA, 20 bp, human
gcctgcgggcctatgaccga

SEQ ID NO: 43722 - DNA, 20 bp, human
gcccggagacgacatggtcc

SEQ ID NO: 43723 - DNA, 20 bp, human
ggacggccccggagacgaca

SEQ ID NO: 43724 - DNA, 20 bp, human
gctcacctagcccgcgtgta

SEQ ID NO: 43725 - DNA, 20 bp, human
ggaccgaagttgcccaccag

SEQ ID NO: 43726 - DNA, 20 bp, human
ggaggtaagtcagggagccc

SEQ ID NO: 43727 - DNA, 20 bp, human
gcaggaccggtccctgatgg

SEQ ID NO: 43728 - DNA, 20 bp, human
gccctgatggaggtaagtca

SEQ ID NO: 43729 - DNA, 20 bp, human
ggacacggcagctgtccaag

SEQ ID NO: 43730 - DNA, 20 bp, human
gcagcagggccatgaggacg

SEQ ID NO: 43731 - DNA, 20 bp, human
gagtgcaggttcccgacgag

SEQ ID NO: 43732 - DNA, 20 bp, human
gtgtcctggcccccctcctg

SEQ ID NO: 43733 - DNA, 20 bp, human
gtctgctgagagcccgcagg

SEQ ID NO: 43734 - DNA, 20 bp, human
gcaacaggaccggtccctga

SEQ ID NO: 43735 - DNA, 20 bp, human
ggaacacctgagggccgagg

SEQ ID NO: 43736 - DNA, 20 bp, human
gtgtgggctacggaacctgt

SEQ ID NO: 43737 - DNA, 20 bp, human
gtaagtgcagggctagaaca

SEQ ID NO: 43738 - DNA, 20 bp, human
gtgaaaactgggacagagga

SEQ ID NO: 43739 - DNA, 20 bp, human
gaaaggttgggagtcccgac

SEQ ID NO: 43740 - DNA, 20 bp, human
gaaggaagctacagttacga

SEQ ID NO: 43741 - DNA, 20 bp, human
gtgttgttaattgttagtag

SEQ ID NO: 43742 - DNA, 20 bp, human
ggtagacccccgtgcatcaa

SEQ ID NO: 43743 - DNA, 20 bp, human
gtatgtggtcgtggcagacg

SEQ ID NO: 43744 - DNA, 20 bp, human
gaggtgggagggagcgacaa

SEQ ID NO: 43745 - DNA, 20 bp, human
gtccagcccttgatgcacgg

SEQ ID NO: 43746 - DNA, 20 bp, human
gctttgctgggctatgtgca

SEQ ID NO: 43747 - DNA, 20 bp, human
gatggctctcatcccagact

SEQ ID NO: 43748 - DNA, 20 bp, human
gggtttccatggccaagtct

SEQ ID NO: 43749 - DNA, 20 bp, human
gctcatcccagacttggcca

SEQ ID NO: 43750 - DNA, 20 bp, human
ggcttctccaccttggaagt

SEQ ID NO: 43751 - DNA, 20 bp, human
gtctttgccaacttccaagg

SEQ ID NO: 43752 - DNA, 20 bp, human
gaagatcaaaaaagatgttc

SEQ ID NO: 43753 - DNA, 20 bp, human
gagctgaaaggaagactcag

SEQ ID NO: 43754 - DNA, 20 bp, human
gagagcaacacagagctgaa

SEQ ID NO: 43755 - DNA, 20 bp, human
ggcacaggtggccctgctac

SEQ ID NO: 43756 - DNA, 20 bp, human
ggataaaagagataacggag

SEQ ID NO: 43757 - DNA, 20 bp, human
gatatagaggagtaccaggc

SEQ ID NO: 43758 - DNA, 20 bp, human
gtcacatatagaggagtacc

SEQ ID NO: 43759 - DNA, 20 bp, human
gtgggcccaattagcacttc

SEQ ID NO: 43760 - DNA, 20 bp, human
gcatagttactcacatatag

SEQ ID NO: 43761 - DNA, 20 bp, human
gatggaaacatgggttcttg

SEQ ID NO: 43762 - DNA, 20 bp, human
gtaagacctgaagtgctaat

SEQ ID NO: 43763 - DNA, 20 bp, human
gtgaaaaagaaaactggtga

SEQ ID NO: 43764 - DNA, 20 bp, human
gtttatgtgttcacagtatt

SEQ ID NO: 43765 - DNA, 20 bp, human
gaaactttgccatggaaaca

SEQ ID NO: 43766 - DNA, 20 bp, human
gacagcagcactcagctaaa

SEQ ID NO: 43767 - DNA, 20 bp, human
gatcaatgaaaacatggcag

SEQ ID NO: 43768 - DNA, 20 bp, human
gagactaatcaatgaaaaca

SEQ ID NO: 43769 - DNA, 20 bp, human
gccaaaattagaaggtggat

SEQ ID NO: 43770 - DNA, 20 bp, human
gcataaatctttcagcagct

SEQ ID NO: 43771 - DNA, 20 bp, human
gggctgaagactgctgtgca

SEQ ID NO: 43772 - DNA, 20 bp, human
gaagactgctgtgcagggca

SEQ ID NO: 43773 - DNA, 20 bp, human
gtagggacagcatttggtag

SEQ ID NO: 43774 - DNA, 20 bp, human
gggagaagtagctgaagtgt

SEQ ID NO: 43775 - DNA, 20 bp, human
gagtcaccaaaattagaagg

SEQ ID NO: 43776 - DNA, 20 bp, human
gtgctgaaaaaaagactcag

SEQ ID NO: 43777 - DNA, 20 bp, human
gtcacagatagaggagtatc

SEQ ID NO: 43778 - DNA, 20 bp, human
gaggatgttcaggctggccg

SEQ ID NO: 43779 - DNA, 20 bp, human
gatggatctcatcccaaact

SEQ ID NO: 43780 - DNA, 20 bp, human
gctcatcccaaacttggccg

SEQ ID NO: 43781 - DNA, 20 bp, human
gaatagcaaaaaggatgttc

SEQ ID NO: 43782 - DNA, 20 bp, human
gtctgttttgaatagcaaaa

SEQ ID NO: 43783 - DNA, 20 bp, human
ggactcagaggagagagata

SEQ ID NO: 43784 - DNA, 20 bp, human
gtgagcaggtggactgcctg

SEQ ID NO: 43785 - DNA, 20 bp, human
gatgttcaggctggccgtgg

SEQ ID NO: 43786 - DNA, 20 bp, human
gtgctgaaaaaaagactcag

SEQ ID NO: 43787 - DNA, 20 bp, human
gtcacagatagaggagtatc

SEQ ID NO: 43788 - DNA, 20 bp, human
gaggatgttcaggctggccg

SEQ ID NO: 43789 - DNA, 20 bp, human
gatggatctcatcccaaact

SEQ ID NO: 43790 - DNA, 20 bp, human
gctcatcccaaacttggccg

SEQ ID NO: 43791 - DNA, 20 bp, human
gaatagcaaaaaggatgttc

SEQ ID NO: 43792 - DNA, 20 bp, human
gtctgttttgaatagcaaaa

SEQ ID NO: 43793 - DNA, 20 bp, human
ggactcagaggagagagata

SEQ ID NO: 43794 - DNA, 20 bp, human
gtgagcaggtggactgcctg

SEQ ID NO: 43795 - DNA, 20 bp, human
gatgttcaggctggccgtgg

SEQ ID NO: 43796 - DNA, 20 bp, human
ggagtcggcggccccgagag

SEQ ID NO: 43797 - DNA, 20 bp, human
gctgggccccacaaacgtga

SEQ ID NO: 43798 - DNA, 20 bp, human
gcggggccgccgactcccag

SEQ ID NO: 43799 - DNA, 20 bp, human
gaggagactgaggcgctcag

SEQ ID NO: 43800 - DNA, 20 bp, human
gcccggggatgtgctcgtag

SEQ ID NO: 43801 - DNA, 20 bp, human
gcgcggccgctgggagtcgg

SEQ ID NO: 43802 - DNA, 20 bp, human
ggggcccagctgtgcgcggt

SEQ ID NO: 43803 - DNA, 20 bp, human
gctgcgagcgcggtgcacga

SEQ ID NO: 43804 - DNA, 20 bp, human
gggctcatggctccggggca

SEQ ID NO: 43805 - DNA, 20 bp, human
gccggaggcggagacgtggt

SEQ ID NO: 43806 - DNA, 20 bp, human
ggactcctgggtgatgtctc

SEQ ID NO: 43807 - DNA, 20 bp, human
gtggcagtcctgcatgtgga

SEQ ID NO: 43808 - DNA, 20 bp, human
ggtcttggcagtcctgcatg

SEQ ID NO: 43809 - DNA, 20 bp, human
gagttcagctctacctgcac

SEQ ID NO: 43810 - DNA, 20 bp, human
gatttgagcacagggggacg

SEQ ID NO: 43811 - DNA, 20 bp, human
gaatgagcagggaggccgct

SEQ ID NO: 43812 - DNA, 20 bp, human
gtatctgcagaaggagggca

SEQ ID NO: 43813 - DNA, 20 bp, human
gaacaaatgtgaggactcaa

SEQ ID NO: 43814 - DNA, 20 bp, human
gtgggagggcaaagagggat

SEQ ID NO: 43815 - DNA, 20 bp, human
ggtctctggaatcctccaag

SEQ ID NO: 43816 - DNA, 20 bp, human
gaagcacaggtggacagggg

SEQ ID NO: 43817 - DNA, 20 bp, human
ggccccagcagacgcctggg

SEQ ID NO: 43818 - DNA, 20 bp, human
gaacaaacgtgaggcctcat

SEQ ID NO: 43819 - DNA, 20 bp, human
gtaggctgggtgttcctatg

SEQ ID NO: 43820 - DNA, 20 bp, human
gacttaagcacaggtggaca

SEQ ID NO: 43821 - DNA, 20 bp, human
gggcattgccctccatgtgc

SEQ ID NO: 43822 - DNA, 20 bp, human
ggacgcctgggtggtgtctc

SEQ ID NO: 43823 - DNA, 20 bp, human
ggtcttggcagtcctgcaca

SEQ ID NO: 43824 - DNA, 20 bp, human
gacaccacccaggcgtctgc

SEQ ID NO: 43825 - DNA, 20 bp, human
gttggcagtcctgcacatgg

SEQ ID NO: 43826 - DNA, 20 bp, human
ggcccaaggaggagaagctc

SEQ ID NO: 43827 - DNA, 20 bp, human
gccagaagcccacaggccca

SEQ ID NO: 43828 - DNA, 20 bp, human
gctgaaggcaggtcagatga

SEQ ID NO: 43829 - DNA, 20 bp, human
ggatcagcccagaagcccac

SEQ ID NO: 43830 - DNA, 20 bp, human
ggtggctggaactgcaacca

SEQ ID NO: 43831 - DNA, 20 bp, human
gccaagtcagggctcaagca

SEQ ID NO: 43832 - DNA, 20 bp, human
gcgacctccacatacctcga

SEQ ID NO: 43833 - DNA, 20 bp, human
gaggtatgtggaggtcggga

SEQ ID NO: 43834 - DNA, 20 bp, human
gatgccctcgaggtatgtgg

SEQ ID NO: 43835 - DNA, 20 bp, human
gcagatgaaggctaggtggc

SEQ ID NO: 43836 - DNA, 20 bp, human
gggcctgtgtactaagtctg

SEQ ID NO: 43837 - DNA, 20 bp, human
gcaggtcaagcagggacccg

SEQ ID NO: 43838 - DNA, 20 bp, human
gagcctcctctaggaacccc

SEQ ID NO: 43839 - DNA, 20 bp, human
gggaggctcatttatgagta

SEQ ID NO: 43840 - DNA, 20 bp, human
gctcagtggagagacaaggg

SEQ ID NO: 43841 - DNA, 20 bp, human
gagggcctaaggaaatggtg

SEQ ID NO: 43842 - DNA, 20 bp, human
gctcagggcatgatatgggg

SEQ ID NO: 43843 - DNA, 20 bp, human
gaaataggtagtgctggcca

SEQ ID NO: 43844 - DNA, 20 bp, human
ggctgctcagtggagagaca

SEQ ID NO: 43845 - DNA, 20 bp, human
gagcaccacgggtctgaggt

SEQ ID NO: 43846 - DNA, 20 bp, human
gacagccttccggaaatcag

SEQ ID NO: 43847 - DNA, 20 bp, human
gggcaaagacctcctagcag

SEQ ID NO: 43848 - DNA, 20 bp, human
gcctctccccctctgctagg

SEQ ID NO: 43849 - DNA, 20 bp, human
gctccaaggacagtggaaag

SEQ ID NO: 43850 - DNA, 20 bp, human
ggggacaagctgcttctgat

SEQ ID NO: 43851 - DNA, 20 bp, human
gcttctgataggagccaggc

SEQ ID NO: 43852 - DNA, 20 bp, human
gctggcccctgatttccgga

SEQ ID NO: 43853 - DNA, 20 bp, human
gcggaaggctgtgggaggcg

SEQ ID NO: 43854 - DNA, 20 bp, human
ggggcaaggatgggcagtgc

SEQ ID NO: 43855 - DNA, 20 bp, human
gactgtccttggagcttcct

SEQ ID NO: 43856 - DNA, 20 bp, human
gccagcctggtaccttctgt

SEQ ID NO: 43857 - DNA, 20 bp, human
gggccctggcccctgatcta

SEQ ID NO: 43858 - DNA, 20 bp, human
ggatgcagggtgaggacctg

SEQ ID NO: 43859 - DNA, 20 bp, human
gctccggggacagtgtatag

SEQ ID NO: 43860 - DNA, 20 bp, human
gtgggaaacactggagccgg

SEQ ID NO: 43861 - DNA, 20 bp, human
gcgaagtcaggaactgctgg

SEQ ID NO: 43862 - DNA, 20 bp, human
gctcaggggtgagtaaacga

SEQ ID NO: 43863 - DNA, 20 bp, human
gaccggtggcaacgtcccca

SEQ ID NO: 43864 - DNA, 20 bp, human
ggtccccggagctcttccct

SEQ ID NO: 43865 - DNA, 20 bp, human
gcttccagaggagcaggaat

SEQ ID NO: 43866 - DNA, 20 bp, human
ggccggaggtagagcaggga

SEQ ID NO: 43867 - DNA, 20 bp, human
gcagtgccggaggtagagca

SEQ ID NO: 43868 - DNA, 20 bp, human
ggtgcttactagggaactgg

SEQ ID NO: 43869 - DNA, 20 bp, human
gctcagggatgggtaaaaag

SEQ ID NO: 43870 - DNA, 20 bp, human
gaggcccagagaacggccca

SEQ ID NO: 43871 - DNA, 20 bp, human
gcaaggcccacgcagctcct

SEQ ID NO: 43872 - DNA, 20 bp, human
gcagcacccaggagctgcgt

SEQ ID NO: 43873 - DNA, 20 bp, human
gaggtccctgggccgttctc

SEQ ID NO: 43874 - DNA, 20 bp, human
gccattctaagtgcttacta

SEQ ID NO: 43875 - DNA, 20 bp, human
gtaagtgcttactagggaac

SEQ ID NO: 43876 - DNA, 20 bp, human
ggcggtcagatcccaggtag

SEQ ID NO: 43877 - DNA, 20 bp, human
ggccggtggatccggatcga

SEQ ID NO: 43878 - DNA, 20 bp, human
ggacggcgcggtcagatccc

SEQ ID NO: 43879 - DNA, 20 bp, human
ggccctcgatccggatccac

SEQ ID NO: 43880 - DNA, 20 bp, human
ggtagtggcgccggtggatc

SEQ ID NO: 43881 - DNA, 20 bp, human
gtccaccggcgccactacct

SEQ ID NO: 43882 - DNA, 20 bp, human
ggccccaaagaggcgtccca

SEQ ID NO: 43883 - DNA, 20 bp, human
ggatccggatcgagggcagg

SEQ ID NO: 43884 - DNA, 20 bp, human
gtagtcaggacatcccagat

SEQ ID NO: 43885 - DNA, 20 bp, human
ggtgagtgcgcgcgtggtga

SEQ ID NO: 43886 - DNA, 20 bp, human
gggtggtgagtgaggtcctg

SEQ ID NO: 43887 - DNA, 20 bp, human
gaacagggatggataaacag

SEQ ID NO: 43888 - DNA, 20 bp, human
gttcaacacaggccaagagt

SEQ ID NO: 43889 - DNA, 20 bp, human
gaggggtaagaatgaggctc

SEQ ID NO: 43890 - DNA, 20 bp, human
gccaaaggcccagcgaggac

SEQ ID NO: 43891 - DNA, 20 bp, human
gcagtaagagtaaacaggga

SEQ ID NO: 43892 - DNA, 20 bp, human
gtttcccgcaacccccgaaa

SEQ ID NO: 43893 - DNA, 20 bp, human
gagaaccaattccgtttcgg

SEQ ID NO: 43894 - DNA, 20 bp, human
gggatgctgccattggccaa

SEQ ID NO: 43895 - DNA, 20 bp, human
ggcaacccccgaaacggaat

SEQ ID NO: 43896 - DNA, 20 bp, human
gggaatgagtgagtgatcag

SEQ ID NO: 43897 - DNA, 20 bp, human
ggccaggagcaaaaacctcc

SEQ ID NO: 43898 - DNA, 20 bp, human
gcggcggccgttgtgataga

SEQ ID NO: 43899 - DNA, 20 bp, human
gctggagccatcccagtctt

SEQ ID NO: 43900 - DNA, 20 bp, human
ggagctccaggaccaatgat

SEQ ID NO: 43901 - DNA, 20 bp, human
gtggcagggctggataggga

SEQ ID NO: 43902 - DNA, 20 bp, human
gctagtgtctcagggtggaa

SEQ ID NO: 43903 - DNA, 20 bp, human
gagcaaaaacctcctggcaa

SEQ ID NO: 43904 - DNA, 20 bp, human
gggaggagaggaggttgtgc

SEQ ID NO: 43905 - DNA, 20 bp, human
gggggtggcagggctggata

SEQ ID NO: 43906 - DNA, 20 bp, human
gcccgcgcctacccactggt

SEQ ID NO: 43907 - DNA, 20 bp, human
ggcagcgcgtggcccaccag

SEQ ID NO: 43908 - DNA, 20 bp, human
gcccgggcggcggccagaga

SEQ ID NO: 43909 - DNA, 20 bp, human
gtgaggtgggaaaagaccga

SEQ ID NO: 43910 - DNA, 20 bp, human
ggtggcccgcgcctacccac

SEQ ID NO: 43911 - DNA, 20 bp, human
gtcctggctgatcggagggt

SEQ ID NO: 43912 - DNA, 20 bp, human
gggccagagagggcgccacg

SEQ ID NO: 43913 - DNA, 20 bp, human
gatgcggcccatccccacgg

SEQ ID NO: 43914 - DNA, 20 bp, human
gagccggacgggcgaggtaa

SEQ ID NO: 43915 - DNA, 20 bp, human
ggctgctgatgaagccggac

SEQ ID NO: 43916 - DNA, 20 bp, human
gagggcccagagaggcggtg

SEQ ID NO: 43917 - DNA, 20 bp, human
gtgcaagccggagggtcccc

SEQ ID NO: 43918 - DNA, 20 bp, human
gaccctacgccagctccggg

SEQ ID NO: 43919 - DNA, 20 bp, human
gtccatccctggggaccctc

SEQ ID NO: 43920 - DNA, 20 bp, human
ggcgaccctacgccagctcc

SEQ ID NO: 43921 - DNA, 20 bp, human
gaaaggccagtgcaagccgg

SEQ ID NO: 43922 - DNA, 20 bp, human
gcccgcccggagctggcgta

SEQ ID NO: 43923 - DNA, 20 bp, human
gcgagtcagaagcttcgcga

SEQ ID NO: 43924 - DNA, 20 bp, human
gccccacccactggttcctt

SEQ ID NO: 43925 - DNA, 20 bp, human
ggcaccagaaggtagatggg

SEQ ID NO: 43926 - DNA, 20 bp, human
gcttgtggccatagaaccag

SEQ ID NO: 43927 - DNA, 20 bp, human
gtattcagggaggggacata

SEQ ID NO: 43928 - DNA, 20 bp, human
gaattagttggggaggttaa

SEQ ID NO: 43929 - DNA, 20 bp, human
gtcaccctgcagacttaatt

SEQ ID NO: 43930 - DNA, 20 bp, human
gcaaaatgccatattcaggg

SEQ ID NO: 43931 - DNA, 20 bp, human
gtttcaaaatgccatattca

SEQ ID NO: 43932 - DNA, 20 bp, human
gagatgttggccagcagacc

SEQ ID NO: 43933 - DNA, 20 bp, human
ggtgaaaactgctgagatgt

SEQ ID NO: 43934 - DNA, 20 bp, human
ggtgcagcaaagctttcata

SEQ ID NO: 43935 - DNA, 20 bp, human
gtcttgttcttctagaatcc

SEQ ID NO: 43936 - DNA, 20 bp, human
gctgggtttagtaggagacc

SEQ ID NO: 43937 - DNA, 20 bp, human
gtggcagatggtcgtccaca

SEQ ID NO: 43938 - DNA, 20 bp, human
gccggctcagtggatggcaa

SEQ ID NO: 43939 - DNA, 20 bp, human
gcaccgctcctcccaatcga

SEQ ID NO: 43940 - DNA, 20 bp, human
gtggcgcgcgtgggacccga

SEQ ID NO: 43941 - DNA, 20 bp, human
gccccgaccggctcagtgga

SEQ ID NO: 43942 - DNA, 20 bp, human
ggtggccccgaccggctcag

SEQ ID NO: 43943 - DNA, 20 bp, human
gtttccgacggagtgaatgg

SEQ ID NO: 43944 - DNA, 20 bp, human
ggctcagtggatggcaaggg

SEQ ID NO: 43945 - DNA, 20 bp, human
gcgcagctgaggcggccgaa

SEQ ID NO: 43946 - DNA, 20 bp, human
gatctaggccaaaatctctg

SEQ ID NO: 43947 - DNA, 20 bp, human
ggaggaagcccagattagta

SEQ ID NO: 43948 - DNA, 20 bp, human
gagcaagtgggaatctacaa

SEQ ID NO: 43949 - DNA, 20 bp, human
gaaggatacaagtagcaagt

SEQ ID NO: 43950 - DNA, 20 bp, human
gaactgacagaaattgtata

SEQ ID NO: 43951 - DNA, 20 bp, human
gagcttgagtctcttttcag

SEQ ID NO: 43952 - DNA, 20 bp, human
gtagtattggcatataccga

SEQ ID NO: 43953 - DNA, 20 bp, human
gcttgtatccttactaatct

SEQ ID NO: 43954 - DNA, 20 bp, human
gatcccccaaatcaaagatg

SEQ ID NO: 43955 - DNA, 20 bp, human
gtattcttggaattaggaga

SEQ ID NO: 43956 - DNA, 20 bp, human
gctgcggcggcttctctcgg

SEQ ID NO: 43957 - DNA, 20 bp, human
gccctagtccagggccggag

SEQ ID NO: 43958 - DNA, 20 bp, human
gggcggcgccccctagtcca

SEQ ID NO: 43959 - DNA, 20 bp, human
gggtctgcctgcgaacagcg

SEQ ID NO: 43960 - DNA, 20 bp, human
gtgcctgcgaacagcgcggt

SEQ ID NO: 43961 - DNA, 20 bp, human
gctgtctgcactggaaatca

SEQ ID NO: 43962 - DNA, 20 bp, human
ggcctctccggccctggact

SEQ ID NO: 43963 - DNA, 20 bp, human
gcgccggacaagcaagcaga

SEQ ID NO: 43964 - DNA, 20 bp, human
gtgggactttgtaataacaa

SEQ ID NO: 43965 - DNA, 20 bp, human
gaatgcataccgccaaccta

SEQ ID NO: 43966 - DNA, 20 bp, human
gactggaccccagagaacca

SEQ ID NO: 43967 - DNA, 20 bp, human
ggcatagccatggttctctg

SEQ ID NO: 43968 - DNA, 20 bp, human
ggccagcaccaagcatctga

SEQ ID NO: 43969 - DNA, 20 bp, human
gatccgcaggagcatagcca

SEQ ID NO: 43970 - DNA, 20 bp, human
gttggacgtcagcattacaa

SEQ ID NO: 43971 - DNA, 20 bp, human
gcgtcagcattacaaaggac

SEQ ID NO: 43972 - DNA, 20 bp, human
gaaccatggctatgctcctg

SEQ ID NO: 43973 - DNA, 20 bp, human
ggcgcatgaggaccaagcat

SEQ ID NO: 43974 - DNA, 20 bp, human
gatggtccccttgcactgaa

SEQ ID NO: 43975 - DNA, 20 bp, human
gtgcgttgtcggagcatccc

SEQ ID NO: 43976 - DNA, 20 bp, human
gccgggctggacgagatcag

SEQ ID NO: 43977 - DNA, 20 bp, human
ggtcccgacacgtcttcggg

SEQ ID NO: 43978 - DNA, 20 bp, human
gctttcgctcgaggtcccgg

SEQ ID NO: 43979 - DNA, 20 bp, human
gtggagaagggtgacgacta

SEQ ID NO: 43980 - DNA, 20 bp, human
gacgtgtcgggacctcttgg

SEQ ID NO: 43981 - DNA, 20 bp, human
ggtgggcaatctgggaccag

SEQ ID NO: 43982 - DNA, 20 bp, human
ggtgggcccggtgggcaggg

SEQ ID NO: 43983 - DNA, 20 bp, human
gcctccccccgaagacgtgt

SEQ ID NO: 43984 - DNA, 20 bp, human
gcgtctttcgctcgaggtcc

SEQ ID NO: 43985 - DNA, 20 bp, human
gagcctggtcaagtggagaa

SEQ ID NO: 43986 - DNA, 20 bp, human
ggagcagccggactctgagg

SEQ ID NO: 43987 - DNA, 20 bp, human
gcggggagcacgcaagtcgg

SEQ ID NO: 43988 - DNA, 20 bp, human
ggcgccgccgcctcagagtc

SEQ ID NO: 43989 - DNA, 20 bp, human
ggcgggcgcgccatgggcag

SEQ ID NO: 43990 - DNA, 20 bp, human
gtggcacggcagccagacgg

SEQ ID NO: 43991 - DNA, 20 bp, human
gccccgcggggaggctctcg

SEQ ID NO: 43992 - DNA, 20 bp, human
ggcaagtcggaggctggaag

SEQ ID NO: 43993 - DNA, 20 bp, human
gcagccggactctgaggcgg

SEQ ID NO: 43994 - DNA, 20 bp, human
ggccgaggaaggacacccct

SEQ ID NO: 43995 - DNA, 20 bp, human
ggcgcttctgagccaccgtc

SEQ ID NO: 43996 - DNA, 20 bp, human
gtttaagaggggagagagca

SEQ ID NO: 43997 - DNA, 20 bp, human
gtcaacgtggcaaaatacag

SEQ ID NO: 43998 - DNA, 20 bp, human
gcttctgctagggctcaacg

SEQ ID NO: 43999 - DNA, 20 bp, human
gttgaaggctaatctgaaag

SEQ ID NO: 44000 - DNA, 20 bp, human
gcccaaacttaaagcaggca

SEQ ID NO: 44001 - DNA, 20 bp, human
gagagcaggcactctgtgaa

SEQ ID NO: 44002 - DNA, 20 bp, human
gtagcacccaaacttaaagc

SEQ ID NO: 44003 - DNA, 20 bp, human
gttgctcagtgcttctgcta

SEQ ID NO: 44004 - DNA, 20 bp, human
gaccttgaagttagcaggta

SEQ ID NO: 44005 - DNA, 20 bp, human
gtaaattacaaaggcacagg

SEQ ID NO: 44006 - DNA, 20 bp, human
ggacatgcagaagccgaaag

SEQ ID NO: 44007 - DNA, 20 bp, human
ggatccatatgatcccacag

SEQ ID NO: 44008 - DNA, 20 bp, human
gggagtgcctggatcctctg

SEQ ID NO: 44009 - DNA, 20 bp, human
gatgatcccacagaggatcc

SEQ ID NO: 44010 - DNA, 20 bp, human
ggataatagtcagccctgaa

SEQ ID NO: 44011 - DNA, 20 bp, human
gtattgctgaaggtgccatt

SEQ ID NO: 44012 - DNA, 20 bp, human
gatccaggcactcctgatgc

SEQ ID NO: 44013 - DNA, 20 bp, human
gcagatgtggacttcttata

SEQ ID NO: 44014 - DNA, 20 bp, human
gcacaacactcagcacggtc

SEQ ID NO: 44015 - DNA, 20 bp, human
gtttctgatacggagatgga

SEQ ID NO: 44016 - DNA, 20 bp, human
ggcgccccgcggctactctg

SEQ ID NO: 44017 - DNA, 20 bp, human
gtctcggcggtggactcaca

SEQ ID NO: 44018 - DNA, 20 bp, human
gtgggagcggccgtgacgtc

SEQ ID NO: 44019 - DNA, 20 bp, human
gggtgcggcaagtctactgc

SEQ ID NO: 44020 - DNA, 20 bp, human
gagccgggcgcctgacgtca

SEQ ID NO: 44021 - DNA, 20 bp, human
gacggtcgggtctgaacctg

SEQ ID NO: 44022 - DNA, 20 bp, human
ggacgagaaccgcagcgacg

SEQ ID NO: 44023 - DNA, 20 bp, human
gccacgaaccgactggataa

SEQ ID NO: 44024 - DNA, 20 bp, human
gaaccgactggataacggtc

SEQ ID NO: 44025 - DNA, 20 bp, human
gcgtctcacgaggagtcggc

SEQ ID NO: 44026 - DNA, 20 bp, human
gtcgcggggcaggatctcag

SEQ ID NO: 44027 - DNA, 20 bp, human
gcgcgagctctgaggaatga

SEQ ID NO: 44028 - DNA, 20 bp, human
gtagctgtcgtcctcctcca

SEQ ID NO: 44029 - DNA, 20 bp, human
gcgggacgcgagcggcgagc

SEQ ID NO: 44030 - DNA, 20 bp, human
gtggcggcgctgagggatgt

SEQ ID NO: 44031 - DNA, 20 bp, human
ggagcccggctcccgcacca

SEQ ID NO: 44032 - DNA, 20 bp, human
gcgagccgggctgaggcgag

SEQ ID NO: 44033 - DNA, 20 bp, human
gcgtccggcagcgcttgcgg

SEQ ID NO: 44034 - DNA, 20 bp, human
gtacggtcagtgcgccccgg

SEQ ID NO: 44035 - DNA, 20 bp, human
gcgcggtctcgcggggccag

SEQ ID NO: 44036 - DNA, 20 bp, human
gctgaggactggcgctgagg

SEQ ID NO: 44037 - DNA, 20 bp, human
ggagcccgctcaaacgcccc

SEQ ID NO: 44038 - DNA, 20 bp, human
gccgagcccgcgggccaacg

SEQ ID NO: 44039 - DNA, 20 bp, human
gaggggcggtccctactgaa

SEQ ID NO: 44040 - DNA, 20 bp, human
gggaaccattcccgctggag

SEQ ID NO: 44041 - DNA, 20 bp, human
gggggcggttgggcgacgaa

SEQ ID NO: 44042 - DNA, 20 bp, human
gtagacgccgtcctccatgg

SEQ ID NO: 44043 - DNA, 20 bp, human
gggaggacggcgtctatggt

SEQ ID NO: 44044 - DNA, 20 bp, human
ggtccagcgcccaacaaaag

SEQ ID NO: 44045 - DNA, 20 bp, human
ggcgctgaggactggcgctg

SEQ ID NO: 44046 - DNA, 20 bp, human
gtcgccggaggagacggggt

SEQ ID NO: 44047 - DNA, 20 bp, human
gagggagcgcgcaggcgacc

SEQ ID NO: 44048 - DNA, 20 bp, human
ggccgaggctgggtctccgg

SEQ ID NO: 44049 - DNA, 20 bp, human
gtcggcgctggcgagggtct

SEQ ID NO: 44050 - DNA, 20 bp, human
gggctggggacgccgccgga

SEQ ID NO: 44051 - DNA, 20 bp, human
gcccttggcgacaagatgcg

SEQ ID NO: 44052 - DNA, 20 bp, human
gcagctcaggtgggcggaag

SEQ ID NO: 44053 - DNA, 20 bp, human
gtcaagatggatgaagacgg

SEQ ID NO: 44054 - DNA, 20 bp, human
gtgagtgtcggaggtgtggt

SEQ ID NO: 44055 - DNA, 20 bp, human
gccggcagcagaggggccgc

SEQ ID NO: 44056 - DNA, 20 bp, human
gcaaggtgacgcatccttgc

SEQ ID NO: 44057 - DNA, 20 bp, human
gcggcaagcgacaggagcac

SEQ ID NO: 44058 - DNA, 20 bp, human
gcggcagttgcttacctggg

SEQ ID NO: 44059 - DNA, 20 bp, human
gctcacagggtcctagataa

SEQ ID NO: 44060 - DNA, 20 bp, human
gagaacgcaactggacacac

SEQ ID NO: 44061 - DNA, 20 bp, human
gagctgggtcggcaagcgac

SEQ ID NO: 44062 - DNA, 20 bp, human
ggccagcccgaacagcagct

SEQ ID NO: 44063 - DNA, 20 bp, human
gtgacggcagttgcttacct

SEQ ID NO: 44064 - DNA, 20 bp, human
gtggtggaaaaggccccaag

SEQ ID NO: 44065 - DNA, 20 bp, human
ggtccattccgacgcctctg

SEQ ID NO: 44066 - DNA, 20 bp, human
ggaaggaggtgagatgctca

SEQ ID NO: 44067 - DNA, 20 bp, human
ggatcactccagctagcaca

SEQ ID NO: 44068 - DNA, 20 bp, human
gcaaatgctagcagacacgg

SEQ ID NO: 44069 - DNA, 20 bp, human
gtgattattatgggtgaagg

SEQ ID NO: 44070 - DNA, 20 bp, human
ggtgagatgctcagggagct

SEQ ID NO: 44071 - DNA, 20 bp, human
gcacagcagcaatggcaatt

SEQ ID NO: 44072 - DNA, 20 bp, human
gcactcaaccatgtgctagc

SEQ ID NO: 44073 - DNA, 20 bp, human
gtcctgcaacacagcagcaa

SEQ ID NO: 44074 - DNA, 20 bp, human
ggattgtggtctcaaatctt

SEQ ID NO: 44075 - DNA, 20 bp, human
gagaatgtgaacactctaaa

SEQ ID NO: 44076 - DNA, 20 bp, human
ggcagcagcagcacgggcag

SEQ ID NO: 44077 - DNA, 20 bp, human
gtgcgggagtagcaggtcgg

SEQ ID NO: 44078 - DNA, 20 bp, human
gtggcaccatgaggacgcct

SEQ ID NO: 44079 - DNA, 20 bp, human
gagaggcccaggcgtcctca

SEQ ID NO: 44080 - DNA, 20 bp, human
ggcatgcgggagtagcaggt

SEQ ID NO: 44081 - DNA, 20 bp, human
ggcgaggctgcaccagcgcc

SEQ ID NO: 44082 - DNA, 20 bp, human
gacttactagcaaatatcaa

SEQ ID NO: 44083 - DNA, 20 bp, human
gtggctcagggcccgcatgc

SEQ ID NO: 44084 - DNA, 20 bp, human
ggcccgcatgcgggagtagc

SEQ ID NO: 44085 - DNA, 20 bp, human
ggaagtcgcgggtgatctcc

SEQ ID NO: 44086 - DNA, 20 bp, human
gagcccggaccgtgacccaa

SEQ ID NO: 44087 - DNA, 20 bp, human
gtacgcaggtcagtgacgga

SEQ ID NO: 44088 - DNA, 20 bp, human
gtcacggtccgggctaacgt

SEQ ID NO: 44089 - DNA, 20 bp, human
gtgtctacgcaggtcagtga

SEQ ID NO: 44090 - DNA, 20 bp, human
gaggctacccgtgcgtccag

SEQ ID NO: 44091 - DNA, 20 bp, human
ggtctcgccccactgcgctc

SEQ ID NO: 44092 - DNA, 20 bp, human
ggcggggaaggcggccactc

SEQ ID NO: 44093 - DNA, 20 bp, human
gcccgcgcctgagcgcagtg

SEQ ID NO: 44094 - DNA, 20 bp, human
ggggagagcccggaaccgga

SEQ ID NO: 44095 - DNA, 20 bp, human
gtggaaggctccctaggcaa

SEQ ID NO: 44096 - DNA, 20 bp, human
gctagtacatggccatccac

SEQ ID NO: 44097 - DNA, 20 bp, human
ggtagggcgactaggatcca

SEQ ID NO: 44098 - DNA, 20 bp, human
gtggctgtaagggttacttc

SEQ ID NO: 44099 - DNA, 20 bp, human
ggctggaacagacagagtgg

SEQ ID NO: 44100 - DNA, 20 bp, human
gctgcatggcaagtgaaggg

SEQ ID NO: 44101 - DNA, 20 bp, human
gtgttgacagtgcctgtgga

SEQ ID NO: 44102 - DNA, 20 bp, human
gtcacatggtgttggctgta

SEQ ID NO: 44103 - DNA, 20 bp, human
gctcctgcatggcaagtgaa

SEQ ID NO: 44104 - DNA, 20 bp, human
ggattcattccactacagct

SEQ ID NO: 44105 - DNA, 20 bp, human
gcctcatcatcacatggtgt

SEQ ID NO: 44106 - DNA, 20 bp, human
ggagctcgggacgtgatcgt

SEQ ID NO: 44107 - DNA, 20 bp, human
gagagccgccgagccggagt

SEQ ID NO: 44108 - DNA, 20 bp, human
gcccgcccactccggctcgg

SEQ ID NO: 44109 - DNA, 20 bp, human
gtgcggcgggcgctgcgggt

SEQ ID NO: 44110 - DNA, 20 bp, human
gaggcccagagccgccgagc

SEQ ID NO: 44111 - DNA, 20 bp, human
gtccgcgggatcccctcggg

SEQ ID NO: 44112 - DNA, 20 bp, human
ggggcgagctcggaggaacg

SEQ ID NO: 44113 - DNA, 20 bp, human
ggcgtccgcgggatcccctc

SEQ ID NO: 44114 - DNA, 20 bp, human
gctccgagctcgccccccga

SEQ ID NO: 44115 - DNA, 20 bp, human
gccgcggctgaaccgcagac

SEQ ID NO: 44116 - DNA, 20 bp, human
gtccgagagggagaaccccg

SEQ ID NO: 44117 - DNA, 20 bp, human
gtactggcccgggagctccg

SEQ ID NO: 44118 - DNA, 20 bp, human
gcgggcgccttagaaagaaa

SEQ ID NO: 44119 - DNA, 20 bp, human
gcggggagccttcagcaagg

SEQ ID NO: 44120 - DNA, 20 bp, human
gcccctgcatgctggaaagg

SEQ ID NO: 44121 - DNA, 20 bp, human
gcgagttagtaacctacgag

SEQ ID NO: 44122 - DNA, 20 bp, human
gaacctacgagcggctgtga

SEQ ID NO: 44123 - DNA, 20 bp, human
ggcgccttagaaagaaaggg

SEQ ID NO: 44124 - DNA, 20 bp, human
ggacgccgctgcagtacccg

SEQ ID NO: 44125 - DNA, 20 bp, human
gctctgcactctgggtacaa

SEQ ID NO: 44126 - DNA, 20 bp, human
ggctcccgcagcccgaggta

SEQ ID NO: 44127 - DNA, 20 bp, human
gcggagcacgcagcagcgag

SEQ ID NO: 44128 - DNA, 20 bp, human
gacttactccgaggacccca

SEQ ID NO: 44129 - DNA, 20 bp, human
gccgacgcctggtaaagtca

SEQ ID NO: 44130 - DNA, 20 bp, human
gggcggcggcgccgtacctc

SEQ ID NO: 44131 - DNA, 20 bp, human
gggcatgctaaagaaagcag

SEQ ID NO: 44132 - DNA, 20 bp, human
ggctgagagccccagagtcc

SEQ ID NO: 44133 - DNA, 20 bp, human
gagcagagggagagaagtgt

SEQ ID NO: 44134 - DNA, 20 bp, human
gcccaagacggggagcgcca

SEQ ID NO: 44135 - DNA, 20 bp, human
gcgtgctccgcgctatcccc

SEQ ID NO: 44136 - DNA, 20 bp, human
gtcggcgcccgacccacagt

SEQ ID NO: 44137 - DNA, 20 bp, human
gcagcgcccactagacggac

SEQ ID NO: 44138 - DNA, 20 bp, human
gggcgtgagaggctcgaggt

SEQ ID NO: 44139 - DNA, 20 bp, human
ggacccacagtaggcagtgc

SEQ ID NO: 44140 - DNA, 20 bp, human
ggctccgctggcagcagtag

SEQ ID NO: 44141 - DNA, 20 bp, human
gccgggcagcgcccactaga

SEQ ID NO: 44142 - DNA, 20 bp, human
ggcagcagtagagatagtgc

SEQ ID NO: 44143 - DNA, 20 bp, human
gtgcccgcactgcctactgt

SEQ ID NO: 44144 - DNA, 20 bp, human
ggggcgcctgtccgtctagt

SEQ ID NO: 44145 - DNA, 20 bp, human
gatgagtcgagagggctgag

SEQ ID NO: 44146 - DNA, 20 bp, human
ggtcggaagtagggagacag

SEQ ID NO: 44147 - DNA, 20 bp, human
gcctgcggcgctgaactcaa

SEQ ID NO: 44148 - DNA, 20 bp, human
gcggccccgcgtcagagtag

SEQ ID NO: 44149 - DNA, 20 bp, human
gtcgcgcgtggtcggaagta

SEQ ID NO: 44150 - DNA, 20 bp, human
gtgtcaggggtggacaagtc

SEQ ID NO: 44151 - DNA, 20 bp, human
gcaggtgccccgcgaggaca

SEQ ID NO: 44152 - DNA, 20 bp, human
gagctgggtccatcctcccc

SEQ ID NO: 44153 - DNA, 20 bp, human
ggagagacgcgtgtcagggg

SEQ ID NO: 44154 - DNA, 20 bp, human
gaggaggaaagagggcgcag

SEQ ID NO: 44155 - DNA, 20 bp, human
gcatcctccccgggagccac

SEQ ID NO: 44156 - DNA, 20 bp, human
gccactcccggcgagagata

SEQ ID NO: 44157 - DNA, 20 bp, human
gcagccctcctaggacactg

SEQ ID NO: 44158 - DNA, 20 bp, human
gcggctccgaagctcccggc

SEQ ID NO: 44159 - DNA, 20 bp, human
gacacacacgacacaaaagg

SEQ ID NO: 44160 - DNA, 20 bp, human
gctcaaagaagggtagcggg

SEQ ID NO: 44161 - DNA, 20 bp, human
gagtcatgctcgcttcacgg

SEQ ID NO: 44162 - DNA, 20 bp, human
gcaagctgggcatctggagt

SEQ ID NO: 44163 - DNA, 20 bp, human
gggctacagcgcagcggatg

SEQ ID NO: 44164 - DNA, 20 bp, human
gccctcctaggacactgagg

SEQ ID NO: 44165 - DNA, 20 bp, human
ggggtttcgaagctactcac

SEQ ID NO: 44166 - DNA, 20 bp, human
gcgagcgcgggagaacgcgt

SEQ ID NO: 44167 - DNA, 20 bp, human
gcccggtccctagcatccca

SEQ ID NO: 44168 - DNA, 20 bp, human
gggcttcccccggcgagagg

SEQ ID NO: 44169 - DNA, 20 bp, human
gtggccttaggagggtctag

SEQ ID NO: 44170 - DNA, 20 bp, human
gggcctgggcgcgctcacac

SEQ ID NO: 44171 - DNA, 20 bp, human
ggggggaagccgaggctcta

SEQ ID NO: 44172 - DNA, 20 bp, human
ggacccggcctgccaggggt

SEQ ID NO: 44173 - DNA, 20 bp, human
gtcggccgctccggacagcc

SEQ ID NO: 44174 - DNA, 20 bp, human
gctgtccggagcggccgatg

SEQ ID NO: 44175 - DNA, 20 bp, human
ggaggtcctcctactactac

SEQ ID NO: 44176 - DNA, 20 bp, human
gactccgggagagaacgaga

SEQ ID NO: 44177 - DNA, 20 bp, human
gtgccacacacccccgggag

SEQ ID NO: 44178 - DNA, 20 bp, human
gcacgagaggcgctctggag

SEQ ID NO: 44179 - DNA, 20 bp, human
gtataaggggaaacagacgg

SEQ ID NO: 44180 - DNA, 20 bp, human
gtaaagagcgagcgcaagag

SEQ ID NO: 44181 - DNA, 20 bp, human
gcgaagcgatgggctccggg

SEQ ID NO: 44182 - DNA, 20 bp, human
ggcgagcacgagaggcgctc

SEQ ID NO: 44183 - DNA, 20 bp, human
gccgccggtagaggtgactg

SEQ ID NO: 44184 - DNA, 20 bp, human
gcaagaggggcgagcacgag

SEQ ID NO: 44185 - DNA, 20 bp, human
gtcggagggatcaaagccgc

SEQ ID NO: 44186 - DNA, 20 bp, human
gctctgggagtcgagtacag

SEQ ID NO: 44187 - DNA, 20 bp, human
gtggcttcgttcctgatgga

SEQ ID NO: 44188 - DNA, 20 bp, human
ggacatgcacgggatgaagg

SEQ ID NO: 44189 - DNA, 20 bp, human
gtgaagacttgcgaacagtt

SEQ ID NO: 44190 - DNA, 20 bp, human
gtattaggagtaagacgagg

SEQ ID NO: 44191 - DNA, 20 bp, human
ggttgagcttgagcgtgagc

SEQ ID NO: 44192 - DNA, 20 bp, human
gtaagacgagggggctctct

SEQ ID NO: 44193 - DNA, 20 bp, human
ggaaaaagatcaaagacttg

SEQ ID NO: 44194 - DNA, 20 bp, human
gggcatgcagaagaggccaa

SEQ ID NO: 44195 - DNA, 20 bp, human
gtgagtgcgaggggatctag

SEQ ID NO: 44196 - DNA, 20 bp, human
ggagggacgcgcggcgacag

SEQ ID NO: 44197 - DNA, 20 bp, human
ggggcgaggcagacaccgag

SEQ ID NO: 44198 - DNA, 20 bp, human
ggacgcgcggcgacagcgga

SEQ ID NO: 44199 - DNA, 20 bp, human
ggccgcgccccgccacaggg

SEQ ID NO: 44200 - DNA, 20 bp, human
gcgccaagagctgctggtca

SEQ ID NO: 44201 - DNA, 20 bp, human
ggcggaggagcagggcgcta

SEQ ID NO: 44202 - DNA, 20 bp, human
ggcccctgaccagcagctct

SEQ ID NO: 44203 - DNA, 20 bp, human
ggttatcagctgccgggccg

SEQ ID NO: 44204 - DNA, 20 bp, human
gcgcctggaggagaagttct

SEQ ID NO: 44205 - DNA, 20 bp, human
gggcttcatggcccccagtc

SEQ ID NO: 44206 - DNA, 20 bp, human
ggcctcccgaaccccacgag

SEQ ID NO: 44207 - DNA, 20 bp, human
gggcctccggcgccgctcgt

SEQ ID NO: 44208 - DNA, 20 bp, human
gaggacccgcgacacagctc

SEQ ID NO: 44209 - DNA, 20 bp, human
gaccccacgagcggcgccgg

SEQ ID NO: 44210 - DNA, 20 bp, human
ggacgggggtgtctgatgga

SEQ ID NO: 44211 - DNA, 20 bp, human
gcgagccacgcagcaggagc

SEQ ID NO: 44212 - DNA, 20 bp, human
gtggcgacctgcggagccgg

SEQ ID NO: 44213 - DNA, 20 bp, human
gctgtgtgttagtgggacgg

SEQ ID NO: 44214 - DNA, 20 bp, human
gtccgcgcgcgctgggcctc

SEQ ID NO: 44215 - DNA, 20 bp, human
gcaacctcgcgcccaaccta

SEQ ID NO: 44216 - DNA, 20 bp, human
gtctcacgaggccccagtgg

SEQ ID NO: 44217 - DNA, 20 bp, human
gctggaggagcagctggtaa

SEQ ID NO: 44218 - DNA, 20 bp, human
ggcccgccgccggaactccg

SEQ ID NO: 44219 - DNA, 20 bp, human
gctccccgcccccaaatcgg

SEQ ID NO: 44220 - DNA, 20 bp, human
ggttacattggctccgggag

SEQ ID NO: 44221 - DNA, 20 bp, human
gggttggatgctcagacacc

SEQ ID NO: 44222 - DNA, 20 bp, human
gtggatgctcagacaccggg

SEQ ID NO: 44223 - DNA, 20 bp, human
gtggcccagcccggaatggg

SEQ ID NO: 44224 - DNA, 20 bp, human
gcgggctctgcgagttacat

SEQ ID NO: 44225 - DNA, 20 bp, human
gagacagacacagacggggg

SEQ ID NO: 44226 - DNA, 20 bp, human
gctgtatatactgctgaccg

SEQ ID NO: 44227 - DNA, 20 bp, human
gtaaccgaactgcagcgccc

SEQ ID NO: 44228 - DNA, 20 bp, human
gggatcaccaagtggagtag

SEQ ID NO: 44229 - DNA, 20 bp, human
gtaataccaaacggctccgt

SEQ ID NO: 44230 - DNA, 20 bp, human
gaccttgcgtgcagttatgt

SEQ ID NO: 44231 - DNA, 20 bp, human
ggaggacccgtcgaccacac

SEQ ID NO: 44232 - DNA, 20 bp, human
gacgggtcctccaagagttt

SEQ ID NO: 44233 - DNA, 20 bp, human
gtggagtagcggcacgaagg

SEQ ID NO: 44234 - DNA, 20 bp, human
ggcaaacagcacatccggtg

SEQ ID NO: 44235 - DNA, 20 bp, human
gcacatccggtgtggtcgac

SEQ ID NO: 44236 - DNA, 20 bp, human
gcgccaccgccaagcctaag

SEQ ID NO: 44237 - DNA, 20 bp, human
gcgtgctcgcgcgaaggctg

SEQ ID NO: 44238 - DNA, 20 bp, human
gtgcgggacccagagcaaag

SEQ ID NO: 44239 - DNA, 20 bp, human
gcgcgcgagcacgtaccggg

SEQ ID NO: 44240 - DNA, 20 bp, human
ggggagcgcgggccgagcta

SEQ ID NO: 44241 - DNA, 20 bp, human
gcacgtaccgggcggtgaga

SEQ ID NO: 44242 - DNA, 20 bp, human
gcgcaggcggctcacgaccg

SEQ ID NO: 44243 - DNA, 20 bp, human
ggcttcgcgccgaatccccg

SEQ ID NO: 44244 - DNA, 20 bp, human
gcctccctggcttccaatag

SEQ ID NO: 44245 - DNA, 20 bp, human
ggacgtccttgtgggtgagg

SEQ ID NO: 44246 - DNA, 20 bp, human
gaagcggcgttagtgaatcg

SEQ ID NO: 44247 - DNA, 20 bp, human
gcgccggcgccctgcggaag

SEQ ID NO: 44248 - DNA, 20 bp, human
gtggtggccacgcaggtgtg

SEQ ID NO: 44249 - DNA, 20 bp, human
gaggatggaggtggcggtcg

SEQ ID NO: 44250 - DNA, 20 bp, human
gatggaggtggcggtcgcgg

SEQ ID NO: 44251 - DNA, 20 bp, human
gggccaccaccgcaccaagg

SEQ ID NO: 44252 - DNA, 20 bp, human
gcactaacgccgcttccgca

SEQ ID NO: 44253 - DNA, 20 bp, human
ggcacgggcgtgggcaacgt

SEQ ID NO: 44254 - DNA, 20 bp, human
gcgtggccaccaccgcacca

SEQ ID NO: 44255 - DNA, 20 bp, human
ggtggtgcagctgtctgcac

SEQ ID NO: 44256 - DNA, 20 bp, human
ggtcagcccacacactctgg

SEQ ID NO: 44257 - DNA, 20 bp, human
ggacgccgccaccaaattat

SEQ ID NO: 44258 - DNA, 20 bp, human
gggccgaagagtaccatccc

SEQ ID NO: 44259 - DNA, 20 bp, human
ggaccccgggggacaaacag

SEQ ID NO: 44260 - DNA, 20 bp, human
gttgagcgccgataatttgg

SEQ ID NO: 44261 - DNA, 20 bp, human
gtttggtggcggcgtccgga

SEQ ID NO: 44262 - DNA, 20 bp, human
gagtgtgtgggctgaccccg

SEQ ID NO: 44263 - DNA, 20 bp, human
gcccccgctccctctccggt

SEQ ID NO: 44264 - DNA, 20 bp, human
ggcgagtgctgtggtaagga

SEQ ID NO: 44265 - DNA, 20 bp, human
gagcgccgataatttggtgg

SEQ ID NO: 44266 - DNA, 20 bp, human
gccgcatccgccacatccga

SEQ ID NO: 44267 - DNA, 20 bp, human
gcgccagcgcccgcaggacc

SEQ ID NO: 44268 - DNA, 20 bp, human
gcgttgggcaagcagaccgg

SEQ ID NO: 44269 - DNA, 20 bp, human
gcgaaggcgccgcgacttcc

SEQ ID NO: 44270 - DNA, 20 bp, human
gtaacgttgggcaagcagac

SEQ ID NO: 44271 - DNA, 20 bp, human
gtaggggcactaataacgtt

SEQ ID NO: 44272 - DNA, 20 bp, human
ggcggcgccttcggatgtgg

SEQ ID NO: 44273 - DNA, 20 bp, human
ggggcgagctcggaggacac

SEQ ID NO: 44274 - DNA, 20 bp, human
gcggatgagagcgcacgctt

SEQ ID NO: 44275 - DNA, 20 bp, human
ggactgcggaggcatagaga

SEQ ID NO: 44276 - DNA, 20 bp, human
gggtgaccggaaggagtaag

SEQ ID NO: 44277 - DNA, 20 bp, human
gcgaccaggcgccttggggt

SEQ ID NO: 44278 - DNA, 20 bp, human
gccaaggcgcctggtcgcca

SEQ ID NO: 44279 - DNA, 20 bp, human
gctgaggacgcgctcgaaga

SEQ ID NO: 44280 - DNA, 20 bp, human
gcgggcgtgtaaaagagcca

SEQ ID NO: 44281 - DNA, 20 bp, human
gaccggaccgcctggcccca

SEQ ID NO: 44282 - DNA, 20 bp, human
ggctcaagcggagtgcgcag

SEQ ID NO: 44283 - DNA, 20 bp, human
gacgctgggggccctcaacg

SEQ ID NO: 44284 - DNA, 20 bp, human
gaggacgcgctcgaagacgg

SEQ ID NO: 44285 - DNA, 20 bp, human
gggcggtccggtgtggatca

SEQ ID NO: 44286 - DNA, 20 bp, human
ggcagccagagcaagcggaa

SEQ ID NO: 44287 - DNA, 20 bp, human
gccagcgcccggagcaccag

SEQ ID NO: 44288 - DNA, 20 bp, human
gtggcagcgtcaccggacaa

SEQ ID NO: 44289 - DNA, 20 bp, human
gcaaaggccaccgagcgcgg

SEQ ID NO: 44290 - DNA, 20 bp, human
gcggagcaccaggggccgaa

SEQ ID NO: 44291 - DNA, 20 bp, human
gcgggcgctggcagcgtcac

SEQ ID NO: 44292 - DNA, 20 bp, human
gggcaagctgtgatagtgtt

SEQ ID NO: 44293 - DNA, 20 bp, human
gagctgtgatagtgtttggg

SEQ ID NO: 44294 - DNA, 20 bp, human
ggtccggttcggcctggtct

SEQ ID NO: 44295 - DNA, 20 bp, human
gcgcgcccgtggggccggag

SEQ ID NO: 44296 - DNA, 20 bp, human
gcagcgtgggcaagacgagg

SEQ ID NO: 44297 - DNA, 20 bp, human
gctgcagcgtgggcaagacg

SEQ ID NO: 44298 - DNA, 20 bp, human
ggagggctgggtctcaccat

SEQ ID NO: 44299 - DNA, 20 bp, human
ggatgggcaggctgcagcgt

SEQ ID NO: 44300 - DNA, 20 bp, human
gcagaagctggcaccagtgg

SEQ ID NO: 44301 - DNA, 20 bp, human
gagccatgcaaggttctagg

SEQ ID NO: 44302 - DNA, 20 bp, human
gaggcaccgagacattcagg

SEQ ID NO: 44303 - DNA, 20 bp, human
gaccctcaggaagtgatcca

SEQ ID NO: 44304 - DNA, 20 bp, human
gcccctggatcacttcctga

SEQ ID NO: 44305 - DNA, 20 bp, human
ggtaaagtgggagccatgca

SEQ ID NO: 44306 - DNA, 20 bp, human
gaagtgcttagagcagatct

SEQ ID NO: 44307 - DNA, 20 bp, human
gtctgtccgccagcccggac

SEQ ID NO: 44308 - DNA, 20 bp, human
gcaggatgctatttcctgag

SEQ ID NO: 44309 - DNA, 20 bp, human
ggaggggaagctcctgattc

SEQ ID NO: 44310 - DNA, 20 bp, human
gaacaagacgctccagaatc

SEQ ID NO: 44311 - DNA, 20 bp, human
gggctcaacattacagccta

SEQ ID NO: 44312 - DNA, 20 bp, human
gagaccagacaactgcagtg

SEQ ID NO: 44313 - DNA, 20 bp, human
ggtctgagtgttaaaagagg

SEQ ID NO: 44314 - DNA, 20 bp, human
gaagtctggagctatggaca

SEQ ID NO: 44315 - DNA, 20 bp, human
gggagtgcagggtcaaagtc

SEQ ID NO: 44316 - DNA, 20 bp, human
ggcacaggcagatggagtga

SEQ ID NO: 44317 - DNA, 20 bp, human
ggaagcctgagcccagtata

SEQ ID NO: 44318 - DNA, 20 bp, human
ggtgagcaaacaattagcac

SEQ ID NO: 44319 - DNA, 20 bp, human
gtcctcccagggataggtga

SEQ ID NO: 44320 - DNA, 20 bp, human
gctgggaggacccaaaatgc

SEQ ID NO: 44321 - DNA, 20 bp, human
gtgatcctcctcccagggat

SEQ ID NO: 44322 - DNA, 20 bp, human
gtaggccctcacctatccct

SEQ ID NO: 44323 - DNA, 20 bp, human
gtggcagcacagagctccca

SEQ ID NO: 44324 - DNA, 20 bp, human
ggccctcacctatccctggg

SEQ ID NO: 44325 - DNA, 20 bp, human
gtaaggctgaaccatatact

SEQ ID NO: 44326 - DNA, 20 bp, human
ggggaggcgaagacatgacg

SEQ ID NO: 44327 - DNA, 20 bp, human
gcgcgggccgcggagaggtc

SEQ ID NO: 44328 - DNA, 20 bp, human
gtgggcgcccgacctctccg

SEQ ID NO: 44329 - DNA, 20 bp, human
gcagtgcgcatgccgtcggt

SEQ ID NO: 44330 - DNA, 20 bp, human
gagaggaaaagagtcagtac

SEQ ID NO: 44331 - DNA, 20 bp, human
gccccggcgagcgctgagac

SEQ ID NO: 44332 - DNA, 20 bp, human
ggccttgatgcccgcccgag

SEQ ID NO: 44333 - DNA, 20 bp, human
gaggcgaagacatgacgcgg

SEQ ID NO: 44334 - DNA, 20 bp, human
gggcggccgcgcccccttaa

SEQ ID NO: 44335 - DNA, 20 bp, human
gtctctagtttcccttcggg

SEQ ID NO: 44336 - DNA, 20 bp, human
gagtctcaggacgggcgctt

SEQ ID NO: 44337 - DNA, 20 bp, human
ggcgaccgacacacgctgcc

SEQ ID NO: 44338 - DNA, 20 bp, human
gggccccaggcagcgtgtgt

SEQ ID NO: 44339 - DNA, 20 bp, human
gaggactagttctccagact

SEQ ID NO: 44340 - DNA, 20 bp, human
ggtcctgagactgcaaaaaa

SEQ ID NO: 44341 - DNA, 20 bp, human
ggcgctttggagccggcccc

SEQ ID NO: 44342 - DNA, 20 bp, human
gcgggaggaatcccccccgg

SEQ ID NO: 44343 - DNA, 20 bp, human
gtgagactgcaaaaaagggt

SEQ ID NO: 44344 - DNA, 20 bp, human
ggggagtgaggccggtagac

SEQ ID NO: 44345 - DNA, 20 bp, human
gaaaaaagggtcgggtcatc

SEQ ID NO: 44346 - DNA, 20 bp, human
ggcggagggaacaaagtccc

SEQ ID NO: 44347 - DNA, 20 bp, human
ggggactcggcaactcgcag

SEQ ID NO: 44348 - DNA, 20 bp, human
gagttgccgagtcccctccg

SEQ ID NO: 44349 - DNA, 20 bp, human
gccggaccgagccaacgccg

SEQ ID NO: 44350 - DNA, 20 bp, human
ggaggctgcttcggagtgtg

SEQ ID NO: 44351 - DNA, 20 bp, human
gccgcgggccgggtgagaac

SEQ ID NO: 44352 - DNA, 20 bp, human
gcgacacaaagcgcctggtc

SEQ ID NO: 44353 - DNA, 20 bp, human
ggctgcttcggagtgtgagg

SEQ ID NO: 44354 - DNA, 20 bp, human
gcgcgcctggctactcaccc

SEQ ID NO: 44355 - DNA, 20 bp, human
gagcgctccggagggaccgg

SEQ ID NO: 44356 - DNA, 20 bp, human
gcaaagtgccaggctccgga

SEQ ID NO: 44357 - DNA, 20 bp, human
gcgcagacgggtgctactca

SEQ ID NO: 44358 - DNA, 20 bp, human
gggcggggcgaagagatccg

SEQ ID NO: 44359 - DNA, 20 bp, human
gagcagcctaggagccgagg

SEQ ID NO: 44360 - DNA, 20 bp, human
ggagacagggtagaggcggc

SEQ ID NO: 44361 - DNA, 20 bp, human
gtctgggaggagaggactgc

SEQ ID NO: 44362 - DNA, 20 bp, human
gcggctcctaggctgctcgg

SEQ ID NO: 44363 - DNA, 20 bp, human
gagacgggtgctactcacgg

SEQ ID NO: 44364 - DNA, 20 bp, human
gcgtctgcgggctcgatggg

SEQ ID NO: 44365 - DNA, 20 bp, human
ggcactcgctcgcagatccc

SEQ ID NO: 44366 - DNA, 20 bp, human
gctccgcagcccggagaata

SEQ ID NO: 44367 - DNA, 20 bp, human
gggtggaggagactcagatg

SEQ ID NO: 44368 - DNA, 20 bp, human
gggcgccggccgtattctcc

SEQ ID NO: 44369 - DNA, 20 bp, human
gggctgcggagggtaaagag

SEQ ID NO: 44370 - DNA, 20 bp, human
ggcagcccggagaatacggc

SEQ ID NO: 44371 - DNA, 20 bp, human
gggagcggagccttagggat

SEQ ID NO: 44372 - DNA, 20 bp, human
ggccactggggtctgcctag

SEQ ID NO: 44373 - DNA, 20 bp, human
gccggcccggtcacccagat

SEQ ID NO: 44374 - DNA, 20 bp, human
gtggggggtaggggagacgg

SEQ ID NO: 44375 - DNA, 20 bp, human
gaggcgcgtcgcggcggcag

SEQ ID NO: 44376 - DNA, 20 bp, human
gctggcactggcacacgcta

SEQ ID NO: 44377 - DNA, 20 bp, human
gacagccagggccccgtgaa

SEQ ID NO: 44378 - DNA, 20 bp, human
gtgctgcctcgagggaggaa

SEQ ID NO: 44379 - DNA, 20 bp, human
ggccagtgctggtgctctgg

SEQ ID NO: 44380 - DNA, 20 bp, human
gtaaagccggtgcggtggtg

SEQ ID NO: 44381 - DNA, 20 bp, human
gaggaatgctgcctcgaggg

SEQ ID NO: 44382 - DNA, 20 bp, human
gtggaaaggcataggtagag

SEQ ID NO: 44383 - DNA, 20 bp, human
ggaaggatcaaagacataag

SEQ ID NO: 44384 - DNA, 20 bp, human
gggatgtccccctttccgag

SEQ ID NO: 44385 - DNA, 20 bp, human
gggctgccccaccaccgcac

SEQ ID NO: 44386 - DNA, 20 bp, human
gtagagagagagacacaact

SEQ ID NO: 44387 - DNA, 20 bp, human
gcacagagcgagaaggtgtc

SEQ ID NO: 44388 - DNA, 20 bp, human
gccattcgcgcccttcacag

SEQ ID NO: 44389 - DNA, 20 bp, human
ggctgtctcacagagcgaga

SEQ ID NO: 44390 - DNA, 20 bp, human
gggagactcagagccatagc

SEQ ID NO: 44391 - DNA, 20 bp, human
ggtgagacagcagcctgcta

SEQ ID NO: 44392 - DNA, 20 bp, human
ggagtcaatgtccacccact

SEQ ID NO: 44393 - DNA, 20 bp, human
gtggagcagatccgatggag

SEQ ID NO: 44394 - DNA, 20 bp, human
gggacagaattgggatatag

SEQ ID NO: 44395 - DNA, 20 bp, human
gctctctctacctctgtgaa

SEQ ID NO: 44396 - DNA, 20 bp, human
gttcaggcccgcagacagaa

SEQ ID NO: 44397 - DNA, 20 bp, human
gctgtgcagacagttcccca

SEQ ID NO: 44398 - DNA, 20 bp, human
ggcccgcagacagaagggct

SEQ ID NO: 44399 - DNA, 20 bp, human
gggagctaggaggctagcat

SEQ ID NO: 44400 - DNA, 20 bp, human
gaaacagcacgggaaatgag

SEQ ID NO: 44401 - DNA, 20 bp, human
gtcagatgcagtgcggacag

SEQ ID NO: 44402 - DNA, 20 bp, human
gtagtccttggctcttatct

SEQ ID NO: 44403 - DNA, 20 bp, human
gagttccccatggcaccgtt

SEQ ID NO: 44404 - DNA, 20 bp, human
ggcaggagtcagatgcagtg

SEQ ID NO: 44405 - DNA, 20 bp, human
gcaggatggaactgactcaa

SEQ ID NO: 44406 - DNA, 20 bp, human
gctccgccctcccgaccctg

SEQ ID NO: 44407 - DNA, 20 bp, human
ggggtctcagcacacgcgct

SEQ ID NO: 44408 - DNA, 20 bp, human
gtccctcgcaggcttccgta

SEQ ID NO: 44409 - DNA, 20 bp, human
gtgagaccccagggtcggga

SEQ ID NO: 44410 - DNA, 20 bp, human
gtccgtaaggcaggccaaag

SEQ ID NO: 44411 - DNA, 20 bp, human
ggggagggcggagactggga

SEQ ID NO: 44412 - DNA, 20 bp, human
gcgcgtgtgctgagacccca

SEQ ID NO: 44413 - DNA, 20 bp, human
gcggactccgcgtggaggtg

SEQ ID NO: 44414 - DNA, 20 bp, human
gccggggacacgcttctagt

SEQ ID NO: 44415 - DNA, 20 bp, human
gtctagtaggccaaactccc

SEQ ID NO: 44416 - DNA, 20 bp, human
gaggagcaaccgagcacgat

SEQ ID NO: 44417 - DNA, 20 bp, human
gttggaaaggttgacgatag

SEQ ID NO: 44418 - DNA, 20 bp, human
gaagggcgcttggaccccag

SEQ ID NO: 44419 - DNA, 20 bp, human
gactagcgggcggagttgaa

SEQ ID NO: 44420 - DNA, 20 bp, human
ggtgcccaagattaccggga

SEQ ID NO: 44421 - DNA, 20 bp, human
gagagagcgactccacgtag

SEQ ID NO: 44422 - DNA, 20 bp, human
gggcctcctccgcacaacat

SEQ ID NO: 44423 - DNA, 20 bp, human
gaatcttgggcactagcggg

SEQ ID NO: 44424 - DNA, 20 bp, human
gagaagagagtgggaactcc

SEQ ID NO: 44425 - DNA, 20 bp, human
gattccttcccggtaatctt

SEQ ID NO: 44426 - DNA, 20 bp, human
gccaaggctacgaagcccat

SEQ ID NO: 44427 - DNA, 20 bp, human
gcgtacctggcgggtaatac

SEQ ID NO: 44428 - DNA, 20 bp, human
gtcactaagggcgacctcag

SEQ ID NO: 44429 - DNA, 20 bp, human
ggccatgcctagctcctctg

SEQ ID NO: 44430 - DNA, 20 bp, human
gggtcgcagcctaaatggat

SEQ ID NO: 44431 - DNA, 20 bp, human
gggaccccgccgcctttcag

SEQ ID NO: 44432 - DNA, 20 bp, human
gctacgaagcccatcggccg

SEQ ID NO: 44433 - DNA, 20 bp, human
gtggcgggtaataccggagc

SEQ ID NO: 44434 - DNA, 20 bp, human
gaggttgagagcacaggtgt

SEQ ID NO: 44435 - DNA, 20 bp, human
gcgggtaataccggagcagg

SEQ ID NO: 44436 - DNA, 20 bp, human
gcggacggtgcggggatcag

SEQ ID NO: 44437 - DNA, 20 bp, human
gaggcggagggaaccatgcg

SEQ ID NO: 44438 - DNA, 20 bp, human
gtgcgaggttctgagaattg

SEQ ID NO: 44439 - DNA, 20 bp, human
gcgcaggccccactacggac

SEQ ID NO: 44440 - DNA, 20 bp, human
gccagtttgaggagactcat

SEQ ID NO: 44441 - DNA, 20 bp, human
ggtttgaggagactcatcgg

SEQ ID NO: 44442 - DNA, 20 bp, human
gcctcagaaaccgtctctcg

SEQ ID NO: 44443 - DNA, 20 bp, human
gcgagggtcgcctcgagaga

SEQ ID NO: 44444 - DNA, 20 bp, human
ggttctgagaattgcggcga

SEQ ID NO: 44445 - DNA, 20 bp, human
ggagagaatggggaaaatta

SEQ ID NO: 44446 - DNA, 20 bp, human
ggaatccaaggaggcttcgg

SEQ ID NO: 44447 - DNA, 20 bp, human
gagagaagagctcggctcca

SEQ ID NO: 44448 - DNA, 20 bp, human
gtagtggaatggcatcccag

SEQ ID NO: 44449 - DNA, 20 bp, human
ggcagcagcaggtatgtcaa

SEQ ID NO: 44450 - DNA, 20 bp, human
gtccctggtggccagtgcag

SEQ ID NO: 44451 - DNA, 20 bp, human
ggacacccccgaagcctcct

SEQ ID NO: 44452 - DNA, 20 bp, human
gtcccagggccctagtggaa

SEQ ID NO: 44453 - DNA, 20 bp, human
gttcgggggtgtctgcagag

SEQ ID NO: 44454 - DNA, 20 bp, human
gccagaatccaaggaggctt

SEQ ID NO: 44455 - DNA, 20 bp, human
gtctgaagaggaggaggatc

SEQ ID NO: 44456 - DNA, 20 bp, human
ggcgccgacgagatcgggtg

SEQ ID NO: 44457 - DNA, 20 bp, human
ggcccggatctgcgcaacgg

SEQ ID NO: 44458 - DNA, 20 bp, human
gggggacgcgcggtgaccgt

SEQ ID NO: 44459 - DNA, 20 bp, human
gacgcgcagtcgggaagcgg

SEQ ID NO: 44460 - DNA, 20 bp, human
gggccggcgtgaccttgacg

SEQ ID NO: 44461 - DNA, 20 bp, human
ggaccccgggcacccgtcca

SEQ ID NO: 44462 - DNA, 20 bp, human
gggagcgggtgaccttccgg

SEQ ID NO: 44463 - DNA, 20 bp, human
gctcctcccctcggcgccaa

SEQ ID NO: 44464 - DNA, 20 bp, human
ggagatcgggtgaggacgag

SEQ ID NO: 44465 - DNA, 20 bp, human
gggtgaccgttggcgccgag

SEQ ID NO: 44466 - DNA, 20 bp, human
ggacggaccatcatgtgaca

SEQ ID NO: 44467 - DNA, 20 bp, human
gcacggaagtagctccgaac

SEQ ID NO: 44468 - DNA, 20 bp, human
gcagcaaaggcaaggaccga

SEQ ID NO: 44469 - DNA, 20 bp, human
ggcctccgccggctctccat

SEQ ID NO: 44470 - DNA, 20 bp, human
gttgcgggtccggtttgtct

SEQ ID NO: 44471 - DNA, 20 bp, human
gccgcgacgccgagacaaac

SEQ ID NO: 44472 - DNA, 20 bp, human
gcttggccggctgcagtcca

SEQ ID NO: 44473 - DNA, 20 bp, human
ggaaggaaaagagacctcac

SEQ ID NO: 44474 - DNA, 20 bp, human
ggccaatggagagccggcgg

SEQ ID NO: 44475 - DNA, 20 bp, human
gccgtcagcgaagggcgagg

SEQ ID NO: 44476 - DNA, 20 bp, human
gtggcgcggcctacacagag

SEQ ID NO: 44477 - DNA, 20 bp, human
gggcaggcgcgggacgccaa

SEQ ID NO: 44478 - DNA, 20 bp, human
gaggcgcgggacgccaaggg

SEQ ID NO: 44479 - DNA, 20 bp, human
gagagcgggtgacaaggctg

SEQ ID NO: 44480 - DNA, 20 bp, human
gaaaccaagagcgggtgaca

SEQ ID NO: 44481 - DNA, 20 bp, human
gaaggctgaggagccccgaa

SEQ ID NO: 44482 - DNA, 20 bp, human
ggccaagggcggcaaggtgg

SEQ ID NO: 44483 - DNA, 20 bp, human
ggctgaggagccccgaaagg

SEQ ID NO: 44484 - DNA, 20 bp, human
gccccgaaaggcggaccgtc

SEQ ID NO: 44485 - DNA, 20 bp, human
gctacacagagaggcaggcg

SEQ ID NO: 44486 - DNA, 20 bp, human
gacaaacgagtgggctgcgg

SEQ ID NO: 44487 - DNA, 20 bp, human
ggcgagaaggcaggcacgag

SEQ ID NO: 44488 - DNA, 20 bp, human
ggcgcaaagcacaaacgagt

SEQ ID NO: 44489 - DNA, 20 bp, human
gtaggcaaaacactgaacgg

SEQ ID NO: 44490 - DNA, 20 bp, human
gtccttccttcagaccccag

SEQ ID NO: 44491 - DNA, 20 bp, human
gctgggaccgccgctgtaaa

SEQ ID NO: 44492 - DNA, 20 bp, human
gaaagaagctgaggacccgg

SEQ ID NO: 44493 - DNA, 20 bp, human
gggtaccgcgtctgcaggtc

SEQ ID NO: 44494 - DNA, 20 bp, human
gtcgcctccaagggcccggg

SEQ ID NO: 44495 - DNA, 20 bp, human
ggaaacccgacctgcagacg

SEQ ID NO: 44496 - DNA, 20 bp, human
gcacagtcctggttatctca

SEQ ID NO: 44497 - DNA, 20 bp, human
gctgaacggagtctgaaagg

SEQ ID NO: 44498 - DNA, 20 bp, human
gaggaggcggagggcatgag

SEQ ID NO: 44499 - DNA, 20 bp, human
gaaggtggcagaggaacgta

SEQ ID NO: 44500 - DNA, 20 bp, human
gggagtcgcgggatgtaggt

SEQ ID NO: 44501 - DNA, 20 bp, human
gtgactgaacggagtctgaa

SEQ ID NO: 44502 - DNA, 20 bp, human
gagcgaaccgggaaagggta

SEQ ID NO: 44503 - DNA, 20 bp, human
gtaggaagtgaccagcgggt

SEQ ID NO: 44504 - DNA, 20 bp, human
ggtcacggccgttgactgaa

SEQ ID NO: 44505 - DNA, 20 bp, human
ggagtctgaaaggaggcgga

SEQ ID NO: 44506 - DNA, 20 bp, human
gaggctggcccagcgactga

SEQ ID NO: 44507 - DNA, 20 bp, human
gtggcccagcgactgagggc

SEQ ID NO: 44508 - DNA, 20 bp, human
gtggggtgccgggtcaggaa

SEQ ID NO: 44509 - DNA, 20 bp, human
gcccggccccagcatgcggg

SEQ ID NO: 44510 - DNA, 20 bp, human
ggaactttctgggttaagga

SEQ ID NO: 44511 - DNA, 20 bp, human
gaccaggagctggaaatgga

SEQ ID NO: 44512 - DNA, 20 bp, human
gcctgacccggcaccccatc

SEQ ID NO: 44513 - DNA, 20 bp, human
gtgccgggtcaggaagggtt

SEQ ID NO: 44514 - DNA, 20 bp, human
gtggaatgtcagctacaccc

SEQ ID NO: 44515 - DNA, 20 bp, human
gagggcataaatggccaggt

SEQ ID NO: 44516 - DNA, 20 bp, human
gccgacttgcaagaactcca

SEQ ID NO: 44517 - DNA, 20 bp, human
gaactccagggagacagcgg

SEQ ID NO: 44518 - DNA, 20 bp, human
gagcacagggcaggacgtcg

SEQ ID NO: 44519 - DNA, 20 bp, human
ggtccccatcccgaagcaca

SEQ ID NO: 44520 - DNA, 20 bp, human
gacagggcaggacgtcgcgg

SEQ ID NO: 44521 - DNA, 20 bp, human
gtggggaagcgaggagtccg

SEQ ID NO: 44522 - DNA, 20 bp, human
ggcgatcgcccagattgcac

SEQ ID NO: 44523 - DNA, 20 bp, human
gggaggtcaggggaagtacg

SEQ ID NO: 44524 - DNA, 20 bp, human
gaggacgtcgcggcggagtg

SEQ ID NO: 44525 - DNA, 20 bp, human
gtccgtggccgagagcttgg

SEQ ID NO: 44526 - DNA, 20 bp, human
gagatgggcaggatcaaagt

SEQ ID NO: 44527 - DNA, 20 bp, human
gaggagatgctgttcatcta

SEQ ID NO: 44528 - DNA, 20 bp, human
gaagaccaagccatcggatg

SEQ ID NO: 44529 - DNA, 20 bp, human
gctgtgggcgacataaatac

SEQ ID NO: 44530 - DNA, 20 bp, human
gttcagcttctgccctagat

SEQ ID NO: 44531 - DNA, 20 bp, human
gtgcagagcgggggttggaa

SEQ ID NO: 44532 - DNA, 20 bp, human
gcctggccaagcctgatgtc

SEQ ID NO: 44533 - DNA, 20 bp, human
gacagcatctcctcatccga

SEQ ID NO: 44534 - DNA, 20 bp, human
gggtatggtgatggttcctg

SEQ ID NO: 44535 - DNA, 20 bp, human
gatacaggtatgcagagcgg

SEQ ID NO: 44536 - DNA, 20 bp, human
gcgctgcagaggctccgagg

SEQ ID NO: 44537 - DNA, 20 bp, human
gtcggctcgcgacgctgcag

SEQ ID NO: 44538 - DNA, 20 bp, human
gccaaggcgcgcggtgggag

SEQ ID NO: 44539 - DNA, 20 bp, human
gtacgaggaggtgatccgag

SEQ ID NO: 44540 - DNA, 20 bp, human
gcggggcgggagagaaacaa

SEQ ID NO: 44541 - DNA, 20 bp, human
gcgcgagccgagcgagccag

SEQ ID NO: 44542 - DNA, 20 bp, human
gcggcggcgcggggacaaag

SEQ ID NO: 44543 - DNA, 20 bp, human
gcctcccccggcgcgcacaa

SEQ ID NO: 44544 - DNA, 20 bp, human
gctgctggcggcttacgagg

SEQ ID NO: 44545 - DNA, 20 bp, human
gggccgaacggacagacgcg

SEQ ID NO: 44546 - DNA, 20 bp, human
gcagctcggggtcgtccggc

SEQ ID NO: 44547 - DNA, 20 bp, human
gtgcggggaagcgctgcgcg

SEQ ID NO: 44548 - DNA, 20 bp, human
gccgggcgccccaacagctg

SEQ ID NO: 44549 - DNA, 20 bp, human
ggactcccgggagcggcgaa

SEQ ID NO: 44550 - DNA, 20 bp, human
gctccgggcgcagcgcatcg

SEQ ID NO: 44551 - DNA, 20 bp, human
gactcacagagcgccctgga

SEQ ID NO: 44552 - DNA, 20 bp, human
gtgcggcagcgactcggccc

SEQ ID NO: 44553 - DNA, 20 bp, human
gcaagccagccggtgacccg

SEQ ID NO: 44554 - DNA, 20 bp, human
gcatcggggcagcaaccggg

SEQ ID NO: 44555 - DNA, 20 bp, human
gcgggagcgcagagaacaag

SEQ ID NO: 44556 - DNA, 20 bp, human
ggggctgcggatcaagaagt

SEQ ID NO: 44557 - DNA, 20 bp, human
gagagggccaagaaaaccag

SEQ ID NO: 44558 - DNA, 20 bp, human
gagccaggggccccactgtt

SEQ ID NO: 44559 - DNA, 20 bp, human
ggcagccagcatcccaacag

SEQ ID NO: 44560 - DNA, 20 bp, human
gaaggggaaagaggtcacca

SEQ ID NO: 44561 - DNA, 20 bp, human
gcgagatgcagatgggacag

SEQ ID NO: 44562 - DNA, 20 bp, human
ggatgagatactacctatgg

SEQ ID NO: 44563 - DNA, 20 bp, human
gtcccaagttagaagcatag

SEQ ID NO: 44564 - DNA, 20 bp, human
ggcagctccgccttcgggag

SEQ ID NO: 44565 - DNA, 20 bp, human
gtgtggcactctctcccctc

SEQ ID NO: 44566 - DNA, 20 bp, human
ggaaggagctgtcccccggg

SEQ ID NO: 44567 - DNA, 20 bp, human
ggcgcctccagggctcccgg

SEQ ID NO: 44568 - DNA, 20 bp, human
gcagtctcgtgagatcggtg

SEQ ID NO: 44569 - DNA, 20 bp, human
gcctataggtactggaaagg

SEQ ID NO: 44570 - DNA, 20 bp, human
gggacggactgagtcagagg

SEQ ID NO: 44571 - DNA, 20 bp, human
gcagggcccgtcggtccccc

SEQ ID NO: 44572 - DNA, 20 bp, human
ggaggggaccggagcacgag

SEQ ID NO: 44573 - DNA, 20 bp, human
ggggctcccgggggaccgac

SEQ ID NO: 44574 - DNA, 20 bp, human
gaggcgtcggcggaggacgg

SEQ ID NO: 44575 - DNA, 20 bp, human
ggactgaaggagctgtcccc

SEQ ID NO: 44576 - DNA, 20 bp, human
gaagcccgcgaagcccacag

SEQ ID NO: 44577 - DNA, 20 bp, human
ggtcgctcgccacccactgt

SEQ ID NO: 44578 - DNA, 20 bp, human
gccaggccgaggatccaaca

SEQ ID NO: 44579 - DNA, 20 bp, human
ggaagctagcaagcacgacc

SEQ ID NO: 44580 - DNA, 20 bp, human
gccagacagacccacccctg

SEQ ID NO: 44581 - DNA, 20 bp, human
gttgcagcgctggcccgttc

SEQ ID NO: 44582 - DNA, 20 bp, human
gcatggcggcgaacctgagc

SEQ ID NO: 44583 - DNA, 20 bp, human
gggcgaacctgagccggaac

SEQ ID NO: 44584 - DNA, 20 bp, human
gagcaagcacgaccaggccg

SEQ ID NO: 44585 - DNA, 20 bp, human
ggtgggtggcgagcgacagg

SEQ ID NO: 44586 - DNA, 20 bp, human
ggggccgcccagcagcagag

SEQ ID NO: 44587 - DNA, 20 bp, human
gctgcagctctcgcaacgga

SEQ ID NO: 44588 - DNA, 20 bp, human
gcatgaacccgtgagcctgg

SEQ ID NO: 44589 - DNA, 20 bp, human
gtggacgagtgtctgcccag

SEQ ID NO: 44590 - DNA, 20 bp, human
gttgcaaccgagggtgagag

SEQ ID NO: 44591 - DNA, 20 bp, human
gaaatctgcagctctcgcaa

SEQ ID NO: 44592 - DNA, 20 bp, human
gccgagaggtgtgcgcggag

SEQ ID NO: 44593 - DNA, 20 bp, human
gggctcacgggttcatggag

SEQ ID NO: 44594 - DNA, 20 bp, human
gtctacaaggtgggcgagcc

SEQ ID NO: 44595 - DNA, 20 bp, human
gtccgaagtgggtgagatgg

SEQ ID NO: 44596 - DNA, 20 bp, human
gcgatcagtcggtcctgggc

SEQ ID NO: 44597 - DNA, 20 bp, human
ggacgctggcgctggcagag

SEQ ID NO: 44598 - DNA, 20 bp, human
gggtgcctaactgaatacag

SEQ ID NO: 44599 - DNA, 20 bp, human
gggagtctacacccaggcgg

SEQ ID NO: 44600 - DNA, 20 bp, human
gctgggctggctgtggtgta

SEQ ID NO: 44601 - DNA, 20 bp, human
gtgagcgatcagtcggtcct

SEQ ID NO: 44602 - DNA, 20 bp, human
gcaggcggtgcgcaacgagg

SEQ ID NO: 44603 - DNA, 20 bp, human
gctgtggtgtagggcgttgc

SEQ ID NO: 44604 - DNA, 20 bp, human
gtttgcaggagtctacaccc

SEQ ID NO: 44605 - DNA, 20 bp, human
ggacaggatctaagggaaac

SEQ ID NO: 44606 - DNA, 20 bp, human
ggcgtccagggcacgcgtga

SEQ ID NO: 44607 - DNA, 20 bp, human
gtcgctgcagaagcgcttcc

SEQ ID NO: 44608 - DNA, 20 bp, human
ggaagctggtaagcacgttt

SEQ ID NO: 44609 - DNA, 20 bp, human
gaacctggagcaggaatgcg

SEQ ID NO: 44610 - DNA, 20 bp, human
gagtccgtatgctgagaacc

SEQ ID NO: 44611 - DNA, 20 bp, human
gcgagtcgaccagtctggag

SEQ ID NO: 44612 - DNA, 20 bp, human
gaccagtgtttggcatactg

SEQ ID NO: 44613 - DNA, 20 bp, human
gcggagcgagtcgaccagtc

SEQ ID NO: 44614 - DNA, 20 bp, human
gcagggcacgcgtgatggag

SEQ ID NO: 44615 - DNA, 20 bp, human
ggggatgcatgcaaaataaa

SEQ ID NO: 44616 - DNA, 20 bp, human
gctcgacgagaggaccacgg

SEQ ID NO: 44617 - DNA, 20 bp, human
ggactcgcagacgcccaagt

SEQ ID NO: 44618 - DNA, 20 bp, human
gcgggtcccggcagccgacg

SEQ ID NO: 44619 - DNA, 20 bp, human
gaggtccgaggcccccgtgt

SEQ ID NO: 44620 - DNA, 20 bp, human
gactggggcagcgtcaaggt

SEQ ID NO: 44621 - DNA, 20 bp, human
gcaagagagaggacactgtg

SEQ ID NO: 44622 - DNA, 20 bp, human
gcgtgggccgcaggaggcta

SEQ ID NO: 44623 - DNA, 20 bp, human
gcggcggagagccgccccgt

SEQ ID NO: 44624 - DNA, 20 bp, human
gccacggccctcaccgacac

SEQ ID NO: 44625 - DNA, 20 bp, human
gggcgtctgcgagtcctccg

SEQ ID NO: 44626 - DNA, 20 bp, human
gagtccgccgccgtcccggg

SEQ ID NO: 44627 - DNA, 20 bp, human
ggaaaggccacccgggacgg

SEQ ID NO: 44628 - DNA, 20 bp, human
gcgcgctccagccctgcggg

SEQ ID NO: 44629 - DNA, 20 bp, human
ggcgccctacggaacgcggt

SEQ ID NO: 44630 - DNA, 20 bp, human
gccggcggggctaacttgtt

SEQ ID NO: 44631 - DNA, 20 bp, human
ggcagggaggaaaggccacc

SEQ ID NO: 44632 - DNA, 20 bp, human
gcggggcgccctacggaacg

SEQ ID NO: 44633 - DNA, 20 bp, human
gagcctcgcactgtccgcag

SEQ ID NO: 44634 - DNA, 20 bp, human
gctgcggggcacagctttag

SEQ ID NO: 44635 - DNA, 20 bp, human
gcgcccggctttggcaacct

SEQ ID NO: 44636 - DNA, 20 bp, human
gagtcccgggaacggaggta

SEQ ID NO: 44637 - DNA, 20 bp, human
gggccgctgcacgccggaag

SEQ ID NO: 44638 - DNA, 20 bp, human
gggccgatccgtcccctcca

SEQ ID NO: 44639 - DNA, 20 bp, human
gggagccgacgccccacgag

SEQ ID NO: 44640 - DNA, 20 bp, human
gcatcagccccgggatgtag

SEQ ID NO: 44641 - DNA, 20 bp, human
ggaaccgtagaggctagtca

SEQ ID NO: 44642 - DNA, 20 bp, human
gtggcgctaggctgttcggg

SEQ ID NO: 44643 - DNA, 20 bp, human
gactgcagggccaagagccg

SEQ ID NO: 44644 - DNA, 20 bp, human
gccgggccgccggcacggag

SEQ ID NO: 44645 - DNA, 20 bp, human
gccaagagccggggccgaca

SEQ ID NO: 44646 - DNA, 20 bp, human
ggagcggttggccaacgcag

SEQ ID NO: 44647 - DNA, 20 bp, human
ggaagcgcgtgacggaggag

SEQ ID NO: 44648 - DNA, 20 bp, human
gtgacgagcgaagcgcgtga

SEQ ID NO: 44649 - DNA, 20 bp, human
gcacccccggcgcaccacgt

SEQ ID NO: 44650 - DNA, 20 bp, human
gcgagcgaagcgcgtgacgg

SEQ ID NO: 44651 - DNA, 20 bp, human
gctcatggcgtacacacccc

SEQ ID NO: 44652 - DNA, 20 bp, human
ggaccaatcgaaatccctct

SEQ ID NO: 44653 - DNA, 20 bp, human
gccagtccggggacttcgat

SEQ ID NO: 44654 - DNA, 20 bp, human
gcgagggtctttgagtccta

SEQ ID NO: 44655 - DNA, 20 bp, human
gttcgattggtcggtcagag

SEQ ID NO: 44656 - DNA, 20 bp, human
gcttgagccgggaaagggaa

SEQ ID NO: 44657 - DNA, 20 bp, human
gagaatgagcggctttccga

SEQ ID NO: 44658 - DNA, 20 bp, human
gaaggggaagcgagaatgag

SEQ ID NO: 44659 - DNA, 20 bp, human
ggcggccccgcagccacatg

SEQ ID NO: 44660 - DNA, 20 bp, human
gaaatggcccggacccggag

SEQ ID NO: 44661 - DNA, 20 bp, human
gaaggacttgagccgggaaa

SEQ ID NO: 44662 - DNA, 20 bp, human
ggatcctgcgacgggaatcg

SEQ ID NO: 44663 - DNA, 20 bp, human
gtccttgcaggctctgccgt

SEQ ID NO: 44664 - DNA, 20 bp, human
gagcctgcaaggacggcgag

SEQ ID NO: 44665 - DNA, 20 bp, human
gctactttccgggccatagt

SEQ ID NO: 44666 - DNA, 20 bp, human
ggtgcagacctaggcgaagg

SEQ ID NO: 44667 - DNA, 20 bp, human
ggcggggctacgcggtacag

SEQ ID NO: 44668 - DNA, 20 bp, human
gggcgcggcagtggcggacc

SEQ ID NO: 44669 - DNA, 20 bp, human
gcggagcgccaactggagct

SEQ ID NO: 44670 - DNA, 20 bp, human
gcactatctgaaggttcggg

SEQ ID NO: 44671 - DNA, 20 bp, human
ggagctgggcacggtcaaca

SEQ ID NO: 44672 - DNA, 20 bp, human
gtgagagcaaagtcagcgtg

SEQ ID NO: 44673 - DNA, 20 bp, human
ggcacttcccgccttcgcct

SEQ ID NO: 44674 - DNA, 20 bp, human
gtcgatggcgcactatctga

SEQ ID NO: 44675 - DNA, 20 bp, human
ggcagtggcggaccgggtga

SEQ ID NO: 44676 - DNA, 20 bp, human
ggtgcagacctaggcgagag

SEQ ID NO: 44677 - DNA, 20 bp, human
gcgaagcgcggcggcaaggg

SEQ ID NO: 44678 - DNA, 20 bp, human
ggcgggagcgaagtcagtgt

SEQ ID NO: 44679 - DNA, 20 bp, human
ggggcgaagcgcggcggcaa

SEQ ID NO: 44680 - DNA, 20 bp, human
ggcctgacgtagcagagccg

SEQ ID NO: 44681 - DNA, 20 bp, human
gggaagagtgtctgtctgga

SEQ ID NO: 44682 - DNA, 20 bp, human
gtagcggcggcggacggaga

SEQ ID NO: 44683 - DNA, 20 bp, human
gggagcgaagtcagtgtggg

SEQ ID NO: 44684 - DNA, 20 bp, human
gccgccgccacggccaacac

SEQ ID NO: 44685 - DNA, 20 bp, human
gggctggtgcactatctgaa

SEQ ID NO: 44686 - DNA, 20 bp, human
gcggtgggcggaactcctag

SEQ ID NO: 44687 - DNA, 20 bp, human
gcttccggccggactccacg

SEQ ID NO: 44688 - DNA, 20 bp, human
gcctagaacggaaaagacgg

SEQ ID NO: 44689 - DNA, 20 bp, human
gcgggccccgagcctatgac

SEQ ID NO: 44690 - DNA, 20 bp, human
gactcctagcggacacctcg

SEQ ID NO: 44691 - DNA, 20 bp, human
gggagactctagtactgagg

SEQ ID NO: 44692 - DNA, 20 bp, human
gtactgagggggcaagaacg

SEQ ID NO: 44693 - DNA, 20 bp, human
gacacctcgtggagtccggc

SEQ ID NO: 44694 - DNA, 20 bp, human
gcacctccgggaccaacgag

SEQ ID NO: 44695 - DNA, 20 bp, human
gcagggcggagactcgggag

SEQ ID NO: 44696 - DNA, 20 bp, human
ggagggcgttcgcggggtga

SEQ ID NO: 44697 - DNA, 20 bp, human
gtgaggcctggagccggagt

SEQ ID NO: 44698 - DNA, 20 bp, human
gcggagggaggcgaccccag

SEQ ID NO: 44699 - DNA, 20 bp, human
ggcccagctcgaaatcggag

SEQ ID NO: 44700 - DNA, 20 bp, human
gagaggccgcagggagaatc

SEQ ID NO: 44701 - DNA, 20 bp, human
gtccattatggagcaaccat

SEQ ID NO: 44702 - DNA, 20 bp, human
gcggttgctccggaagtgga

SEQ ID NO: 44703 - DNA, 20 bp, human
gcgaaatcggagcggaacag

SEQ ID NO: 44704 - DNA, 20 bp, human
gatggcgcccagctcgaaat

SEQ ID NO: 44705 - DNA, 20 bp, human
gttgctccggaagtggaggg

SEQ ID NO: 44706 - DNA, 20 bp, human
gtaggcctggctgggtcgtg

SEQ ID NO: 44707 - DNA, 20 bp, human
gagtggccttgccaccggag

SEQ ID NO: 44708 - DNA, 20 bp, human
gccttgccaccggaggggaa

SEQ ID NO: 44709 - DNA, 20 bp, human
gcgtcggcgcgggagctgag

SEQ ID NO: 44710 - DNA, 20 bp, human
gactcggccggaagtagcgt

SEQ ID NO: 44711 - DNA, 20 bp, human
gacagctgcacatctagaaa

SEQ ID NO: 44712 - DNA, 20 bp, human
gagcggagtggccttgccac

SEQ ID NO: 44713 - DNA, 20 bp, human
gagggcgtgcaggcagtccg

SEQ ID NO: 44714 - DNA, 20 bp, human
gctcgcagtcggcttcacca

SEQ ID NO: 44715 - DNA, 20 bp, human
ggcgtcgtctcccttctcag

SEQ ID NO: 44716 - DNA, 20 bp, human
ggaagccgggctgcctcacg

SEQ ID NO: 44717 - DNA, 20 bp, human
ggccggagccgctctctcac

SEQ ID NO: 44718 - DNA, 20 bp, human
ggcgggcagggagcacccga

SEQ ID NO: 44719 - DNA, 20 bp, human
gcccagggaaagctgacacg

SEQ ID NO: 44720 - DNA, 20 bp, human
gaggcagcccggcttctccc

SEQ ID NO: 44721 - DNA, 20 bp, human
gcggagcgtcgcactgtcag

SEQ ID NO: 44722 - DNA, 20 bp, human
gacatttcccggtgagagag

SEQ ID NO: 44723 - DNA, 20 bp, human
gtagttcctagtgcctcgtg

SEQ ID NO: 44724 - DNA, 20 bp, human
ggcccgcaggatgcccaggt

SEQ ID NO: 44725 - DNA, 20 bp, human
gcgacgcaggcgtggtgcag

SEQ ID NO: 44726 - DNA, 20 bp, human
gtcccttccggattcccctc

SEQ ID NO: 44727 - DNA, 20 bp, human
gagcgaagcgtgcaaggacc

SEQ ID NO: 44728 - DNA, 20 bp, human
gcggcgccaccgggcctagg

SEQ ID NO: 44729 - DNA, 20 bp, human
gagccggaggggaatccgga

SEQ ID NO: 44730 - DNA, 20 bp, human
gggcgcggcgaggaaggcca

SEQ ID NO: 44731 - DNA, 20 bp, human
gcaggtcagcataacaggtt

SEQ ID NO: 44732 - DNA, 20 bp, human
gagctgccacctaggcccgg

SEQ ID NO: 44733 - DNA, 20 bp, human
gcccacccgacacctggcgg

SEQ ID NO: 44734 - DNA, 20 bp, human
gccagcccccgccaggtgtc

SEQ ID NO: 44735 - DNA, 20 bp, human
gcagcataacaggttaggtg

SEQ ID NO: 44736 - DNA, 20 bp, human
gaacattccgcaggaggaaa

SEQ ID NO: 44737 - DNA, 20 bp, human
ggaaaggctgcgactcctcg

SEQ ID NO: 44738 - DNA, 20 bp, human
gtgggcctcgctgaaccagt

SEQ ID NO: 44739 - DNA, 20 bp, human
gctctacgtccccaaccgga

SEQ ID NO: 44740 - DNA, 20 bp, human
ggtcacgaggaacattccgc

SEQ ID NO: 44741 - DNA, 20 bp, human
gcagaacgtgagagtccaac

SEQ ID NO: 44742 - DNA, 20 bp, human
gtgaaaaaggtagccagaat

SEQ ID NO: 44743 - DNA, 20 bp, human
ggggacttcaccttccggtt

SEQ ID NO: 44744 - DNA, 20 bp, human
gcacgtacacgtggaacgaa

SEQ ID NO: 44745 - DNA, 20 bp, human
ggaaggtgaagtccctgtgc

SEQ ID NO: 44746 - DNA, 20 bp, human
gggatgttctccctcctgag

SEQ ID NO: 44747 - DNA, 20 bp, human
ggaacatccgccgaacgaaa

SEQ ID NO: 44748 - DNA, 20 bp, human
ggacagaacttcccctcagg

SEQ ID NO: 44749 - DNA, 20 bp, human
gcacgaagcacagcagaagg

SEQ ID NO: 44750 - DNA, 20 bp, human
ggggtatacccggagctcag

SEQ ID NO: 44751 - DNA, 20 bp, human
gttccgattagggacgtaga

SEQ ID NO: 44752 - DNA, 20 bp, human
ggttctgtcccgggagtaag

SEQ ID NO: 44753 - DNA, 20 bp, human
ggaatccaagtgattcagtg

SEQ ID NO: 44754 - DNA, 20 bp, human
gctgcttcctcgagcagtcg

SEQ ID NO: 44755 - DNA, 20 bp, human
gaaccctctacgtccctaat

SEQ ID NO: 44756 - DNA, 20 bp, human
ggaggtgtgcagacactcgg

SEQ ID NO: 44757 - DNA, 20 bp, human
gaccttcccaccgcagaagg

SEQ ID NO: 44758 - DNA, 20 bp, human
gccccgcgctgcgatccgga

SEQ ID NO: 44759 - DNA, 20 bp, human
gcgcagaagggggtagagaa

SEQ ID NO: 44760 - DNA, 20 bp, human
gccattgttggagaattcaa

SEQ ID NO: 44761 - DNA, 20 bp, human
gggctggttaaagaaccatc

SEQ ID NO: 44762 - DNA, 20 bp, human
gagccatggcaggcagagcg

SEQ ID NO: 44763 - DNA, 20 bp, human
ggggggcagcatgaggtcag

SEQ ID NO: 44764 - DNA, 20 bp, human
gcggcggttccagcatgaag

SEQ ID NO: 44765 - DNA, 20 bp, human
gctccccccgcgctgcgatc

SEQ ID NO: 44766 - DNA, 20 bp, human
ggcgcagcgttagatggcgg

SEQ ID NO: 44767 - DNA, 20 bp, human
ggtctaagaaggagagtatg

SEQ ID NO: 44768 - DNA, 20 bp, human
gaggtcgccgcctagagtgg

SEQ ID NO: 44769 - DNA, 20 bp, human
ggtcccacctccaacagacc

SEQ ID NO: 44770 - DNA, 20 bp, human
gcacgtcccacaacaggtgt

SEQ ID NO: 44771 - DNA, 20 bp, human
gggggcgcccggagactctg

SEQ ID NO: 44772 - DNA, 20 bp, human
gggccgtgggcagaaggtac

SEQ ID NO: 44773 - DNA, 20 bp, human
gagggcgcagcgttagatgg

SEQ ID NO: 44774 - DNA, 20 bp, human
gccccctcccccactctagg

SEQ ID NO: 44775 - DNA, 20 bp, human
gtgttctggttagtctaaga

SEQ ID NO: 44776 - DNA, 20 bp, human
ggatctatgggtccgaaggg

SEQ ID NO: 44777 - DNA, 20 bp, human
gtcatcgcgtagactgtcca

SEQ ID NO: 44778 - DNA, 20 bp, human
ggaaccgctccgtggcccta

SEQ ID NO: 44779 - DNA, 20 bp, human
gcaagctggtttgaaactag

SEQ ID NO: 44780 - DNA, 20 bp, human
gagtccgcaagagggttctg

SEQ ID NO: 44781 - DNA, 20 bp, human
gctagggcgagtccgcaaga

SEQ ID NO: 44782 - DNA, 20 bp, human
gtaacccggaagcggggatg

SEQ ID NO: 44783 - DNA, 20 bp, human
gcggcgacaaacaacgacga

SEQ ID NO: 44784 - DNA, 20 bp, human
gtacgggccgggtcaacagt

SEQ ID NO: 44785 - DNA, 20 bp, human
ggagccgagcctgagatcta

SEQ ID NO: 44786 - DNA, 20 bp, human
ggcctcctacggcaagtcgg

SEQ ID NO: 44787 - DNA, 20 bp, human
gtgtagtgtcggggccgaag

SEQ ID NO: 44788 - DNA, 20 bp, human
ggaggaaggctgtagtgtcg

SEQ ID NO: 44789 - DNA, 20 bp, human
ggccgaagcggacagggaat

SEQ ID NO: 44790 - DNA, 20 bp, human
ggaggaggtcccgcctccta

SEQ ID NO: 44791 - DNA, 20 bp, human
ggtcggggccgaagcggaca

SEQ ID NO: 44792 - DNA, 20 bp, human
gcccgcctcctacggcaagt

SEQ ID NO: 44793 - DNA, 20 bp, human
ggaagcggacagggaattgg

SEQ ID NO: 44794 - DNA, 20 bp, human
gctacagccttcctcagcgg

SEQ ID NO: 44795 - DNA, 20 bp, human
gggacgaggcacacaaggac

SEQ ID NO: 44796 - DNA, 20 bp, human
ggctggccagtgtaagatgg

SEQ ID NO: 44797 - DNA, 20 bp, human
ggcgcaagcgcagagagcgg

SEQ ID NO: 44798 - DNA, 20 bp, human
gatggcggcggcgttggtgg

SEQ ID NO: 44799 - DNA, 20 bp, human
gggccagtgtaagatggcgg

SEQ ID NO: 44800 - DNA, 20 bp, human
gcaggcgcaagcgcagagag

SEQ ID NO: 44801 - DNA, 20 bp, human
ggaaataggagcgcacacat

SEQ ID NO: 44802 - DNA, 20 bp, human
gcgccgccgccatcttacac

SEQ ID NO: 44803 - DNA, 20 bp, human
gccggaacgagacacagacc

SEQ ID NO: 44804 - DNA, 20 bp, human
ggccgtgtccctcaatctaa

SEQ ID NO: 44805 - DNA, 20 bp, human
gcacagaccgggtaggtcaa

SEQ ID NO: 44806 - DNA, 20 bp, human
gcgcctgccccgaggacgga

SEQ ID NO: 44807 - DNA, 20 bp, human
ggaggacggacggtcggaga

SEQ ID NO: 44808 - DNA, 20 bp, human
gcgcatcgtggacacatccg

SEQ ID NO: 44809 - DNA, 20 bp, human
gagcacgcctgccccgagga

SEQ ID NO: 44810 - DNA, 20 bp, human
ggccaacccctaaaagctca

SEQ ID NO: 44811 - DNA, 20 bp, human
gggttacccgttagtgggag

SEQ ID NO: 44812 - DNA, 20 bp, human
gtgccccgaggacggacggt

SEQ ID NO: 44813 - DNA, 20 bp, human
gtatttggttacccgttagt

SEQ ID NO: 44814 - DNA, 20 bp, human
gccccttcagccaatcggat

SEQ ID NO: 44815 - DNA, 20 bp, human
gggagtagcagcggtgacgg

SEQ ID NO: 44816 - DNA, 20 bp, human
gggcgaatgactcgagtcta

SEQ ID NO: 44817 - DNA, 20 bp, human
ggtcttctaaataaccttgt

SEQ ID NO: 44818 - DNA, 20 bp, human
gtctaaataaccttgtgggg

SEQ ID NO: 44819 - DNA, 20 bp, human
gtaccttaaataatactgag

SEQ ID NO: 44820 - DNA, 20 bp, human
gactatctcaaatattaaga

SEQ ID NO: 44821 - DNA, 20 bp, human
gggtaactttcaatcacaga

SEQ ID NO: 44822 - DNA, 20 bp, human
gttccgctcagtattattta

SEQ ID NO: 44823 - DNA, 20 bp, human
gaaaattttacagttgcctg

SEQ ID NO: 44824 - DNA, 20 bp, human
gcaacaatgattttgggagt

SEQ ID NO: 44825 - DNA, 20 bp, human
gatttctcatattgtgcccc

SEQ ID NO: 44826 - DNA, 20 bp, human
gtgtaagcgctgcggagatt

SEQ ID NO: 44827 - DNA, 20 bp, human
gcggcccgcaaagttctaaa

SEQ ID NO: 44828 - DNA, 20 bp, human
ggcggagattgggctagagg

SEQ ID NO: 44829 - DNA, 20 bp, human
gcaaggtcacacaactgaag

SEQ ID NO: 44830 - DNA, 20 bp, human
ggagattgggctagaggcgg

SEQ ID NO: 44831 - DNA, 20 bp, human
ggctgcggagattgggctag

SEQ ID NO: 44832 - DNA, 20 bp, human
gagccggcctgtaagcgctg

SEQ ID NO: 44833 - DNA, 20 bp, human
ggtacccagcgcctccgccg

SEQ ID NO: 44834 - DNA, 20 bp, human
ggcgggcgaggcgggacctc

SEQ ID NO: 44835 - DNA, 20 bp, human
gcgcttacaggccggctcag

SEQ ID NO: 44836 - DNA, 20 bp, human
ggcggccgcccggttcccaa

SEQ ID NO: 44837 - DNA, 20 bp, human
ggaaggggcgcaaggttggt

SEQ ID NO: 44838 - DNA, 20 bp, human
gggagaccacactgctaggg

SEQ ID NO: 44839 - DNA, 20 bp, human
gcagttcaaggtctcatgag

SEQ ID NO: 44840 - DNA, 20 bp, human
ggaaagaaggggcgcaaggt

SEQ ID NO: 44841 - DNA, 20 bp, human
gaggcggggccactgatacc

SEQ ID NO: 44842 - DNA, 20 bp, human
gccacgctttgaggaaagaa

SEQ ID NO: 44843 - DNA, 20 bp, human
gccacactgctagggaggca

SEQ ID NO: 44844 - DNA, 20 bp, human
gccgacccttgggaaccggg

SEQ ID NO: 44845 - DNA, 20 bp, human
gctaggcttccgggtatcag

SEQ ID NO: 44846 - DNA, 20 bp, human
gcagcgactgcgccccgtcc

SEQ ID NO: 44847 - DNA, 20 bp, human
ggcgccgcgctcgtccgcag

SEQ ID NO: 44848 - DNA, 20 bp, human
gccgcgctcgtccgcagagg

SEQ ID NO: 44849 - DNA, 20 bp, human
gcggctcgggatccgtcgag

SEQ ID NO: 44850 - DNA, 20 bp, human
gaagctcggcctcccctcga

SEQ ID NO: 44851 - DNA, 20 bp, human
ggctcgccgcctgccatccg

SEQ ID NO: 44852 - DNA, 20 bp, human
gtagagccggactccgcgga

SEQ ID NO: 44853 - DNA, 20 bp, human
ggaaggaaggagtttggtgg

SEQ ID NO: 44854 - DNA, 20 bp, human
ggagtccggctctacccgcg

SEQ ID NO: 44855 - DNA, 20 bp, human
ggcgggacccgaggcgccag

SEQ ID NO: 44856 - DNA, 20 bp, human
gcgcgccgcgctcctcacca

SEQ ID NO: 44857 - DNA, 20 bp, human
ggcgagcggcgaccctggtg

SEQ ID NO: 44858 - DNA, 20 bp, human
ggcacccgaccaggagacgg

SEQ ID NO: 44859 - DNA, 20 bp, human
ggcagcggcgggagaacaag

SEQ ID NO: 44860 - DNA, 20 bp, human
ggcgcggcgagcggcgaccc

SEQ ID NO: 44861 - DNA, 20 bp, human
gcgctcgccgcgctcacccg

SEQ ID NO: 44862 - DNA, 20 bp, human
gccggacttggggacactgc

SEQ ID NO: 44863 - DNA, 20 bp, human
gtgccagctagccggagccg

SEQ ID NO: 44864 - DNA, 20 bp, human
ggcggcacccgaccaggaga

SEQ ID NO: 44865 - DNA, 20 bp, human
ggacggccgcggcggagcta

SEQ ID NO: 44866 - DNA, 20 bp, human
ggaaggcagcagaggcgcag

SEQ ID NO: 44867 - DNA, 20 bp, human
ggcgctctcacttgttactg

SEQ ID NO: 44868 - DNA, 20 bp, human
gacaaggaaaaaggcttcga

SEQ ID NO: 44869 - DNA, 20 bp, human
gacatccaggagggaccaag

SEQ ID NO: 44870 - DNA, 20 bp, human
gttactggggtgtccgccag

SEQ ID NO: 44871 - DNA, 20 bp, human
gctcccagctcgcacaccgc

SEQ ID NO: 44872 - DNA, 20 bp, human
gggaggaggaggaagccgaa

SEQ ID NO: 44873 - DNA, 20 bp, human
gccagctcgcacaccgctgg

SEQ ID NO: 44874 - DNA, 20 bp, human
ggagatggaaggcaatcctg

SEQ ID NO: 44875 - DNA, 20 bp, human
gcacacgcgccgagcccctt

SEQ ID NO: 44876 - DNA, 20 bp, human
gcgtgggtgggtgaaataat

SEQ ID NO: 44877 - DNA, 20 bp, human
ggtaggaaggaggttgacgt

SEQ ID NO: 44878 - DNA, 20 bp, human
gcctgtgtggagaacctagt

SEQ ID NO: 44879 - DNA, 20 bp, human
gttggagatcttgggatcta

SEQ ID NO: 44880 - DNA, 20 bp, human
gggacacttggaaattgagt

SEQ ID NO: 44881 - DNA, 20 bp, human
ggaaggaggttgacgtgggt

SEQ ID NO: 44882 - DNA, 20 bp, human
gtgggtgaaataatgggcag

SEQ ID NO: 44883 - DNA, 20 bp, human
gcccaagatctccaaggatt

SEQ ID NO: 44884 - DNA, 20 bp, human
ggggccaatcacagactgag

SEQ ID NO: 44885 - DNA, 20 bp, human
gtgtgcaaaagtcttggcag

SEQ ID NO: 44886 - DNA, 20 bp, human
gggtcaccgcttctatggag

SEQ ID NO: 44887 - DNA, 20 bp, human
gagacttagagcgaagccaa

SEQ ID NO: 44888 - DNA, 20 bp, human
gtcacagtttgggaacttac

SEQ ID NO: 44889 - DNA, 20 bp, human
ggttcccaaactgtgaagaa

SEQ ID NO: 44890 - DNA, 20 bp, human
gtaaccggtcaccgcttcta

SEQ ID NO: 44891 - DNA, 20 bp, human
gcaccccgacgcggtctcta

SEQ ID NO: 44892 - DNA, 20 bp, human
gctcagggtacggtaaacgg

SEQ ID NO: 44893 - DNA, 20 bp, human
gccgcacatctagccctacc

SEQ ID NO: 44894 - DNA, 20 bp, human
gaaacgccactccatagaag

SEQ ID NO: 44895 - DNA, 20 bp, human
gggaactgtagggacgagag

SEQ ID NO: 44896 - DNA, 20 bp, human
gcgcctaggcgtccacccag

SEQ ID NO: 44897 - DNA, 20 bp, human
gggccagcggggaagatgag

SEQ ID NO: 44898 - DNA, 20 bp, human
ggagaaactgacgaatccac

SEQ ID NO: 44899 - DNA, 20 bp, human
gtagaccagatccagagcgg

SEQ ID NO: 44900 - DNA, 20 bp, human
gtcctgaaggaggtgaccgg

SEQ ID NO: 44901 - DNA, 20 bp, human
gtcctagtgtctcctctggg

SEQ ID NO: 44902 - DNA, 20 bp, human
gagcggcctcaccgcaccca

SEQ ID NO: 44903 - DNA, 20 bp, human
gcagagcgggggcaattacg

SEQ ID NO: 44904 - DNA, 20 bp, human
gcctgctacgggcagaatca

SEQ ID NO: 44905 - DNA, 20 bp, human
gagctcctagtgtctcctct

SEQ ID NO: 44906 - DNA, 20 bp, human
gtctgactgaggatacacta

SEQ ID NO: 44907 - DNA, 20 bp, human
gcaagagggtagtggtgtac

SEQ ID NO: 44908 - DNA, 20 bp, human
ggaagaatgggtccccattc

SEQ ID NO: 44909 - DNA, 20 bp, human
gggtagtggtgtaccggaat

SEQ ID NO: 44910 - DNA, 20 bp, human
gtggcagacttgaagaacag

SEQ ID NO: 44911 - DNA, 20 bp, human
gagcctagcaagggaggtaa

SEQ ID NO: 44912 - DNA, 20 bp, human
gactgaggatacactatggc

SEQ ID NO: 44913 - DNA, 20 bp, human
gtcgcagaggaaggcctcca

SEQ ID NO: 44914 - DNA, 20 bp, human
gaagaacagagggcagtatg

SEQ ID NO: 44915 - DNA, 20 bp, human
gagaggaaggcctccatggt

SEQ ID NO: 44916 - DNA, 20 bp, human
ggcgggcggcaagtacgtgg

SEQ ID NO: 44917 - DNA, 20 bp, human
gcagccgctggcgcaggacg

SEQ ID NO: 44918 - DNA, 20 bp, human
ggctggagcggacctcccgt

SEQ ID NO: 44919 - DNA, 20 bp, human
gcgctggcgcaggacgggga

SEQ ID NO: 44920 - DNA, 20 bp, human
gggaggtccgctccagccgc

SEQ ID NO: 44921 - DNA, 20 bp, human
gaggcccgggcaccgccgac

SEQ ID NO: 44922 - DNA, 20 bp, human
ggcacccggtgcccacgcgt

SEQ ID NO: 44923 - DNA, 20 bp, human
gacggggacccgttctacgt

SEQ ID NO: 44924 - DNA, 20 bp, human
gggctggacgcgctgcaggc

SEQ ID NO: 44925 - DNA, 20 bp, human
gacgcccgccaagaccatcg

SEQ ID NO: 44926 - DNA, 20 bp, human
gcaggccaggactccaagct

SEQ ID NO: 44927 - DNA, 20 bp, human
ggcagcctagcttggagtcc

SEQ ID NO: 44928 - DNA, 20 bp, human
gcactcaaatgagaccttat

SEQ ID NO: 44929 - DNA, 20 bp, human
gggactgcctcactgggtct

SEQ ID NO: 44930 - DNA, 20 bp, human
gtcaggttggtatctatctt

SEQ ID NO: 44931 - DNA, 20 bp, human
gcaagacaggctacttaaca

SEQ ID NO: 44932 - DNA, 20 bp, human
gatttgctcttagaaagaca

SEQ ID NO: 44933 - DNA, 20 bp, human
gtattcaagctttccaggcc

SEQ ID NO: 44934 - DNA, 20 bp, human
gatgaaagatctgacttcca

SEQ ID NO: 44935 - DNA, 20 bp, human
gtttggcaggactgcctcac

SEQ ID NO: 44936 - DNA, 20 bp, human
gggcggcgcccgggcgtcag

SEQ ID NO: 44937 - DNA, 20 bp, human
gtctgagccggagacaatgg

SEQ ID NO: 44938 - DNA, 20 bp, human
gcagcggacggaccgatcga

SEQ ID NO: 44939 - DNA, 20 bp, human
ggcggagctcgcatcctcgg

SEQ ID NO: 44940 - DNA, 20 bp, human
gggtccgtccgctgacgccc

SEQ ID NO: 44941 - DNA, 20 bp, human
gccaagggcgcgcggaccga

SEQ ID NO: 44942 - DNA, 20 bp, human
ggcagcggagctcgcatcct

SEQ ID NO: 44943 - DNA, 20 bp, human
ggaggcccgcgatcccctcc

SEQ ID NO: 44944 - DNA, 20 bp, human
ggctcgcatcctcggcgggg

SEQ ID NO: 44945 - DNA, 20 bp, human
gcgggcgtgaacgtgagcgt

SEQ ID NO: 44946 - DNA, 20 bp, human
gctatgaaaatattcggtca

SEQ ID NO: 44947 - DNA, 20 bp, human
gtagtattcttacaggtatc

SEQ ID NO: 44948 - DNA, 20 bp, human
gtgacaaacaaattcatgag

SEQ ID NO: 44949 - DNA, 20 bp, human
gagctcagaagtaaattctt

SEQ ID NO: 44950 - DNA, 20 bp, human
gcttcagggaaataaagcct

SEQ ID NO: 44951 - DNA, 20 bp, human
gtagctaagtatttcttcca

SEQ ID NO: 44952 - DNA, 20 bp, human
gtacctctgagatttcacaa

SEQ ID NO: 44953 - DNA, 20 bp, human
gttgctttgttgtttacata

SEQ ID NO: 44954 - DNA, 20 bp, human
gattttcatagtattcttac

SEQ ID NO: 44955 - DNA, 20 bp, human
gttacatatgagattcatac

SEQ ID NO: 44956 - DNA, 20 bp, human
gaagaggttccggagtcggg

SEQ ID NO: 44957 - DNA, 20 bp, human
gtcacgtgaaggccggggcg

SEQ ID NO: 44958 - DNA, 20 bp, human
gacgcaaggctggggtgtcg

SEQ ID NO: 44959 - DNA, 20 bp, human
ggagggccgaggggcagcta

SEQ ID NO: 44960 - DNA, 20 bp, human
gcccgtggagcgggaggtaa

SEQ ID NO: 44961 - DNA, 20 bp, human
gagggagcgcggcttgagga

SEQ ID NO: 44962 - DNA, 20 bp, human
gctgggccgccacaagacta

SEQ ID NO: 44963 - DNA, 20 bp, human
gctctgcagcaactcggtga

SEQ ID NO: 44964 - DNA, 20 bp, human
gcggtccccggggtcagact

SEQ ID NO: 44965 - DNA, 20 bp, human
ggtgcgcgcactggagctcg

SEQ ID NO: 44966 - DNA, 20 bp, human
gcgccctcctctggagagag

SEQ ID NO: 44967 - DNA, 20 bp, human
gagcctctctctccagagga

SEQ ID NO: 44968 - DNA, 20 bp, human
ggcgcggccacaaagacccc

SEQ ID NO: 44969 - DNA, 20 bp, human
gcggccacaaagacccccgg

SEQ ID NO: 44970 - DNA, 20 bp, human
gccagcctggcccgacccgg

SEQ ID NO: 44971 - DNA, 20 bp, human
gccgcccgcagttcctcgaa

SEQ ID NO: 44972 - DNA, 20 bp, human
gccatggcaccaaacaaaag

SEQ ID NO: 44973 - DNA, 20 bp, human
ggcactagtggccgcaaccg

SEQ ID NO: 44974 - DNA, 20 bp, human
gcccgcagctcccgtcccca

SEQ ID NO: 44975 - DNA, 20 bp, human
ggcccgtcctcattgaaatg

SEQ ID NO: 44976 - DNA, 20 bp, human
gcggccctctcagccccgaa

SEQ ID NO: 44977 - DNA, 20 bp, human
gtcgcactggacaatgacct

SEQ ID NO: 44978 - DNA, 20 bp, human
gccgcgctccagggaaggaa

SEQ ID NO: 44979 - DNA, 20 bp, human
gtagggccgcgctccaggga

SEQ ID NO: 44980 - DNA, 20 bp, human
gcttaacgcgccgggacacc

SEQ ID NO: 44981 - DNA, 20 bp, human
ggcgtgggagaggcccccgg

SEQ ID NO: 44982 - DNA, 20 bp, human
gaacggcgcgcgctgcccgg

SEQ ID NO: 44983 - DNA, 20 bp, human
ggcgccgggacacctggctc

SEQ ID NO: 44984 - DNA, 20 bp, human
gtcccgctcgggagccgacc

SEQ ID NO: 44985 - DNA, 20 bp, human
gcgaccgggagaggcaaagt

SEQ ID NO: 44986 - DNA, 20 bp, human
gtctacagctgagataaaaa

SEQ ID NO: 44987 - DNA, 20 bp, human
gtaatacaggagccctctca

SEQ ID NO: 44988 - DNA, 20 bp, human
gcaaagtgaactgaccttca

SEQ ID NO: 44989 - DNA, 20 bp, human
gcaggagccctctcacggtg

SEQ ID NO: 44990 - DNA, 20 bp, human
ggtcaggcctcaccgtgaga

SEQ ID NO: 44991 - DNA, 20 bp, human
gacttacagttagttccacg

SEQ ID NO: 44992 - DNA, 20 bp, human
ggagttgtgtttacagagtc

SEQ ID NO: 44993 - DNA, 20 bp, human
gaagatctgatggttacatc

SEQ ID NO: 44994 - DNA, 20 bp, human
gcagttcactttggggtagc

SEQ ID NO: 44995 - DNA, 20 bp, human
gctaccatggaacagtatgg

SEQ ID NO: 44996 - DNA, 20 bp, human
gctgccactcggcaccccaa

SEQ ID NO: 44997 - DNA, 20 bp, human
gatgccaaaagataagggag

SEQ ID NO: 44998 - DNA, 20 bp, human
ggttcccgccaagaccctaa

SEQ ID NO: 44999 - DNA, 20 bp, human
gccctaaaggtaaagcgggt

SEQ ID NO: 45000 - DNA, 20 bp, human
gagcatccgccgattcgaca

SEQ ID NO: 45001 - DNA, 20 bp, human
ggggcggtgagggtccttga

SEQ ID NO: 45002 - DNA, 20 bp, human
gtggccaccttcggaaccat

SEQ ID NO: 45003 - DNA, 20 bp, human
gcagtgccgtgtcgaatcgg

SEQ ID NO: 45004 - DNA, 20 bp, human
gcaagaccctaaaggtaaag

SEQ ID NO: 45005 - DNA, 20 bp, human
ggtccacctgactcaaaacg

SEQ ID NO: 45006 - DNA, 20 bp, human
gcccgctggagcccaaatcg

SEQ ID NO: 45007 - DNA, 20 bp, human
gcccgtggagaagatcccac

SEQ ID NO: 45008 - DNA, 20 bp, human
ggctggagcccaaatcgcgg

SEQ ID NO: 45009 - DNA, 20 bp, human
gacagggccagagaccctaa

SEQ ID NO: 45010 - DNA, 20 bp, human
gtgcactcggaccacaccgt

SEQ ID NO: 45011 - DNA, 20 bp, human
gctgcgtgaggcttccacaa

SEQ ID NO: 45012 - DNA, 20 bp, human
gcaggtgctagacaggccca

SEQ ID NO: 45013 - DNA, 20 bp, human
gtcatgctggggcaagaaca

SEQ ID NO: 45014 - DNA, 20 bp, human
gcaaagcgcgcgctgcaggg

SEQ ID NO: 45015 - DNA, 20 bp, human
gatcaggaccccattcatgg

SEQ ID NO: 45016 - DNA, 20 bp, human
gcgccgccgatcccagagtc

SEQ ID NO: 45017 - DNA, 20 bp, human
ggtggccgatgatcagagat

SEQ ID NO: 45018 - DNA, 20 bp, human
ggggtcccggactctgggat

SEQ ID NO: 45019 - DNA, 20 bp, human
gggaagtggcggcgcggtca

SEQ ID NO: 45020 - DNA, 20 bp, human
gagcggtctatggagatagt

SEQ ID NO: 45021 - DNA, 20 bp, human
gcatggtagcgaggctctga

SEQ ID NO: 45022 - DNA, 20 bp, human
gctggccttggcttcagctg

SEQ ID NO: 45023 - DNA, 20 bp, human
gtgtggtcaacgcggcgtaa

SEQ ID NO: 45024 - DNA, 20 bp, human
gcgcggcttcccggaagtgg

SEQ ID NO: 45025 - DNA, 20 bp, human
ggcgcgcggcttcccggaag

SEQ ID NO: 45026 - DNA, 20 bp, human
gtaggtgctgctctgtgact

SEQ ID NO: 45027 - DNA, 20 bp, human
ggtttgcaggtgtggaaagg

SEQ ID NO: 45028 - DNA, 20 bp, human
gtgtgctatggagtagaagc

SEQ ID NO: 45029 - DNA, 20 bp, human
gtatagagagtcatggtgtt

SEQ ID NO: 45030 - DNA, 20 bp, human
gacattaatatagagagtca

SEQ ID NO: 45031 - DNA, 20 bp, human
ggcgagcaaaagggattatt

SEQ ID NO: 45032 - DNA, 20 bp, human
ggccggattgtgttcattga

SEQ ID NO: 45033 - DNA, 20 bp, human
gattcccggattaaaaggta

SEQ ID NO: 45034 - DNA, 20 bp, human
gggtcaagttgcgagcaaaa

SEQ ID NO: 45035 - DNA, 20 bp, human
gggctcctgtggcaaattcc

SEQ ID NO: 45036 - DNA, 20 bp, human
gtcttgcctggatgagccag

SEQ ID NO: 45037 - DNA, 20 bp, human
ggaatggagtgacaatgaaa

SEQ ID NO: 45038 - DNA, 20 bp, human
gggaagatggactgaaatag

SEQ ID NO: 45039 - DNA, 20 bp, human
gaggtaagagcaacgtgctt

SEQ ID NO: 45040 - DNA, 20 bp, human
ggcaaggtcggtattctaca

SEQ ID NO: 45041 - DNA, 20 bp, human
ggagaaagcagcatcttgcc

SEQ ID NO: 45042 - DNA, 20 bp, human
ggggagagatgagaagggcc

SEQ ID NO: 45043 - DNA, 20 bp, human
ggcttctcttctgtgtcccc

SEQ ID NO: 45044 - DNA, 20 bp, human
ggtggtctgacatacagcac

SEQ ID NO: 45045 - DNA, 20 bp, human
ggcctggatcaaaataattg

SEQ ID NO: 45046 - DNA, 20 bp, human
ggcgctgagtcgagctgggc

SEQ ID NO: 45047 - DNA, 20 bp, human
ggcggcactcacccactggt

SEQ ID NO: 45048 - DNA, 20 bp, human
gggaggcgctgagtcgagct

SEQ ID NO: 45049 - DNA, 20 bp, human
ggctctgggattcaagatgg

SEQ ID NO: 45050 - DNA, 20 bp, human
gtaggctctgggattcaaga

SEQ ID NO: 45051 - DNA, 20 bp, human
ggactccgcccccaccagag

SEQ ID NO: 45052 - DNA, 20 bp, human
gctgcgatgctggtgatata

SEQ ID NO: 45053 - DNA, 20 bp, human
ggggcaggagatgagcctag

SEQ ID NO: 45054 - DNA, 20 bp, human
ggcgtcgggtctggggacgt

SEQ ID NO: 45055 - DNA, 20 bp, human
gggccgcgcgggttactgtg

SEQ ID NO: 45056 - DNA, 20 bp, human
ggagccccgtgcctatgtct

SEQ ID NO: 45057 - DNA, 20 bp, human
gagaccagaccgatcgggta

SEQ ID NO: 45058 - DNA, 20 bp, human
gttccctccctcccagacat

SEQ ID NO: 45059 - DNA, 20 bp, human
ggggaagatggcagccgtgg

SEQ ID NO: 45060 - DNA, 20 bp, human
gctgggagaccagaccgatc

SEQ ID NO: 45061 - DNA, 20 bp, human
gaccaggccgcctgccgcca

SEQ ID NO: 45062 - DNA, 20 bp, human
gccccgtgcctatgtctggg

SEQ ID NO: 45063 - DNA, 20 bp, human
gccctcccagacataggcac

SEQ ID NO: 45064 - DNA, 20 bp, human
gctggaagtgggtggatctg

SEQ ID NO: 45065 - DNA, 20 bp, human
gggccatcgggccaacgagt

SEQ ID NO: 45066 - DNA, 20 bp, human
gcggccggggactgacggta

SEQ ID NO: 45067 - DNA, 20 bp, human
gggactgacggtacggcact

SEQ ID NO: 45068 - DNA, 20 bp, human
ggcggcagagacgactccaa

SEQ ID NO: 45069 - DNA, 20 bp, human
gctccaacggagacgagaag

SEQ ID NO: 45070 - DNA, 20 bp, human
gagggccttgagaaacaggg

SEQ ID NO: 45071 - DNA, 20 bp, human
gggtgttctgcggggaagga

SEQ ID NO: 45072 - DNA, 20 bp, human
gggagcgggacggaagtgag

SEQ ID NO: 45073 - DNA, 20 bp, human
gcggtacggcactaggactc

SEQ ID NO: 45074 - DNA, 20 bp, human
ggtctctgccgcggcttcct

SEQ ID NO: 45075 - DNA, 20 bp, human
gttctgcggggaaggacgga

SEQ ID NO: 45076 - DNA, 20 bp, human
gcagcgggctccgccatgcg

SEQ ID NO: 45077 - DNA, 20 bp, human
gggcacgcatcccgcaggag

SEQ ID NO: 45078 - DNA, 20 bp, human
gtacacgggaaggtaccagg

SEQ ID NO: 45079 - DNA, 20 bp, human
gaagcgcgaattggacgtgg

SEQ ID NO: 45080 - DNA, 20 bp, human
gagctcctcaactaggcaag

SEQ ID NO: 45081 - DNA, 20 bp, human
gtgcatagaggggcggtgaa

SEQ ID NO: 45082 - DNA, 20 bp, human
gatagaggggcggtgaaagg

SEQ ID NO: 45083 - DNA, 20 bp, human
ggcttcctcttgcctagttg

SEQ ID NO: 45084 - DNA, 20 bp, human
gactagaatgcatagagggg

SEQ ID NO: 45085 - DNA, 20 bp, human
gagcccgctgacctgtccca

SEQ ID NO: 45086 - DNA, 20 bp, human
gcccatgaagcggaagagac

SEQ ID NO: 45087 - DNA, 20 bp, human
gagggcttgcaggtggatag

SEQ ID NO: 45088 - DNA, 20 bp, human
gccatcccaggcagaagagt

SEQ ID NO: 45089 - DNA, 20 bp, human
gaggcactagaccagagagg

SEQ ID NO: 45090 - DNA, 20 bp, human
gctccttggacacaaggttc

SEQ ID NO: 45091 - DNA, 20 bp, human
gggatgagagtggaggtcaa

SEQ ID NO: 45092 - DNA, 20 bp, human
gtggggctcattaggattca

SEQ ID NO: 45093 - DNA, 20 bp, human
gtcctaatgagccccatccc

SEQ ID NO: 45094 - DNA, 20 bp, human
gctcatcccaggtctcctga

SEQ ID NO: 45095 - DNA, 20 bp, human
gggaagtggtatgggtgtaa

SEQ ID NO: 45096 - DNA, 20 bp, human
ggcgtagccagtaccttcca

SEQ ID NO: 45097 - DNA, 20 bp, human
gtcccgggatgggtagtagg

SEQ ID NO: 45098 - DNA, 20 bp, human
ggagacaccaacacaggacc

SEQ ID NO: 45099 - DNA, 20 bp, human
gctctaaccgtggaaggtac

SEQ ID NO: 45100 - DNA, 20 bp, human
gcggttagagacaccaacac

SEQ ID NO: 45101 - DNA, 20 bp, human
gccatcccgggagcaggtga

SEQ ID NO: 45102 - DNA, 20 bp, human
gtgctcccgggatgggtagt

SEQ ID NO: 45103 - DNA, 20 bp, human
ggcactggctacatagtcat

SEQ ID NO: 45104 - DNA, 20 bp, human
gtggtgtctctaaccgtgga

SEQ ID NO: 45105 - DNA, 20 bp, human
ggcctcctactacccatccc

SEQ ID NO: 45106 - DNA, 20 bp, human
ggcgggcatctcctggagac

SEQ ID NO: 45107 - DNA, 20 bp, human
ggaagtcagcgggcatctcc

SEQ ID NO: 45108 - DNA, 20 bp, human
gcccatgcccaggctaagga

SEQ ID NO: 45109 - DNA, 20 bp, human
gaggctcctctccccccaag

SEQ ID NO: 45110 - DNA, 20 bp, human
gatgttgtgcaccccttggg

SEQ ID NO: 45111 - DNA, 20 bp, human
gcttggcacccagggctagg

SEQ ID NO: 45112 - DNA, 20 bp, human
ggctcactggagaaggcctg

SEQ ID NO: 45113 - DNA, 20 bp, human
ggaatcccatgcccaggcta

SEQ ID NO: 45114 - DNA, 20 bp, human
ggcccctggggttgcctggt

SEQ ID NO: 45115 - DNA, 20 bp, human
gggacctgccccctagccct

SEQ ID NO: 45116 - DNA, 20 bp, human
gtggccaacgatgcagctcc

SEQ ID NO: 45117 - DNA, 20 bp, human
ggcagaaatgcacttcccaa

SEQ ID NO: 45118 - DNA, 20 bp, human
gaggctgctttcacagagga

SEQ ID NO: 45119 - DNA, 20 bp, human
ggtgaaggctgctttcacag

SEQ ID NO: 45120 - DNA, 20 bp, human
gagcagccttcacacaagaa

SEQ ID NO: 45121 - DNA, 20 bp, human
gacctggcacacgcagcaat

SEQ ID NO: 45122 - DNA, 20 bp, human
ggctccccataaccaccagg

SEQ ID NO: 45123 - DNA, 20 bp, human
gggagactgtcggggtatag

SEQ ID NO: 45124 - DNA, 20 bp, human
gatacatagggagactgtcg

SEQ ID NO: 45125 - DNA, 20 bp, human
gatcaagacctacagccctt

SEQ ID NO: 45126 - DNA, 20 bp, human
ggtcaagagctaaggaggga

SEQ ID NO: 45127 - DNA, 20 bp, human
gtaaagtcaagagctaagga

SEQ ID NO: 45128 - DNA, 20 bp, human
gcagaaacccccaccaaagg

SEQ ID NO: 45129 - DNA, 20 bp, human
ggagcagaaacccccaccaa

SEQ ID NO: 45130 - DNA, 20 bp, human
gcaattaaagtcaagagcta

SEQ ID NO: 45131 - DNA, 20 bp, human
gtaaagccatgagccccctt

SEQ ID NO: 45132 - DNA, 20 bp, human
ggaaaagtacgacagagaca

SEQ ID NO: 45133 - DNA, 20 bp, human
gcatgagccccctttggtgg

SEQ ID NO: 45134 - DNA, 20 bp, human
gatacccacaagaatcacag

SEQ ID NO: 45135 - DNA, 20 bp, human
ggcataataagtagtatgac

SEQ ID NO: 45136 - DNA, 20 bp, human
gcttccttccctgagcacgg

SEQ ID NO: 45137 - DNA, 20 bp, human
gacgagcaccggcctgcgcg

SEQ ID NO: 45138 - DNA, 20 bp, human
ggcgcggagccggcaccgga

SEQ ID NO: 45139 - DNA, 20 bp, human
gctgatccagggcctacacc

SEQ ID NO: 45140 - DNA, 20 bp, human
ggctcagggaaggaagtcgg

SEQ ID NO: 45141 - DNA, 20 bp, human
gccccgtcagctctgatcca

SEQ ID NO: 45142 - DNA, 20 bp, human
gcacatccggtcaccgtccc

SEQ ID NO: 45143 - DNA, 20 bp, human
gcagggaaggaagtcggggg

SEQ ID NO: 45144 - DNA, 20 bp, human
gccacacacgggcgcaggaa

SEQ ID NO: 45145 - DNA, 20 bp, human
gcggcggcggggacgagcac

SEQ ID NO: 45146 - DNA, 20 bp, human
ggccggccccgcagggtctt

SEQ ID NO: 45147 - DNA, 20 bp, human
gggtcttgggcgtcggtcgt

SEQ ID NO: 45148 - DNA, 20 bp, human
gcgtcggtcgtcggtggggt

SEQ ID NO: 45149 - DNA, 20 bp, human
gcctcacagtgcaggtacgg

SEQ ID NO: 45150 - DNA, 20 bp, human
gtgggcgtcggtcgtcggtg

SEQ ID NO: 45151 - DNA, 20 bp, human
gggccggcggagcagacggt

SEQ ID NO: 45152 - DNA, 20 bp, human
gtaggctgaagagctgaggt

SEQ ID NO: 45153 - DNA, 20 bp, human
gtaaggcggaccccaggagt

SEQ ID NO: 45154 - DNA, 20 bp, human
ggacgctcgcaggaacggag

SEQ ID NO: 45155 - DNA, 20 bp, human
gtagctcagtatggattcag

SEQ ID NO: 45156 - DNA, 20 bp, human
gcggggccggtgttcgggta

SEQ ID NO: 45157 - DNA, 20 bp, human
gcggtgttcgggtaggggag

SEQ ID NO: 45158 - DNA, 20 bp, human
gggcacaagaggtcagtacc

SEQ ID NO: 45159 - DNA, 20 bp, human
ggggtcccgggctaaggcgg

SEQ ID NO: 45160 - DNA, 20 bp, human
gcgggctaaggcggcggcaa

SEQ ID NO: 45161 - DNA, 20 bp, human
gacggatggtggaaaaactc

SEQ ID NO: 45162 - DNA, 20 bp, human
ggacatgggaggcgttgaca

SEQ ID NO: 45163 - DNA, 20 bp, human
gtgggaggcgttgacacgga

SEQ ID NO: 45164 - DNA, 20 bp, human
gcggcccagaaatcgactcc

SEQ ID NO: 45165 - DNA, 20 bp, human
ggaggctgggttcgggtccc

SEQ ID NO: 45166 - DNA, 20 bp, human
gggtcggtagtagcgatggc

SEQ ID NO: 45167 - DNA, 20 bp, human
gcgctccagctcttccactc

SEQ ID NO: 45168 - DNA, 20 bp, human
gggtgggtcggtagtagcga

SEQ ID NO: 45169 - DNA, 20 bp, human
ggggtctgactgacttgcag

SEQ ID NO: 45170 - DNA, 20 bp, human
gcagcggctacaggcccgag

SEQ ID NO: 45171 - DNA, 20 bp, human
gtagctcgcgagggcaaggg

SEQ ID NO: 45172 - DNA, 20 bp, human
ggctgtttcctggccgaggt

SEQ ID NO: 45173 - DNA, 20 bp, human
ggccctcgcgagctatagtt

SEQ ID NO: 45174 - DNA, 20 bp, human
ggggctgcggagaacaggac

SEQ ID NO: 45175 - DNA, 20 bp, human
gaggtacggagcccactctc

SEQ ID NO: 45176 - DNA, 20 bp, human
ggtccttgctgcagtcggac

SEQ ID NO: 45177 - DNA, 20 bp, human
gccgcagttcgctacaatag

SEQ ID NO: 45178 - DNA, 20 bp, human
ggccccatcgcagacagaca

SEQ ID NO: 45179 - DNA, 20 bp, human
ggggttctctatctagtcca

SEQ ID NO: 45180 - DNA, 20 bp, human
ggtcaagtttgtccaatcag

SEQ ID NO: 45181 - DNA, 20 bp, human
gacccggtccgactgcagca

SEQ ID NO: 45182 - DNA, 20 bp, human
gaggaggagcagcctcgggt

SEQ ID NO: 45183 - DNA, 20 bp, human
gaccgtgtctgtctgcgatg

SEQ ID NO: 45184 - DNA, 20 bp, human
gggactacggagaaaggtct

SEQ ID NO: 45185 - DNA, 20 bp, human
gggatcttctggttctagag

SEQ ID NO: 45186 - DNA, 20 bp, human
gtgagtcccagtgggccacc

SEQ ID NO: 45187 - DNA, 20 bp, human
ggcaagttaacagatacaaa

SEQ ID NO: 45188 - DNA, 20 bp, human
gaggagcggccggaagtagc

SEQ ID NO: 45189 - DNA, 20 bp, human
gcccagtgggccacctggag

SEQ ID NO: 45190 - DNA, 20 bp, human
gctaatggccaaagggacag

SEQ ID NO: 45191 - DNA, 20 bp, human
gccacctggagcggaagtgg

SEQ ID NO: 45192 - DNA, 20 bp, human
gcaaagccagacggtacacg

SEQ ID NO: 45193 - DNA, 20 bp, human
gacttgcgctaaaaacgatt

SEQ ID NO: 45194 - DNA, 20 bp, human
gtaattcgtatgaacaggat

SEQ ID NO: 45195 - DNA, 20 bp, human
gaaagtgccttcgggaggat

SEQ ID NO: 45196 - DNA, 20 bp, human
gaattatcgctctacccagg

SEQ ID NO: 45197 - DNA, 20 bp, human
gttggcgccgctgtacccca

SEQ ID NO: 45198 - DNA, 20 bp, human
ggagaagactcaaaagaggt

SEQ ID NO: 45199 - DNA, 20 bp, human
ggaatccagcgccaagccgt

SEQ ID NO: 45200 - DNA, 20 bp, human
gtccaattggggccgtacca

SEQ ID NO: 45201 - DNA, 20 bp, human
gccttctcccgcataatcgg

SEQ ID NO: 45202 - DNA, 20 bp, human
gagtcttctccgccatggta

SEQ ID NO: 45203 - DNA, 20 bp, human
gctcagtggacgccaggtct

SEQ ID NO: 45204 - DNA, 20 bp, human
gaattggggccgtaccatgg

SEQ ID NO: 45205 - DNA, 20 bp, human
gcctggggtgcggccagcac

SEQ ID NO: 45206 - DNA, 20 bp, human
ggaagtcgcggtgcagcggt

SEQ ID NO: 45207 - DNA, 20 bp, human
gtccccacgaatctccccac

SEQ ID NO: 45208 - DNA, 20 bp, human
ggtcgcggtgcagcggtggg

SEQ ID NO: 45209 - DNA, 20 bp, human
gccgtgaagtcgcggtgcag

SEQ ID NO: 45210 - DNA, 20 bp, human
ggcggtgggcggcatgtctg

SEQ ID NO: 45211 - DNA, 20 bp, human
ggagattcgtggggacacgg

SEQ ID NO: 45212 - DNA, 20 bp, human
ggccggtggggagattcgtg

SEQ ID NO: 45213 - DNA, 20 bp, human
gtggtgccggtatcttccca

SEQ ID NO: 45214 - DNA, 20 bp, human
gggcgccgggggtacgagag

SEQ ID NO: 45215 - DNA, 20 bp, human
ggttcctagttaccactcgg

SEQ ID NO: 45216 - DNA, 20 bp, human
gagccgggcaagcccgtgag

SEQ ID NO: 45217 - DNA, 20 bp, human
gcggctccgcagcgaatgga

SEQ ID NO: 45218 - DNA, 20 bp, human
gctccgcagcgaatggacgg

SEQ ID NO: 45219 - DNA, 20 bp, human
gcgctacgcgagagccgagg

SEQ ID NO: 45220 - DNA, 20 bp, human
gagtccccgaccagacacaa

SEQ ID NO: 45221 - DNA, 20 bp, human
gcgcagcgaatggacggcgg

SEQ ID NO: 45222 - DNA, 20 bp, human
gcctccggctccgcagcgaa

SEQ ID NO: 45223 - DNA, 20 bp, human
ggacacaatggagccggcag

SEQ ID NO: 45224 - DNA, 20 bp, human
gcgaccagacacaatggagc

SEQ ID NO: 45225 - DNA, 20 bp, human
gggcaggagagcccccgcct

SEQ ID NO: 45226 - DNA, 20 bp, human
ggcggcgcgggggagatggt

SEQ ID NO: 45227 - DNA, 20 bp, human
gctggcgttggaccccgcag

SEQ ID NO: 45228 - DNA, 20 bp, human
gggagccgcgagggacgacc

SEQ ID NO: 45229 - DNA, 20 bp, human
gcccagggcggcttcgaaac

SEQ ID NO: 45230 - DNA, 20 bp, human
gggccgtccgaggacgaggg

SEQ ID NO: 45231 - DNA, 20 bp, human
gtcgaaacgggcagtcgagg

SEQ ID NO: 45232 - DNA, 20 bp, human
gagggacgaccgggagtgag

SEQ ID NO: 45233 - DNA, 20 bp, human
gcgcggccgtccgaggacga

SEQ ID NO: 45234 - DNA, 20 bp, human
gagggctcggctgctcctgc

SEQ ID NO: 45235 - DNA, 20 bp, human
ggcttcgaaacgggcagtcg

SEQ ID NO: 45236 - DNA, 20 bp, human
gtgggccgcagatgaagagg

SEQ ID NO: 45237 - DNA, 20 bp, human
gcggtgggccgcagatgaag

SEQ ID NO: 45238 - DNA, 20 bp, human
gagagtctgcaccccctcca

SEQ ID NO: 45239 - DNA, 20 bp, human
ggtgaggtaggagccctagg

SEQ ID NO: 45240 - DNA, 20 bp, human
gctggaaacgcgagcgggga

SEQ ID NO: 45241 - DNA, 20 bp, human
gatgcaggaggcgatggagg

SEQ ID NO: 45242 - DNA, 20 bp, human
ggtggtacctctgaaagaag

SEQ ID NO: 45243 - DNA, 20 bp, human
ggtcagcgcgttgtctggag

SEQ ID NO: 45244 - DNA, 20 bp, human
gtgggtgagcgctgtgaggt

SEQ ID NO: 45245 - DNA, 20 bp, human
gtaggagccctagggggagg

SEQ ID NO: 45246 - DNA, 20 bp, human
gcgaggtgcagtgagctggt

SEQ ID NO: 45247 - DNA, 20 bp, human
ggagtgtccggggtgcatgg

SEQ ID NO: 45248 - DNA, 20 bp, human
gtgcgatgaagggccgagat

SEQ ID NO: 45249 - DNA, 20 bp, human
ggggctggacgtgcgatgaa

SEQ ID NO: 45250 - DNA, 20 bp, human
ggcgagcgagcggggcacaa

SEQ ID NO: 45251 - DNA, 20 bp, human
ggccgagatcggagtgtccg

SEQ ID NO: 45252 - DNA, 20 bp, human
gggtcctcagcttcgagccg

SEQ ID NO: 45253 - DNA, 20 bp, human
gccaatggagaaggcgagat

SEQ ID NO: 45254 - DNA, 20 bp, human
gtgctactcactgacagcgg

SEQ ID NO: 45255 - DNA, 20 bp, human
gaggcagcgttgggctgtag

SEQ ID NO: 45256 - DNA, 20 bp, human
gggagataacgcggacagcg

SEQ ID NO: 45257 - DNA, 20 bp, human
gaacgaaccgcagtgtccac

SEQ ID NO: 45258 - DNA, 20 bp, human
ggcggttcgttctcaccggg

SEQ ID NO: 45259 - DNA, 20 bp, human
gcagcagtagcggaagacgg

SEQ ID NO: 45260 - DNA, 20 bp, human
gtcctcgccggtggacactg

SEQ ID NO: 45261 - DNA, 20 bp, human
gtcaccgggaggagataacg

SEQ ID NO: 45262 - DNA, 20 bp, human
gcactgcggttcgttctcac

SEQ ID NO: 45263 - DNA, 20 bp, human
gtctctgaccgggacagggc

SEQ ID NO: 45264 - DNA, 20 bp, human
ggttgtccagcaaaggaggg

SEQ ID NO: 45265 - DNA, 20 bp, human
gagggaagcttgaagggtgg

SEQ ID NO: 45266 - DNA, 20 bp, human
gcttggagctcagacaacaa

SEQ ID NO: 45267 - DNA, 20 bp, human
gtgagcctggcagacccatt

SEQ ID NO: 45268 - DNA, 20 bp, human
gagcagaaaaccggtgagtg

SEQ ID NO: 45269 - DNA, 20 bp, human
gacttaaaagccccactcac

SEQ ID NO: 45270 - DNA, 20 bp, human
gaagagaccccacctcctca

SEQ ID NO: 45271 - DNA, 20 bp, human
ggacaggagataagaaagac

SEQ ID NO: 45272 - DNA, 20 bp, human
gaacaaaggcatagagagat

SEQ ID NO: 45273 - DNA, 20 bp, human
gctgcttgccttgaggaggt

SEQ ID NO: 45274 - DNA, 20 bp, human
gtttgctgcttgccttgagg

SEQ ID NO: 45275 - DNA, 20 bp, human
gggtgcctaatgggtctgcc

SEQ ID NO: 45276 - DNA, 20 bp, human
ggcgaggaacagctccatgt

SEQ ID NO: 45277 - DNA, 20 bp, human
gcaccggggcaggcaaaggt

SEQ ID NO: 45278 - DNA, 20 bp, human
ggcccgcgcaccctctctcg

SEQ ID NO: 45279 - DNA, 20 bp, human
gcccggtgaccagcacccgg

SEQ ID NO: 45280 - DNA, 20 bp, human
gtggtcaccggggcaggcaa

SEQ ID NO: 45281 - DNA, 20 bp, human
gtgccccggtgaccagcacc

SEQ ID NO: 45282 - DNA, 20 bp, human
ggtctccgccctccgcactg

SEQ ID NO: 45283 - DNA, 20 bp, human
gccccgggcaggagtcgctc

SEQ ID NO: 45284 - DNA, 20 bp, human
gggccaccagccccgagaga

SEQ ID NO: 45285 - DNA, 20 bp, human
gtcgcagcgctgggacccgg

SEQ ID NO: 45286 - DNA, 20 bp, human
ggaggcggcggctaagaagg

SEQ ID NO: 45287 - DNA, 20 bp, human
ggctaagaaggcggctctgg

SEQ ID NO: 45288 - DNA, 20 bp, human
ggtggctggaagttactgtg

SEQ ID NO: 45289 - DNA, 20 bp, human
ggctggaagttactgtgagg

SEQ ID NO: 45290 - DNA, 20 bp, human
gtgtgaggcggcggctaaga

SEQ ID NO: 45291 - DNA, 20 bp, human
ggtggtggcgccatcagtgt

SEQ ID NO: 45292 - DNA, 20 bp, human
gtgagaacgaggccagacca

SEQ ID NO: 45293 - DNA, 20 bp, human
gatcagtgtgggctgtgccg

SEQ ID NO: 45294 - DNA, 20 bp, human
gtccccccggaaatcgtctg

SEQ ID NO: 45295 - DNA, 20 bp, human
gagctctcggtagggtccgg

SEQ ID NO: 45296 - DNA, 20 bp, human
gccggccgcgcccctcgagt

SEQ ID NO: 45297 - DNA, 20 bp, human
gccttctgcaccacattcag

SEQ ID NO: 45298 - DNA, 20 bp, human
ggactccccaggcaacacgg

SEQ ID NO: 45299 - DNA, 20 bp, human
gagcgcccgtcggctcctct

SEQ ID NO: 45300 - DNA, 20 bp, human
gaggtaactgccgactcgag

SEQ ID NO: 45301 - DNA, 20 bp, human
gggcagcaccagctctacgt

SEQ ID NO: 45302 - DNA, 20 bp, human
gggcggccgggtcctgccgc

SEQ ID NO: 45303 - DNA, 20 bp, human
gcgcgactccccaggcaaca

SEQ ID NO: 45304 - DNA, 20 bp, human
ggccccgggtcgggtgatga

SEQ ID NO: 45305 - DNA, 20 bp, human
gagaagcgccaagggcgagg

SEQ ID NO: 45306 - DNA, 20 bp, human
ggagctcatatactacgatg

SEQ ID NO: 45307 - DNA, 20 bp, human
gttagcgcgggtccttgtgt

SEQ ID NO: 45308 - DNA, 20 bp, human
ggaccgagtcccgaaggact

SEQ ID NO: 45309 - DNA, 20 bp, human
gcacagcgcgacaggagtgg

SEQ ID NO: 45310 - DNA, 20 bp, human
gcgccaagcagcggtcccag

SEQ ID NO: 45311 - DNA, 20 bp, human
gcgaggggcggggtaacagg

SEQ ID NO: 45312 - DNA, 20 bp, human
gccagcggcaatgactcctc

SEQ ID NO: 45313 - DNA, 20 bp, human
gcggccgtgtcgccaagcag

SEQ ID NO: 45314 - DNA, 20 bp, human
ggggcaggggcgcgacggtc

SEQ ID NO: 45315 - DNA, 20 bp, human
gcaccccccgaggacagagt

SEQ ID NO: 45316 - DNA, 20 bp, human
gggcctgcaacgtgtctctg

SEQ ID NO: 45317 - DNA, 20 bp, human
gcgagcgcgacactagaaag

SEQ ID NO: 45318 - DNA, 20 bp, human
ggaaaggggaccctcgagag

SEQ ID NO: 45319 - DNA, 20 bp, human
gagtgggcccggcgaatgga

SEQ ID NO: 45320 - DNA, 20 bp, human
ggtcgcgctcgagtcccgac

SEQ ID NO: 45321 - DNA, 20 bp, human
ggcttcgggagtcctccaag

SEQ ID NO: 45322 - DNA, 20 bp, human
ggacctccccaggacgaaag

SEQ ID NO: 45323 - DNA, 20 bp, human
ggtagttgtacgacatgtcg

SEQ ID NO: 45324 - DNA, 20 bp, human
gtacagggacgactctttcg

SEQ ID NO: 45325 - DNA, 20 bp, human
gggcgaatggaaggcgctgg

SEQ ID NO: 45326 - DNA, 20 bp, human
gttgggctcaacattgagac

SEQ ID NO: 45327 - DNA, 20 bp, human
gcaaggcacaaaggaggtaa

SEQ ID NO: 45328 - DNA, 20 bp, human
ggaacgaaaagtcctcaata

SEQ ID NO: 45329 - DNA, 20 bp, human
gtcagaacaagcaaagacgt

SEQ ID NO: 45330 - DNA, 20 bp, human
ggatagccatctgaattgag

SEQ ID NO: 45331 - DNA, 20 bp, human
gtgagagctattgattgagg

SEQ ID NO: 45332 - DNA, 20 bp, human
ggaaaagtcctcaatacggt

SEQ ID NO: 45333 - DNA, 20 bp, human
gttcagatggctatcctgac

SEQ ID NO: 45334 - DNA, 20 bp, human
gtccatctcccaaggcacaa

SEQ ID NO: 45335 - DNA, 20 bp, human
gggaaaaaggctttgaggta

SEQ ID NO: 45336 - DNA, 20 bp, human
ggtgctctatgcgaagatca

SEQ ID NO: 45337 - DNA, 20 bp, human
gcagcaggcacaggcagtac

SEQ ID NO: 45338 - DNA, 20 bp, human
gctctatgcgaagatcatgg

SEQ ID NO: 45339 - DNA, 20 bp, human
gcttcacacggaggacgcga

SEQ ID NO: 45340 - DNA, 20 bp, human
ggaggattgagaggcctctg

SEQ ID NO: 45341 - DNA, 20 bp, human
ggcgcgagcaccctaaaagg

SEQ ID NO: 45342 - DNA, 20 bp, human
gccgccttgtttctccccag

SEQ ID NO: 45343 - DNA, 20 bp, human
gacacagcgccaggaaaggt

SEQ ID NO: 45344 - DNA, 20 bp, human
ggcacacacagcgccaggaa

SEQ ID NO: 45345 - DNA, 20 bp, human
gatgcgaagatcatggaggg

SEQ ID NO: 45346 - DNA, 20 bp, human
ggagaagctgctgaggcact

SEQ ID NO: 45347 - DNA, 20 bp, human
gtacccaacaccatccctgg

SEQ ID NO: 45348 - DNA, 20 bp, human
ggcaagaagagggaaacgtg

SEQ ID NO: 45349 - DNA, 20 bp, human
gggctggaaatgcaagaaga

SEQ ID NO: 45350 - DNA, 20 bp, human
gactggctcagtagcaaatg

SEQ ID NO: 45351 - DNA, 20 bp, human
gcagggctactctccttgat

SEQ ID NO: 45352 - DNA, 20 bp, human
gaagagggaaacgtgtggct

SEQ ID NO: 45353 - DNA, 20 bp, human
gcaccaccagggatggtgtt

SEQ ID NO: 45354 - DNA, 20 bp, human
gttggggactgaagagcatg

SEQ ID NO: 45355 - DNA, 20 bp, human
ggctcttcagtccccaaagt

SEQ ID NO: 45356 - DNA, 20 bp, human
gggcggcgttgaatgtgtgg

SEQ ID NO: 45357 - DNA, 20 bp, human
gggagctgggctcagacgcg

SEQ ID NO: 45358 - DNA, 20 bp, human
gcctgctgcgcggggaaccc

SEQ ID NO: 45359 - DNA, 20 bp, human
ggcggctgcgggtctcgtgg

SEQ ID NO: 45360 - DNA, 20 bp, human
gcgcagcgaggagcccgact

SEQ ID NO: 45361 - DNA, 20 bp, human
gactacagcgagggtgagag

SEQ ID NO: 45362 - DNA, 20 bp, human
ggcgagtcgtagccgatgaa

SEQ ID NO: 45363 - DNA, 20 bp, human
gacagcgagggtgagagcgg

SEQ ID NO: 45364 - DNA, 20 bp, human
gccgagttcgtcgggaccag

SEQ ID NO: 45365 - DNA, 20 bp, human
gtgcgcatcggcccatgcag

SEQ ID NO: 45366 - DNA, 20 bp, human
ggatgccaggcgaaaaggtg

SEQ ID NO: 45367 - DNA, 20 bp, human
ggcgccacggcgctcccagt

SEQ ID NO: 45368 - DNA, 20 bp, human
ggcccggatgccaggcgaaa

SEQ ID NO: 45369 - DNA, 20 bp, human
ggctcccagtgggcgagtag

SEQ ID NO: 45370 - DNA, 20 bp, human
ggccctgcacgccccacccg

SEQ ID NO: 45371 - DNA, 20 bp, human
ggggcaccctgtgaaccctg

SEQ ID NO: 45372 - DNA, 20 bp, human
ggcagaccacagggttcaca

SEQ ID NO: 45373 - DNA, 20 bp, human
gtcgcccactgggagcgccg

SEQ ID NO: 45374 - DNA, 20 bp, human
gagtagcgggcccggatgcc

SEQ ID NO: 45375 - DNA, 20 bp, human
gccagggcctagggtcgcgg

SEQ ID NO: 45376 - DNA, 20 bp, human
gtggtaggtagggaccgtcc

SEQ ID NO: 45377 - DNA, 20 bp, human
gaaggacaatgtgggacctc

SEQ ID NO: 45378 - DNA, 20 bp, human
ggtgtccgcgcctctctgag

SEQ ID NO: 45379 - DNA, 20 bp, human
gagcctcgtgtagacttcag

SEQ ID NO: 45380 - DNA, 20 bp, human
gctgctcctcaggacttggt

SEQ ID NO: 45381 - DNA, 20 bp, human
gcggacactcatctgtctgg

SEQ ID NO: 45382 - DNA, 20 bp, human
gtactgcagaaggacaatgt

SEQ ID NO: 45383 - DNA, 20 bp, human
ggcgcggacactcatctgtc

SEQ ID NO: 45384 - DNA, 20 bp, human
gtctacacgaggctggttcg

SEQ ID NO: 45385 - DNA, 20 bp, human
gagaggtgaatgagcccgga

SEQ ID NO: 45386 - DNA, 20 bp, human
gactcactgagcgtgtgtga

SEQ ID NO: 45387 - DNA, 20 bp, human
gcggccgtgcttgctagtga

SEQ ID NO: 45388 - DNA, 20 bp, human
gcgtgcttgctagtgagggc

SEQ ID NO: 45389 - DNA, 20 bp, human
ggccgagagccaggtacgcc

SEQ ID NO: 45390 - DNA, 20 bp, human
gttcaccagtagcaaaggga

SEQ ID NO: 45391 - DNA, 20 bp, human
gccatgctcggagtgtgtga

SEQ ID NO: 45392 - DNA, 20 bp, human
gcgcatccggaaaggagctg

SEQ ID NO: 45393 - DNA, 20 bp, human
gactcgcaggcgtgtggcgg

SEQ ID NO: 45394 - DNA, 20 bp, human
gtgcgggggtgacctgagaa

SEQ ID NO: 45395 - DNA, 20 bp, human
gtggagggaaaaggtcacct

SEQ ID NO: 45396 - DNA, 20 bp, human
gacggtccctaacttcactg

SEQ ID NO: 45397 - DNA, 20 bp, human
ggaccgtccgagagaggaat

SEQ ID NO: 45398 - DNA, 20 bp, human
ggttagggaccgtccgagag

SEQ ID NO: 45399 - DNA, 20 bp, human
gcatgttaaagatgagcggg

SEQ ID NO: 45400 - DNA, 20 bp, human
gtcacccagtcttagagcgg

SEQ ID NO: 45401 - DNA, 20 bp, human
ggcggacaggcctaacgatg

SEQ ID NO: 45402 - DNA, 20 bp, human
gaaatcagagctggaacctg

SEQ ID NO: 45403 - DNA, 20 bp, human
gtagggagaaggcccgctgg

SEQ ID NO: 45404 - DNA, 20 bp, human
gtaacgatgaggcctgaagt

SEQ ID NO: 45405 - DNA, 20 bp, human
ggcggaaacggcctgagcga

SEQ ID NO: 45406 - DNA, 20 bp, human
ggacaagagggggaccgacc

SEQ ID NO: 45407 - DNA, 20 bp, human
gctagggcgcagcaggccaa

SEQ ID NO: 45408 - DNA, 20 bp, human
ggacctgggacgggtctggg

SEQ ID NO: 45409 - DNA, 20 bp, human
ggcgagcgtggacctgggac

SEQ ID NO: 45410 - DNA, 20 bp, human
ggcgcagcaggccaaggggg

SEQ ID NO: 45411 - DNA, 20 bp, human
gctgggcggctctcggtggt

SEQ ID NO: 45412 - DNA, 20 bp, human
gggaggtgcgagcgtggacc

SEQ ID NO: 45413 - DNA, 20 bp, human
ggtggacctgggacgggtct

SEQ ID NO: 45414 - DNA, 20 bp, human
ggagcgcggcggccgatctg

SEQ ID NO: 45415 - DNA, 20 bp, human
ggttcgcacacccattcaag

SEQ ID NO: 45416 - DNA, 20 bp, human
gctcgctgccgggtaaacac

SEQ ID NO: 45417 - DNA, 20 bp, human
gaagcaggcgagtcgtgcag

SEQ ID NO: 45418 - DNA, 20 bp, human
gcgcagtagcatagcctccg

SEQ ID NO: 45419 - DNA, 20 bp, human
gcagttgcaaccatggtcaa

SEQ ID NO: 45420 - DNA, 20 bp, human
gcgtcccgggagcgaactag

SEQ ID NO: 45421 - DNA, 20 bp, human
ggaagctgcggccttggtgg

SEQ ID NO: 45422 - DNA, 20 bp, human
gtgtggcacctcctacatag

SEQ ID NO: 45423 - DNA, 20 bp, human
ggaggcaccgaccttgggag

SEQ ID NO: 45424 - DNA, 20 bp, human
gactgcgaggagccggcgca

SEQ ID NO: 45425 - DNA, 20 bp, human
gacctcctacatagaggtag

SEQ ID NO: 45426 - DNA, 20 bp, human
gcacctctgcccgctcccga

SEQ ID NO: 45427 - DNA, 20 bp, human
gcagtgggcgccggctccct

SEQ ID NO: 45428 - DNA, 20 bp, human
gaggccccagccctcgggag

SEQ ID NO: 45429 - DNA, 20 bp, human
gcttggacttctgcacccag

SEQ ID NO: 45430 - DNA, 20 bp, human
ggggcccgcggctctgcagt

SEQ ID NO: 45431 - DNA, 20 bp, human
ggcgcggcgactataatgac

SEQ ID NO: 45432 - DNA, 20 bp, human
gctcatcctggagctcccgg

SEQ ID NO: 45433 - DNA, 20 bp, human
gagctccaggatgaggagtc

SEQ ID NO: 45434 - DNA, 20 bp, human
gaggcccctcggagaacagt

SEQ ID NO: 45435 - DNA, 20 bp, human
gggctggcctggaagtccat

SEQ ID NO: 45436 - DNA, 20 bp, human
gtggaagccaccaaaatctc

SEQ ID NO: 45437 - DNA, 20 bp, human
gggcccaggccagagcagtc

SEQ ID NO: 45438 - DNA, 20 bp, human
gggcactgggaaacaaggtt

SEQ ID NO: 45439 - DNA, 20 bp, human
gcaggccagagcagtctggt

SEQ ID NO: 45440 - DNA, 20 bp, human
gtaaccagctgccagggagg

SEQ ID NO: 45441 - DNA, 20 bp, human
gtgaaagggcaagcaatctg

SEQ ID NO: 45442 - DNA, 20 bp, human
gtgagagagttgctggacat

SEQ ID NO: 45443 - DNA, 20 bp, human
gaagtcaataaggtcactgg

SEQ ID NO: 45444 - DNA, 20 bp, human
gggtttggtgccagagattt

SEQ ID NO: 45445 - DNA, 20 bp, human
ggaggagtgagcgagcaatg

SEQ ID NO: 45446 - DNA, 20 bp, human
gtgggtccttcggcaggagg

SEQ ID NO: 45447 - DNA, 20 bp, human
gcgcaaaccgcgccaagcaa

SEQ ID NO: 45448 - DNA, 20 bp, human
gaccggaagtaccccatcta

SEQ ID NO: 45449 - DNA, 20 bp, human
gggcggcctgctccaggaaa

SEQ ID NO: 45450 - DNA, 20 bp, human
gtgagctcaaagccccggtc

SEQ ID NO: 45451 - DNA, 20 bp, human
ggtgcacgtgctgggtcctt

SEQ ID NO: 45452 - DNA, 20 bp, human
ggtgagagcggggtccgagg

SEQ ID NO: 45453 - DNA, 20 bp, human
gccccttcggtagaaggtaa

SEQ ID NO: 45454 - DNA, 20 bp, human
gcaaaagagggcccaagccc

SEQ ID NO: 45455 - DNA, 20 bp, human
ggattgggctaccgtagatg

SEQ ID NO: 45456 - DNA, 20 bp, human
gagaggccccgctcccgggt

SEQ ID NO: 45457 - DNA, 20 bp, human
gagctgtcgggggcctgttc

SEQ ID NO: 45458 - DNA, 20 bp, human
gtcccgagagcagctgtcgg

SEQ ID NO: 45459 - DNA, 20 bp, human
gggaagagcgatgagaggta

SEQ ID NO: 45460 - DNA, 20 bp, human
gtcctccgcactgagtgaga

SEQ ID NO: 45461 - DNA, 20 bp, human
gacaggagcacctcctcccg

SEQ ID NO: 45462 - DNA, 20 bp, human
gtgagaggggacttgcctca

SEQ ID NO: 45463 - DNA, 20 bp, human
gagtcccctctcactcagtg

SEQ ID NO: 45464 - DNA, 20 bp, human
gcataccgtctgaaaaccgg

SEQ ID NO: 45465 - DNA, 20 bp, human
ggagcggcggcggaacccgc

SEQ ID NO: 45466 - DNA, 20 bp, human
ggaaaggccgaggcacacat

SEQ ID NO: 45467 - DNA, 20 bp, human
gccagctgctgttctctgga

SEQ ID NO: 45468 - DNA, 20 bp, human
gaacagcagctggggaatct

SEQ ID NO: 45469 - DNA, 20 bp, human
gggacagaacagcttgtggt

SEQ ID NO: 45470 - DNA, 20 bp, human
gccccagtccagcgtctcct

SEQ ID NO: 45471 - DNA, 20 bp, human
gctaggtggtgagcaggtgt

SEQ ID NO: 45472 - DNA, 20 bp, human
gagctggggaatctaggccc

SEQ ID NO: 45473 - DNA, 20 bp, human
gccaagggccagcttcttcc

SEQ ID NO: 45474 - DNA, 20 bp, human
ggcccaggagacgctggact

SEQ ID NO: 45475 - DNA, 20 bp, human
ggaatccctgggggcttggt

SEQ ID NO: 45476 - DNA, 20 bp, human
gtgctggtgaaggagcccgg

SEQ ID NO: 45477 - DNA, 20 bp, human
ggtggtaggcatacatccac

SEQ ID NO: 45478 - DNA, 20 bp, human
gggtgaaggagcccggtggt

SEQ ID NO: 45479 - DNA, 20 bp, human
gcaggaatcctcagaatgtg

SEQ ID NO: 45480 - DNA, 20 bp, human
gtccagacccccaaaaacat

SEQ ID NO: 45481 - DNA, 20 bp, human
gtctggatttatgctatgaa

SEQ ID NO: 45482 - DNA, 20 bp, human
gttgggttggggaaacgcag

SEQ ID NO: 45483 - DNA, 20 bp, human
ggattcctgggaaagcgcca

SEQ ID NO: 45484 - DNA, 20 bp, human
gcagagttgaaattgttggc

SEQ ID NO: 45485 - DNA, 20 bp, human
gggatgaaagtaagttatgt

SEQ ID NO: 45486 - DNA, 20 bp, human
gccgctaccaagtaccacac

SEQ ID NO: 45487 - DNA, 20 bp, human
ggcggcgcgacggtccacaa

SEQ ID NO: 45488 - DNA, 20 bp, human
gtgcactgaggccctcgtca

SEQ ID NO: 45489 - DNA, 20 bp, human
gacaggcgccaccatgacga

SEQ ID NO: 45490 - DNA, 20 bp, human
gtgagatcccggcctcaggg

SEQ ID NO: 45491 - DNA, 20 bp, human
gactgaggccctcgtcatgg

SEQ ID NO: 45492 - DNA, 20 bp, human
gcagagggaaagggccccga

SEQ ID NO: 45493 - DNA, 20 bp, human
ggcactgcggaagccccacc

SEQ ID NO: 45494 - DNA, 20 bp, human
gcggccaccgattccaggta

SEQ ID NO: 45495 - DNA, 20 bp, human
gagagcaggtgccaggaagg

SEQ ID NO: 45496 - DNA, 20 bp, human
ggccccctggtgagatgcca

SEQ ID NO: 45497 - DNA, 20 bp, human
gagccctggcatctcaccag

SEQ ID NO: 45498 - DNA, 20 bp, human
gctgcaggggacagtctgga

SEQ ID NO: 45499 - DNA, 20 bp, human
gatgccagggctgggattca

SEQ ID NO: 45500 - DNA, 20 bp, human
ggaggcaggaatgactgtcc

SEQ ID NO: 45501 - DNA, 20 bp, human
ggcaggtgtcccaaactggt

SEQ ID NO: 45502 - DNA, 20 bp, human
gtctccctgaatcccagccc

SEQ ID NO: 45503 - DNA, 20 bp, human
gtcaccagggggcacagtga

SEQ ID NO: 45504 - DNA, 20 bp, human
gggggcacagtgatggtcca

SEQ ID NO: 45505 - DNA, 20 bp, human
gggagaagaaaggaggttcc

SEQ ID NO: 45506 - DNA, 20 bp, human
gcagaagcgggaggtaccct

SEQ ID NO: 45507 - DNA, 20 bp, human
gctcgcggaccagggaggag

SEQ ID NO: 45508 - DNA, 20 bp, human
gcaaggctcgcggaccaggg

SEQ ID NO: 45509 - DNA, 20 bp, human
ggcgaggcgccacagcaacc

SEQ ID NO: 45510 - DNA, 20 bp, human
gtggcgtgaggaaaggagtg

SEQ ID NO: 45511 - DNA, 20 bp, human
gcagagcttggcgtgaggaa

SEQ ID NO: 45512 - DNA, 20 bp, human
gctggcggaagaaaagctgg

SEQ ID NO: 45513 - DNA, 20 bp, human
gttttgtttgcagaagcggg

SEQ ID NO: 45514 - DNA, 20 bp, human
gagggggagccgcgggatcg

SEQ ID NO: 45515 - DNA, 20 bp, human
gccctccccagtcatgaccc

SEQ ID NO: 45516 - DNA, 20 bp, human
gcctcagcgcgtgaacgtga

SEQ ID NO: 45517 - DNA, 20 bp, human
ggaaaagttttgcccgaagt

SEQ ID NO: 45518 - DNA, 20 bp, human
ggtgacggtacggccgggcc

SEQ ID NO: 45519 - DNA, 20 bp, human
ggctcgggtcccgtccccag

SEQ ID NO: 45520 - DNA, 20 bp, human
ggccggccgggctacctctg

SEQ ID NO: 45521 - DNA, 20 bp, human
ggcgcgtgaacgtgacggta

SEQ ID NO: 45522 - DNA, 20 bp, human
gtggcgtgaggaaaggagtg

SEQ ID NO: 45523 - DNA, 20 bp, human
gcaaggctcgcggaccaggg

SEQ ID NO: 45524 - DNA, 20 bp, human
gtccccagaggtagcccggc

SEQ ID NO: 45525 - DNA, 20 bp, human
gcagagcttggcgtgaggaa

SEQ ID NO: 45526 - DNA, 20 bp, human
gaggcgaagccgcggaggac

SEQ ID NO: 45527 - DNA, 20 bp, human
gcacgccgtgtcagtcggga

SEQ ID NO: 45528 - DNA, 20 bp, human
gatgagccgcgggcagaaaa

SEQ ID NO: 45529 - DNA, 20 bp, human
gccgtgtcagtcgggaggga

SEQ ID NO: 45530 - DNA, 20 bp, human
ggagcgagcaggcgaagccg

SEQ ID NO: 45531 - DNA, 20 bp, human
gggcagaaaagggttcccaa

SEQ ID NO: 45532 - DNA, 20 bp, human
ggcggaggacggggtgaaga

SEQ ID NO: 45533 - DNA, 20 bp, human
gtgaagatggcggccttctc

SEQ ID NO: 45534 - DNA, 20 bp, human
ggggtcactgccacgttaag

SEQ ID NO: 45535 - DNA, 20 bp, human
gccgcaacgcgggtccatca

SEQ ID NO: 45536 - DNA, 20 bp, human
gagactcacggaaccagcat

SEQ ID NO: 45537 - DNA, 20 bp, human
ggcaaaacggccaactctcc

SEQ ID NO: 45538 - DNA, 20 bp, human
gggacccggccgggaatgag

SEQ ID NO: 45539 - DNA, 20 bp, human
gagtggccagaacggtgcag

SEQ ID NO: 45540 - DNA, 20 bp, human
gtgcggccgtacctaagggt

SEQ ID NO: 45541 - DNA, 20 bp, human
ggaaatgcggccgtacctaa

SEQ ID NO: 45542 - DNA, 20 bp, human
ggcgaggagttgcagagtgg

SEQ ID NO: 45543 - DNA, 20 bp, human
ggcatgggacaaacgcacag

SEQ ID NO: 45544 - DNA, 20 bp, human
gtatttttttaggaacagtg

SEQ ID NO: 45545 - DNA, 20 bp, human
ggtctccctacccttaggta

SEQ ID NO: 45546 - DNA, 20 bp, human
ggcagcagcgagaatctaca

SEQ ID NO: 45547 - DNA, 20 bp, human
gctgggcggtgcgcagaagt

SEQ ID NO: 45548 - DNA, 20 bp, human
gccactgagttagaaactgg

SEQ ID NO: 45549 - DNA, 20 bp, human
gtgcctgcggtggaactggg

SEQ ID NO: 45550 - DNA, 20 bp, human
gacgccactgagttagaaac

SEQ ID NO: 45551 - DNA, 20 bp, human
gttgtgcctgcggtggaact

SEQ ID NO: 45552 - DNA, 20 bp, human
ggggacgggtaggcctagga

SEQ ID NO: 45553 - DNA, 20 bp, human
ggcctacccgtccccacaca

SEQ ID NO: 45554 - DNA, 20 bp, human
gtgtggggacgggtaggcct

SEQ ID NO: 45555 - DNA, 20 bp, human
gtgctaaagttagcatcgct

SEQ ID NO: 45556 - DNA, 20 bp, human
gggcgcctccgctgttgggg

SEQ ID NO: 45557 - DNA, 20 bp, human
gtaagttggagccgactcag

SEQ ID NO: 45558 - DNA, 20 bp, human
ggaaggagacgcctaaaccg

SEQ ID NO: 45559 - DNA, 20 bp, human
ggtgcagtcgctgggaagga

SEQ ID NO: 45560 - DNA, 20 bp, human
gcagcgactgcacaaaatgg

SEQ ID NO: 45561 - DNA, 20 bp, human
gtcggggctacaaagccggt

SEQ ID NO: 45562 - DNA, 20 bp, human
gctcaaaccgggcagtgccg

SEQ ID NO: 45563 - DNA, 20 bp, human
ggcgactcgaggcgagacag

SEQ ID NO: 45564 - DNA, 20 bp, human
gcaaagccggtgggcaggtt

SEQ ID NO: 45565 - DNA, 20 bp, human
ggtttggctacgctcaaacc

SEQ ID NO: 45566 - DNA, 20 bp, human
gcttattctaggcacttgtt

SEQ ID NO: 45567 - DNA, 20 bp, human
gctggagccacgcgacgagt

SEQ ID NO: 45568 - DNA, 20 bp, human
gctgtgtggcgccttattct

SEQ ID NO: 45569 - DNA, 20 bp, human
gtgcgcacgtgcggccggaa

SEQ ID NO: 45570 - DNA, 20 bp, human
ggtgagggaaccaaaagcta

SEQ ID NO: 45571 - DNA, 20 bp, human
gcagctgctctgtgtgacgg

SEQ ID NO: 45572 - DNA, 20 bp, human
gggactccccgttcacttct

SEQ ID NO: 45573 - DNA, 20 bp, human
ggtaagcctagaagtgaacg

SEQ ID NO: 45574 - DNA, 20 bp, human
gcaggaacgctggcacccgg

SEQ ID NO: 45575 - DNA, 20 bp, human
gtaaccggaaatgagggatg

SEQ ID NO: 45576 - DNA, 20 bp, human
gtcaccgaggaggtcaatag

SEQ ID NO: 45577 - DNA, 20 bp, human
gcgggccctaacctcgccac

SEQ ID NO: 45578 - DNA, 20 bp, human
gtagggcccgcgttgcgacg

SEQ ID NO: 45579 - DNA, 20 bp, human
gcgcgccggtggcgaggtta

SEQ ID NO: 45580 - DNA, 20 bp, human
gtggccatagtcccggacaa

SEQ ID NO: 45581 - DNA, 20 bp, human
gggaatgacagcatgcatag

SEQ ID NO: 45582 - DNA, 20 bp, human
gaccgccagggcccacgagt

SEQ ID NO: 45583 - DNA, 20 bp, human
gacctcacgcggaccggaag

SEQ ID NO: 45584 - DNA, 20 bp, human
gagctctaagagcaaatcaa

SEQ ID NO: 45585 - DNA, 20 bp, human
gcaggggcctccccaacccg

SEQ ID NO: 45586 - DNA, 20 bp, human
gggatggcacgagggatcgt

SEQ ID NO: 45587 - DNA, 20 bp, human
gggtctgcagccttgtagtg

SEQ ID NO: 45588 - DNA, 20 bp, human
gtgctggtggattcgaggga

SEQ ID NO: 45589 - DNA, 20 bp, human
ggattcgagggatggcacga

SEQ ID NO: 45590 - DNA, 20 bp, human
gctcgtgctggtggattcga

SEQ ID NO: 45591 - DNA, 20 bp, human
gcaaggctgcagaccggaag

SEQ ID NO: 45592 - DNA, 20 bp, human
gagagcctgccgcgaacccc

SEQ ID NO: 45593 - DNA, 20 bp, human
gcatggtcccaggcgcgggt

SEQ ID NO: 45594 - DNA, 20 bp, human
gcgcaggtgagtgctcctat

SEQ ID NO: 45595 - DNA, 20 bp, human
gtcagccctaaaagggtcag

SEQ ID NO: 45596 - DNA, 20 bp, human
gtggccagtgccaagagcag

SEQ ID NO: 45597 - DNA, 20 bp, human
gccggcagccccagccatcg

SEQ ID NO: 45598 - DNA, 20 bp, human
gagactggctaggctcacgt

SEQ ID NO: 45599 - DNA, 20 bp, human
gagatactcacgtcgcccac

SEQ ID NO: 45600 - DNA, 20 bp, human
ggtgatgggaaaccgccgca

SEQ ID NO: 45601 - DNA, 20 bp, human
gccaggagtaggggcgagga

SEQ ID NO: 45602 - DNA, 20 bp, human
gccaagatcgcgccctgcgg

SEQ ID NO: 45603 - DNA, 20 bp, human
gtgccaagagcagcggttgt

SEQ ID NO: 45604 - DNA, 20 bp, human
gtgtgagactccggctaaga

SEQ ID NO: 45605 - DNA, 20 bp, human
gcgcccacaggcagggtgat

SEQ ID NO: 45606 - DNA, 20 bp, human
gtcgggagccttagcagcag

SEQ ID NO: 45607 - DNA, 20 bp, human
gggcgcggctaccatggcgg

SEQ ID NO: 45608 - DNA, 20 bp, human
gtgctccgggggccgaccga

SEQ ID NO: 45609 - DNA, 20 bp, human
gctcaggaagagccctcggt

SEQ ID NO: 45610 - DNA, 20 bp, human
ggagcgtagcgcctagcccc

SEQ ID NO: 45611 - DNA, 20 bp, human
ggccgcgccgtcagatctcg

SEQ ID NO: 45612 - DNA, 20 bp, human
gcggcggcatttgaagcctc

SEQ ID NO: 45613 - DNA, 20 bp, human
gtagcgcctagcccccggca

SEQ ID NO: 45614 - DNA, 20 bp, human
gtgggagaagggggaccgac

SEQ ID NO: 45615 - DNA, 20 bp, human
ggagaagggggaccgacggg

SEQ ID NO: 45616 - DNA, 20 bp, human
gtcttctcaaccgcgtggag

SEQ ID NO: 45617 - DNA, 20 bp, human
gtgagaagaccggtcggcct

SEQ ID NO: 45618 - DNA, 20 bp, human
gcgcggttgagaagaccggt

SEQ ID NO: 45619 - DNA, 20 bp, human
gcctctcccgagctccaaca

SEQ ID NO: 45620 - DNA, 20 bp, human
ggcaggttgcccaggccgac

SEQ ID NO: 45621 - DNA, 20 bp, human
gaagtcgccggggaccacgt

SEQ ID NO: 45622 - DNA, 20 bp, human
gtcttcagcgcaggttgccc

SEQ ID NO: 45623 - DNA, 20 bp, human
gcaacgtggagcctgactga

SEQ ID NO: 45624 - DNA, 20 bp, human
gcgagagccgggtggaccca

SEQ ID NO: 45625 - DNA, 20 bp, human
gcttataggcatccacaggt

SEQ ID NO: 45626 - DNA, 20 bp, human
gacgttgaggccgcgttggg

SEQ ID NO: 45627 - DNA, 20 bp, human
ggttgggcggttcagactca

SEQ ID NO: 45628 - DNA, 20 bp, human
ggggcggttcagactcaggg

SEQ ID NO: 45629 - DNA, 20 bp, human
ggaccaggaaacgggaaaga

SEQ ID NO: 45630 - DNA, 20 bp, human
ggcgacgttgaggccgcgtt

SEQ ID NO: 45631 - DNA, 20 bp, human
ggaaacgggaaagatggcga

SEQ ID NO: 45632 - DNA, 20 bp, human
gtcagaggcgctgtgcccat

SEQ ID NO: 45633 - DNA, 20 bp, human
gactcagggtggtgagtccc

SEQ ID NO: 45634 - DNA, 20 bp, human
ggcggaaaagaagtcattcc

SEQ ID NO: 45635 - DNA, 20 bp, human
gaataatacggccggcgcag

SEQ ID NO: 45636 - DNA, 20 bp, human
gagcagcaactgcagttccg

SEQ ID NO: 45637 - DNA, 20 bp, human
gtgcagctgaggtacagcgg

SEQ ID NO: 45638 - DNA, 20 bp, human
gggtacagcggcggtttctg

SEQ ID NO: 45639 - DNA, 20 bp, human
gcgcgaaccgggcgaggaca

SEQ ID NO: 45640 - DNA, 20 bp, human
gctgcggtggcgtctccaca

SEQ ID NO: 45641 - DNA, 20 bp, human
gcggcgtcacgaggagacag

SEQ ID NO: 45642 - DNA, 20 bp, human
gctcgcgactgacggagctg

SEQ ID NO: 45643 - DNA, 20 bp, human
gtgaccggacaaggagccca

SEQ ID NO: 45644 - DNA, 20 bp, human
ggcgactgacggagctgcgg

SEQ ID NO: 45645 - DNA, 20 bp, human
gaaacacgcggggttcaaca

SEQ ID NO: 45646 - DNA, 20 bp, human
gctgtggggaggcgacgcag

SEQ ID NO: 45647 - DNA, 20 bp, human
gccatggcgtcgttactgtg

SEQ ID NO: 45648 - DNA, 20 bp, human
gggagcagcaatcgcagcca

SEQ ID NO: 45649 - DNA, 20 bp, human
gtggcgtcgttactgtgggg

SEQ ID NO: 45650 - DNA, 20 bp, human
gggctcacggcaccaacaag

SEQ ID NO: 45651 - DNA, 20 bp, human
gtggggaggcgacgcagggg

SEQ ID NO: 45652 - DNA, 20 bp, human
gcagcacgtgcttccaccac

SEQ ID NO: 45653 - DNA, 20 bp, human
gcacggcaccaacaagggga

SEQ ID NO: 45654 - DNA, 20 bp, human
gaggcctctagtttagagtt

SEQ ID NO: 45655 - DNA, 20 bp, human
gaagtgcgctggcaaatgga

SEQ ID NO: 45656 - DNA, 20 bp, human
gggcccagattctgccctgt

SEQ ID NO: 45657 - DNA, 20 bp, human
ggcgggacagcaataaaagg

SEQ ID NO: 45658 - DNA, 20 bp, human
gagctggactagaaaacctc

SEQ ID NO: 45659 - DNA, 20 bp, human
gtaccgtttctccgcccaca

SEQ ID NO: 45660 - DNA, 20 bp, human
gtgagagtgaccgaacagag

SEQ ID NO: 45661 - DNA, 20 bp, human
gtttattgctgtcccgccac

SEQ ID NO: 45662 - DNA, 20 bp, human
gtgggcggagaaacggtagc

SEQ ID NO: 45663 - DNA, 20 bp, human
gtagaaaactggggggcggg

SEQ ID NO: 45664 - DNA, 20 bp, human
gtcattagtaccagggatcc

SEQ ID NO: 45665 - DNA, 20 bp, human
gttctttcgtccaaattgag

SEQ ID NO: 45666 - DNA, 20 bp, human
gtaggcagtagtcctggcag

SEQ ID NO: 45667 - DNA, 20 bp, human
gagagacggcgctcagtctg

SEQ ID NO: 45668 - DNA, 20 bp, human
gtgaaccagcgcactgacct

SEQ ID NO: 45669 - DNA, 20 bp, human
gctatgaggaacagcaggat

SEQ ID NO: 45670 - DNA, 20 bp, human
gtgagcgcggacggatgctt

SEQ ID NO: 45671 - DNA, 20 bp, human
ggatgcttaggcagtagtcc

SEQ ID NO: 45672 - DNA, 20 bp, human
gggtcgcgtaggaaaggagg

SEQ ID NO: 45673 - DNA, 20 bp, human
gttggcaatgtccaaataag

SEQ ID NO: 45674 - DNA, 20 bp, human
ggtcacatggtgccgatggt

SEQ ID NO: 45675 - DNA, 20 bp, human
ggagctcccgagggatttca

SEQ ID NO: 45676 - DNA, 20 bp, human
gagggacctgaggaatcgcg

SEQ ID NO: 45677 - DNA, 20 bp, human
gacctcgtcatcctcgccta

SEQ ID NO: 45678 - DNA, 20 bp, human
gtcggcttaatcggaaccat

SEQ ID NO: 45679 - DNA, 20 bp, human
gccacgccctgtgtaagaga

SEQ ID NO: 45680 - DNA, 20 bp, human
ggctgacttcacctcttaca

SEQ ID NO: 45681 - DNA, 20 bp, human
gggacgtagagataacctag

SEQ ID NO: 45682 - DNA, 20 bp, human
gacgaaaggacagctaacca

SEQ ID NO: 45683 - DNA, 20 bp, human
gaccataggcgaggatgacg

SEQ ID NO: 45684 - DNA, 20 bp, human
gttgcgcaaagacgacgagg

SEQ ID NO: 45685 - DNA, 20 bp, human
gtacttgcgcaaagacgacg

SEQ ID NO: 45686 - DNA, 20 bp, human
gaggagcaaccgagtcacga

SEQ ID NO: 45687 - DNA, 20 bp, human
ggcggccgcgaagtagtgag

SEQ ID NO: 45688 - DNA, 20 bp, human
gggaccgtgaggccccgtcg

SEQ ID NO: 45689 - DNA, 20 bp, human
gggctctaacgcggccggtg

SEQ ID NO: 45690 - DNA, 20 bp, human
gacagcggcagttggaacag

SEQ ID NO: 45691 - DNA, 20 bp, human
ggtgctgcacgcactacagg

SEQ ID NO: 45692 - DNA, 20 bp, human
gcatcccagtggctctacag

SEQ ID NO: 45693 - DNA, 20 bp, human
ggccgcgccgaaaccagcag

SEQ ID NO: 45694 - DNA, 20 bp, human
ggtgcgaaagctctcgtcta

SEQ ID NO: 45695 - DNA, 20 bp, human
ggcgcaacaggaggcgccag

SEQ ID NO: 45696 - DNA, 20 bp, human
ggcaacgcggccctaccagg

SEQ ID NO: 45697 - DNA, 20 bp, human
ggcgtcacccacgcagacca

SEQ ID NO: 45698 - DNA, 20 bp, human
gtaagcgggagaaagacacc

SEQ ID NO: 45699 - DNA, 20 bp, human
gttgtcgaagagcgaaccgt

SEQ ID NO: 45700 - DNA, 20 bp, human
gtcgaagagcgaaccgtcgg

SEQ ID NO: 45701 - DNA, 20 bp, human
gtgggcccgggaccccacgt

SEQ ID NO: 45702 - DNA, 20 bp, human
gttcaggtcctaccttccac

SEQ ID NO: 45703 - DNA, 20 bp, human
ggacgtctggagaacgtcct

SEQ ID NO: 45704 - DNA, 20 bp, human
gagaccatggcagccgccga

SEQ ID NO: 45705 - DNA, 20 bp, human
gcgtggtgcagcagcgagcc

SEQ ID NO: 45706 - DNA, 20 bp, human
gcccggcggaaaaccgaagt

SEQ ID NO: 45707 - DNA, 20 bp, human
gcatttggagagggacgagg

SEQ ID NO: 45708 - DNA, 20 bp, human
ggcagcgcgcggagaagaac

SEQ ID NO: 45709 - DNA, 20 bp, human
gctcgtgtctgagcgcccgg

SEQ ID NO: 45710 - DNA, 20 bp, human
ggggcgcatgcgctaggggt

SEQ ID NO: 45711 - DNA, 20 bp, human
gctgagagcgagaggacgag

SEQ ID NO: 45712 - DNA, 20 bp, human
gaccaagaagaaggtagact

SEQ ID NO: 45713 - DNA, 20 bp, human
ggtccgaatagaccccgcgg

SEQ ID NO: 45714 - DNA, 20 bp, human
ggaactgacagactccaagt

SEQ ID NO: 45715 - DNA, 20 bp, human
gggcctggggccatttggag

SEQ ID NO: 45716 - DNA, 20 bp, human
gacagggagagcgcgtatgg

SEQ ID NO: 45717 - DNA, 20 bp, human
gtaaacagggagagcgcgta

SEQ ID NO: 45718 - DNA, 20 bp, human
ggccaaagcttacctaaaca

SEQ ID NO: 45719 - DNA, 20 bp, human
gctcctcccagtcccaccga

SEQ ID NO: 45720 - DNA, 20 bp, human
ggcggcagcaacagcgacga

SEQ ID NO: 45721 - DNA, 20 bp, human
gaggcctcagcatcaatgag

SEQ ID NO: 45722 - DNA, 20 bp, human
gagcctgcaaccggaagtga

SEQ ID NO: 45723 - DNA, 20 bp, human
gctcggccctcggtgggact

SEQ ID NO: 45724 - DNA, 20 bp, human
gaagagctcaagaaaggaca

SEQ ID NO: 45725 - DNA, 20 bp, human
gccgagaaagagctcaagaa

SEQ ID NO: 45726 - DNA, 20 bp, human
gatctgcctagctcccacta

SEQ ID NO: 45727 - DNA, 20 bp, human
gccctctcacgggagaactg

SEQ ID NO: 45728 - DNA, 20 bp, human
gaccgcgaaggccctctcac

SEQ ID NO: 45729 - DNA, 20 bp, human
gtcccgtgagagggccttcg

SEQ ID NO: 45730 - DNA, 20 bp, human
gcccgggacgagcacaatgg

SEQ ID NO: 45731 - DNA, 20 bp, human
gcccaggtcactaatcagtc

SEQ ID NO: 45732 - DNA, 20 bp, human
ggtccccgggacgagcacaa

SEQ ID NO: 45733 - DNA, 20 bp, human
gactcacacccgccagcccg

SEQ ID NO: 45734 - DNA, 20 bp, human
gctgaagagtaccgagaact

SEQ ID NO: 45735 - DNA, 20 bp, human
gcattagccaggttaggtca

SEQ ID NO: 45736 - DNA, 20 bp, human
gaaatcgggtagtccactgt

SEQ ID NO: 45737 - DNA, 20 bp, human
gttcggtctcacacctacag

SEQ ID NO: 45738 - DNA, 20 bp, human
gagtactgggcctcacgcaa

SEQ ID NO: 45739 - DNA, 20 bp, human
gtgaagagaagcgaaaaatc

SEQ ID NO: 45740 - DNA, 20 bp, human
gccagggtgaggctcttatc

SEQ ID NO: 45741 - DNA, 20 bp, human
gactgggcctcacgcaatgg

SEQ ID NO: 45742 - DNA, 20 bp, human
gtcccgtagaaagcctcggt

SEQ ID NO: 45743 - DNA, 20 bp, human
gcacgaacccgtttgtgagg

SEQ ID NO: 45744 - DNA, 20 bp, human
gtcgcacatgcgcgtctcca

SEQ ID NO: 45745 - DNA, 20 bp, human
gcacctgctggtccagttca

SEQ ID NO: 45746 - DNA, 20 bp, human
gtacgggagtcgactgggta

SEQ ID NO: 45747 - DNA, 20 bp, human
gaggggtacgggagtcgact

SEQ ID NO: 45748 - DNA, 20 bp, human
ggggagagcaagccgcggag

SEQ ID NO: 45749 - DNA, 20 bp, human
ggccagttcccgtagaaaag

SEQ ID NO: 45750 - DNA, 20 bp, human
ggtcgcgtgggcgcctgcga

SEQ ID NO: 45751 - DNA, 20 bp, human
gccacgggtgcccaaagtct

SEQ ID NO: 45752 - DNA, 20 bp, human
gggttactggggagcccgta

SEQ ID NO: 45753 - DNA, 20 bp, human
gggggcggggacaggggtac

SEQ ID NO: 45754 - DNA, 20 bp, human
gcggggtctcagagtcccac

SEQ ID NO: 45755 - DNA, 20 bp, human
ggtgtttgtggcgtgcgtgg

SEQ ID NO: 45756 - DNA, 20 bp, human
gcggaacccgaacggaaggt

SEQ ID NO: 45757 - DNA, 20 bp, human
gggaggagtcggaacccgaa

SEQ ID NO: 45758 - DNA, 20 bp, human
ggagtcggaacccgaacgga

SEQ ID NO: 45759 - DNA, 20 bp, human
gcgggatccacagataggat

SEQ ID NO: 45760 - DNA, 20 bp, human
gggcgagaccccgcgcgtgt

SEQ ID NO: 45761 - DNA, 20 bp, human
gaccgacggcttgatctgag

SEQ ID NO: 45762 - DNA, 20 bp, human
ggccggcagctactggtgag

SEQ ID NO: 45763 - DNA, 20 bp, human
gtgggagcgggcgtgaagag

SEQ ID NO: 45764 - DNA, 20 bp, human
gcagacaaacgagggaccga

SEQ ID NO: 45765 - DNA, 20 bp, human
ggatgggcatggagtccaca

SEQ ID NO: 45766 - DNA, 20 bp, human
ggcgggcgcggagcgaatcc

SEQ ID NO: 45767 - DNA, 20 bp, human
gcagcgcgtactttgggctc

SEQ ID NO: 45768 - DNA, 20 bp, human
gtcagcaacgggccgtgagg

SEQ ID NO: 45769 - DNA, 20 bp, human
gacggcccgttgctgaaggg

SEQ ID NO: 45770 - DNA, 20 bp, human
ggcctcggtaagacttgtga

SEQ ID NO: 45771 - DNA, 20 bp, human
gggctaggaaggaaccctag

SEQ ID NO: 45772 - DNA, 20 bp, human
gccgttgctgaaggggggag

SEQ ID NO: 45773 - DNA, 20 bp, human
gcaactgctgggcctagcga

SEQ ID NO: 45774 - DNA, 20 bp, human
gctccggaaagccgccaact

SEQ ID NO: 45775 - DNA, 20 bp, human
gctccagtgcccccaaggac

SEQ ID NO: 45776 - DNA, 20 bp, human
gagacctgaacctcactagg

SEQ ID NO: 45777 - DNA, 20 bp, human
gagctggacggcaacgacgt

SEQ ID NO: 45778 - DNA, 20 bp, human
gggccttgggagctcctccg

SEQ ID NO: 45779 - DNA, 20 bp, human
gctaggtggcagctgattgg

SEQ ID NO: 45780 - DNA, 20 bp, human
gcttgggagctcctccgtgg

SEQ ID NO: 45781 - DNA, 20 bp, human
ggtcctgagggatatagtgt

SEQ ID NO: 45782 - DNA, 20 bp, human
gtggcagggcaggataggtg

SEQ ID NO: 45783 - DNA, 20 bp, human
ggggacattgttccaagaag

SEQ ID NO: 45784 - DNA, 20 bp, human
ggaacaatgtcccaccacgg

SEQ ID NO: 45785 - DNA, 20 bp, human
gctcttacgacgtcacggtc

SEQ ID NO: 45786 - DNA, 20 bp, human
ggcgaaccggacaaacaagg

SEQ ID NO: 45787 - DNA, 20 bp, human
ggcagcgctgaccgcacgtg

SEQ ID NO: 45788 - DNA, 20 bp, human
gggatggccgccacagctgt

SEQ ID NO: 45789 - DNA, 20 bp, human
ggcctgtgcgtggtactcaa

SEQ ID NO: 45790 - DNA, 20 bp, human
gagggttgttcccgctccag

SEQ ID NO: 45791 - DNA, 20 bp, human
gcaatcactaacgtcctgga

SEQ ID NO: 45792 - DNA, 20 bp, human
gcaggcgaaccggacaaaca

SEQ ID NO: 45793 - DNA, 20 bp, human
gtgggtcgggagtcacggtg

SEQ ID NO: 45794 - DNA, 20 bp, human
gcccttgaagtggcgggatg

SEQ ID NO: 45795 - DNA, 20 bp, human
gtcccctgcactaccatcag

SEQ ID NO: 45796 - DNA, 20 bp, human
gaaaaggctatggaaaacat

SEQ ID NO: 45797 - DNA, 20 bp, human
ggagcaacgtaaaaaggcta

SEQ ID NO: 45798 - DNA, 20 bp, human
gcacaagaagtagcgagaaa

SEQ ID NO: 45799 - DNA, 20 bp, human
gcgagaagagcaacgtaaaa

SEQ ID NO: 45800 - DNA, 20 bp, human
gttctggtcaaagttcttgg

SEQ ID NO: 45801 - DNA, 20 bp, human
gaggtgttatacaggctatt

SEQ ID NO: 45802 - DNA, 20 bp, human
gggagtttagaggacgatga

SEQ ID NO: 45803 - DNA, 20 bp, human
gtggaatgacgaaaaagtca

SEQ ID NO: 45804 - DNA, 20 bp, human
gaactttgaccagaataagc

SEQ ID NO: 45805 - DNA, 20 bp, human
gcgtcatagagttatttaaa

SEQ ID NO: 45806 - DNA, 20 bp, human
ggagacctcacacaagatgg

SEQ ID NO: 45807 - DNA, 20 bp, human
gtcggctgggacgcttcggt

SEQ ID NO: 45808 - DNA, 20 bp, human
gacaatcggctgggacgctt

SEQ ID NO: 45809 - DNA, 20 bp, human
gcacaagatggcggcacccg

SEQ ID NO: 45810 - DNA, 20 bp, human
gccggagacctcacacaaga

SEQ ID NO: 45811 - DNA, 20 bp, human
gtcggagaatcgtgttcctc

SEQ ID NO: 45812 - DNA, 20 bp, human
gtcccagccgattgtggaag

SEQ ID NO: 45813 - DNA, 20 bp, human
gactatcagagcgggatcta

SEQ ID NO: 45814 - DNA, 20 bp, human
gcgcgccgcagacccacttc

SEQ ID NO: 45815 - DNA, 20 bp, human
gtggcgaatagggcaaatag

SEQ ID NO: 45816 - DNA, 20 bp, human
gctacaagcggccacaagga

SEQ ID NO: 45817 - DNA, 20 bp, human
gccggaagcgcggatcacac

SEQ ID NO: 45818 - DNA, 20 bp, human
gtcacacgggcccctacaag

SEQ ID NO: 45819 - DNA, 20 bp, human
gtacaaggggcccctacaag

SEQ ID NO: 45820 - DNA, 20 bp, human
ggtggctcgtggaacaatgt

SEQ ID NO: 45821 - DNA, 20 bp, human
gggagctcgggctgtcatcg

SEQ ID NO: 45822 - DNA, 20 bp, human
ggtgggaccggaataagcaa

SEQ ID NO: 45823 - DNA, 20 bp, human
gggcaggcttcgcggagctc

SEQ ID NO: 45824 - DNA, 20 bp, human
ggcgaagcctgccatccttg

SEQ ID NO: 45825 - DNA, 20 bp, human
gtcatagtctcagcacaggg

SEQ ID NO: 45826 - DNA, 20 bp, human
gaagctgcactactagagac

SEQ ID NO: 45827 - DNA, 20 bp, human
gtgacggcgaagccttgcgg

SEQ ID NO: 45828 - DNA, 20 bp, human
gagaccggtagaaatgaatg

SEQ ID NO: 45829 - DNA, 20 bp, human
gctagtagtgcagcttcggc

SEQ ID NO: 45830 - DNA, 20 bp, human
ggctgttgagggagttgaga

SEQ ID NO: 45831 - DNA, 20 bp, human
gctggaaatggcctcgatga

SEQ ID NO: 45832 - DNA, 20 bp, human
gtgagagggagcgtattgtg

SEQ ID NO: 45833 - DNA, 20 bp, human
ggattggggagctgtcgggg

SEQ ID NO: 45834 - DNA, 20 bp, human
gcggcgaagccttgcggggg

SEQ ID NO: 45835 - DNA, 20 bp, human
gcgggaccgagggtgagttt

SEQ ID NO: 45836 - DNA, 20 bp, human
gacagcgtgaaaggaagcgg

SEQ ID NO: 45837 - DNA, 20 bp, human
gcagtggccacaaccaccta

SEQ ID NO: 45838 - DNA, 20 bp, human
gccgcaatgggcgggatgga

SEQ ID NO: 45839 - DNA, 20 bp, human
gtggcgcctgaatctcagat

SEQ ID NO: 45840 - DNA, 20 bp, human
gcgggcagcgacagcgtgaa

SEQ ID NO: 45841 - DNA, 20 bp, human
ggccggcgcagcccaaaagg

SEQ ID NO: 45842 - DNA, 20 bp, human
gattcaggcgccaacgggaa

SEQ ID NO: 45843 - DNA, 20 bp, human
ggcgacagcgtgaaaggaag

SEQ ID NO: 45844 - DNA, 20 bp, human
gacgcatggccaaggccggg

SEQ ID NO: 45845 - DNA, 20 bp, human
gccggctgcaaatggcgagg

SEQ ID NO: 45846 - DNA, 20 bp, human
gcggtacccgggccccgatg

SEQ ID NO: 45847 - DNA, 20 bp, human
gtgcgaggcagacacccacc

SEQ ID NO: 45848 - DNA, 20 bp, human
gctcgcagaaagcaacgagg

SEQ ID NO: 45849 - DNA, 20 bp, human
ggagcccgcgcagaccgagg

SEQ ID NO: 45850 - DNA, 20 bp, human
gcatggccagccgcacgcct

SEQ ID NO: 45851 - DNA, 20 bp, human
gcgcgctgcgatgacgtcgg

SEQ ID NO: 45852 - DNA, 20 bp, human
gcgcgccacgcccgagtccc

SEQ ID NO: 45853 - DNA, 20 bp, human
gagccgcacgcctgggactc

SEQ ID NO: 45854 - DNA, 20 bp, human
gtgctgacgcgctgccgggt

SEQ ID NO: 45855 - DNA, 20 bp, human
gtggcgcgctgcgatgacgt

SEQ ID NO: 45856 - DNA, 20 bp, human
gcggcgcacatggacacccg

SEQ ID NO: 45857 - DNA, 20 bp, human
gcgcaggcgccgtagaactg

SEQ ID NO: 45858 - DNA, 20 bp, human
ggagccggcgaaagagatcg

SEQ ID NO: 45859 - DNA, 20 bp, human
gcaggcaagccgaacacaaa

SEQ ID NO: 45860 - DNA, 20 bp, human
gaagcaaaataccccaaggg

SEQ ID NO: 45861 - DNA, 20 bp, human
gcgcatgccaagccaaactt

SEQ ID NO: 45862 - DNA, 20 bp, human
gcagcagcgggttcattccc

SEQ ID NO: 45863 - DNA, 20 bp, human
gagaaagcgccacagttcta

SEQ ID NO: 45864 - DNA, 20 bp, human
ggagggccgagtaactgaga

SEQ ID NO: 45865 - DNA, 20 bp, human
ggtcccttgggcacaatacc

SEQ ID NO: 45866 - DNA, 20 bp, human
gccggcttctcgcctacata

SEQ ID NO: 45867 - DNA, 20 bp, human
gtgtgggatagtgggagtat

SEQ ID NO: 45868 - DNA, 20 bp, human
gatagtgggagtatcggcac

SEQ ID NO: 45869 - DNA, 20 bp, human
gcaccttctgcaccaaaaga

SEQ ID NO: 45870 - DNA, 20 bp, human
gcttctcgcctacatacggt

SEQ ID NO: 45871 - DNA, 20 bp, human
ggggcccagtgggacattgt

SEQ ID NO: 45872 - DNA, 20 bp, human
ggatgcagcattatccacac

SEQ ID NO: 45873 - DNA, 20 bp, human
gtgggacattgtgggatagt

SEQ ID NO: 45874 - DNA, 20 bp, human
ggtgtggtcattggttacag

SEQ ID NO: 45875 - DNA, 20 bp, human
ggtcccactgggccccagag

SEQ ID NO: 45876 - DNA, 20 bp, human
gtcccagcgcgcggcccgaa

SEQ ID NO: 45877 - DNA, 20 bp, human
gcccttgtcggccgccattc

SEQ ID NO: 45878 - DNA, 20 bp, human
gccatggcagctcgcgaccg

SEQ ID NO: 45879 - DNA, 20 bp, human
ggcgctgggaacgcagaagg

SEQ ID NO: 45880 - DNA, 20 bp, human
gctccagccccgggatccca

SEQ ID NO: 45881 - DNA, 20 bp, human
ggagacgcgcgaccaaaacc

SEQ ID NO: 45882 - DNA, 20 bp, human
ggcccgaatggcggccgaca

SEQ ID NO: 45883 - DNA, 20 bp, human
ggatccgccccacgagcagg

SEQ ID NO: 45884 - DNA, 20 bp, human
gccaagaccggtcctcgggt

SEQ ID NO: 45885 - DNA, 20 bp, human
gatggcggccgacaagggcc

SEQ ID NO: 45886 - DNA, 20 bp, human
gtagctgggaaacctcgtta

SEQ ID NO: 45887 - DNA, 20 bp, human
ggaagctgcgtgaagcccct

SEQ ID NO: 45888 - DNA, 20 bp, human
gcatcagaggccgggacagt

SEQ ID NO: 45889 - DNA, 20 bp, human
gtcacgcagcttccttaacg

SEQ ID NO: 45890 - DNA, 20 bp, human
gcttcccagcgcctgtcagg

SEQ ID NO: 45891 - DNA, 20 bp, human
ggaggccgggacagtaggaa

SEQ ID NO: 45892 - DNA, 20 bp, human
gtcagattagggtaacgctg

SEQ ID NO: 45893 - DNA, 20 bp, human
ggtaggaagggggaaactgt

SEQ ID NO: 45894 - DNA, 20 bp, human
gtcggggacaaggcacctga

SEQ ID NO: 45895 - DNA, 20 bp, human
ggtcacgagcaccgcctgac

SEQ ID NO: 45896 - DNA, 20 bp, human
gctgggcgcgctgcgggagc

SEQ ID NO: 45897 - DNA, 20 bp, human
gtccctggcgtgggggagtg

SEQ ID NO: 45898 - DNA, 20 bp, human
gcgagcagcggcgaccgacg

SEQ ID NO: 45899 - DNA, 20 bp, human
gcatgtgacagagggctcct

SEQ ID NO: 45900 - DNA, 20 bp, human
gccatggagcatgtgacaga

SEQ ID NO: 45901 - DNA, 20 bp, human
gcctgcgggtgcagcggcac

SEQ ID NO: 45902 - DNA, 20 bp, human
gtggagggatgagcgcccca

SEQ ID NO: 45903 - DNA, 20 bp, human
gacaaggcgcgttcgagcag

SEQ ID NO: 45904 - DNA, 20 bp, human
gttgagaccacagcacccga

SEQ ID NO: 45905 - DNA, 20 bp, human
gcccgctgcatcggacccac

SEQ ID NO: 45906 - DNA, 20 bp, human
gggtcgcgaccagcccagat

SEQ ID NO: 45907 - DNA, 20 bp, human
gtggaggactctgaagcact

SEQ ID NO: 45908 - DNA, 20 bp, human
gacacatgggcctcgatccc

SEQ ID NO: 45909 - DNA, 20 bp, human
gttctcaggccggcctgcac

SEQ ID NO: 45910 - DNA, 20 bp, human
gcaggagaaggccatcccac

SEQ ID NO: 45911 - DNA, 20 bp, human
gctgaaggagccggggatcg

SEQ ID NO: 45912 - DNA, 20 bp, human
ggggtaacgagagagctgag

SEQ ID NO: 45913 - DNA, 20 bp, human
gagccctcgcgtgtacctga

SEQ ID NO: 45914 - DNA, 20 bp, human
ggccggcctgcacgggtaca

SEQ ID NO: 45915 - DNA, 20 bp, human
gcctaggctgtcaccgatct

SEQ ID NO: 45916 - DNA, 20 bp, human
ggctagctgcaagcagaggc

SEQ ID NO: 45917 - DNA, 20 bp, human
gcgtagctagctgcaagcag

SEQ ID NO: 45918 - DNA, 20 bp, human
gggagggtgagtgtctccag

SEQ ID NO: 45919 - DNA, 20 bp, human
gtagtgaggcacagcctgcg

SEQ ID NO: 45920 - DNA, 20 bp, human
gaggctgcgtcgctgctcgg

SEQ ID NO: 45921 - DNA, 20 bp, human
gacgcgaggcggagctgcat

SEQ ID NO: 45922 - DNA, 20 bp, human
ggccatgtagctcaggatgt

SEQ ID NO: 45923 - DNA, 20 bp, human
gactagctttaaagccgggt

SEQ ID NO: 45924 - DNA, 20 bp, human
gccgagggctcctcaaactc

SEQ ID NO: 45925 - DNA, 20 bp, human
gtttaaagccgggtaggagg

SEQ ID NO: 45926 - DNA, 20 bp, human
gtgggaggaaggccgcgcag

SEQ ID NO: 45927 - DNA, 20 bp, human
gagggcccgccagtgcacgg

SEQ ID NO: 45928 - DNA, 20 bp, human
gggccccctcccaaaacccg

SEQ ID NO: 45929 - DNA, 20 bp, human
gactggcgggccctcccctc

SEQ ID NO: 45930 - DNA, 20 bp, human
ggggccgcagtcctgacgag

SEQ ID NO: 45931 - DNA, 20 bp, human
ggcgcgttggcgagaattgg

SEQ ID NO: 45932 - DNA, 20 bp, human
gcccgaggcgcttcacgtca

SEQ ID NO: 45933 - DNA, 20 bp, human
gtgggacacggggaactgta

SEQ ID NO: 45934 - DNA, 20 bp, human
gttggtggtgcggagcggag

SEQ ID NO: 45935 - DNA, 20 bp, human
ggtgggaggcaacgcccgag

SEQ ID NO: 45936 - DNA, 20 bp, human
gcgggcggaggtttccgagg

SEQ ID NO: 45937 - DNA, 20 bp, human
ggagaggaggccgtagcgag

SEQ ID NO: 45938 - DNA, 20 bp, human
ggcgggcagcggaggaggta

SEQ ID NO: 45939 - DNA, 20 bp, human
ggcgccacgagagcgggcag

SEQ ID NO: 45940 - DNA, 20 bp, human
gtcggcggcgccacgagagc

SEQ ID NO: 45941 - DNA, 20 bp, human
gccacgagagcgggcagcgg

SEQ ID NO: 45942 - DNA, 20 bp, human
gggcggtcggcagctgtgtg

SEQ ID NO: 45943 - DNA, 20 bp, human
gggtagggctggacagccgg

SEQ ID NO: 45944 - DNA, 20 bp, human
gatgtggtgcgcagcagggt

SEQ ID NO: 45945 - DNA, 20 bp, human
gctcgaagctcccaaaatgg

SEQ ID NO: 45946 - DNA, 20 bp, human
gcagagaggagtgcttagtt

SEQ ID NO: 45947 - DNA, 20 bp, human
gcgccggatgcataaaagac

SEQ ID NO: 45948 - DNA, 20 bp, human
ggctcagagcgccgagtcct

SEQ ID NO: 45949 - DNA, 20 bp, human
gccgagtcctaggccaggtc

SEQ ID NO: 45950 - DNA, 20 bp, human
gacctagcgcagagcccagg

SEQ ID NO: 45951 - DNA, 20 bp, human
gcataaaagactggctgcgg

SEQ ID NO: 45952 - DNA, 20 bp, human
gttccaggttaccccagacc

SEQ ID NO: 45953 - DNA, 20 bp, human
gctcggggcgcgggaatctg

SEQ ID NO: 45954 - DNA, 20 bp, human
gaggagtccccgtcaaaggt

SEQ ID NO: 45955 - DNA, 20 bp, human
ggttaccccagacctggcct

SEQ ID NO: 45956 - DNA, 20 bp, human
gcagagcctggcgtcggact

SEQ ID NO: 45957 - DNA, 20 bp, human
gttcgaacctggacattgac

SEQ ID NO: 45958 - DNA, 20 bp, human
gcgagcgcagagcctggcgt

SEQ ID NO: 45959 - DNA, 20 bp, human
ggagcgcccagtccgacgcc

SEQ ID NO: 45960 - DNA, 20 bp, human
gcgccgggcgagggaagctg

SEQ ID NO: 45961 - DNA, 20 bp, human
ggcagcttcgcggagaggta

SEQ ID NO: 45962 - DNA, 20 bp, human
gtgctaggtccaaagagctt

SEQ ID NO: 45963 - DNA, 20 bp, human
gctggggatctggggtgctg

SEQ ID NO: 45964 - DNA, 20 bp, human
ggggtcctctgcacccgagg

SEQ ID NO: 45965 - DNA, 20 bp, human
ggtgagagaggagagtgctc

SEQ ID NO: 45966 - DNA, 20 bp, human
ggcggagccgaggcgaacag

SEQ ID NO: 45967 - DNA, 20 bp, human
gctcggcggagtccggatgg

SEQ ID NO: 45968 - DNA, 20 bp, human
gggagtccggatggaggact

SEQ ID NO: 45969 - DNA, 20 bp, human
ggcccgaatagggaccgaaa

SEQ ID NO: 45970 - DNA, 20 bp, human
gcgccttcgggaaggctcgg

SEQ ID NO: 45971 - DNA, 20 bp, human
ggcaggtgtgcagggcgggt

SEQ ID NO: 45972 - DNA, 20 bp, human
gggggtgagctagtcacgtg

SEQ ID NO: 45973 - DNA, 20 bp, human
gactcggcggcaaagcagct

SEQ ID NO: 45974 - DNA, 20 bp, human
gggcgcgcgggaaccggacg

SEQ ID NO: 45975 - DNA, 20 bp, human
gcgaagccgccgcccgaata

SEQ ID NO: 45976 - DNA, 20 bp, human
gtactgaggaaaggtaatag

SEQ ID NO: 45977 - DNA, 20 bp, human
gcaggaagacagatctactg

SEQ ID NO: 45978 - DNA, 20 bp, human
gagacagatctactgaggaa

SEQ ID NO: 45979 - DNA, 20 bp, human
gtagctagatgagtaatcag

SEQ ID NO: 45980 - DNA, 20 bp, human
ggaggaaaggtaatagaggc

SEQ ID NO: 45981 - DNA, 20 bp, human
gaaggtaatagaggctggca

SEQ ID NO: 45982 - DNA, 20 bp, human
gaggcaagaagactcctgta

SEQ ID NO: 45983 - DNA, 20 bp, human
gttacagacagtctacttct

SEQ ID NO: 45984 - DNA, 20 bp, human
gcctccttgtgcattcatct

SEQ ID NO: 45985 - DNA, 20 bp, human
ggcacccagatgaatgcaca

SEQ ID NO: 45986 - DNA, 20 bp, human
ggagagcacagagcaacccg

SEQ ID NO: 45987 - DNA, 20 bp, human
gtccgaggagcgaggccaca

SEQ ID NO: 45988 - DNA, 20 bp, human
gtctcggggcgcaagagaaa

SEQ ID NO: 45989 - DNA, 20 bp, human
ggaaagggcaggaagtcttg

SEQ ID NO: 45990 - DNA, 20 bp, human
ggagaggacaggacgtctcg

SEQ ID NO: 45991 - DNA, 20 bp, human
gagaggacccggcgtccctg

SEQ ID NO: 45992 - DNA, 20 bp, human
ggcgaggacagggcatcccg

SEQ ID NO: 45993 - DNA, 20 bp, human
gcgccttccggcccgagttc

SEQ ID NO: 45994 - DNA, 20 bp, human
gagactcaacatgaagctac

SEQ ID NO: 45995 - DNA, 20 bp, human
gaacatgaagctaccggcca

SEQ ID NO: 45996 - DNA, 20 bp, human
gcgcccccacgtggtccccg

SEQ ID NO: 45997 - DNA, 20 bp, human
gcagtcgtccccctccacgt

SEQ ID NO: 45998 - DNA, 20 bp, human
gcggggactgcggggacaac

SEQ ID NO: 45999 - DNA, 20 bp, human
ggctgcgcgccgggtcctgg

SEQ ID NO: 46000 - DNA, 20 bp, human
ggactgcggggacaacgggc

SEQ ID NO: 46001 - DNA, 20 bp, human
gtgggccatggcgctcccgt

SEQ ID NO: 46002 - DNA, 20 bp, human
gtgtccccgcagtccccgac

SEQ ID NO: 46003 - DNA, 20 bp, human
ggagccctcggggaccacgt

SEQ ID NO: 46004 - DNA, 20 bp, human
gcgtccccctccacgtcggg

SEQ ID NO: 46005 - DNA, 20 bp, human
gcagccgccgcccgacgtgg

SEQ ID NO: 46006 - DNA, 20 bp, human
ggcggatggatccaacatgg

SEQ ID NO: 46007 - DNA, 20 bp, human
gggcgcggatggatccaaca

SEQ ID NO: 46008 - DNA, 20 bp, human
ggcctgagccgagagtgagg

SEQ ID NO: 46009 - DNA, 20 bp, human
gagccgagagtgaggcggag

SEQ ID NO: 46010 - DNA, 20 bp, human
gcgagcctgagccgagagtg

SEQ ID NO: 46011 - DNA, 20 bp, human
gcgcccctccgcctcactct

SEQ ID NO: 46012 - DNA, 20 bp, human
gctctcccgggcctgcctca

SEQ ID NO: 46013 - DNA, 20 bp, human
ggatccgctcgtattgaagg

SEQ ID NO: 46014 - DNA, 20 bp, human
gtggggaggggcgtaaacaa

SEQ ID NO: 46015 - DNA, 20 bp, human
gccagccaggggtattagag

SEQ ID NO: 46016 - DNA, 20 bp, human
ggccgtcgcccaggagtcat

SEQ ID NO: 46017 - DNA, 20 bp, human
ggaacgtagcacggtggtgg

SEQ ID NO: 46018 - DNA, 20 bp, human
gctggcgtccgatgactcct

SEQ ID NO: 46019 - DNA, 20 bp, human
ggtcatcggacgccagaatc

SEQ ID NO: 46020 - DNA, 20 bp, human
gcagtcagcagggagccccg

SEQ ID NO: 46021 - DNA, 20 bp, human
ggcaggcgtaataatagaga

SEQ ID NO: 46022 - DNA, 20 bp, human
gagctccgaacgtagcacgg

SEQ ID NO: 46023 - DNA, 20 bp, human
gcagtcctacccagagtcag

SEQ ID NO: 46024 - DNA, 20 bp, human
gctacacagaggagcgaccc

SEQ ID NO: 46025 - DNA, 20 bp, human
gaccgctggacggagaaaag

SEQ ID NO: 46026 - DNA, 20 bp, human
gtgggcccaacgctcaccaa

SEQ ID NO: 46027 - DNA, 20 bp, human
gggatggcaatggtaagcta

SEQ ID NO: 46028 - DNA, 20 bp, human
gaagttctgtagagaaactc

SEQ ID NO: 46029 - DNA, 20 bp, human
ggcccatggagtgaactggg

SEQ ID NO: 46030 - DNA, 20 bp, human
ggctacggaagcatagtcct

SEQ ID NO: 46031 - DNA, 20 bp, human
ggccgcccagttcactccat

SEQ ID NO: 46032 - DNA, 20 bp, human
gtcctgggctaaactcacaa

SEQ ID NO: 46033 - DNA, 20 bp, human
gtgggcccatggagtgaact

SEQ ID NO: 46034 - DNA, 20 bp, human
gtgcgcctgcgcatttctct

SEQ ID NO: 46035 - DNA, 20 bp, human
gatttctctgggtcgctccc

SEQ ID NO: 46036 - DNA, 20 bp, human
ggcggtaaaggcgtaccaga

SEQ ID NO: 46037 - DNA, 20 bp, human
gtccacgtccagcgcggtaa

SEQ ID NO: 46038 - DNA, 20 bp, human
gcccaagcatgactctgtgg

SEQ ID NO: 46039 - DNA, 20 bp, human
gggttctgagggccattatg

SEQ ID NO: 46040 - DNA, 20 bp, human
ggtgcccaagcatgactctg

SEQ ID NO: 46041 - DNA, 20 bp, human
gcactaggtctctggagggt

SEQ ID NO: 46042 - DNA, 20 bp, human
gtcagccatggccctgcgca

SEQ ID NO: 46043 - DNA, 20 bp, human
gggccctcagaaccccataa

SEQ ID NO: 46044 - DNA, 20 bp, human
gaactgggccccacaactgg

SEQ ID NO: 46045 - DNA, 20 bp, human
gggaggccaggaggttctga

SEQ ID NO: 46046 - DNA, 20 bp, human
ggtgtaaacaacgggaaagc

SEQ ID NO: 46047 - DNA, 20 bp, human
gcctaagagtagggatacgg

SEQ ID NO: 46048 - DNA, 20 bp, human
gccgggagacagatgcgagg

SEQ ID NO: 46049 - DNA, 20 bp, human
gcagccgggagacagatgcg

SEQ ID NO: 46050 - DNA, 20 bp, human
gggagacagatgcgaggcgg

SEQ ID NO: 46051 - DNA, 20 bp, human
gcagatgcgaggcggcggtc

SEQ ID NO: 46052 - DNA, 20 bp, human
gtgcgtgcggagcacccggg

SEQ ID NO: 46053 - DNA, 20 bp, human
gggtgtggacgccggagcag

SEQ ID NO: 46054 - DNA, 20 bp, human
ggagcagcggcggcgtcccc

SEQ ID NO: 46055 - DNA, 20 bp, human
ggctccgcacgcagctggtg

SEQ ID NO: 46056 - DNA, 20 bp, human
ggactgctgagacccaactc

SEQ ID NO: 46057 - DNA, 20 bp, human
gggagagaggttccagagtt

SEQ ID NO: 46058 - DNA, 20 bp, human
gtccgctgcaatctgctccg

SEQ ID NO: 46059 - DNA, 20 bp, human
gctaagtctagagggaagga

SEQ ID NO: 46060 - DNA, 20 bp, human
ggcagtctatgtcactgagg

SEQ ID NO: 46061 - DNA, 20 bp, human
gggcttcacttagaatctct

SEQ ID NO: 46062 - DNA, 20 bp, human
gcagagctgctaagtctaga

SEQ ID NO: 46063 - DNA, 20 bp, human
ggccccggagcagattgcag

SEQ ID NO: 46064 - DNA, 20 bp, human
gcaaagcatccaggtgagag

SEQ ID NO: 46065 - DNA, 20 bp, human
ggcagcggacatcccagaag

SEQ ID NO: 46066 - DNA, 20 bp, human
gacacacatgtcacatgtcc

SEQ ID NO: 46067 - DNA, 20 bp, human
gtgtgacatgtgtgtttaga

SEQ ID NO: 46068 - DNA, 20 bp, human
gttcgcccgctggttccctc

SEQ ID NO: 46069 - DNA, 20 bp, human
gggtcaccctgcctagctag

SEQ ID NO: 46070 - DNA, 20 bp, human
ggactgctgtctgccctctc

SEQ ID NO: 46071 - DNA, 20 bp, human
gcagtcagaggtcagattgg

SEQ ID NO: 46072 - DNA, 20 bp, human
gccaccccagagggaaccag

SEQ ID NO: 46073 - DNA, 20 bp, human
gggacctctggtgactgctg

SEQ ID NO: 46074 - DNA, 20 bp, human
ggaacgtctgtccggacctc

SEQ ID NO: 46075 - DNA, 20 bp, human
ggtccagtagagactatcac

SEQ ID NO: 46076 - DNA, 20 bp, human
gtagcagggattcacccgct

SEQ ID NO: 46077 - DNA, 20 bp, human
gcaaaacctacatggcagaa

SEQ ID NO: 46078 - DNA, 20 bp, human
gccgccccagagggacccag

SEQ ID NO: 46079 - DNA, 20 bp, human
gttcacccgctgggtccctc

SEQ ID NO: 46080 - DNA, 20 bp, human
gcttctaaacacacatgtcc

SEQ ID NO: 46081 - DNA, 20 bp, human
gggtcaccctgcctagctag

SEQ ID NO: 46082 - DNA, 20 bp, human
ggactgctgtctgccctctc

SEQ ID NO: 46083 - DNA, 20 bp, human
gggacctctggtgactgctg

SEQ ID NO: 46084 - DNA, 20 bp, human
gcagtcagaggtcagattgg

SEQ ID NO: 46085 - DNA, 20 bp, human
gcgtccccagcagtcaccag

SEQ ID NO: 46086 - DNA, 20 bp, human
gtagcagggattcacccgct

SEQ ID NO: 46087 - DNA, 20 bp, human
gcaaaacctacatggcagaa

SEQ ID NO: 46088 - DNA, 20 bp, human
gccgccccagagggacccag

SEQ ID NO: 46089 - DNA, 20 bp, human
gttcacccgctgggtccctc

SEQ ID NO: 46090 - DNA, 20 bp, human
gcttctaaacacacatgtcc

SEQ ID NO: 46091 - DNA, 20 bp, human
gggtcaccctgcctagctag

SEQ ID NO: 46092 - DNA, 20 bp, human
ggactgctgtctgccctctc

SEQ ID NO: 46093 - DNA, 20 bp, human
gggacctctggtgactgctg

SEQ ID NO: 46094 - DNA, 20 bp, human
gcagtcagaggtcagattgg

SEQ ID NO: 46095 - DNA, 20 bp, human
gcgtccccagcagtcaccag

SEQ ID NO: 46096 - DNA, 20 bp, human
gctgctgtgaacttctatct

SEQ ID NO: 46097 - DNA, 20 bp, human
ggtcctctcctctgtgtgca

SEQ ID NO: 46098 - DNA, 20 bp, human
gccacagtgagaggtcagac

SEQ ID NO: 46099 - DNA, 20 bp, human
ggaacttctatctgggtgtc

SEQ ID NO: 46100 - DNA, 20 bp, human
gaatgtttgcaaagcctacg

SEQ ID NO: 46101 - DNA, 20 bp, human
gcaagtaggacacgtgtgtt

SEQ ID NO: 46102 - DNA, 20 bp, human
ggagaggacttccttattta

SEQ ID NO: 46103 - DNA, 20 bp, human
gtgggtgtctggcggctgct

SEQ ID NO: 46104 - DNA, 20 bp, human
gagcaggggcttcacccgct

SEQ ID NO: 46105 - DNA, 20 bp, human
gaagctgtgatcgtctttat

SEQ ID NO: 46106 - DNA, 20 bp, human
gtgctcttagaacctcaggt

SEQ ID NO: 46107 - DNA, 20 bp, human
ggattgatgtctcctacctg

SEQ ID NO: 46108 - DNA, 20 bp, human
gaagtaaagtcactcaagtg

SEQ ID NO: 46109 - DNA, 20 bp, human
gtctggagtcaagtgtggaa

SEQ ID NO: 46110 - DNA, 20 bp, human
gtctctgctcttagaacctc

SEQ ID NO: 46111 - DNA, 20 bp, human
gaaaggagatagcaaggtcc

SEQ ID NO: 46112 - DNA, 20 bp, human
gtacaacccagaagcagtct

SEQ ID NO: 46113 - DNA, 20 bp, human
gagttctttgtagatctaaa

SEQ ID NO: 46114 - DNA, 20 bp, human
gagcctcatcagctctttcc

SEQ ID NO: 46115 - DNA, 20 bp, human
ggtcttccccagactgcttc

SEQ ID NO: 46116 - DNA, 20 bp, human
gaggatggtgagggttctca

SEQ ID NO: 46117 - DNA, 20 bp, human
gcacgaggagaacagcagtg

SEQ ID NO: 46118 - DNA, 20 bp, human
gacagcagtgaggatggtga

SEQ ID NO: 46119 - DNA, 20 bp, human
gtcatggctagggtcgctgg

SEQ ID NO: 46120 - DNA, 20 bp, human
ggtgagggttctcatggcta

SEQ ID NO: 46121 - DNA, 20 bp, human
ggaagaatcagtgatattca

SEQ ID NO: 46122 - DNA, 20 bp, human
gttgaggagtctctacttca

SEQ ID NO: 46123 - DNA, 20 bp, human
ggccatgtagaaatgtattg

SEQ ID NO: 46124 - DNA, 20 bp, human
ggagcttgcatcctctgcaa

SEQ ID NO: 46125 - DNA, 20 bp, human
gttctcatggctagggtcgc

SEQ ID NO: 46126 - DNA, 20 bp, human
ggacgactcctcacactgag

SEQ ID NO: 46127 - DNA, 20 bp, human
ggtgaggagtcgtcttgcag

SEQ ID NO: 46128 - DNA, 20 bp, human
gagagtaaacagcagaaggt

SEQ ID NO: 46129 - DNA, 20 bp, human
gctcgtcccttgggacacgg

SEQ ID NO: 46130 - DNA, 20 bp, human
ggcagcaatctcatccacat

SEQ ID NO: 46131 - DNA, 20 bp, human
ggagacgctggctcctttgg

SEQ ID NO: 46132 - DNA, 20 bp, human
gagaaggtaggaagttctca

SEQ ID NO: 46133 - DNA, 20 bp, human
ggggtcatggcgcttgtcac

SEQ ID NO: 46134 - DNA, 20 bp, human
gaggaagttctcatggcgac

SEQ ID NO: 46135 - DNA, 20 bp, human
gctgcaggccactcaaccac

SEQ ID NO: 46136 - DNA, 20 bp, human
ggtgaagcctagcagctatg

SEQ ID NO: 46137 - DNA, 20 bp, human
gtggaacaggcaccaaaaac

SEQ ID NO: 46138 - DNA, 20 bp, human
gcaaagcaaacagaagataa

SEQ ID NO: 46139 - DNA, 20 bp, human
gtgcctgttccaggtaagat

SEQ ID NO: 46140 - DNA, 20 bp, human
gagatgggctgggaaatcta

SEQ ID NO: 46141 - DNA, 20 bp, human
gtttcatccagtctcagcgt

SEQ ID NO: 46142 - DNA, 20 bp, human
gatggatcctcatagctgct

SEQ ID NO: 46143 - DNA, 20 bp, human
gcttcaccccacgctgagac

SEQ ID NO: 46144 - DNA, 20 bp, human
gttggtccaaagcactctga

SEQ ID NO: 46145 - DNA, 20 bp, human
gtccaaagcactctgaagga

SEQ ID NO: 46146 - DNA, 20 bp, human
gcagttaattaggaacccaa

SEQ ID NO: 46147 - DNA, 20 bp, human
gggacagccacaaatccata

SEQ ID NO: 46148 - DNA, 20 bp, human
gggtaaggcagagctcccta

SEQ ID NO: 46149 - DNA, 20 bp, human
ggggagctctgccttaccat

SEQ ID NO: 46150 - DNA, 20 bp, human
gaattaggaacccaatggta

SEQ ID NO: 46151 - DNA, 20 bp, human
ggtgtgttctgcatggtgag

SEQ ID NO: 46152 - DNA, 20 bp, human
gtgagtgggtgtgttctgca

SEQ ID NO: 46153 - DNA, 20 bp, human
gcctaattaactgagtgagt

SEQ ID NO: 46154 - DNA, 20 bp, human
gagatgggctgggaaatcta

SEQ ID NO: 46155 - DNA, 20 bp, human
gtgcctgttccaggtaagat

SEQ ID NO: 46156 - DNA, 20 bp, human
gcttgagctagtaagcctcg

SEQ ID NO: 46157 - DNA, 20 bp, human
gcatggaatcctcagcaatg

SEQ ID NO: 46158 - DNA, 20 bp, human
gtatgcaccttacagccacg

SEQ ID NO: 46159 - DNA, 20 bp, human
gtagtgagtcctcattgctg

SEQ ID NO: 46160 - DNA, 20 bp, human
gaaagctgttcagaaggagg

SEQ ID NO: 46161 - DNA, 20 bp, human
gtggctgtaaggtgcataca

SEQ ID NO: 46162 - DNA, 20 bp, human
gcagggtgccaaggacatct

SEQ ID NO: 46163 - DNA, 20 bp, human
gtgttcagaaggaggaggat

SEQ ID NO: 46164 - DNA, 20 bp, human
ggcgagaagcagacgcaagt

SEQ ID NO: 46165 - DNA, 20 bp, human
gagtaagcctcgtggctgta

SEQ ID NO: 46166 - DNA, 20 bp, human
gcatggaatcctcagcagtg

SEQ ID NO: 46167 - DNA, 20 bp, human
gtatgcaccttacagccatg

SEQ ID NO: 46168 - DNA, 20 bp, human
gtagtgagtcctcactgctg

SEQ ID NO: 46169 - DNA, 20 bp, human
gtgttcagaaggaggaggat

SEQ ID NO: 46170 - DNA, 20 bp, human
ggaaggaggaggatgggaga

SEQ ID NO: 46171 - DNA, 20 bp, human
gaaagctgttcagaaggagg

SEQ ID NO: 46172 - DNA, 20 bp, human
gcagggtgccaaggacatct

SEQ ID NO: 46173 - DNA, 20 bp, human
gtggctgtaaggtgcataca

SEQ ID NO: 46174 - DNA, 20 bp, human
ggcgagaagcagacgcaagt

SEQ ID NO: 46175 - DNA, 20 bp, human
gcatgaggcttactagctca

SEQ ID NO: 46176 - DNA, 20 bp, human
gctaaaagatggccctgatc

SEQ ID NO: 46177 - DNA, 20 bp, human
gactcttcggaatagagatt

SEQ ID NO: 46178 - DNA, 20 bp, human
gtcttttagggaagactctt

SEQ ID NO: 46179 - DNA, 20 bp, human
gttgagaagacccaaatgag

SEQ ID NO: 46180 - DNA, 20 bp, human
gctctcatggcacctgtcat

SEQ ID NO: 46181 - DNA, 20 bp, human
gggaaaaatcaagtcctgcc

SEQ ID NO: 46182 - DNA, 20 bp, human
ggctatgtcacatgtgaagt

SEQ ID NO: 46183 - DNA, 20 bp, human
gcaggtaagtaaaaatggat

SEQ ID NO: 46184 - DNA, 20 bp, human
gtcttagtaaatgtcactgt

SEQ ID NO: 46185 - DNA, 20 bp, human
gtaaaatgtcttcctgatca

SEQ ID NO: 46186 - DNA, 20 bp, human
gactcttcggaatagagatt

SEQ ID NO: 46187 - DNA, 20 bp, human
gctaaaagatggccctgatc

SEQ ID NO: 46188 - DNA, 20 bp, human
gtcttttagggaagactctt

SEQ ID NO: 46189 - DNA, 20 bp, human
gttgagaagacccaaatgag

SEQ ID NO: 46190 - DNA, 20 bp, human
gctctcatggcacctgtcat

SEQ ID NO: 46191 - DNA, 20 bp, human
gggaaaaatcaagtcctgcc

SEQ ID NO: 46192 - DNA, 20 bp, human
ggctatgtcacatgtgaagt

SEQ ID NO: 46193 - DNA, 20 bp, human
gtcttagtaaatgtcactgt

SEQ ID NO: 46194 - DNA, 20 bp, human
gtaaaatgtcttcctgatca

SEQ ID NO: 46195 - DNA, 20 bp, human
gttctcaaggccagcattcc

SEQ ID NO: 46196 - DNA, 20 bp, human
gatgatatgtgatcaagaaa

SEQ ID NO: 46197 - DNA, 20 bp, human
gtaaggagaagggacaggta

SEQ ID NO: 46198 - DNA, 20 bp, human
ggagcacggcaaagagaaag

SEQ ID NO: 46199 - DNA, 20 bp, human
ggaggaaagtcctcatgact

SEQ ID NO: 46200 - DNA, 20 bp, human
gttacagggaaggtgatcgg

SEQ ID NO: 46201 - DNA, 20 bp, human
gttctgaccccaggtaaaat

SEQ ID NO: 46202 - DNA, 20 bp, human
gcagggaaggtgatcggagg

SEQ ID NO: 46203 - DNA, 20 bp, human
gtatgcactcatgccagtca

SEQ ID NO: 46204 - DNA, 20 bp, human
gaaagtcctcatgactgggt

SEQ ID NO: 46205 - DNA, 20 bp, human
gttgagacaggtaaggagaa

SEQ ID NO: 46206 - DNA, 20 bp, human
gattacagaagaggcgttgg

SEQ ID NO: 46207 - DNA, 20 bp, human
gtaaggagaagggacaggta

SEQ ID NO: 46208 - DNA, 20 bp, human
ggagcacggcaaagagaaag

SEQ ID NO: 46209 - DNA, 20 bp, human
ggaggaaagtcctcatgact

SEQ ID NO: 46210 - DNA, 20 bp, human
gaaagtcctcatgactgggt

SEQ ID NO: 46211 - DNA, 20 bp, human
gttgagacaggtaaggagaa

SEQ ID NO: 46212 - DNA, 20 bp, human
gttctgaccccaggtaaaat

SEQ ID NO: 46213 - DNA, 20 bp, human
ggtagagattgagacaggta

SEQ ID NO: 46214 - DNA, 20 bp, human
gtatgcactcatgccagtca

SEQ ID NO: 46215 - DNA, 20 bp, human
gttacagggaaggtgatcgg

SEQ ID NO: 46216 - DNA, 20 bp, human
gtcatggctccaggcatcag

SEQ ID NO: 46217 - DNA, 20 bp, human
gcctgcgttgcagattacaa

SEQ ID NO: 46218 - DNA, 20 bp, human
gatcagtggagagctgatga

SEQ ID NO: 46219 - DNA, 20 bp, human
gatgaaggaagtgcagtagc

SEQ ID NO: 46220 - DNA, 20 bp, human
ggcgttgcagattacaaagg

SEQ ID NO: 46221 - DNA, 20 bp, human
gagggactggaagtcatcct

SEQ ID NO: 46222 - DNA, 20 bp, human
gatgacttccagtcccttca

SEQ ID NO: 46223 - DNA, 20 bp, human
gtacaaagttgaaggttcca

SEQ ID NO: 46224 - DNA, 20 bp, human
gttccttggcagagctgtta

SEQ ID NO: 46225 - DNA, 20 bp, human
gcaaagatgtctgaattcct

SEQ ID NO: 46226 - DNA, 20 bp, human
gtcatggctccaggcatcag

SEQ ID NO: 46227 - DNA, 20 bp, human
gatcagtggagagctgatga

SEQ ID NO: 46228 - DNA, 20 bp, human
gcctgcgttgcagattacaa

SEQ ID NO: 46229 - DNA, 20 bp, human
gatgaaggaagtgcagtagc

SEQ ID NO: 46230 - DNA, 20 bp, human
gatgacttccagtcccttca

SEQ ID NO: 46231 - DNA, 20 bp, human
gagggactggaagtcatcct

SEQ ID NO: 46232 - DNA, 20 bp, human
ggcgttgcagattacaaagg

SEQ ID NO: 46233 - DNA, 20 bp, human
gtacaaagttgaaggttcca

SEQ ID NO: 46234 - DNA, 20 bp, human
gcaaagatgtctgaattcct

SEQ ID NO: 46235 - DNA, 20 bp, human
ggagatggtcccggtcaatg

SEQ ID NO: 46236 - DNA, 20 bp, human
gacaactgacttgaaaaagg

SEQ ID NO: 46237 - DNA, 20 bp, human
gagaagagttgcaaagttgg

SEQ ID NO: 46238 - DNA, 20 bp, human
gatgcaatatataacataag

SEQ ID NO: 46239 - DNA, 20 bp, human
gcacagaagagttgcaaagt

SEQ ID NO: 46240 - DNA, 20 bp, human
gaaaacaactgacttgaaaa

SEQ ID NO: 46241 - DNA, 20 bp, human
gtagagagtttcttaaaaaa

SEQ ID NO: 46242 - DNA, 20 bp, human
ggttatatattgcataaact

SEQ ID NO: 46243 - DNA, 20 bp, human
gcaaatatttgcatattacc

SEQ ID NO: 46244 - DNA, 20 bp, human
gttgtctttattatctgttc

SEQ ID NO: 46245 - DNA, 20 bp, human
gttctttattctgcactttt

SEQ ID NO: 46246 - DNA, 20 bp, human
gtataagtaaacagggactg

SEQ ID NO: 46247 - DNA, 20 bp, human
gatttgaaaaggcccgacat

SEQ ID NO: 46248 - DNA, 20 bp, human
gatatgtccagctgttgagt

SEQ ID NO: 46249 - DNA, 20 bp, human
gataatgttgctgagaacaa

SEQ ID NO: 46250 - DNA, 20 bp, human
gtgtccagctgttgagtagg

SEQ ID NO: 46251 - DNA, 20 bp, human
gcagtcttcataaagctatg

SEQ ID NO: 46252 - DNA, 20 bp, human
gcgggccttttcaaatattg

SEQ ID NO: 46253 - DNA, 20 bp, human
gatttcataagagtgctaag

SEQ ID NO: 46254 - DNA, 20 bp, human
gtcttcatggaaatgataaa

SEQ ID NO: 46255 - DNA, 20 bp, human
gaagaacatataagtaaaca

SEQ ID NO: 46256 - DNA, 20 bp, human
gcccctagcaatcattaggt

SEQ ID NO: 46257 - DNA, 20 bp, human
gtttagaacacagaacatgt

SEQ ID NO: 46258 - DNA, 20 bp, human
ggccaacctaatgattgcta

SEQ ID NO: 46259 - DNA, 20 bp, human
gtagagaaaattgccttata

SEQ ID NO: 46260 - DNA, 20 bp, human
gtctacccctagcaatcatt

SEQ ID NO: 46261 - DNA, 20 bp, human
gtggtagctacaatagcagt

SEQ ID NO: 46262 - DNA, 20 bp, human
gttcatatgaactccttata

SEQ ID NO: 46263 - DNA, 20 bp, human
gaaatttaattctacatctc

SEQ ID NO: 46264 - DNA, 20 bp, human
gcaagacacagtgaagacaa

SEQ ID NO: 46265 - DNA, 20 bp, human
gctgtgtcttgtggtccatc

SEQ ID NO: 46266 - DNA, 20 bp, human
gtctttattatactgaatct

SEQ ID NO: 46267 - DNA, 20 bp, human
gaacagcagtgtatatttct

SEQ ID NO: 46268 - DNA, 20 bp, human
gatgtgaccttcattctacc

SEQ ID NO: 46269 - DNA, 20 bp, human
gtaaatagtaaacgtctttt

SEQ ID NO: 46270 - DNA, 20 bp, human
gaagagaaactctcgttatc

SEQ ID NO: 46271 - DNA, 20 bp, human
ggtaaacgtcttttgggttt

SEQ ID NO: 46272 - DNA, 20 bp, human
gctcattttatctacatatt

SEQ ID NO: 46273 - DNA, 20 bp, human
gggtcacataacacagaaaa

SEQ ID NO: 46274 - DNA, 20 bp, human
gatcttacctggtagaatga

SEQ ID NO: 46275 - DNA, 20 bp, human
gcagttcattcagtttctct

SEQ ID NO: 46276 - DNA, 20 bp, human
gagaggggtgagaaatgatc

SEQ ID NO: 46277 - DNA, 20 bp, human
ggttgaagtgagagactcac

SEQ ID NO: 46278 - DNA, 20 bp, human
gggtagtatcaactgaaagt

SEQ ID NO: 46279 - DNA, 20 bp, human
gatggctgagatctgatgaa

SEQ ID NO: 46280 - DNA, 20 bp, human
gcacaaggacaactaaggcc

SEQ ID NO: 46281 - DNA, 20 bp, human
ggatgagactgttgacatat

SEQ ID NO: 46282 - DNA, 20 bp, human
gtgagactgattattagaag

SEQ ID NO: 46283 - DNA, 20 bp, human
gctgttgacatatgggccag

SEQ ID NO: 46284 - DNA, 20 bp, human
ggtttaatgtctcctgagag

SEQ ID NO: 46285 - DNA, 20 bp, human
gagatctcagccatccctgt

SEQ ID NO: 46286 - DNA, 20 bp, human
gcttggcagagcagaaccag

SEQ ID NO: 46287 - DNA, 20 bp, human
gagttgaggagctataggag

SEQ ID NO: 46288 - DNA, 20 bp, human
ggagagaggcctgagttacc

SEQ ID NO: 46289 - DNA, 20 bp, human
gttgggtagggagttgaggt

SEQ ID NO: 46290 - DNA, 20 bp, human
gggtatagcagtttggagtt

SEQ ID NO: 46291 - DNA, 20 bp, human
gacacagcccttcattctgg

SEQ ID NO: 46292 - DNA, 20 bp, human
ggtgcaagttgaggagctat

SEQ ID NO: 46293 - DNA, 20 bp, human
gacgccagaacctttgagag

SEQ ID NO: 46294 - DNA, 20 bp, human
gtagcagtttggagttgggt

SEQ ID NO: 46295 - DNA, 20 bp, human
gtgagtaggagtcactgcag

SEQ ID NO: 46296 - DNA, 20 bp, human
gagcaggaggtggtagatcc

SEQ ID NO: 46297 - DNA, 20 bp, human
gtcacggtactccccaacat

SEQ ID NO: 46298 - DNA, 20 bp, human
gagtcccagtgtgggaactg

SEQ ID NO: 46299 - DNA, 20 bp, human
gcaggagtttcatggtcctt

SEQ ID NO: 46300 - DNA, 20 bp, human
gcctggctggggtaaaacct

SEQ ID NO: 46301 - DNA, 20 bp, human
gttgccgcctaagaaactag

SEQ ID NO: 46302 - DNA, 20 bp, human
gagttatcctcaatagacag

SEQ ID NO: 46303 - DNA, 20 bp, human
gtcctgctatagctataatg

SEQ ID NO: 46304 - DNA, 20 bp, human
gcaggagcatagtcccagtg

SEQ ID NO: 46305 - DNA, 20 bp, human
gagtgatcccaggtaatcag

SEQ ID NO: 46306 - DNA, 20 bp, human
gcatggctggcagacctgag

SEQ ID NO: 46307 - DNA, 20 bp, human
gggacttcgggagactagag

SEQ ID NO: 46308 - DNA, 20 bp, human
gggagactagagtggaagct

SEQ ID NO: 46309 - DNA, 20 bp, human
gcccgaagctgcaggagaga

SEQ ID NO: 46310 - DNA, 20 bp, human
ggaacccagacccccgagag

SEQ ID NO: 46311 - DNA, 20 bp, human
gggtttgaggggcaaagcgt

SEQ ID NO: 46312 - DNA, 20 bp, human
gaatagggttccctgcagca

SEQ ID NO: 46313 - DNA, 20 bp, human
gggtaaagaagtttcatggc

SEQ ID NO: 46314 - DNA, 20 bp, human
gttgggattggagtgataga

SEQ ID NO: 46315 - DNA, 20 bp, human
ggccagggtggtatcctggt

SEQ ID NO: 46316 - DNA, 20 bp, human
gcaactggtaaaacagacag

SEQ ID NO: 46317 - DNA, 20 bp, human
gatgacctgaggatgggata

SEQ ID NO: 46318 - DNA, 20 bp, human
gagacagaggactccattct

SEQ ID NO: 46319 - DNA, 20 bp, human
gcatgaatgatgaatgatca

SEQ ID NO: 46320 - DNA, 20 bp, human
gaactagagagactacctaa

SEQ ID NO: 46321 - DNA, 20 bp, human
gaacagtcaaaagcagaaga

SEQ ID NO: 46322 - DNA, 20 bp, human
gctggggactctgacaggtt

SEQ ID NO: 46323 - DNA, 20 bp, human
gaaagagagagacttgggta

SEQ ID NO: 46324 - DNA, 20 bp, human
gagctaaccagagataaggt

SEQ ID NO: 46325 - DNA, 20 bp, human
ggcatgttcagagaactctg

SEQ ID NO: 46326 - DNA, 20 bp, human
gggtggcctagtgtgtgagg

SEQ ID NO: 46327 - DNA, 20 bp, human
gcctggtcagagaatcccaa

SEQ ID NO: 46328 - DNA, 20 bp, human
gagctgcaagtccgatgcca

SEQ ID NO: 46329 - DNA, 20 bp, human
gaaaaggagcttcatggcta

SEQ ID NO: 46330 - DNA, 20 bp, human
ggtcatctagcaccacgtat

SEQ ID NO: 46331 - DNA, 20 bp, human
ggcctcctgcctcctatacg

SEQ ID NO: 46332 - DNA, 20 bp, human
gatctagcaccacgtatagg

SEQ ID NO: 46333 - DNA, 20 bp, human
gaccacgtataggaggcagg

SEQ ID NO: 46334 - DNA, 20 bp, human
gctgaacctccttaaggaag

SEQ ID NO: 46335 - DNA, 20 bp, human
gtaaggaggttcaggttacc

SEQ ID NO: 46336 - DNA, 20 bp, human
gtcatggccacggggctcct

SEQ ID NO: 46337 - DNA, 20 bp, human
gctgcagctcaataaagcct

SEQ ID NO: 46338 - DNA, 20 bp, human
gcagaaccaggagagccaca

SEQ ID NO: 46339 - DNA, 20 bp, human
gggtgataagtgctgagaag

SEQ ID NO: 46340 - DNA, 20 bp, human
gaagttgcccaccaagtcag

SEQ ID NO: 46341 - DNA, 20 bp, human
gcagctgacactttagttgg

SEQ ID NO: 46342 - DNA, 20 bp, human
gtggcacatgacccagaacc

SEQ ID NO: 46343 - DNA, 20 bp, human
gggtggagatagaaaataag

SEQ ID NO: 46344 - DNA, 20 bp, human
gtaagtggataaacatatgt

SEQ ID NO: 46345 - DNA, 20 bp, human
gggactagactctcaggtcc

SEQ ID NO: 46346 - DNA, 20 bp, human
gtcgaaatggaagtgaagtg

SEQ ID NO: 46347 - DNA, 20 bp, human
ggcccggagggtaccttcag

SEQ ID NO: 46348 - DNA, 20 bp, human
gccctctgaaggtaccctcc

SEQ ID NO: 46349 - DNA, 20 bp, human
gtgctaactcgggtgaccaa

SEQ ID NO: 46350 - DNA, 20 bp, human
ggtcagcatcaggatattca

SEQ ID NO: 46351 - DNA, 20 bp, human
ggctgaccttcattatctgt

SEQ ID NO: 46352 - DNA, 20 bp, human
gcaggatattcatggctcct

SEQ ID NO: 46353 - DNA, 20 bp, human
gctcgggtgaccaaaggtaa

SEQ ID NO: 46354 - DNA, 20 bp, human
gttatgtagagagacagata

SEQ ID NO: 46355 - DNA, 20 bp, human
gatctgtgggttgctaactc

SEQ ID NO: 46356 - DNA, 20 bp, human
gactgcaagggtgaacagta

SEQ ID NO: 46357 - DNA, 20 bp, human
gttacctcaggagggaatat

SEQ ID NO: 46358 - DNA, 20 bp, human
ggaacagtagggacttcatc

SEQ ID NO: 46359 - DNA, 20 bp, human
ggacttcatcaggaggcagt

SEQ ID NO: 46360 - DNA, 20 bp, human
gtggactgacccgaagtgac

SEQ ID NO: 46361 - DNA, 20 bp, human
gaaatgaggcagggcttgac

SEQ ID NO: 46362 - DNA, 20 bp, human
gcaggagcataaaaactgca

SEQ ID NO: 46363 - DNA, 20 bp, human
gtgtaagaccaagaaaactg

SEQ ID NO: 46364 - DNA, 20 bp, human
gctgccgatattccctcctg

SEQ ID NO: 46365 - DNA, 20 bp, human
gggatctgtgatcggagctg

SEQ ID NO: 46366 - DNA, 20 bp, human
gggaatgatgccaatatcta

SEQ ID NO: 46367 - DNA, 20 bp, human
ggaatctaagtctctgagga

SEQ ID NO: 46368 - DNA, 20 bp, human
gagcatagtgtgcagttcac

SEQ ID NO: 46369 - DNA, 20 bp, human
gttcactggaccaaaagctt

SEQ ID NO: 46370 - DNA, 20 bp, human
gatgatcatgaagagcccca

SEQ ID NO: 46371 - DNA, 20 bp, human
ggcactgaaccagaacagat

SEQ ID NO: 46372 - DNA, 20 bp, human
gcatgaagagccccatggcc

SEQ ID NO: 46373 - DNA, 20 bp, human
gtactcactgagctaaaaag

SEQ ID NO: 46374 - DNA, 20 bp, human
gtgtgtgtgtgcatgaatag

SEQ ID NO: 46375 - DNA, 20 bp, human
gataagaatctaagtctctg

SEQ ID NO: 46376 - DNA, 20 bp, human
ggtcaggcaaccaggagaat

SEQ ID NO: 46377 - DNA, 20 bp, human
gcacccaaggaggtaagagg

SEQ ID NO: 46378 - DNA, 20 bp, human
ggatcatctttaaagacctg

SEQ ID NO: 46379 - DNA, 20 bp, human
gcttgggtgcctctcttcta

SEQ ID NO: 46380 - DNA, 20 bp, human
gtaaggcatagactcaagtc

SEQ ID NO: 46381 - DNA, 20 bp, human
gagggctatagtggactctc

SEQ ID NO: 46382 - DNA, 20 bp, human
gagactcaagtcaggcaacc

SEQ ID NO: 46383 - DNA, 20 bp, human
gttggagtcatgtcaatgtg

SEQ ID NO: 46384 - DNA, 20 bp, human
gtgctgtttgaggtactcac

SEQ ID NO: 46385 - DNA, 20 bp, human
gttaattactgttgtagtac

SEQ ID NO: 46386 - DNA, 20 bp, human
gcacctggtactgtagcatg

SEQ ID NO: 46387 - DNA, 20 bp, human
gagattcaaggcttcctctc

SEQ ID NO: 46388 - DNA, 20 bp, human
gtcatggttgggtgccagag

SEQ ID NO: 46389 - DNA, 20 bp, human
gtagaaatagagctaaaagg

SEQ ID NO: 46390 - DNA, 20 bp, human
gagacatatacagggcagga

SEQ ID NO: 46391 - DNA, 20 bp, human
gagcatgatagacatataca

SEQ ID NO: 46392 - DNA, 20 bp, human
gtcatgctaagactaagccc

SEQ ID NO: 46393 - DNA, 20 bp, human
gagctaaaaggaggtagacc

SEQ ID NO: 46394 - DNA, 20 bp, human
gtgatagacatatacagggc

SEQ ID NO: 46395 - DNA, 20 bp, human
ggggtagatgagaggaacca

SEQ ID NO: 46396 - DNA, 20 bp, human
ggtaccaaagaagagaaaca

SEQ ID NO: 46397 - DNA, 20 bp, human
gatagttcttgattccaact

SEQ ID NO: 46398 - DNA, 20 bp, human
ggggacgcctagaccggaag

SEQ ID NO: 46399 - DNA, 20 bp, human
gattccaactcggtagtgga

SEQ ID NO: 46400 - DNA, 20 bp, human
gcttgattccaactcggtag

SEQ ID NO: 46401 - DNA, 20 bp, human
gcttccatccactaccgagt

SEQ ID NO: 46402 - DNA, 20 bp, human
gccaaagaagagaaacatgg

SEQ ID NO: 46403 - DNA, 20 bp, human
gttgtgactttaataccaaa

SEQ ID NO: 46404 - DNA, 20 bp, human
gaagcaaacagctatcatca

SEQ ID NO: 46405 - DNA, 20 bp, human
gaatgattgtagaagtctat

SEQ ID NO: 46406 - DNA, 20 bp, human
gttctagaccgacctggtgg

SEQ ID NO: 46407 - DNA, 20 bp, human
gcctgttgcccccaccaggt

SEQ ID NO: 46408 - DNA, 20 bp, human
ggagttctagaccgacctgg

SEQ ID NO: 46409 - DNA, 20 bp, human
gaagtttctgtcttacctgg

SEQ ID NO: 46410 - DNA, 20 bp, human
ggtttgaggtgggtgagcac

SEQ ID NO: 46411 - DNA, 20 bp, human
gggaggaactgtgaacatca

SEQ ID NO: 46412 - DNA, 20 bp, human
gaaaaagtttctgtcttacc

SEQ ID NO: 46413 - DNA, 20 bp, human
gtacattcagttctctgaag

SEQ ID NO: 46414 - DNA, 20 bp, human
gcaggagttctagaccgacc

SEQ ID NO: 46415 - DNA, 20 bp, human
gacaaaaaacaagaccctca

SEQ ID NO: 46416 - DNA, 20 bp, human
gacctgggtcaggaatccga

SEQ ID NO: 46417 - DNA, 20 bp, human
gcaacccgggctgatctcaa

SEQ ID NO: 46418 - DNA, 20 bp, human
gacctcctaagacacactga

SEQ ID NO: 46419 - DNA, 20 bp, human
gaggaacttcatggctgaag

SEQ ID NO: 46420 - DNA, 20 bp, human
gaacttcatggctgaagggg

SEQ ID NO: 46421 - DNA, 20 bp, human
ggccttcagtgtgtcttagg

SEQ ID NO: 46422 - DNA, 20 bp, human
gcccactgagttccagtcta

SEQ ID NO: 46423 - DNA, 20 bp, human
gagcccgggttggagctcaa

SEQ ID NO: 46424 - DNA, 20 bp, human
gtcttaggaggttagatata

SEQ ID NO: 46425 - DNA, 20 bp, human
gtgtgggatatcaaggctag

SEQ ID NO: 46426 - DNA, 20 bp, human
gtataaccaaacctatcatg

SEQ ID NO: 46427 - DNA, 20 bp, human
gggatccttgagacattgat

SEQ ID NO: 46428 - DNA, 20 bp, human
ggtggtcttactaaacagta

SEQ ID NO: 46429 - DNA, 20 bp, human
gtactaaacagtaaggctcc

SEQ ID NO: 46430 - DNA, 20 bp, human
gtgtgtagtagagtaacagt

SEQ ID NO: 46431 - DNA, 20 bp, human
ggaccagattgttaagagag

SEQ ID NO: 46432 - DNA, 20 bp, human
gagattgttaagagagtggt

SEQ ID NO: 46433 - DNA, 20 bp, human
gttggttatattatgtcaca

SEQ ID NO: 46434 - DNA, 20 bp, human
gagtaacctcatgataggtt

SEQ ID NO: 46435 - DNA, 20 bp, human
gattttacctggtggcaatg

SEQ ID NO: 46436 - DNA, 20 bp, human
gcttctgttaaggaggctag

SEQ ID NO: 46437 - DNA, 20 bp, human
gggtctgacatcggctgtca

SEQ ID NO: 46438 - DNA, 20 bp, human
gtggctgggaacttctgtta

SEQ ID NO: 46439 - DNA, 20 bp, human
gctgggaacttctgttaagg

SEQ ID NO: 46440 - DNA, 20 bp, human
gtgttaaggaggctagtggc

SEQ ID NO: 46441 - DNA, 20 bp, human
gacaacaaggagaggcttca

SEQ ID NO: 46442 - DNA, 20 bp, human
gaaggagaggcttcatggct

SEQ ID NO: 46443 - DNA, 20 bp, human
gtgaaaattaaagggcccat

SEQ ID NO: 46444 - DNA, 20 bp, human
gataaacatacaccacccat

SEQ ID NO: 46445 - DNA, 20 bp, human
gcagtgctggcaggtaaaac

SEQ ID NO: 46446 - DNA, 20 bp, human
gagaagcagctgtgactcat

SEQ ID NO: 46447 - DNA, 20 bp, human
gagtaagttaaggaccacga

SEQ ID NO: 46448 - DNA, 20 bp, human
gaaggctggactgttggtac

SEQ ID NO: 46449 - DNA, 20 bp, human
ggctgggctggtccagagaa

SEQ ID NO: 46450 - DNA, 20 bp, human
ggccaagaggacgctccttg

SEQ ID NO: 46451 - DNA, 20 bp, human
gtgttggtactggcagaagt

SEQ ID NO: 46452 - DNA, 20 bp, human
ggaatggagaaaagatccaa

SEQ ID NO: 46453 - DNA, 20 bp, human
gcaaagaatagcgaggactt

SEQ ID NO: 46454 - DNA, 20 bp, human
gaaaggaagctgcaacaggg

SEQ ID NO: 46455 - DNA, 20 bp, human
ggccacaaggagcgtcctct

SEQ ID NO: 46456 - DNA, 20 bp, human
gagaggttcatggccgaaga

SEQ ID NO: 46457 - DNA, 20 bp, human
ggagtaatgcagaaagacag

SEQ ID NO: 46458 - DNA, 20 bp, human
ggccgaagagggcacagagt

SEQ ID NO: 46459 - DNA, 20 bp, human
gtaacaagccatcaaccagg

SEQ ID NO: 46460 - DNA, 20 bp, human
gtgagtctgaacataaaagt

SEQ ID NO: 46461 - DNA, 20 bp, human
ggcaaggcagataaagctca

SEQ ID NO: 46462 - DNA, 20 bp, human
gtcagggtagccagaggcat

SEQ ID NO: 46463 - DNA, 20 bp, human
gggggagataggaatctggg

SEQ ID NO: 46464 - DNA, 20 bp, human
gctctccccgcttcaggaaa

SEQ ID NO: 46465 - DNA, 20 bp, human
gggtagccagaggcattgga

SEQ ID NO: 46466 - DNA, 20 bp, human
gctcacctggaagaggcatc

SEQ ID NO: 46467 - DNA, 20 bp, human
gtctactcagtctaaaagtg

SEQ ID NO: 46468 - DNA, 20 bp, human
ggatgatatttacaaactac

SEQ ID NO: 46469 - DNA, 20 bp, human
gtatgaagaggaacgagaag

SEQ ID NO: 46470 - DNA, 20 bp, human
gaggagatacaagaccctca

SEQ ID NO: 46471 - DNA, 20 bp, human
gctactgggctccttcatat

SEQ ID NO: 46472 - DNA, 20 bp, human
ggaacgagtgagttgtccat

SEQ ID NO: 46473 - DNA, 20 bp, human
gtcaccaggagctgagtctg

SEQ ID NO: 46474 - DNA, 20 bp, human
gtcccagccatcagccatga

SEQ ID NO: 46475 - DNA, 20 bp, human
ggcaggagaaaaggatggag

SEQ ID NO: 46476 - DNA, 20 bp, human
gtggcttagaagaacgagtg

SEQ ID NO: 46477 - DNA, 20 bp, human
gggcattcagtctaaaagtg

SEQ ID NO: 46478 - DNA, 20 bp, human
gatgatatttacaagctact

SEQ ID NO: 46479 - DNA, 20 bp, human
gaggagatacaagaccctca

SEQ ID NO: 46480 - DNA, 20 bp, human
gtatgaagaggaacgagaag

SEQ ID NO: 46481 - DNA, 20 bp, human
gaggcatcagaaatatgaag

SEQ ID NO: 46482 - DNA, 20 bp, human
ggaacgagtgaggtgtccat

SEQ ID NO: 46483 - DNA, 20 bp, human
gggaggggacacacagagag

SEQ ID NO: 46484 - DNA, 20 bp, human
gctactgggctccttcatat

SEQ ID NO: 46485 - DNA, 20 bp, human
gtcccagccatcagccatga

SEQ ID NO: 46486 - DNA, 20 bp, human
gggaaagggcgcccacctga

SEQ ID NO: 46487 - DNA, 20 bp, human
gggctgctcagaggtggcgg

SEQ ID NO: 46488 - DNA, 20 bp, human
ggccgacaccacaccagccg

SEQ ID NO: 46489 - DNA, 20 bp, human
gcgcctcttcgcggaagggt

SEQ ID NO: 46490 - DNA, 20 bp, human
gtccccggctggtgtggtgt

SEQ ID NO: 46491 - DNA, 20 bp, human
gcgcgagacgcggctcccca

SEQ ID NO: 46492 - DNA, 20 bp, human
gaccgcgcagggcccgcgag

SEQ ID NO: 46493 - DNA, 20 bp, human
gcctgcgcctcttcgcggaa

SEQ ID NO: 46494 - DNA, 20 bp, human
gtagcgaaaagatctactca

SEQ ID NO: 46495 - DNA, 20 bp, human
gcacctctgagcagccggct

SEQ ID NO: 46496 - DNA, 20 bp, human
ggcgcctcccgccccaccat

SEQ ID NO: 46497 - DNA, 20 bp, human
ggagccggccgcgctccgaa

SEQ ID NO: 46498 - DNA, 20 bp, human
gcgcgctgttgcccatggtg

SEQ ID NO: 46499 - DNA, 20 bp, human
gtggctcgcgaggaacagct

SEQ ID NO: 46500 - DNA, 20 bp, human
gctgggacgcgagggcgcag

SEQ ID NO: 46501 - DNA, 20 bp, human
ggagccggccggggacccca

SEQ ID NO: 46502 - DNA, 20 bp, human
gctgggatgctgggacgcga

SEQ ID NO: 46503 - DNA, 20 bp, human
ggacccactcgaagtcgctg

SEQ ID NO: 46504 - DNA, 20 bp, human
gggctctgctgcacctgtcg

SEQ ID NO: 46505 - DNA, 20 bp, human
ggagctggagcggcccgtct

SEQ ID NO: 46506 - DNA, 20 bp, human
gctgcggtcccggctatggg

SEQ ID NO: 46507 - DNA, 20 bp, human
gcgagcgtcacgccagacag

SEQ ID NO: 46508 - DNA, 20 bp, human
gaggcgcgcgggccgctgtc

SEQ ID NO: 46509 - DNA, 20 bp, human
gagcgctcagtccccagggg

SEQ ID NO: 46510 - DNA, 20 bp, human
gcgccgtccagggattcccg

SEQ ID NO: 46511 - DNA, 20 bp, human
gcgcctcgggaatccctgga

SEQ ID NO: 46512 - DNA, 20 bp, human
gggcaggtgtcccgcgggaa

SEQ ID NO: 46513 - DNA, 20 bp, human
gtcccgcaggcaggaccggg

SEQ ID NO: 46514 - DNA, 20 bp, human
gggcccgcgcgccttctcct

SEQ ID NO: 46515 - DNA, 20 bp, human
gagcgctgcggtcccggcta

SEQ ID NO: 46516 - DNA, 20 bp, human
gcctggagcccatggtcccc

SEQ ID NO: 46517 - DNA, 20 bp, human
gaccatggcgttcgccgggc

SEQ ID NO: 46518 - DNA, 20 bp, human
ggcacgcgcgccggcgacca

SEQ ID NO: 46519 - DNA, 20 bp, human
gtccagcccggcgaacgcca

SEQ ID NO: 46520 - DNA, 20 bp, human
gcggttgctatggcgatcca

SEQ ID NO: 46521 - DNA, 20 bp, human
gttgctatggcgatccaggg

SEQ ID NO: 46522 - DNA, 20 bp, human
gcgagtacattaacccctgg

SEQ ID NO: 46523 - DNA, 20 bp, human
ggtacattaacccctggagg

SEQ ID NO: 46524 - DNA, 20 bp, human
ggagggagcgagcctcgagc

SEQ ID NO: 46525 - DNA, 20 bp, human
ggagcgagtacattaacccc

SEQ ID NO: 46526 - DNA, 20 bp, human
gcccggtcgcaggaactgag

SEQ ID NO: 46527 - DNA, 20 bp, human
gccacgccggcggccacaca

SEQ ID NO: 46528 - DNA, 20 bp, human
ggtagccgccaccaaagctg

SEQ ID NO: 46529 - DNA, 20 bp, human
gggcggccacacagggaaag

SEQ ID NO: 46530 - DNA, 20 bp, human
gcggctaccggcggagacgg

SEQ ID NO: 46531 - DNA, 20 bp, human
ggctcaaccggctccccggg

SEQ ID NO: 46532 - DNA, 20 bp, human
gggaggagccgcgccaacca

SEQ ID NO: 46533 - DNA, 20 bp, human
gccctcagcggcggtgtcag

SEQ ID NO: 46534 - DNA, 20 bp, human
gtcacatctgacacactcgg

SEQ ID NO: 46535 - DNA, 20 bp, human
gggaggagccgagctggcct

SEQ ID NO: 46536 - DNA, 20 bp, human
gaggtcatagcggaggccca

SEQ ID NO: 46537 - DNA, 20 bp, human
gtccacagggcggatgatca

SEQ ID NO: 46538 - DNA, 20 bp, human
gccaaggacaaagctcagag

SEQ ID NO: 46539 - DNA, 20 bp, human
gcccagagtgaaggtcatag

SEQ ID NO: 46540 - DNA, 20 bp, human
ggctgggtgttggtatgagt

SEQ ID NO: 46541 - DNA, 20 bp, human
gctggggagagggccccgct

SEQ ID NO: 46542 - DNA, 20 bp, human
gtggcttcagggggtccaca

SEQ ID NO: 46543 - DNA, 20 bp, human
ggagctatagacataatcac

SEQ ID NO: 46544 - DNA, 20 bp, human
gccagcatacacaggccccc

SEQ ID NO: 46545 - DNA, 20 bp, human
ggtgctggggtacccatggt

SEQ ID NO: 46546 - DNA, 20 bp, human
ggcagatcgtcgcggagcca

SEQ ID NO: 46547 - DNA, 20 bp, human
gcacagtcccgggaccaggc

SEQ ID NO: 46548 - DNA, 20 bp, human
gagagccgcttcccccgtca

SEQ ID NO: 46549 - DNA, 20 bp, human
ggggaagcggctctgcagac

SEQ ID NO: 46550 - DNA, 20 bp, human
gtgagccctgacgggggaag

SEQ ID NO: 46551 - DNA, 20 bp, human
gcgcggcctgagccctgacg

SEQ ID NO: 46552 - DNA, 20 bp, human
gagccgggcccccctcacag

SEQ ID NO: 46553 - DNA, 20 bp, human
gcgcgtcgcgcagatcgtcg

SEQ ID NO: 46554 - DNA, 20 bp, human
gatcgtcgcggagccacggc

SEQ ID NO: 46555 - DNA, 20 bp, human
gcccagcgcaggctcgcccg

SEQ ID NO: 46556 - DNA, 20 bp, human
ggcggacccgagtgataccc

SEQ ID NO: 46557 - DNA, 20 bp, human
ggccacaggagacaacgttg

SEQ ID NO: 46558 - DNA, 20 bp, human
gacaacgttgaggtacagac

SEQ ID NO: 46559 - DNA, 20 bp, human
ggtacagacaggtaagagtc

SEQ ID NO: 46560 - DNA, 20 bp, human
gcgagagtccgaagcccctg

SEQ ID NO: 46561 - DNA, 20 bp, human
gagtctcccgggtatcactc

SEQ ID NO: 46562 - DNA, 20 bp, human
ggggagactagcttggccac

SEQ ID NO: 46563 - DNA, 20 bp, human
ggatacccgggagactagct

SEQ ID NO: 46564 - DNA, 20 bp, human
ggacctcctcgctacctcag

SEQ ID NO: 46565 - DNA, 20 bp, human
gggtaagagtcggggtgatt

SEQ ID NO: 46566 - DNA, 20 bp, human
gaccacactagccccagaga

SEQ ID NO: 46567 - DNA, 20 bp, human
ggatgtgacgggacccagga

SEQ ID NO: 46568 - DNA, 20 bp, human
ggctggtcatgccctctctg

SEQ ID NO: 46569 - DNA, 20 bp, human
gttccatcctgtgcacccag

SEQ ID NO: 46570 - DNA, 20 bp, human
ggctcaaccactgggtgcac

SEQ ID NO: 46571 - DNA, 20 bp, human
gaaccactgggtgcacagga

SEQ ID NO: 46572 - DNA, 20 bp, human
ggaataagaacaggctcaaa

SEQ ID NO: 46573 - DNA, 20 bp, human
gggccgagatataaaggaag

SEQ ID NO: 46574 - DNA, 20 bp, human
gctctctggaagacagcgcg

SEQ ID NO: 46575 - DNA, 20 bp, human
gtgtggaggccgagatataa

SEQ ID NO: 46576 - DNA, 20 bp, human
gcggcggccgagcccatcca

SEQ ID NO: 46577 - DNA, 20 bp, human
gacccgcggaggtcaaggat

SEQ ID NO: 46578 - DNA, 20 bp, human
gctaggggacaggttcgggg

SEQ ID NO: 46579 - DNA, 20 bp, human
gtggccccggggccccacaa

SEQ ID NO: 46580 - DNA, 20 bp, human
ggcggaggtcaaggataggg

SEQ ID NO: 46581 - DNA, 20 bp, human
gcggccggcactaaccccca

SEQ ID NO: 46582 - DNA, 20 bp, human
gtctcaggctggctcgaagg

SEQ ID NO: 46583 - DNA, 20 bp, human
ggctgccctgcccagggcga

SEQ ID NO: 46584 - DNA, 20 bp, human
gccctgggcagggcagcgtg

SEQ ID NO: 46585 - DNA, 20 bp, human
gcactccaggggccatggat

SEQ ID NO: 46586 - DNA, 20 bp, human
gcggctgaggcgcccgagtg

SEQ ID NO: 46587 - DNA, 20 bp, human
gccgagggcagcgacaagtg

SEQ ID NO: 46588 - DNA, 20 bp, human
gccgccggccgggaatctgg

SEQ ID NO: 46589 - DNA, 20 bp, human
gcgcccgagtgcggtactgg

SEQ ID NO: 46590 - DNA, 20 bp, human
ggccccagagactctccgag

SEQ ID NO: 46591 - DNA, 20 bp, human
gcggcgcggctggtccccag

SEQ ID NO: 46592 - DNA, 20 bp, human
gccagagactctccgagggg

SEQ ID NO: 46593 - DNA, 20 bp, human
gagagctccagcagccccga

SEQ ID NO: 46594 - DNA, 20 bp, human
gcgccgccagtaccgcactc

SEQ ID NO: 46595 - DNA, 20 bp, human
ggcggacgtgggccacgagt

SEQ ID NO: 46596 - DNA, 20 bp, human
gcgcggtagcggaacacgag

SEQ ID NO: 46597 - DNA, 20 bp, human
ggcggatcgagctcggagag

SEQ ID NO: 46598 - DNA, 20 bp, human
gagagctcctgagatccggg

SEQ ID NO: 46599 - DNA, 20 bp, human
gaatcccgcacgcgcggtag

SEQ ID NO: 46600 - DNA, 20 bp, human
gctagagtcggagaaagagg

SEQ ID NO: 46601 - DNA, 20 bp, human
ggggctggggatgagctaag

SEQ ID NO: 46602 - DNA, 20 bp, human
gtggccgcggaggctagagt

SEQ ID NO: 46603 - DNA, 20 bp, human
gcacgaggggctgaatgccg

SEQ ID NO: 46604 - DNA, 20 bp, human
gagcccgttacgtaagtcgg

SEQ ID NO: 46605 - DNA, 20 bp, human
ggcaccgccgcgccatcccg

SEQ ID NO: 46606 - DNA, 20 bp, human
gagggtcctgaggcgcccca

SEQ ID NO: 46607 - DNA, 20 bp, human
gagcaggggcccagaagcgt

SEQ ID NO: 46608 - DNA, 20 bp, human
ggccccagggtgcagaagct

SEQ ID NO: 46609 - DNA, 20 bp, human
gtcccagcttctgcaccctg

SEQ ID NO: 46610 - DNA, 20 bp, human
gggtgggtagctcgcagcag

SEQ ID NO: 46611 - DNA, 20 bp, human
gagctacctaaggatcctgg

SEQ ID NO: 46612 - DNA, 20 bp, human
gaagctgggaaaaagcctgg

SEQ ID NO: 46613 - DNA, 20 bp, human
gaggagccccaagggtcctg

SEQ ID NO: 46614 - DNA, 20 bp, human
gcctcttaaaaacctaggag

SEQ ID NO: 46615 - DNA, 20 bp, human
gcggggagtaggagccccaa

SEQ ID NO: 46616 - DNA, 20 bp, human
ggcgcgggacaggcaggtag

SEQ ID NO: 46617 - DNA, 20 bp, human
ggcgcagtggaaggagatcc

SEQ ID NO: 46618 - DNA, 20 bp, human
gcgggaagcgcgggacaggc

SEQ ID NO: 46619 - DNA, 20 bp, human
gcagacgcttgccagggtca

SEQ ID NO: 46620 - DNA, 20 bp, human
gtttgggcagacgcttgcca

SEQ ID NO: 46621 - DNA, 20 bp, human
gcgctggcgggtggctcgga

SEQ ID NO: 46622 - DNA, 20 bp, human
gcggcgcccgcggcccggag

SEQ ID NO: 46623 - DNA, 20 bp, human
gcagtggaaggagatccggg

SEQ ID NO: 46624 - DNA, 20 bp, human
gggctacccggccccagaca

SEQ ID NO: 46625 - DNA, 20 bp, human
ggacatggcgcacccgactt

SEQ ID NO: 46626 - DNA, 20 bp, human
gccgcccccgcaggaggaaa

SEQ ID NO: 46627 - DNA, 20 bp, human
gtgcagcgcaggccccgcga

SEQ ID NO: 46628 - DNA, 20 bp, human
gccaggaagaagccgtgtcg

SEQ ID NO: 46629 - DNA, 20 bp, human
gtgtcagcgcagccccgaca

SEQ ID NO: 46630 - DNA, 20 bp, human
gcatcgcccctggctgtagg

SEQ ID NO: 46631 - DNA, 20 bp, human
gcggagggctgagttccgag

SEQ ID NO: 46632 - DNA, 20 bp, human
gcgggacaggtagagcccgg

SEQ ID NO: 46633 - DNA, 20 bp, human
ggcaggcgcagaccggactg

SEQ ID NO: 46634 - DNA, 20 bp, human
gcgcaggccccgcgagggca

SEQ ID NO: 46635 - DNA, 20 bp, human
gcggaaaccgcggagaaact

SEQ ID NO: 46636 - DNA, 20 bp, human
gcgctctcggctagctgcag

SEQ ID NO: 46637 - DNA, 20 bp, human
gtctcggctagctgcagcgg

SEQ ID NO: 46638 - DNA, 20 bp, human
ggtgtcggccgggaggacca

SEQ ID NO: 46639 - DNA, 20 bp, human
gcagctagccgagagcgccg

SEQ ID NO: 46640 - DNA, 20 bp, human
gtggagccggacgagctgtc

SEQ ID NO: 46641 - DNA, 20 bp, human
gggggaaggcatccaggatg

SEQ ID NO: 46642 - DNA, 20 bp, human
gacaaagcggggctgaagga

SEQ ID NO: 46643 - DNA, 20 bp, human
ggctcgggccgcggcgctct

SEQ ID NO: 46644 - DNA, 20 bp, human
gctggacacggagaccgggc

SEQ ID NO: 46645 - DNA, 20 bp, human
ggccccggcgccatgagtgg

SEQ ID NO: 46646 - DNA, 20 bp, human
gtcccccgcgccgagcgagg

SEQ ID NO: 46647 - DNA, 20 bp, human
ggcccgccctagggcgacac

SEQ ID NO: 46648 - DNA, 20 bp, human
gggtctgtgcgcccgcccta

SEQ ID NO: 46649 - DNA, 20 bp, human
gcgccagttcggccagaaag

SEQ ID NO: 46650 - DNA, 20 bp, human
ggcgcgccagtgtcgcccta

SEQ ID NO: 46651 - DNA, 20 bp, human
gcggccagaaagcggcggga

SEQ ID NO: 46652 - DNA, 20 bp, human
gcagttcggccagaaagcgg

SEQ ID NO: 46653 - DNA, 20 bp, human
gtggaggcgaaagccccggt

SEQ ID NO: 46654 - DNA, 20 bp, human
ggccagtgtcgccctagggc

SEQ ID NO: 46655 - DNA, 20 bp, human
ggcacagaccacagccggag

SEQ ID NO: 46656 - DNA, 20 bp, human
gggaggcggcgcgaacggtc

SEQ ID NO: 46657 - DNA, 20 bp, human
gtgtgtggtgggcttcgacc

SEQ ID NO: 46658 - DNA, 20 bp, human
gggcggcgcgaacggtcagg

SEQ ID NO: 46659 - DNA, 20 bp, human
ggttcgcgccgcctccacag

SEQ ID NO: 46660 - DNA, 20 bp, human
ggtcctacggcacttcccgt

SEQ ID NO: 46661 - DNA, 20 bp, human
gcttcccgtgggaggatctt

SEQ ID NO: 46662 - DNA, 20 bp, human
gtctgcggcgcggtccgctg

SEQ ID NO: 46663 - DNA, 20 bp, human
gccggccaggaccctgtccg

SEQ ID NO: 46664 - DNA, 20 bp, human
ggcgcggtccgctgtggagg

SEQ ID NO: 46665 - DNA, 20 bp, human
ggcggcgcggtccgctgtgg

SEQ ID NO: 46666 - DNA, 20 bp, human
gccgcgcgacctgaagacgt

SEQ ID NO: 46667 - DNA, 20 bp, human
gcccaacagcgcgtccatgg

SEQ ID NO: 46668 - DNA, 20 bp, human
gccagagatgggatgcggag

SEQ ID NO: 46669 - DNA, 20 bp, human
ggagaagaggcccctccagg

SEQ ID NO: 46670 - DNA, 20 bp, human
ggcgctccccaggccgagga

SEQ ID NO: 46671 - DNA, 20 bp, human
gttgggcacagggcctcgcc

SEQ ID NO: 46672 - DNA, 20 bp, human
ggtgcccaacagcgcgtcca

SEQ ID NO: 46673 - DNA, 20 bp, human
gccgagggccccaagcgagg

SEQ ID NO: 46674 - DNA, 20 bp, human
gtgctccggtggggaatgga

SEQ ID NO: 46675 - DNA, 20 bp, human
gtccggtggggaatggaggg

SEQ ID NO: 46676 - DNA, 20 bp, human
gggagacgagttgcatgtgt

SEQ ID NO: 46677 - DNA, 20 bp, human
gctgctggcggtcgggcgct

SEQ ID NO: 46678 - DNA, 20 bp, human
gaggcgaaggagcaaccccg

SEQ ID NO: 46679 - DNA, 20 bp, human
gtggaagtgcctaggaacaa

SEQ ID NO: 46680 - DNA, 20 bp, human
gggcctggggagtctaaaaa

SEQ ID NO: 46681 - DNA, 20 bp, human
gttggttcagctggcgatag

SEQ ID NO: 46682 - DNA, 20 bp, human
gccagagcgtaagaaggatg

SEQ ID NO: 46683 - DNA, 20 bp, human
ggggtcatcggagaagcccg

SEQ ID NO: 46684 - DNA, 20 bp, human
gaagagcactgaggggacaa

SEQ ID NO: 46685 - DNA, 20 bp, human
gagtgcctaggaacaagggg

SEQ ID NO: 46686 - DNA, 20 bp, human
ggcacaccctgactctccat

SEQ ID NO: 46687 - DNA, 20 bp, human
gacagacctatggagagtca

SEQ ID NO: 46688 - DNA, 20 bp, human
gcgcccggtggcgtccatgg

SEQ ID NO: 46689 - DNA, 20 bp, human
gtaggtctgtcagcgcccgg

SEQ ID NO: 46690 - DNA, 20 bp, human
gcagcgcccggtggcgtcca

SEQ ID NO: 46691 - DNA, 20 bp, human
gtgtggccggcgtcccgtgg

SEQ ID NO: 46692 - DNA, 20 bp, human
gtcgccgccatggacgccac

SEQ ID NO: 46693 - DNA, 20 bp, human
gccgcggcagtggcgagtct

SEQ ID NO: 46694 - DNA, 20 bp, human
gtattctaagacgcccccac

SEQ ID NO: 46695 - DNA, 20 bp, human
gcactgaacctagggatcct

SEQ ID NO: 46696 - DNA, 20 bp, human
gcatggcgcgtaggcagcag

SEQ ID NO: 46697 - DNA, 20 bp, human
gacccggtcggtaacctgag

SEQ ID NO: 46698 - DNA, 20 bp, human
gcgggtcggttagattccag

SEQ ID NO: 46699 - DNA, 20 bp, human
ggcgatgctccatggcgcgt

SEQ ID NO: 46700 - DNA, 20 bp, human
gctgtccgcgcgctgagtgg

SEQ ID NO: 46701 - DNA, 20 bp, human
gagcgttacggggtacgtgg

SEQ ID NO: 46702 - DNA, 20 bp, human
gggaatctaaccgacccggt

SEQ ID NO: 46703 - DNA, 20 bp, human
gcccacgatgcgatgctcca

SEQ ID NO: 46704 - DNA, 20 bp, human
ggcccctcaggttaccgacc

SEQ ID NO: 46705 - DNA, 20 bp, human
gcgggccgtaccgagctacc

SEQ ID NO: 46706 - DNA, 20 bp, human
gccagcgcgcgagcttatgg

SEQ ID NO: 46707 - DNA, 20 bp, human
ggttctgactgacaagtcta

SEQ ID NO: 46708 - DNA, 20 bp, human
gtgacaagtctacggaacct

SEQ ID NO: 46709 - DNA, 20 bp, human
ggagccagcgcgcgagctta

SEQ ID NO: 46710 - DNA, 20 bp, human
gggcggggctatggtgccag

SEQ ID NO: 46711 - DNA, 20 bp, human
gccggcagaagccatctcta

SEQ ID NO: 46712 - DNA, 20 bp, human
gtgcctggtagggcaggaag

SEQ ID NO: 46713 - DNA, 20 bp, human
ggcggggccctggaccaatg

SEQ ID NO: 46714 - DNA, 20 bp, human
gggcggggctaggaaatggg

SEQ ID NO: 46715 - DNA, 20 bp, human
gggcggttcttttgactccg

SEQ ID NO: 46716 - DNA, 20 bp, human
ggcagcaaaacgagaatggt

SEQ ID NO: 46717 - DNA, 20 bp, human
ggtaggcgcttcaggcttag

SEQ ID NO: 46718 - DNA, 20 bp, human
ggcgtaggcggggtatctgg

SEQ ID NO: 46719 - DNA, 20 bp, human
gggtgagcgctacacggtcg

SEQ ID NO: 46720 - DNA, 20 bp, human
gcaaggcaaccacaaagagg

SEQ ID NO: 46721 - DNA, 20 bp, human
gcggggcggagccaccggag

SEQ ID NO: 46722 - DNA, 20 bp, human
ggttgccttgctcaggacat

SEQ ID NO: 46723 - DNA, 20 bp, human
gcggtcggggcgggcctagt

SEQ ID NO: 46724 - DNA, 20 bp, human
gcctctggccggggcactga

SEQ ID NO: 46725 - DNA, 20 bp, human
gcggagcggcgcgggttctc

SEQ ID NO: 46726 - DNA, 20 bp, human
ggtgctaccggtgacaagtg

SEQ ID NO: 46727 - DNA, 20 bp, human
ggttggcgtccggggagcaa

SEQ ID NO: 46728 - DNA, 20 bp, human
ggcggtcaagttgagagtct

SEQ ID NO: 46729 - DNA, 20 bp, human
gctggaggagttggcgtccg

SEQ ID NO: 46730 - DNA, 20 bp, human
gagcatatcccggagctccc

SEQ ID NO: 46731 - DNA, 20 bp, human
gagcaccgcggagcatatcc

SEQ ID NO: 46732 - DNA, 20 bp, human
ggttaacagacgggcgctca

SEQ ID NO: 46733 - DNA, 20 bp, human
gatggccaccgtgcaggaga

SEQ ID NO: 46734 - DNA, 20 bp, human
ggcagcagccttctcctgca

SEQ ID NO: 46735 - DNA, 20 bp, human
gagctccgggatatgctccg

SEQ ID NO: 46736 - DNA, 20 bp, human
ggcgcgggaagcgtctgtga

SEQ ID NO: 46737 - DNA, 20 bp, human
ggactgcagcagccaggcta

SEQ ID NO: 46738 - DNA, 20 bp, human
ggagctgccccgaacaaaga

SEQ ID NO: 46739 - DNA, 20 bp, human
gcggcggacagcggagccag

SEQ ID NO: 46740 - DNA, 20 bp, human
gcgagcacccaaaccctcgg

SEQ ID NO: 46741 - DNA, 20 bp, human
gcttggcgagcgagtcctca

SEQ ID NO: 46742 - DNA, 20 bp, human
ggccaatccagtcagagcag

SEQ ID NO: 46743 - DNA, 20 bp, human
gccggggaacagctacggta

SEQ ID NO: 46744 - DNA, 20 bp, human
gagcgagtcctcagggaccg

SEQ ID NO: 46745 - DNA, 20 bp, human
ggcgcgcaccacccgctcgt

SEQ ID NO: 46746 - DNA, 20 bp, human
gccatgtccgcgcacaatcg

SEQ ID NO: 46747 - DNA, 20 bp, human
gcgagctagagtgaacgaaa

SEQ ID NO: 46748 - DNA, 20 bp, human
gtcgctggggcgggaagcag

SEQ ID NO: 46749 - DNA, 20 bp, human
gccggcggcgctgaacgcga

SEQ ID NO: 46750 - DNA, 20 bp, human
ggcctaccagccggcagctc

SEQ ID NO: 46751 - DNA, 20 bp, human
gcccaagtaaaggccgaacc

SEQ ID NO: 46752 - DNA, 20 bp, human
gcgctgaacgcgagggagag

SEQ ID NO: 46753 - DNA, 20 bp, human
gcagccctcaccccaagtaa

SEQ ID NO: 46754 - DNA, 20 bp, human
gctggctgtgggtccccgag

SEQ ID NO: 46755 - DNA, 20 bp, human
gttgtgcgcggacatggcgc

SEQ ID NO: 46756 - DNA, 20 bp, human
ggaagccgcgatgcagaagg

SEQ ID NO: 46757 - DNA, 20 bp, human
gtgcagaaggcggagacggg

SEQ ID NO: 46758 - DNA, 20 bp, human
gctcgctggtccgaattcgg

SEQ ID NO: 46759 - DNA, 20 bp, human
gcgatgcagaaggcggagac

SEQ ID NO: 46760 - DNA, 20 bp, human
gtgcctcgctggtccgaatt

SEQ ID NO: 46761 - DNA, 20 bp, human
ggccgaagccgcgatgcaga

SEQ ID NO: 46762 - DNA, 20 bp, human
ggacgtggcgccaccgaatt

SEQ ID NO: 46763 - DNA, 20 bp, human
gggccgagtttgccgaccaa

SEQ ID NO: 46764 - DNA, 20 bp, human
gggtacttaccggagacggg

SEQ ID NO: 46765 - DNA, 20 bp, human
gccgcgactgttaggtgtct

SEQ ID NO: 46766 - DNA, 20 bp, human
ggtaggcgcggctgaccggt

SEQ ID NO: 46767 - DNA, 20 bp, human
ggcgtacagggattactctg

SEQ ID NO: 46768 - DNA, 20 bp, human
gaggacgcaggcagtggtgt

SEQ ID NO: 46769 - DNA, 20 bp, human
gtaccatggtgactagtgag

SEQ ID NO: 46770 - DNA, 20 bp, human
gcaatggccaggtggtacca

SEQ ID NO: 46771 - DNA, 20 bp, human
ggtactccagccgcaagctc

SEQ ID NO: 46772 - DNA, 20 bp, human
gggtggggcaggcgacggtg

SEQ ID NO: 46773 - DNA, 20 bp, human
gatgagcgccggacctatag

SEQ ID NO: 46774 - DNA, 20 bp, human
ggctgaccggtgggatctgc

SEQ ID NO: 46775 - DNA, 20 bp, human
gggatgggtggaggcgtaca

SEQ ID NO: 46776 - DNA, 20 bp, human
gatggcgtggcagggactag

SEQ ID NO: 46777 - DNA, 20 bp, human
gccagctgctgtggaaccag

SEQ ID NO: 46778 - DNA, 20 bp, human
gcgtgcttgagaaggttcaa

SEQ ID NO: 46779 - DNA, 20 bp, human
gttgagaaggttcaatggcg

SEQ ID NO: 46780 - DNA, 20 bp, human
gtgtaagcccgcgtcaccgc

SEQ ID NO: 46781 - DNA, 20 bp, human
ggggccacgcgtgcttgaga

SEQ ID NO: 46782 - DNA, 20 bp, human
gcgagcctccagacctacgg

SEQ ID NO: 46783 - DNA, 20 bp, human
gccgtcccccgtaggtctgg

SEQ ID NO: 46784 - DNA, 20 bp, human
gctagcggccgagttcctgc

SEQ ID NO: 46785 - DNA, 20 bp, human
gtcctcttcttcgggcccct

SEQ ID NO: 46786 - DNA, 20 bp, human
ggctggcgggcgcacggagg

SEQ ID NO: 46787 - DNA, 20 bp, human
ggatgcggcgaggggagaca

SEQ ID NO: 46788 - DNA, 20 bp, human
gcctcgccgcatccactctc

SEQ ID NO: 46789 - DNA, 20 bp, human
gacgcgctggctggacgagt

SEQ ID NO: 46790 - DNA, 20 bp, human
gggaacacgggcgaactcag

SEQ ID NO: 46791 - DNA, 20 bp, human
ggcgcgtggtcagaaactcc

SEQ ID NO: 46792 - DNA, 20 bp, human
gaacccgcccgcgggaacac

SEQ ID NO: 46793 - DNA, 20 bp, human
gtggctcatggtgacggcgc

SEQ ID NO: 46794 - DNA, 20 bp, human
gaccaggtgtcgcgcacgtc

SEQ ID NO: 46795 - DNA, 20 bp, human
gcgggacgtcaccgagctgg

SEQ ID NO: 46796 - DNA, 20 bp, human
gtgagggcggcagtgaggtc

SEQ ID NO: 46797 - DNA, 20 bp, human
gaactcacggatctcctgta

SEQ ID NO: 46798 - DNA, 20 bp, human
gagggcactcaccgctcgga

SEQ ID NO: 46799 - DNA, 20 bp, human
gcaggaggagattcagttga

SEQ ID NO: 46800 - DNA, 20 bp, human
gaggctctggctgggaatag

SEQ ID NO: 46801 - DNA, 20 bp, human
ggctgtgtgggccctgagag

SEQ ID NO: 46802 - DNA, 20 bp, human
gtctcctgtagggcatgact

SEQ ID NO: 46803 - DNA, 20 bp, human
ggtccctgagggcggcagtg

SEQ ID NO: 46804 - DNA, 20 bp, human
gcttcaggaacagcaggtcc

SEQ ID NO: 46805 - DNA, 20 bp, human
gccagtgaccccaggaagag

SEQ ID NO: 46806 - DNA, 20 bp, human
ggcccacacggaagaggggg

SEQ ID NO: 46807 - DNA, 20 bp, human
gactcccgtcgggtacggga

SEQ ID NO: 46808 - DNA, 20 bp, human
gaccggcaacgactactgtg

SEQ ID NO: 46809 - DNA, 20 bp, human
gagggcccacacggaagagg

SEQ ID NO: 46810 - DNA, 20 bp, human
gttgccggtagcgggtgtgg

SEQ ID NO: 46811 - DNA, 20 bp, human
ggcttcaccggatagagatt

SEQ ID NO: 46812 - DNA, 20 bp, human
gcagtagtcgttgccggtag

SEQ ID NO: 46813 - DNA, 20 bp, human
ggacttgggccacgactcac

SEQ ID NO: 46814 - DNA, 20 bp, human
gccgtcgccacgggtcccaa

SEQ ID NO: 46815 - DNA, 20 bp, human
gcgactcacggggagacaca

SEQ ID NO: 46816 - DNA, 20 bp, human
ggccgacaggagcgtctgtg

SEQ ID NO: 46817 - DNA, 20 bp, human
gtccgcacagacgctcctgt

SEQ ID NO: 46818 - DNA, 20 bp, human
gtcgggctgactgggttcac

SEQ ID NO: 46819 - DNA, 20 bp, human
ggggcagccgagccgctccc

SEQ ID NO: 46820 - DNA, 20 bp, human
gcctccagcctagttctcgg

SEQ ID NO: 46821 - DNA, 20 bp, human
gcaaaaccctcgggctgact

SEQ ID NO: 46822 - DNA, 20 bp, human
ggagcgggccgccaacggtc

SEQ ID NO: 46823 - DNA, 20 bp, human
gagctttggccaaaaccctc

SEQ ID NO: 46824 - DNA, 20 bp, human
gagttctcgggggaagccgg

SEQ ID NO: 46825 - DNA, 20 bp, human
ggcggacggggccggaccgt

SEQ ID NO: 46826 - DNA, 20 bp, human
ggtccgggctcaaagagcca

SEQ ID NO: 46827 - DNA, 20 bp, human
gctgccggggagggtctgac

SEQ ID NO: 46828 - DNA, 20 bp, human
ggcgcgcacagaacaggctg

SEQ ID NO: 46829 - DNA, 20 bp, human
ggttagtgtgttgtacccag

SEQ ID NO: 46830 - DNA, 20 bp, human
ggagtcctggggcatggcgg

SEQ ID NO: 46831 - DNA, 20 bp, human
gggggaggcgcgcacagaac

SEQ ID NO: 46832 - DNA, 20 bp, human
gtgctgggccgcagttccgg

SEQ ID NO: 46833 - DNA, 20 bp, human
gccgccagccaccggaactg

SEQ ID NO: 46834 - DNA, 20 bp, human
gtgagacccagcaagggtaa

SEQ ID NO: 46835 - DNA, 20 bp, human
gtccggtggctggcggaaac

SEQ ID NO: 46836 - DNA, 20 bp, human
gcaccgggagggctacgcgg

SEQ ID NO: 46837 - DNA, 20 bp, human
gggccgccgcgtagccctcc

SEQ ID NO: 46838 - DNA, 20 bp, human
gcggagctccgcctcccgag

SEQ ID NO: 46839 - DNA, 20 bp, human
gcgaggggccccgagctcat

SEQ ID NO: 46840 - DNA, 20 bp, human
ggcggtcgagagatccttgg

SEQ ID NO: 46841 - DNA, 20 bp, human
ggatctctcgaccgcccggg

SEQ ID NO: 46842 - DNA, 20 bp, human
ggcggagctccgagcgccac

SEQ ID NO: 46843 - DNA, 20 bp, human
gcgggcggtcgagagatcct

SEQ ID NO: 46844 - DNA, 20 bp, human
gcggcctgccaatgagctcg

SEQ ID NO: 46845 - DNA, 20 bp, human
ggggccccgagctcattggc

SEQ ID NO: 46846 - DNA, 20 bp, human
gaagtcgcgggaggccggag

SEQ ID NO: 46847 - DNA, 20 bp, human
gcccaccttgtggaggatgg

SEQ ID NO: 46848 - DNA, 20 bp, human
gcccgcgacttctcgaaggt

SEQ ID NO: 46849 - DNA, 20 bp, human
gctcgtgtgagactccacgg

SEQ ID NO: 46850 - DNA, 20 bp, human
ggcctcccgcgacttctcga

SEQ ID NO: 46851 - DNA, 20 bp, human
gggacagaaacggtccgagt

SEQ ID NO: 46852 - DNA, 20 bp, human
gacgccggggtaccagaatc

SEQ ID NO: 46853 - DNA, 20 bp, human
gagacctgaggagcaagggt

SEQ ID NO: 46854 - DNA, 20 bp, human
ggcccaccttcgagaagtcg

SEQ ID NO: 46855 - DNA, 20 bp, human
gagggccgggtgaggacgtc

SEQ ID NO: 46856 - DNA, 20 bp, human
gagccacgctcaggaacccc

SEQ ID NO: 46857 - DNA, 20 bp, human
ggctgtcctgcccgagaggt

SEQ ID NO: 46858 - DNA, 20 bp, human
ggtggcttcagaacgcaggg

SEQ ID NO: 46859 - DNA, 20 bp, human
gcctggtgagctctgcaagc

SEQ ID NO: 46860 - DNA, 20 bp, human
gaccctgagggccagagtag

SEQ ID NO: 46861 - DNA, 20 bp, human
gcccagcgggcacctggaag

SEQ ID NO: 46862 - DNA, 20 bp, human
gcatcagagctaggagaccc

SEQ ID NO: 46863 - DNA, 20 bp, human
ggtcctcgccctggccgcag

SEQ ID NO: 46864 - DNA, 20 bp, human
gacaggccgggtgccgatcc

SEQ ID NO: 46865 - DNA, 20 bp, human
gcctcagccgctaggacccc

SEQ ID NO: 46866 - DNA, 20 bp, human
gtagcggcaggcctaagtgt

SEQ ID NO: 46867 - DNA, 20 bp, human
gagaagagaccggaacacaa

SEQ ID NO: 46868 - DNA, 20 bp, human
gctccaggcacgggcattag

SEQ ID NO: 46869 - DNA, 20 bp, human
ggaccaaagaggatccggag

SEQ ID NO: 46870 - DNA, 20 bp, human
gcctgcgctggcggagtcgg

SEQ ID NO: 46871 - DNA, 20 bp, human
ggttcaaccaggaaagtcca

SEQ ID NO: 46872 - DNA, 20 bp, human
gccccctgcgctggcggagt

SEQ ID NO: 46873 - DNA, 20 bp, human
gccgtgcctggagtagtatc

SEQ ID NO: 46874 - DNA, 20 bp, human
gtccgctccgggctccactc

SEQ ID NO: 46875 - DNA, 20 bp, human
gggctgcccggccgccggaa

SEQ ID NO: 46876 - DNA, 20 bp, human
gtcgctggaagactcggccc

SEQ ID NO: 46877 - DNA, 20 bp, human
gggccgggctggcaacgaga

SEQ ID NO: 46878 - DNA, 20 bp, human
gctggaagactcggcccggg

SEQ ID NO: 46879 - DNA, 20 bp, human
gagacggcgtcggaactcgc

SEQ ID NO: 46880 - DNA, 20 bp, human
gagggcacggagacgacggg

SEQ ID NO: 46881 - DNA, 20 bp, human
ggcgaactgttgagccaccc

SEQ ID NO: 46882 - DNA, 20 bp, human
gcggaactcgctggaagact

SEQ ID NO: 46883 - DNA, 20 bp, human
gtcctgagagacacaagagt

SEQ ID NO: 46884 - DNA, 20 bp, human
gaccgctgctagagtcccgg

SEQ ID NO: 46885 - DNA, 20 bp, human
gccgggcgcccgttcctcta

SEQ ID NO: 46886 - DNA, 20 bp, human
gcctaggggccagttactac

SEQ ID NO: 46887 - DNA, 20 bp, human
gtgctaaggacaaagaactg

SEQ ID NO: 46888 - DNA, 20 bp, human
gcctctctcccggcaagaaa

SEQ ID NO: 46889 - DNA, 20 bp, human
gactacccaggtccccggaa

SEQ ID NO: 46890 - DNA, 20 bp, human
gaagaaacggcctcctgcta

SEQ ID NO: 46891 - DNA, 20 bp, human
ggcgggcgcggagaaccccc

SEQ ID NO: 46892 - DNA, 20 bp, human
gggctggtcagggccggcag

SEQ ID NO: 46893 - DNA, 20 bp, human
gccgggagagagggattaga

SEQ ID NO: 46894 - DNA, 20 bp, human
gctgaccagcctgtagtaac

SEQ ID NO: 46895 - DNA, 20 bp, human
gtcatctaatggcccaccaa

SEQ ID NO: 46896 - DNA, 20 bp, human
gcagcggccactgggagctg

SEQ ID NO: 46897 - DNA, 20 bp, human
gggagccgctaactaatgga

SEQ ID NO: 46898 - DNA, 20 bp, human
ggcggccgtccattagttag

SEQ ID NO: 46899 - DNA, 20 bp, human
gccttgggtcagaggttagg

SEQ ID NO: 46900 - DNA, 20 bp, human
gctccggagccgctaactaa

SEQ ID NO: 46901 - DNA, 20 bp, human
ggactacaaatggacgagag

SEQ ID NO: 46902 - DNA, 20 bp, human
gaggccgacgggcctgacgc

SEQ ID NO: 46903 - DNA, 20 bp, human
gcgttgtccttgaggccgac

SEQ ID NO: 46904 - DNA, 20 bp, human
ggtcaggcccgtcggcctca

SEQ ID NO: 46905 - DNA, 20 bp, human
gtacaaatggacgagagagg

SEQ ID NO: 46906 - DNA, 20 bp, human
gccgcgcaggaccccggagt

SEQ ID NO: 46907 - DNA, 20 bp, human
ggtggaaagcgatgtaacag

SEQ ID NO: 46908 - DNA, 20 bp, human
ggctgggcggctaggacacc

SEQ ID NO: 46909 - DNA, 20 bp, human
gggccctgtggcaggctggt

SEQ ID NO: 46910 - DNA, 20 bp, human
gggacggcgtcgaggctggg

SEQ ID NO: 46911 - DNA, 20 bp, human
gggcttcgcgcagagcacag

SEQ ID NO: 46912 - DNA, 20 bp, human
gatgagggaaacaagctggg

SEQ ID NO: 46913 - DNA, 20 bp, human
gccacagtggagaatgaacg

SEQ ID NO: 46914 - DNA, 20 bp, human
gctccgggacgccagcgccg

SEQ ID NO: 46915 - DNA, 20 bp, human
gccagcagaggcggcagccg

SEQ ID NO: 46916 - DNA, 20 bp, human
gggcaagaagcctaaccaga

SEQ ID NO: 46917 - DNA, 20 bp, human
gaagggctggagagcacatg

SEQ ID NO: 46918 - DNA, 20 bp, human
gccctcctggagattcagtc

SEQ ID NO: 46919 - DNA, 20 bp, human
gagtggccaatctccagatg

SEQ ID NO: 46920 - DNA, 20 bp, human
ggtgagtgaaccccaagggc

SEQ ID NO: 46921 - DNA, 20 bp, human
gttatggtgctgttctgttg

SEQ ID NO: 46922 - DNA, 20 bp, human
gggccaatctccagatgagg

SEQ ID NO: 46923 - DNA, 20 bp, human
gcagaacagcaccataacca

SEQ ID NO: 46924 - DNA, 20 bp, human
gttgctataatctcttactg

SEQ ID NO: 46925 - DNA, 20 bp, human
gcctctgggaaggatctggc

SEQ ID NO: 46926 - DNA, 20 bp, human
gcagcaggcgcgtcacaggg

SEQ ID NO: 46927 - DNA, 20 bp, human
gggatagcgatggagacgcc

SEQ ID NO: 46928 - DNA, 20 bp, human
gggagcttgaagcagaggat

SEQ ID NO: 46929 - DNA, 20 bp, human
gggcgcgtcacagggtggag

SEQ ID NO: 46930 - DNA, 20 bp, human
ggcccagcaggcgcgtcaca

SEQ ID NO: 46931 - DNA, 20 bp, human
gaggacgacgctgatgcgcc

SEQ ID NO: 46932 - DNA, 20 bp, human
gtgggcccgagctttttcct

SEQ ID NO: 46933 - DNA, 20 bp, human
ggagtgtcaacacccgagag

SEQ ID NO: 46934 - DNA, 20 bp, human
gccgcctcgcgcttcctcgg

SEQ ID NO: 46935 - DNA, 20 bp, human
gcgccgcgtccaggcccccg

SEQ ID NO: 46936 - DNA, 20 bp, human
ggcgggctggcgcacactct

SEQ ID NO: 46937 - DNA, 20 bp, human
gtcttgcgcgcagctggagt

SEQ ID NO: 46938 - DNA, 20 bp, human
gcgcctgctggagcttacct

SEQ ID NO: 46939 - DNA, 20 bp, human
ggtcaggcggagctgaacct

SEQ ID NO: 46940 - DNA, 20 bp, human
gggcgcggagccgagcagga

SEQ ID NO: 46941 - DNA, 20 bp, human
ggtccgcagagagtgccagg

SEQ ID NO: 46942 - DNA, 20 bp, human
gcagagctgcacgaagtccg

SEQ ID NO: 46943 - DNA, 20 bp, human
gagcccaggtaagctccagc

SEQ ID NO: 46944 - DNA, 20 bp, human
gggcgtccgcagagagtgcc

SEQ ID NO: 46945 - DNA, 20 bp, human
gtccgaggcgccgcgagccc

SEQ ID NO: 46946 - DNA, 20 bp, human
gtcgggatgacgtgagctgg

SEQ ID NO: 46947 - DNA, 20 bp, human
ggccccggcgggacacgatg

SEQ ID NO: 46948 - DNA, 20 bp, human
ggcgccatggagcgctacgc

SEQ ID NO: 46949 - DNA, 20 bp, human
ggctcacgtcatcccgaccg

SEQ ID NO: 46950 - DNA, 20 bp, human
gctagggactgtcataaaag

SEQ ID NO: 46951 - DNA, 20 bp, human
ggcagctcggctccttcctt

SEQ ID NO: 46952 - DNA, 20 bp, human
ggggcgctcgtcgctgcagc

SEQ ID NO: 46953 - DNA, 20 bp, human
ggctgctggaatgagctgcg

SEQ ID NO: 46954 - DNA, 20 bp, human
ggccgcatcgtgtcccgccg

SEQ ID NO: 46955 - DNA, 20 bp, human
gggaatgagctgcggggtag

SEQ ID NO: 46956 - DNA, 20 bp, human
ggcccgctagccgccggcgg

SEQ ID NO: 46957 - DNA, 20 bp, human
gtcgggatgtcgtgaagctg

SEQ ID NO: 46958 - DNA, 20 bp, human
gccgctgcccccgcgcacct

SEQ ID NO: 46959 - DNA, 20 bp, human
gcgtgggacaatcgtaaaag

SEQ ID NO: 46960 - DNA, 20 bp, human
gggacaatcgtaaaaggggc

SEQ ID NO: 46961 - DNA, 20 bp, human
gctgtagcgccgacagcaac

SEQ ID NO: 46962 - DNA, 20 bp, human
ggcggcttcgtttcccgccg

SEQ ID NO: 46963 - DNA, 20 bp, human
gcttcacgacatcccgagcg

SEQ ID NO: 46964 - DNA, 20 bp, human
ggaaacgaagccgcctccgc

SEQ ID NO: 46965 - DNA, 20 bp, human
gtttacgattgtcccacgcg

SEQ ID NO: 46966 - DNA, 20 bp, human
ggtccaggctctccggtcgc

SEQ ID NO: 46967 - DNA, 20 bp, human
ggcttcgggccctccgggag

SEQ ID NO: 46968 - DNA, 20 bp, human
ggctgtccgcccgggtaaag

SEQ ID NO: 46969 - DNA, 20 bp, human
gggcggacagcgacgagagt

SEQ ID NO: 46970 - DNA, 20 bp, human
gccttcaggcgggaaaggtg

SEQ ID NO: 46971 - DNA, 20 bp, human
gggtaaagaggctcctctcc

SEQ ID NO: 46972 - DNA, 20 bp, human
gaaagaggctcctctcccgg

SEQ ID NO: 46973 - DNA, 20 bp, human
gaccgaccgccgcagccatc

SEQ ID NO: 46974 - DNA, 20 bp, human
ggctaggcttcgggccctcc

SEQ ID NO: 46975 - DNA, 20 bp, human
ggcaggcgggtgccggcgac

SEQ ID NO: 46976 - DNA, 20 bp, human
ggtgccgcacgggtggagaa

SEQ ID NO: 46977 - DNA, 20 bp, human
gcactcaggagatcccacgg

SEQ ID NO: 46978 - DNA, 20 bp, human
ggaccagcaggtaaagtggg

SEQ ID NO: 46979 - DNA, 20 bp, human
gggtgaaggtggtacagcaa

SEQ ID NO: 46980 - DNA, 20 bp, human
gaaggccctggccaaaagta

SEQ ID NO: 46981 - DNA, 20 bp, human
gcacccgtgcggcactgtgg

SEQ ID NO: 46982 - DNA, 20 bp, human
gcaagaccagcaggtaaagt

SEQ ID NO: 46983 - DNA, 20 bp, human
gcctgggagaccaagatacc

SEQ ID NO: 46984 - DNA, 20 bp, human
gtggttagggaagttcagga

SEQ ID NO: 46985 - DNA, 20 bp, human
gctcctgagtgtgaagtcag

SEQ ID NO: 46986 - DNA, 20 bp, human
gcggcagccagagataggca

SEQ ID NO: 46987 - DNA, 20 bp, human
gagcggaggctgaaagacgt

SEQ ID NO: 46988 - DNA, 20 bp, human
gagaggagcggggatgaagt

SEQ ID NO: 46989 - DNA, 20 bp, human
gtacttccaggcagcaacac

SEQ ID NO: 46990 - DNA, 20 bp, human
gagccagagataggcagggc

SEQ ID NO: 46991 - DNA, 20 bp, human
gggagcctgaaagtcatctt

SEQ ID NO: 46992 - DNA, 20 bp, human
gcgctcccggcacagtaaga

SEQ ID NO: 46993 - DNA, 20 bp, human
gtgcaactaaaaaacagcgg

SEQ ID NO: 46994 - DNA, 20 bp, human
gagtgggaggagtgagaggt

SEQ ID NO: 46995 - DNA, 20 bp, human
gtcagagacgggtgaactgc

SEQ ID NO: 46996 - DNA, 20 bp, human
gtgtcggacgactcctcggg

SEQ ID NO: 46997 - DNA, 20 bp, human
gtggcccggcagcatggcgg

SEQ ID NO: 46998 - DNA, 20 bp, human
gcgctgtcggacgactcctc

SEQ ID NO: 46999 - DNA, 20 bp, human
ggcgcgcggcccccgacgga

SEQ ID NO: 47000 - DNA, 20 bp, human
gtccgacagcgagcccgagg

SEQ ID NO: 47001 - DNA, 20 bp, human
gggcggggcacgctcgacag

SEQ ID NO: 47002 - DNA, 20 bp, human
ggagttgggccgcgaggacc

SEQ ID NO: 47003 - DNA, 20 bp, human
gaactgaggcctagatgcag

SEQ ID NO: 47004 - DNA, 20 bp, human
gcggacgactcctcgggcgg

SEQ ID NO: 47005 - DNA, 20 bp, human
ggaggcggttgcgggggacc

SEQ ID NO: 47006 - DNA, 20 bp, human
ggccggtctgacccacggaa

SEQ ID NO: 47007 - DNA, 20 bp, human
gggaagggcgcaacatacag

SEQ ID NO: 47008 - DNA, 20 bp, human
gtcagaccggcggcaaggtg

SEQ ID NO: 47009 - DNA, 20 bp, human
gccgccagcagggatgaagc

SEQ ID NO: 47010 - DNA, 20 bp, human
gttgccgccggtctgaccca

SEQ ID NO: 47011 - DNA, 20 bp, human
gtggacgcgctcccgaggtg

SEQ ID NO: 47012 - DNA, 20 bp, human
gaggagacggcgccccggag

SEQ ID NO: 47013 - DNA, 20 bp, human
gaccagaaggtgatgaacac

SEQ ID NO: 47014 - DNA, 20 bp, human
gtccggaggcctcccgagag

SEQ ID NO: 47015 - DNA, 20 bp, human
gcgcacacgcagcagtaggt

SEQ ID NO: 47016 - DNA, 20 bp, human
ggagcacagggtgaagaccc

SEQ ID NO: 47017 - DNA, 20 bp, human
gtctccgtggcccgctacta

SEQ ID NO: 47018 - DNA, 20 bp, human
gccacggagatagacagctt

SEQ ID NO: 47019 - DNA, 20 bp, human
gcggtcccgcggccagggaa

SEQ ID NO: 47020 - DNA, 20 bp, human
ggaagggatgccccgctcga

SEQ ID NO: 47021 - DNA, 20 bp, human
gcaggtggaactgtcggggt

SEQ ID NO: 47022 - DNA, 20 bp, human
gcaagcctgcacccctcgag

SEQ ID NO: 47023 - DNA, 20 bp, human
ggcccgctactacggcactg

SEQ ID NO: 47024 - DNA, 20 bp, human
gagccgcagtgccgtagtag

SEQ ID NO: 47025 - DNA, 20 bp, human
gcggtgcagcaacttggtaa

SEQ ID NO: 47026 - DNA, 20 bp, human
gctagggaaacggaagatgg

SEQ ID NO: 47027 - DNA, 20 bp, human
ggcggcgttggtcagcgggt

SEQ ID NO: 47028 - DNA, 20 bp, human
ggcagatccggaccaaggta

SEQ ID NO: 47029 - DNA, 20 bp, human
gtacctcgcgggggtagcta

SEQ ID NO: 47030 - DNA, 20 bp, human
gacacagcaccgcccggcgg

SEQ ID NO: 47031 - DNA, 20 bp, human
gtagctagggaaacggaaga

SEQ ID NO: 47032 - DNA, 20 bp, human
gccgcaggagtcggagagga

SEQ ID NO: 47033 - DNA, 20 bp, human
ggaccaaggtagggcggagg

SEQ ID NO: 47034 - DNA, 20 bp, human
ggtccccgcaggagtcggag

SEQ ID NO: 47035 - DNA, 20 bp, human
gcggccgggcacggggttcc

SEQ ID NO: 47036 - DNA, 20 bp, human
gggacagtaaccggcttcag

SEQ ID NO: 47037 - DNA, 20 bp, human
gctggagcgtagctggagtg

SEQ ID NO: 47038 - DNA, 20 bp, human
ggaagccggttactgtccag

SEQ ID NO: 47039 - DNA, 20 bp, human
gaatcccactggacagtaac

SEQ ID NO: 47040 - DNA, 20 bp, human
gagagcggcgaggaaagccc

SEQ ID NO: 47041 - DNA, 20 bp, human
gcttataaggcctgacaggg

SEQ ID NO: 47042 - DNA, 20 bp, human
gtggcgacgggagcagacgc

SEQ ID NO: 47043 - DNA, 20 bp, human
gggtgcccgtgaccacccgg

SEQ ID NO: 47044 - DNA, 20 bp, human
gaaaggagcggcctcccccg

SEQ ID NO: 47045 - DNA, 20 bp, human
gacggcgagagcgagagaca

SEQ ID NO: 47046 - DNA, 20 bp, human
ggtccgcgcgccgctggcag

SEQ ID NO: 47047 - DNA, 20 bp, human
gccggaagcaggtctcgtac

SEQ ID NO: 47048 - DNA, 20 bp, human
gcccttgctgggtagaagag

SEQ ID NO: 47049 - DNA, 20 bp, human
gggatggatgctgcgggaag

SEQ ID NO: 47050 - DNA, 20 bp, human
gaagcaggtctcgtacaggt

SEQ ID NO: 47051 - DNA, 20 bp, human
gcgccgcggcgcacctgtct

SEQ ID NO: 47052 - DNA, 20 bp, human
ggcggccgcgggctcgtcca

SEQ ID NO: 47053 - DNA, 20 bp, human
ggggagccggcagccgagac

SEQ ID NO: 47054 - DNA, 20 bp, human
gaggagaaaggggcgacggg

SEQ ID NO: 47055 - DNA, 20 bp, human
ggtctcgtacaggtaggtgc

SEQ ID NO: 47056 - DNA, 20 bp, human
gggaaggctaaagtaccctc

SEQ ID NO: 47057 - DNA, 20 bp, human
gagtccggcagcccctcgca

SEQ ID NO: 47058 - DNA, 20 bp, human
gggggctgccggactggagt

SEQ ID NO: 47059 - DNA, 20 bp, human
ggctctgaggtctaacccgt

SEQ ID NO: 47060 - DNA, 20 bp, human
gcgggctgctctccatcctg

SEQ ID NO: 47061 - DNA, 20 bp, human
ggccagccatggagtgggat

SEQ ID NO: 47062 - DNA, 20 bp, human
gcgcacaccgcttcaggtct

SEQ ID NO: 47063 - DNA, 20 bp, human
gctggagcaagctctggaca

SEQ ID NO: 47064 - DNA, 20 bp, human
ggcactgccccgcctcagga

SEQ ID NO: 47065 - DNA, 20 bp, human
gctcagagccaagccagcca

SEQ ID NO: 47066 - DNA, 20 bp, human
gccccggcgcggacctaaag

SEQ ID NO: 47067 - DNA, 20 bp, human
gtacaggagccgccgctcca

SEQ ID NO: 47068 - DNA, 20 bp, human
ggtaccgggccgtggagcgg

SEQ ID NO: 47069 - DNA, 20 bp, human
ggcagtcggaagcagtgtac

SEQ ID NO: 47070 - DNA, 20 bp, human
gtgggcgggagcctgagcgg

SEQ ID NO: 47071 - DNA, 20 bp, human
gaggtccgcgccgggggtac

SEQ ID NO: 47072 - DNA, 20 bp, human
gggctcctgtacccccggcg

SEQ ID NO: 47073 - DNA, 20 bp, human
gcctgcctctgccccgtggg

SEQ ID NO: 47074 - DNA, 20 bp, human
ggaagcagtgtaccgggccg

SEQ ID NO: 47075 - DNA, 20 bp, human
ggctcccgcccacggggcag

SEQ ID NO: 47076 - DNA, 20 bp, human
gtgaggcccgcaaggaagcg

SEQ ID NO: 47077 - DNA, 20 bp, human
gggatctgaagccaagtgta

SEQ ID NO: 47078 - DNA, 20 bp, human
gttggagccccgcttccttg

SEQ ID NO: 47079 - DNA, 20 bp, human
ggaggggttgggtggcctcg

SEQ ID NO: 47080 - DNA, 20 bp, human
gggcccagtgtgctcttctg

SEQ ID NO: 47081 - DNA, 20 bp, human
gtctgaagccaagtgtaagg

SEQ ID NO: 47082 - DNA, 20 bp, human
gtgagcgctttccgagtcat

SEQ ID NO: 47083 - DNA, 20 bp, human
gatcgctgaagccccggaga

SEQ ID NO: 47084 - DNA, 20 bp, human
ggggcgatggccgggtggga

SEQ ID NO: 47085 - DNA, 20 bp, human
gtaccccagaagagcacact

SEQ ID NO: 47086 - DNA, 20 bp, human
gaagtggcccggacccccag

SEQ ID NO: 47087 - DNA, 20 bp, human
gctggcggcacttcctggag

SEQ ID NO: 47088 - DNA, 20 bp, human
gagcggcttcccgggcacct

SEQ ID NO: 47089 - DNA, 20 bp, human
ggaggaatgtcccccggtga

SEQ ID NO: 47090 - DNA, 20 bp, human
gcggtactgacactgagtcg

SEQ ID NO: 47091 - DNA, 20 bp, human
ggacattcctcggccactgg

SEQ ID NO: 47092 - DNA, 20 bp, human
ggtggccgaggaatgtcccc

SEQ ID NO: 47093 - DNA, 20 bp, human
ggcccccgctccccacgccc

SEQ ID NO: 47094 - DNA, 20 bp, human
gtgagggagcggtaacctgc

SEQ ID NO: 47095 - DNA, 20 bp, human
ggcacgagccgtcttggcgt

SEQ ID NO: 47096 - DNA, 20 bp, human
ggcctctgtcgcctgcgtgg

SEQ ID NO: 47097 - DNA, 20 bp, human
ggagtgagcagcgataccta

SEQ ID NO: 47098 - DNA, 20 bp, human
gtcttggccatggaactgaa

SEQ ID NO: 47099 - DNA, 20 bp, human
gtcgctgtgtgaatcgtggg

SEQ ID NO: 47100 - DNA, 20 bp, human
gcttagaaagaggcggcccg

SEQ ID NO: 47101 - DNA, 20 bp, human
gtcgaagccgacttagaaag

SEQ ID NO: 47102 - DNA, 20 bp, human
gggaggaaacgccctcgagt

SEQ ID NO: 47103 - DNA, 20 bp, human
gtggccaagagcccactcga

SEQ ID NO: 47104 - DNA, 20 bp, human
gtccgccacgcaggcgacag

SEQ ID NO: 47105 - DNA, 20 bp, human
gtgagcagcgatacctaggg

SEQ ID NO: 47106 - DNA, 20 bp, human
gtccccgggctgtgggctac

SEQ ID NO: 47107 - DNA, 20 bp, human
gtgggctacaggcgcagagc

SEQ ID NO: 47108 - DNA, 20 bp, human
gagcgacacggcgggctcca

SEQ ID NO: 47109 - DNA, 20 bp, human
gcacacggccagcgacacgg

SEQ ID NO: 47110 - DNA, 20 bp, human
gcgccgcgcggtaagcgctg

SEQ ID NO: 47111 - DNA, 20 bp, human
gcgggtgcggccgggactca

SEQ ID NO: 47112 - DNA, 20 bp, human
gtatcgaagataagcgagag

SEQ ID NO: 47113 - DNA, 20 bp, human
ggacgggagctgcggtgcgg

SEQ ID NO: 47114 - DNA, 20 bp, human
gtactacgtgcgcgcctggg

SEQ ID NO: 47115 - DNA, 20 bp, human
gcaggacttcctgggggggt

SEQ ID NO: 47116 - DNA, 20 bp, human
gcgacccctggctagagggt

SEQ ID NO: 47117 - DNA, 20 bp, human
gagcgaggccaggggaaggt

SEQ ID NO: 47118 - DNA, 20 bp, human
gcccctggctagagggtagg

SEQ ID NO: 47119 - DNA, 20 bp, human
ggggaggcgaacaacaggtg

SEQ ID NO: 47120 - DNA, 20 bp, human
gtcagcactgacaaagaggg

SEQ ID NO: 47121 - DNA, 20 bp, human
gcgcgcgcaagcgaggccag

SEQ ID NO: 47122 - DNA, 20 bp, human
gtgcgggtgactccgacccc

SEQ ID NO: 47123 - DNA, 20 bp, human
gactccgacccctggctaga

SEQ ID NO: 47124 - DNA, 20 bp, human
ggccgcctaccctctagcca

SEQ ID NO: 47125 - DNA, 20 bp, human
gcgcatgtcagggaggacgg

SEQ ID NO: 47126 - DNA, 20 bp, human
ggcgcccagcggagctaatc

SEQ ID NO: 47127 - DNA, 20 bp, human
ggcgtccccacggcttcagt

SEQ ID NO: 47128 - DNA, 20 bp, human
gaactgaaggggtgaactag

SEQ ID NO: 47129 - DNA, 20 bp, human
gagccaggagaaccgaggaa

SEQ ID NO: 47130 - DNA, 20 bp, human
gtgcaaagccaggagaaccg

SEQ ID NO: 47131 - DNA, 20 bp, human
ggccggcccactgaagccgt

SEQ ID NO: 47132 - DNA, 20 bp, human
ggcacctgattagctccgct

SEQ ID NO: 47133 - DNA, 20 bp, human
gaacgcaatgtgacctctgg

SEQ ID NO: 47134 - DNA, 20 bp, human
gcggggaatgatcaagatgt

SEQ ID NO: 47135 - DNA, 20 bp, human
gtataacgcaatgtgacctc

SEQ ID NO: 47136 - DNA, 20 bp, human
gtcgcgcctggagggaccga

SEQ ID NO: 47137 - DNA, 20 bp, human
ggggctccgcatcgcaacca

SEQ ID NO: 47138 - DNA, 20 bp, human
ggagggaccgaaggtgccga

SEQ ID NO: 47139 - DNA, 20 bp, human
gggactccagagtctaaagg

SEQ ID NO: 47140 - DNA, 20 bp, human
gatgccccagcgcagcgcca

SEQ ID NO: 47141 - DNA, 20 bp, human
gtgtgaagtcgctggagatg

SEQ ID NO: 47142 - DNA, 20 bp, human
gcagcgccatggttgcgatg

SEQ ID NO: 47143 - DNA, 20 bp, human
ggcgggactccagagtctaa

SEQ ID NO: 47144 - DNA, 20 bp, human
ggctggggcatcgtgtctgt

SEQ ID NO: 47145 - DNA, 20 bp, human
gcgaggcagcgtctgcagca

SEQ ID NO: 47146 - DNA, 20 bp, human
gcagaacctactatgtgcgg

SEQ ID NO: 47147 - DNA, 20 bp, human
gagctgccgccgcacatagt

SEQ ID NO: 47148 - DNA, 20 bp, human
gagacagaacctactatgtg

SEQ ID NO: 47149 - DNA, 20 bp, human
gggcctcgcctgcacaaatg

SEQ ID NO: 47150 - DNA, 20 bp, human
gcgcagacgcctgggaactg

SEQ ID NO: 47151 - DNA, 20 bp, human
gctgcacaaatggggacgag

SEQ ID NO: 47152 - DNA, 20 bp, human
ggcaggcttccggcgagaca

SEQ ID NO: 47153 - DNA, 20 bp, human
gcttccggcgagacatggca

SEQ ID NO: 47154 - DNA, 20 bp, human
gtgcagcgccagggtccacc

SEQ ID NO: 47155 - DNA, 20 bp, human
gctcgccggaagcctgcgtc

SEQ ID NO: 47156 - DNA, 20 bp, human
gtacttccggtagctggtaa

SEQ ID NO: 47157 - DNA, 20 bp, human
ggatacttcccaggacgcgg

SEQ ID NO: 47158 - DNA, 20 bp, human
gcccaggacgcggaggtaac

SEQ ID NO: 47159 - DNA, 20 bp, human
ggctgatacttcccaggacg

SEQ ID NO: 47160 - DNA, 20 bp, human
gtgaatgtctaggttaacag

SEQ ID NO: 47161 - DNA, 20 bp, human
ggtacccaaggataaaaggg

SEQ ID NO: 47162 - DNA, 20 bp, human
gacgcggaggtaacgggcca

SEQ ID NO: 47163 - DNA, 20 bp, human
gtcagtacccaaggataaaa

SEQ ID NO: 47164 - DNA, 20 bp, human
ggcagaagcaggggccgcac

SEQ ID NO: 47165 - DNA, 20 bp, human
gtaacaggggtcactagatt

SEQ ID NO: 47166 - DNA, 20 bp, human
ggaagtgccaagcagcacag

SEQ ID NO: 47167 - DNA, 20 bp, human
gccatcatagcagggaaggg

SEQ ID NO: 47168 - DNA, 20 bp, human
gcctgcagcagagacgggct

SEQ ID NO: 47169 - DNA, 20 bp, human
ggcgtgccagagcggaccct

SEQ ID NO: 47170 - DNA, 20 bp, human
gcgccagtgggccagcggag

SEQ ID NO: 47171 - DNA, 20 bp, human
gcgtctctgctgcaggactc

SEQ ID NO: 47172 - DNA, 20 bp, human
gtggcgcccagggtccgctc

SEQ ID NO: 47173 - DNA, 20 bp, human
gcaaattgcttgtagagtag

SEQ ID NO: 47174 - DNA, 20 bp, human
gcggagccacaagagctcta

SEQ ID NO: 47175 - DNA, 20 bp, human
ggagctgcttgcgcgcatag

SEQ ID NO: 47176 - DNA, 20 bp, human
ggtcccgcgagtgagcagtg

SEQ ID NO: 47177 - DNA, 20 bp, human
gacaggggcgggcttaatga

SEQ ID NO: 47178 - DNA, 20 bp, human
ggcgagtgagcagtgtggat

SEQ ID NO: 47179 - DNA, 20 bp, human
ggggcgggcttaatgacgga

SEQ ID NO: 47180 - DNA, 20 bp, human
gtggatgggggaccagggac

SEQ ID NO: 47181 - DNA, 20 bp, human
gttgtgtgccggatccaacg

SEQ ID NO: 47182 - DNA, 20 bp, human
gcgggcgaggcatggaccga

SEQ ID NO: 47183 - DNA, 20 bp, human
gcttaatgacggaaggagca

SEQ ID NO: 47184 - DNA, 20 bp, human
gagggcgagaacggagagtc

SEQ ID NO: 47185 - DNA, 20 bp, human
ggcgaggcatggaccgaagg

SEQ ID NO: 47186 - DNA, 20 bp, human
gccaggaggccgcacacaca

SEQ ID NO: 47187 - DNA, 20 bp, human
ggacacaagtgagacctact

SEQ ID NO: 47188 - DNA, 20 bp, human
ggttctcagaggctcccagt

SEQ ID NO: 47189 - DNA, 20 bp, human
gcggacgcccaagagcagaa

SEQ ID NO: 47190 - DNA, 20 bp, human
gggtacttggtgaatcctat

SEQ ID NO: 47191 - DNA, 20 bp, human
gcagggttggttgagcacca

SEQ ID NO: 47192 - DNA, 20 bp, human
gtgaatcctataggtgagca

SEQ ID NO: 47193 - DNA, 20 bp, human
ggcttgtcagagagcgacct

SEQ ID NO: 47194 - DNA, 20 bp, human
gacagataactgcaggtgct

SEQ ID NO: 47195 - DNA, 20 bp, human
ggtgtctcagtgtctacact

SEQ ID NO: 47196 - DNA, 20 bp, human
ggaacgggaggcgccagcgg

SEQ ID NO: 47197 - DNA, 20 bp, human
gcgccgtaagcccggcctag

SEQ ID NO: 47198 - DNA, 20 bp, human
gccaacgcggtactagacgg

SEQ ID NO: 47199 - DNA, 20 bp, human
gcgcaagagcacaggaagta

SEQ ID NO: 47200 - DNA, 20 bp, human
gggaaggcgggacctattct

SEQ ID NO: 47201 - DNA, 20 bp, human
gccgccttcctccaactatt

SEQ ID NO: 47202 - DNA, 20 bp, human
gcgcgtctccgcaagagcac

SEQ ID NO: 47203 - DNA, 20 bp, human
gacgggggcagcgtttccag

SEQ ID NO: 47204 - DNA, 20 bp, human
gtgcccctaggccgggctta

SEQ ID NO: 47205 - DNA, 20 bp, human
gtgactcgagagccggctat

SEQ ID NO: 47206 - DNA, 20 bp, human
ggctgagtgggactgtccag

SEQ ID NO: 47207 - DNA, 20 bp, human
ggattctgtagtaggacccg

SEQ ID NO: 47208 - DNA, 20 bp, human
ggattgagccggcgacgtgg

SEQ ID NO: 47209 - DNA, 20 bp, human
gtccaggcagccacactcag

SEQ ID NO: 47210 - DNA, 20 bp, human
gccggggcgattctgtgctg

SEQ ID NO: 47211 - DNA, 20 bp, human
gcctcactagggctaagagg

SEQ ID NO: 47212 - DNA, 20 bp, human
ggagatcctaagccctaagt

SEQ ID NO: 47213 - DNA, 20 bp, human
ggcgccagattcccatatcc

SEQ ID NO: 47214 - DNA, 20 bp, human
ggagtgggactgtccagagg

SEQ ID NO: 47215 - DNA, 20 bp, human
ggaacctcactagggctaag

SEQ ID NO: 47216 - DNA, 20 bp, human
gggcaggccgggactctggt

SEQ ID NO: 47217 - DNA, 20 bp, human
gtcggacccaagcaggtcgg

SEQ ID NO: 47218 - DNA, 20 bp, human
gctgccttaagggatccgag

SEQ ID NO: 47219 - DNA, 20 bp, human
gtaccctggggagacccgag

SEQ ID NO: 47220 - DNA, 20 bp, human
gcggcctctcggatccctta

SEQ ID NO: 47221 - DNA, 20 bp, human
gcctagacccaccagagtcc

SEQ ID NO: 47222 - DNA, 20 bp, human
gcgcccctcgggtctcccca

SEQ ID NO: 47223 - DNA, 20 bp, human
ggattcggtaactcgagcag

SEQ ID NO: 47224 - DNA, 20 bp, human
gcgcactgtgggcaacatcg

SEQ ID NO: 47225 - DNA, 20 bp, human
gggtgggtctaggcgcggat

SEQ ID NO: 47226 - DNA, 20 bp, human
gcggcgccaaggagcctctt

SEQ ID NO: 47227 - DNA, 20 bp, human
gtgcggtacagggacatgcc

SEQ ID NO: 47228 - DNA, 20 bp, human
gctgctggcggcgtcagata

SEQ ID NO: 47229 - DNA, 20 bp, human
gggcgaaccacacgacgctg

SEQ ID NO: 47230 - DNA, 20 bp, human
ggccgtgggtcgctagacgg

SEQ ID NO: 47231 - DNA, 20 bp, human
ggggccgtcccactgacgtc

SEQ ID NO: 47232 - DNA, 20 bp, human
gcacacgacgctgcggtaca

SEQ ID NO: 47233 - DNA, 20 bp, human
gagggcgggcgactcccggg

SEQ ID NO: 47234 - DNA, 20 bp, human
gtgtggcgcgcccaagccca

SEQ ID NO: 47235 - DNA, 20 bp, human
gccagccgtgggtcgctaga

SEQ ID NO: 47236 - DNA, 20 bp, human
gggtccgcaggcgccaacag

SEQ ID NO: 47237 - DNA, 20 bp, human
ggcatggaggcgctgctgct

SEQ ID NO: 47238 - DNA, 20 bp, human
gctcacctggcggaggtcga

SEQ ID NO: 47239 - DNA, 20 bp, human
ggcctggcggcgatccaggg

SEQ ID NO: 47240 - DNA, 20 bp, human
ggccgcctggcggcgatcca

SEQ ID NO: 47241 - DNA, 20 bp, human
gaggcctgtgcagggcggat

SEQ ID NO: 47242 - DNA, 20 bp, human
gggtgagccgagaacccgcc

SEQ ID NO: 47243 - DNA, 20 bp, human
ggctgcctctcacctggcgg

SEQ ID NO: 47244 - DNA, 20 bp, human
gaaggggctgcggaggatcc

SEQ ID NO: 47245 - DNA, 20 bp, human
gacacagagaagccagcaaa

SEQ ID NO: 47246 - DNA, 20 bp, human
gaattcggtggctaaattct

SEQ ID NO: 47247 - DNA, 20 bp, human
gaaatgtgtacggaattgat

SEQ ID NO: 47248 - DNA, 20 bp, human
gaaagtcaccaaaatgtgta

SEQ ID NO: 47249 - DNA, 20 bp, human
gattcctctcggtgcattcg

SEQ ID NO: 47250 - DNA, 20 bp, human
gacccttgcggtgagtatta

SEQ ID NO: 47251 - DNA, 20 bp, human
gtggtgagaccatcaccaag

SEQ ID NO: 47252 - DNA, 20 bp, human
ggcaaatgaaagggatctga

SEQ ID NO: 47253 - DNA, 20 bp, human
gatgaagttgcagacccttg

SEQ ID NO: 47254 - DNA, 20 bp, human
gttcattcttgaagtcagtg

SEQ ID NO: 47255 - DNA, 20 bp, human
gcagagttgttcattcctct

SEQ ID NO: 47256 - DNA, 20 bp, human
gacccggaccctctccaagt

SEQ ID NO: 47257 - DNA, 20 bp, human
gaaaccgcgggaccgaggca

SEQ ID NO: 47258 - DNA, 20 bp, human
gaatagggccgcgcagacca

SEQ ID NO: 47259 - DNA, 20 bp, human
gcagcaacgtgcaggagaag

SEQ ID NO: 47260 - DNA, 20 bp, human
ggaaggggagctggatcgag

SEQ ID NO: 47261 - DNA, 20 bp, human
gcccggggagcgaatgaata

SEQ ID NO: 47262 - DNA, 20 bp, human
gctttgaaaccgcgggaccg

SEQ ID NO: 47263 - DNA, 20 bp, human
gcagggtgcgcgcgtgtggt

SEQ ID NO: 47264 - DNA, 20 bp, human
ggaccctctccaagttggaa

SEQ ID NO: 47265 - DNA, 20 bp, human
ggggtgggggcgctacaatt

SEQ ID NO: 47266 - DNA, 20 bp, human
gtggggagactagatcgata

SEQ ID NO: 47267 - DNA, 20 bp, human
gtgggttccactcttcccag

SEQ ID NO: 47268 - DNA, 20 bp, human
gctcctgtccctgctacctc

SEQ ID NO: 47269 - DNA, 20 bp, human
ggtctgatccatgcacaagg

SEQ ID NO: 47270 - DNA, 20 bp, human
gtgccagaggtagcagggac

SEQ ID NO: 47271 - DNA, 20 bp, human
ggttccactcttcccagggg

SEQ ID NO: 47272 - DNA, 20 bp, human
gtggcagcgtgtaaggtctg

SEQ ID NO: 47273 - DNA, 20 bp, human
gcgcaccgaattccaagccc

SEQ ID NO: 47274 - DNA, 20 bp, human
gtaggtggcgctggttgact

SEQ ID NO: 47275 - DNA, 20 bp, human
gcggagcactcacccgtcgg

SEQ ID NO: 47276 - DNA, 20 bp, human
ggatcgatgggacttcacag

SEQ ID NO: 47277 - DNA, 20 bp, human
gaggtggtgctggttgacgg

SEQ ID NO: 47278 - DNA, 20 bp, human
ggtcacctcgctggaaggag

SEQ ID NO: 47279 - DNA, 20 bp, human
gcgatgggacttcacagagg

SEQ ID NO: 47280 - DNA, 20 bp, human
ggggacacgaaggcaggcaa

SEQ ID NO: 47281 - DNA, 20 bp, human
gccagaaactagaaatccaa

SEQ ID NO: 47282 - DNA, 20 bp, human
gccagcaccacctagcgtcc

SEQ ID NO: 47283 - DNA, 20 bp, human
gcgtagccgcgccttgtgca

SEQ ID NO: 47284 - DNA, 20 bp, human
gccagggccaggggattcgg

SEQ ID NO: 47285 - DNA, 20 bp, human
ggattcggaggggcttcggg

SEQ ID NO: 47286 - DNA, 20 bp, human
gagaggcagcagggacagaa

SEQ ID NO: 47287 - DNA, 20 bp, human
gtgggttccactccttccag

SEQ ID NO: 47288 - DNA, 20 bp, human
gggagggccagggtattcgg

SEQ ID NO: 47289 - DNA, 20 bp, human
gcagctggccgagggcggga

SEQ ID NO: 47290 - DNA, 20 bp, human
gtcacctccgctggaaggag

SEQ ID NO: 47291 - DNA, 20 bp, human
gtggggggactagatcgatg

SEQ ID NO: 47292 - DNA, 20 bp, human
ggttccactccttccagcgg

SEQ ID NO: 47293 - DNA, 20 bp, human
gtgtgcctgggcacggaagt

SEQ ID NO: 47294 - DNA, 20 bp, human
gccagccttacctagcctct

SEQ ID NO: 47295 - DNA, 20 bp, human
ggcacggaagtcggtgcgga

SEQ ID NO: 47296 - DNA, 20 bp, human
gcagcgacgcgactctggtg

SEQ ID NO: 47297 - DNA, 20 bp, human
gccggctgccccttacgcag

SEQ ID NO: 47298 - DNA, 20 bp, human
ggtggcgctgcgatcccgca

SEQ ID NO: 47299 - DNA, 20 bp, human
gcagggcagcgacgcgactc

SEQ ID NO: 47300 - DNA, 20 bp, human
gcgaccagtacagaagacaa

SEQ ID NO: 47301 - DNA, 20 bp, human
gcgagcccggcctcccactc

SEQ ID NO: 47302 - DNA, 20 bp, human
gcatcttacgcaggactcaa

SEQ ID NO: 47303 - DNA, 20 bp, human
ggccgcgcacgcccagctcg

SEQ ID NO: 47304 - DNA, 20 bp, human
gtgcgcggccgcaatgaact

SEQ ID NO: 47305 - DNA, 20 bp, human
ggccaaagcctctcccgagt

SEQ ID NO: 47306 - DNA, 20 bp, human
gctctccggctaccaggtag

SEQ ID NO: 47307 - DNA, 20 bp, human
gctgcgagtggcaggaccga

SEQ ID NO: 47308 - DNA, 20 bp, human
gccctatcgcctcatctcgg

SEQ ID NO: 47309 - DNA, 20 bp, human
gagaaggaacctccgagatg

SEQ ID NO: 47310 - DNA, 20 bp, human
gagaccctatcgcctcatct

SEQ ID NO: 47311 - DNA, 20 bp, human
ggtggcaccttagccagtga

SEQ ID NO: 47312 - DNA, 20 bp, human
gctacgtcgcgcagaaatgt

SEQ ID NO: 47313 - DNA, 20 bp, human
gtagccagtgacggcgagtt

SEQ ID NO: 47314 - DNA, 20 bp, human
gggatgaagttgattgacta

SEQ ID NO: 47315 - DNA, 20 bp, human
ggctccgcagcgtctgcgag

SEQ ID NO: 47316 - DNA, 20 bp, human
gccgatgccatctcaggact

SEQ ID NO: 47317 - DNA, 20 bp, human
gacgctgatcaggactccca

SEQ ID NO: 47318 - DNA, 20 bp, human
ggctgtgcagaacaaagtgg

SEQ ID NO: 47319 - DNA, 20 bp, human
gtgctgctgctgggaatcag

SEQ ID NO: 47320 - DNA, 20 bp, human
gtgatcaccgatgccatctc

SEQ ID NO: 47321 - DNA, 20 bp, human
gccattagggcccaagcaag

SEQ ID NO: 47322 - DNA, 20 bp, human
gccaagaggtgtccaggctg

SEQ ID NO: 47323 - DNA, 20 bp, human
gccatctcaggactgggcaa

SEQ ID NO: 47324 - DNA, 20 bp, human
ggaaagcagaccgaatccag

SEQ ID NO: 47325 - DNA, 20 bp, human
gcacctcttggtaaatgaag

SEQ ID NO: 47326 - DNA, 20 bp, human
gcagagctctacggaaaccc

SEQ ID NO: 47327 - DNA, 20 bp, human
ggaattgaattgggacacta

SEQ ID NO: 47328 - DNA, 20 bp, human
gcaggcacctcgacctcaag

SEQ ID NO: 47329 - DNA, 20 bp, human
gtgggacactagggtgctaa

SEQ ID NO: 47330 - DNA, 20 bp, human
gaagaggatcagcctggcca

SEQ ID NO: 47331 - DNA, 20 bp, human
gaggaagagttgtgccaccc

SEQ ID NO: 47332 - DNA, 20 bp, human
ggctgatcctcttgaggtcg

SEQ ID NO: 47333 - DNA, 20 bp, human
ggagttcaaggcaagatccc

SEQ ID NO: 47334 - DNA, 20 bp, human
gttcctgctgtgcacgggga

SEQ ID NO: 47335 - DNA, 20 bp, human
gaagatcccaggtcacaccg

SEQ ID NO: 47336 - DNA, 20 bp, human
gagctgcgccaggatcaccg

SEQ ID NO: 47337 - DNA, 20 bp, human
gccacacgcgcggggaggga

SEQ ID NO: 47338 - DNA, 20 bp, human
ggcccgacccgggacaggcg

SEQ ID NO: 47339 - DNA, 20 bp, human
ggccatgtcgccattgtctg

SEQ ID NO: 47340 - DNA, 20 bp, human
ggcggccctgcgggtctacg

SEQ ID NO: 47341 - DNA, 20 bp, human
ggccgcagacaatggcgaca

SEQ ID NO: 47342 - DNA, 20 bp, human
ggccaggcgcgcagaagagc

SEQ ID NO: 47343 - DNA, 20 bp, human
gccgcgcccaagacatcagg

SEQ ID NO: 47344 - DNA, 20 bp, human
gttggagcccgacccgggac

SEQ ID NO: 47345 - DNA, 20 bp, human
gcttggttggagcccgaccc

SEQ ID NO: 47346 - DNA, 20 bp, human
gggcgctccagggcgccctg

SEQ ID NO: 47347 - DNA, 20 bp, human
gtgtcccggccagcatgcta

SEQ ID NO: 47348 - DNA, 20 bp, human
gaacatggcctctgctactg

SEQ ID NO: 47349 - DNA, 20 bp, human
gccgggacatctggtgaaca

SEQ ID NO: 47350 - DNA, 20 bp, human
ggctaaggcgggagcccgag

SEQ ID NO: 47351 - DNA, 20 bp, human
ggctgctgccgcagtagcag

SEQ ID NO: 47352 - DNA, 20 bp, human
gaggtccggaccagcaagat

SEQ ID NO: 47353 - DNA, 20 bp, human
gtaaatccgggactcgtcag

SEQ ID NO: 47354 - DNA, 20 bp, human
gcccggccagcatgctaagg

SEQ ID NO: 47355 - DNA, 20 bp, human
gtccggacctggtttcggaa

SEQ ID NO: 47356 - DNA, 20 bp, human
gggttccggccgcaccgtgt

SEQ ID NO: 47357 - DNA, 20 bp, human
gtgtgggctgtagtagcggg

SEQ ID NO: 47358 - DNA, 20 bp, human
gaccgtgtgggctgtagtag

SEQ ID NO: 47359 - DNA, 20 bp, human
gctgtagtagcgggaggggt

SEQ ID NO: 47360 - DNA, 20 bp, human
gaggcctgcagtagccatga

SEQ ID NO: 47361 - DNA, 20 bp, human
gctgcccagcccagtccgga

SEQ ID NO: 47362 - DNA, 20 bp, human
ggacagccacttaactctgg

SEQ ID NO: 47363 - DNA, 20 bp, human
gggggtcctccagagttaag

SEQ ID NO: 47364 - DNA, 20 bp, human
ggcctctccaccctccggac

SEQ ID NO: 47365 - DNA, 20 bp, human
gccggaaccaacagctaaaa

SEQ ID NO: 47366 - DNA, 20 bp, human
ggaagatcctagaggtccca

SEQ ID NO: 47367 - DNA, 20 bp, human
gggatgtcggaagatcctag

SEQ ID NO: 47368 - DNA, 20 bp, human
gagactctggaacaaggtgt

SEQ ID NO: 47369 - DNA, 20 bp, human
gcgtaccgcggagcccggaa

SEQ ID NO: 47370 - DNA, 20 bp, human
gctcaccgggacaaatcaca

SEQ ID NO: 47371 - DNA, 20 bp, human
gacaaggtgtcggcaggggt

SEQ ID NO: 47372 - DNA, 20 bp, human
gcggccaccgtagtgcttag

SEQ ID NO: 47373 - DNA, 20 bp, human
gtggaacaaggtgtcggcag

SEQ ID NO: 47374 - DNA, 20 bp, human
gttcgcaagtcagctacctt

SEQ ID NO: 47375 - DNA, 20 bp, human
ggccctgagactctggaaca

SEQ ID NO: 47376 - DNA, 20 bp, human
gccaccctgcgcttcgatcc

SEQ ID NO: 47377 - DNA, 20 bp, human
gagagctctcggctgtgcag

SEQ ID NO: 47378 - DNA, 20 bp, human
gcgagctgctacctccccat

SEQ ID NO: 47379 - DNA, 20 bp, human
ggagagctcttcacattccc

SEQ ID NO: 47380 - DNA, 20 bp, human
gctgtgcagtggtaccgtcg

SEQ ID NO: 47381 - DNA, 20 bp, human
gtaaaacaaggccaccccat

SEQ ID NO: 47382 - DNA, 20 bp, human
gggctccctggagccggcag

SEQ ID NO: 47383 - DNA, 20 bp, human
gcggtggccggcctggacac

SEQ ID NO: 47384 - DNA, 20 bp, human
gtgggcccgaagctcctccc

SEQ ID NO: 47385 - DNA, 20 bp, human
gaagcccggatcgaagcgca

SEQ ID NO: 47386 - DNA, 20 bp, human
ggcggccgctaggagactca

SEQ ID NO: 47387 - DNA, 20 bp, human
ggtcggcgggagcacgatgg

SEQ ID NO: 47388 - DNA, 20 bp, human
gagcgccatgagtctcctag

SEQ ID NO: 47389 - DNA, 20 bp, human
gccgggagcaggtactctaa

SEQ ID NO: 47390 - DNA, 20 bp, human
gaggcgcggagagatgccgg

SEQ ID NO: 47391 - DNA, 20 bp, human
gctgccatcccaggagtcaa

SEQ ID NO: 47392 - DNA, 20 bp, human
gacctgctcccggcaagaat

SEQ ID NO: 47393 - DNA, 20 bp, human
ggagaggtgcgagacctcga

SEQ ID NO: 47394 - DNA, 20 bp, human
gggggtcggcgggagcacga

SEQ ID NO: 47395 - DNA, 20 bp, human
gagcgtggcacaggcccgaa

SEQ ID NO: 47396 - DNA, 20 bp, human
ggctcatgcgcggtgcacag

SEQ ID NO: 47397 - DNA, 20 bp, human
gcgcggcaggctcctcaaga

SEQ ID NO: 47398 - DNA, 20 bp, human
gtcctcaagagggcacgaaa

SEQ ID NO: 47399 - DNA, 20 bp, human
ggaagtagacaaaggtctcg

SEQ ID NO: 47400 - DNA, 20 bp, human
ggtgcaccgcgcatgagccg

SEQ ID NO: 47401 - DNA, 20 bp, human
gaggtctcggggcactcagg

SEQ ID NO: 47402 - DNA, 20 bp, human
ggccgcggctcccccaacca

SEQ ID NO: 47403 - DNA, 20 bp, human
gctgtaacaacaggtgaatt

SEQ ID NO: 47404 - DNA, 20 bp, human
gggagcaggccgggcatcct

SEQ ID NO: 47405 - DNA, 20 bp, human
gcaaaggtctcggggcactc

SEQ ID NO: 47406 - DNA, 20 bp, human
gggacactgagcgagggtag

SEQ ID NO: 47407 - DNA, 20 bp, human
gctgctcctgaagcccggtc

SEQ ID NO: 47408 - DNA, 20 bp, human
gagggcgcgaccgcctgacc

SEQ ID NO: 47409 - DNA, 20 bp, human
ggaacgtccacggccaactg

SEQ ID NO: 47410 - DNA, 20 bp, human
gtccgggagccgcgcctcag

SEQ ID NO: 47411 - DNA, 20 bp, human
ggtgtcctcagccggtgacc

SEQ ID NO: 47412 - DNA, 20 bp, human
gcaaaagccgcaggaagtga

SEQ ID NO: 47413 - DNA, 20 bp, human
gcccgactccgaaacgccga

SEQ ID NO: 47414 - DNA, 20 bp, human
ggggctccgtcctcccgctg

SEQ ID NO: 47415 - DNA, 20 bp, human
ggactccgaaacgccgaggg

SEQ ID NO: 47416 - DNA, 20 bp, human
ggcatgtcgggagggcaccg

SEQ ID NO: 47417 - DNA, 20 bp, human
gcagcacgtggcggcgagga

SEQ ID NO: 47418 - DNA, 20 bp, human
ggcggccgtgaggtcatcgg

SEQ ID NO: 47419 - DNA, 20 bp, human
gtggacaacgcggtcctcat

SEQ ID NO: 47420 - DNA, 20 bp, human
ggccgggagccgccagcacg

SEQ ID NO: 47421 - DNA, 20 bp, human
ggcgaccaccgatgacctca

SEQ ID NO: 47422 - DNA, 20 bp, human
gacgaacgaaagggattgag

SEQ ID NO: 47423 - DNA, 20 bp, human
ggcccccgcgcttggaagat

SEQ ID NO: 47424 - DNA, 20 bp, human
gcaccacttgcctcccggga

SEQ ID NO: 47425 - DNA, 20 bp, human
gggggcggccgtgaggtcat

SEQ ID NO: 47426 - DNA, 20 bp, human
gggcgtgtggtaagtgaggg

SEQ ID NO: 47427 - DNA, 20 bp, human
gtcgcggcgtgtggtaagtg

SEQ ID NO: 47428 - DNA, 20 bp, human
gcagagaccgaaagaaatgg

SEQ ID NO: 47429 - DNA, 20 bp, human
gtagagcccacgaggccgag

SEQ ID NO: 47430 - DNA, 20 bp, human
gagcgtccctgggagaacct

SEQ ID NO: 47431 - DNA, 20 bp, human
gcgggtgtaccgggttgtgg

SEQ ID NO: 47432 - DNA, 20 bp, human
ggactctcgctggaacccat

SEQ ID NO: 47433 - DNA, 20 bp, human
gccggaagttaaggcgttcg

SEQ ID NO: 47434 - DNA, 20 bp, human
gagccatcgccgccacaacc

SEQ ID NO: 47435 - DNA, 20 bp, human
gagactagcgctcttgggac

SEQ ID NO: 47436 - DNA, 20 bp, human
ggttccaccaagggccttac

SEQ ID NO: 47437 - DNA, 20 bp, human
gaagttctggcgacccggta

SEQ ID NO: 47438 - DNA, 20 bp, human
gctgcccagcgttccaccaa

SEQ ID NO: 47439 - DNA, 20 bp, human
ggtggaacgctgggcagatg

SEQ ID NO: 47440 - DNA, 20 bp, human
ggcgctaacgagacacgaga

SEQ ID NO: 47441 - DNA, 20 bp, human
ggggcctagcgcgcgacggt

SEQ ID NO: 47442 - DNA, 20 bp, human
gagctccccccgcacagagg

SEQ ID NO: 47443 - DNA, 20 bp, human
gcgtgggaccggtgaagttc

SEQ ID NO: 47444 - DNA, 20 bp, human
gatggctgcgcccgtgggac

SEQ ID NO: 47445 - DNA, 20 bp, human
ggaacgctgggcagatgcgg

SEQ ID NO: 47446 - DNA, 20 bp, human
ggcccggacgccatttccag

SEQ ID NO: 47447 - DNA, 20 bp, human
ggtggtacgcgaaaaaacag

SEQ ID NO: 47448 - DNA, 20 bp, human
gagcggttgctggttctgac

SEQ ID NO: 47449 - DNA, 20 bp, human
gggcatcccgggcacctgaa

SEQ ID NO: 47450 - DNA, 20 bp, human
gatgctggcgctccccgtag

SEQ ID NO: 47451 - DNA, 20 bp, human
gatcacggccccagttctga

SEQ ID NO: 47452 - DNA, 20 bp, human
gaacggaagtgggcgcacag

SEQ ID NO: 47453 - DNA, 20 bp, human
gatgactaccatcagaactg

SEQ ID NO: 47454 - DNA, 20 bp, human
gtacgcagtacacccgctac

SEQ ID NO: 47455 - DNA, 20 bp, human
gaaccagcaaccgctggaaa

SEQ ID NO: 47456 - DNA, 20 bp, human
ggaaatccagccccggtccg

SEQ ID NO: 47457 - DNA, 20 bp, human
ggtaagacatccccggaccg

SEQ ID NO: 47458 - DNA, 20 bp, human
ggtggtctgggaacccacgt

SEQ ID NO: 47459 - DNA, 20 bp, human
gtgagggcgagagaaatccc

SEQ ID NO: 47460 - DNA, 20 bp, human
gtccgaaacccagcccacgt

SEQ ID NO: 47461 - DNA, 20 bp, human
ggttcccagaccaccaactc

SEQ ID NO: 47462 - DNA, 20 bp, human
ggccggcgctacaacatcaa

SEQ ID NO: 47463 - DNA, 20 bp, human
gccccatggcgactaggcca

SEQ ID NO: 47464 - DNA, 20 bp, human
gcatggcgactaggccaggg

SEQ ID NO: 47465 - DNA, 20 bp, human
gccccacccgagagtcctga

SEQ ID NO: 47466 - DNA, 20 bp, human
gctgatcagagccccagagg

SEQ ID NO: 47467 - DNA, 20 bp, human
gcgggctcggtgacagtctg

SEQ ID NO: 47468 - DNA, 20 bp, human
ggcggcctcgctgagatcca

SEQ ID NO: 47469 - DNA, 20 bp, human
gtgacactgtgagagagcag

SEQ ID NO: 47470 - DNA, 20 bp, human
gagctttgggcggatagagg

SEQ ID NO: 47471 - DNA, 20 bp, human
ggacacaaggagtcctactc

SEQ ID NO: 47472 - DNA, 20 bp, human
gtgggtgacagggacgacag

SEQ ID NO: 47473 - DNA, 20 bp, human
gcctcgctcagacaggctca

SEQ ID NO: 47474 - DNA, 20 bp, human
gactgtcaccgagcccgagt

SEQ ID NO: 47475 - DNA, 20 bp, human
gaagtattaagggacaataa

SEQ ID NO: 47476 - DNA, 20 bp, human
gacatagacctggccccgag

SEQ ID NO: 47477 - DNA, 20 bp, human
gtagacctggccccgagtgg

SEQ ID NO: 47478 - DNA, 20 bp, human
ggacgtgctcgcctccactc

SEQ ID NO: 47479 - DNA, 20 bp, human
gaggctggcggcccgacgaa

SEQ ID NO: 47480 - DNA, 20 bp, human
gtcccatctcctcagatcgg

SEQ ID NO: 47481 - DNA, 20 bp, human
gggaaaccgggacatagacc

SEQ ID NO: 47482 - DNA, 20 bp, human
gaggcgaaaaccttactggg

SEQ ID NO: 47483 - DNA, 20 bp, human
gctgggaccgcccccctcta

SEQ ID NO: 47484 - DNA, 20 bp, human
gtccaccgatctgaggagat

SEQ ID NO: 47485 - DNA, 20 bp, human
gagatgggaggggaaagacg

SEQ ID NO: 47486 - DNA, 20 bp, human
ggtcgggaggtgctgcccaa

SEQ ID NO: 47487 - DNA, 20 bp, human
gctccaagtgagaatcgtga

SEQ ID NO: 47488 - DNA, 20 bp, human
gcacagacggagtcagagaa

SEQ ID NO: 47489 - DNA, 20 bp, human
gtgagcgtggacaacctcag

SEQ ID NO: 47490 - DNA, 20 bp, human
gtgcggtggcccagctgcag

SEQ ID NO: 47491 - DNA, 20 bp, human
gcaagtgagaatcgtgaggg

SEQ ID NO: 47492 - DNA, 20 bp, human
gaagggtcagaggtccaaac

SEQ ID NO: 47493 - DNA, 20 bp, human
gagtcttggagcaggctaag

SEQ ID NO: 47494 - DNA, 20 bp, human
gggctaaggggttgattgaa

SEQ ID NO: 47495 - DNA, 20 bp, human
gaggccctgataccgaacca

SEQ ID NO: 47496 - DNA, 20 bp, human
gcaccacgtaggcctgccca

SEQ ID NO: 47497 - DNA, 20 bp, human
gctcgcctgcaccaccacgt

SEQ ID NO: 47498 - DNA, 20 bp, human
gcgccttgggcaggcctacg

SEQ ID NO: 47499 - DNA, 20 bp, human
gtagtaggtaggtctgccca

SEQ ID NO: 47500 - DNA, 20 bp, human
gggatgggagattcctaagt

SEQ ID NO: 47501 - DNA, 20 bp, human
gctgccgtgagtacaaactc

SEQ ID NO: 47502 - DNA, 20 bp, human
gaggactcacctgctctagt

SEQ ID NO: 47503 - DNA, 20 bp, human
ggagctgtggccctaccaat

SEQ ID NO: 47504 - DNA, 20 bp, human
ggcaccaggctgagttaagt

SEQ ID NO: 47505 - DNA, 20 bp, human
gtgctctgcccaaaaggggg

SEQ ID NO: 47506 - DNA, 20 bp, human
ggcgggagccttaatcgggt

SEQ ID NO: 47507 - DNA, 20 bp, human
gcgctcagagctactccggc

SEQ ID NO: 47508 - DNA, 20 bp, human
ggagctgtcagtgaagcccg

SEQ ID NO: 47509 - DNA, 20 bp, human
gtgagcgccggctgtgagga

SEQ ID NO: 47510 - DNA, 20 bp, human
ggctctgagcgccggctgtg

SEQ ID NO: 47511 - DNA, 20 bp, human
gtctgggcaagctatagcca

SEQ ID NO: 47512 - DNA, 20 bp, human
gccggcgctcagagctactc

SEQ ID NO: 47513 - DNA, 20 bp, human
gctgtcagtgaagcccgggg

SEQ ID NO: 47514 - DNA, 20 bp, human
gggaagtgaaagctggaacc

SEQ ID NO: 47515 - DNA, 20 bp, human
gccgattaaggctcccgcca

SEQ ID NO: 47516 - DNA, 20 bp, human
gaaacgcacagcaactcgca

SEQ ID NO: 47517 - DNA, 20 bp, human
gggcgaaatggctccgaccg

SEQ ID NO: 47518 - DNA, 20 bp, human
gtaggccagtggcgccccgg

SEQ ID NO: 47519 - DNA, 20 bp, human
gccgcggcggctgagggaag

SEQ ID NO: 47520 - DNA, 20 bp, human
ggtacgccggggcaccgcgg

SEQ ID NO: 47521 - DNA, 20 bp, human
gcatggaggaatcggcgaaa

SEQ ID NO: 47522 - DNA, 20 bp, human
gcgcacagcaactcgcatgg

SEQ ID NO: 47523 - DNA, 20 bp, human
gagaaggccagagtcacaca

SEQ ID NO: 47524 - DNA, 20 bp, human
gctctggcctgcgtacgccg

SEQ ID NO: 47525 - DNA, 20 bp, human
gtgcgtacgccggggcaccg

SEQ ID NO: 47526 - DNA, 20 bp, human
ggcgtccgcgcgctgcacaa

SEQ ID NO: 47527 - DNA, 20 bp, human
gtccctgaggagacgtggag

SEQ ID NO: 47528 - DNA, 20 bp, human
gtctgaagacgtcctcccga

SEQ ID NO: 47529 - DNA, 20 bp, human
gcccctctacgcggccgcag

SEQ ID NO: 47530 - DNA, 20 bp, human
gctgaggagacgtggagagg

SEQ ID NO: 47531 - DNA, 20 bp, human
gaggagggacacggcatggg

SEQ ID NO: 47532 - DNA, 20 bp, human
gtctcctcagggacttcgag

SEQ ID NO: 47533 - DNA, 20 bp, human
gcacggcatggggggagtcc

SEQ ID NO: 47534 - DNA, 20 bp, human
gcgaagtccctgaggagacg

SEQ ID NO: 47535 - DNA, 20 bp, human
ggacttcgagtggctgacga

SEQ ID NO: 47536 - DNA, 20 bp, human
gtcgccggccagcgtgaacc

SEQ ID NO: 47537 - DNA, 20 bp, human
gtggctaaagagcgactggg

SEQ ID NO: 47538 - DNA, 20 bp, human
gggctggctaaagagcgact

SEQ ID NO: 47539 - DNA, 20 bp, human
gtgtaagggctggggaacga

SEQ ID NO: 47540 - DNA, 20 bp, human
ggccgggcggctccatgtcc

SEQ ID NO: 47541 - DNA, 20 bp, human
gggccaggcaggagcgggat

SEQ ID NO: 47542 - DNA, 20 bp, human
gcggggatatgcgggcggga

SEQ ID NO: 47543 - DNA, 20 bp, human
ggagccggccggggatatgc

SEQ ID NO: 47544 - DNA, 20 bp, human
gaggctgagaggggagagac

SEQ ID NO: 47545 - DNA, 20 bp, human
gccggctgcaggggtccaga

SEQ ID NO: 47546 - DNA, 20 bp, human
gttgccccagcgccgagtag

SEQ ID NO: 47547 - DNA, 20 bp, human
gctcctgccattgaacacgg

SEQ ID NO: 47548 - DNA, 20 bp, human
gcaatggcaggaggatcccg

SEQ ID NO: 47549 - DNA, 20 bp, human
gcgggtgcccccgtgttcaa

SEQ ID NO: 47550 - DNA, 20 bp, human
gctgtccctaaggccggcgg

SEQ ID NO: 47551 - DNA, 20 bp, human
gttgccactactcggcgctg

SEQ ID NO: 47552 - DNA, 20 bp, human
gccacgccgttgccactact

SEQ ID NO: 47553 - DNA, 20 bp, human
gtgacagggccggagaaaga

SEQ ID NO: 47554 - DNA, 20 bp, human
gctgccccgcgctgactcgg

SEQ ID NO: 47555 - DNA, 20 bp, human
ggcggcagcgaggaacccgg

SEQ ID NO: 47556 - DNA, 20 bp, human
ggtgggcccacaagaacttg

SEQ ID NO: 47557 - DNA, 20 bp, human
ggatggaacggcaccagccg

SEQ ID NO: 47558 - DNA, 20 bp, human
ggctgcggccccgacttcag

SEQ ID NO: 47559 - DNA, 20 bp, human
gccctcggcagtcagcccta

SEQ ID NO: 47560 - DNA, 20 bp, human
ggagaggctgaggaagggta

SEQ ID NO: 47561 - DNA, 20 bp, human
ggttcttgtgggcccaccct

SEQ ID NO: 47562 - DNA, 20 bp, human
gggccccgacttcagcggtt

SEQ ID NO: 47563 - DNA, 20 bp, human
gtgagtatcgcctggagcta

SEQ ID NO: 47564 - DNA, 20 bp, human
ggccagtcccgggccaacac

SEQ ID NO: 47565 - DNA, 20 bp, human
gagtcccgggccaacacggg

SEQ ID NO: 47566 - DNA, 20 bp, human
gatggagtaacctgacagcg

SEQ ID NO: 47567 - DNA, 20 bp, human
gcaactgcggcccaacgcca

SEQ ID NO: 47568 - DNA, 20 bp, human
gcggcccggaaagtctccca

SEQ ID NO: 47569 - DNA, 20 bp, human
gtaacctgacagcggggacg

SEQ ID NO: 47570 - DNA, 20 bp, human
gggcgagcgcgaggaaatgg

SEQ ID NO: 47571 - DNA, 20 bp, human
gggcatcccccaccacgcca

SEQ ID NO: 47572 - DNA, 20 bp, human
gccaggagcagagccgaggc

SEQ ID NO: 47573 - DNA, 20 bp, human
gcgcgctgtgcgggacgacg

SEQ ID NO: 47574 - DNA, 20 bp, human
gcctggcgggcgctgacgaa

SEQ ID NO: 47575 - DNA, 20 bp, human
gctccccgcgaggcagccct

SEQ ID NO: 47576 - DNA, 20 bp, human
gaatggctgcgagaccctag

SEQ ID NO: 47577 - DNA, 20 bp, human
ggggcggacggccaccgaga

SEQ ID NO: 47578 - DNA, 20 bp, human
gcgcaggccgcaggcctcta

SEQ ID NO: 47579 - DNA, 20 bp, human
gtagccccgcgccatctcgg

SEQ ID NO: 47580 - DNA, 20 bp, human
ggctcccgccgagaagatgg

SEQ ID NO: 47581 - DNA, 20 bp, human
gccgaacgccgcggagtggg

SEQ ID NO: 47582 - DNA, 20 bp, human
gtccccgaacgccgcggagt

SEQ ID NO: 47583 - DNA, 20 bp, human
gctgcggtaagtggcgtccc

SEQ ID NO: 47584 - DNA, 20 bp, human
gaggtccccgagaatgccta

SEQ ID NO: 47585 - DNA, 20 bp, human
ggcgagaccctagaggcctg

SEQ ID NO: 47586 - DNA, 20 bp, human
ggagacggctgacccgagac

SEQ ID NO: 47587 - DNA, 20 bp, human
ggcgaccacgcactacgggt

SEQ ID NO: 47588 - DNA, 20 bp, human
gccctcagggcgcctcccat

SEQ ID NO: 47589 - DNA, 20 bp, human
gcttcggcgtagcccatggg

SEQ ID NO: 47590 - DNA, 20 bp, human
ggccaggtggggaatcagaa

SEQ ID NO: 47591 - DNA, 20 bp, human
ggcagcagccatcttgccag

SEQ ID NO: 47592 - DNA, 20 bp, human
ggcccttcggcgtagcccat

SEQ ID NO: 47593 - DNA, 20 bp, human
gggttggcgccagagtcaaa

SEQ ID NO: 47594 - DNA, 20 bp, human
ggccagggcgcgcgggacaa

SEQ ID NO: 47595 - DNA, 20 bp, human
gcctcactcgaggccaggtg

SEQ ID NO: 47596 - DNA, 20 bp, human
gggatacatctctggcgact

SEQ ID NO: 47597 - DNA, 20 bp, human
gtgcccacttgcaagagtcg

SEQ ID NO: 47598 - DNA, 20 bp, human
ggcactatctgggagaccag

SEQ ID NO: 47599 - DNA, 20 bp, human
gaggcacgcccgttgtgtgg

SEQ ID NO: 47600 - DNA, 20 bp, human
ggaccagaggaccaaactcg

SEQ ID NO: 47601 - DNA, 20 bp, human
ggcgggagccagggaatagt

SEQ ID NO: 47602 - DNA, 20 bp, human
gaaccgcgactcttgcaagt

SEQ ID NO: 47603 - DNA, 20 bp, human
gccagtcaacacaagcacgt

SEQ ID NO: 47604 - DNA, 20 bp, human
gaggccggagcagcactatc

SEQ ID NO: 47605 - DNA, 20 bp, human
gaagaggcacgcccgttgtg

SEQ ID NO: 47606 - DNA, 20 bp, human
ggaggaagctggggtcggtc

SEQ ID NO: 47607 - DNA, 20 bp, human
ggtgagaaagccaccacgtg

SEQ ID NO: 47608 - DNA, 20 bp, human
gggcggcgatccccacgtgg

SEQ ID NO: 47609 - DNA, 20 bp, human
gtccggcgcttgggccagag

SEQ ID NO: 47610 - DNA, 20 bp, human
gtgggccagagtggtgcggg

SEQ ID NO: 47611 - DNA, 20 bp, human
gacgtcaaggaggaccaaag

SEQ ID NO: 47612 - DNA, 20 bp, human
gggaggagctcagagcgtac

SEQ ID NO: 47613 - DNA, 20 bp, human
gccgtgagcgcggaaggcag

SEQ ID NO: 47614 - DNA, 20 bp, human
gcaggcccgggacgtcaagg

SEQ ID NO: 47615 - DNA, 20 bp, human
gcgtggcggcgatccccacg

SEQ ID NO: 47616 - DNA, 20 bp, human
gaggctctgggtgctcttgg

SEQ ID NO: 47617 - DNA, 20 bp, human
gaggctgccacacacttgag

SEQ ID NO: 47618 - DNA, 20 bp, human
gtagaactcagagcttactc

SEQ ID NO: 47619 - DNA, 20 bp, human
gtggccatgggcgagaagac

SEQ ID NO: 47620 - DNA, 20 bp, human
gactgggtgctgaaaaaggt

SEQ ID NO: 47621 - DNA, 20 bp, human
gagtttcaggaagcaggaag

SEQ ID NO: 47622 - DNA, 20 bp, human
gaaggagcagcaaaagtagt

SEQ ID NO: 47623 - DNA, 20 bp, human
ggttcgtcttgaaggtccgt

SEQ ID NO: 47624 - DNA, 20 bp, human
gtggctgtgcatgtggtcgt

SEQ ID NO: 47625 - DNA, 20 bp, human
gcgagaagacgggtatgacc

SEQ ID NO: 47626 - DNA, 20 bp, human
gctcaggaggcagagaagat

SEQ ID NO: 47627 - DNA, 20 bp, human
gacaagggaactgactcagg

SEQ ID NO: 47628 - DNA, 20 bp, human
ggggaggctgaggtacactg

SEQ ID NO: 47629 - DNA, 20 bp, human
gaggcgtcagggagactcac

SEQ ID NO: 47630 - DNA, 20 bp, human
gccaagcacctatgagactg

SEQ ID NO: 47631 - DNA, 20 bp, human
gggggaaccagagcgcacaa

SEQ ID NO: 47632 - DNA, 20 bp, human
gtgggcacactccaactgct

SEQ ID NO: 47633 - DNA, 20 bp, human
gcgcacaagggaactgactc

SEQ ID NO: 47634 - DNA, 20 bp, human
gctttaacggactctgacag

SEQ ID NO: 47635 - DNA, 20 bp, human
gcggcgcatgctgacctcag

SEQ ID NO: 47636 - DNA, 20 bp, human
gagcagggagcggagcatgg

SEQ ID NO: 47637 - DNA, 20 bp, human
gtcgcggttggtggtcggag

SEQ ID NO: 47638 - DNA, 20 bp, human
gggtccggcgcccaactccg

SEQ ID NO: 47639 - DNA, 20 bp, human
gagatgggcgggtcatcggg

SEQ ID NO: 47640 - DNA, 20 bp, human
ggctggctctggaagccgtc

SEQ ID NO: 47641 - DNA, 20 bp, human
gtcatgcgcgccatgaacgg

SEQ ID NO: 47642 - DNA, 20 bp, human
gccgtcgggcagaaccacct

SEQ ID NO: 47643 - DNA, 20 bp, human
ggcctcgccaggccacgtcg

SEQ ID NO: 47644 - DNA, 20 bp, human
ggtctgggcgcagagcctca

SEQ ID NO: 47645 - DNA, 20 bp, human
gaagagcacgaggcacgagg

SEQ ID NO: 47646 - DNA, 20 bp, human
gtgaggggcagaggtcccag

SEQ ID NO: 47647 - DNA, 20 bp, human
ggccaggccggctagcgtcc

SEQ ID NO: 47648 - DNA, 20 bp, human
ggcgcacgcgctcccgtgta

SEQ ID NO: 47649 - DNA, 20 bp, human
ggcggcggcagcgcaaacct

SEQ ID NO: 47650 - DNA, 20 bp, human
gcgcccggccggccctacac

SEQ ID NO: 47651 - DNA, 20 bp, human
gccggctagcgtccgggcag

SEQ ID NO: 47652 - DNA, 20 bp, human
ggcagaggctggaaccggac

SEQ ID NO: 47653 - DNA, 20 bp, human
gctagcgtccgggcagaggc

SEQ ID NO: 47654 - DNA, 20 bp, human
gcatgaggggcggggtccta

SEQ ID NO: 47655 - DNA, 20 bp, human
gagcgcgtgcgcggcgggaa

SEQ ID NO: 47656 - DNA, 20 bp, human
gcacacccggctacaggatc

SEQ ID NO: 47657 - DNA, 20 bp, human
gcatggaggggactaagtaa

SEQ ID NO: 47658 - DNA, 20 bp, human
gctccggaagacaagagagg

SEQ ID NO: 47659 - DNA, 20 bp, human
gcacaggaaaccacttaatg

SEQ ID NO: 47660 - DNA, 20 bp, human
ggacgagggtgtagagaacc

SEQ ID NO: 47661 - DNA, 20 bp, human
gccacctgggccagacgcct

SEQ ID NO: 47662 - DNA, 20 bp, human
ggctgcgcccgcacttcagg

SEQ ID NO: 47663 - DNA, 20 bp, human
gaaggagggacggacagaca

SEQ ID NO: 47664 - DNA, 20 bp, human
gacgcctgggcagaagcggg

SEQ ID NO: 47665 - DNA, 20 bp, human
gagaggagggaaaacggtcg

SEQ ID NO: 47666 - DNA, 20 bp, human
gtcgcaggcggaggtctcgg

SEQ ID NO: 47667 - DNA, 20 bp, human
gcggcggaaccgcaccgagg

SEQ ID NO: 47668 - DNA, 20 bp, human
ggcccggcggaaccgcaccg

SEQ ID NO: 47669 - DNA, 20 bp, human
gtgttcgcaggcggaggtct

SEQ ID NO: 47670 - DNA, 20 bp, human
gcctccgcctgcgaacaaag

SEQ ID NO: 47671 - DNA, 20 bp, human
gggcctcacaaacgtcccta

SEQ ID NO: 47672 - DNA, 20 bp, human
gggatcccctcgcgctctgg

SEQ ID NO: 47673 - DNA, 20 bp, human
gcggcgcccgcggagcatgg

SEQ ID NO: 47674 - DNA, 20 bp, human
gtggcggaccgcagcctgga

SEQ ID NO: 47675 - DNA, 20 bp, human
gacaaagaggaggccgtgcg

SEQ ID NO: 47676 - DNA, 20 bp, human
ggcgccagcggacaccggag

SEQ ID NO: 47677 - DNA, 20 bp, human
gctcaggaggacctcagtgg

SEQ ID NO: 47678 - DNA, 20 bp, human
gtgaggtcctcctgagtcaa

SEQ ID NO: 47679 - DNA, 20 bp, human
gggaccaatgcggagagggg

SEQ ID NO: 47680 - DNA, 20 bp, human
gcgcagggaccagcgggccc

SEQ ID NO: 47681 - DNA, 20 bp, human
ggggcgacccttgactcagg

SEQ ID NO: 47682 - DNA, 20 bp, human
gcaggggcgacccttgactc

SEQ ID NO: 47683 - DNA, 20 bp, human
gaggggaccaatgcggagag

SEQ ID NO: 47684 - DNA, 20 bp, human
gccgccccgggccgcctacc

SEQ ID NO: 47685 - DNA, 20 bp, human
gtgcccgctccggtgtccgc

SEQ ID NO: 47686 - DNA, 20 bp, human
ggctccactcgcgcaggaca

SEQ ID NO: 47687 - DNA, 20 bp, human
ggcgaagccacggcagaagg

SEQ ID NO: 47688 - DNA, 20 bp, human
gtgcggacgcagcgaagcca

SEQ ID NO: 47689 - DNA, 20 bp, human
gcagggcagcgcagggtgtg

SEQ ID NO: 47690 - DNA, 20 bp, human
ggcatgaagtgaaggagtcg

SEQ ID NO: 47691 - DNA, 20 bp, human
ggggggaaatcggttacctg

SEQ ID NO: 47692 - DNA, 20 bp, human
ggaaagcatgccgaaccaaa

SEQ ID NO: 47693 - DNA, 20 bp, human
gggattaccgctctcaggga

SEQ ID NO: 47694 - DNA, 20 bp, human
gcggagttgtgttcttcccc

SEQ ID NO: 47695 - DNA, 20 bp, human
ggtactggagttggtaagag

SEQ ID NO: 47696 - DNA, 20 bp, human
gctgctcggagagactgccg

SEQ ID NO: 47697 - DNA, 20 bp, human
gggtgtccagttggttgccg

SEQ ID NO: 47698 - DNA, 20 bp, human
gtggttcgtgcctccgagaa

SEQ ID NO: 47699 - DNA, 20 bp, human
gcgcggaggagtgagctctt

SEQ ID NO: 47700 - DNA, 20 bp, human
ggctggtgccgcaacagcag

SEQ ID NO: 47701 - DNA, 20 bp, human
gagtgttcaggaagtaatag

SEQ ID NO: 47702 - DNA, 20 bp, human
gaaagacttacctttctcgg

SEQ ID NO: 47703 - DNA, 20 bp, human
gagattgaaatgggcgagga

SEQ ID NO: 47704 - DNA, 20 bp, human
gacctacgcagctgtaatag

SEQ ID NO: 47705 - DNA, 20 bp, human
ggactgccgcggcaaccaac

SEQ ID NO: 47706 - DNA, 20 bp, human
ggtggaaagtaagactttaa

SEQ ID NO: 47707 - DNA, 20 bp, human
gtagttgtgtctcttgacat

SEQ ID NO: 47708 - DNA, 20 bp, human
gtgagctctgtcaaaatggt

SEQ ID NO: 47709 - DNA, 20 bp, human
gtagcttaacaactgatgca

SEQ ID NO: 47710 - DNA, 20 bp, human
ggctgtatacttaaaactaa

SEQ ID NO: 47711 - DNA, 20 bp, human
gatggctggagtagaaattc

SEQ ID NO: 47712 - DNA, 20 bp, human
gtcaccagaaggaaaaattc

SEQ ID NO: 47713 - DNA, 20 bp, human
gatgcagggtctatctttta

SEQ ID NO: 47714 - DNA, 20 bp, human
gttaatagagtagactgtcc

SEQ ID NO: 47715 - DNA, 20 bp, human
gtagtgatacatttgtagtg

SEQ ID NO: 47716 - DNA, 20 bp, human
gggctgtattcgaggaggtt

SEQ ID NO: 47717 - DNA, 20 bp, human
gaggcgcaccaggcgcggtc

SEQ ID NO: 47718 - DNA, 20 bp, human
gaatagtcctgagcagcagg

SEQ ID NO: 47719 - DNA, 20 bp, human
ggcgggtggcgaggaaacac

SEQ ID NO: 47720 - DNA, 20 bp, human
gtctgcgctgggctagtcgg

SEQ ID NO: 47721 - DNA, 20 bp, human
ggaccagcgcggctgagtcg

SEQ ID NO: 47722 - DNA, 20 bp, human
ggagccaggtcccagacgga

SEQ ID NO: 47723 - DNA, 20 bp, human
gcctatgccggggccaaggg

SEQ ID NO: 47724 - DNA, 20 bp, human
gagcagggcaggaagccgat

SEQ ID NO: 47725 - DNA, 20 bp, human
gcgagcccgggccccagcag

SEQ ID NO: 47726 - DNA, 20 bp, human
gcatcggctgcggtgcgccc

SEQ ID NO: 47727 - DNA, 20 bp, human
gagaatacgcctaaccccgg

SEQ ID NO: 47728 - DNA, 20 bp, human
gtggaaagggaagaacctcc

SEQ ID NO: 47729 - DNA, 20 bp, human
gggaagcttcggtcccgagg

SEQ ID NO: 47730 - DNA, 20 bp, human
ggcgaaagggaaaccccctc

SEQ ID NO: 47731 - DNA, 20 bp, human
gtgctggaagagcgctgctg

SEQ ID NO: 47732 - DNA, 20 bp, human
gtctagaatacgcctaaccc

SEQ ID NO: 47733 - DNA, 20 bp, human
gtgtcgggcagcaagtagtg

SEQ ID NO: 47734 - DNA, 20 bp, human
gcgctgctcgccgggtcctg

SEQ ID NO: 47735 - DNA, 20 bp, human
gcggccccacggggacaagg

SEQ ID NO: 47736 - DNA, 20 bp, human
gctgcgggcagagcgggctg

SEQ ID NO: 47737 - DNA, 20 bp, human
gggagcagtaagggagtccc

SEQ ID NO: 47738 - DNA, 20 bp, human
ggccctcccattggacaggg

SEQ ID NO: 47739 - DNA, 20 bp, human
gatggcggcgtgtctcccgg

SEQ ID NO: 47740 - DNA, 20 bp, human
gctcgcgccgtggagaaatg

SEQ ID NO: 47741 - DNA, 20 bp, human
gggacagggcggagcagtaa

SEQ ID NO: 47742 - DNA, 20 bp, human
gctccgccctgtccaatggg

SEQ ID NO: 47743 - DNA, 20 bp, human
gagcgggcggccgcagtgag

SEQ ID NO: 47744 - DNA, 20 bp, human
gcatggggtgcgggtctgtc

SEQ ID NO: 47745 - DNA, 20 bp, human
ggtggtttggctcctcagag

SEQ ID NO: 47746 - DNA, 20 bp, human
gcgacaagggcgaaatggcc

SEQ ID NO: 47747 - DNA, 20 bp, human
gtgcagcactaggcggtgca

SEQ ID NO: 47748 - DNA, 20 bp, human
gcctcaccgtttctccccgg

SEQ ID NO: 47749 - DNA, 20 bp, human
ggagcctcgggaatcttgaa

SEQ ID NO: 47750 - DNA, 20 bp, human
gccgaggctcgggtcacctg

SEQ ID NO: 47751 - DNA, 20 bp, human
gaggccgggtcggtcaggag

SEQ ID NO: 47752 - DNA, 20 bp, human
ggcgccgcggagccccccag

SEQ ID NO: 47753 - DNA, 20 bp, human
gggcggttcagctgcgacaa

SEQ ID NO: 47754 - DNA, 20 bp, human
gtgatcgagatgttcaggac

SEQ ID NO: 47755 - DNA, 20 bp, human
gggggtcgtgcagcactagg

SEQ ID NO: 47756 - DNA, 20 bp, human
ggtgtccaggtgaccgggaa

SEQ ID NO: 47757 - DNA, 20 bp, human
gtcacctggacacgcagcgg

SEQ ID NO: 47758 - DNA, 20 bp, human
ggcgcaggtgtcccaggacg

SEQ ID NO: 47759 - DNA, 20 bp, human
gcggtcacctggacacgcag

SEQ ID NO: 47760 - DNA, 20 bp, human
gcaggaagtcgcgtaggtca

SEQ ID NO: 47761 - DNA, 20 bp, human
gagctcctcccgctccgcct

SEQ ID NO: 47762 - DNA, 20 bp, human
ggcgcgctggacgggaagtg

SEQ ID NO: 47763 - DNA, 20 bp, human
gcgaaaggggttgttaacag

SEQ ID NO: 47764 - DNA, 20 bp, human
ggactcgctgaggagaagaa

SEQ ID NO: 47765 - DNA, 20 bp, human
gaggacgtgctaggactctg

SEQ ID NO: 47766 - DNA, 20 bp, human
gacagcagaaagcaatgagt

SEQ ID NO: 47767 - DNA, 20 bp, human
gagtctagcgcagtaaggta

SEQ ID NO: 47768 - DNA, 20 bp, human
gcagaaagcaatgagttggc

SEQ ID NO: 47769 - DNA, 20 bp, human
gaacagcggcaactgactgc

SEQ ID NO: 47770 - DNA, 20 bp, human
ggaacttctctggctcagtt

SEQ ID NO: 47771 - DNA, 20 bp, human
ggaaggaaacctaagcttta

SEQ ID NO: 47772 - DNA, 20 bp, human
gatatgtgcttgccattacc

SEQ ID NO: 47773 - DNA, 20 bp, human
gtttttctatcacctggtaa

SEQ ID NO: 47774 - DNA, 20 bp, human
gattgtagtctagcgcagta

SEQ ID NO: 47775 - DNA, 20 bp, human
gacaaacttccttaaagctt

SEQ ID NO: 47776 - DNA, 20 bp, human
gagcaccagcgcccggacag

SEQ ID NO: 47777 - DNA, 20 bp, human
gtgtcaccgtccatgcccgt

SEQ ID NO: 47778 - DNA, 20 bp, human
gtaagcggggagggcgatgg

SEQ ID NO: 47779 - DNA, 20 bp, human
ggcggctccccggacaggta

SEQ ID NO: 47780 - DNA, 20 bp, human
ggaggaggggtaggagccgt

SEQ ID NO: 47781 - DNA, 20 bp, human
gcgtgggcggcaccgctgtc

SEQ ID NO: 47782 - DNA, 20 bp, human
gtcccggcccgggtccggaa

SEQ ID NO: 47783 - DNA, 20 bp, human
gagcccttggccccagacgg

SEQ ID NO: 47784 - DNA, 20 bp, human
gcgcaggggcagggcctaga

SEQ ID NO: 47785 - DNA, 20 bp, human
gggcgctggtgctgaagccg

SEQ ID NO: 47786 - DNA, 20 bp, human
gctgcaggagggcttcaatg

SEQ ID NO: 47787 - DNA, 20 bp, human
gactgggcgggagacgctgg

SEQ ID NO: 47788 - DNA, 20 bp, human
gggtccccaaaggatggagg

SEQ ID NO: 47789 - DNA, 20 bp, human
gtggcatgcgggactccgga

SEQ ID NO: 47790 - DNA, 20 bp, human
ggggcgcgcactaggttgag

SEQ ID NO: 47791 - DNA, 20 bp, human
gaggaccccttccggagact

SEQ ID NO: 47792 - DNA, 20 bp, human
gaccccttccggagactggg

SEQ ID NO: 47793 - DNA, 20 bp, human
ggaaagccgcacggccaggc

SEQ ID NO: 47794 - DNA, 20 bp, human
gcttggagagagaagctcta

SEQ ID NO: 47795 - DNA, 20 bp, human
ggcgtctcccgcccagtctc

SEQ ID NO: 47796 - DNA, 20 bp, human
gcctgacgggaccaaggcgg

SEQ ID NO: 47797 - DNA, 20 bp, human
gcccgcggcaaggcacgcac

SEQ ID NO: 47798 - DNA, 20 bp, human
gcggcctgacgggaccaagg

SEQ ID NO: 47799 - DNA, 20 bp, human
gcacagggcagtgcgcgggt

SEQ ID NO: 47800 - DNA, 20 bp, human
ggcgcggcctgacgggacca

SEQ ID NO: 47801 - DNA, 20 bp, human
gccaaggcggcgggagtctg

SEQ ID NO: 47802 - DNA, 20 bp, human
ggccggcgggaaccagaggg

SEQ ID NO: 47803 - DNA, 20 bp, human
gccctcggctgtggaccggg

SEQ ID NO: 47804 - DNA, 20 bp, human
gcatgcgactaggggagcaa

SEQ ID NO: 47805 - DNA, 20 bp, human
gcctagcagcgcggcctgac

SEQ ID NO: 47806 - DNA, 20 bp, human
gagaggggtcgggcactcag

SEQ ID NO: 47807 - DNA, 20 bp, human
gcggttcggctgcagagtca

SEQ ID NO: 47808 - DNA, 20 bp, human
ggctcactcccagcagaggg

SEQ ID NO: 47809 - DNA, 20 bp, human
gggatgctctgaccttgaaa

SEQ ID NO: 47810 - DNA, 20 bp, human
ggacaactaccaggtgagag

SEQ ID NO: 47811 - DNA, 20 bp, human
gaccatcgcgacaaagaccc

SEQ ID NO: 47812 - DNA, 20 bp, human
gcgtcctctgcgcacgggta

SEQ ID NO: 47813 - DNA, 20 bp, human
gactaccaggtgagaggggt

SEQ ID NO: 47814 - DNA, 20 bp, human
gaggactctgggaccgcagg

SEQ ID NO: 47815 - DNA, 20 bp, human
gtccctgcagtcaggactct

SEQ ID NO: 47816 - DNA, 20 bp, human
gcgcagcgatgcctagggag

SEQ ID NO: 47817 - DNA, 20 bp, human
ggccaaggaggcgtgaccca

SEQ ID NO: 47818 - DNA, 20 bp, human
ggccagcgcagcgatgccta

SEQ ID NO: 47819 - DNA, 20 bp, human
gggaagcggtgcgatccaca

SEQ ID NO: 47820 - DNA, 20 bp, human
ggcctcaggacagaaattag

SEQ ID NO: 47821 - DNA, 20 bp, human
gtagcgcaagtccgctccct

SEQ ID NO: 47822 - DNA, 20 bp, human
gcatcaacgcggccatctcc

SEQ ID NO: 47823 - DNA, 20 bp, human
gaggcgctttctcgccaagg

SEQ ID NO: 47824 - DNA, 20 bp, human
gacgcaaagcccggaggggt

SEQ ID NO: 47825 - DNA, 20 bp, human
ggagggaggaccccaacacg

SEQ ID NO: 47826 - DNA, 20 bp, human
ggcgcagagcggagatgcag

SEQ ID NO: 47827 - DNA, 20 bp, human
gcggcagcgccggtacccga

SEQ ID NO: 47828 - DNA, 20 bp, human
gcagatgcggagtgacctgg

SEQ ID NO: 47829 - DNA, 20 bp, human
gccagtgcagagcctctcgg

SEQ ID NO: 47830 - DNA, 20 bp, human
gttggcaaggaggcaaaacg

SEQ ID NO: 47831 - DNA, 20 bp, human
gatcgcgttccgggacacac

SEQ ID NO: 47832 - DNA, 20 bp, human
ggcgttccgggacacacagg

SEQ ID NO: 47833 - DNA, 20 bp, human
gctgagaagcgccagactgg

SEQ ID NO: 47834 - DNA, 20 bp, human
gttccgggacacacaggcgg

SEQ ID NO: 47835 - DNA, 20 bp, human
ggccccacatccaccaagag

SEQ ID NO: 47836 - DNA, 20 bp, human
gacgcaccttactcagacta

SEQ ID NO: 47837 - DNA, 20 bp, human
ggtaaaccttagtctgagta

SEQ ID NO: 47838 - DNA, 20 bp, human
gtgagtaaggtgcgtgaaat

SEQ ID NO: 47839 - DNA, 20 bp, human
ggtaaggctgctagggaggg

SEQ ID NO: 47840 - DNA, 20 bp, human
gtaaggccactgatcctacc

SEQ ID NO: 47841 - DNA, 20 bp, human
gcggatttgggagggcatcc

SEQ ID NO: 47842 - DNA, 20 bp, human
ggtccaggaccagagctccc

SEQ ID NO: 47843 - DNA, 20 bp, human
ggtggagagcagcctcgctt

SEQ ID NO: 47844 - DNA, 20 bp, human
gattggtttcggatttggga

SEQ ID NO: 47845 - DNA, 20 bp, human
ggagctctgctgacctgcat

SEQ ID NO: 47846 - DNA, 20 bp, human
gaacgctctagaccagacct

SEQ ID NO: 47847 - DNA, 20 bp, human
ggagcgtggtcagacaatag

SEQ ID NO: 47848 - DNA, 20 bp, human
gatggtctcgagcccaggtc

SEQ ID NO: 47849 - DNA, 20 bp, human
gacgtgggcggccggaatcc

SEQ ID NO: 47850 - DNA, 20 bp, human
gtttggctttaacagtacgt

SEQ ID NO: 47851 - DNA, 20 bp, human
ggctcgagaccataactgtt

SEQ ID NO: 47852 - DNA, 20 bp, human
gtccgggagtccggtgaccc

SEQ ID NO: 47853 - DNA, 20 bp, human
ggagatctggtggtgaacgt

SEQ ID NO: 47854 - DNA, 20 bp, human
gagaccacagcccgggtcac

SEQ ID NO: 47855 - DNA, 20 bp, human
ggaccgagactctgtagtcc

SEQ ID NO: 47856 - DNA, 20 bp, human
ggtgacctctccaagagcag

SEQ ID NO: 47857 - DNA, 20 bp, human
gggatcagtgaggcctctca

SEQ ID NO: 47858 - DNA, 20 bp, human
ggctcttggagaggtcactc

SEQ ID NO: 47859 - DNA, 20 bp, human
gtcccgagaaggggggtcta

SEQ ID NO: 47860 - DNA, 20 bp, human
ggggggttggtggcactatg

SEQ ID NO: 47861 - DNA, 20 bp, human
gagcagatactgggaatggg

SEQ ID NO: 47862 - DNA, 20 bp, human
gtcagctctgaaggacaacg

SEQ ID NO: 47863 - DNA, 20 bp, human
ggatcatgagagggacacta

SEQ ID NO: 47864 - DNA, 20 bp, human
ggtcactccggagacggcgt

SEQ ID NO: 47865 - DNA, 20 bp, human
gacagcgtgactacagggta

SEQ ID NO: 47866 - DNA, 20 bp, human
ggcgccctcgctcgggcagt

SEQ ID NO: 47867 - DNA, 20 bp, human
gcggcgctcctgatgcggag

SEQ ID NO: 47868 - DNA, 20 bp, human
ggagcgaagcgccctcgctc

SEQ ID NO: 47869 - DNA, 20 bp, human
ggagaggtgcggccatgtcc

SEQ ID NO: 47870 - DNA, 20 bp, human
ggctccgactgcccgagcga

SEQ ID NO: 47871 - DNA, 20 bp, human
gggtgcggccatgtcctggc

SEQ ID NO: 47872 - DNA, 20 bp, human
ggcaccgacttgacaaggcg

SEQ ID NO: 47873 - DNA, 20 bp, human
ggcggggtgacactttctcg

SEQ ID NO: 47874 - DNA, 20 bp, human
gcatcaagcacggcaggcgg

SEQ ID NO: 47875 - DNA, 20 bp, human
ggggcgagaagtccgtgagc

SEQ ID NO: 47876 - DNA, 20 bp, human
gggagaccttggcggagcgg

SEQ ID NO: 47877 - DNA, 20 bp, human
gccagcggaggtgaaagtat

SEQ ID NO: 47878 - DNA, 20 bp, human
ggccagactatacgggacat

SEQ ID NO: 47879 - DNA, 20 bp, human
ggcggaggtgaaagtattgg

SEQ ID NO: 47880 - DNA, 20 bp, human
ggcgcagggaggggagacct

SEQ ID NO: 47881 - DNA, 20 bp, human
gggccatcccggtcacacat

SEQ ID NO: 47882 - DNA, 20 bp, human
gagactatacgggacatggg

SEQ ID NO: 47883 - DNA, 20 bp, human
gtgctcccgggtgatgacgt

SEQ ID NO: 47884 - DNA, 20 bp, human
gaggggagaccttggcggag

SEQ ID NO: 47885 - DNA, 20 bp, human
ggtggcttacacttcctcca

SEQ ID NO: 47886 - DNA, 20 bp, human
ggctgcagcaggtaacgtgg

SEQ ID NO: 47887 - DNA, 20 bp, human
ggaccaggagctccaaaacg

SEQ ID NO: 47888 - DNA, 20 bp, human
gccagctgcagcaggtaacg

SEQ ID NO: 47889 - DNA, 20 bp, human
gacccggctggtggcgaagt

SEQ ID NO: 47890 - DNA, 20 bp, human
gcgagtgccaggggacaatg

SEQ ID NO: 47891 - DNA, 20 bp, human
gcaggagctccaaaacgcgg

SEQ ID NO: 47892 - DNA, 20 bp, human
gttgggtgcgcagcgaggag

SEQ ID NO: 47893 - DNA, 20 bp, human
gccggaccaacgagtgccag

SEQ ID NO: 47894 - DNA, 20 bp, human
gtaggcgagggaggaataca

SEQ ID NO: 47895 - DNA, 20 bp, human
gaagtgccgcagggagttag

SEQ ID NO: 47896 - DNA, 20 bp, human
gactggggctgaatcacagt

SEQ ID NO: 47897 - DNA, 20 bp, human
ggcgcgggcgaactccccag

SEQ ID NO: 47898 - DNA, 20 bp, human
gccgcggcgggcctgagcga

SEQ ID NO: 47899 - DNA, 20 bp, human
gctcccatcctccaagggtg

SEQ ID NO: 47900 - DNA, 20 bp, human
gggtaacctcccatcctcca

SEQ ID NO: 47901 - DNA, 20 bp, human
gcgtggggaccaggagtcgg

SEQ ID NO: 47902 - DNA, 20 bp, human
ggggggcgggggacactctg

SEQ ID NO: 47903 - DNA, 20 bp, human
ggcgggcctgagcgacgggc

SEQ ID NO: 47904 - DNA, 20 bp, human
gcgcgtggtggactcgactt

SEQ ID NO: 47905 - DNA, 20 bp, human
gggctggagcggtggacacg

SEQ ID NO: 47906 - DNA, 20 bp, human
gtctgccgcggagttggaaa

SEQ ID NO: 47907 - DNA, 20 bp, human
ggacagcgcctggcgacccc

SEQ ID NO: 47908 - DNA, 20 bp, human
ggtgggctagggcaaggtaa

SEQ ID NO: 47909 - DNA, 20 bp, human
gtacccggggagcatcctaa

SEQ ID NO: 47910 - DNA, 20 bp, human
gagtgccgtttccaactccg

SEQ ID NO: 47911 - DNA, 20 bp, human
gcgcgctgctaccttcgggt

SEQ ID NO: 47912 - DNA, 20 bp, human
ggctagggcaaggtaaaggc

SEQ ID NO: 47913 - DNA, 20 bp, human
gccggtggggatctaccccc

SEQ ID NO: 47914 - DNA, 20 bp, human
ggaagtggctctgagaacaa

SEQ ID NO: 47915 - DNA, 20 bp, human
ggaaggaggcgaggttccgg

SEQ ID NO: 47916 - DNA, 20 bp, human
gtgggctgaaccaaccatgt

SEQ ID NO: 47917 - DNA, 20 bp, human
gcagtgcatcgtgggagcag

SEQ ID NO: 47918 - DNA, 20 bp, human
ggctataagcagtgcatcgt

SEQ ID NO: 47919 - DNA, 20 bp, human
gcccacaagacgagcaccaa

SEQ ID NO: 47920 - DNA, 20 bp, human
gcagcttcaaacaggaccgg

SEQ ID NO: 47921 - DNA, 20 bp, human
ggcccgcagataatgctgtg

SEQ ID NO: 47922 - DNA, 20 bp, human
gcagtgggcatccctgatca

SEQ ID NO: 47923 - DNA, 20 bp, human
gcaagggcaaagggacttgt

SEQ ID NO: 47924 - DNA, 20 bp, human
gagggtgggcgcactcctga

SEQ ID NO: 47925 - DNA, 20 bp, human
ggatactgaggaatccacgg

SEQ ID NO: 47926 - DNA, 20 bp, human
gcgtcccgcgcgggagacca

SEQ ID NO: 47927 - DNA, 20 bp, human
ggtctcccgcgcgggacgga

SEQ ID NO: 47928 - DNA, 20 bp, human
ggtggagaaatgggtgtcgg

SEQ ID NO: 47929 - DNA, 20 bp, human
gccagactgggcccagtgta

SEQ ID NO: 47930 - DNA, 20 bp, human
gctagatctggactccgacc

SEQ ID NO: 47931 - DNA, 20 bp, human
gacctcacctggcgccgggt

SEQ ID NO: 47932 - DNA, 20 bp, human
gcgcagcagccagcaggaag

SEQ ID NO: 47933 - DNA, 20 bp, human
ggatttagaaaattcctcta

SEQ ID NO: 47934 - DNA, 20 bp, human
gctccgaggggccctgagga

SEQ ID NO: 47935 - DNA, 20 bp, human
gcagaggtggacaggttggg

SEQ ID NO: 47936 - DNA, 20 bp, human
ggcgggctgcaactatctca

SEQ ID NO: 47937 - DNA, 20 bp, human
gggatgccaggtaggagtgg

SEQ ID NO: 47938 - DNA, 20 bp, human
ggcagtggagccggaagggt

SEQ ID NO: 47939 - DNA, 20 bp, human
gggcagcagtggagccggaa

SEQ ID NO: 47940 - DNA, 20 bp, human
gcaagagcatccgggactca

SEQ ID NO: 47941 - DNA, 20 bp, human
ggctgcaactatctcagggc

SEQ ID NO: 47942 - DNA, 20 bp, human
gtgaaatggttgcagcagag

SEQ ID NO: 47943 - DNA, 20 bp, human
gcccggaggggatgccaggt

SEQ ID NO: 47944 - DNA, 20 bp, human
ggagtctcgcccctgagact

SEQ ID NO: 47945 - DNA, 20 bp, human
gagagtcccgccagccccac

SEQ ID NO: 47946 - DNA, 20 bp, human
gggagccgtggagccgaaga

SEQ ID NO: 47947 - DNA, 20 bp, human
gcgtggagccgaagagggaa

SEQ ID NO: 47948 - DNA, 20 bp, human
gggggtgagaacccacggag

SEQ ID NO: 47949 - DNA, 20 bp, human
ggtgagaacccacggagggg

SEQ ID NO: 47950 - DNA, 20 bp, human
gtaaggggctctgacttcat

SEQ ID NO: 47951 - DNA, 20 bp, human
ggcggccaggccccccaaca

SEQ ID NO: 47952 - DNA, 20 bp, human
gtggcagccccggagttcgg

SEQ ID NO: 47953 - DNA, 20 bp, human
gacaccccgattctcaggag

SEQ ID NO: 47954 - DNA, 20 bp, human
gcctaaaaggggctccccag

SEQ ID NO: 47955 - DNA, 20 bp, human
gggccccccctgcaaaagtg

SEQ ID NO: 47956 - DNA, 20 bp, human
gcgtagggtgaggggcgtag

SEQ ID NO: 47957 - DNA, 20 bp, human
gaaagtgaggggcaagtcta

SEQ ID NO: 47958 - DNA, 20 bp, human
gagaggaggccgggctgaag

SEQ ID NO: 47959 - DNA, 20 bp, human
gttgcactgcgtagggtgag

SEQ ID NO: 47960 - DNA, 20 bp, human
gccgggctgaagaggtttgt

SEQ ID NO: 47961 - DNA, 20 bp, human
gtgaggggcaagtctagggg

SEQ ID NO: 47962 - DNA, 20 bp, human
gaaatgtctgtgaaagtgag

SEQ ID NO: 47963 - DNA, 20 bp, human
gtgtcgtcaggacaacaggg

SEQ ID NO: 47964 - DNA, 20 bp, human
gtaggaccagtcaagacccg

SEQ ID NO: 47965 - DNA, 20 bp, human
gatatctgggtagatatggg

SEQ ID NO: 47966 - DNA, 20 bp, human
gtcagcagcggccgcctccc

SEQ ID NO: 47967 - DNA, 20 bp, human
gagccaacatggctgcgctc

SEQ ID NO: 47968 - DNA, 20 bp, human
gcggcgctggggctccatgg

SEQ ID NO: 47969 - DNA, 20 bp, human
gcgccgttcaggtagagaat

SEQ ID NO: 47970 - DNA, 20 bp, human
gggaccacttccaggacctg

SEQ ID NO: 47971 - DNA, 20 bp, human
gcggcggcagctggacgagg

SEQ ID NO: 47972 - DNA, 20 bp, human
ggccatgttggctgccgcgg

SEQ ID NO: 47973 - DNA, 20 bp, human
ggcggcggcgggactggaag

SEQ ID NO: 47974 - DNA, 20 bp, human
gcagcgccgcccgcaggtcc

SEQ ID NO: 47975 - DNA, 20 bp, human
gcacttccaggacctgcggg

SEQ ID NO: 47976 - DNA, 20 bp, human
gccgggcggctgaaagggta

SEQ ID NO: 47977 - DNA, 20 bp, human
ggcgctcgcctctggagcgg

SEQ ID NO: 47978 - DNA, 20 bp, human
ggcttccctcgcccgcggag

SEQ ID NO: 47979 - DNA, 20 bp, human
ggggtaacctgggatctcgg

SEQ ID NO: 47980 - DNA, 20 bp, human
gggctcgtgggaccaacgga

SEQ ID NO: 47981 - DNA, 20 bp, human
ggcaccccgggcggctgaaa

SEQ ID NO: 47982 - DNA, 20 bp, human
gagggcccgggagtgcaccc

SEQ ID NO: 47983 - DNA, 20 bp, human
gcgccgcaatctccaggaca

SEQ ID NO: 47984 - DNA, 20 bp, human
gctatgctgccgattccccg

SEQ ID NO: 47985 - DNA, 20 bp, human
ggcgcggactctcgagccag

SEQ ID NO: 47986 - DNA, 20 bp, human
gcgagtcgcaggtgaccccg

SEQ ID NO: 47987 - DNA, 20 bp, human
gccctggaggggccgtccaa

SEQ ID NO: 47988 - DNA, 20 bp, human
gccgccatgaaagggctatc

SEQ ID NO: 47989 - DNA, 20 bp, human
gccaagggcagcgtcaacgg

SEQ ID NO: 47990 - DNA, 20 bp, human
gcaagtcgcactccctggag

SEQ ID NO: 47991 - DNA, 20 bp, human
gtggtgcgacagcgagtcac

SEQ ID NO: 47992 - DNA, 20 bp, human
ggagtcacaggccgagtcgc

SEQ ID NO: 47993 - DNA, 20 bp, human
gagccgcagccatcaccacg

SEQ ID NO: 47994 - DNA, 20 bp, human
ggtagggcttgcggtcggag

SEQ ID NO: 47995 - DNA, 20 bp, human
gctgtcgctgcggtgctcca

SEQ ID NO: 47996 - DNA, 20 bp, human
gcagctggccccacacactg

SEQ ID NO: 47997 - DNA, 20 bp, human
ggccccggaaagctgatgcc

SEQ ID NO: 47998 - DNA, 20 bp, human
gtcctggccctcaggaactg

SEQ ID NO: 47999 - DNA, 20 bp, human
gtccgggccccgccagagcg

SEQ ID NO: 48000 - DNA, 20 bp, human
gagctttccggggccggcag

SEQ ID NO: 48001 - DNA, 20 bp, human
ggcggggcccggacagaacc

SEQ ID NO: 48002 - DNA, 20 bp, human
ggccgggcatcagctttccg

SEQ ID NO: 48003 - DNA, 20 bp, human
ggatcctcctctgccggccc

SEQ ID NO: 48004 - DNA, 20 bp, human
gagaagaactaagtacaatg

SEQ ID NO: 48005 - DNA, 20 bp, human
gggacggtccgcatgatggg

SEQ ID NO: 48006 - DNA, 20 bp, human
gggacccacgctcccggtca

SEQ ID NO: 48007 - DNA, 20 bp, human
gcccgcgggcccgacccgag

SEQ ID NO: 48008 - DNA, 20 bp, human
gcggccctgaccgggagcgt

SEQ ID NO: 48009 - DNA, 20 bp, human
gtaagccgcggggaggagtg

SEQ ID NO: 48010 - DNA, 20 bp, human
gctgtccccgcggccctgac

SEQ ID NO: 48011 - DNA, 20 bp, human
gcggctggaggctcgggtct

SEQ ID NO: 48012 - DNA, 20 bp, human
ggccgctcggcgctcgcttg

SEQ ID NO: 48013 - DNA, 20 bp, human
gcgagcctccagccgggcga

SEQ ID NO: 48014 - DNA, 20 bp, human
gggaccggggcccggcactg

SEQ ID NO: 48015 - DNA, 20 bp, human
ggcgggcccgacccgagggg

SEQ ID NO: 48016 - DNA, 20 bp, human
gctcgggccgggctgcgtga

SEQ ID NO: 48017 - DNA, 20 bp, human
gggacagacggacggactgg

SEQ ID NO: 48018 - DNA, 20 bp, human
ggagtggggtcgcccagaaa

SEQ ID NO: 48019 - DNA, 20 bp, human
ggacccgagatggggagcga

SEQ ID NO: 48020 - DNA, 20 bp, human
gcgtggaccggacagacgga

SEQ ID NO: 48021 - DNA, 20 bp, human
gtgaagagcgctctgagaag

SEQ ID NO: 48022 - DNA, 20 bp, human
gtgagaaggggacccgagat

SEQ ID NO: 48023 - DNA, 20 bp, human
gcagaagagggaaagcccag

SEQ ID NO: 48024 - DNA, 20 bp, human
gggagctcccagtggatatg

SEQ ID NO: 48025 - DNA, 20 bp, human
ggggggagtcccgaagagtg

SEQ ID NO: 48026 - DNA, 20 bp, human
gagggttcctgcttcggagt

SEQ ID NO: 48027 - DNA, 20 bp, human
gcttccgttgaaggtctaga

SEQ ID NO: 48028 - DNA, 20 bp, human
ggtggaggctcgggttgtga

SEQ ID NO: 48029 - DNA, 20 bp, human
ggcgagcgggagcaagtcag

SEQ ID NO: 48030 - DNA, 20 bp, human
gtccaatcagcggctcggtg

SEQ ID NO: 48031 - DNA, 20 bp, human
ggcaagtttgaatttcgtgg

SEQ ID NO: 48032 - DNA, 20 bp, human
gagaagggtctgaggaccgg

SEQ ID NO: 48033 - DNA, 20 bp, human
gtcgggaagggcaggtaaca

SEQ ID NO: 48034 - DNA, 20 bp, human
ggttgtgagggttcctgctt

SEQ ID NO: 48035 - DNA, 20 bp, human
gcctgcttcggagtcggcgg

SEQ ID NO: 48036 - DNA, 20 bp, human
gcatgcgagcgtggtgggta

SEQ ID NO: 48037 - DNA, 20 bp, human
gggaggcggtacgaaaaggg

SEQ ID NO: 48038 - DNA, 20 bp, human
gatgccaaggcccgtcccag

SEQ ID NO: 48039 - DNA, 20 bp, human
gccggctcgcgccccctctg

SEQ ID NO: 48040 - DNA, 20 bp, human
gcttggcatgcgagcgtggt

SEQ ID NO: 48041 - DNA, 20 bp, human
gcgccctgggacccctggga

SEQ ID NO: 48042 - DNA, 20 bp, human
ggcgagacaggcacagcgcg

SEQ ID NO: 48043 - DNA, 20 bp, human
gtggttgcggacgcgaaagg

SEQ ID NO: 48044 - DNA, 20 bp, human
ggcttagggctaggcgggac

SEQ ID NO: 48045 - DNA, 20 bp, human
ggaactcaccataggtgctg

SEQ ID NO: 48046 - DNA, 20 bp, human
gccgagcgctcgggaatctg

SEQ ID NO: 48047 - DNA, 20 bp, human
ggatcgtagtcaggacggag

SEQ ID NO: 48048 - DNA, 20 bp, human
ggcgaggccaggcgcgggaa

SEQ ID NO: 48049 - DNA, 20 bp, human
gcggccccgcggccagctag

SEQ ID NO: 48050 - DNA, 20 bp, human
gtccaggcgaccccgagcgg

SEQ ID NO: 48051 - DNA, 20 bp, human
ggcgcggcggagatagaaag

SEQ ID NO: 48052 - DNA, 20 bp, human
ggagcggggtctgcaaggag

SEQ ID NO: 48053 - DNA, 20 bp, human
ggagagaggccggatccgac

SEQ ID NO: 48054 - DNA, 20 bp, human
ggttgggatcgtagtcagga

SEQ ID NO: 48055 - DNA, 20 bp, human
gccaggcgcgggaatggctg

SEQ ID NO: 48056 - DNA, 20 bp, human
gggagacccgacccggccga

SEQ ID NO: 48057 - DNA, 20 bp, human
gcacacgcgcaggaccggag

SEQ ID NO: 48058 - DNA, 20 bp, human
ggcttcttcgcaggagaggg

SEQ ID NO: 48059 - DNA, 20 bp, human
gcgcggtctggaaatcccac

SEQ ID NO: 48060 - DNA, 20 bp, human
ggcggcccggtgtcactcgg

SEQ ID NO: 48061 - DNA, 20 bp, human
gtgagcttcttcgcaggaga

SEQ ID NO: 48062 - DNA, 20 bp, human
gcgggcaaggcgataatccg

SEQ ID NO: 48063 - DNA, 20 bp, human
gaccgggccgcgatccgcag

SEQ ID NO: 48064 - DNA, 20 bp, human
ggccgccgccgagtgacacc

SEQ ID NO: 48065 - DNA, 20 bp, human
gcgggtgcgcgcagaggatc

SEQ ID NO: 48066 - DNA, 20 bp, human
gcgtcgggcagtgggagatc

SEQ ID NO: 48067 - DNA, 20 bp, human
gagaggagcccggacatccg

SEQ ID NO: 48068 - DNA, 20 bp, human
gagcgctaggatcacagtct

SEQ ID NO: 48069 - DNA, 20 bp, human
ggcacctgcaagaggccgtc

SEQ ID NO: 48070 - DNA, 20 bp, human
gcagcgggccgtgtctggga

SEQ ID NO: 48071 - DNA, 20 bp, human
gggagaccatggccttctgg

SEQ ID NO: 48072 - DNA, 20 bp, human
gccacctggctctgacctgg

SEQ ID NO: 48073 - DNA, 20 bp, human
gacgccagcgggccgtgtct

SEQ ID NO: 48074 - DNA, 20 bp, human
gccgagacccccccaccaga

SEQ ID NO: 48075 - DNA, 20 bp, human
gcgggctgctcggtgtagac

SEQ ID NO: 48076 - DNA, 20 bp, human
ggccggtgtacgctgcacca

SEQ ID NO: 48077 - DNA, 20 bp, human
ggccttggtgcagcgtacac

SEQ ID NO: 48078 - DNA, 20 bp, human
gagcgcgcaggtttcagtag

SEQ ID NO: 48079 - DNA, 20 bp, human
gcgctgcaccaaggcggctg

SEQ ID NO: 48080 - DNA, 20 bp, human
gcgcgcaggccgggaacacg

SEQ ID NO: 48081 - DNA, 20 bp, human
ggcggcagaggggacggaga

SEQ ID NO: 48082 - DNA, 20 bp, human
gcacagggaccgagggaagg

SEQ ID NO: 48083 - DNA, 20 bp, human
gcacccgcgggccctcaatc

SEQ ID NO: 48084 - DNA, 20 bp, human
gacgctgccgccatcccctc

SEQ ID NO: 48085 - DNA, 20 bp, human
ggctgcaagcgggctagtgc

SEQ ID NO: 48086 - DNA, 20 bp, human
gcggccgggccgggcaccaa

SEQ ID NO: 48087 - DNA, 20 bp, human
gatcacggcggaggagccga

SEQ ID NO: 48088 - DNA, 20 bp, human
gtaacagagcaagacgagac

SEQ ID NO: 48089 - DNA, 20 bp, human
gcgggcggacaccggatata

SEQ ID NO: 48090 - DNA, 20 bp, human
ggcgcggcggagtcctccgg

SEQ ID NO: 48091 - DNA, 20 bp, human
ggaggcgcggcggagtcctc

SEQ ID NO: 48092 - DNA, 20 bp, human
gctgagtcaagtatctggac

SEQ ID NO: 48093 - DNA, 20 bp, human
gacttgactcagagttaggg

SEQ ID NO: 48094 - DNA, 20 bp, human
gccagaccgtaccttctgga

SEQ ID NO: 48095 - DNA, 20 bp, human
gcgatcccgctgtgtgtctc

SEQ ID NO: 48096 - DNA, 20 bp, human
gctccccaggaaccaaccag

SEQ ID NO: 48097 - DNA, 20 bp, human
gcgaggcggccaacagacag

SEQ ID NO: 48098 - DNA, 20 bp, human
ggtgcagcctcgagctggag

SEQ ID NO: 48099 - DNA, 20 bp, human
gagctctgcgccgaactgag

SEQ ID NO: 48100 - DNA, 20 bp, human
ggacccgtgcagcctcgagc

SEQ ID NO: 48101 - DNA, 20 bp, human
gggtgttagggaccgctgaa

SEQ ID NO: 48102 - DNA, 20 bp, human
gagccgctggttggttcctg

SEQ ID NO: 48103 - DNA, 20 bp, human
ggttagggaccgctgaaggg

SEQ ID NO: 48104 - DNA, 20 bp, human
ggcaatgcgagcgggcccca

SEQ ID NO: 48105 - DNA, 20 bp, human
gtgacgtaggggtagcccag

SEQ ID NO: 48106 - DNA, 20 bp, human
ggcaggtgagcggccccgag

SEQ ID NO: 48107 - DNA, 20 bp, human
ggtgctggaggcggcgatct

SEQ ID NO: 48108 - DNA, 20 bp, human
gcgaaagaggatgcgaccag

SEQ ID NO: 48109 - DNA, 20 bp, human
gtagggagcgtaggaggtgt

SEQ ID NO: 48110 - DNA, 20 bp, human
ggaagggtgggcgactcctg

SEQ ID NO: 48111 - DNA, 20 bp, human
gaggggaccgggagagacag

SEQ ID NO: 48112 - DNA, 20 bp, human
gtggtggtacgtgctggagg

SEQ ID NO: 48113 - DNA, 20 bp, human
gcgactcctggggcttgtgg

SEQ ID NO: 48114 - DNA, 20 bp, human
gcggtggacaccggaagggt

SEQ ID NO: 48115 - DNA, 20 bp, human
gaccagcagcccccgagcgg

SEQ ID NO: 48116 - DNA, 20 bp, human
gtggcttgggacgcgaggag

SEQ ID NO: 48117 - DNA, 20 bp, human
gcagcgcccgccaggatgag

SEQ ID NO: 48118 - DNA, 20 bp, human
gggtcagtgacagaagactc

SEQ ID NO: 48119 - DNA, 20 bp, human
ggcgcgcagcgaccgcctga

SEQ ID NO: 48120 - DNA, 20 bp, human
gccaagtcggaatataccta

SEQ ID NO: 48121 - DNA, 20 bp, human
gtgccggtaggaggctccgt

SEQ ID NO: 48122 - DNA, 20 bp, human
ggagcccgcatggcagctaa

SEQ ID NO: 48123 - DNA, 20 bp, human
ggcggaggccagccctgggg

SEQ ID NO: 48124 - DNA, 20 bp, human
gggacccggccgcgtctggg

SEQ ID NO: 48125 - DNA, 20 bp, human
ggaccggagtgcgagagagg

SEQ ID NO: 48126 - DNA, 20 bp, human
gcggaagccagcacgcaggg

SEQ ID NO: 48127 - DNA, 20 bp, human
gcagccgcggtggacctgaa

SEQ ID NO: 48128 - DNA, 20 bp, human
ggggaggggaaagtcatggg

SEQ ID NO: 48129 - DNA, 20 bp, human
gggtgcagcggcggcggtct

SEQ ID NO: 48130 - DNA, 20 bp, human
gtggcgcgcacgcccccgcg

SEQ ID NO: 48131 - DNA, 20 bp, human
gaagcggaagccagcacgca

SEQ ID NO: 48132 - DNA, 20 bp, human
gactggatgcccaagagaca

SEQ ID NO: 48133 - DNA, 20 bp, human
gtcccgggaaccgaacccga

SEQ ID NO: 48134 - DNA, 20 bp, human
gggcagaaatgctagagagg

SEQ ID NO: 48135 - DNA, 20 bp, human
gccaggaacctcggttataa

SEQ ID NO: 48136 - DNA, 20 bp, human
ggagctagcgtagctatagt

SEQ ID NO: 48137 - DNA, 20 bp, human
ggccgcggcgaggaggagac

SEQ ID NO: 48138 - DNA, 20 bp, human
ggtgatactgatactggtag

SEQ ID NO: 48139 - DNA, 20 bp, human
ggacatggctgtgggagcga

SEQ ID NO: 48140 - DNA, 20 bp, human
ggcagccccacagccaacta

SEQ ID NO: 48141 - DNA, 20 bp, human
gttggctgggtagctcccgg

SEQ ID NO: 48142 - DNA, 20 bp, human
gcacgccgtgatactgatac

SEQ ID NO: 48143 - DNA, 20 bp, human
gtagctgcggacgtctggaa

SEQ ID NO: 48144 - DNA, 20 bp, human
ggcctcagccagcagtcagc

SEQ ID NO: 48145 - DNA, 20 bp, human
gcagccagcagtcagccggc

SEQ ID NO: 48146 - DNA, 20 bp, human
gctgcgagtggctcatgtag

SEQ ID NO: 48147 - DNA, 20 bp, human
ggagtggctcatgtaggggt

SEQ ID NO: 48148 - DNA, 20 bp, human
gcacggctcgccctacgcgt

SEQ ID NO: 48149 - DNA, 20 bp, human
gtggctcatgtaggggtagg

SEQ ID NO: 48150 - DNA, 20 bp, human
gagagcggcgcgagccaagt

SEQ ID NO: 48151 - DNA, 20 bp, human
gaggatccaaagagctaagg

SEQ ID NO: 48152 - DNA, 20 bp, human
gcgagtgcaggcagtgcaga

SEQ ID NO: 48153 - DNA, 20 bp, human
gtccctccgcccgacgcgta

SEQ ID NO: 48154 - DNA, 20 bp, human
ggcagacgccacgagtcgaa

SEQ ID NO: 48155 - DNA, 20 bp, human
ggccttgttaactcaaaggg

SEQ ID NO: 48156 - DNA, 20 bp, human
gcgcggctttgcggggacgg

SEQ ID NO: 48157 - DNA, 20 bp, human
ggggagccaccggaggtcaa

SEQ ID NO: 48158 - DNA, 20 bp, human
gcagctgccggacccaggtg

SEQ ID NO: 48159 - DNA, 20 bp, human
gaacccggacaaggtagcag

SEQ ID NO: 48160 - DNA, 20 bp, human
ggcacttccgcacctgggtc

SEQ ID NO: 48161 - DNA, 20 bp, human
gccgcggcagaaacttccgg

SEQ ID NO: 48162 - DNA, 20 bp, human
gggctgcagctgccggaccc

SEQ ID NO: 48163 - DNA, 20 bp, human
ggccgttaggaacatccaag

SEQ ID NO: 48164 - DNA, 20 bp, human
gaagccgcggcagaaacttc

SEQ ID NO: 48165 - DNA, 20 bp, human
ggttgactaggggagggtag

SEQ ID NO: 48166 - DNA, 20 bp, human
gaaaggaggtgtgtcctcta

SEQ ID NO: 48167 - DNA, 20 bp, human
gggaggtgtgtcctctaggg

SEQ ID NO: 48168 - DNA, 20 bp, human
gcacatttcaaggatgactg

SEQ ID NO: 48169 - DNA, 20 bp, human
gggggacaagttctatctac

SEQ ID NO: 48170 - DNA, 20 bp, human
ggctatgaaaacgggcagaa

SEQ ID NO: 48171 - DNA, 20 bp, human
gccctgaagtttaggaaagg

SEQ ID NO: 48172 - DNA, 20 bp, human
ggtggatgtgtattattaag

SEQ ID NO: 48173 - DNA, 20 bp, human
gacataaagggcatttgcag

SEQ ID NO: 48174 - DNA, 20 bp, human
gtaggtacctataaatgtcc

SEQ ID NO: 48175 - DNA, 20 bp, human
gtctggctgagaaatataaa

SEQ ID NO: 48176 - DNA, 20 bp, human
ggcctggctggtaagggccc

SEQ ID NO: 48177 - DNA, 20 bp, human
gctacagacggaaaagggag

SEQ ID NO: 48178 - DNA, 20 bp, human
gaccccgtagtgctgcatgg

SEQ ID NO: 48179 - DNA, 20 bp, human
gtgcagcactacggggtgaa

SEQ ID NO: 48180 - DNA, 20 bp, human
gttgcagatagagaaactat

SEQ ID NO: 48181 - DNA, 20 bp, human
ggccgccatgcagcactacg

SEQ ID NO: 48182 - DNA, 20 bp, human
gcccccacacggtaagccac

SEQ ID NO: 48183 - DNA, 20 bp, human
ggaatgcaggaacccccaca

SEQ ID NO: 48184 - DNA, 20 bp, human
gggtcagaagctccctccat

SEQ ID NO: 48185 - DNA, 20 bp, human
ggaagctccctccatcggaa

SEQ ID NO: 48186 - DNA, 20 bp, human
gctaactcgggcctagaaca

SEQ ID NO: 48187 - DNA, 20 bp, human
ggctgacaggattctaactc

SEQ ID NO: 48188 - DNA, 20 bp, human
gccggtgtcaggaaaatgtc

SEQ ID NO: 48189 - DNA, 20 bp, human
gcagctgtcccctctggtgg

SEQ ID NO: 48190 - DNA, 20 bp, human
gcaacggcgcgcgggtctcc

SEQ ID NO: 48191 - DNA, 20 bp, human
gcgtttggcgccaaaccctg

SEQ ID NO: 48192 - DNA, 20 bp, human
gcctgtcagctgaggaggtc

SEQ ID NO: 48193 - DNA, 20 bp, human
gtcctccccaaaggtcggag

SEQ ID NO: 48194 - DNA, 20 bp, human
gcaacggttcagtctatcaa

SEQ ID NO: 48195 - DNA, 20 bp, human
gcgccgttgaccacagggtt

SEQ ID NO: 48196 - DNA, 20 bp, human
gcagatctgagtcctgtagg

SEQ ID NO: 48197 - DNA, 20 bp, human
ggggggcctctacagaatcc

SEQ ID NO: 48198 - DNA, 20 bp, human
gctgtataggaactacatgg

SEQ ID NO: 48199 - DNA, 20 bp, human
gctactgtataggaactaca

SEQ ID NO: 48200 - DNA, 20 bp, human
ggtgttgactcactcagtgt

SEQ ID NO: 48201 - DNA, 20 bp, human
gtctgggaggcaattacctt

SEQ ID NO: 48202 - DNA, 20 bp, human
gtgatgccaggattctgtag

SEQ ID NO: 48203 - DNA, 20 bp, human
gccttcggagaaaaacgaat

SEQ ID NO: 48204 - DNA, 20 bp, human
gattgaactaactactgtat

SEQ ID NO: 48205 - DNA, 20 bp, human
gcaacacagtaactgatgcc

SEQ ID NO: 48206 - DNA, 20 bp, human
ggccgggacggagcatgact

SEQ ID NO: 48207 - DNA, 20 bp, human
gacggagcatgactaggccg

SEQ ID NO: 48208 - DNA, 20 bp, human
ggcctagtcatgctccgtcc

SEQ ID NO: 48209 - DNA, 20 bp, human
gggcaaacacaggtcagtat

SEQ ID NO: 48210 - DNA, 20 bp, human
gcagcagctgcgcgccggga

SEQ ID NO: 48211 - DNA, 20 bp, human
gccagagacagtctacgcat

SEQ ID NO: 48212 - DNA, 20 bp, human
gctgctcagaggcgacgggg

SEQ ID NO: 48213 - DNA, 20 bp, human
ggtcctgctcagaggcgacg

SEQ ID NO: 48214 - DNA, 20 bp, human
gggcgcaggcgcctgctccg

SEQ ID NO: 48215 - DNA, 20 bp, human
gtctacgcataggcaaacac

SEQ ID NO: 48216 - DNA, 20 bp, human
ggaccaacaggctaaagagg

SEQ ID NO: 48217 - DNA, 20 bp, human
gcactgccggggagagaaag

SEQ ID NO: 48218 - DNA, 20 bp, human
ggatggccgcggaggtggag

SEQ ID NO: 48219 - DNA, 20 bp, human
gaccaaccgcgggaaggaaa

SEQ ID NO: 48220 - DNA, 20 bp, human
gagcgaccaacaggctaaag

SEQ ID NO: 48221 - DNA, 20 bp, human
ggaataccctcggccacacc

SEQ ID NO: 48222 - DNA, 20 bp, human
gccggcaaccacggtgggag

SEQ ID NO: 48223 - DNA, 20 bp, human
gggaaatggacataaacccg

SEQ ID NO: 48224 - DNA, 20 bp, human
ggttattccgagcatggaga

SEQ ID NO: 48225 - DNA, 20 bp, human
gccaaggctccgcggagatg

SEQ ID NO: 48226 - DNA, 20 bp, human
gacacaagagtggcttcatt

SEQ ID NO: 48227 - DNA, 20 bp, human
gcagaatatcaacacaagag

SEQ ID NO: 48228 - DNA, 20 bp, human
gttactgtggcataaacaac

SEQ ID NO: 48229 - DNA, 20 bp, human
gataccatgtagagagagat

SEQ ID NO: 48230 - DNA, 20 bp, human
gtcaaaaagtctcaaaaatc

SEQ ID NO: 48231 - DNA, 20 bp, human
gcagtgtgtttcatgaataa

SEQ ID NO: 48232 - DNA, 20 bp, human
gattctttgtgaactacgga

SEQ ID NO: 48233 - DNA, 20 bp, human
gttttttttcacaatcttgt

SEQ ID NO: 48234 - DNA, 20 bp, human
gctgcatgacacttctaaaa

SEQ ID NO: 48235 - DNA, 20 bp, human
gaagggatagtttatagaac

SEQ ID NO: 48236 - DNA, 20 bp, human
gacaggcagacatgcagcca

SEQ ID NO: 48237 - DNA, 20 bp, human
gccaggagaaggtcgagcag

SEQ ID NO: 48238 - DNA, 20 bp, human
ggtaaggtcagcagaggcta

SEQ ID NO: 48239 - DNA, 20 bp, human
gctctgagccccaggatggg

SEQ ID NO: 48240 - DNA, 20 bp, human
gtcggggtcctcctgtcaca

SEQ ID NO: 48241 - DNA, 20 bp, human
gtgccaggccctgtgacagg

SEQ ID NO: 48242 - DNA, 20 bp, human
gttgtcctgggccagttcgg

SEQ ID NO: 48243 - DNA, 20 bp, human
gctggcccaggacaagtacg

SEQ ID NO: 48244 - DNA, 20 bp, human
ggagctgggcgcctccgaac

SEQ ID NO: 48245 - DNA, 20 bp, human
gcagctcctggtggacgccc

SEQ ID NO: 48246 - DNA, 20 bp, human
gctgcgagggatgaacccga

SEQ ID NO: 48247 - DNA, 20 bp, human
ggacagcgacgctccggagg

SEQ ID NO: 48248 - DNA, 20 bp, human
gagcgcttgtggcccttgag

SEQ ID NO: 48249 - DNA, 20 bp, human
gacggacagcgacgctccgg

SEQ ID NO: 48250 - DNA, 20 bp, human
ggtgcaacctgatcgccgag

SEQ ID NO: 48251 - DNA, 20 bp, human
gccgacggacagcgacgctc

SEQ ID NO: 48252 - DNA, 20 bp, human
ggctacgcctcgccgctcaa

SEQ ID NO: 48253 - DNA, 20 bp, human
gagtctccaggcgagagagg

SEQ ID NO: 48254 - DNA, 20 bp, human
gcgcctggagactgctgcga

SEQ ID NO: 48255 - DNA, 20 bp, human
gcaggttgcacttcttgcac

SEQ ID NO: 48256 - DNA, 20 bp, human
gagatcgctggctcacccgg

SEQ ID NO: 48257 - DNA, 20 bp, human
gaggctgggcgggaaaggtc

SEQ ID NO: 48258 - DNA, 20 bp, human
gcccgcctggctcagatcgc

SEQ ID NO: 48259 - DNA, 20 bp, human
gccgctcggggtgtcaggga

SEQ ID NO: 48260 - DNA, 20 bp, human
gagcggacagtactaggaag

SEQ ID NO: 48261 - DNA, 20 bp, human
gctcagatcgctggctcacc

SEQ ID NO: 48262 - DNA, 20 bp, human
gacccactggatggtggagg

SEQ ID NO: 48263 - DNA, 20 bp, human
gaagcggcctcagcaaggtg

SEQ ID NO: 48264 - DNA, 20 bp, human
ggatgccgctcggggtgtca

SEQ ID NO: 48265 - DNA, 20 bp, human
gcagcaaggtgaggcgcccg

SEQ ID NO: 48266 - DNA, 20 bp, human
gcttgggcgcgcagccgggt

SEQ ID NO: 48267 - DNA, 20 bp, human
ggtcggcacgtcctccttcg

SEQ ID NO: 48268 - DNA, 20 bp, human
gcgcagcgcctccgcgaagg

SEQ ID NO: 48269 - DNA, 20 bp, human
gggcacgtcctccttcgcgg

SEQ ID NO: 48270 - DNA, 20 bp, human
ggagccaggacaggacgcca

SEQ ID NO: 48271 - DNA, 20 bp, human
gggagctggagagacgactg

SEQ ID NO: 48272 - DNA, 20 bp, human
ggcgtcctgtcctggctcaa

SEQ ID NO: 48273 - DNA, 20 bp, human
gaccggggctgcgggaccaa

SEQ ID NO: 48274 - DNA, 20 bp, human
gggagcacacacgaccaccg

SEQ ID NO: 48275 - DNA, 20 bp, human
gggctgcgaggcccgctcag

SEQ ID NO: 48276 - DNA, 20 bp, human
ggaatggagcggtcacagtg

SEQ ID NO: 48277 - DNA, 20 bp, human
ggtggagctcagtaggacca

SEQ ID NO: 48278 - DNA, 20 bp, human
ggtgagcctggcagagaccc

SEQ ID NO: 48279 - DNA, 20 bp, human
gcgaagcccgggggctacag

SEQ ID NO: 48280 - DNA, 20 bp, human
gtgcccgcctatggacacgg

SEQ ID NO: 48281 - DNA, 20 bp, human
gccaggagagccccgagcac

SEQ ID NO: 48282 - DNA, 20 bp, human
ggccgagcgccagcgcgtca

SEQ ID NO: 48283 - DNA, 20 bp, human
gagccaccgtgtccataggc

SEQ ID NO: 48284 - DNA, 20 bp, human
gctagcccaggggccaagtg

SEQ ID NO: 48285 - DNA, 20 bp, human
gcgtctccagctccaggacg

SEQ ID NO: 48286 - DNA, 20 bp, human
ggagcggctcattgagagtc

SEQ ID NO: 48287 - DNA, 20 bp, human
gggcaacgctcatagagagg

SEQ ID NO: 48288 - DNA, 20 bp, human
gtaaggaccaacaatagagc

SEQ ID NO: 48289 - DNA, 20 bp, human
gctggcagcgccgggcaact

SEQ ID NO: 48290 - DNA, 20 bp, human
gggcccaggcctcctcaaca

SEQ ID NO: 48291 - DNA, 20 bp, human
ggaggtctgggactctcgga

SEQ ID NO: 48292 - DNA, 20 bp, human
gtctgtctaatggagcccta

SEQ ID NO: 48293 - DNA, 20 bp, human
gagggacgcccgaagggtct

SEQ ID NO: 48294 - DNA, 20 bp, human
gagaggaggtctgggactct

SEQ ID NO: 48295 - DNA, 20 bp, human
gcccggctgcgcgcagcgtc

SEQ ID NO: 48296 - DNA, 20 bp, human
ggcaaggctgggcatcgcca

SEQ ID NO: 48297 - DNA, 20 bp, human
gcggcctccgccccaaaagg

SEQ ID NO: 48298 - DNA, 20 bp, human
gtcgctcgctcggctccacg

SEQ ID NO: 48299 - DNA, 20 bp, human
gaggctgggcatcgccacgg

SEQ ID NO: 48300 - DNA, 20 bp, human
ggcgcaagagcagtaggact

SEQ ID NO: 48301 - DNA, 20 bp, human
ggcccaggccagcccggatg

SEQ ID NO: 48302 - DNA, 20 bp, human
gtcctcgaagcctcccccgg

SEQ ID NO: 48303 - DNA, 20 bp, human
gcccaaaagggggtcccgca

SEQ ID NO: 48304 - DNA, 20 bp, human
gcggcctgcgcaggtctagg

SEQ ID NO: 48305 - DNA, 20 bp, human
gccctccagccggttctggg

SEQ ID NO: 48306 - DNA, 20 bp, human
gacactcgcaggcctggaag

SEQ ID NO: 48307 - DNA, 20 bp, human
ggtatcactgcccaaatcag

SEQ ID NO: 48308 - DNA, 20 bp, human
ggagggagccagagtttggg

SEQ ID NO: 48309 - DNA, 20 bp, human
gtgggtggaggaagcatgag

SEQ ID NO: 48310 - DNA, 20 bp, human
gtttgcacctgggcacacta

SEQ ID NO: 48311 - DNA, 20 bp, human
gatgcttgtggcccctgatt

SEQ ID NO: 48312 - DNA, 20 bp, human
gagaattgcagtgcgacctg

SEQ ID NO: 48313 - DNA, 20 bp, human
gtgccttgaagagggagcag

SEQ ID NO: 48314 - DNA, 20 bp, human
gcctgggcacactaaggtcc

SEQ ID NO: 48315 - DNA, 20 bp, human
gcaccatactcatgagaaga

SEQ ID NO: 48316 - DNA, 20 bp, human
gcacagctccgggaagaccc

SEQ ID NO: 48317 - DNA, 20 bp, human
ggcggtagaggtgacaccca

SEQ ID NO: 48318 - DNA, 20 bp, human
ggcccaagaaacccccacgg

SEQ ID NO: 48319 - DNA, 20 bp, human
gccggagctgtgggaatggg

SEQ ID NO: 48320 - DNA, 20 bp, human
gccgctgcaggcgcccccgt

SEQ ID NO: 48321 - DNA, 20 bp, human
gtttcttgggcaaggaggag

SEQ ID NO: 48322 - DNA, 20 bp, human
ggtgagaacgtccgcggtag

SEQ ID NO: 48323 - DNA, 20 bp, human
gggcggctgctaagaagacc

SEQ ID NO: 48324 - DNA, 20 bp, human
ggagccccagggtcttgagt

SEQ ID NO: 48325 - DNA, 20 bp, human
gccgcggacgttctcacctg

SEQ ID NO: 48326 - DNA, 20 bp, human
gcagggcctagcacatgaca

SEQ ID NO: 48327 - DNA, 20 bp, human
ggggagtccggctaagaggg

SEQ ID NO: 48328 - DNA, 20 bp, human
ggggcccgcgaggcagggaa

SEQ ID NO: 48329 - DNA, 20 bp, human
gcgtgccccagggagcgagt

SEQ ID NO: 48330 - DNA, 20 bp, human
ggagagacattagtgcccca

SEQ ID NO: 48331 - DNA, 20 bp, human
gaggtttttggcccagatca

SEQ ID NO: 48332 - DNA, 20 bp, human
gtgttcgtgcagctagttca

SEQ ID NO: 48333 - DNA, 20 bp, human
gtagccggactccctaaccc

SEQ ID NO: 48334 - DNA, 20 bp, human
gacgcgccaaggggcccgcg

SEQ ID NO: 48335 - DNA, 20 bp, human
gttagggagtccggctaaga

SEQ ID NO: 48336 - DNA, 20 bp, human
ggccagccggcgggagctag

SEQ ID NO: 48337 - DNA, 20 bp, human
gcgggcactttggaagaacc

SEQ ID NO: 48338 - DNA, 20 bp, human
gaagcagccacgggcgagag

SEQ ID NO: 48339 - DNA, 20 bp, human
gtggctcaggctgcagagta

SEQ ID NO: 48340 - DNA, 20 bp, human
gtggcgccgggacccctggg

SEQ ID NO: 48341 - DNA, 20 bp, human
gggtccagcgtaggagaggt

SEQ ID NO: 48342 - DNA, 20 bp, human
gcggcttcggaggagctaaa

SEQ ID NO: 48343 - DNA, 20 bp, human
gctgcagccactctcgcccg

SEQ ID NO: 48344 - DNA, 20 bp, human
gaggcacagcggcgatccgg

SEQ ID NO: 48345 - DNA, 20 bp, human
gcacagcggcgatccggcgg

SEQ ID NO: 48346 - DNA, 20 bp, human
ggaccgagagagatcatcta

SEQ ID NO: 48347 - DNA, 20 bp, human
ggaggtgtatgtcaccgagg

SEQ ID NO: 48348 - DNA, 20 bp, human
gctggtgcaagggtccccag

SEQ ID NO: 48349 - DNA, 20 bp, human
gaggttgtcttggcaacagg

SEQ ID NO: 48350 - DNA, 20 bp, human
ggaggagatgcgccgaggga

SEQ ID NO: 48351 - DNA, 20 bp, human
gtgggggaggggcaatacag

SEQ ID NO: 48352 - DNA, 20 bp, human
gatggaggtgtatgtcaccg

SEQ ID NO: 48353 - DNA, 20 bp, human
gtctctctcggtccctccag

SEQ ID NO: 48354 - DNA, 20 bp, human
ggggtgctcggtaccttcaa

SEQ ID NO: 48355 - DNA, 20 bp, human
gcggtaccttcaagggccca

SEQ ID NO: 48356 - DNA, 20 bp, human
gggaccctgggaaagcccac

SEQ ID NO: 48357 - DNA, 20 bp, human
ggaaacccgagcccgcgcca

SEQ ID NO: 48358 - DNA, 20 bp, human
ggagggcaaatctcaattag

SEQ ID NO: 48359 - DNA, 20 bp, human
gcttccccaacaggtagcac

SEQ ID NO: 48360 - DNA, 20 bp, human
gcggcccgtgctacctgttg

SEQ ID NO: 48361 - DNA, 20 bp, human
gtgtggggagtggaactcgg

SEQ ID NO: 48362 - DNA, 20 bp, human
gaggcgggcgcgtccaggcc

SEQ ID NO: 48363 - DNA, 20 bp, human
gacccgagcccgcgccaggg

SEQ ID NO: 48364 - DNA, 20 bp, human
gccaccccagcttctccggt

SEQ ID NO: 48365 - DNA, 20 bp, human
gggatggcccggggggtagg

SEQ ID NO: 48366 - DNA, 20 bp, human
gggcggcagtccggcagtgg

SEQ ID NO: 48367 - DNA, 20 bp, human
gcctgcagcgccgggaccgg

SEQ ID NO: 48368 - DNA, 20 bp, human
gggcccgcgccggaaaaggt

SEQ ID NO: 48369 - DNA, 20 bp, human
ggcgggcggcagtccggcag

SEQ ID NO: 48370 - DNA, 20 bp, human
gtgaggcggcaccggagtct

SEQ ID NO: 48371 - DNA, 20 bp, human
gatgcaggccgctcacccgt

SEQ ID NO: 48372 - DNA, 20 bp, human
ggccatcttgggcgcccccc

SEQ ID NO: 48373 - DNA, 20 bp, human
gcccaggctgctgtcgtcgt

SEQ ID NO: 48374 - DNA, 20 bp, human
gtgggtagaaatagagctca

SEQ ID NO: 48375 - DNA, 20 bp, human
gctgggtgctgaaaggatgg

SEQ ID NO: 48376 - DNA, 20 bp, human
gaacgacgggcagaggcgcg

SEQ ID NO: 48377 - DNA, 20 bp, human
gggcggcggccgctcttcgg

SEQ ID NO: 48378 - DNA, 20 bp, human
gacctggcccttgagaacta

SEQ ID NO: 48379 - DNA, 20 bp, human
gcgacggcagaagcagcgac

SEQ ID NO: 48380 - DNA, 20 bp, human
ggtcgcgggccccagctgag

SEQ ID NO: 48381 - DNA, 20 bp, human
gtccagaggcgcgtagtgag

SEQ ID NO: 48382 - DNA, 20 bp, human
gcggtcagtgaggtactgta

SEQ ID NO: 48383 - DNA, 20 bp, human
gactcatcccgagccccgga

SEQ ID NO: 48384 - DNA, 20 bp, human
gagaggcgcgtagtgagtgg

SEQ ID NO: 48385 - DNA, 20 bp, human
ggagcttggcccagaacgac

SEQ ID NO: 48386 - DNA, 20 bp, human
gggcggtcgaggagctccca

SEQ ID NO: 48387 - DNA, 20 bp, human
ggcaggcagtgggaacatcc

SEQ ID NO: 48388 - DNA, 20 bp, human
gccctaggggaagataccag

SEQ ID NO: 48389 - DNA, 20 bp, human
gagctcccatggcagggacg

SEQ ID NO: 48390 - DNA, 20 bp, human
gacggtcccacgggtcccag

SEQ ID NO: 48391 - DNA, 20 bp, human
gtcccatggcagggacgagg

SEQ ID NO: 48392 - DNA, 20 bp, human
gtcaggaggctgtgagatgt

SEQ ID NO: 48393 - DNA, 20 bp, human
ggggcgcacgcctcctcagg

SEQ ID NO: 48394 - DNA, 20 bp, human
gggcagggacctcctgtcca

SEQ ID NO: 48395 - DNA, 20 bp, human
gcggagggaaggcgaaaggg

SEQ ID NO: 48396 - DNA, 20 bp, human
gcccgggcccggtcagtctg

SEQ ID NO: 48397 - DNA, 20 bp, human
gggagctgtgagcggagagg

SEQ ID NO: 48398 - DNA, 20 bp, human
ggggagagaggtgaaatcaa

SEQ ID NO: 48399 - DNA, 20 bp, human
gcatcgagaaaagcctacgg

SEQ ID NO: 48400 - DNA, 20 bp, human
gggacccggtgcagctccct

SEQ ID NO: 48401 - DNA, 20 bp, human
ggggcccggtcagtctgagg

SEQ ID NO: 48402 - DNA, 20 bp, human
gcccgactccggaggctcgt

SEQ ID NO: 48403 - DNA, 20 bp, human
gaggcaggccccgactccgg

SEQ ID NO: 48404 - DNA, 20 bp, human
gcagaaaagacagcggaacc

SEQ ID NO: 48405 - DNA, 20 bp, human
ggccgaaactcctcaactta

SEQ ID NO: 48406 - DNA, 20 bp, human
gcgttgggctgtaaagacta

SEQ ID NO: 48407 - DNA, 20 bp, human
gaaggaaagagggtactctc

SEQ ID NO: 48408 - DNA, 20 bp, human
ggtaaagactagggcgccag

SEQ ID NO: 48409 - DNA, 20 bp, human
ggggcgaccggggaagcgtt

SEQ ID NO: 48410 - DNA, 20 bp, human
gaagcaacgctctgcagtag

SEQ ID NO: 48411 - DNA, 20 bp, human
gggagtctgcgggtgaccac

SEQ ID NO: 48412 - DNA, 20 bp, human
gacgggagcgcaggccgagg

SEQ ID NO: 48413 - DNA, 20 bp, human
gaagagggtactctctggct

SEQ ID NO: 48414 - DNA, 20 bp, human
gcacctgtcgcaggctccga

SEQ ID NO: 48415 - DNA, 20 bp, human
gtagccgagggttatctgtt

SEQ ID NO: 48416 - DNA, 20 bp, human
ggctcggccgagcgcaacag

SEQ ID NO: 48417 - DNA, 20 bp, human
gacagtaacggaggacacaa

SEQ ID NO: 48418 - DNA, 20 bp, human
ggtggtcccgggaccaagag

SEQ ID NO: 48419 - DNA, 20 bp, human
ggcgtggaggagccatctcc

SEQ ID NO: 48420 - DNA, 20 bp, human
gggagtcgcgcggaggacgg

SEQ ID NO: 48421 - DNA, 20 bp, human
gaaacacgcgaggagtcgga

SEQ ID NO: 48422 - DNA, 20 bp, human
gtggtgatcaccagctcatg

SEQ ID NO: 48423 - DNA, 20 bp, human
gtcgcccagggtggtgaccc

SEQ ID NO: 48424 - DNA, 20 bp, human
gctccgggaggacaaacaag

SEQ ID NO: 48425 - DNA, 20 bp, human
gcccagccacgcaggtatcg

SEQ ID NO: 48426 - DNA, 20 bp, human
ggcagagggcgcgctcccag

SEQ ID NO: 48427 - DNA, 20 bp, human
ggtgcagcactgtggacccg

SEQ ID NO: 48428 - DNA, 20 bp, human
ggtccgcagacaggacctcg

SEQ ID NO: 48429 - DNA, 20 bp, human
gcccgtggcctaggttctaa

SEQ ID NO: 48430 - DNA, 20 bp, human
gtggcctaggttctaagggg

SEQ ID NO: 48431 - DNA, 20 bp, human
gagagaggaaggggcgtccc

SEQ ID NO: 48432 - DNA, 20 bp, human
gcagcggttgtggagtgccg

SEQ ID NO: 48433 - DNA, 20 bp, human
gccagcgtcggtggcaaggg

SEQ ID NO: 48434 - DNA, 20 bp, human
gggcgtcccgggatatttgg

SEQ ID NO: 48435 - DNA, 20 bp, human
gcgaatcccagaatactcag

SEQ ID NO: 48436 - DNA, 20 bp, human
ggcgcgcgagagccaccggg

SEQ ID NO: 48437 - DNA, 20 bp, human
gcagcacgcggagggaagcc

SEQ ID NO: 48438 - DNA, 20 bp, human
gaggagcagcagcacgcgga

SEQ ID NO: 48439 - DNA, 20 bp, human
gcctgcgtgtctgtctgaca

SEQ ID NO: 48440 - DNA, 20 bp, human
gtcctccaggtcccccccgg

SEQ ID NO: 48441 - DNA, 20 bp, human
ggtaagccagggacaacaac

SEQ ID NO: 48442 - DNA, 20 bp, human
gtccagtgtgaaacacctgg

SEQ ID NO: 48443 - DNA, 20 bp, human
ggcaactgagactctagaga

SEQ ID NO: 48444 - DNA, 20 bp, human
ggacaacaacaggtaagcca

SEQ ID NO: 48445 - DNA, 20 bp, human
gagagccaccgggggggacc

SEQ ID NO: 48446 - DNA, 20 bp, human
gtggaaccggtacgtcggtg

SEQ ID NO: 48447 - DNA, 20 bp, human
gctcggtggaaccggtacgt

SEQ ID NO: 48448 - DNA, 20 bp, human
ggcatccccgcactgctcgg

SEQ ID NO: 48449 - DNA, 20 bp, human
ggcgtccctccctagagacg

SEQ ID NO: 48450 - DNA, 20 bp, human
gccgcactgctcggtggaac

SEQ ID NO: 48451 - DNA, 20 bp, human
gctccgcctcaccgacgtac

SEQ ID NO: 48452 - DNA, 20 bp, human
gaaccggtacgtcggtgagg

SEQ ID NO: 48453 - DNA, 20 bp, human
gtcagccccgtctctaggga

SEQ ID NO: 48454 - DNA, 20 bp, human
ggcggagggcgagtggacga

SEQ ID NO: 48455 - DNA, 20 bp, human
gacgctaggccgttgctaag

SEQ ID NO: 48456 - DNA, 20 bp, human
gagcacccgcaggtcgtcca

SEQ ID NO: 48457 - DNA, 20 bp, human
gcggcgccatggacgacctg

SEQ ID NO: 48458 - DNA, 20 bp, human
ggccgaaagccgcatacacg

SEQ ID NO: 48459 - DNA, 20 bp, human
gctcctccggcaccatagtg

SEQ ID NO: 48460 - DNA, 20 bp, human
ggcgcatccacagcacccgc

SEQ ID NO: 48461 - DNA, 20 bp, human
gcggctccctctgcactgcg

SEQ ID NO: 48462 - DNA, 20 bp, human
gcaggtcctcgaaaagctgg

SEQ ID NO: 48463 - DNA, 20 bp, human
ggaggccggggccggacgat

SEQ ID NO: 48464 - DNA, 20 bp, human
gtggcgccgcgcagtgcaga

SEQ ID NO: 48465 - DNA, 20 bp, human
gcgggcaggagggaagcccg

SEQ ID NO: 48466 - DNA, 20 bp, human
gaggctacagctgtgcgcag

SEQ ID NO: 48467 - DNA, 20 bp, human
gctgctaagtagcagcaggt

SEQ ID NO: 48468 - DNA, 20 bp, human
gatgatgctggggttcacgg

SEQ ID NO: 48469 - DNA, 20 bp, human
ggcccaggtggcagcccggg

SEQ ID NO: 48470 - DNA, 20 bp, human
gggcggcgaagctaaacaca

SEQ ID NO: 48471 - DNA, 20 bp, human
ggcggctgctaagtagcagc

SEQ ID NO: 48472 - DNA, 20 bp, human
ggaggttaggcgaagggtcg

SEQ ID NO: 48473 - DNA, 20 bp, human
ggcgatgatgctggggttca

SEQ ID NO: 48474 - DNA, 20 bp, human
gggacaaccggcaggttctt

SEQ ID NO: 48475 - DNA, 20 bp, human
ggccgcctggcgatgatgct

SEQ ID NO: 48476 - DNA, 20 bp, human
gagagccggtggcgttccgg

SEQ ID NO: 48477 - DNA, 20 bp, human
gcaaacgagtagctggagaa

SEQ ID NO: 48478 - DNA, 20 bp, human
ggaaacctccggaacgccac

SEQ ID NO: 48479 - DNA, 20 bp, human
gaaaggcagggggataacga

SEQ ID NO: 48480 - DNA, 20 bp, human
gctgcctttcacctgaggag

SEQ ID NO: 48481 - DNA, 20 bp, human
gctactcgtttgagagccgg

SEQ ID NO: 48482 - DNA, 20 bp, human
ggagaagggcggtcgctgac

SEQ ID NO: 48483 - DNA, 20 bp, human
ggtcgtcgccatggaaactg

SEQ ID NO: 48484 - DNA, 20 bp, human
ggaagtagtgagaaacaatc

SEQ ID NO: 48485 - DNA, 20 bp, human
gttgagagccggtggcgttc

SEQ ID NO: 48486 - DNA, 20 bp, human
ggccggcgagcgccagacta

SEQ ID NO: 48487 - DNA, 20 bp, human
ggtcggagcctggcgtggta

SEQ ID NO: 48488 - DNA, 20 bp, human
ggcgccagactagggtgaat

SEQ ID NO: 48489 - DNA, 20 bp, human
gggttacggccaggaggcgt

SEQ ID NO: 48490 - DNA, 20 bp, human
ggggaacgcggcctgcctga

SEQ ID NO: 48491 - DNA, 20 bp, human
ggaggcgtcggagcctggcg

SEQ ID NO: 48492 - DNA, 20 bp, human
gctcgcgttgagagctcctg

SEQ ID NO: 48493 - DNA, 20 bp, human
gcttccaggaagggccacaa

SEQ ID NO: 48494 - DNA, 20 bp, human
gcccgcgcggaaccctcacc

SEQ ID NO: 48495 - DNA, 20 bp, human
gaggtccggcccgcccacgc

SEQ ID NO: 48496 - DNA, 20 bp, human
gagaagccccaggtaccgtg

SEQ ID NO: 48497 - DNA, 20 bp, human
gcaggccttcaggactccac

SEQ ID NO: 48498 - DNA, 20 bp, human
gggagcagggaggccttcag

SEQ ID NO: 48499 - DNA, 20 bp, human
gggaggccttcagaggatgg

SEQ ID NO: 48500 - DNA, 20 bp, human
gagccatgaacagctcccgg

SEQ ID NO: 48501 - DNA, 20 bp, human
gccaggccatgcttccggag

SEQ ID NO: 48502 - DNA, 20 bp, human
gttggagcccctcgagggaa

SEQ ID NO: 48503 - DNA, 20 bp, human
gaaggccgctcaccagctga

SEQ ID NO: 48504 - DNA, 20 bp, human
gatggctcccttccctcgag

SEQ ID NO: 48505 - DNA, 20 bp, human
ggatcgggaggtctcatctc

SEQ ID NO: 48506 - DNA, 20 bp, human
gtgcagacgccggcccgaga

SEQ ID NO: 48507 - DNA, 20 bp, human
gcatcggtcggtctagggag

SEQ ID NO: 48508 - DNA, 20 bp, human
gcttagagtggcccatcggt

SEQ ID NO: 48509 - DNA, 20 bp, human
ggaactgctctgctaagtcg

SEQ ID NO: 48510 - DNA, 20 bp, human
gtgcccctcgcagccctctc

SEQ ID NO: 48511 - DNA, 20 bp, human
ggtactaggaaataccgcag

SEQ ID NO: 48512 - DNA, 20 bp, human
gcggtcggtctagggagggg

SEQ ID NO: 48513 - DNA, 20 bp, human
ggaggggcaacttcttagag

SEQ ID NO: 48514 - DNA, 20 bp, human
gacttcttagagtggcccat

SEQ ID NO: 48515 - DNA, 20 bp, human
gtggcccatcggtcggtcta

SEQ ID NO: 48516 - DNA, 20 bp, human
gggaggagggagaacagttc

SEQ ID NO: 48517 - DNA, 20 bp, human
gcagaccaactggataggag

SEQ ID NO: 48518 - DNA, 20 bp, human
gtgccagtgttaagagtcca

SEQ ID NO: 48519 - DNA, 20 bp, human
gacccctccaaacaacatcc

SEQ ID NO: 48520 - DNA, 20 bp, human
gatggggatgacaccaacaa

SEQ ID NO: 48521 - DNA, 20 bp, human
ggaagcgtggccaccgctgg

SEQ ID NO: 48522 - DNA, 20 bp, human
gcaattagagtggacaccat

SEQ ID NO: 48523 - DNA, 20 bp, human
gctgttgctaagggaaggag

SEQ ID NO: 48524 - DNA, 20 bp, human
ggggctgccaggatgttgtt

SEQ ID NO: 48525 - DNA, 20 bp, human
ggccaggatgttgtttggag

SEQ ID NO: 48526 - DNA, 20 bp, human
gtctaggagaaaaacttgag

SEQ ID NO: 48527 - DNA, 20 bp, human
gacaccaggcttcgagagag

SEQ ID NO: 48528 - DNA, 20 bp, human
gtaatgttcacctggtgcat

SEQ ID NO: 48529 - DNA, 20 bp, human
gaaaacttgagtggtataag

SEQ ID NO: 48530 - DNA, 20 bp, human
ggattgggaggagacagctc

SEQ ID NO: 48531 - DNA, 20 bp, human
gtagccgtgcatggacaggc

SEQ ID NO: 48532 - DNA, 20 bp, human
gactccagcctgtccatgca

SEQ ID NO: 48533 - DNA, 20 bp, human
gatcatctgtcacacctggg

SEQ ID NO: 48534 - DNA, 20 bp, human
gtctcctagagtgtctgccc

SEQ ID NO: 48535 - DNA, 20 bp, human
gggagtcagctcttccggaa

SEQ ID NO: 48536 - DNA, 20 bp, human
ggtcgggagtagaaagtact

SEQ ID NO: 48537 - DNA, 20 bp, human
gagagagagcaatgcctggt

SEQ ID NO: 48538 - DNA, 20 bp, human
gtctctctggagaccctcgg

SEQ ID NO: 48539 - DNA, 20 bp, human
gctccagagagagcaatgcc

SEQ ID NO: 48540 - DNA, 20 bp, human
gctggcgacgtgttactcag

SEQ ID NO: 48541 - DNA, 20 bp, human
gctctggagaccctcggcgg

SEQ ID NO: 48542 - DNA, 20 bp, human
gggacctgcgctgttaaata

SEQ ID NO: 48543 - DNA, 20 bp, human
gggagcccaggcccgagggt

SEQ ID NO: 48544 - DNA, 20 bp, human
gtggcgcagtgcttccgtag

SEQ ID NO: 48545 - DNA, 20 bp, human
ggcagagaaaatcaatggaa

SEQ ID NO: 48546 - DNA, 20 bp, human
gggaacccctaggacgatag

SEQ ID NO: 48547 - DNA, 20 bp, human
gagggccccgggacttgcag

SEQ ID NO: 48548 - DNA, 20 bp, human
gacgctagacggctctggtg

SEQ ID NO: 48549 - DNA, 20 bp, human
gccagagccgtctagcgtcc

SEQ ID NO: 48550 - DNA, 20 bp, human
gtagacggctctggtgcgga

SEQ ID NO: 48551 - DNA, 20 bp, human
gacgctgcccggacgctaga

SEQ ID NO: 48552 - DNA, 20 bp, human
gtcctgcccgcggaacccct

SEQ ID NO: 48553 - DNA, 20 bp, human
gctgctggcgcgccgctagg

SEQ ID NO: 48554 - DNA, 20 bp, human
gctgggaagggaacttataa

SEQ ID NO: 48555 - DNA, 20 bp, human
gggagttcgctaggcaggag

SEQ ID NO: 48556 - DNA, 20 bp, human
gtggaggccccggcagaaga

SEQ ID NO: 48557 - DNA, 20 bp, human
gccttaggcaagatttagag

SEQ ID NO: 48558 - DNA, 20 bp, human
ggccccgcgccctccgacag

SEQ ID NO: 48559 - DNA, 20 bp, human
ggaagaaacagcatcttctg

SEQ ID NO: 48560 - DNA, 20 bp, human
gcggggcctccactgtcgga

SEQ ID NO: 48561 - DNA, 20 bp, human
gcggtatctggaggacctcc

SEQ ID NO: 48562 - DNA, 20 bp, human
gaaggccactcatactccgg

SEQ ID NO: 48563 - DNA, 20 bp, human
ggataccgccggagtatgag

SEQ ID NO: 48564 - DNA, 20 bp, human
ggcaagatttagagaggcaa

SEQ ID NO: 48565 - DNA, 20 bp, human
gtggaggacctccgggaaga

SEQ ID NO: 48566 - DNA, 20 bp, human
gggccggagcagctcccccg

SEQ ID NO: 48567 - DNA, 20 bp, human
gccctgggttcaactaacag

SEQ ID NO: 48568 - DNA, 20 bp, human
gccggaacgaggctgacggt

SEQ ID NO: 48569 - DNA, 20 bp, human
gagcggttgcgctgccccgg

SEQ ID NO: 48570 - DNA, 20 bp, human
ggaagtccactatacccctc

SEQ ID NO: 48571 - DNA, 20 bp, human
gtcagtgggctgagtggtcg

SEQ ID NO: 48572 - DNA, 20 bp, human
gccgctggggccggcctcag

SEQ ID NO: 48573 - DNA, 20 bp, human
ggctacgcaaaggcatccag

SEQ ID NO: 48574 - DNA, 20 bp, human
gtgccccgggggagctgctc

SEQ ID NO: 48575 - DNA, 20 bp, human
gacggttgggagtccgagac

SEQ ID NO: 48576 - DNA, 20 bp, human
gctagccgcgctgttctcgg

SEQ ID NO: 48577 - DNA, 20 bp, human
ggcgcggctaggtgctccag

SEQ ID NO: 48578 - DNA, 20 bp, human
gctggaggccgcgcgcgatg

SEQ ID NO: 48579 - DNA, 20 bp, human
ggcgctgttctcggaggtga

SEQ ID NO: 48580 - DNA, 20 bp, human
gccccaggagtcgcagtcgt

SEQ ID NO: 48581 - DNA, 20 bp, human
gaggagtcgcagtcgtcggt

SEQ ID NO: 48582 - DNA, 20 bp, human
ggcggcggagaacgcggatg

SEQ ID NO: 48583 - DNA, 20 bp, human
ggtctgcggggacctgcccg

SEQ ID NO: 48584 - DNA, 20 bp, human
gctgttctcggaggtgaggg

SEQ ID NO: 48585 - DNA, 20 bp, human
ggcgcggcctccagctgcat

SEQ ID NO: 48586 - DNA, 20 bp, human
ggcacggggacccacaacga

SEQ ID NO: 48587 - DNA, 20 bp, human
gcagtgggagcacttaccag

SEQ ID NO: 48588 - DNA, 20 bp, human
ggttggattctatcctgcaa

SEQ ID NO: 48589 - DNA, 20 bp, human
gcacttaccagaggtcacgg

SEQ ID NO: 48590 - DNA, 20 bp, human
gagaggaggccgggattagt

SEQ ID NO: 48591 - DNA, 20 bp, human
gttgctgggtaaccgcgtca

SEQ ID NO: 48592 - DNA, 20 bp, human
gggtaaccgcgtcagggagt

SEQ ID NO: 48593 - DNA, 20 bp, human
gtagggacagccgtcgttgt

SEQ ID NO: 48594 - DNA, 20 bp, human
gctggtcagaatgagtccat

SEQ ID NO: 48595 - DNA, 20 bp, human
gttgcgactggtaactgaag

SEQ ID NO: 48596 - DNA, 20 bp, human
gagcagaaggagcggaccca

SEQ ID NO: 48597 - DNA, 20 bp, human
gggatagctctgccagatgg

SEQ ID NO: 48598 - DNA, 20 bp, human
gtatgaggcagggtgtacag

SEQ ID NO: 48599 - DNA, 20 bp, human
gggctccggtgctcctcaaa

SEQ ID NO: 48600 - DNA, 20 bp, human
gtccggtgctcctcaaacgg

SEQ ID NO: 48601 - DNA, 20 bp, human
gcagggcagcgaggactaag

SEQ ID NO: 48602 - DNA, 20 bp, human
gagcaccggagccgcgaccg

SEQ ID NO: 48603 - DNA, 20 bp, human
gactagagtggagagtgaca

SEQ ID NO: 48604 - DNA, 20 bp, human
gagcgttcaatccacggtcg

SEQ ID NO: 48605 - DNA, 20 bp, human
gactgtatcaggacctgagt

SEQ ID NO: 48606 - DNA, 20 bp, human
gggaggagcggtaactaccc

SEQ ID NO: 48607 - DNA, 20 bp, human
gggctcaaactcaccggtgc

SEQ ID NO: 48608 - DNA, 20 bp, human
gcagaacgctcggtgagagg

SEQ ID NO: 48609 - DNA, 20 bp, human
gcacgcgcacagggaggcag

SEQ ID NO: 48610 - DNA, 20 bp, human
gaacgctcggtgagaggcgg

SEQ ID NO: 48611 - DNA, 20 bp, human
gcctccaaaagggaaatcgt

SEQ ID NO: 48612 - DNA, 20 bp, human
ggcgccagccaggggactag

SEQ ID NO: 48613 - DNA, 20 bp, human
gccccgagcgagcacggacg

SEQ ID NO: 48614 - DNA, 20 bp, human
gcctgcgcacgcgcacaggg

SEQ ID NO: 48615 - DNA, 20 bp, human
gcgagcgagcacggacgggg

SEQ ID NO: 48616 - DNA, 20 bp, human
gtatgacaaaggaggagaac

SEQ ID NO: 48617 - DNA, 20 bp, human
gtaaatgcttgtttacatgt

SEQ ID NO: 48618 - DNA, 20 bp, human
ggctaactaaagttagctgt

SEQ ID NO: 48619 - DNA, 20 bp, human
gataaatcagaggcaatttg

SEQ ID NO: 48620 - DNA, 20 bp, human
gacacgacaccataaatcag

SEQ ID NO: 48621 - DNA, 20 bp, human
gatatgttttttggaggagg

SEQ ID NO: 48622 - DNA, 20 bp, human
gttgatatgttttttggagg

SEQ ID NO: 48623 - DNA, 20 bp, human
ggagaacaggcaattaaaga

SEQ ID NO: 48624 - DNA, 20 bp, human
gaaagggaattatatgacaa

SEQ ID NO: 48625 - DNA, 20 bp, human
gacatatcaaagatgtccat

SEQ ID NO: 48626 - DNA, 20 bp, human
ggcggagtcgggcccacaag

SEQ ID NO: 48627 - DNA, 20 bp, human
gcgccgccgacgccgcttgt

SEQ ID NO: 48628 - DNA, 20 bp, human
ggaagcagacagagcggagt

SEQ ID NO: 48629 - DNA, 20 bp, human
gtcgggcccacaagcggcgt

SEQ ID NO: 48630 - DNA, 20 bp, human
gcccggcgctcgttcaagga

SEQ ID NO: 48631 - DNA, 20 bp, human
gaggccgagggagacagcga

SEQ ID NO: 48632 - DNA, 20 bp, human
gggccggccgggcagtgctc

SEQ ID NO: 48633 - DNA, 20 bp, human
gggcgctcgttcaaggaggg

SEQ ID NO: 48634 - DNA, 20 bp, human
gctcgttcaaggagggagga

SEQ ID NO: 48635 - DNA, 20 bp, human
gagcccccggcgctcgttca

SEQ ID NO: 48636 - DNA, 20 bp, human
gaggcccacctagagccggg

SEQ ID NO: 48637 - DNA, 20 bp, human
gtgcgcggtgctccacacgc

SEQ ID NO: 48638 - DNA, 20 bp, human
gagaagcgtggagcccccgg

SEQ ID NO: 48639 - DNA, 20 bp, human
ggcgcaggcgcagagtcccc

SEQ ID NO: 48640 - DNA, 20 bp, human
gactgcggccaggattctga

SEQ ID NO: 48641 - DNA, 20 bp, human
ggtgtcagccttacaggtga

SEQ ID NO: 48642 - DNA, 20 bp, human
ggcggccaggattctgaggg

SEQ ID NO: 48643 - DNA, 20 bp, human
gcgcggctgccggctatatc

SEQ ID NO: 48644 - DNA, 20 bp, human
gaccaccagcaaccagcgtg

SEQ ID NO: 48645 - DNA, 20 bp, human
ggagagaagcgtggagcccc

SEQ ID NO: 48646 - DNA, 20 bp, human
gggagccggtggctctagtg

SEQ ID NO: 48647 - DNA, 20 bp, human
ggctccacggacccacggaa

SEQ ID NO: 48648 - DNA, 20 bp, human
gagccggctggctggagagt

SEQ ID NO: 48649 - DNA, 20 bp, human
ggccggtggctctagtgcgg

SEQ ID NO: 48650 - DNA, 20 bp, human
gcggctggctggagagtagg

SEQ ID NO: 48651 - DNA, 20 bp, human
ggcacgggccgggctcccga

SEQ ID NO: 48652 - DNA, 20 bp, human
ggagctccggggaatcagac

SEQ ID NO: 48653 - DNA, 20 bp, human
gggcgggcgggagctacaag

SEQ ID NO: 48654 - DNA, 20 bp, human
gccaggcgtggaagtcggtc

SEQ ID NO: 48655 - DNA, 20 bp, human
gggaagcttccgcaaggaga

SEQ ID NO: 48656 - DNA, 20 bp, human
gcgcgcggccgccaatccga

SEQ ID NO: 48657 - DNA, 20 bp, human
gtatagagtccgggactggt

SEQ ID NO: 48658 - DNA, 20 bp, human
gggccgcaggagggggtcat

SEQ ID NO: 48659 - DNA, 20 bp, human
gagagtccgggactggtcgg

SEQ ID NO: 48660 - DNA, 20 bp, human
gggggacggcgacagcgggt

SEQ ID NO: 48661 - DNA, 20 bp, human
gggtcggcgggccgcaggag

SEQ ID NO: 48662 - DNA, 20 bp, human
gggaggcccgcgaggccgga

SEQ ID NO: 48663 - DNA, 20 bp, human
gctagaagcttctggccgag

SEQ ID NO: 48664 - DNA, 20 bp, human
ggcggccgcgcggtgggagg

SEQ ID NO: 48665 - DNA, 20 bp, human
gacggcgacagcgggtcggc

SEQ ID NO: 48666 - DNA, 20 bp, human
gagtggaccggcagaagagg

SEQ ID NO: 48667 - DNA, 20 bp, human
gagccatggttcctctgtcc

SEQ ID NO: 48668 - DNA, 20 bp, human
gggactcccgggaagtggac

SEQ ID NO: 48669 - DNA, 20 bp, human
gggtgagagaagcccccggt

SEQ ID NO: 48670 - DNA, 20 bp, human
gaccgggactcgggactccc

SEQ ID NO: 48671 - DNA, 20 bp, human
gattggctctcgcctaccgg

SEQ ID NO: 48672 - DNA, 20 bp, human
gggacctaaggccctctcac

SEQ ID NO: 48673 - DNA, 20 bp, human
gggaagtggaccggcagaag

SEQ ID NO: 48674 - DNA, 20 bp, human
gaggccgcctcacaccgggg

SEQ ID NO: 48675 - DNA, 20 bp, human
gggctagctagctgtctctg

SEQ ID NO: 48676 - DNA, 20 bp, human
ggaaccagaacgcggaacca

SEQ ID NO: 48677 - DNA, 20 bp, human
gccatggcggaaccagaacg

SEQ ID NO: 48678 - DNA, 20 bp, human
gcagaacgcggaaccaggga

SEQ ID NO: 48679 - DNA, 20 bp, human
gcgctggcagccgggacgaa

SEQ ID NO: 48680 - DNA, 20 bp, human
gagccgtctggagactcggg

SEQ ID NO: 48681 - DNA, 20 bp, human
gtcatccttgttggattcca

SEQ ID NO: 48682 - DNA, 20 bp, human
ggaacacgggaacggaccga

SEQ ID NO: 48683 - DNA, 20 bp, human
gtgaggtgccggagagactg

SEQ ID NO: 48684 - DNA, 20 bp, human
ggacggctcgcatcccgcag

SEQ ID NO: 48685 - DNA, 20 bp, human
gactggcctgggctaccgaa

SEQ ID NO: 48686 - DNA, 20 bp, human
ggcacccaggagaggatata

SEQ ID NO: 48687 - DNA, 20 bp, human
gcaggtatgcaagaagtgaa

SEQ ID NO: 48688 - DNA, 20 bp, human
gtagtcctcagactctagca

SEQ ID NO: 48689 - DNA, 20 bp, human
gacagccttgctagagtctg

SEQ ID NO: 48690 - DNA, 20 bp, human
ggagcacagagtaataatcc

SEQ ID NO: 48691 - DNA, 20 bp, human
ggagtaataatcctggccca

SEQ ID NO: 48692 - DNA, 20 bp, human
gtggcccatggctggctagc

SEQ ID NO: 48693 - DNA, 20 bp, human
gactgccagctagccagcca

SEQ ID NO: 48694 - DNA, 20 bp, human
gaataatcctggcccatggc

SEQ ID NO: 48695 - DNA, 20 bp, human
gcggttgtcaggagcaacca

SEQ ID NO: 48696 - DNA, 20 bp, human
gccggcagcgcagctaagaa

SEQ ID NO: 48697 - DNA, 20 bp, human
ggctgcgctgccggaggaaa

SEQ ID NO: 48698 - DNA, 20 bp, human
ggcagcgcagctaagaaggg

SEQ ID NO: 48699 - DNA, 20 bp, human
gaccagacaagtctcctcca

SEQ ID NO: 48700 - DNA, 20 bp, human
gtgccggaggaaacggaaga

SEQ ID NO: 48701 - DNA, 20 bp, human
gggcgggcaggcgggtgcag

SEQ ID NO: 48702 - DNA, 20 bp, human
ggtcccgtcttaccacagtg

SEQ ID NO: 48703 - DNA, 20 bp, human
gctccagggagaatgaaacc

SEQ ID NO: 48704 - DNA, 20 bp, human
gtccctggaggagacttgtc

SEQ ID NO: 48705 - DNA, 20 bp, human
gtccaggaggggccgaggtg

SEQ ID NO: 48706 - DNA, 20 bp, human
gccccccgccgggaaccgtc

SEQ ID NO: 48707 - DNA, 20 bp, human
gctgcagaagagaaggagtc

SEQ ID NO: 48708 - DNA, 20 bp, human
gcgtcaggcgggcctccttg

SEQ ID NO: 48709 - DNA, 20 bp, human
gccggtgactaggctccctc

SEQ ID NO: 48710 - DNA, 20 bp, human
ggcgcgcaggcatgcgtcag

SEQ ID NO: 48711 - DNA, 20 bp, human
gcggcctgcgggggcagata

SEQ ID NO: 48712 - DNA, 20 bp, human
gaggcccaggagccctatcg

SEQ ID NO: 48713 - DNA, 20 bp, human
gagcagtccccctccccggg

SEQ ID NO: 48714 - DNA, 20 bp, human
ggagcgccttccgccacccg

SEQ ID NO: 48715 - DNA, 20 bp, human
gtggcaactggtcagtcgtc

SEQ ID NO: 48716 - DNA, 20 bp, human
gaattcagctagctgtctta

SEQ ID NO: 48717 - DNA, 20 bp, human
gtatctgtaagtgagccgtt

SEQ ID NO: 48718 - DNA, 20 bp, human
ggacaagaacaaatctcctc

SEQ ID NO: 48719 - DNA, 20 bp, human
ggtaagtgagccgttgggga

SEQ ID NO: 48720 - DNA, 20 bp, human
gatatatgatcagtttgggg

SEQ ID NO: 48721 - DNA, 20 bp, human
gttgtccggatgaaatttga

SEQ ID NO: 48722 - DNA, 20 bp, human
gaacaaatctcctcaggcag

SEQ ID NO: 48723 - DNA, 20 bp, human
gcctctctctcagcttgtta

SEQ ID NO: 48724 - DNA, 20 bp, human
ggagaaatatatgatcagtt

SEQ ID NO: 48725 - DNA, 20 bp, human
ggcattttgggaattgagaa

SEQ ID NO: 48726 - DNA, 20 bp, human
gaggcgactcctgtcccggg

SEQ ID NO: 48727 - DNA, 20 bp, human
gcgactcctgtcccgggtgg

SEQ ID NO: 48728 - DNA, 20 bp, human
gctgtcccgggtggaggcgg

SEQ ID NO: 48729 - DNA, 20 bp, human
gtgggacactgagggcccgt

SEQ ID NO: 48730 - DNA, 20 bp, human
ggggcaggcgactcctgtcc

SEQ ID NO: 48731 - DNA, 20 bp, human
ggctgtctcacggaccacgg

SEQ ID NO: 48732 - DNA, 20 bp, human
gctcccggtcccgctatcgg

SEQ ID NO: 48733 - DNA, 20 bp, human
gtcggccgggacaaaaggcg

SEQ ID NO: 48734 - DNA, 20 bp, human
ggaccagattgggttctgtg

SEQ ID NO: 48735 - DNA, 20 bp, human
gacaggagtcgcctgcccgc

SEQ ID NO: 48736 - DNA, 20 bp, human
gtggtccttgggccagactg

SEQ ID NO: 48737 - DNA, 20 bp, human
gctctcaggggtcctcagtc

SEQ ID NO: 48738 - DNA, 20 bp, human
ggactgagcgacccacacac

SEQ ID NO: 48739 - DNA, 20 bp, human
ggtgtgggtcgctcagtcca

SEQ ID NO: 48740 - DNA, 20 bp, human
gttcaaggccatcttccggt

SEQ ID NO: 48741 - DNA, 20 bp, human
gtcagcctagccccaagagt

SEQ ID NO: 48742 - DNA, 20 bp, human
ggtacttcaaggccatcttc

SEQ ID NO: 48743 - DNA, 20 bp, human
gattcttgggatcccatcgg

SEQ ID NO: 48744 - DNA, 20 bp, human
ggagaccagtgctggtccag

SEQ ID NO: 48745 - DNA, 20 bp, human
gaaggttgtggcccactctt

SEQ ID NO: 48746 - DNA, 20 bp, human
gccctcaccgaggacagaag

SEQ ID NO: 48747 - DNA, 20 bp, human
gtcggaacagaccctcaccg

SEQ ID NO: 48748 - DNA, 20 bp, human
gacagcgcggggggtgaccg

SEQ ID NO: 48749 - DNA, 20 bp, human
gcggcgtccttgccggaacg

SEQ ID NO: 48750 - DNA, 20 bp, human
ggtcctctgggtcaggtctg

SEQ ID NO: 48751 - DNA, 20 bp, human
gcgcgtctgaaaccagaaac

SEQ ID NO: 48752 - DNA, 20 bp, human
ggccggggaaaggactggac

SEQ ID NO: 48753 - DNA, 20 bp, human
gcaggaaatgcgtcacgcgg

SEQ ID NO: 48754 - DNA, 20 bp, human
gaaccgccgccgcggaggct

SEQ ID NO: 48755 - DNA, 20 bp, human
gtcacgcggcggcggcacgg

SEQ ID NO: 48756 - DNA, 20 bp, human
ggcctgagctgaggaaacca

SEQ ID NO: 48757 - DNA, 20 bp, human
gtgctgggtattgagaaccg

SEQ ID NO: 48758 - DNA, 20 bp, human
ggaagtagctgaggcatacg

SEQ ID NO: 48759 - DNA, 20 bp, human
gaccgtggtttcctcagctc

SEQ ID NO: 48760 - DNA, 20 bp, human
ggcacagaaggattaaacgg

SEQ ID NO: 48761 - DNA, 20 bp, human
gtagttggaagtgggtgtgc

SEQ ID NO: 48762 - DNA, 20 bp, human
gaggacctgttaaatcgtcc

SEQ ID NO: 48763 - DNA, 20 bp, human
gtcataaagtggcacttaaa

SEQ ID NO: 48764 - DNA, 20 bp, human
gcagaaggattaaacggagg

SEQ ID NO: 48765 - DNA, 20 bp, human
ggcttcctggacgatttaac

SEQ ID NO: 48766 - DNA, 20 bp, human
gcagccagcacggtcataca

SEQ ID NO: 48767 - DNA, 20 bp, human
gcccccactgagaggagtgg

SEQ ID NO: 48768 - DNA, 20 bp, human
ggggcccccactgagaggag

SEQ ID NO: 48769 - DNA, 20 bp, human
gtgtggggccaggccagagt

SEQ ID NO: 48770 - DNA, 20 bp, human
ggagtcagacagaacctcat

SEQ ID NO: 48771 - DNA, 20 bp, human
gaccaattctcagggactgg

SEQ ID NO: 48772 - DNA, 20 bp, human
gccctccagtccctgagaat

SEQ ID NO: 48773 - DNA, 20 bp, human
ggagaggagagggaacgtgg

SEQ ID NO: 48774 - DNA, 20 bp, human
gcctgacaataaggaggagg

SEQ ID NO: 48775 - DNA, 20 bp, human
gagtaccaattctcagggac

SEQ ID NO: 48776 - DNA, 20 bp, human
gcgagacccgggctctaatc

SEQ ID NO: 48777 - DNA, 20 bp, human
gggaaggaggagcgctaggt

SEQ ID NO: 48778 - DNA, 20 bp, human
gcggtcgccgcagggacaat

SEQ ID NO: 48779 - DNA, 20 bp, human
ggaggagcagcagtagtcgg

SEQ ID NO: 48780 - DNA, 20 bp, human
gcggtgtacgaccgagatta

SEQ ID NO: 48781 - DNA, 20 bp, human
gtagggcgccgggatcacgt

SEQ ID NO: 48782 - DNA, 20 bp, human
gggccgagagaatggaagaa

SEQ ID NO: 48783 - DNA, 20 bp, human
gcgctggcgaccctgacgat

SEQ ID NO: 48784 - DNA, 20 bp, human
gctggcacgcaccctaatct

SEQ ID NO: 48785 - DNA, 20 bp, human
gacaggcaggaggtagccgc

SEQ ID NO: 48786 - DNA, 20 bp, human
gcagctgtgtgtaggcctgg

SEQ ID NO: 48787 - DNA, 20 bp, human
gggcctacacacagctgtag

SEQ ID NO: 48788 - DNA, 20 bp, human
gcatcgcgctgggctcggaa

SEQ ID NO: 48789 - DNA, 20 bp, human
ggagccggctgccggacggg

SEQ ID NO: 48790 - DNA, 20 bp, human
gacagcagcggcgtccgcgg

SEQ ID NO: 48791 - DNA, 20 bp, human
gggctgccggacgggcgggt

SEQ ID NO: 48792 - DNA, 20 bp, human
gggtcttcggaacgtagcgc

SEQ ID NO: 48793 - DNA, 20 bp, human
gcagctgtagaggcagcgcc

SEQ ID NO: 48794 - DNA, 20 bp, human
ggagttgtttgacttagtgg

SEQ ID NO: 48795 - DNA, 20 bp, human
gttggccgagagctgggacg

SEQ ID NO: 48796 - DNA, 20 bp, human
gcggcgcgtgaggaacctac

SEQ ID NO: 48797 - DNA, 20 bp, human
ggcgcgcggccggtaccggt

SEQ ID NO: 48798 - DNA, 20 bp, human
gaccagcgcgcggccggtac

SEQ ID NO: 48799 - DNA, 20 bp, human
gtaactgagagggaatcgct

SEQ ID NO: 48800 - DNA, 20 bp, human
ggaccccgcgatggcaaggt

SEQ ID NO: 48801 - DNA, 20 bp, human
gcagccgcggcgcacgggat

SEQ ID NO: 48802 - DNA, 20 bp, human
gcctcacgcgccggtctcca

SEQ ID NO: 48803 - DNA, 20 bp, human
ggcggcgcacgggattggtg

SEQ ID NO: 48804 - DNA, 20 bp, human
ggtgaggaacctaccggtac

SEQ ID NO: 48805 - DNA, 20 bp, human
ggccgcgcgctggtagtcgc

SEQ ID NO: 48806 - DNA, 20 bp, human
gtgtccctgacgcggatcac

SEQ ID NO: 48807 - DNA, 20 bp, human
ggggccagtgatccgcgtca

SEQ ID NO: 48808 - DNA, 20 bp, human
gtcagccaggacgagtatgt

SEQ ID NO: 48809 - DNA, 20 bp, human
gcccgaggaggccaccgtag

SEQ ID NO: 48810 - DNA, 20 bp, human
gaccaaggtcaaggccacta

SEQ ID NO: 48811 - DNA, 20 bp, human
gcacgctcaagaggaaacgg

SEQ ID NO: 48812 - DNA, 20 bp, human
gcacgccagccgcccgatgg

SEQ ID NO: 48813 - DNA, 20 bp, human
gaaggttgcgaagatggcga

SEQ ID NO: 48814 - DNA, 20 bp, human
gatggcgacggccttgagcg

SEQ ID NO: 48815 - DNA, 20 bp, human
gcagcggctggacgctctgg

SEQ ID NO: 48816 - DNA, 20 bp, human
gttcttccctcggaaacaag

SEQ ID NO: 48817 - DNA, 20 bp, human
ggcttccgtaaaattcccat

SEQ ID NO: 48818 - DNA, 20 bp, human
gacatctggtgtattgactg

SEQ ID NO: 48819 - DNA, 20 bp, human
gtacttgaatagtgtcctat

SEQ ID NO: 48820 - DNA, 20 bp, human
ggtgtcctatgggaatttta

SEQ ID NO: 48821 - DNA, 20 bp, human
gctgtgcctcttgtttccga

SEQ ID NO: 48822 - DNA, 20 bp, human
gtaatcagtccttcttccct

SEQ ID NO: 48823 - DNA, 20 bp, human
gtatattgtgaaacagcata

SEQ ID NO: 48824 - DNA, 20 bp, human
gaagattactacacattact

SEQ ID NO: 48825 - DNA, 20 bp, human
gttatggtgactcataattg

SEQ ID NO: 48826 - DNA, 20 bp, human
gtcggctttaccttcgcggg

SEQ ID NO: 48827 - DNA, 20 bp, human
gcaccaggaacccgcggcag

SEQ ID NO: 48828 - DNA, 20 bp, human
gccggcggcgggaggagcta

SEQ ID NO: 48829 - DNA, 20 bp, human
gtccagagtgaaactctgag

SEQ ID NO: 48830 - DNA, 20 bp, human
gaaagcctgagcgaagatgg

SEQ ID NO: 48831 - DNA, 20 bp, human
gccgagggcggaacccacaa

SEQ ID NO: 48832 - DNA, 20 bp, human
gatgtcactcaaagccgggg

SEQ ID NO: 48833 - DNA, 20 bp, human
gcgggggggcgtccaacgaa

SEQ ID NO: 48834 - DNA, 20 bp, human
gcgaaggtaaagccgactcc

SEQ ID NO: 48835 - DNA, 20 bp, human
ggaggccgccatcttcgctc

SEQ ID NO: 48836 - DNA, 20 bp, human
gcaggccgggcggctcgagg

SEQ ID NO: 48837 - DNA, 20 bp, human
gagactaacagggaacccac

SEQ ID NO: 48838 - DNA, 20 bp, human
gcggacgtaccgaagaacgg

SEQ ID NO: 48839 - DNA, 20 bp, human
gagacggacgtaccgaagaa

SEQ ID NO: 48840 - DNA, 20 bp, human
gacccaccggctgtgtagaa

SEQ ID NO: 48841 - DNA, 20 bp, human
gcggctctcgtagctcaccc

SEQ ID NO: 48842 - DNA, 20 bp, human
gtcccttctacacagccggt

SEQ ID NO: 48843 - DNA, 20 bp, human
gaggagttaccgccgttctt

SEQ ID NO: 48844 - DNA, 20 bp, human
gggctgtgtagaagggacga

SEQ ID NO: 48845 - DNA, 20 bp, human
ggaagcagagcgtgagcggg

SEQ ID NO: 48846 - DNA, 20 bp, human
gactggagcgatgacaccac

SEQ ID NO: 48847 - DNA, 20 bp, human
gaaggcggcccggagactca

SEQ ID NO: 48848 - DNA, 20 bp, human
gccggagactcaaggcgccg

SEQ ID NO: 48849 - DNA, 20 bp, human
gcgcggcagtgactacgagg

SEQ ID NO: 48850 - DNA, 20 bp, human
gagaccgtgagcgaatgcgg

SEQ ID NO: 48851 - DNA, 20 bp, human
gcgaatgcgggggagtacaa

SEQ ID NO: 48852 - DNA, 20 bp, human
gtctccgggccgccttgcca

SEQ ID NO: 48853 - DNA, 20 bp, human
gactgaacaagtgagcgcta

SEQ ID NO: 48854 - DNA, 20 bp, human
gtacccagctcgggtgagaa

SEQ ID NO: 48855 - DNA, 20 bp, human
gacactccgaaaggagccaa

SEQ ID NO: 48856 - DNA, 20 bp, human
gcccggcccggcgaactaac

SEQ ID NO: 48857 - DNA, 20 bp, human
gtccagctagagggccgaag

SEQ ID NO: 48858 - DNA, 20 bp, human
gagctggcagcctacctgtt

SEQ ID NO: 48859 - DNA, 20 bp, human
ggcccaggcgagcgctggtg

SEQ ID NO: 48860 - DNA, 20 bp, human
gagttaccgggaaagtacac

SEQ ID NO: 48861 - DNA, 20 bp, human
gcggcgaactaactggagca

SEQ ID NO: 48862 - DNA, 20 bp, human
gaggcgagcgctggtgtgga

SEQ ID NO: 48863 - DNA, 20 bp, human
ggaaagtacaccggcccaac

SEQ ID NO: 48864 - DNA, 20 bp, human
gcacggagctgcagccggtt

SEQ ID NO: 48865 - DNA, 20 bp, human
gagatagacggcgccgacct

SEQ ID NO: 48866 - DNA, 20 bp, human
gtccatctgtaagagctcct

SEQ ID NO: 48867 - DNA, 20 bp, human
gatccgtcaggccggaacca

SEQ ID NO: 48868 - DNA, 20 bp, human
gtgcagaagagactgaaatg

SEQ ID NO: 48869 - DNA, 20 bp, human
ggcacctcttgtcacagtca

SEQ ID NO: 48870 - DNA, 20 bp, human
gaaggcagaagcggaaacgg

SEQ ID NO: 48871 - DNA, 20 bp, human
gaccaaggagctcttacaga

SEQ ID NO: 48872 - DNA, 20 bp, human
gctgccttgactgtgacaag

SEQ ID NO: 48873 - DNA, 20 bp, human
gggaccgtccaggaaatgtc

SEQ ID NO: 48874 - DNA, 20 bp, human
gccgcggcctctaggagaca

SEQ ID NO: 48875 - DNA, 20 bp, human
gcacgcgcgcttagactctt

SEQ ID NO: 48876 - DNA, 20 bp, human
gccagttaggcgaaagataa

SEQ ID NO: 48877 - DNA, 20 bp, human
gccgaggctgaaagagaagg

SEQ ID NO: 48878 - DNA, 20 bp, human
gtgctgattgggaaccgata

SEQ ID NO: 48879 - DNA, 20 bp, human
gtgattgggaaccgatatgg

SEQ ID NO: 48880 - DNA, 20 bp, human
ggggccaggttagcaagctg

SEQ ID NO: 48881 - DNA, 20 bp, human
gccgatatggcggcgactct

SEQ ID NO: 48882 - DNA, 20 bp, human
gctttcagcctcgggcacgg

SEQ ID NO: 48883 - DNA, 20 bp, human
gtcagcctcgggcacggggg

SEQ ID NO: 48884 - DNA, 20 bp, human
gagagaccgcagcaccccac

SEQ ID NO: 48885 - DNA, 20 bp, human
gaaggtcaggtggcccagtt

SEQ ID NO: 48886 - DNA, 20 bp, human
gggcgcctgtgcttgaggtt

SEQ ID NO: 48887 - DNA, 20 bp, human
gtcatggactcggagattag

SEQ ID NO: 48888 - DNA, 20 bp, human
gggaactcctgtaaggtcag

SEQ ID NO: 48889 - DNA, 20 bp, human
gggatgagccgtgctcccgg

SEQ ID NO: 48890 - DNA, 20 bp, human
gttgcgtcgctctctggtaa

SEQ ID NO: 48891 - DNA, 20 bp, human
gcggaggtcgccaagaagac

SEQ ID NO: 48892 - DNA, 20 bp, human
gcttgcctggaactcctgta

SEQ ID NO: 48893 - DNA, 20 bp, human
ggtgctgtgaagatgtgtta

SEQ ID NO: 48894 - DNA, 20 bp, human
gtgaagatgtgttagggcaa

SEQ ID NO: 48895 - DNA, 20 bp, human
gcccgcccgcagtcgcacta

SEQ ID NO: 48896 - DNA, 20 bp, human
gggatggatctttcgtggtg

SEQ ID NO: 48897 - DNA, 20 bp, human
gctctaagacgcccaggaac

SEQ ID NO: 48898 - DNA, 20 bp, human
gcctgggcgtcttagagcca

SEQ ID NO: 48899 - DNA, 20 bp, human
gttgggtgggcacttaccag

SEQ ID NO: 48900 - DNA, 20 bp, human
gagtcagcagcggcgagagg

SEQ ID NO: 48901 - DNA, 20 bp, human
gggctagtcgccagggtcaa

SEQ ID NO: 48902 - DNA, 20 bp, human
gcctccttccttctaatcta

SEQ ID NO: 48903 - DNA, 20 bp, human
ggtgagaaggaaccgaggtt

SEQ ID NO: 48904 - DNA, 20 bp, human
gctaccctagattagaagga

SEQ ID NO: 48905 - DNA, 20 bp, human
gccatcccggaagtgcttac

SEQ ID NO: 48906 - DNA, 20 bp, human
gcggtggtgtaggtcagtga

SEQ ID NO: 48907 - DNA, 20 bp, human
gcggcagacgacgcaggctg

SEQ ID NO: 48908 - DNA, 20 bp, human
gggcggccgccgcttcgcat

SEQ ID NO: 48909 - DNA, 20 bp, human
gggtcagtgaaggcgcgcgg

SEQ ID NO: 48910 - DNA, 20 bp, human
gtgtgagccggggtgcgcca

SEQ ID NO: 48911 - DNA, 20 bp, human
gtcgcgggtatgaggagatg

SEQ ID NO: 48912 - DNA, 20 bp, human
gggcggggcaaggagctcct

SEQ ID NO: 48913 - DNA, 20 bp, human
gctccgcggagtccgcccgg

SEQ ID NO: 48914 - DNA, 20 bp, human
gtcgcccaccgagacgggca

SEQ ID NO: 48915 - DNA, 20 bp, human
gcccaccgagacgggcaggg

SEQ ID NO: 48916 - DNA, 20 bp, human
gtgaggagcctcccaatcca

SEQ ID NO: 48917 - DNA, 20 bp, human
gcacctgagcctgagacctg

SEQ ID NO: 48918 - DNA, 20 bp, human
gcctcgcgggtgtcacctcc

SEQ ID NO: 48919 - DNA, 20 bp, human
gcctctccaggccgagatga

SEQ ID NO: 48920 - DNA, 20 bp, human
gctccgagccttccagttag

SEQ ID NO: 48921 - DNA, 20 bp, human
gagcagagcccctaactgga

SEQ ID NO: 48922 - DNA, 20 bp, human
gaggcaagcaagccctgtgg

SEQ ID NO: 48923 - DNA, 20 bp, human
ggacagagcagccctggatt

SEQ ID NO: 48924 - DNA, 20 bp, human
gggtgtcacctcccggcagt

SEQ ID NO: 48925 - DNA, 20 bp, human
gagggctgagggcgtttgga

SEQ ID NO: 48926 - DNA, 20 bp, human
ggtcggccagaactccggac

SEQ ID NO: 48927 - DNA, 20 bp, human
ggcggaagaagaagccggtc

SEQ ID NO: 48928 - DNA, 20 bp, human
gccgacagcaggcgaggagt

SEQ ID NO: 48929 - DNA, 20 bp, human
ggacctacctaacttcacat

SEQ ID NO: 48930 - DNA, 20 bp, human
ggcagcgcctatgtgaagtt

SEQ ID NO: 48931 - DNA, 20 bp, human
gagaagccggtccggagttc

SEQ ID NO: 48932 - DNA, 20 bp, human
gtctggagcgtggaagactg

SEQ ID NO: 48933 - DNA, 20 bp, human
gaccaggagccccagaaatc

SEQ ID NO: 48934 - DNA, 20 bp, human
gcgcctatgtgaagttaggt

SEQ ID NO: 48935 - DNA, 20 bp, human
gtcggaacagtgacttccgg

SEQ ID NO: 48936 - DNA, 20 bp, human
gcccagccgggagagagcag

SEQ ID NO: 48937 - DNA, 20 bp, human
ggagtgctgcagaatcgctg

SEQ ID NO: 48938 - DNA, 20 bp, human
gtgctgcagaatcgctgggg

SEQ ID NO: 48939 - DNA, 20 bp, human
gcgtgtagctggggccagac

SEQ ID NO: 48940 - DNA, 20 bp, human
gaccgcctacgagacactca

SEQ ID NO: 48941 - DNA, 20 bp, human
ggcgcccggctagtcccgtc

SEQ ID NO: 48942 - DNA, 20 bp, human
gcggagacgagggccccggg

SEQ ID NO: 48943 - DNA, 20 bp, human
gactggccgcgggaagccca

SEQ ID NO: 48944 - DNA, 20 bp, human
gacgccgcagagcgccgagg

SEQ ID NO: 48945 - DNA, 20 bp, human
gtggtggaggggctctactg

SEQ ID NO: 48946 - DNA, 20 bp, human
gcccagccgggagagagcag

SEQ ID NO: 48947 - DNA, 20 bp, human
ggagtgctgcagaatcgctg

SEQ ID NO: 48948 - DNA, 20 bp, human
gtgctgcagaatcgctgggg

SEQ ID NO: 48949 - DNA, 20 bp, human
gcgtgtagctggggccagac

SEQ ID NO: 48950 - DNA, 20 bp, human
gaccgcctacgagacactca

SEQ ID NO: 48951 - DNA, 20 bp, human
ggcgcccggctagtcccgtc

SEQ ID NO: 48952 - DNA, 20 bp, human
gcggagacgagggccccggg

SEQ ID NO: 48953 - DNA, 20 bp, human
gactggccgcgggaagccca

SEQ ID NO: 48954 - DNA, 20 bp, human
gacgccgcagagcgccgagg

SEQ ID NO: 48955 - DNA, 20 bp, human
gtggtggaggggctctactg

SEQ ID NO: 48956 - DNA, 20 bp, human
gggtgcacaagaagagaccg

SEQ ID NO: 48957 - DNA, 20 bp, human
ggtccgggaccgggagatgg

SEQ ID NO: 48958 - DNA, 20 bp, human
gaggccgacggcccctcatg

SEQ ID NO: 48959 - DNA, 20 bp, human
gggacggccccctagaacgc

SEQ ID NO: 48960 - DNA, 20 bp, human
ggcacaagaagagaccgagg

SEQ ID NO: 48961 - DNA, 20 bp, human
ggaacgcgggcaaggtatct

SEQ ID NO: 48962 - DNA, 20 bp, human
gcatggccctggctctctcg

SEQ ID NO: 48963 - DNA, 20 bp, human
gcgggccccaggctgttgag

SEQ ID NO: 48964 - DNA, 20 bp, human
gggaggccaacatgccgaag

SEQ ID NO: 48965 - DNA, 20 bp, human
ggagacccgggcctgctcgg

SEQ ID NO: 48966 - DNA, 20 bp, human
gcagccggctcccagaccgt

SEQ ID NO: 48967 - DNA, 20 bp, human
ggtcgggacgaaggctcccg

SEQ ID NO: 48968 - DNA, 20 bp, human
gcgattgcctagaaaatagg

SEQ ID NO: 48969 - DNA, 20 bp, human
gactttaccccggaggaccc

SEQ ID NO: 48970 - DNA, 20 bp, human
gtctaggcaatcggtgccaa

SEQ ID NO: 48971 - DNA, 20 bp, human
gtgccctgcctgggtcctcc

SEQ ID NO: 48972 - DNA, 20 bp, human
gggaaggagctatctgccag

SEQ ID NO: 48973 - DNA, 20 bp, human
ggagggacacccgcagtgaa

SEQ ID NO: 48974 - DNA, 20 bp, human
gcctcacctgcgcagacctg

SEQ ID NO: 48975 - DNA, 20 bp, human
gggagccttcgtcccgaccg

SEQ ID NO: 48976 - DNA, 20 bp, human
gaagcgcggggggcctggtc

SEQ ID NO: 48977 - DNA, 20 bp, human
gctgggctccagagccactg

SEQ ID NO: 48978 - DNA, 20 bp, human
gcgcgagtgaagaggaggaa

SEQ ID NO: 48979 - DNA, 20 bp, human
gcgagggctcgcgagtgaag

SEQ ID NO: 48980 - DNA, 20 bp, human
gccgccgtcggctctcgctc

SEQ ID NO: 48981 - DNA, 20 bp, human
gcctgccccggccaggaagt

SEQ ID NO: 48982 - DNA, 20 bp, human
gagcagaggaaggcagcggt

SEQ ID NO: 48983 - DNA, 20 bp, human
gagctgcgcccgcccgccgt

SEQ ID NO: 48984 - DNA, 20 bp, human
gccagcacgcgccggcgctc

SEQ ID NO: 48985 - DNA, 20 bp, human
ggggctcgcgagtgaagagg

SEQ ID NO: 48986 - DNA, 20 bp, human
ggggcctgcagcaacctcca

SEQ ID NO: 48987 - DNA, 20 bp, human
gtcaatggccaagggttcag

SEQ ID NO: 48988 - DNA, 20 bp, human
gggaggcccgagaaccgtcg

SEQ ID NO: 48989 - DNA, 20 bp, human
gagccatgcgctggcgatgg

SEQ ID NO: 48990 - DNA, 20 bp, human
ggaaccgtcgtgggtccgag

SEQ ID NO: 48991 - DNA, 20 bp, human
gtgggaggatacccgagaca

SEQ ID NO: 48992 - DNA, 20 bp, human
ggcagcggctgttaccttgg

SEQ ID NO: 48993 - DNA, 20 bp, human
gccgtcgtgggtccgagagg

SEQ ID NO: 48994 - DNA, 20 bp, human
gccgtagtgggcctggtaga

SEQ ID NO: 48995 - DNA, 20 bp, human
gagagaaaccggccaatgag

SEQ ID NO: 48996 - DNA, 20 bp, human
gctagacttcaagcacccgg

SEQ ID NO: 48997 - DNA, 20 bp, human
ggtccccaagttccctgggt

SEQ ID NO: 48998 - DNA, 20 bp, human
gtcccgtccccaagttccct

SEQ ID NO: 48999 - DNA, 20 bp, human
gagcgcattggaccaggatg

SEQ ID NO: 49000 - DNA, 20 bp, human
gggccggcccggttgttcaa

SEQ ID NO: 49001 - DNA, 20 bp, human
ggttcccacccagggaactt

SEQ ID NO: 49002 - DNA, 20 bp, human
gccctcccggctcctcggag

SEQ ID NO: 49003 - DNA, 20 bp, human
gaagaccccgttcccaccca

SEQ ID NO: 49004 - DNA, 20 bp, human
ggccgctccgaggagccggg

SEQ ID NO: 49005 - DNA, 20 bp, human
gtgaagcaggcccggagagg

SEQ ID NO: 49006 - DNA, 20 bp, human
ggagggcgcgggtgcggcac

SEQ ID NO: 49007 - DNA, 20 bp, human
ggcctgcccgggcctgacgt

SEQ ID NO: 49008 - DNA, 20 bp, human
ggccgggggtctgagcaccg

SEQ ID NO: 49009 - DNA, 20 bp, human
gcgcgctcccggaaggacgt

SEQ ID NO: 49010 - DNA, 20 bp, human
ggggtctgagcaccgtggtg

SEQ ID NO: 49011 - DNA, 20 bp, human
gcggcgcgcgcgctcccgga

SEQ ID NO: 49012 - DNA, 20 bp, human
gactccagagccggaaatgg

SEQ ID NO: 49013 - DNA, 20 bp, human
gaggtgagctcgctgcgggt

SEQ ID NO: 49014 - DNA, 20 bp, human
gggctccgctccccgattcg

SEQ ID NO: 49015 - DNA, 20 bp, human
gccagcagcgccgcgaatcg

SEQ ID NO: 49016 - DNA, 20 bp, human
gcaaggtgggacactactgg

SEQ ID NO: 49017 - DNA, 20 bp, human
gagccaaggtgggacactac

SEQ ID NO: 49018 - DNA, 20 bp, human
gagctcctccccggatgaca

SEQ ID NO: 49019 - DNA, 20 bp, human
gtgccaagtacctgaactgg

SEQ ID NO: 49020 - DNA, 20 bp, human
ggcagttactgatatagcca

SEQ ID NO: 49021 - DNA, 20 bp, human
gttactgatatagccaaggt

SEQ ID NO: 49022 - DNA, 20 bp, human
gactactggagggagctaga

SEQ ID NO: 49023 - DNA, 20 bp, human
gtactctaccctgtcatccg

SEQ ID NO: 49024 - DNA, 20 bp, human
gagtacctgaactggaggca

SEQ ID NO: 49025 - DNA, 20 bp, human
ggggaaggagaaataacagg

SEQ ID NO: 49026 - DNA, 20 bp, human
gtgaaacggtggaacaggta

SEQ ID NO: 49027 - DNA, 20 bp, human
gtgctttgaaacggtggaac

SEQ ID NO: 49028 - DNA, 20 bp, human
ggctgtttgctttgaaacgg

SEQ ID NO: 49029 - DNA, 20 bp, human
gtcaggttgccatttatata

SEQ ID NO: 49030 - DNA, 20 bp, human
gcgattctgtgtccgcaaac

SEQ ID NO: 49031 - DNA, 20 bp, human
gggttccgggttccaggaac

SEQ ID NO: 49032 - DNA, 20 bp, human
gttgctgttttcaactggtc

SEQ ID NO: 49033 - DNA, 20 bp, human
ggcactaatccttatataaa

SEQ ID NO: 49034 - DNA, 20 bp, human
gagtacctgttcctggaacc

SEQ ID NO: 49035 - DNA, 20 bp, human
gataaatggcaacctgaaga

SEQ ID NO: 49036 - DNA, 20 bp, human
ggcgtcgacgctgagggtct

SEQ ID NO: 49037 - DNA, 20 bp, human
gttgagagcaggagactgga

SEQ ID NO: 49038 - DNA, 20 bp, human
ggtgtcctagagcctggcgg

SEQ ID NO: 49039 - DNA, 20 bp, human
ggtcaactgctggacccggc

SEQ ID NO: 49040 - DNA, 20 bp, human
gcgcagtcaactgctggacc

SEQ ID NO: 49041 - DNA, 20 bp, human
gcaagtgtcctagagcctgg

SEQ ID NO: 49042 - DNA, 20 bp, human
gggagggaagaagcaagtcc

SEQ ID NO: 49043 - DNA, 20 bp, human
gtcgttctcttaagccaggt

SEQ ID NO: 49044 - DNA, 20 bp, human
gagcaaggcaaggagctcaa

SEQ ID NO: 49045 - DNA, 20 bp, human
gagagcagggtagacgcctg

SEQ ID NO: 49046 - DNA, 20 bp, human
ggaagcgcaggggctgatgt

SEQ ID NO: 49047 - DNA, 20 bp, human
gggcgcgcatctcccagcag

SEQ ID NO: 49048 - DNA, 20 bp, human
ggcacctggcagacgcgcgg

SEQ ID NO: 49049 - DNA, 20 bp, human
gggacaagctaacctcagtg

SEQ ID NO: 49050 - DNA, 20 bp, human
ggaccgctggggaagcgcag

SEQ ID NO: 49051 - DNA, 20 bp, human
gcgatgggcgccactgagaa

SEQ ID NO: 49052 - DNA, 20 bp, human
ggtcgggacctgttaccctg

SEQ ID NO: 49053 - DNA, 20 bp, human
ggagggcgcggcgcaccgat

SEQ ID NO: 49054 - DNA, 20 bp, human
ggacgcccgaacccgaccct

SEQ ID NO: 49055 - DNA, 20 bp, human
ggctgggagatgcgcgccgg

SEQ ID NO: 49056 - DNA, 20 bp, human
gggtcccggcggtaagatgg

SEQ ID NO: 49057 - DNA, 20 bp, human
ggctgccgcggagtgcgatg

SEQ ID NO: 49058 - DNA, 20 bp, human
gggagaggccgagtctccga

SEQ ID NO: 49059 - DNA, 20 bp, human
ggatcacccaggaaggacag

SEQ ID NO: 49060 - DNA, 20 bp, human
ggcggagtgcgatgtggtaa

SEQ ID NO: 49061 - DNA, 20 bp, human
gtctccgagggcaatttcag

SEQ ID NO: 49062 - DNA, 20 bp, human
gccgcctggcgtaggagctg

SEQ ID NO: 49063 - DNA, 20 bp, human
gccggatggaccccctgaag

SEQ ID NO: 49064 - DNA, 20 bp, human
ggaggtctggtgcgaggtgg

SEQ ID NO: 49065 - DNA, 20 bp, human
ggggggtcgggggcgatgta

SEQ ID NO: 49066 - DNA, 20 bp, human
ggagagagcgggacttcagg

SEQ ID NO: 49067 - DNA, 20 bp, human
ggcgcagaagggtcacgtgg

SEQ ID NO: 49068 - DNA, 20 bp, human
ggcgggacttcaggcggcgg

SEQ ID NO: 49069 - DNA, 20 bp, human
ggctgctgggagatcccccg

SEQ ID NO: 49070 - DNA, 20 bp, human
ggcagagtgccccaagtccg

SEQ ID NO: 49071 - DNA, 20 bp, human
gcctgcgcagaagggtcacg

SEQ ID NO: 49072 - DNA, 20 bp, human
gagaaggctaagtcactccc

SEQ ID NO: 49073 - DNA, 20 bp, human
gggactaagaaacgtctcgg

SEQ ID NO: 49074 - DNA, 20 bp, human
ggactgaaggaatcgcccaa

SEQ ID NO: 49075 - DNA, 20 bp, human
gaacgtctcgggggccaaga

SEQ ID NO: 49076 - DNA, 20 bp, human
gtctcccggttatgccctcc

SEQ ID NO: 49077 - DNA, 20 bp, human
gctttccaggagggcataac

SEQ ID NO: 49078 - DNA, 20 bp, human
gccgggcggagatacgaccc

SEQ ID NO: 49079 - DNA, 20 bp, human
ggcgaaaaagaagcagtcct

SEQ ID NO: 49080 - DNA, 20 bp, human
gggcggagatacgaccccgg

SEQ ID NO: 49081 - DNA, 20 bp, human
gggtccagcagccccatgcc

SEQ ID NO: 49082 - DNA, 20 bp, human
gagcagtcctgggttgtacc

SEQ ID NO: 49083 - DNA, 20 bp, human
ggctgcgccgggtacaaccc

SEQ ID NO: 49084 - DNA, 20 bp, human
gcccagcacccggtaaaggt

SEQ ID NO: 49085 - DNA, 20 bp, human
ggctcctcccaccgaaacgg

SEQ ID NO: 49086 - DNA, 20 bp, human
gacagtagcaaccgccggaa

SEQ ID NO: 49087 - DNA, 20 bp, human
gcacagaccacccccggcca

SEQ ID NO: 49088 - DNA, 20 bp, human
ggggaggggctggttaccag

SEQ ID NO: 49089 - DNA, 20 bp, human
gggcaacctgggtacatcac

SEQ ID NO: 49090 - DNA, 20 bp, human
gcctccctgcatctcgacgg

SEQ ID NO: 49091 - DNA, 20 bp, human
gccctcgtccggaaaagggt

SEQ ID NO: 49092 - DNA, 20 bp, human
gcggacgaggggagaataag

SEQ ID NO: 49093 - DNA, 20 bp, human
gaaggtactcaccattccgg

SEQ ID NO: 49094 - DNA, 20 bp, human
gcagtgacagtagcaaccgc

SEQ ID NO: 49095 - DNA, 20 bp, human
gcgaaaggtactcaccattc

SEQ ID NO: 49096 - DNA, 20 bp, human
gcaacgtccggtgagggggc

SEQ ID NO: 49097 - DNA, 20 bp, human
gctccggcccccgcaggagc

SEQ ID NO: 49098 - DNA, 20 bp, human
gagccagcgaacccccgcca

SEQ ID NO: 49099 - DNA, 20 bp, human
gcgctccttgacaaccctgg

SEQ ID NO: 49100 - DNA, 20 bp, human
gtccttgacaaccctggcgg

SEQ ID NO: 49101 - DNA, 20 bp, human
gttgaggatgggaagacctg

SEQ ID NO: 49102 - DNA, 20 bp, human
gtcgtcaacgtccggtgagg

SEQ ID NO: 49103 - DNA, 20 bp, human
ggcgaaaggtcgagggatca

SEQ ID NO: 49104 - DNA, 20 bp, human
ggacgcgggaccacgaagct

SEQ ID NO: 49105 - DNA, 20 bp, human
gctcgcaggtcccgaagtgg

SEQ ID NO: 49106 - DNA, 20 bp, human
ggtcacagtggaaggatcat

SEQ ID NO: 49107 - DNA, 20 bp, human
gtggggcttaccctgaccag

SEQ ID NO: 49108 - DNA, 20 bp, human
ggagagcagaggttagcttc

SEQ ID NO: 49109 - DNA, 20 bp, human
gggctcagacctagacatct

SEQ ID NO: 49110 - DNA, 20 bp, human
gtcagggtaagccccagggg

SEQ ID NO: 49111 - DNA, 20 bp, human
gtcccttgcaggatggcagt

SEQ ID NO: 49112 - DNA, 20 bp, human
ggagcttgtcccttgcagga

SEQ ID NO: 49113 - DNA, 20 bp, human
ggagtaggtggcccaatact

SEQ ID NO: 49114 - DNA, 20 bp, human
ggttttaagaacatgatcgt

SEQ ID NO: 49115 - DNA, 20 bp, human
gcagaccttccctctggtca

SEQ ID NO: 49116 - DNA, 20 bp, human
ggagtctgcgggcggaatca

SEQ ID NO: 49117 - DNA, 20 bp, human
gtctgcgggcggaatcatgg

SEQ ID NO: 49118 - DNA, 20 bp, human
gcggcaaacaaggcccacac

SEQ ID NO: 49119 - DNA, 20 bp, human
ggcgggcggaatcatggcgg

SEQ ID NO: 49120 - DNA, 20 bp, human
gggtccaagaacagatgact

SEQ ID NO: 49121 - DNA, 20 bp, human
gggagggtcaggaatctcaa

SEQ ID NO: 49122 - DNA, 20 bp, human
ggcagctgccctgtccagtg

SEQ ID NO: 49123 - DNA, 20 bp, human
gagccccaaggtaaagacgg

SEQ ID NO: 49124 - DNA, 20 bp, human
gttccggctcaccagcactg

SEQ ID NO: 49125 - DNA, 20 bp, human
ggagaagaccgacccaaagt

SEQ ID NO: 49126 - DNA, 20 bp, human
gtgggctccggatcctgcac

SEQ ID NO: 49127 - DNA, 20 bp, human
ggcacaggcagtgcgtgtct

SEQ ID NO: 49128 - DNA, 20 bp, human
ggcactgcctgtgcaggatc

SEQ ID NO: 49129 - DNA, 20 bp, human
gaacagctggcaccacgtag

SEQ ID NO: 49130 - DNA, 20 bp, human
gtggtggagctcaaggtcag

SEQ ID NO: 49131 - DNA, 20 bp, human
gtgactcggggtcctctacg

SEQ ID NO: 49132 - DNA, 20 bp, human
ggtcagggggacgcaggcgg

SEQ ID NO: 49133 - DNA, 20 bp, human
gatctcaggtgagcaccagg

SEQ ID NO: 49134 - DNA, 20 bp, human
gcaccaggtggagtgcctct

SEQ ID NO: 49135 - DNA, 20 bp, human
gaggctccagcgtccctccc

SEQ ID NO: 49136 - DNA, 20 bp, human
gagcagctcctgcctgaata

SEQ ID NO: 49137 - DNA, 20 bp, human
gctcctgcctgaatagggct

SEQ ID NO: 49138 - DNA, 20 bp, human
gctcctagccctattcaggc

SEQ ID NO: 49139 - DNA, 20 bp, human
gtcccctcctagccctattc

SEQ ID NO: 49140 - DNA, 20 bp, human
gagtgacagagcaggtggtc

SEQ ID NO: 49141 - DNA, 20 bp, human
gtatcccagaataggcacca

SEQ ID NO: 49142 - DNA, 20 bp, human
ggcgtcagggacccccatga

SEQ ID NO: 49143 - DNA, 20 bp, human
gccagaataggcaccagggt

SEQ ID NO: 49144 - DNA, 20 bp, human
gtgagccacccggccaggaa

SEQ ID NO: 49145 - DNA, 20 bp, human
gtgttgcggtgtctctctcc

SEQ ID NO: 49146 - DNA, 20 bp, human
ggggctcgcccgctaggtcg

SEQ ID NO: 49147 - DNA, 20 bp, human
gaaggagaggtcaggcgctc

SEQ ID NO: 49148 - DNA, 20 bp, human
gtactctggcggggaaggag

SEQ ID NO: 49149 - DNA, 20 bp, human
gcgccgcggccccgacctag

SEQ ID NO: 49150 - DNA, 20 bp, human
gcggccggaggtgggactta

SEQ ID NO: 49151 - DNA, 20 bp, human
gcggaggtgggacttagggt

SEQ ID NO: 49152 - DNA, 20 bp, human
gccgcgcacggacggacagg

SEQ ID NO: 49153 - DNA, 20 bp, human
gacggccacttcacgtgcag

SEQ ID NO: 49154 - DNA, 20 bp, human
gccgtgcgcgggccagtcag

SEQ ID NO: 49155 - DNA, 20 bp, human
gccagggtccaggtgagcgg

SEQ ID NO: 49156 - DNA, 20 bp, human
gcgaggctcagagatcctag

SEQ ID NO: 49157 - DNA, 20 bp, human
gctgcgggcgtgtccgacac

SEQ ID NO: 49158 - DNA, 20 bp, human
gggaccgccgcgcttcgcat

SEQ ID NO: 49159 - DNA, 20 bp, human
ggggagcctgcagaacgcag

SEQ ID NO: 49160 - DNA, 20 bp, human
gcctagggggatggggatcc

SEQ ID NO: 49161 - DNA, 20 bp, human
gccgcgcagtgagaaggcag

SEQ ID NO: 49162 - DNA, 20 bp, human
gggctctgctggccgcactc

SEQ ID NO: 49163 - DNA, 20 bp, human
ggatcccgggtccaggctgc

SEQ ID NO: 49164 - DNA, 20 bp, human
gggatggggatcccgggtcc

SEQ ID NO: 49165 - DNA, 20 bp, human
gctccctctggcagtagctc

SEQ ID NO: 49166 - DNA, 20 bp, human
gagcagcgccaggatgtcac

SEQ ID NO: 49167 - DNA, 20 bp, human
ggccagctcccgtgacatcc

SEQ ID NO: 49168 - DNA, 20 bp, human
gctggggggactacaggagt

SEQ ID NO: 49169 - DNA, 20 bp, human
gtccctccagggttgctggg

SEQ ID NO: 49170 - DNA, 20 bp, human
ggatcctcctcccaggaaag

SEQ ID NO: 49171 - DNA, 20 bp, human
gtcagtggagcctgcggaag

SEQ ID NO: 49172 - DNA, 20 bp, human
gcttaaagttggcccttagg

SEQ ID NO: 49173 - DNA, 20 bp, human
gtgccgtcatcttaaaacag

SEQ ID NO: 49174 - DNA, 20 bp, human
gcattatacgttccagataa

SEQ ID NO: 49175 - DNA, 20 bp, human
ggaaggtgagcccctttcct

SEQ ID NO: 49176 - DNA, 20 bp, human
gctacctcctcggggaaccc

SEQ ID NO: 49177 - DNA, 20 bp, human
ggggcgctgggttacatcag

SEQ ID NO: 49178 - DNA, 20 bp, human
ggcaagtttagggaagtgaa

SEQ ID NO: 49179 - DNA, 20 bp, human
gatctggacgagagctccgg

SEQ ID NO: 49180 - DNA, 20 bp, human
gaatctgtgtcgggactgcg

SEQ ID NO: 49181 - DNA, 20 bp, human
gcggttcccaggcaagttta

SEQ ID NO: 49182 - DNA, 20 bp, human
gaggcgccaggtgccagtcc

SEQ ID NO: 49183 - DNA, 20 bp, human
ggctcttagagggtccgggg

SEQ ID NO: 49184 - DNA, 20 bp, human
gggaggctggcgggacggca

SEQ ID NO: 49185 - DNA, 20 bp, human
ggctccggaggctggcggga

SEQ ID NO: 49186 - DNA, 20 bp, human
gaatccaggtactgatactg

SEQ ID NO: 49187 - DNA, 20 bp, human
gcctatctaatatacaatga

SEQ ID NO: 49188 - DNA, 20 bp, human
gtggggaagctgcctattag

SEQ ID NO: 49189 - DNA, 20 bp, human
gtgaattacagcagaaagta

SEQ ID NO: 49190 - DNA, 20 bp, human
gtttgcagcagcaggaatcc

SEQ ID NO: 49191 - DNA, 20 bp, human
gcacaggcttcatattgatg

SEQ ID NO: 49192 - DNA, 20 bp, human
ggcctgtgacatgaaagaca

SEQ ID NO: 49193 - DNA, 20 bp, human
gactctgcaggaatatatta

SEQ ID NO: 49194 - DNA, 20 bp, human
gtgtatgacttctatatcac

SEQ ID NO: 49195 - DNA, 20 bp, human
gtagctggtagaaatgttgt

SEQ ID NO: 49196 - DNA, 20 bp, human
gggtgactgcgctaacaagg

SEQ ID NO: 49197 - DNA, 20 bp, human
gttataaagagggtacgagg

SEQ ID NO: 49198 - DNA, 20 bp, human
gcagtccaagcgggattgtg

SEQ ID NO: 49199 - DNA, 20 bp, human
gagcgggattgtgaggtaag

SEQ ID NO: 49200 - DNA, 20 bp, human
ggaagcttccagaggccggt

SEQ ID NO: 49201 - DNA, 20 bp, human
gtgtagccggacaggcggag

SEQ ID NO: 49202 - DNA, 20 bp, human
ggaccccagtaccacaggag

SEQ ID NO: 49203 - DNA, 20 bp, human
gctgggactaccgtacctgg

SEQ ID NO: 49204 - DNA, 20 bp, human
gagggagggggccaatctca

SEQ ID NO: 49205 - DNA, 20 bp, human
gccagtaccacaggagaggt

SEQ ID NO: 49206 - DNA, 20 bp, human
gagagctgcgagagcgacgg

SEQ ID NO: 49207 - DNA, 20 bp, human
ggctgcgagagcgacggtgg

SEQ ID NO: 49208 - DNA, 20 bp, human
gacgagagctgcgagagcga

SEQ ID NO: 49209 - DNA, 20 bp, human
gagccaggacgcagtgacgg

SEQ ID NO: 49210 - DNA, 20 bp, human
gacggcccgggcgcagacag

SEQ ID NO: 49211 - DNA, 20 bp, human
ggtcaggcgtgcccattgtc

SEQ ID NO: 49212 - DNA, 20 bp, human
gcctgccccgccgggatctc

SEQ ID NO: 49213 - DNA, 20 bp, human
ggcgccaactgccaggtgag

SEQ ID NO: 49214 - DNA, 20 bp, human
gcagttggcgccggagatcc

SEQ ID NO: 49215 - DNA, 20 bp, human
gcaatgggcacgcctgacac

SEQ ID NO: 49216 - DNA, 20 bp, human
gtctgtgggagggggtccta

SEQ ID NO: 49217 - DNA, 20 bp, human
gctgtgggcgaagacgtcat

SEQ ID NO: 49218 - DNA, 20 bp, human
gattagggtgagcctcagac

SEQ ID NO: 49219 - DNA, 20 bp, human
gcttcgcccacagcctaagg

SEQ ID NO: 49220 - DNA, 20 bp, human
gaagaggaggcggactctgt

SEQ ID NO: 49221 - DNA, 20 bp, human
ggacgtgcaatcacctgaag

SEQ ID NO: 49222 - DNA, 20 bp, human
gcggttctaacagctgggtg

SEQ ID NO: 49223 - DNA, 20 bp, human
ggagtctctccgtgtatggg

SEQ ID NO: 49224 - DNA, 20 bp, human
gtccttctggaatcttgtaa

SEQ ID NO: 49225 - DNA, 20 bp, human
gtctaacagctgggtgcggg

SEQ ID NO: 49226 - DNA, 20 bp, human
gggaggcggaccatgaggag

SEQ ID NO: 49227 - DNA, 20 bp, human
ggaaggccccgccccaggga

SEQ ID NO: 49228 - DNA, 20 bp, human
gggcggcgtggtcaagtcac

SEQ ID NO: 49229 - DNA, 20 bp, human
gcccacagccgcctcaggca

SEQ ID NO: 49230 - DNA, 20 bp, human
ggcacgcgactcagcaacct

SEQ ID NO: 49231 - DNA, 20 bp, human
gggagcggaggcggaccatg

SEQ ID NO: 49232 - DNA, 20 bp, human
ggcgtggtcaagtcacagga

SEQ ID NO: 49233 - DNA, 20 bp, human
gggtggagccgtccctgggg

SEQ ID NO: 49234 - DNA, 20 bp, human
ggccgtgtagcgtcagatac

SEQ ID NO: 49235 - DNA, 20 bp, human
ggaggggtggagccgtccct

SEQ ID NO: 49236 - DNA, 20 bp, human
gccaccacgagagcccctcg

SEQ ID NO: 49237 - DNA, 20 bp, human
gcccgcggcgcaggcagtct

SEQ ID NO: 49238 - DNA, 20 bp, human
gacgtttgcagactagcggg

SEQ ID NO: 49239 - DNA, 20 bp, human
gcggctgccgctagcgctcc

SEQ ID NO: 49240 - DNA, 20 bp, human
gggcgtgattcggtagccgg

SEQ ID NO: 49241 - DNA, 20 bp, human
gctgccccgaggggctctcg

SEQ ID NO: 49242 - DNA, 20 bp, human
ggccctaaaggatgggacgg

SEQ ID NO: 49243 - DNA, 20 bp, human
ggttgtctgccctaaaggat

SEQ ID NO: 49244 - DNA, 20 bp, human
gcggggcccgccgcagccat

SEQ ID NO: 49245 - DNA, 20 bp, human
ggccgcgggtgcagcgtcgg

SEQ ID NO: 49246 - DNA, 20 bp, human
gccccgtgttttcagagtca

SEQ ID NO: 49247 - DNA, 20 bp, human
gttcccactacgacgatttg

SEQ ID NO: 49248 - DNA, 20 bp, human
gccggccacggcaatgaatg

SEQ ID NO: 49249 - DNA, 20 bp, human
gggaggaaggaggcgaactg

SEQ ID NO: 49250 - DNA, 20 bp, human
gcgcgtgccgctgcctccaa

SEQ ID NO: 49251 - DNA, 20 bp, human
gatgcaacgctgccccggga

SEQ ID NO: 49252 - DNA, 20 bp, human
gaggccgcgcccggtcccag

SEQ ID NO: 49253 - DNA, 20 bp, human
ggtgccggcttccgaggaga

SEQ ID NO: 49254 - DNA, 20 bp, human
gggaggcgaactgtgggccc

SEQ ID NO: 49255 - DNA, 20 bp, human
ggttcgctcgggccagaccc

SEQ ID NO: 49256 - DNA, 20 bp, human
ggatctgcggcaggtccagg

SEQ ID NO: 49257 - DNA, 20 bp, human
gccaggtcgttgagggtcgg

SEQ ID NO: 49258 - DNA, 20 bp, human
ggtcgcctgagaaccggatg

SEQ ID NO: 49259 - DNA, 20 bp, human
ggtcttgccgaggcccgggc

SEQ ID NO: 49260 - DNA, 20 bp, human
gtcggcaagacgcccgctcc

SEQ ID NO: 49261 - DNA, 20 bp, human
gccgcggcggggaaccggac

SEQ ID NO: 49262 - DNA, 20 bp, human
gctgcccagggcgtcccaca

SEQ ID NO: 49263 - DNA, 20 bp, human
gagcgccgcagttacgccgg

SEQ ID NO: 49264 - DNA, 20 bp, human
ggcgggaggtcgctcgggtc

SEQ ID NO: 49265 - DNA, 20 bp, human
gtgcgccgccggcgtaactg

SEQ ID NO: 49266 - DNA, 20 bp, human
gcaggtcctggcgcagacgt

SEQ ID NO: 49267 - DNA, 20 bp, human
gggcgctgcggtggaatggg

SEQ ID NO: 49268 - DNA, 20 bp, human
gacgacctgacagggagtag

SEQ ID NO: 49269 - DNA, 20 bp, human
ggacgggcagcgggagccag

SEQ ID NO: 49270 - DNA, 20 bp, human
ggggccgttggaacgtggac

SEQ ID NO: 49271 - DNA, 20 bp, human
ggccagagggtggatggacc

SEQ ID NO: 49272 - DNA, 20 bp, human
ggttagctgtcagagccaag

SEQ ID NO: 49273 - DNA, 20 bp, human
gtcagagccaagcggcgggc

SEQ ID NO: 49274 - DNA, 20 bp, human
gactccctgtcaggtcgtag

SEQ ID NO: 49275 - DNA, 20 bp, human
ggatctgcggcagctccagc

SEQ ID NO: 49276 - DNA, 20 bp, human
gccaggggcggaggtgacag

SEQ ID NO: 49277 - DNA, 20 bp, human
ggcgccgagggaccgccggg

SEQ ID NO: 49278 - DNA, 20 bp, human
gacccgcccgccgcttccag

SEQ ID NO: 49279 - DNA, 20 bp, human
gtgccactccggcaatgagg

SEQ ID NO: 49280 - DNA, 20 bp, human
ggccgcgccgagggaccgcc

SEQ ID NO: 49281 - DNA, 20 bp, human
ggcggcgcgctgactcacac

SEQ ID NO: 49282 - DNA, 20 bp, human
ggtcagagcaatgcgaacgt

SEQ ID NO: 49283 - DNA, 20 bp, human
gtcacctccgcccctggaag

SEQ ID NO: 49284 - DNA, 20 bp, human
gggagcccgcgagggacagt

SEQ ID NO: 49285 - DNA, 20 bp, human
gttccgcctcattgccggag

SEQ ID NO: 49286 - DNA, 20 bp, human
ggtacgcgccggcatctcgg

SEQ ID NO: 49287 - DNA, 20 bp, human
ggaggcttcagcagacgcgg

SEQ ID NO: 49288 - DNA, 20 bp, human
gtggccgggacggccagtgt

SEQ ID NO: 49289 - DNA, 20 bp, human
gtcggaggcttcagcagacg

SEQ ID NO: 49290 - DNA, 20 bp, human
ggcttggtcgcacaggaagt

SEQ ID NO: 49291 - DNA, 20 bp, human
gaccgcctgcggacatcgtc

SEQ ID NO: 49292 - DNA, 20 bp, human
gcggccaacggacacccctc

SEQ ID NO: 49293 - DNA, 20 bp, human
gggcagcgagatggccggga

SEQ ID NO: 49294 - DNA, 20 bp, human
ggcggtacgcgccggcatct

SEQ ID NO: 49295 - DNA, 20 bp, human
gggtccccttcttcaagcag

SEQ ID NO: 49296 - DNA, 20 bp, human
gcactcctcgagggctccag

SEQ ID NO: 49297 - DNA, 20 bp, human
gccaaggccccactcctcga

SEQ ID NO: 49298 - DNA, 20 bp, human
gtggcacctggcgccctcgg

SEQ ID NO: 49299 - DNA, 20 bp, human
ggggccggcctgtgacacca

SEQ ID NO: 49300 - DNA, 20 bp, human
ggtggggccttggggctcgt

SEQ ID NO: 49301 - DNA, 20 bp, human
gcacggtgcgaccctgacag

SEQ ID NO: 49302 - DNA, 20 bp, human
gccagaaacgcaggtcacca

SEQ ID NO: 49303 - DNA, 20 bp, human
gcagcttgcggcctcttaag

SEQ ID NO: 49304 - DNA, 20 bp, human
gccccgctggagggcctggt

SEQ ID NO: 49305 - DNA, 20 bp, human
gtgctcttcctgtcccccga

SEQ ID NO: 49306 - DNA, 20 bp, human
gccagggacctcccgaggag

SEQ ID NO: 49307 - DNA, 20 bp, human
gcctggagagggtctctccc

SEQ ID NO: 49308 - DNA, 20 bp, human
ggccggtcccgtccgtcggg

SEQ ID NO: 49309 - DNA, 20 bp, human
gctgcttcgagggctgctag

SEQ ID NO: 49310 - DNA, 20 bp, human
gcggacggggcagcgggagt

SEQ ID NO: 49311 - DNA, 20 bp, human
gcgctgggctcgcgaatctc

SEQ ID NO: 49312 - DNA, 20 bp, human
gcagccctcgaagcagctgg

SEQ ID NO: 49313 - DNA, 20 bp, human
gcggggtgaggaaacgtcca

SEQ ID NO: 49314 - DNA, 20 bp, human
gcggcagcgctggggttaag

SEQ ID NO: 49315 - DNA, 20 bp, human
gccgaggaggggctctcgcc

SEQ ID NO: 49316 - DNA, 20 bp, human
gtccgcaccccggagatcag

SEQ ID NO: 49317 - DNA, 20 bp, human
ggcaccccggagatcagagg

SEQ ID NO: 49318 - DNA, 20 bp, human
gggatagcctccaggattgg

SEQ ID NO: 49319 - DNA, 20 bp, human
gccggagatcagaggtggct

SEQ ID NO: 49320 - DNA, 20 bp, human
ggactcgcccccaatcctgg

SEQ ID NO: 49321 - DNA, 20 bp, human
gagctggctggagctgctca

SEQ ID NO: 49322 - DNA, 20 bp, human
gcagctgagaggacaatgca

SEQ ID NO: 49323 - DNA, 20 bp, human
gcaggcgctgacatagtgag

SEQ ID NO: 49324 - DNA, 20 bp, human
gctggaggctatccgcaccc

SEQ ID NO: 49325 - DNA, 20 bp, human
gtccgactcgcccccaatcc

SEQ ID NO: 49326 - DNA, 20 bp, human
gtgcccaacccagggatgag

SEQ ID NO: 49327 - DNA, 20 bp, human
gggactgggccatggaacga

SEQ ID NO: 49328 - DNA, 20 bp, human
ggcgcaggcaaagaatgagc

SEQ ID NO: 49329 - DNA, 20 bp, human
gtgggccatggaacgaggga

SEQ ID NO: 49330 - DNA, 20 bp, human
ggacccttgagcccctctca

SEQ ID NO: 49331 - DNA, 20 bp, human
ggcccacctgggacagcggg

SEQ ID NO: 49332 - DNA, 20 bp, human
gagaggtcaccaggctatgg

SEQ ID NO: 49333 - DNA, 20 bp, human
gagatggggcaaaaagggga

SEQ ID NO: 49334 - DNA, 20 bp, human
ggcctgagggacactgtagg

SEQ ID NO: 49335 - DNA, 20 bp, human
ggccagaggtcaccaggcta

SEQ ID NO: 49336 - DNA, 20 bp, human
ggacctgcaaagctagtgag

SEQ ID NO: 49337 - DNA, 20 bp, human
gcaggccgcgccgcactcgt

SEQ ID NO: 49338 - DNA, 20 bp, human
gtgatgaaggcctacgagtg

SEQ ID NO: 49339 - DNA, 20 bp, human
gggcctgaaggggcacgcgg

SEQ ID NO: 49340 - DNA, 20 bp, human
ggccaaagccctgtacccca

SEQ ID NO: 49341 - DNA, 20 bp, human
gcgggccccatactctgagg

SEQ ID NO: 49342 - DNA, 20 bp, human
gagggcgccggacccggtct

SEQ ID NO: 49343 - DNA, 20 bp, human
ggcaggccgcctcagagtat

SEQ ID NO: 49344 - DNA, 20 bp, human
gcctagctgggcagggacat

SEQ ID NO: 49345 - DNA, 20 bp, human
ggggagtcctgcgagagact

SEQ ID NO: 49346 - DNA, 20 bp, human
gtcgctgcgccccggcacca

SEQ ID NO: 49347 - DNA, 20 bp, human
gcagcaagcctgcgggtgta

SEQ ID NO: 49348 - DNA, 20 bp, human
ggcagaagtacagggccggg

SEQ ID NO: 49349 - DNA, 20 bp, human
gccctggcgccggagagcgc

SEQ ID NO: 49350 - DNA, 20 bp, human
gtgggtcccagcaagcctgc

SEQ ID NO: 49351 - DNA, 20 bp, human
gatgctcccgcagaagtaca

SEQ ID NO: 49352 - DNA, 20 bp, human
gccagcgccccagcccgaga

SEQ ID NO: 49353 - DNA, 20 bp, human
gccccagcccgagaaggaaa

SEQ ID NO: 49354 - DNA, 20 bp, human
gggcgctggatggagcaccg

SEQ ID NO: 49355 - DNA, 20 bp, human
gcccgcagaagtacagggcc

SEQ ID NO: 49356 - DNA, 20 bp, human
gcaccagatgggccagccag

SEQ ID NO: 49357 - DNA, 20 bp, human
gacgctcgtggtggatccat

SEQ ID NO: 49358 - DNA, 20 bp, human
gttcttccgagggctcaagt

SEQ ID NO: 49359 - DNA, 20 bp, human
gccctcggaagaagagaccc

SEQ ID NO: 49360 - DNA, 20 bp, human
ggtggtggatccatgggaag

SEQ ID NO: 49361 - DNA, 20 bp, human
gtcaagtgggacgctcgtgg

SEQ ID NO: 49362 - DNA, 20 bp, human
gtaaggaaaacgagataagt

SEQ ID NO: 49363 - DNA, 20 bp, human
gtctggtggtgtctccagaa

SEQ ID NO: 49364 - DNA, 20 bp, human
gggtggtgtctccagaaggg

SEQ ID NO: 49365 - DNA, 20 bp, human
gggagctggcccgcaggaaa

SEQ ID NO: 49366 - DNA, 20 bp, human
ggcgtcgccagtggctccca

SEQ ID NO: 49367 - DNA, 20 bp, human
gtctggcacggcaggaggaa

SEQ ID NO: 49368 - DNA, 20 bp, human
gcggccccgctaggtccccg

SEQ ID NO: 49369 - DNA, 20 bp, human
ggagtccagcggagttgtgg

SEQ ID NO: 49370 - DNA, 20 bp, human
gcgtcacctagctaggaggg

SEQ ID NO: 49371 - DNA, 20 bp, human
ggacctagcggggccgagag

SEQ ID NO: 49372 - DNA, 20 bp, human
ggcgcgctccagtgacgtca

SEQ ID NO: 49373 - DNA, 20 bp, human
gcgcgggcgagagaacgcgg

SEQ ID NO: 49374 - DNA, 20 bp, human
gagcagccgcggggacctag

SEQ ID NO: 49375 - DNA, 20 bp, human
gggggcgccatgggagccac

SEQ ID NO: 49376 - DNA, 20 bp, human
gaagctcgggtcctctctgt

SEQ ID NO: 49377 - DNA, 20 bp, human
gggcgcaagggtccggttaa

SEQ ID NO: 49378 - DNA, 20 bp, human
ggccagcatccaagccgcgt

SEQ ID NO: 49379 - DNA, 20 bp, human
ggtggttaccagatctgcac

SEQ ID NO: 49380 - DNA, 20 bp, human
ggaagtcgtggtggtcgcga

SEQ ID NO: 49381 - DNA, 20 bp, human
gcgcgagggagccggaaaga

SEQ ID NO: 49382 - DNA, 20 bp, human
ggccttagcccgtgcagatc

SEQ ID NO: 49383 - DNA, 20 bp, human
ggcacaagccccatttaggg

SEQ ID NO: 49384 - DNA, 20 bp, human
gtccggagcgccagggaaga

SEQ ID NO: 49385 - DNA, 20 bp, human
gtgcgaagcggcgagaagta

SEQ ID NO: 49386 - DNA, 20 bp, human
ggactccgcgctctcctcgc

SEQ ID NO: 49387 - DNA, 20 bp, human
ggctgtgcgagccgagaggg

SEQ ID NO: 49388 - DNA, 20 bp, human
gccaggcgctggtctagtca

SEQ ID NO: 49389 - DNA, 20 bp, human
ggagccagaggtggcatctg

SEQ ID NO: 49390 - DNA, 20 bp, human
gcagagcctccgagaaacag

SEQ ID NO: 49391 - DNA, 20 bp, human
gcgagctgtgcgagccgaga

SEQ ID NO: 49392 - DNA, 20 bp, human
gtgccacctctggctcctca

SEQ ID NO: 49393 - DNA, 20 bp, human
gaggctggggtctccaccgt

SEQ ID NO: 49394 - DNA, 20 bp, human
gacagggacaacctagaagt

SEQ ID NO: 49395 - DNA, 20 bp, human
gggacaacctagaagtgggt

SEQ ID NO: 49396 - DNA, 20 bp, human
gcttcctaggagccttcctg

SEQ ID NO: 49397 - DNA, 20 bp, human
gccctgcggtagttccccat

SEQ ID NO: 49398 - DNA, 20 bp, human
gggaaggctcctaggaagag

SEQ ID NO: 49399 - DNA, 20 bp, human
gttccttaggaagtcaccgt

SEQ ID NO: 49400 - DNA, 20 bp, human
gctccagcgccgtcaggact

SEQ ID NO: 49401 - DNA, 20 bp, human
gccacctgcggggcagaact

SEQ ID NO: 49402 - DNA, 20 bp, human
gcaggtgggaaggggcgtcg

SEQ ID NO: 49403 - DNA, 20 bp, human
ggacccacggtgacttccta

SEQ ID NO: 49404 - DNA, 20 bp, human
gcatgtccccttaccaggga

SEQ ID NO: 49405 - DNA, 20 bp, human
gccatcccgaagacacgaag

SEQ ID NO: 49406 - DNA, 20 bp, human
gccaagtcagggccgtccgg

SEQ ID NO: 49407 - DNA, 20 bp, human
ggcgggcagcggccaagtca

SEQ ID NO: 49408 - DNA, 20 bp, human
gtcgctcgcgccgtccgcag

SEQ ID NO: 49409 - DNA, 20 bp, human
gcgcgccgtccgcagcggag

SEQ ID NO: 49410 - DNA, 20 bp, human
gggcgcccgcgaggacgacg

SEQ ID NO: 49411 - DNA, 20 bp, human
ggacgccgacggctacgagt

SEQ ID NO: 49412 - DNA, 20 bp, human
gtgcctgcatgaccctccgg

SEQ ID NO: 49413 - DNA, 20 bp, human
gccccctgcctgccggcctc

SEQ ID NO: 49414 - DNA, 20 bp, human
gcgtccggctcgtcctccgg

SEQ ID NO: 49415 - DNA, 20 bp, human
gctgcttgatgggacggatg

SEQ ID NO: 49416 - DNA, 20 bp, human
gggcaggaaactccgcgtct

SEQ ID NO: 49417 - DNA, 20 bp, human
gccagccgcgcagatagcag

SEQ ID NO: 49418 - DNA, 20 bp, human
gttcgagccgcgacaggatg

SEQ ID NO: 49419 - DNA, 20 bp, human
gccaagcgcgaggagaagta

SEQ ID NO: 49420 - DNA, 20 bp, human
ggaaaatggcggcctagacg

SEQ ID NO: 49421 - DNA, 20 bp, human
ggtgggcacccagcgcgtca

SEQ ID NO: 49422 - DNA, 20 bp, human
ggagtttcctgcccgacccg

SEQ ID NO: 49423 - DNA, 20 bp, human
gggtagcccggggggctcca

SEQ ID NO: 49424 - DNA, 20 bp, human
gagaggagcgggcgtcggag

SEQ ID NO: 49425 - DNA, 20 bp, human
gctctgccgtggagcccccc

SEQ ID NO: 49426 - DNA, 20 bp, human
gaggttggcgcggggaagac

SEQ ID NO: 49427 - DNA, 20 bp, human
gaccgacgcgtaaggaccgg

SEQ ID NO: 49428 - DNA, 20 bp, human
ggtgcacgcgggacgctcag

SEQ ID NO: 49429 - DNA, 20 bp, human
gaacggcgggtggatagaga

SEQ ID NO: 49430 - DNA, 20 bp, human
gttggcgcggggaagaccgg

SEQ ID NO: 49431 - DNA, 20 bp, human
gggtagcagaagcgcagcgt

SEQ ID NO: 49432 - DNA, 20 bp, human
gccgagttccgcttcctgaa

SEQ ID NO: 49433 - DNA, 20 bp, human
gagttccgcttcctgaacgg

SEQ ID NO: 49434 - DNA, 20 bp, human
gccacccgccgttcaggaag

SEQ ID NO: 49435 - DNA, 20 bp, human
ggcccccggtccttacgcgt

SEQ ID NO: 49436 - DNA, 20 bp, human
gcggccacatcgcagctcgg

SEQ ID NO: 49437 - DNA, 20 bp, human
gccgccgccgagctgcgatg

SEQ ID NO: 49438 - DNA, 20 bp, human
ggactcactgccccggcccg

SEQ ID NO: 49439 - DNA, 20 bp, human
gcggccggagagctgtcagc

SEQ ID NO: 49440 - DNA, 20 bp, human
gacgcctccgccgtgccggg

SEQ ID NO: 49441 - DNA, 20 bp, human
gggcaaaagccgggctcgga

SEQ ID NO: 49442 - DNA, 20 bp, human
ggtgcgaaaacttactggag

SEQ ID NO: 49443 - DNA, 20 bp, human
gcagcgcgcggcgcaccaag

SEQ ID NO: 49444 - DNA, 20 bp, human
gtgcgatgtggccggccggc

SEQ ID NO: 49445 - DNA, 20 bp, human
gctccggccgcccggcacgg

SEQ ID NO: 49446 - DNA, 20 bp, human
ggcgcaaagctgacaaggag

SEQ ID NO: 49447 - DNA, 20 bp, human
gggcctcgcgtcctcccgtg

SEQ ID NO: 49448 - DNA, 20 bp, human
ggcgcccagccaccccctga

SEQ ID NO: 49449 - DNA, 20 bp, human
gctgacggcttccccacggg

SEQ ID NO: 49450 - DNA, 20 bp, human
gccctggcgcaaagctgaca

SEQ ID NO: 49451 - DNA, 20 bp, human
gtggggaagccgtcaggggg

SEQ ID NO: 49452 - DNA, 20 bp, human
ggcgagctggggcactcctg

SEQ ID NO: 49453 - DNA, 20 bp, human
gcaaggccaagtctcccacg

SEQ ID NO: 49454 - DNA, 20 bp, human
ggggtggaagtatgcatggt

SEQ ID NO: 49455 - DNA, 20 bp, human
gatgcatggtgggcaggcca

SEQ ID NO: 49456 - DNA, 20 bp, human
ggccatgtggacccccacgg

SEQ ID NO: 49457 - DNA, 20 bp, human
gtgcggcccgcgggaggggt

SEQ ID NO: 49458 - DNA, 20 bp, human
gcgaccgggcgacaacgcgg

SEQ ID NO: 49459 - DNA, 20 bp, human
gacggccatgtggaccccca

SEQ ID NO: 49460 - DNA, 20 bp, human
gtgtggcgcaccgcgagtcg

SEQ ID NO: 49461 - DNA, 20 bp, human
gggagaaatacggcgtaggt

SEQ ID NO: 49462 - DNA, 20 bp, human
gggcgcaccgcgagtcgagg

SEQ ID NO: 49463 - DNA, 20 bp, human
gggcacgaggatgcgaatcc

SEQ ID NO: 49464 - DNA, 20 bp, human
gaatacggcgtaggtaggtg

SEQ ID NO: 49465 - DNA, 20 bp, human
ggcgggtctctgtgcagaga

SEQ ID NO: 49466 - DNA, 20 bp, human
gcgggtacccgggagcgcgt

SEQ ID NO: 49467 - DNA, 20 bp, human
ggtacccgggagcgcgtcgg

SEQ ID NO: 49468 - DNA, 20 bp, human
ggcatcgcgcagctggtacg

SEQ ID NO: 49469 - DNA, 20 bp, human
gcaaccgggcggagcgagag

SEQ ID NO: 49470 - DNA, 20 bp, human
ggaactaagcgaacacgccg

SEQ ID NO: 49471 - DNA, 20 bp, human
gttgttgtgagccggagaag

SEQ ID NO: 49472 - DNA, 20 bp, human
gctacggagcacgagaaata

SEQ ID NO: 49473 - DNA, 20 bp, human
gggttgaaaatgcctaatcc

SEQ ID NO: 49474 - DNA, 20 bp, human
gaacacgccggggcactctc

SEQ ID NO: 49475 - DNA, 20 bp, human
gagtcctccgacgcgctccc

SEQ ID NO: 49476 - DNA, 20 bp, human
gccatcggcgctccctggag

SEQ ID NO: 49477 - DNA, 20 bp, human
gtctgggagccggggacggt

SEQ ID NO: 49478 - DNA, 20 bp, human
gccgctggatcccgaccaag

SEQ ID NO: 49479 - DNA, 20 bp, human
gccctgggcgacttccccat

SEQ ID NO: 49480 - DNA, 20 bp, human
gggtcgggccgggacaaggt

SEQ ID NO: 49481 - DNA, 20 bp, human
gaccaagaggcagaagtacg

SEQ ID NO: 49482 - DNA, 20 bp, human
gccggcccagcaggtgaccg

SEQ ID NO: 49483 - DNA, 20 bp, human
gagaggactcctaccgtccc

SEQ ID NO: 49484 - DNA, 20 bp, human
ggaagtttggcggaacatgg

SEQ ID NO: 49485 - DNA, 20 bp, human
gccgcccgcggtcacctgct

SEQ ID NO: 49486 - DNA, 20 bp, human
gggcggagccgggccacgtg

SEQ ID NO: 49487 - DNA, 20 bp, human
gccggctgcccagaaccggg

SEQ ID NO: 49488 - DNA, 20 bp, human
gggagcgcagggagttcagg

SEQ ID NO: 49489 - DNA, 20 bp, human
gacagtgaggggccgagagg

SEQ ID NO: 49490 - DNA, 20 bp, human
gcggcgggacgcgaggacca

SEQ ID NO: 49491 - DNA, 20 bp, human
ggcgtggggatgcggatgac

SEQ ID NO: 49492 - DNA, 20 bp, human
ggagagcgcggggacagtga

SEQ ID NO: 49493 - DNA, 20 bp, human
gcgctctcggagatcggggt

SEQ ID NO: 49494 - DNA, 20 bp, human
ggtgtgtccggagggcttcc

SEQ ID NO: 49495 - DNA, 20 bp, human
gcccgcgctctcggagatcg

SEQ ID NO: 49496 - DNA, 20 bp, human
ggcgcctctaaggaacatta

SEQ ID NO: 49497 - DNA, 20 bp, human
ggctgaaggccggggttcga

SEQ ID NO: 49498 - DNA, 20 bp, human
gggactggcggaggccgcga

SEQ ID NO: 49499 - DNA, 20 bp, human
gtccgcagaagtccaggccc

SEQ ID NO: 49500 - DNA, 20 bp, human
gaccctctaggggccaagag

SEQ ID NO: 49501 - DNA, 20 bp, human
gagatcagcaggtaaatatc

SEQ ID NO: 49502 - DNA, 20 bp, human
gcggcccccgacgagcccgg

SEQ ID NO: 49503 - DNA, 20 bp, human
ggcggaccccgcaccctcta

SEQ ID NO: 49504 - DNA, 20 bp, human
gggtgggcggagagacggga

SEQ ID NO: 49505 - DNA, 20 bp, human
gcacccctcttggcccctag

SEQ ID NO: 49506 - DNA, 20 bp, human
gcagcgccgaccgacagacg

SEQ ID NO: 49507 - DNA, 20 bp, human
gatgttccgcggctactctg

SEQ ID NO: 49508 - DNA, 20 bp, human
gcttggctgggcatgttccg

SEQ ID NO: 49509 - DNA, 20 bp, human
ggcgcgccgcagagtagccg

SEQ ID NO: 49510 - DNA, 20 bp, human
gaggtggccgggtcccagaa

SEQ ID NO: 49511 - DNA, 20 bp, human
gcgggtcccagaagggtgat

SEQ ID NO: 49512 - DNA, 20 bp, human
ggcaaacctcgtctgtcggt

SEQ ID NO: 49513 - DNA, 20 bp, human
gcctgtaagaacctggaggg

SEQ ID NO: 49514 - DNA, 20 bp, human
gacgaggtttgcgcttggct

SEQ ID NO: 49515 - DNA, 20 bp, human
gtcggggaagggatccccgg

SEQ ID NO: 49516 - DNA, 20 bp, human
gcaggcatgccagtggtcca

SEQ ID NO: 49517 - DNA, 20 bp, human
gcatgccagtggtccaagga

SEQ ID NO: 49518 - DNA, 20 bp, human
ggaaagagtggagttcacaa

SEQ ID NO: 49519 - DNA, 20 bp, human
gccctggccgtgcaaggcac

SEQ ID NO: 49520 - DNA, 20 bp, human
gggagtagtaacacccctgg

SEQ ID NO: 49521 - DNA, 20 bp, human
ggatgcagctcagggcgaag

SEQ ID NO: 49522 - DNA, 20 bp, human
ggaatcgaagtcatattaca

SEQ ID NO: 49523 - DNA, 20 bp, human
gctttccttccttggaccac

SEQ ID NO: 49524 - DNA, 20 bp, human
gtgggaaggcatgacagcaa

SEQ ID NO: 49525 - DNA, 20 bp, human
gttgtacgagaccctcttac

SEQ ID NO: 49526 - DNA, 20 bp, human
ggttagggaatccggtctca

SEQ ID NO: 49527 - DNA, 20 bp, human
gccgtccggcacggtcacgt

SEQ ID NO: 49528 - DNA, 20 bp, human
gaagcacaggtgaccatcaa

SEQ ID NO: 49529 - DNA, 20 bp, human
ggaccgcactgcgggcgtcg

SEQ ID NO: 49530 - DNA, 20 bp, human
gggtcacgtgggcgagaaaa

SEQ ID NO: 49531 - DNA, 20 bp, human
gcgcccgcagtgcggtctgg

SEQ ID NO: 49532 - DNA, 20 bp, human
gggctgcctgggcttgacga

SEQ ID NO: 49533 - DNA, 20 bp, human
gagccctctctggtgaacag

SEQ ID NO: 49534 - DNA, 20 bp, human
gctggagactcaggacccgt

SEQ ID NO: 49535 - DNA, 20 bp, human
gagtgtagccacctaagcac

SEQ ID NO: 49536 - DNA, 20 bp, human
gggacggagcagtgatggaa

SEQ ID NO: 49537 - DNA, 20 bp, human
gaagccccggaggcccgtgt

SEQ ID NO: 49538 - DNA, 20 bp, human
ggcaccggagagacccacac

SEQ ID NO: 49539 - DNA, 20 bp, human
gagacccacacgggcctccg

SEQ ID NO: 49540 - DNA, 20 bp, human
gggaagcgtctgtagtctag

SEQ ID NO: 49541 - DNA, 20 bp, human
gggcggcccgggtcccgacg

SEQ ID NO: 49542 - DNA, 20 bp, human
gcccaccgcgacccccccag

SEQ ID NO: 49543 - DNA, 20 bp, human
gtctctctccctagaggtgg

SEQ ID NO: 49544 - DNA, 20 bp, human
ggagagagagagtgctcgag

SEQ ID NO: 49545 - DNA, 20 bp, human
ggaagcgcggaaggaaccgc

SEQ ID NO: 49546 - DNA, 20 bp, human
gcacacggctaagaagagag

SEQ ID NO: 49547 - DNA, 20 bp, human
gggtcagaggatgggagacg

SEQ ID NO: 49548 - DNA, 20 bp, human
gtccgagatggtcagaggat

SEQ ID NO: 49549 - DNA, 20 bp, human
gttcaccggacaccttggaa

SEQ ID NO: 49550 - DNA, 20 bp, human
ggggcaaacagccctcagta

SEQ ID NO: 49551 - DNA, 20 bp, human
gggggctccgagatggtcag

SEQ ID NO: 49552 - DNA, 20 bp, human
ggtgcacagtcagacctata

SEQ ID NO: 49553 - DNA, 20 bp, human
gcggacaccttggaagggaa

SEQ ID NO: 49554 - DNA, 20 bp, human
ggctctgggtctaacttggt

SEQ ID NO: 49555 - DNA, 20 bp, human
gcagtttaggatgacaatag

SEQ ID NO: 49556 - DNA, 20 bp, human
ggacagcgtggagtggtcaa

SEQ ID NO: 49557 - DNA, 20 bp, human
gacgctgtccgagagctcaa

SEQ ID NO: 49558 - DNA, 20 bp, human
gctgggcatccagtccacat

SEQ ID NO: 49559 - DNA, 20 bp, human
gccaggagttggctagagaa

SEQ ID NO: 49560 - DNA, 20 bp, human
ggcgtgagtgtataccgtga

SEQ ID NO: 49561 - DNA, 20 bp, human
gggagcccccggccacctga

SEQ ID NO: 49562 - DNA, 20 bp, human
gaggcagacctgggagactt

SEQ ID NO: 49563 - DNA, 20 bp, human
ggagcctgtcttcagctcag

SEQ ID NO: 49564 - DNA, 20 bp, human
ggcgcgtgcccagctgaacc

SEQ ID NO: 49565 - DNA, 20 bp, human
ggctgccaaggaccaacagt

SEQ ID NO: 49566 - DNA, 20 bp, human
gaggcgcggccgcagggcta

SEQ ID NO: 49567 - DNA, 20 bp, human
gggccgcagggctagggatc

SEQ ID NO: 49568 - DNA, 20 bp, human
ggagagtaggaaggtcccat

SEQ ID NO: 49569 - DNA, 20 bp, human
gcgagggaggcgcggccgca

SEQ ID NO: 49570 - DNA, 20 bp, human
gagcccgatccctagccctg

SEQ ID NO: 49571 - DNA, 20 bp, human
gggcctgggttgctcggatg

SEQ ID NO: 49572 - DNA, 20 bp, human
gcggagaggaaagctgcggg

SEQ ID NO: 49573 - DNA, 20 bp, human
gccagagcctgcaagagtct

SEQ ID NO: 49574 - DNA, 20 bp, human
ggctcggatgaggtttgtgt

SEQ ID NO: 49575 - DNA, 20 bp, human
gggcgcccaggtaaattggg

SEQ ID NO: 49576 - DNA, 20 bp, human
gacgatgcccggcagccgga

SEQ ID NO: 49577 - DNA, 20 bp, human
gcaggccccgcgcccctaaa

SEQ ID NO: 49578 - DNA, 20 bp, human
gcacatgccaggcagcacgc

SEQ ID NO: 49579 - DNA, 20 bp, human
gcttggaggcatggcgcgtg

SEQ ID NO: 49580 - DNA, 20 bp, human
ggccccgcgcccctaaaagg

SEQ ID NO: 49581 - DNA, 20 bp, human
gtgcggaggggccctgccaa

SEQ ID NO: 49582 - DNA, 20 bp, human
gtgctggaaataaaaatgac

SEQ ID NO: 49583 - DNA, 20 bp, human
gggtgaggagcagcccctcg

SEQ ID NO: 49584 - DNA, 20 bp, human
gtcgtgcatctgtggtctcg

SEQ ID NO: 49585 - DNA, 20 bp, human
gaccacagatgcacgatgcc

SEQ ID NO: 49586 - DNA, 20 bp, human
ggctctgcgctccccgaaag

SEQ ID NO: 49587 - DNA, 20 bp, human
gagccggccgcccactgtca

SEQ ID NO: 49588 - DNA, 20 bp, human
gcggcttgcagccactttcg

SEQ ID NO: 49589 - DNA, 20 bp, human
gggccgcccactgtcagggt

SEQ ID NO: 49590 - DNA, 20 bp, human
ggtccccccaaccctgacag

SEQ ID NO: 49591 - DNA, 20 bp, human
ggtgacagccccggagacgc

SEQ ID NO: 49592 - DNA, 20 bp, human
gcgcgcgccggagaattgcg

SEQ ID NO: 49593 - DNA, 20 bp, human
gcactgtaaggccagcgtct

SEQ ID NO: 49594 - DNA, 20 bp, human
gactctccgtccaccctcca

SEQ ID NO: 49595 - DNA, 20 bp, human
gcgctgggcgaggctttaga

SEQ ID NO: 49596 - DNA, 20 bp, human
gggacggcggctctcgactc

SEQ ID NO: 49597 - DNA, 20 bp, human
gcccggcagcacccacgggc

SEQ ID NO: 49598 - DNA, 20 bp, human
gggagccccccggcaggtgt

SEQ ID NO: 49599 - DNA, 20 bp, human
gggcgaccccgcgtccccac

SEQ ID NO: 49600 - DNA, 20 bp, human
gggtgacccgtgcgggtaca

SEQ ID NO: 49601 - DNA, 20 bp, human
gccgggccgaacgagcgccg

SEQ ID NO: 49602 - DNA, 20 bp, human
ggggctggcgcctcgctcgg

SEQ ID NO: 49603 - DNA, 20 bp, human
ggagacccgcgcagacccgg

SEQ ID NO: 49604 - DNA, 20 bp, human
gggccatggccagcgcgatc

SEQ ID NO: 49605 - DNA, 20 bp, human
ggagtccccaggtccgtctg

SEQ ID NO: 49606 - DNA, 20 bp, human
gtgacagaagatgaccgagg

SEQ ID NO: 49607 - DNA, 20 bp, human
gccatgacagaagatgaccg

SEQ ID NO: 49608 - DNA, 20 bp, human
gcccgcagtggaagagtagg

SEQ ID NO: 49609 - DNA, 20 bp, human
ggtctgccctgctggaaaga

SEQ ID NO: 49610 - DNA, 20 bp, human
gcccccacctgcgctcccag

SEQ ID NO: 49611 - DNA, 20 bp, human
gtttccagcagggcagactg

SEQ ID NO: 49612 - DNA, 20 bp, human
gccgaggcggcgctggtgga

SEQ ID NO: 49613 - DNA, 20 bp, human
gggtggccctgtaggcggag

SEQ ID NO: 49614 - DNA, 20 bp, human
gcgggacggcaagaaggtcg

SEQ ID NO: 49615 - DNA, 20 bp, human
gaagagggttcttccgtcca

SEQ ID NO: 49616 - DNA, 20 bp, human
gggatcggtgctggcagagg

SEQ ID NO: 49617 - DNA, 20 bp, human
ggcggctgtaactgtgagga

SEQ ID NO: 49618 - DNA, 20 bp, human
gcacgagtatcggtcccata

SEQ ID NO: 49619 - DNA, 20 bp, human
gccagcaccgatccactcag

SEQ ID NO: 49620 - DNA, 20 bp, human
gagccccgtcaagcagaggg

SEQ ID NO: 49621 - DNA, 20 bp, human
gcacggcgcaccacgagtat

SEQ ID NO: 49622 - DNA, 20 bp, human
gcctcgctgctggagaacgg

SEQ ID NO: 49623 - DNA, 20 bp, human
gctgaggggcccgaagtcta

SEQ ID NO: 49624 - DNA, 20 bp, human
gtagaaggcctgcactgcga

SEQ ID NO: 49625 - DNA, 20 bp, human
gagtggatcggtgctggcag

SEQ ID NO: 49626 - DNA, 20 bp, human
gcgacgtgggtgagggtcac

SEQ ID NO: 49627 - DNA, 20 bp, human
ggtcaccggccgccatgaag

SEQ ID NO: 49628 - DNA, 20 bp, human
gctcgctccccgcttcatgg

SEQ ID NO: 49629 - DNA, 20 bp, human
gcgggtaagatggcagcgga

SEQ ID NO: 49630 - DNA, 20 bp, human
gcaaatagtgaaccacggag

SEQ ID NO: 49631 - DNA, 20 bp, human
ggcccggtctccgggtaaga

SEQ ID NO: 49632 - DNA, 20 bp, human
gtgaggcgagaaaagatccc

SEQ ID NO: 49633 - DNA, 20 bp, human
ggtgctcgctccccgcttca

SEQ ID NO: 49634 - DNA, 20 bp, human
gacaggagtgcggcctctct

SEQ ID NO: 49635 - DNA, 20 bp, human
ggccatcttacccggagacc

SEQ ID NO: 49636 - DNA, 20 bp, human
gaaagggccatgacgcgcgg

SEQ ID NO: 49637 - DNA, 20 bp, human
gcgcgcgggaagtctctgta

SEQ ID NO: 49638 - DNA, 20 bp, human
gggagccgcactacctcggg

SEQ ID NO: 49639 - DNA, 20 bp, human
gtcggtgcccggctactcac

SEQ ID NO: 49640 - DNA, 20 bp, human
gggaagcccggtgagtagcc

SEQ ID NO: 49641 - DNA, 20 bp, human
ggcgggaagtctctgtaggg

SEQ ID NO: 49642 - DNA, 20 bp, human
ggtcggagccgcactacctc

SEQ ID NO: 49643 - DNA, 20 bp, human
ggagtagccgggcaccgaaa

SEQ ID NO: 49644 - DNA, 20 bp, human
gcagcagggaaagggcgaag

SEQ ID NO: 49645 - DNA, 20 bp, human
gccgaaagggccatgacgcg

SEQ ID NO: 49646 - DNA, 20 bp, human
gaccgagaccgggagccgaa

SEQ ID NO: 49647 - DNA, 20 bp, human
gacggcagctacaccgagac

SEQ ID NO: 49648 - DNA, 20 bp, human
ggagctgcgccggcgagaag

SEQ ID NO: 49649 - DNA, 20 bp, human
ggagctgtcactaggccctt

SEQ ID NO: 49650 - DNA, 20 bp, human
ggcccttcggctcccggtct

SEQ ID NO: 49651 - DNA, 20 bp, human
gcccaggtgagggaggccgg

SEQ ID NO: 49652 - DNA, 20 bp, human
gctcgccggcgcagctctcc

SEQ ID NO: 49653 - DNA, 20 bp, human
gtggctcggccgcttctcgc

SEQ ID NO: 49654 - DNA, 20 bp, human
gagcctagcggccgcactgg

SEQ ID NO: 49655 - DNA, 20 bp, human
ggcgcgagcacggtgcactc

SEQ ID NO: 49656 - DNA, 20 bp, human
gccagggtcgggtaacccta

SEQ ID NO: 49657 - DNA, 20 bp, human
gtcggggccggagaccggga

SEQ ID NO: 49658 - DNA, 20 bp, human
gccgggagccagaaccgccg

SEQ ID NO: 49659 - DNA, 20 bp, human
gtggttctccggctcttcct

SEQ ID NO: 49660 - DNA, 20 bp, human
ggccggagaaccagcggcag

SEQ ID NO: 49661 - DNA, 20 bp, human
gtatcctccgcgccagggtc

SEQ ID NO: 49662 - DNA, 20 bp, human
gccagggcaccagcaaacaa

SEQ ID NO: 49663 - DNA, 20 bp, human
ggcgcaggcacgacttaccg

SEQ ID NO: 49664 - DNA, 20 bp, human
ggagctcggggccggagacc

SEQ ID NO: 49665 - DNA, 20 bp, human
ggccgctgccgctggttctc

SEQ ID NO: 49666 - DNA, 20 bp, human
gtttggggtgtccccagggg

SEQ ID NO: 49667 - DNA, 20 bp, human
gcggccgcgcgcgcggacat

SEQ ID NO: 49668 - DNA, 20 bp, human
gtcacgccggcccaagatgg

SEQ ID NO: 49669 - DNA, 20 bp, human
ggcagcgacagtggagtcca

SEQ ID NO: 49670 - DNA, 20 bp, human
gctcggccgggaagcaacgg

SEQ ID NO: 49671 - DNA, 20 bp, human
gccgcccgcctagcatggtg

SEQ ID NO: 49672 - DNA, 20 bp, human
gcgggcctgtgactacaaag

SEQ ID NO: 49673 - DNA, 20 bp, human
gcgctcaccggtcccccctg

SEQ ID NO: 49674 - DNA, 20 bp, human
ggcttcacgccggcccaaga

SEQ ID NO: 49675 - DNA, 20 bp, human
gactacaaagagggagtcgg

SEQ ID NO: 49676 - DNA, 20 bp, human
gacaccggggaacctctcta

SEQ ID NO: 49677 - DNA, 20 bp, human
gagccgccgtcgggacaccg

SEQ ID NO: 49678 - DNA, 20 bp, human
ggtgcagcggggcagaacat

SEQ ID NO: 49679 - DNA, 20 bp, human
gttccccggtgtcccgacgg

SEQ ID NO: 49680 - DNA, 20 bp, human
ggctaaggaaggagtggcta

SEQ ID NO: 49681 - DNA, 20 bp, human
gaggttccccggtgtcccga

SEQ ID NO: 49682 - DNA, 20 bp, human
gaacataggttgccttagag

SEQ ID NO: 49683 - DNA, 20 bp, human
gttgccttagagaggttccc

SEQ ID NO: 49684 - DNA, 20 bp, human
gggcagcctggaactcggag

SEQ ID NO: 49685 - DNA, 20 bp, human
gagcagcggcacacgggtcc

SEQ ID NO: 49686 - DNA, 20 bp, human
ggtaactcgagggtccccac

SEQ ID NO: 49687 - DNA, 20 bp, human
gatggcggtgacgggctggt

SEQ ID NO: 49688 - DNA, 20 bp, human
gcggaagtgaccctctggaa

SEQ ID NO: 49689 - DNA, 20 bp, human
gtgcagcagcgcagtcttct

SEQ ID NO: 49690 - DNA, 20 bp, human
gaaagatggcggtgacgggc

SEQ ID NO: 49691 - DNA, 20 bp, human
gaggggaaagatggcggtga

SEQ ID NO: 49692 - DNA, 20 bp, human
gccctctggaacggttgcca

SEQ ID NO: 49693 - DNA, 20 bp, human
ggccatggcaaccgttccag

SEQ ID NO: 49694 - DNA, 20 bp, human
gatggtgtagaggaatctaa

SEQ ID NO: 49695 - DNA, 20 bp, human
gggttgccatggcagcggct

SEQ ID NO: 49696 - DNA, 20 bp, human
ggtggctgcttggggaccat

SEQ ID NO: 49697 - DNA, 20 bp, human
gtgccagccctggatggtgg

SEQ ID NO: 49698 - DNA, 20 bp, human
gtggctaagggacatgtagt

SEQ ID NO: 49699 - DNA, 20 bp, human
gtgccccccaagaagctaga

SEQ ID NO: 49700 - DNA, 20 bp, human
gtggaccggctgggccatgt

SEQ ID NO: 49701 - DNA, 20 bp, human
ggggctgcacccatccagag

SEQ ID NO: 49702 - DNA, 20 bp, human
gggctgccagccctggatgg

SEQ ID NO: 49703 - DNA, 20 bp, human
ggcccccatgacgtcaagat

SEQ ID NO: 49704 - DNA, 20 bp, human
gacggtgctcaatgaatgtc

SEQ ID NO: 49705 - DNA, 20 bp, human
ggctgggccatgtcggagct

SEQ ID NO: 49706 - DNA, 20 bp, human
gctgccaggagaggcaccag

SEQ ID NO: 49707 - DNA, 20 bp, human
gggagaggcaccagaggtgt

SEQ ID NO: 49708 - DNA, 20 bp, human
gcctggctggcccgtgcaga

SEQ ID NO: 49709 - DNA, 20 bp, human
gactcacccatcaatgacag

SEQ ID NO: 49710 - DNA, 20 bp, human
gtgcttagggaaccaggact

SEQ ID NO: 49711 - DNA, 20 bp, human
gggactcccctgtcattgat

SEQ ID NO: 49712 - DNA, 20 bp, human
ggggtggaagtgatgacagg

SEQ ID NO: 49713 - DNA, 20 bp, human
ggaagctcatccttctgcac

SEQ ID NO: 49714 - DNA, 20 bp, human
gcagtgcagacggccacaag

SEQ ID NO: 49715 - DNA, 20 bp, human
gccacatggtggggtccccg

SEQ ID NO: 49716 - DNA, 20 bp, human
ggagcaagtctgcatcgcag

SEQ ID NO: 49717 - DNA, 20 bp, human
ggcgatgcagacttgctccc

SEQ ID NO: 49718 - DNA, 20 bp, human
gccagctgtgagcctggcgt

SEQ ID NO: 49719 - DNA, 20 bp, human
gggcagcaggtggccgggta

SEQ ID NO: 49720 - DNA, 20 bp, human
ggccagtgggaggacagcgg

SEQ ID NO: 49721 - DNA, 20 bp, human
gctggggagtcggtgcgcca

SEQ ID NO: 49722 - DNA, 20 bp, human
gcgtgggagctgcctaggcc

SEQ ID NO: 49723 - DNA, 20 bp, human
gttcctgggactcaaggagg

SEQ ID NO: 49724 - DNA, 20 bp, human
gggtgggcaccccagtaccc

SEQ ID NO: 49725 - DNA, 20 bp, human
gcctaggcagctcccacgcc

SEQ ID NO: 49726 - DNA, 20 bp, human
gtgtgccctcccccttgcag

SEQ ID NO: 49727 - DNA, 20 bp, human
gtgctgtttcccctgcaagg

SEQ ID NO: 49728 - DNA, 20 bp, human
gaatcttgtcttagtgtgtc

SEQ ID NO: 49729 - DNA, 20 bp, human
gccagaacaggtagccactg

SEQ ID NO: 49730 - DNA, 20 bp, human
gaggtagccactgcgggctc

SEQ ID NO: 49731 - DNA, 20 bp, human
ggtttcccctgcaaggggga

SEQ ID NO: 49732 - DNA, 20 bp, human
gcttttgatgtttggatgtt

SEQ ID NO: 49733 - DNA, 20 bp, human
ggtgtgctgtttcccctgca

SEQ ID NO: 49734 - DNA, 20 bp, human
gggtgggtttgtggtcttgt

SEQ ID NO: 49735 - DNA, 20 bp, human
gtttgtggtcttgttggctc

SEQ ID NO: 49736 - DNA, 20 bp, human
gagatccagggcgacatcaa

SEQ ID NO: 49737 - DNA, 20 bp, human
gcttgctaccaggaaggagt

SEQ ID NO: 49738 - DNA, 20 bp, human
gcctcagcctccaattggta

SEQ ID NO: 49739 - DNA, 20 bp, human
gtgtgccaaggctctatggg

SEQ ID NO: 49740 - DNA, 20 bp, human
gtgtctgtatcagacatcat

SEQ ID NO: 49741 - DNA, 20 bp, human
gatacactggagatgagtag

SEQ ID NO: 49742 - DNA, 20 bp, human
gggacgtagcatcactgagg

SEQ ID NO: 49743 - DNA, 20 bp, human
ggctaccaggaaggagtagg

SEQ ID NO: 49744 - DNA, 20 bp, human
gtgctcagagcgcagaggtg

SEQ ID NO: 49745 - DNA, 20 bp, human
gggttgtgccaaggctctat

SEQ ID NO: 49746 - DNA, 20 bp, human
gaggctgggtcgtcatgatc

SEQ ID NO: 49747 - DNA, 20 bp, human
ggacccagcctcccgaagag

SEQ ID NO: 49748 - DNA, 20 bp, human
ggatgggcagaggccgacaa

SEQ ID NO: 49749 - DNA, 20 bp, human
gcactcgtggacgggtatgt

SEQ ID NO: 49750 - DNA, 20 bp, human
gcttcaaccccctcttcggg

SEQ ID NO: 49751 - DNA, 20 bp, human
gcacccttgggcaggagagg

SEQ ID NO: 49752 - DNA, 20 bp, human
ggcacacccttgggcaggag

SEQ ID NO: 49753 - DNA, 20 bp, human
ggcggggtgagcacaccctt

SEQ ID NO: 49754 - DNA, 20 bp, human
gagaggccgacaatggggtc

SEQ ID NO: 49755 - DNA, 20 bp, human
ggctatcaaggaggctatca

SEQ ID NO: 49756 - DNA, 20 bp, human
gctacgatttcattcattct

SEQ ID NO: 49757 - DNA, 20 bp, human
gagcgggttctgaatggcgg

SEQ ID NO: 49758 - DNA, 20 bp, human
ggaccctgagggagagatgg

SEQ ID NO: 49759 - DNA, 20 bp, human
ggtttccccacccagagtgg

SEQ ID NO: 49760 - DNA, 20 bp, human
gtctccctcagggtctccgg

SEQ ID NO: 49761 - DNA, 20 bp, human
gggcacctccggagaccctg

SEQ ID NO: 49762 - DNA, 20 bp, human
ggaaatcgtagcgcgctggg

SEQ ID NO: 49763 - DNA, 20 bp, human
gaaacccctacccccactct

SEQ ID NO: 49764 - DNA, 20 bp, human
gcaaccccagggggcgacag

SEQ ID NO: 49765 - DNA, 20 bp, human
gcgctgtcagtgaaggaatg

SEQ ID NO: 49766 - DNA, 20 bp, human
gccggcccgcaccacctcag

SEQ ID NO: 49767 - DNA, 20 bp, human
gagggggccagggatgacag

SEQ ID NO: 49768 - DNA, 20 bp, human
gaccgctgggaggaccgacc

SEQ ID NO: 49769 - DNA, 20 bp, human
gcaggacccggggagcaaga

SEQ ID NO: 49770 - DNA, 20 bp, human
gagatggccactgtcatccc

SEQ ID NO: 49771 - DNA, 20 bp, human
ggccgggtcggtcctcccag

SEQ ID NO: 49772 - DNA, 20 bp, human
ggcaccacctcagggggcca

SEQ ID NO: 49773 - DNA, 20 bp, human
gacctgctgggggcaggacc

SEQ ID NO: 49774 - DNA, 20 bp, human
gactccacatcccaagacaa

SEQ ID NO: 49775 - DNA, 20 bp, human
gccggtcgccacacacacac

SEQ ID NO: 49776 - DNA, 20 bp, human
gcatgttgcgactcctggtg

SEQ ID NO: 49777 - DNA, 20 bp, human
gctgcgcgctgcggactgtg

SEQ ID NO: 49778 - DNA, 20 bp, human
ggcttctcggcccgaggcag

SEQ ID NO: 49779 - DNA, 20 bp, human
gcgaggcccgggcggcccta

SEQ ID NO: 49780 - DNA, 20 bp, human
gtctcgggagaggaccggga

SEQ ID NO: 49781 - DNA, 20 bp, human
gaggcgtctcgggagaggac

SEQ ID NO: 49782 - DNA, 20 bp, human
gtgcagcgaacgggacggga

SEQ ID NO: 49783 - DNA, 20 bp, human
gccgagacgcctcagtccgg

SEQ ID NO: 49784 - DNA, 20 bp, human
gctcccgagacgcctcagtc

SEQ ID NO: 49785 - DNA, 20 bp, human
gcccgcagtgcactccgcag

SEQ ID NO: 49786 - DNA, 20 bp, human
gcaggatggcagtagtttag

SEQ ID NO: 49787 - DNA, 20 bp, human
gggtcacaggaaactcgccc

SEQ ID NO: 49788 - DNA, 20 bp, human
gcagtacctgacaataatca

SEQ ID NO: 49789 - DNA, 20 bp, human
gagtaagaacagaactgcag

SEQ ID NO: 49790 - DNA, 20 bp, human
ggtggcccccagtgaagagg

SEQ ID NO: 49791 - DNA, 20 bp, human
gagtcgagcgcgaaaggtac

SEQ ID NO: 49792 - DNA, 20 bp, human
ggcgctcgactgttggtcac

SEQ ID NO: 49793 - DNA, 20 bp, human
gactgcaggggcctgcttcc

SEQ ID NO: 49794 - DNA, 20 bp, human
gaggtacaggattatccctg

SEQ ID NO: 49795 - DNA, 20 bp, human
gaccaacagtcgagcgcgaa

SEQ ID NO: 49796 - DNA, 20 bp, human
gggctcggccaagtacaccg

SEQ ID NO: 49797 - DNA, 20 bp, human
ggtcttacttacgctttcag

SEQ ID NO: 49798 - DNA, 20 bp, human
gtcggccaagtacaccgagg

SEQ ID NO: 49799 - DNA, 20 bp, human
gcgagcgctctacagcagga

SEQ ID NO: 49800 - DNA, 20 bp, human
gccggagtcccccgcctcgc

SEQ ID NO: 49801 - DNA, 20 bp, human
gcgtcgggcagtggccgcct

SEQ ID NO: 49802 - DNA, 20 bp, human
ggaagagagaagccccgccg

SEQ ID NO: 49803 - DNA, 20 bp, human
gcccaacgcgcagaaatgtc

SEQ ID NO: 49804 - DNA, 20 bp, human
gtgcagagagagccagatat

SEQ ID NO: 49805 - DNA, 20 bp, human
ggcctgcaagcgcaatgctc

SEQ ID NO: 49806 - DNA, 20 bp, human
gtggcggcgctggtcgtatc

SEQ ID NO: 49807 - DNA, 20 bp, human
gtatccggggcagcggagca

SEQ ID NO: 49808 - DNA, 20 bp, human
gatgcgcaggcaggtgatgg

SEQ ID NO: 49809 - DNA, 20 bp, human
gagacagcgctggaagaacg

SEQ ID NO: 49810 - DNA, 20 bp, human
gccgagatgcgaggtctgga

SEQ ID NO: 49811 - DNA, 20 bp, human
gccggggcagcggagcaggg

SEQ ID NO: 49812 - DNA, 20 bp, human
gggcccaaggcgactaacag

SEQ ID NO: 49813 - DNA, 20 bp, human
ggcgcaggcctggcattcgg

SEQ ID NO: 49814 - DNA, 20 bp, human
gccagcacccacctctgcca

SEQ ID NO: 49815 - DNA, 20 bp, human
ggactaacagcgggatctag

SEQ ID NO: 49816 - DNA, 20 bp, human
ggttcttcaggatctcaggg

SEQ ID NO: 49817 - DNA, 20 bp, human
gcgggtgggtaaagccctgg

SEQ ID NO: 49818 - DNA, 20 bp, human
gcccgggtaatgagcatagg

SEQ ID NO: 49819 - DNA, 20 bp, human
gtctcaaagttgtagttgga

SEQ ID NO: 49820 - DNA, 20 bp, human
gacccgggtgggtaaagccc

SEQ ID NO: 49821 - DNA, 20 bp, human
ggattgctgcctgcagctga

SEQ ID NO: 49822 - DNA, 20 bp, human
ggtgggtaaagccctggtgg

SEQ ID NO: 49823 - DNA, 20 bp, human
gctgcagctgagggttcttc

SEQ ID NO: 49824 - DNA, 20 bp, human
gcagagacatgagaggtgga

SEQ ID NO: 49825 - DNA, 20 bp, human
ggagggttcttcaggatctc

SEQ ID NO: 49826 - DNA, 20 bp, human
ggtaagcagtcctggcaccc

SEQ ID NO: 49827 - DNA, 20 bp, human
gatgtttagcagccctgccg

SEQ ID NO: 49828 - DNA, 20 bp, human
gggctgaaggggatactcac

SEQ ID NO: 49829 - DNA, 20 bp, human
gtagcggagaaacagtagtt

SEQ ID NO: 49830 - DNA, 20 bp, human
ggggtagggggaatcacagt

SEQ ID NO: 49831 - DNA, 20 bp, human
gatcacagtcggccttcagc

SEQ ID NO: 49832 - DNA, 20 bp, human
ggctacacgtgggactaccg

SEQ ID NO: 49833 - DNA, 20 bp, human
ggggcgacccatcccgacag

SEQ ID NO: 49834 - DNA, 20 bp, human
gggtcaaaatcgccttgtgg

SEQ ID NO: 49835 - DNA, 20 bp, human
ggcgctgcagcgagagaccg

SEQ ID NO: 49836 - DNA, 20 bp, human
ggtaacgccccagcagtccg

SEQ ID NO: 49837 - DNA, 20 bp, human
gtccggcgaagttaaaccct

SEQ ID NO: 49838 - DNA, 20 bp, human
gggaccctaaggcagggatc

SEQ ID NO: 49839 - DNA, 20 bp, human
gatcccaggttgggacccta

SEQ ID NO: 49840 - DNA, 20 bp, human
gtgcctaccgagagagctca

SEQ ID NO: 49841 - DNA, 20 bp, human
gaggttgggaccctaaggca

SEQ ID NO: 49842 - DNA, 20 bp, human
gtgccctgagctctctcggt

SEQ ID NO: 49843 - DNA, 20 bp, human
gcttagattaggtcagggag

SEQ ID NO: 49844 - DNA, 20 bp, human
gaaaccctcggagctggcct

SEQ ID NO: 49845 - DNA, 20 bp, human
gtacccaatgatggaaggaa

SEQ ID NO: 49846 - DNA, 20 bp, human
gagttgcttctgcggaaagg

SEQ ID NO: 49847 - DNA, 20 bp, human
gacgccgccggcctcaccta

SEQ ID NO: 49848 - DNA, 20 bp, human
gccaaggacatcacagtcaa

SEQ ID NO: 49849 - DNA, 20 bp, human
gacagttaggactgaggtgt

SEQ ID NO: 49850 - DNA, 20 bp, human
gtacccgctgagagaatcgt

SEQ ID NO: 49851 - DNA, 20 bp, human
gtgcagttgcttctgcggaa

SEQ ID NO: 49852 - DNA, 20 bp, human
gccggctccgtgcagagaaa

SEQ ID NO: 49853 - DNA, 20 bp, human
gggcttccttccctacagtt

SEQ ID NO: 49854 - DNA, 20 bp, human
ggaagcaactgcaaaagcgc

SEQ ID NO: 49855 - DNA, 20 bp, human
ggacatcacagtcaagggcc

SEQ ID NO: 49856 - DNA, 20 bp, human
ggcgctagcggcggctggaa

SEQ ID NO: 49857 - DNA, 20 bp, human
gagaccagagagcgacagac

SEQ ID NO: 49858 - DNA, 20 bp, human
ggagccgcgaccctcatgct

SEQ ID NO: 49859 - DNA, 20 bp, human
gcgcactgcgcccagcatga

SEQ ID NO: 49860 - DNA, 20 bp, human
gccgctagcgccgaaagagt

SEQ ID NO: 49861 - DNA, 20 bp, human
ggcgcccagcatgagggtcg

SEQ ID NO: 49862 - DNA, 20 bp, human
gagttgatggaataaggtag

SEQ ID NO: 49863 - DNA, 20 bp, human
ggtagtggctccaaacttca

SEQ ID NO: 49864 - DNA, 20 bp, human
ggagggtcgcggctctgatc

SEQ ID NO: 49865 - DNA, 20 bp, human
gtcctccgagccacaggaag

SEQ ID NO: 49866 - DNA, 20 bp, human
gggacgagcgcagagcccca

SEQ ID NO: 49867 - DNA, 20 bp, human
gtcgcccaggagatgaagag

SEQ ID NO: 49868 - DNA, 20 bp, human
gggcgcggagccggcagtag

SEQ ID NO: 49869 - DNA, 20 bp, human
gggctgggtactgcgcgggg

SEQ ID NO: 49870 - DNA, 20 bp, human
ggcggagccggcagtagagg

SEQ ID NO: 49871 - DNA, 20 bp, human
gggccctttggccaggaggt

SEQ ID NO: 49872 - DNA, 20 bp, human
gccgcgctgacggtgtccct

SEQ ID NO: 49873 - DNA, 20 bp, human
gggccgggctgggtactgcg

SEQ ID NO: 49874 - DNA, 20 bp, human
ggaaggagtcgcgagagagg

SEQ ID NO: 49875 - DNA, 20 bp, human
gcagtagaggcgggtcggcg

SEQ ID NO: 49876 - DNA, 20 bp, human
ggcagccagctgccgacacc

SEQ ID NO: 49877 - DNA, 20 bp, human
gggactacgactgacttcca

SEQ ID NO: 49878 - DNA, 20 bp, human
gtagtcctcgcaggtctcgg

SEQ ID NO: 49879 - DNA, 20 bp, human
ggctcccgccgagacctgcg

SEQ ID NO: 49880 - DNA, 20 bp, human
gtcgtagtcctcgcaggtct

SEQ ID NO: 49881 - DNA, 20 bp, human
ggcggaactgagccagatgc

SEQ ID NO: 49882 - DNA, 20 bp, human
ggcttccccggcccgggtgt

SEQ ID NO: 49883 - DNA, 20 bp, human
gggccaacctttctacggaa

SEQ ID NO: 49884 - DNA, 20 bp, human
gagtcagtcgtagtcctcgc

SEQ ID NO: 49885 - DNA, 20 bp, human
ggacctggtgcgctacctct

SEQ ID NO: 49886 - DNA, 20 bp, human
gcaccgtgtgccggagatag

SEQ ID NO: 49887 - DNA, 20 bp, human
gccccagacgcccctatctc

SEQ ID NO: 49888 - DNA, 20 bp, human
gcgcggggaaatggtgagat

SEQ ID NO: 49889 - DNA, 20 bp, human
ggtggacccggaaccggatg

SEQ ID NO: 49890 - DNA, 20 bp, human
gccagctcctgagcagaccc

SEQ ID NO: 49891 - DNA, 20 bp, human
gatgtggcttgcggctcggg

SEQ ID NO: 49892 - DNA, 20 bp, human
gctggagagttcaagagatg

SEQ ID NO: 49893 - DNA, 20 bp, human
gcgtggcctggagaaaaggg

SEQ ID NO: 49894 - DNA, 20 bp, human
gcgcccctatctccggcaca

SEQ ID NO: 49895 - DNA, 20 bp, human
ggccagagcaactactatat

SEQ ID NO: 49896 - DNA, 20 bp, human
gagcggaacgtgaaccaggg

SEQ ID NO: 49897 - DNA, 20 bp, human
ggtaggttgaaggctgaatg

SEQ ID NO: 49898 - DNA, 20 bp, human
ggtggggtagaggtaagtgt

SEQ ID NO: 49899 - DNA, 20 bp, human
gcagtggccacaggacttcc

SEQ ID NO: 49900 - DNA, 20 bp, human
gcccagggcatagcagccgg

SEQ ID NO: 49901 - DNA, 20 bp, human
gccggcggacaccagcaagt

SEQ ID NO: 49902 - DNA, 20 bp, human
gggcactgtgggctatcgtg

SEQ ID NO: 49903 - DNA, 20 bp, human
gcctgggtggccctgaccac

SEQ ID NO: 49904 - DNA, 20 bp, human
gagaggtaagtgtaggttga

SEQ ID NO: 49905 - DNA, 20 bp, human
gccccgcgcggcccggatgt

SEQ ID NO: 49906 - DNA, 20 bp, human
ggcggcgaggcgagaccaag

SEQ ID NO: 49907 - DNA, 20 bp, human
gccgcgctccggcctctctt

SEQ ID NO: 49908 - DNA, 20 bp, human
gtccgggctctccccccccc

SEQ ID NO: 49909 - DNA, 20 bp, human
gagggagggaccctacgacg

SEQ ID NO: 49910 - DNA, 20 bp, human
gggctgcggttgccgaagag

SEQ ID NO: 49911 - DNA, 20 bp, human
gggcgagaggatgcgcaagg

SEQ ID NO: 49912 - DNA, 20 bp, human
gcggcggaccaggtgagagt

SEQ ID NO: 49913 - DNA, 20 bp, human
gcagcagactacggatgtct

SEQ ID NO: 49914 - DNA, 20 bp, human
gaagcggcaagttagtgcag

SEQ ID NO: 49915 - DNA, 20 bp, human
gacatccgtagtctgctgag

SEQ ID NO: 49916 - DNA, 20 bp, human
gcagcctcgaggttcggaaa

SEQ ID NO: 49917 - DNA, 20 bp, human
gcagggagcgagcaggagaa

SEQ ID NO: 49918 - DNA, 20 bp, human
gcgctccctgtgctccacca

SEQ ID NO: 49919 - DNA, 20 bp, human
gcaccaagcccaggccgaga

SEQ ID NO: 49920 - DNA, 20 bp, human
gcgacagcactcttgcaggt

SEQ ID NO: 49921 - DNA, 20 bp, human
ggcagagccccaatgaatgg

SEQ ID NO: 49922 - DNA, 20 bp, human
gctctgaggtgaaaccccaa

SEQ ID NO: 49923 - DNA, 20 bp, human
gcgagacggcgcgggtgtca

SEQ ID NO: 49924 - DNA, 20 bp, human
gaggtgggaacctacacaat

SEQ ID NO: 49925 - DNA, 20 bp, human
ggaggccaaggagtgctccg

SEQ ID NO: 49926 - DNA, 20 bp, human
ggcgcaggcagaagtcaccg

SEQ ID NO: 49927 - DNA, 20 bp, human
gactccaccgcccggagcag

SEQ ID NO: 49928 - DNA, 20 bp, human
gcgccagttggagttctcta

SEQ ID NO: 49929 - DNA, 20 bp, human
gtctgaaggcacaagttcaa

SEQ ID NO: 49930 - DNA, 20 bp, human
gaggcagaagtcaccgcggg

SEQ ID NO: 49931 - DNA, 20 bp, human
gcggcactcaccttcatcgt

SEQ ID NO: 49932 - DNA, 20 bp, human
gggaagtgagcgttcagaga

SEQ ID NO: 49933 - DNA, 20 bp, human
ggcgttcagagaaggagcgc

SEQ ID NO: 49934 - DNA, 20 bp, human
gcggggccgaaacttgccag

SEQ ID NO: 49935 - DNA, 20 bp, human
ggttagaagagggagaccgc

SEQ ID NO: 49936 - DNA, 20 bp, human
ggcgcggagcgatggtgacg

SEQ ID NO: 49937 - DNA, 20 bp, human
gcggagcgatggtgacgagg

SEQ ID NO: 49938 - DNA, 20 bp, human
gcagcgagacgcgtcggcag

SEQ ID NO: 49939 - DNA, 20 bp, human
ggcggtcaccgcgtcccgga

SEQ ID NO: 49940 - DNA, 20 bp, human
gagagcttctcgggggcggg

SEQ ID NO: 49941 - DNA, 20 bp, human
gggacgcggtgaccgcgatc

SEQ ID NO: 49942 - DNA, 20 bp, human
gccggagagtcgtgggcggg

SEQ ID NO: 49943 - DNA, 20 bp, human
gggggcggcggcgggttctc

SEQ ID NO: 49944 - DNA, 20 bp, human
gaggtccttccccgcgcccc

SEQ ID NO: 49945 - DNA, 20 bp, human
gactcgcctccgggggcgcg

SEQ ID NO: 49946 - DNA, 20 bp, human
gcgcccgcggaaggcgacat

SEQ ID NO: 49947 - DNA, 20 bp, human
gccgcgggcgcccgtcacgt

SEQ ID NO: 49948 - DNA, 20 bp, human
ggcagcaggaccggggccca

SEQ ID NO: 49949 - DNA, 20 bp, human
gtcttctacactgggaacga

SEQ ID NO: 49950 - DNA, 20 bp, human
ggggaacgagggcgacgtgt

SEQ ID NO: 49951 - DNA, 20 bp, human
gcgacaccaggaagcgctga

SEQ ID NO: 49952 - DNA, 20 bp, human
ggacatgggctccgctccct

SEQ ID NO: 49953 - DNA, 20 bp, human
gggacccagaacctgtctgt

SEQ ID NO: 49954 - DNA, 20 bp, human
gtggtcttcgcggagcacgt

SEQ ID NO: 49955 - DNA, 20 bp, human
ggccgccagctccgcgacga

SEQ ID NO: 49956 - DNA, 20 bp, human
gggggacccaggaagtcagt

SEQ ID NO: 49957 - DNA, 20 bp, human
gtgccaaccccgtcaaggtg

SEQ ID NO: 49958 - DNA, 20 bp, human
gctccctgccaaccccgtca

SEQ ID NO: 49959 - DNA, 20 bp, human
gggcggcgcctcaccttgac

SEQ ID NO: 49960 - DNA, 20 bp, human
gcctaccccactgacttcct

SEQ ID NO: 49961 - DNA, 20 bp, human
gcagtgctgagagggtcccc

SEQ ID NO: 49962 - DNA, 20 bp, human
gcgcctcaccttgacggggt

SEQ ID NO: 49963 - DNA, 20 bp, human
ggtgaggcccagaggatcac

SEQ ID NO: 49964 - DNA, 20 bp, human
ggggtaggggtagtccatca

SEQ ID NO: 49965 - DNA, 20 bp, human
gggccggctggagtgtcccg

SEQ ID NO: 49966 - DNA, 20 bp, human
gacgcggcactaagaagcag

SEQ ID NO: 49967 - DNA, 20 bp, human
ggcggcgccggtgacaaccc

SEQ ID NO: 49968 - DNA, 20 bp, human
ggcgccggtgacaacccagg

SEQ ID NO: 49969 - DNA, 20 bp, human
gaggggcgcccagtgaacgg

SEQ ID NO: 49970 - DNA, 20 bp, human
gacaacccaggcggcgaacg

SEQ ID NO: 49971 - DNA, 20 bp, human
gtcaaggggcgcccagtgaa

SEQ ID NO: 49972 - DNA, 20 bp, human
gggaagtgctaaagcctccg

SEQ ID NO: 49973 - DNA, 20 bp, human
gtcgccgcctgggttgtcac

SEQ ID NO: 49974 - DNA, 20 bp, human
gcagtgaacggtggttgact

SEQ ID NO: 49975 - DNA, 20 bp, human
ggtagcagcggccttggcct

SEQ ID NO: 49976 - DNA, 20 bp, human
ggcctgggcagcaacgggat

SEQ ID NO: 49977 - DNA, 20 bp, human
gcaggtcgtcccgggtccag

SEQ ID NO: 49978 - DNA, 20 bp, human
ggggactgcgaccccggaag

SEQ ID NO: 49979 - DNA, 20 bp, human
gctgcgaccccggaagtggc

SEQ ID NO: 49980 - DNA, 20 bp, human
gctggccagcgcaggaatcg

SEQ ID NO: 49981 - DNA, 20 bp, human
gccggaagtggcgggagcgg

SEQ ID NO: 49982 - DNA, 20 bp, human
ggcatggagccgcgaccgtg

SEQ ID NO: 49983 - DNA, 20 bp, human
ggtgcggccacctccggaag

SEQ ID NO: 49984 - DNA, 20 bp, human
gggcagcaacgggatgggtg

SEQ ID NO: 49985 - DNA, 20 bp, human
gaccccggaagtggcgggag

SEQ ID NO: 49986 - DNA, 20 bp, human
gtctgtgctcgggatgaaca

SEQ ID NO: 49987 - DNA, 20 bp, human
gtcgggatgaacagggccgg

SEQ ID NO: 49988 - DNA, 20 bp, human
gtgctcgggatgaacagggc

SEQ ID NO: 49989 - DNA, 20 bp, human
gcctcctcgtacaccacata

SEQ ID NO: 49990 - DNA, 20 bp, human
gtcagccttctaggacgtgg

SEQ ID NO: 49991 - DNA, 20 bp, human
gatgaggggagaggctccaa

SEQ ID NO: 49992 - DNA, 20 bp, human
gacgagctggagccactgct

SEQ ID NO: 49993 - DNA, 20 bp, human
gggcaaacaccacctgccat

SEQ ID NO: 49994 - DNA, 20 bp, human
gcagccgtatgtggtgtacg

SEQ ID NO: 49995 - DNA, 20 bp, human
gggtggtgtttgcccttgtg

SEQ ID NO: 49996 - DNA, 20 bp, human
ggcggggacggagaggatgt

SEQ ID NO: 49997 - DNA, 20 bp, human
gcaggagcttaagaatcgtc

SEQ ID NO: 49998 - DNA, 20 bp, human
gggacggcatgggctgtagt

SEQ ID NO: 49999 - DNA, 20 bp, human
ggacatcctgaatcagatca

SEQ ID NO: 50000 - DNA, 20 bp, human
gccctccgcagccttcggag

SEQ ID NO: 50001 - DNA, 20 bp, human
gtagacaggctctgacgccc

SEQ ID NO: 50002 - DNA, 20 bp, human
ggagcttaagaatcgtccgg

SEQ ID NO: 50003 - DNA, 20 bp, human
gttatggcctgatctagcta

SEQ ID NO: 50004 - DNA, 20 bp, human
ggacggagaggatgtgggta

SEQ ID NO: 50005 - DNA, 20 bp, human
gtagatcaggccataaacaa

SEQ ID NO: 50006 - DNA, 20 bp, human
gtaccaggtagcccggaaag

SEQ ID NO: 50007 - DNA, 20 bp, human
gagagggagtcaacacagag

SEQ ID NO: 50008 - DNA, 20 bp, human
gaaaccggagctccaacgaa

SEQ ID NO: 50009 - DNA, 20 bp, human
gtaggtaaacctcaaaccag

SEQ ID NO: 50010 - DNA, 20 bp, human
gatagtcagatagtcaagaa

SEQ ID NO: 50011 - DNA, 20 bp, human
gttattaaaagcggtgatgg

SEQ ID NO: 50012 - DNA, 20 bp, human
gtgactatctgactataggg

SEQ ID NO: 50013 - DNA, 20 bp, human
gagtcaagaagggcattatc

SEQ ID NO: 50014 - DNA, 20 bp, human
gcggttttcagcctctttcc

SEQ ID NO: 50015 - DNA, 20 bp, human
gtgaccattcgttggagctc

SEQ ID NO: 50016 - DNA, 20 bp, human
gtcttctacaagtatggaga

SEQ ID NO: 50017 - DNA, 20 bp, human
gaggctgcaatcatattctt

SEQ ID NO: 50018 - DNA, 20 bp, human
ggaggtcagtacagttttag

SEQ ID NO: 50019 - DNA, 20 bp, human
gtgattgcagcctggtatat

SEQ ID NO: 50020 - DNA, 20 bp, human
gctgctcactccaatatacc

SEQ ID NO: 50021 - DNA, 20 bp, human
gtcaagaggagaaaattcga

SEQ ID NO: 50022 - DNA, 20 bp, human
gcttggggcaggggccattt

SEQ ID NO: 50023 - DNA, 20 bp, human
gattttggaagcatgttgcg

SEQ ID NO: 50024 - DNA, 20 bp, human
gggaaaaatcaggagtgccc

SEQ ID NO: 50025 - DNA, 20 bp, human
gtttctaggtttagttgagg

SEQ ID NO: 50026 - DNA, 20 bp, human
ggttgtgagggtcataagat

SEQ ID NO: 50027 - DNA, 20 bp, human
gagagtggtcttggttgtga

SEQ ID NO: 50028 - DNA, 20 bp, human
ggactgggtacgcggaacac

SEQ ID NO: 50029 - DNA, 20 bp, human
gcctggtttgcgctggagag

SEQ ID NO: 50030 - DNA, 20 bp, human
ggcgccaggagcgaggtgag

SEQ ID NO: 50031 - DNA, 20 bp, human
gtgctggcagcgagcaagag

SEQ ID NO: 50032 - DNA, 20 bp, human
ggcgggatatgtctacgtgc

SEQ ID NO: 50033 - DNA, 20 bp, human
gctggaggagaggcgcgaag

SEQ ID NO: 50034 - DNA, 20 bp, human
ggcggaacacaggctcgcgg

SEQ ID NO: 50035 - DNA, 20 bp, human
gcgtagacatatcccgccgt

SEQ ID NO: 50036 - DNA, 20 bp, human
ggcgcctgggttcaggtcca

SEQ ID NO: 50037 - DNA, 20 bp, human
gtatccctggacctgaaccc

SEQ ID NO: 50038 - DNA, 20 bp, human
gctgaacccaggcgcacatc

SEQ ID NO: 50039 - DNA, 20 bp, human
gggtgcttcgtccacgtggg

SEQ ID NO: 50040 - DNA, 20 bp, human
ggctggtgcttcgtccacgt

SEQ ID NO: 50041 - DNA, 20 bp, human
gaaacgatgacagcctctgt

SEQ ID NO: 50042 - DNA, 20 bp, human
ggaagtccctgccacccacg

SEQ ID NO: 50043 - DNA, 20 bp, human
gctttgctagttcttatccc

SEQ ID NO: 50044 - DNA, 20 bp, human
gtcttcacgtgtctttgctt

SEQ ID NO: 50045 - DNA, 20 bp, human
ggcaaagacacgtgaagaag

SEQ ID NO: 50046 - DNA, 20 bp, human
gcccaggccatggtgactag

SEQ ID NO: 50047 - DNA, 20 bp, human
ggaacccacggagtgctggt

SEQ ID NO: 50048 - DNA, 20 bp, human
gtggtgggaggagatcaaca

SEQ ID NO: 50049 - DNA, 20 bp, human
gtgggttccccgaggctctg

SEQ ID NO: 50050 - DNA, 20 bp, human
gactgaggtccatgctgcct

SEQ ID NO: 50051 - DNA, 20 bp, human
gcttctgcccctagtcacca

SEQ ID NO: 50052 - DNA, 20 bp, human
gagcatgcagtggtgaggtt

SEQ ID NO: 50053 - DNA, 20 bp, human
ggggggctgctagactctca

SEQ ID NO: 50054 - DNA, 20 bp, human
gccccaggggcaggtgatag

SEQ ID NO: 50055 - DNA, 20 bp, human
gcccagtgcagtgcagggac

SEQ ID NO: 50056 - DNA, 20 bp, human
gagggagaaggcgcccggag

SEQ ID NO: 50057 - DNA, 20 bp, human
ggtcgccgtgacaaccggag

SEQ ID NO: 50058 - DNA, 20 bp, human
ggcgcaggcgagacgcggcg

SEQ ID NO: 50059 - DNA, 20 bp, human
ggcccggagcggccacttag

SEQ ID NO: 50060 - DNA, 20 bp, human
gtggcagtaccgccgggagg

SEQ ID NO: 50061 - DNA, 20 bp, human
ggccgtgacaaccggagcgg

SEQ ID NO: 50062 - DNA, 20 bp, human
gacaaccggagcggcggcaa

SEQ ID NO: 50063 - DNA, 20 bp, human
gctccaagcgcagccttaac

SEQ ID NO: 50064 - DNA, 20 bp, human
gcacgcacagcgcccctaag

SEQ ID NO: 50065 - DNA, 20 bp, human
gcaagtttcggagcctgtta

SEQ ID NO: 50066 - DNA, 20 bp, human
gcaggcgagtcaggtctctc

SEQ ID NO: 50067 - DNA, 20 bp, human
gtcataatcaaggagtatgg

SEQ ID NO: 50068 - DNA, 20 bp, human
gccgcagccagtctaagggg

SEQ ID NO: 50069 - DNA, 20 bp, human
gttctcataatcaaggagta

SEQ ID NO: 50070 - DNA, 20 bp, human
gcaaggagtatggtggagct

SEQ ID NO: 50071 - DNA, 20 bp, human
gccggccgcagccagtctaa

SEQ ID NO: 50072 - DNA, 20 bp, human
gccttgattatgagaaaaca

SEQ ID NO: 50073 - DNA, 20 bp, human
gaaagtctgaaagagcgaaa

SEQ ID NO: 50074 - DNA, 20 bp, human
gacctccggctcccgggcga

SEQ ID NO: 50075 - DNA, 20 bp, human
ggaaactgccaaggggctcc

SEQ ID NO: 50076 - DNA, 20 bp, human
gcgcgccgcgggtacaagga

SEQ ID NO: 50077 - DNA, 20 bp, human
gcgcggtcttgggagagctg

SEQ ID NO: 50078 - DNA, 20 bp, human
ggcctgggctgcgaccccgg

SEQ ID NO: 50079 - DNA, 20 bp, human
gcccatcaggtaggtctcca

SEQ ID NO: 50080 - DNA, 20 bp, human
ggcagcgcgccgcgggtaca

SEQ ID NO: 50081 - DNA, 20 bp, human
ggctctcccaagaccgcgag

SEQ ID NO: 50082 - DNA, 20 bp, human
gccctggacgaggcaggcac

SEQ ID NO: 50083 - DNA, 20 bp, human
gacggggctaggcgggaacg

SEQ ID NO: 50084 - DNA, 20 bp, human
gcctggcgtccccatcaggt

SEQ ID NO: 50085 - DNA, 20 bp, human
gaaggaccaagtttgcggag

SEQ ID NO: 50086 - DNA, 20 bp, human
ggttcggcgacgcggaggga

SEQ ID NO: 50087 - DNA, 20 bp, human
ggccaggagcgggcccccgg

SEQ ID NO: 50088 - DNA, 20 bp, human
gcgaaggctagggcgccctg

SEQ ID NO: 50089 - DNA, 20 bp, human
gaggggttcggcgacgcgga

SEQ ID NO: 50090 - DNA, 20 bp, human
gcgggagtggttgggaaaga

SEQ ID NO: 50091 - DNA, 20 bp, human
ggccttcgcagaaacgatgg

SEQ ID NO: 50092 - DNA, 20 bp, human
gatcgtttctgcgaaggcta

SEQ ID NO: 50093 - DNA, 20 bp, human
gtggatattgacaaacccag

SEQ ID NO: 50094 - DNA, 20 bp, human
gccccggaggccgaggggtt

SEQ ID NO: 50095 - DNA, 20 bp, human
gtggcggcgacaccggaggg

SEQ ID NO: 50096 - DNA, 20 bp, human
gctcttaagaacgaacggct

SEQ ID NO: 50097 - DNA, 20 bp, human
ggagctggtggcgcggtgca

SEQ ID NO: 50098 - DNA, 20 bp, human
gcagggctcttaagaacgaa

SEQ ID NO: 50099 - DNA, 20 bp, human
ggtgcgacagccgtcactta

SEQ ID NO: 50100 - DNA, 20 bp, human
gcagctccggccgtaagtga

SEQ ID NO: 50101 - DNA, 20 bp, human
gagctgtttgtgctgggagc

SEQ ID NO: 50102 - DNA, 20 bp, human
ggacagccgtcacttacggc

SEQ ID NO: 50103 - DNA, 20 bp, human
gtcaggaggccgtggattca

SEQ ID NO: 50104 - DNA, 20 bp, human
ggcagggaggcagcgagaaa

SEQ ID NO: 50105 - DNA, 20 bp, human
gagtgggacagtccacgact

SEQ ID NO: 50106 - DNA, 20 bp, human
gctggcagactcgagactgt

SEQ ID NO: 50107 - DNA, 20 bp, human
gcgcaaggagggtttgtcac

SEQ ID NO: 50108 - DNA, 20 bp, human
ggctggagcttgaggacgca

SEQ ID NO: 50109 - DNA, 20 bp, human
gcagagaggtggactctagg

SEQ ID NO: 50110 - DNA, 20 bp, human
gcggagcgcgagtcgaaaac

SEQ ID NO: 50111 - DNA, 20 bp, human
ggtcgaaaacaggcagacta

SEQ ID NO: 50112 - DNA, 20 bp, human
gggagcttgaggacgcaagg

SEQ ID NO: 50113 - DNA, 20 bp, human
gattcagaggaggacaagac

SEQ ID NO: 50114 - DNA, 20 bp, human
gggactttccgctactggag

SEQ ID NO: 50115 - DNA, 20 bp, human
gagggcaacccctccagtag

SEQ ID NO: 50116 - DNA, 20 bp, human
ggaggaccccgggacgactg

SEQ ID NO: 50117 - DNA, 20 bp, human
gcgccccgcggtacccacgg

SEQ ID NO: 50118 - DNA, 20 bp, human
gccgcaggagcgcccccggg

SEQ ID NO: 50119 - DNA, 20 bp, human
gccatcgacgacttccacca

SEQ ID NO: 50120 - DNA, 20 bp, human
gggaccgcgagcccatgaag

SEQ ID NO: 50121 - DNA, 20 bp, human
ggagctcgggggctgtcggt

SEQ ID NO: 50122 - DNA, 20 bp, human
gccactaaaggaggagtcga

SEQ ID NO: 50123 - DNA, 20 bp, human
ggacttccaccagggcacca

SEQ ID NO: 50124 - DNA, 20 bp, human
gccccgccccgcggtaccca

SEQ ID NO: 50125 - DNA, 20 bp, human
gggcagagctcgggggctgt

SEQ ID NO: 50126 - DNA, 20 bp, human
gtccaacacagccccagcta

SEQ ID NO: 50127 - DNA, 20 bp, human
gcggtggccgacttgaaccg

SEQ ID NO: 50128 - DNA, 20 bp, human
gccttctgtgctacaaaagg

SEQ ID NO: 50129 - DNA, 20 bp, human
ggagagagatgtcttatcag

SEQ ID NO: 50130 - DNA, 20 bp, human
ggcctccgttagcaacagaa

SEQ ID NO: 50131 - DNA, 20 bp, human
gactacagcaataaaagcct

SEQ ID NO: 50132 - DNA, 20 bp, human
gagaccttctgtgctacaaa

SEQ ID NO: 50133 - DNA, 20 bp, human
gggcggcgcatgcgccacgg

SEQ ID NO: 50134 - DNA, 20 bp, human
gtaaaagcctcggttcaagt

SEQ ID NO: 50135 - DNA, 20 bp, human
gaggcaaaaactgccgggaa

SEQ ID NO: 50136 - DNA, 20 bp, human
gggcgagccggagcagaaga

SEQ ID NO: 50137 - DNA, 20 bp, human
gctaccggcggtgggaaggg

SEQ ID NO: 50138 - DNA, 20 bp, human
gtgtgcgctgaggaaggcgc

SEQ ID NO: 50139 - DNA, 20 bp, human
ggggcgctgtgcgctgagga

SEQ ID NO: 50140 - DNA, 20 bp, human
gcgcgctcctggggaactac

SEQ ID NO: 50141 - DNA, 20 bp, human
ggaactaccggcggtgggaa

SEQ ID NO: 50142 - DNA, 20 bp, human
gcgcacagcgccccgagatc

SEQ ID NO: 50143 - DNA, 20 bp, human
gaaagaggaaacccaaacag

SEQ ID NO: 50144 - DNA, 20 bp, human
ggctcctggggaactaccgg

SEQ ID NO: 50145 - DNA, 20 bp, human
gacagcgccccgagatcagg

SEQ ID NO: 50146 - DNA, 20 bp, human
gggacagggaccagacgcaa

SEQ ID NO: 50147 - DNA, 20 bp, human
ggtaggggcggcacaagcgg

SEQ ID NO: 50148 - DNA, 20 bp, human
gacgcgtgcgtggggacggc

SEQ ID NO: 50149 - DNA, 20 bp, human
gccggccccgggttctcccc

SEQ ID NO: 50150 - DNA, 20 bp, human
gtcctgggggtctctggtag

SEQ ID NO: 50151 - DNA, 20 bp, human
gtgagccgggacgcgtgcgt

SEQ ID NO: 50152 - DNA, 20 bp, human
gggagcaggatgtccttcca

SEQ ID NO: 50153 - DNA, 20 bp, human
gaggctcccggaagccggca

SEQ ID NO: 50154 - DNA, 20 bp, human
gcccacgcacaagaccagga

SEQ ID NO: 50155 - DNA, 20 bp, human
gggaccggaacggagccgtg

SEQ ID NO: 50156 - DNA, 20 bp, human
gtgctaggcgcgaaacccct

SEQ ID NO: 50157 - DNA, 20 bp, human
gccggagctgcgggtgctcg

SEQ ID NO: 50158 - DNA, 20 bp, human
gagcgcgggagtccagagtg

SEQ ID NO: 50159 - DNA, 20 bp, human
gacagcgcagatcctgggac

SEQ ID NO: 50160 - DNA, 20 bp, human
ggtccgtctccgtctcgccg

SEQ ID NO: 50161 - DNA, 20 bp, human
gtgcacgcgcgctcgctcgg

SEQ ID NO: 50162 - DNA, 20 bp, human
gctgcgtgaggcgcacaaaa

SEQ ID NO: 50163 - DNA, 20 bp, human
gggatgtcctagcccgggag

SEQ ID NO: 50164 - DNA, 20 bp, human
ggcttcgcgggcgtacaaag

SEQ ID NO: 50165 - DNA, 20 bp, human
ggcctcacgcagaaacagaa

SEQ ID NO: 50166 - DNA, 20 bp, human
ggctctaggacgtgtcagga

SEQ ID NO: 50167 - DNA, 20 bp, human
gtacttcacacggtcagggt

SEQ ID NO: 50168 - DNA, 20 bp, human
gcttaggcaggggtcctcaa

SEQ ID NO: 50169 - DNA, 20 bp, human
ggggttggtggtgactacgt

SEQ ID NO: 50170 - DNA, 20 bp, human
ggaaggcagagcagccagta

SEQ ID NO: 50171 - DNA, 20 bp, human
gaggtagaggttaaggatca

SEQ ID NO: 50172 - DNA, 20 bp, human
gcatgatcaactgaaggtag

SEQ ID NO: 50173 - DNA, 20 bp, human
ggtcgacagtccctatagtc

SEQ ID NO: 50174 - DNA, 20 bp, human
gggtggtgactacgtgggtc

SEQ ID NO: 50175 - DNA, 20 bp, human
gccggctctacctcagggat

SEQ ID NO: 50176 - DNA, 20 bp, human
gaaggatggtttggccgagg

SEQ ID NO: 50177 - DNA, 20 bp, human
gcccaacggcgtcggagcag

SEQ ID NO: 50178 - DNA, 20 bp, human
gtcgcctaactggtccccaa

SEQ ID NO: 50179 - DNA, 20 bp, human
ggtagcccgaacgcagatcg

SEQ ID NO: 50180 - DNA, 20 bp, human
gatcgtggaagccgaagacg

SEQ ID NO: 50181 - DNA, 20 bp, human
gggcacagtgggagtcgcag

SEQ ID NO: 50182 - DNA, 20 bp, human
ggcgcaaagggtgtcgggag

SEQ ID NO: 50183 - DNA, 20 bp, human
gggtggtccggaaatttgag

SEQ ID NO: 50184 - DNA, 20 bp, human
gtccctccagatgccaggga

SEQ ID NO: 50185 - DNA, 20 bp, human
gacgccgttggggaccagtt

SEQ ID NO: 50186 - DNA, 20 bp, human
gcccggagcatggaacaggg

SEQ ID NO: 50187 - DNA, 20 bp, human
gggccgggcgcgtacactca

SEQ ID NO: 50188 - DNA, 20 bp, human
gcgtgtggtcaggcagaggt

SEQ ID NO: 50189 - DNA, 20 bp, human
gcaggcagcccggagcaacc

SEQ ID NO: 50190 - DNA, 20 bp, human
gtagcctgggatgtttaggg

SEQ ID NO: 50191 - DNA, 20 bp, human
ggggcgcgtacactcacgga

SEQ ID NO: 50192 - DNA, 20 bp, human
ggcgtacactcacggacggt

SEQ ID NO: 50193 - DNA, 20 bp, human
ggtacccggagcatggaaca

SEQ ID NO: 50194 - DNA, 20 bp, human
gccgggcgccgggttgctcc

SEQ ID NO: 50195 - DNA, 20 bp, human
gcactcacctgatatacggg

SEQ ID NO: 50196 - DNA, 20 bp, human
gcctatgctaaaaggagaca

SEQ ID NO: 50197 - DNA, 20 bp, human
gagcgctagtcggtctggta

SEQ ID NO: 50198 - DNA, 20 bp, human
gcggccagcgctagtcggtc

SEQ ID NO: 50199 - DNA, 20 bp, human
ggccagcggccagcgctagt

SEQ ID NO: 50200 - DNA, 20 bp, human
gagacgcgagagacggaact

SEQ ID NO: 50201 - DNA, 20 bp, human
gtagcccccggaggcaatga

SEQ ID NO: 50202 - DNA, 20 bp, human
gcgcttccggagaaaatcag

SEQ ID NO: 50203 - DNA, 20 bp, human
ggtaaggtaagtcgaagtag

SEQ ID NO: 50204 - DNA, 20 bp, human
gcttggggcaggaggagagt

SEQ ID NO: 50205 - DNA, 20 bp, human
gtggccctcattgcctccgg

SEQ ID NO: 50206 - DNA, 20 bp, human
ggcaggatacagatgatgac

SEQ ID NO: 50207 - DNA, 20 bp, human
gggagcggcggtccagactg

SEQ ID NO: 50208 - DNA, 20 bp, human
gggcggcgctggacccgacg

SEQ ID NO: 50209 - DNA, 20 bp, human
ggcagacggacgaagagatt

SEQ ID NO: 50210 - DNA, 20 bp, human
gggacccgacgcggcgagag

SEQ ID NO: 50211 - DNA, 20 bp, human
gaccgggtcgaggggcgtgg

SEQ ID NO: 50212 - DNA, 20 bp, human
ggacccaggggaaccgcgac

SEQ ID NO: 50213 - DNA, 20 bp, human
gcttcttgctcggcatctcg

SEQ ID NO: 50214 - DNA, 20 bp, human
gccggccaggaggcttcaag

SEQ ID NO: 50215 - DNA, 20 bp, human
gtccaggcccccgaacaccg

SEQ ID NO: 50216 - DNA, 20 bp, human
gggctagtgccgaggagagt

SEQ ID NO: 50217 - DNA, 20 bp, human
ggagcagagccagggtccgt

SEQ ID NO: 50218 - DNA, 20 bp, human
gtgcgagccgggaccccaga

SEQ ID NO: 50219 - DNA, 20 bp, human
ggggagccgagcgcagccga

SEQ ID NO: 50220 - DNA, 20 bp, human
gtggaaaagtgggcgtccag

SEQ ID NO: 50221 - DNA, 20 bp, human
gtgtcagagcgtggaaaagt

SEQ ID NO: 50222 - DNA, 20 bp, human
gaaagtgggcgtccagcggt

SEQ ID NO: 50223 - DNA, 20 bp, human
gtgcgagcccggacaaaggt

SEQ ID NO: 50224 - DNA, 20 bp, human
gcgcagccgagggcgagccg

SEQ ID NO: 50225 - DNA, 20 bp, human
gccgagggcgagccgcggaa

SEQ ID NO: 50226 - DNA, 20 bp, human
gagggaccccggcggattca

SEQ ID NO: 50227 - DNA, 20 bp, human
gttcgggtccagggcctcta

SEQ ID NO: 50228 - DNA, 20 bp, human
gagttggagatggtcaacct

SEQ ID NO: 50229 - DNA, 20 bp, human
ggaggccctggacccgaacg

SEQ ID NO: 50230 - DNA, 20 bp, human
gagggagccgcctagggacc

SEQ ID NO: 50231 - DNA, 20 bp, human
ggttcctagcaaccagcctg

SEQ ID NO: 50232 - DNA, 20 bp, human
gaatccgccggggtccctag

SEQ ID NO: 50233 - DNA, 20 bp, human
gtgcgcgcttagaagcccgg

SEQ ID NO: 50234 - DNA, 20 bp, human
gaccccggcggattcatggc

SEQ ID NO: 50235 - DNA, 20 bp, human
gctccggtgaccgctctccc

SEQ ID NO: 50236 - DNA, 20 bp, human
gcaggctcctgagaggtcgc

SEQ ID NO: 50237 - DNA, 20 bp, human
gaggagcctgtggcaatgcg

SEQ ID NO: 50238 - DNA, 20 bp, human
ggacgaccccaaggcaaggt

SEQ ID NO: 50239 - DNA, 20 bp, human
gcgcggggccctgctctgta

SEQ ID NO: 50240 - DNA, 20 bp, human
ggagagacgaccccaaggca

SEQ ID NO: 50241 - DNA, 20 bp, human
gcaggtcccaagagaggcgg

SEQ ID NO: 50242 - DNA, 20 bp, human
gcaaggtaggtggctcggac

SEQ ID NO: 50243 - DNA, 20 bp, human
gcagcggctccgaaacgttg

SEQ ID NO: 50244 - DNA, 20 bp, human
ggctcgccctgggaattatt

SEQ ID NO: 50245 - DNA, 20 bp, human
gcagagccttggcgaacctc

SEQ ID NO: 50246 - DNA, 20 bp, human
gaggaggagggacctccaag

SEQ ID NO: 50247 - DNA, 20 bp, human
gtgcagagccggatcccagg

SEQ ID NO: 50248 - DNA, 20 bp, human
gccatgcagagccggatccc

SEQ ID NO: 50249 - DNA, 20 bp, human
gtcagtgtcacggggagagg

SEQ ID NO: 50250 - DNA, 20 bp, human
gggagcgcccgcctgggatc

SEQ ID NO: 50251 - DNA, 20 bp, human
gtccagcttcagtgccgaac

SEQ ID NO: 50252 - DNA, 20 bp, human
ggcgggcgctcccgagcagg

SEQ ID NO: 50253 - DNA, 20 bp, human
gcaagccatagggcgcccgg

SEQ ID NO: 50254 - DNA, 20 bp, human
gtctgcatgggctccccgtc

SEQ ID NO: 50255 - DNA, 20 bp, human
gggcgggcgactcagtgtca

SEQ ID NO: 50256 - DNA, 20 bp, human
gcatgcactaaggtctaata

SEQ ID NO: 50257 - DNA, 20 bp, human
gggctctagaagctatatca

SEQ ID NO: 50258 - DNA, 20 bp, human
gagctatgaaacatgcacta

SEQ ID NO: 50259 - DNA, 20 bp, human
gatagcttctagagcccaca

SEQ ID NO: 50260 - DNA, 20 bp, human
ggccgaagtggtaaactcct

SEQ ID NO: 50261 - DNA, 20 bp, human
gtcaccttagaggcaaaaat

SEQ ID NO: 50262 - DNA, 20 bp, human
gtaaggtctaatagggaagc

SEQ ID NO: 50263 - DNA, 20 bp, human
gtttctttagaggatttggg

SEQ ID NO: 50264 - DNA, 20 bp, human
gcccacaaggatacaatttt

SEQ ID NO: 50265 - DNA, 20 bp, human
gaccgaggagtttaccactt

SEQ ID NO: 50266 - DNA, 20 bp, human
gtcgcgccgggtcctccgta

SEQ ID NO: 50267 - DNA, 20 bp, human
ggaagctccgcaccagaaag

SEQ ID NO: 50268 - DNA, 20 bp, human
gggtccctggatagaaggac

SEQ ID NO: 50269 - DNA, 20 bp, human
gtcacgatgaaggagttggt

SEQ ID NO: 50270 - DNA, 20 bp, human
gcagcaccaggagagcgagg

SEQ ID NO: 50271 - DNA, 20 bp, human
gcctcggagtagacgaagag

SEQ ID NO: 50272 - DNA, 20 bp, human
gcgggtcctccgtagggaca

SEQ ID NO: 50273 - DNA, 20 bp, human
gggtgtatcgccgagggaca

SEQ ID NO: 50274 - DNA, 20 bp, human
gggtgcggagcttccagctg

SEQ ID NO: 50275 - DNA, 20 bp, human
gacagacgccaagacagacg

SEQ ID NO: 50276 - DNA, 20 bp, human
gtgctgccgccaggcagcaa

SEQ ID NO: 50277 - DNA, 20 bp, human
ggtagcgcgccggacggcag

SEQ ID NO: 50278 - DNA, 20 bp, human
gaggcggtgaccacctgtga

SEQ ID NO: 50279 - DNA, 20 bp, human
ggccacgaaaaggtctgaca

SEQ ID NO: 50280 - DNA, 20 bp, human
gccactggggccctcacagg

SEQ ID NO: 50281 - DNA, 20 bp, human
gggtatagagcgaactgccc

SEQ ID NO: 50282 - DNA, 20 bp, human
gacgcggtgccgttgctgcc

SEQ ID NO: 50283 - DNA, 20 bp, human
gctgtccccatcgcggagac

SEQ ID NO: 50284 - DNA, 20 bp, human
gccgcttcctgtccccatcg

SEQ ID NO: 50285 - DNA, 20 bp, human
ggccgggctgcggagcgcgc

SEQ ID NO: 50286 - DNA, 20 bp, human
gactcgcggtgacccctacg

SEQ ID NO: 50287 - DNA, 20 bp, human
ggcggtggcagtttgcccgc

SEQ ID NO: 50288 - DNA, 20 bp, human
gcagaacaggagccaaacac

SEQ ID NO: 50289 - DNA, 20 bp, human
gcagagggcagtcggaacac

SEQ ID NO: 50290 - DNA, 20 bp, human
gggagccaaacactgggagg

SEQ ID NO: 50291 - DNA, 20 bp, human
gcagtagcgcctggtggcgg

SEQ ID NO: 50292 - DNA, 20 bp, human
gacaggagccaaacactggg

SEQ ID NO: 50293 - DNA, 20 bp, human
gctaagggcctaaggtgcag

SEQ ID NO: 50294 - DNA, 20 bp, human
gctactgcagcacgcaggcg

SEQ ID NO: 50295 - DNA, 20 bp, human
gccctgactgaggagagtcg

SEQ ID NO: 50296 - DNA, 20 bp, human
ggaggtgggcgcacagacag

SEQ ID NO: 50297 - DNA, 20 bp, human
ggtgggcgcacagacagcgg

SEQ ID NO: 50298 - DNA, 20 bp, human
gggcaattccggtctgacgg

SEQ ID NO: 50299 - DNA, 20 bp, human
gctcggacacagaagaacaa

SEQ ID NO: 50300 - DNA, 20 bp, human
gctactcgggcacacggtct

SEQ ID NO: 50301 - DNA, 20 bp, human
ggagctgggactactctact

SEQ ID NO: 50302 - DNA, 20 bp, human
ggcggcggcaccggcaattc

SEQ ID NO: 50303 - DNA, 20 bp, human
gaatgctggggcaagatccg

SEQ ID NO: 50304 - DNA, 20 bp, human
gaccggcaattccggtctga

SEQ ID NO: 50305 - DNA, 20 bp, human
gtcgcccggactctgaatcc

SEQ ID NO: 50306 - DNA, 20 bp, human
ggcgctcccgcccagcccta

SEQ ID NO: 50307 - DNA, 20 bp, human
gaggaccaaagaagtgactc

SEQ ID NO: 50308 - DNA, 20 bp, human
gcgcaagcagcaaccccaca

SEQ ID NO: 50309 - DNA, 20 bp, human
gagacagacagcaagacatc

SEQ ID NO: 50310 - DNA, 20 bp, human
ggagcgccgggtgcgcccta

SEQ ID NO: 50311 - DNA, 20 bp, human
ggggaggtggacacacccga

SEQ ID NO: 50312 - DNA, 20 bp, human
gtataaaggcgagtgctgag

SEQ ID NO: 50313 - DNA, 20 bp, human
ggggccaccgcagccaggtc

SEQ ID NO: 50314 - DNA, 20 bp, human
gacccgaaggactgccctgt

SEQ ID NO: 50315 - DNA, 20 bp, human
gtggacggccgagacctggg

SEQ ID NO: 50316 - DNA, 20 bp, human
gaaagccaggctactaccgc

SEQ ID NO: 50317 - DNA, 20 bp, human
gaccgcaggtaccaagacag

SEQ ID NO: 50318 - DNA, 20 bp, human
gctccggaacaggaaaccga

SEQ ID NO: 50319 - DNA, 20 bp, human
gccagacggtacgccccacg

SEQ ID NO: 50320 - DNA, 20 bp, human
gtagctgcagatctgaagtg

SEQ ID NO: 50321 - DNA, 20 bp, human
ggcgggcggtgccactgtct

SEQ ID NO: 50322 - DNA, 20 bp, human
gtcgccgtcagagcaaagcc

SEQ ID NO: 50323 - DNA, 20 bp, human
gccgcccgcgcctccggaac

SEQ ID NO: 50324 - DNA, 20 bp, human
gacggtacgccccacgaggc

SEQ ID NO: 50325 - DNA, 20 bp, human
gagatccacctggggaaaga

SEQ ID NO: 50326 - DNA, 20 bp, human
ggtgtgcatacagcagctgt

SEQ ID NO: 50327 - DNA, 20 bp, human
gggcttgagtttctattctt

SEQ ID NO: 50328 - DNA, 20 bp, human
gcttctttgctgattcacag

SEQ ID NO: 50329 - DNA, 20 bp, human
ggcccgccacacagtacctc

SEQ ID NO: 50330 - DNA, 20 bp, human
gaagccgatttgagcaacta

SEQ ID NO: 50331 - DNA, 20 bp, human
ggcggcagctgtaagctggg

SEQ ID NO: 50332 - DNA, 20 bp, human
gctccagaggtactgtgtgg

SEQ ID NO: 50333 - DNA, 20 bp, human
ggcacatgcaagcagaccgc

SEQ ID NO: 50334 - DNA, 20 bp, human
gagaccttagttgctcaaat

SEQ ID NO: 50335 - DNA, 20 bp, human
gcctgacggaatcagaaggt

SEQ ID NO: 50336 - DNA, 20 bp, human
gggacggtggccagataaca

SEQ ID NO: 50337 - DNA, 20 bp, human
gagagcggctaagaagacgc

SEQ ID NO: 50338 - DNA, 20 bp, human
gagacgctggcacttgcaca

SEQ ID NO: 50339 - DNA, 20 bp, human
gcagtcccaatggccaggga

SEQ ID NO: 50340 - DNA, 20 bp, human
gcaccacagcaggatggaag

SEQ ID NO: 50341 - DNA, 20 bp, human
gagactggccagggaatagg

SEQ ID NO: 50342 - DNA, 20 bp, human
gagaggcttgggattcagga

SEQ ID NO: 50343 - DNA, 20 bp, human
gtagccgctctgtgcatccc

SEQ ID NO: 50344 - DNA, 20 bp, human
gtcaagcccaaactgcagag

SEQ ID NO: 50345 - DNA, 20 bp, human
gggtttggaagacagtccgg

SEQ ID NO: 50346 - DNA, 20 bp, human
gtgagagttgggatccccaa

SEQ ID NO: 50347 - DNA, 20 bp, human
gctccccggcgcgtacccag

SEQ ID NO: 50348 - DNA, 20 bp, human
ggttgggatccccaagggaa

SEQ ID NO: 50349 - DNA, 20 bp, human
gagggtgcagaggaaaacta

SEQ ID NO: 50350 - DNA, 20 bp, human
gaatcagcgcactcaaggag

SEQ ID NO: 50351 - DNA, 20 bp, human
ggcgtcgggccggggtagga

SEQ ID NO: 50352 - DNA, 20 bp, human
gccgcggagccctcctaccc

SEQ ID NO: 50353 - DNA, 20 bp, human
gtcgcgctcctcctgagcag

SEQ ID NO: 50354 - DNA, 20 bp, human
gaggatcgcgacctgagagt

SEQ ID NO: 50355 - DNA, 20 bp, human
ggcgatcgcctagggtgcag

SEQ ID NO: 50356 - DNA, 20 bp, human
gcctcccgcgccctgcacct

SEQ ID NO: 50357 - DNA, 20 bp, human
ggggcagggccaggagaacg

SEQ ID NO: 50358 - DNA, 20 bp, human
gccgagagcgagacctgccg

SEQ ID NO: 50359 - DNA, 20 bp, human
gcgagacctgccgaggtgca

SEQ ID NO: 50360 - DNA, 20 bp, human
gcggcggccatcgggatgcc

SEQ ID NO: 50361 - DNA, 20 bp, human
gctccgtgcagcgtccaggg

SEQ ID NO: 50362 - DNA, 20 bp, human
ggccatcgggatgccgggca

SEQ ID NO: 50363 - DNA, 20 bp, human
gcagctccgtgcagcgtcca

SEQ ID NO: 50364 - DNA, 20 bp, human
ggcgggcgccgtcgcgggtt

SEQ ID NO: 50365 - DNA, 20 bp, human
ggggcaggcaagcctgagag

SEQ ID NO: 50366 - DNA, 20 bp, human
gcgagtgaagccgagcgcgg

SEQ ID NO: 50367 - DNA, 20 bp, human
gggcgccgcgccccacgctg

SEQ ID NO: 50368 - DNA, 20 bp, human
gtgcccgggcggctaggcag

SEQ ID NO: 50369 - DNA, 20 bp, human
ggcgggcgtgagctcatccc

SEQ ID NO: 50370 - DNA, 20 bp, human
gggcagggaaggttggcaga

SEQ ID NO: 50371 - DNA, 20 bp, human
gtgtgactgaggccggagca

SEQ ID NO: 50372 - DNA, 20 bp, human
gggatccatgtgactgaggc

SEQ ID NO: 50373 - DNA, 20 bp, human
gagactgcagagcgccccag

SEQ ID NO: 50374 - DNA, 20 bp, human
ggggcgagtgaagccgagcg

SEQ ID NO: 50375 - DNA, 20 bp, human
gagggtgagggctggcgcac

SEQ ID NO: 50376 - DNA, 20 bp, human
gcagggagcagggagatgag

SEQ ID NO: 50377 - DNA, 20 bp, human
gctacgggcgcgccccaaaa

SEQ ID NO: 50378 - DNA, 20 bp, human
gctccctgctccctgcacgg

SEQ ID NO: 50379 - DNA, 20 bp, human
gggtcctgtggccggccgtg

SEQ ID NO: 50380 - DNA, 20 bp, human
gccaccaagccgcaggaaga

SEQ ID NO: 50381 - DNA, 20 bp, human
ggagagcggggcgccgagtg

SEQ ID NO: 50382 - DNA, 20 bp, human
gccaaaacggcagacgcggg

SEQ ID NO: 50383 - DNA, 20 bp, human
gcggctgggagcgcgctgag

SEQ ID NO: 50384 - DNA, 20 bp, human
ggccgccgcagccgagcgct

SEQ ID NO: 50385 - DNA, 20 bp, human
gtcagcccagcgctcggctg

SEQ ID NO: 50386 - DNA, 20 bp, human
gatcagttgaatcagactca

SEQ ID NO: 50387 - DNA, 20 bp, human
gagctgctcagaggctggat

SEQ ID NO: 50388 - DNA, 20 bp, human
gatcagactcacggcagctg

SEQ ID NO: 50389 - DNA, 20 bp, human
ggagctgggtaggaagccca

SEQ ID NO: 50390 - DNA, 20 bp, human
gacttcgagttcacctgggg

SEQ ID NO: 50391 - DNA, 20 bp, human
gtctggaagtgctctcccag

SEQ ID NO: 50392 - DNA, 20 bp, human
gcaagggataggtgtgggac

SEQ ID NO: 50393 - DNA, 20 bp, human
gggaccctttagcaagggat

SEQ ID NO: 50394 - DNA, 20 bp, human
ggggttgagaagagctactg

SEQ ID NO: 50395 - DNA, 20 bp, human
gtccacttcgagttcacctg

SEQ ID NO: 50396 - DNA, 20 bp, human
gaggagtccacgcctccggt

SEQ ID NO: 50397 - DNA, 20 bp, human
gtaactggacggcccaccgg

SEQ ID NO: 50398 - DNA, 20 bp, human
ggcggcgggactcctagacc

SEQ ID NO: 50399 - DNA, 20 bp, human
gaagttcccaagcagccgga

SEQ ID NO: 50400 - DNA, 20 bp, human
ggatgcactgacctggccgg

SEQ ID NO: 50401 - DNA, 20 bp, human
ggcgtggactcctcgggaac

SEQ ID NO: 50402 - DNA, 20 bp, human
gccaggtcagtgcatctctc

SEQ ID NO: 50403 - DNA, 20 bp, human
gaagtcgggataagaaaaca

SEQ ID NO: 50404 - DNA, 20 bp, human
gtcctaccttccggctgctt

SEQ ID NO: 50405 - DNA, 20 bp, human
gagctaactggacggcccac

SEQ ID NO: 50406 - DNA, 20 bp, human
gcacgcgcagccggaagtgg

SEQ ID NO: 50407 - DNA, 20 bp, human
gggtcacgcgcagccggaag

SEQ ID NO: 50408 - DNA, 20 bp, human
gcgcagagcgatggagacag

SEQ ID NO: 50409 - DNA, 20 bp, human
gccgccctcagcgctcactg

SEQ ID NO: 50410 - DNA, 20 bp, human
gtggccccttgaacacccgg

SEQ ID NO: 50411 - DNA, 20 bp, human
ggccggaaggaggaaggcgt

SEQ ID NO: 50412 - DNA, 20 bp, human
gggtgcgtctccgccaaggt

SEQ ID NO: 50413 - DNA, 20 bp, human
gctgcggagaattggagatg

SEQ ID NO: 50414 - DNA, 20 bp, human
gtcgcgcgggaagcacctgg

SEQ ID NO: 50415 - DNA, 20 bp, human
gccggctgcgcgtgacccca

SEQ ID NO: 50416 - DNA, 20 bp, human
gaaggctggcccgtgactga

SEQ ID NO: 50417 - DNA, 20 bp, human
gcacaggaaactaatcgtca

SEQ ID NO: 50418 - DNA, 20 bp, human
gagctctcagacatccttaa

SEQ ID NO: 50419 - DNA, 20 bp, human
gtcagacatccttaagggaa

SEQ ID NO: 50420 - DNA, 20 bp, human
ggtttcctgtgtcatcatgg

SEQ ID NO: 50421 - DNA, 20 bp, human
gaacctgctgccgtcagtca

SEQ ID NO: 50422 - DNA, 20 bp, human
ggagtgcaatgctggtgaag

SEQ ID NO: 50423 - DNA, 20 bp, human
ggtcaagatgattaacgaca

SEQ ID NO: 50424 - DNA, 20 bp, human
gcgtgcaggacatttcttac

SEQ ID NO: 50425 - DNA, 20 bp, human
gtttcttacgggttgttctt

SEQ ID NO: 50426 - DNA, 20 bp, human
gctgggagcggtaagtggag

SEQ ID NO: 50427 - DNA, 20 bp, human
gctctcagtagcgtcgcccg

SEQ ID NO: 50428 - DNA, 20 bp, human
gcggagggctcggttcggag

SEQ ID NO: 50429 - DNA, 20 bp, human
gcggtgctcggcgttcaagg

SEQ ID NO: 50430 - DNA, 20 bp, human
gcgcatcccggggcatggcg

SEQ ID NO: 50431 - DNA, 20 bp, human
ggccctggagtgaggaggac

SEQ ID NO: 50432 - DNA, 20 bp, human
gcggcggcggagcagcctcg

SEQ ID NO: 50433 - DNA, 20 bp, human
gcgggaacacgatgagaacc

SEQ ID NO: 50434 - DNA, 20 bp, human
gtaagtggaggggcgcgcaa

SEQ ID NO: 50435 - DNA, 20 bp, human
gacgcgtgaagcctgagcca

SEQ ID NO: 50436 - DNA, 20 bp, human
gagaagacaaaggaatacga

SEQ ID NO: 50437 - DNA, 20 bp, human
ggaatttcgtcagtctggaa

SEQ ID NO: 50438 - DNA, 20 bp, human
gtcctaacaagacataataa

SEQ ID NO: 50439 - DNA, 20 bp, human
ggccttagaaattcattcag

SEQ ID NO: 50440 - DNA, 20 bp, human
gcttctcctgagtaggaaag

SEQ ID NO: 50441 - DNA, 20 bp, human
gagtggattcacgaactcac

SEQ ID NO: 50442 - DNA, 20 bp, human
ggcctctgaatgaatttcta

SEQ ID NO: 50443 - DNA, 20 bp, human
gccacaccttaaaagaagga

SEQ ID NO: 50444 - DNA, 20 bp, human
ggttcttacatgcttgagtc

SEQ ID NO: 50445 - DNA, 20 bp, human
gtcctttattatgtcttgtt

SEQ ID NO: 50446 - DNA, 20 bp, human
gctcaggcagatcccgacgg

SEQ ID NO: 50447 - DNA, 20 bp, human
gcagcccggggagggtgaga

SEQ ID NO: 50448 - DNA, 20 bp, human
gtgggccccaagggagacgg

SEQ ID NO: 50449 - DNA, 20 bp, human
gcacagaggatcctcggccg

SEQ ID NO: 50450 - DNA, 20 bp, human
gcgcggcgacatcaccgcct

SEQ ID NO: 50451 - DNA, 20 bp, human
gctgaggtaagcggacttgg

SEQ ID NO: 50452 - DNA, 20 bp, human
gcagcgcccgcgtgcccagg

SEQ ID NO: 50453 - DNA, 20 bp, human
ggcgggcgctgctctggata

SEQ ID NO: 50454 - DNA, 20 bp, human
gtgcggcgccgagcccccgt

SEQ ID NO: 50455 - DNA, 20 bp, human
ggctccggccgcgcagcccg

SEQ ID NO: 50456 - DNA, 20 bp, human
gaatcagacaccagctgagt

SEQ ID NO: 50457 - DNA, 20 bp, human
gatacaatgagttgacactg

SEQ ID NO: 50458 - DNA, 20 bp, human
gagtgctactaactagcgat

SEQ ID NO: 50459 - DNA, 20 bp, human
gagtagatgttcttacatgc

SEQ ID NO: 50460 - DNA, 20 bp, human
gttagggtggggatccagac

SEQ ID NO: 50461 - DNA, 20 bp, human
gacaatgggcacgattatga

SEQ ID NO: 50462 - DNA, 20 bp, human
ggtcattgctaagtcatgct

SEQ ID NO: 50463 - DNA, 20 bp, human
gtctcttacatccaagacca

SEQ ID NO: 50464 - DNA, 20 bp, human
gaaggtacgtataaccagtc

SEQ ID NO: 50465 - DNA, 20 bp, human
gctttttagaaaatgttagt

SEQ ID NO: 50466 - DNA, 20 bp, human
gtctgggacgagaaacgtgg

SEQ ID NO: 50467 - DNA, 20 bp, human
ggtctctgggacgagaaacg

SEQ ID NO: 50468 - DNA, 20 bp, human
gtgcggcgagatccgacctg

SEQ ID NO: 50469 - DNA, 20 bp, human
gggcggaggcgagggtgcga

SEQ ID NO: 50470 - DNA, 20 bp, human
gcaggtaacgcgcacaaggg

SEQ ID NO: 50471 - DNA, 20 bp, human
gcggggaacaccattgctgg

SEQ ID NO: 50472 - DNA, 20 bp, human
gagcctccgacccccagcaa

SEQ ID NO: 50473 - DNA, 20 bp, human
ggaacaccattgctgggggt

SEQ ID NO: 50474 - DNA, 20 bp, human
gaatggtgttccccgcccca

SEQ ID NO: 50475 - DNA, 20 bp, human
ggggcaggtaacgcgcacaa

SEQ ID NO: 50476 - DNA, 20 bp, human
ggctggcaggatagaagcag

SEQ ID NO: 50477 - DNA, 20 bp, human
ggcagcagagacgctgcaga

SEQ ID NO: 50478 - DNA, 20 bp, human
ggaccatctgtagactcctt

SEQ ID NO: 50479 - DNA, 20 bp, human
gcccaccctaaaccaagggt

SEQ ID NO: 50480 - DNA, 20 bp, human
gcttagacatcaactgcaga

SEQ ID NO: 50481 - DNA, 20 bp, human
gatagaagcagcggctcact

SEQ ID NO: 50482 - DNA, 20 bp, human
gctcttccccagaactacag

SEQ ID NO: 50483 - DNA, 20 bp, human
gcctccccaccctaaaccaa

SEQ ID NO: 50484 - DNA, 20 bp, human
gcgtctctgctgctttccga

SEQ ID NO: 50485 - DNA, 20 bp, human
gcagagcccctgtagttctg

SEQ ID NO: 50486 - DNA, 20 bp, human
gttcggaactgagaagacga

SEQ ID NO: 50487 - DNA, 20 bp, human
gttgagacacccttttagga

SEQ ID NO: 50488 - DNA, 20 bp, human
ggagaagcggggtgagaatc

SEQ ID NO: 50489 - DNA, 20 bp, human
ggcgtgcaagagaaacccaa

SEQ ID NO: 50490 - DNA, 20 bp, human
gtcacccatgccctcctaaa

SEQ ID NO: 50491 - DNA, 20 bp, human
gcacccttttaggagggcat

SEQ ID NO: 50492 - DNA, 20 bp, human
gttctcaccccgcttctcta

SEQ ID NO: 50493 - DNA, 20 bp, human
gctttctgtagagcagaatt

SEQ ID NO: 50494 - DNA, 20 bp, human
gtgacagagacaagaccttg

SEQ ID NO: 50495 - DNA, 20 bp, human
ggaagtagattatgtctctg

SEQ ID NO: 50496 - DNA, 20 bp, human
ggaccgcttcaccctgatca

SEQ ID NO: 50497 - DNA, 20 bp, human
gagccgatactccctgatca

SEQ ID NO: 50498 - DNA, 20 bp, human
gggcgtccaggagtgacctg

SEQ ID NO: 50499 - DNA, 20 bp, human
gcaccctgatcagggagtat

SEQ ID NO: 50500 - DNA, 20 bp, human
ggtgaccgtgacgtagaagg

SEQ ID NO: 50501 - DNA, 20 bp, human
ggcggtgaccgtgacgtaga

SEQ ID NO: 50502 - DNA, 20 bp, human
gctccctgatcagggtgaag

SEQ ID NO: 50503 - DNA, 20 bp, human
ggacgccgaagagattagtg

SEQ ID NO: 50504 - DNA, 20 bp, human
ggccccgaccgtggacactg

SEQ ID NO: 50505 - DNA, 20 bp, human
ggccgccgcactaatctctt

SEQ ID NO: 50506 - DNA, 20 bp, human
gaactcggacggctactggt

SEQ ID NO: 50507 - DNA, 20 bp, human
gaggaaagctgtggctcgga

SEQ ID NO: 50508 - DNA, 20 bp, human
gaaagctgtggctcggaggg

SEQ ID NO: 50509 - DNA, 20 bp, human
gtgcgctacgaggtgaccag

SEQ ID NO: 50510 - DNA, 20 bp, human
ggtggctcggagggcggcaa

SEQ ID NO: 50511 - DNA, 20 bp, human
gggagacggcgacgggccgg

SEQ ID NO: 50512 - DNA, 20 bp, human
ggtgatcaccgaccagaact

SEQ ID NO: 50513 - DNA, 20 bp, human
gtcaccgaccagaactcgga

SEQ ID NO: 50514 - DNA, 20 bp, human
ggtacctgcccggagagcgc

SEQ ID NO: 50515 - DNA, 20 bp, human
gcggcgggcaatcgggagag

SEQ ID NO: 50516 - DNA, 20 bp, human
gtgcatttgggcagtagcat

SEQ ID NO: 50517 - DNA, 20 bp, human
gctaagaaaggcatacttac

SEQ ID NO: 50518 - DNA, 20 bp, human
gacagagtatgaagcaaaga

SEQ ID NO: 50519 - DNA, 20 bp, human
ggagatatgagtttctatag

SEQ ID NO: 50520 - DNA, 20 bp, human
ggctttatgtgatatctgtg

SEQ ID NO: 50521 - DNA, 20 bp, human
gacatttagatttgcactaa

SEQ ID NO: 50522 - DNA, 20 bp, human
gaaactcatatctcgtctga

SEQ ID NO: 50523 - DNA, 20 bp, human
gaaaggcatacttactggaa

SEQ ID NO: 50524 - DNA, 20 bp, human
gacttaatgcccagaagtca

SEQ ID NO: 50525 - DNA, 20 bp, human
gatgagacgatgaattggag

SEQ ID NO: 50526 - DNA, 20 bp, human
gtgcaaaagtccaggacagt

SEQ ID NO: 50527 - DNA, 20 bp, human
gttcaaacaaggcttcaatt

SEQ ID NO: 50528 - DNA, 20 bp, human
gcctaaggaagagatagatt

SEQ ID NO: 50529 - DNA, 20 bp, human
gtaccttaaaaggcttcaaa

SEQ ID NO: 50530 - DNA, 20 bp, human
gtgaaagtggcccactgtcc

SEQ ID NO: 50531 - DNA, 20 bp, human
gaacggacaattacgaccta

SEQ ID NO: 50532 - DNA, 20 bp, human
gagagaaagataagaaattc

SEQ ID NO: 50533 - DNA, 20 bp, human
gcagttggttctgagtaaaa

SEQ ID NO: 50534 - DNA, 20 bp, human
gtatttcatcttaccttaaa

SEQ ID NO: 50535 - DNA, 20 bp, human
gtctctttgaagactgaaag

SEQ ID NO: 50536 - DNA, 20 bp, human
gagccgaagacgcagagcgg

SEQ ID NO: 50537 - DNA, 20 bp, human
gggagacgcccttagatgag

SEQ ID NO: 50538 - DNA, 20 bp, human
gaggaaggagcagcacgctg

SEQ ID NO: 50539 - DNA, 20 bp, human
gctctccaggacatcctcgt

SEQ ID NO: 50540 - DNA, 20 bp, human
gacgtacaggtaagcagcag

SEQ ID NO: 50541 - DNA, 20 bp, human
gctccgggcaggccgatggt

SEQ ID NO: 50542 - DNA, 20 bp, human
gagcttggcactgatcagag

SEQ ID NO: 50543 - DNA, 20 bp, human
ggccaagctccgcagcccca

SEQ ID NO: 50544 - DNA, 20 bp, human
gatcagagccaccactcctt

SEQ ID NO: 50545 - DNA, 20 bp, human
gtagatgagcggtagagagg

SEQ ID NO: 50546 - DNA, 20 bp, human
ggcgctacgcgagtgatcca

SEQ ID NO: 50547 - DNA, 20 bp, human
gagcccgcagaaacccgtcg

SEQ ID NO: 50548 - DNA, 20 bp, human
ggactcagcagacagcgacg

SEQ ID NO: 50549 - DNA, 20 bp, human
gcgaggcgagggcgactcga

SEQ ID NO: 50550 - DNA, 20 bp, human
gtccagcgaaggatgcgtga

SEQ ID NO: 50551 - DNA, 20 bp, human
ggtagggtctcagcaagacg

SEQ ID NO: 50552 - DNA, 20 bp, human
gcgacgaggctgcgactcgg

SEQ ID NO: 50553 - DNA, 20 bp, human
ggcaccgcaagctccagaaa

SEQ ID NO: 50554 - DNA, 20 bp, human
ggtcgcggcgtgtcttacct

SEQ ID NO: 50555 - DNA, 20 bp, human
gcgggtcgttcaagaagccg

SEQ ID NO: 50556 - DNA, 20 bp, human
gatgcagaccgtcctcctca

SEQ ID NO: 50557 - DNA, 20 bp, human
gggtctggagacacccgcag

SEQ ID NO: 50558 - DNA, 20 bp, human
gcccgcagccgtgaggagga

SEQ ID NO: 50559 - DNA, 20 bp, human
gcccgcagaggccacgctca

SEQ ID NO: 50560 - DNA, 20 bp, human
gccaggacggcgggagacgg

SEQ ID NO: 50561 - DNA, 20 bp, human
ggcctcggtgtgcagacccc

SEQ ID NO: 50562 - DNA, 20 bp, human
gcgcggcgaagatggtgagt

SEQ ID NO: 50563 - DNA, 20 bp, human
ggcggcgcgagcttaccccg

SEQ ID NO: 50564 - DNA, 20 bp, human
gcagccgcggatccaccccg

SEQ ID NO: 50565 - DNA, 20 bp, human
gaccgtcctcctcacggctg

SEQ ID NO: 50566 - DNA, 20 bp, human
gccgagccgcaaagacagag

SEQ ID NO: 50567 - DNA, 20 bp, human
gaggcgatgtcgccgaaacc

SEQ ID NO: 50568 - DNA, 20 bp, human
gagggcgacggggtgccatg

SEQ ID NO: 50569 - DNA, 20 bp, human
gcagccgtcccaggtagcgg

SEQ ID NO: 50570 - DNA, 20 bp, human
gccgccgccgcccgtgaggg

SEQ ID NO: 50571 - DNA, 20 bp, human
gagcgggcagaggcgatgga

SEQ ID NO: 50572 - DNA, 20 bp, human
ggtctctcctccctcacggg

SEQ ID NO: 50573 - DNA, 20 bp, human
gaccgggctgcaggcgggta

SEQ ID NO: 50574 - DNA, 20 bp, human
gagacgggctcgctgcccca

SEQ ID NO: 50575 - DNA, 20 bp, human
ggatctgggataccttggga

SEQ ID NO: 50576 - DNA, 20 bp, human
gccagcgtcacaggtcagtc

SEQ ID NO: 50577 - DNA, 20 bp, human
ggccgagagccggaagccag

SEQ ID NO: 50578 - DNA, 20 bp, human
ggccgccgccatgaaggccg

SEQ ID NO: 50579 - DNA, 20 bp, human
ggcgcagccgcgagtcccca

SEQ ID NO: 50580 - DNA, 20 bp, human
gcatcccgcacgcaggacaa

SEQ ID NO: 50581 - DNA, 20 bp, human
gaccacggccttcatggcgg

SEQ ID NO: 50582 - DNA, 20 bp, human
ggagcctcggagcatctccg

SEQ ID NO: 50583 - DNA, 20 bp, human
ggtggtgcagcgcgtcaccc

SEQ ID NO: 50584 - DNA, 20 bp, human
gcgctgcaccacggccttca

SEQ ID NO: 50585 - DNA, 20 bp, human
ggcgtcacaggtcagtcggg

SEQ ID NO: 50586 - DNA, 20 bp, human
gacatggcctagtaactgtc

SEQ ID NO: 50587 - DNA, 20 bp, human
gcaaggggtctgagacagta

SEQ ID NO: 50588 - DNA, 20 bp, human
ggccagttgtagcacccgag

SEQ ID NO: 50589 - DNA, 20 bp, human
gccggaccgccggtctcaga

SEQ ID NO: 50590 - DNA, 20 bp, human
gcatagaccacgagctgcaa

SEQ ID NO: 50591 - DNA, 20 bp, human
ggagacacgctcttcctctc

SEQ ID NO: 50592 - DNA, 20 bp, human
gtgccccgccagcgcgtcga

SEQ ID NO: 50593 - DNA, 20 bp, human
gagctgacccggtatccccg

SEQ ID NO: 50594 - DNA, 20 bp, human
ggctcgtggtctatgctggt

SEQ ID NO: 50595 - DNA, 20 bp, human
ggtccggccgcggggatacc

SEQ ID NO: 50596 - DNA, 20 bp, human
gtgctccagcagctggtgaa

SEQ ID NO: 50597 - DNA, 20 bp, human
gagtgctgggctagctgact

SEQ ID NO: 50598 - DNA, 20 bp, human
gtgctggcaggtggaacgca

SEQ ID NO: 50599 - DNA, 20 bp, human
gtgctaaagcaggcactctt

SEQ ID NO: 50600 - DNA, 20 bp, human
gggatcatctcctagagttt

SEQ ID NO: 50601 - DNA, 20 bp, human
gctatgttgtgagaaagtgc

SEQ ID NO: 50602 - DNA, 20 bp, human
gacatgggctcaggtaaact

SEQ ID NO: 50603 - DNA, 20 bp, human
gggctatgagtataccagat

SEQ ID NO: 50604 - DNA, 20 bp, human
gaccacagtggccatccaag

SEQ ID NO: 50605 - DNA, 20 bp, human
gtcctgccagcaaagcctaa

SEQ ID NO: 50606 - DNA, 20 bp, human
gaacagggcttgacagcgcg

SEQ ID NO: 50607 - DNA, 20 bp, human
ggacaaaccgcggggtgacc

SEQ ID NO: 50608 - DNA, 20 bp, human
gttacagtggcgggagttgg

SEQ ID NO: 50609 - DNA, 20 bp, human
gggcttacagtggcgggagt

SEQ ID NO: 50610 - DNA, 20 bp, human
gagctgtaaggggccttgga

SEQ ID NO: 50611 - DNA, 20 bp, human
gagtttggcgcggagtttgg

SEQ ID NO: 50612 - DNA, 20 bp, human
gggccggggcttacagtggc

SEQ ID NO: 50613 - DNA, 20 bp, human
gagtcggccctggtcggagg

SEQ ID NO: 50614 - DNA, 20 bp, human
gtaacgatttgtgttgtgag

SEQ ID NO: 50615 - DNA, 20 bp, human
gcgatttctgctgaacttgg

SEQ ID NO: 50616 - DNA, 20 bp, human
gttatcgggtgcccatgtgg

SEQ ID NO: 50617 - DNA, 20 bp, human
gggtaacggaccacatgatg

SEQ ID NO: 50618 - DNA, 20 bp, human
gtgctgtgtgttgagcacaa

SEQ ID NO: 50619 - DNA, 20 bp, human
gaaacagctgaaaccggagg

SEQ ID NO: 50620 - DNA, 20 bp, human
gtaaaaacagctgaaaccgg

SEQ ID NO: 50621 - DNA, 20 bp, human
gtctctgacttctgtcgcag

SEQ ID NO: 50622 - DNA, 20 bp, human
gagtggcataacttgctggg

SEQ ID NO: 50623 - DNA, 20 bp, human
gcgcagtggcataacttgct

SEQ ID NO: 50624 - DNA, 20 bp, human
gtgggcaggagaaatttatc

SEQ ID NO: 50625 - DNA, 20 bp, human
gggttactttggagtttgtt

SEQ ID NO: 50626 - DNA, 20 bp, human
gcgcgtgccgggcggagaag

SEQ ID NO: 50627 - DNA, 20 bp, human
ggtggctccggggcctgagt

SEQ ID NO: 50628 - DNA, 20 bp, human
ggggcgagtgaggcaggtcc

SEQ ID NO: 50629 - DNA, 20 bp, human
gtgcggcgctgcaggagtcg

SEQ ID NO: 50630 - DNA, 20 bp, human
gcggctagccccggagggac

SEQ ID NO: 50631 - DNA, 20 bp, human
gtcgtcgggaaggtctcctg

SEQ ID NO: 50632 - DNA, 20 bp, human
gctccaggcgagccgggctc

SEQ ID NO: 50633 - DNA, 20 bp, human
ggcagcggcagcgcctactc

SEQ ID NO: 50634 - DNA, 20 bp, human
gcggcgcggctagccccgga

SEQ ID NO: 50635 - DNA, 20 bp, human
gcgccggagcaggggtcgtc

SEQ ID NO: 50636 - DNA, 20 bp, human
ggcggcgaggaccagaccgg

SEQ ID NO: 50637 - DNA, 20 bp, human
gagcgcctcccggtcctggg

SEQ ID NO: 50638 - DNA, 20 bp, human
gctccgggtgggtatacggt

SEQ ID NO: 50639 - DNA, 20 bp, human
gcgcaccccccaggaccggg

SEQ ID NO: 50640 - DNA, 20 bp, human
gttggcggcgtgggacccag

SEQ ID NO: 50641 - DNA, 20 bp, human
gagcccggcgcagtccactg

SEQ ID NO: 50642 - DNA, 20 bp, human
ggggccggtagtgggagtgc

SEQ ID NO: 50643 - DNA, 20 bp, human
gcgggggcggggccggtagt

SEQ ID NO: 50644 - DNA, 20 bp, human
ggggcggcgcaaagtaactt

SEQ ID NO: 50645 - DNA, 20 bp, human
gcctggggggtgcgcgtcac

SEQ ID NO: 50646 - DNA, 20 bp, human
gcctccaccagggatcggag

SEQ ID NO: 50647 - DNA, 20 bp, human
ggctttccgggagacaccag

SEQ ID NO: 50648 - DNA, 20 bp, human
gggaatgcaccgaaaatcat

SEQ ID NO: 50649 - DNA, 20 bp, human
gtccgtgcgcgatcacggcc

SEQ ID NO: 50650 - DNA, 20 bp, human
gggcgcggggacctccacca

SEQ ID NO: 50651 - DNA, 20 bp, human
gcccaacgaaaagtatgtcc

SEQ ID NO: 50652 - DNA, 20 bp, human
ggtaccactccgatccctgg

SEQ ID NO: 50653 - DNA, 20 bp, human
gaaccgaggatccccctcac

SEQ ID NO: 50654 - DNA, 20 bp, human
ggagctgttcgaggactcgc

SEQ ID NO: 50655 - DNA, 20 bp, human
gagcgtcgttgctaaggcag

SEQ ID NO: 50656 - DNA, 20 bp, human
gattgaagcccggctgccgc

SEQ ID NO: 50657 - DNA, 20 bp, human
gagcccgttgcgcggccttc

SEQ ID NO: 50658 - DNA, 20 bp, human
gaaagaggcacgaacactcc

SEQ ID NO: 50659 - DNA, 20 bp, human
gggcagctctgcgattaggg

SEQ ID NO: 50660 - DNA, 20 bp, human
gttcaatgccacggcctgac

SEQ ID NO: 50661 - DNA, 20 bp, human
gggacactccggtcaggccg

SEQ ID NO: 50662 - DNA, 20 bp, human
gtaccagtgggacgtatgta

SEQ ID NO: 50663 - DNA, 20 bp, human
gcagcatattgcaggaagta

SEQ ID NO: 50664 - DNA, 20 bp, human
gtcgggcagctctgcgatta

SEQ ID NO: 50665 - DNA, 20 bp, human
ggacgccgaacgacaaggag

SEQ ID NO: 50666 - DNA, 20 bp, human
gagcgcacccggcatccccc

SEQ ID NO: 50667 - DNA, 20 bp, human
gagactgcccggccgacgga

SEQ ID NO: 50668 - DNA, 20 bp, human
gcccacccgcgagatcccgg

SEQ ID NO: 50669 - DNA, 20 bp, human
ggcggccgccgggatctcgc

SEQ ID NO: 50670 - DNA, 20 bp, human
gcgggaagcacggggatgcg

SEQ ID NO: 50671 - DNA, 20 bp, human
gggctcctgcgtccgtccgt

SEQ ID NO: 50672 - DNA, 20 bp, human
gccgcgacgcgacccccgag

SEQ ID NO: 50673 - DNA, 20 bp, human
ggccgctcgcgggcccccag

SEQ ID NO: 50674 - DNA, 20 bp, human
gacccggcatccccccggca

SEQ ID NO: 50675 - DNA, 20 bp, human
ggcctgccccaagggaaagc

SEQ ID NO: 50676 - DNA, 20 bp, human
gcagaaacgcacacatgcag

SEQ ID NO: 50677 - DNA, 20 bp, human
gcccttcaacctctgtggtc

SEQ ID NO: 50678 - DNA, 20 bp, human
gtttggccggcaggccggca

SEQ ID NO: 50679 - DNA, 20 bp, human
ggccctgtcccaccactcag

SEQ ID NO: 50680 - DNA, 20 bp, human
gcggcaggccggcatggagg

SEQ ID NO: 50681 - DNA, 20 bp, human
ggggcgcagttgcctgccca

SEQ ID NO: 50682 - DNA, 20 bp, human
ggtgcgtcataggagttcag

SEQ ID NO: 50683 - DNA, 20 bp, human
ggccactgagtggtgggaca

SEQ ID NO: 50684 - DNA, 20 bp, human
gcatggaggtggtgcgtcat

SEQ ID NO: 50685 - DNA, 20 bp, human
gaggaacccttcaacctctg

SEQ ID NO: 50686 - DNA, 20 bp, human
gcaatggcggcgctgacgag

SEQ ID NO: 50687 - DNA, 20 bp, human
gggcggcgctgacgagaggt

SEQ ID NO: 50688 - DNA, 20 bp, human
gagggaggcacagcccggat

SEQ ID NO: 50689 - DNA, 20 bp, human
ggtcatgtgaccggcaatgg

SEQ ID NO: 50690 - DNA, 20 bp, human
gtggcaacccaggccggaca

SEQ ID NO: 50691 - DNA, 20 bp, human
gccctccagacagaggccag

SEQ ID NO: 50692 - DNA, 20 bp, human
gtcagtcatgtgaccggcaa

SEQ ID NO: 50693 - DNA, 20 bp, human
ggacgagaggtaggtgagcc

SEQ ID NO: 50694 - DNA, 20 bp, human
gccggcctgggttgccacag

SEQ ID NO: 50695 - DNA, 20 bp, human
gcagggacccttgcccatcc

SEQ ID NO: 50696 - DNA, 20 bp, human
gggaggcagctgggcggtaa

SEQ ID NO: 50697 - DNA, 20 bp, human
gaggccatggctctgcgcgt

SEQ ID NO: 50698 - DNA, 20 bp, human
gatggctctgcgcgtcggga

SEQ ID NO: 50699 - DNA, 20 bp, human
ggacagtgaacactcggtgg

SEQ ID NO: 50700 - DNA, 20 bp, human
gcccgcaccaggcacatgtg

SEQ ID NO: 50701 - DNA, 20 bp, human
ggaacactcggtggaggatg

SEQ ID NO: 50702 - DNA, 20 bp, human
gatggaaagcatccacacta

SEQ ID NO: 50703 - DNA, 20 bp, human
gcgggtggagttcagtgaaa

SEQ ID NO: 50704 - DNA, 20 bp, human
gcccagttccagctgaccta

SEQ ID NO: 50705 - DNA, 20 bp, human
gtccacccggaaggtgcccg

SEQ ID NO: 50706 - DNA, 20 bp, human
gcgaggcgcaactggtgcga

SEQ ID NO: 50707 - DNA, 20 bp, human
gcccaccccggcgtctgcag

SEQ ID NO: 50708 - DNA, 20 bp, human
ggcggtgagccaccacatcg

SEQ ID NO: 50709 - DNA, 20 bp, human
gtgggctgtagggacgccag

SEQ ID NO: 50710 - DNA, 20 bp, human
gactcgaccccacagagcag

SEQ ID NO: 50711 - DNA, 20 bp, human
gcaggagcatggcgagcccg

SEQ ID NO: 50712 - DNA, 20 bp, human
gcagcagcagcggaccccgg

SEQ ID NO: 50713 - DNA, 20 bp, human
gggaggaagcggaggaggtc

SEQ ID NO: 50714 - DNA, 20 bp, human
gccggcgtctgcagaggccg

SEQ ID NO: 50715 - DNA, 20 bp, human
gcgagctggggctgacggcg

SEQ ID NO: 50716 - DNA, 20 bp, human
gcgcggggctctcatagtgc

SEQ ID NO: 50717 - DNA, 20 bp, human
gcagtcatggcggcccggcg

SEQ ID NO: 50718 - DNA, 20 bp, human
gggcgggcggtggacagtca

SEQ ID NO: 50719 - DNA, 20 bp, human
ggggcggtggacagtcatgg

SEQ ID NO: 50720 - DNA, 20 bp, human
ggggctctcatagtgctgga

SEQ ID NO: 50721 - DNA, 20 bp, human
gtggcgtgctgtgaactgtg

SEQ ID NO: 50722 - DNA, 20 bp, human
gtgcgtggagacgccagcgg

SEQ ID NO: 50723 - DNA, 20 bp, human
gccagccgcagacaacgaag

SEQ ID NO: 50724 - DNA, 20 bp, human
gcccgggtagccgggaacat

SEQ ID NO: 50725 - DNA, 20 bp, human
ggtggacagtcatggcggcc

SEQ ID NO: 50726 - DNA, 20 bp, human
gcagaggcaccggacgagag

SEQ ID NO: 50727 - DNA, 20 bp, human
gcgcggagccctctctcgtc

SEQ ID NO: 50728 - DNA, 20 bp, human
gggacaggccctaacaggac

SEQ ID NO: 50729 - DNA, 20 bp, human
gcacggcgtcaccagagccc

SEQ ID NO: 50730 - DNA, 20 bp, human
gggagacaagttgcagtccc

SEQ ID NO: 50731 - DNA, 20 bp, human
gagccttaggataagatcgg

SEQ ID NO: 50732 - DNA, 20 bp, human
gccgggggagggagctccaa

SEQ ID NO: 50733 - DNA, 20 bp, human
gccagcacaacataccaggg

SEQ ID NO: 50734 - DNA, 20 bp, human
ggccatcttggtcctaaggg

SEQ ID NO: 50735 - DNA, 20 bp, human
gctgcagctctgcgccggga

SEQ ID NO: 50736 - DNA, 20 bp, human
gctcgccactgtgcaggtgt

SEQ ID NO: 50737 - DNA, 20 bp, human
gctgcacagtggcgagacca

SEQ ID NO: 50738 - DNA, 20 bp, human
gtctggggcatgtcagtcca

SEQ ID NO: 50739 - DNA, 20 bp, human
gacattgggcacaccctggg

SEQ ID NO: 50740 - DNA, 20 bp, human
gccgaccataggaacccact

SEQ ID NO: 50741 - DNA, 20 bp, human
ggtgtgagcatctggaccta

SEQ ID NO: 50742 - DNA, 20 bp, human
ggcggagcctgacggatcgg

SEQ ID NO: 50743 - DNA, 20 bp, human
gactgtgcaggtgtcggctc

SEQ ID NO: 50744 - DNA, 20 bp, human
ggtgaaacattggagacatt

SEQ ID NO: 50745 - DNA, 20 bp, human
gcggggaggctgaggatcgg

SEQ ID NO: 50746 - DNA, 20 bp, human
gggcagcgcgcgaggtgaga

SEQ ID NO: 50747 - DNA, 20 bp, human
ggagacggcgagggctcccg

SEQ ID NO: 50748 - DNA, 20 bp, human
ggcgcgaggtgagacggcga

SEQ ID NO: 50749 - DNA, 20 bp, human
gacggtgtcgagaggatctg

SEQ ID NO: 50750 - DNA, 20 bp, human
ggggtctgccagctccgcag

SEQ ID NO: 50751 - DNA, 20 bp, human
gcggaggtgcttccagcgga

SEQ ID NO: 50752 - DNA, 20 bp, human
ggccgggccttcggcaccga

SEQ ID NO: 50753 - DNA, 20 bp, human
gtggagtctggcgcctgggg

SEQ ID NO: 50754 - DNA, 20 bp, human
gaccgcactagccgggcctt

SEQ ID NO: 50755 - DNA, 20 bp, human
gagcgacgcagttccgggtc

SEQ ID NO: 50756 - DNA, 20 bp, human
gcgcagaaccaggaaagtaa

SEQ ID NO: 50757 - DNA, 20 bp, human
gcatagtgcaggtagagtgg

SEQ ID NO: 50758 - DNA, 20 bp, human
gatccgtggccactcggtaa

SEQ ID NO: 50759 - DNA, 20 bp, human
gtacaaggctgggaccgagt

SEQ ID NO: 50760 - DNA, 20 bp, human
gccgagtggccacggatccc

SEQ ID NO: 50761 - DNA, 20 bp, human
gagagtgggggaaggctcat

SEQ ID NO: 50762 - DNA, 20 bp, human
gtaatcctgaggaacagtct

SEQ ID NO: 50763 - DNA, 20 bp, human
gcccagctgggtccttggga

SEQ ID NO: 50764 - DNA, 20 bp, human
gccggctagaaaaactctgt

SEQ ID NO: 50765 - DNA, 20 bp, human
gcctcatagtgcaggtagag

SEQ ID NO: 50766 - DNA, 20 bp, human
gctgtcgccgaagatggagg

SEQ ID NO: 50767 - DNA, 20 bp, human
gctccagctcaaaggctcca

SEQ ID NO: 50768 - DNA, 20 bp, human
gggccactgcagggtcatca

SEQ ID NO: 50769 - DNA, 20 bp, human
gaagagccgctccagctcaa

SEQ ID NO: 50770 - DNA, 20 bp, human
gaagaggctgtcgccgaaga

SEQ ID NO: 50771 - DNA, 20 bp, human
gcgttgacgtgggtgtactg

SEQ ID NO: 50772 - DNA, 20 bp, human
gggccagacctcgttgacgt

SEQ ID NO: 50773 - DNA, 20 bp, human
gctggagcggctcttctgga

SEQ ID NO: 50774 - DNA, 20 bp, human
gacccctggagcctttgagc

SEQ ID NO: 50775 - DNA, 20 bp, human
ggggaagaagccacgtcccc

SEQ ID NO: 50776 - DNA, 20 bp, human
gtgaggacgcggaggcgtgt

SEQ ID NO: 50777 - DNA, 20 bp, human
gcccgaggtccgctaggagg

SEQ ID NO: 50778 - DNA, 20 bp, human
gtcaagtcccaggggtccag

SEQ ID NO: 50779 - DNA, 20 bp, human
gactcgatgtcggcctggta

SEQ ID NO: 50780 - DNA, 20 bp, human
gaggaccgggcaccttccgg

SEQ ID NO: 50781 - DNA, 20 bp, human
ggcgcggagccgattctccc

SEQ ID NO: 50782 - DNA, 20 bp, human
gcccgcgtgtgacccaacgg

SEQ ID NO: 50783 - DNA, 20 bp, human
gcatcgagtcccgctcccca

SEQ ID NO: 50784 - DNA, 20 bp, human
gtaggggactggcgtgaagg

SEQ ID NO: 50785 - DNA, 20 bp, human
gagactcctccggagccacg

SEQ ID NO: 50786 - DNA, 20 bp, human
gtggctggcgaggctcagta

SEQ ID NO: 50787 - DNA, 20 bp, human
gggcctaggggccgagacag

SEQ ID NO: 50788 - DNA, 20 bp, human
gggtctgtagctccgaatag

SEQ ID NO: 50789 - DNA, 20 bp, human
gcacgggacaagctatctca

SEQ ID NO: 50790 - DNA, 20 bp, human
gtcacagacagagagggtga

SEQ ID NO: 50791 - DNA, 20 bp, human
ggaacctcgcttcttcctca

SEQ ID NO: 50792 - DNA, 20 bp, human
gcgaggctcagtacggtgtg

SEQ ID NO: 50793 - DNA, 20 bp, human
gggaggctggcgatacgagg

SEQ ID NO: 50794 - DNA, 20 bp, human
gttgacccaatggaccatga

SEQ ID NO: 50795 - DNA, 20 bp, human
ggatgtcgccatcccctatt

SEQ ID NO: 50796 - DNA, 20 bp, human
gccgatggcggagggaacgg

SEQ ID NO: 50797 - DNA, 20 bp, human
gactccagagcggatgtgag

SEQ ID NO: 50798 - DNA, 20 bp, human
ggcgccgatggcggagggaa

SEQ ID NO: 50799 - DNA, 20 bp, human
gatgtgaggggcgccgatgg

SEQ ID NO: 50800 - DNA, 20 bp, human
gggacaccacgtgcatgcta

SEQ ID NO: 50801 - DNA, 20 bp, human
gcggaggctcctctagagaa

SEQ ID NO: 50802 - DNA, 20 bp, human
gaggcccgcgctgcatactg

SEQ ID NO: 50803 - DNA, 20 bp, human
ggcgcccctcacatccgctc

SEQ ID NO: 50804 - DNA, 20 bp, human
gccccaagacccgccagtaa

SEQ ID NO: 50805 - DNA, 20 bp, human
ggtccctgcatatggacgta

SEQ ID NO: 50806 - DNA, 20 bp, human
gaccccaggagtgccaatca

SEQ ID NO: 50807 - DNA, 20 bp, human
ggagagtcagttcgccaggt

SEQ ID NO: 50808 - DNA, 20 bp, human
gcgcagagcactcggaccct

SEQ ID NO: 50809 - DNA, 20 bp, human
gtgactctcagcccgcgcct

SEQ ID NO: 50810 - DNA, 20 bp, human
gacctgcgcggctcctagcc

SEQ ID NO: 50811 - DNA, 20 bp, human
gaggtggtgacgcagaatcc

SEQ ID NO: 50812 - DNA, 20 bp, human
gcactgctcgagtacctgcg

SEQ ID NO: 50813 - DNA, 20 bp, human
gggcacgacgccagcccagg

SEQ ID NO: 50814 - DNA, 20 bp, human
gtggcgtcgtgccctagcca

SEQ ID NO: 50815 - DNA, 20 bp, human
gcccaccttctccttggcta

SEQ ID NO: 50816 - DNA, 20 bp, human
gtgtgcgacgcgggtcggag

SEQ ID NO: 50817 - DNA, 20 bp, human
gcagggacgctagtactcag

SEQ ID NO: 50818 - DNA, 20 bp, human
gctgtgtgtgcgacgcgggt

SEQ ID NO: 50819 - DNA, 20 bp, human
gcgcaggcctccagcgtcca

SEQ ID NO: 50820 - DNA, 20 bp, human
gtcggcgcagagagacccgg

SEQ ID NO: 50821 - DNA, 20 bp, human
gcgcttggcgccgtccaggg

SEQ ID NO: 50822 - DNA, 20 bp, human
ggttgaaagcgaagaaggag

SEQ ID NO: 50823 - DNA, 20 bp, human
ggcagggccgatcacgctgg

SEQ ID NO: 50824 - DNA, 20 bp, human
ggccgggccaagggcgccat

SEQ ID NO: 50825 - DNA, 20 bp, human
gcgctcgtccagcaacacca

SEQ ID NO: 50826 - DNA, 20 bp, human
gaatgaagccgagtgaatgg

SEQ ID NO: 50827 - DNA, 20 bp, human
ggaagaggagcgccagatgg

SEQ ID NO: 50828 - DNA, 20 bp, human
gtgcgagtccatagctgaag

SEQ ID NO: 50829 - DNA, 20 bp, human
gtgtgtgccgaggagtgaag

SEQ ID NO: 50830 - DNA, 20 bp, human
gcattcagcccccattcact

SEQ ID NO: 50831 - DNA, 20 bp, human
gggaggagctacagcaggta

SEQ ID NO: 50832 - DNA, 20 bp, human
gtggcgctcctcttcagcta

SEQ ID NO: 50833 - DNA, 20 bp, human
gatcaatgaagccgagtgaa

SEQ ID NO: 50834 - DNA, 20 bp, human
gctggaggtggaggattgta

SEQ ID NO: 50835 - DNA, 20 bp, human
gggtagcaggagccaacggc

SEQ ID NO: 50836 - DNA, 20 bp, human
gagacgctggagcgcggcgt

SEQ ID NO: 50837 - DNA, 20 bp, human
gcctgtttagggtcttatcc

SEQ ID NO: 50838 - DNA, 20 bp, human
ggctcctcagccaagaagaa

SEQ ID NO: 50839 - DNA, 20 bp, human
gtcggccaaaagcgccagtc

SEQ ID NO: 50840 - DNA, 20 bp, human
gcgctggagcgcggcgtagg

SEQ ID NO: 50841 - DNA, 20 bp, human
gatagcgagacgctggagcg

SEQ ID NO: 50842 - DNA, 20 bp, human
gggccgacttggcattgggt

SEQ ID NO: 50843 - DNA, 20 bp, human
gggcattgagggcgccggac

SEQ ID NO: 50844 - DNA, 20 bp, human
gcagaagccacgagctggaa

SEQ ID NO: 50845 - DNA, 20 bp, human
gtgggacccacatgagccag

SEQ ID NO: 50846 - DNA, 20 bp, human
gaggctccgggcccgagtga

SEQ ID NO: 50847 - DNA, 20 bp, human
ggagctcgcagccatcactc

SEQ ID NO: 50848 - DNA, 20 bp, human
gcgacggcctcggaaggtaa

SEQ ID NO: 50849 - DNA, 20 bp, human
gatggccgcgcccagagaca

SEQ ID NO: 50850 - DNA, 20 bp, human
ggcctggggtcgaggatcta

SEQ ID NO: 50851 - DNA, 20 bp, human
gtcctcccgacggcctcgga

SEQ ID NO: 50852 - DNA, 20 bp, human
gcagcgggaggaggttcacg

SEQ ID NO: 50853 - DNA, 20 bp, human
gcggagtctactcgatggta

SEQ ID NO: 50854 - DNA, 20 bp, human
gcgcagccatcactcgggcc

SEQ ID NO: 50855 - DNA, 20 bp, human
ggtgctaacagtggactcgg

SEQ ID NO: 50856 - DNA, 20 bp, human
gggacaactgtcaagtgtag

SEQ ID NO: 50857 - DNA, 20 bp, human
gagctggccaaggggcatgg

SEQ ID NO: 50858 - DNA, 20 bp, human
gtgaccaggtatggccacca

SEQ ID NO: 50859 - DNA, 20 bp, human
gtcagtgcagtgaccaggta

SEQ ID NO: 50860 - DNA, 20 bp, human
gtgaggtcagtgcagtgacc

SEQ ID NO: 50861 - DNA, 20 bp, human
gctcctctggatacagacgg

SEQ ID NO: 50862 - DNA, 20 bp, human
ggggagagaggtctcagcca

SEQ ID NO: 50863 - DNA, 20 bp, human
gtgagtggtagctggccaag

SEQ ID NO: 50864 - DNA, 20 bp, human
gtgggaaggagaaatgacac

SEQ ID NO: 50865 - DNA, 20 bp, human
gtctccctggtggccatacc

SEQ ID NO: 50866 - DNA, 20 bp, human
ggggcgggacttcgcgcttc

SEQ ID NO: 50867 - DNA, 20 bp, human
gcgagagtaggcggcctcag

SEQ ID NO: 50868 - DNA, 20 bp, human
gggatgccagcgagagtagg

SEQ ID NO: 50869 - DNA, 20 bp, human
ggcggcgcgggttgcggtta

SEQ ID NO: 50870 - DNA, 20 bp, human
ggggcctgcgggtcccctac

SEQ ID NO: 50871 - DNA, 20 bp, human
ggcgcccagcccgcagaagc

SEQ ID NO: 50872 - DNA, 20 bp, human
ggaagagtcaaggaccgcca

SEQ ID NO: 50873 - DNA, 20 bp, human
gctcggggagatgcaaaaag

SEQ ID NO: 50874 - DNA, 20 bp, human
gcggcgcgctccagagcggg

SEQ ID NO: 50875 - DNA, 20 bp, human
gggtcggaaggcgacggagg

SEQ ID NO: 50876 - DNA, 20 bp, human
gctgccgagtgcatcttgat

SEQ ID NO: 50877 - DNA, 20 bp, human
gcagtgacattaaaacgact

SEQ ID NO: 50878 - DNA, 20 bp, human
gttaaaacgacttggaatga

SEQ ID NO: 50879 - DNA, 20 bp, human
gaaaccgatcaagatgcact

SEQ ID NO: 50880 - DNA, 20 bp, human
gagggagggctatgtttgat

SEQ ID NO: 50881 - DNA, 20 bp, human
gtagccaagtatgtaagtcc

SEQ ID NO: 50882 - DNA, 20 bp, human
gtttcctggacttacatact

SEQ ID NO: 50883 - DNA, 20 bp, human
gcactcggcagttacttttg

SEQ ID NO: 50884 - DNA, 20 bp, human
gaatgtccgtttgcacaaag

SEQ ID NO: 50885 - DNA, 20 bp, human
ggatttaaactttactaata

SEQ ID NO: 50886 - DNA, 20 bp, human
gaaccaaccgagggaaccaa

SEQ ID NO: 50887 - DNA, 20 bp, human
gcaaccgagggaaccaaggg

SEQ ID NO: 50888 - DNA, 20 bp, human
gggagaccggcgagaacaga

SEQ ID NO: 50889 - DNA, 20 bp, human
ggatgccgccgcacggagac

SEQ ID NO: 50890 - DNA, 20 bp, human
ggccagcttgggtatgagag

SEQ ID NO: 50891 - DNA, 20 bp, human
gccgtgggcccggcacactg

SEQ ID NO: 50892 - DNA, 20 bp, human
gcccacggcccgcgggacaa

SEQ ID NO: 50893 - DNA, 20 bp, human
ggtctcgagtcacagggaca

SEQ ID NO: 50894 - DNA, 20 bp, human
ggccgaggagtcagcgacaa

SEQ ID NO: 50895 - DNA, 20 bp, human
ggggccagttaaccaaccga

SEQ ID NO: 50896 - DNA, 20 bp, human
ggagtcgccggactctggaa

SEQ ID NO: 50897 - DNA, 20 bp, human
gcaagcgcggatgaggtcat

SEQ ID NO: 50898 - DNA, 20 bp, human
ggacctgacccctccccgag

SEQ ID NO: 50899 - DNA, 20 bp, human
gggccgcgttgtgaaagtgg

SEQ ID NO: 50900 - DNA, 20 bp, human
gccagagtccggcgactctg

SEQ ID NO: 50901 - DNA, 20 bp, human
gtccccgagcggccggaacg

SEQ ID NO: 50902 - DNA, 20 bp, human
gagagatgaagaacttaggg

SEQ ID NO: 50903 - DNA, 20 bp, human
gtccctctgagggaattggg

SEQ ID NO: 50904 - DNA, 20 bp, human
gcatgttcccttccagagtc

SEQ ID NO: 50905 - DNA, 20 bp, human
ggaaaggaggagacaggcga

SEQ ID NO: 50906 - DNA, 20 bp, human
gggcccgttgccgtagagat

SEQ ID NO: 50907 - DNA, 20 bp, human
gaacgggccgggtcgcacca

SEQ ID NO: 50908 - DNA, 20 bp, human
ggcccgggcggctacggaag

SEQ ID NO: 50909 - DNA, 20 bp, human
gcacagagcccgggcggcta

SEQ ID NO: 50910 - DNA, 20 bp, human
gggccgggtaggtttcctag

SEQ ID NO: 50911 - DNA, 20 bp, human
gggcagggctggatggagtg

SEQ ID NO: 50912 - DNA, 20 bp, human
gctgcagccctggtgcgacc

SEQ ID NO: 50913 - DNA, 20 bp, human
ggttgccgtagagatgggca

SEQ ID NO: 50914 - DNA, 20 bp, human
ggaggctgcgggatcatgac

SEQ ID NO: 50915 - DNA, 20 bp, human
gttctctgaagacccggcac

SEQ ID NO: 50916 - DNA, 20 bp, human
gctgctgcggttacctggat

SEQ ID NO: 50917 - DNA, 20 bp, human
gcagaggtgctcgcccatcc

SEQ ID NO: 50918 - DNA, 20 bp, human
ggtaacaaagccagcctcag

SEQ ID NO: 50919 - DNA, 20 bp, human
gactcacctaggagcaacca

SEQ ID NO: 50920 - DNA, 20 bp, human
ggctggacgactcagtctct

SEQ ID NO: 50921 - DNA, 20 bp, human
ggggcgagcacctctgaggc

SEQ ID NO: 50922 - DNA, 20 bp, human
gatcccagcgatgcaatgta

SEQ ID NO: 50923 - DNA, 20 bp, human
gctcaggaagcaatgcacca

SEQ ID NO: 50924 - DNA, 20 bp, human
gtcgctgggataaacggagc

SEQ ID NO: 50925 - DNA, 20 bp, human
gtgtggctgctgcggttacc

SEQ ID NO: 50926 - DNA, 20 bp, human
gtcacctcgcaggaagtaca

SEQ ID NO: 50927 - DNA, 20 bp, human
gcgcccggagtcgaccgctc

SEQ ID NO: 50928 - DNA, 20 bp, human
gagcaggcaggcgagaacgg

SEQ ID NO: 50929 - DNA, 20 bp, human
ggggaaagaccgaaaggaag

SEQ ID NO: 50930 - DNA, 20 bp, human
ggggccgtggtgctggacga

SEQ ID NO: 50931 - DNA, 20 bp, human
ggccgcagcagcgcgttcca

SEQ ID NO: 50932 - DNA, 20 bp, human
gggccggagctccgccaccg

SEQ ID NO: 50933 - DNA, 20 bp, human
gtgcccgagcggtcgactcc

SEQ ID NO: 50934 - DNA, 20 bp, human
gcgggtctcgtgcagcagcg

SEQ ID NO: 50935 - DNA, 20 bp, human
gcgcaggaagtacacggcag

SEQ ID NO: 50936 - DNA, 20 bp, human
gcacctagcctgagacttgg

SEQ ID NO: 50937 - DNA, 20 bp, human
gaggtacgcaaggcacagtg

SEQ ID NO: 50938 - DNA, 20 bp, human
gagccgcgccgccaagtctc

SEQ ID NO: 50939 - DNA, 20 bp, human
ggtccagcagcgacatggag

SEQ ID NO: 50940 - DNA, 20 bp, human
gcgccgccaagtctcaggct

SEQ ID NO: 50941 - DNA, 20 bp, human
gcggccctgcctcatatcga

SEQ ID NO: 50942 - DNA, 20 bp, human
gaaggcacagtgaggcggaa

SEQ ID NO: 50943 - DNA, 20 bp, human
gcatgcagtgcagcagcgta

SEQ ID NO: 50944 - DNA, 20 bp, human
gaccgaggcattgacaatgg

SEQ ID NO: 50945 - DNA, 20 bp, human
ggtccgaggtctctctacgc

SEQ ID NO: 50946 - DNA, 20 bp, human
gttcatcccattccccatgg

SEQ ID NO: 50947 - DNA, 20 bp, human
ggttcgccttcagccaccat

SEQ ID NO: 50948 - DNA, 20 bp, human
gtgtggtcgcaggcgcacta

SEQ ID NO: 50949 - DNA, 20 bp, human
gagacggcagggcgtcggag

SEQ ID NO: 50950 - DNA, 20 bp, human
ggcctgcgaccacacggccg

SEQ ID NO: 50951 - DNA, 20 bp, human
gatggggaatgggatgaaca

SEQ ID NO: 50952 - DNA, 20 bp, human
ggcaaacccagcgcgaacga

SEQ ID NO: 50953 - DNA, 20 bp, human
gtagtttgggagcgaagagg

SEQ ID NO: 50954 - DNA, 20 bp, human
gggaccggccgggcaaccca

SEQ ID NO: 50955 - DNA, 20 bp, human
gtccagagacccggcgtgga

SEQ ID NO: 50956 - DNA, 20 bp, human
ggctgggcagagcgacccga

SEQ ID NO: 50957 - DNA, 20 bp, human
ggcagaccacgtggcccggg

SEQ ID NO: 50958 - DNA, 20 bp, human
gaggtaggtggtgagttact

SEQ ID NO: 50959 - DNA, 20 bp, human
ggtggacgaggccaacgcac

SEQ ID NO: 50960 - DNA, 20 bp, human
ggggcagagcgacccgaggg

SEQ ID NO: 50961 - DNA, 20 bp, human
gcggcgccctgcagaccacg

SEQ ID NO: 50962 - DNA, 20 bp, human
gtgagttacttggctcggag

SEQ ID NO: 50963 - DNA, 20 bp, human
ggaaggtcagcgggggacac

SEQ ID NO: 50964 - DNA, 20 bp, human
gtccaacaggaactggtagt

SEQ ID NO: 50965 - DNA, 20 bp, human
ggtccacgatctgcacgaag

SEQ ID NO: 50966 - DNA, 20 bp, human
gctgtcttgggcagaaacag

SEQ ID NO: 50967 - DNA, 20 bp, human
ggggagaggcgcccagctag

SEQ ID NO: 50968 - DNA, 20 bp, human
ggcgccttgcagaccagaca

SEQ ID NO: 50969 - DNA, 20 bp, human
gccgagtcgccaggcagcgt

SEQ ID NO: 50970 - DNA, 20 bp, human
gtcttgggcagaaacagcgg

SEQ ID NO: 50971 - DNA, 20 bp, human
gcagctggctctccacgctg

SEQ ID NO: 50972 - DNA, 20 bp, human
gaggcgcgcgggctcgtggg

SEQ ID NO: 50973 - DNA, 20 bp, human
gcgcttgcaaagaggtagag

SEQ ID NO: 50974 - DNA, 20 bp, human
ggcccagctaggggcgacgg

SEQ ID NO: 50975 - DNA, 20 bp, human
gagagagaggctggctcgct

SEQ ID NO: 50976 - DNA, 20 bp, human
gtcagggcttcttctcctag

SEQ ID NO: 50977 - DNA, 20 bp, human
gggctttgccctgagtgtca

SEQ ID NO: 50978 - DNA, 20 bp, human
gggctcaccaggattgacaa

SEQ ID NO: 50979 - DNA, 20 bp, human
ggagacaaaggtgtgcgcat

SEQ ID NO: 50980 - DNA, 20 bp, human
gtaacagctgtcctgcccct

SEQ ID NO: 50981 - DNA, 20 bp, human
gtgtcagggcacaaccatga

SEQ ID NO: 50982 - DNA, 20 bp, human
gcagctggtcccagccatca

SEQ ID NO: 50983 - DNA, 20 bp, human
gtgcgcatgggcataggtga

SEQ ID NO: 50984 - DNA, 20 bp, human
gggtccctcagcccttggtg

SEQ ID NO: 50985 - DNA, 20 bp, human
gaaggtgtgcgcatgggcat

SEQ ID NO: 50986 - DNA, 20 bp, human
gccagtgccacaggccgcgg

SEQ ID NO: 50987 - DNA, 20 bp, human
ggcgctcccgaggaagagtg

SEQ ID NO: 50988 - DNA, 20 bp, human
ggcaccaacggtggaggtac

SEQ ID NO: 50989 - DNA, 20 bp, human
gcgacgcgcaccaacggtgg

SEQ ID NO: 50990 - DNA, 20 bp, human
ggacgcaagcccagtgccac

SEQ ID NO: 50991 - DNA, 20 bp, human
gagcccagtgccacaggccg

SEQ ID NO: 50992 - DNA, 20 bp, human
ggcgcgacgcgcaccaacgg

SEQ ID NO: 50993 - DNA, 20 bp, human
gagggcgcgacgcgcaccaa

SEQ ID NO: 50994 - DNA, 20 bp, human
gcgggtcctagaggcctccg

SEQ ID NO: 50995 - DNA, 20 bp, human
ggccagacgccgcagtagag

SEQ ID NO: 50996 - DNA, 20 bp, human
gagctcgaacgagcccgaca

SEQ ID NO: 50997 - DNA, 20 bp, human
ggagcaagcgaggcggagag

SEQ ID NO: 50998 - DNA, 20 bp, human
gaggccaagccccaagcggg

SEQ ID NO: 50999 - DNA, 20 bp, human
gcccaaggccaagccccaag

SEQ ID NO: 51000 - DNA, 20 bp, human
gcccgaccccagcctcgggt

SEQ ID NO: 51001 - DNA, 20 bp, human
gacctgctctcggacggcag

SEQ ID NO: 51002 - DNA, 20 bp, human
gtcaccccgcggatctacgt

SEQ ID NO: 51003 - DNA, 20 bp, human
gtcaacgacctgctctcgga

SEQ ID NO: 51004 - DNA, 20 bp, human
gcctccgggagccacagcgg

SEQ ID NO: 51005 - DNA, 20 bp, human
gcggccccgccgtccctctc

SEQ ID NO: 51006 - DNA, 20 bp, human
gtaagccgaggagaaaactc

SEQ ID NO: 51007 - DNA, 20 bp, human
gcgccggaggagcgtaggca

SEQ ID NO: 51008 - DNA, 20 bp, human
gtggtcgccgggaaccgagg

SEQ ID NO: 51009 - DNA, 20 bp, human
gtgaaccgggacgagaatgg

SEQ ID NO: 51010 - DNA, 20 bp, human
gtgatgaaccgggacgagaa

SEQ ID NO: 51011 - DNA, 20 bp, human
gtgccctgcctacgctcctc

SEQ ID NO: 51012 - DNA, 20 bp, human
gcgcgaggctgcgggaggaa

SEQ ID NO: 51013 - DNA, 20 bp, human
gccgcctaggctgcagaaag

SEQ ID NO: 51014 - DNA, 20 bp, human
gggcgggcgagagctaagaa

SEQ ID NO: 51015 - DNA, 20 bp, human
gagcgtaggcagggcagcgc

SEQ ID NO: 51016 - DNA, 20 bp, human
ggcggaatccccggcttcta

SEQ ID NO: 51017 - DNA, 20 bp, human
gccgtggtggtgctggacca

SEQ ID NO: 51018 - DNA, 20 bp, human
gtacgtgctgcccgacgagg

SEQ ID NO: 51019 - DNA, 20 bp, human
ggcgcgcgcgccgcctcgtc

SEQ ID NO: 51020 - DNA, 20 bp, human
gccgcgggcgaggcacggga

SEQ ID NO: 51021 - DNA, 20 bp, human
ggcgcggccggcggaatccc

SEQ ID NO: 51022 - DNA, 20 bp, human
gaggcagcgaaggccagata

SEQ ID NO: 51023 - DNA, 20 bp, human
ggggctggctatcgagcgag

SEQ ID NO: 51024 - DNA, 20 bp, human
gtgggcagccgcgtcacgga

SEQ ID NO: 51025 - DNA, 20 bp, human
gcggcttctagggcggcgag

SEQ ID NO: 51026 - DNA, 20 bp, human
ggcgcgaggcagctcctcaa

SEQ ID NO: 51027 - DNA, 20 bp, human
ggcctaccagacgcccctcg

SEQ ID NO: 51028 - DNA, 20 bp, human
gtgggtgcagagagaacctc

SEQ ID NO: 51029 - DNA, 20 bp, human
ggctggagctgggcaacgag

SEQ ID NO: 51030 - DNA, 20 bp, human
ggaggagctgcctcgcgcag

SEQ ID NO: 51031 - DNA, 20 bp, human
gggcctatgcctgccccgag

SEQ ID NO: 51032 - DNA, 20 bp, human
ggactccgtgctactgagag

SEQ ID NO: 51033 - DNA, 20 bp, human
ggtctgagcgtatctatcat

SEQ ID NO: 51034 - DNA, 20 bp, human
gtccggggagaaagacgccc

SEQ ID NO: 51035 - DNA, 20 bp, human
ggccccgaggggcgtctggt

SEQ ID NO: 51036 - DNA, 20 bp, human
ggacagccccaattaaacgg

SEQ ID NO: 51037 - DNA, 20 bp, human
ggcgcacatgtcgacttcgg

SEQ ID NO: 51038 - DNA, 20 bp, human
gcggagccgccgtttaattg

SEQ ID NO: 51039 - DNA, 20 bp, human
gacgactcgaagagctcgtg

SEQ ID NO: 51040 - DNA, 20 bp, human
gaggcgggcgcccggagacg

SEQ ID NO: 51041 - DNA, 20 bp, human
gaattggggctgtcaggccg

SEQ ID NO: 51042 - DNA, 20 bp, human
ggccactcggcgctcttgca

SEQ ID NO: 51043 - DNA, 20 bp, human
gcatgtgcgcccgcgctggg

SEQ ID NO: 51044 - DNA, 20 bp, human
gcggccggggcgccgtccca

SEQ ID NO: 51045 - DNA, 20 bp, human
gcacatgtcgacttcggggg

SEQ ID NO: 51046 - DNA, 20 bp, human
gtctcttgcaggatcaggaa

SEQ ID NO: 51047 - DNA, 20 bp, human
gttcaggctacatgcaacag

SEQ ID NO: 51048 - DNA, 20 bp, human
gccctgcggcccacctcctg

SEQ ID NO: 51049 - DNA, 20 bp, human
gcctccctgaggcagaaggt

SEQ ID NO: 51050 - DNA, 20 bp, human
gggacagcggcagggcccca

SEQ ID NO: 51051 - DNA, 20 bp, human
gcaggaaagggatgaaatac

SEQ ID NO: 51052 - DNA, 20 bp, human
gcagcgggcccttcttgaag

SEQ ID NO: 51053 - DNA, 20 bp, human
ggcagggaccaccagaggga

SEQ ID NO: 51054 - DNA, 20 bp, human
gagtcagactgggccaaggg

SEQ ID NO: 51055 - DNA, 20 bp, human
gtgggaggcggcacgactgg

SEQ ID NO: 51056 - DNA, 20 bp, human
ggtccggcggggcgtcgtgg

SEQ ID NO: 51057 - DNA, 20 bp, human
ggccccgggcctgtcactcg

SEQ ID NO: 51058 - DNA, 20 bp, human
gcgagcgcgagcgaggtgag

SEQ ID NO: 51059 - DNA, 20 bp, human
gtgtcactcgcggccgagcg

SEQ ID NO: 51060 - DNA, 20 bp, human
gtgccccagcgcccccgacg

SEQ ID NO: 51061 - DNA, 20 bp, human
ggccgtggccgctcattccg

SEQ ID NO: 51062 - DNA, 20 bp, human
gcccccgccgggcccatgga

SEQ ID NO: 51063 - DNA, 20 bp, human
ggagccgcgccggaacctcc

SEQ ID NO: 51064 - DNA, 20 bp, human
gtggggcagcggcacccggt

SEQ ID NO: 51065 - DNA, 20 bp, human
gggctcgggcgtccggcgtc

SEQ ID NO: 51066 - DNA, 20 bp, human
gccgcgcaccggccgcttcc

SEQ ID NO: 51067 - DNA, 20 bp, human
ggcccgcgcagcccgcgcac

SEQ ID NO: 51068 - DNA, 20 bp, human
ggggagatctaggcctcgaa

SEQ ID NO: 51069 - DNA, 20 bp, human
ggttgtaactccacgtccga

SEQ ID NO: 51070 - DNA, 20 bp, human
gagagacctggagcgagatc

SEQ ID NO: 51071 - DNA, 20 bp, human
gccggctgccaggaagcggc

SEQ ID NO: 51072 - DNA, 20 bp, human
gctggccctgggggagatct

SEQ ID NO: 51073 - DNA, 20 bp, human
ggacctggagcgagatccgg

SEQ ID NO: 51074 - DNA, 20 bp, human
gatctcccccagggccaggt

SEQ ID NO: 51075 - DNA, 20 bp, human
gccgagacaggagcagaaag

SEQ ID NO: 51076 - DNA, 20 bp, human
gggcctctcctggagccgag

SEQ ID NO: 51077 - DNA, 20 bp, human
gtgcccctcggctccaggag

SEQ ID NO: 51078 - DNA, 20 bp, human
gacgccaccggaaccccggg

SEQ ID NO: 51079 - DNA, 20 bp, human
gctaacgccaccggaacccc

SEQ ID NO: 51080 - DNA, 20 bp, human
gtgcaagtggcaggagacac

SEQ ID NO: 51081 - DNA, 20 bp, human
gggtggaggagcgcacgtcg

SEQ ID NO: 51082 - DNA, 20 bp, human
gctacaggcacccgggtctg

SEQ ID NO: 51083 - DNA, 20 bp, human
gttggagtttccctccgcag

SEQ ID NO: 51084 - DNA, 20 bp, human
gggagacacgggaggtgcac

SEQ ID NO: 51085 - DNA, 20 bp, human
gccgccacccggggttccgg

SEQ ID NO: 51086 - DNA, 20 bp, human
gaggcgagcgaggagaccac

SEQ ID NO: 51087 - DNA, 20 bp, human
gcgagcgaggagaccaccgg

SEQ ID NO: 51088 - DNA, 20 bp, human
gtagagaggaaggcccatgg

SEQ ID NO: 51089 - DNA, 20 bp, human
gcctggcccggagagtaccg

SEQ ID NO: 51090 - DNA, 20 bp, human
gcagtcaccggagagatcac

SEQ ID NO: 51091 - DNA, 20 bp, human
gaggagaccaccgggggaag

SEQ ID NO: 51092 - DNA, 20 bp, human
ggcgctggccgcctgagcca

SEQ ID NO: 51093 - DNA, 20 bp, human
gcgtctggaaggaatccacg

SEQ ID NO: 51094 - DNA, 20 bp, human
gcaggacgggcgcgtcttca

SEQ ID NO: 51095 - DNA, 20 bp, human
gtcggggccgctggctggaa

SEQ ID NO: 51096 - DNA, 20 bp, human
gagtagggctaaaaacccag

SEQ ID NO: 51097 - DNA, 20 bp, human
gaaagctcagtcaagcacaa

SEQ ID NO: 51098 - DNA, 20 bp, human
gttgcctgcttgtctctaac

SEQ ID NO: 51099 - DNA, 20 bp, human
ggaatcaaggattccagatc

SEQ ID NO: 51100 - DNA, 20 bp, human
gcattctgtagagagaaatc

SEQ ID NO: 51101 - DNA, 20 bp, human
gtagatgaagtccaaagttc

SEQ ID NO: 51102 - DNA, 20 bp, human
gatgcctgttagagacaagc

SEQ ID NO: 51103 - DNA, 20 bp, human
ggctaaaacagagcaactat

SEQ ID NO: 51104 - DNA, 20 bp, human
ggggaacttactgtgtgaat

SEQ ID NO: 51105 - DNA, 20 bp, human
gtcagagctcaaaatatcct

SEQ ID NO: 51106 - DNA, 20 bp, human
gtctcggccccgacgctccg

SEQ ID NO: 51107 - DNA, 20 bp, human
gccgggggcctcggagcgtc

SEQ ID NO: 51108 - DNA, 20 bp, human
gcgggcagcttgaccaggta

SEQ ID NO: 51109 - DNA, 20 bp, human
gggccacgggcagcttgacc

SEQ ID NO: 51110 - DNA, 20 bp, human
ggcgagggacgcagcacgga

SEQ ID NO: 51111 - DNA, 20 bp, human
gtgacgcgctcgggggccac

SEQ ID NO: 51112 - DNA, 20 bp, human
gatctaccacatggacgagg

SEQ ID NO: 51113 - DNA, 20 bp, human
gggccgaccgagtctgacac

SEQ ID NO: 51114 - DNA, 20 bp, human
gctcgggccgcgccgttaaa

SEQ ID NO: 51115 - DNA, 20 bp, human
ggcgcgcgcccacctgtccg

SEQ ID NO: 51116 - DNA, 20 bp, human
gtcggtttgcgggtgtgcgc

SEQ ID NO: 51117 - DNA, 20 bp, human
gctcaaagccccggtctcag

SEQ ID NO: 51118 - DNA, 20 bp, human
gaagctcgcggcgtcggtgg

SEQ ID NO: 51119 - DNA, 20 bp, human
gggtacctggaggaagctcg

SEQ ID NO: 51120 - DNA, 20 bp, human
gaggaagctcgcggcgtcgg

SEQ ID NO: 51121 - DNA, 20 bp, human
gcgcggcggccgctgagacc

SEQ ID NO: 51122 - DNA, 20 bp, human
gagtcacgtgacatgaggag

SEQ ID NO: 51123 - DNA, 20 bp, human
ggacaggactgacccagtac

SEQ ID NO: 51124 - DNA, 20 bp, human
gcgcaaggcctagataggac

SEQ ID NO: 51125 - DNA, 20 bp, human
gtggattgggcgacatggag

SEQ ID NO: 51126 - DNA, 20 bp, human
gggtagcggccggagaacaa

SEQ ID NO: 51127 - DNA, 20 bp, human
gcagtccagtcgggagagtg

SEQ ID NO: 51128 - DNA, 20 bp, human
gcggcgctgggacccggtag

SEQ ID NO: 51129 - DNA, 20 bp, human
ggcggctcaacccagctcgg

SEQ ID NO: 51130 - DNA, 20 bp, human
gagaggtaaggggaccgcac

SEQ ID NO: 51131 - DNA, 20 bp, human
gcgcggtcgccagtccagtc

SEQ ID NO: 51132 - DNA, 20 bp, human
gcgagcctcccagacggcgg

SEQ ID NO: 51133 - DNA, 20 bp, human
ggcgaccgcgactcttccgg

SEQ ID NO: 51134 - DNA, 20 bp, human
gcgggcccgctcccctcctc

SEQ ID NO: 51135 - DNA, 20 bp, human
gtcaccttggcggactttaa

SEQ ID NO: 51136 - DNA, 20 bp, human
gtgacgtcatagctctgcgg

SEQ ID NO: 51137 - DNA, 20 bp, human
ggtcatggcaggcacgccag

SEQ ID NO: 51138 - DNA, 20 bp, human
ggaagcagcccagttccgaa

SEQ ID NO: 51139 - DNA, 20 bp, human
ggggcgccggtagaaaggaa

SEQ ID NO: 51140 - DNA, 20 bp, human
ggcagagaaggtgctggacg

SEQ ID NO: 51141 - DNA, 20 bp, human
ggaggtcctaagacaagcag

SEQ ID NO: 51142 - DNA, 20 bp, human
gccatgacgtcatagctctg

SEQ ID NO: 51143 - DNA, 20 bp, human
gcttggagggagccaatccg

SEQ ID NO: 51144 - DNA, 20 bp, human
gctatagtagcgcagggctc

SEQ ID NO: 51145 - DNA, 20 bp, human
gccgaagggcgccggtagaa

SEQ ID NO: 51146 - DNA, 20 bp, human
gacgggacgccgctcctggg

SEQ ID NO: 51147 - DNA, 20 bp, human
gccggacccagcgaagctag

SEQ ID NO: 51148 - DNA, 20 bp, human
gcgagcaggcgcgtgtgtag

SEQ ID NO: 51149 - DNA, 20 bp, human
ggcgcctcaggagccagtgt

SEQ ID NO: 51150 - DNA, 20 bp, human
ggatgaggcggtgtgcagga

SEQ ID NO: 51151 - DNA, 20 bp, human
gcccacccgggagtctggaa

SEQ ID NO: 51152 - DNA, 20 bp, human
gtgtgtaggggtgagcgcac

SEQ ID NO: 51153 - DNA, 20 bp, human
ggcaacgggacgccgctcct

SEQ ID NO: 51154 - DNA, 20 bp, human
gaggggtgagcgcaccggaa

SEQ ID NO: 51155 - DNA, 20 bp, human
ggagggggcaacgggcagag

SEQ ID NO: 51156 - DNA, 20 bp, human
ggcgcctcaggagccagtgt

SEQ ID NO: 51157 - DNA, 20 bp, human
gtgagcagagggcacgcggt

SEQ ID NO: 51158 - DNA, 20 bp, human
gaggcgccgcaaagcggaag

SEQ ID NO: 51159 - DNA, 20 bp, human
gacgcggtgggcagcgaagg

SEQ ID NO: 51160 - DNA, 20 bp, human
gcagtgtaggcgccgcaaag

SEQ ID NO: 51161 - DNA, 20 bp, human
gcgcgcggataggtgagcag

SEQ ID NO: 51162 - DNA, 20 bp, human
ggcggaaggggcgcgcggat

SEQ ID NO: 51163 - DNA, 20 bp, human
gggagcccgccgcagagtag

SEQ ID NO: 51164 - DNA, 20 bp, human
ggatgaggcggtgtgcagga

SEQ ID NO: 51165 - DNA, 20 bp, human
ggagggggcaacgggcagag

SEQ ID NO: 51166 - DNA, 20 bp, human
gggctttgcggtagcccagg

SEQ ID NO: 51167 - DNA, 20 bp, human
gaggcacgaataacacccaa

SEQ ID NO: 51168 - DNA, 20 bp, human
gagggaagcgaccgagaacg

SEQ ID NO: 51169 - DNA, 20 bp, human
gggctagggaccagaccccc

SEQ ID NO: 51170 - DNA, 20 bp, human
gggcgcccgcgggcagggaa

SEQ ID NO: 51171 - DNA, 20 bp, human
gccagccggctgagacaggt

SEQ ID NO: 51172 - DNA, 20 bp, human
ggacccgcggacggatggga

SEQ ID NO: 51173 - DNA, 20 bp, human
ggcgaccgagaacgcggcta

SEQ ID NO: 51174 - DNA, 20 bp, human
gcctgaccccctctgacagg

SEQ ID NO: 51175 - DNA, 20 bp, human
gcacggacccgcggacggat

SEQ ID NO: 51176 - DNA, 20 bp, human
gatggagcaaggacactcac

SEQ ID NO: 51177 - DNA, 20 bp, human
gggagagaagcttgtgatac

SEQ ID NO: 51178 - DNA, 20 bp, human
gcagcacaaaaattgataca

SEQ ID NO: 51179 - DNA, 20 bp, human
gtcatggttgcagatataaa

SEQ ID NO: 51180 - DNA, 20 bp, human
gtataggcaaactatcaaaa

SEQ ID NO: 51181 - DNA, 20 bp, human
gggagtttatgtttacatga

SEQ ID NO: 51182 - DNA, 20 bp, human
ggatctatttgtatatccta

SEQ ID NO: 51183 - DNA, 20 bp, human
gtgatgcatcagtacaagtg

SEQ ID NO: 51184 - DNA, 20 bp, human
ggaaatgtttctatggccat

SEQ ID NO: 51185 - DNA, 20 bp, human
gacagggttgctctttattt

SEQ ID NO: 51186 - DNA, 20 bp, human
gcggacggtccggcttccgg

SEQ ID NO: 51187 - DNA, 20 bp, human
gggagccggctccgccctaa

SEQ ID NO: 51188 - DNA, 20 bp, human
gggtgggctagcggacggtc

SEQ ID NO: 51189 - DNA, 20 bp, human
gctgcagatgacccctggat

SEQ ID NO: 51190 - DNA, 20 bp, human
gtggctgtctcgctgagtcg

SEQ ID NO: 51191 - DNA, 20 bp, human
gtccaggagcgatgagaagg

SEQ ID NO: 51192 - DNA, 20 bp, human
gccttccaggagcgatgaga

SEQ ID NO: 51193 - DNA, 20 bp, human
ggctagcccaccgcagactg

SEQ ID NO: 51194 - DNA, 20 bp, human
gtctgcggtgggctagcgga

SEQ ID NO: 51195 - DNA, 20 bp, human
ggtgtcggccgtgcagaatg

SEQ ID NO: 51196 - DNA, 20 bp, human
ggcgggatgtcgccgctccc

SEQ ID NO: 51197 - DNA, 20 bp, human
ggcggcagcgttggtgcagg

SEQ ID NO: 51198 - DNA, 20 bp, human
gcggcagagccgagagacta

SEQ ID NO: 51199 - DNA, 20 bp, human
gaggaagtgatcgctcccgg

SEQ ID NO: 51200 - DNA, 20 bp, human
gccttcccagcccacaaggt

SEQ ID NO: 51201 - DNA, 20 bp, human
gcacaaggtgggcgaccagg

SEQ ID NO: 51202 - DNA, 20 bp, human
ggagaggaagtgatcgctcc

SEQ ID NO: 51203 - DNA, 20 bp, human
ggctcggctcgcgctcctcc

SEQ ID NO: 51204 - DNA, 20 bp, human
gagaggggggtgtcactggg

SEQ ID NO: 51205 - DNA, 20 bp, human
gcccagcgcagacgacaccg

SEQ ID NO: 51206 - DNA, 20 bp, human
ggctgctacggcgagagctt

SEQ ID NO: 51207 - DNA, 20 bp, human
ggagcgacctcgttctggtg

SEQ ID NO: 51208 - DNA, 20 bp, human
gctcttggccgtgaccccag

SEQ ID NO: 51209 - DNA, 20 bp, human
ggcacacaaagagggatggg

SEQ ID NO: 51210 - DNA, 20 bp, human
ggagggcgcggtccacggca

SEQ ID NO: 51211 - DNA, 20 bp, human
ggtgaggggagacactatca

SEQ ID NO: 51212 - DNA, 20 bp, human
ggccaagagggcgcggtcca

SEQ ID NO: 51213 - DNA, 20 bp, human
ggcgtccggaagaagccagt

SEQ ID NO: 51214 - DNA, 20 bp, human
ggcctctggagggtcgagaa

SEQ ID NO: 51215 - DNA, 20 bp, human
gtggctacagttggtgttgg

SEQ ID NO: 51216 - DNA, 20 bp, human
gtcgggaatcacaccactcc

SEQ ID NO: 51217 - DNA, 20 bp, human
gggcaggcgacgacgaggac

SEQ ID NO: 51218 - DNA, 20 bp, human
gcaagactaaatgtgcgagg

SEQ ID NO: 51219 - DNA, 20 bp, human
gggaagcaaggcgtacggtg

SEQ ID NO: 51220 - DNA, 20 bp, human
gtaacgggaagcaaggcgta

SEQ ID NO: 51221 - DNA, 20 bp, human
gatgtgcgaggcggctgagg

SEQ ID NO: 51222 - DNA, 20 bp, human
gctgaggatgcaggacctaa

SEQ ID NO: 51223 - DNA, 20 bp, human
gtgtaagtcgaggataatcc

SEQ ID NO: 51224 - DNA, 20 bp, human
gcggcgggaacccggatatg

SEQ ID NO: 51225 - DNA, 20 bp, human
gcccggcggagaagaaccga

SEQ ID NO: 51226 - DNA, 20 bp, human
gagctgctgctaggtcccaa

SEQ ID NO: 51227 - DNA, 20 bp, human
gcaggcggctggaacgggga

SEQ ID NO: 51228 - DNA, 20 bp, human
gggcaagatggcgccggtgg

SEQ ID NO: 51229 - DNA, 20 bp, human
gaggcggggacctgagggag

SEQ ID NO: 51230 - DNA, 20 bp, human
gctggcgggaaagggaccgt

SEQ ID NO: 51231 - DNA, 20 bp, human
ggaccgtcggacacactgag

SEQ ID NO: 51232 - DNA, 20 bp, human
gggcgacctgaccagtgagg

SEQ ID NO: 51233 - DNA, 20 bp, human
gggaggacctgtggcgacaa

SEQ ID NO: 51234 - DNA, 20 bp, human
gccgcccgcggcctcaccat

SEQ ID NO: 51235 - DNA, 20 bp, human
ggcctccagcgcctgagggt

SEQ ID NO: 51236 - DNA, 20 bp, human
gcgttcgccatgattggaag

SEQ ID NO: 51237 - DNA, 20 bp, human
gatcatggcgaacgggactg

SEQ ID NO: 51238 - DNA, 20 bp, human
gagggaaacatgcttcggtc

SEQ ID NO: 51239 - DNA, 20 bp, human
gcagtccggagggaagtgaa

SEQ ID NO: 51240 - DNA, 20 bp, human
gtcgccatgattggaagggg

SEQ ID NO: 51241 - DNA, 20 bp, human
ggaacgggactgcggacgtt

SEQ ID NO: 51242 - DNA, 20 bp, human
gaaacatgcttcggtcaggt

SEQ ID NO: 51243 - DNA, 20 bp, human
gtggcgacggagcactacgg

SEQ ID NO: 51244 - DNA, 20 bp, human
gggcaaccagatgctcctca

SEQ ID NO: 51245 - DNA, 20 bp, human
ggcccagccagagggacgtc

SEQ ID NO: 51246 - DNA, 20 bp, human
gtcgccgcctgattctaggc

SEQ ID NO: 51247 - DNA, 20 bp, human
gtggctgccgcaaacgtcac

SEQ ID NO: 51248 - DNA, 20 bp, human
ggagctcgccgcctgattct

SEQ ID NO: 51249 - DNA, 20 bp, human
gtagtgaccagcctagaatc

SEQ ID NO: 51250 - DNA, 20 bp, human
gccgggttcagggaatacct

SEQ ID NO: 51251 - DNA, 20 bp, human
gcgaacccccgcaccaggag

SEQ ID NO: 51252 - DNA, 20 bp, human
ggccgcaaacgtcacaggct

SEQ ID NO: 51253 - DNA, 20 bp, human
gaatacctgggcatcgtcga

SEQ ID NO: 51254 - DNA, 20 bp, human
gcgagctccgcaaggagtct

SEQ ID NO: 51255 - DNA, 20 bp, human
gacccccgcaccaggagggg

SEQ ID NO: 51256 - DNA, 20 bp, human
gcttagatgcgccacggttt

SEQ ID NO: 51257 - DNA, 20 bp, human
gagaaactcggggggccagg

SEQ ID NO: 51258 - DNA, 20 bp, human
ggggctgcttagatgcgcca

SEQ ID NO: 51259 - DNA, 20 bp, human
gaccgtcgctaccgaaaccg

SEQ ID NO: 51260 - DNA, 20 bp, human
ggggcctgagcactaggcgg

SEQ ID NO: 51261 - DNA, 20 bp, human
gtagcgacggtatctctagc

SEQ ID NO: 51262 - DNA, 20 bp, human
gctacgcggagggctaagtc

SEQ ID NO: 51263 - DNA, 20 bp, human
gtccggagtggggcgaaata

SEQ ID NO: 51264 - DNA, 20 bp, human
gatacgcagccgggagcagg

SEQ ID NO: 51265 - DNA, 20 bp, human
gggagggctaagtccggagt

SEQ ID NO: 51266 - DNA, 20 bp, human
gctgcgggagccggagaccg

SEQ ID NO: 51267 - DNA, 20 bp, human
gtccgcccttggagtttcgc

SEQ ID NO: 51268 - DNA, 20 bp, human
gcccttggcgttgacggtcc

SEQ ID NO: 51269 - DNA, 20 bp, human
ggcggccggcgaaactccaa

SEQ ID NO: 51270 - DNA, 20 bp, human
gacacaggcccgccacccgg

SEQ ID NO: 51271 - DNA, 20 bp, human
ggtgaggcgccagtgcggag

SEQ ID NO: 51272 - DNA, 20 bp, human
ggggtggccggggcaaaggg

SEQ ID NO: 51273 - DNA, 20 bp, human
ggaacagcgccggagtgact

SEQ ID NO: 51274 - DNA, 20 bp, human
gtccagcagcgccacgaggg

SEQ ID NO: 51275 - DNA, 20 bp, human
gccccggcccctgacatcag

SEQ ID NO: 51276 - DNA, 20 bp, human
gggcctctaaagcctgaccg

SEQ ID NO: 51277 - DNA, 20 bp, human
gctaccggatcggtcggaaa

SEQ ID NO: 51278 - DNA, 20 bp, human
gctacgcggggctaccggat

SEQ ID NO: 51279 - DNA, 20 bp, human
gtctacctcacagagctggg

SEQ ID NO: 51280 - DNA, 20 bp, human
gcgcaggcgcagaaaggcac

SEQ ID NO: 51281 - DNA, 20 bp, human
gtcggccaggaagagatgat

SEQ ID NO: 51282 - DNA, 20 bp, human
ggcggggctaccggatcggt

SEQ ID NO: 51283 - DNA, 20 bp, human
ggccccagccgacttgaggg

SEQ ID NO: 51284 - DNA, 20 bp, human
ggctcccgcttccggtcaag

SEQ ID NO: 51285 - DNA, 20 bp, human
ggctaagtgttcgctacgcg

SEQ ID NO: 51286 - DNA, 20 bp, human
gtctggaactgtgctggacg

SEQ ID NO: 51287 - DNA, 20 bp, human
gactgaagtgtgatctgtca

SEQ ID NO: 51288 - DNA, 20 bp, human
gtcagggtggtgggattgag

SEQ ID NO: 51289 - DNA, 20 bp, human
gctgccagaaaacaagacca

SEQ ID NO: 51290 - DNA, 20 bp, human
gggacgaggctgagtaagca

SEQ ID NO: 51291 - DNA, 20 bp, human
gccctttgtgaggacactgg

SEQ ID NO: 51292 - DNA, 20 bp, human
gtatcggcctctcctaacct

SEQ ID NO: 51293 - DNA, 20 bp, human
gtttgtgaggacactggagg

SEQ ID NO: 51294 - DNA, 20 bp, human
gagaaaacaagaccaaggtt

SEQ ID NO: 51295 - DNA, 20 bp, human
gtggtcctctggaactgtgc

SEQ ID NO: 51296 - DNA, 20 bp, human
ggcggaggccgcgaaactct

SEQ ID NO: 51297 - DNA, 20 bp, human
ggcgttgttgacatcccggg

SEQ ID NO: 51298 - DNA, 20 bp, human
gaactctgggctcaggccgg

SEQ ID NO: 51299 - DNA, 20 bp, human
ggtagcgttgttgacatccc

SEQ ID NO: 51300 - DNA, 20 bp, human
gctccgcgatggtaaatctg

SEQ ID NO: 51301 - DNA, 20 bp, human
gcaggggagtgagaaatccg

SEQ ID NO: 51302 - DNA, 20 bp, human
ggcctgagcccagagtttcg

SEQ ID NO: 51303 - DNA, 20 bp, human
ggaccccagatttaccatcg

SEQ ID NO: 51304 - DNA, 20 bp, human
gacggtcggcgtgcttggaa

SEQ ID NO: 51305 - DNA, 20 bp, human
gcgagagggagaccttggaa

SEQ ID NO: 51306 - DNA, 20 bp, human
gggacgcgccggaggaaaga

SEQ ID NO: 51307 - DNA, 20 bp, human
gggtcagccccgcagagcaa

SEQ ID NO: 51308 - DNA, 20 bp, human
ggaggaggtaaccgccgggt

SEQ ID NO: 51309 - DNA, 20 bp, human
gccttccgtcgccgacccgg

SEQ ID NO: 51310 - DNA, 20 bp, human
gctgcggaggaggtaaccgc

SEQ ID NO: 51311 - DNA, 20 bp, human
ggactaccaggctgcggagg

SEQ ID NO: 51312 - DNA, 20 bp, human
gcgccactcagggagccgga

SEQ ID NO: 51313 - DNA, 20 bp, human
gggaaacggcggcaatgtcc

SEQ ID NO: 51314 - DNA, 20 bp, human
gcacccttccgtcgccgacc

SEQ ID NO: 51315 - DNA, 20 bp, human
gtggcctagctgaaggaggt

SEQ ID NO: 51316 - DNA, 20 bp, human
gcccgcgctgaggaagccaa

SEQ ID NO: 51317 - DNA, 20 bp, human
ggtagcgccggctctccctg

SEQ ID NO: 51318 - DNA, 20 bp, human
gtgaggaagccaagggacgg

SEQ ID NO: 51319 - DNA, 20 bp, human
gccgagactccgagccatgg

SEQ ID NO: 51320 - DNA, 20 bp, human
gggcgctcccaggtagccaa

SEQ ID NO: 51321 - DNA, 20 bp, human
ggggcggtacctcgtcgcag

SEQ ID NO: 51322 - DNA, 20 bp, human
gacacgccggtagagcaccg

SEQ ID NO: 51323 - DNA, 20 bp, human
gctggggcggagcgacacgc

SEQ ID NO: 51324 - DNA, 20 bp, human
ggcattaccgggagcgggaa

SEQ ID NO: 51325 - DNA, 20 bp, human
ggcgccgccctcctaccggg

SEQ ID NO: 51326 - DNA, 20 bp, human
gaagagaatgtgggaatcga

SEQ ID NO: 51327 - DNA, 20 bp, human
ggatattatacccatacata

SEQ ID NO: 51328 - DNA, 20 bp, human
gtatgggagtagatgttagt

SEQ ID NO: 51329 - DNA, 20 bp, human
ggaaagaagacgatgcatac

SEQ ID NO: 51330 - DNA, 20 bp, human
ggacatgcattcaaccataa

SEQ ID NO: 51331 - DNA, 20 bp, human
gttgaaatacagtaaaactc

SEQ ID NO: 51332 - DNA, 20 bp, human
ggatggtctattttgaatgg

SEQ ID NO: 51333 - DNA, 20 bp, human
gataaatagcagttagtggg

SEQ ID NO: 51334 - DNA, 20 bp, human
gtttaagaaaccgtatgtat

SEQ ID NO: 51335 - DNA, 20 bp, human
gcaagagctaatattttggt

SEQ ID NO: 51336 - DNA, 20 bp, human
gactggctgagggtatccgg

SEQ ID NO: 51337 - DNA, 20 bp, human
gcggcggacgcggcaagcca

SEQ ID NO: 51338 - DNA, 20 bp, human
gtgagggtatccggcggacg

SEQ ID NO: 51339 - DNA, 20 bp, human
gcccactggctgagggtatc

SEQ ID NO: 51340 - DNA, 20 bp, human
ggcctagcaacagctgccct

SEQ ID NO: 51341 - DNA, 20 bp, human
gagctgccctaggctgtgat

SEQ ID NO: 51342 - DNA, 20 bp, human
gtgggcctgctgagaccgga

SEQ ID NO: 51343 - DNA, 20 bp, human
ggcctagggcagctgttgct

SEQ ID NO: 51344 - DNA, 20 bp, human
gcaagcggtcgcagggaggt

SEQ ID NO: 51345 - DNA, 20 bp, human
gtggcaatcggcacctgcca

SEQ ID NO: 51346 - DNA, 20 bp, human
gccccgtctccctcacatag

SEQ ID NO: 51347 - DNA, 20 bp, human
ggcctccttaccggtcgggt

SEQ ID NO: 51348 - DNA, 20 bp, human
ggccgcctacccgaccggta

SEQ ID NO: 51349 - DNA, 20 bp, human
ggcggccgcccgcgccacag

SEQ ID NO: 51350 - DNA, 20 bp, human
ggaagtagcagcaggaccgg

SEQ ID NO: 51351 - DNA, 20 bp, human
gggacctcgaacaaagtcgg

SEQ ID NO: 51352 - DNA, 20 bp, human
gctccccgcgcccctatgtg

SEQ ID NO: 51353 - DNA, 20 bp, human
gcacggcctccttaccggtc

SEQ ID NO: 51354 - DNA, 20 bp, human
ggcctacccgaccggtaagg

SEQ ID NO: 51355 - DNA, 20 bp, human
gggcggcacggcctccttac

SEQ ID NO: 51356 - DNA, 20 bp, human
gctggaggcgccacagggag

SEQ ID NO: 51357 - DNA, 20 bp, human
gtctggtcgagagtacccgt

SEQ ID NO: 51358 - DNA, 20 bp, human
gcgcggcgcgacgctcccac

SEQ ID NO: 51359 - DNA, 20 bp, human
ggccgggacggctgcctccg

SEQ ID NO: 51360 - DNA, 20 bp, human
gcacgccacctacgccggga

SEQ ID NO: 51361 - DNA, 20 bp, human
ggggggccctgatagagagg

SEQ ID NO: 51362 - DNA, 20 bp, human
gggtagagtgagccctcagt

SEQ ID NO: 51363 - DNA, 20 bp, human
gttcccagccggggccagtc

SEQ ID NO: 51364 - DNA, 20 bp, human
ggccctgatagagaggaggt

SEQ ID NO: 51365 - DNA, 20 bp, human
ggcccggtgagacagggatg

SEQ ID NO: 51366 - DNA, 20 bp, human
gtggcccaggatcacttctg

SEQ ID NO: 51367 - DNA, 20 bp, human
ggatccccagaagtgatcct

SEQ ID NO: 51368 - DNA, 20 bp, human
ggtcaatggccacgtcgtag

SEQ ID NO: 51369 - DNA, 20 bp, human
gcccaggctccacatgtcaa

SEQ ID NO: 51370 - DNA, 20 bp, human
gctgggccacccctacgacg

SEQ ID NO: 51371 - DNA, 20 bp, human
gcggctcccacggagaccgt

SEQ ID NO: 51372 - DNA, 20 bp, human
gtggatgtacgtgtatactg

SEQ ID NO: 51373 - DNA, 20 bp, human
gcagctggcctgcatcatgg

SEQ ID NO: 51374 - DNA, 20 bp, human
gatgtacgtgtatactgcgg

SEQ ID NO: 51375 - DNA, 20 bp, human
gtcacggcggagttgtacac

SEQ ID NO: 51376 - DNA, 20 bp, human
gggcattggtcacttctccg

SEQ ID NO: 51377 - DNA, 20 bp, human
gagtgaccaatgcctgggag

SEQ ID NO: 51378 - DNA, 20 bp, human
ggcgaaggcgacagctctct

SEQ ID NO: 51379 - DNA, 20 bp, human
gattggtcacttctccgcgg

SEQ ID NO: 51380 - DNA, 20 bp, human
ggcacacaggcgcgcagtca

SEQ ID NO: 51381 - DNA, 20 bp, human
gggcgacagctctcttggcg

SEQ ID NO: 51382 - DNA, 20 bp, human
gcgcccccctgcagaagtcg

SEQ ID NO: 51383 - DNA, 20 bp, human
gccccagtgcgaagaaggac

SEQ ID NO: 51384 - DNA, 20 bp, human
gggaaaagcgaaagtgccgt

SEQ ID NO: 51385 - DNA, 20 bp, human
gtagcacccgagcatgggcg

SEQ ID NO: 51386 - DNA, 20 bp, human
ggcggagtctcccaatgaca

SEQ ID NO: 51387 - DNA, 20 bp, human
gatggccgggggctggacta

SEQ ID NO: 51388 - DNA, 20 bp, human
ggcgcaaagagggctcggaa

SEQ ID NO: 51389 - DNA, 20 bp, human
gctgtccaagagcgagatct

SEQ ID NO: 51390 - DNA, 20 bp, human
gaagagggctcggaaaggtc

SEQ ID NO: 51391 - DNA, 20 bp, human
gcggcggccgcgatggccgg

SEQ ID NO: 51392 - DNA, 20 bp, human
gcagcgaggggacccacaag

SEQ ID NO: 51393 - DNA, 20 bp, human
ggccggcgttccgagaacag

SEQ ID NO: 51394 - DNA, 20 bp, human
ggtccagcccccggccatcg

SEQ ID NO: 51395 - DNA, 20 bp, human
ggcgagatctgggctacgcc

SEQ ID NO: 51396 - DNA, 20 bp, human
gtgaggacaggggaacaaaa

SEQ ID NO: 51397 - DNA, 20 bp, human
gggaatgacagatggcaagt

SEQ ID NO: 51398 - DNA, 20 bp, human
ggcagcagaggaatgaggac

SEQ ID NO: 51399 - DNA, 20 bp, human
gatgaatatacataaaacta

SEQ ID NO: 51400 - DNA, 20 bp, human
ggttttgcagcagaggaatg

SEQ ID NO: 51401 - DNA, 20 bp, human
gaaatggatccagataaaca

SEQ ID NO: 51402 - DNA, 20 bp, human
gtggttcatttctagttaca

SEQ ID NO: 51403 - DNA, 20 bp, human
ggatactcttcagtacatgg

SEQ ID NO: 51404 - DNA, 20 bp, human
gttactcttcttcaaatcag

SEQ ID NO: 51405 - DNA, 20 bp, human
gaaccttctgcttaaaatac

SEQ ID NO: 51406 - DNA, 20 bp, human
gtggatccagcagactactc

SEQ ID NO: 51407 - DNA, 20 bp, human
ggtctgctggatccatggtg

SEQ ID NO: 51408 - DNA, 20 bp, human
gattatgcaaacccacacca

SEQ ID NO: 51409 - DNA, 20 bp, human
gtgctgctccttgggatgat

SEQ ID NO: 51410 - DNA, 20 bp, human
gtgggtttgcataataggag

SEQ ID NO: 51411 - DNA, 20 bp, human
gccccagcatgctgctcctt

SEQ ID NO: 51412 - DNA, 20 bp, human
gatagatctagaaggagact

SEQ ID NO: 51413 - DNA, 20 bp, human
gactttgggagtgtcacttg

SEQ ID NO: 51414 - DNA, 20 bp, human
gctggttcaatagatctaga

SEQ ID NO: 51415 - DNA, 20 bp, human
gtaagggatgagttttactg

SEQ ID NO: 51416 - DNA, 20 bp, human
ggcgtctgtggtaacccggg

SEQ ID NO: 51417 - DNA, 20 bp, human
gggccaccccagcttcctaa

SEQ ID NO: 51418 - DNA, 20 bp, human
gagaggctggcgactgggtt

SEQ ID NO: 51419 - DNA, 20 bp, human
ggccgcgtctgtggtaaccc

SEQ ID NO: 51420 - DNA, 20 bp, human
gccacgttgggagagttgag

SEQ ID NO: 51421 - DNA, 20 bp, human
gggttgttcccgcccatcag

SEQ ID NO: 51422 - DNA, 20 bp, human
gcggtgagaggctggcgact

SEQ ID NO: 51423 - DNA, 20 bp, human
gtctgtggtaacccgggcgg

SEQ ID NO: 51424 - DNA, 20 bp, human
ggcgcggcagagatgcatta

SEQ ID NO: 51425 - DNA, 20 bp, human
ggcacaacaatagctcctac

SEQ ID NO: 51426 - DNA, 20 bp, human
ggccccgacccaagtttgta

SEQ ID NO: 51427 - DNA, 20 bp, human
gcccggctcctctggcaact

SEQ ID NO: 51428 - DNA, 20 bp, human
gagaggccggagggagatcg

SEQ ID NO: 51429 - DNA, 20 bp, human
gactccagctggatctgcag

SEQ ID NO: 51430 - DNA, 20 bp, human
gcgagagacgcgggttccag

SEQ ID NO: 51431 - DNA, 20 bp, human
gggagcagcaaagcggagag

SEQ ID NO: 51432 - DNA, 20 bp, human
gggtcccgcccagttgccag

SEQ ID NO: 51433 - DNA, 20 bp, human
gagtctggaaggccctagag

SEQ ID NO: 51434 - DNA, 20 bp, human
gccggagggagatcgcggag

SEQ ID NO: 51435 - DNA, 20 bp, human
ggccgggacaccgagggaag

SEQ ID NO: 51436 - DNA, 20 bp, human
ggcgggaagacgtctcgagg

SEQ ID NO: 51437 - DNA, 20 bp, human
gtagcttggctgcagtccga

SEQ ID NO: 51438 - DNA, 20 bp, human
gctccagtgccgccaacctg

SEQ ID NO: 51439 - DNA, 20 bp, human
gggaggttaaacattagcgg

SEQ ID NO: 51440 - DNA, 20 bp, human
gggcggtggagcaagtctgg

SEQ ID NO: 51441 - DNA, 20 bp, human
ggagggatcagcgattcggg

SEQ ID NO: 51442 - DNA, 20 bp, human
ggccccgctgcaccccggca

SEQ ID NO: 51443 - DNA, 20 bp, human
gcgggacgtggggcgagtat

SEQ ID NO: 51444 - DNA, 20 bp, human
gtcgggaggttaaacattag

SEQ ID NO: 51445 - DNA, 20 bp, human
gccgccaacctgcgggaccg

SEQ ID NO: 51446 - DNA, 20 bp, human
ggctctgaggagaagaatct

SEQ ID NO: 51447 - DNA, 20 bp, human
gattttgaggcggcctggga

SEQ ID NO: 51448 - DNA, 20 bp, human
gaactggccatccaacatga

SEQ ID NO: 51449 - DNA, 20 bp, human
gtaccatccccgggcagaag

SEQ ID NO: 51450 - DNA, 20 bp, human
ggaagtccctaggcacccta

SEQ ID NO: 51451 - DNA, 20 bp, human
gcaccgagaacggtccccta

SEQ ID NO: 51452 - DNA, 20 bp, human
ggcttcctcgtccttcatgt

SEQ ID NO: 51453 - DNA, 20 bp, human
gctcaccgtgtctagactag

SEQ ID NO: 51454 - DNA, 20 bp, human
gatctcaggccgaaacctcg

SEQ ID NO: 51455 - DNA, 20 bp, human
gcaggccgcctcaaaatcta

SEQ ID NO: 51456 - DNA, 20 bp, human
ggccgctgcctgcaaagtcc

SEQ ID NO: 51457 - DNA, 20 bp, human
gtggcggcaggcctcggcga

SEQ ID NO: 51458 - DNA, 20 bp, human
gcggcccgggtgacaggcgg

SEQ ID NO: 51459 - DNA, 20 bp, human
ggcgtccctggggtccgtac

SEQ ID NO: 51460 - DNA, 20 bp, human
gcgggatcgagccctcgccg

SEQ ID NO: 51461 - DNA, 20 bp, human
gtgactgaggcgcccaggct

SEQ ID NO: 51462 - DNA, 20 bp, human
gcagcaggtcagggtcgcag

SEQ ID NO: 51463 - DNA, 20 bp, human
gcccgccggtacggacccca

SEQ ID NO: 51464 - DNA, 20 bp, human
ggtgccccccgcgcagaccc

SEQ ID NO: 51465 - DNA, 20 bp, human
gccaaacacggcgccctccc

SEQ ID NO: 51466 - DNA, 20 bp, human
ggagcgagccgcaaggaagt

SEQ ID NO: 51467 - DNA, 20 bp, human
ggacgcgatgcgctgggatg

SEQ ID NO: 51468 - DNA, 20 bp, human
gggcgtgccctcaagctcgg

SEQ ID NO: 51469 - DNA, 20 bp, human
ggcgatgcgctgggatgggg

SEQ ID NO: 51470 - DNA, 20 bp, human
ggactgcaccgacttccttg

SEQ ID NO: 51471 - DNA, 20 bp, human
gccgcgggccgtgtgaaagg

SEQ ID NO: 51472 - DNA, 20 bp, human
ggactagagagcgagccgca

SEQ ID NO: 51473 - DNA, 20 bp, human
gccttgcagcatagcgagta

SEQ ID NO: 51474 - DNA, 20 bp, human
gctcgggacgagacagcccc

SEQ ID NO: 51475 - DNA, 20 bp, human
gccgcttggagatcgcccgg

SEQ ID NO: 51476 - DNA, 20 bp, human
ggcggccggcagctgaaaaa

SEQ ID NO: 51477 - DNA, 20 bp, human
ggcagcctccatggacaaaa

SEQ ID NO: 51478 - DNA, 20 bp, human
ggatgcaacggattgcgagg

SEQ ID NO: 51479 - DNA, 20 bp, human
ggctgccggccgcagcaccc

SEQ ID NO: 51480 - DNA, 20 bp, human
gtcgggggcggccgatgcaa

SEQ ID NO: 51481 - DNA, 20 bp, human
ggcggggatggaggcgtcgg

SEQ ID NO: 51482 - DNA, 20 bp, human
ggggcactgctagccagccc

SEQ ID NO: 51483 - DNA, 20 bp, human
ggccgatgcaacggattgcg

SEQ ID NO: 51484 - DNA, 20 bp, human
gtggatgtacgcgcccgggg

SEQ ID NO: 51485 - DNA, 20 bp, human
gcagtacctggtgaccgccg

SEQ ID NO: 51486 - DNA, 20 bp, human
gccctggcctgggacggtcc

SEQ ID NO: 51487 - DNA, 20 bp, human
gggagggccgaacagaccgg

SEQ ID NO: 51488 - DNA, 20 bp, human
gtccggttctaggaacctcg

SEQ ID NO: 51489 - DNA, 20 bp, human
gagggcgccgggaccgtccc

SEQ ID NO: 51490 - DNA, 20 bp, human
gcccggagggccgaacagac

SEQ ID NO: 51491 - DNA, 20 bp, human
gcgggagtgtctgccccagg

SEQ ID NO: 51492 - DNA, 20 bp, human
gggttctaggaacctcgggg

SEQ ID NO: 51493 - DNA, 20 bp, human
gggcgatagaaaaccggagg

SEQ ID NO: 51494 - DNA, 20 bp, human
gtggatgggcgatagaaaac

SEQ ID NO: 51495 - DNA, 20 bp, human
gttctagggggcggatggat

SEQ ID NO: 51496 - DNA, 20 bp, human
ggaccgcagctctgtcccat

SEQ ID NO: 51497 - DNA, 20 bp, human
gcggcggccaggaacggaag

SEQ ID NO: 51498 - DNA, 20 bp, human
gctgggctaaggggagacaa

SEQ ID NO: 51499 - DNA, 20 bp, human
ggcgcctgggaggcactaca

SEQ ID NO: 51500 - DNA, 20 bp, human
ggaggagaagagctgcctat

SEQ ID NO: 51501 - DNA, 20 bp, human
gagctgcagtagcgcctggg

SEQ ID NO: 51502 - DNA, 20 bp, human
ggccatcgagctacagctat

SEQ ID NO: 51503 - DNA, 20 bp, human
gcccagaccacgtctcaggg

SEQ ID NO: 51504 - DNA, 20 bp, human
ggcccccgggcactccaagc

SEQ ID NO: 51505 - DNA, 20 bp, human
gctgagacgtggtctgggaa

SEQ ID NO: 51506 - DNA, 20 bp, human
gtgaggcccacgaccgaggg

SEQ ID NO: 51507 - DNA, 20 bp, human
gcaggcacgagaagagcctg

SEQ ID NO: 51508 - DNA, 20 bp, human
gtgaatgaggcccacgaccg

SEQ ID NO: 51509 - DNA, 20 bp, human
ggggtggaaacgaggagaag

SEQ ID NO: 51510 - DNA, 20 bp, human
gaagcggcccagactcccgt

SEQ ID NO: 51511 - DNA, 20 bp, human
ggcctcattcacgcttcccc

SEQ ID NO: 51512 - DNA, 20 bp, human
ggcccggggaagcgtgaatg

SEQ ID NO: 51513 - DNA, 20 bp, human
gcccctcccccctcggtcgt

SEQ ID NO: 51514 - DNA, 20 bp, human
gggaggcccggcgtgacaag

SEQ ID NO: 51515 - DNA, 20 bp, human
ggcccacgaccgagggggga

SEQ ID NO: 51516 - DNA, 20 bp, human
ggagcagacgacccagacga

SEQ ID NO: 51517 - DNA, 20 bp, human
gacgcagacggaaaaagagg

SEQ ID NO: 51518 - DNA, 20 bp, human
gccgacgcagacggaaaaag

SEQ ID NO: 51519 - DNA, 20 bp, human
gctgctggtaagctccggga

SEQ ID NO: 51520 - DNA, 20 bp, human
gggcgggcatgcgcagaggg

SEQ ID NO: 51521 - DNA, 20 bp, human
ggcagttcgcagcacgtgat

SEQ ID NO: 51522 - DNA, 20 bp, human
gctggacccgacggaggaga

SEQ ID NO: 51523 - DNA, 20 bp, human
gtaagctccgggacgggacg

SEQ ID NO: 51524 - DNA, 20 bp, human
gggcggtggtctcccaaatc

SEQ ID NO: 51525 - DNA, 20 bp, human
gagacgacggccagcggggt

SEQ ID NO: 51526 - DNA, 20 bp, human
ggcagcgccagcgctcagac

SEQ ID NO: 51527 - DNA, 20 bp, human
gctccggcccggcagtagag

SEQ ID NO: 51528 - DNA, 20 bp, human
gttagcggggactacgatcc

SEQ ID NO: 51529 - DNA, 20 bp, human
ggctcggccggtctgagcgc

SEQ ID NO: 51530 - DNA, 20 bp, human
gtgcagctctcactccggcc

SEQ ID NO: 51531 - DNA, 20 bp, human
gccgggtgcagctctcactc

SEQ ID NO: 51532 - DNA, 20 bp, human
gcgggcggcggcatcgggaa

SEQ ID NO: 51533 - DNA, 20 bp, human
gtccccgcgccgagtgccct

SEQ ID NO: 51534 - DNA, 20 bp, human
gcacaacttggagctttcat

SEQ ID NO: 51535 - DNA, 20 bp, human
gcggggactacgatccaggc

SEQ ID NO: 51536 - DNA, 20 bp, human
gagagggagcgtgaccgtcc

SEQ ID NO: 51537 - DNA, 20 bp, human
gcaggccccgcgcagctaag

SEQ ID NO: 51538 - DNA, 20 bp, human
ggacctgtcagtccacctca

SEQ ID NO: 51539 - DNA, 20 bp, human
gaaacccgcgcccggaacca

SEQ ID NO: 51540 - DNA, 20 bp, human
ggagacgccgggaccgggac

SEQ ID NO: 51541 - DNA, 20 bp, human
gggcccgccagtcccggtcc

SEQ ID NO: 51542 - DNA, 20 bp, human
gggagagagacgccgggacc

SEQ ID NO: 51543 - DNA, 20 bp, human
ggcgcggcgcccgggcgaca

SEQ ID NO: 51544 - DNA, 20 bp, human
gaggtcagcgggacgcagag

SEQ ID NO: 51545 - DNA, 20 bp, human
gcgccgtgaggtggactgac

SEQ ID NO: 51546 - DNA, 20 bp, human
ggcgatggcagtgcgggtga

SEQ ID NO: 51547 - DNA, 20 bp, human
gcggcgcgttgcgacatgga

SEQ ID NO: 51548 - DNA, 20 bp, human
gggccaggctcaggcatcgg

SEQ ID NO: 51549 - DNA, 20 bp, human
gcgggtgacggccgctcata

SEQ ID NO: 51550 - DNA, 20 bp, human
gccgcaggagaggcccgtga

SEQ ID NO: 51551 - DNA, 20 bp, human
gtgcgacatggagggcgcga

SEQ ID NO: 51552 - DNA, 20 bp, human
gtgggcttctgccgtatgag

SEQ ID NO: 51553 - DNA, 20 bp, human
gcctgcggcgcgttgcgaca

SEQ ID NO: 51554 - DNA, 20 bp, human
gtgtggacgcacaccagaga

SEQ ID NO: 51555 - DNA, 20 bp, human
gtcccgcccggcttcggcct

SEQ ID NO: 51556 - DNA, 20 bp, human
gcttgcttctggacccgggt

SEQ ID NO: 51557 - DNA, 20 bp, human
ggtgaggtagaagaatagta

SEQ ID NO: 51558 - DNA, 20 bp, human
gagttctctcctctgcgtgg

SEQ ID NO: 51559 - DNA, 20 bp, human
gtgaagggccgagggaagaa

SEQ ID NO: 51560 - DNA, 20 bp, human
gaagacaaggagagccgagc

SEQ ID NO: 51561 - DNA, 20 bp, human
gagcggccgaagggaaccgt

SEQ ID NO: 51562 - DNA, 20 bp, human
gtgcttccgggccaccgctc

SEQ ID NO: 51563 - DNA, 20 bp, human
ggggttccctggaatctgaa

SEQ ID NO: 51564 - DNA, 20 bp, human
ggcaggtgcggggccatgaa

SEQ ID NO: 51565 - DNA, 20 bp, human
gagaacttgcttctggaccc

SEQ ID NO: 51566 - DNA, 20 bp, human
gagatagtgagcgctggtgg

SEQ ID NO: 51567 - DNA, 20 bp, human
gggtggcagatagtgagcgc

SEQ ID NO: 51568 - DNA, 20 bp, human
ggcggagttaaagtcaaagc

SEQ ID NO: 51569 - DNA, 20 bp, human
gatcggagtagagcaaatgt

SEQ ID NO: 51570 - DNA, 20 bp, human
gtgacaggtggatgatgcag

SEQ ID NO: 51571 - DNA, 20 bp, human
gaagtctgtagaggtgactg

SEQ ID NO: 51572 - DNA, 20 bp, human
ggaccatccggggatagagg

SEQ ID NO: 51573 - DNA, 20 bp, human
ggtgtgaaaaaagtctgtag

SEQ ID NO: 51574 - DNA, 20 bp, human
gacagtgtaaggggtactgt

SEQ ID NO: 51575 - DNA, 20 bp, human
gctgtggagacagacgtgac

SEQ ID NO: 51576 - DNA, 20 bp, human
ggctgcaggccaccatgaac

SEQ ID NO: 51577 - DNA, 20 bp, human
ggagcctacgcagaccctag

SEQ ID NO: 51578 - DNA, 20 bp, human
gttagtagcagagtgacgga

SEQ ID NO: 51579 - DNA, 20 bp, human
gcggcaggcgcaacgaatgg

SEQ ID NO: 51580 - DNA, 20 bp, human
gtccggaagccggttcatgg

SEQ ID NO: 51581 - DNA, 20 bp, human
gcaggcggaagtggcgtcag

SEQ ID NO: 51582 - DNA, 20 bp, human
gaattgcttgtggacggtgt

SEQ ID NO: 51583 - DNA, 20 bp, human
ggagccgctagggtctgcgt

SEQ ID NO: 51584 - DNA, 20 bp, human
gacaggctcccgagccgcta

SEQ ID NO: 51585 - DNA, 20 bp, human
ggctactaaggtgtagagac

SEQ ID NO: 51586 - DNA, 20 bp, human
gcagcgcgagaggccttcgg

SEQ ID NO: 51587 - DNA, 20 bp, human
gctcgcgccgtcctacgggg

SEQ ID NO: 51588 - DNA, 20 bp, human
ggctattccatcccacatgg

SEQ ID NO: 51589 - DNA, 20 bp, human
gccacatggcggcgctcctg

SEQ ID NO: 51590 - DNA, 20 bp, human
gggagcgccgccatgtggga

SEQ ID NO: 51591 - DNA, 20 bp, human
gctctggccgccccgtagga

SEQ ID NO: 51592 - DNA, 20 bp, human
ggacggcgcgaggccaacct

SEQ ID NO: 51593 - DNA, 20 bp, human
ggggatggaatagcacacgt

SEQ ID NO: 51594 - DNA, 20 bp, human
gctgcagcgcgagaggcctt

SEQ ID NO: 51595 - DNA, 20 bp, human
gttggcctcgcgccgtccta

SEQ ID NO: 51596 - DNA, 20 bp, human
ggcgagctcgaggaagagac

SEQ ID NO: 51597 - DNA, 20 bp, human
gcgggtcagggtgacctctg

SEQ ID NO: 51598 - DNA, 20 bp, human
gcgctcacgcgtgggagact

SEQ ID NO: 51599 - DNA, 20 bp, human
gggccatggcagctgcgcag

SEQ ID NO: 51600 - DNA, 20 bp, human
ggaggcaacgcaggctgcta

SEQ ID NO: 51601 - DNA, 20 bp, human
ggggtgaggaaactgcgact

SEQ ID NO: 51602 - DNA, 20 bp, human
gcaagtatgtgacaccactg

SEQ ID NO: 51603 - DNA, 20 bp, human
ggtatgtgacaccactgggg

SEQ ID NO: 51604 - DNA, 20 bp, human
gaccactggggcggttccga

SEQ ID NO: 51605 - DNA, 20 bp, human
gtacaaggcctgtagacgga

SEQ ID NO: 51606 - DNA, 20 bp, human
gaggaaagcatccaacggag

SEQ ID NO: 51607 - DNA, 20 bp, human
gaacacggcggcgcagaggt

SEQ ID NO: 51608 - DNA, 20 bp, human
gctccggccgcaggcgacga

SEQ ID NO: 51609 - DNA, 20 bp, human
ggaaagtgctggcaaagcgt

SEQ ID NO: 51610 - DNA, 20 bp, human
gaatgatcacaggccggtgg

SEQ ID NO: 51611 - DNA, 20 bp, human
gtcctgcttcttcaagtgaa

SEQ ID NO: 51612 - DNA, 20 bp, human
gctggagtttccttttgtag

SEQ ID NO: 51613 - DNA, 20 bp, human
gcatgctgcttccactccgt

SEQ ID NO: 51614 - DNA, 20 bp, human
gtgcgctccgctctccgccg

SEQ ID NO: 51615 - DNA, 20 bp, human
gcagacagctccaggtcctc

SEQ ID NO: 51616 - DNA, 20 bp, human
ggcgcgcgggccccatgaat

SEQ ID NO: 51617 - DNA, 20 bp, human
ggggaagacctggagccgag

SEQ ID NO: 51618 - DNA, 20 bp, human
gcgccagtgaagcaaaggac

SEQ ID NO: 51619 - DNA, 20 bp, human
gccgcgcagaggtaacgaca

SEQ ID NO: 51620 - DNA, 20 bp, human
ggcggtggctgcgagcgcca

SEQ ID NO: 51621 - DNA, 20 bp, human
ggccgtagtaacccattcat

SEQ ID NO: 51622 - DNA, 20 bp, human
ggaaggatgcgagcgaccta

SEQ ID NO: 51623 - DNA, 20 bp, human
gccccatgaatgggttacta

SEQ ID NO: 51624 - DNA, 20 bp, human
gcacctcgccagtgaagcaa

SEQ ID NO: 51625 - DNA, 20 bp, human
gggatgcgagcgacctaggg

SEQ ID NO: 51626 - DNA, 20 bp, human
gtccattcctcggggagaga

SEQ ID NO: 51627 - DNA, 20 bp, human
gagtgctgcggcgcagtccc

SEQ ID NO: 51628 - DNA, 20 bp, human
gcaggcgcgacatacaccag

SEQ ID NO: 51629 - DNA, 20 bp, human
gcctggagcggcgcgcgcag

SEQ ID NO: 51630 - DNA, 20 bp, human
gggaccgcaggcgccgagca

SEQ ID NO: 51631 - DNA, 20 bp, human
gaacggggcagtgagtgctg

SEQ ID NO: 51632 - DNA, 20 bp, human
gccgcggctgcaggacactg

SEQ ID NO: 51633 - DNA, 20 bp, human
gcaggcgccgagcagggcga

SEQ ID NO: 51634 - DNA, 20 bp, human
gcgggacgggctgaagccgg

SEQ ID NO: 51635 - DNA, 20 bp, human
gggaaagggtccattcctcg

SEQ ID NO: 51636 - DNA, 20 bp, human
gcgcctgcgctccctccctt

SEQ ID NO: 51637 - DNA, 20 bp, human
gggagcggtagccgaaggga

SEQ ID NO: 51638 - DNA, 20 bp, human
gcgggggagcggtagccgaa

SEQ ID NO: 51639 - DNA, 20 bp, human
ggcgctgattaccatccggg

SEQ ID NO: 51640 - DNA, 20 bp, human
gggagctgcctcgggcaagg

SEQ ID NO: 51641 - DNA, 20 bp, human
gcggggcgctgattaccatc

SEQ ID NO: 51642 - DNA, 20 bp, human
gccggccctgccgtagcccc

SEQ ID NO: 51643 - DNA, 20 bp, human
gctgattaccatccgggagg

SEQ ID NO: 51644 - DNA, 20 bp, human
gctccaggtgctgccgcccg

SEQ ID NO: 51645 - DNA, 20 bp, human
gttgcccgaggcagctcccg

SEQ ID NO: 51646 - DNA, 20 bp, human
gcagctggcccagaggacaa

SEQ ID NO: 51647 - DNA, 20 bp, human
ggagtgggtgggaacgtcgt

SEQ ID NO: 51648 - DNA, 20 bp, human
gaggagaagctgcggggtca

SEQ ID NO: 51649 - DNA, 20 bp, human
gacgtcgtgggagacttgag

SEQ ID NO: 51650 - DNA, 20 bp, human
gtcctcccgtgcccaatggt

SEQ ID NO: 51651 - DNA, 20 bp, human
gagctgcggggtcatggctg

SEQ ID NO: 51652 - DNA, 20 bp, human
ggtgggagacttgagagggg

SEQ ID NO: 51653 - DNA, 20 bp, human
gcgtgcccaatggtgggatg

SEQ ID NO: 51654 - DNA, 20 bp, human
gtcccaccattgggcacggg

SEQ ID NO: 51655 - DNA, 20 bp, human
gggtaaccccatcccaccat

SEQ ID NO: 51656 - DNA, 20 bp, human
gttcttgggcgggacattgt

SEQ ID NO: 51657 - DNA, 20 bp, human
gggtctgtgggttgtttctt

SEQ ID NO: 51658 - DNA, 20 bp, human
gagcccacaagacagtacaa

SEQ ID NO: 51659 - DNA, 20 bp, human
gcacaagacagtacaaagga

SEQ ID NO: 51660 - DNA, 20 bp, human
gacaaggcactactcagtgt

SEQ ID NO: 51661 - DNA, 20 bp, human
gtggagccccaacctggtat

SEQ ID NO: 51662 - DNA, 20 bp, human
gtactaagcttggggttaca

SEQ ID NO: 51663 - DNA, 20 bp, human
gctgtgggttgtttcttggg

SEQ ID NO: 51664 - DNA, 20 bp, human
gatgcattggagccccaacc

SEQ ID NO: 51665 - DNA, 20 bp, human
ggtgattgggaatgagaaca

SEQ ID NO: 51666 - DNA, 20 bp, human
gagtcatagcgactaataat

SEQ ID NO: 51667 - DNA, 20 bp, human
gctgtcaagaaatatagtat

SEQ ID NO: 51668 - DNA, 20 bp, human
gcattggtttaaggttaatc

SEQ ID NO: 51669 - DNA, 20 bp, human
gtaattttgttaagaatcat

SEQ ID NO: 51670 - DNA, 20 bp, human
ggcaacataactatattctt

SEQ ID NO: 51671 - DNA, 20 bp, human
gttctaaaaacaaattgact

SEQ ID NO: 51672 - DNA, 20 bp, human
ggctgagaaccattggttta

SEQ ID NO: 51673 - DNA, 20 bp, human
gtctcacagtctttttgttt

SEQ ID NO: 51674 - DNA, 20 bp, human
gtgttttgctcatgaacgtg

SEQ ID NO: 51675 - DNA, 20 bp, human
gtcatgaacgtgaggtattt

SEQ ID NO: 51676 - DNA, 20 bp, human
gactccgaatccgagagcgg

SEQ ID NO: 51677 - DNA, 20 bp, human
ggggtatcccgagacccaag

SEQ ID NO: 51678 - DNA, 20 bp, human
gtcggtggcacgtggagcca

SEQ ID NO: 51679 - DNA, 20 bp, human
gagccacggcgtgggagtag

SEQ ID NO: 51680 - DNA, 20 bp, human
gtgaacgacgtggtgagcgt

SEQ ID NO: 51681 - DNA, 20 bp, human
gtgctggcgctggagcgatt

SEQ ID NO: 51682 - DNA, 20 bp, human
gagcgtgggcacagggtcgg

SEQ ID NO: 51683 - DNA, 20 bp, human
ggcacgtggagccacggcgt

SEQ ID NO: 51684 - DNA, 20 bp, human
gaagaaggccgtgaacgacg

SEQ ID NO: 51685 - DNA, 20 bp, human
gcaatcacggtcactcccag

SEQ ID NO: 51686 - DNA, 20 bp, human
gtaggtgctgaggccagtat

SEQ ID NO: 51687 - DNA, 20 bp, human
gctgatggctgcgtgtgtat

SEQ ID NO: 51688 - DNA, 20 bp, human
gtcaatggaagaagaatagg

SEQ ID NO: 51689 - DNA, 20 bp, human
ggaggccagtatgggtgcaa

SEQ ID NO: 51690 - DNA, 20 bp, human
ggggtgcaaggggcccgcgt

SEQ ID NO: 51691 - DNA, 20 bp, human
gtggctgcgtgtgtataggc

SEQ ID NO: 51692 - DNA, 20 bp, human
ggtcgccgccaagtccccaa

SEQ ID NO: 51693 - DNA, 20 bp, human
ggggccccttgcacccatac

SEQ ID NO: 51694 - DNA, 20 bp, human
gtggcctcagcacctaagac

SEQ ID NO: 51695 - DNA, 20 bp, human
gcagccagtatatgccaggt

SEQ ID NO: 51696 - DNA, 20 bp, human
gcactcaccaaggcgcgcga

SEQ ID NO: 51697 - DNA, 20 bp, human
gaggggatgagcccgaacta

SEQ ID NO: 51698 - DNA, 20 bp, human
gccaaggcgcgcgacggcag

SEQ ID NO: 51699 - DNA, 20 bp, human
gacccagcctaaagagagcc

SEQ ID NO: 51700 - DNA, 20 bp, human
gttccaaacgctggcaccga

SEQ ID NO: 51701 - DNA, 20 bp, human
gtgtcctctggacaaccgtg

SEQ ID NO: 51702 - DNA, 20 bp, human
gtcctgaaaactgcaactgg

SEQ ID NO: 51703 - DNA, 20 bp, human
ggaatcagaactacaaccct

SEQ ID NO: 51704 - DNA, 20 bp, human
gctaccgcacggttgtccag

SEQ ID NO: 51705 - DNA, 20 bp, human
gctggctccgggctctcttt

SEQ ID NO: 51706 - DNA, 20 bp, human
ggacctgggaatcagaactc

SEQ ID NO: 51707 - DNA, 20 bp, human
ggcgctctgttcacagacct

SEQ ID NO: 51708 - DNA, 20 bp, human
gagcagggagagaaacgacg

SEQ ID NO: 51709 - DNA, 20 bp, human
gtggaggaatcggcagcaca

SEQ ID NO: 51710 - DNA, 20 bp, human
gcgtcggaagcctgaagcat

SEQ ID NO: 51711 - DNA, 20 bp, human
gtgaagcatgggcgctgagt

SEQ ID NO: 51712 - DNA, 20 bp, human
gtaaagtttggtggaggaat

SEQ ID NO: 51713 - DNA, 20 bp, human
gttcaggcttccgacgccaa

SEQ ID NO: 51714 - DNA, 20 bp, human
gggtcctgggccgttggcgt

SEQ ID NO: 51715 - DNA, 20 bp, human
gaggaagtctgttagctgag

SEQ ID NO: 51716 - DNA, 20 bp, human
gctctgtcccgacgcctgac

SEQ ID NO: 51717 - DNA, 20 bp, human
gggccgccgaagcctggatc

SEQ ID NO: 51718 - DNA, 20 bp, human
gctggcttcaggttccggtc

SEQ ID NO: 51719 - DNA, 20 bp, human
ggctgatcgagagctgccac

SEQ ID NO: 51720 - DNA, 20 bp, human
ggcaggagggagcctagact

SEQ ID NO: 51721 - DNA, 20 bp, human
gtcagctctcgcagtcggag

SEQ ID NO: 51722 - DNA, 20 bp, human
gtcaggttccggtcaggcgt

SEQ ID NO: 51723 - DNA, 20 bp, human
gtctgtccctctgggttgaa

SEQ ID NO: 51724 - DNA, 20 bp, human
gcggagaggcggctaaggaa

SEQ ID NO: 51725 - DNA, 20 bp, human
gtccaggcttcggcggccgg

SEQ ID NO: 51726 - DNA, 20 bp, human
gagcttggcttggagaccca

SEQ ID NO: 51727 - DNA, 20 bp, human
gtgagcgcgccgcctgggcc

SEQ ID NO: 51728 - DNA, 20 bp, human
gccgagccgtccgagcagct

SEQ ID NO: 51729 - DNA, 20 bp, human
gggtcccagccggatgtggg

SEQ ID NO: 51730 - DNA, 20 bp, human
gccaagccaagctgagtcca

SEQ ID NO: 51731 - DNA, 20 bp, human
gtagctcgcgtgctccgccc

SEQ ID NO: 51732 - DNA, 20 bp, human
gagggcagccgggctgggtc

SEQ ID NO: 51733 - DNA, 20 bp, human
gctgcgcttggtcccgtcgg

SEQ ID NO: 51734 - DNA, 20 bp, human
gacgccttccgagagccggg

SEQ ID NO: 51735 - DNA, 20 bp, human
ggctgggtcgggctcgcggg

SEQ ID NO: 51736 - DNA, 20 bp, human
gtccgctccggtaactccgg

SEQ ID NO: 51737 - DNA, 20 bp, human
gtgagagcatggcctctcca

SEQ ID NO: 51738 - DNA, 20 bp, human
gcgcagctccggctctagga

SEQ ID NO: 51739 - DNA, 20 bp, human
gagggcgcctccggagttac

SEQ ID NO: 51740 - DNA, 20 bp, human
gccctgtccggaccctcggg

SEQ ID NO: 51741 - DNA, 20 bp, human
gggccatgctctcaaccgcc

SEQ ID NO: 51742 - DNA, 20 bp, human
gggtacccgcagttccgctc

SEQ ID NO: 51743 - DNA, 20 bp, human
gagttaccggagcggaactg

SEQ ID NO: 51744 - DNA, 20 bp, human
gtcctccaagagggatagac

SEQ ID NO: 51745 - DNA, 20 bp, human
gacgcaggcgtcctccaaga

SEQ ID NO: 51746 - DNA, 20 bp, human
gcgctgcgcgcagcgccacc

SEQ ID NO: 51747 - DNA, 20 bp, human
ggcgccaccggggcccggtc

SEQ ID NO: 51748 - DNA, 20 bp, human
gtcagggccgtccagtgggt

SEQ ID NO: 51749 - DNA, 20 bp, human
gtccatcagggccgtccagt

SEQ ID NO: 51750 - DNA, 20 bp, human
ggcctcagcggcagggactc

SEQ ID NO: 51751 - DNA, 20 bp, human
gcggcggtgaccgagcgggt

SEQ ID NO: 51752 - DNA, 20 bp, human
ggagccggcggtgaccgagc

SEQ ID NO: 51753 - DNA, 20 bp, human
ggggggagggaacccgtctc

SEQ ID NO: 51754 - DNA, 20 bp, human
gcgccaacgccccagggtgg

SEQ ID NO: 51755 - DNA, 20 bp, human
gcgcccgctcggctgcgctg

SEQ ID NO: 51756 - DNA, 20 bp, human
ggtccgaacgcagtagacga

SEQ ID NO: 51757 - DNA, 20 bp, human
gcgaacgcagtagacgaagg

SEQ ID NO: 51758 - DNA, 20 bp, human
gacgcagtagacgaaggcgg

SEQ ID NO: 51759 - DNA, 20 bp, human
ggcgatggcggcggggatag

SEQ ID NO: 51760 - DNA, 20 bp, human
gacgccgggtcagtaggtcg

SEQ ID NO: 51761 - DNA, 20 bp, human
ggctcaaccggcccaacaag

SEQ ID NO: 51762 - DNA, 20 bp, human
gtgactcacgccgggtcagt

SEQ ID NO: 51763 - DNA, 20 bp, human
gactccgcgacctactgacc

SEQ ID NO: 51764 - DNA, 20 bp, human
gtggtctggggcttcaccga

SEQ ID NO: 51765 - DNA, 20 bp, human
gggagtaacgtgcccgttag

SEQ ID NO: 51766 - DNA, 20 bp, human
gagcaactcctttctggtag

SEQ ID NO: 51767 - DNA, 20 bp, human
gtaggttgaaggtgctgtta

SEQ ID NO: 51768 - DNA, 20 bp, human
gcgacggtaagtggtcgtaa

SEQ ID NO: 51769 - DNA, 20 bp, human
gagcggtacagtccattcca

SEQ ID NO: 51770 - DNA, 20 bp, human
gtgcgccggccggggaaaga

SEQ ID NO: 51771 - DNA, 20 bp, human
gcgaggccctgtgctaagtt

SEQ ID NO: 51772 - DNA, 20 bp, human
gttaccgtcgcaggccacgg

SEQ ID NO: 51773 - DNA, 20 bp, human
gtcaccaccgtggcctgcga

SEQ ID NO: 51774 - DNA, 20 bp, human
gggtaagtggtcgtaagggt

SEQ ID NO: 51775 - DNA, 20 bp, human
gaacggaaaagcgtgtgtag

SEQ ID NO: 51776 - DNA, 20 bp, human
gctctcagcgggagccgaga

SEQ ID NO: 51777 - DNA, 20 bp, human
gcacagtcggaagaccccaa

SEQ ID NO: 51778 - DNA, 20 bp, human
gctagagtctggagccacta

SEQ ID NO: 51779 - DNA, 20 bp, human
gcgggagccgagacggtgca

SEQ ID NO: 51780 - DNA, 20 bp, human
gctccggccctgcaccgtct

SEQ ID NO: 51781 - DNA, 20 bp, human
gcacagaacgcgcagcatcg

SEQ ID NO: 51782 - DNA, 20 bp, human
gaagagaccgaggttgccag

SEQ ID NO: 51783 - DNA, 20 bp, human
gagggcctttgaagagaccg

SEQ ID NO: 51784 - DNA, 20 bp, human
gaaaccgctccaggcctgag

SEQ ID NO: 51785 - DNA, 20 bp, human
ggagcggggtccgcacgggt

SEQ ID NO: 51786 - DNA, 20 bp, human
gacggtggccgagacccgga

SEQ ID NO: 51787 - DNA, 20 bp, human
gactcgacggaactcgacgg

SEQ ID NO: 51788 - DNA, 20 bp, human
gggaactcgacggaactcga

SEQ ID NO: 51789 - DNA, 20 bp, human
gcgcgaagcctgggcctgtc

SEQ ID NO: 51790 - DNA, 20 bp, human
ggggccgggacggaactcga

SEQ ID NO: 51791 - DNA, 20 bp, human
gctgtcaggcggttccgtcc

SEQ ID NO: 51792 - DNA, 20 bp, human
ggtcctccccgggtcaatgg

SEQ ID NO: 51793 - DNA, 20 bp, human
gcggcgccctgaccccgact

SEQ ID NO: 51794 - DNA, 20 bp, human
gggccgcgccggagacacat

SEQ ID NO: 51795 - DNA, 20 bp, human
gacgcgcaggtgggattgta

SEQ ID NO: 51796 - DNA, 20 bp, human
gcaggacagcaggacacgca

SEQ ID NO: 51797 - DNA, 20 bp, human
gaggcgggacagcgaaccgg

SEQ ID NO: 51798 - DNA, 20 bp, human
ggacagcaggacacgcaggg

SEQ ID NO: 51799 - DNA, 20 bp, human
ggcgggatcggacggaagag

SEQ ID NO: 51800 - DNA, 20 bp, human
gctggggatgcgggatcgga

SEQ ID NO: 51801 - DNA, 20 bp, human
ggccaggcgggacagcgaac

SEQ ID NO: 51802 - DNA, 20 bp, human
gagcgaaccgggggcctcag

SEQ ID NO: 51803 - DNA, 20 bp, human
gtcaggcggaagaggggtgt

SEQ ID NO: 51804 - DNA, 20 bp, human
gctgcgtccgcggcccgctg

SEQ ID NO: 51805 - DNA, 20 bp, human
gtgaaaggctataggcgagg

SEQ ID NO: 51806 - DNA, 20 bp, human
gcgaacgaacccaggtagag

SEQ ID NO: 51807 - DNA, 20 bp, human
ggaaccttgccgctctacct

SEQ ID NO: 51808 - DNA, 20 bp, human
gcgggtgcgaaacccggggt

SEQ ID NO: 51809 - DNA, 20 bp, human
ggtggcttctgtgcgagtcc

SEQ ID NO: 51810 - DNA, 20 bp, human
ggaacccaggtagagcggca

SEQ ID NO: 51811 - DNA, 20 bp, human
gccgcgcgttgcggtcaaga

SEQ ID NO: 51812 - DNA, 20 bp, human
gacgcgcgggataaaggtcg

SEQ ID NO: 51813 - DNA, 20 bp, human
gcgcgcgggtgcgaaacccg

SEQ ID NO: 51814 - DNA, 20 bp, human
gggtcccgccccgttcccag

SEQ ID NO: 51815 - DNA, 20 bp, human
gaccgcaacgcgcgggataa

SEQ ID NO: 51816 - DNA, 20 bp, human
gcctagagccgcccaaggga

SEQ ID NO: 51817 - DNA, 20 bp, human
gcagccctagagccgcccaa

SEQ ID NO: 51818 - DNA, 20 bp, human
ggggatggcgatggcgtact

SEQ ID NO: 51819 - DNA, 20 bp, human
gtacgccatcgccatccctt

SEQ ID NO: 51820 - DNA, 20 bp, human
gcgggactccaagcttacct

SEQ ID NO: 51821 - DNA, 20 bp, human
gcttggcttggagactggcg

SEQ ID NO: 51822 - DNA, 20 bp, human
ggccgcccaagggatggcga

SEQ ID NO: 51823 - DNA, 20 bp, human
gggctgggaagtgcaggccc

SEQ ID NO: 51824 - DNA, 20 bp, human
gaagtccacacgagtgataa

SEQ ID NO: 51825 - DNA, 20 bp, human
gcgggcgaccatgggccgaa

SEQ ID NO: 51826 - DNA, 20 bp, human
gctgaccactggacactcag

SEQ ID NO: 51827 - DNA, 20 bp, human
gctcagaggtgggtcctctc

SEQ ID NO: 51828 - DNA, 20 bp, human
gccggccactgaagcttgtc

SEQ ID NO: 51829 - DNA, 20 bp, human
gaccactggacactcagagg

SEQ ID NO: 51830 - DNA, 20 bp, human
gtcctggggcaactgaccac

SEQ ID NO: 51831 - DNA, 20 bp, human
gcccaactcacctccctcag

SEQ ID NO: 51832 - DNA, 20 bp, human
gtcctgctgatgaggatgta

SEQ ID NO: 51833 - DNA, 20 bp, human
ggcttgtctggtggctgtta

SEQ ID NO: 51834 - DNA, 20 bp, human
gggctgtggtccccatcctg

SEQ ID NO: 51835 - DNA, 20 bp, human
ggggtcctctcaggcaagtc

SEQ ID NO: 51836 - DNA, 20 bp, human
gctggagatctaaactaagt

SEQ ID NO: 51837 - DNA, 20 bp, human
gtacaaggtctgaaatactt

SEQ ID NO: 51838 - DNA, 20 bp, human
gaaactaagtaggctttgct

SEQ ID NO: 51839 - DNA, 20 bp, human
gtaagtttctacttagcatg

SEQ ID NO: 51840 - DNA, 20 bp, human
gatttaatactaagtataca

SEQ ID NO: 51841 - DNA, 20 bp, human
ggtggaatggttttaatatt

SEQ ID NO: 51842 - DNA, 20 bp, human
gttctacttagcatgtggaa

SEQ ID NO: 51843 - DNA, 20 bp, human
gaaagtttacttaagataac

SEQ ID NO: 51844 - DNA, 20 bp, human
ggttcaatagaagtataaat

SEQ ID NO: 51845 - DNA, 20 bp, human
gaatttaaaacttttttacc

SEQ ID NO: 51846 - DNA, 20 bp, human
ggtggaggctctgtccatag

SEQ ID NO: 51847 - DNA, 20 bp, human
gccacatacccagctgacat

SEQ ID NO: 51848 - DNA, 20 bp, human
gtgcggtgcccatgtcagct

SEQ ID NO: 51849 - DNA, 20 bp, human
ggccctgccccaagatcaga

SEQ ID NO: 51850 - DNA, 20 bp, human
gagctgggtatgtggcgggc

SEQ ID NO: 51851 - DNA, 20 bp, human
gggagctgggctccccataa

SEQ ID NO: 51852 - DNA, 20 bp, human
gagctgtgctgggtgatcct

SEQ ID NO: 51853 - DNA, 20 bp, human
gggcctcctgaattgtggga

SEQ ID NO: 51854 - DNA, 20 bp, human
gcaggcccaaagctccttct

SEQ ID NO: 51855 - DNA, 20 bp, human
gagcctgagcacatcctaga

SEQ ID NO: 51856 - DNA, 20 bp, human
ggctggccgcgtgagtaggt

SEQ ID NO: 51857 - DNA, 20 bp, human
gggctgccctctcgcgctgc

SEQ ID NO: 51858 - DNA, 20 bp, human
ggacgctctctgggccaata

SEQ ID NO: 51859 - DNA, 20 bp, human
ggtacgtacaccatacctcg

SEQ ID NO: 51860 - DNA, 20 bp, human
gcgcgacctacctactcacg

SEQ ID NO: 51861 - DNA, 20 bp, human
gctactcacgcggccagccg

SEQ ID NO: 51862 - DNA, 20 bp, human
ggaggcggctggcacaagac

SEQ ID NO: 51863 - DNA, 20 bp, human
gcccagcaacaagacagagc

SEQ ID NO: 51864 - DNA, 20 bp, human
gccagagagcgtccgggtca

SEQ ID NO: 51865 - DNA, 20 bp, human
gaggtaggtcgcgcgcgggt

SEQ ID NO: 51866 - DNA, 20 bp, human
gcgagcggctccagagccaa

SEQ ID NO: 51867 - DNA, 20 bp, human
gggccgccggcgaggaatgg

SEQ ID NO: 51868 - DNA, 20 bp, human
gaaagcccggctaaatccag

SEQ ID NO: 51869 - DNA, 20 bp, human
gtgaagaggtggaactccta

SEQ ID NO: 51870 - DNA, 20 bp, human
gtaccgccattcctcgccgg

SEQ ID NO: 51871 - DNA, 20 bp, human
gcggaattcgcggtcactag

SEQ ID NO: 51872 - DNA, 20 bp, human
gggtgcggcgagggagttcc

SEQ ID NO: 51873 - DNA, 20 bp, human
gccccaaaggctgcaagtgc

SEQ ID NO: 51874 - DNA, 20 bp, human
gaagagtgtgggtgaaggga

SEQ ID NO: 51875 - DNA, 20 bp, human
gccgggccctgacgcggagt

SEQ ID NO: 51876 - DNA, 20 bp, human
gatgaggcccggtacagtgg

SEQ ID NO: 51877 - DNA, 20 bp, human
ggaccccataggaggaaaga

SEQ ID NO: 51878 - DNA, 20 bp, human
gccggagctgcggcccgagt

SEQ ID NO: 51879 - DNA, 20 bp, human
gttcactgcgcggttccaag

SEQ ID NO: 51880 - DNA, 20 bp, human
gccacccctctccggagctg

SEQ ID NO: 51881 - DNA, 20 bp, human
ggccccaagaaaaagactag

SEQ ID NO: 51882 - DNA, 20 bp, human
gaaatcgagtgcgccaactc

SEQ ID NO: 51883 - DNA, 20 bp, human
gctccagggtcgcggaggga

SEQ ID NO: 51884 - DNA, 20 bp, human
gtatggggtccaaaaatgta

SEQ ID NO: 51885 - DNA, 20 bp, human
gcctcatagccacttcctag

SEQ ID NO: 51886 - DNA, 20 bp, human
gcgacagtggctgggcggga

SEQ ID NO: 51887 - DNA, 20 bp, human
gcggagtagagctgcacatg

SEQ ID NO: 51888 - DNA, 20 bp, human
ggaggccatgggctacccgg

SEQ ID NO: 51889 - DNA, 20 bp, human
gaggctgcttagggtgccag

SEQ ID NO: 51890 - DNA, 20 bp, human
gacccgttcctgcgcgacag

SEQ ID NO: 51891 - DNA, 20 bp, human
ggacagtagccgcctgtcag

SEQ ID NO: 51892 - DNA, 20 bp, human
ggtcagggtcgaggccaccg

SEQ ID NO: 51893 - DNA, 20 bp, human
gagccactgtcgcgcaggaa

SEQ ID NO: 51894 - DNA, 20 bp, human
gcgggcacccctggcacctc

SEQ ID NO: 51895 - DNA, 20 bp, human
ggcggctactgtcctgccat

SEQ ID NO: 51896 - DNA, 20 bp, human
gtcccacactcacccggtaa

SEQ ID NO: 51897 - DNA, 20 bp, human
gtccgttaccgggtgagtgt

SEQ ID NO: 51898 - DNA, 20 bp, human
gccggtaacggacgagtaga

SEQ ID NO: 51899 - DNA, 20 bp, human
gcgctgaggtggatttgtac

SEQ ID NO: 51900 - DNA, 20 bp, human
gggaggctgggtgttagtga

SEQ ID NO: 51901 - DNA, 20 bp, human
gagatgtgtgctctgcgctg

SEQ ID NO: 51902 - DNA, 20 bp, human
gttagtgaaggcggggacag

SEQ ID NO: 51903 - DNA, 20 bp, human
ggtggcttgagggcaagtca

SEQ ID NO: 51904 - DNA, 20 bp, human
gatggctcttgctcccaaat

SEQ ID NO: 51905 - DNA, 20 bp, human
gggacagtggatcagacttg

SEQ ID NO: 51906 - DNA, 20 bp, human
gcggtcaaggaagagttccc

SEQ ID NO: 51907 - DNA, 20 bp, human
ggccgagacggaggtgtcat

SEQ ID NO: 51908 - DNA, 20 bp, human
ggtttccaaacttgcagaca

SEQ ID NO: 51909 - DNA, 20 bp, human
ggaagcaacgggttcctcca

SEQ ID NO: 51910 - DNA, 20 bp, human
gtcccgggaagccctttaaa

SEQ ID NO: 51911 - DNA, 20 bp, human
gcctgtcacccagaactgga

SEQ ID NO: 51912 - DNA, 20 bp, human
gggaagccctttaaacggaa

SEQ ID NO: 51913 - DNA, 20 bp, human
ggcttcacaggtggccaccg

SEQ ID NO: 51914 - DNA, 20 bp, human
gagcggggctagtgtcagag

SEQ ID NO: 51915 - DNA, 20 bp, human
ggcaatgagggaaagcccct

SEQ ID NO: 51916 - DNA, 20 bp, human
gcccatggcgatgttgagtt

SEQ ID NO: 51917 - DNA, 20 bp, human
gtacttaagtgagaacacgt

SEQ ID NO: 51918 - DNA, 20 bp, human
gggtcaccaagagggtatgt

SEQ ID NO: 51919 - DNA, 20 bp, human
gaattctctggagtttgcca

SEQ ID NO: 51920 - DNA, 20 bp, human
gcaatctgttgcttcttcca

SEQ ID NO: 51921 - DNA, 20 bp, human
gtccatcataagcctattat

SEQ ID NO: 51922 - DNA, 20 bp, human
gaagatgctcgctggttgtc

SEQ ID NO: 51923 - DNA, 20 bp, human
gtcataagcctattatagga

SEQ ID NO: 51924 - DNA, 20 bp, human
gtcaggacgactaaacagat

SEQ ID NO: 51925 - DNA, 20 bp, human
gcctgtcgccttcctataat

SEQ ID NO: 51926 - DNA, 20 bp, human
gctcgtggaagaagcgaagg

SEQ ID NO: 51927 - DNA, 20 bp, human
ggagctcgtggaagaagcga

SEQ ID NO: 51928 - DNA, 20 bp, human
gacgcgcctggagcaaaccg

SEQ ID NO: 51929 - DNA, 20 bp, human
gctgcgcgcagagggtcgtc

SEQ ID NO: 51930 - DNA, 20 bp, human
gaaagcaggaagtgagctcg

SEQ ID NO: 51931 - DNA, 20 bp, human
ggccagacccggagtcgcac

SEQ ID NO: 51932 - DNA, 20 bp, human
gccgacccaggcgccagacc

SEQ ID NO: 51933 - DNA, 20 bp, human
gcccagtccagccccgcgag

SEQ ID NO: 51934 - DNA, 20 bp, human
gtcgtccggtgaagccatgg

SEQ ID NO: 51935 - DNA, 20 bp, human
gccccgtgcgactccgggtc

SEQ ID NO: 51936 - DNA, 20 bp, human
ggtggtggcgtggagacgtg

SEQ ID NO: 51937 - DNA, 20 bp, human
ggtggtgaaggccgatgctg

SEQ ID NO: 51938 - DNA, 20 bp, human
ggtgaaggccgatgctgtgg

SEQ ID NO: 51939 - DNA, 20 bp, human
gactgcagcagccaccaaca

SEQ ID NO: 51940 - DNA, 20 bp, human
gcaccaacaaggctggacta

SEQ ID NO: 51941 - DNA, 20 bp, human
gacgcccacccccacagcat

SEQ ID NO: 51942 - DNA, 20 bp, human
ggccggaagtgacctcacgg

SEQ ID NO: 51943 - DNA, 20 bp, human
ggcctcgtagacctttatag

SEQ ID NO: 51944 - DNA, 20 bp, human
gcggaggtgggagcgaaggg

SEQ ID NO: 51945 - DNA, 20 bp, human
gcgtggagagaattcttctg

SEQ ID NO: 51946 - DNA, 20 bp, human
gacagcctgaggacaagata

SEQ ID NO: 51947 - DNA, 20 bp, human
gaccgagacgctgaaggaca

SEQ ID NO: 51948 - DNA, 20 bp, human
gtcctcccggcgggtaaggg

SEQ ID NO: 51949 - DNA, 20 bp, human
gggggtctgcgcccttcgag

SEQ ID NO: 51950 - DNA, 20 bp, human
gtcgtgggtgccggaagtgg

SEQ ID NO: 51951 - DNA, 20 bp, human
gagggaggggtcacacccag

SEQ ID NO: 51952 - DNA, 20 bp, human
ggagctgtgggccccaatgg

SEQ ID NO: 51953 - DNA, 20 bp, human
gcggcgggtaagggtggacg

SEQ ID NO: 51954 - DNA, 20 bp, human
ggccccagcggattcagaga

SEQ ID NO: 51955 - DNA, 20 bp, human
gaggcgagctgacaaaaggg

SEQ ID NO: 51956 - DNA, 20 bp, human
gggacagggttccacagatg

SEQ ID NO: 51957 - DNA, 20 bp, human
gcaggtcactgattgtagtg

SEQ ID NO: 51958 - DNA, 20 bp, human
gagtatcggtgtcctcagat

SEQ ID NO: 51959 - DNA, 20 bp, human
gctgtgcttaggaggactgg

SEQ ID NO: 51960 - DNA, 20 bp, human
gctgtgattaggcctatctg

SEQ ID NO: 51961 - DNA, 20 bp, human
gtgtagtggggatcagcatg

SEQ ID NO: 51962 - DNA, 20 bp, human
ggcactgtgcttaggaggac

SEQ ID NO: 51963 - DNA, 20 bp, human
gtgaactcagagtccaagta

SEQ ID NO: 51964 - DNA, 20 bp, human
gaaccctgtcctggtgataa

SEQ ID NO: 51965 - DNA, 20 bp, human
gctctgctgaggttgctcgg

SEQ ID NO: 51966 - DNA, 20 bp, human
gcaggtcactggttgtagtt

SEQ ID NO: 51967 - DNA, 20 bp, human
gctactcagactccaagttc

SEQ ID NO: 51968 - DNA, 20 bp, human
gtgatgataaagacctacag

SEQ ID NO: 51969 - DNA, 20 bp, human
gggtcggtacttcctatctg

SEQ ID NO: 51970 - DNA, 20 bp, human
ggattcacaactctgagcat

SEQ ID NO: 51971 - DNA, 20 bp, human
ggagcattggtgtcctcaga

SEQ ID NO: 51972 - DNA, 20 bp, human
gtctgagtcctcctttcctc

SEQ ID NO: 51973 - DNA, 20 bp, human
gctattattaagtccatctg

SEQ ID NO: 51974 - DNA, 20 bp, human
ggctctgctgaggatgtttg

SEQ ID NO: 51975 - DNA, 20 bp, human
gcgtctcattagacacttgc

SEQ ID NO: 51976 - DNA, 20 bp, human
gggaagcgagccgggctacg

SEQ ID NO: 51977 - DNA, 20 bp, human
gagtacgagaagcgctacag

SEQ ID NO: 51978 - DNA, 20 bp, human
ggagcgcggggtgcggtggt

SEQ ID NO: 51979 - DNA, 20 bp, human
gcccagcacgtagccccagt

SEQ ID NO: 51980 - DNA, 20 bp, human
gcgcccgcgcgaccatgcaa

SEQ ID NO: 51981 - DNA, 20 bp, human
gacgggggagttccttaaag

SEQ ID NO: 51982 - DNA, 20 bp, human
gcgtgccaggtcgcgcatct

SEQ ID NO: 51983 - DNA, 20 bp, human
gggtgcggtggtcggcgggg

SEQ ID NO: 51984 - DNA, 20 bp, human
gcggcccacgggccccgagg

SEQ ID NO: 51985 - DNA, 20 bp, human
gcggggtgcggtggtcggcg

SEQ ID NO: 51986 - DNA, 20 bp, human
gtcgtaggcgtggtagaaca

SEQ ID NO: 51987 - DNA, 20 bp, human
gcaggatgaactggttgcag

SEQ ID NO: 51988 - DNA, 20 bp, human
gttctccaggtagctgtcgt

SEQ ID NO: 51989 - DNA, 20 bp, human
gcgcagctcatcgaagggaa

SEQ ID NO: 51990 - DNA, 20 bp, human
ggcaggtagtgcgagcggag

SEQ ID NO: 51991 - DNA, 20 bp, human
gcaggtgtcgtgcccgtcac

SEQ ID NO: 51992 - DNA, 20 bp, human
ggaggtcgcagctcatcgaa

SEQ ID NO: 51993 - DNA, 20 bp, human
ggggtgggggacgagaaatc

SEQ ID NO: 51994 - DNA, 20 bp, human
gcttgactcgctccctgggt

SEQ ID NO: 51995 - DNA, 20 bp, human
gagcagctcccaggatgaac

SEQ ID NO: 51996 - DNA, 20 bp, human
gaggcgctccgggatactga

SEQ ID NO: 51997 - DNA, 20 bp, human
ggtgaggctgacaacaggag

SEQ ID NO: 51998 - DNA, 20 bp, human
gcgctccgggatactgaggg

SEQ ID NO: 51999 - DNA, 20 bp, human
gggatgcggagtaacacgga

SEQ ID NO: 52000 - DNA, 20 bp, human
gggcgggatgcggagtaaca

SEQ ID NO: 52001 - DNA, 20 bp, human
gcgagcgcgatggagactag

SEQ ID NO: 52002 - DNA, 20 bp, human
gccgcgcgagaaccctagag

SEQ ID NO: 52003 - DNA, 20 bp, human
ggcgctggggaccggcttgg

SEQ ID NO: 52004 - DNA, 20 bp, human
ggcgaccgggtcgcaatgac

SEQ ID NO: 52005 - DNA, 20 bp, human
gccgggatactgagggcgga

SEQ ID NO: 52006 - DNA, 20 bp, human
gagcgactgggacacggtga

SEQ ID NO: 52007 - DNA, 20 bp, human
ggccgagagcgactgggaca

SEQ ID NO: 52008 - DNA, 20 bp, human
ggcgaagacgagcgtccgtc

SEQ ID NO: 52009 - DNA, 20 bp, human
ggccatggccgagagcgact

SEQ ID NO: 52010 - DNA, 20 bp, human
gcgtccgtccggcggctcag

SEQ ID NO: 52011 - DNA, 20 bp, human
gcgggaccagtgccagggtg

SEQ ID NO: 52012 - DNA, 20 bp, human
gaggagcagggaaccggacg

SEQ ID NO: 52013 - DNA, 20 bp, human
gtcccagtcgctctcggcca

SEQ ID NO: 52014 - DNA, 20 bp, human
gctgcgcaagaagggcccta

SEQ ID NO: 52015 - DNA, 20 bp, human
ggggcaaggggcaggcgata

SEQ ID NO: 52016 - DNA, 20 bp, human
ggcgcactgtgtacaaacag

SEQ ID NO: 52017 - DNA, 20 bp, human
ggagggcagtgtagccgagg

SEQ ID NO: 52018 - DNA, 20 bp, human
gaatgaagcgtgagctggag

SEQ ID NO: 52019 - DNA, 20 bp, human
gcactgtgtacaaacagagg

SEQ ID NO: 52020 - DNA, 20 bp, human
ggagagtggtgactaaagag

SEQ ID NO: 52021 - DNA, 20 bp, human
gaccagccggggtcacgtcc

SEQ ID NO: 52022 - DNA, 20 bp, human
ggcggagggcagtgtagccg

SEQ ID NO: 52023 - DNA, 20 bp, human
gcgtgaccccggctggtcag

SEQ ID NO: 52024 - DNA, 20 bp, human
gggctggtcaggggtcgtcg

SEQ ID NO: 52025 - DNA, 20 bp, human
gtgagctggaggggagcgag

SEQ ID NO: 52026 - DNA, 20 bp, human
gtcgcctggcgcagatgcag

SEQ ID NO: 52027 - DNA, 20 bp, human
gcacgcggcggtggagagct

SEQ ID NO: 52028 - DNA, 20 bp, human
gcaggagagaaggcagcgag

SEQ ID NO: 52029 - DNA, 20 bp, human
ggagcgtctgcaggcgcacg

SEQ ID NO: 52030 - DNA, 20 bp, human
gtgcagaggcgcgtctgact

SEQ ID NO: 52031 - DNA, 20 bp, human
gcagcgagcggagcgtctgc

SEQ ID NO: 52032 - DNA, 20 bp, human
gggcgcaggacccgttcgcc

SEQ ID NO: 52033 - DNA, 20 bp, human
gccgttcaaactgaacccaa

SEQ ID NO: 52034 - DNA, 20 bp, human
gccccgttaaaagggcactt

SEQ ID NO: 52035 - DNA, 20 bp, human
gagaagcaagaaaagcatga

SEQ ID NO: 52036 - DNA, 20 bp, human
ggtaggcacggagaccatag

SEQ ID NO: 52037 - DNA, 20 bp, human
gtggagcgcgcaggctggac

SEQ ID NO: 52038 - DNA, 20 bp, human
gggcacggagaccatagcgg

SEQ ID NO: 52039 - DNA, 20 bp, human
gagcgcaacggagcaccagg

SEQ ID NO: 52040 - DNA, 20 bp, human
gcaacggagcaccaggtggt

SEQ ID NO: 52041 - DNA, 20 bp, human
gaggcagacccaggagctgt

SEQ ID NO: 52042 - DNA, 20 bp, human
ggtgccttgggcatgagatg

SEQ ID NO: 52043 - DNA, 20 bp, human
gagaggcagccagggcaccg

SEQ ID NO: 52044 - DNA, 20 bp, human
gctcgattatgcaagaggag

SEQ ID NO: 52045 - DNA, 20 bp, human
gacggagaccatagcggcgg

SEQ ID NO: 52046 - DNA, 20 bp, human
ggccagctccgcgcagggat

SEQ ID NO: 52047 - DNA, 20 bp, human
ggcgcaacgactacccgcac

SEQ ID NO: 52048 - DNA, 20 bp, human
ggccgcagccaactcctggc

SEQ ID NO: 52049 - DNA, 20 bp, human
ggaccgccgcagccaactcc

SEQ ID NO: 52050 - DNA, 20 bp, human
ggtgcgcgggctgcaactcc

SEQ ID NO: 52051 - DNA, 20 bp, human
gcgcaggtaagcgcacgggg

SEQ ID NO: 52052 - DNA, 20 bp, human
ggcgcacacaaaaggaccca

SEQ ID NO: 52053 - DNA, 20 bp, human
gggtcactgtgagcccgaaa

SEQ ID NO: 52054 - DNA, 20 bp, human
gcactcgtgaagacgcctgg

SEQ ID NO: 52055 - DNA, 20 bp, human
ggcgcacccaggacagcgag

SEQ ID NO: 52056 - DNA, 20 bp, human
gtcgctgggaccccaatccc

SEQ ID NO: 52057 - DNA, 20 bp, human
gtccccggcgacgaccgggt

SEQ ID NO: 52058 - DNA, 20 bp, human
gcggcgacgaccgggtggga

SEQ ID NO: 52059 - DNA, 20 bp, human
gcgcgcgccctggggcaagt

SEQ ID NO: 52060 - DNA, 20 bp, human
gtggtctgacgattgtggag

SEQ ID NO: 52061 - DNA, 20 bp, human
gcggcttcagaaaacctcct

SEQ ID NO: 52062 - DNA, 20 bp, human
ggtcccagcgagacctcccc

SEQ ID NO: 52063 - DNA, 20 bp, human
ggggcgacccgtcgcagcag

SEQ ID NO: 52064 - DNA, 20 bp, human
ggacgattgtggagaggcgg

SEQ ID NO: 52065 - DNA, 20 bp, human
gccaatccccggcgacgacc

SEQ ID NO: 52066 - DNA, 20 bp, human
gtgcgcgccagtgggaaact

SEQ ID NO: 52067 - DNA, 20 bp, human
gacccctcctggccacgcgg

SEQ ID NO: 52068 - DNA, 20 bp, human
ggccataaggtcttagtggg

SEQ ID NO: 52069 - DNA, 20 bp, human
gtgggccataaggtcttagt

SEQ ID NO: 52070 - DNA, 20 bp, human
ggcgcggtcgttggcacctg

SEQ ID NO: 52071 - DNA, 20 bp, human
ggccagtctggcgcggtcgt

SEQ ID NO: 52072 - DNA, 20 bp, human
ggtccgcacagacttggagg

SEQ ID NO: 52073 - DNA, 20 bp, human
gaaacagctgagagggcatc

SEQ ID NO: 52074 - DNA, 20 bp, human
gcgcgtccgcacagacttgg

SEQ ID NO: 52075 - DNA, 20 bp, human
gcacctgcggaggtgcctaa

SEQ ID NO: 52076 - DNA, 20 bp, human
gagagagcgagcgaacgact

SEQ ID NO: 52077 - DNA, 20 bp, human
ggcggccccgacttccccac

SEQ ID NO: 52078 - DNA, 20 bp, human
gttccccacaggcggcgaga

SEQ ID NO: 52079 - DNA, 20 bp, human
gagggtctggagagtcaccg

SEQ ID NO: 52080 - DNA, 20 bp, human
ggccgcctgtggggaagtcg

SEQ ID NO: 52081 - DNA, 20 bp, human
ggtctggagagtcaccgcgg

SEQ ID NO: 52082 - DNA, 20 bp, human
ggcgcaccccgagtagtgag

SEQ ID NO: 52083 - DNA, 20 bp, human
ggcccatctgtcagttacgg

SEQ ID NO: 52084 - DNA, 20 bp, human
ggcggtggcgacggccgctc

SEQ ID NO: 52085 - DNA, 20 bp, human
ggaaggaggtcggggcgagg

SEQ ID NO: 52086 - DNA, 20 bp, human
gctgaaacgtctttggaagg

SEQ ID NO: 52087 - DNA, 20 bp, human
ggcagcgggtcggagatcga

SEQ ID NO: 52088 - DNA, 20 bp, human
gcaggcggcaggaacctgga

SEQ ID NO: 52089 - DNA, 20 bp, human
ggctagggagcgaaagtctg

SEQ ID NO: 52090 - DNA, 20 bp, human
ggcggaggccccgccccagg

SEQ ID NO: 52091 - DNA, 20 bp, human
gggccgggcttgcttgacgg

SEQ ID NO: 52092 - DNA, 20 bp, human
ggccccaggcggcaggaacc

SEQ ID NO: 52093 - DNA, 20 bp, human
gcgaaggaacgggccaattg

SEQ ID NO: 52094 - DNA, 20 bp, human
ggatctccgacccgctgcta

SEQ ID NO: 52095 - DNA, 20 bp, human
gcggaggaatatgtccgaga

SEQ ID NO: 52096 - DNA, 20 bp, human
gctggcctctttacgggtta

SEQ ID NO: 52097 - DNA, 20 bp, human
gtgccgtgtgtggttcccgc

SEQ ID NO: 52098 - DNA, 20 bp, human
gggcccgcgggaaccacaca

SEQ ID NO: 52099 - DNA, 20 bp, human
gcatgtgcgctgggacgcac

SEQ ID NO: 52100 - DNA, 20 bp, human
gactcaagcacgaggcgaag

SEQ ID NO: 52101 - DNA, 20 bp, human
gccgccgcgtgcgaatctgg

SEQ ID NO: 52102 - DNA, 20 bp, human
ggtaaagaggccaggcccgc

SEQ ID NO: 52103 - DNA, 20 bp, human
gcacaggtaagtgccgtgtg

SEQ ID NO: 52104 - DNA, 20 bp, human
ggccaccgagaatcggacgg

SEQ ID NO: 52105 - DNA, 20 bp, human
gagggccataacccgtaaag

SEQ ID NO: 52106 - DNA, 20 bp, human
ggaggacagaagccaccctg

SEQ ID NO: 52107 - DNA, 20 bp, human
gccggcgccgccagtccctc

SEQ ID NO: 52108 - DNA, 20 bp, human
gcaccctggggtgggaacac

SEQ ID NO: 52109 - DNA, 20 bp, human
ggtccctcttcggaagacgg

SEQ ID NO: 52110 - DNA, 20 bp, human
gcacccgtgttcccacccca

SEQ ID NO: 52111 - DNA, 20 bp, human
ggtcccatcacagaggtcag

SEQ ID NO: 52112 - DNA, 20 bp, human
ggagacctcggctccgggta

SEQ ID NO: 52113 - DNA, 20 bp, human
gctcccggagataaaaccgc

SEQ ID NO: 52114 - DNA, 20 bp, human
gggggccgagcgtccttacc

SEQ ID NO: 52115 - DNA, 20 bp, human
ggcgtccttacccggagccg

SEQ ID NO: 52116 - DNA, 20 bp, human
ggaaccagccctagaagcgc

SEQ ID NO: 52117 - DNA, 20 bp, human
gtcttaagttcgtacctcca

SEQ ID NO: 52118 - DNA, 20 bp, human
ggcagcgatgcggaaacacc

SEQ ID NO: 52119 - DNA, 20 bp, human
ggtatttgaggtctacttag

SEQ ID NO: 52120 - DNA, 20 bp, human
gcacggctcccgaagatgac

SEQ ID NO: 52121 - DNA, 20 bp, human
ggcggttcacgagcaaggaa

SEQ ID NO: 52122 - DNA, 20 bp, human
gtattaactgggcagcgatg

SEQ ID NO: 52123 - DNA, 20 bp, human
ggccacgtggcgcagcgtgt

SEQ ID NO: 52124 - DNA, 20 bp, human
gaggctggggccacttccgg

SEQ ID NO: 52125 - DNA, 20 bp, human
ggagcggacgggctgagtcg

SEQ ID NO: 52126 - DNA, 20 bp, human
gcggagacggcagcaaacac

SEQ ID NO: 52127 - DNA, 20 bp, human
ggcagatgtctggtctccca

SEQ ID NO: 52128 - DNA, 20 bp, human
gctggtgcttgacaaagacg

SEQ ID NO: 52129 - DNA, 20 bp, human
ggcccccgccggaaggagtc

SEQ ID NO: 52130 - DNA, 20 bp, human
ggtctggtctcccacggaga

SEQ ID NO: 52131 - DNA, 20 bp, human
gctcgcgccgttagggactg

SEQ ID NO: 52132 - DNA, 20 bp, human
gcgcgcccgactccttccgg

SEQ ID NO: 52133 - DNA, 20 bp, human
ggcacgggaaatgaagcact

SEQ ID NO: 52134 - DNA, 20 bp, human
gacttggggcgagcgcagag

SEQ ID NO: 52135 - DNA, 20 bp, human
gatgaaagggagggccgccc

SEQ ID NO: 52136 - DNA, 20 bp, human
ggccggccaccagatacggg

SEQ ID NO: 52137 - DNA, 20 bp, human
ggtctgccaggagctacggc

SEQ ID NO: 52138 - DNA, 20 bp, human
gctagcggcgcagacacgtg

SEQ ID NO: 52139 - DNA, 20 bp, human
gtccagtagcgacaactctg

SEQ ID NO: 52140 - DNA, 20 bp, human
gcgggccggccaccagatac

SEQ ID NO: 52141 - DNA, 20 bp, human
ggccgcagagttgtcgctac

SEQ ID NO: 52142 - DNA, 20 bp, human
gaggagctacggccggaaga

SEQ ID NO: 52143 - DNA, 20 bp, human
ggaacaagaacctcccgcat

SEQ ID NO: 52144 - DNA, 20 bp, human
ggacccagcacggtgctacc

SEQ ID NO: 52145 - DNA, 20 bp, human
gggagtcttggcccaatcta

SEQ ID NO: 52146 - DNA, 20 bp, human
ggtaagtttgctggctctgg

SEQ ID NO: 52147 - DNA, 20 bp, human
ggcggctggggtaagtttgc

SEQ ID NO: 52148 - DNA, 20 bp, human
gtaagccgcccgggagagaa

SEQ ID NO: 52149 - DNA, 20 bp, human
gcacaggggacaggttgaag

SEQ ID NO: 52150 - DNA, 20 bp, human
gccctcccttctctcccggg

SEQ ID NO: 52151 - DNA, 20 bp, human
gactgtactgctggagagta

SEQ ID NO: 52152 - DNA, 20 bp, human
ggttttgtggagtaacacag

SEQ ID NO: 52153 - DNA, 20 bp, human
gtcccgggcggcttactttg

SEQ ID NO: 52154 - DNA, 20 bp, human
gtgggagcgagaggattctc

SEQ ID NO: 52155 - DNA, 20 bp, human
gctggagagtagggttccta

SEQ ID NO: 52156 - DNA, 20 bp, human
gcgagtcgcgccgaggatgg

SEQ ID NO: 52157 - DNA, 20 bp, human
ggcgcggcgcacagacatgg

SEQ ID NO: 52158 - DNA, 20 bp, human
gcggtggaagcggggagaca

SEQ ID NO: 52159 - DNA, 20 bp, human
ggcggcccgcgggttacata

SEQ ID NO: 52160 - DNA, 20 bp, human
gccgtcgtcgccgccatcct

SEQ ID NO: 52161 - DNA, 20 bp, human
ggtgccaggaggagacgtag

SEQ ID NO: 52162 - DNA, 20 bp, human
gcccagctccaaccaggtct

SEQ ID NO: 52163 - DNA, 20 bp, human
gaagcgagtcgcgccgagga

SEQ ID NO: 52164 - DNA, 20 bp, human
gtggcaggcgtagtaatggc

SEQ ID NO: 52165 - DNA, 20 bp, human
gacagcgcggcgcacagaca

SEQ ID NO: 52166 - DNA, 20 bp, human
ggacacgcttcactgatacc

SEQ ID NO: 52167 - DNA, 20 bp, human
ggatacccggaaggacgagc

SEQ ID NO: 52168 - DNA, 20 bp, human
gcgcttcactgatacccgga

SEQ ID NO: 52169 - DNA, 20 bp, human
gctggccccgatatgagtag

SEQ ID NO: 52170 - DNA, 20 bp, human
ggtagggggagcgcagagta

SEQ ID NO: 52171 - DNA, 20 bp, human
gggagaggcacagggattcg

SEQ ID NO: 52172 - DNA, 20 bp, human
gggagctcacgttgacttga

SEQ ID NO: 52173 - DNA, 20 bp, human
gccagatattgtaggagtgg

SEQ ID NO: 52174 - DNA, 20 bp, human
gggaagctcctgtgttgcac

SEQ ID NO: 52175 - DNA, 20 bp, human
ggctccccctactcatatcg

SEQ ID NO: 52176 - DNA, 20 bp, human
gacagcgagcgggactcggg

SEQ ID NO: 52177 - DNA, 20 bp, human
ggcgggcgctcgatccagga

SEQ ID NO: 52178 - DNA, 20 bp, human
ggcgacagcgagcgggactc

SEQ ID NO: 52179 - DNA, 20 bp, human
ggagtgcgggcgctcgatcc

SEQ ID NO: 52180 - DNA, 20 bp, human
ggcgctcgatccaggaagga

SEQ ID NO: 52181 - DNA, 20 bp, human
ggcgcctgtctgcccgaggg

SEQ ID NO: 52182 - DNA, 20 bp, human
gcacggccgcgagggtccag

SEQ ID NO: 52183 - DNA, 20 bp, human
gcgcgagggtccagaggagt

SEQ ID NO: 52184 - DNA, 20 bp, human
ggcgtgcaggcgacagcgag

SEQ ID NO: 52185 - DNA, 20 bp, human
gctcgcggcccggagctcca

SEQ ID NO: 52186 - DNA, 20 bp, human
gccgcggcgactaccgaggg

SEQ ID NO: 52187 - DNA, 20 bp, human
gcggcggcatggcagggcgg

SEQ ID NO: 52188 - DNA, 20 bp, human
gggcgggtgaacgtgaacgt

SEQ ID NO: 52189 - DNA, 20 bp, human
ggactaccgagggaggtgag

SEQ ID NO: 52190 - DNA, 20 bp, human
gggaccgcggcgactaccga

SEQ ID NO: 52191 - DNA, 20 bp, human
gtcatccggaccatcatcgg

SEQ ID NO: 52192 - DNA, 20 bp, human
gtgctgggccacatcgacag

SEQ ID NO: 52193 - DNA, 20 bp, human
gcggcggcggcatggcaggg

SEQ ID NO: 52194 - DNA, 20 bp, human
ggtcaggagccccaccaatg

SEQ ID NO: 52195 - DNA, 20 bp, human
gccctcatccggaccatcat

SEQ ID NO: 52196 - DNA, 20 bp, human
ggcggatccccgcccgagtt

SEQ ID NO: 52197 - DNA, 20 bp, human
gactgcgagcgggagccgtg

SEQ ID NO: 52198 - DNA, 20 bp, human
gcgcagagcggccgagaggt

SEQ ID NO: 52199 - DNA, 20 bp, human
gcgggacacgcagaccgaag

SEQ ID NO: 52200 - DNA, 20 bp, human
ggacccgcggcaggtcgggt

SEQ ID NO: 52201 - DNA, 20 bp, human
ggtccccgcgccccacctct

SEQ ID NO: 52202 - DNA, 20 bp, human
gaaagtcctgcgcccaactc

SEQ ID NO: 52203 - DNA, 20 bp, human
gagacccagcaccagccgca

SEQ ID NO: 52204 - DNA, 20 bp, human
ggtcctgcgcccaactcggg

SEQ ID NO: 52205 - DNA, 20 bp, human
gaagtccgtgctccccggag

SEQ ID NO: 52206 - DNA, 20 bp, human
gggagtgtaggtagcaccag

SEQ ID NO: 52207 - DNA, 20 bp, human
ggtgctgggtcaacgcggtg

SEQ ID NO: 52208 - DNA, 20 bp, human
gccagcaccagggctcgcgg

SEQ ID NO: 52209 - DNA, 20 bp, human
gccgcgttgacccagcacca

SEQ ID NO: 52210 - DNA, 20 bp, human
gtaggtagcaccagaggcgg

SEQ ID NO: 52211 - DNA, 20 bp, human
gcgtgcgcggccctaacaga

SEQ ID NO: 52212 - DNA, 20 bp, human
gcgggaagcaggcacaacag

SEQ ID NO: 52213 - DNA, 20 bp, human
gagtcagagagggaatcccg

SEQ ID NO: 52214 - DNA, 20 bp, human
gaatgcatgtgtgggagtgt

SEQ ID NO: 52215 - DNA, 20 bp, human
gcggctaccgagaccctcgc

SEQ ID NO: 52216 - DNA, 20 bp, human
gagccaggctgggaaagcgg

SEQ ID NO: 52217 - DNA, 20 bp, human
gcagagtgagacccagacac

SEQ ID NO: 52218 - DNA, 20 bp, human
gtcctggagttaggaaggtg

SEQ ID NO: 52219 - DNA, 20 bp, human
gtgagacccagacacgggag

SEQ ID NO: 52220 - DNA, 20 bp, human
gcctggctggcagcctaccg

SEQ ID NO: 52221 - DNA, 20 bp, human
gcgggtgtgcagataagacc

SEQ ID NO: 52222 - DNA, 20 bp, human
ggtagctggttgggttgctg

SEQ ID NO: 52223 - DNA, 20 bp, human
gaaagcggtggtagctggtt

SEQ ID NO: 52224 - DNA, 20 bp, human
ggcctcaccttcctaactcc

SEQ ID NO: 52225 - DNA, 20 bp, human
gcggtgggcgtggccgcggt

SEQ ID NO: 52226 - DNA, 20 bp, human
gtgcttgcgtaggggtaccg

SEQ ID NO: 52227 - DNA, 20 bp, human
gtgtgggcttgcttgcgtag

SEQ ID NO: 52228 - DNA, 20 bp, human
gagaggcccgacccatgtga

SEQ ID NO: 52229 - DNA, 20 bp, human
gagaaacagggcgagctgga

SEQ ID NO: 52230 - DNA, 20 bp, human
gtggagggctcccgtcacat

SEQ ID NO: 52231 - DNA, 20 bp, human
gttcgcacgacttggagtta

SEQ ID NO: 52232 - DNA, 20 bp, human
ggcctctggttcctccaact

SEQ ID NO: 52233 - DNA, 20 bp, human
gagggttgccatggagtcgg

SEQ ID NO: 52234 - DNA, 20 bp, human
gctaaggacgcgtgaaagtg

SEQ ID NO: 52235 - DNA, 20 bp, human
gggggtcggcacaatatctg

SEQ ID NO: 52236 - DNA, 20 bp, human
gagcagcgccgcccgagggg

SEQ ID NO: 52237 - DNA, 20 bp, human
gtagagcagcgccgcccgag

SEQ ID NO: 52238 - DNA, 20 bp, human
gctgaccacagagagcgcgg

SEQ ID NO: 52239 - DNA, 20 bp, human
gccgcgcggcgcgggatcct

SEQ ID NO: 52240 - DNA, 20 bp, human
ggggctgaccacagagagcg

SEQ ID NO: 52241 - DNA, 20 bp, human
gcccccaagggtcccactac

SEQ ID NO: 52242 - DNA, 20 bp, human
gagaaggctggcggtcccgg

SEQ ID NO: 52243 - DNA, 20 bp, human
ggaaatgagtgtgctaatag

SEQ ID NO: 52244 - DNA, 20 bp, human
gtgggaagcctcctcagcgt

SEQ ID NO: 52245 - DNA, 20 bp, human
gtcgtaagagcagggtctat

SEQ ID NO: 52246 - DNA, 20 bp, human
gttccttgcaggagaggtgg

SEQ ID NO: 52247 - DNA, 20 bp, human
gcaggacggaggccggagaa

SEQ ID NO: 52248 - DNA, 20 bp, human
gcccttccttgcaggagagg

SEQ ID NO: 52249 - DNA, 20 bp, human
gggagacctcaaactccggg

SEQ ID NO: 52250 - DNA, 20 bp, human
gcccgaggccgaggaagatc

SEQ ID NO: 52251 - DNA, 20 bp, human
gcaggcggccgctgccaaag

SEQ ID NO: 52252 - DNA, 20 bp, human
gaggtgcagagtaagaaagt

SEQ ID NO: 52253 - DNA, 20 bp, human
gggagcccggctagaagggt

SEQ ID NO: 52254 - DNA, 20 bp, human
gcccttcacgttcaggacgg

SEQ ID NO: 52255 - DNA, 20 bp, human
gttgttggcgttggtggcgg

SEQ ID NO: 52256 - DNA, 20 bp, human
gcggctccgcagcaagatgg

SEQ ID NO: 52257 - DNA, 20 bp, human
gatggcggacgagaaggaca

SEQ ID NO: 52258 - DNA, 20 bp, human
gcgcggccgaggttatcgtt

SEQ ID NO: 52259 - DNA, 20 bp, human
ggaccggctccgcagcaaga

SEQ ID NO: 52260 - DNA, 20 bp, human
gaagagctgggctcccaagg

SEQ ID NO: 52261 - DNA, 20 bp, human
gaggacagggaaggtaaggt

SEQ ID NO: 52262 - DNA, 20 bp, human
gagcaagatggcggacgaga

SEQ ID NO: 52263 - DNA, 20 bp, human
gaccccaggcgagagtgtgg

SEQ ID NO: 52264 - DNA, 20 bp, human
gtggacgggagaaaccggga

SEQ ID NO: 52265 - DNA, 20 bp, human
ggctgcgaatgggaagcggg

SEQ ID NO: 52266 - DNA, 20 bp, human
gccagaagtggtaggtagca

SEQ ID NO: 52267 - DNA, 20 bp, human
gattgaagcccagaagtggt

SEQ ID NO: 52268 - DNA, 20 bp, human
gggtagcacggcttaaaagt

SEQ ID NO: 52269 - DNA, 20 bp, human
gtctgattgaagcccagaag

SEQ ID NO: 52270 - DNA, 20 bp, human
gggctctgaggtggagacct

SEQ ID NO: 52271 - DNA, 20 bp, human
gagatcaggaatccaataaa

SEQ ID NO: 52272 - DNA, 20 bp, human
gtctgggcttcaatcagatc

SEQ ID NO: 52273 - DNA, 20 bp, human
ggttgctgacttaggaataa

SEQ ID NO: 52274 - DNA, 20 bp, human
gaaaactaggttgctgactt

SEQ ID NO: 52275 - DNA, 20 bp, human
ggatggaacaaaccctttat

SEQ ID NO: 52276 - DNA, 20 bp, human
gggcccagtgggatctcctc

SEQ ID NO: 52277 - DNA, 20 bp, human
gcgggtggagaagaccggac

SEQ ID NO: 52278 - DNA, 20 bp, human
gagcccgaggagatcccact

SEQ ID NO: 52279 - DNA, 20 bp, human
gagctgctgctctaactgga

SEQ ID NO: 52280 - DNA, 20 bp, human
gcggacgggggtgatacgtg

SEQ ID NO: 52281 - DNA, 20 bp, human
ggtgcagctgctgctctaac

SEQ ID NO: 52282 - DNA, 20 bp, human
gcgccacagctgggagttct

SEQ ID NO: 52283 - DNA, 20 bp, human
ggaggtacacggagggccag

SEQ ID NO: 52284 - DNA, 20 bp, human
gagagtgcacgggtgaccgt

SEQ ID NO: 52285 - DNA, 20 bp, human
gcgacaacccggggacgcta

SEQ ID NO: 52286 - DNA, 20 bp, human
ggctcggagcggaaagagtc

SEQ ID NO: 52287 - DNA, 20 bp, human
gggagagccgagaagcacta

SEQ ID NO: 52288 - DNA, 20 bp, human
gcggagcggaaagagtcggg

SEQ ID NO: 52289 - DNA, 20 bp, human
ggccagctgttcccccccaa

SEQ ID NO: 52290 - DNA, 20 bp, human
gtgaggctggagggttccta

SEQ ID NO: 52291 - DNA, 20 bp, human
gcacgcccaaggtaacgtgg

SEQ ID NO: 52292 - DNA, 20 bp, human
gtgggcgtgtaggcttcccg

SEQ ID NO: 52293 - DNA, 20 bp, human
gtgacagctgagagccgagc

SEQ ID NO: 52294 - DNA, 20 bp, human
gctagtagcactgacctgca

SEQ ID NO: 52295 - DNA, 20 bp, human
gctacacgcccaaggtaacg

SEQ ID NO: 52296 - DNA, 20 bp, human
gccagcttccggcaactcaa

SEQ ID NO: 52297 - DNA, 20 bp, human
ggtgacagaagcaagcggag

SEQ ID NO: 52298 - DNA, 20 bp, human
gccgcagtgacagaagcaag

SEQ ID NO: 52299 - DNA, 20 bp, human
gagaggcggtagctgacagg

SEQ ID NO: 52300 - DNA, 20 bp, human
gagcggagcggccgccagga

SEQ ID NO: 52301 - DNA, 20 bp, human
gctcaagggttacgaccagg

SEQ ID NO: 52302 - DNA, 20 bp, human
gcaactcaagggttacgacc

SEQ ID NO: 52303 - DNA, 20 bp, human
gcgttcggcgggacccgctg

SEQ ID NO: 52304 - DNA, 20 bp, human
gcacgcactcggccagcttc

SEQ ID NO: 52305 - DNA, 20 bp, human
gaagggttacgaccaggcgg

SEQ ID NO: 52306 - DNA, 20 bp, human
ggctgttgcccgagagacga

SEQ ID NO: 52307 - DNA, 20 bp, human
gccaagccgcggggtctcag

SEQ ID NO: 52308 - DNA, 20 bp, human
gagcagcgccggccttctca

SEQ ID NO: 52309 - DNA, 20 bp, human
gccagctaggcggagaatcg

SEQ ID NO: 52310 - DNA, 20 bp, human
gcccacccccagggacgaag

SEQ ID NO: 52311 - DNA, 20 bp, human
gcagcccctctgagaccccg

SEQ ID NO: 52312 - DNA, 20 bp, human
gaggtaagctacgggaacag

SEQ ID NO: 52313 - DNA, 20 bp, human
ggcgactgccgtcgtctctc

SEQ ID NO: 52314 - DNA, 20 bp, human
gcgtcctagagacgccgaat

SEQ ID NO: 52315 - DNA, 20 bp, human
gccagctgattctcacagag

SEQ ID NO: 52316 - DNA, 20 bp, human
gcggcccgagactgagacag

SEQ ID NO: 52317 - DNA, 20 bp, human
gaccgcagctggacagatct

SEQ ID NO: 52318 - DNA, 20 bp, human
ggccgagatctgtccagctg

SEQ ID NO: 52319 - DNA, 20 bp, human
gtgccatggtgattagagaa

SEQ ID NO: 52320 - DNA, 20 bp, human
gaggcccctgtctcagtctc

SEQ ID NO: 52321 - DNA, 20 bp, human
gtaccgtcacaggtaatctc

SEQ ID NO: 52322 - DNA, 20 bp, human
gagcgcctaaggcttctaca

SEQ ID NO: 52323 - DNA, 20 bp, human
gaagcgcagccaattctctt

SEQ ID NO: 52324 - DNA, 20 bp, human
gggcctttctctaatcacca

SEQ ID NO: 52325 - DNA, 20 bp, human
gtggccagagtagtgagaga

SEQ ID NO: 52326 - DNA, 20 bp, human
gagccttggaggtcaggcag

SEQ ID NO: 52327 - DNA, 20 bp, human
gaggagatcaaattgagtca

SEQ ID NO: 52328 - DNA, 20 bp, human
gcccatctcaacaaagacat

SEQ ID NO: 52329 - DNA, 20 bp, human
gacttacagcagacagtgaa

SEQ ID NO: 52330 - DNA, 20 bp, human
gaaaggagttacagcactcc

SEQ ID NO: 52331 - DNA, 20 bp, human
ggaagtcgagatggaactct

SEQ ID NO: 52332 - DNA, 20 bp, human
gttgccagcaagattaactg

SEQ ID NO: 52333 - DNA, 20 bp, human
gcgggaaactggaagatgcc

SEQ ID NO: 52334 - DNA, 20 bp, human
gaattgagtcagggtgagtg

SEQ ID NO: 52335 - DNA, 20 bp, human
ggcagctcttatctgtgtcc

SEQ ID NO: 52336 - DNA, 20 bp, human
ggtatattttgtccagatag

SEQ ID NO: 52337 - DNA, 20 bp, human
ggaagcaaggatcgtttctg

SEQ ID NO: 52338 - DNA, 20 bp, human
gaacccaggtaaggacccag

SEQ ID NO: 52339 - DNA, 20 bp, human
gctgtgtcaactgaaggctc

SEQ ID NO: 52340 - DNA, 20 bp, human
gctcctctgggtccttacct

SEQ ID NO: 52341 - DNA, 20 bp, human
gattagctaaaacccaggta

SEQ ID NO: 52342 - DNA, 20 bp, human
ggtgagaaacgtgaaggctt

SEQ ID NO: 52343 - DNA, 20 bp, human
gttagtactgtgtcaactga

SEQ ID NO: 52344 - DNA, 20 bp, human
gttatccgtgagaaacgtga

SEQ ID NO: 52345 - DNA, 20 bp, human
gacggcaagaacaccttgaa

SEQ ID NO: 52346 - DNA, 20 bp, human
ggccgcggcagtccaggtgg

SEQ ID NO: 52347 - DNA, 20 bp, human
ggacgccgaccgggcactgg

SEQ ID NO: 52348 - DNA, 20 bp, human
gggtgccgaagtagccacag

SEQ ID NO: 52349 - DNA, 20 bp, human
gccagacccagacgccgacc

SEQ ID NO: 52350 - DNA, 20 bp, human
gagcgccaccagtgcccggt

SEQ ID NO: 52351 - DNA, 20 bp, human
ggccaggcgcgcctcttcat

SEQ ID NO: 52352 - DNA, 20 bp, human
ggcgccctggcgcaccacta

SEQ ID NO: 52353 - DNA, 20 bp, human
gggagagcgtgggagtcacg

SEQ ID NO: 52354 - DNA, 20 bp, human
ggccgcggtccagcccgtag

SEQ ID NO: 52355 - DNA, 20 bp, human
gggcggggcgaagggaccgg

SEQ ID NO: 52356 - DNA, 20 bp, human
gcagcgaggggagtgcgcag

SEQ ID NO: 52357 - DNA, 20 bp, human
ggcagcgcggccgcacaggt

SEQ ID NO: 52358 - DNA, 20 bp, human
gcacaggtaggagcccccaa

SEQ ID NO: 52359 - DNA, 20 bp, human
gtcgccagatcagacccacg

SEQ ID NO: 52360 - DNA, 20 bp, human
gggtaggagcccccaacggg

SEQ ID NO: 52361 - DNA, 20 bp, human
gggtctgatctggcgaagtc

SEQ ID NO: 52362 - DNA, 20 bp, human
gctcctatggaatccaggtg

SEQ ID NO: 52363 - DNA, 20 bp, human
gtaacagcaagctaacgcgg

SEQ ID NO: 52364 - DNA, 20 bp, human
gagacaccctgcacagtcca

SEQ ID NO: 52365 - DNA, 20 bp, human
gaccagctcctatggaatcc

SEQ ID NO: 52366 - DNA, 20 bp, human
gtgcctgcgggcagacggac

SEQ ID NO: 52367 - DNA, 20 bp, human
gctgcgggcagacggacggg

SEQ ID NO: 52368 - DNA, 20 bp, human
gcccagagcagtagagaccc

SEQ ID NO: 52369 - DNA, 20 bp, human
gtggctcgggcaatgcctgc

SEQ ID NO: 52370 - DNA, 20 bp, human
ggatggtggacacgggtcag

SEQ ID NO: 52371 - DNA, 20 bp, human
gtgggcccgcgacacccccg

SEQ ID NO: 52372 - DNA, 20 bp, human
ggaggagcgcgggcctctgt

SEQ ID NO: 52373 - DNA, 20 bp, human
gtgtcgcgggcccaagtgag

SEQ ID NO: 52374 - DNA, 20 bp, human
gtcctggggctgcgagatgg

SEQ ID NO: 52375 - DNA, 20 bp, human
ggcccaagcacggtcctgag

SEQ ID NO: 52376 - DNA, 20 bp, human
ggagtggctcagatccgaac

SEQ ID NO: 52377 - DNA, 20 bp, human
gtgtcacgtgaccctgcgag

SEQ ID NO: 52378 - DNA, 20 bp, human
gattgtcaggcgcctaaagg

SEQ ID NO: 52379 - DNA, 20 bp, human
gccgcgcgtacctggggtgg

SEQ ID NO: 52380 - DNA, 20 bp, human
gtagccgagatgccaggatt

SEQ ID NO: 52381 - DNA, 20 bp, human
gcttattgtcaggcgcctaa

SEQ ID NO: 52382 - DNA, 20 bp, human
gaacctcgccgctcccacaa

SEQ ID NO: 52383 - DNA, 20 bp, human
ggaagcgacttcttattgtc

SEQ ID NO: 52384 - DNA, 20 bp, human
gcggatctgagccactcgca

SEQ ID NO: 52385 - DNA, 20 bp, human
gttaccccaaggaggaagaa

SEQ ID NO: 52386 - DNA, 20 bp, human
ggtcgcctgggcaaccggag

SEQ ID NO: 52387 - DNA, 20 bp, human
gcgaagcaggacctaggtgg

SEQ ID NO: 52388 - DNA, 20 bp, human
gagaggacgaagcaggacct

SEQ ID NO: 52389 - DNA, 20 bp, human
gtaggtggcggcggtggtac

SEQ ID NO: 52390 - DNA, 20 bp, human
gagcaggacctaggtggcgg

SEQ ID NO: 52391 - DNA, 20 bp, human
ggaaagggcaagccatgcac

SEQ ID NO: 52392 - DNA, 20 bp, human
ggcgttaccatggatcctgg

SEQ ID NO: 52393 - DNA, 20 bp, human
gcaaccggagaggacgaagc

SEQ ID NO: 52394 - DNA, 20 bp, human
gaggacgtgcccggaagaaa

SEQ ID NO: 52395 - DNA, 20 bp, human
gctaaagggacaagaggcag

SEQ ID NO: 52396 - DNA, 20 bp, human
gtaggtggcaggaccctcaa

SEQ ID NO: 52397 - DNA, 20 bp, human
gctcagtgtccgaaaatcca

SEQ ID NO: 52398 - DNA, 20 bp, human
gatccagggtcccagaagag

SEQ ID NO: 52399 - DNA, 20 bp, human
gggtcccagaagagagggcc

SEQ ID NO: 52400 - DNA, 20 bp, human
gggacactggatgctgcata

SEQ ID NO: 52401 - DNA, 20 bp, human
gcaaagggctgttgggacac

SEQ ID NO: 52402 - DNA, 20 bp, human
gtagagagagtccttatagg

SEQ ID NO: 52403 - DNA, 20 bp, human
ggccaaacaacacggccggg

SEQ ID NO: 52404 - DNA, 20 bp, human
gcaacccagggcagcagcat

SEQ ID NO: 52405 - DNA, 20 bp, human
gacgtgggggccaaacaaca

SEQ ID NO: 52406 - DNA, 20 bp, human
ggctctacaacactccgccg

SEQ ID NO: 52407 - DNA, 20 bp, human
gggacgcgggacgggacgca

SEQ ID NO: 52408 - DNA, 20 bp, human
gggcggctggacatcaacga

SEQ ID NO: 52409 - DNA, 20 bp, human
gctccgggaactccgtgtag

SEQ ID NO: 52410 - DNA, 20 bp, human
ggctctccaggtccttgatg

SEQ ID NO: 52411 - DNA, 20 bp, human
gtacttctgggggacaagaa

SEQ ID NO: 52412 - DNA, 20 bp, human
gcgcgctcctcgcaggctcg

SEQ ID NO: 52413 - DNA, 20 bp, human
gcgccgcctcatcaaggacc

SEQ ID NO: 52414 - DNA, 20 bp, human
gctacaacactccgccgagg

SEQ ID NO: 52415 - DNA, 20 bp, human
gtgaggcggcggctgaactc

SEQ ID NO: 52416 - DNA, 20 bp, human
gggcgcgcagacctcaacca

SEQ ID NO: 52417 - DNA, 20 bp, human
ggccggcggctgcagatgga

SEQ ID NO: 52418 - DNA, 20 bp, human
gtgacggcaggctcccgggg

SEQ ID NO: 52419 - DNA, 20 bp, human
gagctcgtccgtggccatgg

SEQ ID NO: 52420 - DNA, 20 bp, human
gagtgccgcgcgggccacca

SEQ ID NO: 52421 - DNA, 20 bp, human
ggcccgcgcggcactcgcct

SEQ ID NO: 52422 - DNA, 20 bp, human
gagcgggatccggggatcgg

SEQ ID NO: 52423 - DNA, 20 bp, human
ggagcagcccgggctgaacg

SEQ ID NO: 52424 - DNA, 20 bp, human
gcggcgctgcgctgagagca

SEQ ID NO: 52425 - DNA, 20 bp, human
gggctgacggcaggctcccg

SEQ ID NO: 52426 - DNA, 20 bp, human
gagtgggaacccagacccat

SEQ ID NO: 52427 - DNA, 20 bp, human
gcgccgcggagaaagccagt

SEQ ID NO: 52428 - DNA, 20 bp, human
gttcccactggctttctccg

SEQ ID NO: 52429 - DNA, 20 bp, human
gggggacgcgggtctcctat

SEQ ID NO: 52430 - DNA, 20 bp, human
gaataggggtgccagagaga

SEQ ID NO: 52431 - DNA, 20 bp, human
gcctcactttagagtaatag

SEQ ID NO: 52432 - DNA, 20 bp, human
ggcgggtctcctatgggtct

SEQ ID NO: 52433 - DNA, 20 bp, human
ggatatgacggagaagtgag

SEQ ID NO: 52434 - DNA, 20 bp, human
ggcggagtcgctaggcgaag

SEQ ID NO: 52435 - DNA, 20 bp, human
gccgcggcgcagtcagcgct

SEQ ID NO: 52436 - DNA, 20 bp, human
ggcatcggagggtaccagag

SEQ ID NO: 52437 - DNA, 20 bp, human
gcacagtccgtagggcaatg

SEQ ID NO: 52438 - DNA, 20 bp, human
gcggcgctctgggggatgtg

SEQ ID NO: 52439 - DNA, 20 bp, human
gcgagtccccacagtccgta

SEQ ID NO: 52440 - DNA, 20 bp, human
gggggctacccggcatcgga

SEQ ID NO: 52441 - DNA, 20 bp, human
gggagacgtcggcgctctgg

SEQ ID NO: 52442 - DNA, 20 bp, human
gaggcaactcaggggctacc

SEQ ID NO: 52443 - DNA, 20 bp, human
ggggaaggcaggcgcgaaaa

SEQ ID NO: 52444 - DNA, 20 bp, human
ggagtcccccaaactccggg

SEQ ID NO: 52445 - DNA, 20 bp, human
gcggcggcagcggtaacagc

SEQ ID NO: 52446 - DNA, 20 bp, human
gttcacagtcgaggagagaa

SEQ ID NO: 52447 - DNA, 20 bp, human
gccggcccgcttcacagtcg

SEQ ID NO: 52448 - DNA, 20 bp, human
gagaggacagtccgcagcag

SEQ ID NO: 52449 - DNA, 20 bp, human
gtcgcccccgaggtccggtt

SEQ ID NO: 52450 - DNA, 20 bp, human
gagaccaaaccggacctcgg

SEQ ID NO: 52451 - DNA, 20 bp, human
gggtctggcctggcaggtcc

SEQ ID NO: 52452 - DNA, 20 bp, human
gtcgccaggagagcagcgag

SEQ ID NO: 52453 - DNA, 20 bp, human
ggaccccctagacaaccctt

SEQ ID NO: 52454 - DNA, 20 bp, human
ggccccaagggttgtctagg

SEQ ID NO: 52455 - DNA, 20 bp, human
gctgccaggccagaccaaac

SEQ ID NO: 52456 - DNA, 20 bp, human
ggggcgtctaggaaactcgg

SEQ ID NO: 52457 - DNA, 20 bp, human
gtaaggctgggggccgacgg

SEQ ID NO: 52458 - DNA, 20 bp, human
gaggctgttgggctatagta

SEQ ID NO: 52459 - DNA, 20 bp, human
ggagcgctcgggccgtgtgg

SEQ ID NO: 52460 - DNA, 20 bp, human
ggagcgcggggctcagtcgg

SEQ ID NO: 52461 - DNA, 20 bp, human
gtggtgggactatgggacag

SEQ ID NO: 52462 - DNA, 20 bp, human
gggtgtctgaagaggctgtt

SEQ ID NO: 52463 - DNA, 20 bp, human
gcggagaagccgggagcgcg

SEQ ID NO: 52464 - DNA, 20 bp, human
ggctatagtaaggagcgctc

SEQ ID NO: 52465 - DNA, 20 bp, human
gagagggggacgcactctgt

SEQ ID NO: 52466 - DNA, 20 bp, human
gtagactacgtggcggaggc

SEQ ID NO: 52467 - DNA, 20 bp, human
gagagggaagttgcggaaag

SEQ ID NO: 52468 - DNA, 20 bp, human
gttcacagtcgaggagagaa

SEQ ID NO: 52469 - DNA, 20 bp, human
gccggcccgcttcacagtcg

SEQ ID NO: 52470 - DNA, 20 bp, human
gagaggacagtccgcagcag

SEQ ID NO: 52471 - DNA, 20 bp, human
gtcgcccccgaggtccggtt

SEQ ID NO: 52472 - DNA, 20 bp, human
gggtctggcctggcaggtcc

SEQ ID NO: 52473 - DNA, 20 bp, human
gagaccaaaccggacctcgg

SEQ ID NO: 52474 - DNA, 20 bp, human
gtcgccaggagagcagcgag

SEQ ID NO: 52475 - DNA, 20 bp, human
ggaccccctagacaaccctt

SEQ ID NO: 52476 - DNA, 20 bp, human
ggccggtgtatgtctccccg

SEQ ID NO: 52477 - DNA, 20 bp, human
ggccgcggggagacatacac

SEQ ID NO: 52478 - DNA, 20 bp, human
gcccccgacgcgccactccg

SEQ ID NO: 52479 - DNA, 20 bp, human
gcgccactccggggagagag

SEQ ID NO: 52480 - DNA, 20 bp, human
gcgcgcgctgcacagtcacc

SEQ ID NO: 52481 - DNA, 20 bp, human
gtacccctccccagcttggt

SEQ ID NO: 52482 - DNA, 20 bp, human
ggcggcggcttaacaaagag

SEQ ID NO: 52483 - DNA, 20 bp, human
gcaggtaagccgataacagg

SEQ ID NO: 52484 - DNA, 20 bp, human
gggctgcggcgcgcaactcc

SEQ ID NO: 52485 - DNA, 20 bp, human
gcggatccccgctctctccc

SEQ ID NO: 52486 - DNA, 20 bp, human
gaagggagtagacagcacag

SEQ ID NO: 52487 - DNA, 20 bp, human
gtatgcgagctggacagcag

SEQ ID NO: 52488 - DNA, 20 bp, human
ggtagacagcacagcggcag

SEQ ID NO: 52489 - DNA, 20 bp, human
gacagcacagcggcagcgga

SEQ ID NO: 52490 - DNA, 20 bp, human
gctgcgggaagaccccgtcg

SEQ ID NO: 52491 - DNA, 20 bp, human
gcagcagtgggaggtttgtg

SEQ ID NO: 52492 - DNA, 20 bp, human
ggcggtcaccgagacctctg

SEQ ID NO: 52493 - DNA, 20 bp, human
gatcgggcgggatcacccgg

SEQ ID NO: 52494 - DNA, 20 bp, human
gtccaagggacagcgatccc

SEQ ID NO: 52495 - DNA, 20 bp, human
gagggacagcgatcccggga

SEQ ID NO: 52496 - DNA, 20 bp, human
ggggccaagaagggactgac

SEQ ID NO: 52497 - DNA, 20 bp, human
gtgggacccccaatcctccg

SEQ ID NO: 52498 - DNA, 20 bp, human
ggcgcactccgggccaagaa

SEQ ID NO: 52499 - DNA, 20 bp, human
ggtctccacctagtgaaatg

SEQ ID NO: 52500 - DNA, 20 bp, human
gcgagccccgctggaacgga

SEQ ID NO: 52501 - DNA, 20 bp, human
ggtctgccccggaggattgg

SEQ ID NO: 52502 - DNA, 20 bp, human
gaggcgctaaaagctactat

SEQ ID NO: 52503 - DNA, 20 bp, human
gccccgccagtctgccccgg

SEQ ID NO: 52504 - DNA, 20 bp, human
ggacccggagcggagacgac

SEQ ID NO: 52505 - DNA, 20 bp, human
gagcgcctgggagcgttcgg

SEQ ID NO: 52506 - DNA, 20 bp, human
gccagcctcgctgggattga

SEQ ID NO: 52507 - DNA, 20 bp, human
gccggaccagggagcgagga

SEQ ID NO: 52508 - DNA, 20 bp, human
gcgccccccggcccagaatg

SEQ ID NO: 52509 - DNA, 20 bp, human
gggcgccggaccagggagcg

SEQ ID NO: 52510 - DNA, 20 bp, human
gcagtcccgagcccaggagg

SEQ ID NO: 52511 - DNA, 20 bp, human
gcagcctggagcctgtctac

SEQ ID NO: 52512 - DNA, 20 bp, human
gccccccattctgggccggg

SEQ ID NO: 52513 - DNA, 20 bp, human
ggcaggaagcaggtccgcgt

SEQ ID NO: 52514 - DNA, 20 bp, human
gattgagggcagcgggctaa

SEQ ID NO: 52515 - DNA, 20 bp, human
gtcttcagcccggaccaccc

SEQ ID NO: 52516 - DNA, 20 bp, human
ggaacgaggcgaagggcgaa

SEQ ID NO: 52517 - DNA, 20 bp, human
gcggccggccactcacgggt

SEQ ID NO: 52518 - DNA, 20 bp, human
gccgcggtcacgcaaccaag

SEQ ID NO: 52519 - DNA, 20 bp, human
ggcgccgcccggcgaggagt

SEQ ID NO: 52520 - DNA, 20 bp, human
gccgaacgttaagggaactg

SEQ ID NO: 52521 - DNA, 20 bp, human
ggcgaagggcgaagggcgaa

SEQ ID NO: 52522 - DNA, 20 bp, human
gtggtggtaacctgacccgt

SEQ ID NO: 52523 - DNA, 20 bp, human
gggctcacgccatctccgga

SEQ ID NO: 52524 - DNA, 20 bp, human
ggggacgcgctgttaggagg

SEQ ID NO: 52525 - DNA, 20 bp, human
gggagcggacgcggaccccg

SEQ ID NO: 52526 - DNA, 20 bp, human
gcccgccgagatgtacggta

SEQ ID NO: 52527 - DNA, 20 bp, human
gaaggaccaccgcccagcac

SEQ ID NO: 52528 - DNA, 20 bp, human
ggcgacgccggcctctcgag

SEQ ID NO: 52529 - DNA, 20 bp, human
gctgcagcccggcgctgaat

SEQ ID NO: 52530 - DNA, 20 bp, human
gcctcgggccggggaccctg

SEQ ID NO: 52531 - DNA, 20 bp, human
gtgggcggtggtccttcggg

SEQ ID NO: 52532 - DNA, 20 bp, human
gcgcgccccgccgagatgta

SEQ ID NO: 52533 - DNA, 20 bp, human
gccgagatgtacggtaagga

SEQ ID NO: 52534 - DNA, 20 bp, human
gccgccgggcaccaggtcag

SEQ ID NO: 52535 - DNA, 20 bp, human
gagcccggcgctgaatgggc

SEQ ID NO: 52536 - DNA, 20 bp, human
gaggctgcgcctgaatggag

SEQ ID NO: 52537 - DNA, 20 bp, human
gactcaggcgccacagctgg

SEQ ID NO: 52538 - DNA, 20 bp, human
gtgagtcgtggcctccgcca

SEQ ID NO: 52539 - DNA, 20 bp, human
gggcctctagcccccagctg

SEQ ID NO: 52540 - DNA, 20 bp, human
gagctgtggcgcctgagtcg

SEQ ID NO: 52541 - DNA, 20 bp, human
gccgcccaaaaggagcagat

SEQ ID NO: 52542 - DNA, 20 bp, human
gtcgtggcctccgccaaggt

SEQ ID NO: 52543 - DNA, 20 bp, human
gggccgtggaggtctctccc

SEQ ID NO: 52544 - DNA, 20 bp, human
gtggcctccgccaaggttgg

SEQ ID NO: 52545 - DNA, 20 bp, human
gccattcaggcgcagcctct

SEQ ID NO: 52546 - DNA, 20 bp, human
gctttcggaagctctcggtg

SEQ ID NO: 52547 - DNA, 20 bp, human
ggtgggtgcgacccgagaga

SEQ ID NO: 52548 - DNA, 20 bp, human
ggacgggaagcggcactccg

SEQ ID NO: 52549 - DNA, 20 bp, human
gaactttgttcgggctccat

SEQ ID NO: 52550 - DNA, 20 bp, human
gtcagagacgtgcgggtgaa

SEQ ID NO: 52551 - DNA, 20 bp, human
gtgcgacccgagagaaggag

SEQ ID NO: 52552 - DNA, 20 bp, human
gcgcagcgagcgggttcctc

SEQ ID NO: 52553 - DNA, 20 bp, human
gcccggccccagacgggaag

SEQ ID NO: 52554 - DNA, 20 bp, human
gcgaaagtccgagagctctg

SEQ ID NO: 52555 - DNA, 20 bp, human
gcgaccgccccggccccaga

SEQ ID NO: 52556 - DNA, 20 bp, human
ggcgggtcagcggcacggaa

SEQ ID NO: 52557 - DNA, 20 bp, human
gggggcggaagcacgatctc

SEQ ID NO: 52558 - DNA, 20 bp, human
gctacaatgcaggagctcag

SEQ ID NO: 52559 - DNA, 20 bp, human
ggtaagttgaagcgggtcag

SEQ ID NO: 52560 - DNA, 20 bp, human
ggagctcagaggacttcgga

SEQ ID NO: 52561 - DNA, 20 bp, human
ggacgagtagcccaagacgt

SEQ ID NO: 52562 - DNA, 20 bp, human
gggcaaagaacggctgaaag

SEQ ID NO: 52563 - DNA, 20 bp, human
gcgcttcggaagccttggga

SEQ ID NO: 52564 - DNA, 20 bp, human
gccgggcagaaaggcgacag

SEQ ID NO: 52565 - DNA, 20 bp, human
gcggaagggttgctccaggt

SEQ ID NO: 52566 - DNA, 20 bp, human
gcagctacaacccttggatt

SEQ ID NO: 52567 - DNA, 20 bp, human
gtctttcagccccaatccaa

SEQ ID NO: 52568 - DNA, 20 bp, human
gttcaaaaagagaaactgtt

SEQ ID NO: 52569 - DNA, 20 bp, human
ggtatgattgaccccagatg

SEQ ID NO: 52570 - DNA, 20 bp, human
gaaagagaaactgttgggag

SEQ ID NO: 52571 - DNA, 20 bp, human
gccagatgcggctgcctgag

SEQ ID NO: 52572 - DNA, 20 bp, human
gctggagcatggcccgggca

SEQ ID NO: 52573 - DNA, 20 bp, human
gtgagcggaggcctcagccc

SEQ ID NO: 52574 - DNA, 20 bp, human
gggtgtcaggtatttcttac

SEQ ID NO: 52575 - DNA, 20 bp, human
gtggaggacaacagcacaac

SEQ ID NO: 52576 - DNA, 20 bp, human
ggcgggagcgcaaggctcca

SEQ ID NO: 52577 - DNA, 20 bp, human
gctccggacgcagccaggtg

SEQ ID NO: 52578 - DNA, 20 bp, human
gggggtgcctgcaaagacat

SEQ ID NO: 52579 - DNA, 20 bp, human
gctcacacccatacacgcgg

SEQ ID NO: 52580 - DNA, 20 bp, human
ggcctcggccaggcttgcca

SEQ ID NO: 52581 - DNA, 20 bp, human
gagcagggaggaaagcccgt

SEQ ID NO: 52582 - DNA, 20 bp, human
gcgtccagcttcatccgcag

SEQ ID NO: 52583 - DNA, 20 bp, human
gcaggcacccccgcgtgtat

SEQ ID NO: 52584 - DNA, 20 bp, human
gctcctcctgagcccccctc

SEQ ID NO: 52585 - DNA, 20 bp, human
gtcctgagcccccctcggga

SEQ ID NO: 52586 - DNA, 20 bp, human
gccctgcacggctgcaaggg

SEQ ID NO: 52587 - DNA, 20 bp, human
gtggccctgcacggctgcaa

SEQ ID NO: 52588 - DNA, 20 bp, human
gcgcctggaggcacctcctg

SEQ ID NO: 52589 - DNA, 20 bp, human
gaggcccactggccgcctgg

SEQ ID NO: 52590 - DNA, 20 bp, human
gaggctcctgtggacaggcc

SEQ ID NO: 52591 - DNA, 20 bp, human
ggctccccccgggcgaggaa

SEQ ID NO: 52592 - DNA, 20 bp, human
gtcaggggaagggcgactgg

SEQ ID NO: 52593 - DNA, 20 bp, human
gcacggtcagcgggagtgag

SEQ ID NO: 52594 - DNA, 20 bp, human
gtggccaaacgcctgctagt

SEQ ID NO: 52595 - DNA, 20 bp, human
ggcagcatcaggtatggcag

SEQ ID NO: 52596 - DNA, 20 bp, human
gccgcactcaccgccggatc

SEQ ID NO: 52597 - DNA, 20 bp, human
gccgcggggcccacgaggga

SEQ ID NO: 52598 - DNA, 20 bp, human
ggggaccgcggggcccacga

SEQ ID NO: 52599 - DNA, 20 bp, human
gcggtgagtgcggagcgagc

SEQ ID NO: 52600 - DNA, 20 bp, human
gtcgcgccgggtcggacgag

SEQ ID NO: 52601 - DNA, 20 bp, human
gcctctgcgccctccctcgt

SEQ ID NO: 52602 - DNA, 20 bp, human
gcgcggcccctcgtccgacc

SEQ ID NO: 52603 - DNA, 20 bp, human
gcgggccgggccgggagaat

SEQ ID NO: 52604 - DNA, 20 bp, human
gacccctcgcggcgggagca

SEQ ID NO: 52605 - DNA, 20 bp, human
gagccagcagcgcggctggg

SEQ ID NO: 52606 - DNA, 20 bp, human
gccaagtctggaacccacgg

SEQ ID NO: 52607 - DNA, 20 bp, human
gcctgagaaaggggtgataa

SEQ ID NO: 52608 - DNA, 20 bp, human
gacttgggataagtaaacag

SEQ ID NO: 52609 - DNA, 20 bp, human
gcagggggcggaccagggaa

SEQ ID NO: 52610 - DNA, 20 bp, human
gatcccaagtctggaaccca

SEQ ID NO: 52611 - DNA, 20 bp, human
ggagtagggcaggagaaact

SEQ ID NO: 52612 - DNA, 20 bp, human
ggtgggtcgcttatagggag

SEQ ID NO: 52613 - DNA, 20 bp, human
gccacctggcctgggtccgt

SEQ ID NO: 52614 - DNA, 20 bp, human
gatagggaggggagtagagt

SEQ ID NO: 52615 - DNA, 20 bp, human
ggggtgataagggcatgtga

SEQ ID NO: 52616 - DNA, 20 bp, human
ggggctgggcccggaaacac

SEQ ID NO: 52617 - DNA, 20 bp, human
gttcaagcactggagacgca

SEQ ID NO: 52618 - DNA, 20 bp, human
gagggaccgacttcaagcac

SEQ ID NO: 52619 - DNA, 20 bp, human
gggcaggagttaggcgactg

SEQ ID NO: 52620 - DNA, 20 bp, human
gtcccgggcgcacacggaaa

SEQ ID NO: 52621 - DNA, 20 bp, human
gcggctgcagtcctacctct

SEQ ID NO: 52622 - DNA, 20 bp, human
gccgctggtgacctagattg

SEQ ID NO: 52623 - DNA, 20 bp, human
gaaacacgggtagttccaag

SEQ ID NO: 52624 - DNA, 20 bp, human
gacgggtagttccaagaggt

SEQ ID NO: 52625 - DNA, 20 bp, human
ggcggccccaacggatcccc

SEQ ID NO: 52626 - DNA, 20 bp, human
gccgcgcgagctagacgtcc

SEQ ID NO: 52627 - DNA, 20 bp, human
gacggtgtgagcgcccgacg

SEQ ID NO: 52628 - DNA, 20 bp, human
gcttcggccgggagagtctg

SEQ ID NO: 52629 - DNA, 20 bp, human
gggcggcgcagctgatctca

SEQ ID NO: 52630 - DNA, 20 bp, human
gcggagtcccgagctagccc

SEQ ID NO: 52631 - DNA, 20 bp, human
gaggagacgcgtgggacacc

SEQ ID NO: 52632 - DNA, 20 bp, human
gggcgctcacaccgtgcggg

SEQ ID NO: 52633 - DNA, 20 bp, human
gctcccgcggtcccggtcgg

SEQ ID NO: 52634 - DNA, 20 bp, human
gccgggaccgcgggaggaac

SEQ ID NO: 52635 - DNA, 20 bp, human
gcaaccgcgcaccggcgcac

SEQ ID NO: 52636 - DNA, 20 bp, human
gggaggagcgcagggcatac

SEQ ID NO: 52637 - DNA, 20 bp, human
gccgctgtcattggccatgg

SEQ ID NO: 52638 - DNA, 20 bp, human
gtgcggcggccgagcaggag

SEQ ID NO: 52639 - DNA, 20 bp, human
gcgctaccctcgcctcaggg

SEQ ID NO: 52640 - DNA, 20 bp, human
gggagcttaggactcggaag

SEQ ID NO: 52641 - DNA, 20 bp, human
ggtagaaggagctgcggcag

SEQ ID NO: 52642 - DNA, 20 bp, human
gtgagagaatagggcctgtg

SEQ ID NO: 52643 - DNA, 20 bp, human
gcacgtacaccacggccccg

SEQ ID NO: 52644 - DNA, 20 bp, human
ggtgcggcgaatggcaacct

SEQ ID NO: 52645 - DNA, 20 bp, human
gcggcgctgcgccggagctt

SEQ ID NO: 52646 - DNA, 20 bp, human
ggggcggctggcacaaacgg

SEQ ID NO: 52647 - DNA, 20 bp, human
gcggaggaaaaagctcggtg

SEQ ID NO: 52648 - DNA, 20 bp, human
ggcagggcggctggcacaaa

SEQ ID NO: 52649 - DNA, 20 bp, human
ggagacaggacgagagataa

SEQ ID NO: 52650 - DNA, 20 bp, human
gtgagcgcagtaggcgacag

SEQ ID NO: 52651 - DNA, 20 bp, human
gataaaggtgcccccatcca

SEQ ID NO: 52652 - DNA, 20 bp, human
ggtccgcggcgacagaggaa

SEQ ID NO: 52653 - DNA, 20 bp, human
gagagggtccgcggcgacag

SEQ ID NO: 52654 - DNA, 20 bp, human
gcgcgctgtgcggcgcaggg

SEQ ID NO: 52655 - DNA, 20 bp, human
gacagaggaaaggacggagg

SEQ ID NO: 52656 - DNA, 20 bp, human
gggctgtagccggagtggag

SEQ ID NO: 52657 - DNA, 20 bp, human
gcagccccgccccttcactc

SEQ ID NO: 52658 - DNA, 20 bp, human
gccgggcccggggagtagga

SEQ ID NO: 52659 - DNA, 20 bp, human
ggcggggctgactgcatgaa

SEQ ID NO: 52660 - DNA, 20 bp, human
ggggccttaatggatctggg

SEQ ID NO: 52661 - DNA, 20 bp, human
gatggaagctcgggaccctg

SEQ ID NO: 52662 - DNA, 20 bp, human
gggctagagggaacactgaa

SEQ ID NO: 52663 - DNA, 20 bp, human
ggtggagcggctgccagccg

SEQ ID NO: 52664 - DNA, 20 bp, human
gaaggagccggggctgtagc

SEQ ID NO: 52665 - DNA, 20 bp, human
gtgagggagctggtcctgag

SEQ ID NO: 52666 - DNA, 20 bp, human
gtgcggcgcaaggagtcgga

SEQ ID NO: 52667 - DNA, 20 bp, human
ggcagtgcggcgcaaggagt

SEQ ID NO: 52668 - DNA, 20 bp, human
gactggcccggcgagcagtg

SEQ ID NO: 52669 - DNA, 20 bp, human
gcagggcacgatgtactcca

SEQ ID NO: 52670 - DNA, 20 bp, human
gcggagtctggccgcagtcg

SEQ ID NO: 52671 - DNA, 20 bp, human
ggacaacttcctgggcgagg

SEQ ID NO: 52672 - DNA, 20 bp, human
ggtggcttcccatccccaaa

SEQ ID NO: 52673 - DNA, 20 bp, human
gtgccctgtctgcacgaggt

SEQ ID NO: 52674 - DNA, 20 bp, human
ggctacctggacaacttcct

SEQ ID NO: 52675 - DNA, 20 bp, human
gcccggggttcagaaacctg

SEQ ID NO: 52676 - DNA, 20 bp, human
gtggctgcggcggcggatgg

SEQ ID NO: 52677 - DNA, 20 bp, human
gatcccagcgcgcagaactt

SEQ ID NO: 52678 - DNA, 20 bp, human
gtagggtagttgtccatggt

SEQ ID NO: 52679 - DNA, 20 bp, human
gccggcggcgccgaggaact

SEQ ID NO: 52680 - DNA, 20 bp, human
gttgctgccgctgccctctg

SEQ ID NO: 52681 - DNA, 20 bp, human
ggtcctgcggcggcggaagc

SEQ ID NO: 52682 - DNA, 20 bp, human
gtcaaatagaggcggatccg

SEQ ID NO: 52683 - DNA, 20 bp, human
gggctggagagctggtgtcg

SEQ ID NO: 52684 - DNA, 20 bp, human
ggacaactaccctaagctgg

SEQ ID NO: 52685 - DNA, 20 bp, human
gagtgaggaaaggatccgaa

SEQ ID NO: 52686 - DNA, 20 bp, human
ggcaaggcgcatcacacaaa

SEQ ID NO: 52687 - DNA, 20 bp, human
gtatacaccacatatcccat

SEQ ID NO: 52688 - DNA, 20 bp, human
gtcacctctagccttaaggg

SEQ ID NO: 52689 - DNA, 20 bp, human
gacatgtcaagccatcagca

SEQ ID NO: 52690 - DNA, 20 bp, human
gctgccccccttaaggctag

SEQ ID NO: 52691 - DNA, 20 bp, human
gttgtagttacctactgagt

SEQ ID NO: 52692 - DNA, 20 bp, human
gaaatcgccgcctactcagt

SEQ ID NO: 52693 - DNA, 20 bp, human
ggtgtgatgcgccttgctga

SEQ ID NO: 52694 - DNA, 20 bp, human
gtagttacctactgagtagg

SEQ ID NO: 52695 - DNA, 20 bp, human
gcttaaacaaagtgactgtt

SEQ ID NO: 52696 - DNA, 20 bp, human
gcagcagccggaacacagac

SEQ ID NO: 52697 - DNA, 20 bp, human
gtggcggcgaggtcctccac

SEQ ID NO: 52698 - DNA, 20 bp, human
gtctgacaacatctacccgg

SEQ ID NO: 52699 - DNA, 20 bp, human
gaagatggtcaccgacgtgg

SEQ ID NO: 52700 - DNA, 20 bp, human
gccgggcctgcgaagacacg

SEQ ID NO: 52701 - DNA, 20 bp, human
gtcaaaggggcctcccagtt

SEQ ID NO: 52702 - DNA, 20 bp, human
gggaaagatggtcaccgacg

SEQ ID NO: 52703 - DNA, 20 bp, human
ggaggacctcgccgccacgt

SEQ ID NO: 52704 - DNA, 20 bp, human
gtttgaccagatgaacggag

SEQ ID NO: 52705 - DNA, 20 bp, human
gaagacacgcggcttacctc

SEQ ID NO: 52706 - DNA, 20 bp, human
gcagtgagcttgctaggaag

SEQ ID NO: 52707 - DNA, 20 bp, human
ggcatccgagaggcgatccg

SEQ ID NO: 52708 - DNA, 20 bp, human
gcaggcaagcggcatccgag

SEQ ID NO: 52709 - DNA, 20 bp, human
ggcgagagggaaagttcggg

SEQ ID NO: 52710 - DNA, 20 bp, human
gaagctgcgttaggagcgag

SEQ ID NO: 52711 - DNA, 20 bp, human
ggaggcgatccgtggtgcag

SEQ ID NO: 52712 - DNA, 20 bp, human
ggcgcgctcaacctcttctc

SEQ ID NO: 52713 - DNA, 20 bp, human
gagcttgctaggaagcggcg

SEQ ID NO: 52714 - DNA, 20 bp, human
gagctcgggagtgctatgac

SEQ ID NO: 52715 - DNA, 20 bp, human
ggtcgctgctgccggagaag

SEQ ID NO: 52716 - DNA, 20 bp, human
gaggggtgctcagacgacga

SEQ ID NO: 52717 - DNA, 20 bp, human
gaggtaaggagggcgagcag

SEQ ID NO: 52718 - DNA, 20 bp, human
ggcccggcagcgctttggag

SEQ ID NO: 52719 - DNA, 20 bp, human
gctgagaaccaggagggact

SEQ ID NO: 52720 - DNA, 20 bp, human
gacctctgggaaaggagtcg

SEQ ID NO: 52721 - DNA, 20 bp, human
gattggagctatgagaatag

SEQ ID NO: 52722 - DNA, 20 bp, human
gcggccaccggctaccctgg

SEQ ID NO: 52723 - DNA, 20 bp, human
gtcggcgcaacagccttcag

SEQ ID NO: 52724 - DNA, 20 bp, human
gtgggaagcttaggagtcct

SEQ ID NO: 52725 - DNA, 20 bp, human
ggacttgacgaggagcgcgt

SEQ ID NO: 52726 - DNA, 20 bp, human
gctcacactaaccctaccca

SEQ ID NO: 52727 - DNA, 20 bp, human
ggccagactcagcccgacag

SEQ ID NO: 52728 - DNA, 20 bp, human
gtggcggaggagaaaggcgg

SEQ ID NO: 52729 - DNA, 20 bp, human
ggctctggcagggcttggta

SEQ ID NO: 52730 - DNA, 20 bp, human
gccccagcggagacaggcgg

SEQ ID NO: 52731 - DNA, 20 bp, human
gagcccgacagcgggattag

SEQ ID NO: 52732 - DNA, 20 bp, human
gggttgagctgccgtgggta

SEQ ID NO: 52733 - DNA, 20 bp, human
gggaggagcggctatgagaa

SEQ ID NO: 52734 - DNA, 20 bp, human
ggtggaggttgagctgccgt

SEQ ID NO: 52735 - DNA, 20 bp, human
ggttagtgtgagaggtgcgg

SEQ ID NO: 52736 - DNA, 20 bp, human
ggtgtcccaggctccgaccc

SEQ ID NO: 52737 - DNA, 20 bp, human
gtcgccacccgacgcgcccc

SEQ ID NO: 52738 - DNA, 20 bp, human
gagccccgggcctgagaagt

SEQ ID NO: 52739 - DNA, 20 bp, human
ggcccgggcagcgctctcta

SEQ ID NO: 52740 - DNA, 20 bp, human
gcgggcagcgctctctaggg

SEQ ID NO: 52741 - DNA, 20 bp, human
ggagcctgggaacggaacca

SEQ ID NO: 52742 - DNA, 20 bp, human
ggaggtcccagcaagttcgg

SEQ ID NO: 52743 - DNA, 20 bp, human
ggagtctgcggggtcgcctg

SEQ ID NO: 52744 - DNA, 20 bp, human
gggaaccagggcccaagctg

SEQ ID NO: 52745 - DNA, 20 bp, human
gtcgcctggggcgcgtcggg

SEQ ID NO: 52746 - DNA, 20 bp, human
gacggcgatgaaggagtcgg

SEQ ID NO: 52747 - DNA, 20 bp, human
gcggcagagggcgcttcgac

SEQ ID NO: 52748 - DNA, 20 bp, human
gtcatgcacggccccactga

SEQ ID NO: 52749 - DNA, 20 bp, human
gatgacggcgatgaaggagt

SEQ ID NO: 52750 - DNA, 20 bp, human
ggccccctggagtgatgggt

SEQ ID NO: 52751 - DNA, 20 bp, human
gcgatgaaggagtcggtggt

SEQ ID NO: 52752 - DNA, 20 bp, human
gggagcgacccacactgcgc

SEQ ID NO: 52753 - DNA, 20 bp, human
gccggcaccacgccctcagt

SEQ ID NO: 52754 - DNA, 20 bp, human
ggccccacgaggagcaccat

SEQ ID NO: 52755 - DNA, 20 bp, human
gtgatcgagcaggacttccc

SEQ ID NO: 52756 - DNA, 20 bp, human
gcggctcagacggctccgga

SEQ ID NO: 52757 - DNA, 20 bp, human
gggtcaggcatgaggaacca

SEQ ID NO: 52758 - DNA, 20 bp, human
gctgtgctcgcggtcccgtc

SEQ ID NO: 52759 - DNA, 20 bp, human
gctagcccaggggataggga

SEQ ID NO: 52760 - DNA, 20 bp, human
ggagagggtggggtcccgcg

SEQ ID NO: 52761 - DNA, 20 bp, human
ggacatggttacagactggg

SEQ ID NO: 52762 - DNA, 20 bp, human
gcgaggatccgaagcgcccg

SEQ ID NO: 52763 - DNA, 20 bp, human
gcacccggctcagacggctc

SEQ ID NO: 52764 - DNA, 20 bp, human
ggggagaccgttacagactg

SEQ ID NO: 52765 - DNA, 20 bp, human
gtcttctagcccaggggata

SEQ ID NO: 52766 - DNA, 20 bp, human
gccggaccgaggcggctcag

SEQ ID NO: 52767 - DNA, 20 bp, human
gcgctcctgccggaccgagg

SEQ ID NO: 52768 - DNA, 20 bp, human
gtacgggacatcttcccctg

SEQ ID NO: 52769 - DNA, 20 bp, human
gctccgctcctgccggaccg

SEQ ID NO: 52770 - DNA, 20 bp, human
gggggaagactcctcctcag

SEQ ID NO: 52771 - DNA, 20 bp, human
gcccagccagctgaacatcg

SEQ ID NO: 52772 - DNA, 20 bp, human
ggagggaggataaataatct

SEQ ID NO: 52773 - DNA, 20 bp, human
gcggatgcagagctgtccgc

SEQ ID NO: 52774 - DNA, 20 bp, human
gtgagccccgcgcttgggtg

SEQ ID NO: 52775 - DNA, 20 bp, human
ggcagagctgtccgcgggct

SEQ ID NO: 52776 - DNA, 20 bp, human
gggcccaccagcaggatcat

SEQ ID NO: 52777 - DNA, 20 bp, human
gcgactgcggcgcacacgtg

SEQ ID NO: 52778 - DNA, 20 bp, human
gagcggtacgcctcctccag

SEQ ID NO: 52779 - DNA, 20 bp, human
gagccggggagagtcgaacc

SEQ ID NO: 52780 - DNA, 20 bp, human
gcgccagtccacgctcggat

SEQ ID NO: 52781 - DNA, 20 bp, human
gctccgggttcgactctccc

SEQ ID NO: 52782 - DNA, 20 bp, human
gggcggctcagtgcgagccg

SEQ ID NO: 52783 - DNA, 20 bp, human
ggcgagcgcgcgtgacgtag

SEQ ID NO: 52784 - DNA, 20 bp, human
ggctggccgccgcccgagga

SEQ ID NO: 52785 - DNA, 20 bp, human
gtccgaaccgcaaggaagga

SEQ ID NO: 52786 - DNA, 20 bp, human
gtatagggatggggcaccac

SEQ ID NO: 52787 - DNA, 20 bp, human
gcaggcatagggaaacgagg

SEQ ID NO: 52788 - DNA, 20 bp, human
ggctgtggctgttggagggg

SEQ ID NO: 52789 - DNA, 20 bp, human
gaccagctcctatagggatg

SEQ ID NO: 52790 - DNA, 20 bp, human
gccagaagaattcaacccag

SEQ ID NO: 52791 - DNA, 20 bp, human
gataggcagctagagatagg

SEQ ID NO: 52792 - DNA, 20 bp, human
gtcagacttgataacacccg

SEQ ID NO: 52793 - DNA, 20 bp, human
gaatctcaccagctcctata

SEQ ID NO: 52794 - DNA, 20 bp, human
gacccaggcatagggaaacg

SEQ ID NO: 52795 - DNA, 20 bp, human
ggtggcaaaaccattcccct

SEQ ID NO: 52796 - DNA, 20 bp, human
gctcggtgatagaggaaaca

SEQ ID NO: 52797 - DNA, 20 bp, human
gaaacatggccgagtatacg

SEQ ID NO: 52798 - DNA, 20 bp, human
ggaggtgccctcggtgatag

SEQ ID NO: 52799 - DNA, 20 bp, human
gagggctccgcatgaaggac

SEQ ID NO: 52800 - DNA, 20 bp, human
gacgcggctgcacaacgcct

SEQ ID NO: 52801 - DNA, 20 bp, human
gaagttgcaagtaagcagga

SEQ ID NO: 52802 - DNA, 20 bp, human
ggttgaccggcgggtttcgg

SEQ ID NO: 52803 - DNA, 20 bp, human
ggcaggagggctccgcatga

SEQ ID NO: 52804 - DNA, 20 bp, human
gccgcatgaaggacaggtcg

SEQ ID NO: 52805 - DNA, 20 bp, human
ggaccggcgggtttcggagg

SEQ ID NO: 52806 - DNA, 20 bp, human
gctgctcacctcggcatcgg

SEQ ID NO: 52807 - DNA, 20 bp, human
gccgctgctcacctcggcat

SEQ ID NO: 52808 - DNA, 20 bp, human
ggcgaaggaagagctccgag

SEQ ID NO: 52809 - DNA, 20 bp, human
gatggccgccgccgatgccg

SEQ ID NO: 52810 - DNA, 20 bp, human
gcgcccgcaagccggatctg

SEQ ID NO: 52811 - DNA, 20 bp, human
gctcacctcggcatcggcgg

SEQ ID NO: 52812 - DNA, 20 bp, human
gtcggccggcgctccaaagt

SEQ ID NO: 52813 - DNA, 20 bp, human
gaggacaaaaggaaaagtag

SEQ ID NO: 52814 - DNA, 20 bp, human
ggcccggcctcggcctgagg

SEQ ID NO: 52815 - DNA, 20 bp, human
gaggaagagctccgagagga

SEQ ID NO: 52816 - DNA, 20 bp, human
ggcagccgaggccgcggaag

SEQ ID NO: 52817 - DNA, 20 bp, human
ggcgcccgtcgcccactcag

SEQ ID NO: 52818 - DNA, 20 bp, human
gcggccgccgaggtgcggaa

SEQ ID NO: 52819 - DNA, 20 bp, human
gggtagaccccgcatctctg

SEQ ID NO: 52820 - DNA, 20 bp, human
gccagcgcaagcggcgatgg

SEQ ID NO: 52821 - DNA, 20 bp, human
gccgccggctgcccctgagt

SEQ ID NO: 52822 - DNA, 20 bp, human
gtctctggggccgagagaag

SEQ ID NO: 52823 - DNA, 20 bp, human
gctccccttccgcacctcgg

SEQ ID NO: 52824 - DNA, 20 bp, human
gagcggcgcgtgcagccggg

SEQ ID NO: 52825 - DNA, 20 bp, human
gagatgcggggtctaccgag

SEQ ID NO: 52826 - DNA, 20 bp, human
gcggagctgtgggtaggtgc

SEQ ID NO: 52827 - DNA, 20 bp, human
gagaaccagccggcaccacg

SEQ ID NO: 52828 - DNA, 20 bp, human
gcggggcgcttccagggccg

SEQ ID NO: 52829 - DNA, 20 bp, human
ggcgagcgcgaagaaccagc

SEQ ID NO: 52830 - DNA, 20 bp, human
gacggggccgctgggaagtc

SEQ ID NO: 52831 - DNA, 20 bp, human
gccacagctcctaggcaatt

SEQ ID NO: 52832 - DNA, 20 bp, human
gcacaactgtgcacgaggta

SEQ ID NO: 52833 - DNA, 20 bp, human
ggcacgctccgggtcacaca

SEQ ID NO: 52834 - DNA, 20 bp, human
ggggccgctgcgcccgcact

SEQ ID NO: 52835 - DNA, 20 bp, human
gctggcctgcggtgggctag

SEQ ID NO: 52836 - DNA, 20 bp, human
gggggcccaacagctcgagg

SEQ ID NO: 52837 - DNA, 20 bp, human
ggactacgactatcccgaag

SEQ ID NO: 52838 - DNA, 20 bp, human
gctcgaggaggaaggcccaa

SEQ ID NO: 52839 - DNA, 20 bp, human
gacttcgagagcgaggacga

SEQ ID NO: 52840 - DNA, 20 bp, human
gttgtcggcttcttcaagag

SEQ ID NO: 52841 - DNA, 20 bp, human
gtggcgcgccaagtaggagg

SEQ ID NO: 52842 - DNA, 20 bp, human
ggctggaagctttttcctag

SEQ ID NO: 52843 - DNA, 20 bp, human
gtgagcggtttgcacaatgt

SEQ ID NO: 52844 - DNA, 20 bp, human
ggctaacgggcccaacgctg

SEQ ID NO: 52845 - DNA, 20 bp, human
gctttttcctagaggttgag

SEQ ID NO: 52846 - DNA, 20 bp, human
gtggacgaagagggtcccga

SEQ ID NO: 52847 - DNA, 20 bp, human
gggtggcggagacggagata

SEQ ID NO: 52848 - DNA, 20 bp, human
gtcagaccgtggggtcaact

SEQ ID NO: 52849 - DNA, 20 bp, human
gtggacagagcgatgcccgg

SEQ ID NO: 52850 - DNA, 20 bp, human
gcttggacatctcagaccgt

SEQ ID NO: 52851 - DNA, 20 bp, human
gagcagccgagttgacccca

SEQ ID NO: 52852 - DNA, 20 bp, human
gggtccagacacgggaacgg

SEQ ID NO: 52853 - DNA, 20 bp, human
gggggagccagtggacgaag

SEQ ID NO: 52854 - DNA, 20 bp, human
ggcggccagggaagcccgga

SEQ ID NO: 52855 - DNA, 20 bp, human
gaactggacagagcgatgcc

SEQ ID NO: 52856 - DNA, 20 bp, human
ggactatggcggagccgact

SEQ ID NO: 52857 - DNA, 20 bp, human
gcatagtcccagcgtttcta

SEQ ID NO: 52858 - DNA, 20 bp, human
gacatctccaacagcccagt

SEQ ID NO: 52859 - DNA, 20 bp, human
ggtggaaggctgcaaggcga

SEQ ID NO: 52860 - DNA, 20 bp, human
gtgggacactgctatctccg

SEQ ID NO: 52861 - DNA, 20 bp, human
gagaggactgagggcctcgg

SEQ ID NO: 52862 - DNA, 20 bp, human
gatagcagtgtcccacaggt

SEQ ID NO: 52863 - DNA, 20 bp, human
gcagcgaagtccatctgcgg

SEQ ID NO: 52864 - DNA, 20 bp, human
gcagcagcgaagtccatctg

SEQ ID NO: 52865 - DNA, 20 bp, human
ggccttccacaaacagcctg

SEQ ID NO: 52866 - DNA, 20 bp, human
gccggccacgggtatctctg

SEQ ID NO: 52867 - DNA, 20 bp, human
gcaaccaacatgccggccac

SEQ ID NO: 52868 - DNA, 20 bp, human
gcctcccagcgtgtggaaag

SEQ ID NO: 52869 - DNA, 20 bp, human
gtacgcggcgaagtaggcgg

SEQ ID NO: 52870 - DNA, 20 bp, human
ggacgacctcagctctgggg

SEQ ID NO: 52871 - DNA, 20 bp, human
gatacccgtggccggcatgt

SEQ ID NO: 52872 - DNA, 20 bp, human
gacgccatcaaagaggacgt

SEQ ID NO: 52873 - DNA, 20 bp, human
ggttacctcagagatacccg

SEQ ID NO: 52874 - DNA, 20 bp, human
gtaacggccctcccagcgtg

SEQ ID NO: 52875 - DNA, 20 bp, human
gtcggctcacgccatcaaag

SEQ ID NO: 52876 - DNA, 20 bp, human
gagacgccgggcccgcccaa

SEQ ID NO: 52877 - DNA, 20 bp, human
gggaacgtcgggaagcgagg

SEQ ID NO: 52878 - DNA, 20 bp, human
gggcgggcccggcgtctcag

SEQ ID NO: 52879 - DNA, 20 bp, human
ggacgcaatggtgacgggag

SEQ ID NO: 52880 - DNA, 20 bp, human
gcgcgaccggaaggagcagg

SEQ ID NO: 52881 - DNA, 20 bp, human
gcaagcgggtgcaccaatgg

SEQ ID NO: 52882 - DNA, 20 bp, human
ggctgctgaatcctcggcgg

SEQ ID NO: 52883 - DNA, 20 bp, human
gggaagcgagggggctcaag

SEQ ID NO: 52884 - DNA, 20 bp, human
gaggcggtaggtcagccctt

SEQ ID NO: 52885 - DNA, 20 bp, human
gccggatccgtgacaacggg

SEQ ID NO: 52886 - DNA, 20 bp, human
gtcctcgcagttggactggt

SEQ ID NO: 52887 - DNA, 20 bp, human
gcagcgtccagcctagacgg

SEQ ID NO: 52888 - DNA, 20 bp, human
gcgagacagcgccggaagta

SEQ ID NO: 52889 - DNA, 20 bp, human
gctacagccggagacaaact

SEQ ID NO: 52890 - DNA, 20 bp, human
gcagccggagacaaactagg

SEQ ID NO: 52891 - DNA, 20 bp, human
ggcactcctcgcagttggac

SEQ ID NO: 52892 - DNA, 20 bp, human
gcagcgttcctgggagccga

SEQ ID NO: 52893 - DNA, 20 bp, human
gtcccaccagtccaactgcg

SEQ ID NO: 52894 - DNA, 20 bp, human
ggagggccagagactaagtg

SEQ ID NO: 52895 - DNA, 20 bp, human
gagttggactggtgggaact

SEQ ID NO: 52896 - DNA, 20 bp, human
gcgagcagagccgtggtccg

SEQ ID NO: 52897 - DNA, 20 bp, human
ggtaatgccgcccggacccc

SEQ ID NO: 52898 - DNA, 20 bp, human
ggggcccagccggcgacggg

SEQ ID NO: 52899 - DNA, 20 bp, human
ggcctcctgcgggagaatgt

SEQ ID NO: 52900 - DNA, 20 bp, human
gaaagcgacgcaaagagtcg

SEQ ID NO: 52901 - DNA, 20 bp, human
ggcgactctgagctcgggag

SEQ ID NO: 52902 - DNA, 20 bp, human
gctgggtgacctgcaatcta

SEQ ID NO: 52903 - DNA, 20 bp, human
gaagccagagaggacgcgag

SEQ ID NO: 52904 - DNA, 20 bp, human
gcaccgagcagcggtcagtc

SEQ ID NO: 52905 - DNA, 20 bp, human
ggagctcagagtcgcgtgtg

SEQ ID NO: 52906 - DNA, 20 bp, human
ggtgggtgcgcagaagaggc

SEQ ID NO: 52907 - DNA, 20 bp, human
gcgccagacggaaaacgtat

SEQ ID NO: 52908 - DNA, 20 bp, human
gagccgaggtatagtcccag

SEQ ID NO: 52909 - DNA, 20 bp, human
gagtcggaagaggtctcacg

SEQ ID NO: 52910 - DNA, 20 bp, human
ggacggaaaacgtataggta

SEQ ID NO: 52911 - DNA, 20 bp, human
gcacagtgctggggtcgcag

SEQ ID NO: 52912 - DNA, 20 bp, human
gagagtagtaaccgccagaa

SEQ ID NO: 52913 - DNA, 20 bp, human
gttgagggaccttaaccgga

SEQ ID NO: 52914 - DNA, 20 bp, human
ggcagtgactgttctaacgg

SEQ ID NO: 52915 - DNA, 20 bp, human
ggaaaacgtataggtaggga

SEQ ID NO: 52916 - DNA, 20 bp, human
gggcgagggcgcgagagaag

SEQ ID NO: 52917 - DNA, 20 bp, human
gaggcaggaagaggcgaagg

SEQ ID NO: 52918 - DNA, 20 bp, human
gcgagacaaagccccactag

SEQ ID NO: 52919 - DNA, 20 bp, human
gccgcggccggggctccgag

SEQ ID NO: 52920 - DNA, 20 bp, human
gactagtgtgaggccggtga

SEQ ID NO: 52921 - DNA, 20 bp, human
ggcagaaagggggcccctag

SEQ ID NO: 52922 - DNA, 20 bp, human
gatgcgcgccgggcaaggga

SEQ ID NO: 52923 - DNA, 20 bp, human
gggttgggattaggctggag

SEQ ID NO: 52924 - DNA, 20 bp, human
ggacatgcgatactagtgtg

SEQ ID NO: 52925 - DNA, 20 bp, human
gtcggggaaggggtcgccag

SEQ ID NO: 52926 - DNA, 20 bp, human
gcgtccacgccgctcttgac

SEQ ID NO: 52927 - DNA, 20 bp, human
ggaatacgaaagcccagagg

SEQ ID NO: 52928 - DNA, 20 bp, human
gagaactcacctgtcaagag

SEQ ID NO: 52929 - DNA, 20 bp, human
ggtgagttctgaagaagcga

SEQ ID NO: 52930 - DNA, 20 bp, human
gtggtgaactctcacccgag

SEQ ID NO: 52931 - DNA, 20 bp, human
gcgcatgaggagacgtgtag

SEQ ID NO: 52932 - DNA, 20 bp, human
gttctctttccgggacaaca

SEQ ID NO: 52933 - DNA, 20 bp, human
gtcacctgtcaagagcggcg

SEQ ID NO: 52934 - DNA, 20 bp, human
gctcctcgggtagttctcaa

SEQ ID NO: 52935 - DNA, 20 bp, human
gcccggaaagagaaaccgct

SEQ ID NO: 52936 - DNA, 20 bp, human
gcggaggctggttttccgtc

SEQ ID NO: 52937 - DNA, 20 bp, human
ggaccccgaatatgacggtg

SEQ ID NO: 52938 - DNA, 20 bp, human
gtagctgcagcatcggagtg

SEQ ID NO: 52939 - DNA, 20 bp, human
gatcggagtgtggcagtgct

SEQ ID NO: 52940 - DNA, 20 bp, human
gacggcgctagctgcagcat

SEQ ID NO: 52941 - DNA, 20 bp, human
gcgcggccggcgatgcaggg

SEQ ID NO: 52942 - DNA, 20 bp, human
gggtcctcaggcaaacctca

SEQ ID NO: 52943 - DNA, 20 bp, human
ggccgccggttcaaccctgg

SEQ ID NO: 52944 - DNA, 20 bp, human
gggaacagaaatgtaaacaa

SEQ ID NO: 52945 - DNA, 20 bp, human
gcagctagcgccgtccgacc

SEQ ID NO: 52946 - DNA, 20 bp, human
ggccgccggccggagacccg

SEQ ID NO: 52947 - DNA, 20 bp, human
ggcggcggcgcaggtgagca

SEQ ID NO: 52948 - DNA, 20 bp, human
ggaagccgcgggtctccggc

SEQ ID NO: 52949 - DNA, 20 bp, human
gggaagacgaataggcctag

SEQ ID NO: 52950 - DNA, 20 bp, human
gggtctagtggaagacgaat

SEQ ID NO: 52951 - DNA, 20 bp, human
gcccagtgctgacccagccg

SEQ ID NO: 52952 - DNA, 20 bp, human
ggccgcgggtctccggccgg

SEQ ID NO: 52953 - DNA, 20 bp, human
ggcgtccgcgtcctgagctg

SEQ ID NO: 52954 - DNA, 20 bp, human
gagggaaggcggagtccaag

SEQ ID NO: 52955 - DNA, 20 bp, human
ggcctgaaatactcatagac

SEQ ID NO: 52956 - DNA, 20 bp, human
gacagccagccgtgttcccc

SEQ ID NO: 52957 - DNA, 20 bp, human
gcgggctgagacgtggccag

SEQ ID NO: 52958 - DNA, 20 bp, human
gcagaggccgggctgagacg

SEQ ID NO: 52959 - DNA, 20 bp, human
gcgaggctcctgctctcccg

SEQ ID NO: 52960 - DNA, 20 bp, human
gtcagcgacgcgagtaccgg

SEQ ID NO: 52961 - DNA, 20 bp, human
ggctgtccaggccgtcgggg

SEQ ID NO: 52962 - DNA, 20 bp, human
gcaagttgcctcccccgggt

SEQ ID NO: 52963 - DNA, 20 bp, human
gccgcttggagctcccaaga

SEQ ID NO: 52964 - DNA, 20 bp, human
gcgaccgcgcggcaggtgag

SEQ ID NO: 52965 - DNA, 20 bp, human
ggtggccaggggaacacggc

SEQ ID NO: 52966 - DNA, 20 bp, human
gctccagggcctgtagctcg

SEQ ID NO: 52967 - DNA, 20 bp, human
gcagcgctgcgcccaaggca

SEQ ID NO: 52968 - DNA, 20 bp, human
ggcccaccgccgcccaggca

SEQ ID NO: 52969 - DNA, 20 bp, human
gcatggcagcgctgcgccca

SEQ ID NO: 52970 - DNA, 20 bp, human
ggagcatgggtggaacctaa

SEQ ID NO: 52971 - DNA, 20 bp, human
gggcaaggccgccctgcctt

SEQ ID NO: 52972 - DNA, 20 bp, human
gagaagaattcggcctaggt

SEQ ID NO: 52973 - DNA, 20 bp, human
gtggattcctccctcttacc

SEQ ID NO: 52974 - DNA, 20 bp, human
gcaaggactaaagtgagcat

SEQ ID NO: 52975 - DNA, 20 bp, human
gccgccccgcaggctgccgg

SEQ ID NO: 52976 - DNA, 20 bp, human
gtgtcagactggctcgcagg

SEQ ID NO: 52977 - DNA, 20 bp, human
ggtgcgccggaagaggggta

SEQ ID NO: 52978 - DNA, 20 bp, human
gcggaagtgcgccggaagtg

SEQ ID NO: 52979 - DNA, 20 bp, human
ggtgcagcgcgctgtcagac

SEQ ID NO: 52980 - DNA, 20 bp, human
gtcctgctgcggagccccag

SEQ ID NO: 52981 - DNA, 20 bp, human
gccgcccgcgctgtctcgaa

SEQ ID NO: 52982 - DNA, 20 bp, human
gactctggaaacacaaccag

SEQ ID NO: 52983 - DNA, 20 bp, human
gaggacgccatggacgacaa

SEQ ID NO: 52984 - DNA, 20 bp, human
ggtgccagccccctaatctg

SEQ ID NO: 52985 - DNA, 20 bp, human
gtgggaaggagcgtatgtgt

SEQ ID NO: 52986 - DNA, 20 bp, human
gaccaccgctggagcaacgc

SEQ ID NO: 52987 - DNA, 20 bp, human
gtgccgggatccgcagcgaa

SEQ ID NO: 52988 - DNA, 20 bp, human
gtgcccacggtggtctcgga

SEQ ID NO: 52989 - DNA, 20 bp, human
gagccctccgagaccaccgt

SEQ ID NO: 52990 - DNA, 20 bp, human
gaagtgcaaactgtgtggtc

SEQ ID NO: 52991 - DNA, 20 bp, human
gtgccttcagccttcaccgg

SEQ ID NO: 52992 - DNA, 20 bp, human
ggtgtggattccgccggtga

SEQ ID NO: 52993 - DNA, 20 bp, human
gtgggatcgggaacagacag

SEQ ID NO: 52994 - DNA, 20 bp, human
gagattatccgggaggagta

SEQ ID NO: 52995 - DNA, 20 bp, human
gtggcaggtgtggattccgc

SEQ ID NO: 52996 - DNA, 20 bp, human
gagatcgctgggagcggttg

SEQ ID NO: 52997 - DNA, 20 bp, human
gaggcggcgtggagatcgct

SEQ ID NO: 52998 - DNA, 20 bp, human
gccattgggctgtcagtcag

SEQ ID NO: 52999 - DNA, 20 bp, human
ggggtcagccagcttgtgtg

SEQ ID NO: 53000 - DNA, 20 bp, human
gtgtgtccgaagtagaaggg

SEQ ID NO: 53001 - DNA, 20 bp, human
ggagtgagcgagcaccagac

SEQ ID NO: 53002 - DNA, 20 bp, human
gggccgaggtggacccgaag

SEQ ID NO: 53003 - DNA, 20 bp, human
gtgccaggccgcacacaagc

SEQ ID NO: 53004 - DNA, 20 bp, human
gggagcggttgcggcgtgcc

SEQ ID NO: 53005 - DNA, 20 bp, human
ggaggtggacccgaaggggt

SEQ ID NO: 53006 - DNA, 20 bp, human
gtggccgtggctgttcgcga

SEQ ID NO: 53007 - DNA, 20 bp, human
gggcggctccgtgaccacgg

SEQ ID NO: 53008 - DNA, 20 bp, human
gctgagggcgatggctgctg

SEQ ID NO: 53009 - DNA, 20 bp, human
gagccagagagactccggga

SEQ ID NO: 53010 - DNA, 20 bp, human
ggtcggctccgcgtaccagt

SEQ ID NO: 53011 - DNA, 20 bp, human
gtcaccctcgcgaacagcca

SEQ ID NO: 53012 - DNA, 20 bp, human
ggcgtggcgctggaacggag

SEQ ID NO: 53013 - DNA, 20 bp, human
gagccatcgccctcagtcct

SEQ ID NO: 53014 - DNA, 20 bp, human
gcacttaccccaggcccagg

SEQ ID NO: 53015 - DNA, 20 bp, human
ggactcgggatccgggatga

SEQ ID NO: 53016 - DNA, 20 bp, human
gagctgccaccgcacgcagt

SEQ ID NO: 53017 - DNA, 20 bp, human
gccaccagaactgcttgtag

SEQ ID NO: 53018 - DNA, 20 bp, human
gccaggcggcgccactacag

SEQ ID NO: 53019 - DNA, 20 bp, human
gaagatggcggcccctgtag

SEQ ID NO: 53020 - DNA, 20 bp, human
ggactaaccaccacaccagg

SEQ ID NO: 53021 - DNA, 20 bp, human
ggtcgggctaacaagcgcag

SEQ ID NO: 53022 - DNA, 20 bp, human
gcccgactaaccaccacacc

SEQ ID NO: 53023 - DNA, 20 bp, human
ggcgcacgcgagcagccaga

SEQ ID NO: 53024 - DNA, 20 bp, human
gacttgtggtcgccacgaag

SEQ ID NO: 53025 - DNA, 20 bp, human
gatagacgcaggtccttcaa

SEQ ID NO: 53026 - DNA, 20 bp, human
ggccaggccctcagccgtgg

SEQ ID NO: 53027 - DNA, 20 bp, human
ggggaatgtcaagaaagcga

SEQ ID NO: 53028 - DNA, 20 bp, human
gaagggaccccaggaggcaa

SEQ ID NO: 53029 - DNA, 20 bp, human
gcccttgggagagatcggat

SEQ ID NO: 53030 - DNA, 20 bp, human
gagggcccggctggaaacca

SEQ ID NO: 53031 - DNA, 20 bp, human
gtgtcggccaagaatagcga

SEQ ID NO: 53032 - DNA, 20 bp, human
ggaggtgtctggttgttccg

SEQ ID NO: 53033 - DNA, 20 bp, human
gatggctgcccccacggctg

SEQ ID NO: 53034 - DNA, 20 bp, human
ggaacaaccagacacctctt

SEQ ID NO: 53035 - DNA, 20 bp, human
gcgaggggtatgccagggaa

SEQ ID NO: 53036 - DNA, 20 bp, human
gagcgcacgctgaggaggat

SEQ ID NO: 53037 - DNA, 20 bp, human
gagacttgcttccccctcac

SEQ ID NO: 53038 - DNA, 20 bp, human
gagcgaagcgcacgctgagg

SEQ ID NO: 53039 - DNA, 20 bp, human
gggaggatcggcggccggtg

SEQ ID NO: 53040 - DNA, 20 bp, human
ggcgcagggacgggaaaggg

SEQ ID NO: 53041 - DNA, 20 bp, human
gtgagaccgccccatcgtca

SEQ ID NO: 53042 - DNA, 20 bp, human
gggaggttccgcatgcgcgg

SEQ ID NO: 53043 - DNA, 20 bp, human
gtcccgcgcagggacgggaa

SEQ ID NO: 53044 - DNA, 20 bp, human
ggagccggggttaagagtta

SEQ ID NO: 53045 - DNA, 20 bp, human
gcactttcggcatattgtag

SEQ ID NO: 53046 - DNA, 20 bp, human
ggcgcggctgcctcacatgg

SEQ ID NO: 53047 - DNA, 20 bp, human
gcattcgagccccttccggg

SEQ ID NO: 53048 - DNA, 20 bp, human
gcacccagtgaggcgagctg

SEQ ID NO: 53049 - DNA, 20 bp, human
gtgagtcgtcctcccggaag

SEQ ID NO: 53050 - DNA, 20 bp, human
gagccggccgccgccatgtg

SEQ ID NO: 53051 - DNA, 20 bp, human
gccagtgaggcgagctgggg

SEQ ID NO: 53052 - DNA, 20 bp, human
ggcacccccggcacccagtg

SEQ ID NO: 53053 - DNA, 20 bp, human
gattccggaaacgccaacca

SEQ ID NO: 53054 - DNA, 20 bp, human
gcactccagtgtgggagaac

SEQ ID NO: 53055 - DNA, 20 bp, human
ggcggcagtgcccagcagaa

SEQ ID NO: 53056 - DNA, 20 bp, human
gagaagctggagtgactcta

SEQ ID NO: 53057 - DNA, 20 bp, human
gagacgggaaggccgagtag

SEQ ID NO: 53058 - DNA, 20 bp, human
gcgaggcgggtgatgcaacc

SEQ ID NO: 53059 - DNA, 20 bp, human
gccccttcccagacgttcag

SEQ ID NO: 53060 - DNA, 20 bp, human
gtaatgttcccaagattggg

SEQ ID NO: 53061 - DNA, 20 bp, human
gccaggccagtccacgatct

SEQ ID NO: 53062 - DNA, 20 bp, human
ggcctctgaacgtctgggaa

SEQ ID NO: 53063 - DNA, 20 bp, human
gcacgcctgcgcccagatcg

SEQ ID NO: 53064 - DNA, 20 bp, human
gcagagatccccccaatctt

SEQ ID NO: 53065 - DNA, 20 bp, human
gcgtggactggcctgggtac

SEQ ID NO: 53066 - DNA, 20 bp, human
gacgaaggggaaccagcgta

SEQ ID NO: 53067 - DNA, 20 bp, human
gggcgcgtgggaccttacgc

SEQ ID NO: 53068 - DNA, 20 bp, human
gcagccggccagagacggaa

SEQ ID NO: 53069 - DNA, 20 bp, human
gggccgggagaggagacgaa

SEQ ID NO: 53070 - DNA, 20 bp, human
ggcgtcagcgaactctctag

SEQ ID NO: 53071 - DNA, 20 bp, human
gggagctccagtccgggtag

SEQ ID NO: 53072 - DNA, 20 bp, human
gccgggagacagcccctacc

SEQ ID NO: 53073 - DNA, 20 bp, human
gctatcgactggggtctggg

SEQ ID NO: 53074 - DNA, 20 bp, human
gcccggaaccgtcgccccag

SEQ ID NO: 53075 - DNA, 20 bp, human
gggggaaggaaaggcccctg

SEQ ID NO: 53076 - DNA, 20 bp, human
gccaacgctgcctactcgca

SEQ ID NO: 53077 - DNA, 20 bp, human
ggcctactcgcagggctccg

SEQ ID NO: 53078 - DNA, 20 bp, human
ggccgcggagccctgcgagt

SEQ ID NO: 53079 - DNA, 20 bp, human
gcggtgcggcctgggagagt

SEQ ID NO: 53080 - DNA, 20 bp, human
gcccattcgggctttcacag

SEQ ID NO: 53081 - DNA, 20 bp, human
gcaggacgcggagaacgtgg

SEQ ID NO: 53082 - DNA, 20 bp, human
gcggccgctagggaaggact

SEQ ID NO: 53083 - DNA, 20 bp, human
gggacagcgcgggtcacgtg

SEQ ID NO: 53084 - DNA, 20 bp, human
gtgtcccgcgctgaaggcgg

SEQ ID NO: 53085 - DNA, 20 bp, human
gcgagtccaagtgacagaca

SEQ ID NO: 53086 - DNA, 20 bp, human
gcggctatcacagccctcta

SEQ ID NO: 53087 - DNA, 20 bp, human
gtagccggtagccacccacc

SEQ ID NO: 53088 - DNA, 20 bp, human
gatcccttgtgcctggtggg

SEQ ID NO: 53089 - DNA, 20 bp, human
ggtgcctggtgggtggctac

SEQ ID NO: 53090 - DNA, 20 bp, human
gtctatcccttgtgcctggt

SEQ ID NO: 53091 - DNA, 20 bp, human
ggccctgcggtgtgactcgc

SEQ ID NO: 53092 - DNA, 20 bp, human
gcaccgcagggccctgacag

SEQ ID NO: 53093 - DNA, 20 bp, human
gttccgctgtcagggccctg

SEQ ID NO: 53094 - DNA, 20 bp, human
gcccacccggacctcgacct

SEQ ID NO: 53095 - DNA, 20 bp, human
ggcccgcgagtcacaccgca

SEQ ID NO: 53096 - DNA, 20 bp, human
ggccctgcggtgtgactcgc

SEQ ID NO: 53097 - DNA, 20 bp, human
gcaccgcagggccctgacag

SEQ ID NO: 53098 - DNA, 20 bp, human
gttccgctgtcagggccctg

SEQ ID NO: 53099 - DNA, 20 bp, human
ggcggaaacgccgagagaga

SEQ ID NO: 53100 - DNA, 20 bp, human
ggaaacgccgagagagaagg

SEQ ID NO: 53101 - DNA, 20 bp, human
gtgtggaacgcagtgcacat

SEQ ID NO: 53102 - DNA, 20 bp, human
gcccacccggacctcgacct

SEQ ID NO: 53103 - DNA, 20 bp, human
ggcccgcgagtcacaccgca

SEQ ID NO: 53104 - DNA, 20 bp, human
gagagtttgcaggatcggag

SEQ ID NO: 53105 - DNA, 20 bp, human
gaacgcagtgcacatgggag

SEQ ID NO: 53106 - DNA, 20 bp, human
gacgcgggacacgaccttgt

SEQ ID NO: 53107 - DNA, 20 bp, human
ggacgcggggcccccgaaag

SEQ ID NO: 53108 - DNA, 20 bp, human
gcggccgggatggcaacaga

SEQ ID NO: 53109 - DNA, 20 bp, human
gctgctgctaacgcggtccc

SEQ ID NO: 53110 - DNA, 20 bp, human
gcaacagatggtgcgtgccg

SEQ ID NO: 53111 - DNA, 20 bp, human
gcacctgggttaagacggag

SEQ ID NO: 53112 - DNA, 20 bp, human
ggggacggcaacagcaggaa

SEQ ID NO: 53113 - DNA, 20 bp, human
ggccaaggacctcacccaca

SEQ ID NO: 53114 - DNA, 20 bp, human
ggacctcactcaaaaagtca

SEQ ID NO: 53115 - DNA, 20 bp, human
gcgaggccattgcaggtgag

SEQ ID NO: 53116 - DNA, 20 bp, human
gacggacactaaggatcttc

SEQ ID NO: 53117 - DNA, 20 bp, human
gcctaggcctgacacgtgcg

SEQ ID NO: 53118 - DNA, 20 bp, human
ggagaacgttagagcttcac

SEQ ID NO: 53119 - DNA, 20 bp, human
ggccatcttgccaaagaaaa

SEQ ID NO: 53120 - DNA, 20 bp, human
gggttcctggacggacacta

SEQ ID NO: 53121 - DNA, 20 bp, human
gacgttagagcttcacaggc

SEQ ID NO: 53122 - DNA, 20 bp, human
gaaagctctaacagcactcc

SEQ ID NO: 53123 - DNA, 20 bp, human
gaggcctgacacgtgcgagg

SEQ ID NO: 53124 - DNA, 20 bp, human
gctgaggtgtcagtgcggga

SEQ ID NO: 53125 - DNA, 20 bp, human
gctggcttgtaaaagcaacc

SEQ ID NO: 53126 - DNA, 20 bp, human
gatcttgtcgagaaagaagg

SEQ ID NO: 53127 - DNA, 20 bp, human
ggccatcttgtcgagaaaga

SEQ ID NO: 53128 - DNA, 20 bp, human
ggatgggaggaaaggacggt

SEQ ID NO: 53129 - DNA, 20 bp, human
ggaaaggacggtaggacacc

SEQ ID NO: 53130 - DNA, 20 bp, human
gcgggaccctgttgggtgag

SEQ ID NO: 53131 - DNA, 20 bp, human
gtaaagaattaatgagttag

SEQ ID NO: 53132 - DNA, 20 bp, human
gctctgaccactcacccaac

SEQ ID NO: 53133 - DNA, 20 bp, human
gttgtcgagaaagaaggagg

SEQ ID NO: 53134 - DNA, 20 bp, human
ggagataaatgagaagtggg

SEQ ID NO: 53135 - DNA, 20 bp, human
gagtgagataaatgagaagt

SEQ ID NO: 53136 - DNA, 20 bp, human
gggcctggccgcgaataccc

SEQ ID NO: 53137 - DNA, 20 bp, human
gctcactcaaagtctccagt

SEQ ID NO: 53138 - DNA, 20 bp, human
gcaacaggcgggtcccaagg

SEQ ID NO: 53139 - DNA, 20 bp, human
gagtcggcgatcgcggaaag

SEQ ID NO: 53140 - DNA, 20 bp, human
gccacctggtcggcccaact

SEQ ID NO: 53141 - DNA, 20 bp, human
ggccggggaacacctggagt

SEQ ID NO: 53142 - DNA, 20 bp, human
gtgggccgaccaggtggagg

SEQ ID NO: 53143 - DNA, 20 bp, human
gcccggccagagagcggaag

SEQ ID NO: 53144 - DNA, 20 bp, human
gaggcgggtcccaaggagga

SEQ ID NO: 53145 - DNA, 20 bp, human
ggcaggggcagaccgtgacg

SEQ ID NO: 53146 - DNA, 20 bp, human
ggaagaggtggcagtagagc

SEQ ID NO: 53147 - DNA, 20 bp, human
gcgtcccgcaaggaaggtac

SEQ ID NO: 53148 - DNA, 20 bp, human
gagatggcgtcccgcaagga

SEQ ID NO: 53149 - DNA, 20 bp, human
gagagccggtaccttccttg

SEQ ID NO: 53150 - DNA, 20 bp, human
gggaaggggactgagaatag

SEQ ID NO: 53151 - DNA, 20 bp, human
ggcgcagcagggaaaggcaa

SEQ ID NO: 53152 - DNA, 20 bp, human
gggagaccagcagctaacga

SEQ ID NO: 53153 - DNA, 20 bp, human
gagccacaccaagcccaagg

SEQ ID NO: 53154 - DNA, 20 bp, human
ggtgtgagtgacaggttcct

SEQ ID NO: 53155 - DNA, 20 bp, human
gggaaagatggcgtcccgca

SEQ ID NO: 53156 - DNA, 20 bp, human
gtggtgagtttcagagttag

SEQ ID NO: 53157 - DNA, 20 bp, human
ggtccttggccacagtaaag

SEQ ID NO: 53158 - DNA, 20 bp, human
gtattctaccgggaaaggtg

SEQ ID NO: 53159 - DNA, 20 bp, human
gcctcgcgtcacagccggga

SEQ ID NO: 53160 - DNA, 20 bp, human
gagagttaggggtattgcag

SEQ ID NO: 53161 - DNA, 20 bp, human
ggaactctattggccgagtg

SEQ ID NO: 53162 - DNA, 20 bp, human
ggttaggggtattgcagtgg

SEQ ID NO: 53163 - DNA, 20 bp, human
ggccgcaacgtgagtaagac

SEQ ID NO: 53164 - DNA, 20 bp, human
ggcgtgtccacccatcgtcc

SEQ ID NO: 53165 - DNA, 20 bp, human
gaggtggggaagaactctat

SEQ ID NO: 53166 - DNA, 20 bp, human
gcgaggagttagcacggcgg

SEQ ID NO: 53167 - DNA, 20 bp, human
gtcttccacggagaaagcgt

SEQ ID NO: 53168 - DNA, 20 bp, human
gcacacccggctcgagatgg

SEQ ID NO: 53169 - DNA, 20 bp, human
ggctcacacccggctcgaga

SEQ ID NO: 53170 - DNA, 20 bp, human
gccgcttgccggccatgtgt

SEQ ID NO: 53171 - DNA, 20 bp, human
gacatggccggcaagcggag

SEQ ID NO: 53172 - DNA, 20 bp, human
gcggagagcagactctcaac

SEQ ID NO: 53173 - DNA, 20 bp, human
gccatgtgtgggccgaagac

SEQ ID NO: 53174 - DNA, 20 bp, human
ggccgccgccatctcgagcc

SEQ ID NO: 53175 - DNA, 20 bp, human
gtctcacacacgctcacacc

SEQ ID NO: 53176 - DNA, 20 bp, human
gctggaggctaacactgacc

SEQ ID NO: 53177 - DNA, 20 bp, human
gacccggcacggcgtcctca

SEQ ID NO: 53178 - DNA, 20 bp, human
ggcacggcgtcctcaaggac

SEQ ID NO: 53179 - DNA, 20 bp, human
gtggaaggcgacagaagtca

SEQ ID NO: 53180 - DNA, 20 bp, human
gcctagaagcgagagaatct

SEQ ID NO: 53181 - DNA, 20 bp, human
gattaagaggcactcaaagg

SEQ ID NO: 53182 - DNA, 20 bp, human
ggagattaagaggcactcaa

SEQ ID NO: 53183 - DNA, 20 bp, human
gatagagaaaccccaccccg

SEQ ID NO: 53184 - DNA, 20 bp, human
gaagaggcactcaaaggagg

SEQ ID NO: 53185 - DNA, 20 bp, human
gacgtgggcaagttgctcaa

SEQ ID NO: 53186 - DNA, 20 bp, human
gtcatcagcgggataagaca

SEQ ID NO: 53187 - DNA, 20 bp, human
gaggcgtgtgagttcctcaa

SEQ ID NO: 53188 - DNA, 20 bp, human
gtctagggaccgggaactgt

SEQ ID NO: 53189 - DNA, 20 bp, human
ggcagagccagggttgtcta

SEQ ID NO: 53190 - DNA, 20 bp, human
gtgaggtaaggtggccgtaa

SEQ ID NO: 53191 - DNA, 20 bp, human
gcccggtccctagacaaccc

SEQ ID NO: 53192 - DNA, 20 bp, human
gtcgaacacgcgaagtgggc

SEQ ID NO: 53193 - DNA, 20 bp, human
gccggcggtgctcgcaagcg

SEQ ID NO: 53194 - DNA, 20 bp, human
gcattacgggtgcaatgagg

SEQ ID NO: 53195 - DNA, 20 bp, human
gtaaggtggccgtaagggcg

SEQ ID NO: 53196 - DNA, 20 bp, human
ggtcggcgtggtcttgcgag

SEQ ID NO: 53197 - DNA, 20 bp, human
gacgctcatggtgcaggccc

SEQ ID NO: 53198 - DNA, 20 bp, human
ggaccacgccgaccggaaaa

SEQ ID NO: 53199 - DNA, 20 bp, human
gatgcagccacattcggagt

SEQ ID NO: 53200 - DNA, 20 bp, human
gcagccacattcggagtggg

SEQ ID NO: 53201 - DNA, 20 bp, human
ggaacgcgcgccccagccac

SEQ ID NO: 53202 - DNA, 20 bp, human
gatgaaggccgggacgctca

SEQ ID NO: 53203 - DNA, 20 bp, human
gtggagtgtccgctgtgccc

SEQ ID NO: 53204 - DNA, 20 bp, human
gccgaccggaaaagggaact

SEQ ID NO: 53205 - DNA, 20 bp, human
gtctacacgcgagaatgggg

SEQ ID NO: 53206 - DNA, 20 bp, human
gcactccgccctagtttcta

SEQ ID NO: 53207 - DNA, 20 bp, human
gcgggcccgtcggaaggggg

SEQ ID NO: 53208 - DNA, 20 bp, human
gccaggattcccggtaagaa

SEQ ID NO: 53209 - DNA, 20 bp, human
gggctctgggccacacatag

SEQ ID NO: 53210 - DNA, 20 bp, human
gtaccactcgcgagaggcgg

SEQ ID NO: 53211 - DNA, 20 bp, human
gcggcgggcccgtcggaagg

SEQ ID NO: 53212 - DNA, 20 bp, human
gcgacgcggccaccaggtcg

SEQ ID NO: 53213 - DNA, 20 bp, human
ggggttccggagcattctga

SEQ ID NO: 53214 - DNA, 20 bp, human
ggacctggcgtgggaaagaa

SEQ ID NO: 53215 - DNA, 20 bp, human
gaggcggccgccactatgtg

SEQ ID NO: 53216 - DNA, 20 bp, human
ggcatacctgttataatccg

SEQ ID NO: 53217 - DNA, 20 bp, human
gtggctccgcggattataac

SEQ ID NO: 53218 - DNA, 20 bp, human
gcgcccgactgaaaagacag

SEQ ID NO: 53219 - DNA, 20 bp, human
ggaccctcccccaactcgtg

SEQ ID NO: 53220 - DNA, 20 bp, human
gtaacaggtatgcagtctgt

SEQ ID NO: 53221 - DNA, 20 bp, human
gggtcatccacacgagttgg

SEQ ID NO: 53222 - DNA, 20 bp, human
ggacggtggtgcgaaagcag

SEQ ID NO: 53223 - DNA, 20 bp, human
gttacttggggaagggttgg

SEQ ID NO: 53224 - DNA, 20 bp, human
ggtgtagagcacgggaaaca

SEQ ID NO: 53225 - DNA, 20 bp, human
gcgccgctgtcttttcagtc

SEQ ID NO: 53226 - DNA, 20 bp, human
gtataaggcacaataccctc

SEQ ID NO: 53227 - DNA, 20 bp, human
gacagatgcatcacgaacta

SEQ ID NO: 53228 - DNA, 20 bp, human
gcagttggagattgagttca

SEQ ID NO: 53229 - DNA, 20 bp, human
gtatgcaggtatggtttgta

SEQ ID NO: 53230 - DNA, 20 bp, human
gtacatccaagagagcgctt

SEQ ID NO: 53231 - DNA, 20 bp, human
gaaagctgtaggctttattg

SEQ ID NO: 53232 - DNA, 20 bp, human
gggggccaatactagtgctt

SEQ ID NO: 53233 - DNA, 20 bp, human
gtaaagcctacagctttatt

SEQ ID NO: 53234 - DNA, 20 bp, human
ggcctacagctttattagga

SEQ ID NO: 53235 - DNA, 20 bp, human
gaactgcttgcgtgttgcat

SEQ ID NO: 53236 - DNA, 20 bp, human
ggagcccgaggtcgccatcg

SEQ ID NO: 53237 - DNA, 20 bp, human
gtacttaaggcgtctgttct

SEQ ID NO: 53238 - DNA, 20 bp, human
gaggcgtctgttctcggcag

SEQ ID NO: 53239 - DNA, 20 bp, human
gcggccacgatggcgacctc

SEQ ID NO: 53240 - DNA, 20 bp, human
gcgccatgattcagagtccg

SEQ ID NO: 53241 - DNA, 20 bp, human
gggtcagggtcgaggctcgg

SEQ ID NO: 53242 - DNA, 20 bp, human
gcgaccctgaccacgacctc

SEQ ID NO: 53243 - DNA, 20 bp, human
gtgcgggaggacctgctgcg

SEQ ID NO: 53244 - DNA, 20 bp, human
gcccatggtgtcgaacgtgg

SEQ ID NO: 53245 - DNA, 20 bp, human
gcgaaagcggctgctcaaag

SEQ ID NO: 53246 - DNA, 20 bp, human
gatagcgggcgcgtcgagct

SEQ ID NO: 53247 - DNA, 20 bp, human
gccgagcgcggccaaggact

SEQ ID NO: 53248 - DNA, 20 bp, human
gaacgcaaaagacccggatg

SEQ ID NO: 53249 - DNA, 20 bp, human
gtgtagcggaccggagtggg

SEQ ID NO: 53250 - DNA, 20 bp, human
gaggcagtaatggtagactc

SEQ ID NO: 53251 - DNA, 20 bp, human
gtgcccgcgtgaaggcgtgg

SEQ ID NO: 53252 - DNA, 20 bp, human
gggaggcgcagaaaggtgtg

SEQ ID NO: 53253 - DNA, 20 bp, human
gccaaggcgcgaggctgtag

SEQ ID NO: 53254 - DNA, 20 bp, human
ggtgattcacgtctacgaaa

SEQ ID NO: 53255 - DNA, 20 bp, human
gaatcaccgtgcccgcgtga

SEQ ID NO: 53256 - DNA, 20 bp, human
gggccaaaggcaatactcac

SEQ ID NO: 53257 - DNA, 20 bp, human
gtgccaccggctggacgagg

SEQ ID NO: 53258 - DNA, 20 bp, human
gtgggatccgcaggcagggt

SEQ ID NO: 53259 - DNA, 20 bp, human
ggagccggcctggagtgaga

SEQ ID NO: 53260 - DNA, 20 bp, human
gccggcctggagtgagatgg

SEQ ID NO: 53261 - DNA, 20 bp, human
gccgcgaggtgtctacaggg

SEQ ID NO: 53262 - DNA, 20 bp, human
gcggagcgcggggacccgtg

SEQ ID NO: 53263 - DNA, 20 bp, human
gcggctgcgtgagtaacgag

SEQ ID NO: 53264 - DNA, 20 bp, human
gacagggtggagggtagctg

SEQ ID NO: 53265 - DNA, 20 bp, human
gagcgagtactgggatccgc

SEQ ID NO: 53266 - DNA, 20 bp, human
gttacggccggggcccccag

SEQ ID NO: 53267 - DNA, 20 bp, human
gcccgccccgggaggctcat

SEQ ID NO: 53268 - DNA, 20 bp, human
ggtagccgatgagcctcccg

SEQ ID NO: 53269 - DNA, 20 bp, human
gtgtagcagagactccagag

SEQ ID NO: 53270 - DNA, 20 bp, human
ggatgtaacacggggactag

SEQ ID NO: 53271 - DNA, 20 bp, human
ggcccgggacgcgcccctgg

SEQ ID NO: 53272 - DNA, 20 bp, human
gcaacgcggcgtgtgaagag

SEQ ID NO: 53273 - DNA, 20 bp, human
ggcgctcagtggtggaagac

SEQ ID NO: 53274 - DNA, 20 bp, human
gaacacggggactagaggag

SEQ ID NO: 53275 - DNA, 20 bp, human
gactacgcgagtcttacggc

SEQ ID NO: 53276 - DNA, 20 bp, human
gaccgacaaaggaaagcctc

SEQ ID NO: 53277 - DNA, 20 bp, human
ggtggcgccgcgaccgacaa

SEQ ID NO: 53278 - DNA, 20 bp, human
gcctgaggcagtggcgacag

SEQ ID NO: 53279 - DNA, 20 bp, human
gtggggaaagctggattcag

SEQ ID NO: 53280 - DNA, 20 bp, human
gaggcagcgctgccagactg

SEQ ID NO: 53281 - DNA, 20 bp, human
ggagcggaagtcactccctg

SEQ ID NO: 53282 - DNA, 20 bp, human
gggaggggtggggacctcgg

SEQ ID NO: 53283 - DNA, 20 bp, human
ggattgcctgcgacgtggag

SEQ ID NO: 53284 - DNA, 20 bp, human
gtggggcggcgcaaaccctg

SEQ ID NO: 53285 - DNA, 20 bp, human
gcggagtcccggagacccca

SEQ ID NO: 53286 - DNA, 20 bp, human
gtccgatcggaagggaacaa

SEQ ID NO: 53287 - DNA, 20 bp, human
ggcaggcggggcggagaaaa

SEQ ID NO: 53288 - DNA, 20 bp, human
gccgaagctggcttccgacc

SEQ ID NO: 53289 - DNA, 20 bp, human
gctgtcctcccccggcccgg

SEQ ID NO: 53290 - DNA, 20 bp, human
gccgcgccgagacaaagcgg

SEQ ID NO: 53291 - DNA, 20 bp, human
gtctggctcgacaggtgagg

SEQ ID NO: 53292 - DNA, 20 bp, human
gcgtccgccggccttgcagg

SEQ ID NO: 53293 - DNA, 20 bp, human
ggggccgcgccgagacaaag

SEQ ID NO: 53294 - DNA, 20 bp, human
gcgagacaaagcggcggtgg

SEQ ID NO: 53295 - DNA, 20 bp, human
gcgccgcgttccgatcggaa

SEQ ID NO: 53296 - DNA, 20 bp, human
gcacaggagaccatgtccgg

SEQ ID NO: 53297 - DNA, 20 bp, human
gagggcagcgagaggttcgc

SEQ ID NO: 53298 - DNA, 20 bp, human
gaccgggtgtccaggctcaa

SEQ ID NO: 53299 - DNA, 20 bp, human
gggagggaccccggacggag

SEQ ID NO: 53300 - DNA, 20 bp, human
gctggaagacgcactcagag

SEQ ID NO: 53301 - DNA, 20 bp, human
gccgcccaggagccggcaag

SEQ ID NO: 53302 - DNA, 20 bp, human
ggctggcagggacggatatg

SEQ ID NO: 53303 - DNA, 20 bp, human
gcacaaggggcagcacagct

SEQ ID NO: 53304 - DNA, 20 bp, human
ggcagtttgtaactcgggtc

SEQ ID NO: 53305 - DNA, 20 bp, human
gctcccgcccgcccaggagc

SEQ ID NO: 53306 - DNA, 20 bp, human
gctgaggccggaggatcgag

SEQ ID NO: 53307 - DNA, 20 bp, human
gcagcggcgacgacgacgac

SEQ ID NO: 53308 - DNA, 20 bp, human
gcgaggcgccgaggagttag

SEQ ID NO: 53309 - DNA, 20 bp, human
gaggccggaggatcgagcgg

SEQ ID NO: 53310 - DNA, 20 bp, human
gcggcgctcacctcccggtg

SEQ ID NO: 53311 - DNA, 20 bp, human
gccgaggagttagaggaccg

SEQ ID NO: 53312 - DNA, 20 bp, human
gtcttctccaccacaccggg

SEQ ID NO: 53313 - DNA, 20 bp, human
gaggaccgcggcgggacacc

SEQ ID NO: 53314 - DNA, 20 bp, human
gcgacgacgacgaccggaag

SEQ ID NO: 53315 - DNA, 20 bp, human
gccgccgccgctcgatcctc

SEQ ID NO: 53316 - DNA, 20 bp, human
gccgcctggcgttgaggtcg

SEQ ID NO: 53317 - DNA, 20 bp, human
gtaggaagcaaagtcgcgag

SEQ ID NO: 53318 - DNA, 20 bp, human
gggccctggcccctattcct

SEQ ID NO: 53319 - DNA, 20 bp, human
gcgttgacatagcgagcggg

SEQ ID NO: 53320 - DNA, 20 bp, human
ggagcagcaaagtaaccgcc

SEQ ID NO: 53321 - DNA, 20 bp, human
gggacgttgacatagcgagc

SEQ ID NO: 53322 - DNA, 20 bp, human
ggcgtggtgctgtagcagtc

SEQ ID NO: 53323 - DNA, 20 bp, human
ggccagcagctgcacgtggt

SEQ ID NO: 53324 - DNA, 20 bp, human
ggctcctcgacctcaacgcc

SEQ ID NO: 53325 - DNA, 20 bp, human
gagcaaagtcgcgaggggta

SEQ ID NO: 53326 - DNA, 20 bp, human
gcagcccgccggctacccgc

SEQ ID NO: 53327 - DNA, 20 bp, human
gggagaccgtactcactgag

SEQ ID NO: 53328 - DNA, 20 bp, human
ggaccgtactcactgagggg

SEQ ID NO: 53329 - DNA, 20 bp, human
gggccgggctgcagttacgg

SEQ ID NO: 53330 - DNA, 20 bp, human
gagacagcccaagccggtcg

SEQ ID NO: 53331 - DNA, 20 bp, human
gggcgcgagagcgaaggctg

SEQ ID NO: 53332 - DNA, 20 bp, human
gcacgcaggcccgggcccag

SEQ ID NO: 53333 - DNA, 20 bp, human
gctgatcgccggataacaag

SEQ ID NO: 53334 - DNA, 20 bp, human
gggccgcccctcagtgagta

SEQ ID NO: 53335 - DNA, 20 bp, human
gggaggcaccgagtaagggt

SEQ ID NO: 53336 - DNA, 20 bp, human
gccgccgagcgggatctgtg

SEQ ID NO: 53337 - DNA, 20 bp, human
gcctggcctacactcctggg

SEQ ID NO: 53338 - DNA, 20 bp, human
gcccacgggcgcaggcacca

SEQ ID NO: 53339 - DNA, 20 bp, human
gtcctcgggtcaggccgagg

SEQ ID NO: 53340 - DNA, 20 bp, human
gctgtgcggggagccggaaa

SEQ ID NO: 53341 - DNA, 20 bp, human
ggcgggagtcaggccctaaa

SEQ ID NO: 53342 - DNA, 20 bp, human
gacgtctgtgcggctgcgtg

SEQ ID NO: 53343 - DNA, 20 bp, human
gcttcctggcctacactcct

SEQ ID NO: 53344 - DNA, 20 bp, human
gagaagcggtggccgccgag

SEQ ID NO: 53345 - DNA, 20 bp, human
gtgcgcctgcggagaagcgg

SEQ ID NO: 53346 - DNA, 20 bp, human
gagtcggagctctatggagg

SEQ ID NO: 53347 - DNA, 20 bp, human
ggtggcagctgctgagttct

SEQ ID NO: 53348 - DNA, 20 bp, human
ggtgagtcggagctctatgg

SEQ ID NO: 53349 - DNA, 20 bp, human
ggcagtgagtcggagctcta

SEQ ID NO: 53350 - DNA, 20 bp, human
gggcagcgggtaccgagtgg

SEQ ID NO: 53351 - DNA, 20 bp, human
gagctctatggaggtggcag

SEQ ID NO: 53352 - DNA, 20 bp, human
gggcctcaaactcagctcag

SEQ ID NO: 53353 - DNA, 20 bp, human
gcgacgaccggatcctgagg

SEQ ID NO: 53354 - DNA, 20 bp, human
gcgactcactgctggcgcta

SEQ ID NO: 53355 - DNA, 20 bp, human
gagagcgctccactcggcgg

SEQ ID NO: 53356 - DNA, 20 bp, human
ggcaatcgcactctccactt

SEQ ID NO: 53357 - DNA, 20 bp, human
gagagtgcgattgcagaagg

SEQ ID NO: 53358 - DNA, 20 bp, human
gacaggcctggctccagtct

SEQ ID NO: 53359 - DNA, 20 bp, human
gacaggagaaatgaaatacc

SEQ ID NO: 53360 - DNA, 20 bp, human
ggtgcttcttcgggcggagg

SEQ ID NO: 53361 - DNA, 20 bp, human
gcgttgtcaagccgccaaag

SEQ ID NO: 53362 - DNA, 20 bp, human
gagactgaactcggacccaa

SEQ ID NO: 53363 - DNA, 20 bp, human
gtaaatagtgcttcttcggg

SEQ ID NO: 53364 - DNA, 20 bp, human
gatcgcactctccactttgg

SEQ ID NO: 53365 - DNA, 20 bp, human
gaatattaatagatggggtg

SEQ ID NO: 53366 - DNA, 20 bp, human
gacgagcagagcatccaaca

SEQ ID NO: 53367 - DNA, 20 bp, human
gtgagccccgctaccgagaa

SEQ ID NO: 53368 - DNA, 20 bp, human
gagcggggctcaggcgatgc

SEQ ID NO: 53369 - DNA, 20 bp, human
gccccgcgggccagcaccac

SEQ ID NO: 53370 - DNA, 20 bp, human
gtgacaacgcgaccccaggg

SEQ ID NO: 53371 - DNA, 20 bp, human
gggggctcaggcgatgccgg

SEQ ID NO: 53372 - DNA, 20 bp, human
ggcccggtcccgctctgggg

SEQ ID NO: 53373 - DNA, 20 bp, human
gcgggatgggggcagacccg

SEQ ID NO: 53374 - DNA, 20 bp, human
ggccaccaacccccccagag

SEQ ID NO: 53375 - DNA, 20 bp, human
gcgggtccggccccccccct

SEQ ID NO: 53376 - DNA, 20 bp, human
gcttacttgagagagtccag

SEQ ID NO: 53377 - DNA, 20 bp, human
gacccgaaaggggtgcgaga

SEQ ID NO: 53378 - DNA, 20 bp, human
gtgtgctgaataaggggatg

SEQ ID NO: 53379 - DNA, 20 bp, human
gcaggggacgatgcatgtcc

SEQ ID NO: 53380 - DNA, 20 bp, human
gtcctcacaggtaacacaag

SEQ ID NO: 53381 - DNA, 20 bp, human
gggggcgttgccgcaagatt

SEQ ID NO: 53382 - DNA, 20 bp, human
ggggacgatgcatgtcccgg

SEQ ID NO: 53383 - DNA, 20 bp, human
gttaatgcttcacccgaaag

SEQ ID NO: 53384 - DNA, 20 bp, human
gaaggggcatccaaatcttg

SEQ ID NO: 53385 - DNA, 20 bp, human
ggggatggggtaggggttcc

SEQ ID NO: 53386 - DNA, 20 bp, human
gctccgctccgagaggaacc

SEQ ID NO: 53387 - DNA, 20 bp, human
ggtccaagggatttgcgatc

SEQ ID NO: 53388 - DNA, 20 bp, human
gaccctggttcctctcggag

SEQ ID NO: 53389 - DNA, 20 bp, human
gctacggtaggaccagtgcg

SEQ ID NO: 53390 - DNA, 20 bp, human
ggcccgcggaggcctaggag

SEQ ID NO: 53391 - DNA, 20 bp, human
gcactggtcctaccgtaggg

SEQ ID NO: 53392 - DNA, 20 bp, human
ggccccatcccccctacggt

SEQ ID NO: 53393 - DNA, 20 bp, human
gtcggcggcggcagagggtg

SEQ ID NO: 53394 - DNA, 20 bp, human
gggtccttcctcgctcaccc

SEQ ID NO: 53395 - DNA, 20 bp, human
gagaggaaccagggtgagcg

SEQ ID NO: 53396 - DNA, 20 bp, human
gcagagcgagaacattccag

SEQ ID NO: 53397 - DNA, 20 bp, human
gccttcaccggactcacctc

SEQ ID NO: 53398 - DNA, 20 bp, human
ggccgagggtagcttgagcg

SEQ ID NO: 53399 - DNA, 20 bp, human
ggccgcgctcaagctaccct

SEQ ID NO: 53400 - DNA, 20 bp, human
gcggccgccgccatcttgtg

SEQ ID NO: 53401 - DNA, 20 bp, human
gagatggcggccgcacaaga

SEQ ID NO: 53402 - DNA, 20 bp, human
gaacattccagaggtgagtc

SEQ ID NO: 53403 - DNA, 20 bp, human
gcagggggccgccccttcac

SEQ ID NO: 53404 - DNA, 20 bp, human
gaggtgccgccgccgagcag

SEQ ID NO: 53405 - DNA, 20 bp, human
gcgccagccagcggcccgag

SEQ ID NO: 53406 - DNA, 20 bp, human
gagatccattgacaatgtaa

SEQ ID NO: 53407 - DNA, 20 bp, human
gcatggaagactcaccaggt

SEQ ID NO: 53408 - DNA, 20 bp, human
gtcatcatggaagactcacc

SEQ ID NO: 53409 - DNA, 20 bp, human
gattgtcaatggatctcatg

SEQ ID NO: 53410 - DNA, 20 bp, human
gatgaccgttacattgtcaa

SEQ ID NO: 53411 - DNA, 20 bp, human
gcatgaaaatatctaatcag

SEQ ID NO: 53412 - DNA, 20 bp, human
ggtcattcttaacatcaaac

SEQ ID NO: 53413 - DNA, 20 bp, human
gacatttgctctgccttctc

SEQ ID NO: 53414 - DNA, 20 bp, human
gttagcggtatcacagaagc

SEQ ID NO: 53415 - DNA, 20 bp, human
gatggaaatatctcgaaaac

SEQ ID NO: 53416 - DNA, 20 bp, human
ggctgcttggttggtcagtg

SEQ ID NO: 53417 - DNA, 20 bp, human
gccgccaggcggccacgccg

SEQ ID NO: 53418 - DNA, 20 bp, human
gcaccggggcaagggtacct

SEQ ID NO: 53419 - DNA, 20 bp, human
gcacgggttcggccagagag

SEQ ID NO: 53420 - DNA, 20 bp, human
gagcggcgcgaggtgaggag

SEQ ID NO: 53421 - DNA, 20 bp, human
gcagagagcggcgcgaggtg

SEQ ID NO: 53422 - DNA, 20 bp, human
gggcccaggtacccttgccc

SEQ ID NO: 53423 - DNA, 20 bp, human
ggggccagatcggcccaccg

SEQ ID NO: 53424 - DNA, 20 bp, human
gcgcttgcgcggctgtcata

SEQ ID NO: 53425 - DNA, 20 bp, human
gacctgggccgttgaggacc

SEQ ID NO: 53426 - DNA, 20 bp, human
ggcgcgggtgcgcagacgaa

SEQ ID NO: 53427 - DNA, 20 bp, human
gcgctggtcccctacagcag

SEQ ID NO: 53428 - DNA, 20 bp, human
gggctgggtcccccgcagta

SEQ ID NO: 53429 - DNA, 20 bp, human
ggccgccccgaaccctactg

SEQ ID NO: 53430 - DNA, 20 bp, human
gggaaggtcgccggcttctg

SEQ ID NO: 53431 - DNA, 20 bp, human
ggcggcagttccaagagacg

SEQ ID NO: 53432 - DNA, 20 bp, human
ggctgaaaggtgaagacctg

SEQ ID NO: 53433 - DNA, 20 bp, human
gagaatggatgggggaacag

SEQ ID NO: 53434 - DNA, 20 bp, human
gcctgttctgccggcatcca

SEQ ID NO: 53435 - DNA, 20 bp, human
ggccccgaaccctactgcgg

SEQ ID NO: 53436 - DNA, 20 bp, human
ggacagcggggaggtaccag

SEQ ID NO: 53437 - DNA, 20 bp, human
gcagggagacgaaggtcctc

SEQ ID NO: 53438 - DNA, 20 bp, human
gtaaaatgcctgggtagagg

SEQ ID NO: 53439 - DNA, 20 bp, human
gcttgccaaggtctccctca

SEQ ID NO: 53440 - DNA, 20 bp, human
ggctgattggcatccaggat

SEQ ID NO: 53441 - DNA, 20 bp, human
ggtgtaaaatgcctgggtag

SEQ ID NO: 53442 - DNA, 20 bp, human
gaatgcctgggtagaggcgg

SEQ ID NO: 53443 - DNA, 20 bp, human
gggctggccatgtaagatcg

SEQ ID NO: 53444 - DNA, 20 bp, human
ggtctccctgagggagacct

SEQ ID NO: 53445 - DNA, 20 bp, human
gggaatgacttccagctgat

SEQ ID NO: 53446 - DNA, 20 bp, human
gaggggttgggtccgtacgg

SEQ ID NO: 53447 - DNA, 20 bp, human
gggcggccgccgtggctcag

SEQ ID NO: 53448 - DNA, 20 bp, human
gtgggcacgtagggcctcga

SEQ ID NO: 53449 - DNA, 20 bp, human
gagcgaagacaggtagatag

SEQ ID NO: 53450 - DNA, 20 bp, human
ggtggagagccgggtgcgag

SEQ ID NO: 53451 - DNA, 20 bp, human
ggcacgtagggcctcgacgg

SEQ ID NO: 53452 - DNA, 20 bp, human
ggggggagcgaggctcgact

SEQ ID NO: 53453 - DNA, 20 bp, human
gcgagcggcggcagcacgag

SEQ ID NO: 53454 - DNA, 20 bp, human
gcgggccgggtgggcacgta

SEQ ID NO: 53455 - DNA, 20 bp, human
gtaccccgctcctcaggccg

SEQ ID NO: 53456 - DNA, 20 bp, human
gcgcgtgcggagcttgttac

SEQ ID NO: 53457 - DNA, 20 bp, human
ggcgggacccgaggacggag

SEQ ID NO: 53458 - DNA, 20 bp, human
gactgtctggtagcgatcgg

SEQ ID NO: 53459 - DNA, 20 bp, human
ggcgcaggagtcaagagctc

SEQ ID NO: 53460 - DNA, 20 bp, human
ggaccggagctgaccctccc

SEQ ID NO: 53461 - DNA, 20 bp, human
gcaagagctccggcagtggg

SEQ ID NO: 53462 - DNA, 20 bp, human
ggcacgcggcgactgtacct

SEQ ID NO: 53463 - DNA, 20 bp, human
gccgcccctaggcctcatgg

SEQ ID NO: 53464 - DNA, 20 bp, human
ggacggaggccgggatactt

SEQ ID NO: 53465 - DNA, 20 bp, human
gagggacatggactcggtgg

SEQ ID NO: 53466 - DNA, 20 bp, human
gccgcgccaggagccgaggg

SEQ ID NO: 53467 - DNA, 20 bp, human
gggcccgcgccaggagccga

SEQ ID NO: 53468 - DNA, 20 bp, human
gggagagggtgagtgcggta

SEQ ID NO: 53469 - DNA, 20 bp, human
gggtagggcataccagaggg

SEQ ID NO: 53470 - DNA, 20 bp, human
gctgccctaggcacaccaca

SEQ ID NO: 53471 - DNA, 20 bp, human
gggacagcgatatctgccct

SEQ ID NO: 53472 - DNA, 20 bp, human
gaccctggcccagctgtccg

SEQ ID NO: 53473 - DNA, 20 bp, human
gtcaccctgtggtgtgccta

SEQ ID NO: 53474 - DNA, 20 bp, human
gcttagagctgaaagaaccg

SEQ ID NO: 53475 - DNA, 20 bp, human
ggcctcgaaaaaggctgggt

SEQ ID NO: 53476 - DNA, 20 bp, human
gggtggagacgggcgcatgt

SEQ ID NO: 53477 - DNA, 20 bp, human
gaaacgcgggcgtaggtgac

SEQ ID NO: 53478 - DNA, 20 bp, human
ggcgcagcctctgagcatcg

SEQ ID NO: 53479 - DNA, 20 bp, human
ggaggtgccccgatgctcag

SEQ ID NO: 53480 - DNA, 20 bp, human
gggtggtgcacgggaaacgc

SEQ ID NO: 53481 - DNA, 20 bp, human
gcagccaggccggggcccaa

SEQ ID NO: 53482 - DNA, 20 bp, human
ggaaccacatgtgtgaagca

SEQ ID NO: 53483 - DNA, 20 bp, human
ggggttcgtggagttatggt

SEQ ID NO: 53484 - DNA, 20 bp, human
ggagcggctaggtggtgcac

SEQ ID NO: 53485 - DNA, 20 bp, human
ggccgcgcaaggacccgctg

SEQ ID NO: 53486 - DNA, 20 bp, human
gggcggccgagggtcatggt

SEQ ID NO: 53487 - DNA, 20 bp, human
gagcaaggccggcaggacac

SEQ ID NO: 53488 - DNA, 20 bp, human
gtccccacggtgcccctcca

SEQ ID NO: 53489 - DNA, 20 bp, human
gagtcggcggccgagggtca

SEQ ID NO: 53490 - DNA, 20 bp, human
gggacctggggtggcatcgt

SEQ ID NO: 53491 - DNA, 20 bp, human
gcgaacggccccgatcccgt

SEQ ID NO: 53492 - DNA, 20 bp, human
ggtctgtctgtgccttggag

SEQ ID NO: 53493 - DNA, 20 bp, human
gagccgggcgcgcacactcc

SEQ ID NO: 53494 - DNA, 20 bp, human
gctcgcggcgggagcccacc

SEQ ID NO: 53495 - DNA, 20 bp, human
ggaaaagacacgcgagtcgg

SEQ ID NO: 53496 - DNA, 20 bp, human
gccttcggcggcgcccgacg

SEQ ID NO: 53497 - DNA, 20 bp, human
gcgggtcgtgcgcgctgagg

SEQ ID NO: 53498 - DNA, 20 bp, human
gctccgctcggcctcggtag

SEQ ID NO: 53499 - DNA, 20 bp, human
gcaccgctaccgaggccgag

SEQ ID NO: 53500 - DNA, 20 bp, human
gggcgagggggatacggcgt

SEQ ID NO: 53501 - DNA, 20 bp, human
gtaacggctccgctcggcct

SEQ ID NO: 53502 - DNA, 20 bp, human
gccgtccctcgaggcgccag

SEQ ID NO: 53503 - DNA, 20 bp, human
ggggacgggcgagggggata

SEQ ID NO: 53504 - DNA, 20 bp, human
gctccgggggcgggagagtg

SEQ ID NO: 53505 - DNA, 20 bp, human
gcgggcttccaaggcgaccg

SEQ ID NO: 53506 - DNA, 20 bp, human
gtgcacacacggcagtgcgg

SEQ ID NO: 53507 - DNA, 20 bp, human
gggcagagcagctgcacaca

SEQ ID NO: 53508 - DNA, 20 bp, human
gagagaaggggttggtgata

SEQ ID NO: 53509 - DNA, 20 bp, human
gagctgcacacacggcagtg

SEQ ID NO: 53510 - DNA, 20 bp, human
gcgcgcgtgctgcccgggat

SEQ ID NO: 53511 - DNA, 20 bp, human
gatacggtgctataaatctg

SEQ ID NO: 53512 - DNA, 20 bp, human
gggacgtcttaaaagggagg

SEQ ID NO: 53513 - DNA, 20 bp, human
ggggggaggacgtcttaaaa

SEQ ID NO: 53514 - DNA, 20 bp, human
gcggtgcagttctcccaata

SEQ ID NO: 53515 - DNA, 20 bp, human
ggggcaagaaaaacaaacca

SEQ ID NO: 53516 - DNA, 20 bp, human
ggtagccggccgggtgagga

SEQ ID NO: 53517 - DNA, 20 bp, human
gggcagtagccggccgggtg

SEQ ID NO: 53518 - DNA, 20 bp, human
gggcgtccaaaatggaccag

SEQ ID NO: 53519 - DNA, 20 bp, human
gggcgggagtagagagaatt

SEQ ID NO: 53520 - DNA, 20 bp, human
gctgcttgtgcccacgggag

SEQ ID NO: 53521 - DNA, 20 bp, human
gtgagctctaggaacttcgc

SEQ ID NO: 53522 - DNA, 20 bp, human
ggaactctgggcgggaacac

SEQ ID NO: 53523 - DNA, 20 bp, human
gactgaggcagtagccggcc

SEQ ID NO: 53524 - DNA, 20 bp, human
ggagaattgggcgcctcggg

SEQ ID NO: 53525 - DNA, 20 bp, human
ggtgggcacaagcaggttgg

SEQ ID NO: 53526 - DNA, 20 bp, human
gacacaagaatggtcactgt

SEQ ID NO: 53527 - DNA, 20 bp, human
ggacaggaccgaccgagggg

SEQ ID NO: 53528 - DNA, 20 bp, human
gccggacaggaccgaccgag

SEQ ID NO: 53529 - DNA, 20 bp, human
gcccgccgggcacacaagaa

SEQ ID NO: 53530 - DNA, 20 bp, human
gggcggcgcggtccagagcg

SEQ ID NO: 53531 - DNA, 20 bp, human
ggcgcggtccgtgttgaggg

SEQ ID NO: 53532 - DNA, 20 bp, human
ggatgtggcgatgaaggcgg

SEQ ID NO: 53533 - DNA, 20 bp, human
ggattccctttcggcgacag

SEQ ID NO: 53534 - DNA, 20 bp, human
ggccgaaagggaatcgggac

SEQ ID NO: 53535 - DNA, 20 bp, human
gaaagggaatcgggacgggg

SEQ ID NO: 53536 - DNA, 20 bp, human
gatctctgcagagaacctgg

SEQ ID NO: 53537 - DNA, 20 bp, human
gggacacagaccacagatgt

SEQ ID NO: 53538 - DNA, 20 bp, human
gcccagggagcagggcttag

SEQ ID NO: 53539 - DNA, 20 bp, human
ggtcacaccacggggacaca

SEQ ID NO: 53540 - DNA, 20 bp, human
gacgcagacagtcacaccac

SEQ ID NO: 53541 - DNA, 20 bp, human
ggcgccaaggagaccgctgg

SEQ ID NO: 53542 - DNA, 20 bp, human
ggtctgtccgtgtgtccccg

SEQ ID NO: 53543 - DNA, 20 bp, human
gtaggggctagcagcccacg

SEQ ID NO: 53544 - DNA, 20 bp, human
gtttctctgtgtggccccgt

SEQ ID NO: 53545 - DNA, 20 bp, human
gagagggtgagggagcgtct

SEQ ID NO: 53546 - DNA, 20 bp, human
gttccgttgaaggctcacag

SEQ ID NO: 53547 - DNA, 20 bp, human
gttgtgtagagagtgcgggt

SEQ ID NO: 53548 - DNA, 20 bp, human
gatctacatcctagaatcgg

SEQ ID NO: 53549 - DNA, 20 bp, human
gcgttgaaggctcacagagg

SEQ ID NO: 53550 - DNA, 20 bp, human
gcaaaagagatagtaaatgt

SEQ ID NO: 53551 - DNA, 20 bp, human
gacacgactgctaaagttaa

SEQ ID NO: 53552 - DNA, 20 bp, human
gatccaggagctgcctctcg

SEQ ID NO: 53553 - DNA, 20 bp, human
gcaataagaatggttatggt

SEQ ID NO: 53554 - DNA, 20 bp, human
gagctgaaacccccgattct

SEQ ID NO: 53555 - DNA, 20 bp, human
gatggcactgcatgcacaca

SEQ ID NO: 53556 - DNA, 20 bp, human
gagtaccacaaagcaaacta

SEQ ID NO: 53557 - DNA, 20 bp, human
gaaatggctcctgtagattg

SEQ ID NO: 53558 - DNA, 20 bp, human
gtttaacagctaaaacttgt

SEQ ID NO: 53559 - DNA, 20 bp, human
gtaccccaaaaaatacaatt

SEQ ID NO: 53560 - DNA, 20 bp, human
gatagatgttaaatatccag

SEQ ID NO: 53561 - DNA, 20 bp, human
gattgaacttaattgctagg

SEQ ID NO: 53562 - DNA, 20 bp, human
gtgagctgataaacagaggg

SEQ ID NO: 53563 - DNA, 20 bp, human
gtcttgagctgataaacaga

SEQ ID NO: 53564 - DNA, 20 bp, human
gatagagaaagaatacttga

SEQ ID NO: 53565 - DNA, 20 bp, human
gccacacacattttatcaga

SEQ ID NO: 53566 - DNA, 20 bp, human
gccaaccgcctaggcgacgg

SEQ ID NO: 53567 - DNA, 20 bp, human
gcccccaaccgcctaggcga

SEQ ID NO: 53568 - DNA, 20 bp, human
gacggcggcgacacagagct

SEQ ID NO: 53569 - DNA, 20 bp, human
gcaccgacccccaaccgcct

SEQ ID NO: 53570 - DNA, 20 bp, human
ggctgagtgtccccaggcaa

SEQ ID NO: 53571 - DNA, 20 bp, human
ggtcgccgccgtcgcctagg

SEQ ID NO: 53572 - DNA, 20 bp, human
ggagcgggacttggagaaag

SEQ ID NO: 53573 - DNA, 20 bp, human
gtgtccccaggcaacggtcg

SEQ ID NO: 53574 - DNA, 20 bp, human
gggagagcaggtaagagcgc

SEQ ID NO: 53575 - DNA, 20 bp, human
gtgtgtcgccgccgtcgcct

SEQ ID NO: 53576 - DNA, 20 bp, human
ggggcaagagtagcccccag

SEQ ID NO: 53577 - DNA, 20 bp, human
gtagctgggagtgtaaggag

SEQ ID NO: 53578 - DNA, 20 bp, human
gcagagtagctgggagtgta

SEQ ID NO: 53579 - DNA, 20 bp, human
ggagtggcggagtccggctg

SEQ ID NO: 53580 - DNA, 20 bp, human
ggcggggaatcctaccggag

SEQ ID NO: 53581 - DNA, 20 bp, human
gcagatacctcagcgctacc

SEQ ID NO: 53582 - DNA, 20 bp, human
ggttccgccaggtagcgctg

SEQ ID NO: 53583 - DNA, 20 bp, human
ggacaggcggggaatcctac

SEQ ID NO: 53584 - DNA, 20 bp, human
ggccgctgcgctcccctacc

SEQ ID NO: 53585 - DNA, 20 bp, human
ggatctccgagcaagagcgt

SEQ ID NO: 53586 - DNA, 20 bp, human
ggttgagcgcggcgcccggt

SEQ ID NO: 53587 - DNA, 20 bp, human
gcgggggcgagggaaaacag

SEQ ID NO: 53588 - DNA, 20 bp, human
ggcgccggcgaaaggagaag

SEQ ID NO: 53589 - DNA, 20 bp, human
ggccgggccaagacacgggg

SEQ ID NO: 53590 - DNA, 20 bp, human
ggagggccgggccaagacac

SEQ ID NO: 53591 - DNA, 20 bp, human
ggcgcggcggggcgactcca

SEQ ID NO: 53592 - DNA, 20 bp, human
gcgcgtgtgatggagaaccc

SEQ ID NO: 53593 - DNA, 20 bp, human
ggtcatgatcggccccgtca

SEQ ID NO: 53594 - DNA, 20 bp, human
gcacggaacccaggctgccg

SEQ ID NO: 53595 - DNA, 20 bp, human
gacggggccgatcatgacag

SEQ ID NO: 53596 - DNA, 20 bp, human
ggcggtggctaggtccaaag

SEQ ID NO: 53597 - DNA, 20 bp, human
ggtggctaggtccaaagagg

SEQ ID NO: 53598 - DNA, 20 bp, human
gaggctttcaaggcaagaga

SEQ ID NO: 53599 - DNA, 20 bp, human
ggcttacgtgagggcagcgg

SEQ ID NO: 53600 - DNA, 20 bp, human
gtccaaagaggaggctttca

SEQ ID NO: 53601 - DNA, 20 bp, human
gagaaaaggcgcttacgtga

SEQ ID NO: 53602 - DNA, 20 bp, human
gggcgcttacgtgagggcag

SEQ ID NO: 53603 - DNA, 20 bp, human
gtcccagcaccagcgtgcag

SEQ ID NO: 53604 - DNA, 20 bp, human
gtcctaaagaagctttaggg

SEQ ID NO: 53605 - DNA, 20 bp, human
gtccactgcacgctggtgct

SEQ ID NO: 53606 - DNA, 20 bp, human
gcaactggattagtatacct

SEQ ID NO: 53607 - DNA, 20 bp, human
gatctatggcgtgagatgta

SEQ ID NO: 53608 - DNA, 20 bp, human
ggagcatcttcaagaactta

SEQ ID NO: 53609 - DNA, 20 bp, human
gcatgactgaaagagtgaaa

SEQ ID NO: 53610 - DNA, 20 bp, human
ggattaaaagtctaaatgtc

SEQ ID NO: 53611 - DNA, 20 bp, human
gacctgtaattttttatcta

SEQ ID NO: 53612 - DNA, 20 bp, human
gtaacagaaagtgctaacca

SEQ ID NO: 53613 - DNA, 20 bp, human
gcagaaagtgctaaccatgg

SEQ ID NO: 53614 - DNA, 20 bp, human
ggcaactcaatagaaaaatg

SEQ ID NO: 53615 - DNA, 20 bp, human
gtcaagtgtcagttcttcct

SEQ ID NO: 53616 - DNA, 20 bp, human
gtgatgcaccagcgaggaat

SEQ ID NO: 53617 - DNA, 20 bp, human
ggcaccagcgaggaataggc

SEQ ID NO: 53618 - DNA, 20 bp, human
ggatcagccctgaggattag

SEQ ID NO: 53619 - DNA, 20 bp, human
gcaagccaggatcagccctg

SEQ ID NO: 53620 - DNA, 20 bp, human
gcttgtcagggaaggataat

SEQ ID NO: 53621 - DNA, 20 bp, human
gcgctggtgcatcaggtcgt

SEQ ID NO: 53622 - DNA, 20 bp, human
gggtgctgccctcagatgaa

SEQ ID NO: 53623 - DNA, 20 bp, human
gtaggtggtggccatactcg

SEQ ID NO: 53624 - DNA, 20 bp, human
gtatctgatcacaaaagtgg

SEQ ID NO: 53625 - DNA, 20 bp, human
gacccggaaatagtctaagt

SEQ ID NO: 53626 - DNA, 20 bp, human
gacacacgcgggccacccca

SEQ ID NO: 53627 - DNA, 20 bp, human
gacaccgaggacggtcggtg

SEQ ID NO: 53628 - DNA, 20 bp, human
gaggcggtgggaggacaccg

SEQ ID NO: 53629 - DNA, 20 bp, human
gggtgggaggacaccgagga

SEQ ID NO: 53630 - DNA, 20 bp, human
gtgcggggtgcgtggccgtg

SEQ ID NO: 53631 - DNA, 20 bp, human
ggaccgaccggggagacggt

SEQ ID NO: 53632 - DNA, 20 bp, human
gtggtgcagaggctcgatgg

SEQ ID NO: 53633 - DNA, 20 bp, human
ggcaccccctccgtcagtgg

SEQ ID NO: 53634 - DNA, 20 bp, human
gccacccccactgacggagg

SEQ ID NO: 53635 - DNA, 20 bp, human
gggaccaccctgcgcgaggg

SEQ ID NO: 53636 - DNA, 20 bp, human
gccaggcctgggttccgagg

SEQ ID NO: 53637 - DNA, 20 bp, human
gcccccaggcctgggttccg

SEQ ID NO: 53638 - DNA, 20 bp, human
gggacgagtccaccctaagt

SEQ ID NO: 53639 - DNA, 20 bp, human
ggctagctccctataagtgg

SEQ ID NO: 53640 - DNA, 20 bp, human
gtgagctgtagggaaacgca

SEQ ID NO: 53641 - DNA, 20 bp, human
gcgggcccacgtgagctgta

SEQ ID NO: 53642 - DNA, 20 bp, human
gtccccacgccaacttaggg

SEQ ID NO: 53643 - DNA, 20 bp, human
gcaggctagctccctataag

SEQ ID NO: 53644 - DNA, 20 bp, human
gagctcacgtgggcccgagg

SEQ ID NO: 53645 - DNA, 20 bp, human
gccacccacccccacttata

SEQ ID NO: 53646 - DNA, 20 bp, human
gcacatctgggtaggtaaca

SEQ ID NO: 53647 - DNA, 20 bp, human
gtgtcagcatggaaagtcgg

SEQ ID NO: 53648 - DNA, 20 bp, human
ggcgggcgcaggagcatccg

SEQ ID NO: 53649 - DNA, 20 bp, human
ggcgcgagctcgggcgacgg

SEQ ID NO: 53650 - DNA, 20 bp, human
gtactgcattattccccagg

SEQ ID NO: 53651 - DNA, 20 bp, human
gtggagcagtcaggccgagc

SEQ ID NO: 53652 - DNA, 20 bp, human
gacagactgcacaccgcctg

SEQ ID NO: 53653 - DNA, 20 bp, human
gctgctctcacacacaccag

SEQ ID NO: 53654 - DNA, 20 bp, human
ggcggtgcgtccgcgcggga

SEQ ID NO: 53655 - DNA, 20 bp, human
ggcaggaagttggagcagtc

SEQ ID NO: 53656 - DNA, 20 bp, human
gggacccaggagcagtcggg

SEQ ID NO: 53657 - DNA, 20 bp, human
gtggccgcgagatcccgagg

SEQ ID NO: 53658 - DNA, 20 bp, human
gttcggggcgttccttgcag

SEQ ID NO: 53659 - DNA, 20 bp, human
ggcggagccgtagaaggcgg

SEQ ID NO: 53660 - DNA, 20 bp, human
gtctcgtgggcgaaaggtgg

SEQ ID NO: 53661 - DNA, 20 bp, human
gctgtggccgcgagatcccg

SEQ ID NO: 53662 - DNA, 20 bp, human
gaagtctcgtgggcgaaagg

SEQ ID NO: 53663 - DNA, 20 bp, human
gcgcggcacaacaggaagtg

SEQ ID NO: 53664 - DNA, 20 bp, human
gtcggggggtttgagagtgg

SEQ ID NO: 53665 - DNA, 20 bp, human
ggcggcggagccgtagaagg

SEQ ID NO: 53666 - DNA, 20 bp, human
gagagatggtcgcaagatgg

SEQ ID NO: 53667 - DNA, 20 bp, human
gaagatggcggcgctgaagg

SEQ ID NO: 53668 - DNA, 20 bp, human
gtgaaggaggataggagcta

SEQ ID NO: 53669 - DNA, 20 bp, human
gtagctctcgaaggccctca

SEQ ID NO: 53670 - DNA, 20 bp, human
gcgtgcgggcgggttagcga

SEQ ID NO: 53671 - DNA, 20 bp, human
gcgtcggtgtcggcacctgg

SEQ ID NO: 53672 - DNA, 20 bp, human
gggtgcccagcaggccagaa

SEQ ID NO: 53673 - DNA, 20 bp, human
gggagctacgggctgtcgtg

SEQ ID NO: 53674 - DNA, 20 bp, human
ggcccggggggcgtcggtgt

SEQ ID NO: 53675 - DNA, 20 bp, human
gagcccggacgcctcagtga

SEQ ID NO: 53676 - DNA, 20 bp, human
gccgtcggaaagtcccgcag

SEQ ID NO: 53677 - DNA, 20 bp, human
gcaagccaggaaatcctcgg

SEQ ID NO: 53678 - DNA, 20 bp, human
gcgcggtcccgggctagcct

SEQ ID NO: 53679 - DNA, 20 bp, human
gggcagggtggctgacgccg

SEQ ID NO: 53680 - DNA, 20 bp, human
gaggcagagcgcacccctca

SEQ ID NO: 53681 - DNA, 20 bp, human
ggctcaccgagacggcgatc

SEQ ID NO: 53682 - DNA, 20 bp, human
ggttggggaagcgggcagtc

SEQ ID NO: 53683 - DNA, 20 bp, human
gccaacgcccaggctagccc

SEQ ID NO: 53684 - DNA, 20 bp, human
gagcgcccggatcgccgtct

SEQ ID NO: 53685 - DNA, 20 bp, human
gtggccgctgcgggcgctga

SEQ ID NO: 53686 - DNA, 20 bp, human
gtgaggcccaaggtccctag

SEQ ID NO: 53687 - DNA, 20 bp, human
ggccggagctgtcctctcag

SEQ ID NO: 53688 - DNA, 20 bp, human
gtcgagtgcaagcagcacgg

SEQ ID NO: 53689 - DNA, 20 bp, human
gccgctaggcaggtgatccc

SEQ ID NO: 53690 - DNA, 20 bp, human
gaaaccctgaacagaggagg

SEQ ID NO: 53691 - DNA, 20 bp, human
gggcgctgcaagagtgtcag

SEQ ID NO: 53692 - DNA, 20 bp, human
gcaagcagcacgggggccac

SEQ ID NO: 53693 - DNA, 20 bp, human
gccaaccaaaccctgaacag

SEQ ID NO: 53694 - DNA, 20 bp, human
gctccggacgccggatcctg

SEQ ID NO: 53695 - DNA, 20 bp, human
gaagcagtgtccccaggatc

SEQ ID NO: 53696 - DNA, 20 bp, human
gagcgggagcgggcgaggat

SEQ ID NO: 53697 - DNA, 20 bp, human
ggaggatgggcacaggatag

SEQ ID NO: 53698 - DNA, 20 bp, human
gacgcacttacactctgggt

SEQ ID NO: 53699 - DNA, 20 bp, human
ggcacacgcacttacactct

SEQ ID NO: 53700 - DNA, 20 bp, human
ggccgcgctcggcagggtga

SEQ ID NO: 53701 - DNA, 20 bp, human
gcgccgaggtcagcgagtcg

SEQ ID NO: 53702 - DNA, 20 bp, human
gagccgcggcgcccccaggg

SEQ ID NO: 53703 - DNA, 20 bp, human
ggtgcgtgtgctggggcgag

SEQ ID NO: 53704 - DNA, 20 bp, human
ggtggccgccgcgctcggca

SEQ ID NO: 53705 - DNA, 20 bp, human
ggaagtctgagctccgggga

SEQ ID NO: 53706 - DNA, 20 bp, human
gcggctcgtcaggcccccga

SEQ ID NO: 53707 - DNA, 20 bp, human
ggggcgcccctcactcacca

SEQ ID NO: 53708 - DNA, 20 bp, human
gagccgccgagcggagaccc

SEQ ID NO: 53709 - DNA, 20 bp, human
gctcaccagggcgcagacct

SEQ ID NO: 53710 - DNA, 20 bp, human
gctgcgccctggtgagtgag

SEQ ID NO: 53711 - DNA, 20 bp, human
gccaggttgagcatgacccc

SEQ ID NO: 53712 - DNA, 20 bp, human
gaggcgttgggtgggaagat

SEQ ID NO: 53713 - DNA, 20 bp, human
gcgggtcctggacccagaag

SEQ ID NO: 53714 - DNA, 20 bp, human
ggccggggccttaggaaggg

SEQ ID NO: 53715 - DNA, 20 bp, human
gagaagccggagagcgctcg

SEQ ID NO: 53716 - DNA, 20 bp, human
gtgcaacgcggccttcccaa

SEQ ID NO: 53717 - DNA, 20 bp, human
gtggccaggagcagcagtct

SEQ ID NO: 53718 - DNA, 20 bp, human
gtgctcctggccatgcaacg

SEQ ID NO: 53719 - DNA, 20 bp, human
gtccaacccggaactaacct

SEQ ID NO: 53720 - DNA, 20 bp, human
gaacctcggctcccttggga

SEQ ID NO: 53721 - DNA, 20 bp, human
gagtgcgggacaccgaggtc

SEQ ID NO: 53722 - DNA, 20 bp, human
gccgcgagtgcgggacaccg

SEQ ID NO: 53723 - DNA, 20 bp, human
gggccttcccaagggagccg

SEQ ID NO: 53724 - DNA, 20 bp, human
gggacaccgaggtcaggtct

SEQ ID NO: 53725 - DNA, 20 bp, human
ggcttcgcctgcaagtggag

SEQ ID NO: 53726 - DNA, 20 bp, human
gcgggcgccgaggctggaca

SEQ ID NO: 53727 - DNA, 20 bp, human
gtccgcgcccgcagccagtg

SEQ ID NO: 53728 - DNA, 20 bp, human
gggcgtgcagaggcttccct

SEQ ID NO: 53729 - DNA, 20 bp, human
gtagccggagcgcctgggga

SEQ ID NO: 53730 - DNA, 20 bp, human
gggctgcaggtcggcgcgag

SEQ ID NO: 53731 - DNA, 20 bp, human
gctctcgggtgttaattggg

SEQ ID NO: 53732 - DNA, 20 bp, human
gcgctaggcgacctacgccc

SEQ ID NO: 53733 - DNA, 20 bp, human
gaggaggcgaccgagagcag

SEQ ID NO: 53734 - DNA, 20 bp, human
gcagacagagccaaaatgga

SEQ ID NO: 53735 - DNA, 20 bp, human
gtactccctaggctcctctg

SEQ ID NO: 53736 - DNA, 20 bp, human
gcaggagcggaagaactagg

SEQ ID NO: 53737 - DNA, 20 bp, human
gcagccggcaacggaaacga

SEQ ID NO: 53738 - DNA, 20 bp, human
gcactgcaaacagccggcaa

SEQ ID NO: 53739 - DNA, 20 bp, human
ggcgccgcccgcgaatggga

SEQ ID NO: 53740 - DNA, 20 bp, human
gcaccgcgacccggaagtca

SEQ ID NO: 53741 - DNA, 20 bp, human
gtcacaggagcggaagaact

SEQ ID NO: 53742 - DNA, 20 bp, human
ggcggcgcctgagcacccca

SEQ ID NO: 53743 - DNA, 20 bp, human
gacacgtcacctctggacta

SEQ ID NO: 53744 - DNA, 20 bp, human
gaagagcgcatagcacagct

SEQ ID NO: 53745 - DNA, 20 bp, human
gtccgggtcgcggtgcttga

SEQ ID NO: 53746 - DNA, 20 bp, human
gagcagatgaggcctagccg

SEQ ID NO: 53747 - DNA, 20 bp, human
gagatgaggcctagccgagg

SEQ ID NO: 53748 - DNA, 20 bp, human
gtgaggcctagccgaggcgg

SEQ ID NO: 53749 - DNA, 20 bp, human
gcctcaaggcagcgagtcca

SEQ ID NO: 53750 - DNA, 20 bp, human
ggcccccaggacaaaactat

SEQ ID NO: 53751 - DNA, 20 bp, human
gcctgggacggagtcctcta

SEQ ID NO: 53752 - DNA, 20 bp, human
gatgacaaccagtcagacag

SEQ ID NO: 53753 - DNA, 20 bp, human
gccggctgctagctccgcac

SEQ ID NO: 53754 - DNA, 20 bp, human
gcacagagacagacgctcac

SEQ ID NO: 53755 - DNA, 20 bp, human
gaagagctttccaaacttgg

SEQ ID NO: 53756 - DNA, 20 bp, human
gagagggcgagaggcaacag

SEQ ID NO: 53757 - DNA, 20 bp, human
gtcccggaggcgaccgaagg

SEQ ID NO: 53758 - DNA, 20 bp, human
gcagcggaggaggaggactc

SEQ ID NO: 53759 - DNA, 20 bp, human
ggtgcaggcggctggagtcc

SEQ ID NO: 53760 - DNA, 20 bp, human
gggactgggggtgacacgga

SEQ ID NO: 53761 - DNA, 20 bp, human
gcaaaggattgcacaactcg

SEQ ID NO: 53762 - DNA, 20 bp, human
ggaccgaaggcggcgacccg

SEQ ID NO: 53763 - DNA, 20 bp, human
gcactgcatcgcaggactgg

SEQ ID NO: 53764 - DNA, 20 bp, human
gagctggttcctgctcgccg

SEQ ID NO: 53765 - DNA, 20 bp, human
gggactctggcgtgctacaa

SEQ ID NO: 53766 - DNA, 20 bp, human
gatccccgggctgctcggag

SEQ ID NO: 53767 - DNA, 20 bp, human
ggcgccgttggcctgaggta

SEQ ID NO: 53768 - DNA, 20 bp, human
ggagggctggctgcagacgt

SEQ ID NO: 53769 - DNA, 20 bp, human
gacctgcgtgctggatcccc

SEQ ID NO: 53770 - DNA, 20 bp, human
gctcgacaagggctgcgaag

SEQ ID NO: 53771 - DNA, 20 bp, human
gcttcctgcgccctcgacaa

SEQ ID NO: 53772 - DNA, 20 bp, human
gggcaaagcggcgacaacac

SEQ ID NO: 53773 - DNA, 20 bp, human
gctgcagggagggagctcgg

SEQ ID NO: 53774 - DNA, 20 bp, human
gggctgctcggaggggtgcg

SEQ ID NO: 53775 - DNA, 20 bp, human
gcagggatggaggcgctggg

SEQ ID NO: 53776 - DNA, 20 bp, human
gtccacaggtgtgcagactg

SEQ ID NO: 53777 - DNA, 20 bp, human
gtccaggccgagaggggtgg

SEQ ID NO: 53778 - DNA, 20 bp, human
gcgggtgcccgccctgtagg

SEQ ID NO: 53779 - DNA, 20 bp, human
gcccgagatggcgggtctga

SEQ ID NO: 53780 - DNA, 20 bp, human
gggcagttccgaggacccag

SEQ ID NO: 53781 - DNA, 20 bp, human
gcagcgggaacccctgggtc

SEQ ID NO: 53782 - DNA, 20 bp, human
gccttacctccaggccgaga

SEQ ID NO: 53783 - DNA, 20 bp, human
gtgtggtgtctccagaccca

SEQ ID NO: 53784 - DNA, 20 bp, human
gactgcaaggggtcccaggt

SEQ ID NO: 53785 - DNA, 20 bp, human
gatgctctgatccccctaca

SEQ ID NO: 53786 - DNA, 20 bp, human
ggagctttcgcagctggaga

SEQ ID NO: 53787 - DNA, 20 bp, human
gtcactatctcccgggtgaa

SEQ ID NO: 53788 - DNA, 20 bp, human
ggtcggaagtcactatctcc

SEQ ID NO: 53789 - DNA, 20 bp, human
ggagaaggtgagtgctggtg

SEQ ID NO: 53790 - DNA, 20 bp, human
ggtggccgggacctgaaagt

SEQ ID NO: 53791 - DNA, 20 bp, human
gtgggcaaaatgagcttctg

SEQ ID NO: 53792 - DNA, 20 bp, human
gagtcgcgcttggaaggatg

SEQ ID NO: 53793 - DNA, 20 bp, human
gtgggtaccagcagattcgg

SEQ ID NO: 53794 - DNA, 20 bp, human
gggacctgaaagtaggagag

SEQ ID NO: 53795 - DNA, 20 bp, human
gtggggagactgtagtccct

SEQ ID NO: 53796 - DNA, 20 bp, human
gcaacggcggagcgctcgga

SEQ ID NO: 53797 - DNA, 20 bp, human
gccaagctgcaggaaaatct

SEQ ID NO: 53798 - DNA, 20 bp, human
gggccagagagaagtccccg

SEQ ID NO: 53799 - DNA, 20 bp, human
ggtaggggccaggcgggcaa

SEQ ID NO: 53800 - DNA, 20 bp, human
gggtccagactcacccgtag

SEQ ID NO: 53801 - DNA, 20 bp, human
gctgggtgtgtctctcgtcg

SEQ ID NO: 53802 - DNA, 20 bp, human
gggggccaggcgggcaacgg

SEQ ID NO: 53803 - DNA, 20 bp, human
gaaagtcggcccagcagatg

SEQ ID NO: 53804 - DNA, 20 bp, human
gaaggtgcctggcaaagtta

SEQ ID NO: 53805 - DNA, 20 bp, human
gcggccagcaagcccgatgg

SEQ ID NO: 53806 - DNA, 20 bp, human
ggtccggagggtcggagggt

SEQ ID NO: 53807 - DNA, 20 bp, human
gggccccgtgcatgcaacag

SEQ ID NO: 53808 - DNA, 20 bp, human
gcggcttcctcgggcatccc

SEQ ID NO: 53809 - DNA, 20 bp, human
gcagagggacccggctaccc

SEQ ID NO: 53810 - DNA, 20 bp, human
gcactcaccatgatccgcag

SEQ ID NO: 53811 - DNA, 20 bp, human
ggaacccgctaccctcggag

SEQ ID NO: 53812 - DNA, 20 bp, human
ggcggacccggcccctccga

SEQ ID NO: 53813 - DNA, 20 bp, human
gggcggcgatgcgctgtcca

SEQ ID NO: 53814 - DNA, 20 bp, human
gggaagccgcccctccttcg

SEQ ID NO: 53815 - DNA, 20 bp, human
ggtgcatgcaacaggggact

SEQ ID NO: 53816 - DNA, 20 bp, human
gccgaggtgcaggtagtatg

SEQ ID NO: 53817 - DNA, 20 bp, human
gtggctgcgcccgggatagc

SEQ ID NO: 53818 - DNA, 20 bp, human
gcgggacagaaggaactcct

SEQ ID NO: 53819 - DNA, 20 bp, human
ggccactgcgatatataacg

SEQ ID NO: 53820 - DNA, 20 bp, human
ggtagtgtgaagccagtaca

SEQ ID NO: 53821 - DNA, 20 bp, human
gctacctgcacctcggacaa

SEQ ID NO: 53822 - DNA, 20 bp, human
gaacctaggcatgtgcgcgg

SEQ ID NO: 53823 - DNA, 20 bp, human
ggcggcgcagccagctatcc

SEQ ID NO: 53824 - DNA, 20 bp, human
gtccgcgttatatatcgcag

SEQ ID NO: 53825 - DNA, 20 bp, human
gaggtcgcgccagcccgggc

SEQ ID NO: 53826 - DNA, 20 bp, human
gccgggagctgcgagaccag

SEQ ID NO: 53827 - DNA, 20 bp, human
gggttcccgggagaaagacg

SEQ ID NO: 53828 - DNA, 20 bp, human
gtcccgggagaaagacgagg

SEQ ID NO: 53829 - DNA, 20 bp, human
gcaagcggaaggcgtcgtca

SEQ ID NO: 53830 - DNA, 20 bp, human
gtgcgatggaccaggtccag

SEQ ID NO: 53831 - DNA, 20 bp, human
gccggctgaggagattggag

SEQ ID NO: 53832 - DNA, 20 bp, human
ggaaggcagggccaagcgga

SEQ ID NO: 53833 - DNA, 20 bp, human
gaggcgtcgtcaaggttccc

SEQ ID NO: 53834 - DNA, 20 bp, human
ggagctgcgagaccaggggc

SEQ ID NO: 53835 - DNA, 20 bp, human
gtccacggcactcaacgaca

SEQ ID NO: 53836 - DNA, 20 bp, human
gatgtagaaggagacaccgg

SEQ ID NO: 53837 - DNA, 20 bp, human
gccgcgcgatgggaagagga

SEQ ID NO: 53838 - DNA, 20 bp, human
ggcgcagaggcggatgtaga

SEQ ID NO: 53839 - DNA, 20 bp, human
ggtggcagccggcgcagagg

SEQ ID NO: 53840 - DNA, 20 bp, human
gcgggtggcagccggcgcag

SEQ ID NO: 53841 - DNA, 20 bp, human
gcaccaggtccgagacctaa

SEQ ID NO: 53842 - DNA, 20 bp, human
gggacccgcgcgatgggaag

SEQ ID NO: 53843 - DNA, 20 bp, human
gtggctaggacccgcgcgat

SEQ ID NO: 53844 - DNA, 20 bp, human
gttgagcagcagcaaggcgg

SEQ ID NO: 53845 - DNA, 20 bp, human
gatccctccgcgtctggtgt

SEQ ID NO: 53846 - DNA, 20 bp, human
gtggggaagacctagggggg

SEQ ID NO: 53847 - DNA, 20 bp, human
gcattcatttcctcctacgg

SEQ ID NO: 53848 - DNA, 20 bp, human
gagcctctcagctacatcca

SEQ ID NO: 53849 - DNA, 20 bp, human
gacgaccgctggagaccgag

SEQ ID NO: 53850 - DNA, 20 bp, human
gcacgccgctcggtctccag

SEQ ID NO: 53851 - DNA, 20 bp, human
gagccctggatgtagctgag

SEQ ID NO: 53852 - DNA, 20 bp, human
ggtagccgcggttcacacag

SEQ ID NO: 53853 - DNA, 20 bp, human
gcggcgtccgcatccaccgt

SEQ ID NO: 53854 - DNA, 20 bp, human
ggtgtgaaccgcggctacat

SEQ ID NO: 53855 - DNA, 20 bp, human
gcatgaagcgcgaggtctgt

SEQ ID NO: 53856 - DNA, 20 bp, human
gcagtcggcggccgggacag

SEQ ID NO: 53857 - DNA, 20 bp, human
gagggaaggtcgggcccggt

SEQ ID NO: 53858 - DNA, 20 bp, human
gcttctcgggagcccccacc

SEQ ID NO: 53859 - DNA, 20 bp, human
gcacccggcagcatcccgaa

SEQ ID NO: 53860 - DNA, 20 bp, human
gagcatcccgaagggaaggt

SEQ ID NO: 53861 - DNA, 20 bp, human
ggcactcaccgcacagggag

SEQ ID NO: 53862 - DNA, 20 bp, human
gcgcggaggagaagagactg

SEQ ID NO: 53863 - DNA, 20 bp, human
gccctttccaacccagtcgg

SEQ ID NO: 53864 - DNA, 20 bp, human
gcggcagcatcccgaaggga

SEQ ID NO: 53865 - DNA, 20 bp, human
gtggccggatggaggaactt

SEQ ID NO: 53866 - DNA, 20 bp, human
gtgaccagttggcgacatgg

SEQ ID NO: 53867 - DNA, 20 bp, human
gccctcggagcggaactact

SEQ ID NO: 53868 - DNA, 20 bp, human
gcaggttactagcagctcat

SEQ ID NO: 53869 - DNA, 20 bp, human
gctgggagccgggtcgtaag

SEQ ID NO: 53870 - DNA, 20 bp, human
gcgtgagaagtctccagcac

SEQ ID NO: 53871 - DNA, 20 bp, human
gggctgaccagttggcgaca

SEQ ID NO: 53872 - DNA, 20 bp, human
ggacatggtggcacccgtgc

SEQ ID NO: 53873 - DNA, 20 bp, human
gtcgcctcctaggtctgggg

SEQ ID NO: 53874 - DNA, 20 bp, human
gccagccgagggccagacgg

SEQ ID NO: 53875 - DNA, 20 bp, human
gcctaggaggcgagtcgggt

SEQ ID NO: 53876 - DNA, 20 bp, human
gctacggcggcgcagaaatg

SEQ ID NO: 53877 - DNA, 20 bp, human
gatctctggtggctctgcta

SEQ ID NO: 53878 - DNA, 20 bp, human
gtctggtggctctgctacgg

SEQ ID NO: 53879 - DNA, 20 bp, human
gtgggaacgtctgaacggag

SEQ ID NO: 53880 - DNA, 20 bp, human
gccaggaagcctaagtgaaa

SEQ ID NO: 53881 - DNA, 20 bp, human
gtggacacactgaccctagg

SEQ ID NO: 53882 - DNA, 20 bp, human
ggaatggacacactgaccct

SEQ ID NO: 53883 - DNA, 20 bp, human
gctcctcggagggcatatat

SEQ ID NO: 53884 - DNA, 20 bp, human
ggaagtggatggtctctcat

SEQ ID NO: 53885 - DNA, 20 bp, human
gccagtcgccccgccaccta

SEQ ID NO: 53886 - DNA, 20 bp, human
ggtagtgttgccgcgagtac

SEQ ID NO: 53887 - DNA, 20 bp, human
ggacggtcgcgtgcccgcaa

SEQ ID NO: 53888 - DNA, 20 bp, human
gactggaggctctaagatgg

SEQ ID NO: 53889 - DNA, 20 bp, human
gggaatgaaatagagagcga

SEQ ID NO: 53890 - DNA, 20 bp, human
gactgcagacccagtactcg

SEQ ID NO: 53891 - DNA, 20 bp, human
gcgacctaagagctggtcta

SEQ ID NO: 53892 - DNA, 20 bp, human
gcctggagaaagcagaaggg

SEQ ID NO: 53893 - DNA, 20 bp, human
gttgagatggaggggaatac

SEQ ID NO: 53894 - DNA, 20 bp, human
gcctattgggttaacactgg

SEQ ID NO: 53895 - DNA, 20 bp, human
gctcgcggcaacactaccgc

SEQ ID NO: 53896 - DNA, 20 bp, human
gggacgcgagttggagatgt

SEQ ID NO: 53897 - DNA, 20 bp, human
gagcagcaccaggccgccca

SEQ ID NO: 53898 - DNA, 20 bp, human
gccccggcctaccctggata

SEQ ID NO: 53899 - DNA, 20 bp, human
gggcacaggtgccctatcca

SEQ ID NO: 53900 - DNA, 20 bp, human
gagagcgagggacggataaa

SEQ ID NO: 53901 - DNA, 20 bp, human
gatgcacttgctccccacta

SEQ ID NO: 53902 - DNA, 20 bp, human
ggcagggaccggacgcgagt

SEQ ID NO: 53903 - DNA, 20 bp, human
gtgggtcatgacgccatcag

SEQ ID NO: 53904 - DNA, 20 bp, human
ggaagggattgtcaaagagt

SEQ ID NO: 53905 - DNA, 20 bp, human
gcaggtgccctatccagggt

SEQ ID NO: 53906 - DNA, 20 bp, human
gttgcgcgagccgggctgtc

SEQ ID NO: 53907 - DNA, 20 bp, human
ggcttgggcccgccgaaagt

SEQ ID NO: 53908 - DNA, 20 bp, human
gtgggaagcatggccgacag

SEQ ID NO: 53909 - DNA, 20 bp, human
gccatctcgcatattctcaa

SEQ ID NO: 53910 - DNA, 20 bp, human
gagctcgcccatgaagacgg

SEQ ID NO: 53911 - DNA, 20 bp, human
gactgcagaataggcccgag

SEQ ID NO: 53912 - DNA, 20 bp, human
gaataggcccgagaggagag

SEQ ID NO: 53913 - DNA, 20 bp, human
gtgtggctggctcgcaaaag

SEQ ID NO: 53914 - DNA, 20 bp, human
gtccccgggtcgatcctctg

SEQ ID NO: 53915 - DNA, 20 bp, human
ggcggaatactgcatccggg

SEQ ID NO: 53916 - DNA, 20 bp, human
gattctgaagacaaagtata

SEQ ID NO: 53917 - DNA, 20 bp, human
gaaggagggttcttcatcag

SEQ ID NO: 53918 - DNA, 20 bp, human
ggttctgctcccaagagctc

SEQ ID NO: 53919 - DNA, 20 bp, human
gaggaaggtctagagcatca

SEQ ID NO: 53920 - DNA, 20 bp, human
gccaagagctctggattatc

SEQ ID NO: 53921 - DNA, 20 bp, human
gaagaaccagaagtagctgg

SEQ ID NO: 53922 - DNA, 20 bp, human
gtatctggggattggttgaa

SEQ ID NO: 53923 - DNA, 20 bp, human
gtgggagggtgtgacaagtg

SEQ ID NO: 53924 - DNA, 20 bp, human
ggaaccttaaagagagatcg

SEQ ID NO: 53925 - DNA, 20 bp, human
gttgacccggaaacttggga

SEQ ID NO: 53926 - DNA, 20 bp, human
gatgccaggaaacctctcat

SEQ ID NO: 53927 - DNA, 20 bp, human
gtcattggcggtggccgcag

SEQ ID NO: 53928 - DNA, 20 bp, human
gcgacgacctcggcgaccag

SEQ ID NO: 53929 - DNA, 20 bp, human
ggcactcacctaggagcggg

SEQ ID NO: 53930 - DNA, 20 bp, human
ggcgggaggcgtttcattgg

SEQ ID NO: 53931 - DNA, 20 bp, human
gtgagcactcacctaggagc

SEQ ID NO: 53932 - DNA, 20 bp, human
gttggcggtggccgcagtgg

SEQ ID NO: 53933 - DNA, 20 bp, human
ggaccattaacacccatgag

SEQ ID NO: 53934 - DNA, 20 bp, human
gccctgccgcgcccgcccag

SEQ ID NO: 53935 - DNA, 20 bp, human
ggcggctgtggacccgggac

SEQ ID NO: 53936 - DNA, 20 bp, human
ggatgctggtaagggcgggt

SEQ ID NO: 53937 - DNA, 20 bp, human
ggcgagccgcagcagtttca

SEQ ID NO: 53938 - DNA, 20 bp, human
gcgggtgggagagtcggcgg

SEQ ID NO: 53939 - DNA, 20 bp, human
ggtctccacgaggacccagg

SEQ ID NO: 53940 - DNA, 20 bp, human
gtcgccggcgcgccgggcaa

SEQ ID NO: 53941 - DNA, 20 bp, human
gcgcggtaagagcgtctcgg

SEQ ID NO: 53942 - DNA, 20 bp, human
gagagcgtctcgggggagtg

SEQ ID NO: 53943 - DNA, 20 bp, human
gtgagggagcagtctccacg

SEQ ID NO: 53944 - DNA, 20 bp, human
ggactcgccccaaagagcgc

SEQ ID NO: 53945 - DNA, 20 bp, human
gtggcgccagagggtccgcc

SEQ ID NO: 53946 - DNA, 20 bp, human
gcgcatcatggcggctgagt

SEQ ID NO: 53947 - DNA, 20 bp, human
ggaacctgacgagggaggac

SEQ ID NO: 53948 - DNA, 20 bp, human
ggcatgcgctcgcatcatgg

SEQ ID NO: 53949 - DNA, 20 bp, human
gctggtctaccaggtgtcag

SEQ ID NO: 53950 - DNA, 20 bp, human
gcggtctacgaagaccaagt

SEQ ID NO: 53951 - DNA, 20 bp, human
ggctacgctgctgattcctg

SEQ ID NO: 53952 - DNA, 20 bp, human
gtgggtcaggcacacgcgag

SEQ ID NO: 53953 - DNA, 20 bp, human
gaaatcgaacctgacgaggg

SEQ ID NO: 53954 - DNA, 20 bp, human
ggatcccgtcctccctcgtc

SEQ ID NO: 53955 - DNA, 20 bp, human
gggtgcatgcgctcgcatca

SEQ ID NO: 53956 - DNA, 20 bp, human
gtgggaagaagccgagatgg

SEQ ID NO: 53957 - DNA, 20 bp, human
gtggtgggaagaagccgaga

SEQ ID NO: 53958 - DNA, 20 bp, human
gcagccgtcccttcgctggt

SEQ ID NO: 53959 - DNA, 20 bp, human
gcgctgccccgggctcgact

SEQ ID NO: 53960 - DNA, 20 bp, human
gggaggacaagcgcacctgt

SEQ ID NO: 53961 - DNA, 20 bp, human
gcttcccaccagcgaaggga

SEQ ID NO: 53962 - DNA, 20 bp, human
gctcgggaatatgtatgagg

SEQ ID NO: 53963 - DNA, 20 bp, human
gcgggcggttgaaatgaaag

SEQ ID NO: 53964 - DNA, 20 bp, human
gcttggagaatccgacgtcc

SEQ ID NO: 53965 - DNA, 20 bp, human
gcgcacctgtcggaaggctc

SEQ ID NO: 53966 - DNA, 20 bp, human
gacgggccaagctgaggtgg

SEQ ID NO: 53967 - DNA, 20 bp, human
ggagtacgcgtccgggccaa

SEQ ID NO: 53968 - DNA, 20 bp, human
gccatcttcccagaacctag

SEQ ID NO: 53969 - DNA, 20 bp, human
ggcggaagaggcggaatagg

SEQ ID NO: 53970 - DNA, 20 bp, human
gcgcgtccgggccaagggaa

SEQ ID NO: 53971 - DNA, 20 bp, human
gtagaggcagcggggtgaga

SEQ ID NO: 53972 - DNA, 20 bp, human
gctgggcggtgcggaagagg

SEQ ID NO: 53973 - DNA, 20 bp, human
gaccgaggagcagacaccgt

SEQ ID NO: 53974 - DNA, 20 bp, human
gtgggaaggtaacttcgggt

SEQ ID NO: 53975 - DNA, 20 bp, human
gcactgtacgggccaagctg

SEQ ID NO: 53976 - DNA, 20 bp, human
gcagtcgcaggagagttctg

SEQ ID NO: 53977 - DNA, 20 bp, human
gaaggtcaccctgtcagagg

SEQ ID NO: 53978 - DNA, 20 bp, human
gggtaaggtcaccctgtcag

SEQ ID NO: 53979 - DNA, 20 bp, human
gaagctcggctcacagtcgc

SEQ ID NO: 53980 - DNA, 20 bp, human
gctggggtacacgggcaaag

SEQ ID NO: 53981 - DNA, 20 bp, human
gcgtcgcgccccctctgaca

SEQ ID NO: 53982 - DNA, 20 bp, human
gacgtcgtggcgcacctcag

SEQ ID NO: 53983 - DNA, 20 bp, human
gagaaagtgatgataacgat

SEQ ID NO: 53984 - DNA, 20 bp, human
gaggagagttctggggtaca

SEQ ID NO: 53985 - DNA, 20 bp, human
ggggcacagttgcttctctt

SEQ ID NO: 53986 - DNA, 20 bp, human
gggcgctgctgccccaacac

SEQ ID NO: 53987 - DNA, 20 bp, human
gcacaggcgggcactctctg

SEQ ID NO: 53988 - DNA, 20 bp, human
gagagtgcccgcctgtgttg

SEQ ID NO: 53989 - DNA, 20 bp, human
ggcggctgctccaggaccac

SEQ ID NO: 53990 - DNA, 20 bp, human
ggactccctcccccactcag

SEQ ID NO: 53991 - DNA, 20 bp, human
ggcccctgaggtgctaggac

SEQ ID NO: 53992 - DNA, 20 bp, human
gctgagtgggccggaagccg

SEQ ID NO: 53993 - DNA, 20 bp, human
gctcgggtcctctcccccta

SEQ ID NO: 53994 - DNA, 20 bp, human
gccacccatcaagggcatag

SEQ ID NO: 53995 - DNA, 20 bp, human
ggaccacaggtgaccgagtg

SEQ ID NO: 53996 - DNA, 20 bp, human
gcaaagcggagaacgctggt

SEQ ID NO: 53997 - DNA, 20 bp, human
ggactgaggaacatacgagg

SEQ ID NO: 53998 - DNA, 20 bp, human
gtttggactgagaagcatcg

SEQ ID NO: 53999 - DNA, 20 bp, human
gcctgttgtggagtacgctt

SEQ ID NO: 54000 - DNA, 20 bp, human
ggagacaaagcggagaacgc

SEQ ID NO: 54001 - DNA, 20 bp, human
ggtgggataagaagtatcgg

SEQ ID NO: 54002 - DNA, 20 bp, human
gggcttggtctaatctgagt

SEQ ID NO: 54003 - DNA, 20 bp, human
gaaggactgaggaacatacg

SEQ ID NO: 54004 - DNA, 20 bp, human
gttggtagatcaggaaatgt

SEQ ID NO: 54005 - DNA, 20 bp, human
gttcctgatctaccaatcat

SEQ ID NO: 54006 - DNA, 20 bp, human
gacttagcgttccctcagac

SEQ ID NO: 54007 - DNA, 20 bp, human
gcggccgcctcgctgatgaa

SEQ ID NO: 54008 - DNA, 20 bp, human
ggcagtggaagaaatgcccg

SEQ ID NO: 54009 - DNA, 20 bp, human
gtgctcggaagactgccggg

SEQ ID NO: 54010 - DNA, 20 bp, human
gggcagtcttccgagcaaga

SEQ ID NO: 54011 - DNA, 20 bp, human
gcgttccctcagacgggcag

SEQ ID NO: 54012 - DNA, 20 bp, human
ggaacgctaagtagtgtgtc

SEQ ID NO: 54013 - DNA, 20 bp, human
gtgcgcagcccgagacctcc

SEQ ID NO: 54014 - DNA, 20 bp, human
gcggcaataatccaggacgg

SEQ ID NO: 54015 - DNA, 20 bp, human
gcccgacagcgctgacaccg

SEQ ID NO: 54016 - DNA, 20 bp, human
gctgctgctgctgctatcgg

SEQ ID NO: 54017 - DNA, 20 bp, human
gggggcgtgcagttgttcca

SEQ ID NO: 54018 - DNA, 20 bp, human
ggagactgggagggcttccg

SEQ ID NO: 54019 - DNA, 20 bp, human
ggtctatgccgggagacctt

SEQ ID NO: 54020 - DNA, 20 bp, human
gactgcctcccaaggtctcc

SEQ ID NO: 54021 - DNA, 20 bp, human
gtcccggcatagaccgttag

SEQ ID NO: 54022 - DNA, 20 bp, human
ggtcatggcggccgctctgt

SEQ ID NO: 54023 - DNA, 20 bp, human
gtgtctcagactgaagggga

SEQ ID NO: 54024 - DNA, 20 bp, human
gccgccgagatccagtcctg

SEQ ID NO: 54025 - DNA, 20 bp, human
gtagacggagaagagcacgt

SEQ ID NO: 54026 - DNA, 20 bp, human
ggaagcgcgactggagtctg

SEQ ID NO: 54027 - DNA, 20 bp, human
gagagccacctccagcatgg

SEQ ID NO: 54028 - DNA, 20 bp, human
gaggagccgaggcccaaacg

SEQ ID NO: 54029 - DNA, 20 bp, human
gtccacgaagagggtgtggt

SEQ ID NO: 54030 - DNA, 20 bp, human
gccagggtgccgtggaagag

SEQ ID NO: 54031 - DNA, 20 bp, human
ggccgagaagcgggacgagg

SEQ ID NO: 54032 - DNA, 20 bp, human
gggggatgcagtccacgaag

SEQ ID NO: 54033 - DNA, 20 bp, human
ggcagtccacgaagagggtg

SEQ ID NO: 54034 - DNA, 20 bp, human
gaggagcacctccccctggg

SEQ ID NO: 54035 - DNA, 20 bp, human
ggccctttccgcgcttacca

SEQ ID NO: 54036 - DNA, 20 bp, human
gagtcgcggccgccagctag

SEQ ID NO: 54037 - DNA, 20 bp, human
gccaggcaggcgcagagtcg

SEQ ID NO: 54038 - DNA, 20 bp, human
ggaggggcacacagtcggtg

SEQ ID NO: 54039 - DNA, 20 bp, human
ggcccccggcccagtccagg

SEQ ID NO: 54040 - DNA, 20 bp, human
gacggacgcgagctaggcac

SEQ ID NO: 54041 - DNA, 20 bp, human
gttcccgcgcccctagctgg

SEQ ID NO: 54042 - DNA, 20 bp, human
gtgcgcatccacaaagccag

SEQ ID NO: 54043 - DNA, 20 bp, human
gtggcgagcgaggcctggac

SEQ ID NO: 54044 - DNA, 20 bp, human
gtgcaatcgggacctcctcc

SEQ ID NO: 54045 - DNA, 20 bp, human
gcacacagtcggtgaggcac

SEQ ID NO: 54046 - DNA, 20 bp, human
ggatccctgaaagtaaactg

SEQ ID NO: 54047 - DNA, 20 bp, human
ggttccatggtgcccgtaga

SEQ ID NO: 54048 - DNA, 20 bp, human
gcggattggaaatcactagt

SEQ ID NO: 54049 - DNA, 20 bp, human
ggtcacttgaagcagttcca

SEQ ID NO: 54050 - DNA, 20 bp, human
gttgctaataaggccctgcc

SEQ ID NO: 54051 - DNA, 20 bp, human
gtaataagattggcatgtgt

SEQ ID NO: 54052 - DNA, 20 bp, human
gtgttactgctgcaaatact

SEQ ID NO: 54053 - DNA, 20 bp, human
gaaatctgggaatagaatgc

SEQ ID NO: 54054 - DNA, 20 bp, human
gttccaatccgtaccaccag

SEQ ID NO: 54055 - DNA, 20 bp, human
gcgatgaaatcacaaagtac

SEQ ID NO: 54056 - DNA, 20 bp, human
gcggctgccgaggagcacgg

SEQ ID NO: 54057 - DNA, 20 bp, human
gaccaaaaccggccgagcaa

SEQ ID NO: 54058 - DNA, 20 bp, human
gccagagaagctataagagg

SEQ ID NO: 54059 - DNA, 20 bp, human
gctgccgaggagcacggcgg

SEQ ID NO: 54060 - DNA, 20 bp, human
gccggccaggatcaactcgt

SEQ ID NO: 54061 - DNA, 20 bp, human
gcttcgagtacgagacccag

SEQ ID NO: 54062 - DNA, 20 bp, human
gggcccgggcctaccaaaac

SEQ ID NO: 54063 - DNA, 20 bp, human
gggcacgagcgcatcgggag

SEQ ID NO: 54064 - DNA, 20 bp, human
gtcaccagagaagctataag

SEQ ID NO: 54065 - DNA, 20 bp, human
ggtacgagacccagaggcgg

SEQ ID NO: 54066 - DNA, 20 bp, human
gccaccaagattctgcagag

SEQ ID NO: 54067 - DNA, 20 bp, human
gtgcgtggcagttgaaagag

SEQ ID NO: 54068 - DNA, 20 bp, human
gatccgcaggcctgcgaccg

SEQ ID NO: 54069 - DNA, 20 bp, human
gtgcagagcggtgttcagga

SEQ ID NO: 54070 - DNA, 20 bp, human
gagttgcaggtgagcgtccc

SEQ ID NO: 54071 - DNA, 20 bp, human
ggagtggcgggagaagttgc

SEQ ID NO: 54072 - DNA, 20 bp, human
gtggcagttgaaagagtggc

SEQ ID NO: 54073 - DNA, 20 bp, human
gtctacttccgggccctgcg

SEQ ID NO: 54074 - DNA, 20 bp, human
ggaagtagatctcctgatag

SEQ ID NO: 54075 - DNA, 20 bp, human
gggagacatgtaacctgcct

SEQ ID NO: 54076 - DNA, 20 bp, human
gccggaagcgaggaagaggt

SEQ ID NO: 54077 - DNA, 20 bp, human
ggcgcgggttggacccggga

SEQ ID NO: 54078 - DNA, 20 bp, human
gccggccacccgcccaggta

SEQ ID NO: 54079 - DNA, 20 bp, human
gagcgaggaagaggtcggtc

SEQ ID NO: 54080 - DNA, 20 bp, human
gccaggtagggcgctcgcga

SEQ ID NO: 54081 - DNA, 20 bp, human
gggaccggggagtctccatt

SEQ ID NO: 54082 - DNA, 20 bp, human
gcatggcgcgggttggaccc

SEQ ID NO: 54083 - DNA, 20 bp, human
gccaggatggctgggaccgg

SEQ ID NO: 54084 - DNA, 20 bp, human
gtcggcacaaacccccgact

SEQ ID NO: 54085 - DNA, 20 bp, human
ggaagaggtcggtccggcca

SEQ ID NO: 54086 - DNA, 20 bp, human
gcctcgtgaacgaagcggtg

SEQ ID NO: 54087 - DNA, 20 bp, human
gcccaagcggccccgactag

SEQ ID NO: 54088 - DNA, 20 bp, human
gtcaagcctcgtgaacgaag

SEQ ID NO: 54089 - DNA, 20 bp, human
ggaggcttgaatccatcact

SEQ ID NO: 54090 - DNA, 20 bp, human
ggccagtctggagacagtca

SEQ ID NO: 54091 - DNA, 20 bp, human
gagaactgtttgaaggcggg

SEQ ID NO: 54092 - DNA, 20 bp, human
gttgggactccgtggaatga

SEQ ID NO: 54093 - DNA, 20 bp, human
gggagaagtagtaaatcgat

SEQ ID NO: 54094 - DNA, 20 bp, human
gggccatcttgcaacaatac

SEQ ID NO: 54095 - DNA, 20 bp, human
ggccccttaccctcattcca

SEQ ID NO: 54096 - DNA, 20 bp, human
gggcgctgcgtggagcatcg

SEQ ID NO: 54097 - DNA, 20 bp, human
gggcagccagctccgacaca

SEQ ID NO: 54098 - DNA, 20 bp, human
gtagggacaggggaacagaa

SEQ ID NO: 54099 - DNA, 20 bp, human
ggctccgacacatggagtag

SEQ ID NO: 54100 - DNA, 20 bp, human
ggagagggtccgagaagagt

SEQ ID NO: 54101 - DNA, 20 bp, human
gctcggccagcggggtgcaa

SEQ ID NO: 54102 - DNA, 20 bp, human
gtcgagctcctgggttgaaa

SEQ ID NO: 54103 - DNA, 20 bp, human
gggtcccctactccatgtgt

SEQ ID NO: 54104 - DNA, 20 bp, human
gacacggccatcccgcggtc

SEQ ID NO: 54105 - DNA, 20 bp, human
gagctcctgggttgaaaggg

SEQ ID NO: 54106 - DNA, 20 bp, human
gcgcctccgaacagccacag

SEQ ID NO: 54107 - DNA, 20 bp, human
gccccaggatccggtcatca

SEQ ID NO: 54108 - DNA, 20 bp, human
gtgcccctgtggctgttcgg

SEQ ID NO: 54109 - DNA, 20 bp, human
ggcagaggtagcagctccag

SEQ ID NO: 54110 - DNA, 20 bp, human
gatggcggggcgctccacag

SEQ ID NO: 54111 - DNA, 20 bp, human
ggtcatcagggaaagaggac

SEQ ID NO: 54112 - DNA, 20 bp, human
gcccactggaacctgtgtag

SEQ ID NO: 54113 - DNA, 20 bp, human
gaggacagggagaccagaag

SEQ ID NO: 54114 - DNA, 20 bp, human
ggcatccccggggccggcag

SEQ ID NO: 54115 - DNA, 20 bp, human
gagggccagctgggacgagg

SEQ ID NO: 54116 - DNA, 20 bp, human
ggggctgcagaaggagaagt

SEQ ID NO: 54117 - DNA, 20 bp, human
ggcggccgcggagcactggt

SEQ ID NO: 54118 - DNA, 20 bp, human
gaggaacgagaagccggagg

SEQ ID NO: 54119 - DNA, 20 bp, human
ggccgcccggggaagtccaa

SEQ ID NO: 54120 - DNA, 20 bp, human
gccgcgaaggcaagaggctc

SEQ ID NO: 54121 - DNA, 20 bp, human
gccgcagagggagccgcccg

SEQ ID NO: 54122 - DNA, 20 bp, human
ggccagggcgccgcccgcga

SEQ ID NO: 54123 - DNA, 20 bp, human
gccctgccaaagacgacgag

SEQ ID NO: 54124 - DNA, 20 bp, human
gcaggcagagctgactccgg

SEQ ID NO: 54125 - DNA, 20 bp, human
gcatgagcccctgggaccat

SEQ ID NO: 54126 - DNA, 20 bp, human
gagcagcgccggccactccg

SEQ ID NO: 54127 - DNA, 20 bp, human
gccgaggccgctgcacagag

SEQ ID NO: 54128 - DNA, 20 bp, human
gtcccgccccgagggtcccg

SEQ ID NO: 54129 - DNA, 20 bp, human
gcggccgggccagcgagctc

SEQ ID NO: 54130 - DNA, 20 bp, human
gcagccagacgagcaggcgg

SEQ ID NO: 54131 - DNA, 20 bp, human
ggagtggccggcgctgctag

SEQ ID NO: 54132 - DNA, 20 bp, human
ggtgtagagactgtagcggg

SEQ ID NO: 54133 - DNA, 20 bp, human
ggcgagctcgggggccgaag

SEQ ID NO: 54134 - DNA, 20 bp, human
gtctcgggggcgcaggccag

SEQ ID NO: 54135 - DNA, 20 bp, human
ggcacagccagacgagcagg

SEQ ID NO: 54136 - DNA, 20 bp, human
gcagctcagtgtgtggtgag

SEQ ID NO: 54137 - DNA, 20 bp, human
ggccagcgccggtcgcggtc

SEQ ID NO: 54138 - DNA, 20 bp, human
gcacgttccccggaacgcgg

SEQ ID NO: 54139 - DNA, 20 bp, human
gccagcgccagcgccggtcg

SEQ ID NO: 54140 - DNA, 20 bp, human
ggaagccgtcctccatgctg

SEQ ID NO: 54141 - DNA, 20 bp, human
gactggcgcgcggaccccgc

SEQ ID NO: 54142 - DNA, 20 bp, human
gcggcccggcggcctcagca

SEQ ID NO: 54143 - DNA, 20 bp, human
gcaacacgttccccggaacg

SEQ ID NO: 54144 - DNA, 20 bp, human
gcggaacgcggaggctgccc

SEQ ID NO: 54145 - DNA, 20 bp, human
ggcgcaaagttgttgcggag

SEQ ID NO: 54146 - DNA, 20 bp, human
ggctccaaagctactcatgg

SEQ ID NO: 54147 - DNA, 20 bp, human
gtggggggtggtctgcgaaa

SEQ ID NO: 54148 - DNA, 20 bp, human
gccgccgccatgagtagctt

SEQ ID NO: 54149 - DNA, 20 bp, human
gagacctccggggagcggtg

SEQ ID NO: 54150 - DNA, 20 bp, human
ggaagcggcagagccggtcc

SEQ ID NO: 54151 - DNA, 20 bp, human
ggaaaacggggccgagtaag

SEQ ID NO: 54152 - DNA, 20 bp, human
gagcaccttgctgattagga

SEQ ID NO: 54153 - DNA, 20 bp, human
gggacgcgatcctggaagaa

SEQ ID NO: 54154 - DNA, 20 bp, human
gggaggtctccgatgaaaac

SEQ ID NO: 54155 - DNA, 20 bp, human
gtgctgggggaactgcgggt

SEQ ID NO: 54156 - DNA, 20 bp, human
gcaaggtcggaactgaggag

SEQ ID NO: 54157 - DNA, 20 bp, human
gccccctgctatggagatag

SEQ ID NO: 54158 - DNA, 20 bp, human
gcgctgctgcgatactgcaa

SEQ ID NO: 54159 - DNA, 20 bp, human
gagcagggggacagacagag

SEQ ID NO: 54160 - DNA, 20 bp, human
gagcattccagaagcttgag

SEQ ID NO: 54161 - DNA, 20 bp, human
ggtgtcgtacaggccgcaga

SEQ ID NO: 54162 - DNA, 20 bp, human
ggtacaggccgcagaaggcc

SEQ ID NO: 54163 - DNA, 20 bp, human
gccgaggtggctagacggag

SEQ ID NO: 54164 - DNA, 20 bp, human
gggaccctgacccaagagca

SEQ ID NO: 54165 - DNA, 20 bp, human
gggatcttcagcaagggagg

SEQ ID NO: 54166 - DNA, 20 bp, human
ggcgccgtaccaccaccccg

SEQ ID NO: 54167 - DNA, 20 bp, human
gaggggaaggggaagcaccc

SEQ ID NO: 54168 - DNA, 20 bp, human
gagggcgaccggaggaactg

SEQ ID NO: 54169 - DNA, 20 bp, human
gcacccccgggagccgagag

SEQ ID NO: 54170 - DNA, 20 bp, human
ggcgaccggaggaactgtgg

SEQ ID NO: 54171 - DNA, 20 bp, human
ggaggcccggagtaacgcag

SEQ ID NO: 54172 - DNA, 20 bp, human
ggagctggacggctgtctgg

SEQ ID NO: 54173 - DNA, 20 bp, human
ggccgctcggagcaacccgg

SEQ ID NO: 54174 - DNA, 20 bp, human
gagacccaagcaactaggga

SEQ ID NO: 54175 - DNA, 20 bp, human
gacagcgccgcagcacaaac

SEQ ID NO: 54176 - DNA, 20 bp, human
ggccgcggcttactacccca

SEQ ID NO: 54177 - DNA, 20 bp, human
ggagccgctgccaccccgag

SEQ ID NO: 54178 - DNA, 20 bp, human
gaaaggagggtctgacacag

SEQ ID NO: 54179 - DNA, 20 bp, human
gggcgcggctctcaacgtga

SEQ ID NO: 54180 - DNA, 20 bp, human
gggaggggccctcagtccac

SEQ ID NO: 54181 - DNA, 20 bp, human
gaccggagtccgcggagggg

SEQ ID NO: 54182 - DNA, 20 bp, human
gctcagtccaccggagtccg

SEQ ID NO: 54183 - DNA, 20 bp, human
gccgggctccgggcttagag

SEQ ID NO: 54184 - DNA, 20 bp, human
ggccctggggtagtaagccg

SEQ ID NO: 54185 - DNA, 20 bp, human
ggcgaacggacggacgacgg

SEQ ID NO: 54186 - DNA, 20 bp, human
ggtcccggcagccagcggga

SEQ ID NO: 54187 - DNA, 20 bp, human
gcgagcgccgcaggtgaccg

SEQ ID NO: 54188 - DNA, 20 bp, human
gtgccacctgcggctcgagt

SEQ ID NO: 54189 - DNA, 20 bp, human
gcgcggctggcgggaagtcc

SEQ ID NO: 54190 - DNA, 20 bp, human
ggcgggtgggcgccccgaca

SEQ ID NO: 54191 - DNA, 20 bp, human
ggtacagcccgcgggagcac

SEQ ID NO: 54192 - DNA, 20 bp, human
ggggaagtcccggcagccag

SEQ ID NO: 54193 - DNA, 20 bp, human
gggctgtggctacaaagccg

SEQ ID NO: 54194 - DNA, 20 bp, human
gagactaggcgagccgaggc

SEQ ID NO: 54195 - DNA, 20 bp, human
gcacccactcgagccgcagg

SEQ ID NO: 54196 - DNA, 20 bp, human
gtggcgtccgctggcagcag

SEQ ID NO: 54197 - DNA, 20 bp, human
gcgctggcagcagaggttag

SEQ ID NO: 54198 - DNA, 20 bp, human
ggaggcactagtgcagtcgg

SEQ ID NO: 54199 - DNA, 20 bp, human
gacgcgccggtggcgtccgc

SEQ ID NO: 54200 - DNA, 20 bp, human
ggtcttactcggaagaaacg

SEQ ID NO: 54201 - DNA, 20 bp, human
gggtcgcccgagggacccgg

SEQ ID NO: 54202 - DNA, 20 bp, human
gacagacgcacacgtcccgg

SEQ ID NO: 54203 - DNA, 20 bp, human
gggacgtgtgcgtctgtggg

SEQ ID NO: 54204 - DNA, 20 bp, human
ggcgggccgaacagtcctga

SEQ ID NO: 54205 - DNA, 20 bp, human
ggcgcgtcccggatcccgcg

SEQ ID NO: 54206 - DNA, 20 bp, human
gtgaagggtcccagcgacag

SEQ ID NO: 54207 - DNA, 20 bp, human
gggaaacttataacctcggg

SEQ ID NO: 54208 - DNA, 20 bp, human
gagtatgtgaccgcactgag

SEQ ID NO: 54209 - DNA, 20 bp, human
gtcgctgggacccttcaggt

SEQ ID NO: 54210 - DNA, 20 bp, human
ggggagctgtcctacctgaa

SEQ ID NO: 54211 - DNA, 20 bp, human
gagaggaaacttataacctc

SEQ ID NO: 54212 - DNA, 20 bp, human
gtactggggtgtgtaatggg

SEQ ID NO: 54213 - DNA, 20 bp, human
ggcaatcggaatcaaaacgg

SEQ ID NO: 54214 - DNA, 20 bp, human
ggggttcttgttctaggatg

SEQ ID NO: 54215 - DNA, 20 bp, human
gcggagtctggggaaatcaa

SEQ ID NO: 54216 - DNA, 20 bp, human
gcgagcgtggcgcagaccag

SEQ ID NO: 54217 - DNA, 20 bp, human
gctgcccgcgaggcgagtct

SEQ ID NO: 54218 - DNA, 20 bp, human
ggcgctggcagctggatcga

SEQ ID NO: 54219 - DNA, 20 bp, human
gcgggccagcgggtcctcct

SEQ ID NO: 54220 - DNA, 20 bp, human
gggtgcgcccacaactcacc

SEQ ID NO: 54221 - DNA, 20 bp, human
gtgagttgtgggcgcaccca

SEQ ID NO: 54222 - DNA, 20 bp, human
gccagcgccgggtgagttgt

SEQ ID NO: 54223 - DNA, 20 bp, human
gggcgcagaccagaggtcgg

SEQ ID NO: 54224 - DNA, 20 bp, human
ggtccccagactcgcctcgc

SEQ ID NO: 54225 - DNA, 20 bp, human
gagagccccgggtgtaagtc

SEQ ID NO: 54226 - DNA, 20 bp, human
gctgggcaccaaagagtcct

SEQ ID NO: 54227 - DNA, 20 bp, human
gccaggaacaggggacctag

SEQ ID NO: 54228 - DNA, 20 bp, human
gaaggaggcccagacagtga

SEQ ID NO: 54229 - DNA, 20 bp, human
gacctcgtggacatagccag

SEQ ID NO: 54230 - DNA, 20 bp, human
gccagccctgaataacggac

SEQ ID NO: 54231 - DNA, 20 bp, human
gaccagtctggcagcagggt

SEQ ID NO: 54232 - DNA, 20 bp, human
ggcctcgggagggtgaaagg

SEQ ID NO: 54233 - DNA, 20 bp, human
gaagtcccagccctgaataa

SEQ ID NO: 54234 - DNA, 20 bp, human
gctttggtgcccaggaacag

SEQ ID NO: 54235 - DNA, 20 bp, human
gggcacggaggcccgagcga

SEQ ID NO: 54236 - DNA, 20 bp, human
gctcacactcaccccagaag

SEQ ID NO: 54237 - DNA, 20 bp, human
ggagtgtgaggctgaatggg

SEQ ID NO: 54238 - DNA, 20 bp, human
gctagtgggtaggagcagac

SEQ ID NO: 54239 - DNA, 20 bp, human
gtcaacctgctcctcttctg

SEQ ID NO: 54240 - DNA, 20 bp, human
gcttgaggctgatattctag

SEQ ID NO: 54241 - DNA, 20 bp, human
ggatggacttccctgagcta

SEQ ID NO: 54242 - DNA, 20 bp, human
gagaactacagcataatgcg

SEQ ID NO: 54243 - DNA, 20 bp, human
gtcagggaagtccatctgtt

SEQ ID NO: 54244 - DNA, 20 bp, human
gaggctgaatggggggctag

SEQ ID NO: 54245 - DNA, 20 bp, human
gtgacacacaggacttgctc

SEQ ID NO: 54246 - DNA, 20 bp, human
gctgcccagcctgcggagac

SEQ ID NO: 54247 - DNA, 20 bp, human
gatagcgcatagaaagacat

SEQ ID NO: 54248 - DNA, 20 bp, human
ggagaaagacgagaaagacg

SEQ ID NO: 54249 - DNA, 20 bp, human
gtgcgctatattaagagcag

SEQ ID NO: 54250 - DNA, 20 bp, human
gattaagagcagtggctctg

SEQ ID NO: 54251 - DNA, 20 bp, human
gatagaaagacatgggcggg

SEQ ID NO: 54252 - DNA, 20 bp, human
ggtgtctgtggggccggcga

SEQ ID NO: 54253 - DNA, 20 bp, human
gttggcatctgctccataag

SEQ ID NO: 54254 - DNA, 20 bp, human
gtcctcgctaccacccccag

SEQ ID NO: 54255 - DNA, 20 bp, human
gctgtcccgtctccgcaggc

SEQ ID NO: 54256 - DNA, 20 bp, human
ggaaagaccagaaagatccg

SEQ ID NO: 54257 - DNA, 20 bp, human
gcagaccccccggatctttc

SEQ ID NO: 54258 - DNA, 20 bp, human
gatcacaggtgtggagaaat

SEQ ID NO: 54259 - DNA, 20 bp, human
ggcttggtggcagacgtctg

SEQ ID NO: 54260 - DNA, 20 bp, human
gccgcacagagcagaccccc

SEQ ID NO: 54261 - DNA, 20 bp, human
ggtgtccacataaaagccca

SEQ ID NO: 54262 - DNA, 20 bp, human
gaaagcccagggagggagaa

SEQ ID NO: 54263 - DNA, 20 bp, human
ggcggtgaagcttctcttct

SEQ ID NO: 54264 - DNA, 20 bp, human
gccagctgctactactcagg

SEQ ID NO: 54265 - DNA, 20 bp, human
gcctgcctggcatcggaaga

SEQ ID NO: 54266 - DNA, 20 bp, human
ggcacagtagagagcttcca

SEQ ID NO: 54267 - DNA, 20 bp, human
gttgagctaggaaaggtggt

SEQ ID NO: 54268 - DNA, 20 bp, human
gaatggtccctgcatttctg

SEQ ID NO: 54269 - DNA, 20 bp, human
gaggaaaggtggttggctta

SEQ ID NO: 54270 - DNA, 20 bp, human
gtttcttgagctaggaaagg

SEQ ID NO: 54271 - DNA, 20 bp, human
gccaagctactagattggat

SEQ ID NO: 54272 - DNA, 20 bp, human
gccaagtggtccctgactgg

SEQ ID NO: 54273 - DNA, 20 bp, human
gtgttacagtcacacatacc

SEQ ID NO: 54274 - DNA, 20 bp, human
gccctgcatttctgtggtac

SEQ ID NO: 54275 - DNA, 20 bp, human
ggtgactgtaacaatgactg

SEQ ID NO: 54276 - DNA, 20 bp, human
gggcagtgcggggacaccgg

SEQ ID NO: 54277 - DNA, 20 bp, human
gctgcgaggcgcgagttagc

SEQ ID NO: 54278 - DNA, 20 bp, human
gcagccgcgggagctgtgcg

SEQ ID NO: 54279 - DNA, 20 bp, human
gtgcacaccccgcaaggcgg

SEQ ID NO: 54280 - DNA, 20 bp, human
gttggccaccaaggactcta

SEQ ID NO: 54281 - DNA, 20 bp, human
gacgctgtggccggaccccg

SEQ ID NO: 54282 - DNA, 20 bp, human
gcacagcgtacggccaggcg

SEQ ID NO: 54283 - DNA, 20 bp, human
ggtcccagcgggactccgaa

SEQ ID NO: 54284 - DNA, 20 bp, human
gtccagcccgcggccaagcg

SEQ ID NO: 54285 - DNA, 20 bp, human
gttggccgcgggctggaaca

SEQ ID NO: 54286 - DNA, 20 bp, human
ggaggaagcggaactctctg

SEQ ID NO: 54287 - DNA, 20 bp, human
gaggccgctagaatggaccc

SEQ ID NO: 54288 - DNA, 20 bp, human
gctagaatggaccccggcag

SEQ ID NO: 54289 - DNA, 20 bp, human
gggcgggccggaccaggtca

SEQ ID NO: 54290 - DNA, 20 bp, human
gttgccggcgcactgcggag

SEQ ID NO: 54291 - DNA, 20 bp, human
gagcgctcaggccgctagaa

SEQ ID NO: 54292 - DNA, 20 bp, human
gggaccttgccggcgcactg

SEQ ID NO: 54293 - DNA, 20 bp, human
gtgcctgggcgcgcagatct

SEQ ID NO: 54294 - DNA, 20 bp, human
gcggcggacgaattccccgg

SEQ ID NO: 54295 - DNA, 20 bp, human
gatggaccccggcagcggcg

SEQ ID NO: 54296 - DNA, 20 bp, human
gtaagtccaaggacaatcca

SEQ ID NO: 54297 - DNA, 20 bp, human
gcaaccgtcctggctccgag

SEQ ID NO: 54298 - DNA, 20 bp, human
ggcagggcgccctaagtcca

SEQ ID NO: 54299 - DNA, 20 bp, human
gcgaggacggacgagaattg

SEQ ID NO: 54300 - DNA, 20 bp, human
ggaagaagcgaacacttcca

SEQ ID NO: 54301 - DNA, 20 bp, human
ggcaaagtgggtggtgaaca

SEQ ID NO: 54302 - DNA, 20 bp, human
ggccgcgggtctggactgaa

SEQ ID NO: 54303 - DNA, 20 bp, human
ggactgaaggggcgcaaagt

SEQ ID NO: 54304 - DNA, 20 bp, human
ggagtagacgcccctaccgg

SEQ ID NO: 54305 - DNA, 20 bp, human
gcagagcccgcgggatcccc

SEQ ID NO: 54306 - DNA, 20 bp, human
gtcttcctaggcagtagtga

SEQ ID NO: 54307 - DNA, 20 bp, human
gacgggccgctggcaaagtg

SEQ ID NO: 54308 - DNA, 20 bp, human
gaaagtctagccatcttcct

SEQ ID NO: 54309 - DNA, 20 bp, human
gagtggggtggggagcgagg

SEQ ID NO: 54310 - DNA, 20 bp, human
ggcaggcgaagcctcagcga

SEQ ID NO: 54311 - DNA, 20 bp, human
gctttgccagcggcccgtgg

SEQ ID NO: 54312 - DNA, 20 bp, human
gcctcagcgaaggcacgggg

SEQ ID NO: 54313 - DNA, 20 bp, human
gcagctgtgcccagagcgtg

SEQ ID NO: 54314 - DNA, 20 bp, human
gaaacccctcactactgcct

SEQ ID NO: 54315 - DNA, 20 bp, human
ggaagcctcagcgaaggcac

SEQ ID NO: 54316 - DNA, 20 bp, human
gggagggccgaaggctgatt

SEQ ID NO: 54317 - DNA, 20 bp, human
gcgtccccggagaaccagtg

SEQ ID NO: 54318 - DNA, 20 bp, human
ggccgaaggctgatttggaa

SEQ ID NO: 54319 - DNA, 20 bp, human
gccgcgccgggcgcacatgg

SEQ ID NO: 54320 - DNA, 20 bp, human
gatcccacactggttctccg

SEQ ID NO: 54321 - DNA, 20 bp, human
gctccgtgtgcgccgcggga

SEQ ID NO: 54322 - DNA, 20 bp, human
ggcggctcggagcagctctt

SEQ ID NO: 54323 - DNA, 20 bp, human
gtcagccttcggccctcccg

SEQ ID NO: 54324 - DNA, 20 bp, human
gtgatttggaagggcgtccc

SEQ ID NO: 54325 - DNA, 20 bp, human
gcccaagcctggcgaagcag

SEQ ID NO: 54326 - DNA, 20 bp, human
gagaccaggggagacgcgcc

SEQ ID NO: 54327 - DNA, 20 bp, human
gcagccgcgggaggagagtc

SEQ ID NO: 54328 - DNA, 20 bp, human
gcggggtccgaggagaacgg

SEQ ID NO: 54329 - DNA, 20 bp, human
gttgcacacggcctcggcgg

SEQ ID NO: 54330 - DNA, 20 bp, human
gggaggagagacccccccct

SEQ ID NO: 54331 - DNA, 20 bp, human
ggaggagcaggaccacgagg

SEQ ID NO: 54332 - DNA, 20 bp, human
gctgcgtctcccggctggtg

SEQ ID NO: 54333 - DNA, 20 bp, human
gaggcgccggccgggagtgt

SEQ ID NO: 54334 - DNA, 20 bp, human
gtcgccgcgaggaacccggg

SEQ ID NO: 54335 - DNA, 20 bp, human
ggagacgggagacaagtgtc

SEQ ID NO: 54336 - DNA, 20 bp, human
ggtgggcgtccataacctgg

SEQ ID NO: 54337 - DNA, 20 bp, human
gcaaatggcggcatcgaacg

SEQ ID NO: 54338 - DNA, 20 bp, human
ggagtcttacaaacaaatgg

SEQ ID NO: 54339 - DNA, 20 bp, human
gggcgtccataacctggtgg

SEQ ID NO: 54340 - DNA, 20 bp, human
gttggtgggcgtccataacc

SEQ ID NO: 54341 - DNA, 20 bp, human
gcctgagtcttacaaacaaa

SEQ ID NO: 54342 - DNA, 20 bp, human
ggatgtggataaaaaagcag

SEQ ID NO: 54343 - DNA, 20 bp, human
gggttaccaccaccaggtta

SEQ ID NO: 54344 - DNA, 20 bp, human
ggagctacaggttcatgtgt

SEQ ID NO: 54345 - DNA, 20 bp, human
gcaatcagcaatgaagaagg

SEQ ID NO: 54346 - DNA, 20 bp, human
gtccggagcgcgtcacggta

SEQ ID NO: 54347 - DNA, 20 bp, human
gggcggggcgcagactgctc

SEQ ID NO: 54348 - DNA, 20 bp, human
ggcgtggggacgacagacgg

SEQ ID NO: 54349 - DNA, 20 bp, human
ggaagcgaggagccgagcta

SEQ ID NO: 54350 - DNA, 20 bp, human
gagcgcctgcaacaggtccg

SEQ ID NO: 54351 - DNA, 20 bp, human
gctccgcggtgcaatgtctg

SEQ ID NO: 54352 - DNA, 20 bp, human
ggcgtctccggagcgcgtca

SEQ ID NO: 54353 - DNA, 20 bp, human
gtgggggaaacttacagcag

SEQ ID NO: 54354 - DNA, 20 bp, human
gctcgcggaccggctaccga

SEQ ID NO: 54355 - DNA, 20 bp, human
ggcggcgtggggacgacaga

SEQ ID NO: 54356 - DNA, 20 bp, human
gtcgcggtagctgcaactgg

SEQ ID NO: 54357 - DNA, 20 bp, human
gcaactgggggcatgtccag

SEQ ID NO: 54358 - DNA, 20 bp, human
gtacgcagccgagcagggta

SEQ ID NO: 54359 - DNA, 20 bp, human
gcgctcgcagaggccgccat

SEQ ID NO: 54360 - DNA, 20 bp, human
ggcctgcagagctcgcgccg

SEQ ID NO: 54361 - DNA, 20 bp, human
ggaaccacttcgcttacctg

SEQ ID NO: 54362 - DNA, 20 bp, human
ggagccgcaggtaagcgaag

SEQ ID NO: 54363 - DNA, 20 bp, human
gggccccgccgcgctcgcag

SEQ ID NO: 54364 - DNA, 20 bp, human
gtcttggcccaaggcaccga

SEQ ID NO: 54365 - DNA, 20 bp, human
gagccagcgcgcggtgccca

SEQ ID NO: 54366 - DNA, 20 bp, human
gggagcagcagagcccaacc

SEQ ID NO: 54367 - DNA, 20 bp, human
ggcgtcgcgggatccaacga

SEQ ID NO: 54368 - DNA, 20 bp, human
ggggcgagctggccaagtac

SEQ ID NO: 54369 - DNA, 20 bp, human
gaaaggacgccggggacacc

SEQ ID NO: 54370 - DNA, 20 bp, human
ggttccgaggcccaagccct

SEQ ID NO: 54371 - DNA, 20 bp, human
ggatgccacgcccctcatac

SEQ ID NO: 54372 - DNA, 20 bp, human
gacgccggggacacccggtt

SEQ ID NO: 54373 - DNA, 20 bp, human
ggcacagcacgtacgactcg

SEQ ID NO: 54374 - DNA, 20 bp, human
gttgggcctcggaacccaga

SEQ ID NO: 54375 - DNA, 20 bp, human
ggagcccaaccgggtgtccc

SEQ ID NO: 54376 - DNA, 20 bp, human
gcccagttggaggccaaaaa

SEQ ID NO: 54377 - DNA, 20 bp, human
gttggaggccaaaaagggag

SEQ ID NO: 54378 - DNA, 20 bp, human
gctccaactgggcaccatga

SEQ ID NO: 54379 - DNA, 20 bp, human
gagggccgtgggacaaggga

SEQ ID NO: 54380 - DNA, 20 bp, human
gcacagcacggccaatacca

SEQ ID NO: 54381 - DNA, 20 bp, human
ggggcagggccgtgggacaa

SEQ ID NO: 54382 - DNA, 20 bp, human
gactgtaaggaataaagcta

SEQ ID NO: 54383 - DNA, 20 bp, human
gtcctccaaggtgtcaagaa

SEQ ID NO: 54384 - DNA, 20 bp, human
gccccagacaacaaaatctt

SEQ ID NO: 54385 - DNA, 20 bp, human
gcttggggagatcaaaagtc

SEQ ID NO: 54386 - DNA, 20 bp, human
ggcggaagcggagggatctc

SEQ ID NO: 54387 - DNA, 20 bp, human
ggcgggagaagacccggcag

SEQ ID NO: 54388 - DNA, 20 bp, human
gccgcttcaagggaaagcaa

SEQ ID NO: 54389 - DNA, 20 bp, human
gctagggactgtggcctcgg

SEQ ID NO: 54390 - DNA, 20 bp, human
ggagaaccgcgcccaccccg

SEQ ID NO: 54391 - DNA, 20 bp, human
gagaccgggacaccgaggcg

SEQ ID NO: 54392 - DNA, 20 bp, human
ggcagtgcaagcgtagaacc

SEQ ID NO: 54393 - DNA, 20 bp, human
gagggccatggcttcgtccc

SEQ ID NO: 54394 - DNA, 20 bp, human
gtgacgcttctgtcctccta

SEQ ID NO: 54395 - DNA, 20 bp, human
gaggacagaagcgtcaaact

SEQ ID NO: 54396 - DNA, 20 bp, human
gggccccagggcgcagatga

SEQ ID NO: 54397 - DNA, 20 bp, human
gagggcgcagatgaaggctg

SEQ ID NO: 54398 - DNA, 20 bp, human
gatgaaggctgtggtatgac

SEQ ID NO: 54399 - DNA, 20 bp, human
gagctcaggatacaggaagg

SEQ ID NO: 54400 - DNA, 20 bp, human
gccctccagagccccaagga

SEQ ID NO: 54401 - DNA, 20 bp, human
gtgctgtcactgccatccat

SEQ ID NO: 54402 - DNA, 20 bp, human
ggaaggaggccgggaatact

SEQ ID NO: 54403 - DNA, 20 bp, human
ggctcgcacggggacccgag

SEQ ID NO: 54404 - DNA, 20 bp, human
gtggggcctggtccgtgcac

SEQ ID NO: 54405 - DNA, 20 bp, human
gtggcccagccccttctcta

SEQ ID NO: 54406 - DNA, 20 bp, human
gcacccggtcggctacacgg

SEQ ID NO: 54407 - DNA, 20 bp, human
ggcgtgcgcggacagtgtca

SEQ ID NO: 54408 - DNA, 20 bp, human
gggtcacccggtcggctaca

SEQ ID NO: 54409 - DNA, 20 bp, human
gtctatgcggaagatcccgg

SEQ ID NO: 54410 - DNA, 20 bp, human
ggcggtgacggtcacccggt

SEQ ID NO: 54411 - DNA, 20 bp, human
ggacagtgtcatggaggccg

SEQ ID NO: 54412 - DNA, 20 bp, human
gcgccgccgtgtagccgacc

SEQ ID NO: 54413 - DNA, 20 bp, human
gtgcgcggacagtgtcatgg

SEQ ID NO: 54414 - DNA, 20 bp, human
gcacagtaagggacagaggg

SEQ ID NO: 54415 - DNA, 20 bp, human
gagtgtcatggaggccgcgg

SEQ ID NO: 54416 - DNA, 20 bp, human
ggagatggggacacacggag

SEQ ID NO: 54417 - DNA, 20 bp, human
ggctcaccgcagaccgcccg

SEQ ID NO: 54418 - DNA, 20 bp, human
gggaggaggtgcggccccaa

SEQ ID NO: 54419 - DNA, 20 bp, human
ggacacgtccatgggaacag

SEQ ID NO: 54420 - DNA, 20 bp, human
gcgccgcggcgcgaccgggg

SEQ ID NO: 54421 - DNA, 20 bp, human
gacgtccatgggaacagagg

SEQ ID NO: 54422 - DNA, 20 bp, human
ggtagagaaatgagacatag

SEQ ID NO: 54423 - DNA, 20 bp, human
gggctcaactcaggtaagaa

SEQ ID NO: 54424 - DNA, 20 bp, human
gcgcgcaccaggctcaactc

SEQ ID NO: 54425 - DNA, 20 bp, human
gtcccgccgcggcgcgaccg

SEQ ID NO: 54426 - DNA, 20 bp, human
ggcggtggtgcgaggctcag

SEQ ID NO: 54427 - DNA, 20 bp, human
gggcggagtccggggctcag

SEQ ID NO: 54428 - DNA, 20 bp, human
ggggcaggggctcactcgag

SEQ ID NO: 54429 - DNA, 20 bp, human
gcctctcccccgcggcactc

SEQ ID NO: 54430 - DNA, 20 bp, human
gaaagcctgggcccacgtca

SEQ ID NO: 54431 - DNA, 20 bp, human
gccctgcccgagtgccgcgg

SEQ ID NO: 54432 - DNA, 20 bp, human
gccccggactcacccgaggt

SEQ ID NO: 54433 - DNA, 20 bp, human
gaagtcccgtcgggtggcag

SEQ ID NO: 54434 - DNA, 20 bp, human
ggctctgtcctgacaactac

SEQ ID NO: 54435 - DNA, 20 bp, human
ggccagccgctgccacccga

SEQ ID NO: 54436 - DNA, 20 bp, human
ggagagaggactgctaagag

SEQ ID NO: 54437 - DNA, 20 bp, human
gctccaaggctacttcatcg

SEQ ID NO: 54438 - DNA, 20 bp, human
gtagcaatccggagagaaat

SEQ ID NO: 54439 - DNA, 20 bp, human
gggataacttgttagagaaa

SEQ ID NO: 54440 - DNA, 20 bp, human
gtcgccttctgaaggaccac

SEQ ID NO: 54441 - DNA, 20 bp, human
ggctaagagggggttaaagg

SEQ ID NO: 54442 - DNA, 20 bp, human
ggaacctgtggtccttcaga

SEQ ID NO: 54443 - DNA, 20 bp, human
gagaaaaggtcgaaatatct

SEQ ID NO: 54444 - DNA, 20 bp, human
gggtgttttcttcccgagag

SEQ ID NO: 54445 - DNA, 20 bp, human
gagaaagggacggagatact

SEQ ID NO: 54446 - DNA, 20 bp, human
gcggcgcggacagtatctgt

SEQ ID NO: 54447 - DNA, 20 bp, human
gcggcgagatctccgtgctc

SEQ ID NO: 54448 - DNA, 20 bp, human
gcctaggcgacgagacccag

SEQ ID NO: 54449 - DNA, 20 bp, human
ggccgagtcactgtcaggga

SEQ ID NO: 54450 - DNA, 20 bp, human
gcgtcgcctaggagaggaag

SEQ ID NO: 54451 - DNA, 20 bp, human
gagtcactgtcagggaaggt

SEQ ID NO: 54452 - DNA, 20 bp, human
gcggggccgagtcactgtca

SEQ ID NO: 54453 - DNA, 20 bp, human
ggggtctcgtcgcctaggag

SEQ ID NO: 54454 - DNA, 20 bp, human
gaccgaggtgaacgtaaagc

SEQ ID NO: 54455 - DNA, 20 bp, human
gctaggcaggaagtcggcgc

SEQ ID NO: 54456 - DNA, 20 bp, human
gggactgcagactcagacgg

SEQ ID NO: 54457 - DNA, 20 bp, human
gactcagacggtggtagtgg

SEQ ID NO: 54458 - DNA, 20 bp, human
gcagactcagacggtggtag

SEQ ID NO: 54459 - DNA, 20 bp, human
gaggagagaggggagtccaa

SEQ ID NO: 54460 - DNA, 20 bp, human
ggcagagggccagaaagcga

SEQ ID NO: 54461 - DNA, 20 bp, human
gacggcggcgctgagagagc

SEQ ID NO: 54462 - DNA, 20 bp, human
gcggtgctcgccctcatcta

SEQ ID NO: 54463 - DNA, 20 bp, human
gctgcaccgggccagagatg

SEQ ID NO: 54464 - DNA, 20 bp, human
gcagggagggaaggcgccct

SEQ ID NO: 54465 - DNA, 20 bp, human
gcagcggcaccgggtaaagg

SEQ ID NO: 54466 - DNA, 20 bp, human
gatggagctccgagtctagg

SEQ ID NO: 54467 - DNA, 20 bp, human
gcctccagcgaagacatccc

SEQ ID NO: 54468 - DNA, 20 bp, human
gtggatggagctccgagtct

SEQ ID NO: 54469 - DNA, 20 bp, human
gcccagctgccacctagact

SEQ ID NO: 54470 - DNA, 20 bp, human
gcagcgaagacatcccaggt

SEQ ID NO: 54471 - DNA, 20 bp, human
gaaggagaaggcctaagtgg

SEQ ID NO: 54472 - DNA, 20 bp, human
ggactgcttgaccagagggg

SEQ ID NO: 54473 - DNA, 20 bp, human
gtaaatgcgcagcctgagag

SEQ ID NO: 54474 - DNA, 20 bp, human
ggaacagactgcttgaccag

SEQ ID NO: 54475 - DNA, 20 bp, human
gcccaggagctatagataag

SEQ ID NO: 54476 - DNA, 20 bp, human
ggcagctcgagcccagtccg

SEQ ID NO: 54477 - DNA, 20 bp, human
gtaggcgttccacccggcca

SEQ ID NO: 54478 - DNA, 20 bp, human
ggggagagaggtgaagggta

SEQ ID NO: 54479 - DNA, 20 bp, human
gtatttgcaaaggacggtag

SEQ ID NO: 54480 - DNA, 20 bp, human
ggcctacatcgacaacctca

SEQ ID NO: 54481 - DNA, 20 bp, human
gtcgatgtaggcgttccacc

SEQ ID NO: 54482 - DNA, 20 bp, human
gagcggagccgcggtccgga

SEQ ID NO: 54483 - DNA, 20 bp, human
ggcaggaagtggcggtgcga

SEQ ID NO: 54484 - DNA, 20 bp, human
gtgtctgggctggcgagtgg

SEQ ID NO: 54485 - DNA, 20 bp, human
gctgccccgataccaaagtc

SEQ ID NO: 54486 - DNA, 20 bp, human
gcgcagctgtgggaccacta

SEQ ID NO: 54487 - DNA, 20 bp, human
gaccaggtgcccgtagacgt

SEQ ID NO: 54488 - DNA, 20 bp, human
ggagatttaaggctacagcg

SEQ ID NO: 54489 - DNA, 20 bp, human
gctcctaccatggaggaaga

SEQ ID NO: 54490 - DNA, 20 bp, human
gcgacagcagggacgctcgt

SEQ ID NO: 54491 - DNA, 20 bp, human
gcttaaatctcctaccatgg

SEQ ID NO: 54492 - DNA, 20 bp, human
gctggagggaaggagcggga

SEQ ID NO: 54493 - DNA, 20 bp, human
gccagcctgccgacgtctac

SEQ ID NO: 54494 - DNA, 20 bp, human
gaggcggcggccgcagctgt

SEQ ID NO: 54495 - DNA, 20 bp, human
gcgtgtgcggaggagacttc

SEQ ID NO: 54496 - DNA, 20 bp, human
gcaggagcccgagaccacgt

SEQ ID NO: 54497 - DNA, 20 bp, human
gtgaactcgtgagcaggacg

SEQ ID NO: 54498 - DNA, 20 bp, human
gtggagacgagggttaggag

SEQ ID NO: 54499 - DNA, 20 bp, human
gcgagttcagggctcctggg

SEQ ID NO: 54500 - DNA, 20 bp, human
gggccttgcattggagacga

SEQ ID NO: 54501 - DNA, 20 bp, human
gagacgagggttaggagagg

SEQ ID NO: 54502 - DNA, 20 bp, human
gtcacgagttcagggctcct

SEQ ID NO: 54503 - DNA, 20 bp, human
gcacctggaactggaaaagg

SEQ ID NO: 54504 - DNA, 20 bp, human
gggccgagtcccgtagcatc

SEQ ID NO: 54505 - DNA, 20 bp, human
gagtcccgtagcatccggta

SEQ ID NO: 54506 - DNA, 20 bp, human
gaccagtcctgaccgcacgg

SEQ ID NO: 54507 - DNA, 20 bp, human
ggcccccgtgcggtcaggac

SEQ ID NO: 54508 - DNA, 20 bp, human
gcgtggccgcggcccccgtg

SEQ ID NO: 54509 - DNA, 20 bp, human
ggagatcctgccgcgcacca

SEQ ID NO: 54510 - DNA, 20 bp, human
ggcgcaggggccatggtgcg

SEQ ID NO: 54511 - DNA, 20 bp, human
ggtggcccccaagcgacgtg

SEQ ID NO: 54512 - DNA, 20 bp, human
gtaaagtgggaggcgcgcct

SEQ ID NO: 54513 - DNA, 20 bp, human
gcacgtcccggaccgagagc

SEQ ID NO: 54514 - DNA, 20 bp, human
gatctcccggctctcggtcc

SEQ ID NO: 54515 - DNA, 20 bp, human
gtacttatacaattgctcca

SEQ ID NO: 54516 - DNA, 20 bp, human
ggcggaggcaacccgctgcg

SEQ ID NO: 54517 - DNA, 20 bp, human
ggccgccgtatggggagcgg

SEQ ID NO: 54518 - DNA, 20 bp, human
gcgggcgccgctactcacac

SEQ ID NO: 54519 - DNA, 20 bp, human
ggcagacagaggacgccccg

SEQ ID NO: 54520 - DNA, 20 bp, human
gcccgggcgcgtaaaagtga

SEQ ID NO: 54521 - DNA, 20 bp, human
gagtgagggagcttgagacg

SEQ ID NO: 54522 - DNA, 20 bp, human
ggggagtggagctagaggtg

SEQ ID NO: 54523 - DNA, 20 bp, human
gccccggagctgcttacctg

SEQ ID NO: 54524 - DNA, 20 bp, human
ggggaggggagtggagctag

SEQ ID NO: 54525 - DNA, 20 bp, human
gtctagactgagaggggagt

SEQ ID NO: 54526 - DNA, 20 bp, human
gcaacttcggacctctgagg

SEQ ID NO: 54527 - DNA, 20 bp, human
ggcgcttccaggcctagacc

SEQ ID NO: 54528 - DNA, 20 bp, human
gcgggcatttcggaagagag

SEQ ID NO: 54529 - DNA, 20 bp, human
gagagtgccgggtctaggcc

SEQ ID NO: 54530 - DNA, 20 bp, human
gtaggcctggaagcgcgagg

SEQ ID NO: 54531 - DNA, 20 bp, human
gcagccttgggccagagtgc

SEQ ID NO: 54532 - DNA, 20 bp, human
gcaccgcctaggcaaaaccc

SEQ ID NO: 54533 - DNA, 20 bp, human
gggccggcgcggcagttcct

SEQ ID NO: 54534 - DNA, 20 bp, human
gcaataggagacgccgcagt

SEQ ID NO: 54535 - DNA, 20 bp, human
gggccgtggctggggactgt

SEQ ID NO: 54536 - DNA, 20 bp, human
ggctggtgggaacgtgaaaa

SEQ ID NO: 54537 - DNA, 20 bp, human
gttcatcctgagtggctggt

SEQ ID NO: 54538 - DNA, 20 bp, human
gtcccactcggctcctctta

SEQ ID NO: 54539 - DNA, 20 bp, human
gggactgggttgacgaagtc

SEQ ID NO: 54540 - DNA, 20 bp, human
gaaacaaggggggtggaatg

SEQ ID NO: 54541 - DNA, 20 bp, human
gtaatagtgggacttgccgt

SEQ ID NO: 54542 - DNA, 20 bp, human
gtgaactttgcggagagaga

SEQ ID NO: 54543 - DNA, 20 bp, human
gcatgtggccattctctgtg

SEQ ID NO: 54544 - DNA, 20 bp, human
ggtggccattctctgtgcgg

SEQ ID NO: 54545 - DNA, 20 bp, human
gtgcattcaaacgaaacatg

SEQ ID NO: 54546 - DNA, 20 bp, human
gtggcaggggcggctgtgta

SEQ ID NO: 54547 - DNA, 20 bp, human
gccctgccccaggagagtac

SEQ ID NO: 54548 - DNA, 20 bp, human
ggggccacgatggagcgcga

SEQ ID NO: 54549 - DNA, 20 bp, human
gctgtgtagggcacttgcaa

SEQ ID NO: 54550 - DNA, 20 bp, human
gaccggagagaggcatggtc

SEQ ID NO: 54551 - DNA, 20 bp, human
gcctgccctggcaaggtacc

SEQ ID NO: 54552 - DNA, 20 bp, human
gctggcccctatggacgtgg

SEQ ID NO: 54553 - DNA, 20 bp, human
gcagccgtcgcgctccatcg

SEQ ID NO: 54554 - DNA, 20 bp, human
ggagcgcgacggctgcgcgg

SEQ ID NO: 54555 - DNA, 20 bp, human
gaaaaacccgtactctcctg

SEQ ID NO: 54556 - DNA, 20 bp, human
ggctcctccttgccatgtcg

SEQ ID NO: 54557 - DNA, 20 bp, human
gaaagcagtgcactccgtga

SEQ ID NO: 54558 - DNA, 20 bp, human
gttgccatgtcgaggattct

SEQ ID NO: 54559 - DNA, 20 bp, human
gaatcctcgacatggcaagg

SEQ ID NO: 54560 - DNA, 20 bp, human
gggagaacggaggaatgacg

SEQ ID NO: 54561 - DNA, 20 bp, human
gtttccaagaatcctcgaca

SEQ ID NO: 54562 - DNA, 20 bp, human
ggggaggaaggtcctcctac

SEQ ID NO: 54563 - DNA, 20 bp, human
gtacacaaaggtgattcaaa

SEQ ID NO: 54564 - DNA, 20 bp, human
gcgttccagtcgtgtcaggt

SEQ ID NO: 54565 - DNA, 20 bp, human
gactaaatcaaattacacaa

SEQ ID NO: 54566 - DNA, 20 bp, human
gtgccagactagactaaaga

SEQ ID NO: 54567 - DNA, 20 bp, human
ggccacaaagcgttctgtca

SEQ ID NO: 54568 - DNA, 20 bp, human
gctccttctttagtctagtc

SEQ ID NO: 54569 - DNA, 20 bp, human
gacaggtctatgcagctacc

SEQ ID NO: 54570 - DNA, 20 bp, human
gtccatgacagaacgctttg

SEQ ID NO: 54571 - DNA, 20 bp, human
gaacgtagattccattgtcc

SEQ ID NO: 54572 - DNA, 20 bp, human
gtctacgttgactttagcaa

SEQ ID NO: 54573 - DNA, 20 bp, human
gtaagagtgttcttcttaac

SEQ ID NO: 54574 - DNA, 20 bp, human
gtatgcagctaccaggacaa

SEQ ID NO: 54575 - DNA, 20 bp, human
gcaataaaaaagtgattgag

SEQ ID NO: 54576 - DNA, 20 bp, human
gtgcagcctgcggaaaatgc

SEQ ID NO: 54577 - DNA, 20 bp, human
ggagagtcatagacatccaa

SEQ ID NO: 54578 - DNA, 20 bp, human
gcatagaagcaaaattggtt

SEQ ID NO: 54579 - DNA, 20 bp, human
gccgctgatggaggtccaga

SEQ ID NO: 54580 - DNA, 20 bp, human
gacagacatcaacttggtgt

SEQ ID NO: 54581 - DNA, 20 bp, human
gcggctccagcattttccgc

SEQ ID NO: 54582 - DNA, 20 bp, human
gctgctcacagacatcaact

SEQ ID NO: 54583 - DNA, 20 bp, human
gatcaacttggtgtcggctg

SEQ ID NO: 54584 - DNA, 20 bp, human
gaagcgggttagccccgaac

SEQ ID NO: 54585 - DNA, 20 bp, human
gaggagttgcttcctgttcg

SEQ ID NO: 54586 - DNA, 20 bp, human
gtgggaagttgcggggaagg

SEQ ID NO: 54587 - DNA, 20 bp, human
gcgcggcacctggcactcgt

SEQ ID NO: 54588 - DNA, 20 bp, human
gtagtggaggaacctaaggt

SEQ ID NO: 54589 - DNA, 20 bp, human
gacggtagtggaggaaccta

SEQ ID NO: 54590 - DNA, 20 bp, human
ggaagtcagccgaacggtag

SEQ ID NO: 54591 - DNA, 20 bp, human
ggtcagccgaacggtagtgg

SEQ ID NO: 54592 - DNA, 20 bp, human
gtgctggggaaggcaacctg

SEQ ID NO: 54593 - DNA, 20 bp, human
gcggatgtcgatgccatggg

SEQ ID NO: 54594 - DNA, 20 bp, human
ggcactcgtgggaagttgcg

SEQ ID NO: 54595 - DNA, 20 bp, human
ggagagtgggtcatagggtc

SEQ ID NO: 54596 - DNA, 20 bp, human
gtagctcgggtagacgtcaa

SEQ ID NO: 54597 - DNA, 20 bp, human
gggcgcgccgcgggtaacgg

SEQ ID NO: 54598 - DNA, 20 bp, human
ggctcacctgcgctcaactc

SEQ ID NO: 54599 - DNA, 20 bp, human
gtcgggcgcgccgcgggtaa

SEQ ID NO: 54600 - DNA, 20 bp, human
ggtaacggcgggagggtgac

SEQ ID NO: 54601 - DNA, 20 bp, human
gggacccagaggagcagtgt

SEQ ID NO: 54602 - DNA, 20 bp, human
ggtgactggaggaacgcccc

SEQ ID NO: 54603 - DNA, 20 bp, human
ggagctcctgcgcgttccgg

SEQ ID NO: 54604 - DNA, 20 bp, human
ggaacgcccccggaacgcgc

SEQ ID NO: 54605 - DNA, 20 bp, human
gaaatgtggagccagatcca

SEQ ID NO: 54606 - DNA, 20 bp, human
gtagtcctttgggacatcaa

SEQ ID NO: 54607 - DNA, 20 bp, human
gaggcgacagctgtgccagc

SEQ ID NO: 54608 - DNA, 20 bp, human
gggagggctggcatccagca

SEQ ID NO: 54609 - DNA, 20 bp, human
ggcagggaacagtgagctcc

SEQ ID NO: 54610 - DNA, 20 bp, human
gacgagagactagggaagtc

SEQ ID NO: 54611 - DNA, 20 bp, human
gattgggatacgagagacta

SEQ ID NO: 54612 - DNA, 20 bp, human
ggcttcactgccatgctgcc

SEQ ID NO: 54613 - DNA, 20 bp, human
ggaatccaaaacaggtcctt

SEQ ID NO: 54614 - DNA, 20 bp, human
gtggtactcaccagtcatta

SEQ ID NO: 54615 - DNA, 20 bp, human
gaaacaccagcagcttccgg

SEQ ID NO: 54616 - DNA, 20 bp, human
gaggcccagcatgagaggcc

SEQ ID NO: 54617 - DNA, 20 bp, human
ggtcacagggcagtactcac

SEQ ID NO: 54618 - DNA, 20 bp, human
gcagagccaaggggaccatt

SEQ ID NO: 54619 - DNA, 20 bp, human
gcattaggaatcctcaccgt

SEQ ID NO: 54620 - DNA, 20 bp, human
gcgtgtcgtgcaggataaag

SEQ ID NO: 54621 - DNA, 20 bp, human
gacccccaggccccgtcaca

SEQ ID NO: 54622 - DNA, 20 bp, human
gggattcctaatggtcccct

SEQ ID NO: 54623 - DNA, 20 bp, human
gtggaactacgaccaggatg

SEQ ID NO: 54624 - DNA, 20 bp, human
ggtaccggtgctccggcccc

SEQ ID NO: 54625 - DNA, 20 bp, human
ggttgggggtgtccacatcc

SEQ ID NO: 54626 - DNA, 20 bp, human
gacagcgtccaaggtttgag

SEQ ID NO: 54627 - DNA, 20 bp, human
gggggcggtcgcaacgtcac

SEQ ID NO: 54628 - DNA, 20 bp, human
ggtcgcaacgtcacgggcaa

SEQ ID NO: 54629 - DNA, 20 bp, human
gagacggtctcccaccagtg

SEQ ID NO: 54630 - DNA, 20 bp, human
ggcgaccaatccgcactggt

SEQ ID NO: 54631 - DNA, 20 bp, human
gatggtctcaggctccgcag

SEQ ID NO: 54632 - DNA, 20 bp, human
gaggcctaccgctcaaacct

SEQ ID NO: 54633 - DNA, 20 bp, human
gtggttggaaagacggtgaa

SEQ ID NO: 54634 - DNA, 20 bp, human
gattggccgagcatggacgt

SEQ ID NO: 54635 - DNA, 20 bp, human
ggccgagcatggacgtgggg

SEQ ID NO: 54636 - DNA, 20 bp, human
ggagtaggtggaatatcctg

SEQ ID NO: 54637 - DNA, 20 bp, human
gtgttacctgagaggaaagt

SEQ ID NO: 54638 - DNA, 20 bp, human
gcaccaccactcccaagcag

SEQ ID NO: 54639 - DNA, 20 bp, human
ggcaagaatcaactttctgt

SEQ ID NO: 54640 - DNA, 20 bp, human
gcctcaggaaagcctctaga

SEQ ID NO: 54641 - DNA, 20 bp, human
gagacgaggatgccgaggaa

SEQ ID NO: 54642 - DNA, 20 bp, human
gagcggccgactttcctctc

SEQ ID NO: 54643 - DNA, 20 bp, human
ggagaggaagtttggtcgtt

SEQ ID NO: 54644 - DNA, 20 bp, human
gaccctaggagaaccggcag

SEQ ID NO: 54645 - DNA, 20 bp, human
ggacggtgccggcaagaaac

SEQ ID NO: 54646 - DNA, 20 bp, human
gcacccggtgtagaaagctc

SEQ ID NO: 54647 - DNA, 20 bp, human
gagctcaggcggtcccgtag

SEQ ID NO: 54648 - DNA, 20 bp, human
gtcaggcggtcccgtagcgg

SEQ ID NO: 54649 - DNA, 20 bp, human
ggtgctgctggcgcccaggt

SEQ ID NO: 54650 - DNA, 20 bp, human
ggaagcggggcagaccggga

SEQ ID NO: 54651 - DNA, 20 bp, human
gacgccaccgtcagggagga

SEQ ID NO: 54652 - DNA, 20 bp, human
gccgccgtcctccctgacgg

SEQ ID NO: 54653 - DNA, 20 bp, human
gttctacaccgggtgagtga

SEQ ID NO: 54654 - DNA, 20 bp, human
gctctgaaacgccaccgtca

SEQ ID NO: 54655 - DNA, 20 bp, human
gagcccgccgtcctccctga

SEQ ID NO: 54656 - DNA, 20 bp, human
gtgagtccggactgcagatg

SEQ ID NO: 54657 - DNA, 20 bp, human
gaccctgaggtacagacccg

SEQ ID NO: 54658 - DNA, 20 bp, human
ggcctcgggtctgtacctca

SEQ ID NO: 54659 - DNA, 20 bp, human
gagtccagggttgcagtcaa

SEQ ID NO: 54660 - DNA, 20 bp, human
ggctgggggggggaaagacg

SEQ ID NO: 54661 - DNA, 20 bp, human
gtccgtgagagaggtcctca

SEQ ID NO: 54662 - DNA, 20 bp, human
ggggggaaagacgaggaaag

SEQ ID NO: 54663 - DNA, 20 bp, human
ggcctcctctcagaaggaag

SEQ ID NO: 54664 - DNA, 20 bp, human
gccagggttgcagtcaaggg

SEQ ID NO: 54665 - DNA, 20 bp, human
ggggtgggaaagttcattca

SEQ ID NO: 54666 - DNA, 20 bp, human
ggtccgtcaacgcagcccag

SEQ ID NO: 54667 - DNA, 20 bp, human
ggcaccttcccggccatggg

SEQ ID NO: 54668 - DNA, 20 bp, human
gtccggctccccgcactctc

SEQ ID NO: 54669 - DNA, 20 bp, human
gtgctgaaggaacaagtccc

SEQ ID NO: 54670 - DNA, 20 bp, human
gcggcgggcgcggaactccc

SEQ ID NO: 54671 - DNA, 20 bp, human
ggctgcgttgacggactcgg

SEQ ID NO: 54672 - DNA, 20 bp, human
gggcgtccggcagcacccag

SEQ ID NO: 54673 - DNA, 20 bp, human
gaccgcaccttcccggccat

SEQ ID NO: 54674 - DNA, 20 bp, human
ggcgtggacccggagagtgc

SEQ ID NO: 54675 - DNA, 20 bp, human
ggcgcccgcccgcccatggc

SEQ ID NO: 54676 - DNA, 20 bp, human
gtacctgtgcggagccgatt

SEQ ID NO: 54677 - DNA, 20 bp, human
gccttcccggggctttagag

SEQ ID NO: 54678 - DNA, 20 bp, human
gtgtcatgcccacgacgggt

SEQ ID NO: 54679 - DNA, 20 bp, human
gagacgcgcccacccgtcgt

SEQ ID NO: 54680 - DNA, 20 bp, human
ggcgactagcgctgccgcag

SEQ ID NO: 54681 - DNA, 20 bp, human
gctccgaatcggctccgcac

SEQ ID NO: 54682 - DNA, 20 bp, human
gtcccctgatcttacctgtg

SEQ ID NO: 54683 - DNA, 20 bp, human
ggcacccccgactccttcct

SEQ ID NO: 54684 - DNA, 20 bp, human
gctagtcgccttctccgaat

SEQ ID NO: 54685 - DNA, 20 bp, human
ggcagagacgcagtccagag

SEQ ID NO: 54686 - DNA, 20 bp, human
gcggccagccggcttcctgg

SEQ ID NO: 54687 - DNA, 20 bp, human
gccgtgatgctgcccactgg

SEQ ID NO: 54688 - DNA, 20 bp, human
ggatcccgagcggtcacccg

SEQ ID NO: 54689 - DNA, 20 bp, human
ggccaggtgtcccctgccag

SEQ ID NO: 54690 - DNA, 20 bp, human
ggatccccccctcgaatggg

SEQ ID NO: 54691 - DNA, 20 bp, human
gagctccgcccattcgaggg

SEQ ID NO: 54692 - DNA, 20 bp, human
gggagcttgaccgggcagca

SEQ ID NO: 54693 - DNA, 20 bp, human
gtcgagggggggatcccgag

SEQ ID NO: 54694 - DNA, 20 bp, human
ggcgcctcgggtgaccgctc

SEQ ID NO: 54695 - DNA, 20 bp, human
gcagcagggatgctgcaccc

SEQ ID NO: 54696 - DNA, 20 bp, human
ggagcccgggccccacgtag

SEQ ID NO: 54697 - DNA, 20 bp, human
ggcggtgagtgtgcgagtgt

SEQ ID NO: 54698 - DNA, 20 bp, human
ggtgagtgtgcgagtgtcgg

SEQ ID NO: 54699 - DNA, 20 bp, human
ggggccccacgtagaggatc

SEQ ID NO: 54700 - DNA, 20 bp, human
gggcgccggatcctctacgt

SEQ ID NO: 54701 - DNA, 20 bp, human
gcgcgcgcgccacccttgcg

SEQ ID NO: 54702 - DNA, 20 bp, human
ggccagcctccgaagagcag

SEQ ID NO: 54703 - DNA, 20 bp, human
ggatgcaacccaaaggagta

SEQ ID NO: 54704 - DNA, 20 bp, human
ggcggcgggctgccgcgcaa

SEQ ID NO: 54705 - DNA, 20 bp, human
gggctgcggcatggagacac

SEQ ID NO: 54706 - DNA, 20 bp, human
gccaggccctagggaatcgt

SEQ ID NO: 54707 - DNA, 20 bp, human
gtccccgccgggctcatcca

SEQ ID NO: 54708 - DNA, 20 bp, human
ggcgcgctccgccacaccca

SEQ ID NO: 54709 - DNA, 20 bp, human
gccgccgggctcatccaggg

SEQ ID NO: 54710 - DNA, 20 bp, human
gtgtccctgacgcagactgg

SEQ ID NO: 54711 - DNA, 20 bp, human
gacgaccccacgattcccta

SEQ ID NO: 54712 - DNA, 20 bp, human
gatcgtggggtcgtatcccg

SEQ ID NO: 54713 - DNA, 20 bp, human
ggccctgtggcccaaaacac

SEQ ID NO: 54714 - DNA, 20 bp, human
ggccgctcggacaggactga

SEQ ID NO: 54715 - DNA, 20 bp, human
gagggcgggccaaatagcag

SEQ ID NO: 54716 - DNA, 20 bp, human
ggaccaccgaagggaaccca

SEQ ID NO: 54717 - DNA, 20 bp, human
gcgagaggtgccgaaggaac

SEQ ID NO: 54718 - DNA, 20 bp, human
gagctcgggactgaaccgag

SEQ ID NO: 54719 - DNA, 20 bp, human
gctttctaggctgcagacgt

SEQ ID NO: 54720 - DNA, 20 bp, human
gaggcgttgagaccaccgaa

SEQ ID NO: 54721 - DNA, 20 bp, human
gtgcagacgtaggagatgcc

SEQ ID NO: 54722 - DNA, 20 bp, human
ggggaacccatggctaggta

SEQ ID NO: 54723 - DNA, 20 bp, human
gctgggagcacggcagagga

SEQ ID NO: 54724 - DNA, 20 bp, human
gcggcggcgccacgtcccca

SEQ ID NO: 54725 - DNA, 20 bp, human
gtgcccgggtagggtcccct

SEQ ID NO: 54726 - DNA, 20 bp, human
gccttgccgctccgggaagt

SEQ ID NO: 54727 - DNA, 20 bp, human
ggcccaggtgagggtccaaa

SEQ ID NO: 54728 - DNA, 20 bp, human
gcccccccaggacatccctt

SEQ ID NO: 54729 - DNA, 20 bp, human
ggtccaaagggatgtcctgg

SEQ ID NO: 54730 - DNA, 20 bp, human
gagggtccaaagggatgtcc

SEQ ID NO: 54731 - DNA, 20 bp, human
gaggctggacgccaggtgcg

SEQ ID NO: 54732 - DNA, 20 bp, human
gcagggagaggctggacgcc

SEQ ID NO: 54733 - DNA, 20 bp, human
gagcttcctccttgccgctc

SEQ ID NO: 54734 - DNA, 20 bp, human
ggcttctgtgtccgcgcacc

SEQ ID NO: 54735 - DNA, 20 bp, human
gggctgcccacttcccggag

SEQ ID NO: 54736 - DNA, 20 bp, human
gtaggtgcccgagctactga

SEQ ID NO: 54737 - DNA, 20 bp, human
gcttagaccctcagtagctc

SEQ ID NO: 54738 - DNA, 20 bp, human
gcctgtagggctctccgaca

SEQ ID NO: 54739 - DNA, 20 bp, human
gcgttacctaccacactctt

SEQ ID NO: 54740 - DNA, 20 bp, human
gccgcgctcgcgggcctgta

SEQ ID NO: 54741 - DNA, 20 bp, human
gtagaacagggcggagacag

SEQ ID NO: 54742 - DNA, 20 bp, human
gctccggtagcacgccctgt

SEQ ID NO: 54743 - DNA, 20 bp, human
gtggtaaaacaagggcgcta

SEQ ID NO: 54744 - DNA, 20 bp, human
ggtaacggtcctcagcgcaa

SEQ ID NO: 54745 - DNA, 20 bp, human
ggtctagtcagtaccactcc

SEQ ID NO: 54746 - DNA, 20 bp, human
gcggcggctgttccagagga

SEQ ID NO: 54747 - DNA, 20 bp, human
gccgtgaactaccgaggagg

SEQ ID NO: 54748 - DNA, 20 bp, human
gcagccgtgaactaccgagg

SEQ ID NO: 54749 - DNA, 20 bp, human
ggagacggcggctgttccag

SEQ ID NO: 54750 - DNA, 20 bp, human
gtgaactaccgaggaggagg

SEQ ID NO: 54751 - DNA, 20 bp, human
gaggagggagtcgtcataac

SEQ ID NO: 54752 - DNA, 20 bp, human
ggggcagccgtgaactaccg

SEQ ID NO: 54753 - DNA, 20 bp, human
ggccgctcaccggaaacctc

SEQ ID NO: 54754 - DNA, 20 bp, human
ggcccgaggtttccggtgag

SEQ ID NO: 54755 - DNA, 20 bp, human
gtccggtgagcggcagtagc

SEQ ID NO: 54756 - DNA, 20 bp, human
gggacagcctgagctccgag

SEQ ID NO: 54757 - DNA, 20 bp, human
gcgcctcgcgcactctccag

SEQ ID NO: 54758 - DNA, 20 bp, human
ggccactgcgcgctactcca

SEQ ID NO: 54759 - DNA, 20 bp, human
gccagtcccccggtcctcag

SEQ ID NO: 54760 - DNA, 20 bp, human
gtccgacccctgaggaccgg

SEQ ID NO: 54761 - DNA, 20 bp, human
gaataaggccaccggaggag

SEQ ID NO: 54762 - DNA, 20 bp, human
gtccatggagtagcgcgcag

SEQ ID NO: 54763 - DNA, 20 bp, human
ggtagtaccgctcggagctc

SEQ ID NO: 54764 - DNA, 20 bp, human
gggcagtctctcctgcgagg

SEQ ID NO: 54765 - DNA, 20 bp, human
gaaaggcgcgggctagtggg

SEQ ID NO: 54766 - DNA, 20 bp, human
gctagcctgtaaggaggatt

SEQ ID NO: 54767 - DNA, 20 bp, human
gctaccgctagcctgtaagg

SEQ ID NO: 54768 - DNA, 20 bp, human
ggagtcgggtcggagagagg

SEQ ID NO: 54769 - DNA, 20 bp, human
gagagagagcgggcgagagt

SEQ ID NO: 54770 - DNA, 20 bp, human
gtacaggctagcggtagcgg

SEQ ID NO: 54771 - DNA, 20 bp, human
ggctccgacggcacccgagg

SEQ ID NO: 54772 - DNA, 20 bp, human
gtgtaaggaggattcggcag

SEQ ID NO: 54773 - DNA, 20 bp, human
gccgcgggaaaggaaggcga

SEQ ID NO: 54774 - DNA, 20 bp, human
gccgcgccgcacccaggggt

SEQ ID NO: 54775 - DNA, 20 bp, human
ggtccccgcgccgcacccag

SEQ ID NO: 54776 - DNA, 20 bp, human
gacggcagcgtccagggtcc

SEQ ID NO: 54777 - DNA, 20 bp, human
gcgctccggccgcgtcagga

SEQ ID NO: 54778 - DNA, 20 bp, human
gtgaggcccagggtaagtga

SEQ ID NO: 54779 - DNA, 20 bp, human
gcccagcccaggagcccggg

SEQ ID NO: 54780 - DNA, 20 bp, human
gccggccgcgtcaggagggc

SEQ ID NO: 54781 - DNA, 20 bp, human
gcggatgcactgagcggctg

SEQ ID NO: 54782 - DNA, 20 bp, human
ggcggcgttgcgggaaccgg

SEQ ID NO: 54783 - DNA, 20 bp, human
gcggccggagcgcagccctg

SEQ ID NO: 54784 - DNA, 20 bp, human
ggggcgggaggctctcggga

SEQ ID NO: 54785 - DNA, 20 bp, human
gctgctacggcgagccggaa

SEQ ID NO: 54786 - DNA, 20 bp, human
gggccgcctcaggagcgctg

SEQ ID NO: 54787 - DNA, 20 bp, human
ggacactgccgaggattgta

SEQ ID NO: 54788 - DNA, 20 bp, human
ggaggcggccgtacaatcct

SEQ ID NO: 54789 - DNA, 20 bp, human
gggcgggtggtgaaggtccg

SEQ ID NO: 54790 - DNA, 20 bp, human
gcgccccagcgctcctgagg

SEQ ID NO: 54791 - DNA, 20 bp, human
gcggggtccggggaaggagt

SEQ ID NO: 54792 - DNA, 20 bp, human
ggggcaggcgcgaccgagag

SEQ ID NO: 54793 - DNA, 20 bp, human
ggcggaccgccacacgggtc

SEQ ID NO: 54794 - DNA, 20 bp, human
ggttcagacgccgagcacct

SEQ ID NO: 54795 - DNA, 20 bp, human
gcgcgcagtcaggtggaagg

SEQ ID NO: 54796 - DNA, 20 bp, human
gttctggaattcgggaccgc

SEQ ID NO: 54797 - DNA, 20 bp, human
ggtggcaggaacctcttaaa

SEQ ID NO: 54798 - DNA, 20 bp, human
gacctcttaaagggcgagag

SEQ ID NO: 54799 - DNA, 20 bp, human
ggcggcgcggagccagaacg

SEQ ID NO: 54800 - DNA, 20 bp, human
ggcctccacctgcactgaca

SEQ ID NO: 54801 - DNA, 20 bp, human
ggccgctctcgccctttaag

SEQ ID NO: 54802 - DNA, 20 bp, human
gcccgggagaggcgagacca

SEQ ID NO: 54803 - DNA, 20 bp, human
gtccggagctagacacgtcc

SEQ ID NO: 54804 - DNA, 20 bp, human
gaccagggtcgaagggtcca

SEQ ID NO: 54805 - DNA, 20 bp, human
gaggcgagaccagggtcgaa

SEQ ID NO: 54806 - DNA, 20 bp, human
gacgcggcccgaggagcgag

SEQ ID NO: 54807 - DNA, 20 bp, human
ggactgactaaacgcaccag

SEQ ID NO: 54808 - DNA, 20 bp, human
ggactaaacgcaccagcgga

SEQ ID NO: 54809 - DNA, 20 bp, human
gccagagccgctgaggaaag

SEQ ID NO: 54810 - DNA, 20 bp, human
gggctggcctcgcctcgcag

SEQ ID NO: 54811 - DNA, 20 bp, human
gctcccgccttccctctgcg

SEQ ID NO: 54812 - DNA, 20 bp, human
gtaaacgcaccagcggaggg

SEQ ID NO: 54813 - DNA, 20 bp, human
ggctgcagcccgacgaacaa

SEQ ID NO: 54814 - DNA, 20 bp, human
gagccaccggtgaggcgagg

SEQ ID NO: 54815 - DNA, 20 bp, human
gcgccgcctcgcctcaccgg

SEQ ID NO: 54816 - DNA, 20 bp, human
gcagccctggggaggaacgg

SEQ ID NO: 54817 - DNA, 20 bp, human
gtggatgccgactgcagcag

SEQ ID NO: 54818 - DNA, 20 bp, human
ggcctggagagaggatccgg

SEQ ID NO: 54819 - DNA, 20 bp, human
ggcagtcggcatccatcagc

SEQ ID NO: 54820 - DNA, 20 bp, human
ggaggaggctgcagaccggt

SEQ ID NO: 54821 - DNA, 20 bp, human
gggctgcagaccggtaggta

SEQ ID NO: 54822 - DNA, 20 bp, human
gtgcagaccggtaggtaggg

SEQ ID NO: 54823 - DNA, 20 bp, human
gtcgcccccgttcctcccca

SEQ ID NO: 54824 - DNA, 20 bp, human
gccgccgccgctgctgcagt

SEQ ID NO: 54825 - DNA, 20 bp, human
gggcatccatcagcgggcgg

SEQ ID NO: 54826 - DNA, 20 bp, human
gcctctgacggccccagtca

SEQ ID NO: 54827 - DNA, 20 bp, human
ggaaacctagcggagggagg

SEQ ID NO: 54828 - DNA, 20 bp, human
ggtcccggcggagccaggaa

SEQ ID NO: 54829 - DNA, 20 bp, human
gcgagcgagctcctgaggta

SEQ ID NO: 54830 - DNA, 20 bp, human
gtttgaaacctagcggaggg

SEQ ID NO: 54831 - DNA, 20 bp, human
gtgaagagggacgggtcccg

SEQ ID NO: 54832 - DNA, 20 bp, human
gcctcttcagtcccagccgc

SEQ ID NO: 54833 - DNA, 20 bp, human
gcgcggcgagcgagctcctg

SEQ ID NO: 54834 - DNA, 20 bp, human
gcagctgggaagctgattcc

SEQ ID NO: 54835 - DNA, 20 bp, human
ggacgcgtgacctgagccca

SEQ ID NO: 54836 - DNA, 20 bp, human
gccttcggccagggatccca

SEQ ID NO: 54837 - DNA, 20 bp, human
gcggcgtggggactaggctc

SEQ ID NO: 54838 - DNA, 20 bp, human
gcgaggcgcgcgggacagtg

SEQ ID NO: 54839 - DNA, 20 bp, human
gaggctcgggcgcgcgtcct

SEQ ID NO: 54840 - DNA, 20 bp, human
gcggcggtgcgcaggagact

SEQ ID NO: 54841 - DNA, 20 bp, human
ggcgccgcggcgtggggact

SEQ ID NO: 54842 - DNA, 20 bp, human
gaacagcggcgagcagccct

SEQ ID NO: 54843 - DNA, 20 bp, human
ggcccgccgcggcgcagtag

SEQ ID NO: 54844 - DNA, 20 bp, human
gagaggcggaaaagttacct

SEQ ID NO: 54845 - DNA, 20 bp, human
gctcctgcgcaccgccgccg

SEQ ID NO: 54846 - DNA, 20 bp, human
gggagagggtggacgtacca

SEQ ID NO: 54847 - DNA, 20 bp, human
gcccgggcgctgactctccc

SEQ ID NO: 54848 - DNA, 20 bp, human
gtgagacgagcagctcccgg

SEQ ID NO: 54849 - DNA, 20 bp, human
gcggccgccgaaccgcccgg

SEQ ID NO: 54850 - DNA, 20 bp, human
ggccccgccgggcggttcgg

SEQ ID NO: 54851 - DNA, 20 bp, human
ggaccggccgccgaaccgcc

SEQ ID NO: 54852 - DNA, 20 bp, human
gagcagcagggcatcaaggt

SEQ ID NO: 54853 - DNA, 20 bp, human
ggagaaaggcggaaaagccc

SEQ ID NO: 54854 - DNA, 20 bp, human
gcagctcccggcggggtccg

SEQ ID NO: 54855 - DNA, 20 bp, human
ggggtgagacgagcagctcc

SEQ ID NO: 54856 - DNA, 20 bp, human
gcgcgtagcgctgcatggag

SEQ ID NO: 54857 - DNA, 20 bp, human
gggagcggcggccaaaggtc

SEQ ID NO: 54858 - DNA, 20 bp, human
gagtgctcggagaagaggat

SEQ ID NO: 54859 - DNA, 20 bp, human
gcccgtcgagcaggaagacg

SEQ ID NO: 54860 - DNA, 20 bp, human
ggcgcaatgtgccaaggagg

SEQ ID NO: 54861 - DNA, 20 bp, human
gtgaggagtgctcggagaag

SEQ ID NO: 54862 - DNA, 20 bp, human
ggggcgtgctgcagtcccgg

SEQ ID NO: 54863 - DNA, 20 bp, human
ggtagcgctgcatggagcgg

SEQ ID NO: 54864 - DNA, 20 bp, human
gtggggccccggaagagacc

SEQ ID NO: 54865 - DNA, 20 bp, human
gtggcacctcgcgcccctgg

SEQ ID NO: 54866 - DNA, 20 bp, human
gccgagcaaggctgagaaag

SEQ ID NO: 54867 - DNA, 20 bp, human
gagcccagcggaccagcgag

SEQ ID NO: 54868 - DNA, 20 bp, human
ggcgcccacaacgagcccac

SEQ ID NO: 54869 - DNA, 20 bp, human
ggcccaccggctctaatccc

SEQ ID NO: 54870 - DNA, 20 bp, human
ggaccagcgaggggtacccg

SEQ ID NO: 54871 - DNA, 20 bp, human
ggggccgcacccagacccta

SEQ ID NO: 54872 - DNA, 20 bp, human
gtccggggattagagccggt

SEQ ID NO: 54873 - DNA, 20 bp, human
ggagccggtgggctcgttgt

SEQ ID NO: 54874 - DNA, 20 bp, human
gagcggggaagagccgagca

SEQ ID NO: 54875 - DNA, 20 bp, human
gccgcacccagaccctaggg

SEQ ID NO: 54876 - DNA, 20 bp, human
gggtgctcacaggagtagtg

SEQ ID NO: 54877 - DNA, 20 bp, human
ggccaagccagcgctcgaca

SEQ ID NO: 54878 - DNA, 20 bp, human
gggtaggtgggtgctggtag

SEQ ID NO: 54879 - DNA, 20 bp, human
gtggagcgtggtgtgatgat

SEQ ID NO: 54880 - DNA, 20 bp, human
gaggagcggcctgcaaccat

SEQ ID NO: 54881 - DNA, 20 bp, human
gggcctgcaaccatgggaca

SEQ ID NO: 54882 - DNA, 20 bp, human
gaacatgtcagggtgctcac

SEQ ID NO: 54883 - DNA, 20 bp, human
gtcacaggagtagtgggggg

SEQ ID NO: 54884 - DNA, 20 bp, human
gccaggagataccagcagag

SEQ ID NO: 54885 - DNA, 20 bp, human
gctgcggccaagtggataag

SEQ ID NO: 54886 - DNA, 20 bp, human
gcgctgcgcgatgcagtgtg

SEQ ID NO: 54887 - DNA, 20 bp, human
gcgcgatgcagtgtggggaa

SEQ ID NO: 54888 - DNA, 20 bp, human
gtaacaccagccgggagggt

SEQ ID NO: 54889 - DNA, 20 bp, human
ggcactaacaccagccggga

SEQ ID NO: 54890 - DNA, 20 bp, human
gagggagcgggcctgacggt

SEQ ID NO: 54891 - DNA, 20 bp, human
gccggccggcgactgagagt

SEQ ID NO: 54892 - DNA, 20 bp, human
gttggctgaagagcgcacag

SEQ ID NO: 54893 - DNA, 20 bp, human
gagcgcagagcccgccgtcc

SEQ ID NO: 54894 - DNA, 20 bp, human
gagcgggcctgacggtgggt

SEQ ID NO: 54895 - DNA, 20 bp, human
gcgccgccgcaggcagcaga

SEQ ID NO: 54896 - DNA, 20 bp, human
gcgcccgggctgttcctgta

SEQ ID NO: 54897 - DNA, 20 bp, human
ggaaggaggaggaatcggta

SEQ ID NO: 54898 - DNA, 20 bp, human
gcagcggcggcgagcgatcc

SEQ ID NO: 54899 - DNA, 20 bp, human
gcgactgacaaaggggaggg

SEQ ID NO: 54900 - DNA, 20 bp, human
ggcggacattaccacagcgg

SEQ ID NO: 54901 - DNA, 20 bp, human
gatggcggacattaccacag

SEQ ID NO: 54902 - DNA, 20 bp, human
gatggcgcagggagcggatc

SEQ ID NO: 54903 - DNA, 20 bp, human
gcctccttctccatcccggt

SEQ ID NO: 54904 - DNA, 20 bp, human
gcgcagggagcggatcgggc

SEQ ID NO: 54905 - DNA, 20 bp, human
gtgccgcggtagataggcag

SEQ ID NO: 54906 - DNA, 20 bp, human
gtcgggaggacagcgacgag

SEQ ID NO: 54907 - DNA, 20 bp, human
gtcgttgatgagtcaccgcc

SEQ ID NO: 54908 - DNA, 20 bp, human
gccctccgcgcggtaggaaa

SEQ ID NO: 54909 - DNA, 20 bp, human
gccccgaaacgggcataata

SEQ ID NO: 54910 - DNA, 20 bp, human
ggcgtggagaccggacggtg

SEQ ID NO: 54911 - DNA, 20 bp, human
ggagggcctgagccggagca

SEQ ID NO: 54912 - DNA, 20 bp, human
ggaaggtgctcgctcgccga

SEQ ID NO: 54913 - DNA, 20 bp, human
gcgagcgagcaccttcgacg

SEQ ID NO: 54914 - DNA, 20 bp, human
ggcgcgcgcgccgagaagag

SEQ ID NO: 54915 - DNA, 20 bp, human
gaaacgggcataatagggag

SEQ ID NO: 54916 - DNA, 20 bp, human
gtgagcagtgaaaaccgaag

SEQ ID NO: 54917 - DNA, 20 bp, human
gtgccaggcgccgcagcagt

SEQ ID NO: 54918 - DNA, 20 bp, human
ggaggcgtccgggatcagag

SEQ ID NO: 54919 - DNA, 20 bp, human
gcaggcgccgcagcagtggg

SEQ ID NO: 54920 - DNA, 20 bp, human
gtgaaaaccgaagcggcaga

SEQ ID NO: 54921 - DNA, 20 bp, human
ggtgccactagcatcctggg

SEQ ID NO: 54922 - DNA, 20 bp, human
gcgcgtccggatctcaaaag

SEQ ID NO: 54923 - DNA, 20 bp, human
gagcggcagaggccaccgaa

SEQ ID NO: 54924 - DNA, 20 bp, human
gaaggctccagtgaatcgcg

SEQ ID NO: 54925 - DNA, 20 bp, human
gcgctggttgagcccgtcgt

SEQ ID NO: 54926 - DNA, 20 bp, human
ggaagggtctatggccgagg

SEQ ID NO: 54927 - DNA, 20 bp, human
ggcaggttgcttgaagcgca

SEQ ID NO: 54928 - DNA, 20 bp, human
gcagtccggaggccagaacc

SEQ ID NO: 54929 - DNA, 20 bp, human
gtcggccatagacccttccg

SEQ ID NO: 54930 - DNA, 20 bp, human
gaagaggccagtgaagtcac

SEQ ID NO: 54931 - DNA, 20 bp, human
gggccagtgaagtcacagga

SEQ ID NO: 54932 - DNA, 20 bp, human
gggagaagggccggtgtcaa

SEQ ID NO: 54933 - DNA, 20 bp, human
gggcgccgcggaagggtcta

SEQ ID NO: 54934 - DNA, 20 bp, human
ggccagccggactaaaacaa

SEQ ID NO: 54935 - DNA, 20 bp, human
gcacgcggagaaggtacctt

SEQ ID NO: 54936 - DNA, 20 bp, human
gatccttctagactgacggg

SEQ ID NO: 54937 - DNA, 20 bp, human
ggaaatccataacgtgacta

SEQ ID NO: 54938 - DNA, 20 bp, human
ggatcagagtaatgaatctg

SEQ ID NO: 54939 - DNA, 20 bp, human
gcctaatatagtcaatggaa

SEQ ID NO: 54940 - DNA, 20 bp, human
gcttatccttctagactgac

SEQ ID NO: 54941 - DNA, 20 bp, human
gttccacccgtcagtctaga

SEQ ID NO: 54942 - DNA, 20 bp, human
gatcaatggtcttaaatatt

SEQ ID NO: 54943 - DNA, 20 bp, human
gattctggaggtctcaaaaa

SEQ ID NO: 54944 - DNA, 20 bp, human
gtattaggaaaggaacatac

SEQ ID NO: 54945 - DNA, 20 bp, human
gttaatcctaatatagtcaa

SEQ ID NO: 54946 - DNA, 20 bp, human
gccggcccggagctatggag

SEQ ID NO: 54947 - DNA, 20 bp, human
gcctgggacagtggcccgga

SEQ ID NO: 54948 - DNA, 20 bp, human
gccaagggctcagatctctg

SEQ ID NO: 54949 - DNA, 20 bp, human
ggggctcagatctctggggt

SEQ ID NO: 54950 - DNA, 20 bp, human
gtgggactgtctgggaatgc

SEQ ID NO: 54951 - DNA, 20 bp, human
gagcgccgctccatagctcc

SEQ ID NO: 54952 - DNA, 20 bp, human
gtcgggcacagcgagagagc

SEQ ID NO: 54953 - DNA, 20 bp, human
gtggccagtcgatagcctgg

SEQ ID NO: 54954 - DNA, 20 bp, human
gcagaagccggcattcctag

SEQ ID NO: 54955 - DNA, 20 bp, human
ggcgctggcccctggggcta

SEQ ID NO: 54956 - DNA, 20 bp, human
gagcgcagtcgcagcaccag

SEQ ID NO: 54957 - DNA, 20 bp, human
gggctcccgcaggaccgacg

SEQ ID NO: 54958 - DNA, 20 bp, human
ggccgacggcggccctgagg

SEQ ID NO: 54959 - DNA, 20 bp, human
gggctgtactgcaggtcccg

SEQ ID NO: 54960 - DNA, 20 bp, human
gcaccagcggcgagcggctc

SEQ ID NO: 54961 - DNA, 20 bp, human
gcggccctgaggcggcacag

SEQ ID NO: 54962 - DNA, 20 bp, human
gccccaagagggcgcagggg

SEQ ID NO: 54963 - DNA, 20 bp, human
gcgcaggtgcagcagcgtgg

SEQ ID NO: 54964 - DNA, 20 bp, human
ggggcggggtgcgtgtacag

SEQ ID NO: 54965 - DNA, 20 bp, human
gccgcccctgtgccgcctca

SEQ ID NO: 54966 - DNA, 20 bp, human
ggaccgagctgtcagtccgg

SEQ ID NO: 54967 - DNA, 20 bp, human
gcaggaaccgcgggagccag

SEQ ID NO: 54968 - DNA, 20 bp, human
ggcagaccgagctgtcagtc

SEQ ID NO: 54969 - DNA, 20 bp, human
gcgagctgtcagtccggcgg

SEQ ID NO: 54970 - DNA, 20 bp, human
ggccagaggcggcggtccag

SEQ ID NO: 54971 - DNA, 20 bp, human
gggaccggcgcaggtctcca

SEQ ID NO: 54972 - DNA, 20 bp, human
gggacaagctgagtgattgg

SEQ ID NO: 54973 - DNA, 20 bp, human
gcagcggtgctaggctggcg

SEQ ID NO: 54974 - DNA, 20 bp, human
gggtccagcggccggtgaga

SEQ ID NO: 54975 - DNA, 20 bp, human
ggctggagacccgggaggtt

SEQ ID NO: 54976 - DNA, 20 bp, human
gtaaggactcggggcaggag

SEQ ID NO: 54977 - DNA, 20 bp, human
gaggggctccggagaataag

SEQ ID NO: 54978 - DNA, 20 bp, human
gcccccacccggggtcatag

SEQ ID NO: 54979 - DNA, 20 bp, human
gccggagcccctatgacccc

SEQ ID NO: 54980 - DNA, 20 bp, human
gctcggaggctgcggagaag

SEQ ID NO: 54981 - DNA, 20 bp, human
gcgggagcggacaccgaggc

SEQ ID NO: 54982 - DNA, 20 bp, human
ggctgaaaccgcttattctc

SEQ ID NO: 54983 - DNA, 20 bp, human
gagcccctatgaccccgggt

SEQ ID NO: 54984 - DNA, 20 bp, human
gaacttccattaaggactcg

SEQ ID NO: 54985 - DNA, 20 bp, human
ggaagttgcgcgcaggccgg

SEQ ID NO: 54986 - DNA, 20 bp, human
ggcgctccccctcacatcag

SEQ ID NO: 54987 - DNA, 20 bp, human
ggcatgccactgatgtgagg

SEQ ID NO: 54988 - DNA, 20 bp, human
gagcaaactgctctattcgg

SEQ ID NO: 54989 - DNA, 20 bp, human
ggaagagcgtgagccccgcg

SEQ ID NO: 54990 - DNA, 20 bp, human
gtaccttcattggaaggctg

SEQ ID NO: 54991 - DNA, 20 bp, human
ggaagccttgcacgtcggga

SEQ ID NO: 54992 - DNA, 20 bp, human
gctggcttaccttcattgga

SEQ ID NO: 54993 - DNA, 20 bp, human
gtcagcctgcgagcggagca

SEQ ID NO: 54994 - DNA, 20 bp, human
ggggggagcgctctgattgc

SEQ ID NO: 54995 - DNA, 20 bp, human
gacaaggtaattgctcgaaa

SEQ ID NO: 54996 - DNA, 20 bp, human
gtattccactgggatagaag

SEQ ID NO: 54997 - DNA, 20 bp, human
ggaagcggcaggagcagcgt

SEQ ID NO: 54998 - DNA, 20 bp, human
gccgctcgaggcgccctgag

SEQ ID NO: 54999 - DNA, 20 bp, human
gcgttggcaccggcgaacca

SEQ ID NO: 55000 - DNA, 20 bp, human
ggcaccggcgaaccatggct

SEQ ID NO: 55001 - DNA, 20 bp, human
gccactgggatagaagcggc

SEQ ID NO: 55002 - DNA, 20 bp, human
gtctcccgtgcatcccctca

SEQ ID NO: 55003 - DNA, 20 bp, human
ggatgcacgggagacaacgc

SEQ ID NO: 55004 - DNA, 20 bp, human
gcgcctcgagcgggcctctc

SEQ ID NO: 55005 - DNA, 20 bp, human
gcgccagagaggcccgctcg

SEQ ID NO: 55006 - DNA, 20 bp, human
gctgccggccggtaggagcg

SEQ ID NO: 55007 - DNA, 20 bp, human
gagatctggactcggatcaa

SEQ ID NO: 55008 - DNA, 20 bp, human
gagggtgtcgagagggtcct

SEQ ID NO: 55009 - DNA, 20 bp, human
gtcggatcaagggtgtcgag

SEQ ID NO: 55010 - DNA, 20 bp, human
gcagcaggagcgcgccttgg

SEQ ID NO: 55011 - DNA, 20 bp, human
gacacagcaggagcgcgcct

SEQ ID NO: 55012 - DNA, 20 bp, human
ggctagtgcagatctggact

SEQ ID NO: 55013 - DNA, 20 bp, human
gggttgaaactgcaccgcca

SEQ ID NO: 55014 - DNA, 20 bp, human
ggctccgcgctcctaccggc

SEQ ID NO: 55015 - DNA, 20 bp, human
ggctgagtgctgaagagggg

SEQ ID NO: 55016 - DNA, 20 bp, human
gtcgcgcaagcgggacactg

SEQ ID NO: 55017 - DNA, 20 bp, human
gcgcaagcgggacactgtgg

SEQ ID NO: 55018 - DNA, 20 bp, human
ggagggtgcttggagaacca

SEQ ID NO: 55019 - DNA, 20 bp, human
ggcgcgaggactattcactt

SEQ ID NO: 55020 - DNA, 20 bp, human
gtcctcgcggctggaggcga

SEQ ID NO: 55021 - DNA, 20 bp, human
gtctccaacaaccaaggtaa

SEQ ID NO: 55022 - DNA, 20 bp, human
gaccaaggtaagggacgggg

SEQ ID NO: 55023 - DNA, 20 bp, human
gacaaccaaggtaagggacg

SEQ ID NO: 55024 - DNA, 20 bp, human
gcaggaggcaaccagtaccc

SEQ ID NO: 55025 - DNA, 20 bp, human
gggtgcagctgcttcggagg

SEQ ID NO: 55026 - DNA, 20 bp, human
ggtgcgagcgaacaggagtg

SEQ ID NO: 55027 - DNA, 20 bp, human
ggaccagcgagcgcgaacca

SEQ ID NO: 55028 - DNA, 20 bp, human
ggcacaagccagctcgtccg

SEQ ID NO: 55029 - DNA, 20 bp, human
gagcggcctcagcggtgagg

SEQ ID NO: 55030 - DNA, 20 bp, human
gcaggctgcgaaggaaggta

SEQ ID NO: 55031 - DNA, 20 bp, human
gctcgctggtccgccaggag

SEQ ID NO: 55032 - DNA, 20 bp, human
gtctgcagtcggagacttgc

SEQ ID NO: 55033 - DNA, 20 bp, human
ggagggtcgcccggcgccgg

SEQ ID NO: 55034 - DNA, 20 bp, human
gaggagcggcctcagcggtg

SEQ ID NO: 55035 - DNA, 20 bp, human
gaggcgcaggctgcgaagga

SEQ ID NO: 55036 - DNA, 20 bp, human
gcccggccgggcgcacaccc

SEQ ID NO: 55037 - DNA, 20 bp, human
ggcacaccccggcgcacacg

SEQ ID NO: 55038 - DNA, 20 bp, human
gcggctcccagcgcacacgc

SEQ ID NO: 55039 - DNA, 20 bp, human
ggggagccgcgtgtgcgccg

SEQ ID NO: 55040 - DNA, 20 bp, human
gggaagagacccgggattaa

SEQ ID NO: 55041 - DNA, 20 bp, human
ggtgcgcccggccgggtgtg

SEQ ID NO: 55042 - DNA, 20 bp, human
ggagcttgaggaagacggac

SEQ ID NO: 55043 - DNA, 20 bp, human
gcctgcgctctgggtcgtca

SEQ ID NO: 55044 - DNA, 20 bp, human
gggaagacggacaggtaccg

SEQ ID NO: 55045 - DNA, 20 bp, human
ggccgggtgtgcggagagcg

SEQ ID NO: 55046 - DNA, 20 bp, human
ggccggctccgtcctcccgt

SEQ ID NO: 55047 - DNA, 20 bp, human
gctacagcggagcctacggg

SEQ ID NO: 55048 - DNA, 20 bp, human
gtagctacagcggagcctac

SEQ ID NO: 55049 - DNA, 20 bp, human
gtaccctccacggagcaagt

SEQ ID NO: 55050 - DNA, 20 bp, human
gctcctcctggcatccgcag

SEQ ID NO: 55051 - DNA, 20 bp, human
gcgcgagagcgagtgcgtcc

SEQ ID NO: 55052 - DNA, 20 bp, human
gtagctagcaatgtgacacc

SEQ ID NO: 55053 - DNA, 20 bp, human
ggaaggtaacgtaccctcca

SEQ ID NO: 55054 - DNA, 20 bp, human
gcagccaacttgctccgtgg

SEQ ID NO: 55055 - DNA, 20 bp, human
ggtcacattgctagctacag

SEQ ID NO: 55056 - DNA, 20 bp, human
ggattgactgtgccaggagg

SEQ ID NO: 55057 - DNA, 20 bp, human
gcattctgctggctgcgcgg

SEQ ID NO: 55058 - DNA, 20 bp, human
gcttccacggcggcgagcag

SEQ ID NO: 55059 - DNA, 20 bp, human
ggcccggcgagcgccgccca

SEQ ID NO: 55060 - DNA, 20 bp, human
gcgggctggctacaaagcct

SEQ ID NO: 55061 - DNA, 20 bp, human
ggctcgctcaccttccacgg

SEQ ID NO: 55062 - DNA, 20 bp, human
ggctgattgactgtgccagg

SEQ ID NO: 55063 - DNA, 20 bp, human
gggccggacacacctccccg

SEQ ID NO: 55064 - DNA, 20 bp, human
gcgaagggaccatcttgccg

SEQ ID NO: 55065 - DNA, 20 bp, human
gcgcgccttgccgccccccc

SEQ ID NO: 55066 - DNA, 20 bp, human
ggcagaagtgagtacgtgag

SEQ ID NO: 55067 - DNA, 20 bp, human
ggccgagcgcaccctctctc

SEQ ID NO: 55068 - DNA, 20 bp, human
ggtcagctgcgggcccgact

SEQ ID NO: 55069 - DNA, 20 bp, human
gcgggctctggccatggccg

SEQ ID NO: 55070 - DNA, 20 bp, human
gctgggatccggggcttcgg

SEQ ID NO: 55071 - DNA, 20 bp, human
gggctgcaggcacccgagag

SEQ ID NO: 55072 - DNA, 20 bp, human
gcgggcccgactgggatccg

SEQ ID NO: 55073 - DNA, 20 bp, human
ggaagccccggatcccagtc

SEQ ID NO: 55074 - DNA, 20 bp, human
gaccggtccaggaggatccg

SEQ ID NO: 55075 - DNA, 20 bp, human
gcctagagctgccacggcca

SEQ ID NO: 55076 - DNA, 20 bp, human
ggagcggggacggagcggga

SEQ ID NO: 55077 - DNA, 20 bp, human
ggcgggcgcgcagcaagacg

SEQ ID NO: 55078 - DNA, 20 bp, human
gggcgccgcctcactcgggt

SEQ ID NO: 55079 - DNA, 20 bp, human
gagggagagtcagacctggg

SEQ ID NO: 55080 - DNA, 20 bp, human
gcgcgctgagggccccgacg

SEQ ID NO: 55081 - DNA, 20 bp, human
ggatggtgggagcccgagcg

SEQ ID NO: 55082 - DNA, 20 bp, human
gcctcgcgggcggggatggt

SEQ ID NO: 55083 - DNA, 20 bp, human
ggcccgagcggggacggagc

SEQ ID NO: 55084 - DNA, 20 bp, human
gggagtcccgcgcggagtat

SEQ ID NO: 55085 - DNA, 20 bp, human
ggcccagggagagtcagacc

SEQ ID NO: 55086 - DNA, 20 bp, human
gtccctcaggaagccaccta

SEQ ID NO: 55087 - DNA, 20 bp, human
gtccactgcgaggcctcggg

SEQ ID NO: 55088 - DNA, 20 bp, human
ggcccgctgctgtagagccg

SEQ ID NO: 55089 - DNA, 20 bp, human
gagccgcggctctacagcag

SEQ ID NO: 55090 - DNA, 20 bp, human
gccagagtggggttcatgaa

SEQ ID NO: 55091 - DNA, 20 bp, human
gaggcctcgcagtggacccg

SEQ ID NO: 55092 - DNA, 20 bp, human
ggcccctaggtggcttcctg

SEQ ID NO: 55093 - DNA, 20 bp, human
gcccggactggagaagacgc

SEQ ID NO: 55094 - DNA, 20 bp, human
gggactggagaagacgcggg

SEQ ID NO: 55095 - DNA, 20 bp, human
ggagactgcggccaacggga

SEQ ID NO: 55096 - DNA, 20 bp, human
gggcaggcgcgcgatctctc

SEQ ID NO: 55097 - DNA, 20 bp, human
gaactagccgaggagagcca

SEQ ID NO: 55098 - DNA, 20 bp, human
gggctccttcccccagtagg

SEQ ID NO: 55099 - DNA, 20 bp, human
gccccgggcgcttacggtct

SEQ ID NO: 55100 - DNA, 20 bp, human
gtgcgcgtgccgcctactgg

SEQ ID NO: 55101 - DNA, 20 bp, human
gggtctcggctcgcaggctc

SEQ ID NO: 55102 - DNA, 20 bp, human
gcggcgtccgcccacagtct

SEQ ID NO: 55103 - DNA, 20 bp, human
ggccgagaccgtaagcgccc

SEQ ID NO: 55104 - DNA, 20 bp, human
gctggaagcagagctcgccc

SEQ ID NO: 55105 - DNA, 20 bp, human
gggccggccccgggcgctta

SEQ ID NO: 55106 - DNA, 20 bp, human
ggccgcgcgcagcgtcatgg

SEQ ID NO: 55107 - DNA, 20 bp, human
gccggacacgcagctaacct

SEQ ID NO: 55108 - DNA, 20 bp, human
gcgccaccccattagacagg

SEQ ID NO: 55109 - DNA, 20 bp, human
gacggccgcgcgcagcgtca

SEQ ID NO: 55110 - DNA, 20 bp, human
gaccccgtcaaggtcgaaga

SEQ ID NO: 55111 - DNA, 20 bp, human
gcagcgccagcaccccgtca

SEQ ID NO: 55112 - DNA, 20 bp, human
gcgaggacgccgaacaccgc

SEQ ID NO: 55113 - DNA, 20 bp, human
gtaacctgggagatgcgcga

SEQ ID NO: 55114 - DNA, 20 bp, human
gaagggagaggagttactca

SEQ ID NO: 55115 - DNA, 20 bp, human
gtggccttcgcgcatctccc

SEQ ID NO: 55116 - DNA, 20 bp, human
gcgacagggacaggaaacaa

SEQ ID NO: 55117 - DNA, 20 bp, human
gtcaggtgagtggtgcgctc

SEQ ID NO: 55118 - DNA, 20 bp, human
gtaaacacctgggcgcgaca

SEQ ID NO: 55119 - DNA, 20 bp, human
gtcgcgcccaggtgtttacc

SEQ ID NO: 55120 - DNA, 20 bp, human
gaccgtgctcacccagcgag

SEQ ID NO: 55121 - DNA, 20 bp, human
gacccctcgctgggtgagca

SEQ ID NO: 55122 - DNA, 20 bp, human
ggcctgagcgacccctcgct

SEQ ID NO: 55123 - DNA, 20 bp, human
gtcgcacgggggcgctatcg

SEQ ID NO: 55124 - DNA, 20 bp, human
ggcttcagcgacaggcgcga

SEQ ID NO: 55125 - DNA, 20 bp, human
ggggtcgcgtggggtcgaga

SEQ ID NO: 55126 - DNA, 20 bp, human
ggcagtgggtgcccaaggag

SEQ ID NO: 55127 - DNA, 20 bp, human
gcactgcccttcctcgggag

SEQ ID NO: 55128 - DNA, 20 bp, human
gggagcgtgagcatcaggcg

SEQ ID NO: 55129 - DNA, 20 bp, human
gcagcctcgccattgggagg

SEQ ID NO: 55130 - DNA, 20 bp, human
ggagccccccaccctcgcgg

SEQ ID NO: 55131 - DNA, 20 bp, human
gccctagtgtcctggcagga

SEQ ID NO: 55132 - DNA, 20 bp, human
ggctcacccgctcccgagga

SEQ ID NO: 55133 - DNA, 20 bp, human
gccgcagtagcagtagacca

SEQ ID NO: 55134 - DNA, 20 bp, human
ggccggcgcagaccttccgg

SEQ ID NO: 55135 - DNA, 20 bp, human
ggcgcgtcgagaggcgacgg

SEQ ID NO: 55136 - DNA, 20 bp, human
gacgggtctagggaatcagt

SEQ ID NO: 55137 - DNA, 20 bp, human
gcagcgtggccggcagagca

SEQ ID NO: 55138 - DNA, 20 bp, human
gtggcaccaccaccccaaag

SEQ ID NO: 55139 - DNA, 20 bp, human
gggagcgctatacgggtcta

SEQ ID NO: 55140 - DNA, 20 bp, human
gggtcagcccaggtcgcccg

SEQ ID NO: 55141 - DNA, 20 bp, human
ggcgtccctgcgcactcccc

SEQ ID NO: 55142 - DNA, 20 bp, human
gccgggaggagagctctcct

SEQ ID NO: 55143 - DNA, 20 bp, human
gcggcccgcacccccaaccg

SEQ ID NO: 55144 - DNA, 20 bp, human
ggctcccaacgccccagctc

SEQ ID NO: 55145 - DNA, 20 bp, human
gcaccaccagcagctccggc

SEQ ID NO: 55146 - DNA, 20 bp, human
ggcgggaggccacaagagca

SEQ ID NO: 55147 - DNA, 20 bp, human
gaaggccgcaaggggagagg

SEQ ID NO: 55148 - DNA, 20 bp, human
gagcagggccaacgttagaa

SEQ ID NO: 55149 - DNA, 20 bp, human
gaacgttagaaaggccgcaa

SEQ ID NO: 55150 - DNA, 20 bp, human
ggacgtcaggcgccactacg

SEQ ID NO: 55151 - DNA, 20 bp, human
gtgtggcctcccgcagaatg

SEQ ID NO: 55152 - DNA, 20 bp, human
gttcgcgggtagctacgatg

SEQ ID NO: 55153 - DNA, 20 bp, human
ggggcgtcatccacattctg

SEQ ID NO: 55154 - DNA, 20 bp, human
ggcaggacgcttacatgctc

SEQ ID NO: 55155 - DNA, 20 bp, human
ggcgggtagctacgatgagg

SEQ ID NO: 55156 - DNA, 20 bp, human
ggcacgcacgaacgcaagga

SEQ ID NO: 55157 - DNA, 20 bp, human
gttgcttcccgtctcctcgg

SEQ ID NO: 55158 - DNA, 20 bp, human
gtctccgcgccccttctggg

SEQ ID NO: 55159 - DNA, 20 bp, human
gacacagacacgacagacag

SEQ ID NO: 55160 - DNA, 20 bp, human
gacacagacaaccgacacgg

SEQ ID NO: 55161 - DNA, 20 bp, human
gacagaaggaggcgacggac

SEQ ID NO: 55162 - DNA, 20 bp, human
gcccagagcccggcgtgagg

SEQ ID NO: 55163 - DNA, 20 bp, human
gagttcactgaaacaggcac

SEQ ID NO: 55164 - DNA, 20 bp, human
gctgttgcttcccgtctcct

SEQ ID NO: 55165 - DNA, 20 bp, human
ggggcagtcaaggccgacac

SEQ ID NO: 55166 - DNA, 20 bp, human
gaggtgagccacagcccgtg

SEQ ID NO: 55167 - DNA, 20 bp, human
gcacagcccgtggggctcca

SEQ ID NO: 55168 - DNA, 20 bp, human
gaacggggctccaggatccg

SEQ ID NO: 55169 - DNA, 20 bp, human
gaggccagagcgagtccccg

SEQ ID NO: 55170 - DNA, 20 bp, human
ggatccgaggtaggagtaag

SEQ ID NO: 55171 - DNA, 20 bp, human
gggttgttccaagatgaacg

SEQ ID NO: 55172 - DNA, 20 bp, human
gcgccgggctcggggagagg

SEQ ID NO: 55173 - DNA, 20 bp, human
ggggctccaggatccgaggt

SEQ ID NO: 55174 - DNA, 20 bp, human
gcggaccgggctctgcacgg

SEQ ID NO: 55175 - DNA, 20 bp, human
gagcctggcgtagggaccag

SEQ ID NO: 55176 - DNA, 20 bp, human
ggacgacttcgtctatcaga

SEQ ID NO: 55177 - DNA, 20 bp, human
gtctcctcaaggacgaggaa

SEQ ID NO: 55178 - DNA, 20 bp, human
ggtggctctcctcaaggacg

SEQ ID NO: 55179 - DNA, 20 bp, human
ggaaggtttctctgtttgaa

SEQ ID NO: 55180 - DNA, 20 bp, human
ggccgacctgacctacaacg

SEQ ID NO: 55181 - DNA, 20 bp, human
ggaacggttgaaggctgaga

SEQ ID NO: 55182 - DNA, 20 bp, human
gatagggtgcgcacttacca

SEQ ID NO: 55183 - DNA, 20 bp, human
gcactgctgggccacacgtt

SEQ ID NO: 55184 - DNA, 20 bp, human
gcgtgtggcccagcagtgcc

SEQ ID NO: 55185 - DNA, 20 bp, human
gagaactggacgggccccac

SEQ ID NO: 55186 - DNA, 20 bp, human
gagcgccaggcagcactccg

SEQ ID NO: 55187 - DNA, 20 bp, human
gtgagctgtagaggacctaa

SEQ ID NO: 55188 - DNA, 20 bp, human
gggaggtgcagacccctcag

SEQ ID NO: 55189 - DNA, 20 bp, human
ggcccccaaaaagggactca

SEQ ID NO: 55190 - DNA, 20 bp, human
gggtcggagggtcaccgcag

SEQ ID NO: 55191 - DNA, 20 bp, human
ggtcaccgcagaggctactc

SEQ ID NO: 55192 - DNA, 20 bp, human
ggccctgagtccctttttgg

SEQ ID NO: 55193 - DNA, 20 bp, human
gctaggaggcaaacgcacgc

SEQ ID NO: 55194 - DNA, 20 bp, human
gctgcctggcgctggctagg

SEQ ID NO: 55195 - DNA, 20 bp, human
ggtgctgcctggcgctggct

SEQ ID NO: 55196 - DNA, 20 bp, human
gaggcccacgacccgctgga

SEQ ID NO: 55197 - DNA, 20 bp, human
gcagaaggcccacgacccgc

SEQ ID NO: 55198 - DNA, 20 bp, human
gccagagaataagataccgt

SEQ ID NO: 55199 - DNA, 20 bp, human
ggccagaagcaggaatctga

SEQ ID NO: 55200 - DNA, 20 bp, human
ggcagcctggggaccagttg

SEQ ID NO: 55201 - DNA, 20 bp, human
ggggcctttgggaggacctt

SEQ ID NO: 55202 - DNA, 20 bp, human
ggccgtggcattcccacaga

SEQ ID NO: 55203 - DNA, 20 bp, human
gacaccagtgctagtgtggg

SEQ ID NO: 55204 - DNA, 20 bp, human
gaataagataccgtgggagt

SEQ ID NO: 55205 - DNA, 20 bp, human
ggtggaaggagcgtggaatc

SEQ ID NO: 55206 - DNA, 20 bp, human
gcacgctccgccagtcccaa

SEQ ID NO: 55207 - DNA, 20 bp, human
gtgcgcacccttgggactgg

SEQ ID NO: 55208 - DNA, 20 bp, human
gctcatcccgggaagctcgg

SEQ ID NO: 55209 - DNA, 20 bp, human
gggttgcgcacccttgggac

SEQ ID NO: 55210 - DNA, 20 bp, human
ggcgcgccgggtgaccacac

SEQ ID NO: 55211 - DNA, 20 bp, human
gggagcgtgctatctgggaa

SEQ ID NO: 55212 - DNA, 20 bp, human
gcgggccctgggtcgcggga

SEQ ID NO: 55213 - DNA, 20 bp, human
gcagccggttgcgcaccctt

SEQ ID NO: 55214 - DNA, 20 bp, human
gcggccaggcgcggagatgg

SEQ ID NO: 55215 - DNA, 20 bp, human
gggggtccctcagcgacctg

SEQ ID NO: 55216 - DNA, 20 bp, human
gcccaggtggagatcctgga

SEQ ID NO: 55217 - DNA, 20 bp, human
gcgcccccaggtggagatcc

SEQ ID NO: 55218 - DNA, 20 bp, human
gccacctgggggcggaatca

SEQ ID NO: 55219 - DNA, 20 bp, human
gcatagtgaaagaggaccgt

SEQ ID NO: 55220 - DNA, 20 bp, human
gcagtaaggattcacatcag

SEQ ID NO: 55221 - DNA, 20 bp, human
gggagccagggcgaatcacg

SEQ ID NO: 55222 - DNA, 20 bp, human
gatacgcgcgcggacggcga

SEQ ID NO: 55223 - DNA, 20 bp, human
gggtccaggtctaagaggcg

SEQ ID NO: 55224 - DNA, 20 bp, human
gaggatgaccacgaggatga

SEQ ID NO: 55225 - DNA, 20 bp, human
gccaggtctaagaggcgggg

SEQ ID NO: 55226 - DNA, 20 bp, human
gcccgggcaagagctagagt

SEQ ID NO: 55227 - DNA, 20 bp, human
gcccggcacagtccacagct

SEQ ID NO: 55228 - DNA, 20 bp, human
gggtcagctgcgtccggcgg

SEQ ID NO: 55229 - DNA, 20 bp, human
gcctggtcagctgcgtccgg

SEQ ID NO: 55230 - DNA, 20 bp, human
gggtcagcagctgcctccgc

SEQ ID NO: 55231 - DNA, 20 bp, human
ggggcctggtcagctgcgtc

SEQ ID NO: 55232 - DNA, 20 bp, human
gccgaccaggcgcctctaag

SEQ ID NO: 55233 - DNA, 20 bp, human
gccccgccacggggagccca

SEQ ID NO: 55234 - DNA, 20 bp, human
gcatccaggacccagtctaa

SEQ ID NO: 55235 - DNA, 20 bp, human
gcccagcgagcaggagacaa

SEQ ID NO: 55236 - DNA, 20 bp, human
ggaggacgaatagcaccagg

SEQ ID NO: 55237 - DNA, 20 bp, human
gcaggaatccgggaaaccaa

SEQ ID NO: 55238 - DNA, 20 bp, human
gtaagaggacgaatagcacc

SEQ ID NO: 55239 - DNA, 20 bp, human
gaattcgggaaccaccagaa

SEQ ID NO: 55240 - DNA, 20 bp, human
gccaggtcccgggttgggag

SEQ ID NO: 55241 - DNA, 20 bp, human
gcgggaaccaccagaaaggc

SEQ ID NO: 55242 - DNA, 20 bp, human
gggatagagatgatgcctca

SEQ ID NO: 55243 - DNA, 20 bp, human
ggagatgatgcctcaaggaa

SEQ ID NO: 55244 - DNA, 20 bp, human
ggctggcctctcttcaacat

SEQ ID NO: 55245 - DNA, 20 bp, human
gaagatcccatgttgaagag

SEQ ID NO: 55246 - DNA, 20 bp, human
ggaggacgaatagcaccagg

SEQ ID NO: 55247 - DNA, 20 bp, human
gcaggaatccgggaaaccaa

SEQ ID NO: 55248 - DNA, 20 bp, human
gtaagaggacgaatagcacc

SEQ ID NO: 55249 - DNA, 20 bp, human
gaattcgggaaccaccagaa

SEQ ID NO: 55250 - DNA, 20 bp, human
gccaggtcccgggttgggag

SEQ ID NO: 55251 - DNA, 20 bp, human
gcgggaaccaccagaaaggc

SEQ ID NO: 55252 - DNA, 20 bp, human
gggatagagatgatgcctca

SEQ ID NO: 55253 - DNA, 20 bp, human
ggagatgatgcctcaaggaa

SEQ ID NO: 55254 - DNA, 20 bp, human
ggctggcctctcttcaacat

SEQ ID NO: 55255 - DNA, 20 bp, human
gaagatcccatgttgaagag

SEQ ID NO: 55256 - DNA, 20 bp, human
gcgggcgcgcggagacactg

SEQ ID NO: 55257 - DNA, 20 bp, human
gtaggccgacaaattgagag

SEQ ID NO: 55258 - DNA, 20 bp, human
gctgcagagcgtgccccggg

SEQ ID NO: 55259 - DNA, 20 bp, human
gggggaacgcccaggccagg

SEQ ID NO: 55260 - DNA, 20 bp, human
gtcacgggagaggcggccag

SEQ ID NO: 55261 - DNA, 20 bp, human
ggcacgccgaggccagggta

SEQ ID NO: 55262 - DNA, 20 bp, human
gtgtcggcctagctgcctcc

SEQ ID NO: 55263 - DNA, 20 bp, human
ggccggccccgagccctcac

SEQ ID NO: 55264 - DNA, 20 bp, human
gtgcagggtggggaacgccc

SEQ ID NO: 55265 - DNA, 20 bp, human
gcgagccctcacgggagagg

SEQ ID NO: 55266 - DNA, 20 bp, human
gctggctcgtgccagaacta

SEQ ID NO: 55267 - DNA, 20 bp, human
ggctcgtgccagaactacgg

SEQ ID NO: 55268 - DNA, 20 bp, human
gctacggaggaccccgcgaa

SEQ ID NO: 55269 - DNA, 20 bp, human
gggaggcgcagtgtgagccc

SEQ ID NO: 55270 - DNA, 20 bp, human
gggcagtagctgcggcgcag

SEQ ID NO: 55271 - DNA, 20 bp, human
gagggagaggtgagttgact

SEQ ID NO: 55272 - DNA, 20 bp, human
gagccaggcgtactgacagg

SEQ ID NO: 55273 - DNA, 20 bp, human
gacgagccaggcgtactgac

SEQ ID NO: 55274 - DNA, 20 bp, human
gctgagaaaaagatccgaag

SEQ ID NO: 55275 - DNA, 20 bp, human
gagcaactctcgctctccgg

SEQ ID NO: 55276 - DNA, 20 bp, human
gctgtgggaggaaacttcct

SEQ ID NO: 55277 - DNA, 20 bp, human
gacctgtgtcagagagagct

SEQ ID NO: 55278 - DNA, 20 bp, human
ggcccagctctctctgacac

SEQ ID NO: 55279 - DNA, 20 bp, human
gaccggccggccaagcccgg

SEQ ID NO: 55280 - DNA, 20 bp, human
gcggagccggagcccccctg

SEQ ID NO: 55281 - DNA, 20 bp, human
ggggatgcgtgcggccctgt

SEQ ID NO: 55282 - DNA, 20 bp, human
gggaggcgcccgacgaccct

SEQ ID NO: 55283 - DNA, 20 bp, human
ggatggaaacaccatggctg

SEQ ID NO: 55284 - DNA, 20 bp, human
gaaggaagacgggctgactg

SEQ ID NO: 55285 - DNA, 20 bp, human
gagcgggtgcgactgcggga

SEQ ID NO: 55286 - DNA, 20 bp, human
gcgagtccgcgggaagatgg

SEQ ID NO: 55287 - DNA, 20 bp, human
gcccgtacctgctgggagag

SEQ ID NO: 55288 - DNA, 20 bp, human
ggcccgagtccgcgggaaga

SEQ ID NO: 55289 - DNA, 20 bp, human
ggctgggctgcatcccggag

SEQ ID NO: 55290 - DNA, 20 bp, human
ggtgcccgcgagggtcgctc

SEQ ID NO: 55291 - DNA, 20 bp, human
gccgcccggcccgtacctgc

SEQ ID NO: 55292 - DNA, 20 bp, human
gccaggccggggacccgcgg

SEQ ID NO: 55293 - DNA, 20 bp, human
gagggtcgctcgggcacggg

SEQ ID NO: 55294 - DNA, 20 bp, human
gagggagacaaagactcgct

SEQ ID NO: 55295 - DNA, 20 bp, human
gggcctgggagcttcagcgg

SEQ ID NO: 55296 - DNA, 20 bp, human
ggggcggctccagacttcac

SEQ ID NO: 55297 - DNA, 20 bp, human
gtaaagagcagcgatctccg

SEQ ID NO: 55298 - DNA, 20 bp, human
gttggcagccaggtgcggta

SEQ ID NO: 55299 - DNA, 20 bp, human
gtccgaggcgagcacagcgc

SEQ ID NO: 55300 - DNA, 20 bp, human
gtcacaggcagcagctagcg

SEQ ID NO: 55301 - DNA, 20 bp, human
gcccacagcttgcccggacc

SEQ ID NO: 55302 - DNA, 20 bp, human
gcctgggcgcgggtctgcac

SEQ ID NO: 55303 - DNA, 20 bp, human
gccgcgagcccagacgaggt

SEQ ID NO: 55304 - DNA, 20 bp, human
gagctgctgcctgtgaagtc

SEQ ID NO: 55305 - DNA, 20 bp, human
gagccgccggaccccgggac

SEQ ID NO: 55306 - DNA, 20 bp, human
gcctggaagggaaaggacag

SEQ ID NO: 55307 - DNA, 20 bp, human
ggcaggcaggtaaggagatc

SEQ ID NO: 55308 - DNA, 20 bp, human
gaggtaaggagatccgggtc

SEQ ID NO: 55309 - DNA, 20 bp, human
gaggggccggcagcctggaa

SEQ ID NO: 55310 - DNA, 20 bp, human
gaggctggggtaggaattag

SEQ ID NO: 55311 - DNA, 20 bp, human
gatgcctgcattgagggagg

SEQ ID NO: 55312 - DNA, 20 bp, human
ggcccccttctctcctgacc

SEQ ID NO: 55313 - DNA, 20 bp, human
gccccgtccctcagacccat

SEQ ID NO: 55314 - DNA, 20 bp, human
gccagggtctcagggaggac

SEQ ID NO: 55315 - DNA, 20 bp, human
gagacccattggtcaagccc

SEQ ID NO: 55316 - DNA, 20 bp, human
gctgggaaggaagttctgga

SEQ ID NO: 55317 - DNA, 20 bp, human
gggacctgggaaggaagttc

SEQ ID NO: 55318 - DNA, 20 bp, human
ggatccgagaggacatccag

SEQ ID NO: 55319 - DNA, 20 bp, human
gcaggtgagagggaagaagt

SEQ ID NO: 55320 - DNA, 20 bp, human
gatcagagcaaggaagggca

SEQ ID NO: 55321 - DNA, 20 bp, human
gctaaggcgggatcagagca

SEQ ID NO: 55322 - DNA, 20 bp, human
gcgaggcccgggtaggaagt

SEQ ID NO: 55323 - DNA, 20 bp, human
gcaggcggagctgatccgag

SEQ ID NO: 55324 - DNA, 20 bp, human
gcgtggcctgacggtgtgat

SEQ ID NO: 55325 - DNA, 20 bp, human
gggaagttctggaaggcagt

SEQ ID NO: 55326 - DNA, 20 bp, human
gcgcgaacagacggacgcac

SEQ ID NO: 55327 - DNA, 20 bp, human
gcacggtcaggccctcggga

SEQ ID NO: 55328 - DNA, 20 bp, human
gcggccgaggcgcgaacaga

SEQ ID NO: 55329 - DNA, 20 bp, human
gagcaggacccgtccaggag

SEQ ID NO: 55330 - DNA, 20 bp, human
gcgcaccggcgagcgccgag

SEQ ID NO: 55331 - DNA, 20 bp, human
gcgcgctcggcctgtcccct

SEQ ID NO: 55332 - DNA, 20 bp, human
ggctgggagtgggcaggacg

SEQ ID NO: 55333 - DNA, 20 bp, human
gccggagagcgctggtggta

SEQ ID NO: 55334 - DNA, 20 bp, human
ggagagcgctggtggtaggg

SEQ ID NO: 55335 - DNA, 20 bp, human
gcctccacggtcaggccctc

SEQ ID NO: 55336 - DNA, 20 bp, human
gcagctcccctacccctaag

SEQ ID NO: 55337 - DNA, 20 bp, human
gggcctgccttgccccttag

SEQ ID NO: 55338 - DNA, 20 bp, human
gggtggtccggtgctggtgg

SEQ ID NO: 55339 - DNA, 20 bp, human
gccgggtgcctggtcccccc

SEQ ID NO: 55340 - DNA, 20 bp, human
gagattccctaccccaggga

SEQ ID NO: 55341 - DNA, 20 bp, human
gacatctagggcttaaaggg

SEQ ID NO: 55342 - DNA, 20 bp, human
gccaggcacccggccttcac

SEQ ID NO: 55343 - DNA, 20 bp, human
ggcaggtggtccggtgctgg

SEQ ID NO: 55344 - DNA, 20 bp, human
gggggatcaagcccaaggag

SEQ ID NO: 55345 - DNA, 20 bp, human
gtaggtaggtaggtcaaggt

SEQ ID NO: 55346 - DNA, 20 bp, human
gatgggattccaaagtgcag

SEQ ID NO: 55347 - DNA, 20 bp, human
gtcccgcgaagggcccttag

SEQ ID NO: 55348 - DNA, 20 bp, human
gtcccgggccgccgtcgctg

SEQ ID NO: 55349 - DNA, 20 bp, human
gccacaggggcccaacaaca

SEQ ID NO: 55350 - DNA, 20 bp, human
ggaccagagagagggtttgg

SEQ ID NO: 55351 - DNA, 20 bp, human
gatccctcccgcagcgacgg

SEQ ID NO: 55352 - DNA, 20 bp, human
gcgtgcacgcgggccagagg

SEQ ID NO: 55353 - DNA, 20 bp, human
ggggccgccgtcgctgcggg

SEQ ID NO: 55354 - DNA, 20 bp, human
gcgcatccctcccgcagcga

SEQ ID NO: 55355 - DNA, 20 bp, human
gcgactcaatttataaggtg

SEQ ID NO: 55356 - DNA, 20 bp, human
ggtagccgcctcggcccctt

SEQ ID NO: 55357 - DNA, 20 bp, human
ggctggctttgataagtaca

SEQ ID NO: 55358 - DNA, 20 bp, human
gtgacacacaagcaccacac

SEQ ID NO: 55359 - DNA, 20 bp, human
gcatccttgcccagccggtg

SEQ ID NO: 55360 - DNA, 20 bp, human
gggagagcgctcagtgatca

SEQ ID NO: 55361 - DNA, 20 bp, human
ggcagcgactcccggctaca

SEQ ID NO: 55362 - DNA, 20 bp, human
gcacaagcaccacaccggct

SEQ ID NO: 55363 - DNA, 20 bp, human
gggacccgcaggacctccgg

SEQ ID NO: 55364 - DNA, 20 bp, human
gatcactgagcgctctccta

SEQ ID NO: 55365 - DNA, 20 bp, human
gcccactcggcagcgactcc

SEQ ID NO: 55366 - DNA, 20 bp, human
ggcctgggaggatcagtgag

SEQ ID NO: 55367 - DNA, 20 bp, human
gggaagtgagaggtcggctg

SEQ ID NO: 55368 - DNA, 20 bp, human
gggggtcctcaaagtgagag

SEQ ID NO: 55369 - DNA, 20 bp, human
gctacaattggacccagaag

SEQ ID NO: 55370 - DNA, 20 bp, human
gcatccacagcctgcacggg

SEQ ID NO: 55371 - DNA, 20 bp, human
gacccagaagaggtggactt

SEQ ID NO: 55372 - DNA, 20 bp, human
ggtcccctagacaggcaagg

SEQ ID NO: 55373 - DNA, 20 bp, human
ggatcctcccgtgcaggctg

SEQ ID NO: 55374 - DNA, 20 bp, human
gctctggacgtagctgggaa

SEQ ID NO: 55375 - DNA, 20 bp, human
gctgggtcagtgccctcaca

SEQ ID NO: 55376 - DNA, 20 bp, human
gtggctctgacctgatgaaa

SEQ ID NO: 55377 - DNA, 20 bp, human
gactgaggatgcagagctag

SEQ ID NO: 55378 - DNA, 20 bp, human
gtttaaaggttgttatagta

SEQ ID NO: 55379 - DNA, 20 bp, human
gtctatactggcaaagaatg

SEQ ID NO: 55380 - DNA, 20 bp, human
gcactttgtgccatttcatc

SEQ ID NO: 55381 - DNA, 20 bp, human
gcaatagtgcctgtctatac

SEQ ID NO: 55382 - DNA, 20 bp, human
gaaagaatgtggtctgtgtc

SEQ ID NO: 55383 - DNA, 20 bp, human
ggaaactactctaattttat

SEQ ID NO: 55384 - DNA, 20 bp, human
gttacaatacttttaatctc

SEQ ID NO: 55385 - DNA, 20 bp, human
gcaaaattttgaattagctt

SEQ ID NO: 55386 - DNA, 20 bp, human
gctgctgggccacagaaagg

SEQ ID NO: 55387 - DNA, 20 bp, human
gggtagacgcactagattac

SEQ ID NO: 55388 - DNA, 20 bp, human
gcattagcaggagcataatt

SEQ ID NO: 55389 - DNA, 20 bp, human
gctcctgctaatgagaaaaa

SEQ ID NO: 55390 - DNA, 20 bp, human
gtttttaaggaaaaaactcc

SEQ ID NO: 55391 - DNA, 20 bp, human
gctctctcaccttcaatagt

SEQ ID NO: 55392 - DNA, 20 bp, human
gatcatgaaaaattggtatg

SEQ ID NO: 55393 - DNA, 20 bp, human
ggcaggtcctgtgtctaact

SEQ ID NO: 55394 - DNA, 20 bp, human
gtaaacaatataaaattcat

SEQ ID NO: 55395 - DNA, 20 bp, human
ggtatgtggcagttttctac

SEQ ID NO: 55396 - DNA, 20 bp, human
ggagaagccgaggccaagcg

SEQ ID NO: 55397 - DNA, 20 bp, human
gggcagccattacagccgca

SEQ ID NO: 55398 - DNA, 20 bp, human
gaatccgaggaagtggtcca

SEQ ID NO: 55399 - DNA, 20 bp, human
gcttctcgcagtaatggcca

SEQ ID NO: 55400 - DNA, 20 bp, human
gcagtgccttgcggctgtaa

SEQ ID NO: 55401 - DNA, 20 bp, human
ggtcgggctgagagaatccg

SEQ ID NO: 55402 - DNA, 20 bp, human
gaaggagtcaccgaactgtc

SEQ ID NO: 55403 - DNA, 20 bp, human
gcctagccccgcgccagctg

SEQ ID NO: 55404 - DNA, 20 bp, human
gtcgtaggagcgctcctggt

SEQ ID NO: 55405 - DNA, 20 bp, human
gctgccctggaccacttcct

SEQ ID NO: 55406 - DNA, 20 bp, human
gggagctaggccggcggcag

SEQ ID NO: 55407 - DNA, 20 bp, human
gtggcggcggcgcaagggtg

SEQ ID NO: 55408 - DNA, 20 bp, human
gaaagggccggtgctcaagt

SEQ ID NO: 55409 - DNA, 20 bp, human
ggctcccgccggccgaacag

SEQ ID NO: 55410 - DNA, 20 bp, human
ggctcgagcgcgctgtacct

SEQ ID NO: 55411 - DNA, 20 bp, human
ggcccgcagtcccctacccg

SEQ ID NO: 55412 - DNA, 20 bp, human
gccgccggcctagctccccc

SEQ ID NO: 55413 - DNA, 20 bp, human
gccacgcgcccggagggaca

SEQ ID NO: 55414 - DNA, 20 bp, human
gggtggtggcggcggcgcaa

SEQ ID NO: 55415 - DNA, 20 bp, human
gcagggacagggaccggcag

SEQ ID NO: 55416 - DNA, 20 bp, human
gcgtgcccaaggagacaggg

SEQ ID NO: 55417 - DNA, 20 bp, human
ggaaagcccaccagaccaaa

SEQ ID NO: 55418 - DNA, 20 bp, human
gctgtctccttgggcacgag

SEQ ID NO: 55419 - DNA, 20 bp, human
ggacagggtggttacagaca

SEQ ID NO: 55420 - DNA, 20 bp, human
gatcacagaagctgcccggg

SEQ ID NO: 55421 - DNA, 20 bp, human
gtaccctggggacaagggaa

SEQ ID NO: 55422 - DNA, 20 bp, human
ggcactgaggatgcagcaca

SEQ ID NO: 55423 - DNA, 20 bp, human
ggtaaccaccctgtctcctt

SEQ ID NO: 55424 - DNA, 20 bp, human
gttacgtttgtggggtggat

SEQ ID NO: 55425 - DNA, 20 bp, human
ggctgcagatttgactgaag

SEQ ID NO: 55426 - DNA, 20 bp, human
gaatcaacaactgtgaaggc

SEQ ID NO: 55427 - DNA, 20 bp, human
ggatggggggacgtgggaca

SEQ ID NO: 55428 - DNA, 20 bp, human
gcagctcagggaagagacgt

SEQ ID NO: 55429 - DNA, 20 bp, human
gtgattcgcgtgaggaggga

SEQ ID NO: 55430 - DNA, 20 bp, human
gggcagcaggctctgcaagt

SEQ ID NO: 55431 - DNA, 20 bp, human
ggtcctccacgaagcactgg

SEQ ID NO: 55432 - DNA, 20 bp, human
gcctgagtacaaggctgtgg

SEQ ID NO: 55433 - DNA, 20 bp, human
ggtaggaatcctggatggtg

SEQ ID NO: 55434 - DNA, 20 bp, human
gaggagagatggggggacgt

SEQ ID NO: 55435 - DNA, 20 bp, human
ggtggtcctccacgaagcac

SEQ ID NO: 55436 - DNA, 20 bp, human
gttgggaccggagaaaccag

SEQ ID NO: 55437 - DNA, 20 bp, human
ggcgcagtaaagggccccgt

SEQ ID NO: 55438 - DNA, 20 bp, human
gtaaagggccccgtgggaag

SEQ ID NO: 55439 - DNA, 20 bp, human
ggcgggagggggcagttaca

SEQ ID NO: 55440 - DNA, 20 bp, human
gtggacagtcgagacgctca

SEQ ID NO: 55441 - DNA, 20 bp, human
gttctccggtcccaatggag

SEQ ID NO: 55442 - DNA, 20 bp, human
ggattcccctccattgggac

SEQ ID NO: 55443 - DNA, 20 bp, human
ggggcgcgcggcgcagtaaa

SEQ ID NO: 55444 - DNA, 20 bp, human
gccggagccgcgagcaccca

SEQ ID NO: 55445 - DNA, 20 bp, human
ggatggcccatccaagagac

SEQ ID NO: 55446 - DNA, 20 bp, human
gcctcccacagaagaagagt

SEQ ID NO: 55447 - DNA, 20 bp, human
gtcggcgggacaccgtctca

SEQ ID NO: 55448 - DNA, 20 bp, human
gatccaaagtgactgatgaa

SEQ ID NO: 55449 - DNA, 20 bp, human
gtatctctctcgggtgagag

SEQ ID NO: 55450 - DNA, 20 bp, human
gagaggttgtaagaatgcgg

SEQ ID NO: 55451 - DNA, 20 bp, human
gccagctgaatatctctctc

SEQ ID NO: 55452 - DNA, 20 bp, human
gtctcgggtgagagcggatg

SEQ ID NO: 55453 - DNA, 20 bp, human
gttgcctttgttcagcacag

SEQ ID NO: 55454 - DNA, 20 bp, human
gtcggcggagatcctcgttg

SEQ ID NO: 55455 - DNA, 20 bp, human
gaaagtgactgatgaaggga

SEQ ID NO: 55456 - DNA, 20 bp, human
gcccctaggctaggacatcg

SEQ ID NO: 55457 - DNA, 20 bp, human
gtcggcctcagcctcttctg

SEQ ID NO: 55458 - DNA, 20 bp, human
gggtggtcctggcaaaccgg

SEQ ID NO: 55459 - DNA, 20 bp, human
gttctggggagaccaattag

SEQ ID NO: 55460 - DNA, 20 bp, human
gggcgtggtccggccgaggg

SEQ ID NO: 55461 - DNA, 20 bp, human
gtgaaccgctggcgaattgg

SEQ ID NO: 55462 - DNA, 20 bp, human
ggcgtcgccgaccctctaat

SEQ ID NO: 55463 - DNA, 20 bp, human
ggcgcagcctcggagggtat

SEQ ID NO: 55464 - DNA, 20 bp, human
gcagtgcgcgcagcctcgga

SEQ ID NO: 55465 - DNA, 20 bp, human
gacctgaaccgctggcgaat

SEQ ID NO: 55466 - DNA, 20 bp, human
gcgcggtgtggcgactccca

SEQ ID NO: 55467 - DNA, 20 bp, human
ggggctgcagctggagaccg

SEQ ID NO: 55468 - DNA, 20 bp, human
gcagccgccggacaagtgtg

SEQ ID NO: 55469 - DNA, 20 bp, human
ggagcgctggaaatgacgct

SEQ ID NO: 55470 - DNA, 20 bp, human
gtttcctcacacttgtccgg

SEQ ID NO: 55471 - DNA, 20 bp, human
ggcagaacatagcccggctg

SEQ ID NO: 55472 - DNA, 20 bp, human
gggactcggtcgcccgccct

SEQ ID NO: 55473 - DNA, 20 bp, human
ggtccgcgcccgcgggtcca

SEQ ID NO: 55474 - DNA, 20 bp, human
gcgtcatttccagcgctccg

SEQ ID NO: 55475 - DNA, 20 bp, human
ggggaaatagctgcacagtc

SEQ ID NO: 55476 - DNA, 20 bp, human
ggagccgaggcggtagatgt

SEQ ID NO: 55477 - DNA, 20 bp, human
gggccgtctcaccgtcctca

SEQ ID NO: 55478 - DNA, 20 bp, human
gcacttggggagcggagggg

SEQ ID NO: 55479 - DNA, 20 bp, human
gctgggccgtgctgtggcgg

SEQ ID NO: 55480 - DNA, 20 bp, human
gagccgcggacgaggtagtg

SEQ ID NO: 55481 - DNA, 20 bp, human
gcggtagatgtggggatcct

SEQ ID NO: 55482 - DNA, 20 bp, human
gctcggctcccgcccgatcc

SEQ ID NO: 55483 - DNA, 20 bp, human
ggggccgtgagcaagaagct

SEQ ID NO: 55484 - DNA, 20 bp, human
gctccccactacctcgtccg

SEQ ID NO: 55485 - DNA, 20 bp, human
ggcctcagcactagcgacag

SEQ ID NO: 55486 - DNA, 20 bp, human
gtgagggtggctgccggaga

SEQ ID NO: 55487 - DNA, 20 bp, human
gccggggccaaggcgacgag

SEQ ID NO: 55488 - DNA, 20 bp, human
gggctgccggagagggactg

SEQ ID NO: 55489 - DNA, 20 bp, human
gcccggcacgaggaatgccc

SEQ ID NO: 55490 - DNA, 20 bp, human
gacctcccgcagtccctctc

SEQ ID NO: 55491 - DNA, 20 bp, human
gccacccctcgaggcaagag

SEQ ID NO: 55492 - DNA, 20 bp, human
gggcagccggggctagcgag

SEQ ID NO: 55493 - DNA, 20 bp, human
gctcctgctcgctcggtctc

SEQ ID NO: 55494 - DNA, 20 bp, human
gagccggagaccgagcgagc

SEQ ID NO: 55495 - DNA, 20 bp, human
gccgcccaagaaagccccgt

SEQ ID NO: 55496 - DNA, 20 bp, human
ggactgcagagggatcgagg

SEQ ID NO: 55497 - DNA, 20 bp, human
gaaagactgcagagggatcg

SEQ ID NO: 55498 - DNA, 20 bp, human
gaccagcaggtgaggcctcg

SEQ ID NO: 55499 - DNA, 20 bp, human
ggatgaggtccctcctggag

SEQ ID NO: 55500 - DNA, 20 bp, human
gcctgacgctatggagctct

SEQ ID NO: 55501 - DNA, 20 bp, human
ggcacggccagcgtggccca

SEQ ID NO: 55502 - DNA, 20 bp, human
gggacttgtggacctgtaag

SEQ ID NO: 55503 - DNA, 20 bp, human
gccccaacacccagcgctag

SEQ ID NO: 55504 - DNA, 20 bp, human
ggatggacaaggccaggcgt

SEQ ID NO: 55505 - DNA, 20 bp, human
ggggcggggcgagccgaagg

SEQ ID NO: 55506 - DNA, 20 bp, human
ggggagcagcagtgatagcg

SEQ ID NO: 55507 - DNA, 20 bp, human
gggtcgtcgagcccagagaa

SEQ ID NO: 55508 - DNA, 20 bp, human
ggcagccccaccggtcgagt

SEQ ID NO: 55509 - DNA, 20 bp, human
gcggcgccatgaagtgagaa

SEQ ID NO: 55510 - DNA, 20 bp, human
gaggacctgagggttaccgg

SEQ ID NO: 55511 - DNA, 20 bp, human
gccccgctgcacagtccggc

SEQ ID NO: 55512 - DNA, 20 bp, human
gcgacgaccgggcactgtgg

SEQ ID NO: 55513 - DNA, 20 bp, human
gtcgaccccgctgcacagtc

SEQ ID NO: 55514 - DNA, 20 bp, human
gcagcccccttctcacttca

SEQ ID NO: 55515 - DNA, 20 bp, human
gcgccggccggactgtgcag

SEQ ID NO: 55516 - DNA, 20 bp, human
gcccaaaggcctgtcccaac

SEQ ID NO: 55517 - DNA, 20 bp, human
ggtggacaacagggagcttc

SEQ ID NO: 55518 - DNA, 20 bp, human
gcgctcccacaggcccgccg

SEQ ID NO: 55519 - DNA, 20 bp, human
ggatgccgcggcgggcctgt

SEQ ID NO: 55520 - DNA, 20 bp, human
gtccaggaagcggcactatg

SEQ ID NO: 55521 - DNA, 20 bp, human
gagcccagcaggagccttca

SEQ ID NO: 55522 - DNA, 20 bp, human
gaagatgaccccgctcccac

SEQ ID NO: 55523 - DNA, 20 bp, human
gaaagagaccgagcggaccg

SEQ ID NO: 55524 - DNA, 20 bp, human
gcgggagagatgctggacct

SEQ ID NO: 55525 - DNA, 20 bp, human
gccgcggcatccgctctggg

SEQ ID NO: 55526 - DNA, 20 bp, human
ggtcgctcgtactccagcag

SEQ ID NO: 55527 - DNA, 20 bp, human
gtactccagcagcggcgcca

SEQ ID NO: 55528 - DNA, 20 bp, human
ggtcagggcagccggctcga

SEQ ID NO: 55529 - DNA, 20 bp, human
gccggctcgacggattgcca

SEQ ID NO: 55530 - DNA, 20 bp, human
gcgacccggaagagcttcca

SEQ ID NO: 55531 - DNA, 20 bp, human
ggaacacagacgtatgtaag

SEQ ID NO: 55532 - DNA, 20 bp, human
gcccgcacggtgtgagcgac

SEQ ID NO: 55533 - DNA, 20 bp, human
gggaactgctcgacactgac

SEQ ID NO: 55534 - DNA, 20 bp, human
gtatgtaaggggtcgctagg

SEQ ID NO: 55535 - DNA, 20 bp, human
gatgcaggtccctcacactg

SEQ ID NO: 55536 - DNA, 20 bp, human
ggacagatcacagtagtggg

SEQ ID NO: 55537 - DNA, 20 bp, human
gtagtgggaggcggtgtggt

SEQ ID NO: 55538 - DNA, 20 bp, human
gagatcacagtagtgggagg

SEQ ID NO: 55539 - DNA, 20 bp, human
ggacagccagttacgtatgt

SEQ ID NO: 55540 - DNA, 20 bp, human
ggggaggcggtgtggttggt

SEQ ID NO: 55541 - DNA, 20 bp, human
gcatgacctacatacgtaac

SEQ ID NO: 55542 - DNA, 20 bp, human
gcgctgttcagctggaccag

SEQ ID NO: 55543 - DNA, 20 bp, human
ggaaggggaaggtatcttgt

SEQ ID NO: 55544 - DNA, 20 bp, human
gtcttgcagtctattgccca

SEQ ID NO: 55545 - DNA, 20 bp, human
gaatttaaaacagtctctga

SEQ ID NO: 55546 - DNA, 20 bp, human
gagtgggggacggcactaat

SEQ ID NO: 55547 - DNA, 20 bp, human
ggtcccccactggaaaaccg

SEQ ID NO: 55548 - DNA, 20 bp, human
gatcgtggtatacggaggag

SEQ ID NO: 55549 - DNA, 20 bp, human
gggacgcagccgcctcatgg

SEQ ID NO: 55550 - DNA, 20 bp, human
gcgccgctaatggaagaccg

SEQ ID NO: 55551 - DNA, 20 bp, human
gaaagccccggggataccga

SEQ ID NO: 55552 - DNA, 20 bp, human
gggcggctgcgtcctaagag

SEQ ID NO: 55553 - DNA, 20 bp, human
gagccacggttttccagtgg

SEQ ID NO: 55554 - DNA, 20 bp, human
gtgaacatcgtggtatacgg

SEQ ID NO: 55555 - DNA, 20 bp, human
gcgcctcccggaagaaagac

SEQ ID NO: 55556 - DNA, 20 bp, human
ggtcgagctgggttccaagg

SEQ ID NO: 55557 - DNA, 20 bp, human
gcccgtcgagctgggttcca

SEQ ID NO: 55558 - DNA, 20 bp, human
ggttccaaggcggctggcgg

SEQ ID NO: 55559 - DNA, 20 bp, human
gtgggttccaaggcggctgg

SEQ ID NO: 55560 - DNA, 20 bp, human
ggccaaggagcgctcacctg

SEQ ID NO: 55561 - DNA, 20 bp, human
gctgacaggctcaatcacca

SEQ ID NO: 55562 - DNA, 20 bp, human
gcagcgaggacgcactgtag

SEQ ID NO: 55563 - DNA, 20 bp, human
gataagagtgtgggcggatg

SEQ ID NO: 55564 - DNA, 20 bp, human
gcctgcgcgcagggtcagct

SEQ ID NO: 55565 - DNA, 20 bp, human
ggtcaaattgataagagtgt

SEQ ID NO: 55566 - DNA, 20 bp, human
ggtcgagctgggttccaagg

SEQ ID NO: 55567 - DNA, 20 bp, human
gcccgtcgagctgggttcca

SEQ ID NO: 55568 - DNA, 20 bp, human
ggttccaaggcggctggcgg

SEQ ID NO: 55569 - DNA, 20 bp, human
gtgggttccaaggcggctgg

SEQ ID NO: 55570 - DNA, 20 bp, human
ggccaaggagcgctcacctg

SEQ ID NO: 55571 - DNA, 20 bp, human
gctgacaggctcaatcacca

SEQ ID NO: 55572 - DNA, 20 bp, human
gcagcgaggacgcactgtag

SEQ ID NO: 55573 - DNA, 20 bp, human
gataagagtgtgggcggatg

SEQ ID NO: 55574 - DNA, 20 bp, human
gcctgcgcgcagggtcagct

SEQ ID NO: 55575 - DNA, 20 bp, human
ggtcaaattgataagagtgt

SEQ ID NO: 55576 - DNA, 20 bp, human
ggttagctagacccgcccag

SEQ ID NO: 55577 - DNA, 20 bp, human
ggaggcatcccgaaggtttc

SEQ ID NO: 55578 - DNA, 20 bp, human
ggagcttggagcttagagtt

SEQ ID NO: 55579 - DNA, 20 bp, human
gtggtctccttaaaagccag

SEQ ID NO: 55580 - DNA, 20 bp, human
gcccaatccgagggtcatgg

SEQ ID NO: 55581 - DNA, 20 bp, human
ggattgggttccagttaccc

SEQ ID NO: 55582 - DNA, 20 bp, human
gggcaaatgaccctccagta

SEQ ID NO: 55583 - DNA, 20 bp, human
gggtccccaggaggatccgg

SEQ ID NO: 55584 - DNA, 20 bp, human
gagctaaccgacctggccca

SEQ ID NO: 55585 - DNA, 20 bp, human
gtgggttccagttaccccgg

SEQ ID NO: 55586 - DNA, 20 bp, human
ggcgcggaaacctcaggcaa

SEQ ID NO: 55587 - DNA, 20 bp, human
ggcgctcgccccttacgcag

SEQ ID NO: 55588 - DNA, 20 bp, human
gagccccgcgcggaaacctc

SEQ ID NO: 55589 - DNA, 20 bp, human
gggcaaaaccccaacccgaa

SEQ ID NO: 55590 - DNA, 20 bp, human
gtacacaggcctctgcgtaa

SEQ ID NO: 55591 - DNA, 20 bp, human
gggcggagcccgagagaact

SEQ ID NO: 55592 - DNA, 20 bp, human
gcctggccggatggatccgt

SEQ ID NO: 55593 - DNA, 20 bp, human
ggtgttcacctagttctctc

SEQ ID NO: 55594 - DNA, 20 bp, human
gggacccaagcagaacggga

SEQ ID NO: 55595 - DNA, 20 bp, human
gtcctgtcctcctccggcgg

SEQ ID NO: 55596 - DNA, 20 bp, human
ggcatatcgtgtcctcacac

SEQ ID NO: 55597 - DNA, 20 bp, human
ggtgaggacacgatatgctg

SEQ ID NO: 55598 - DNA, 20 bp, human
gccgcccctgagctctgtca

SEQ ID NO: 55599 - DNA, 20 bp, human
ggtgattgcgaggtcagtaa

SEQ ID NO: 55600 - DNA, 20 bp, human
ggaatgaacgagtccgtgga

SEQ ID NO: 55601 - DNA, 20 bp, human
gcgacgtccagtgctccagc

SEQ ID NO: 55602 - DNA, 20 bp, human
gcgatgagacgggaaagtgt

SEQ ID NO: 55603 - DNA, 20 bp, human
ggagagcagagtcaacacgg

SEQ ID NO: 55604 - DNA, 20 bp, human
gtgctctccgaaggcgaaga

SEQ ID NO: 55605 - DNA, 20 bp, human
ggtcgccatgacagagctca

SEQ ID NO: 55606 - DNA, 20 bp, human
gagagggacacagccaacgt

SEQ ID NO: 55607 - DNA, 20 bp, human
gagcggctgtcagcctagaa

SEQ ID NO: 55608 - DNA, 20 bp, human
gctctgacactggaaatatc

SEQ ID NO: 55609 - DNA, 20 bp, human
ggcgggagcagacgggctcg

SEQ ID NO: 55610 - DNA, 20 bp, human
gacgggctcgcggcagtggc

SEQ ID NO: 55611 - DNA, 20 bp, human
ggcagacgggctcgcggcag

SEQ ID NO: 55612 - DNA, 20 bp, human
gccaacgtggggtcccttct

SEQ ID NO: 55613 - DNA, 20 bp, human
ggggcggccggaagccagag

SEQ ID NO: 55614 - DNA, 20 bp, human
gcaccccagtcccaccatag

SEQ ID NO: 55615 - DNA, 20 bp, human
ggcaagtgagctcaactgtc

SEQ ID NO: 55616 - DNA, 20 bp, human
gggagaggctctgagaggcg

SEQ ID NO: 55617 - DNA, 20 bp, human
gcaacgtgacaagagcggag

SEQ ID NO: 55618 - DNA, 20 bp, human
gcgacgggcgcgggacggga

SEQ ID NO: 55619 - DNA, 20 bp, human
gccagaactggggatcactc

SEQ ID NO: 55620 - DNA, 20 bp, human
gggcctgcggggtcccggta

SEQ ID NO: 55621 - DNA, 20 bp, human
ggcggcgagggcggcccgac

SEQ ID NO: 55622 - DNA, 20 bp, human
gcggagtgcgatattaaccc

SEQ ID NO: 55623 - DNA, 20 bp, human
ggcccggagccaggaatcgg

SEQ ID NO: 55624 - DNA, 20 bp, human
gccccggcggacacaggtgg

SEQ ID NO: 55625 - DNA, 20 bp, human
gccgccacccccgtgatccc

SEQ ID NO: 55626 - DNA, 20 bp, human
gtcggagaggttgaagggtc

SEQ ID NO: 55627 - DNA, 20 bp, human
gcacacatccaggcaccgtt

SEQ ID NO: 55628 - DNA, 20 bp, human
ggtcagccaatggcaggaag

SEQ ID NO: 55629 - DNA, 20 bp, human
gggccagcactattaaggta

SEQ ID NO: 55630 - DNA, 20 bp, human
gttgatgaggttgtttagag

SEQ ID NO: 55631 - DNA, 20 bp, human
gaggcagataagttagggtt

SEQ ID NO: 55632 - DNA, 20 bp, human
ggcagactcggagaggttga

SEQ ID NO: 55633 - DNA, 20 bp, human
gattatggccagcactatta

SEQ ID NO: 55634 - DNA, 20 bp, human
gtcctctattgtggcagtgg

SEQ ID NO: 55635 - DNA, 20 bp, human
gccttgcggatggttggagt

SEQ ID NO: 55636 - DNA, 20 bp, human
ggggcgctggacttaccgag

SEQ ID NO: 55637 - DNA, 20 bp, human
gacacgccctcccccgacgg

SEQ ID NO: 55638 - DNA, 20 bp, human
ggctcccacgctggctacag

SEQ ID NO: 55639 - DNA, 20 bp, human
gaggttagcgccgccgtcgg

SEQ ID NO: 55640 - DNA, 20 bp, human
gccctcggggccaagagcgc

SEQ ID NO: 55641 - DNA, 20 bp, human
gcctgctcgggtttaggacg

SEQ ID NO: 55642 - DNA, 20 bp, human
ggagccgggcaggtcgcgtg

SEQ ID NO: 55643 - DNA, 20 bp, human
gcgggccgcgcgggcaggtt

SEQ ID NO: 55644 - DNA, 20 bp, human
ggacggcggcgctaacctct

SEQ ID NO: 55645 - DNA, 20 bp, human
gcagccgctgtagccagcgt

SEQ ID NO: 55646 - DNA, 20 bp, human
gcaccaaggaggctcagtag

SEQ ID NO: 55647 - DNA, 20 bp, human
gaaggaggctcagtagaggg

SEQ ID NO: 55648 - DNA, 20 bp, human
gccacctcagctgacaggtg

SEQ ID NO: 55649 - DNA, 20 bp, human
gggcatcgtgccgccgccgg

SEQ ID NO: 55650 - DNA, 20 bp, human
gcgctgagggaactcccgac

SEQ ID NO: 55651 - DNA, 20 bp, human
ggaggtggggtccaccaagg

SEQ ID NO: 55652 - DNA, 20 bp, human
gcagcgggctcggacccacg

SEQ ID NO: 55653 - DNA, 20 bp, human
ggcaggcccctagggacccc

SEQ ID NO: 55654 - DNA, 20 bp, human
gctgccccacctgtcagctg

SEQ ID NO: 55655 - DNA, 20 bp, human
gtgggctgttcccatctggg

SEQ ID NO: 55656 - DNA, 20 bp, human
gaggctgggaccataacaca

SEQ ID NO: 55657 - DNA, 20 bp, human
gagggagtctgacatccggg

SEQ ID NO: 55658 - DNA, 20 bp, human
gctccagtccgcaggcgagt

SEQ ID NO: 55659 - DNA, 20 bp, human
gttctgtgaaacatggcggt

SEQ ID NO: 55660 - DNA, 20 bp, human
gtgatctctagagagccggt

SEQ ID NO: 55661 - DNA, 20 bp, human
gaggcgagtaggatcccaat

SEQ ID NO: 55662 - DNA, 20 bp, human
gcaacgtgctgccacgaatg

SEQ ID NO: 55663 - DNA, 20 bp, human
ggaagccgctccacctccca

SEQ ID NO: 55664 - DNA, 20 bp, human
ggcgttactggcaggaccct

SEQ ID NO: 55665 - DNA, 20 bp, human
gcggactggagaaaccacct

SEQ ID NO: 55666 - DNA, 20 bp, human
gttccggccggtccccatgg

SEQ ID NO: 55667 - DNA, 20 bp, human
gggtccccatggaggcgctg

SEQ ID NO: 55668 - DNA, 20 bp, human
gagagctcaggatgcacctg

SEQ ID NO: 55669 - DNA, 20 bp, human
ggcttccccagcgcctccat

SEQ ID NO: 55670 - DNA, 20 bp, human
gccggaagagggagtctgta

SEQ ID NO: 55671 - DNA, 20 bp, human
gcctttccggccggtcccca

SEQ ID NO: 55672 - DNA, 20 bp, human
gatggtcactgcaggacaag

SEQ ID NO: 55673 - DNA, 20 bp, human
ggagtaggacctttaggggt

SEQ ID NO: 55674 - DNA, 20 bp, human
gcaaggggcgagggtcagaa

SEQ ID NO: 55675 - DNA, 20 bp, human
gctggcctgccggtgtctga

SEQ ID NO: 55676 - DNA, 20 bp, human
ggcggcaacgtaagtatcct

SEQ ID NO: 55677 - DNA, 20 bp, human
gctcggtagagggagacgtg

SEQ ID NO: 55678 - DNA, 20 bp, human
gcgtgtaacggcggcggtgt

SEQ ID NO: 55679 - DNA, 20 bp, human
gtaagctcgtgtaacggcgg

SEQ ID NO: 55680 - DNA, 20 bp, human
gcgcgaggattggctgttag

SEQ ID NO: 55681 - DNA, 20 bp, human
ggtcaggcctggcgtccctg

SEQ ID NO: 55682 - DNA, 20 bp, human
gtgtagttaagctcgtgtaa

SEQ ID NO: 55683 - DNA, 20 bp, human
ggtccctgcggcgggaagaa

SEQ ID NO: 55684 - DNA, 20 bp, human
gggctccgaggcctagagtc

SEQ ID NO: 55685 - DNA, 20 bp, human
gtgctgtagcgaagagagtt

SEQ ID NO: 55686 - DNA, 20 bp, human
gacacgctcccggaagtggg

SEQ ID NO: 55687 - DNA, 20 bp, human
ggcggccacacaaactccag

SEQ ID NO: 55688 - DNA, 20 bp, human
gccacccgaggataaagcca

SEQ ID NO: 55689 - DNA, 20 bp, human
gtaccgggctcgcgttcccg

SEQ ID NO: 55690 - DNA, 20 bp, human
ggtgtcttggagccccctca

SEQ ID NO: 55691 - DNA, 20 bp, human
ggagtgattcggccctgagg

SEQ ID NO: 55692 - DNA, 20 bp, human
ggccgaatcactctctggga

SEQ ID NO: 55693 - DNA, 20 bp, human
ggctccaagacacccacccg

SEQ ID NO: 55694 - DNA, 20 bp, human
gcagggccgaatcactctct

SEQ ID NO: 55695 - DNA, 20 bp, human
gtatcctcgggtgggtgtct

SEQ ID NO: 55696 - DNA, 20 bp, human
gcggctcgcgcggtactcga

SEQ ID NO: 55697 - DNA, 20 bp, human
gtggaaaagcaaggagtgtc

SEQ ID NO: 55698 - DNA, 20 bp, human
gaagcaaggagtgtcgggaa

SEQ ID NO: 55699 - DNA, 20 bp, human
gcggtactcgagggagttcc

SEQ ID NO: 55700 - DNA, 20 bp, human
ggtcgggaatggcgaccaag

SEQ ID NO: 55701 - DNA, 20 bp, human
gagctggacttggaaaagca

SEQ ID NO: 55702 - DNA, 20 bp, human
gggctgaagaccgaggtcca

SEQ ID NO: 55703 - DNA, 20 bp, human
gtcgggctcctgtcaccctc

SEQ ID NO: 55704 - DNA, 20 bp, human
gggcccaaggctgaagaccg

SEQ ID NO: 55705 - DNA, 20 bp, human
gcgagggagttccgggtcgg

SEQ ID NO: 55706 - DNA, 20 bp, human
gttcccggccgcctgaacag

SEQ ID NO: 55707 - DNA, 20 bp, human
gtgcggcgccggccaggcag

SEQ ID NO: 55708 - DNA, 20 bp, human
gagagtgcgcggaggtgagt

SEQ ID NO: 55709 - DNA, 20 bp, human
ggcatccagggtaagcacat

SEQ ID NO: 55710 - DNA, 20 bp, human
gtcggggtcagagtgcgcgg

SEQ ID NO: 55711 - DNA, 20 bp, human
gctggctgccgctgttcagg

SEQ ID NO: 55712 - DNA, 20 bp, human
ggcacatgggccagcacccc

SEQ ID NO: 55713 - DNA, 20 bp, human
ggtgctggctgccgctgttc

SEQ ID NO: 55714 - DNA, 20 bp, human
gattaaccagggcccaatct

SEQ ID NO: 55715 - DNA, 20 bp, human
gtcggtgtgttgtggactcg

SEQ ID NO: 55716 - DNA, 20 bp, human
gcttcctgtgcgccgccatg

SEQ ID NO: 55717 - DNA, 20 bp, human
gcgccgtggtctgaggtccg

SEQ ID NO: 55718 - DNA, 20 bp, human
gtccgcggcagggtcccgca

SEQ ID NO: 55719 - DNA, 20 bp, human
ggcggcagggtcccgcatgg

SEQ ID NO: 55720 - DNA, 20 bp, human
gggcgcacaggaagcacggt

SEQ ID NO: 55721 - DNA, 20 bp, human
gtggcggcgcacaggaagca

SEQ ID NO: 55722 - DNA, 20 bp, human
gcacaggaagcacggtaggt

SEQ ID NO: 55723 - DNA, 20 bp, human
gcccctgttggtgagtgagt

SEQ ID NO: 55724 - DNA, 20 bp, human
gtggtctgaggtccgcggca

SEQ ID NO: 55725 - DNA, 20 bp, human
gtcagaggggtcctagccca

SEQ ID NO: 55726 - DNA, 20 bp, human
ggcacactggacagtcaggg

SEQ ID NO: 55727 - DNA, 20 bp, human
gggtgcacactggacagtca

SEQ ID NO: 55728 - DNA, 20 bp, human
ggtgcattgagtcagtctac

SEQ ID NO: 55729 - DNA, 20 bp, human
gcagggtggttgtgagctga

SEQ ID NO: 55730 - DNA, 20 bp, human
gtactactgagtgagcctgc

SEQ ID NO: 55731 - DNA, 20 bp, human
gccagaaacaggtagacaga

SEQ ID NO: 55732 - DNA, 20 bp, human
ggctaccttcccatcaaaga

SEQ ID NO: 55733 - DNA, 20 bp, human
ggcactgatgtcaccaaggg

SEQ ID NO: 55734 - DNA, 20 bp, human
gttgagtcagtctacaggct

SEQ ID NO: 55735 - DNA, 20 bp, human
gaagacttccacaaagctga

SEQ ID NO: 55736 - DNA, 20 bp, human
gtaaagcgcccgggtatcac

SEQ ID NO: 55737 - DNA, 20 bp, human
gtctgctccaggaggagagg

SEQ ID NO: 55738 - DNA, 20 bp, human
ggcgggactataaagcgccc

SEQ ID NO: 55739 - DNA, 20 bp, human
gggttgggccggtgataccc

SEQ ID NO: 55740 - DNA, 20 bp, human
gtctccggaaggagacgtgg

SEQ ID NO: 55741 - DNA, 20 bp, human
gaggagacgtggcggcggtt

SEQ ID NO: 55742 - DNA, 20 bp, human
gcgcagaggaccagtaacac

SEQ ID NO: 55743 - DNA, 20 bp, human
ggccgccggacgcctccagg

SEQ ID NO: 55744 - DNA, 20 bp, human
gccggaaggagacgtggcgg

SEQ ID NO: 55745 - DNA, 20 bp, human
gtcatcgctgagttgaggaa

SEQ ID NO: 55746 - DNA, 20 bp, human
ggatgcgtcactgatcggtg

SEQ ID NO: 55747 - DNA, 20 bp, human
ggggagtcggctgcacgtgc

SEQ ID NO: 55748 - DNA, 20 bp, human
ggcgaggaaagccgacccct

SEQ ID NO: 55749 - DNA, 20 bp, human
gggggcgatgcgtcactgat

SEQ ID NO: 55750 - DNA, 20 bp, human
gtgaggcgcggccgaggggt

SEQ ID NO: 55751 - DNA, 20 bp, human
gactcaagcccgggttctgg

SEQ ID NO: 55752 - DNA, 20 bp, human
gcaggaagctcaccgagcag

SEQ ID NO: 55753 - DNA, 20 bp, human
gtcggtgaggcgcggccgag

SEQ ID NO: 55754 - DNA, 20 bp, human
ggtcactgatcggtgaggcg

SEQ ID NO: 55755 - DNA, 20 bp, human
gccacccgggagcgaccctt

SEQ ID NO: 55756 - DNA, 20 bp, human
gcggttacgttagacctggg

SEQ ID NO: 55757 - DNA, 20 bp, human
gtcgtgggctcggacgagta

SEQ ID NO: 55758 - DNA, 20 bp, human
ggcccagcgcgcgcacgaag

SEQ ID NO: 55759 - DNA, 20 bp, human
gccccggttacgttagacct

SEQ ID NO: 55760 - DNA, 20 bp, human
gcgagtacggagcgcctgca

SEQ ID NO: 55761 - DNA, 20 bp, human
gtagctgccgctcagggtcg

SEQ ID NO: 55762 - DNA, 20 bp, human
gggtcaagcgccctggtctg

SEQ ID NO: 55763 - DNA, 20 bp, human
ggagaggacgcgacagaaaa

SEQ ID NO: 55764 - DNA, 20 bp, human
gccctgcggctcgcaaggag

SEQ ID NO: 55765 - DNA, 20 bp, human
gaaaggacgcaactgcagat

SEQ ID NO: 55766 - DNA, 20 bp, human
gccagtggcccggtcgggaa

SEQ ID NO: 55767 - DNA, 20 bp, human
ggctggagccgccgaccaag

SEQ ID NO: 55768 - DNA, 20 bp, human
gcggccccgcccaggacgag

SEQ ID NO: 55769 - DNA, 20 bp, human
ggccgccgaccaagaggctt

SEQ ID NO: 55770 - DNA, 20 bp, human
gtcccaagcctcttggtcgg

SEQ ID NO: 55771 - DNA, 20 bp, human
ggagggtgagatccgaatcc

SEQ ID NO: 55772 - DNA, 20 bp, human
gggcggagccacaccggggt

SEQ ID NO: 55773 - DNA, 20 bp, human
gcgcgcgtgcgcagagagga

SEQ ID NO: 55774 - DNA, 20 bp, human
gaacttccagtggcccggtc

SEQ ID NO: 55775 - DNA, 20 bp, human
ggcccaccgcccctcgtcct

SEQ ID NO: 55776 - DNA, 20 bp, human
gcaggaaggcctagggatgt

SEQ ID NO: 55777 - DNA, 20 bp, human
gcgagaagggagttctgtgg

SEQ ID NO: 55778 - DNA, 20 bp, human
gagcgcatcaggaaggccta

SEQ ID NO: 55779 - DNA, 20 bp, human
ggcaggcaagcgcatcagga

SEQ ID NO: 55780 - DNA, 20 bp, human
gtatgaaatatgagaggcca

SEQ ID NO: 55781 - DNA, 20 bp, human
gtttcccggcccacatccct

SEQ ID NO: 55782 - DNA, 20 bp, human
gaaggcctagggatgtgggc

SEQ ID NO: 55783 - DNA, 20 bp, human
gtccccatgcagagagacca

SEQ ID NO: 55784 - DNA, 20 bp, human
ggggagcaggcaagcgcatc

SEQ ID NO: 55785 - DNA, 20 bp, human
gtaactttctcaggatcctc

SEQ ID NO: 55786 - DNA, 20 bp, human
gaccggaagttatggaggta

SEQ ID NO: 55787 - DNA, 20 bp, human
gggggcaccggaagttatgg

SEQ ID NO: 55788 - DNA, 20 bp, human
gcctagctcgggatcgaacc

SEQ ID NO: 55789 - DNA, 20 bp, human
gcccgagctaggcagggagt

SEQ ID NO: 55790 - DNA, 20 bp, human
ggtccgagtgtggaccctac

SEQ ID NO: 55791 - DNA, 20 bp, human
gagcggggcaccggaagtta

SEQ ID NO: 55792 - DNA, 20 bp, human
gctaggaacgagccacggtc

SEQ ID NO: 55793 - DNA, 20 bp, human
ggaccctacaggcagcgact

SEQ ID NO: 55794 - DNA, 20 bp, human
gatggaggtagggcgggtgt

SEQ ID NO: 55795 - DNA, 20 bp, human
gcaggtgagagcccgacctg

SEQ ID NO: 55796 - DNA, 20 bp, human
gatgctgctcaactcatcca

SEQ ID NO: 55797 - DNA, 20 bp, human
ggtgctcttagagtaggagt

SEQ ID NO: 55798 - DNA, 20 bp, human
gctgctcaactcatccatgg

SEQ ID NO: 55799 - DNA, 20 bp, human
gtggaaggtgcactcaccaa

SEQ ID NO: 55800 - DNA, 20 bp, human
ggagtaggagttggaactat

SEQ ID NO: 55801 - DNA, 20 bp, human
gctatgcgtagtagaataaa

SEQ ID NO: 55802 - DNA, 20 bp, human
gtggaggacaaaatgctaaa

SEQ ID NO: 55803 - DNA, 20 bp, human
ggcactcaccaaaggaagtc

SEQ ID NO: 55804 - DNA, 20 bp, human
gttggaactataggacttga

SEQ ID NO: 55805 - DNA, 20 bp, human
gtaatttgtgctcttagagt

SEQ ID NO: 55806 - DNA, 20 bp, human
gcggcggccggggctgtcgc

SEQ ID NO: 55807 - DNA, 20 bp, human
gggagccccgggggtagcgg

SEQ ID NO: 55808 - DNA, 20 bp, human
ggactcagaaccccactcca

SEQ ID NO: 55809 - DNA, 20 bp, human
gtgagtcggctgctgtgagg

SEQ ID NO: 55810 - DNA, 20 bp, human
ggggccgtgccaggagggag

SEQ ID NO: 55811 - DNA, 20 bp, human
gtcagcgagtcccagcggtc

SEQ ID NO: 55812 - DNA, 20 bp, human
ggtagagcgtcgagagggag

SEQ ID NO: 55813 - DNA, 20 bp, human
gcgcagcgcctcctagtgag

SEQ ID NO: 55814 - DNA, 20 bp, human
gagtcccagcggtccggcag

SEQ ID NO: 55815 - DNA, 20 bp, human
gaggggtcagcgagtcccag

SEQ ID NO: 55816 - DNA, 20 bp, human
gggcggtgaccgagcctcag

SEQ ID NO: 55817 - DNA, 20 bp, human
gagcggacgcagaactgact

SEQ ID NO: 55818 - DNA, 20 bp, human
gggcggtacggacagaggac

SEQ ID NO: 55819 - DNA, 20 bp, human
ggtacggacagaggacgggg

SEQ ID NO: 55820 - DNA, 20 bp, human
gccgggggcggtacggacag

SEQ ID NO: 55821 - DNA, 20 bp, human
gcctggctccgggggcggta

SEQ ID NO: 55822 - DNA, 20 bp, human
gccacggcggaaagacgaaa

SEQ ID NO: 55823 - DNA, 20 bp, human
gagaactgactaggcagcgg

SEQ ID NO: 55824 - DNA, 20 bp, human
gacagccgcgctggcttggg

SEQ ID NO: 55825 - DNA, 20 bp, human
gtccccgatgaagtctgacg

SEQ ID NO: 55826 - DNA, 20 bp, human
gtgcagctgcccaggcgcta

SEQ ID NO: 55827 - DNA, 20 bp, human
gccaggcgctatggcgagtg

SEQ ID NO: 55828 - DNA, 20 bp, human
gctatggcgagtgcggtcag

SEQ ID NO: 55829 - DNA, 20 bp, human
gggacagagcgctcccttgg

SEQ ID NO: 55830 - DNA, 20 bp, human
gtgggaccacccaggcgtga

SEQ ID NO: 55831 - DNA, 20 bp, human
ggcagggagaggtgtagtct

SEQ ID NO: 55832 - DNA, 20 bp, human
ggagatctgccagcgtggaa

SEQ ID NO: 55833 - DNA, 20 bp, human
ggaccacccaggcgtgaggg

SEQ ID NO: 55834 - DNA, 20 bp, human
ggagtgcggtcagggggtcg

SEQ ID NO: 55835 - DNA, 20 bp, human
gggccgagttgggaccaccc

SEQ ID NO: 55836 - DNA, 20 bp, human
gcagcttgtcgccccacgct

SEQ ID NO: 55837 - DNA, 20 bp, human
ggagcagcccccggagacag

SEQ ID NO: 55838 - DNA, 20 bp, human
gcccggagacagcggcacag

SEQ ID NO: 55839 - DNA, 20 bp, human
ggccgagccgggaagctggt

SEQ ID NO: 55840 - DNA, 20 bp, human
gcccggtgggaagagatgca

SEQ ID NO: 55841 - DNA, 20 bp, human
ggcagcccggggcctcggac

SEQ ID NO: 55842 - DNA, 20 bp, human
gtcacgcggcgggaaggaac

SEQ ID NO: 55843 - DNA, 20 bp, human
gcccaccgggaatgagactc

SEQ ID NO: 55844 - DNA, 20 bp, human
gccgtgcgggccggccccag

SEQ ID NO: 55845 - DNA, 20 bp, human
gtcggtgcgtcagcctcacg

SEQ ID NO: 55846 - DNA, 20 bp, human
gcagcggccgagcgactcca

SEQ ID NO: 55847 - DNA, 20 bp, human
gggtctgcactccagtccgg

SEQ ID NO: 55848 - DNA, 20 bp, human
gcgagcgactccagggtcag

SEQ ID NO: 55849 - DNA, 20 bp, human
gctggcgagcagaaaacccg

SEQ ID NO: 55850 - DNA, 20 bp, human
gacgctccgcaggaagctca

SEQ ID NO: 55851 - DNA, 20 bp, human
gcagggccgggccagaaaag

SEQ ID NO: 55852 - DNA, 20 bp, human
ggagtcgcctgcctccggac

SEQ ID NO: 55853 - DNA, 20 bp, human
gccaaggggacggttcccag

SEQ ID NO: 55854 - DNA, 20 bp, human
gacggcgacactccgggtaa

SEQ ID NO: 55855 - DNA, 20 bp, human
ggagcgagcgcccagagaaa

SEQ ID NO: 55856 - DNA, 20 bp, human
gaggtgcaggcaccagacct

SEQ ID NO: 55857 - DNA, 20 bp, human
gtgcacagcgatgtgagctg

SEQ ID NO: 55858 - DNA, 20 bp, human
gcccggaaaagagtacaggg

SEQ ID NO: 55859 - DNA, 20 bp, human
gctgcccggaaaagagtaca

SEQ ID NO: 55860 - DNA, 20 bp, human
gttctaggaattcctaggtc

SEQ ID NO: 55861 - DNA, 20 bp, human
gagcagcattaagtatctag

SEQ ID NO: 55862 - DNA, 20 bp, human
gacttgccagctggaaatac

SEQ ID NO: 55863 - DNA, 20 bp, human
gtactcattcgtcttgatat

SEQ ID NO: 55864 - DNA, 20 bp, human
gttgatatgggcaagggaag

SEQ ID NO: 55865 - DNA, 20 bp, human
gagttttgagtagaaagctt

SEQ ID NO: 55866 - DNA, 20 bp, human
gctgcaggaacccggcgata

SEQ ID NO: 55867 - DNA, 20 bp, human
gcccaagtgggagaaccgga

SEQ ID NO: 55868 - DNA, 20 bp, human
gcagcggcagccatatcgcc

SEQ ID NO: 55869 - DNA, 20 bp, human
gagatgcagccgagggaact

SEQ ID NO: 55870 - DNA, 20 bp, human
ggaatccagcgtctccccac

SEQ ID NO: 55871 - DNA, 20 bp, human
gctcggctgcatctttgcaa

SEQ ID NO: 55872 - DNA, 20 bp, human
gtctcccacttgggactcga

SEQ ID NO: 55873 - DNA, 20 bp, human
ggattccgggagctgacggg

SEQ ID NO: 55874 - DNA, 20 bp, human
gaaggggcacccagttccct

SEQ ID NO: 55875 - DNA, 20 bp, human
gggaggtaggtaagcgatag

SEQ ID NO: 55876 - DNA, 20 bp, human
ggcctctctggaagttgtcc

SEQ ID NO: 55877 - DNA, 20 bp, human
ggtgttcgccgctggagccc

SEQ ID NO: 55878 - DNA, 20 bp, human
gctctcgacccgggctccag

SEQ ID NO: 55879 - DNA, 20 bp, human
gagcccgggtcgagaggacg

SEQ ID NO: 55880 - DNA, 20 bp, human
gcggcagcggaggattctcc

SEQ ID NO: 55881 - DNA, 20 bp, human
ggcacctcgtcctctcgacc

SEQ ID NO: 55882 - DNA, 20 bp, human
ggctccagcggcgaacaccc

SEQ ID NO: 55883 - DNA, 20 bp, human
gcccgggacaacttccagag

SEQ ID NO: 55884 - DNA, 20 bp, human
gcccggacttcggggagaag

SEQ ID NO: 55885 - DNA, 20 bp, human
gagggactgatacgtagtca

SEQ ID NO: 55886 - DNA, 20 bp, human
ggggagcgcgagccagcaag

SEQ ID NO: 55887 - DNA, 20 bp, human
gtgcgaggcagagtgctagc

SEQ ID NO: 55888 - DNA, 20 bp, human
ggcgacggcggtccggtgcg

SEQ ID NO: 55889 - DNA, 20 bp, human
gaggggcccggacatcgcgc

SEQ ID NO: 55890 - DNA, 20 bp, human
gtcgcgcaggcgcctcttgc

SEQ ID NO: 55891 - DNA, 20 bp, human
gggcgggcgccggcacttcg

SEQ ID NO: 55892 - DNA, 20 bp, human
gaggcgcctgcgcgatgtcc

SEQ ID NO: 55893 - DNA, 20 bp, human
ggccgcgcgacgaccacagc

SEQ ID NO: 55894 - DNA, 20 bp, human
gaccacagccggcgtggaga

SEQ ID NO: 55895 - DNA, 20 bp, human
gctatatatagaggcggcgg

SEQ ID NO: 55896 - DNA, 20 bp, human
gcagcccggccgccatccta

SEQ ID NO: 55897 - DNA, 20 bp, human
gttgttctggagtcctctgt

SEQ ID NO: 55898 - DNA, 20 bp, human
gtaacgaggccacagaagct

SEQ ID NO: 55899 - DNA, 20 bp, human
gtcccctgacgaccgtccag

SEQ ID NO: 55900 - DNA, 20 bp, human
gaagactacaccagaagctc

SEQ ID NO: 55901 - DNA, 20 bp, human
gggaccactggacggtcgtc

SEQ ID NO: 55902 - DNA, 20 bp, human
gaggatgcagagttcatgaa

SEQ ID NO: 55903 - DNA, 20 bp, human
gggctgacagctcggacccc

SEQ ID NO: 55904 - DNA, 20 bp, human
gactctggcctccccgcagc

SEQ ID NO: 55905 - DNA, 20 bp, human
gtcggggagagctgcggcag

SEQ ID NO: 55906 - DNA, 20 bp, human
gcgaagaaggcaaggcgtag

SEQ ID NO: 55907 - DNA, 20 bp, human
ggaggctgatgagagcggta

SEQ ID NO: 55908 - DNA, 20 bp, human
gcccgaaggatggcttgcag

SEQ ID NO: 55909 - DNA, 20 bp, human
ggagaaaggaaaataggtgg

SEQ ID NO: 55910 - DNA, 20 bp, human
gggcgttcaaccctcgtacg

SEQ ID NO: 55911 - DNA, 20 bp, human
gttgagaggaatcgttccag

SEQ ID NO: 55912 - DNA, 20 bp, human
gggaaaccccagatactaca

SEQ ID NO: 55913 - DNA, 20 bp, human
gaatgacctcgcacacccat

SEQ ID NO: 55914 - DNA, 20 bp, human
gagaacgaaaccacgtacga

SEQ ID NO: 55915 - DNA, 20 bp, human
gtgggctgtctgctgtgcag

SEQ ID NO: 55916 - DNA, 20 bp, human
gggcgacaggaacccaaccc

SEQ ID NO: 55917 - DNA, 20 bp, human
gagtgagcggggacacacga

SEQ ID NO: 55918 - DNA, 20 bp, human
gagccgctgggagaatcccg

SEQ ID NO: 55919 - DNA, 20 bp, human
gctggcctggcggcgatcgt

SEQ ID NO: 55920 - DNA, 20 bp, human
gctccccgccggagaccaaa

SEQ ID NO: 55921 - DNA, 20 bp, human
gcggcgggaactgaagtgag

SEQ ID NO: 55922 - DNA, 20 bp, human
gtagcggcgtgtctgcccta

SEQ ID NO: 55923 - DNA, 20 bp, human
ggtctacgtctgcggaggtg

SEQ ID NO: 55924 - DNA, 20 bp, human
ggaaacccgctacaaagtag

SEQ ID NO: 55925 - DNA, 20 bp, human
gcactcacagtgcaactccg

SEQ ID NO: 55926 - DNA, 20 bp, human
gtcaggtggcatgccagtgt

SEQ ID NO: 55927 - DNA, 20 bp, human
ggccagtgtgggtcaaaata

SEQ ID NO: 55928 - DNA, 20 bp, human
gaaaaaggtctctcagtacg

SEQ ID NO: 55929 - DNA, 20 bp, human
gctcctttcacctcaaaaaa

SEQ ID NO: 55930 - DNA, 20 bp, human
gtccttattttgacccacac

SEQ ID NO: 55931 - DNA, 20 bp, human
gactgtgcctgtgagagtag

SEQ ID NO: 55932 - DNA, 20 bp, human
gtgagagtaggggcatggga

SEQ ID NO: 55933 - DNA, 20 bp, human
gctctcagtacggggaatct

SEQ ID NO: 55934 - DNA, 20 bp, human
gagtaggggcatgggaagga

SEQ ID NO: 55935 - DNA, 20 bp, human
ggattcctgaaccaaatgtt

SEQ ID NO: 55936 - DNA, 20 bp, human
gctgaacgacagaaccgagt

SEQ ID NO: 55937 - DNA, 20 bp, human
gggtcaggccagcataagta

SEQ ID NO: 55938 - DNA, 20 bp, human
ggagtgggctcctgaaaaga

SEQ ID NO: 55939 - DNA, 20 bp, human
gtgagtagatctgagacaca

SEQ ID NO: 55940 - DNA, 20 bp, human
gggtacttacctggataacc

SEQ ID NO: 55941 - DNA, 20 bp, human
gatgcgcagaaagagttaaa

SEQ ID NO: 55942 - DNA, 20 bp, human
gcacccctctgggtaacatc

SEQ ID NO: 55943 - DNA, 20 bp, human
gataaccaggcgaggtaacc

SEQ ID NO: 55944 - DNA, 20 bp, human
gcaccagatgttacccagag

SEQ ID NO: 55945 - DNA, 20 bp, human
gaggacttccacacccctct

SEQ ID NO: 55946 - DNA, 20 bp, human
gcagttgccagtcttctcca

SEQ ID NO: 55947 - DNA, 20 bp, human
gaggcaggggattatttctc

SEQ ID NO: 55948 - DNA, 20 bp, human
gccctgaggtttgggcttgt

SEQ ID NO: 55949 - DNA, 20 bp, human
gacccacaagcccaaacctc

SEQ ID NO: 55950 - DNA, 20 bp, human
gtactgaaatccctgaggtt

SEQ ID NO: 55951 - DNA, 20 bp, human
ggtagatactttcacgggtt

SEQ ID NO: 55952 - DNA, 20 bp, human
gaagttgcagattcttttta

SEQ ID NO: 55953 - DNA, 20 bp, human
gtcacttacactgcgcctga

SEQ ID NO: 55954 - DNA, 20 bp, human
gcaacagagcaggccatgtg

SEQ ID NO: 55955 - DNA, 20 bp, human
gtccaggccacagtaaccca

SEQ ID NO: 55956 - DNA, 20 bp, human
gctccaggtcagagaatacg

SEQ ID NO: 55957 - DNA, 20 bp, human
gacaaagggaagggacccaa

SEQ ID NO: 55958 - DNA, 20 bp, human
gcatccctctggatcctgca

SEQ ID NO: 55959 - DNA, 20 bp, human
gaactataacacttaccaca

SEQ ID NO: 55960 - DNA, 20 bp, human
ggctcgagccgtaagaaaca

SEQ ID NO: 55961 - DNA, 20 bp, human
gtagcaggccgcttccaaga

SEQ ID NO: 55962 - DNA, 20 bp, human
gcggtggtggcaaacagcag

SEQ ID NO: 55963 - DNA, 20 bp, human
gaagcggcctgctaccatct

SEQ ID NO: 55964 - DNA, 20 bp, human
ggtcagcggcaggtctgcgg

SEQ ID NO: 55965 - DNA, 20 bp, human
gggagtcagcggcaggtctg

SEQ ID NO: 55966 - DNA, 20 bp, human
ggccgagccgctgacaccca

SEQ ID NO: 55967 - DNA, 20 bp, human
ggagccgccctgggtgtcag

SEQ ID NO: 55968 - DNA, 20 bp, human
gcacacaggcgcgcagactt

SEQ ID NO: 55969 - DNA, 20 bp, human
ggaagacctggatacctctg

SEQ ID NO: 55970 - DNA, 20 bp, human
gggatggcggggggaggtaa

SEQ ID NO: 55971 - DNA, 20 bp, human
gctggccgggacggagtcag

SEQ ID NO: 55972 - DNA, 20 bp, human
ggcccccacacccaaactgg

SEQ ID NO: 55973 - DNA, 20 bp, human
gcttgggctggagccgccct

SEQ ID NO: 55974 - DNA, 20 bp, human
gtcccactccagggcatcac

SEQ ID NO: 55975 - DNA, 20 bp, human
gtcggctcccgcgcacgctc

SEQ ID NO: 55976 - DNA, 20 bp, human
gtactccgagcagggaaggt

SEQ ID NO: 55977 - DNA, 20 bp, human
gccgccgctcccttacagaa

SEQ ID NO: 55978 - DNA, 20 bp, human
ggtgcctttctgtaagggag

SEQ ID NO: 55979 - DNA, 20 bp, human
gccaggctggaggattaccc

SEQ ID NO: 55980 - DNA, 20 bp, human
gggtgcgtgcctttctgtaa

SEQ ID NO: 55981 - DNA, 20 bp, human
gacgggcctgatgctgactg

SEQ ID NO: 55982 - DNA, 20 bp, human
gctggggtctgctgaactcg

SEQ ID NO: 55983 - DNA, 20 bp, human
gaaggcacctctgcgccctc

SEQ ID NO: 55984 - DNA, 20 bp, human
gcttccctgctcggagtatg

SEQ ID NO: 55985 - DNA, 20 bp, human
gagcggggaatcttcacccg

SEQ ID NO: 55986 - DNA, 20 bp, human
gggtacgcgagcgtccctga

SEQ ID NO: 55987 - DNA, 20 bp, human
gagggtcagactagcgccag

SEQ ID NO: 55988 - DNA, 20 bp, human
gcctccgccaggcaaaagga

SEQ ID NO: 55989 - DNA, 20 bp, human
gatggctgcgcgccacctcg

SEQ ID NO: 55990 - DNA, 20 bp, human
ggctgccccggtgctagcaa

SEQ ID NO: 55991 - DNA, 20 bp, human
gagcggatcgcctcacatcc

SEQ ID NO: 55992 - DNA, 20 bp, human
gctcctgatacccggatgtg

SEQ ID NO: 55993 - DNA, 20 bp, human
ggctagtctgaccctccgcc

SEQ ID NO: 55994 - DNA, 20 bp, human
gcaggcggcggggaccgtca

SEQ ID NO: 55995 - DNA, 20 bp, human
ggcagccattgctagcaccg

SEQ ID NO: 55996 - DNA, 20 bp, human
gccgcctcggcctactccag

SEQ ID NO: 55997 - DNA, 20 bp, human
gctgaggcgcaggtaacctc

SEQ ID NO: 55998 - DNA, 20 bp, human
ggagagctcgccgggctctg

SEQ ID NO: 55999 - DNA, 20 bp, human
gtaacctctggagtaggccg

SEQ ID NO: 56000 - DNA, 20 bp, human
gcgcaggtaacctctggagt

SEQ ID NO: 56001 - DNA, 20 bp, human
gtaggctgaggagagctcgc

SEQ ID NO: 56002 - DNA, 20 bp, human
gcgtcgggaagagggaaacc

SEQ ID NO: 56003 - DNA, 20 bp, human
gtttgaagacgctcacggag

SEQ ID NO: 56004 - DNA, 20 bp, human
gagcgcggagaacgagtcag

SEQ ID NO: 56005 - DNA, 20 bp, human
gttacctgcgcctcagagcc

SEQ ID NO: 56006 - DNA, 20 bp, human
gccgaacccagtcttaccta

SEQ ID NO: 56007 - DNA, 20 bp, human
gcgccaccgtaggtaagact

SEQ ID NO: 56008 - DNA, 20 bp, human
gcggagtgaccagaagaagc

SEQ ID NO: 56009 - DNA, 20 bp, human
gctggtcactccgccaccgt

SEQ ID NO: 56010 - DNA, 20 bp, human
gagaagcgggccgaagtaaa

SEQ ID NO: 56011 - DNA, 20 bp, human
gagcgggccgaagtaaaagg

SEQ ID NO: 56012 - DNA, 20 bp, human
gaacccagtcttacctacgg

SEQ ID NO: 56013 - DNA, 20 bp, human
gtaagactgggttcgggtag

SEQ ID NO: 56014 - DNA, 20 bp, human
gcccccgaaccaggcgccgg

SEQ ID NO: 56015 - DNA, 20 bp, human
gtaaaaggcggggctcaaga

SEQ ID NO: 56016 - DNA, 20 bp, human
gttgaagagctcgagatgaa

SEQ ID NO: 56017 - DNA, 20 bp, human
gtaggactgcggacggtgag

SEQ ID NO: 56018 - DNA, 20 bp, human
ggccccacgtgaggcttggt

SEQ ID NO: 56019 - DNA, 20 bp, human
ggtcctaccaagcctcacgt

SEQ ID NO: 56020 - DNA, 20 bp, human
ggtgaggcttggtaggactg

SEQ ID NO: 56021 - DNA, 20 bp, human
gcacctcctgtaccgcaggg

SEQ ID NO: 56022 - DNA, 20 bp, human
gggcttggtaggactgcgga

SEQ ID NO: 56023 - DNA, 20 bp, human
ggtcagataatccgagagag

SEQ ID NO: 56024 - DNA, 20 bp, human
gctcgagatgaagggcttga

SEQ ID NO: 56025 - DNA, 20 bp, human
gagggctggcccctgaacta

SEQ ID NO: 56026 - DNA, 20 bp, human
gccaagaaggctaatcacaa

SEQ ID NO: 56027 - DNA, 20 bp, human
gaacaaaggacattagactc

SEQ ID NO: 56028 - DNA, 20 bp, human
gggagatttcacaatttcag

SEQ ID NO: 56029 - DNA, 20 bp, human
ggaaatgcaatcaggtaggt

SEQ ID NO: 56030 - DNA, 20 bp, human
gctgtagtgctatggctaat

SEQ ID NO: 56031 - DNA, 20 bp, human
gcaagaagagaaatgcaatc

SEQ ID NO: 56032 - DNA, 20 bp, human
ggaaaaaattagagattctt

SEQ ID NO: 56033 - DNA, 20 bp, human
gctgatttagataattctat

SEQ ID NO: 56034 - DNA, 20 bp, human
ggtcttagaacactcgattc

SEQ ID NO: 56035 - DNA, 20 bp, human
gtctatcttaaatttacatg

SEQ ID NO: 56036 - DNA, 20 bp, human
gctctcagcatgccccggga

SEQ ID NO: 56037 - DNA, 20 bp, human
gggcaggtggattcttgaca

SEQ ID NO: 56038 - DNA, 20 bp, human
gcaccagcaaagaccacgac

SEQ ID NO: 56039 - DNA, 20 bp, human
gccccgggaggggagaggta

SEQ ID NO: 56040 - DNA, 20 bp, human
gctcaagagtaagagggaaa

SEQ ID NO: 56041 - DNA, 20 bp, human
gcggctcggctctccagtcg

SEQ ID NO: 56042 - DNA, 20 bp, human
gctcataaacgtgtaggcag

SEQ ID NO: 56043 - DNA, 20 bp, human
gggacagtgctcgacgactg

SEQ ID NO: 56044 - DNA, 20 bp, human
gaggtgtcagccttctaatg

SEQ ID NO: 56045 - DNA, 20 bp, human
gttcccagctgcctccggct

SEQ ID NO: 56046 - DNA, 20 bp, human
gtcctggagggagtgtcggg

SEQ ID NO: 56047 - DNA, 20 bp, human
ggactgccccgggccgctga

SEQ ID NO: 56048 - DNA, 20 bp, human
gggtctggcgcggaaaacga

SEQ ID NO: 56049 - DNA, 20 bp, human
gtcctcgcggagtactggtc

SEQ ID NO: 56050 - DNA, 20 bp, human
gaagagggcgagctctgggg

SEQ ID NO: 56051 - DNA, 20 bp, human
ggtcctgtacctaggaaaga

SEQ ID NO: 56052 - DNA, 20 bp, human
gccagcccttcagcggcccg

SEQ ID NO: 56053 - DNA, 20 bp, human
ggcctgaccagtactccgcg

SEQ ID NO: 56054 - DNA, 20 bp, human
gttggatcctcgcggagtac

SEQ ID NO: 56055 - DNA, 20 bp, human
gatgaagctaactggaggaa

SEQ ID NO: 56056 - DNA, 20 bp, human
gagcgccaggcagcgcggag

SEQ ID NO: 56057 - DNA, 20 bp, human
gtgcggccgtcggggatctg

SEQ ID NO: 56058 - DNA, 20 bp, human
gccgcggcccgcgcccgcaa

SEQ ID NO: 56059 - DNA, 20 bp, human
gggtccgcgcggttcgccag

SEQ ID NO: 56060 - DNA, 20 bp, human
ggaggcgtcgtgggccggtg

SEQ ID NO: 56061 - DNA, 20 bp, human
gagtggctgctgtcgcaggg

SEQ ID NO: 56062 - DNA, 20 bp, human
ggccagaggagcccgcggtg

SEQ ID NO: 56063 - DNA, 20 bp, human
gtgcagtggctgctgtcgca

SEQ ID NO: 56064 - DNA, 20 bp, human
gccggtggcggaggcgtcgt

SEQ ID NO: 56065 - DNA, 20 bp, human
gtgcaggcaggcgaggtggc

SEQ ID NO: 56066 - DNA, 20 bp, human
gacagccaggtgcacagcgg

SEQ ID NO: 56067 - DNA, 20 bp, human
gaccccggttgcccgtccgg

SEQ ID NO: 56068 - DNA, 20 bp, human
ggaccccctggttctcacag

SEQ ID NO: 56069 - DNA, 20 bp, human
gggtaggagcagcccccgga

SEQ ID NO: 56070 - DNA, 20 bp, human
gtatcaggtaacgcaggtgt

SEQ ID NO: 56071 - DNA, 20 bp, human
gccgctggccgcgagtcccc

SEQ ID NO: 56072 - DNA, 20 bp, human
gcggaccccggttgcccgtc

SEQ ID NO: 56073 - DNA, 20 bp, human
gcacagtgggcagcgggcga

SEQ ID NO: 56074 - DNA, 20 bp, human
ggcggccagcggccgtcgag

SEQ ID NO: 56075 - DNA, 20 bp, human
gtccggcttgccacggaccc

SEQ ID NO: 56076 - DNA, 20 bp, human
gtcagtggcgactcatgcac

SEQ ID NO: 56077 - DNA, 20 bp, human
ggcgactcatgcacaggctg

SEQ ID NO: 56078 - DNA, 20 bp, human
gcactgagagcccgggccag

SEQ ID NO: 56079 - DNA, 20 bp, human
ggagtcgccactgagagccc

SEQ ID NO: 56080 - DNA, 20 bp, human
gccacggaggatcagagtac

SEQ ID NO: 56081 - DNA, 20 bp, human
gccagctgcccggcaaccag

SEQ ID NO: 56082 - DNA, 20 bp, human
gcttatcgggtaaccagagc

SEQ ID NO: 56083 - DNA, 20 bp, human
gtcagagtactggccacccc

SEQ ID NO: 56084 - DNA, 20 bp, human
ggagtccccaagagaaacaa

SEQ ID NO: 56085 - DNA, 20 bp, human
gctcgtggccgccaaggatg

SEQ ID NO: 56086 - DNA, 20 bp, human
ggccccactggaccttctct

SEQ ID NO: 56087 - DNA, 20 bp, human
gtctcccatcgaccaggcgg

SEQ ID NO: 56088 - DNA, 20 bp, human
gtccccagagaaggtccagt

SEQ ID NO: 56089 - DNA, 20 bp, human
ggcttctctgggcccctaag

SEQ ID NO: 56090 - DNA, 20 bp, human
gtggtcgatgggagagcctg

SEQ ID NO: 56091 - DNA, 20 bp, human
ggggcccccgaggtgttctg

SEQ ID NO: 56092 - DNA, 20 bp, human
gccgggagacaggaatgcag

SEQ ID NO: 56093 - DNA, 20 bp, human
ggcccctaagaggatgggaa

SEQ ID NO: 56094 - DNA, 20 bp, human
gccgcccccgcctggtcgat

SEQ ID NO: 56095 - DNA, 20 bp, human
gaacacctcgggggccccac

SEQ ID NO: 56096 - DNA, 20 bp, human
gtatgttatctggaacagac

SEQ ID NO: 56097 - DNA, 20 bp, human
ggtgtgctgtactaagaaaa

SEQ ID NO: 56098 - DNA, 20 bp, human
gcttatgctatagaatgggc

SEQ ID NO: 56099 - DNA, 20 bp, human
ggctctttaacaggctcgaa

SEQ ID NO: 56100 - DNA, 20 bp, human
gcctgtctaccgactcagaa

SEQ ID NO: 56101 - DNA, 20 bp, human
ggtcttcttatgctatagaa

SEQ ID NO: 56102 - DNA, 20 bp, human
gttcttagtacagcacacac

SEQ ID NO: 56103 - DNA, 20 bp, human
gggtaaaatccgttctgagt

SEQ ID NO: 56104 - DNA, 20 bp, human
gttaccaaaactgaaaatgc

SEQ ID NO: 56105 - DNA, 20 bp, human
ggataatcttctcttcaagt

SEQ ID NO: 56106 - DNA, 20 bp, human
ggccgcggcgttgaactcgt

SEQ ID NO: 56107 - DNA, 20 bp, human
gctcagacccggggccgtag

SEQ ID NO: 56108 - DNA, 20 bp, human
gtgaagccgggcgacccgac

SEQ ID NO: 56109 - DNA, 20 bp, human
ggtcagaccggcctccccta

SEQ ID NO: 56110 - DNA, 20 bp, human
gcgggagcaagtgcagtccc

SEQ ID NO: 56111 - DNA, 20 bp, human
gctgcgggtccggtgaagcc

SEQ ID NO: 56112 - DNA, 20 bp, human
ggcggcgttgaactcgtagg

SEQ ID NO: 56113 - DNA, 20 bp, human
gccgccaacgcgcaggtcta

SEQ ID NO: 56114 - DNA, 20 bp, human
gagacccggggccgtagggg

SEQ ID NO: 56115 - DNA, 20 bp, human
ggactgcacttgctcccgtc

SEQ ID NO: 56116 - DNA, 20 bp, human
gcgcgcttgcaactgcctcc

SEQ ID NO: 56117 - DNA, 20 bp, human
gcgagctgcgacgggctctg

SEQ ID NO: 56118 - DNA, 20 bp, human
gcagtagctttcaggacagt

SEQ ID NO: 56119 - DNA, 20 bp, human
gggaccacccgagctgcgac

SEQ ID NO: 56120 - DNA, 20 bp, human
ggagcccgtcgcagctcggg

SEQ ID NO: 56121 - DNA, 20 bp, human
gcgggagaccccccctaatg

SEQ ID NO: 56122 - DNA, 20 bp, human
gcgctttcctcaacaggtgg

SEQ ID NO: 56123 - DNA, 20 bp, human
ggccccgccgccacctgttg

SEQ ID NO: 56124 - DNA, 20 bp, human
gtcctcaacaggtggcggcg

SEQ ID NO: 56125 - DNA, 20 bp, human
ggctcgctttcctcaacagg

SEQ ID NO: 56126 - DNA, 20 bp, human
gcactagcagtagcaaggaa

SEQ ID NO: 56127 - DNA, 20 bp, human
gcgggtccagactcacaagt

SEQ ID NO: 56128 - DNA, 20 bp, human
ggaggactgaaatggctcca

SEQ ID NO: 56129 - DNA, 20 bp, human
gctactgctagtgcaaaagg

SEQ ID NO: 56130 - DNA, 20 bp, human
gaagttgcggaggactgaaa

SEQ ID NO: 56131 - DNA, 20 bp, human
gtggagcaccgaccaggtgt

SEQ ID NO: 56132 - DNA, 20 bp, human
gggcagttggccaataagtt

SEQ ID NO: 56133 - DNA, 20 bp, human
gccccgacgggcaaagaacc

SEQ ID NO: 56134 - DNA, 20 bp, human
gcgctccgccgagacgaggt

SEQ ID NO: 56135 - DNA, 20 bp, human
ggaccaggtgtgggcttggg

SEQ ID NO: 56136 - DNA, 20 bp, human
gccagacacgcggaccgacg

SEQ ID NO: 56137 - DNA, 20 bp, human
gtcatggccgcagaggaagg

SEQ ID NO: 56138 - DNA, 20 bp, human
gcggcactgcgtactcagtg

SEQ ID NO: 56139 - DNA, 20 bp, human
ggggctctcggccagacacg

SEQ ID NO: 56140 - DNA, 20 bp, human
gggcggagtcatggccgcag

SEQ ID NO: 56141 - DNA, 20 bp, human
ggccgcggagccgccaggta

SEQ ID NO: 56142 - DNA, 20 bp, human
gcgcagacgcggatcagctt

SEQ ID NO: 56143 - DNA, 20 bp, human
ggagtcatggccgcagagga

SEQ ID NO: 56144 - DNA, 20 bp, human
ggcgggacaccgtgtatcgg

SEQ ID NO: 56145 - DNA, 20 bp, human
ggctcaggccgctcgcctcg

SEQ ID NO: 56146 - DNA, 20 bp, human
gagcgcggtcgggcaggcat

SEQ ID NO: 56147 - DNA, 20 bp, human
gcggcggcgccgccgagtga

SEQ ID NO: 56148 - DNA, 20 bp, human
ggccgccgagtgaggggacg

SEQ ID NO: 56149 - DNA, 20 bp, human
ggtgtcctacaagcagccgg

SEQ ID NO: 56150 - DNA, 20 bp, human
gcgcgccgcgtcccctcact

SEQ ID NO: 56151 - DNA, 20 bp, human
gctggctgcgggtcctgact

SEQ ID NO: 56152 - DNA, 20 bp, human
ggaggaagcggagtaggaag

SEQ ID NO: 56153 - DNA, 20 bp, human
gaggccggcccaccaggact

SEQ ID NO: 56154 - DNA, 20 bp, human
gggcgccgccggctgcttgt

SEQ ID NO: 56155 - DNA, 20 bp, human
gaggacacaaaaggacatcg

SEQ ID NO: 56156 - DNA, 20 bp, human
gctgcctggtgtctgtgcta

SEQ ID NO: 56157 - DNA, 20 bp, human
gcagccctagcacagacacc

SEQ ID NO: 56158 - DNA, 20 bp, human
ggctgctcagagggtaagtt

SEQ ID NO: 56159 - DNA, 20 bp, human
gggtctgggtgcctctagga

SEQ ID NO: 56160 - DNA, 20 bp, human
gtggcctaaacagaacagat

SEQ ID NO: 56161 - DNA, 20 bp, human
gtagctgcctccctccacgt

SEQ ID NO: 56162 - DNA, 20 bp, human
ggggtaagttgggtccagtc

SEQ ID NO: 56163 - DNA, 20 bp, human
gcagaggtgatccagtgatt

SEQ ID NO: 56164 - DNA, 20 bp, human
gtcaacagtcacccaccagg

SEQ ID NO: 56165 - DNA, 20 bp, human
gggtgggtgactgttgacac

SEQ ID NO: 56166 - DNA, 20 bp, human
gaggcaagtctacaagaggt

SEQ ID NO: 56167 - DNA, 20 bp, human
gcgctaccaagagaaaaggg

SEQ ID NO: 56168 - DNA, 20 bp, human
ggcgggagcccagttaaagg

SEQ ID NO: 56169 - DNA, 20 bp, human
gtggcgctccggctagccgt

SEQ ID NO: 56170 - DNA, 20 bp, human
gccggggtccgcgtcccgag

SEQ ID NO: 56171 - DNA, 20 bp, human
ggtcgcgggagcccagttaa

SEQ ID NO: 56172 - DNA, 20 bp, human
gtcaccgagccgggctgcga

SEQ ID NO: 56173 - DNA, 20 bp, human
ggtgctggccggccctccgg

SEQ ID NO: 56174 - DNA, 20 bp, human
ggtaaagtggcaaagagtga

SEQ ID NO: 56175 - DNA, 20 bp, human
gggctgtgcactcaccgagc

SEQ ID NO: 56176 - DNA, 20 bp, human
gcaacaaatgtgcaaatcag

SEQ ID NO: 56177 - DNA, 20 bp, human
gagttatccacacacagcat

SEQ ID NO: 56178 - DNA, 20 bp, human
gccatagcatttacaaatag

SEQ ID NO: 56179 - DNA, 20 bp, human
gtcttcagctataccaagag

SEQ ID NO: 56180 - DNA, 20 bp, human
gaaacagtatagacatgaat

SEQ ID NO: 56181 - DNA, 20 bp, human
gtctttgaatcgagatgtgg

SEQ ID NO: 56182 - DNA, 20 bp, human
gacatgttcgtggtgtggaa

SEQ ID NO: 56183 - DNA, 20 bp, human
gaatattccgatgctgtgtg

SEQ ID NO: 56184 - DNA, 20 bp, human
gtattctttgaatcgagatg

SEQ ID NO: 56185 - DNA, 20 bp, human
ggctttcattgaaattgcag

SEQ ID NO: 56186 - DNA, 20 bp, human
gactgcgacagtgttagcgt

SEQ ID NO: 56187 - DNA, 20 bp, human
gagtgaatcaatagaaacaa

SEQ ID NO: 56188 - DNA, 20 bp, human
gtgtgttgtagtgatcatgt

SEQ ID NO: 56189 - DNA, 20 bp, human
gtcatgtaggtgctttggaa

SEQ ID NO: 56190 - DNA, 20 bp, human
gaacactgtcgcagtttgaa

SEQ ID NO: 56191 - DNA, 20 bp, human
ggatcactacaacacatact

SEQ ID NO: 56192 - DNA, 20 bp, human
gaatatctcctaatcttgta

SEQ ID NO: 56193 - DNA, 20 bp, human
ggccacgtgatacacattag

SEQ ID NO: 56194 - DNA, 20 bp, human
gagctgctccctacaagatt

SEQ ID NO: 56195 - DNA, 20 bp, human
gagtgatcatgtaggtgctt

SEQ ID NO: 56196 - DNA, 20 bp, human
gcaggcgtcccagagagcgg

SEQ ID NO: 56197 - DNA, 20 bp, human
gtggagcccgccgcctccag

SEQ ID NO: 56198 - DNA, 20 bp, human
gcaggccgggctccctaaac

SEQ ID NO: 56199 - DNA, 20 bp, human
gaacgcctgcgtggagccat

SEQ ID NO: 56200 - DNA, 20 bp, human
gcgggaccgggaccgacagg

SEQ ID NO: 56201 - DNA, 20 bp, human
ggcgggaaggccggacaggt

SEQ ID NO: 56202 - DNA, 20 bp, human
gttaagaggaggtaactagt

SEQ ID NO: 56203 - DNA, 20 bp, human
gccaggcgcggtcttcgcgg

SEQ ID NO: 56204 - DNA, 20 bp, human
gcggtgggcacaccccgcag

SEQ ID NO: 56205 - DNA, 20 bp, human
gagcccggcagcgataaccg

SEQ ID NO: 56206 - DNA, 20 bp, human
gcattggccgcccttctcca

SEQ ID NO: 56207 - DNA, 20 bp, human
ggtaggtatctccacaaact

SEQ ID NO: 56208 - DNA, 20 bp, human
gtggagatacctacttgggt

SEQ ID NO: 56209 - DNA, 20 bp, human
ggttggttggaaataggtaa

SEQ ID NO: 56210 - DNA, 20 bp, human
gggttggaaataggtaaggg

SEQ ID NO: 56211 - DNA, 20 bp, human
ggatacctacttgggttggt

SEQ ID NO: 56212 - DNA, 20 bp, human
ggtagaactcagaaaatatc

SEQ ID NO: 56213 - DNA, 20 bp, human
ggggcggccaatgtgattct

SEQ ID NO: 56214 - DNA, 20 bp, human
gtgtgattctgggcaaagtg

SEQ ID NO: 56215 - DNA, 20 bp, human
gttagcttgaccttccataa

SEQ ID NO: 56216 - DNA, 20 bp, human
gagaggacgaggagaataca

SEQ ID NO: 56217 - DNA, 20 bp, human
gcacggtccaaacctgagta

SEQ ID NO: 56218 - DNA, 20 bp, human
ggaactggctctgggaccaa

SEQ ID NO: 56219 - DNA, 20 bp, human
gcagaagcggaaaacaacgt

SEQ ID NO: 56220 - DNA, 20 bp, human
gccctgggagaggcaagcgg

SEQ ID NO: 56221 - DNA, 20 bp, human
gcggacgaccaagaccgtga

SEQ ID NO: 56222 - DNA, 20 bp, human
ggtgacctcgctgatggcaa

SEQ ID NO: 56223 - DNA, 20 bp, human
gggaggcaggggacccgcta

SEQ ID NO: 56224 - DNA, 20 bp, human
gcctgagtacggaacagaag

SEQ ID NO: 56225 - DNA, 20 bp, human
gaccaagaccgtgagggtgg

SEQ ID NO: 56226 - DNA, 20 bp, human
ggtcgggcggatcctcccag

SEQ ID NO: 56227 - DNA, 20 bp, human
gatccgcccgacccagggac

SEQ ID NO: 56228 - DNA, 20 bp, human
gggaggatccgcccgaccca

SEQ ID NO: 56229 - DNA, 20 bp, human
ggggagctgatcgcaagact

SEQ ID NO: 56230 - DNA, 20 bp, human
ggggcggatcctcccagagg

SEQ ID NO: 56231 - DNA, 20 bp, human
gaggcagctactggacgacg

SEQ ID NO: 56232 - DNA, 20 bp, human
ggctccattgtgccacctct

SEQ ID NO: 56233 - DNA, 20 bp, human
gatgctgcacagaggaccga

SEQ ID NO: 56234 - DNA, 20 bp, human
gcgagggtggtcgctcaccc

SEQ ID NO: 56235 - DNA, 20 bp, human
gcgagcagcgaggcagctac

SEQ ID NO: 56236 - DNA, 20 bp, human
ggcggcagcagcaactacgg

SEQ ID NO: 56237 - DNA, 20 bp, human
gagcggaagagcgatcgggt

SEQ ID NO: 56238 - DNA, 20 bp, human
gtttgtcgaagctagaggac

SEQ ID NO: 56239 - DNA, 20 bp, human
gtgagggaggcgggagactt

SEQ ID NO: 56240 - DNA, 20 bp, human
gaagctagaggaccggcagg

SEQ ID NO: 56241 - DNA, 20 bp, human
gaggaagcggaagagcgatc

SEQ ID NO: 56242 - DNA, 20 bp, human
gctagtgaggaacctcaaaa

SEQ ID NO: 56243 - DNA, 20 bp, human
gggaagagcgatcgggtagg

SEQ ID NO: 56244 - DNA, 20 bp, human
ggggaggcgggagacttagg

SEQ ID NO: 56245 - DNA, 20 bp, human
ggcggggtcactcagaaaag

SEQ ID NO: 56246 - DNA, 20 bp, human
ggcgccagcgcccctctgag

SEQ ID NO: 56247 - DNA, 20 bp, human
ggggtgctcgcgctgatccc

SEQ ID NO: 56248 - DNA, 20 bp, human
gcagcccgcctcggccggga

SEQ ID NO: 56249 - DNA, 20 bp, human
gggtagcccagcgcgtacac

SEQ ID NO: 56250 - DNA, 20 bp, human
ggcctggacgaggggagatc

SEQ ID NO: 56251 - DNA, 20 bp, human
gggagtgcctgcctggacga

SEQ ID NO: 56252 - DNA, 20 bp, human
gctggcgctgctggaagacg

SEQ ID NO: 56253 - DNA, 20 bp, human
gagatcgggactggtggtca

SEQ ID NO: 56254 - DNA, 20 bp, human
gcggcgcctgagaaccccgg

SEQ ID NO: 56255 - DNA, 20 bp, human
ggacgaggggagatcgggac

SEQ ID NO: 56256 - DNA, 20 bp, human
gccacgaaggtacagagctc

SEQ ID NO: 56257 - DNA, 20 bp, human
gcaggcgcccaagcttcccg

SEQ ID NO: 56258 - DNA, 20 bp, human
ggaaccgccgcgggaagctt

SEQ ID NO: 56259 - DNA, 20 bp, human
gtcattgtcaaggaattcga

SEQ ID NO: 56260 - DNA, 20 bp, human
gctacctagctggctacctg

SEQ ID NO: 56261 - DNA, 20 bp, human
gtctcggcgcgccgagctca

SEQ ID NO: 56262 - DNA, 20 bp, human
gcgggtgaagctctcgggaa

SEQ ID NO: 56263 - DNA, 20 bp, human
gggcgacgagatgcgagcag

SEQ ID NO: 56264 - DNA, 20 bp, human
gttgtcaaggaattcgaagg

SEQ ID NO: 56265 - DNA, 20 bp, human
ggtgctggccccgcagctcg

SEQ ID NO: 56266 - DNA, 20 bp, human
gaaaccgcaccccgcaccaa

SEQ ID NO: 56267 - DNA, 20 bp, human
gttttgcaaagggatgagta

SEQ ID NO: 56268 - DNA, 20 bp, human
gaaccccgagggtgagacgt

SEQ ID NO: 56269 - DNA, 20 bp, human
gcggcagccgccattttggt

SEQ ID NO: 56270 - DNA, 20 bp, human
gcgcgccccaccgaccaaaa

SEQ ID NO: 56271 - DNA, 20 bp, human
gggatgcggcgccgaagcca

SEQ ID NO: 56272 - DNA, 20 bp, human
gcagtggcggcggaggaatg

SEQ ID NO: 56273 - DNA, 20 bp, human
ggtggggcgcgcgcaagagg

SEQ ID NO: 56274 - DNA, 20 bp, human
ggcttgcaacagggaaatct

SEQ ID NO: 56275 - DNA, 20 bp, human
gctcggtggtcgagccaggg

SEQ ID NO: 56276 - DNA, 20 bp, human
ggcccagtcctgggcggcag

SEQ ID NO: 56277 - DNA, 20 bp, human
ggggcctctgggggatggcg

SEQ ID NO: 56278 - DNA, 20 bp, human
ggcggcggcggctctgacgt

SEQ ID NO: 56279 - DNA, 20 bp, human
gcggctctgacgtaggacac

SEQ ID NO: 56280 - DNA, 20 bp, human
gaggggtccgggaaccaaga

SEQ ID NO: 56281 - DNA, 20 bp, human
gtggccggatgaggagaacc

SEQ ID NO: 56282 - DNA, 20 bp, human
gggaaccaagagggcacgga

SEQ ID NO: 56283 - DNA, 20 bp, human
gccgccgggccgctctaggg

SEQ ID NO: 56284 - DNA, 20 bp, human
gcgggggcgtccatcctgag

SEQ ID NO: 56285 - DNA, 20 bp, human
gtactacccagagatccaga

SEQ ID NO: 56286 - DNA, 20 bp, human
gcgggcacggggctgctgta

SEQ ID NO: 56287 - DNA, 20 bp, human
gcagagtgaccgacaaaggt

SEQ ID NO: 56288 - DNA, 20 bp, human
gggagcaagtgtggaggacc

SEQ ID NO: 56289 - DNA, 20 bp, human
ggcggagaccatgttccgag

SEQ ID NO: 56290 - DNA, 20 bp, human
ggcaagtgtggaggacctgg

SEQ ID NO: 56291 - DNA, 20 bp, human
gtgcccagagtgaccgacaa

SEQ ID NO: 56292 - DNA, 20 bp, human
ggcgttccgcagggagtcca

SEQ ID NO: 56293 - DNA, 20 bp, human
ggaggcggcgccagttggcc

SEQ ID NO: 56294 - DNA, 20 bp, human
gggagccgccgctcggaaca

SEQ ID NO: 56295 - DNA, 20 bp, human
ggaccgacaaaggtgggaaa

SEQ ID NO: 56296 - DNA, 20 bp, human
gggtcagcccgcaccctcag

SEQ ID NO: 56297 - DNA, 20 bp, human
gtgcgggctgaccctgtaag

SEQ ID NO: 56298 - DNA, 20 bp, human
gcccgccgcagccacttaca

SEQ ID NO: 56299 - DNA, 20 bp, human
gagtgggtgaaagcagtcag

SEQ ID NO: 56300 - DNA, 20 bp, human
gctgaccctgtaagtggctg

SEQ ID NO: 56301 - DNA, 20 bp, human
gactgagccgctgagggtgc

SEQ ID NO: 56302 - DNA, 20 bp, human
gttctggactgagccgctga

SEQ ID NO: 56303 - DNA, 20 bp, human
gtacccactggaagaagtca

SEQ ID NO: 56304 - DNA, 20 bp, human
ggtgctcgtagctgtcaaga

SEQ ID NO: 56305 - DNA, 20 bp, human
gggaacctggatagaactct

SEQ ID NO: 56306 - DNA, 20 bp, human
gagttaagggtggtcctcag

SEQ ID NO: 56307 - DNA, 20 bp, human
gcagttaggtagacagttaa

SEQ ID NO: 56308 - DNA, 20 bp, human
gttaggtagacagttaaggg

SEQ ID NO: 56309 - DNA, 20 bp, human
gtgaccacaccggtcctgtc

SEQ ID NO: 56310 - DNA, 20 bp, human
gggaccggtgtggtcacgga

SEQ ID NO: 56311 - DNA, 20 bp, human
gtatggtaacccacagtgag

SEQ ID NO: 56312 - DNA, 20 bp, human
ggagtgaagcctgacaggac

SEQ ID NO: 56313 - DNA, 20 bp, human
gggttagagtttgtaggcag

SEQ ID NO: 56314 - DNA, 20 bp, human
gaagcctgacaggaccggtg

SEQ ID NO: 56315 - DNA, 20 bp, human
gcgttgtcctcatccagcct

SEQ ID NO: 56316 - DNA, 20 bp, human
gtatctaggctaaaggtcaa

SEQ ID NO: 56317 - DNA, 20 bp, human
ggaacgccgtgaagcaagag

SEQ ID NO: 56318 - DNA, 20 bp, human
gtcggtggactcctgaactg

SEQ ID NO: 56319 - DNA, 20 bp, human
gcggcgggcgctggacctct

SEQ ID NO: 56320 - DNA, 20 bp, human
ggccgtgaagcaagagcggt

SEQ ID NO: 56321 - DNA, 20 bp, human
ggcgccggcgcagagcgaga

SEQ ID NO: 56322 - DNA, 20 bp, human
gctgggtgagaggaaacggg

SEQ ID NO: 56323 - DNA, 20 bp, human
gaagagcggtcggcagagcg

SEQ ID NO: 56324 - DNA, 20 bp, human
gctggacctctaggccgcgg

SEQ ID NO: 56325 - DNA, 20 bp, human
gccggcgcagagcgagaagg

SEQ ID NO: 56326 - DNA, 20 bp, human
gtgtactgagggtcgcccgg

SEQ ID NO: 56327 - DNA, 20 bp, human
gcccgcagtgggcgcgatgg

SEQ ID NO: 56328 - DNA, 20 bp, human
ggaccccgcagtgggcgcga

SEQ ID NO: 56329 - DNA, 20 bp, human
gcggggtcaggaatgagcgg

SEQ ID NO: 56330 - DNA, 20 bp, human
gctcattcctgaccccgcag

SEQ ID NO: 56331 - DNA, 20 bp, human
gctgcaggagccgggcgcta

SEQ ID NO: 56332 - DNA, 20 bp, human
gatggcggaggctgtactga

SEQ ID NO: 56333 - DNA, 20 bp, human
gtaatagggagagatccggg

SEQ ID NO: 56334 - DNA, 20 bp, human
gtccgccatcgcgcccactg

SEQ ID NO: 56335 - DNA, 20 bp, human
gcagcaaggacggaactccg

SEQ ID NO: 56336 - DNA, 20 bp, human
ggcgggcgccgacagactgg

SEQ ID NO: 56337 - DNA, 20 bp, human
gattttctccgagagcgggc

SEQ ID NO: 56338 - DNA, 20 bp, human
gcgagcggcaggagaacgtc

SEQ ID NO: 56339 - DNA, 20 bp, human
gagacccagagctgaggtgt

SEQ ID NO: 56340 - DNA, 20 bp, human
gctgcagggtcacctcctgg

SEQ ID NO: 56341 - DNA, 20 bp, human
gctgctgtccagacccggat

SEQ ID NO: 56342 - DNA, 20 bp, human
gactgagcccggcccgctct

SEQ ID NO: 56343 - DNA, 20 bp, human
ggccatggcccaggcgacgg

SEQ ID NO: 56344 - DNA, 20 bp, human
ggcggccgcagagcatgccg

SEQ ID NO: 56345 - DNA, 20 bp, human
ggcaggagaacgtctggagg

SEQ ID NO: 56346 - DNA, 20 bp, human
ggcgagccggcgatcgaagc

SEQ ID NO: 56347 - DNA, 20 bp, human
gcaagttcggaccaaggtag

SEQ ID NO: 56348 - DNA, 20 bp, human
gcctggcaggaccccatcct

SEQ ID NO: 56349 - DNA, 20 bp, human
gcaccccgcgctccaggtag

SEQ ID NO: 56350 - DNA, 20 bp, human
ggcccgtgatgtcacaatcg

SEQ ID NO: 56351 - DNA, 20 bp, human
gcggaccaaggtagcggagt

SEQ ID NO: 56352 - DNA, 20 bp, human
ggcagctcgcgcctgagtca

SEQ ID NO: 56353 - DNA, 20 bp, human
gcccgagcaagttcggacca

SEQ ID NO: 56354 - DNA, 20 bp, human
ggaaatgccgaagtacgcga

SEQ ID NO: 56355 - DNA, 20 bp, human
gcccgggaaggatgtcgtcc

SEQ ID NO: 56356 - DNA, 20 bp, human
ggaacgccaggagggataac

SEQ ID NO: 56357 - DNA, 20 bp, human
ggggcgtcggaggtcaccgg

SEQ ID NO: 56358 - DNA, 20 bp, human
gctgcccgctcgaaagtccc

SEQ ID NO: 56359 - DNA, 20 bp, human
gcagtaagcgggacactctg

SEQ ID NO: 56360 - DNA, 20 bp, human
gggcagtcccaggctcgcgt

SEQ ID NO: 56361 - DNA, 20 bp, human
gggctgccggccggctagag

SEQ ID NO: 56362 - DNA, 20 bp, human
ggagccggggactttcgagc

SEQ ID NO: 56363 - DNA, 20 bp, human
gcaataacgagtgcagaagg

SEQ ID NO: 56364 - DNA, 20 bp, human
gccccgggcaagagaacgcc

SEQ ID NO: 56365 - DNA, 20 bp, human
ggggcaagagaacgccagga

SEQ ID NO: 56366 - DNA, 20 bp, human
gggccgtcgccactcacccg

SEQ ID NO: 56367 - DNA, 20 bp, human
gccgggcgcgggggaaagaa

SEQ ID NO: 56368 - DNA, 20 bp, human
gtgcgcgcccggcactccag

SEQ ID NO: 56369 - DNA, 20 bp, human
gtctggccgagagcttgggt

SEQ ID NO: 56370 - DNA, 20 bp, human
gaggcccccacccaagctct

SEQ ID NO: 56371 - DNA, 20 bp, human
gccagaagggaacggcgaaa

SEQ ID NO: 56372 - DNA, 20 bp, human
gcagctggatctggaggacg

SEQ ID NO: 56373 - DNA, 20 bp, human
gagaaatgcaccgcccagaa

SEQ ID NO: 56374 - DNA, 20 bp, human
gtgccgggcgcgcaccgtcc

SEQ ID NO: 56375 - DNA, 20 bp, human
gcccccaaaccaagggtcta

SEQ ID NO: 56376 - DNA, 20 bp, human
gaagtctccgcccggctccc

SEQ ID NO: 56377 - DNA, 20 bp, human
gaaccgggccgtcccccacg

SEQ ID NO: 56378 - DNA, 20 bp, human
gcgccggccagagacgatca

SEQ ID NO: 56379 - DNA, 20 bp, human
gcggccagagacgatcaggg

SEQ ID NO: 56380 - DNA, 20 bp, human
gtaggcgaccccgaagacag

SEQ ID NO: 56381 - DNA, 20 bp, human
ggctgctgcgaggactctag

SEQ ID NO: 56382 - DNA, 20 bp, human
gctccagagactgacgagtg

SEQ ID NO: 56383 - DNA, 20 bp, human
gctagcacgcaggaaccccc

SEQ ID NO: 56384 - DNA, 20 bp, human
ggccccgggtgaccctccat

SEQ ID NO: 56385 - DNA, 20 bp, human
ggagccgcccggccagcgtc

SEQ ID NO: 56386 - DNA, 20 bp, human
gaagcagagtcgccctacag

SEQ ID NO: 56387 - DNA, 20 bp, human
gaggtgaaggaggcggtgta

SEQ ID NO: 56388 - DNA, 20 bp, human
gtgaaggaggcggtgtaggg

SEQ ID NO: 56389 - DNA, 20 bp, human
gcctaacgggactaaagaga

SEQ ID NO: 56390 - DNA, 20 bp, human
gaggcgctttcggcttccaa

SEQ ID NO: 56391 - DNA, 20 bp, human
gtgtgaatgggactgtcgga

SEQ ID NO: 56392 - DNA, 20 bp, human
gtagcccagcacttccccct

SEQ ID NO: 56393 - DNA, 20 bp, human
gccgaattgagctctgtcag

SEQ ID NO: 56394 - DNA, 20 bp, human
gtctctttggatccaggtga

SEQ ID NO: 56395 - DNA, 20 bp, human
gtgcgcggtcggtgtacccc

SEQ ID NO: 56396 - DNA, 20 bp, human
gcgggagactgacagtgagg

SEQ ID NO: 56397 - DNA, 20 bp, human
gctggacgcttgagtctcca

SEQ ID NO: 56398 - DNA, 20 bp, human
gggacccaggacccgagaag

SEQ ID NO: 56399 - DNA, 20 bp, human
gactggcacggtccgactgc

SEQ ID NO: 56400 - DNA, 20 bp, human
gcccggactgtaccacctcc

SEQ ID NO: 56401 - DNA, 20 bp, human
gtccgactgcgggctcggtt

SEQ ID NO: 56402 - DNA, 20 bp, human
gagtctccaaggctgactgt

SEQ ID NO: 56403 - DNA, 20 bp, human
gttcctgggtctccgagatg

SEQ ID NO: 56404 - DNA, 20 bp, human
gacccggggctgcatgcggg

SEQ ID NO: 56405 - DNA, 20 bp, human
ggagatccaacagtcagcct

SEQ ID NO: 56406 - DNA, 20 bp, human
ggtggtcgcgatcagaggaa

SEQ ID NO: 56407 - DNA, 20 bp, human
gtccaacccagacaccccgg

SEQ ID NO: 56408 - DNA, 20 bp, human
ggaggagaccggaccgaaga

SEQ ID NO: 56409 - DNA, 20 bp, human
ggacggaccgtgccgggaag

SEQ ID NO: 56410 - DNA, 20 bp, human
ggaccactccccgaagagtg

SEQ ID NO: 56411 - DNA, 20 bp, human
gttcggtccggtctcctccg

SEQ ID NO: 56412 - DNA, 20 bp, human
gggatccaacccagacaccc

SEQ ID NO: 56413 - DNA, 20 bp, human
ggcacggtccgtcttcggtc

SEQ ID NO: 56414 - DNA, 20 bp, human
gggacacttccatccaagta

SEQ ID NO: 56415 - DNA, 20 bp, human
gggggagtggtcgcgatcag

SEQ ID NO: 56416 - DNA, 20 bp, human
gatcagggaaggccaaccct

SEQ ID NO: 56417 - DNA, 20 bp, human
gagggaaggccaaccctggg

SEQ ID NO: 56418 - DNA, 20 bp, human
gacaagaggttgccagtgaa

SEQ ID NO: 56419 - DNA, 20 bp, human
gtgcagtgcatggtccactc

SEQ ID NO: 56420 - DNA, 20 bp, human
gctgctccaacggtggccta

SEQ ID NO: 56421 - DNA, 20 bp, human
gggctttgtaggcccaatca

SEQ ID NO: 56422 - DNA, 20 bp, human
gccctgccctaggccaccgt

SEQ ID NO: 56423 - DNA, 20 bp, human
ggcttccccatacccagaca

SEQ ID NO: 56424 - DNA, 20 bp, human
gcgggagcctggggacgact

SEQ ID NO: 56425 - DNA, 20 bp, human
gcagggctgactcggactca

SEQ ID NO: 56426 - DNA, 20 bp, human
gcctcaggtgaggctgcggg

SEQ ID NO: 56427 - DNA, 20 bp, human
gcttttgtgaatggaacccc

SEQ ID NO: 56428 - DNA, 20 bp, human
gaccgagcccgggtaaagca

SEQ ID NO: 56429 - DNA, 20 bp, human
gggccggggccgccttactc

SEQ ID NO: 56430 - DNA, 20 bp, human
ggcggggctaggccggagta

SEQ ID NO: 56431 - DNA, 20 bp, human
ggggctaggccggagtaagg

SEQ ID NO: 56432 - DNA, 20 bp, human
gtcccgccaaaggccaaagg

SEQ ID NO: 56433 - DNA, 20 bp, human
gctgcgcccgaaaaacaagt

SEQ ID NO: 56434 - DNA, 20 bp, human
gacccccgccctggaatctg

SEQ ID NO: 56435 - DNA, 20 bp, human
gcagacagttgtgagcccgg

SEQ ID NO: 56436 - DNA, 20 bp, human
ggaaccgctccgcgcaccag

SEQ ID NO: 56437 - DNA, 20 bp, human
gcggttcaccgtcttcggag

SEQ ID NO: 56438 - DNA, 20 bp, human
gccagccggctagagttcac

SEQ ID NO: 56439 - DNA, 20 bp, human
gggccgaaccgctccgaaga

SEQ ID NO: 56440 - DNA, 20 bp, human
gcagccgctggtgcgcggag

SEQ ID NO: 56441 - DNA, 20 bp, human
ggagcctccaagtcccctcg

SEQ ID NO: 56442 - DNA, 20 bp, human
gggcgcctgggcgaaaggct

SEQ ID NO: 56443 - DNA, 20 bp, human
gccccggagcgcgagtgcgg

SEQ ID NO: 56444 - DNA, 20 bp, human
ggagtccagccgctggtgcg

SEQ ID NO: 56445 - DNA, 20 bp, human
ggcgcctcccccacgacgtg

SEQ ID NO: 56446 - DNA, 20 bp, human
gtctcacagcgagagagatc

SEQ ID NO: 56447 - DNA, 20 bp, human
ggagagatcaggaagttctc

SEQ ID NO: 56448 - DNA, 20 bp, human
gttccaccacgtagaaggag

SEQ ID NO: 56449 - DNA, 20 bp, human
gcggctgccgggagagatgc

SEQ ID NO: 56450 - DNA, 20 bp, human
ggcgctccagacccccgggg

SEQ ID NO: 56451 - DNA, 20 bp, human
gaaagagatgcagctcgcgg

SEQ ID NO: 56452 - DNA, 20 bp, human
gccctgagctgcaccggcca

SEQ ID NO: 56453 - DNA, 20 bp, human
gtgggagacgggcccgagcg

SEQ ID NO: 56454 - DNA, 20 bp, human
gcgcgcgctccagacccccg

SEQ ID NO: 56455 - DNA, 20 bp, human
gctggccgtggagcctttct

SEQ ID NO: 56456 - DNA, 20 bp, human
ggagaactggaaggtcgcgt

SEQ ID NO: 56457 - DNA, 20 bp, human
gcctggctccgagaactgga

SEQ ID NO: 56458 - DNA, 20 bp, human
gagttctcggagccaggtta

SEQ ID NO: 56459 - DNA, 20 bp, human
gggggcgaccagtggtaagg

SEQ ID NO: 56460 - DNA, 20 bp, human
gttggcggaggaggactgcg

SEQ ID NO: 56461 - DNA, 20 bp, human
ggtaggggcgaccagtggta

SEQ ID NO: 56462 - DNA, 20 bp, human
gttggtgtaggggcgaccag

SEQ ID NO: 56463 - DNA, 20 bp, human
gctccgccaaacccctaacc

SEQ ID NO: 56464 - DNA, 20 bp, human
gagccaggttaggggtttgg

SEQ ID NO: 56465 - DNA, 20 bp, human
gtcacatctggttggtgtag

SEQ ID NO: 56466 - DNA, 20 bp, human
gcggcctgggtgctcacgga

SEQ ID NO: 56467 - DNA, 20 bp, human
ggacccagcctacaacacct

SEQ ID NO: 56468 - DNA, 20 bp, human
gtgcaggagcccgagtcagt

SEQ ID NO: 56469 - DNA, 20 bp, human
gcctgggtgctcacggacgg

SEQ ID NO: 56470 - DNA, 20 bp, human
ggggctggcctggggatgtg

SEQ ID NO: 56471 - DNA, 20 bp, human
gcccggagctgatcactgag

SEQ ID NO: 56472 - DNA, 20 bp, human
gaggagcccgagtcagtggg

SEQ ID NO: 56473 - DNA, 20 bp, human
gccgagtcagtgggaggaaa

SEQ ID NO: 56474 - DNA, 20 bp, human
ggagttcagggagcgctctc

SEQ ID NO: 56475 - DNA, 20 bp, human
ggtccctgcccaggtgttgt

SEQ ID NO: 56476 - DNA, 20 bp, human
gtagggaagcgctctctcca

SEQ ID NO: 56477 - DNA, 20 bp, human
gcacggaccgagggaccagc

SEQ ID NO: 56478 - DNA, 20 bp, human
gcgggcgggacacggaccga

SEQ ID NO: 56479 - DNA, 20 bp, human
gccgggccgccacgaagtta

SEQ ID NO: 56480 - DNA, 20 bp, human
gggaagcgctctctccaggg

SEQ ID NO: 56481 - DNA, 20 bp, human
gctcggaggaaactttccgc

SEQ ID NO: 56482 - DNA, 20 bp, human
gagaggggttccccccgaca

SEQ ID NO: 56483 - DNA, 20 bp, human
gcgaggaaagaggagggacg

SEQ ID NO: 56484 - DNA, 20 bp, human
ggagcgcttccctaacttcg

SEQ ID NO: 56485 - DNA, 20 bp, human
gtcagctggggacctcacca

SEQ ID NO: 56486 - DNA, 20 bp, human
gcccagtcgagggttcacct

SEQ ID NO: 56487 - DNA, 20 bp, human
gcccaggcgccccagcaaag

SEQ ID NO: 56488 - DNA, 20 bp, human
ggccgcaccagtggacacgg

SEQ ID NO: 56489 - DNA, 20 bp, human
gtaaggacggcgtcacatgg

SEQ ID NO: 56490 - DNA, 20 bp, human
gcctgggctggcccgcgcag

SEQ ID NO: 56491 - DNA, 20 bp, human
gacatggcggggagaatcga

SEQ ID NO: 56492 - DNA, 20 bp, human
gcaggacagtgcagtagaag

SEQ ID NO: 56493 - DNA, 20 bp, human
ggggagggggcggagaactg

SEQ ID NO: 56494 - DNA, 20 bp, human
gtgcggctgcccccagtcga

SEQ ID NO: 56495 - DNA, 20 bp, human
gggctaaggacggcgtcaca

SEQ ID NO: 56496 - DNA, 20 bp, human
gggctcggcgaagcagggaa

SEQ ID NO: 56497 - DNA, 20 bp, human
gaggagtcgggagactgcac

SEQ ID NO: 56498 - DNA, 20 bp, human
ggggtcggccgagcagacag

SEQ ID NO: 56499 - DNA, 20 bp, human
ggcacaggccagaaagtctg

SEQ ID NO: 56500 - DNA, 20 bp, human
gcctccggctcggcgaagca

SEQ ID NO: 56501 - DNA, 20 bp, human
gagcgcacgcgacaccaggt

SEQ ID NO: 56502 - DNA, 20 bp, human
gtcaaggagtcgcagagccg

SEQ ID NO: 56503 - DNA, 20 bp, human
gggccagaaagtctgcggag

SEQ ID NO: 56504 - DNA, 20 bp, human
gcacgcgacaccaggtgggt

SEQ ID NO: 56505 - DNA, 20 bp, human
gcgactccttgagcctggtt

SEQ ID NO: 56506 - DNA, 20 bp, human
ggacaggcgatggacccctc

SEQ ID NO: 56507 - DNA, 20 bp, human
ggtgagcgggatacacctaa

SEQ ID NO: 56508 - DNA, 20 bp, human
gcccggccagcacccacgtg

SEQ ID NO: 56509 - DNA, 20 bp, human
gggagggcaggatctgaata

SEQ ID NO: 56510 - DNA, 20 bp, human
ggggacccgctacctcaaag

SEQ ID NO: 56511 - DNA, 20 bp, human
gtgaggtagcgggtcccgac

SEQ ID NO: 56512 - DNA, 20 bp, human
gtccggaagctccagcgact

SEQ ID NO: 56513 - DNA, 20 bp, human
ggagtcctggagcacccaga

SEQ ID NO: 56514 - DNA, 20 bp, human
gccgccccggagggatcctc

SEQ ID NO: 56515 - DNA, 20 bp, human
gcggcctgaggatccctccg

SEQ ID NO: 56516 - DNA, 20 bp, human
gaaaggaaatgtgtcatctg

SEQ ID NO: 56517 - DNA, 20 bp, human
gtaacacaacctggcctcca

SEQ ID NO: 56518 - DNA, 20 bp, human
gaaggtaggtcatatatata

SEQ ID NO: 56519 - DNA, 20 bp, human
gtggccactggcatgacagg

SEQ ID NO: 56520 - DNA, 20 bp, human
gtggcctccaaggcataaac

SEQ ID NO: 56521 - DNA, 20 bp, human
gagtggccaactagagaagt

SEQ ID NO: 56522 - DNA, 20 bp, human
gcaactaaagcacatgtcac

SEQ ID NO: 56523 - DNA, 20 bp, human
gcgccatggagttttaaatt

SEQ ID NO: 56524 - DNA, 20 bp, human
gacatgtgctttagttgcag

SEQ ID NO: 56525 - DNA, 20 bp, human
gaacatttccagtttacttg

SEQ ID NO: 56526 - DNA, 20 bp, human
gcaaaagaagttaacagctg

SEQ ID NO: 56527 - DNA, 20 bp, human
gaaaggtcttatacaaacct

SEQ ID NO: 56528 - DNA, 20 bp, human
gttggtgatttggctaagaa

SEQ ID NO: 56529 - DNA, 20 bp, human
ggctaaattcttgttctaac

SEQ ID NO: 56530 - DNA, 20 bp, human
gttgttctaactggacattt

SEQ ID NO: 56531 - DNA, 20 bp, human
ggtctaaagatgtctataac

SEQ ID NO: 56532 - DNA, 20 bp, human
gaactatttcagtttgctag

SEQ ID NO: 56533 - DNA, 20 bp, human
gtgtctataacaggtttttg

SEQ ID NO: 56534 - DNA, 20 bp, human
gagaaaattttcacacaatt

SEQ ID NO: 56535 - DNA, 20 bp, human
gttggctaagaaaggaaaat

SEQ ID NO: 56536 - DNA, 20 bp, human
gctggctgcagttccgacag

SEQ ID NO: 56537 - DNA, 20 bp, human
gtggccagctggcaaggggc

SEQ ID NO: 56538 - DNA, 20 bp, human
gccagcgcccacgagaagga

SEQ ID NO: 56539 - DNA, 20 bp, human
gctcccggcaccgccgctgt

SEQ ID NO: 56540 - DNA, 20 bp, human
gggaccccggaggaaccagc

SEQ ID NO: 56541 - DNA, 20 bp, human
ggctgcagttccgacagcgg

SEQ ID NO: 56542 - DNA, 20 bp, human
gtaactgtggcgtcccaggg

SEQ ID NO: 56543 - DNA, 20 bp, human
gccgcagccctccttctcgt

SEQ ID NO: 56544 - DNA, 20 bp, human
gtcgtcggcgggtctaactg

SEQ ID NO: 56545 - DNA, 20 bp, human
gccgaggcgctgagacgcgg

SEQ ID NO: 56546 - DNA, 20 bp, human
gtcagcgggtgaaatggcag

SEQ ID NO: 56547 - DNA, 20 bp, human
gtcccggagaggagtcctga

SEQ ID NO: 56548 - DNA, 20 bp, human
gctcctgtcagcgggtgaaa

SEQ ID NO: 56549 - DNA, 20 bp, human
gctctccgggaaccccctca

SEQ ID NO: 56550 - DNA, 20 bp, human
ggcgggtgaaatggcagcgg

SEQ ID NO: 56551 - DNA, 20 bp, human
ggggcagcggctcctgtcag

SEQ ID NO: 56552 - DNA, 20 bp, human
gagggatcggcaacgagggt

SEQ ID NO: 56553 - DNA, 20 bp, human
gcactgcaaagggtggacgg

SEQ ID NO: 56554 - DNA, 20 bp, human
ggaacggcgcggctaggatc

SEQ ID NO: 56555 - DNA, 20 bp, human
gtggggaggggacggagtgg

SEQ ID NO: 56556 - DNA, 20 bp, human
gtgagtattggaaccagtgc

SEQ ID NO: 56557 - DNA, 20 bp, human
ggagggtctgagccatctag

SEQ ID NO: 56558 - DNA, 20 bp, human
gtacaggactcgcctcctca

SEQ ID NO: 56559 - DNA, 20 bp, human
gccctcctccctataatgag

SEQ ID NO: 56560 - DNA, 20 bp, human
ggtggtcctctgatcaacat

SEQ ID NO: 56561 - DNA, 20 bp, human
gaccagcctatgttgatcag

SEQ ID NO: 56562 - DNA, 20 bp, human
ggaattgttgtttagctcag

SEQ ID NO: 56563 - DNA, 20 bp, human
ggcacctgcctctcattata

SEQ ID NO: 56564 - DNA, 20 bp, human
gcctgcctctcattataggg

SEQ ID NO: 56565 - DNA, 20 bp, human
gcgggtcattctagagagaa

SEQ ID NO: 56566 - DNA, 20 bp, human
gagtcccctcggagggcggt

SEQ ID NO: 56567 - DNA, 20 bp, human
ggggctctgcagagattcgg

SEQ ID NO: 56568 - DNA, 20 bp, human
gggcttccagagaaccgcgg

SEQ ID NO: 56569 - DNA, 20 bp, human
ggggcacgcgcccgccaaga

SEQ ID NO: 56570 - DNA, 20 bp, human
gggctctccagacgccccca

SEQ ID NO: 56571 - DNA, 20 bp, human
gcttctccgggtgggcgtcg

SEQ ID NO: 56572 - DNA, 20 bp, human
gggcttcgcgagagccgtgg

SEQ ID NO: 56573 - DNA, 20 bp, human
gggcattcagagcgcgggaa

SEQ ID NO: 56574 - DNA, 20 bp, human
ggcggcggcgactgacagct

SEQ ID NO: 56575 - DNA, 20 bp, human
gccggcccctgccatcttgg

SEQ ID NO: 56576 - DNA, 20 bp, human
gctggcgaaagacggcagga

SEQ ID NO: 56577 - DNA, 20 bp, human
gcgaaagacggcaggagggc

SEQ ID NO: 56578 - DNA, 20 bp, human
gagccggtaagtgggactgg

SEQ ID NO: 56579 - DNA, 20 bp, human
gagcgggcgtcctcactggc

SEQ ID NO: 56580 - DNA, 20 bp, human
ggcaggcacagccggtaagt

SEQ ID NO: 56581 - DNA, 20 bp, human
gaggggaaggggtcccccaa

SEQ ID NO: 56582 - DNA, 20 bp, human
gcaagggctcccccgccaag

SEQ ID NO: 56583 - DNA, 20 bp, human
ggacgcgcatgcacccacaa

SEQ ID NO: 56584 - DNA, 20 bp, human
ggcgaagcggcctcaatccg

SEQ ID NO: 56585 - DNA, 20 bp, human
gttggctggcgaaagacggc

SEQ ID NO: 56586 - DNA, 20 bp, human
gatggggagccagggagcta

SEQ ID NO: 56587 - DNA, 20 bp, human
gccgaggacaaagggcccag

SEQ ID NO: 56588 - DNA, 20 bp, human
gggctgggcttggctggtga

SEQ ID NO: 56589 - DNA, 20 bp, human
gagctggtgagtgggactag

SEQ ID NO: 56590 - DNA, 20 bp, human
gaggcagcgggcgtccttgc

SEQ ID NO: 56591 - DNA, 20 bp, human
gagcgggagaagtgccggac

SEQ ID NO: 56592 - DNA, 20 bp, human
ggcaagcacagctggtgagt

SEQ ID NO: 56593 - DNA, 20 bp, human
ggcatcaatctgtggcccac

SEQ ID NO: 56594 - DNA, 20 bp, human
gttggtgtcccgaggacaaa

SEQ ID NO: 56595 - DNA, 20 bp, human
ggtgagtgggactaggggat

SEQ ID NO: 56596 - DNA, 20 bp, human
gtgcctgcgagtccatctac

SEQ ID NO: 56597 - DNA, 20 bp, human
gcagaggcggtgcggcacag

SEQ ID NO: 56598 - DNA, 20 bp, human
ggtgccgcaccgcctctggg

SEQ ID NO: 56599 - DNA, 20 bp, human
ggagggctcaggcaaccacg

SEQ ID NO: 56600 - DNA, 20 bp, human
gcgacagcctctccggacag

SEQ ID NO: 56601 - DNA, 20 bp, human
gcttcctcccagaggcggtg

SEQ ID NO: 56602 - DNA, 20 bp, human
ggagaggctgtcgactgagg

SEQ ID NO: 56603 - DNA, 20 bp, human
ggaggagcgctcgcttcaca

SEQ ID NO: 56604 - DNA, 20 bp, human
gtggcctgcgccgaagtgaa

SEQ ID NO: 56605 - DNA, 20 bp, human
gctgcgccgaagtgaagggt

SEQ ID NO: 56606 - DNA, 20 bp, human
gtgagcagcgacgtggaggt

SEQ ID NO: 56607 - DNA, 20 bp, human
gcccagagcgctgtgcaggg

SEQ ID NO: 56608 - DNA, 20 bp, human
ggacatgagcagcgacgtgg

SEQ ID NO: 56609 - DNA, 20 bp, human
ggcggcgccgaggcccccgg

SEQ ID NO: 56610 - DNA, 20 bp, human
gaagccgggccattattcag

SEQ ID NO: 56611 - DNA, 20 bp, human
gctaggcgcagcctatcatt

SEQ ID NO: 56612 - DNA, 20 bp, human
ggctgtcccgtcctaatgat

SEQ ID NO: 56613 - DNA, 20 bp, human
ggccgacatgagcagcgacg

SEQ ID NO: 56614 - DNA, 20 bp, human
gctgctcatgtcggcctcag

SEQ ID NO: 56615 - DNA, 20 bp, human
gcgcagcctatcattaggac

SEQ ID NO: 56616 - DNA, 20 bp, human
gcgtccacgggtgagtatgg

SEQ ID NO: 56617 - DNA, 20 bp, human
gtggcgtccacgggtgagta

SEQ ID NO: 56618 - DNA, 20 bp, human
ggttccaccatactcacccg

SEQ ID NO: 56619 - DNA, 20 bp, human
ggagagaaaatggcgtccac

SEQ ID NO: 56620 - DNA, 20 bp, human
gcagcctgcgggccccccgg

SEQ ID NO: 56621 - DNA, 20 bp, human
gcgcgaggaccgccacacaa

SEQ ID NO: 56622 - DNA, 20 bp, human
gctgcgtgaaggggaggatt

SEQ ID NO: 56623 - DNA, 20 bp, human
gccggcggtttcatagtgac

SEQ ID NO: 56624 - DNA, 20 bp, human
gtccgggcctcccgccacgt

SEQ ID NO: 56625 - DNA, 20 bp, human
gcttcgaggccctgcgtgaa

SEQ ID NO: 56626 - DNA, 20 bp, human
ggcggcggttatcaaatcac

SEQ ID NO: 56627 - DNA, 20 bp, human
gcctctgcggcgtgtgtccc

SEQ ID NO: 56628 - DNA, 20 bp, human
gagaaaggtccgcgacgccg

SEQ ID NO: 56629 - DNA, 20 bp, human
gactggacgttgggccgggc

SEQ ID NO: 56630 - DNA, 20 bp, human
ggcgtcgcggacctttctcc

SEQ ID NO: 56631 - DNA, 20 bp, human
gcgagactggacgttgggcc

SEQ ID NO: 56632 - DNA, 20 bp, human
gaacagacgagactggacgt

SEQ ID NO: 56633 - DNA, 20 bp, human
ggaggaaaaagccctaacga

SEQ ID NO: 56634 - DNA, 20 bp, human
ggaaaaagccctaacgatgg

SEQ ID NO: 56635 - DNA, 20 bp, human
ggcgtgtgtccccggcgtcg

SEQ ID NO: 56636 - DNA, 20 bp, human
gggtctggtagagtctccca

SEQ ID NO: 56637 - DNA, 20 bp, human
gtcccagggagagggtaagg

SEQ ID NO: 56638 - DNA, 20 bp, human
gtaaagacctggaacctgtg

SEQ ID NO: 56639 - DNA, 20 bp, human
gggccctagtgaatccgggt

SEQ ID NO: 56640 - DNA, 20 bp, human
gcgggctcacgttaaagacc

SEQ ID NO: 56641 - DNA, 20 bp, human
gacacgcagcctcgaaggtc

SEQ ID NO: 56642 - DNA, 20 bp, human
gagagggtaagggggtcgaa

SEQ ID NO: 56643 - DNA, 20 bp, human
gacccccttaccctctccct

SEQ ID NO: 56644 - DNA, 20 bp, human
gctgggacacgcagcctcga

SEQ ID NO: 56645 - DNA, 20 bp, human
gcacccacccggattcacta

SEQ ID NO: 56646 - DNA, 20 bp, human
gtcctcggcgagggagcgaa

SEQ ID NO: 56647 - DNA, 20 bp, human
gttccgagcacggacatcac

SEQ ID NO: 56648 - DNA, 20 bp, human
gcggacatcacaggacccgg

SEQ ID NO: 56649 - DNA, 20 bp, human
gataaagccctccgggccag

SEQ ID NO: 56650 - DNA, 20 bp, human
gcacgcccggcgcggaacct

SEQ ID NO: 56651 - DNA, 20 bp, human
gcgctccctcgccgaggagg

SEQ ID NO: 56652 - DNA, 20 bp, human
gcgccgggcgtggacggtgt

SEQ ID NO: 56653 - DNA, 20 bp, human
gagcgcctcctcctcggcga

SEQ ID NO: 56654 - DNA, 20 bp, human
gggcgcccgtcccttctccc

SEQ ID NO: 56655 - DNA, 20 bp, human
gcctgccctccccgggagaa

SEQ ID NO: 56656 - DNA, 20 bp, human
gggccggcaacgcagaacac

SEQ ID NO: 56657 - DNA, 20 bp, human
gtggccagagcacccacggc

SEQ ID NO: 56658 - DNA, 20 bp, human
gcagcttctgcggaaaaatg

SEQ ID NO: 56659 - DNA, 20 bp, human
gcgacgcccctaactcactg

SEQ ID NO: 56660 - DNA, 20 bp, human
gcgggctggagcaggcgcca

SEQ ID NO: 56661 - DNA, 20 bp, human
gggaacccgcgcaaattgaa

SEQ ID NO: 56662 - DNA, 20 bp, human
gaggtctgcagttcagtgaa

SEQ ID NO: 56663 - DNA, 20 bp, human
gcgcgcaggtcgacccccaa

SEQ ID NO: 56664 - DNA, 20 bp, human
gttgccggccgtgggtgctc

SEQ ID NO: 56665 - DNA, 20 bp, human
gtaagagagcagacgattcc

SEQ ID NO: 56666 - DNA, 20 bp, human
gcgggagccgcgcccaccaa

SEQ ID NO: 56667 - DNA, 20 bp, human
gccgactgtgtagtccgctc

SEQ ID NO: 56668 - DNA, 20 bp, human
gccaccaagggagggagacg

SEQ ID NO: 56669 - DNA, 20 bp, human
gagccgcgcccaccaaggga

SEQ ID NO: 56670 - DNA, 20 bp, human
gcctaaagcactgtctccca

SEQ ID NO: 56671 - DNA, 20 bp, human
gctctgggaaggcggtccgt

SEQ ID NO: 56672 - DNA, 20 bp, human
gctggctctgccagaactgt

SEQ ID NO: 56673 - DNA, 20 bp, human
ggggcatgcatggcactccc

SEQ ID NO: 56674 - DNA, 20 bp, human
gaggccgcggcgaaaccagg

SEQ ID NO: 56675 - DNA, 20 bp, human
gacagggagccgtccacctc

SEQ ID NO: 56676 - DNA, 20 bp, human
gcggccgaaggcttaccgca

SEQ ID NO: 56677 - DNA, 20 bp, human
gctaaggcggctcctcagtc

SEQ ID NO: 56678 - DNA, 20 bp, human
gcaggcaccagggtctaagg

SEQ ID NO: 56679 - DNA, 20 bp, human
gcgaggcgggtcttccaaaa

SEQ ID NO: 56680 - DNA, 20 bp, human
gggcggacagacgagctgac

SEQ ID NO: 56681 - DNA, 20 bp, human
ggctgggagggcagtcctca

SEQ ID NO: 56682 - DNA, 20 bp, human
gtccaaaacggagaccggat

SEQ ID NO: 56683 - DNA, 20 bp, human
gcctcgggtctaggagaatg

SEQ ID NO: 56684 - DNA, 20 bp, human
gccattacggttccgcccat

SEQ ID NO: 56685 - DNA, 20 bp, human
gggagacagcagccggactg

SEQ ID NO: 56686 - DNA, 20 bp, human
gggcggaagtgaggtgccgg

SEQ ID NO: 56687 - DNA, 20 bp, human
gctggcggccgcggagtctt

SEQ ID NO: 56688 - DNA, 20 bp, human
gagtcttcggcgagacctac

SEQ ID NO: 56689 - DNA, 20 bp, human
gggtctcgccgaagactccg

SEQ ID NO: 56690 - DNA, 20 bp, human
gctcacggccggcacagaca

SEQ ID NO: 56691 - DNA, 20 bp, human
ggacggctggaggtatgtgt

SEQ ID NO: 56692 - DNA, 20 bp, human
gggcgaagcggcgcagtctg

SEQ ID NO: 56693 - DNA, 20 bp, human
gtcctgccgcagctcacggc

SEQ ID NO: 56694 - DNA, 20 bp, human
gctcgcggcgggcggaagtg

SEQ ID NO: 56695 - DNA, 20 bp, human
ggccgtcctgccgcagctca

SEQ ID NO: 56696 - DNA, 20 bp, human
ggtagccgtagagggtgagt

SEQ ID NO: 56697 - DNA, 20 bp, human
gggcggcggcgtagccgtag

SEQ ID NO: 56698 - DNA, 20 bp, human
gggaggcagcgaaggcggag

SEQ ID NO: 56699 - DNA, 20 bp, human
ggccgtagagggtgagtcgg

SEQ ID NO: 56700 - DNA, 20 bp, human
gggaaggacaccagcgcctg

SEQ ID NO: 56701 - DNA, 20 bp, human
gccacttccggccgggaccc

SEQ ID NO: 56702 - DNA, 20 bp, human
ggcacgagcgggatactcca

SEQ ID NO: 56703 - DNA, 20 bp, human
ggccaccgactcaccctcta

SEQ ID NO: 56704 - DNA, 20 bp, human
gtactccacggggtccggaa

SEQ ID NO: 56705 - DNA, 20 bp, human
ggagggacacctgctccgag

SEQ ID NO: 56706 - DNA, 20 bp, human
gctcagaagggcttagacag

SEQ ID NO: 56707 - DNA, 20 bp, human
gatgtcaagcgagacagagt

SEQ ID NO: 56708 - DNA, 20 bp, human
ggtgggagagagacttcctt

SEQ ID NO: 56709 - DNA, 20 bp, human
ggccggctgcatctcatcct

SEQ ID NO: 56710 - DNA, 20 bp, human
gggagcctcggtgggaagaa

SEQ ID NO: 56711 - DNA, 20 bp, human
gggccctgtgagcaagtggc

SEQ ID NO: 56712 - DNA, 20 bp, human
ggagagacttccttggggag

SEQ ID NO: 56713 - DNA, 20 bp, human
gcaggaccagggtccagtgg

SEQ ID NO: 56714 - DNA, 20 bp, human
gtcataccaggggacaacgc

SEQ ID NO: 56715 - DNA, 20 bp, human
gggcgtgcccagctgcattg

SEQ ID NO: 56716 - DNA, 20 bp, human
gcatccccagagaggtccta

SEQ ID NO: 56717 - DNA, 20 bp, human
gcccagctccccattctcca

SEQ ID NO: 56718 - DNA, 20 bp, human
gaaaccccgcagggtgccag

SEQ ID NO: 56719 - DNA, 20 bp, human
gcccagagaggtcctagggc

SEQ ID NO: 56720 - DNA, 20 bp, human
gagctccccattctccaggg

SEQ ID NO: 56721 - DNA, 20 bp, human
ggtcctagggctggtggaca

SEQ ID NO: 56722 - DNA, 20 bp, human
gaccagccctaggacctctc

SEQ ID NO: 56723 - DNA, 20 bp, human
gcatggccgccctggagaat

SEQ ID NO: 56724 - DNA, 20 bp, human
gaggaggtctgtgaaaagtg

SEQ ID NO: 56725 - DNA, 20 bp, human
gaccaagtgtctctgtacag

SEQ ID NO: 56726 - DNA, 20 bp, human
gaggccctggatggcatcgt

SEQ ID NO: 56727 - DNA, 20 bp, human
ggtgcccacgatgccatcca

SEQ ID NO: 56728 - DNA, 20 bp, human
ggcatcctaggatagctcag

SEQ ID NO: 56729 - DNA, 20 bp, human
gcaggcaggtgcacctggta

SEQ ID NO: 56730 - DNA, 20 bp, human
ggggccagggaaggcatcct

SEQ ID NO: 56731 - DNA, 20 bp, human
gctgtccgcgggctaattag

SEQ ID NO: 56732 - DNA, 20 bp, human
gcaagctgatgcgccggaag

SEQ ID NO: 56733 - DNA, 20 bp, human
gtggctggcagggacagagt

SEQ ID NO: 56734 - DNA, 20 bp, human
gtggccccctaattagcccg

SEQ ID NO: 56735 - DNA, 20 bp, human
ggccgctccccaccttagag

SEQ ID NO: 56736 - DNA, 20 bp, human
ggcgggcttgtgacccgaca

SEQ ID NO: 56737 - DNA, 20 bp, human
ggacagggcggccctcatcc

SEQ ID NO: 56738 - DNA, 20 bp, human
gggcgcgccgacgggcaggg

SEQ ID NO: 56739 - DNA, 20 bp, human
gagttgactctccagttggg

SEQ ID NO: 56740 - DNA, 20 bp, human
ggtgctgcagggcctctacc

SEQ ID NO: 56741 - DNA, 20 bp, human
ggggcggccctcatcccgga

SEQ ID NO: 56742 - DNA, 20 bp, human
ggcggcgcccaggctatcgg

SEQ ID NO: 56743 - DNA, 20 bp, human
gtatggacgtccatggacag

SEQ ID NO: 56744 - DNA, 20 bp, human
gggcttgtgacccgacaggg

SEQ ID NO: 56745 - DNA, 20 bp, human
gtggaggggccaagactgac

SEQ ID NO: 56746 - DNA, 20 bp, human
gtaggctccaaggaagccaa

SEQ ID NO: 56747 - DNA, 20 bp, human
gctccccgcgtccaagatgg

SEQ ID NO: 56748 - DNA, 20 bp, human
ggctctccccgcgtccaaga

SEQ ID NO: 56749 - DNA, 20 bp, human
gtctgccgccatcttggacg

SEQ ID NO: 56750 - DNA, 20 bp, human
ggcaaaagcaaagacccctc

SEQ ID NO: 56751 - DNA, 20 bp, human
gggagagccgctaggctcca

SEQ ID NO: 56752 - DNA, 20 bp, human
ggggctctaacccctcccca

SEQ ID NO: 56753 - DNA, 20 bp, human
gtagagaaaaccaggtgtaa

SEQ ID NO: 56754 - DNA, 20 bp, human
ggggaggggttagagccctg

SEQ ID NO: 56755 - DNA, 20 bp, human
gtaaccccagaaaaaaaagg

SEQ ID NO: 56756 - DNA, 20 bp, human
gccggagctggcgagccgag

SEQ ID NO: 56757 - DNA, 20 bp, human
gagagaggtgcgaaacagaa

SEQ ID NO: 56758 - DNA, 20 bp, human
gccggcggctctacagggag

SEQ ID NO: 56759 - DNA, 20 bp, human
gcgggcggagcgtgaaatgg

SEQ ID NO: 56760 - DNA, 20 bp, human
gcgtatgaggcggtgacaat

SEQ ID NO: 56761 - DNA, 20 bp, human
ggagccaggagcctcaggtt

SEQ ID NO: 56762 - DNA, 20 bp, human
gtcctcgcgggaataatagg

SEQ ID NO: 56763 - DNA, 20 bp, human
gccacttccggcgtatgagg

SEQ ID NO: 56764 - DNA, 20 bp, human
gggtttgcaggcagctgggt

SEQ ID NO: 56765 - DNA, 20 bp, human
gcgggtgtcccaagggagga

SEQ ID NO: 56766 - DNA, 20 bp, human
gctcgcccccgtcgttcccg

SEQ ID NO: 56767 - DNA, 20 bp, human
ggggatgagatctttaccgg

SEQ ID NO: 56768 - DNA, 20 bp, human
gcggagaacagcgagagtct

SEQ ID NO: 56769 - DNA, 20 bp, human
gcccaccacgagcgagacgg

SEQ ID NO: 56770 - DNA, 20 bp, human
gatccgctcgtgctcgggga

SEQ ID NO: 56771 - DNA, 20 bp, human
gtgcggggtgacagctacag

SEQ ID NO: 56772 - DNA, 20 bp, human
gcggcgccgcgggaacgacg

SEQ ID NO: 56773 - DNA, 20 bp, human
ggggcccgaggacacttctg

SEQ ID NO: 56774 - DNA, 20 bp, human
gctgtcaccccgcagccggt

SEQ ID NO: 56775 - DNA, 20 bp, human
gccgggcgggaccgagaagg

SEQ ID NO: 56776 - DNA, 20 bp, human
gtggtgggagcggcattgtg

SEQ ID NO: 56777 - DNA, 20 bp, human
gcggctgtggagcctgtggt

SEQ ID NO: 56778 - DNA, 20 bp, human
gtcggcctgcgggtagccag

SEQ ID NO: 56779 - DNA, 20 bp, human
gcctgagtcactgggctgta

SEQ ID NO: 56780 - DNA, 20 bp, human
gcgcagcgcgtcccctccgt

SEQ ID NO: 56781 - DNA, 20 bp, human
gagcctcggagggagaacga

SEQ ID NO: 56782 - DNA, 20 bp, human
ggagggcgcccgacagatgg

SEQ ID NO: 56783 - DNA, 20 bp, human
ggtgagccgagccgacggag

SEQ ID NO: 56784 - DNA, 20 bp, human
ggggagggtcctgagtcact

SEQ ID NO: 56785 - DNA, 20 bp, human
ggcgtgtcgagcctgaggga

SEQ ID NO: 56786 - DNA, 20 bp, human
gccgcggaggaaagatactg

SEQ ID NO: 56787 - DNA, 20 bp, human
gatcatcgctctgaaccccg

SEQ ID NO: 56788 - DNA, 20 bp, human
ggcgatgattcccccacagg

SEQ ID NO: 56789 - DNA, 20 bp, human
ggaccagctcactaagaaca

SEQ ID NO: 56790 - DNA, 20 bp, human
gagcggaagtgggtgtgacg

SEQ ID NO: 56791 - DNA, 20 bp, human
ggagcggatgcctcctgtgg

SEQ ID NO: 56792 - DNA, 20 bp, human
gtgagtctccccgcagctgg

SEQ ID NO: 56793 - DNA, 20 bp, human
ggtcgcaaggctctccccca

SEQ ID NO: 56794 - DNA, 20 bp, human
gcgggaccaagagcggaagt

SEQ ID NO: 56795 - DNA, 20 bp, human
ggtcgagcggatgcctcctg

SEQ ID NO: 56796 - DNA, 20 bp, human
gcaaggccaaccgagctcct

SEQ ID NO: 56797 - DNA, 20 bp, human
gggctgtctagacccaccca

SEQ ID NO: 56798 - DNA, 20 bp, human
gtgggtctagacagccgcgg

SEQ ID NO: 56799 - DNA, 20 bp, human
gagctcggttggccttgggt

SEQ ID NO: 56800 - DNA, 20 bp, human
gtcctcccctccagaggcgg

SEQ ID NO: 56801 - DNA, 20 bp, human
gcggcaggcagcaacgtaag

SEQ ID NO: 56802 - DNA, 20 bp, human
gcgtaagcgggatgctctcc

SEQ ID NO: 56803 - DNA, 20 bp, human
gggggaggagggagtcggtg

SEQ ID NO: 56804 - DNA, 20 bp, human
ggctctcgcagcagtcggat

SEQ ID NO: 56805 - DNA, 20 bp, human
gacgcactcactgtcactat

SEQ ID NO: 56806 - DNA, 20 bp, human
gcagaaaacgacgggaaccc

SEQ ID NO: 56807 - DNA, 20 bp, human
gaaaacgacgggaaccccgg

SEQ ID NO: 56808 - DNA, 20 bp, human
gggccgagccgggagaataa

SEQ ID NO: 56809 - DNA, 20 bp, human
gatcgcgatgagtaactggg

SEQ ID NO: 56810 - DNA, 20 bp, human
ggaagccgctcagaaaacga

SEQ ID NO: 56811 - DNA, 20 bp, human
ggggccagcgaagggaggac

SEQ ID NO: 56812 - DNA, 20 bp, human
gtcacactccaggtaggagt

SEQ ID NO: 56813 - DNA, 20 bp, human
gcgctgagggagcgttgaca

SEQ ID NO: 56814 - DNA, 20 bp, human
gagaaaacgaagatgcccgg

SEQ ID NO: 56815 - DNA, 20 bp, human
gaatctgggccagcgaaggg

SEQ ID NO: 56816 - DNA, 20 bp, human
ggggaagcgctcacttaccg

SEQ ID NO: 56817 - DNA, 20 bp, human
gtttgggacagcggcaatca

SEQ ID NO: 56818 - DNA, 20 bp, human
gcctatccaggactctgtac

SEQ ID NO: 56819 - DNA, 20 bp, human
ggtgcaccacagcggcgata

SEQ ID NO: 56820 - DNA, 20 bp, human
gggatgcagtatctcacagg

SEQ ID NO: 56821 - DNA, 20 bp, human
ggtggctaagtgcaccacag

SEQ ID NO: 56822 - DNA, 20 bp, human
ggtcagtgaggtggagatag

SEQ ID NO: 56823 - DNA, 20 bp, human
ggaccaacattgtaccactg

SEQ ID NO: 56824 - DNA, 20 bp, human
ggatcaacacaactagtgtg

SEQ ID NO: 56825 - DNA, 20 bp, human
gaatggcgcggtaaaggaag

SEQ ID NO: 56826 - DNA, 20 bp, human
gtggtcgccgacaggaccct

SEQ ID NO: 56827 - DNA, 20 bp, human
gtcgtctcgcgagagcttgt

SEQ ID NO: 56828 - DNA, 20 bp, human
gtgggctcccgggtactggg

SEQ ID NO: 56829 - DNA, 20 bp, human
ggcaagggctagggacgtct

SEQ ID NO: 56830 - DNA, 20 bp, human
gagggctagggacgtctggg

SEQ ID NO: 56831 - DNA, 20 bp, human
gagagctggtcgggtggcta

SEQ ID NO: 56832 - DNA, 20 bp, human
gctgcggagagctggtcggg

SEQ ID NO: 56833 - DNA, 20 bp, human
gggcagcaccatctctccgt

SEQ ID NO: 56834 - DNA, 20 bp, human
gggcgagcgcgacgtcgcaa

SEQ ID NO: 56835 - DNA, 20 bp, human
gccctgggctcccgggtact

SEQ ID NO: 56836 - DNA, 20 bp, human
ggcgcaggcgcagctcagtc

SEQ ID NO: 56837 - DNA, 20 bp, human
gccgtagtgattgtatcccc

SEQ ID NO: 56838 - DNA, 20 bp, human
gtaactccccgcgggaccca

SEQ ID NO: 56839 - DNA, 20 bp, human
gctgcgcctgcgcaactcat

SEQ ID NO: 56840 - DNA, 20 bp, human
gctccactcctgacctccgg

SEQ ID NO: 56841 - DNA, 20 bp, human
gagcctcttagcgagagact

SEQ ID NO: 56842 - DNA, 20 bp, human
gggcccagtctctcgctaag

SEQ ID NO: 56843 - DNA, 20 bp, human
gcaaaagtcacagccaccgg

SEQ ID NO: 56844 - DNA, 20 bp, human
gttacacacacagggatacg

SEQ ID NO: 56845 - DNA, 20 bp, human
ggctcggaagcgaggtgtgt

SEQ ID NO: 56846 - DNA, 20 bp, human
gtgtttggtggagcccgcga

SEQ ID NO: 56847 - DNA, 20 bp, human
gtcgcggctgaatctctcgc

SEQ ID NO: 56848 - DNA, 20 bp, human
gagaagtgggcacaagacta

SEQ ID NO: 56849 - DNA, 20 bp, human
gagtgggcacaagactacgg

SEQ ID NO: 56850 - DNA, 20 bp, human
ggccgaacctgcgtctgtcg

SEQ ID NO: 56851 - DNA, 20 bp, human
gacgcaggttcggccatcgc

SEQ ID NO: 56852 - DNA, 20 bp, human
ggcgctgcacgcacagtact

SEQ ID NO: 56853 - DNA, 20 bp, human
gggtggtgcggcagtgagag

SEQ ID NO: 56854 - DNA, 20 bp, human
ggtcacaaggagcccggcag

SEQ ID NO: 56855 - DNA, 20 bp, human
ggcacgcacagtactaggtc

SEQ ID NO: 56856 - DNA, 20 bp, human
gggcgcgccgcccgtccacc

SEQ ID NO: 56857 - DNA, 20 bp, human
gtggagctcttgtcggacca

SEQ ID NO: 56858 - DNA, 20 bp, human
gggacagaggccgatgagaa

SEQ ID NO: 56859 - DNA, 20 bp, human
gagtaggcagagagcggacc

SEQ ID NO: 56860 - DNA, 20 bp, human
gaccaccgcgcagcacacta

SEQ ID NO: 56861 - DNA, 20 bp, human
ggcggccgggcagcatggcg

SEQ ID NO: 56862 - DNA, 20 bp, human
gggagaactacagctcccgg

SEQ ID NO: 56863 - DNA, 20 bp, human
gtcggaccagggctaccggg

SEQ ID NO: 56864 - DNA, 20 bp, human
gtgaagagccgcaaagagga

SEQ ID NO: 56865 - DNA, 20 bp, human
gccagggctaccgggtggac

SEQ ID NO: 56866 - DNA, 20 bp, human
ggggctcggcgcgatggagg

SEQ ID NO: 56867 - DNA, 20 bp, human
gggcagcgcgcgccgcaaac

SEQ ID NO: 56868 - DNA, 20 bp, human
gatcgcgccgagcccacgtg

SEQ ID NO: 56869 - DNA, 20 bp, human
gtgcggcgcgcgctgccagg

SEQ ID NO: 56870 - DNA, 20 bp, human
ggctgcagccaggaccccga

SEQ ID NO: 56871 - DNA, 20 bp, human
ggctggtatcgtgaggaggt

SEQ ID NO: 56872 - DNA, 20 bp, human
gtgcagttgtcacttccgcc

SEQ ID NO: 56873 - DNA, 20 bp, human
gaccagctggtatcgtgagg

SEQ ID NO: 56874 - DNA, 20 bp, human
gcaaggtaagaacttcaccc

SEQ ID NO: 56875 - DNA, 20 bp, human
gcactcggttgcacagtaca

SEQ ID NO: 56876 - DNA, 20 bp, human
ggcctgtcgcgggcccgaca

SEQ ID NO: 56877 - DNA, 20 bp, human
gggatgcggcggtgatcccc

SEQ ID NO: 56878 - DNA, 20 bp, human
gcggcggtgatccccaggca

SEQ ID NO: 56879 - DNA, 20 bp, human
gcggcggctgcgattcttca

SEQ ID NO: 56880 - DNA, 20 bp, human
gaagggctcggcctacctgg

SEQ ID NO: 56881 - DNA, 20 bp, human
ggtgcctcccgcctccaggt

SEQ ID NO: 56882 - DNA, 20 bp, human
gacggaagaaccagtggatg

SEQ ID NO: 56883 - DNA, 20 bp, human
gcgtcggccgcgtacagctg

SEQ ID NO: 56884 - DNA, 20 bp, human
gttcttcagggccgcggatg

SEQ ID NO: 56885 - DNA, 20 bp, human
ggatgcggcagggcgttggg

SEQ ID NO: 56886 - DNA, 20 bp, human
ggggggcgcggtccagagga

SEQ ID NO: 56887 - DNA, 20 bp, human
gagaaggtgtacatcgtgca

SEQ ID NO: 56888 - DNA, 20 bp, human
gagatgacgtgcggctcgtg

SEQ ID NO: 56889 - DNA, 20 bp, human
ggtccaggtagctacagcag

SEQ ID NO: 56890 - DNA, 20 bp, human
gatgcgccctcctaaccacg

SEQ ID NO: 56891 - DNA, 20 bp, human
gagggccaggctgaacccgg

SEQ ID NO: 56892 - DNA, 20 bp, human
gctcctcactggcaaaccca

SEQ ID NO: 56893 - DNA, 20 bp, human
ggaaatgggagtttggaggt

SEQ ID NO: 56894 - DNA, 20 bp, human
gtgagagagcatcggcccca

SEQ ID NO: 56895 - DNA, 20 bp, human
gtacatcgtgcatggcgtcc

SEQ ID NO: 56896 - DNA, 20 bp, human
gtcaagtgagtgttggcggg

SEQ ID NO: 56897 - DNA, 20 bp, human
gaggaagctgccgtccgcca

SEQ ID NO: 56898 - DNA, 20 bp, human
ggctgggttcaagtgagtgt

SEQ ID NO: 56899 - DNA, 20 bp, human
ggagcccttgaccagtgaag

SEQ ID NO: 56900 - DNA, 20 bp, human
gcagtgagacgggagatgaa

SEQ ID NO: 56901 - DNA, 20 bp, human
gagttctgtaccctggcgga

SEQ ID NO: 56902 - DNA, 20 bp, human
ggtagagttctgtaccctgg

SEQ ID NO: 56903 - DNA, 20 bp, human
gagtgagtgttggcgggtgg

SEQ ID NO: 56904 - DNA, 20 bp, human
gcgggtagagttctgtaccc

SEQ ID NO: 56905 - DNA, 20 bp, human
gcctggccttgcctcttcac

SEQ ID NO: 56906 - DNA, 20 bp, human
gcggcgcgcaaggaaagatc

SEQ ID NO: 56907 - DNA, 20 bp, human
ggttgggtcaccggccccac

SEQ ID NO: 56908 - DNA, 20 bp, human
gccacaggcaccagaatccg

SEQ ID NO: 56909 - DNA, 20 bp, human
ggggcccggggagctactag

SEQ ID NO: 56910 - DNA, 20 bp, human
gtgcgcctcggggcgagcag

SEQ ID NO: 56911 - DNA, 20 bp, human
gccagaatccgcgggaaaaa

SEQ ID NO: 56912 - DNA, 20 bp, human
ggagctactaggggaacgac

SEQ ID NO: 56913 - DNA, 20 bp, human
gcggtgacccaacaccatga

SEQ ID NO: 56914 - DNA, 20 bp, human
gggcgttcgcagtttgagag

SEQ ID NO: 56915 - DNA, 20 bp, human
ggatggcacggagtaggaag

SEQ ID NO: 56916 - DNA, 20 bp, human
gttttagactttcaaagggg

SEQ ID NO: 56917 - DNA, 20 bp, human
gctccttggcgcctcctgtt

SEQ ID NO: 56918 - DNA, 20 bp, human
ggagcccgtctggtatgtgg

SEQ ID NO: 56919 - DNA, 20 bp, human
ggccgagcccgtctggtatg

SEQ ID NO: 56920 - DNA, 20 bp, human
gagccgctcggagcaccccc

SEQ ID NO: 56921 - DNA, 20 bp, human
gggccgagaaggacaggatc

SEQ ID NO: 56922 - DNA, 20 bp, human
gcgtgaaactggtcttgtac

SEQ ID NO: 56923 - DNA, 20 bp, human
gccgtctggtatgtggtggg

SEQ ID NO: 56924 - DNA, 20 bp, human
gttggcgcctcctgttagga

SEQ ID NO: 56925 - DNA, 20 bp, human
ggggaacgcccacacctgaa

SEQ ID NO: 56926 - DNA, 20 bp, human
gctgccgagaggaatccgag

SEQ ID NO: 56927 - DNA, 20 bp, human
ggctcccgatacccaatcaa

SEQ ID NO: 56928 - DNA, 20 bp, human
gattcggcgaccgaacgcgg

SEQ ID NO: 56929 - DNA, 20 bp, human
gaacattcggcgaccgaacg

SEQ ID NO: 56930 - DNA, 20 bp, human
gggcgaccgaacgcggcggt

SEQ ID NO: 56931 - DNA, 20 bp, human
gttcagaaccgggtaacatt

SEQ ID NO: 56932 - DNA, 20 bp, human
ggagaggaatccgagaggca

SEQ ID NO: 56933 - DNA, 20 bp, human
gcttgcatgcaacaagacgg

SEQ ID NO: 56934 - DNA, 20 bp, human
gagcggctccaagactccgg

SEQ ID NO: 56935 - DNA, 20 bp, human
gtgctctgcacggagagtgg

SEQ ID NO: 56936 - DNA, 20 bp, human
ggttggctaggagaacaggt

SEQ ID NO: 56937 - DNA, 20 bp, human
gccagactcggccctggcag

SEQ ID NO: 56938 - DNA, 20 bp, human
gaggtaagcgcggctctcca

SEQ ID NO: 56939 - DNA, 20 bp, human
gtaagcgcggctctccaggg

SEQ ID NO: 56940 - DNA, 20 bp, human
ggccagggccgagtctgggc

SEQ ID NO: 56941 - DNA, 20 bp, human
ggggcgggtcgcaggaggaa

SEQ ID NO: 56942 - DNA, 20 bp, human
gcgctgctgggtcgggacaa

SEQ ID NO: 56943 - DNA, 20 bp, human
ggaaggttggctaggagaac

SEQ ID NO: 56944 - DNA, 20 bp, human
gtgtcagacggcccggatcc

SEQ ID NO: 56945 - DNA, 20 bp, human
gcgagcagcgagcgaggggc

SEQ ID NO: 56946 - DNA, 20 bp, human
ggatgggaggagataccata

SEQ ID NO: 56947 - DNA, 20 bp, human
ggaccagtcagagctcccac

SEQ ID NO: 56948 - DNA, 20 bp, human
gagataccatagggtttggg

SEQ ID NO: 56949 - DNA, 20 bp, human
gcagtcagagctcccacagg

SEQ ID NO: 56950 - DNA, 20 bp, human
ggggctgctcaggcaagggg

SEQ ID NO: 56951 - DNA, 20 bp, human
gaggcggcttggccagggac

SEQ ID NO: 56952 - DNA, 20 bp, human
ggagctctgactggtcccca

SEQ ID NO: 56953 - DNA, 20 bp, human
gctccaaggcagggggacac

SEQ ID NO: 56954 - DNA, 20 bp, human
gttgccctcaactgagagga

SEQ ID NO: 56955 - DNA, 20 bp, human
gcgtctgccagcgggcacag

SEQ ID NO: 56956 - DNA, 20 bp, human
gaagtgagcgcctggagcaa

SEQ ID NO: 56957 - DNA, 20 bp, human
gcaggcgctcactttgcggg

SEQ ID NO: 56958 - DNA, 20 bp, human
ggagcgtcaccgaaagggag

SEQ ID NO: 56959 - DNA, 20 bp, human
gagggaggggcggccactcg

SEQ ID NO: 56960 - DNA, 20 bp, human
gattagctggattaacaacc

SEQ ID NO: 56961 - DNA, 20 bp, human
ggcaagggacagtccccgag

SEQ ID NO: 56962 - DNA, 20 bp, human
ggaagtggagcgtcaccgaa

SEQ ID NO: 56963 - DNA, 20 bp, human
gtgcgggcggcactttttcc

SEQ ID NO: 56964 - DNA, 20 bp, human
gatctactgcactcgaggta

SEQ ID NO: 56965 - DNA, 20 bp, human
ggctccaggcgctcactttg

SEQ ID NO: 56966 - DNA, 20 bp, human
gcgccggaaatggccgaagc

SEQ ID NO: 56967 - DNA, 20 bp, human
ggccgggcgccggggattgt

SEQ ID NO: 56968 - DNA, 20 bp, human
ggtcccgagcagcccaaact

SEQ ID NO: 56969 - DNA, 20 bp, human
gggagggctaacgggtccct

SEQ ID NO: 56970 - DNA, 20 bp, human
gcccaaactgggacgagaga

SEQ ID NO: 56971 - DNA, 20 bp, human
ggacgagagagggcgtgtgg

SEQ ID NO: 56972 - DNA, 20 bp, human
gcgcgcccggaagggctcat

SEQ ID NO: 56973 - DNA, 20 bp, human
ggcgcggccagcagtcctac

SEQ ID NO: 56974 - DNA, 20 bp, human
gcgccgcgggtcacagaggg

SEQ ID NO: 56975 - DNA, 20 bp, human
gcggcagccgggagggctaa

SEQ ID NO: 56976 - DNA, 20 bp, human
gtgccttccccccctgacaa

SEQ ID NO: 56977 - DNA, 20 bp, human
gatagatatgggtcacagaa

SEQ ID NO: 56978 - DNA, 20 bp, human
gttccccccctgacaagggg

SEQ ID NO: 56979 - DNA, 20 bp, human
gtgaatgtgtaatgagaatc

SEQ ID NO: 56980 - DNA, 20 bp, human
ggttaagtaatttccaacag

SEQ ID NO: 56981 - DNA, 20 bp, human
gcccccctgacaaggggagg

SEQ ID NO: 56982 - DNA, 20 bp, human
gggctatagtttctagtgtt

SEQ ID NO: 56983 - DNA, 20 bp, human
gtctgaattcaaactagaaa

SEQ ID NO: 56984 - DNA, 20 bp, human
gtatccttacctgcaacttg

SEQ ID NO: 56985 - DNA, 20 bp, human
gcctcctcctccccttgtca

SEQ ID NO: 56986 - DNA, 20 bp, human
gcttccccaccaaacagcag

SEQ ID NO: 56987 - DNA, 20 bp, human
ggagtggagcgcctctgcag

SEQ ID NO: 56988 - DNA, 20 bp, human
gctgttaccaaacagaacgg

SEQ ID NO: 56989 - DNA, 20 bp, human
gaagctgttaccaaacagaa

SEQ ID NO: 56990 - DNA, 20 bp, human
ggctatctgccgctgctgtt

SEQ ID NO: 56991 - DNA, 20 bp, human
gacagaacggtgggagctga

SEQ ID NO: 56992 - DNA, 20 bp, human
gacagtggacggcaacagga

SEQ ID NO: 56993 - DNA, 20 bp, human
gagaaacccgccacagtgga

SEQ ID NO: 56994 - DNA, 20 bp, human
gccaggagcaaaactatgtc

SEQ ID NO: 56995 - DNA, 20 bp, human
ggaaggcttaaagtcggaag

SEQ ID NO: 56996 - DNA, 20 bp, human
ggacgaggccgggctgactg

SEQ ID NO: 56997 - DNA, 20 bp, human
gcgcgggagagcaaacttca

SEQ ID NO: 56998 - DNA, 20 bp, human
gcttggcgagtgccagaaag

SEQ ID NO: 56999 - DNA, 20 bp, human
gcgcgcaggcggtgtagacg

SEQ ID NO: 57000 - DNA, 20 bp, human
gaggccgggctgactgcggc

SEQ ID NO: 57001 - DNA, 20 bp, human
ggcagagcccccctctggaa

SEQ ID NO: 57002 - DNA, 20 bp, human
gtggagagggcgccccgacg

SEQ ID NO: 57003 - DNA, 20 bp, human
gggccggtgcgggtccgacg

SEQ ID NO: 57004 - DNA, 20 bp, human
ggtgcgggtccgacgaggcc

SEQ ID NO: 57005 - DNA, 20 bp, human
gcagcagcagagcccccctc

SEQ ID NO: 57006 - DNA, 20 bp, human
gctcccacccacaaggaccg

SEQ ID NO: 57007 - DNA, 20 bp, human
gagtagaaccaatcgagcgg

SEQ ID NO: 57008 - DNA, 20 bp, human
gaatcgagcggaggaaaccg

SEQ ID NO: 57009 - DNA, 20 bp, human
gcacagtagaaccaatcgag

SEQ ID NO: 57010 - DNA, 20 bp, human
gcgctgagatcccagatcag

SEQ ID NO: 57011 - DNA, 20 bp, human
ggcagctgagactcacccaa

SEQ ID NO: 57012 - DNA, 20 bp, human
ggtggctgagagaagcgctg

SEQ ID NO: 57013 - DNA, 20 bp, human
gagagaagcgctgaggcgta

SEQ ID NO: 57014 - DNA, 20 bp, human
gggcgtaaggcaagaaaccg

SEQ ID NO: 57015 - DNA, 20 bp, human
gccgggtcacgctaacgccg

SEQ ID NO: 57016 - DNA, 20 bp, human
gagctctttccccctctcta

SEQ ID NO: 57017 - DNA, 20 bp, human
gaggcagcgacaacttcacg

SEQ ID NO: 57018 - DNA, 20 bp, human
ggttgtcgctgccttagaga

SEQ ID NO: 57019 - DNA, 20 bp, human
gcgggaacccgaggcggacc

SEQ ID NO: 57020 - DNA, 20 bp, human
gggctcccccgggagccctg

SEQ ID NO: 57021 - DNA, 20 bp, human
gcgaggcggaccgggcgacg

SEQ ID NO: 57022 - DNA, 20 bp, human
gcaacttcacgtggacagga

SEQ ID NO: 57023 - DNA, 20 bp, human
ggggcgggggttggaagaag

SEQ ID NO: 57024 - DNA, 20 bp, human
gagccggggagtgacgactg

SEQ ID NO: 57025 - DNA, 20 bp, human
ggggagaagccggctccgag

SEQ ID NO: 57026 - DNA, 20 bp, human
gggaggcttgcaaccctagg

SEQ ID NO: 57027 - DNA, 20 bp, human
gcgtaatcagaagcctccta

SEQ ID NO: 57028 - DNA, 20 bp, human
gccccaaccattagccaagg

SEQ ID NO: 57029 - DNA, 20 bp, human
gagcctccttggctaatggt

SEQ ID NO: 57030 - DNA, 20 bp, human
gtgtatatgctagcagacaa

SEQ ID NO: 57031 - DNA, 20 bp, human
gaaatcctgtatctcaaagg

SEQ ID NO: 57032 - DNA, 20 bp, human
gaaacaaagtgatacacgct

SEQ ID NO: 57033 - DNA, 20 bp, human
gtctgattacggttaatgtc

SEQ ID NO: 57034 - DNA, 20 bp, human
gtttgtagttgtgttcagct

SEQ ID NO: 57035 - DNA, 20 bp, human
gaaagaagctttattggatt

SEQ ID NO: 57036 - DNA, 20 bp, human
gacccgcggctcgggatgga

SEQ ID NO: 57037 - DNA, 20 bp, human
gcgggacccgcggctcggga

SEQ ID NO: 57038 - DNA, 20 bp, human
ggtcctagcagcgggacccg

SEQ ID NO: 57039 - DNA, 20 bp, human
gtggggagggctagagaccg

SEQ ID NO: 57040 - DNA, 20 bp, human
gcgcgcatgcgtcctagcag

SEQ ID NO: 57041 - DNA, 20 bp, human
gccaccctcggaatgaggag

SEQ ID NO: 57042 - DNA, 20 bp, human
gtgagtgagtaaacaagcct

SEQ ID NO: 57043 - DNA, 20 bp, human
gcaccctccatcccgagccg

SEQ ID NO: 57044 - DNA, 20 bp, human
gctttagcgaggtggactct

SEQ ID NO: 57045 - DNA, 20 bp, human
ggcgcccctcctcattccga

SEQ ID NO: 57046 - DNA, 20 bp, human
ggccccgctcggcgataccc

SEQ ID NO: 57047 - DNA, 20 bp, human
gccggaccgagcgccaaacg

SEQ ID NO: 57048 - DNA, 20 bp, human
ggtcgcgtccgacacccggt

SEQ ID NO: 57049 - DNA, 20 bp, human
gccgcggccgcgccacacaa

SEQ ID NO: 57050 - DNA, 20 bp, human
gtccggtgcccggtccaggg

SEQ ID NO: 57051 - DNA, 20 bp, human
gtctgagtcccaccgggtgt

SEQ ID NO: 57052 - DNA, 20 bp, human
gtccggtcgcgtccgacacc

SEQ ID NO: 57053 - DNA, 20 bp, human
gccaggacaagcaccgggaa

SEQ ID NO: 57054 - DNA, 20 bp, human
ggctcggcgatacccgggac

SEQ ID NO: 57055 - DNA, 20 bp, human
gccgcgggaccctgcgagtg

SEQ ID NO: 57056 - DNA, 20 bp, human
ggcgcactcggcggacgcaa

SEQ ID NO: 57057 - DNA, 20 bp, human
gcactcggcggacgcaaggg

SEQ ID NO: 57058 - DNA, 20 bp, human
ggcactgcaggcgccgggtg

SEQ ID NO: 57059 - DNA, 20 bp, human
ggggcagcgagcgcactcgg

SEQ ID NO: 57060 - DNA, 20 bp, human
gcgagtgctcggcttctcac

SEQ ID NO: 57061 - DNA, 20 bp, human
gtccgccgaggaacttcccg

SEQ ID NO: 57062 - DNA, 20 bp, human
gggagcacacggagcactgc

SEQ ID NO: 57063 - DNA, 20 bp, human
gctcgctggggagggatccg

SEQ ID NO: 57064 - DNA, 20 bp, human
ggcagccccgggaagttcct

SEQ ID NO: 57065 - DNA, 20 bp, human
gccttcgggagagacctgag

SEQ ID NO: 57066 - DNA, 20 bp, human
ggggcgggcgggcgctctaa

SEQ ID NO: 57067 - DNA, 20 bp, human
gcgaagacgctgtcccaacc

SEQ ID NO: 57068 - DNA, 20 bp, human
gagggttctgctctgactcc

SEQ ID NO: 57069 - DNA, 20 bp, human
gtctgctctgactccaggtt

SEQ ID NO: 57070 - DNA, 20 bp, human
gcgctgcgggcgccgagtgt

SEQ ID NO: 57071 - DNA, 20 bp, human
gcgcagaagacgataggaat

SEQ ID NO: 57072 - DNA, 20 bp, human
ggggcgccgagtgtcgggcg

SEQ ID NO: 57073 - DNA, 20 bp, human
ggaaaagaccgtaactactg

SEQ ID NO: 57074 - DNA, 20 bp, human
ggagaggcttcattggagag

SEQ ID NO: 57075 - DNA, 20 bp, human
gaccgtaactactggggagg

SEQ ID NO: 57076 - DNA, 20 bp, human
gggaggcactgagcaggacg

SEQ ID NO: 57077 - DNA, 20 bp, human
gaggacagggacacagtact

SEQ ID NO: 57078 - DNA, 20 bp, human
gcagtgggcgccccatggtg

SEQ ID NO: 57079 - DNA, 20 bp, human
gcagggaggcacaggacgag

SEQ ID NO: 57080 - DNA, 20 bp, human
ggccatctgccaccacaggg

SEQ ID NO: 57081 - DNA, 20 bp, human
gaggtgcagtgggcgcccca

SEQ ID NO: 57082 - DNA, 20 bp, human
gcagcctctggcagcactca

SEQ ID NO: 57083 - DNA, 20 bp, human
ggagcaggacgaggtgcagt

SEQ ID NO: 57084 - DNA, 20 bp, human
gggagacacagtgagatggg

SEQ ID NO: 57085 - DNA, 20 bp, human
gaacggagacacagtgagat

SEQ ID NO: 57086 - DNA, 20 bp, human
gacacaagctcattcagagg

SEQ ID NO: 57087 - DNA, 20 bp, human
gcctacacaagctcattcag

SEQ ID NO: 57088 - DNA, 20 bp, human
ggattagttatggatattag

SEQ ID NO: 57089 - DNA, 20 bp, human
gttgctgcaattcttaataa

SEQ ID NO: 57090 - DNA, 20 bp, human
ggtacctgaaaagaccttgt

SEQ ID NO: 57091 - DNA, 20 bp, human
gctttggctagcaggcacac

SEQ ID NO: 57092 - DNA, 20 bp, human
gtgcagcaagtaagccaaca

SEQ ID NO: 57093 - DNA, 20 bp, human
gtggagataaatagatttat

SEQ ID NO: 57094 - DNA, 20 bp, human
gaatgagcttgtgtaggaaa

SEQ ID NO: 57095 - DNA, 20 bp, human
gtatccataactaatctgag

SEQ ID NO: 57096 - DNA, 20 bp, human
ggttcccaggagtccttcgg

SEQ ID NO: 57097 - DNA, 20 bp, human
gcgcgctgggtagatgagtg

SEQ ID NO: 57098 - DNA, 20 bp, human
gtctgttcccaggagtcctt

SEQ ID NO: 57099 - DNA, 20 bp, human
ggtacactcctcgtcctcac

SEQ ID NO: 57100 - DNA, 20 bp, human
gctcactggagagggccgtc

SEQ ID NO: 57101 - DNA, 20 bp, human
ggctccgcgactacagcgag

SEQ ID NO: 57102 - DNA, 20 bp, human
gaggacgaggagtgtacctc

SEQ ID NO: 57103 - DNA, 20 bp, human
gacagccgccgaaggactcc

SEQ ID NO: 57104 - DNA, 20 bp, human
gccctcctggtggccgtgag

SEQ ID NO: 57105 - DNA, 20 bp, human
gcttcggcggctgttgtgtc

SEQ ID NO: 57106 - DNA, 20 bp, human
ggccgcactccggagactcg

SEQ ID NO: 57107 - DNA, 20 bp, human
gggcagctgggaccatccca

SEQ ID NO: 57108 - DNA, 20 bp, human
gcaacatcccgggtataggg

SEQ ID NO: 57109 - DNA, 20 bp, human
ggtgcgctctcgcgaggagg

SEQ ID NO: 57110 - DNA, 20 bp, human
gagatgttgcaggcgccgag

SEQ ID NO: 57111 - DNA, 20 bp, human
gtggcaaagaacctcctgaa

SEQ ID NO: 57112 - DNA, 20 bp, human
gagaccggatccggaagcaa

SEQ ID NO: 57113 - DNA, 20 bp, human
gcagaggaccaagagaaccg

SEQ ID NO: 57114 - DNA, 20 bp, human
gggcagcgcccctcccggta

SEQ ID NO: 57115 - DNA, 20 bp, human
gcgtagcaaccgcgagtctc

SEQ ID NO: 57116 - DNA, 20 bp, human
gaggcagctggaccaacgga

SEQ ID NO: 57117 - DNA, 20 bp, human
gcaacggacggatgccatga

SEQ ID NO: 57118 - DNA, 20 bp, human
gcagactagcaacagatcgg

SEQ ID NO: 57119 - DNA, 20 bp, human
gtcccaaggtggaatctaca

SEQ ID NO: 57120 - DNA, 20 bp, human
gggagacagacaaccagact

SEQ ID NO: 57121 - DNA, 20 bp, human
ggccttaagaagacaacggg

SEQ ID NO: 57122 - DNA, 20 bp, human
gatgggccttaagaagacaa

SEQ ID NO: 57123 - DNA, 20 bp, human
gggtgactaggaggcctatg

SEQ ID NO: 57124 - DNA, 20 bp, human
gttggtccagctgcctatcc

SEQ ID NO: 57125 - DNA, 20 bp, human
gcctgtgggtccaggtgact

SEQ ID NO: 57126 - DNA, 20 bp, human
gccagccccacgcggcgcac

SEQ ID NO: 57127 - DNA, 20 bp, human
gcgcttcgccggcaaggctg

SEQ ID NO: 57128 - DNA, 20 bp, human
gagtgggccgttcctggtca

SEQ ID NO: 57129 - DNA, 20 bp, human
gttcctgtagccacacgacg

SEQ ID NO: 57130 - DNA, 20 bp, human
gtgaagcctaggggacaccg

SEQ ID NO: 57131 - DNA, 20 bp, human
gtctgccggtgcgccgcgtg

SEQ ID NO: 57132 - DNA, 20 bp, human
gcgccgggcgagctagattc

SEQ ID NO: 57133 - DNA, 20 bp, human
gcgcggaactggggactggg

SEQ ID NO: 57134 - DNA, 20 bp, human
gctcagtcccagaccccggg

SEQ ID NO: 57135 - DNA, 20 bp, human
ggggtgacccctccgcccca

SEQ ID NO: 57136 - DNA, 20 bp, human
gtccagaggtgccctcgcgt

SEQ ID NO: 57137 - DNA, 20 bp, human
gacagagcaagcccacgcga

SEQ ID NO: 57138 - DNA, 20 bp, human
gtcatagggtgcagggtcgg

SEQ ID NO: 57139 - DNA, 20 bp, human
gccgtttgaggaagtccccg

SEQ ID NO: 57140 - DNA, 20 bp, human
gcagcgggccctggctcata

SEQ ID NO: 57141 - DNA, 20 bp, human
gtatggagctggaacacaaa

SEQ ID NO: 57142 - DNA, 20 bp, human
ggtgcagaaggtggacgcag

SEQ ID NO: 57143 - DNA, 20 bp, human
ggccctgtggcgccggtcac

SEQ ID NO: 57144 - DNA, 20 bp, human
gttcctcagggagcagatta

SEQ ID NO: 57145 - DNA, 20 bp, human
ggttggaggtgcttccccaa

SEQ ID NO: 57146 - DNA, 20 bp, human
gaagcacaccactgaagatg

SEQ ID NO: 57147 - DNA, 20 bp, human
gcaatatgatgataaaagtc

SEQ ID NO: 57148 - DNA, 20 bp, human
gtaaggtgagagtttaatgt

SEQ ID NO: 57149 - DNA, 20 bp, human
gttttcaacctcatcttcag

SEQ ID NO: 57150 - DNA, 20 bp, human
gatgccccctagagatacaa

SEQ ID NO: 57151 - DNA, 20 bp, human
gggatctaaatacttcgaaa

SEQ ID NO: 57152 - DNA, 20 bp, human
gaaacccttgtatctctagg

SEQ ID NO: 57153 - DNA, 20 bp, human
ggttttgtcagtattaggaa

SEQ ID NO: 57154 - DNA, 20 bp, human
gcaggagaactctatgcaga

SEQ ID NO: 57155 - DNA, 20 bp, human
gtacaagttttgtcagtatt

SEQ ID NO: 57156 - DNA, 20 bp, human
gctgtgcacaaggctacaca

SEQ ID NO: 57157 - DNA, 20 bp, human
ggcagtcttggccattctgg

SEQ ID NO: 57158 - DNA, 20 bp, human
gaggagccaggaacactgta

SEQ ID NO: 57159 - DNA, 20 bp, human
gacactatggcgcacgtccg

SEQ ID NO: 57160 - DNA, 20 bp, human
gcaggaacactgtaaggcgg

SEQ ID NO: 57161 - DNA, 20 bp, human
ggccccaggcggccagctta

SEQ ID NO: 57162 - DNA, 20 bp, human
gacactgtaaggcggtgggg

SEQ ID NO: 57163 - DNA, 20 bp, human
gggggctgagacctacttag

SEQ ID NO: 57164 - DNA, 20 bp, human
gcccagcctgctccctatat

SEQ ID NO: 57165 - DNA, 20 bp, human
ggcagcgaccgtgcttgctg

SEQ ID NO: 57166 - DNA, 20 bp, human
ggtgcccacgggtaagatca

SEQ ID NO: 57167 - DNA, 20 bp, human
gggaccctgatcttacccgt

SEQ ID NO: 57168 - DNA, 20 bp, human
gtcagggtccaagcgaccct

SEQ ID NO: 57169 - DNA, 20 bp, human
gtggctttcggaggaaactg

SEQ ID NO: 57170 - DNA, 20 bp, human
gtcggcgagcgctgtgtctg

SEQ ID NO: 57171 - DNA, 20 bp, human
gtcggctgggcccgcgaagg

SEQ ID NO: 57172 - DNA, 20 bp, human
ggtcggggagccggtcttcg

SEQ ID NO: 57173 - DNA, 20 bp, human
gggccaggtgagagatgcac

SEQ ID NO: 57174 - DNA, 20 bp, human
gtccaagatcgagtccaaag

SEQ ID NO: 57175 - DNA, 20 bp, human
gtgcgcggcgctgctccggg

SEQ ID NO: 57176 - DNA, 20 bp, human
gcagcagaggctccgattcg

SEQ ID NO: 57177 - DNA, 20 bp, human
gccgattcggggcaggtgag

SEQ ID NO: 57178 - DNA, 20 bp, human
gtctgctgcgcgcctcccca

SEQ ID NO: 57179 - DNA, 20 bp, human
gaacctaacccgccctgggg

SEQ ID NO: 57180 - DNA, 20 bp, human
ggccaaggaggcacccaggt

SEQ ID NO: 57181 - DNA, 20 bp, human
gggcacccaggtgggacatg

SEQ ID NO: 57182 - DNA, 20 bp, human
gcctgcagtggcaccatcca

SEQ ID NO: 57183 - DNA, 20 bp, human
ggctcccgcatgtcccacct

SEQ ID NO: 57184 - DNA, 20 bp, human
gctgcgccaaggaggcaccc

SEQ ID NO: 57185 - DNA, 20 bp, human
gtgagaggctgactttctct

SEQ ID NO: 57186 - DNA, 20 bp, human
gctttccctgcggaggacca

SEQ ID NO: 57187 - DNA, 20 bp, human
gctgctgacacatggaactg

SEQ ID NO: 57188 - DNA, 20 bp, human
gtttcctgcctgcacggcac

SEQ ID NO: 57189 - DNA, 20 bp, human
gtaccactctgacaaaaagt

SEQ ID NO: 57190 - DNA, 20 bp, human
ggaacacttagtctatgacc

SEQ ID NO: 57191 - DNA, 20 bp, human
gtccatgtgtcagcagcaaa

SEQ ID NO: 57192 - DNA, 20 bp, human
ggatgtctacgattaagtca

SEQ ID NO: 57193 - DNA, 20 bp, human
ggggggtaggatggggatgt

SEQ ID NO: 57194 - DNA, 20 bp, human
gcacaaactgtaaaccccaa

SEQ ID NO: 57195 - DNA, 20 bp, human
gtttctcagggggtaggatg

SEQ ID NO: 57196 - DNA, 20 bp, human
gcagagacgggatacagagt

SEQ ID NO: 57197 - DNA, 20 bp, human
gtgcccccgcagacccacca

SEQ ID NO: 57198 - DNA, 20 bp, human
ggcgccggtagagataaacc

SEQ ID NO: 57199 - DNA, 20 bp, human
gccagcttctggagccgagg

SEQ ID NO: 57200 - DNA, 20 bp, human
ggctggcaagcggccctggt

SEQ ID NO: 57201 - DNA, 20 bp, human
gcctgagtgcagtcatgtgg

SEQ ID NO: 57202 - DNA, 20 bp, human
gcgtgggaggactggagtgt

SEQ ID NO: 57203 - DNA, 20 bp, human
gacgagagcgggagcaccgg

SEQ ID NO: 57204 - DNA, 20 bp, human
gatcccgtctctgaccccat

SEQ ID NO: 57205 - DNA, 20 bp, human
ggcggacgagcagatcgcgc

SEQ ID NO: 57206 - DNA, 20 bp, human
gcccgagcaaaactctccag

SEQ ID NO: 57207 - DNA, 20 bp, human
gcggccagagggagtgcgag

SEQ ID NO: 57208 - DNA, 20 bp, human
ggcgcgccccgggcttccag

SEQ ID NO: 57209 - DNA, 20 bp, human
gactccctctggccggccca

SEQ ID NO: 57210 - DNA, 20 bp, human
gaccagcccctggaagcccg

SEQ ID NO: 57211 - DNA, 20 bp, human
gtaggcgcgggggacaacat

SEQ ID NO: 57212 - DNA, 20 bp, human
gcaaaactctccagcggaag

SEQ ID NO: 57213 - DNA, 20 bp, human
ggccggcgggagttgcaggg

SEQ ID NO: 57214 - DNA, 20 bp, human
gcgagatcgagcgggttccg

SEQ ID NO: 57215 - DNA, 20 bp, human
ggggttccgtggcgcccgtg

SEQ ID NO: 57216 - DNA, 20 bp, human
gacagcccggtagagtgtat

SEQ ID NO: 57217 - DNA, 20 bp, human
ggtagagtctaacccatcaa

SEQ ID NO: 57218 - DNA, 20 bp, human
gctgtggcaacagcccacag

SEQ ID NO: 57219 - DNA, 20 bp, human
gctggcccatacactctacc

SEQ ID NO: 57220 - DNA, 20 bp, human
gcggaagagtacagacagcc

SEQ ID NO: 57221 - DNA, 20 bp, human
gattcgtgagtacccactgt

SEQ ID NO: 57222 - DNA, 20 bp, human
gaaaacacctgctaatacaa

SEQ ID NO: 57223 - DNA, 20 bp, human
ggcttaaattctaattctgg

SEQ ID NO: 57224 - DNA, 20 bp, human
gtgctgtgggtgacttctgg

SEQ ID NO: 57225 - DNA, 20 bp, human
gtccctcccgaacagttaac

SEQ ID NO: 57226 - DNA, 20 bp, human
gtgccaccaccccaggacct

SEQ ID NO: 57227 - DNA, 20 bp, human
gaagcgctgcccaggtcctg

SEQ ID NO: 57228 - DNA, 20 bp, human
gcagccagcgggagcaggaa

SEQ ID NO: 57229 - DNA, 20 bp, human
ggctgggacagcccggagtg

SEQ ID NO: 57230 - DNA, 20 bp, human
gcggagtgtggttagcagct

SEQ ID NO: 57231 - DNA, 20 bp, human
gtcaggtgtggagtccgggt

SEQ ID NO: 57232 - DNA, 20 bp, human
ggacagaagcggcacagcta

SEQ ID NO: 57233 - DNA, 20 bp, human
gcaccaggacccagaggcgt

SEQ ID NO: 57234 - DNA, 20 bp, human
gcattgcagctgggacagcc

SEQ ID NO: 57235 - DNA, 20 bp, human
gcagctaaggcagttctacg

SEQ ID NO: 57236 - DNA, 20 bp, human
gggggaatgtcaacaggcag

SEQ ID NO: 57237 - DNA, 20 bp, human
gggctggggagcacaggtag

SEQ ID NO: 57238 - DNA, 20 bp, human
gtcccatggggaatgtcaac

SEQ ID NO: 57239 - DNA, 20 bp, human
gggacaagcgcagggagtct

SEQ ID NO: 57240 - DNA, 20 bp, human
ggagtgcaggaagtgcgcac

SEQ ID NO: 57241 - DNA, 20 bp, human
gctcacaggcaggggcccat

SEQ ID NO: 57242 - DNA, 20 bp, human
gtgtccgacctcacaggcag

SEQ ID NO: 57243 - DNA, 20 bp, human
gatgggggtgtccggagcaa

SEQ ID NO: 57244 - DNA, 20 bp, human
gtgcgcttgtccgacctcac

SEQ ID NO: 57245 - DNA, 20 bp, human
ggtgtgggaaacggcatgtg

SEQ ID NO: 57246 - DNA, 20 bp, human
gggaggaaggtgcagacatc

SEQ ID NO: 57247 - DNA, 20 bp, human
gtttaaggaactttacccac

SEQ ID NO: 57248 - DNA, 20 bp, human
gtgcagacatcgggttagga

SEQ ID NO: 57249 - DNA, 20 bp, human
gcccaggtagtatcttctgg

SEQ ID NO: 57250 - DNA, 20 bp, human
gaaggtgcagacatcgggtt

SEQ ID NO: 57251 - DNA, 20 bp, human
gggtaaaggcatgtcctgta

SEQ ID NO: 57252 - DNA, 20 bp, human
ggtcctgtagggtctgatcg

SEQ ID NO: 57253 - DNA, 20 bp, human
ggccaccagaagatactacc

SEQ ID NO: 57254 - DNA, 20 bp, human
ggatggttgtgatgctacct

SEQ ID NO: 57255 - DNA, 20 bp, human
gtgatcggggccaggattgt

SEQ ID NO: 57256 - DNA, 20 bp, human
gtcgctcgctcagtacctgg

SEQ ID NO: 57257 - DNA, 20 bp, human
ggagcgagccccgacggccg

SEQ ID NO: 57258 - DNA, 20 bp, human
gacggccgcggtgggtggag

SEQ ID NO: 57259 - DNA, 20 bp, human
gcctcttccgctgccgccgt

SEQ ID NO: 57260 - DNA, 20 bp, human
gggctcgctcgctcagtacc

SEQ ID NO: 57261 - DNA, 20 bp, human
gcttcctccactaaaagagt

SEQ ID NO: 57262 - DNA, 20 bp, human
ggcatctcggtgcatctgtt

SEQ ID NO: 57263 - DNA, 20 bp, human
gtgcggtgtcacaggccccg

SEQ ID NO: 57264 - DNA, 20 bp, human
ggactcactgaaaataaaga

SEQ ID NO: 57265 - DNA, 20 bp, human
ggtgcgcagaaagcgtcccg

SEQ ID NO: 57266 - DNA, 20 bp, human
gcgctctttgcacctcatca

SEQ ID NO: 57267 - DNA, 20 bp, human
gcctgccccttgccctgatg

SEQ ID NO: 57268 - DNA, 20 bp, human
ggtgcaaagagcgggatcgg

SEQ ID NO: 57269 - DNA, 20 bp, human
gggccgcccgcctcttcctg

SEQ ID NO: 57270 - DNA, 20 bp, human
gtgcacctcatcagggcaag

SEQ ID NO: 57271 - DNA, 20 bp, human
ggcgtagggcagacactcct

SEQ ID NO: 57272 - DNA, 20 bp, human
gtgccctgcgtccccctcgg

SEQ ID NO: 57273 - DNA, 20 bp, human
ggcccgccgagggggacgca

SEQ ID NO: 57274 - DNA, 20 bp, human
ggctggcaccaggccgcgta

SEQ ID NO: 57275 - DNA, 20 bp, human
gccagcaggcgctcttccac

SEQ ID NO: 57276 - DNA, 20 bp, human
gcagggcggcggccagctcg

SEQ ID NO: 57277 - DNA, 20 bp, human
gcttggggcggcgagcatgg

SEQ ID NO: 57278 - DNA, 20 bp, human
ggcgtagggcagacactcct

SEQ ID NO: 57279 - DNA, 20 bp, human
ggctggcaccaggccgcgta

SEQ ID NO: 57280 - DNA, 20 bp, human
gggcggccagctcgaggcag

SEQ ID NO: 57281 - DNA, 20 bp, human
gtgcagcggctccccgtagg

SEQ ID NO: 57282 - DNA, 20 bp, human
gggacttcctggcccgctac

SEQ ID NO: 57283 - DNA, 20 bp, human
gggccggctggcccagctcg

SEQ ID NO: 57284 - DNA, 20 bp, human
ggcgcgtcgggaagtgcttg

SEQ ID NO: 57285 - DNA, 20 bp, human
gcccgtggaagagcgcctgc

SEQ ID NO: 57286 - DNA, 20 bp, human
gcagggcggcggccagctcg

SEQ ID NO: 57287 - DNA, 20 bp, human
gcttggggcggcgagcatgg

SEQ ID NO: 57288 - DNA, 20 bp, human
ggcgtagggcagacactcct

SEQ ID NO: 57289 - DNA, 20 bp, human
ggctggcaccaggccgcgta

SEQ ID NO: 57290 - DNA, 20 bp, human
gggcggccagctcgaggcag

SEQ ID NO: 57291 - DNA, 20 bp, human
gtgcagcggctccccgtagg

SEQ ID NO: 57292 - DNA, 20 bp, human
gggacttcctggcccgctac

SEQ ID NO: 57293 - DNA, 20 bp, human
gggccggctggcccagctcg

SEQ ID NO: 57294 - DNA, 20 bp, human
ggcgcgtcgggaagtgcttg

SEQ ID NO: 57295 - DNA, 20 bp, human
gcccgtggaagagcgcctgc

SEQ ID NO: 57296 - DNA, 20 bp, human
gcagcgcgtgaacatgatca

SEQ ID NO: 57297 - DNA, 20 bp, human
gactgagtagatatcctaaa

SEQ ID NO: 57298 - DNA, 20 bp, human
gtaaaaggcagatggtgatg

SEQ ID NO: 57299 - DNA, 20 bp, human
gggcagatggtgatgaggcc

SEQ ID NO: 57300 - DNA, 20 bp, human
gtgatcatggcagaatcacc

SEQ ID NO: 57301 - DNA, 20 bp, human
gtaacagccagcacgcaggt

SEQ ID NO: 57302 - DNA, 20 bp, human
gcacgcaggttggtaagtac

SEQ ID NO: 57303 - DNA, 20 bp, human
gagtctaacagccagcacgc

SEQ ID NO: 57304 - DNA, 20 bp, human
gtactcagtgctgaatgtac

SEQ ID NO: 57305 - DNA, 20 bp, human
gtgctagcagattgtgaaag

SEQ ID NO: 57306 - DNA, 20 bp, human
gtggcagcagagcagacgcc

SEQ ID NO: 57307 - DNA, 20 bp, human
gtgccctctagcaggaccca

SEQ ID NO: 57308 - DNA, 20 bp, human
gacctcggagggcgagaagg

SEQ ID NO: 57309 - DNA, 20 bp, human
gggcgccgctggacctcgga

SEQ ID NO: 57310 - DNA, 20 bp, human
gtggacctcggagggcgaga

SEQ ID NO: 57311 - DNA, 20 bp, human
gcaccttgggtcctgctaga

SEQ ID NO: 57312 - DNA, 20 bp, human
ggggatgttagaggcgctca

SEQ ID NO: 57313 - DNA, 20 bp, human
ggctagagggcaagtgaacg

SEQ ID NO: 57314 - DNA, 20 bp, human
gggctggagcagtactacgt

SEQ ID NO: 57315 - DNA, 20 bp, human
ggaagctggagaggtcgtag

SEQ ID NO: 57316 - DNA, 20 bp, human
gcagcaggctgaagggatca

SEQ ID NO: 57317 - DNA, 20 bp, human
gtgagccaggtagagcacgg

SEQ ID NO: 57318 - DNA, 20 bp, human
ggtagtgtcaaggcaggtgg

SEQ ID NO: 57319 - DNA, 20 bp, human
gcggcttcaactgtcgcggt

SEQ ID NO: 57320 - DNA, 20 bp, human
gggcctgagggtactcgcag

SEQ ID NO: 57321 - DNA, 20 bp, human
gcagcaggccagggcgaccc

SEQ ID NO: 57322 - DNA, 20 bp, human
gggcctggagaacatggaca

SEQ ID NO: 57323 - DNA, 20 bp, human
ggcggcggcttcaactgtcg

SEQ ID NO: 57324 - DNA, 20 bp, human
gctacctggctcagaaagtg

SEQ ID NO: 57325 - DNA, 20 bp, human
gtgtcgcggtaggcagcagc

SEQ ID NO: 57326 - DNA, 20 bp, human
gtactagggcgacttaggag

SEQ ID NO: 57327 - DNA, 20 bp, human
ggggcgctaggctttctcat

SEQ ID NO: 57328 - DNA, 20 bp, human
gcgagcagctttagtcttag

SEQ ID NO: 57329 - DNA, 20 bp, human
ggccctagtagagaatggaa

SEQ ID NO: 57330 - DNA, 20 bp, human
ggctttctcataggcttagt

SEQ ID NO: 57331 - DNA, 20 bp, human
gaagtcgccctagtagagaa

SEQ ID NO: 57332 - DNA, 20 bp, human
gacaaataggacaaatggat

SEQ ID NO: 57333 - DNA, 20 bp, human
gtaccaaggacatttactgt

SEQ ID NO: 57334 - DNA, 20 bp, human
ggaagcaatggttcagtcac

SEQ ID NO: 57335 - DNA, 20 bp, human
ggggtctttgaggcaaactt

SEQ ID NO: 57336 - DNA, 20 bp, human
gtacttgccggagaaactca

SEQ ID NO: 57337 - DNA, 20 bp, human
gttgccggagaaactcatgg

SEQ ID NO: 57338 - DNA, 20 bp, human
gctacagtggacagtctggt

SEQ ID NO: 57339 - DNA, 20 bp, human
gcgcaggtcagtcgtgaaga

SEQ ID NO: 57340 - DNA, 20 bp, human
gctgtgctggatagatacca

SEQ ID NO: 57341 - DNA, 20 bp, human
gccagggagacagatgataa

SEQ ID NO: 57342 - DNA, 20 bp, human
gcagcctacagtggacagtc

SEQ ID NO: 57343 - DNA, 20 bp, human
gctgcacaaggccaccccat

SEQ ID NO: 57344 - DNA, 20 bp, human
gcctataaaacagcctacag

SEQ ID NO: 57345 - DNA, 20 bp, human
gacagtgctcagtgtgtggt

SEQ ID NO: 57346 - DNA, 20 bp, human
gtgaccagctccaaggaaca

SEQ ID NO: 57347 - DNA, 20 bp, human
ggaatgattgaccagctcca

SEQ ID NO: 57348 - DNA, 20 bp, human
gtgtttgctctaagctttag

SEQ ID NO: 57349 - DNA, 20 bp, human
ggttttccctgaagtagtat

SEQ ID NO: 57350 - DNA, 20 bp, human
ggttctgtgcaaaactatgt

SEQ ID NO: 57351 - DNA, 20 bp, human
gaagttcccatactacttca

SEQ ID NO: 57352 - DNA, 20 bp, human
gtttgcacagaactatatcc

SEQ ID NO: 57353 - DNA, 20 bp, human
gcttccatgttccttggagc

SEQ ID NO: 57354 - DNA, 20 bp, human
gtatcatatccagtaaaaat

SEQ ID NO: 57355 - DNA, 20 bp, human
gaattccgaagactacatga

SEQ ID NO: 57356 - DNA, 20 bp, human
gtgaatctctagctgcctag

SEQ ID NO: 57357 - DNA, 20 bp, human
ggcgtttgacagcacttgga

SEQ ID NO: 57358 - DNA, 20 bp, human
gggatccagaagatgttcag

SEQ ID NO: 57359 - DNA, 20 bp, human
gagctcctgatgtggtagag

SEQ ID NO: 57360 - DNA, 20 bp, human
gccagaagatgttcagagga

SEQ ID NO: 57361 - DNA, 20 bp, human
ggaatccactatctcactaa

SEQ ID NO: 57362 - DNA, 20 bp, human
gcatggcgtttgacagcact

SEQ ID NO: 57363 - DNA, 20 bp, human
ggttgtttacagtaagaaaa

SEQ ID NO: 57364 - DNA, 20 bp, human
gggatcctctctaccacatc

SEQ ID NO: 57365 - DNA, 20 bp, human
gttacagatagctcctgatg

SEQ ID NO: 57366 - DNA, 20 bp, human
ggcctagcccagcatcacta

SEQ ID NO: 57367 - DNA, 20 bp, human
gggaaagggagtgtagccag

SEQ ID NO: 57368 - DNA, 20 bp, human
gctatggtggacgctttcct

SEQ ID NO: 57369 - DNA, 20 bp, human
gccgggcagggagccgccgt

SEQ ID NO: 57370 - DNA, 20 bp, human
gcgtccaccatagtgatgct

SEQ ID NO: 57371 - DNA, 20 bp, human
ggtcttaaccaggagggatg

SEQ ID NO: 57372 - DNA, 20 bp, human
gtaaagcggcagcccgggca

SEQ ID NO: 57373 - DNA, 20 bp, human
gagagaagctacaagagagc

SEQ ID NO: 57374 - DNA, 20 bp, human
gctggttagagaccacggta

SEQ ID NO: 57375 - DNA, 20 bp, human
gggttaagactggggaatag

SEQ ID NO: 57376 - DNA, 20 bp, human
gcaaagagctaagtaaacca

SEQ ID NO: 57377 - DNA, 20 bp, human
gattattcttcaaggtgaga

SEQ ID NO: 57378 - DNA, 20 bp, human
gaagttatctggactcaaga

SEQ ID NO: 57379 - DNA, 20 bp, human
gtttctaggattattcttca

SEQ ID NO: 57380 - DNA, 20 bp, human
gtagcaatgtctggaagccc

SEQ ID NO: 57381 - DNA, 20 bp, human
gggaagctgcagttttcagg

SEQ ID NO: 57382 - DNA, 20 bp, human
gtgaaaaacttgggtatcct

SEQ ID NO: 57383 - DNA, 20 bp, human
ggactttatttgaaaaactt

SEQ ID NO: 57384 - DNA, 20 bp, human
gaaggtgtaccaatataaaa

SEQ ID NO: 57385 - DNA, 20 bp, human
gaaatgcgttgtggaatgac

SEQ ID NO: 57386 - DNA, 20 bp, human
gggcgtggcagcgtgctgtg

SEQ ID NO: 57387 - DNA, 20 bp, human
ggtcagcgtgccagattctg

SEQ ID NO: 57388 - DNA, 20 bp, human
ggcgggccgcaagattccgg

SEQ ID NO: 57389 - DNA, 20 bp, human
gggtgcgcgcgctaaaggac

SEQ ID NO: 57390 - DNA, 20 bp, human
ggcacgctgacggggaccta

SEQ ID NO: 57391 - DNA, 20 bp, human
ggccggcggctgctttataa

SEQ ID NO: 57392 - DNA, 20 bp, human
gaagtgcagcgtgaggtgac

SEQ ID NO: 57393 - DNA, 20 bp, human
gccggaggtggtccaccccg

SEQ ID NO: 57394 - DNA, 20 bp, human
gcagcgtgctgtgaggcacc

SEQ ID NO: 57395 - DNA, 20 bp, human
gtcgaaagaagtgcagcgtg

SEQ ID NO: 57396 - DNA, 20 bp, human
ggcacatgggtgagccggaa

SEQ ID NO: 57397 - DNA, 20 bp, human
gtctctgcaggtctcctttc

SEQ ID NO: 57398 - DNA, 20 bp, human
gggcctatcctgagtcaagt

SEQ ID NO: 57399 - DNA, 20 bp, human
gaaaggtatggggtagaaga

SEQ ID NO: 57400 - DNA, 20 bp, human
ggactttgtgtcctatccct

SEQ ID NO: 57401 - DNA, 20 bp, human
gacaatgcagaaggatctca

SEQ ID NO: 57402 - DNA, 20 bp, human
gtgtgttgtctgcgtgcaca

SEQ ID NO: 57403 - DNA, 20 bp, human
gcacaaagtctaggttcatg

SEQ ID NO: 57404 - DNA, 20 bp, human
gccagaatctgaaaaacgtc

SEQ ID NO: 57405 - DNA, 20 bp, human
gcagcagttatacatgctga

SEQ ID NO: 57406 - DNA, 20 bp, human
gcgctcctgtctctaaagag

SEQ ID NO: 57407 - DNA, 20 bp, human
gacactactgtgataataag

SEQ ID NO: 57408 - DNA, 20 bp, human
ggtacatgaaggctctaggt

SEQ ID NO: 57409 - DNA, 20 bp, human
ggacaggagcggggatcttc

SEQ ID NO: 57410 - DNA, 20 bp, human
gttattggccctgggtaaga

SEQ ID NO: 57411 - DNA, 20 bp, human
gatagcctagcatctgatca

SEQ ID NO: 57412 - DNA, 20 bp, human
gtcttatttggaaagagggt

SEQ ID NO: 57413 - DNA, 20 bp, human
gctcttggaaagagggacac

SEQ ID NO: 57414 - DNA, 20 bp, human
ggggaaggagcgctcgagtg

SEQ ID NO: 57415 - DNA, 20 bp, human
gttgcttgccttcttaccca

SEQ ID NO: 57416 - DNA, 20 bp, human
gaagaagggctcaaccatca

SEQ ID NO: 57417 - DNA, 20 bp, human
gttgaaaaccaaagaaatat

SEQ ID NO: 57418 - DNA, 20 bp, human
gtgagcccttcttgggaacc

SEQ ID NO: 57419 - DNA, 20 bp, human
gagcttccaggttcccaaga

SEQ ID NO: 57420 - DNA, 20 bp, human
gtttggttttcaattacgag

SEQ ID NO: 57421 - DNA, 20 bp, human
gtaaatatatggatcatgac

SEQ ID NO: 57422 - DNA, 20 bp, human
gaattgatcaatttaattgt

SEQ ID NO: 57423 - DNA, 20 bp, human
gcgtaatgcctatatttctt

SEQ ID NO: 57424 - DNA, 20 bp, human
gattttcaaaaaggataaat

SEQ ID NO: 57425 - DNA, 20 bp, human
gtcttccttttgtgatccta

SEQ ID NO: 57426 - DNA, 20 bp, human
gcaccggagtgcaggttcgg

SEQ ID NO: 57427 - DNA, 20 bp, human
gggtctcgccgcttgcccag

SEQ ID NO: 57428 - DNA, 20 bp, human
ggcgcctggaggccaaccgg

SEQ ID NO: 57429 - DNA, 20 bp, human
gcacccccgaacctgcactc

SEQ ID NO: 57430 - DNA, 20 bp, human
gaggcaccggagtgcaggtt

SEQ ID NO: 57431 - DNA, 20 bp, human
gaagcggcgagacctggcca

SEQ ID NO: 57432 - DNA, 20 bp, human
ggccagcgagccgaggacag

SEQ ID NO: 57433 - DNA, 20 bp, human
gcctgtagtgaatcaggcac

SEQ ID NO: 57434 - DNA, 20 bp, human
ggtggaatccttgggccgct

SEQ ID NO: 57435 - DNA, 20 bp, human
gcgagctgctcgcctccctg

SEQ ID NO: 57436 - DNA, 20 bp, human
ggcgcgtgctcggggtccgc

SEQ ID NO: 57437 - DNA, 20 bp, human
gccgggcaacaggtatgatc

SEQ ID NO: 57438 - DNA, 20 bp, human
gctgcggatgcgggatgaaa

SEQ ID NO: 57439 - DNA, 20 bp, human
ggcgctcagggtgcgaggag

SEQ ID NO: 57440 - DNA, 20 bp, human
gccgcaggacacccaatcac

SEQ ID NO: 57441 - DNA, 20 bp, human
gtggctagtgatcgaccgta

SEQ ID NO: 57442 - DNA, 20 bp, human
gggtatgatcaggcgcctcc

SEQ ID NO: 57443 - DNA, 20 bp, human
gaatccactcctggagcccg

SEQ ID NO: 57444 - DNA, 20 bp, human
gggctgtcaggcgcgtgctc

SEQ ID NO: 57445 - DNA, 20 bp, human
gcaaacaccgactaattcgg

SEQ ID NO: 57446 - DNA, 20 bp, human
ggagcttgggacgtcctgta

SEQ ID NO: 57447 - DNA, 20 bp, human
ggtgcacggggcgtcacagt

SEQ ID NO: 57448 - DNA, 20 bp, human
gcgtgggccaaacagacctc

SEQ ID NO: 57449 - DNA, 20 bp, human
gtaacctgcgcaccgacagg

SEQ ID NO: 57450 - DNA, 20 bp, human
gcgggctgcacacaccggct

SEQ ID NO: 57451 - DNA, 20 bp, human
gccgaaagcgaagagggccc

SEQ ID NO: 57452 - DNA, 20 bp, human
gttgggacgtcctgtaggga

SEQ ID NO: 57453 - DNA, 20 bp, human
gggggaggccgcagtgcacg

SEQ ID NO: 57454 - DNA, 20 bp, human
gtcctctgggccgactgggg

SEQ ID NO: 57455 - DNA, 20 bp, human
gtctcctcccagctgaaggt

SEQ ID NO: 57456 - DNA, 20 bp, human
gctgcggatgcgggatgaaa

SEQ ID NO: 57457 - DNA, 20 bp, human
ggcctggagaagtggagtct

SEQ ID NO: 57458 - DNA, 20 bp, human
gccggtggccgccgagaccg

SEQ ID NO: 57459 - DNA, 20 bp, human
gggcgtcgccaggccagcta

SEQ ID NO: 57460 - DNA, 20 bp, human
gtacgccgggcaggatgcca

SEQ ID NO: 57461 - DNA, 20 bp, human
gccagctatggcccccgacc

SEQ ID NO: 57462 - DNA, 20 bp, human
ggctatggcccccgacccgg

SEQ ID NO: 57463 - DNA, 20 bp, human
ggtctcggcggccaccgggt

SEQ ID NO: 57464 - DNA, 20 bp, human
gcgcctggctgcgctcaccg

SEQ ID NO: 57465 - DNA, 20 bp, human
ggcgctcagggtgcgaggag

SEQ ID NO: 57466 - DNA, 20 bp, human
gcgctgaggacgccacggta

SEQ ID NO: 57467 - DNA, 20 bp, human
gtaaggaagccacccaccgg

SEQ ID NO: 57468 - DNA, 20 bp, human
gcacggcgctgaggacgcca

SEQ ID NO: 57469 - DNA, 20 bp, human
gaggcgcacgctcgctcgta

SEQ ID NO: 57470 - DNA, 20 bp, human
gagctccaggctccacccgc

SEQ ID NO: 57471 - DNA, 20 bp, human
ggaggtcaaaggtcagcgag

SEQ ID NO: 57472 - DNA, 20 bp, human
ggtcccggcgtggaggtcaa

SEQ ID NO: 57473 - DNA, 20 bp, human
gggtccgagcaagaccccga

SEQ ID NO: 57474 - DNA, 20 bp, human
gccaggctccacccgccggt

SEQ ID NO: 57475 - DNA, 20 bp, human
ggatgctaaggccccacagg

SEQ ID NO: 57476 - DNA, 20 bp, human
gcccgctcctagggtacaca

SEQ ID NO: 57477 - DNA, 20 bp, human
gtgggctccgtaggttccat

SEQ ID NO: 57478 - DNA, 20 bp, human
ggacgcgcacggaggactgg

SEQ ID NO: 57479 - DNA, 20 bp, human
gacggaggactggaggactg

SEQ ID NO: 57480 - DNA, 20 bp, human
gacggagcccatggaaccta

SEQ ID NO: 57481 - DNA, 20 bp, human
gccccgcacccaaggatgga

SEQ ID NO: 57482 - DNA, 20 bp, human
gcgctccgcgccggttccat

SEQ ID NO: 57483 - DNA, 20 bp, human
ggaacctgagagtctggact

SEQ ID NO: 57484 - DNA, 20 bp, human
ggtgaggacgagctcctggt

SEQ ID NO: 57485 - DNA, 20 bp, human
gctcctgcgccccgctccta

SEQ ID NO: 57486 - DNA, 20 bp, human
gcgcgggccaggatgagggc

SEQ ID NO: 57487 - DNA, 20 bp, human
gcgcacccggataccttcag

SEQ ID NO: 57488 - DNA, 20 bp, human
gccggagccgcggaactcgg

SEQ ID NO: 57489 - DNA, 20 bp, human
gacagtcgcgggccaggatg

SEQ ID NO: 57490 - DNA, 20 bp, human
gatggaccgggagatgatcc

SEQ ID NO: 57491 - DNA, 20 bp, human
gtgggaagaagactcccttg

SEQ ID NO: 57492 - DNA, 20 bp, human
gccggacaggaagattggtc

SEQ ID NO: 57493 - DNA, 20 bp, human
ggcggcgttaagcccggcgg

SEQ ID NO: 57494 - DNA, 20 bp, human
gtggcggccgccgagttccg

SEQ ID NO: 57495 - DNA, 20 bp, human
gtaacgccgctgaaggtatc

SEQ ID NO: 57496 - DNA, 20 bp, human
ggaggagcgggatctaaccc

SEQ ID NO: 57497 - DNA, 20 bp, human
gggacgggtcaggagcgtag

SEQ ID NO: 57498 - DNA, 20 bp, human
gcgggtcaggagcgtagagg

SEQ ID NO: 57499 - DNA, 20 bp, human
gaatggcggcgcctgaggag

SEQ ID NO: 57500 - DNA, 20 bp, human
ggaaggctagggtccaacag

SEQ ID NO: 57501 - DNA, 20 bp, human
gttgggggccgggggaatca

SEQ ID NO: 57502 - DNA, 20 bp, human
gcgtagaggcggcggcaaaa

SEQ ID NO: 57503 - DNA, 20 bp, human
gcggcagatatagactcgtt

SEQ ID NO: 57504 - DNA, 20 bp, human
ggagggtccgaccgataacc

SEQ ID NO: 57505 - DNA, 20 bp, human
gtgacgccaactccgcggtg

SEQ ID NO: 57506 - DNA, 20 bp, human
gaccggaagctgcagcacac

SEQ ID NO: 57507 - DNA, 20 bp, human
gcacggctgcgggcctaagg

SEQ ID NO: 57508 - DNA, 20 bp, human
gcgcccaagaggccaggtca

SEQ ID NO: 57509 - DNA, 20 bp, human
gaccgcaaccacctcggagt

SEQ ID NO: 57510 - DNA, 20 bp, human
gggacatgctgaagagcacc

SEQ ID NO: 57511 - DNA, 20 bp, human
ggggccgggcctgaccacag

SEQ ID NO: 57512 - DNA, 20 bp, human
gtggtcgagaagacgccgta

SEQ ID NO: 57513 - DNA, 20 bp, human
gcatgctgcctactccgagg

SEQ ID NO: 57514 - DNA, 20 bp, human
ggagcccataggcactctca

SEQ ID NO: 57515 - DNA, 20 bp, human
gcggcacggctgcgggccta

SEQ ID NO: 57516 - DNA, 20 bp, human
gactctggcgaagagcttca

SEQ ID NO: 57517 - DNA, 20 bp, human
gctgcggccatggactacgt

SEQ ID NO: 57518 - DNA, 20 bp, human
gactcccagaagcgggacaa

SEQ ID NO: 57519 - DNA, 20 bp, human
gaactacgcggaccacgtca

SEQ ID NO: 57520 - DNA, 20 bp, human
gagtgcccctgtagtcacgt

SEQ ID NO: 57521 - DNA, 20 bp, human
ggtcccgggcggtcatatcc

SEQ ID NO: 57522 - DNA, 20 bp, human
gcccagcccacgtgactaca

SEQ ID NO: 57523 - DNA, 20 bp, human
gacggcttcaggaacagcac

SEQ ID NO: 57524 - DNA, 20 bp, human
gtcccggcccgtggcagtcg

SEQ ID NO: 57525 - DNA, 20 bp, human
gtgcggtgccaaaaaagagg

SEQ ID NO: 57526 - DNA, 20 bp, human
gggctggctgcggtcactgg

SEQ ID NO: 57527 - DNA, 20 bp, human
gcggggccgaaggtcaaggg

SEQ ID NO: 57528 - DNA, 20 bp, human
gtcgcggggccgaaggtcaa

SEQ ID NO: 57529 - DNA, 20 bp, human
gccgtctgtgtggtcagaag

SEQ ID NO: 57530 - DNA, 20 bp, human
gcccggctggctgcggtcac

SEQ ID NO: 57531 - DNA, 20 bp, human
gcggagcgcagaactagtac

SEQ ID NO: 57532 - DNA, 20 bp, human
gggatcacccgagagaaaag

SEQ ID NO: 57533 - DNA, 20 bp, human
gctcaggctttgtttgatgg

SEQ ID NO: 57534 - DNA, 20 bp, human
gctcgggtgatccggccgag

SEQ ID NO: 57535 - DNA, 20 bp, human
ggagcactcactaactgtcg

SEQ ID NO: 57536 - DNA, 20 bp, human
gagccggggaactacagcag

SEQ ID NO: 57537 - DNA, 20 bp, human
ggcgcactccagcgagaagc

SEQ ID NO: 57538 - DNA, 20 bp, human
ggcagcgggcgcctgagcac

SEQ ID NO: 57539 - DNA, 20 bp, human
gggacgcgcccgcttctcgc

SEQ ID NO: 57540 - DNA, 20 bp, human
gggagggcagaactagaacc

SEQ ID NO: 57541 - DNA, 20 bp, human
gattggtgccctgctagggg

SEQ ID NO: 57542 - DNA, 20 bp, human
gccaggcctggtctacctgg

SEQ ID NO: 57543 - DNA, 20 bp, human
gcaggcaaccacccctagca

SEQ ID NO: 57544 - DNA, 20 bp, human
gcgccgctgctgtagttccc

SEQ ID NO: 57545 - DNA, 20 bp, human
gtggctgggttaggccagaa

SEQ ID NO: 57546 - DNA, 20 bp, human
gtcgccccaggggacctgag

SEQ ID NO: 57547 - DNA, 20 bp, human
gcgaggtctgggatcaccgg

SEQ ID NO: 57548 - DNA, 20 bp, human
ggagaggcgcgacaaacagt

SEQ ID NO: 57549 - DNA, 20 bp, human
ggtgatcccagacctcgggg

SEQ ID NO: 57550 - DNA, 20 bp, human
gggcggcggccatctctggg

SEQ ID NO: 57551 - DNA, 20 bp, human
gcccgcgcgggtgagacgct

SEQ ID NO: 57552 - DNA, 20 bp, human
ggctcccctggccgagaaac

SEQ ID NO: 57553 - DNA, 20 bp, human
gtgagacgctgggtgagttc

SEQ ID NO: 57554 - DNA, 20 bp, human
gtcaccgccggcaaaggtgg

SEQ ID NO: 57555 - DNA, 20 bp, human
ggcgcctctcaggtcccctg

SEQ ID NO: 57556 - DNA, 20 bp, human
gtgccagggtgagccctgag

SEQ ID NO: 57557 - DNA, 20 bp, human
gcgataggcactgcccctca

SEQ ID NO: 57558 - DNA, 20 bp, human
ggttgctagaacccacgcgg

SEQ ID NO: 57559 - DNA, 20 bp, human
ggatgttgctagaacccacg

SEQ ID NO: 57560 - DNA, 20 bp, human
gcgggctgactcctcacggg

SEQ ID NO: 57561 - DNA, 20 bp, human
gcaggctgcggttacccaag

SEQ ID NO: 57562 - DNA, 20 bp, human
gacagtcacaccagacgccc

SEQ ID NO: 57563 - DNA, 20 bp, human
ggaggcccgggtggccgctt

SEQ ID NO: 57564 - DNA, 20 bp, human
gacggaggaccttcaaacta

SEQ ID NO: 57565 - DNA, 20 bp, human
gctagaacccacgcggagga

SEQ ID NO: 57566 - DNA, 20 bp, human
gccaagagcccctagagagg

SEQ ID NO: 57567 - DNA, 20 bp, human
gggagacacgctgcttactc

SEQ ID NO: 57568 - DNA, 20 bp, human
gcatccaagagcccctagag

SEQ ID NO: 57569 - DNA, 20 bp, human
ggagcccctagagaggggga

SEQ ID NO: 57570 - DNA, 20 bp, human
gagttgtgaaccaacaccta

SEQ ID NO: 57571 - DNA, 20 bp, human
gctgccaggtaagtaccgtg

SEQ ID NO: 57572 - DNA, 20 bp, human
gcaagctttgttcctcgtgg

SEQ ID NO: 57573 - DNA, 20 bp, human
gtacctggcaggaagtaaag

SEQ ID NO: 57574 - DNA, 20 bp, human
gaacaggagagtgtctggag

SEQ ID NO: 57575 - DNA, 20 bp, human
gactgaaacaggagagtgtc

SEQ ID NO: 57576 - DNA, 20 bp, human
ggcgccagggagtagaaggg

SEQ ID NO: 57577 - DNA, 20 bp, human
gcagcgaggccagagcggta

SEQ ID NO: 57578 - DNA, 20 bp, human
gctgcatctgcagggcatgg

SEQ ID NO: 57579 - DNA, 20 bp, human
ggacctgcgggcaccgcgag

SEQ ID NO: 57580 - DNA, 20 bp, human
gcagtggcgcgcgtctctgg

SEQ ID NO: 57581 - DNA, 20 bp, human
gccgggcgccagggagtaga

SEQ ID NO: 57582 - DNA, 20 bp, human
gcgcgccccccagacatggt

SEQ ID NO: 57583 - DNA, 20 bp, human
ggcaggagcgcggcccacgg

SEQ ID NO: 57584 - DNA, 20 bp, human
gctgcgggcaccgcgagagg

SEQ ID NO: 57585 - DNA, 20 bp, human
ggcagcgcagcgcagaggcg

SEQ ID NO: 57586 - DNA, 20 bp, human
gctccttcgccaaaggacag

SEQ ID NO: 57587 - DNA, 20 bp, human
gaagcgctggtcttcctctg

SEQ ID NO: 57588 - DNA, 20 bp, human
ggaagtaaggtaaatatagc

SEQ ID NO: 57589 - DNA, 20 bp, human
ggaaaggctcaggtaaagag

SEQ ID NO: 57590 - DNA, 20 bp, human
gtttgaccccttaccaccaa

SEQ ID NO: 57591 - DNA, 20 bp, human
ggagactgggttggcaggta

SEQ ID NO: 57592 - DNA, 20 bp, human
gttacttcctttggtggtaa

SEQ ID NO: 57593 - DNA, 20 bp, human
gcctcagagactgggttggc

SEQ ID NO: 57594 - DNA, 20 bp, human
gcatgtatcatggctgtcag

SEQ ID NO: 57595 - DNA, 20 bp, human
gggctttgtcccctgtcctt

SEQ ID NO: 57596 - DNA, 20 bp, human
gccaccatcagggcgggatc

SEQ ID NO: 57597 - DNA, 20 bp, human
gggcggaccggtgagactga

SEQ ID NO: 57598 - DNA, 20 bp, human
gggaccggtgagactgaggg

SEQ ID NO: 57599 - DNA, 20 bp, human
gggcccaggcattctccaag

SEQ ID NO: 57600 - DNA, 20 bp, human
gccggcctcgggcctcctca

SEQ ID NO: 57601 - DNA, 20 bp, human
ggagcggccggggacctcac

SEQ ID NO: 57602 - DNA, 20 bp, human
gccgccgccctcagtctcac

SEQ ID NO: 57603 - DNA, 20 bp, human
gagcggcgcctcgcagcatc

SEQ ID NO: 57604 - DNA, 20 bp, human
gggctctggctgcagcgtcg

SEQ ID NO: 57605 - DNA, 20 bp, human
ggcgggctggctggccggta

SEQ ID NO: 57606 - DNA, 20 bp, human
ggctcgcggccccggccatg

SEQ ID NO: 57607 - DNA, 20 bp, human
gccattgacgaagggcactg

SEQ ID NO: 57608 - DNA, 20 bp, human
gctgggagtcgggagaggcg

SEQ ID NO: 57609 - DNA, 20 bp, human
gtgccgcccgtctgggagtc

SEQ ID NO: 57610 - DNA, 20 bp, human
ggacccccgaggcgctgagg

SEQ ID NO: 57611 - DNA, 20 bp, human
gagaggaccccattgacgaa

SEQ ID NO: 57612 - DNA, 20 bp, human
gcctctcccgactcccagac

SEQ ID NO: 57613 - DNA, 20 bp, human
gtcgggagaggcgaggctcg

SEQ ID NO: 57614 - DNA, 20 bp, human
gcccgacccccgaggcgctg

SEQ ID NO: 57615 - DNA, 20 bp, human
gagttacctggaggactcgg

SEQ ID NO: 57616 - DNA, 20 bp, human
ggtacagatcaccgcacagg

SEQ ID NO: 57617 - DNA, 20 bp, human
ggccctgggaggtgagcccg

SEQ ID NO: 57618 - DNA, 20 bp, human
gcccgccggaagcggaagtc

SEQ ID NO: 57619 - DNA, 20 bp, human
gggtggttgtcggattttag

SEQ ID NO: 57620 - DNA, 20 bp, human
ggcggaagtcaggtggttgt

SEQ ID NO: 57621 - DNA, 20 bp, human
gtgggccgtgagaagtaaac

SEQ ID NO: 57622 - DNA, 20 bp, human
ggaggtgtcctccccctgtg

SEQ ID NO: 57623 - DNA, 20 bp, human
ggttgtcggattttagagga

SEQ ID NO: 57624 - DNA, 20 bp, human
ggggcagcgaaaccccattc

SEQ ID NO: 57625 - DNA, 20 bp, human
gttccccgggctcacctccc

SEQ ID NO: 57626 - DNA, 20 bp, human
gggacggaggcgctcgctca

SEQ ID NO: 57627 - DNA, 20 bp, human
gggcgccgctccgcgaagag

SEQ ID NO: 57628 - DNA, 20 bp, human
gcgagagggcggtaccacgg

SEQ ID NO: 57629 - DNA, 20 bp, human
ggagcagacgccggaagtag

SEQ ID NO: 57630 - DNA, 20 bp, human
gtggtacgggtccgactgag

SEQ ID NO: 57631 - DNA, 20 bp, human
ggctggaaggtgactctccg

SEQ ID NO: 57632 - DNA, 20 bp, human
gcggcggcagcgacatgggg

SEQ ID NO: 57633 - DNA, 20 bp, human
gcgagagccaaggcccgagg

SEQ ID NO: 57634 - DNA, 20 bp, human
gttggagagggagcccccaa

SEQ ID NO: 57635 - DNA, 20 bp, human
gaccacggcggcagcgacat

SEQ ID NO: 57636 - DNA, 20 bp, human
gtatgggaggctgccctgta

SEQ ID NO: 57637 - DNA, 20 bp, human
gtggggaccagagctcggac

SEQ ID NO: 57638 - DNA, 20 bp, human
gggactggtaccggccggaa

SEQ ID NO: 57639 - DNA, 20 bp, human
gccgacgaacttaccgtaca

SEQ ID NO: 57640 - DNA, 20 bp, human
ggtacctagcagcctcaccg

SEQ ID NO: 57641 - DNA, 20 bp, human
gccagagctcggactggtac

SEQ ID NO: 57642 - DNA, 20 bp, human
gagcaaagcgtgatgaccgt

SEQ ID NO: 57643 - DNA, 20 bp, human
gctcgcgaaaactcagtcag

SEQ ID NO: 57644 - DNA, 20 bp, human
gagctcggactggtaccggc

SEQ ID NO: 57645 - DNA, 20 bp, human
ggccctgagccccgagatct

SEQ ID NO: 57646 - DNA, 20 bp, human
gctcggcccgtggtctgcag

SEQ ID NO: 57647 - DNA, 20 bp, human
ggcgcgagcagggaccgtca

SEQ ID NO: 57648 - DNA, 20 bp, human
ggacagaccactgcagacca

SEQ ID NO: 57649 - DNA, 20 bp, human
ggcctcagggaagcgagccc

SEQ ID NO: 57650 - DNA, 20 bp, human
gagtggtctgtcagacgcga

SEQ ID NO: 57651 - DNA, 20 bp, human
gctgcccgggcaggaaacgc

SEQ ID NO: 57652 - DNA, 20 bp, human
gctgcttaggtcgcctgccc

SEQ ID NO: 57653 - DNA, 20 bp, human
ggctaccccgtccccgacag

SEQ ID NO: 57654 - DNA, 20 bp, human
gtgccggccgcgctgcggac

SEQ ID NO: 57655 - DNA, 20 bp, human
gggtagcacttgaataaggg

SEQ ID NO: 57656 - DNA, 20 bp, human
gccgtcggggtgccaggcag

SEQ ID NO: 57657 - DNA, 20 bp, human
gccctcggaaaccgccccgg

SEQ ID NO: 57658 - DNA, 20 bp, human
ggggccctcggaaaccgccc

SEQ ID NO: 57659 - DNA, 20 bp, human
gaaccgccccggcggctgag

SEQ ID NO: 57660 - DNA, 20 bp, human
gtggggtggggagtcgtcag

SEQ ID NO: 57661 - DNA, 20 bp, human
gcagccggctccgaacgatc

SEQ ID NO: 57662 - DNA, 20 bp, human
ggttggcgacaaggaggaat

SEQ ID NO: 57663 - DNA, 20 bp, human
gagcctctcagccgccgggg

SEQ ID NO: 57664 - DNA, 20 bp, human
gcgcagcctctcagccgccg

SEQ ID NO: 57665 - DNA, 20 bp, human
gatccggagcccctcccgtc

SEQ ID NO: 57666 - DNA, 20 bp, human
gcaggtcgagtccttgggaa

SEQ ID NO: 57667 - DNA, 20 bp, human
gcttctcaggtcgagtcctt

SEQ ID NO: 57668 - DNA, 20 bp, human
gggatgctgggacatagccc

SEQ ID NO: 57669 - DNA, 20 bp, human
gcaaggagggctgcctctag

SEQ ID NO: 57670 - DNA, 20 bp, human
ggctgggttcctcactccac

SEQ ID NO: 57671 - DNA, 20 bp, human
gaagtcaggagcgtgttgct

SEQ ID NO: 57672 - DNA, 20 bp, human
gcagcagcctccgttcccag

SEQ ID NO: 57673 - DNA, 20 bp, human
ggggacttcccggtggagtg

SEQ ID NO: 57674 - DNA, 20 bp, human
gttgctagtctgggacttcc

SEQ ID NO: 57675 - DNA, 20 bp, human
ggtgataattgacttaggtg

SEQ ID NO: 57676 - DNA, 20 bp, human
gcagcggcccgactgctcgg

SEQ ID NO: 57677 - DNA, 20 bp, human
ggcccgaggcggcgcgaggg

SEQ ID NO: 57678 - DNA, 20 bp, human
gcccggcccgcaagccagtc

SEQ ID NO: 57679 - DNA, 20 bp, human
gccccgcggcagcgccgaga

SEQ ID NO: 57680 - DNA, 20 bp, human
gaagccagtccggcgcaggg

SEQ ID NO: 57681 - DNA, 20 bp, human
ggtgcacaccgcgccgggta

SEQ ID NO: 57682 - DNA, 20 bp, human
gcgcccgccgagagggtccc

SEQ ID NO: 57683 - DNA, 20 bp, human
gcggcggccctgcccgaccc

SEQ ID NO: 57684 - DNA, 20 bp, human
gcgcaagccagtccggcgca

SEQ ID NO: 57685 - DNA, 20 bp, human
ggcgggcgtacggggaccac

SEQ ID NO: 57686 - DNA, 20 bp, human
gctgtggtagttccttagag

SEQ ID NO: 57687 - DNA, 20 bp, human
gagagtttgacagacatggt

SEQ ID NO: 57688 - DNA, 20 bp, human
gagcctgcctatatctactg

SEQ ID NO: 57689 - DNA, 20 bp, human
gtcaaggcctaagtgacgaa

SEQ ID NO: 57690 - DNA, 20 bp, human
gtatctactgaggtgaggtt

SEQ ID NO: 57691 - DNA, 20 bp, human
gtaatcatgggcattcaagg

SEQ ID NO: 57692 - DNA, 20 bp, human
gaggaagagagctttgtaat

SEQ ID NO: 57693 - DNA, 20 bp, human
gacaagaaaatagatatctg

SEQ ID NO: 57694 - DNA, 20 bp, human
gaaacactgggacttttcta

SEQ ID NO: 57695 - DNA, 20 bp, human
ggcttttcttcaccgctcta

SEQ ID NO: 57696 - DNA, 20 bp, human
ggccccagatgggtgatcag

SEQ ID NO: 57697 - DNA, 20 bp, human
gtgatcagcggcagaatggg

SEQ ID NO: 57698 - DNA, 20 bp, human
gtcggatccgcgctctcccg

SEQ ID NO: 57699 - DNA, 20 bp, human
gagagcgcggatccgacgga

SEQ ID NO: 57700 - DNA, 20 bp, human
gtatccgcagtccccaccag

SEQ ID NO: 57701 - DNA, 20 bp, human
gcagcggcagacgtccctat

SEQ ID NO: 57702 - DNA, 20 bp, human
ggccgctgatcacccatctg

SEQ ID NO: 57703 - DNA, 20 bp, human
ggcccctgccgtggacaagg

SEQ ID NO: 57704 - DNA, 20 bp, human
gtcgcagcgcaggcctaggg

SEQ ID NO: 57705 - DNA, 20 bp, human
ggcgcggatccgacggaagg

SEQ ID NO: 57706 - DNA, 20 bp, human
gcacgttgcagcccaggcgg

SEQ ID NO: 57707 - DNA, 20 bp, human
gatcgcaccgaagcccaaga

SEQ ID NO: 57708 - DNA, 20 bp, human
gtgggcttcggtgcgatcgg

SEQ ID NO: 57709 - DNA, 20 bp, human
ggagctgggatcgccctctt

SEQ ID NO: 57710 - DNA, 20 bp, human
gcggttgtcgccctaaacag

SEQ ID NO: 57711 - DNA, 20 bp, human
gaggcgcgggatctcgagct

SEQ ID NO: 57712 - DNA, 20 bp, human
gcagaggagtggcctcactg

SEQ ID NO: 57713 - DNA, 20 bp, human
gggccacgttgcagcccagg

SEQ ID NO: 57714 - DNA, 20 bp, human
gggcctggcccccctactgg

SEQ ID NO: 57715 - DNA, 20 bp, human
gccccctactggtggagagg

SEQ ID NO: 57716 - DNA, 20 bp, human
gcgcggagggcagctccaaa

SEQ ID NO: 57717 - DNA, 20 bp, human
gcagatgtgactagactagg

SEQ ID NO: 57718 - DNA, 20 bp, human
gtgccttgagaggcccagac

SEQ ID NO: 57719 - DNA, 20 bp, human
gcctccgcggtcgagctgag

SEQ ID NO: 57720 - DNA, 20 bp, human
gactagggggctgcgaggtg

SEQ ID NO: 57721 - DNA, 20 bp, human
gggtatcccgaggacagtgt

SEQ ID NO: 57722 - DNA, 20 bp, human
gtgggggccttcgacagtga

SEQ ID NO: 57723 - DNA, 20 bp, human
gccccaaaggtgcccacgcg

SEQ ID NO: 57724 - DNA, 20 bp, human
ggtgctcacttccccttcca

SEQ ID NO: 57725 - DNA, 20 bp, human
ggtccagatgtgactagact

SEQ ID NO: 57726 - DNA, 20 bp, human
gaggcttcgccggagagtga

SEQ ID NO: 57727 - DNA, 20 bp, human
gctgcctgagccctcccact

SEQ ID NO: 57728 - DNA, 20 bp, human
gtggttcggtctgcaccgag

SEQ ID NO: 57729 - DNA, 20 bp, human
gcgcgggtagagagcagacg

SEQ ID NO: 57730 - DNA, 20 bp, human
gccgcgaagggcccggctgg

SEQ ID NO: 57731 - DNA, 20 bp, human
gcaggacgcgcggccgcgaa

SEQ ID NO: 57732 - DNA, 20 bp, human
gctgcaaggagggagagtcg

SEQ ID NO: 57733 - DNA, 20 bp, human
gccgggctcaacggagaccc

SEQ ID NO: 57734 - DNA, 20 bp, human
gcttcgccggagagtgaggg

SEQ ID NO: 57735 - DNA, 20 bp, human
gggcggcggccgcgatggtt

SEQ ID NO: 57736 - DNA, 20 bp, human
ggtagagccagtcagtccca

SEQ ID NO: 57737 - DNA, 20 bp, human
gtcagcgagtccggtctcaa

SEQ ID NO: 57738 - DNA, 20 bp, human
gggactcgctgatcatctac

SEQ ID NO: 57739 - DNA, 20 bp, human
gcagcggagacgcgctcgag

SEQ ID NO: 57740 - DNA, 20 bp, human
gtccgaagtccgcgccgggt

SEQ ID NO: 57741 - DNA, 20 bp, human
ggcccggggttggggagaac

SEQ ID NO: 57742 - DNA, 20 bp, human
ggtgcccggggaacgaccct

SEQ ID NO: 57743 - DNA, 20 bp, human
gcgccaatcggtgcagactc

SEQ ID NO: 57744 - DNA, 20 bp, human
gggcgcgcagggctattgcg

SEQ ID NO: 57745 - DNA, 20 bp, human
ggccggggcgtcgcttccga

SEQ ID NO: 57746 - DNA, 20 bp, human
ggaggacagagggcacccat

SEQ ID NO: 57747 - DNA, 20 bp, human
gggtacactcacctctgcat

SEQ ID NO: 57748 - DNA, 20 bp, human
gactgccaaggagactccct

SEQ ID NO: 57749 - DNA, 20 bp, human
gttgggcaggtccagactga

SEQ ID NO: 57750 - DNA, 20 bp, human
gggcagtgggtcagattcca

SEQ ID NO: 57751 - DNA, 20 bp, human
gaattaggcctcccatgcag

SEQ ID NO: 57752 - DNA, 20 bp, human
gactgcttgtctgaccccat

SEQ ID NO: 57753 - DNA, 20 bp, human
gcccaaggacccctgcaatt

SEQ ID NO: 57754 - DNA, 20 bp, human
ggctgcctgccaggcttcta

SEQ ID NO: 57755 - DNA, 20 bp, human
gcatgggaggcctaattgca

SEQ ID NO: 57756 - DNA, 20 bp, human
ggcctcgccagcactcggcc

SEQ ID NO: 57757 - DNA, 20 bp, human
gtcccgcccagctggagctc

SEQ ID NO: 57758 - DNA, 20 bp, human
gtggattccaggccgagtgc

SEQ ID NO: 57759 - DNA, 20 bp, human
ggctccagctgggcgggaaa

SEQ ID NO: 57760 - DNA, 20 bp, human
gctcgtatttgaggaagcaa

SEQ ID NO: 57761 - DNA, 20 bp, human
gcgcagtgagtgagcacaca

SEQ ID NO: 57762 - DNA, 20 bp, human
gtccaggccgagtgctggcg

SEQ ID NO: 57763 - DNA, 20 bp, human
gggcgtggtaggattggaag

SEQ ID NO: 57764 - DNA, 20 bp, human
ggcgttgagcgctggattcc

SEQ ID NO: 57765 - DNA, 20 bp, human
gcctggaaaggcagaaagtg

SEQ ID NO: 57766 - DNA, 20 bp, human
gagcaggcaaggaccgccgt

SEQ ID NO: 57767 - DNA, 20 bp, human
gcaggcgtctgagacttggt

SEQ ID NO: 57768 - DNA, 20 bp, human
gggccagcctaccggcgact

SEQ ID NO: 57769 - DNA, 20 bp, human
gccggcccaggccagcctac

SEQ ID NO: 57770 - DNA, 20 bp, human
gaagcatcctagtcgccggt

SEQ ID NO: 57771 - DNA, 20 bp, human
ggtgctggattccaagggac

SEQ ID NO: 57772 - DNA, 20 bp, human
ggcgaaagcatcctagtcgc

SEQ ID NO: 57773 - DNA, 20 bp, human
gtggaaaggcaaggccgagg

SEQ ID NO: 57774 - DNA, 20 bp, human
ggccaatcggcttccgaagt

SEQ ID NO: 57775 - DNA, 20 bp, human
gaaaccgggagaatagaagc

SEQ ID NO: 57776 - DNA, 20 bp, human
gtgcctggagtgtagtgtga

SEQ ID NO: 57777 - DNA, 20 bp, human
ggactctccggttctgtgag

SEQ ID NO: 57778 - DNA, 20 bp, human
gagtgtgagggtgcttctta

SEQ ID NO: 57779 - DNA, 20 bp, human
gcaccctcacactacactcc

SEQ ID NO: 57780 - DNA, 20 bp, human
ggaaaaaccactcacagaac

SEQ ID NO: 57781 - DNA, 20 bp, human
gggatttctggaaagagacg

SEQ ID NO: 57782 - DNA, 20 bp, human
gcctgcaaatccagagcggc

SEQ ID NO: 57783 - DNA, 20 bp, human
gtcggacctggagttcttag

SEQ ID NO: 57784 - DNA, 20 bp, human
gaacggcaccgggcagggaa

SEQ ID NO: 57785 - DNA, 20 bp, human
gccgtcagtgcccgccgctc

SEQ ID NO: 57786 - DNA, 20 bp, human
gtacgcgcgggagtgcccag

SEQ ID NO: 57787 - DNA, 20 bp, human
ggcgtactcggccgcctgag

SEQ ID NO: 57788 - DNA, 20 bp, human
gcctgagcggtaagagcccc

SEQ ID NO: 57789 - DNA, 20 bp, human
gcttggccccgagccattgg

SEQ ID NO: 57790 - DNA, 20 bp, human
gcccccagcccgggcacgaa

SEQ ID NO: 57791 - DNA, 20 bp, human
gcggcctgcgtgaacctccg

SEQ ID NO: 57792 - DNA, 20 bp, human
ggatggggaccgagtgcccg

SEQ ID NO: 57793 - DNA, 20 bp, human
gctcggggccaagtcagagg

SEQ ID NO: 57794 - DNA, 20 bp, human
ggcggccgagggacctgcgt

SEQ ID NO: 57795 - DNA, 20 bp, human
gaccctgagtgtgggcgtgt

SEQ ID NO: 57796 - DNA, 20 bp, human
ggccaccctcagcacagcca

SEQ ID NO: 57797 - DNA, 20 bp, human
gctgagggtggcggccggat

SEQ ID NO: 57798 - DNA, 20 bp, human
gggtggcggccggataggtg

SEQ ID NO: 57799 - DNA, 20 bp, human
gggcagtaggaacgccgagt

SEQ ID NO: 57800 - DNA, 20 bp, human
ggtgcggagcttcctgaacg

SEQ ID NO: 57801 - DNA, 20 bp, human
gcgctgaaggagcacttccg

SEQ ID NO: 57802 - DNA, 20 bp, human
gttcctgaacgaggcaggag

SEQ ID NO: 57803 - DNA, 20 bp, human
ggaggcggtgacctgacggt

SEQ ID NO: 57804 - DNA, 20 bp, human
ggacagatgaggaaacggag

SEQ ID NO: 57805 - DNA, 20 bp, human
gaggaagctccgcacctatc

SEQ ID NO: 57806 - DNA, 20 bp, human
gtctccgcccaggaggcaaa

SEQ ID NO: 57807 - DNA, 20 bp, human
ggcagcgggctcgaaactac

SEQ ID NO: 57808 - DNA, 20 bp, human
gagcagagggcataacaatg

SEQ ID NO: 57809 - DNA, 20 bp, human
ggcgggaggcggttgttccc

SEQ ID NO: 57810 - DNA, 20 bp, human
ggtagcaacctgctaggagc

SEQ ID NO: 57811 - DNA, 20 bp, human
gggctcgaaactacaggact

SEQ ID NO: 57812 - DNA, 20 bp, human
ggagctagcaggaaccctcg

SEQ ID NO: 57813 - DNA, 20 bp, human
ggaacggctctatcacctgg

SEQ ID NO: 57814 - DNA, 20 bp, human
gcgccccggacactaacccg

SEQ ID NO: 57815 - DNA, 20 bp, human
gctgctagctcagatcttaa

SEQ ID NO: 57816 - DNA, 20 bp, human
gggctcggtcgcccagtcac

SEQ ID NO: 57817 - DNA, 20 bp, human
gtcgcccagtcactggtaca

SEQ ID NO: 57818 - DNA, 20 bp, human
ggcgcagagaggaatgcaca

SEQ ID NO: 57819 - DNA, 20 bp, human
gcaccctgcgatttccacgg

SEQ ID NO: 57820 - DNA, 20 bp, human
gttcggcacacccagaccca

SEQ ID NO: 57821 - DNA, 20 bp, human
gcttccctgtaccagtgact

SEQ ID NO: 57822 - DNA, 20 bp, human
gccgctcccaaatcccggct

SEQ ID NO: 57823 - DNA, 20 bp, human
ggatttccacgggggcaggt

SEQ ID NO: 57824 - DNA, 20 bp, human
gtgtcggatgagaaggcccg

SEQ ID NO: 57825 - DNA, 20 bp, human
gatgggtgcgccgtgggtct

SEQ ID NO: 57826 - DNA, 20 bp, human
ggcagtggcgcgcgggggac

SEQ ID NO: 57827 - DNA, 20 bp, human
ggctctgcagtggcgcgcgg

SEQ ID NO: 57828 - DNA, 20 bp, human
gcgcgcgggggacgggtcgg

SEQ ID NO: 57829 - DNA, 20 bp, human
gcaggctctgcagtggcgcg

SEQ ID NO: 57830 - DNA, 20 bp, human
gtacctagggactgacggac

SEQ ID NO: 57831 - DNA, 20 bp, human
gaggtatccgcactgctcag

SEQ ID NO: 57832 - DNA, 20 bp, human
ggcggatacctagggactga

SEQ ID NO: 57833 - DNA, 20 bp, human
gagcctgtccgtcagtccct

SEQ ID NO: 57834 - DNA, 20 bp, human
gtggcgcgcgggggacgggt

SEQ ID NO: 57835 - DNA, 20 bp, human
gacgtcgcttgtcttctggg

SEQ ID NO: 57836 - DNA, 20 bp, human
ggcagccgggagagccatgg

SEQ ID NO: 57837 - DNA, 20 bp, human
gcgaggagccgtgaaacgtg

SEQ ID NO: 57838 - DNA, 20 bp, human
ggggcgttcagagtctatga

SEQ ID NO: 57839 - DNA, 20 bp, human
gcagagtctatgagggcgga

SEQ ID NO: 57840 - DNA, 20 bp, human
ggctgtgtgagtctcgcagt

SEQ ID NO: 57841 - DNA, 20 bp, human
ggcggggagtcgggtcccgg

SEQ ID NO: 57842 - DNA, 20 bp, human
gcgttcagagtctatgaggg

SEQ ID NO: 57843 - DNA, 20 bp, human
gaccgctgggacggagtgtg

SEQ ID NO: 57844 - DNA, 20 bp, human
gcccgcacactccgtcccag

SEQ ID NO: 57845 - DNA, 20 bp, human
gcccccaatggctccttcca

SEQ ID NO: 57846 - DNA, 20 bp, human
gcagaaagtgactccagtgg

SEQ ID NO: 57847 - DNA, 20 bp, human
gtgactccagtggtggaacc

SEQ ID NO: 57848 - DNA, 20 bp, human
gtcacgtaactaaaaatggt

SEQ ID NO: 57849 - DNA, 20 bp, human
gtgggcgccattttgaagtt

SEQ ID NO: 57850 - DNA, 20 bp, human
gctcacttgctgttagctaa

SEQ ID NO: 57851 - DNA, 20 bp, human
gcagacaggaaacttgatgg

SEQ ID NO: 57852 - DNA, 20 bp, human
gcaacctgatggattctggg

SEQ ID NO: 57853 - DNA, 20 bp, human
gaaacaatcaggctacgaag

SEQ ID NO: 57854 - DNA, 20 bp, human
gcaagtttcctgtctggtag

SEQ ID NO: 57855 - DNA, 20 bp, human
gtctcgaaggggtgggaatg

SEQ ID NO: 57856 - DNA, 20 bp, human
ggcggcggcggcaacaacaa

SEQ ID NO: 57857 - DNA, 20 bp, human
ggcggcggcaacaacaacgg

SEQ ID NO: 57858 - DNA, 20 bp, human
ggccggggcaggcagcaacg

SEQ ID NO: 57859 - DNA, 20 bp, human
gcggggtgcagggggagacc

SEQ ID NO: 57860 - DNA, 20 bp, human
ggtgacgaagccggactccg

SEQ ID NO: 57861 - DNA, 20 bp, human
gcactattgttgatgaggag

SEQ ID NO: 57862 - DNA, 20 bp, human
gtattgttgatgaggagcgg

SEQ ID NO: 57863 - DNA, 20 bp, human
ggccggactccggggtgcag

SEQ ID NO: 57864 - DNA, 20 bp, human
gagggcaggccccccaagac

SEQ ID NO: 57865 - DNA, 20 bp, human
gacctcgccggtccacaggt

SEQ ID NO: 57866 - DNA, 20 bp, human
gtagcggccggggtcctcag

SEQ ID NO: 57867 - DNA, 20 bp, human
ggctgccggctaacgcggag

SEQ ID NO: 57868 - DNA, 20 bp, human
gggcagggcggatcctgagg

SEQ ID NO: 57869 - DNA, 20 bp, human
gggccgccgagagaccccgg

SEQ ID NO: 57870 - DNA, 20 bp, human
ggccggagtcggagccagag

SEQ ID NO: 57871 - DNA, 20 bp, human
ggcgccgctgccggctaacg

SEQ ID NO: 57872 - DNA, 20 bp, human
gtgctggaagcaagtcccaa

SEQ ID NO: 57873 - DNA, 20 bp, human
gggggttcgcgggcctggag

SEQ ID NO: 57874 - DNA, 20 bp, human
gctgcccccgagaccccctc

SEQ ID NO: 57875 - DNA, 20 bp, human
gtggactccgagaccccctg

SEQ ID NO: 57876 - DNA, 20 bp, human
ggagaagggcgactacaatg

SEQ ID NO: 57877 - DNA, 20 bp, human
ggcccctggatccggggaaa

SEQ ID NO: 57878 - DNA, 20 bp, human
gggagactcggtgagtgtgt

SEQ ID NO: 57879 - DNA, 20 bp, human
gggacggtgcgcgctcagtg

SEQ ID NO: 57880 - DNA, 20 bp, human
gtccagctgcagctaccggc

SEQ ID NO: 57881 - DNA, 20 bp, human
gctgggagttggaagatgaa

SEQ ID NO: 57882 - DNA, 20 bp, human
gcggccccttcccttatcca

SEQ ID NO: 57883 - DNA, 20 bp, human
gggccgtcatccttaggaga

SEQ ID NO: 57884 - DNA, 20 bp, human
gtgtgtagggaagccgggct

SEQ ID NO: 57885 - DNA, 20 bp, human
ggtgctgggggccctggata

SEQ ID NO: 57886 - DNA, 20 bp, human
gggcctcggcctcgcagcgg

SEQ ID NO: 57887 - DNA, 20 bp, human
gggtgtagaagccgccgtag

SEQ ID NO: 57888 - DNA, 20 bp, human
gtggccgccgctgacccagt

SEQ ID NO: 57889 - DNA, 20 bp, human
gcatgtgctgccgcctccca

SEQ ID NO: 57890 - DNA, 20 bp, human
ggcctgcaccgcctctacgg

SEQ ID NO: 57891 - DNA, 20 bp, human
ggtagaagccgccgtagagg

SEQ ID NO: 57892 - DNA, 20 bp, human
gtctacaccgactgggtcag

SEQ ID NO: 57893 - DNA, 20 bp, human
gcacatgcttggctacctgg

SEQ ID NO: 57894 - DNA, 20 bp, human
gacaccgactgggtcagcgg

SEQ ID NO: 57895 - DNA, 20 bp, human
gaggcggtgcaggcagttgt

SEQ ID NO: 57896 - DNA, 20 bp, human
gcggaccccgcagtcagtgt

SEQ ID NO: 57897 - DNA, 20 bp, human
gtcgcccgagaaccaccggg

SEQ ID NO: 57898 - DNA, 20 bp, human
ggcgcgagaatgcagttccg

SEQ ID NO: 57899 - DNA, 20 bp, human
gcccgtcccggcccaactcc

SEQ ID NO: 57900 - DNA, 20 bp, human
gccagagtggtgcgagccga

SEQ ID NO: 57901 - DNA, 20 bp, human
gaggcccgccggctagcagg

SEQ ID NO: 57902 - DNA, 20 bp, human
ggacggcggcgttagaaagg

SEQ ID NO: 57903 - DNA, 20 bp, human
gagcctcccggatcccgtcc

SEQ ID NO: 57904 - DNA, 20 bp, human
gggccgggacgggatccggg

SEQ ID NO: 57905 - DNA, 20 bp, human
gctgctgcccacactgactg

SEQ ID NO: 57906 - DNA, 20 bp, human
ggccgcggtgacaaggacag

SEQ ID NO: 57907 - DNA, 20 bp, human
gatcttaagggagggagtag

SEQ ID NO: 57908 - DNA, 20 bp, human
ggcggaagcggaagtgaacg

SEQ ID NO: 57909 - DNA, 20 bp, human
ggcgcgtctgcggctggtgt

SEQ ID NO: 57910 - DNA, 20 bp, human
gaccgcggctgcgacatcat

SEQ ID NO: 57911 - DNA, 20 bp, human
ggtgaacgaggcggctgtgg

SEQ ID NO: 57912 - DNA, 20 bp, human
gtcagaggtgacctcaagat

SEQ ID NO: 57913 - DNA, 20 bp, human
gtaggtagggccgggcccga

SEQ ID NO: 57914 - DNA, 20 bp, human
gctggtgttggcgcatctct

SEQ ID NO: 57915 - DNA, 20 bp, human
ggctgaggcggctgggccta

SEQ ID NO: 57916 - DNA, 20 bp, human
gcggtgggcagacgcgatag

SEQ ID NO: 57917 - DNA, 20 bp, human
gggtagccgccatagagccg

SEQ ID NO: 57918 - DNA, 20 bp, human
ggcggctgcgcaagcaggat

SEQ ID NO: 57919 - DNA, 20 bp, human
gcgctgccgcggctctatgg

SEQ ID NO: 57920 - DNA, 20 bp, human
gacacccatgcttcgtcggt

SEQ ID NO: 57921 - DNA, 20 bp, human
gctgcccaccgacgaagcat

SEQ ID NO: 57922 - DNA, 20 bp, human
gctggacacccatgcttcgt

SEQ ID NO: 57923 - DNA, 20 bp, human
ggaggcaacatggctcccgg

SEQ ID NO: 57924 - DNA, 20 bp, human
gaggcacccaaggcagcggg

SEQ ID NO: 57925 - DNA, 20 bp, human
ggtgtaccaccgagaagacg

SEQ ID NO: 57926 - DNA, 20 bp, human
ggctgacagattctcggtgg

SEQ ID NO: 57927 - DNA, 20 bp, human
gagctgcctccgggtacggg

SEQ ID NO: 57928 - DNA, 20 bp, human
gcccgctgacagattctcgg

SEQ ID NO: 57929 - DNA, 20 bp, human
gcgagagacggtccacgaac

SEQ ID NO: 57930 - DNA, 20 bp, human
gcagcccgctgacagattct

SEQ ID NO: 57931 - DNA, 20 bp, human
gctgaggccgtggatcaggg

SEQ ID NO: 57932 - DNA, 20 bp, human
gcagataagccactcctggg

SEQ ID NO: 57933 - DNA, 20 bp, human
ggcggcggccctggactgcg

SEQ ID NO: 57934 - DNA, 20 bp, human
gggtgctcagtcagggacct

SEQ ID NO: 57935 - DNA, 20 bp, human
ggagacggtccacgaacggg

SEQ ID NO: 57936 - DNA, 20 bp, human
gggaagaactggcccagcgg

SEQ ID NO: 57937 - DNA, 20 bp, human
gcgcgtgcgcaggacccgat

SEQ ID NO: 57938 - DNA, 20 bp, human
gcgcggaagaactggcccag

SEQ ID NO: 57939 - DNA, 20 bp, human
gcggctgaggaccacaagcg

SEQ ID NO: 57940 - DNA, 20 bp, human
gcccgatgggtgcccggacg

SEQ ID NO: 57941 - DNA, 20 bp, human
gagaagcgggaacctccgct

SEQ ID NO: 57942 - DNA, 20 bp, human
ggttcccgcttctgaagcgt

SEQ ID NO: 57943 - DNA, 20 bp, human
gggccgggctacagatgctg

SEQ ID NO: 57944 - DNA, 20 bp, human
gccgggtccgggagcatggg

SEQ ID NO: 57945 - DNA, 20 bp, human
gtccgcgtccgggcacccat

SEQ ID NO: 57946 - DNA, 20 bp, human
gcgtctgcggtagtggaact

SEQ ID NO: 57947 - DNA, 20 bp, human
gggcttaccatgagttgcca

SEQ ID NO: 57948 - DNA, 20 bp, human
gtctcagccctggcaactca

SEQ ID NO: 57949 - DNA, 20 bp, human
gctgctagggctgcaaaggt

SEQ ID NO: 57950 - DNA, 20 bp, human
ggatggagaaggattcgcgg

SEQ ID NO: 57951 - DNA, 20 bp, human
gggacccaactgattgtcaa

SEQ ID NO: 57952 - DNA, 20 bp, human
ggtgagccgggttgagatac

SEQ ID NO: 57953 - DNA, 20 bp, human
gcccaactgattgtcaaagg

SEQ ID NO: 57954 - DNA, 20 bp, human
gctggaggaggcaagcggtg

SEQ ID NO: 57955 - DNA, 20 bp, human
ggcttatcgcaggctctgag

SEQ ID NO: 57956 - DNA, 20 bp, human
gatcgcctcacaggatgggt

SEQ ID NO: 57957 - DNA, 20 bp, human
gagggcgccccgggtcacga

SEQ ID NO: 57958 - DNA, 20 bp, human
gagcccggccggctcggact

SEQ ID NO: 57959 - DNA, 20 bp, human
gcgggccgccagacgctcgg

SEQ ID NO: 57960 - DNA, 20 bp, human
gtctctagcgatgcagacaa

SEQ ID NO: 57961 - DNA, 20 bp, human
gcgcccagtccgagccggcc

SEQ ID NO: 57962 - DNA, 20 bp, human
gtcccgggccgccagacgct

SEQ ID NO: 57963 - DNA, 20 bp, human
ggctccctccgagcgtctgg

SEQ ID NO: 57964 - DNA, 20 bp, human
gggcagggcgggcaccaccc

SEQ ID NO: 57965 - DNA, 20 bp, human
gcccgtcgcacggatcagga

SEQ ID NO: 57966 - DNA, 20 bp, human
gctgcacgaaagcccgggag

SEQ ID NO: 57967 - DNA, 20 bp, human
gtcgtgcaggaagagcaaca

SEQ ID NO: 57968 - DNA, 20 bp, human
gctgaaagagccggacctct

SEQ ID NO: 57969 - DNA, 20 bp, human
gagagcaacacggacatccc

SEQ ID NO: 57970 - DNA, 20 bp, human
gctccatggatgagacacag

SEQ ID NO: 57971 - DNA, 20 bp, human
ggaggctgctgaacccgagc

SEQ ID NO: 57972 - DNA, 20 bp, human
gtaggtcacgcagaaaccct

SEQ ID NO: 57973 - DNA, 20 bp, human
gccctggggaacgcctgaaa

SEQ ID NO: 57974 - DNA, 20 bp, human
gctggccacccgtggactta

SEQ ID NO: 57975 - DNA, 20 bp, human
ggcacggctcccttctgcag

SEQ ID NO: 57976 - DNA, 20 bp, human
gtgggttgtcagtcagtgag

SEQ ID NO: 57977 - DNA, 20 bp, human
ggcggcagtggtggctctcc

SEQ ID NO: 57978 - DNA, 20 bp, human
ggttgtcagtcagtgagagg

SEQ ID NO: 57979 - DNA, 20 bp, human
gcgcgcgaggcgccatgggt

SEQ ID NO: 57980 - DNA, 20 bp, human
gcaggctgcgcccaacttcg

SEQ ID NO: 57981 - DNA, 20 bp, human
gctggtcgtgcctgtcagag

SEQ ID NO: 57982 - DNA, 20 bp, human
gcagtggtggctctcccggc

SEQ ID NO: 57983 - DNA, 20 bp, human
gcactgactgacaacccagc

SEQ ID NO: 57984 - DNA, 20 bp, human
gtcggctggactcaccaggg

SEQ ID NO: 57985 - DNA, 20 bp, human
gttcctagcagaacgggtcc

SEQ ID NO: 57986 - DNA, 20 bp, human
gagacagcagggtgacaggt

SEQ ID NO: 57987 - DNA, 20 bp, human
gtaggaagccggagacagca

SEQ ID NO: 57988 - DNA, 20 bp, human
gcagggtgacaggtaggcgg

SEQ ID NO: 57989 - DNA, 20 bp, human
ggtggcgccagcagagaggg

SEQ ID NO: 57990 - DNA, 20 bp, human
gggccctaagaagcaatcac

SEQ ID NO: 57991 - DNA, 20 bp, human
ggagcaaggcggtgtcgtga

SEQ ID NO: 57992 - DNA, 20 bp, human
gcgacgtgggggcccaccta

SEQ ID NO: 57993 - DNA, 20 bp, human
gtccgggaccaccaacacac

SEQ ID NO: 57994 - DNA, 20 bp, human
gggccgcggaaactacagac

SEQ ID NO: 57995 - DNA, 20 bp, human
gcggtgtcgtgagggctgaa

SEQ ID NO: 57996 - DNA, 20 bp, human
gggagcagcgatggacggtc

SEQ ID NO: 57997 - DNA, 20 bp, human
ggacgcgtcgcaggccggat

SEQ ID NO: 57998 - DNA, 20 bp, human
gagcgaggagcagcgatgga

SEQ ID NO: 57999 - DNA, 20 bp, human
gaggccggatcggcaaggcc

SEQ ID NO: 58000 - DNA, 20 bp, human
ggtcgcaggccggatcggca

SEQ ID NO: 58001 - DNA, 20 bp, human
ggacgtcaatgggctccacc

SEQ ID NO: 58002 - DNA, 20 bp, human
gccggatcggcaaggccagg

SEQ ID NO: 58003 - DNA, 20 bp, human
gtcgcttcgctggacgtcaa

SEQ ID NO: 58004 - DNA, 20 bp, human
gtctgcagaggtcagtaccg

SEQ ID NO: 58005 - DNA, 20 bp, human
gtcgctgctcctcgcttcgc

SEQ ID NO: 58006 - DNA, 20 bp, human
ggcgcctgtggagaccctag

SEQ ID NO: 58007 - DNA, 20 bp, human
ggcgcgcgcggcacgatgga

SEQ ID NO: 58008 - DNA, 20 bp, human
gcgcggcacgatggacggtc

SEQ ID NO: 58009 - DNA, 20 bp, human
gagaccctagcggtggccac

SEQ ID NO: 58010 - DNA, 20 bp, human
ggcaacccagcgaaactccg

SEQ ID NO: 58011 - DNA, 20 bp, human
gccaccgctagggtctccac

SEQ ID NO: 58012 - DNA, 20 bp, human
ggtttcgctgggttgcgtgg

SEQ ID NO: 58013 - DNA, 20 bp, human
gtgcgtgggggtcagcgcta

SEQ ID NO: 58014 - DNA, 20 bp, human
ggtgccagtggccaccgcta

SEQ ID NO: 58015 - DNA, 20 bp, human
gcggagcgcgcgcggcacga

SEQ ID NO: 58016 - DNA, 20 bp, human
ggccagcgcggcgcgatgga

SEQ ID NO: 58017 - DNA, 20 bp, human
gtacgcctcggtgcagcccc

SEQ ID NO: 58018 - DNA, 20 bp, human
ggaagccccggtaatcactg

SEQ ID NO: 58019 - DNA, 20 bp, human
gtagcgggaagtgcatgtcg

SEQ ID NO: 58020 - DNA, 20 bp, human
gaaactcagcggagccagcg

SEQ ID NO: 58021 - DNA, 20 bp, human
gttcgccgggggctgcaccg

SEQ ID NO: 58022 - DNA, 20 bp, human
gtgcacttcccgctacgcct

SEQ ID NO: 58023 - DNA, 20 bp, human
ggcctggggaccggtgctct

SEQ ID NO: 58024 - DNA, 20 bp, human
gggctgcaccgaggcgtagc

SEQ ID NO: 58025 - DNA, 20 bp, human
gccggaggggccgagccagg

SEQ ID NO: 58026 - DNA, 20 bp, human
gggcggcactgaccccgagg

SEQ ID NO: 58027 - DNA, 20 bp, human
ggcccgctgctagctcctgg

SEQ ID NO: 58028 - DNA, 20 bp, human
gccgctcagaactcagtcca

SEQ ID NO: 58029 - DNA, 20 bp, human
ggtccagggcaggtactgga

SEQ ID NO: 58030 - DNA, 20 bp, human
gcgccgtcggatcaacctcc

SEQ ID NO: 58031 - DNA, 20 bp, human
gggcagctcgcggtcatggg

SEQ ID NO: 58032 - DNA, 20 bp, human
gctcctggaggttgatccga

SEQ ID NO: 58033 - DNA, 20 bp, human
gaacctccaggagctagcag

SEQ ID NO: 58034 - DNA, 20 bp, human
ggcaggtgcaggatgcgggt

SEQ ID NO: 58035 - DNA, 20 bp, human
gtcagagccgggttcgccgt

SEQ ID NO: 58036 - DNA, 20 bp, human
gggagtcaggccgggccggt

SEQ ID NO: 58037 - DNA, 20 bp, human
gccaagcccgggctccgaag

SEQ ID NO: 58038 - DNA, 20 bp, human
ggagggaacgagctcggacg

SEQ ID NO: 58039 - DNA, 20 bp, human
ggccaaggcggccggctgga

SEQ ID NO: 58040 - DNA, 20 bp, human
gagtccccttgagccgggaa

SEQ ID NO: 58041 - DNA, 20 bp, human
ggggccggtgggagctgcca

SEQ ID NO: 58042 - DNA, 20 bp, human
ggcccgaccgggagcggagc

SEQ ID NO: 58043 - DNA, 20 bp, human
gtggagggacggggcccgac

SEQ ID NO: 58044 - DNA, 20 bp, human
ggctcagaagagcgcgggaa

SEQ ID NO: 58045 - DNA, 20 bp, human
gtccgctccggctccgctcc

SEQ ID NO: 58046 - DNA, 20 bp, human
gagtgagagccccaaaagga

SEQ ID NO: 58047 - DNA, 20 bp, human
gcaaggacgtgctaggagtc

SEQ ID NO: 58048 - DNA, 20 bp, human
ggtgctaggagtcaggaact

SEQ ID NO: 58049 - DNA, 20 bp, human
gcagctctcaaggacgtgct

SEQ ID NO: 58050 - DNA, 20 bp, human
ggctctcactctggaggatg

SEQ ID NO: 58051 - DNA, 20 bp, human
gaaaaggaagggaccggaac

SEQ ID NO: 58052 - DNA, 20 bp, human
gtctggaggatggggtggat

SEQ ID NO: 58053 - DNA, 20 bp, human
ggggagtgactgtccggcac

SEQ ID NO: 58054 - DNA, 20 bp, human
gtgacctcccaaagcgtcat

SEQ ID NO: 58055 - DNA, 20 bp, human
gtacagcacccactgacaag

SEQ ID NO: 58056 - DNA, 20 bp, human
gcgggagacgacagcagcat

SEQ ID NO: 58057 - DNA, 20 bp, human
ggaacgcaggcggtggtcgt

SEQ ID NO: 58058 - DNA, 20 bp, human
gcccctgagccgaggaacgc

SEQ ID NO: 58059 - DNA, 20 bp, human
ggagacgacagcagcatggg

SEQ ID NO: 58060 - DNA, 20 bp, human
gggggttcggttcagaccta

SEQ ID NO: 58061 - DNA, 20 bp, human
gcagcagcggcagcacctaa

SEQ ID NO: 58062 - DNA, 20 bp, human
ggcttgtccagagggctcga

SEQ ID NO: 58063 - DNA, 20 bp, human
gtcaggggcacctggatggc

SEQ ID NO: 58064 - DNA, 20 bp, human
ggaccaccgcctgcgttcct

SEQ ID NO: 58065 - DNA, 20 bp, human
ggtgagaggcttggtcacag

SEQ ID NO: 58066 - DNA, 20 bp, human
gtagggtcgcggccacactg

SEQ ID NO: 58067 - DNA, 20 bp, human
gcatcgccttgcagagggta

SEQ ID NO: 58068 - DNA, 20 bp, human
ggagagcccgtgagagggga

SEQ ID NO: 58069 - DNA, 20 bp, human
gggcgggccaggcaacagga

SEQ ID NO: 58070 - DNA, 20 bp, human
ggtcgcggccacactgggga

SEQ ID NO: 58071 - DNA, 20 bp, human
ggtgtgcccactgctcaggg

SEQ ID NO: 58072 - DNA, 20 bp, human
gtccggccaccctgagcagt

SEQ ID NO: 58073 - DNA, 20 bp, human
gcttgcagagggtagggtcg

SEQ ID NO: 58074 - DNA, 20 bp, human
gtctgccctgcaaaacccca

SEQ ID NO: 58075 - DNA, 20 bp, human
ggcaggccgtgggagcgaac

SEQ ID NO: 58076 - DNA, 20 bp, human
gcggctcccggtgctccccc

SEQ ID NO: 58077 - DNA, 20 bp, human
gcgcgcgccggggggagcac

SEQ ID NO: 58078 - DNA, 20 bp, human
gcggcgctgcagagcggctg

SEQ ID NO: 58079 - DNA, 20 bp, human
gccgggccctcaccgactcg

SEQ ID NO: 58080 - DNA, 20 bp, human
gtagcagggcaaggcgggtg

SEQ ID NO: 58081 - DNA, 20 bp, human
ggcgcgccccgagtcggtga

SEQ ID NO: 58082 - DNA, 20 bp, human
ggaggaccgcgcctgcggga

SEQ ID NO: 58083 - DNA, 20 bp, human
ggcggacggaaggaaagtga

SEQ ID NO: 58084 - DNA, 20 bp, human
gggagggacagagggaccgc

SEQ ID NO: 58085 - DNA, 20 bp, human
gcggaggcgcaagacgagag

SEQ ID NO: 58086 - DNA, 20 bp, human
ggcggcagcagggacgaccc

SEQ ID NO: 58087 - DNA, 20 bp, human
gacagagctagggacggtag

SEQ ID NO: 58088 - DNA, 20 bp, human
ggcagagagcgcacgtgcag

SEQ ID NO: 58089 - DNA, 20 bp, human
gcatcccccaggtctccgag

SEQ ID NO: 58090 - DNA, 20 bp, human
gctcgccgctcggagacctg

SEQ ID NO: 58091 - DNA, 20 bp, human
gtagggatgagagcgcggca

SEQ ID NO: 58092 - DNA, 20 bp, human
gggagctgaggccgagctga

SEQ ID NO: 58093 - DNA, 20 bp, human
gcagcagggacgacccaggc

SEQ ID NO: 58094 - DNA, 20 bp, human
gcctgagggggacagagcta

SEQ ID NO: 58095 - DNA, 20 bp, human
gacacgcaggagcccatcac

SEQ ID NO: 58096 - DNA, 20 bp, human
ggcatggctccgtcccgagg

SEQ ID NO: 58097 - DNA, 20 bp, human
gccgaggaggaccacgaccg

SEQ ID NO: 58098 - DNA, 20 bp, human
ggccgcatggctccgtcccg

SEQ ID NO: 58099 - DNA, 20 bp, human
gcgcagctcgtgctcctcgg

SEQ ID NO: 58100 - DNA, 20 bp, human
gctcgaaaagggcgacccgg

SEQ ID NO: 58101 - DNA, 20 bp, human
gtaactgcggcccccaaccg

SEQ ID NO: 58102 - DNA, 20 bp, human
gcggcaggcccacgcttcaa

SEQ ID NO: 58103 - DNA, 20 bp, human
gggccaggtctccgctgcag

SEQ ID NO: 58104 - DNA, 20 bp, human
gcgcttcaaagggttaactg

SEQ ID NO: 58105 - DNA, 20 bp, human
gggcgccagggcgcagtcat

SEQ ID NO: 58106 - DNA, 20 bp, human
ggcgtagacgagcagcaggc

SEQ ID NO: 58107 - DNA, 20 bp, human
gttataaggcgaggagcccg

SEQ ID NO: 58108 - DNA, 20 bp, human
gtgccccgccgggctgaggg

SEQ ID NO: 58109 - DNA, 20 bp, human
gacacggccctgagtctctg

SEQ ID NO: 58110 - DNA, 20 bp, human
gtccctcgcggctccgagcg

SEQ ID NO: 58111 - DNA, 20 bp, human
ggtagacgccgccctcagcc

SEQ ID NO: 58112 - DNA, 20 bp, human
gcgggccggggccatgcggg

SEQ ID NO: 58113 - DNA, 20 bp, human
ggggattcaagcgcgttata

SEQ ID NO: 58114 - DNA, 20 bp, human
ggcgggcccgggcgtcttac

SEQ ID NO: 58115 - DNA, 20 bp, human
gcgtcttaccggcggacgag

SEQ ID NO: 58116 - DNA, 20 bp, human
gaactgactcacggcaacat

SEQ ID NO: 58117 - DNA, 20 bp, human
gaaatggtgtaactgactca

SEQ ID NO: 58118 - DNA, 20 bp, human
gggttcgcaaaccttgtaga

SEQ ID NO: 58119 - DNA, 20 bp, human
gtgctacagaacaactccct

SEQ ID NO: 58120 - DNA, 20 bp, human
gtggtttatatccatctaca

SEQ ID NO: 58121 - DNA, 20 bp, human
gagcattgagaagggctacg

SEQ ID NO: 58122 - DNA, 20 bp, human
gaagtgctgtctgtgatgtt

SEQ ID NO: 58123 - DNA, 20 bp, human
gtgtaaatcatactatagta

SEQ ID NO: 58124 - DNA, 20 bp, human
ggtcttttttattgtaccaa

SEQ ID NO: 58125 - DNA, 20 bp, human
gggcaagttagcagcaaggt

SEQ ID NO: 58126 - DNA, 20 bp, human
ggtgagtcggatgcgtccaa

SEQ ID NO: 58127 - DNA, 20 bp, human
gcacgcgcatctgggatcgg

SEQ ID NO: 58128 - DNA, 20 bp, human
gctggggcggccgataccaa

SEQ ID NO: 58129 - DNA, 20 bp, human
gctctctaggcggagtgggg

SEQ ID NO: 58130 - DNA, 20 bp, human
ggcgcacgcgcatctgggat

SEQ ID NO: 58131 - DNA, 20 bp, human
gtaccaaggggcgggtgagt

SEQ ID NO: 58132 - DNA, 20 bp, human
gagccctcgcggttctaagt

SEQ ID NO: 58133 - DNA, 20 bp, human
ggcggcagccctcagacgtg

SEQ ID NO: 58134 - DNA, 20 bp, human
gggcggccgataccaagggg

SEQ ID NO: 58135 - DNA, 20 bp, human
gagtcttcggagttacatgg

SEQ ID NO: 58136 - DNA, 20 bp, human
gccgagcccgcgaggagcca

SEQ ID NO: 58137 - DNA, 20 bp, human
ggcgccgcggaggacagcag

SEQ ID NO: 58138 - DNA, 20 bp, human
gccgcctgacgcgcccccgg

SEQ ID NO: 58139 - DNA, 20 bp, human
gatgagtgaggccaccagtg

SEQ ID NO: 58140 - DNA, 20 bp, human
ggggcgcgtcaggcggaagg

SEQ ID NO: 58141 - DNA, 20 bp, human
gtgtcagcctgcaaaaactg

SEQ ID NO: 58142 - DNA, 20 bp, human
ggcggtggcgggggtaacac

SEQ ID NO: 58143 - DNA, 20 bp, human
gctgcacagcctggtcacgg

SEQ ID NO: 58144 - DNA, 20 bp, human
gccgcggccgttaccagaag

SEQ ID NO: 58145 - DNA, 20 bp, human
gccgctgcacagcctggtca

SEQ ID NO: 58146 - DNA, 20 bp, human
gggactggagagagaatgcg

SEQ ID NO: 58147 - DNA, 20 bp, human
gaggtgaagtcatccaatga

SEQ ID NO: 58148 - DNA, 20 bp, human
gtcctagcttcattcaaggg

SEQ ID NO: 58149 - DNA, 20 bp, human
gctcccagtactgtgacagg

SEQ ID NO: 58150 - DNA, 20 bp, human
ggcacgaactcactcaagag

SEQ ID NO: 58151 - DNA, 20 bp, human
gtcacagtactgggagtaag

SEQ ID NO: 58152 - DNA, 20 bp, human
gaaggtgaagactttggacc

SEQ ID NO: 58153 - DNA, 20 bp, human
gagctcctagcttcattcaa

SEQ ID NO: 58154 - DNA, 20 bp, human
gaaagggcagaaatgcctga

SEQ ID NO: 58155 - DNA, 20 bp, human
gaggaaagaacgtctctact

SEQ ID NO: 58156 - DNA, 20 bp, human
ggcggcagccacaacatccg

SEQ ID NO: 58157 - DNA, 20 bp, human
gacggccctgggaagaacta

SEQ ID NO: 58158 - DNA, 20 bp, human
ggccacggccccggatgttg

SEQ ID NO: 58159 - DNA, 20 bp, human
gcagtgcagcgaagaaaaca

SEQ ID NO: 58160 - DNA, 20 bp, human
gggagcctgacacatctcgg

SEQ ID NO: 58161 - DNA, 20 bp, human
ggcgagaagtagagccctag

SEQ ID NO: 58162 - DNA, 20 bp, human
ggactcagcagaggctcgta

SEQ ID NO: 58163 - DNA, 20 bp, human
gccaggagcctgacacatct

SEQ ID NO: 58164 - DNA, 20 bp, human
gggcaccctagttcttccca

SEQ ID NO: 58165 - DNA, 20 bp, human
ggagcgctctgtggtgcctg

SEQ ID NO: 58166 - DNA, 20 bp, human
ggcagtcgccccagtcccga

SEQ ID NO: 58167 - DNA, 20 bp, human
ggctccgaccgccagcagtc

SEQ ID NO: 58168 - DNA, 20 bp, human
ggggcgaacggcggacgaag

SEQ ID NO: 58169 - DNA, 20 bp, human
ggccccgttgaaggtcggtg

SEQ ID NO: 58170 - DNA, 20 bp, human
gccgccagcagtcgggtgag

SEQ ID NO: 58171 - DNA, 20 bp, human
gggtcgagggacgcgcgcag

SEQ ID NO: 58172 - DNA, 20 bp, human
gggccgcggcgggcgaacgg

SEQ ID NO: 58173 - DNA, 20 bp, human
gcgaacggcggacgaagagg

SEQ ID NO: 58174 - DNA, 20 bp, human
gtccccaccgaccttcaacg

SEQ ID NO: 58175 - DNA, 20 bp, human
gtgggccagtagccgagccg

SEQ ID NO: 58176 - DNA, 20 bp, human
gctacccacgcggtgcgcag

SEQ ID NO: 58177 - DNA, 20 bp, human
gcagccgctgcgcaccgcgt

SEQ ID NO: 58178 - DNA, 20 bp, human
gcgcgcagcgtctacccacg

SEQ ID NO: 58179 - DNA, 20 bp, human
gcaagaaagcaaggaccgac

SEQ ID NO: 58180 - DNA, 20 bp, human
gatccgctcgctcctcctcc

SEQ ID NO: 58181 - DNA, 20 bp, human
gcctccaggcagcctcgccg

SEQ ID NO: 58182 - DNA, 20 bp, human
gagaggagtgagggcgccag

SEQ ID NO: 58183 - DNA, 20 bp, human
gaggctgtcagcgcggtcgg

SEQ ID NO: 58184 - DNA, 20 bp, human
gtcctggcgcctgctcgctg

SEQ ID NO: 58185 - DNA, 20 bp, human
gaccgcatcagcaccggcgg

SEQ ID NO: 58186 - DNA, 20 bp, human
ggggcagcgcggggtcgcca

SEQ ID NO: 58187 - DNA, 20 bp, human
gcccgtacgccgattccata

SEQ ID NO: 58188 - DNA, 20 bp, human
ggcctcgggccgctcacctg

SEQ ID NO: 58189 - DNA, 20 bp, human
ggccggcgcccatatggaat

SEQ ID NO: 58190 - DNA, 20 bp, human
gctccgcgccggcgcccata

SEQ ID NO: 58191 - DNA, 20 bp, human
ggccgcgtaagaggggaagg

SEQ ID NO: 58192 - DNA, 20 bp, human
gggaaggggccgcgtaagag

SEQ ID NO: 58193 - DNA, 20 bp, human
ggtccccgcagaccgggtgt

SEQ ID NO: 58194 - DNA, 20 bp, human
gcctttctggtctttcacgt

SEQ ID NO: 58195 - DNA, 20 bp, human
gcgtaagaggggaaggtggt

SEQ ID NO: 58196 - DNA, 20 bp, human
gacgctttctgagagaatgg

SEQ ID NO: 58197 - DNA, 20 bp, human
gtcccaatgcaaaggcccca

SEQ ID NO: 58198 - DNA, 20 bp, human
gtccgctgaacccacatggc

SEQ ID NO: 58199 - DNA, 20 bp, human
gggcagtccttccagccatg

SEQ ID NO: 58200 - DNA, 20 bp, human
gtagccatctgtgtaagtat

SEQ ID NO: 58201 - DNA, 20 bp, human
ggctgctcttcgcttacctt

SEQ ID NO: 58202 - DNA, 20 bp, human
gtctttccgctgaacccaca

SEQ ID NO: 58203 - DNA, 20 bp, human
gaggcctatacttacacaga

SEQ ID NO: 58204 - DNA, 20 bp, human
gcatctcatcaaaacaagga

SEQ ID NO: 58205 - DNA, 20 bp, human
gaccttggggcctttgcatt

SEQ ID NO: 58206 - DNA, 20 bp, human
gggtggtggcgacgcagacg

SEQ ID NO: 58207 - DNA, 20 bp, human
gtctcctcccgctcgccgtt

SEQ ID NO: 58208 - DNA, 20 bp, human
ggagagagtggcgacagagg

SEQ ID NO: 58209 - DNA, 20 bp, human
gaggtgcagagcctccctaa

SEQ ID NO: 58210 - DNA, 20 bp, human
gagagtggcgacagaggcgg

SEQ ID NO: 58211 - DNA, 20 bp, human
gggggagagagtggcgacag

SEQ ID NO: 58212 - DNA, 20 bp, human
gcgacgcagacgcggaacag

SEQ ID NO: 58213 - DNA, 20 bp, human
gacccgcggcgacggcaaga

SEQ ID NO: 58214 - DNA, 20 bp, human
gctcccgctcgccgttaggg

SEQ ID NO: 58215 - DNA, 20 bp, human
gtggaggactctagcaggtg

SEQ ID NO: 58216 - DNA, 20 bp, human
gcactcccggagagcaatca

SEQ ID NO: 58217 - DNA, 20 bp, human
gcacttcggcagaaacactg

SEQ ID NO: 58218 - DNA, 20 bp, human
ggtgagcacatacacaaaca

SEQ ID NO: 58219 - DNA, 20 bp, human
ggatagttgcttccagagaa

SEQ ID NO: 58220 - DNA, 20 bp, human
gggcacgctcgctctacctt

SEQ ID NO: 58221 - DNA, 20 bp, human
ggcattgcaaggcaagtctc

SEQ ID NO: 58222 - DNA, 20 bp, human
ggaacagcggctgggaacgg

SEQ ID NO: 58223 - DNA, 20 bp, human
gctggaagcaactatcgtga

SEQ ID NO: 58224 - DNA, 20 bp, human
ggctcctgcaagcaatcagc

SEQ ID NO: 58225 - DNA, 20 bp, human
gacggctccccggccagact

SEQ ID NO: 58226 - DNA, 20 bp, human
gggagcgaccgcagtgacga

SEQ ID NO: 58227 - DNA, 20 bp, human
ggctaggctcgggcaccgtc

SEQ ID NO: 58228 - DNA, 20 bp, human
gctcgggcaccgtcaggcag

SEQ ID NO: 58229 - DNA, 20 bp, human
gagtgacgaaggagtccctt

SEQ ID NO: 58230 - DNA, 20 bp, human
ggcgggcggggcggaggatc

SEQ ID NO: 58231 - DNA, 20 bp, human
gcccaacaccagcaagtccc

SEQ ID NO: 58232 - DNA, 20 bp, human
gcccgggcatggctcacgcg

SEQ ID NO: 58233 - DNA, 20 bp, human
gcgcccgggccgcctgagct

SEQ ID NO: 58234 - DNA, 20 bp, human
gggcccagctcaggcggccc

SEQ ID NO: 58235 - DNA, 20 bp, human
gcaggcactcgggaagcgtc

SEQ ID NO: 58236 - DNA, 20 bp, human
gcgccctcagctggagatgg

SEQ ID NO: 58237 - DNA, 20 bp, human
ggctcggagtctaggtgacg

SEQ ID NO: 58238 - DNA, 20 bp, human
gtaggtgacggggcgagacg

SEQ ID NO: 58239 - DNA, 20 bp, human
gggccggggcaggcacgcca

SEQ ID NO: 58240 - DNA, 20 bp, human
gttcaggaatttcagacgaa

SEQ ID NO: 58241 - DNA, 20 bp, human
gccgcccccgcggcaaagca

SEQ ID NO: 58242 - DNA, 20 bp, human
ggcgagacggggccggtagg

SEQ ID NO: 58243 - DNA, 20 bp, human
gatctccagatacactcgga

SEQ ID NO: 58244 - DNA, 20 bp, human
gctaccatggccattaacaa

SEQ ID NO: 58245 - DNA, 20 bp, human
ggggcaggcacgccagggtg

SEQ ID NO: 58246 - DNA, 20 bp, human
gacccccgggacgtagacaa

SEQ ID NO: 58247 - DNA, 20 bp, human
gaggcgcgcggtgaagactg

SEQ ID NO: 58248 - DNA, 20 bp, human
gggtcgggcctccagacctg

SEQ ID NO: 58249 - DNA, 20 bp, human
gggccagcgggaccacagcg

SEQ ID NO: 58250 - DNA, 20 bp, human
gccgggacgtagacaagggc

SEQ ID NO: 58251 - DNA, 20 bp, human
gaggcccgacctgctctcct

SEQ ID NO: 58252 - DNA, 20 bp, human
gccccacgcggaagagaacg

SEQ ID NO: 58253 - DNA, 20 bp, human
ggggtgcgcggcccaagaga

SEQ ID NO: 58254 - DNA, 20 bp, human
gggaccacagcgcggctacg

SEQ ID NO: 58255 - DNA, 20 bp, human
gtccccgggaggacccagta

SEQ ID NO: 58256 - DNA, 20 bp, human
ggagccggcgcaccccaggt

SEQ ID NO: 58257 - DNA, 20 bp, human
gcccgccgggcatggagtag

SEQ ID NO: 58258 - DNA, 20 bp, human
ggcgccgccttcttggagag

SEQ ID NO: 58259 - DNA, 20 bp, human
gcggaccccgaggaacaagc

SEQ ID NO: 58260 - DNA, 20 bp, human
ggtgatcgtcgaggagaccg

SEQ ID NO: 58261 - DNA, 20 bp, human
gtggacccacggccgacctg

SEQ ID NO: 58262 - DNA, 20 bp, human
ggcacccgcggcttccaaag

SEQ ID NO: 58263 - DNA, 20 bp, human
ggagtccccgaagcccacgg

SEQ ID NO: 58264 - DNA, 20 bp, human
gcgccttcttggagagcggt

SEQ ID NO: 58265 - DNA, 20 bp, human
gcgcctaccgctctccaaga

SEQ ID NO: 58266 - DNA, 20 bp, human
gaccatggcgacgctctctg

SEQ ID NO: 58267 - DNA, 20 bp, human
ggcagcacctaattctccac

SEQ ID NO: 58268 - DNA, 20 bp, human
gctgggccgcacggagttgg

SEQ ID NO: 58269 - DNA, 20 bp, human
gctcaggatgacatgggggg

SEQ ID NO: 58270 - DNA, 20 bp, human
ggtgatggcaaggactattg

SEQ ID NO: 58271 - DNA, 20 bp, human
ggataaggagcgagcgatga

SEQ ID NO: 58272 - DNA, 20 bp, human
ggcgatgagggaagccactc

SEQ ID NO: 58273 - DNA, 20 bp, human
gtctccagaggggatattac

SEQ ID NO: 58274 - DNA, 20 bp, human
gccttgccatcaccctgcgg

SEQ ID NO: 58275 - DNA, 20 bp, human
gagcgtcgccatggtctgca

SEQ ID NO: 58276 - DNA, 20 bp, human
gcgcgccgcgcagaaccggg

SEQ ID NO: 58277 - DNA, 20 bp, human
gaccagtgcccggttagcag

SEQ ID NO: 58278 - DNA, 20 bp, human
gcagaccgcccccatacggt

SEQ ID NO: 58279 - DNA, 20 bp, human
ggcgggagcccgcaaaggga

SEQ ID NO: 58280 - DNA, 20 bp, human
gccatggcagcatccgctgg

SEQ ID NO: 58281 - DNA, 20 bp, human
ggacccagaccgcccccata

SEQ ID NO: 58282 - DNA, 20 bp, human
gtcagcagcgggactatgcc

SEQ ID NO: 58283 - DNA, 20 bp, human
gacggcgggcgtcgtcacca

SEQ ID NO: 58284 - DNA, 20 bp, human
ggagcccacccggcaaacca

SEQ ID NO: 58285 - DNA, 20 bp, human
gcgcaaagggagggtacggc

SEQ ID NO: 58286 - DNA, 20 bp, human
gagccggggacaggcagcac

SEQ ID NO: 58287 - DNA, 20 bp, human
gagacctggaagccggggac

SEQ ID NO: 58288 - DNA, 20 bp, human
gggagcagagacctggaagc

SEQ ID NO: 58289 - DNA, 20 bp, human
gcgccagtgtcgctgctgaa

SEQ ID NO: 58290 - DNA, 20 bp, human
gccgaatcggaagatccaca

SEQ ID NO: 58291 - DNA, 20 bp, human
gatccacagggcgctgtcaa

SEQ ID NO: 58292 - DNA, 20 bp, human
gccctaggccacgtctacag

SEQ ID NO: 58293 - DNA, 20 bp, human
gcgctgctgaagggtggacc

SEQ ID NO: 58294 - DNA, 20 bp, human
ggctgaagggtggaccaggc

SEQ ID NO: 58295 - DNA, 20 bp, human
gcggcggtccggggctccct

SEQ ID NO: 58296 - DNA, 20 bp, human
gaattaagagttatttaaga

SEQ ID NO: 58297 - DNA, 20 bp, human
gatatttaacttctttagtt

SEQ ID NO: 58298 - DNA, 20 bp, human
gctcatggtggtcctactct

SEQ ID NO: 58299 - DNA, 20 bp, human
gaaacattaagaatttaata

SEQ ID NO: 58300 - DNA, 20 bp, human
gaaattaagatgtaagatta

SEQ ID NO: 58301 - DNA, 20 bp, human
gctgattcttttttcctcgc

SEQ ID NO: 58302 - DNA, 20 bp, human
gttcttaaaacttacaatcc

SEQ ID NO: 58303 - DNA, 20 bp, human
ggtgaatttctcatttctca

SEQ ID NO: 58304 - DNA, 20 bp, human
gatttttttaaaccaagagt

SEQ ID NO: 58305 - DNA, 20 bp, human
gaatttctcatttctcatgg

SEQ ID NO: 58306 - DNA, 20 bp, human
ggccgaagccaggctcatcc

SEQ ID NO: 58307 - DNA, 20 bp, human
gtccacaggatgagactcat

SEQ ID NO: 58308 - DNA, 20 bp, human
gctggcgctgggcaatccac

SEQ ID NO: 58309 - DNA, 20 bp, human
gccgcccaggcagcaaagtc

SEQ ID NO: 58310 - DNA, 20 bp, human
gggcagcaaagtcaggcggt

SEQ ID NO: 58311 - DNA, 20 bp, human
ggcagaccctcagaccaggt

SEQ ID NO: 58312 - DNA, 20 bp, human
ggccgatgagtctcatcctg

SEQ ID NO: 58313 - DNA, 20 bp, human
gcggcccaccccgccttaag

SEQ ID NO: 58314 - DNA, 20 bp, human
ggctgccccaggaccacgga

SEQ ID NO: 58315 - DNA, 20 bp, human
gtgaccctgacgccatccaa

SEQ ID NO: 58316 - DNA, 20 bp, human
ggctcgcgggttctcctggc

SEQ ID NO: 58317 - DNA, 20 bp, human
ggggttctcctggctggccc

SEQ ID NO: 58318 - DNA, 20 bp, human
gtggatcgcggattggaggt

SEQ ID NO: 58319 - DNA, 20 bp, human
gcgcaggtgcaggcgccgct

SEQ ID NO: 58320 - DNA, 20 bp, human
ggctgccccaggaccacgga

SEQ ID NO: 58321 - DNA, 20 bp, human
gtgagcctcgcaaagccgcc

SEQ ID NO: 58322 - DNA, 20 bp, human
gggctcaggagccagtggtt

SEQ ID NO: 58323 - DNA, 20 bp, human
gggggcgagggggagtgaaa

SEQ ID NO: 58324 - DNA, 20 bp, human
gttttccgtccgtggtcctg

SEQ ID NO: 58325 - DNA, 20 bp, human
gcgccagtgtcgctgctgaa

SEQ ID NO: 58326 - DNA, 20 bp, human
gcatcaggcggcatcacggt

SEQ ID NO: 58327 - DNA, 20 bp, human
gcagacttaagcacctggag

SEQ ID NO: 58328 - DNA, 20 bp, human
gccccagctgcttcatcagg

SEQ ID NO: 58329 - DNA, 20 bp, human
gatgctctgaggggacgtca

SEQ ID NO: 58330 - DNA, 20 bp, human
ggcacctggagcggctgact

SEQ ID NO: 58331 - DNA, 20 bp, human
ggtctggactgcggaggccg

SEQ ID NO: 58332 - DNA, 20 bp, human
ggcttcatcaggcggcatca

SEQ ID NO: 58333 - DNA, 20 bp, human
gacgctagttgacacaattg

SEQ ID NO: 58334 - DNA, 20 bp, human
gggccctggcgacatcacag

SEQ ID NO: 58335 - DNA, 20 bp, human
ggtggttggggtctaggagt

SEQ ID NO: 58336 - DNA, 20 bp, human
ggcgcggtggaggaaagcat

SEQ ID NO: 58337 - DNA, 20 bp, human
gacggcgggcgctgtgggag

SEQ ID NO: 58338 - DNA, 20 bp, human
gtcacccgcctgctacccgg

SEQ ID NO: 58339 - DNA, 20 bp, human
gttcgcggagcgggataagt

SEQ ID NO: 58340 - DNA, 20 bp, human
gtgtagctgcgggtaagaaa

SEQ ID NO: 58341 - DNA, 20 bp, human
gcaccagctcctcatactct

SEQ ID NO: 58342 - DNA, 20 bp, human
gttgactacggcgggcgctg

SEQ ID NO: 58343 - DNA, 20 bp, human
gggagcgagtattcgcggag

SEQ ID NO: 58344 - DNA, 20 bp, human
ggctgcgggtaagaaacggc

SEQ ID NO: 58345 - DNA, 20 bp, human
gttacccccgggtagcaggc

SEQ ID NO: 58346 - DNA, 20 bp, human
gttctccaggacgaagatgg

SEQ ID NO: 58347 - DNA, 20 bp, human
gcgcggactgaagatgactg

SEQ ID NO: 58348 - DNA, 20 bp, human
ggcccgctctcccctgccag

SEQ ID NO: 58349 - DNA, 20 bp, human
ggatgactgtggctctcggg

SEQ ID NO: 58350 - DNA, 20 bp, human
ggctccgggccgaatcgcct

SEQ ID NO: 58351 - DNA, 20 bp, human
ggtcagcgcgcgggtcccca

SEQ ID NO: 58352 - DNA, 20 bp, human
gcgcggcatgcccctggcag

SEQ ID NO: 58353 - DNA, 20 bp, human
ggttgccgccatcttcgtcc

SEQ ID NO: 58354 - DNA, 20 bp, human
gtgtttctccaggacgaaga

SEQ ID NO: 58355 - DNA, 20 bp, human
gggagggagcgccccgccgg

SEQ ID NO: 58356 - DNA, 20 bp, human
gccccctgaaatatgttcag

SEQ ID NO: 58357 - DNA, 20 bp, human
gcggcgtcccagagcccacg

SEQ ID NO: 58358 - DNA, 20 bp, human
gcagcagatagtcagcgcgg

SEQ ID NO: 58359 - DNA, 20 bp, human
gcagcagcagatagtcagcg

SEQ ID NO: 58360 - DNA, 20 bp, human
ggctctcggccggtctgcgg

SEQ ID NO: 58361 - DNA, 20 bp, human
gctgggacgccgccgcagac

SEQ ID NO: 58362 - DNA, 20 bp, human
ggcccctgaacatatttcag

SEQ ID NO: 58363 - DNA, 20 bp, human
ggcaccgcgcgaggaggcac

SEQ ID NO: 58364 - DNA, 20 bp, human
ggttcaggggcgcttggatg

SEQ ID NO: 58365 - DNA, 20 bp, human
ggcgcggcggcgtctttccc

SEQ ID NO: 58366 - DNA, 20 bp, human
gaaggcatatccagacacat

SEQ ID NO: 58367 - DNA, 20 bp, human
ggattgcggagctgaagttc

SEQ ID NO: 58368 - DNA, 20 bp, human
gagtgtagcgggaggaacga

SEQ ID NO: 58369 - DNA, 20 bp, human
ggtgccaaaagcgccagact

SEQ ID NO: 58370 - DNA, 20 bp, human
gagttcaggcagcgggagcg

SEQ ID NO: 58371 - DNA, 20 bp, human
gcccctttgggactgtcagt

SEQ ID NO: 58372 - DNA, 20 bp, human
ggtgacaggcacgacgattg

SEQ ID NO: 58373 - DNA, 20 bp, human
gcaccaactgacagtcccaa

SEQ ID NO: 58374 - DNA, 20 bp, human
ggtccagattgtgtctgaat

SEQ ID NO: 58375 - DNA, 20 bp, human
gttgatacagtagagttctt

SEQ ID NO: 58376 - DNA, 20 bp, human
gggagagactgagagcgggg

SEQ ID NO: 58377 - DNA, 20 bp, human
gagactgagagcgggggggt

SEQ ID NO: 58378 - DNA, 20 bp, human
gcctttttcagcggagaaag

SEQ ID NO: 58379 - DNA, 20 bp, human
ggcggagaaagaggatgccg

SEQ ID NO: 58380 - DNA, 20 bp, human
gagccggcgggactacactt

SEQ ID NO: 58381 - DNA, 20 bp, human
gttccagggcagaggaaacg

SEQ ID NO: 58382 - DNA, 20 bp, human
ggggcggcgctgcgtttcca

SEQ ID NO: 58383 - DNA, 20 bp, human
gcgccgtccaagcgccaacg

SEQ ID NO: 58384 - DNA, 20 bp, human
gcgccggctaccaatgcccg

SEQ ID NO: 58385 - DNA, 20 bp, human
gaaaaggccacccccaagta

SEQ ID NO: 58386 - DNA, 20 bp, human
gtatggcaggcatgagacgg

SEQ ID NO: 58387 - DNA, 20 bp, human
ggggggtacttctgacacag

SEQ ID NO: 58388 - DNA, 20 bp, human
gtcaggaacagcttctccca

SEQ ID NO: 58389 - DNA, 20 bp, human
gtcacacatctagggagtgg

SEQ ID NO: 58390 - DNA, 20 bp, human
gcaccatagcccaggtggtc

SEQ ID NO: 58391 - DNA, 20 bp, human
gtgggctgggcagtcgtgcc

SEQ ID NO: 58392 - DNA, 20 bp, human
ggagataagtgttcagttct

SEQ ID NO: 58393 - DNA, 20 bp, human
gcaaaacaaaaagacaacta

SEQ ID NO: 58394 - DNA, 20 bp, human
gagattggtgtcacaaatgg

SEQ ID NO: 58395 - DNA, 20 bp, human
gactcaaggtcacacatcta

SEQ ID NO: 58396 - DNA, 20 bp, human
gggagagactgagagcgggg

SEQ ID NO: 58397 - DNA, 20 bp, human
gagactgagagcgggggggt

SEQ ID NO: 58398 - DNA, 20 bp, human
gcctttttcagcggagaaag

SEQ ID NO: 58399 - DNA, 20 bp, human
ggcggagaaagaggatgccg

SEQ ID NO: 58400 - DNA, 20 bp, human
gagccggcgggactacactt

SEQ ID NO: 58401 - DNA, 20 bp, human
gttccagggcagaggaaacg

SEQ ID NO: 58402 - DNA, 20 bp, human
ggggcggcgctgcgtttcca

SEQ ID NO: 58403 - DNA, 20 bp, human
gcgccgtccaagcgccaacg

SEQ ID NO: 58404 - DNA, 20 bp, human
gcgccggctaccaatgcccg

SEQ ID NO: 58405 - DNA, 20 bp, human
gaaaaggccacccccaagta

SEQ ID NO: 58406 - DNA, 20 bp, human
gcacggaaagggacaatgaa

SEQ ID NO: 58407 - DNA, 20 bp, human
ggtgccacggtgacaaggac

SEQ ID NO: 58408 - DNA, 20 bp, human
gacaaggacgggatcctgtc

SEQ ID NO: 58409 - DNA, 20 bp, human
gctctgccagtgacacggaa

SEQ ID NO: 58410 - DNA, 20 bp, human
gtggaggtgccacggtgaca

SEQ ID NO: 58411 - DNA, 20 bp, human
ggatcccgtccttgtcaccg

SEQ ID NO: 58412 - DNA, 20 bp, human
gttcagatggttggggagtg

SEQ ID NO: 58413 - DNA, 20 bp, human
gaagctttggccgagaggaa

SEQ ID NO: 58414 - DNA, 20 bp, human
gggcagagcagaagcttacc

SEQ ID NO: 58415 - DNA, 20 bp, human
gcagcaggaagctgaacaga

SEQ ID NO: 58416 - DNA, 20 bp, human
gggatagagatgatctgtgt

SEQ ID NO: 58417 - DNA, 20 bp, human
ggagggcccactccattcag

SEQ ID NO: 58418 - DNA, 20 bp, human
gtatcctactgggtctggag

SEQ ID NO: 58419 - DNA, 20 bp, human
ggccctcagtaaatacctgg

SEQ ID NO: 58420 - DNA, 20 bp, human
gaaggcaccgctgaatggag

SEQ ID NO: 58421 - DNA, 20 bp, human
gtgggccctcagtaaatacc

SEQ ID NO: 58422 - DNA, 20 bp, human
ggaatgtgacctggccagtg

SEQ ID NO: 58423 - DNA, 20 bp, human
gtacctggaggaatgtgacc

SEQ ID NO: 58424 - DNA, 20 bp, human
gggccaggtcacattcctcc

SEQ ID NO: 58425 - DNA, 20 bp, human
ggcttgcctagactcaccca

SEQ ID NO: 58426 - DNA, 20 bp, human
gcttcctcagggcagcacga

SEQ ID NO: 58427 - DNA, 20 bp, human
gcacgagggtcgtgttaact

SEQ ID NO: 58428 - DNA, 20 bp, human
ggctgcttctggcacctcag

SEQ ID NO: 58429 - DNA, 20 bp, human
gcgaccctcgtgctgccctg

SEQ ID NO: 58430 - DNA, 20 bp, human
ggtcaacgtccaagacacag

SEQ ID NO: 58431 - DNA, 20 bp, human
gggcactcagggccgtggac

SEQ ID NO: 58432 - DNA, 20 bp, human
gtggatatcatagtaatgta

SEQ ID NO: 58433 - DNA, 20 bp, human
ggaggagcttcagcttcctc

SEQ ID NO: 58434 - DNA, 20 bp, human
gactcactccttggcactca

SEQ ID NO: 58435 - DNA, 20 bp, human
gttaacttggtgttcttcat

SEQ ID NO: 58436 - DNA, 20 bp, human
gttacaagaaccggcagcgg

SEQ ID NO: 58437 - DNA, 20 bp, human
gcatttacaagaaccggcag

SEQ ID NO: 58438 - DNA, 20 bp, human
gtccagctcagtccaggcag

SEQ ID NO: 58439 - DNA, 20 bp, human
gttacgaatacctggttgaa

SEQ ID NO: 58440 - DNA, 20 bp, human
gcttcagtaatcaagagcaa

SEQ ID NO: 58441 - DNA, 20 bp, human
gtgaatgcctttttcacaaa

SEQ ID NO: 58442 - DNA, 20 bp, human
gagagttcaacgggtctcag

SEQ ID NO: 58443 - DNA, 20 bp, human
gagattcagggcctgcccag

SEQ ID NO: 58444 - DNA, 20 bp, human
gctcccctcaggatctgcag

SEQ ID NO: 58445 - DNA, 20 bp, human
ggcgaggccacagggaaatc

SEQ ID NO: 58446 - DNA, 20 bp, human
ggcagagccaggcgagcacg

SEQ ID NO: 58447 - DNA, 20 bp, human
ggcagagacgaagagaccca

SEQ ID NO: 58448 - DNA, 20 bp, human
gcagctccccgcgtccgctc

SEQ ID NO: 58449 - DNA, 20 bp, human
gtacgtgagcgcagagcagg

SEQ ID NO: 58450 - DNA, 20 bp, human
gcgagcacagctacatgtgg

SEQ ID NO: 58451 - DNA, 20 bp, human
gcgtaggggaagaagctgtg

SEQ ID NO: 58452 - DNA, 20 bp, human
gcggccgctgtcttctgctg

SEQ ID NO: 58453 - DNA, 20 bp, human
ggcagcagtacttgtggtcg

SEQ ID NO: 58454 - DNA, 20 bp, human
ggccacctcgggccaccaga

SEQ ID NO: 58455 - DNA, 20 bp, human
gcagacggccggctagagcc

SEQ ID NO: 58456 - DNA, 20 bp, human
gtccgtagggacctaaccta

SEQ ID NO: 58457 - DNA, 20 bp, human
gtacatgtggagcctcaggt

SEQ ID NO: 58458 - DNA, 20 bp, human
gaggtccctacggaaggacg

SEQ ID NO: 58459 - DNA, 20 bp, human
ggatcggaagagccgagtcc

SEQ ID NO: 58460 - DNA, 20 bp, human
gggctccgcgtccttccgta

SEQ ID NO: 58461 - DNA, 20 bp, human
ggagccgagtccgggcagag

SEQ ID NO: 58462 - DNA, 20 bp, human
ggacaagcggagccacgcca

SEQ ID NO: 58463 - DNA, 20 bp, human
gagcctctgagggcgggtga

SEQ ID NO: 58464 - DNA, 20 bp, human
gtgccctcacccgccctcag

SEQ ID NO: 58465 - DNA, 20 bp, human
gggacccctctgcccggact

SEQ ID NO: 58466 - DNA, 20 bp, human
gatgtaggtcgtgagaaggt

SEQ ID NO: 58467 - DNA, 20 bp, human
gacccacgcgcctcagcccg

SEQ ID NO: 58468 - DNA, 20 bp, human
gggggaggaggtgacttcta

SEQ ID NO: 58469 - DNA, 20 bp, human
ggcatccgccaactgggcag

SEQ ID NO: 58470 - DNA, 20 bp, human
gggctgagggagcaggcatt

SEQ ID NO: 58471 - DNA, 20 bp, human
ggccacggccggggacaggt

SEQ ID NO: 58472 - DNA, 20 bp, human
gtcggagcgcaacttttcga

SEQ ID NO: 58473 - DNA, 20 bp, human
ggccgcgggctgaggcgcgt

SEQ ID NO: 58474 - DNA, 20 bp, human
gtcgaaggtgcgtcagccgc

SEQ ID NO: 58475 - DNA, 20 bp, human
gaagaatgtaggtcgtgaga

SEQ ID NO: 58476 - DNA, 20 bp, human
gtgcgcttgagaagcgatgg

SEQ ID NO: 58477 - DNA, 20 bp, human
gtggtgcgcttgagaagcga

SEQ ID NO: 58478 - DNA, 20 bp, human
gggtgtgagtgtctaagata

SEQ ID NO: 58479 - DNA, 20 bp, human
gtaccctgggactagagtga

SEQ ID NO: 58480 - DNA, 20 bp, human
ggagagtaaaaggcgcaggt

SEQ ID NO: 58481 - DNA, 20 bp, human
gtgagtgtctaagataggga

SEQ ID NO: 58482 - DNA, 20 bp, human
ggcttgagaagcgatggcgg

SEQ ID NO: 58483 - DNA, 20 bp, human
gctggtgtgaaggataccct

SEQ ID NO: 58484 - DNA, 20 bp, human
gtgcggtgttaggtgagttc

SEQ ID NO: 58485 - DNA, 20 bp, human
gacccctcactctagtccca

SEQ ID NO: 58486 - DNA, 20 bp, human
gggcaccggttgggacacgg

SEQ ID NO: 58487 - DNA, 20 bp, human
gcccggagaagctccggcgg

SEQ ID NO: 58488 - DNA, 20 bp, human
gggcgttcggcgaggactcg

SEQ ID NO: 58489 - DNA, 20 bp, human
gtcggggcccggagaagctc

SEQ ID NO: 58490 - DNA, 20 bp, human
ggctgccaccgtgtcccaac

SEQ ID NO: 58491 - DNA, 20 bp, human
ggggcccggagaagctccgg

SEQ ID NO: 58492 - DNA, 20 bp, human
gcgaggccgccggggagcgt

SEQ ID NO: 58493 - DNA, 20 bp, human
gctccggcggcggcaccggt

SEQ ID NO: 58494 - DNA, 20 bp, human
gcacggtggcagcccggctc

SEQ ID NO: 58495 - DNA, 20 bp, human
gggcggcctacgctccccgg

SEQ ID NO: 58496 - DNA, 20 bp, human
gggcagaggaaggggcgccg

SEQ ID NO: 58497 - DNA, 20 bp, human
ggcggcggcagcgctctagg

SEQ ID NO: 58498 - DNA, 20 bp, human
gggctcccgggcgaaagcgg

SEQ ID NO: 58499 - DNA, 20 bp, human
ggcagcgctctaggcggagg

SEQ ID NO: 58500 - DNA, 20 bp, human
gggcggcctagggccccggg

SEQ ID NO: 58501 - DNA, 20 bp, human
ggcggcagcgctctaggcgg

SEQ ID NO: 58502 - DNA, 20 bp, human
ggcggtgacagggagcgtcc

SEQ ID NO: 58503 - DNA, 20 bp, human
gcccggctcccgggcgaaag

SEQ ID NO: 58504 - DNA, 20 bp, human
ggtgacagggagcgtcccgg

SEQ ID NO: 58505 - DNA, 20 bp, human
gacagggagcgtcccggcgg

SEQ ID NO: 58506 - DNA, 20 bp, human
gcgacccgcgctccagtgat

SEQ ID NO: 58507 - DNA, 20 bp, human
gcaccgagtggcgaagctgg

SEQ ID NO: 58508 - DNA, 20 bp, human
gccccggtaaatcccatcac

SEQ ID NO: 58509 - DNA, 20 bp, human
gttgggctgggacctcgcat

SEQ ID NO: 58510 - DNA, 20 bp, human
gtcccaccgagtggcgaagc

SEQ ID NO: 58511 - DNA, 20 bp, human
gtttaccggggtctggagac

SEQ ID NO: 58512 - DNA, 20 bp, human
gtccagtgatgggatttacc

SEQ ID NO: 58513 - DNA, 20 bp, human
ggaccccttaaaggccctgg

SEQ ID NO: 58514 - DNA, 20 bp, human
gtggggcatcggtaatactg

SEQ ID NO: 58515 - DNA, 20 bp, human
gtgccgccagggcctttaag

SEQ ID NO: 58516 - DNA, 20 bp, human
ggcgacagtgacagcgatag

SEQ ID NO: 58517 - DNA, 20 bp, human
gggtggcagcgagagctatg

SEQ ID NO: 58518 - DNA, 20 bp, human
gggtcatttcagctggacag

SEQ ID NO: 58519 - DNA, 20 bp, human
gagacgccaaagctagaaag

SEQ ID NO: 58520 - DNA, 20 bp, human
ggcaggggcgtgtcacggag

SEQ ID NO: 58521 - DNA, 20 bp, human
gcgggaaaggaatcccggag

SEQ ID NO: 58522 - DNA, 20 bp, human
gtgagcgtttagggaccagg

SEQ ID NO: 58523 - DNA, 20 bp, human
ggcccccgggaaaggaatcc

SEQ ID NO: 58524 - DNA, 20 bp, human
ggctagaaaggggtggaccc

SEQ ID NO: 58525 - DNA, 20 bp, human
gatcccggagaggaaactgt

SEQ ID NO: 58526 - DNA, 20 bp, human
ggttggagtgggaaggacgc

SEQ ID NO: 58527 - DNA, 20 bp, human
gagaacttcgccggggacgg

SEQ ID NO: 58528 - DNA, 20 bp, human
gagaccgctgaggctcccca

SEQ ID NO: 58529 - DNA, 20 bp, human
gtgccaggcgcagaccgctg

SEQ ID NO: 58530 - DNA, 20 bp, human
gggggaggtctagggatagt

SEQ ID NO: 58531 - DNA, 20 bp, human
gccagcgcagaacttcgccg

SEQ ID NO: 58532 - DNA, 20 bp, human
gggagagcaatagatagggg

SEQ ID NO: 58533 - DNA, 20 bp, human
gggtggaaagctgaatgcat

SEQ ID NO: 58534 - DNA, 20 bp, human
gtagataggggaggttaggg

SEQ ID NO: 58535 - DNA, 20 bp, human
gcgcagaacttcgccgggga

SEQ ID NO: 58536 - DNA, 20 bp, human
gcacctccggacccagccac

SEQ ID NO: 58537 - DNA, 20 bp, human
ggacgcgggaactgacgcac

SEQ ID NO: 58538 - DNA, 20 bp, human
gagtagcaggggagaccccg

SEQ ID NO: 58539 - DNA, 20 bp, human
gcccgccgctggagtagcag

SEQ ID NO: 58540 - DNA, 20 bp, human
gaactgacgcaccggcacag

SEQ ID NO: 58541 - DNA, 20 bp, human
ggccgcgcgctggagagcct

SEQ ID NO: 58542 - DNA, 20 bp, human
gcgcctgtggctgggtccgg

SEQ ID NO: 58543 - DNA, 20 bp, human
ggctgcggggacaacgcctg

SEQ ID NO: 58544 - DNA, 20 bp, human
ggctgagtgtgcgagcgcca

SEQ ID NO: 58545 - DNA, 20 bp, human
ggcgcgctgatcctctgtgc

SEQ ID NO: 58546 - DNA, 20 bp, human
gggctggggcggcacacgtg

SEQ ID NO: 58547 - DNA, 20 bp, human
gttccgggcgccagcggctg

SEQ ID NO: 58548 - DNA, 20 bp, human
gggcagtcctcggagcgccg

SEQ ID NO: 58549 - DNA, 20 bp, human
gggacgcgctgcgaccccgt

SEQ ID NO: 58550 - DNA, 20 bp, human
gaggcgccctcgaaagtacg

SEQ ID NO: 58551 - DNA, 20 bp, human
gaggggcctctcgctccgag

SEQ ID NO: 58552 - DNA, 20 bp, human
gtcccgcgttcggctcccac

SEQ ID NO: 58553 - DNA, 20 bp, human
gcggcctcgtggccagaccg

SEQ ID NO: 58554 - DNA, 20 bp, human
gctcgtggccagaccgcggg

SEQ ID NO: 58555 - DNA, 20 bp, human
ggccacctggaggggcgatg

SEQ ID NO: 58556 - DNA, 20 bp, human
gccgggaccgtggtcatcac

SEQ ID NO: 58557 - DNA, 20 bp, human
gcagcagagccgggggtcac

SEQ ID NO: 58558 - DNA, 20 bp, human
gggcagcaggaccctaccat

SEQ ID NO: 58559 - DNA, 20 bp, human
gcccacatcagcagagccgg

SEQ ID NO: 58560 - DNA, 20 bp, human
ggtcatcaccgggggcatct

SEQ ID NO: 58561 - DNA, 20 bp, human
gcccgccgcccgggaatacc

SEQ ID NO: 58562 - DNA, 20 bp, human
gctcatctctcagggagaca

SEQ ID NO: 58563 - DNA, 20 bp, human
ggcccgggaatacctggagc

SEQ ID NO: 58564 - DNA, 20 bp, human
gagatgagggggagccatcg

SEQ ID NO: 58565 - DNA, 20 bp, human
gatgcccccggtgatgacca

SEQ ID NO: 58566 - DNA, 20 bp, human
ggcgctcgtggtaggagcca

SEQ ID NO: 58567 - DNA, 20 bp, human
gccccggcgtcctcgatcgg

SEQ ID NO: 58568 - DNA, 20 bp, human
ggtctagacaggaactctgc

SEQ ID NO: 58569 - DNA, 20 bp, human
ggatgcccagcgctcgtggt

SEQ ID NO: 58570 - DNA, 20 bp, human
ggggccccggcgtcctcgat

SEQ ID NO: 58571 - DNA, 20 bp, human
gatgtgcaggaggtctagac

SEQ ID NO: 58572 - DNA, 20 bp, human
gaagccaaggcctacatcct

SEQ ID NO: 58573 - DNA, 20 bp, human
gcggccagtgccgaggatgt

SEQ ID NO: 58574 - DNA, 20 bp, human
gtgggcatctcaggtgaacg

SEQ ID NO: 58575 - DNA, 20 bp, human
gcccattacctggaagccca

SEQ ID NO: 58576 - DNA, 20 bp, human
gctcacccagggacatagtg

SEQ ID NO: 58577 - DNA, 20 bp, human
ggtggagtcctctctggagt

SEQ ID NO: 58578 - DNA, 20 bp, human
gtgaagtgtggagtcctctc

SEQ ID NO: 58579 - DNA, 20 bp, human
ggccagcagccggcagaggc

SEQ ID NO: 58580 - DNA, 20 bp, human
gaactgaaggccacaccacg

SEQ ID NO: 58581 - DNA, 20 bp, human
gcaggactcccctcagggaa

SEQ ID NO: 58582 - DNA, 20 bp, human
gggtgacaggactcccctca

SEQ ID NO: 58583 - DNA, 20 bp, human
gcctctctggagtgggcgtc

SEQ ID NO: 58584 - DNA, 20 bp, human
gcacagactgcagtgccccg

SEQ ID NO: 58585 - DNA, 20 bp, human
gaagggagctggatgccggg

SEQ ID NO: 58586 - DNA, 20 bp, human
gggaaatgcccggctcccca

SEQ ID NO: 58587 - DNA, 20 bp, human
gtctgcctctggggatggcg

SEQ ID NO: 58588 - DNA, 20 bp, human
gtacacacagaccagagcct

SEQ ID NO: 58589 - DNA, 20 bp, human
gagaaagatcagggcttcag

SEQ ID NO: 58590 - DNA, 20 bp, human
ggaggaaggatcgaaagccc

SEQ ID NO: 58591 - DNA, 20 bp, human
gcagggcgattctggtgagt

SEQ ID NO: 58592 - DNA, 20 bp, human
gtggctcaaaggcaaacaaa

SEQ ID NO: 58593 - DNA, 20 bp, human
gctgtggggctagaggaagg

SEQ ID NO: 58594 - DNA, 20 bp, human
ggaggctgaggtctctatgg

SEQ ID NO: 58595 - DNA, 20 bp, human
gagccctggtatgaaggtgc

SEQ ID NO: 58596 - DNA, 20 bp, human
gaattcaccggagctcgggg

SEQ ID NO: 58597 - DNA, 20 bp, human
gcctgggagtggacccggag

SEQ ID NO: 58598 - DNA, 20 bp, human
gagcagcgccgagaattcac

SEQ ID NO: 58599 - DNA, 20 bp, human
gtgcggccctccctctcaga

SEQ ID NO: 58600 - DNA, 20 bp, human
gcggggtctgccgtctgaga

SEQ ID NO: 58601 - DNA, 20 bp, human
ggagaattcaccggagctcg

SEQ ID NO: 58602 - DNA, 20 bp, human
ggaggaggcggcggggacac

SEQ ID NO: 58603 - DNA, 20 bp, human
gcagaatccgagcccggaca

SEQ ID NO: 58604 - DNA, 20 bp, human
gccaccttccgggagcccag

SEQ ID NO: 58605 - DNA, 20 bp, human
gtggaggtcaccagccgcct

SEQ ID NO: 58606 - DNA, 20 bp, human
gccagagatgggcttaccta

SEQ ID NO: 58607 - DNA, 20 bp, human
gttgcgcaccacctggaaag

SEQ ID NO: 58608 - DNA, 20 bp, human
ggcagctgaccaggttggag

SEQ ID NO: 58609 - DNA, 20 bp, human
ggcttcacagacagaactag

SEQ ID NO: 58610 - DNA, 20 bp, human
gcagaccatgaaacatcagt

SEQ ID NO: 58611 - DNA, 20 bp, human
ggcagcaagccactccaacc

SEQ ID NO: 58612 - DNA, 20 bp, human
gagtctgtgcccaaaaactg

SEQ ID NO: 58613 - DNA, 20 bp, human
gcctgggccaggaagtgctc

SEQ ID NO: 58614 - DNA, 20 bp, human
gcaaggcagctaagatatcc

SEQ ID NO: 58615 - DNA, 20 bp, human
gctggtcagctgccaggcta

SEQ ID NO: 58616 - DNA, 20 bp, human
gtcccgtcggagccactcaa

SEQ ID NO: 58617 - DNA, 20 bp, human
gcgtcggagccactcaaggg

SEQ ID NO: 58618 - DNA, 20 bp, human
gtgttcaaggtgggttaggg

SEQ ID NO: 58619 - DNA, 20 bp, human
gtgtgaggccaagtatgcaa

SEQ ID NO: 58620 - DNA, 20 bp, human
gggagctggtgagtctggtg

SEQ ID NO: 58621 - DNA, 20 bp, human
gcagactcaccagctcccgt

SEQ ID NO: 58622 - DNA, 20 bp, human
gcaagccaaacctggaccag

SEQ ID NO: 58623 - DNA, 20 bp, human
gggtggtcaatgttcaaggt

SEQ ID NO: 58624 - DNA, 20 bp, human
gaggggggctgaatgtgcca

SEQ ID NO: 58625 - DNA, 20 bp, human
gccttagggtccaagaccac

SEQ ID NO: 58626 - DNA, 20 bp, human
gtagcctccggagaagacaa

SEQ ID NO: 58627 - DNA, 20 bp, human
gtagccgccgaggagcccga

SEQ ID NO: 58628 - DNA, 20 bp, human
gcaacctgggacaggagagt

SEQ ID NO: 58629 - DNA, 20 bp, human
gtcctcggcggctactgcag

SEQ ID NO: 58630 - DNA, 20 bp, human
ggcgctggcgagaatgagag

SEQ ID NO: 58631 - DNA, 20 bp, human
gcagagccgagtcgctgagg

SEQ ID NO: 58632 - DNA, 20 bp, human
ggggacccaagcaggttggg

SEQ ID NO: 58633 - DNA, 20 bp, human
gtcctctgcagtagccgccg

SEQ ID NO: 58634 - DNA, 20 bp, human
ggggcgggcgacaagggagg

SEQ ID NO: 58635 - DNA, 20 bp, human
gcgaggagcccgacgggtgg

SEQ ID NO: 58636 - DNA, 20 bp, human
gatgcgagcgtgaaacccgg

SEQ ID NO: 58637 - DNA, 20 bp, human
ggccacctcggccacctagg

SEQ ID NO: 58638 - DNA, 20 bp, human
gcgtgcaggtgcggtccggg

SEQ ID NO: 58639 - DNA, 20 bp, human
ggctcaggcggaagtgaggt

SEQ ID NO: 58640 - DNA, 20 bp, human
ggcgcgctcaggcggaagtg

SEQ ID NO: 58641 - DNA, 20 bp, human
gtccggtggctgcgcagcgt

SEQ ID NO: 58642 - DNA, 20 bp, human
gccccgcccggccttgcccg

SEQ ID NO: 58643 - DNA, 20 bp, human
ggccgcggcgcggtgagtgg

SEQ ID NO: 58644 - DNA, 20 bp, human
gggagacctgctacgataag

SEQ ID NO: 58645 - DNA, 20 bp, human
gacgcgtgcaggtgcggtcc

SEQ ID NO: 58646 - DNA, 20 bp, human
gcgtcgtcggagggcacggt

SEQ ID NO: 58647 - DNA, 20 bp, human
gggtctgcggggatcccgta

SEQ ID NO: 58648 - DNA, 20 bp, human
gcggaggccggcgcacctgg

SEQ ID NO: 58649 - DNA, 20 bp, human
gagtgcgtcacgtcgtcgga

SEQ ID NO: 58650 - DNA, 20 bp, human
gcgccaggcccagcccgcag

SEQ ID NO: 58651 - DNA, 20 bp, human
gggcggaggcgagcgaagac

SEQ ID NO: 58652 - DNA, 20 bp, human
gccgcggccgacccgcgacg

SEQ ID NO: 58653 - DNA, 20 bp, human
gccgtctcggcctcacccag

SEQ ID NO: 58654 - DNA, 20 bp, human
gcgctagtgcgtcacgtcgt

SEQ ID NO: 58655 - DNA, 20 bp, human
ggtcacgtcgtcggagggca

SEQ ID NO: 58656 - DNA, 20 bp, human
gtcttgaaggctaggatgag

SEQ ID NO: 58657 - DNA, 20 bp, human
gccaggagccacggggacaa

SEQ ID NO: 58658 - DNA, 20 bp, human
gaagtggttatcgttcgtgg

SEQ ID NO: 58659 - DNA, 20 bp, human
gcacgggagcaacctaggaa

SEQ ID NO: 58660 - DNA, 20 bp, human
ggtggcagtctgctgttacg

SEQ ID NO: 58661 - DNA, 20 bp, human
gggaattgtgaattcccctg

SEQ ID NO: 58662 - DNA, 20 bp, human
ggggagcaacctaggaaagg

SEQ ID NO: 58663 - DNA, 20 bp, human
gtacacggaagatcagaaaa

SEQ ID NO: 58664 - DNA, 20 bp, human
gattatgctgcacaggacac

SEQ ID NO: 58665 - DNA, 20 bp, human
gtggatgcttctctggacag

SEQ ID NO: 58666 - DNA, 20 bp, human
ggtgctgctccttcactaag

SEQ ID NO: 58667 - DNA, 20 bp, human
gaactcagaccgcttagtga

SEQ ID NO: 58668 - DNA, 20 bp, human
gctacactgcagggctgtta

SEQ ID NO: 58669 - DNA, 20 bp, human
gaggaaaccgctgagaaggg

SEQ ID NO: 58670 - DNA, 20 bp, human
ggtgcggggcaaactttctg

SEQ ID NO: 58671 - DNA, 20 bp, human
gcagtgcccactacactgca

SEQ ID NO: 58672 - DNA, 20 bp, human
gatctacaggaaaaagtggg

SEQ ID NO: 58673 - DNA, 20 bp, human
ggaagggaggaggtatgtgc

SEQ ID NO: 58674 - DNA, 20 bp, human
gcatgaaacgacgacaaaag

SEQ ID NO: 58675 - DNA, 20 bp, human
gcagggctgttaaggttcaa

SEQ ID NO: 58676 - DNA, 20 bp, human
ggctggagcaccgacaccct

SEQ ID NO: 58677 - DNA, 20 bp, human
gccagctgttcagtgagagt

SEQ ID NO: 58678 - DNA, 20 bp, human
gctgggaaggaagccctgat

SEQ ID NO: 58679 - DNA, 20 bp, human
gaggctgttatgagtatata

SEQ ID NO: 58680 - DNA, 20 bp, human
gtgttcagtgagagttggct

SEQ ID NO: 58681 - DNA, 20 bp, human
gtgagggtggtcccatcggt

SEQ ID NO: 58682 - DNA, 20 bp, human
ggccaggtaggtgaaaagaa

SEQ ID NO: 58683 - DNA, 20 bp, human
gaagctgagggtggtcccat

SEQ ID NO: 58684 - DNA, 20 bp, human
ggtggacactgagctcccca

SEQ ID NO: 58685 - DNA, 20 bp, human
gtgtactgaaggcctccagc

SEQ ID NO: 58686 - DNA, 20 bp, human
gaggcacagcagcagcgtcg

SEQ ID NO: 58687 - DNA, 20 bp, human
gcggcataaaggggaccccc

SEQ ID NO: 58688 - DNA, 20 bp, human
gtccgaggcgcggcataaag

SEQ ID NO: 58689 - DNA, 20 bp, human
gtcgccgagagcgggccggg

SEQ ID NO: 58690 - DNA, 20 bp, human
gggtcaccgccttccagacg

SEQ ID NO: 58691 - DNA, 20 bp, human
gggctgccacgtctggaagg

SEQ ID NO: 58692 - DNA, 20 bp, human
ggggagccgggagcgcgatc

SEQ ID NO: 58693 - DNA, 20 bp, human
ggacctgctcatctccgccg

SEQ ID NO: 58694 - DNA, 20 bp, human
gcgacccagcccccgatccc

SEQ ID NO: 58695 - DNA, 20 bp, human
gctcgtctggatgcgcccgg

SEQ ID NO: 58696 - DNA, 20 bp, human
ggagccggagctgcgaggcg

SEQ ID NO: 58697 - DNA, 20 bp, human
ggggagagggaggccgtccg

SEQ ID NO: 58698 - DNA, 20 bp, human
gggtcttggggagacacaat

SEQ ID NO: 58699 - DNA, 20 bp, human
gcggagacaatcgcgctgag

SEQ ID NO: 58700 - DNA, 20 bp, human
ggggcggcggcgcagatcct

SEQ ID NO: 58701 - DNA, 20 bp, human
gcgggcgggagcctgatcag

SEQ ID NO: 58702 - DNA, 20 bp, human
ggacttgccgggagcccggg

SEQ ID NO: 58703 - DNA, 20 bp, human
gggtgagtctcagccgggag

SEQ ID NO: 58704 - DNA, 20 bp, human
gctggggttggcgcttctgg

SEQ ID NO: 58705 - DNA, 20 bp, human
gactcaccctgcgggctggg

SEQ ID NO: 58706 - DNA, 20 bp, human
ggatgaggctgaggtcggag

SEQ ID NO: 58707 - DNA, 20 bp, human
ggaacgaacgaggataggaa

SEQ ID NO: 58708 - DNA, 20 bp, human
ggacctacctggaaccgtca

SEQ ID NO: 58709 - DNA, 20 bp, human
gcatattgcggggctccggg

SEQ ID NO: 58710 - DNA, 20 bp, human
gcttggcagattgcgcgagg

SEQ ID NO: 58711 - DNA, 20 bp, human
gcaccagatcaagggaccaa

SEQ ID NO: 58712 - DNA, 20 bp, human
gatggtgacaggaacgaacg

SEQ ID NO: 58713 - DNA, 20 bp, human
gcgaggccctaagagatcgc

SEQ ID NO: 58714 - DNA, 20 bp, human
gctggggagagagatcggga

SEQ ID NO: 58715 - DNA, 20 bp, human
gcgggcggcggcgggcgcca

SEQ ID NO: 58716 - DNA, 20 bp, human
gcggggcgcggatcccgaga

SEQ ID NO: 58717 - DNA, 20 bp, human
gaggcccagacacaagtcag

SEQ ID NO: 58718 - DNA, 20 bp, human
gtccactcgcaagaaagcgg

SEQ ID NO: 58719 - DNA, 20 bp, human
gccgcacgagggagttcgac

SEQ ID NO: 58720 - DNA, 20 bp, human
gcatgggacctgcccatcag

SEQ ID NO: 58721 - DNA, 20 bp, human
gtgcaactcgaacttggtcg

SEQ ID NO: 58722 - DNA, 20 bp, human
gcggaagtgcaactcgaact

SEQ ID NO: 58723 - DNA, 20 bp, human
ggttcgactggcgaactgga

SEQ ID NO: 58724 - DNA, 20 bp, human
gcccgggtcgaaatcaggag

SEQ ID NO: 58725 - DNA, 20 bp, human
gcagacagcctcggtcccca

SEQ ID NO: 58726 - DNA, 20 bp, human
gcggtccaggtgccctacgt

SEQ ID NO: 58727 - DNA, 20 bp, human
ggcgcgctcgcgccgacgta

SEQ ID NO: 58728 - DNA, 20 bp, human
gcccggcccgaactaccaca

SEQ ID NO: 58729 - DNA, 20 bp, human
gggtggcggcgagagtccac

SEQ ID NO: 58730 - DNA, 20 bp, human
gccaggaccgcccctctcca

SEQ ID NO: 58731 - DNA, 20 bp, human
gccgagccgggaaggacctt

SEQ ID NO: 58732 - DNA, 20 bp, human
gtggagcccagggagccggt

SEQ ID NO: 58733 - DNA, 20 bp, human
gagcagcgcccacaccgcgt

SEQ ID NO: 58734 - DNA, 20 bp, human
gcagtgggcggtgaagggat

SEQ ID NO: 58735 - DNA, 20 bp, human
ggcctcggggagactgctgg

SEQ ID NO: 58736 - DNA, 20 bp, human
gttcctgggggcatgagaag

SEQ ID NO: 58737 - DNA, 20 bp, human
gggaaacgcgcccgccgaca

SEQ ID NO: 58738 - DNA, 20 bp, human
gcggcttggcgggttcctgg

SEQ ID NO: 58739 - DNA, 20 bp, human
ggaaatctcgcgatggaggg

SEQ ID NO: 58740 - DNA, 20 bp, human
gatctcgcgatggagggagg

SEQ ID NO: 58741 - DNA, 20 bp, human
gtaaggaatagggatagtgg

SEQ ID NO: 58742 - DNA, 20 bp, human
gccggtcaccgcctcgacag

SEQ ID NO: 58743 - DNA, 20 bp, human
gcgacaaggatcgccagaac

SEQ ID NO: 58744 - DNA, 20 bp, human
gcctgtctgcaaagtgacgg

SEQ ID NO: 58745 - DNA, 20 bp, human
ggcgcggcgaccaggagctc

SEQ ID NO: 58746 - DNA, 20 bp, human
ggtggcagaagctacagcag

SEQ ID NO: 58747 - DNA, 20 bp, human
gccagggagaggcccggtcg

SEQ ID NO: 58748 - DNA, 20 bp, human
gcagaggtgaccaaacgcca

SEQ ID NO: 58749 - DNA, 20 bp, human
ggcggtggagaatgaagcag

SEQ ID NO: 58750 - DNA, 20 bp, human
ggtgaccaaacgccagggag

SEQ ID NO: 58751 - DNA, 20 bp, human
gggagaggcccggtcgtggc

SEQ ID NO: 58752 - DNA, 20 bp, human
gggcaatggcagcaaccctg

SEQ ID NO: 58753 - DNA, 20 bp, human
gggggctccgagggaggcaa

SEQ ID NO: 58754 - DNA, 20 bp, human
gtggctccaagagggaccat

SEQ ID NO: 58755 - DNA, 20 bp, human
gtacgaacttccggttctcc

SEQ ID NO: 58756 - DNA, 20 bp, human
gggtgggtcggcacaggatc

SEQ ID NO: 58757 - DNA, 20 bp, human
gcctccgccgcaggatcccc

SEQ ID NO: 58758 - DNA, 20 bp, human
ggcacggaggcctgcaccgg

SEQ ID NO: 58759 - DNA, 20 bp, human
gcagcaggcaggcgatgagg

SEQ ID NO: 58760 - DNA, 20 bp, human
gaggatccgcaccagcacgg

SEQ ID NO: 58761 - DNA, 20 bp, human
gtcacggctgccttgagggt

SEQ ID NO: 58762 - DNA, 20 bp, human
ggcgatgaggagggtggtaa

SEQ ID NO: 58763 - DNA, 20 bp, human
gaggcaggcgatgaggaggg

SEQ ID NO: 58764 - DNA, 20 bp, human
gtccaggatccgcaccagca

SEQ ID NO: 58765 - DNA, 20 bp, human
gcgcgacctacccaccctca

SEQ ID NO: 58766 - DNA, 20 bp, human
gatggagggggagagtacgt

SEQ ID NO: 58767 - DNA, 20 bp, human
gcctgtagctgtggaaactt

SEQ ID NO: 58768 - DNA, 20 bp, human
gggcggcggtagcatggagg

SEQ ID NO: 58769 - DNA, 20 bp, human
ggtacgtcggcggtgctctc

SEQ ID NO: 58770 - DNA, 20 bp, human
gcctcttgtgtagcctgagg

SEQ ID NO: 58771 - DNA, 20 bp, human
gaggctacacaagaggacga

SEQ ID NO: 58772 - DNA, 20 bp, human
gatgctggagaagacttcgt

SEQ ID NO: 58773 - DNA, 20 bp, human
gctacacaagaggacgaggg

SEQ ID NO: 58774 - DNA, 20 bp, human
ggaccggagcaacagcgggg

SEQ ID NO: 58775 - DNA, 20 bp, human
ggagggggagagtacgtcgg

SEQ ID NO: 58776 - DNA, 20 bp, human
gagaggcaagagctcaccgg

SEQ ID NO: 58777 - DNA, 20 bp, human
gacagcaacgcggaccacgt

SEQ ID NO: 58778 - DNA, 20 bp, human
gctgaaggtgtagcccgaaa

SEQ ID NO: 58779 - DNA, 20 bp, human
ggggtcgggaaggaatctaa

SEQ ID NO: 58780 - DNA, 20 bp, human
ggaggagctggtgacccggg

SEQ ID NO: 58781 - DNA, 20 bp, human
gtagctggagatttccatca

SEQ ID NO: 58782 - DNA, 20 bp, human
gccctccgcggggcatgatg

SEQ ID NO: 58783 - DNA, 20 bp, human
gaagcctgactttcagggag

SEQ ID NO: 58784 - DNA, 20 bp, human
gagacttaagaggggcgcac

SEQ ID NO: 58785 - DNA, 20 bp, human
gtaagaggggcgcacggggt

SEQ ID NO: 58786 - DNA, 20 bp, human
gtctcagtgagcagaaacag

SEQ ID NO: 58787 - DNA, 20 bp, human
gcgcggagaaggcaaggagg

SEQ ID NO: 58788 - DNA, 20 bp, human
gaggaggaactccaaagctg

SEQ ID NO: 58789 - DNA, 20 bp, human
gtggccaactgcagtctggg

SEQ ID NO: 58790 - DNA, 20 bp, human
gcagtgggcggtgtggaacg

SEQ ID NO: 58791 - DNA, 20 bp, human
ggcctcactcaccaacccct

SEQ ID NO: 58792 - DNA, 20 bp, human
ggctggggcggcctgctcgg

SEQ ID NO: 58793 - DNA, 20 bp, human
ggccgcgcaggctaaaagag

SEQ ID NO: 58794 - DNA, 20 bp, human
gggggactcgccggcctgag

SEQ ID NO: 58795 - DNA, 20 bp, human
ggtctgggaggcgcaactac

SEQ ID NO: 58796 - DNA, 20 bp, human
gtaagagttaagggttctgt

SEQ ID NO: 58797 - DNA, 20 bp, human
gattcagaggtccccaaaca

SEQ ID NO: 58798 - DNA, 20 bp, human
gcatccacagcaaggtgatg

SEQ ID NO: 58799 - DNA, 20 bp, human
gttaagggttctgtaggctg

SEQ ID NO: 58800 - DNA, 20 bp, human
gggatgacaaatgtaacctt

SEQ ID NO: 58801 - DNA, 20 bp, human
gctcagtaagaagtaggaag

SEQ ID NO: 58802 - DNA, 20 bp, human
gtacaccattactaagtcag

SEQ ID NO: 58803 - DNA, 20 bp, human
ggcacttggatatgctgacg

SEQ ID NO: 58804 - DNA, 20 bp, human
ggacctctgaatggtacaca

SEQ ID NO: 58805 - DNA, 20 bp, human
gataccacatcaccttgctg

SEQ ID NO: 58806 - DNA, 20 bp, human
gtacgtgtaaggcatcatag

SEQ ID NO: 58807 - DNA, 20 bp, human
gggcgtcagaaagctcgtag

SEQ ID NO: 58808 - DNA, 20 bp, human
gaggtgagacgggaacccac

SEQ ID NO: 58809 - DNA, 20 bp, human
gtgagcaaggaaacagtcta

SEQ ID NO: 58810 - DNA, 20 bp, human
gtcctccctgtcctgcccct

SEQ ID NO: 58811 - DNA, 20 bp, human
gctgtcctgccccttggcag

SEQ ID NO: 58812 - DNA, 20 bp, human
gggaggtaagatgcagaggg

SEQ ID NO: 58813 - DNA, 20 bp, human
gttagagtgatgtcagtggt

SEQ ID NO: 58814 - DNA, 20 bp, human
ggagagagggcggacctgtg

SEQ ID NO: 58815 - DNA, 20 bp, human
gcagaaagctcgtaggggtt

SEQ ID NO: 58816 - DNA, 20 bp, human
gagggtttgctgaagcaaac

SEQ ID NO: 58817 - DNA, 20 bp, human
gccggcagctgccttcgttg

SEQ ID NO: 58818 - DNA, 20 bp, human
gaggctgtcggagcagaggt

SEQ ID NO: 58819 - DNA, 20 bp, human
gttgctgctgggactccggg

SEQ ID NO: 58820 - DNA, 20 bp, human
ggaaccgccatgaagagaga

SEQ ID NO: 58821 - DNA, 20 bp, human
gtgggactccgggaggctgt

SEQ ID NO: 58822 - DNA, 20 bp, human
ggaagggattccctcatcac

SEQ ID NO: 58823 - DNA, 20 bp, human
gcctccgcgagctcaggcgt

SEQ ID NO: 58824 - DNA, 20 bp, human
gcgtgagcgggaaggaacct

SEQ ID NO: 58825 - DNA, 20 bp, human
gcagcatgggcggtactacc

SEQ ID NO: 58826 - DNA, 20 bp, human
gggaccagccaggagtccca

SEQ ID NO: 58827 - DNA, 20 bp, human
gtggccacatagggcgggaa

SEQ ID NO: 58828 - DNA, 20 bp, human
gtgaggccgaggaaccgcag

SEQ ID NO: 58829 - DNA, 20 bp, human
gcgagctccccagctggcgg

SEQ ID NO: 58830 - DNA, 20 bp, human
gagggctccggggtgaggga

SEQ ID NO: 58831 - DNA, 20 bp, human
gtagctggccccgtcctctg

SEQ ID NO: 58832 - DNA, 20 bp, human
gttgcaggtcagccccggtg

SEQ ID NO: 58833 - DNA, 20 bp, human
ggtggagggctaacaggaag

SEQ ID NO: 58834 - DNA, 20 bp, human
ggagagcactcgacttccct

SEQ ID NO: 58835 - DNA, 20 bp, human
gacctaaagatccagttctg

SEQ ID NO: 58836 - DNA, 20 bp, human
gcccgagtcatggcctctgt

SEQ ID NO: 58837 - DNA, 20 bp, human
gggcagtgctctctacctca

SEQ ID NO: 58838 - DNA, 20 bp, human
gagctggagcacgccagcag

SEQ ID NO: 58839 - DNA, 20 bp, human
gcatgtggcagctctagggg

SEQ ID NO: 58840 - DNA, 20 bp, human
gacgccagcagtggagctcg

SEQ ID NO: 58841 - DNA, 20 bp, human
gccctttctgggccttcatg

SEQ ID NO: 58842 - DNA, 20 bp, human
gcttcatgtggcagctctag

SEQ ID NO: 58843 - DNA, 20 bp, human
ggaggccaaacccctgtcac

SEQ ID NO: 58844 - DNA, 20 bp, human
ggtttggcctctggacagag

SEQ ID NO: 58845 - DNA, 20 bp, human
gcagagaggtgagagacgat

SEQ ID NO: 58846 - DNA, 20 bp, human
gtgccaccgggcgtaaccaa

SEQ ID NO: 58847 - DNA, 20 bp, human
ggtggcagctgtggggtcta

SEQ ID NO: 58848 - DNA, 20 bp, human
gacgcccggtggcagctgtg

SEQ ID NO: 58849 - DNA, 20 bp, human
ggggtctagggctcagacgg

SEQ ID NO: 58850 - DNA, 20 bp, human
gggccgcccccaactccggg

SEQ ID NO: 58851 - DNA, 20 bp, human
gcagaggcgaagttgtagtg

SEQ ID NO: 58852 - DNA, 20 bp, human
gtgcttgagactgcctccga

SEQ ID NO: 58853 - DNA, 20 bp, human
ggcctccgagggcatcaaga

SEQ ID NO: 58854 - DNA, 20 bp, human
gtcaagagggccgaggccag

SEQ ID NO: 58855 - DNA, 20 bp, human
ggtggtcccccgcagctcca

SEQ ID NO: 58856 - DNA, 20 bp, human
ggagagcgtcaaatgaagag

SEQ ID NO: 58857 - DNA, 20 bp, human
gctctgcctcagaaggctgg

SEQ ID NO: 58858 - DNA, 20 bp, human
gccatcaccctctaagaagg

SEQ ID NO: 58859 - DNA, 20 bp, human
ggaggctgaaggctgcgtcc

SEQ ID NO: 58860 - DNA, 20 bp, human
gatgcctactctgcctcaga

SEQ ID NO: 58861 - DNA, 20 bp, human
gggcatacctgcagctactg

SEQ ID NO: 58862 - DNA, 20 bp, human
gattagacaaaaggagagtg

SEQ ID NO: 58863 - DNA, 20 bp, human
gcgtctgcaaaaggaaggga

SEQ ID NO: 58864 - DNA, 20 bp, human
gaacacgtcaagaagcatca

SEQ ID NO: 58865 - DNA, 20 bp, human
gtcctgagggaattaggttg

SEQ ID NO: 58866 - DNA, 20 bp, human
ggtgtgtggcaggcagatga

SEQ ID NO: 58867 - DNA, 20 bp, human
gatagaagcgtgggcatggt

SEQ ID NO: 58868 - DNA, 20 bp, human
ggcagcccgcagtggaaagt

SEQ ID NO: 58869 - DNA, 20 bp, human
gtagtcgggcatagaagcgt

SEQ ID NO: 58870 - DNA, 20 bp, human
gaggcaacaccccaaggtgt

SEQ ID NO: 58871 - DNA, 20 bp, human
ggagtgagactcagaggacg

SEQ ID NO: 58872 - DNA, 20 bp, human
gatcagtgggaatgagccca

SEQ ID NO: 58873 - DNA, 20 bp, human
gcttggaacaaacattgcaa

SEQ ID NO: 58874 - DNA, 20 bp, human
gtccgtccggcccacacctt

SEQ ID NO: 58875 - DNA, 20 bp, human
gcccagaactggaaaggtac

SEQ ID NO: 58876 - DNA, 20 bp, human
gcagccggccgagctccgtc

SEQ ID NO: 58877 - DNA, 20 bp, human
gggttccccactgcagacct

SEQ ID NO: 58878 - DNA, 20 bp, human
gctccattcagcccactcaa

SEQ ID NO: 58879 - DNA, 20 bp, human
ggagggggaggctaccacca

SEQ ID NO: 58880 - DNA, 20 bp, human
gctgtcccaggtctgcagtg

SEQ ID NO: 58881 - DNA, 20 bp, human
gggctaccaccagggaggaa

SEQ ID NO: 58882 - DNA, 20 bp, human
gggggaggctaccaccaggg

SEQ ID NO: 58883 - DNA, 20 bp, human
gcagccggacggagctcggc

SEQ ID NO: 58884 - DNA, 20 bp, human
gacaactgcttccagccgga

SEQ ID NO: 58885 - DNA, 20 bp, human
gtgccttgcgggctgatctc

SEQ ID NO: 58886 - DNA, 20 bp, human
ggtactggaggacacagtca

SEQ ID NO: 58887 - DNA, 20 bp, human
gcgaggcctatcagtactgg

SEQ ID NO: 58888 - DNA, 20 bp, human
gtgacgaggcctatcagtac

SEQ ID NO: 58889 - DNA, 20 bp, human
gggtgcctgggagagtgacg

SEQ ID NO: 58890 - DNA, 20 bp, human
gtaggcctcgtcactctccc

SEQ ID NO: 58891 - DNA, 20 bp, human
ggccattatatccagcccag

SEQ ID NO: 58892 - DNA, 20 bp, human
ggagcaggggcgtgaatgtg

SEQ ID NO: 58893 - DNA, 20 bp, human
ggaagaccccacagccaaaa

SEQ ID NO: 58894 - DNA, 20 bp, human
gtagctacacttcaagggtg

SEQ ID NO: 58895 - DNA, 20 bp, human
gcaggtgaagctgtaaagaa

SEQ ID NO: 58896 - DNA, 20 bp, human
gagccaggcccggaactagt

SEQ ID NO: 58897 - DNA, 20 bp, human
gtcgctgcgctgcctcccgg

SEQ ID NO: 58898 - DNA, 20 bp, human
gcctaatgagctcccccggg

SEQ ID NO: 58899 - DNA, 20 bp, human
gcaagccgggcaagtcgaag

SEQ ID NO: 58900 - DNA, 20 bp, human
gggcgcagcctactagttcc

SEQ ID NO: 58901 - DNA, 20 bp, human
ggaagccgaagggcacgaaa

SEQ ID NO: 58902 - DNA, 20 bp, human
gagacctaatgagctccccc

SEQ ID NO: 58903 - DNA, 20 bp, human
gttcgaggacgatgagaccg

SEQ ID NO: 58904 - DNA, 20 bp, human
gcccttgtccagggctccga

SEQ ID NO: 58905 - DNA, 20 bp, human
ggctccccggacgggctagg

SEQ ID NO: 58906 - DNA, 20 bp, human
gacgcgttgcctggagactg

SEQ ID NO: 58907 - DNA, 20 bp, human
gagtgagacccgccccgacc

SEQ ID NO: 58908 - DNA, 20 bp, human
gtcccctccgcaagagtgag

SEQ ID NO: 58909 - DNA, 20 bp, human
ggcccaggcaagagggcgcg

SEQ ID NO: 58910 - DNA, 20 bp, human
gtccgcaagagtgagaggca

SEQ ID NO: 58911 - DNA, 20 bp, human
gcggggaaggaggagccctc

SEQ ID NO: 58912 - DNA, 20 bp, human
gttgcgggaactgtacctca

SEQ ID NO: 58913 - DNA, 20 bp, human
gggtgtcccgccatggcctt

SEQ ID NO: 58914 - DNA, 20 bp, human
gctgggttcgtagctccttg

SEQ ID NO: 58915 - DNA, 20 bp, human
ggccacgcgccctcttgcct

SEQ ID NO: 58916 - DNA, 20 bp, human
gttgggaagatggcgacccc

SEQ ID NO: 58917 - DNA, 20 bp, human
gggcagcagcactattacgg

SEQ ID NO: 58918 - DNA, 20 bp, human
ggactcggcgaggctgcgga

SEQ ID NO: 58919 - DNA, 20 bp, human
gcgaggacagcgcagctccg

SEQ ID NO: 58920 - DNA, 20 bp, human
ggctggcagcagcactatta

SEQ ID NO: 58921 - DNA, 20 bp, human
gccgcaccgaggactcggcg

SEQ ID NO: 58922 - DNA, 20 bp, human
gggcgaccccgggcatgagc

SEQ ID NO: 58923 - DNA, 20 bp, human
ggcccgggaggcaagagtcg

SEQ ID NO: 58924 - DNA, 20 bp, human
gcgaggactcggcgaggctg

SEQ ID NO: 58925 - DNA, 20 bp, human
gccgctcgcagcccgcaccg

SEQ ID NO: 58926 - DNA, 20 bp, human
gactgcagactgatcgccag

SEQ ID NO: 58927 - DNA, 20 bp, human
gagctcaccaaggtaaggtg

SEQ ID NO: 58928 - DNA, 20 bp, human
ggcaccctgcggcgaggcgt

SEQ ID NO: 58929 - DNA, 20 bp, human
ggcacgcacgtgcacacggt

SEQ ID NO: 58930 - DNA, 20 bp, human
gttgcacacgaaacctgcac

SEQ ID NO: 58931 - DNA, 20 bp, human
gacgaaacctgcactggctg

SEQ ID NO: 58932 - DNA, 20 bp, human
gctccagccggcgccaccgt

SEQ ID NO: 58933 - DNA, 20 bp, human
gagggctccaaagccgacgg

SEQ ID NO: 58934 - DNA, 20 bp, human
gatcgccagcggcacgtgcg

SEQ ID NO: 58935 - DNA, 20 bp, human
gtgcaaggggagagcttccg

SEQ ID NO: 58936 - DNA, 20 bp, human
gcttgcccctggggattgcg

SEQ ID NO: 58937 - DNA, 20 bp, human
gcatcagccgcgcaatcccc

SEQ ID NO: 58938 - DNA, 20 bp, human
gagttcactgtgcgttccct

SEQ ID NO: 58939 - DNA, 20 bp, human
ggcgcccgcagccgaccaaa

SEQ ID NO: 58940 - DNA, 20 bp, human
ggcaggtgagcccgtttggt

SEQ ID NO: 58941 - DNA, 20 bp, human
gaagctcccaacctgagcag

SEQ ID NO: 58942 - DNA, 20 bp, human
gaggtccctccgcctggccc

SEQ ID NO: 58943 - DNA, 20 bp, human
gcttcagagttcggcgcccc

SEQ ID NO: 58944 - DNA, 20 bp, human
gtgggctggcgctgggcgct

SEQ ID NO: 58945 - DNA, 20 bp, human
ggacctgacggagacagaga

SEQ ID NO: 58946 - DNA, 20 bp, human
gtccagtaggaagctaggag

SEQ ID NO: 58947 - DNA, 20 bp, human
gcaaggttagggagcatcaa

SEQ ID NO: 58948 - DNA, 20 bp, human
gacctctcctagcttcctac

SEQ ID NO: 58949 - DNA, 20 bp, human
ggctaataaagatatccagt

SEQ ID NO: 58950 - DNA, 20 bp, human
gtccatcgagccagagaggt

SEQ ID NO: 58951 - DNA, 20 bp, human
gagagtatgccacaacttct

SEQ ID NO: 58952 - DNA, 20 bp, human
gtactgagaatgggatctca

SEQ ID NO: 58953 - DNA, 20 bp, human
gtgccacaacttctaggatc

SEQ ID NO: 58954 - DNA, 20 bp, human
gggcatactctgctactaat

SEQ ID NO: 58955 - DNA, 20 bp, human
gtttcacctgacaccgactg

SEQ ID NO: 58956 - DNA, 20 bp, human
gttggaggttaagggcacca

SEQ ID NO: 58957 - DNA, 20 bp, human
gcctaaacttggcatataca

SEQ ID NO: 58958 - DNA, 20 bp, human
gaagctcgaggatagccctg

SEQ ID NO: 58959 - DNA, 20 bp, human
gtgcctgctttggaggttaa

SEQ ID NO: 58960 - DNA, 20 bp, human
ggggcaccagggtgtctcct

SEQ ID NO: 58961 - DNA, 20 bp, human
gcagctaactcgggctcaag

SEQ ID NO: 58962 - DNA, 20 bp, human
gatagccctgaggcacatcg

SEQ ID NO: 58963 - DNA, 20 bp, human
gggtgtttggcagttaccag

SEQ ID NO: 58964 - DNA, 20 bp, human
gcaaccacccgcctgaggca

SEQ ID NO: 58965 - DNA, 20 bp, human
ggccctgaggcacatcgtgg

SEQ ID NO: 58966 - DNA, 20 bp, human
gaccaaggccgggactgctg

SEQ ID NO: 58967 - DNA, 20 bp, human
gggtccgggaggctgagtaa

SEQ ID NO: 58968 - DNA, 20 bp, human
gactgctggggtgaaggtcc

SEQ ID NO: 58969 - DNA, 20 bp, human
ggctggggtgaaggtccggg

SEQ ID NO: 58970 - DNA, 20 bp, human
gctgataaaccagaacagga

SEQ ID NO: 58971 - DNA, 20 bp, human
ggctgagtaaggggacggaa

SEQ ID NO: 58972 - DNA, 20 bp, human
gaaagaaagcaaggggacca

SEQ ID NO: 58973 - DNA, 20 bp, human
ggccaccctaccccaacgta

SEQ ID NO: 58974 - DNA, 20 bp, human
ggaatctgaacgccaagaag

SEQ ID NO: 58975 - DNA, 20 bp, human
gaccccagcagtcccggcct

SEQ ID NO: 58976 - DNA, 20 bp, human
gctcgcccggctcctcacag

SEQ ID NO: 58977 - DNA, 20 bp, human
gttggcactgcttaccactg

SEQ ID NO: 58978 - DNA, 20 bp, human
gcagtgccggggcagcaaag

SEQ ID NO: 58979 - DNA, 20 bp, human
gaagtagaaccccagtgccg

SEQ ID NO: 58980 - DNA, 20 bp, human
gtgggtggcatggtggactg

SEQ ID NO: 58981 - DNA, 20 bp, human
gacacaaggacctgggtcag

SEQ ID NO: 58982 - DNA, 20 bp, human
gtaatgagaaggctgccctc

SEQ ID NO: 58983 - DNA, 20 bp, human
gtcctgccagggctcccacc

SEQ ID NO: 58984 - DNA, 20 bp, human
ggcctgagagtagggcctgt

SEQ ID NO: 58985 - DNA, 20 bp, human
gagcggttgcagtcctgcca

SEQ ID NO: 58986 - DNA, 20 bp, human
gagcctgtcaagccaggttg

SEQ ID NO: 58987 - DNA, 20 bp, human
ggagcgctgcgggtatttag

SEQ ID NO: 58988 - DNA, 20 bp, human
ggcaaacgaattggaaggtg

SEQ ID NO: 58989 - DNA, 20 bp, human
gacggcggcggcaaacgaat

SEQ ID NO: 58990 - DNA, 20 bp, human
gcggcggcaaacgaattgga

SEQ ID NO: 58991 - DNA, 20 bp, human
gcgcagggcaaaagaagcag

SEQ ID NO: 58992 - DNA, 20 bp, human
gtgccccaacctggcttgac

SEQ ID NO: 58993 - DNA, 20 bp, human
gagaccaagcctgtcaagcc

SEQ ID NO: 58994 - DNA, 20 bp, human
gctggagcgagaggcgtcac

SEQ ID NO: 58995 - DNA, 20 bp, human
gaatggtgtccgagagaccg

SEQ ID NO: 58996 - DNA, 20 bp, human
gggcccggcgtgggcctcgt

SEQ ID NO: 58997 - DNA, 20 bp, human
gcacgccgggccgcagcacc

SEQ ID NO: 58998 - DNA, 20 bp, human
gctggagcaggcagtaggta

SEQ ID NO: 58999 - DNA, 20 bp, human
gtgcccacgaggcccacgcc

SEQ ID NO: 59000 - DNA, 20 bp, human
gtcctagcgcgggcgcacag

SEQ ID NO: 59001 - DNA, 20 bp, human
ggcaggcagtaggtagggaa

SEQ ID NO: 59002 - DNA, 20 bp, human
gggaaagcggcgctcttctg

SEQ ID NO: 59003 - DNA, 20 bp, human
gcaacgcggccatactgcgc

SEQ ID NO: 59004 - DNA, 20 bp, human
gaagaggctgtccatggctc

SEQ ID NO: 59005 - DNA, 20 bp, human
gggccgcagcaccaggcaac

SEQ ID NO: 59006 - DNA, 20 bp, human
gggatcatggaacctgaaat

SEQ ID NO: 59007 - DNA, 20 bp, human
gagctgcggcagatcctgtt

SEQ ID NO: 59008 - DNA, 20 bp, human
gccgcagcttctgaaaagag

SEQ ID NO: 59009 - DNA, 20 bp, human
gccagttatagctaaagaca

SEQ ID NO: 59010 - DNA, 20 bp, human
gtgtggacaggaaggatata

SEQ ID NO: 59011 - DNA, 20 bp, human
gatatatggataaggaacat

SEQ ID NO: 59012 - DNA, 20 bp, human
gtacatggatgtggacagga

SEQ ID NO: 59013 - DNA, 20 bp, human
gtagctttcactctggaagt

SEQ ID NO: 59014 - DNA, 20 bp, human
gcaggaaggatatatggata

SEQ ID NO: 59015 - DNA, 20 bp, human
gatggactgtgtttccaaac

SEQ ID NO: 59016 - DNA, 20 bp, human
gtcagtgacaagacagatgg

SEQ ID NO: 59017 - DNA, 20 bp, human
gtcctcagtgacaagacaga

SEQ ID NO: 59018 - DNA, 20 bp, human
ggctgcaggagcagctcaga

SEQ ID NO: 59019 - DNA, 20 bp, human
gatgctcctgatgtgaccgg

SEQ ID NO: 59020 - DNA, 20 bp, human
gccggaggtgccttccaaag

SEQ ID NO: 59021 - DNA, 20 bp, human
gcaggagcaagccttggccg

SEQ ID NO: 59022 - DNA, 20 bp, human
gaggcacctccggtcacatc

SEQ ID NO: 59023 - DNA, 20 bp, human
gccctgtcctggcagatgaa

SEQ ID NO: 59024 - DNA, 20 bp, human
gcacatcaggagcatggatg

SEQ ID NO: 59025 - DNA, 20 bp, human
gtcgactccggactactctg

SEQ ID NO: 59026 - DNA, 20 bp, human
ggaagctgactgccacgatg

SEQ ID NO: 59027 - DNA, 20 bp, human
ggcgctcggatgcctcatcg

SEQ ID NO: 59028 - DNA, 20 bp, human
ggcgctggcgctcaccacct

SEQ ID NO: 59029 - DNA, 20 bp, human
gccgagaagcctgcccagaa

SEQ ID NO: 59030 - DNA, 20 bp, human
gtcggaccctctgtgaggag

SEQ ID NO: 59031 - DNA, 20 bp, human
ggagtgtccgcgaccaggcg

SEQ ID NO: 59032 - DNA, 20 bp, human
gtcggtgagtgtccgcgacc

SEQ ID NO: 59033 - DNA, 20 bp, human
ggcctcccagccggctgcca

SEQ ID NO: 59034 - DNA, 20 bp, human
gactcctgccccttctgggc

SEQ ID NO: 59035 - DNA, 20 bp, human
gttgcctcggaccctctgtg

SEQ ID NO: 59036 - DNA, 20 bp, human
gtcccgcgccgatgcgaggt

SEQ ID NO: 59037 - DNA, 20 bp, human
gggacgtgcctacctcgcat

SEQ ID NO: 59038 - DNA, 20 bp, human
gcggtaggagcgggaatgaa

SEQ ID NO: 59039 - DNA, 20 bp, human
ggctttcccggcatctcggt

SEQ ID NO: 59040 - DNA, 20 bp, human
gtaagtaagtccctcgaggt

SEQ ID NO: 59041 - DNA, 20 bp, human
ggcactcccgcgccgatgcg

SEQ ID NO: 59042 - DNA, 20 bp, human
gcccggcatctcggtaggag

SEQ ID NO: 59043 - DNA, 20 bp, human
gcaggaagccggcgcaggtt

SEQ ID NO: 59044 - DNA, 20 bp, human
gtgcctacctcgcatcggcg

SEQ ID NO: 59045 - DNA, 20 bp, human
ggagcgcagttaccgctcac

SEQ ID NO: 59046 - DNA, 20 bp, human
gcaggcgacacaggagacag

SEQ ID NO: 59047 - DNA, 20 bp, human
gggagcgggacaggcgacac

SEQ ID NO: 59048 - DNA, 20 bp, human
gggccaagcgaggggcgtca

SEQ ID NO: 59049 - DNA, 20 bp, human
ggccgagggacgccagctgt

SEQ ID NO: 59050 - DNA, 20 bp, human
gttctctagtccccgacctg

SEQ ID NO: 59051 - DNA, 20 bp, human
gcaagcgaggggcgtcacgg

SEQ ID NO: 59052 - DNA, 20 bp, human
ggggtccagtgcccactggg

SEQ ID NO: 59053 - DNA, 20 bp, human
gggctggagtcactaggcga

SEQ ID NO: 59054 - DNA, 20 bp, human
ggggcgtccagtaggatccg

SEQ ID NO: 59055 - DNA, 20 bp, human
ggagcgaggcgcaggcaacc

SEQ ID NO: 59056 - DNA, 20 bp, human
ggaggaacaggaagccctga

SEQ ID NO: 59057 - DNA, 20 bp, human
ggggcgggactctattgtgg

SEQ ID NO: 59058 - DNA, 20 bp, human
ggctgagggtgcccgcggga

SEQ ID NO: 59059 - DNA, 20 bp, human
gcgggaaggcatctgggtcg

SEQ ID NO: 59060 - DNA, 20 bp, human
gcgaggccgcactcacctac

SEQ ID NO: 59061 - DNA, 20 bp, human
gggactctattgtggcggtg

SEQ ID NO: 59062 - DNA, 20 bp, human
gtattgtggcggtgaggaac

SEQ ID NO: 59063 - DNA, 20 bp, human
ggtggggcgggactctattg

SEQ ID NO: 59064 - DNA, 20 bp, human
gaggcgagacgacctcacct

SEQ ID NO: 59065 - DNA, 20 bp, human
gtcgcggcgaggaccctttc

SEQ ID NO: 59066 - DNA, 20 bp, human
gctgactggctgcttctcag

SEQ ID NO: 59067 - DNA, 20 bp, human
gccagataccgggactgagg

SEQ ID NO: 59068 - DNA, 20 bp, human
ggacatgcagacctgcatat

SEQ ID NO: 59069 - DNA, 20 bp, human
gtggagctggacggagaaac

SEQ ID NO: 59070 - DNA, 20 bp, human
ggtcccagataccgggactg

SEQ ID NO: 59071 - DNA, 20 bp, human
ggtgaatgagaggagcgatg

SEQ ID NO: 59072 - DNA, 20 bp, human
gcagacctgcatattggagc

SEQ ID NO: 59073 - DNA, 20 bp, human
gccgtccagctccaatatgc

SEQ ID NO: 59074 - DNA, 20 bp, human
gtcgctcctctcattcactg

SEQ ID NO: 59075 - DNA, 20 bp, human
gcgatgggggagagcctgac

SEQ ID NO: 59076 - DNA, 20 bp, human
ggcttcggcgccggacccgg

SEQ ID NO: 59077 - DNA, 20 bp, human
gaaggctgctaccccagccg

SEQ ID NO: 59078 - DNA, 20 bp, human
gagcagccttcccccgggtc

SEQ ID NO: 59079 - DNA, 20 bp, human
ggccccgggggagaaagctt

SEQ ID NO: 59080 - DNA, 20 bp, human
gaggacaacagccaatatgg

SEQ ID NO: 59081 - DNA, 20 bp, human
ggcgagcggggagacttcgg

SEQ ID NO: 59082 - DNA, 20 bp, human
ggtgaggggagcggtagcgg

SEQ ID NO: 59083 - DNA, 20 bp, human
ggcggcggcgtgtggagcga

SEQ ID NO: 59084 - DNA, 20 bp, human
ggagcggcggcatgacgcgg

SEQ ID NO: 59085 - DNA, 20 bp, human
gcgcgagcggcggcatgacg

SEQ ID NO: 59086 - DNA, 20 bp, human
gaaaccctcgaggaaggggt

SEQ ID NO: 59087 - DNA, 20 bp, human
gccgctaggcgagcgcaagt

SEQ ID NO: 59088 - DNA, 20 bp, human
gtggagacgagaaaccctcg

SEQ ID NO: 59089 - DNA, 20 bp, human
gcgagaaaccctcgaggaag

SEQ ID NO: 59090 - DNA, 20 bp, human
gtggctgggcacgaacgtag

SEQ ID NO: 59091 - DNA, 20 bp, human
gctagcggcttcggagaccc

SEQ ID NO: 59092 - DNA, 20 bp, human
gggagaccaacgcacaacag

SEQ ID NO: 59093 - DNA, 20 bp, human
gacctggtccacccactcct

SEQ ID NO: 59094 - DNA, 20 bp, human
gacgacgcgcaggtcgacga

SEQ ID NO: 59095 - DNA, 20 bp, human
gggcgagcgcaagtgggcca

SEQ ID NO: 59096 - DNA, 20 bp, human
gacgcgcgggagcctggctt

SEQ ID NO: 59097 - DNA, 20 bp, human
ggggagcctggcttgggtaa

SEQ ID NO: 59098 - DNA, 20 bp, human
gccggggcctgagatcgcgg

SEQ ID NO: 59099 - DNA, 20 bp, human
gacgccggggcctgagatcg

SEQ ID NO: 59100 - DNA, 20 bp, human
ggaatagagaggccgagaaa

SEQ ID NO: 59101 - DNA, 20 bp, human
ggagagcccctagctctggg

SEQ ID NO: 59102 - DNA, 20 bp, human
ggccacaggagtcgcttcgt

SEQ ID NO: 59103 - DNA, 20 bp, human
gagagctgccacaaacgccg

SEQ ID NO: 59104 - DNA, 20 bp, human
gagcgactcctgtggcccaa

SEQ ID NO: 59105 - DNA, 20 bp, human
ggtgcatccaccgcgatctc

SEQ ID NO: 59106 - DNA, 20 bp, human
ggcgcgtctcacctcgacag

SEQ ID NO: 59107 - DNA, 20 bp, human
gcccgccggccgccctagag

SEQ ID NO: 59108 - DNA, 20 bp, human
gcacgcccccggcccttaaa

SEQ ID NO: 59109 - DNA, 20 bp, human
gaaggtcaccctccgctcta

SEQ ID NO: 59110 - DNA, 20 bp, human
ggggaccctggcccctgtcg

SEQ ID NO: 59111 - DNA, 20 bp, human
gcggcccgtgcgcacctgtg

SEQ ID NO: 59112 - DNA, 20 bp, human
gaggcccgcgggcgcgtagt

SEQ ID NO: 59113 - DNA, 20 bp, human
ggctgaccccggacacgcgg

SEQ ID NO: 59114 - DNA, 20 bp, human
ggccggccgccctagagcgg

SEQ ID NO: 59115 - DNA, 20 bp, human
gggtcagcccgagcccgtgc

SEQ ID NO: 59116 - DNA, 20 bp, human
gggaacgcgggcccctccct

SEQ ID NO: 59117 - DNA, 20 bp, human
ggcctcccagctggaagagg

SEQ ID NO: 59118 - DNA, 20 bp, human
ggcggcgctccgagaatcgg

SEQ ID NO: 59119 - DNA, 20 bp, human
gtcccagctggaagaggcgg

SEQ ID NO: 59120 - DNA, 20 bp, human
gagccccaaagccccgacgg

SEQ ID NO: 59121 - DNA, 20 bp, human
gcccgcggcgctccgagaat

SEQ ID NO: 59122 - DNA, 20 bp, human
gcctcaggcacggtccctcc

SEQ ID NO: 59123 - DNA, 20 bp, human
gagagggcaaggccgaaaaa

SEQ ID NO: 59124 - DNA, 20 bp, human
ggtcagccccaaagccccga

SEQ ID NO: 59125 - DNA, 20 bp, human
gccaggagaccgggaaagcg

SEQ ID NO: 59126 - DNA, 20 bp, human
ggccgggcggccagaggcga

SEQ ID NO: 59127 - DNA, 20 bp, human
ggcgcagcgggccaagtccc

SEQ ID NO: 59128 - DNA, 20 bp, human
ggcacggagcactccggaca

SEQ ID NO: 59129 - DNA, 20 bp, human
gtgccagccgggcgcacagg

SEQ ID NO: 59130 - DNA, 20 bp, human
ggaccctggcaagcctgggg

SEQ ID NO: 59131 - DNA, 20 bp, human
ggctactccgcggagccggg

SEQ ID NO: 59132 - DNA, 20 bp, human
gactccggacagggcatccg

SEQ ID NO: 59133 - DNA, 20 bp, human
ggctcacgcggaggaagcct

SEQ ID NO: 59134 - DNA, 20 bp, human
gcagactcgccgcgctcacg

SEQ ID NO: 59135 - DNA, 20 bp, human
gggcagagcaccgctgggac

SEQ ID NO: 59136 - DNA, 20 bp, human
ggtagtgggtctgctcacgt

SEQ ID NO: 59137 - DNA, 20 bp, human
gtatatgcaagaagtgtagt

SEQ ID NO: 59138 - DNA, 20 bp, human
gcaaggtaagagatgtgggt

SEQ ID NO: 59139 - DNA, 20 bp, human
gtgcttcaaggtaagagatg

SEQ ID NO: 59140 - DNA, 20 bp, human
gagctgccgagcagtttgtt

SEQ ID NO: 59141 - DNA, 20 bp, human
ggcaggctgccccaaatgca

SEQ ID NO: 59142 - DNA, 20 bp, human
gttcagcctgtggccactag

SEQ ID NO: 59143 - DNA, 20 bp, human
gcagcctgcagttctgacaa

SEQ ID NO: 59144 - DNA, 20 bp, human
gaaaagccgaacaaactgct

SEQ ID NO: 59145 - DNA, 20 bp, human
gtgtgtgtggtggtatgtag

SEQ ID NO: 59146 - DNA, 20 bp, human
gctaggctgcgcaggcccgg

SEQ ID NO: 59147 - DNA, 20 bp, human
gcctcacagctgcagcaacg

SEQ ID NO: 59148 - DNA, 20 bp, human
gagtatggctctggcccaca

SEQ ID NO: 59149 - DNA, 20 bp, human
ggcagcaagggatagtcatt

SEQ ID NO: 59150 - DNA, 20 bp, human
gagctgcagcaacgtggctt

SEQ ID NO: 59151 - DNA, 20 bp, human
gggcattggggctggttgcg

SEQ ID NO: 59152 - DNA, 20 bp, human
gcagctgcaaagtatggctc

SEQ ID NO: 59153 - DNA, 20 bp, human
gttgggcttcaggggggcat

SEQ ID NO: 59154 - DNA, 20 bp, human
gactttgcagctgccgattc

SEQ ID NO: 59155 - DNA, 20 bp, human
gacagagcatctccgccttg

SEQ ID NO: 59156 - DNA, 20 bp, human
gatctgagggagcctacccg

SEQ ID NO: 59157 - DNA, 20 bp, human
gagtcccgagtagaccgcag

SEQ ID NO: 59158 - DNA, 20 bp, human
gcggtccgccccactaagag

SEQ ID NO: 59159 - DNA, 20 bp, human
ggagcctctgcggtctactc

SEQ ID NO: 59160 - DNA, 20 bp, human
gtgagatctacggggatctg

SEQ ID NO: 59161 - DNA, 20 bp, human
ggaggctcgcggccgcgggt

SEQ ID NO: 59162 - DNA, 20 bp, human
gccggatctactgagatcta

SEQ ID NO: 59163 - DNA, 20 bp, human
ggaacaactccggcctcggg

SEQ ID NO: 59164 - DNA, 20 bp, human
ggcaccgccggggacatggt

SEQ ID NO: 59165 - DNA, 20 bp, human
gtgcacaccgggatactccg

SEQ ID NO: 59166 - DNA, 20 bp, human
ggacactagagggctcccag

SEQ ID NO: 59167 - DNA, 20 bp, human
gtcttcctggagccaagcat

SEQ ID NO: 59168 - DNA, 20 bp, human
gtgtgggatggacactcgag

SEQ ID NO: 59169 - DNA, 20 bp, human
gggggccagctgtgtaagta

SEQ ID NO: 59170 - DNA, 20 bp, human
gacacagctggccccatgct

SEQ ID NO: 59171 - DNA, 20 bp, human
gtgaaacggccaagatggta

SEQ ID NO: 59172 - DNA, 20 bp, human
gttgcgaacaggacactaga

SEQ ID NO: 59173 - DNA, 20 bp, human
gggtaaggtgagtagttcct

SEQ ID NO: 59174 - DNA, 20 bp, human
gcggtgcaacagttcacaaa

SEQ ID NO: 59175 - DNA, 20 bp, human
gtggtggaagacaaatgaaa

SEQ ID NO: 59176 - DNA, 20 bp, human
gaggctgctcgaggccacag

SEQ ID NO: 59177 - DNA, 20 bp, human
gcaccggggcgctaactggg

SEQ ID NO: 59178 - DNA, 20 bp, human
gggccaccggggcgctaact

SEQ ID NO: 59179 - DNA, 20 bp, human
gaggtacgaactgcacctga

SEQ ID NO: 59180 - DNA, 20 bp, human
gcgcgcgaagaggctgctcg

SEQ ID NO: 59181 - DNA, 20 bp, human
ggtggagcgggtcggtgcga

SEQ ID NO: 59182 - DNA, 20 bp, human
gcgctaactgggtggccggt

SEQ ID NO: 59183 - DNA, 20 bp, human
gggccacccagttagcgccc

SEQ ID NO: 59184 - DNA, 20 bp, human
gtggaagcggtggagcgggt

SEQ ID NO: 59185 - DNA, 20 bp, human
gagtgggaagggctcctcgg

SEQ ID NO: 59186 - DNA, 20 bp, human
ggtgcattcggggcagagta

SEQ ID NO: 59187 - DNA, 20 bp, human
ggagtaaggcagcaaaatgt

SEQ ID NO: 59188 - DNA, 20 bp, human
gccccgaatgcactggagtg

SEQ ID NO: 59189 - DNA, 20 bp, human
gtggagtggggatggtccat

SEQ ID NO: 59190 - DNA, 20 bp, human
ggcagcaaaatgtaggagca

SEQ ID NO: 59191 - DNA, 20 bp, human
gcaaaggtctcgtcaggcag

SEQ ID NO: 59192 - DNA, 20 bp, human
ggcagatctgaaacatatcc

SEQ ID NO: 59193 - DNA, 20 bp, human
gaggtaagaagcatctttaa

SEQ ID NO: 59194 - DNA, 20 bp, human
gtcacttcaaaggtctcgtc

SEQ ID NO: 59195 - DNA, 20 bp, human
ggacatgtgatactttagag

SEQ ID NO: 59196 - DNA, 20 bp, human
gtgaatggctattacgtccc

SEQ ID NO: 59197 - DNA, 20 bp, human
gcgctgaggacgggaggaca

SEQ ID NO: 59198 - DNA, 20 bp, human
gggaaggcaacgctgaggac

SEQ ID NO: 59199 - DNA, 20 bp, human
gggaggggaaggcaacgctg

SEQ ID NO: 59200 - DNA, 20 bp, human
gggcgaggaaagctaaaacc

SEQ ID NO: 59201 - DNA, 20 bp, human
gcgtggggacggctaagata

SEQ ID NO: 59202 - DNA, 20 bp, human
gaaggcgtcagtgggaaaga

SEQ ID NO: 59203 - DNA, 20 bp, human
gacccaagctcggtgaatat

SEQ ID NO: 59204 - DNA, 20 bp, human
gcacgcttgagggtgaggta

SEQ ID NO: 59205 - DNA, 20 bp, human
gtctggctctctctcgctag

SEQ ID NO: 59206 - DNA, 20 bp, human
ggactatgtctccctctaga

SEQ ID NO: 59207 - DNA, 20 bp, human
gtgctctcaacggcagttgc

SEQ ID NO: 59208 - DNA, 20 bp, human
ggaccgttgtttgctctcaa

SEQ ID NO: 59209 - DNA, 20 bp, human
gtgccgttgagagcaaacaa

SEQ ID NO: 59210 - DNA, 20 bp, human
gggcaccgtcaccaccgagg

SEQ ID NO: 59211 - DNA, 20 bp, human
gttgctggggctaacagaac

SEQ ID NO: 59212 - DNA, 20 bp, human
ggccagggcactgctaccag

SEQ ID NO: 59213 - DNA, 20 bp, human
gggagaaagaaaggagcggg

SEQ ID NO: 59214 - DNA, 20 bp, human
gcctggcaccgtcaccaccg

SEQ ID NO: 59215 - DNA, 20 bp, human
gggctaacagaactggctgt

SEQ ID NO: 59216 - DNA, 20 bp, human
ggcagactctgggatcacac

SEQ ID NO: 59217 - DNA, 20 bp, human
gaagctgttctcaggtgcca

SEQ ID NO: 59218 - DNA, 20 bp, human
ggaggggctcttgcagactc

SEQ ID NO: 59219 - DNA, 20 bp, human
ggtgagcctggaccactgct

SEQ ID NO: 59220 - DNA, 20 bp, human
gcagcaaggccaaaagctca

SEQ ID NO: 59221 - DNA, 20 bp, human
gggtattcccaaagctgcac

SEQ ID NO: 59222 - DNA, 20 bp, human
ggcagctttgggaataccag

SEQ ID NO: 59223 - DNA, 20 bp, human
gggagctgcccagccattga

SEQ ID NO: 59224 - DNA, 20 bp, human
gtcactccacctggacaagt

SEQ ID NO: 59225 - DNA, 20 bp, human
gggacagtctcttctggcct

SEQ ID NO: 59226 - DNA, 20 bp, human
gagtcggtgcgccccgtcca

SEQ ID NO: 59227 - DNA, 20 bp, human
gggtaccagccgagaggcag

SEQ ID NO: 59228 - DNA, 20 bp, human
gtaactcggtaccagccgag

SEQ ID NO: 59229 - DNA, 20 bp, human
gcggcgcgcagctagcagtg

SEQ ID NO: 59230 - DNA, 20 bp, human
ggcggctgcgggcaaacatc

SEQ ID NO: 59231 - DNA, 20 bp, human
gtgcacgccgacctcagcac

SEQ ID NO: 59232 - DNA, 20 bp, human
gctagcgcgctgaccaggag

SEQ ID NO: 59233 - DNA, 20 bp, human
ggcaccgagctgagttaact

SEQ ID NO: 59234 - DNA, 20 bp, human
gtaaggaggggcgagaggat

SEQ ID NO: 59235 - DNA, 20 bp, human
gtatttaggtgctgtctcgt

SEQ ID NO: 59236 - DNA, 20 bp, human
gcgcgtggatcactaggacg

SEQ ID NO: 59237 - DNA, 20 bp, human
gggtggccgagtggtcggag

SEQ ID NO: 59238 - DNA, 20 bp, human
gacgtgctggaagccgggtc

SEQ ID NO: 59239 - DNA, 20 bp, human
gcgggcagagcgcggaggac

SEQ ID NO: 59240 - DNA, 20 bp, human
gggaggttagcagaaagtct

SEQ ID NO: 59241 - DNA, 20 bp, human
ggcggctccggcgcccgacc

SEQ ID NO: 59242 - DNA, 20 bp, human
gggatccccagcccaagccg

SEQ ID NO: 59243 - DNA, 20 bp, human
ggaactgcgcgtggatcact

SEQ ID NO: 59244 - DNA, 20 bp, human
ggcgatggtggccgagtggt

SEQ ID NO: 59245 - DNA, 20 bp, human
gccgcggaggctgcacccgg

SEQ ID NO: 59246 - DNA, 20 bp, human
gaggctggcgcgaggaacgg

SEQ ID NO: 59247 - DNA, 20 bp, human
gctgggatgctgggatagaa

SEQ ID NO: 59248 - DNA, 20 bp, human
gaaaccagtgggcacaactg

SEQ ID NO: 59249 - DNA, 20 bp, human
gggtgtccctggatacaggt

SEQ ID NO: 59250 - DNA, 20 bp, human
gcaccacaagaaaaaccagt

SEQ ID NO: 59251 - DNA, 20 bp, human
gggagcacagatatctgact

SEQ ID NO: 59252 - DNA, 20 bp, human
ggactcacatccaagccccc

SEQ ID NO: 59253 - DNA, 20 bp, human
ggatgtgagtctagtgctcc

SEQ ID NO: 59254 - DNA, 20 bp, human
gtccccgcccggagaagtct

SEQ ID NO: 59255 - DNA, 20 bp, human
gacgaccgcccgggacggag

SEQ ID NO: 59256 - DNA, 20 bp, human
gccccggatgaggaactcgg

SEQ ID NO: 59257 - DNA, 20 bp, human
gcggatgaggaactcggagg

SEQ ID NO: 59258 - DNA, 20 bp, human
ggtgggaccggaaaaagacg

SEQ ID NO: 59259 - DNA, 20 bp, human
ggggaaagcggggacgggag

SEQ ID NO: 59260 - DNA, 20 bp, human
gggaggcggcccgacccagt

SEQ ID NO: 59261 - DNA, 20 bp, human
gatagaaccgagagagacgg

SEQ ID NO: 59262 - DNA, 20 bp, human
gtgagtgacggccccggatg

SEQ ID NO: 59263 - DNA, 20 bp, human
gcggccccggatgaggaact

SEQ ID NO: 59264 - DNA, 20 bp, human
gccgcgcgtccatgattcga

SEQ ID NO: 59265 - DNA, 20 bp, human
gcccagtgagttagcatgga

SEQ ID NO: 59266 - DNA, 20 bp, human
ggtgttgcggagggaagtgt

SEQ ID NO: 59267 - DNA, 20 bp, human
gtccggtccactcccatcag

SEQ ID NO: 59268 - DNA, 20 bp, human
gaggctggataccttcctga

SEQ ID NO: 59269 - DNA, 20 bp, human
ggcccagcgctgcaagcctc

SEQ ID NO: 59270 - DNA, 20 bp, human
gcaaagggaaatgcaagagg

SEQ ID NO: 59271 - DNA, 20 bp, human
gcagcccagccgcagcgacc

SEQ ID NO: 59272 - DNA, 20 bp, human
gctgaagggcgattattcta

SEQ ID NO: 59273 - DNA, 20 bp, human
gcggccgggtcgctgcggct

SEQ ID NO: 59274 - DNA, 20 bp, human
ggtacactaggccttaagag

SEQ ID NO: 59275 - DNA, 20 bp, human
gtattctagggtcggccgag

SEQ ID NO: 59276 - DNA, 20 bp, human
gaccgctggcaccggtcggg

SEQ ID NO: 59277 - DNA, 20 bp, human
gcggaccgctggcaccggtc

SEQ ID NO: 59278 - DNA, 20 bp, human
ggccggctcgcgactgaggt

SEQ ID NO: 59279 - DNA, 20 bp, human
ggcagagtgtcgctcgacat

SEQ ID NO: 59280 - DNA, 20 bp, human
gcacacagcggacccctaag

SEQ ID NO: 59281 - DNA, 20 bp, human
gggacccctaagcggaccgc

SEQ ID NO: 59282 - DNA, 20 bp, human
gcactctgctgccacccgac

SEQ ID NO: 59283 - DNA, 20 bp, human
ggtgccagcggtccgcttag

SEQ ID NO: 59284 - DNA, 20 bp, human
gtggcgctggcgcctcggga

SEQ ID NO: 59285 - DNA, 20 bp, human
gccgtgtgcagcgctcatgg

SEQ ID NO: 59286 - DNA, 20 bp, human
gaccgctggcaccggtcggg

SEQ ID NO: 59287 - DNA, 20 bp, human
gcggaccgctggcaccggtc

SEQ ID NO: 59288 - DNA, 20 bp, human
ggccggctcgcgactgaggt

SEQ ID NO: 59289 - DNA, 20 bp, human
gcacacagcggacccctaag

SEQ ID NO: 59290 - DNA, 20 bp, human
ggcagagtgtcgctcgacat

SEQ ID NO: 59291 - DNA, 20 bp, human
gggacccctaagcggaccgc

SEQ ID NO: 59292 - DNA, 20 bp, human
gcactctgctgccacccgac

SEQ ID NO: 59293 - DNA, 20 bp, human
ggtgccagcggtccgcttag

SEQ ID NO: 59294 - DNA, 20 bp, human
gtggcgctggcgcctcggga

SEQ ID NO: 59295 - DNA, 20 bp, human
gccgtgtgcagcgctcatgg

SEQ ID NO: 59296 - DNA, 20 bp, human
gcgctgcgacgcccctttcg

SEQ ID NO: 59297 - DNA, 20 bp, human
ggacaggtgagtacggctta

SEQ ID NO: 59298 - DNA, 20 bp, human
gggtgagtacggcttatgga

SEQ ID NO: 59299 - DNA, 20 bp, human
gatcatgccggagcccgaac

SEQ ID NO: 59300 - DNA, 20 bp, human
gacttcctgacaggtgagta

SEQ ID NO: 59301 - DNA, 20 bp, human
gagtacggcttatggagggt

SEQ ID NO: 59302 - DNA, 20 bp, human
gttagttctgtgcccgggag

SEQ ID NO: 59303 - DNA, 20 bp, human
ggtcgcccagcagccatctt

SEQ ID NO: 59304 - DNA, 20 bp, human
ggtctgggagggcctcttgt

SEQ ID NO: 59305 - DNA, 20 bp, human
ggacgcaggagccaatgaga

SEQ ID NO: 59306 - DNA, 20 bp, human
ggagcacggtaagaacttat

SEQ ID NO: 59307 - DNA, 20 bp, human
gggaagctctctgaatatgg

SEQ ID NO: 59308 - DNA, 20 bp, human
gtctggggtggggattataa

SEQ ID NO: 59309 - DNA, 20 bp, human
gcttataggcttcttatctg

SEQ ID NO: 59310 - DNA, 20 bp, human
gttgcgggaagggcctggta

SEQ ID NO: 59311 - DNA, 20 bp, human
gttgggatcacagccctacc

SEQ ID NO: 59312 - DNA, 20 bp, human
gctcggaagctctctgaata

SEQ ID NO: 59313 - DNA, 20 bp, human
gcaatccaaaccaaatagag

SEQ ID NO: 59314 - DNA, 20 bp, human
ggaagaaaagtattacacaa

SEQ ID NO: 59315 - DNA, 20 bp, human
gagccaagaacctctctatt

SEQ ID NO: 59316 - DNA, 20 bp, human
gctctaaacggaggccccaa

SEQ ID NO: 59317 - DNA, 20 bp, human
gggaagagcacgcccagtcc

SEQ ID NO: 59318 - DNA, 20 bp, human
gaaacggaggccccaaaggt

SEQ ID NO: 59319 - DNA, 20 bp, human
ggaagcgctggggtcccgga

SEQ ID NO: 59320 - DNA, 20 bp, human
gtgtaggcctggcaccgtag

SEQ ID NO: 59321 - DNA, 20 bp, human
gcctccgcgcagcccggact

SEQ ID NO: 59322 - DNA, 20 bp, human
gagatgagtactctaaacgg

SEQ ID NO: 59323 - DNA, 20 bp, human
gcctggcaccgtagaggtag

SEQ ID NO: 59324 - DNA, 20 bp, human
gaggccccaaaggtaggcgg

SEQ ID NO: 59325 - DNA, 20 bp, human
ggattgcagtgcgagctcta

SEQ ID NO: 59326 - DNA, 20 bp, human
ggtgctccgccgggaagatg

SEQ ID NO: 59327 - DNA, 20 bp, human
ggttgccacgcggaccccag

SEQ ID NO: 59328 - DNA, 20 bp, human
gcgcaggaccagcttccggg

SEQ ID NO: 59329 - DNA, 20 bp, human
gtggcaaccctggaccgcag

SEQ ID NO: 59330 - DNA, 20 bp, human
ggcggagcacggcaaacgtg

SEQ ID NO: 59331 - DNA, 20 bp, human
gacggcagcctggtgcactc

SEQ ID NO: 59332 - DNA, 20 bp, human
gcgagtccgtgtgcccagga

SEQ ID NO: 59333 - DNA, 20 bp, human
gtgagctccccggaaaggaa

SEQ ID NO: 59334 - DNA, 20 bp, human
gactttccccatcttcccgg

SEQ ID NO: 59335 - DNA, 20 bp, human
gaaacgtgcggagcgcctcc

SEQ ID NO: 59336 - DNA, 20 bp, human
gctcttggggggccctgtag

SEQ ID NO: 59337 - DNA, 20 bp, human
gcagccgacggatgcgagtt

SEQ ID NO: 59338 - DNA, 20 bp, human
gtcggagccgctcctccctc

SEQ ID NO: 59339 - DNA, 20 bp, human
gaggcagaagaactgcccga

SEQ ID NO: 59340 - DNA, 20 bp, human
gacgcgcgcacgttgagtgg

SEQ ID NO: 59341 - DNA, 20 bp, human
gtcgtggctgaggctctggg

SEQ ID NO: 59342 - DNA, 20 bp, human
gcgccggcctaaggagctct

SEQ ID NO: 59343 - DNA, 20 bp, human
gccacacccgtcgaccttgt

SEQ ID NO: 59344 - DNA, 20 bp, human
gggagtcctgaggctgctcg

SEQ ID NO: 59345 - DNA, 20 bp, human
ggaggagcggctccgaggac

SEQ ID NO: 59346 - DNA, 20 bp, human
gcacgggcaagaggcaaccc

SEQ ID NO: 59347 - DNA, 20 bp, human
ggcacggccgggagaagcat

SEQ ID NO: 59348 - DNA, 20 bp, human
gtccccgaggccgagcgctc

SEQ ID NO: 59349 - DNA, 20 bp, human
gaaccctgcgaggaggacgg

SEQ ID NO: 59350 - DNA, 20 bp, human
gtgtctcccgtcagggtcac

SEQ ID NO: 59351 - DNA, 20 bp, human
gccgcggggacccccctcag

SEQ ID NO: 59352 - DNA, 20 bp, human
ggcccgggaaccctgcgagg

SEQ ID NO: 59353 - DNA, 20 bp, human
gcggagcgcggcaaaaggca

SEQ ID NO: 59354 - DNA, 20 bp, human
gtctgaccggcgctagcaac

SEQ ID NO: 59355 - DNA, 20 bp, human
gcaggctgccgggcgtcccg

SEQ ID NO: 59356 - DNA, 20 bp, human
gctctctagagacatgacat

SEQ ID NO: 59357 - DNA, 20 bp, human
gtagagacatgacataggac

SEQ ID NO: 59358 - DNA, 20 bp, human
gacagggcacccgggacaat

SEQ ID NO: 59359 - DNA, 20 bp, human
gttcactggagtgggtggat

SEQ ID NO: 59360 - DNA, 20 bp, human
gagccacactgacgctgaag

SEQ ID NO: 59361 - DNA, 20 bp, human
gggccgagtccaggtttcac

SEQ ID NO: 59362 - DNA, 20 bp, human
gggctcccaaaagcacaggt

SEQ ID NO: 59363 - DNA, 20 bp, human
gcactgaactctctttaggg

SEQ ID NO: 59364 - DNA, 20 bp, human
gctccacttcagcgtcagtg

SEQ ID NO: 59365 - DNA, 20 bp, human
gcatgacataggacaggctt

SEQ ID NO: 59366 - DNA, 20 bp, human
gcccaggggaaggtgcaata

SEQ ID NO: 59367 - DNA, 20 bp, human
gtccgtattgcaccttcccc

SEQ ID NO: 59368 - DNA, 20 bp, human
gtcttcactaaggatacatc

SEQ ID NO: 59369 - DNA, 20 bp, human
ggggacaattgtcttcacta

SEQ ID NO: 59370 - DNA, 20 bp, human
gtttgcttgccctcgcaact

SEQ ID NO: 59371 - DNA, 20 bp, human
gccctcgcaactgggagact

SEQ ID NO: 59372 - DNA, 20 bp, human
ggaagggagttgctcatgac

SEQ ID NO: 59373 - DNA, 20 bp, human
gaggcacagaagcaggacca

SEQ ID NO: 59374 - DNA, 20 bp, human
gctcagagaagagaacataa

SEQ ID NO: 59375 - DNA, 20 bp, human
ggagtctagacggcaccgtt

SEQ ID NO: 59376 - DNA, 20 bp, human
ggcaggtgccagcggagagt

SEQ ID NO: 59377 - DNA, 20 bp, human
gtgtgcgcctggactcctag

SEQ ID NO: 59378 - DNA, 20 bp, human
ggtgccagcggagagtgggt

SEQ ID NO: 59379 - DNA, 20 bp, human
ggccgagcgacagcatcctc

SEQ ID NO: 59380 - DNA, 20 bp, human
gcgagtgagccgagggaatg

SEQ ID NO: 59381 - DNA, 20 bp, human
gccgcccgcccggacgctcg

SEQ ID NO: 59382 - DNA, 20 bp, human
gccgcccgcaggaggagtcg

SEQ ID NO: 59383 - DNA, 20 bp, human
gccgccggctgcaaagcccg

SEQ ID NO: 59384 - DNA, 20 bp, human
gaggtctgcaacagctggtg

SEQ ID NO: 59385 - DNA, 20 bp, human
gaggtggaagtagaggtcgg

SEQ ID NO: 59386 - DNA, 20 bp, human
gcgctctgcgcggcgagagg

SEQ ID NO: 59387 - DNA, 20 bp, human
gcgagggcccgaggcttcct

SEQ ID NO: 59388 - DNA, 20 bp, human
ggtgggcccgcgcctcaggt

SEQ ID NO: 59389 - DNA, 20 bp, human
ggaccgcacacagggacacg

SEQ ID NO: 59390 - DNA, 20 bp, human
gcacgtccctggcccacctg

SEQ ID NO: 59391 - DNA, 20 bp, human
gagcgagcctagggcccgac

SEQ ID NO: 59392 - DNA, 20 bp, human
gcttcctgggagacccgctc

SEQ ID NO: 59393 - DNA, 20 bp, human
gcggcccgagcgggtctccc

SEQ ID NO: 59394 - DNA, 20 bp, human
gcggtcactagaaggacctc

SEQ ID NO: 59395 - DNA, 20 bp, human
gccccttgcgcggtccccag

SEQ ID NO: 59396 - DNA, 20 bp, human
gggcgaagggcggaaggggt

SEQ ID NO: 59397 - DNA, 20 bp, human
gccgctcggcctctccggag

SEQ ID NO: 59398 - DNA, 20 bp, human
gcaggcgggagctgcgctcg

SEQ ID NO: 59399 - DNA, 20 bp, human
gcacctgcccgggaccccgc

SEQ ID NO: 59400 - DNA, 20 bp, human
gtccgcggaccaggacccct

SEQ ID NO: 59401 - DNA, 20 bp, human
gtgggtccccgcgccatctc

SEQ ID NO: 59402 - DNA, 20 bp, human
gcgccgcgcccgggagaccg

SEQ ID NO: 59403 - DNA, 20 bp, human
gcccgcctggccgagcctct

SEQ ID NO: 59404 - DNA, 20 bp, human
gagaggagcgcgctgaggat

SEQ ID NO: 59405 - DNA, 20 bp, human
ggggcgcggccgctccggag

SEQ ID NO: 59406 - DNA, 20 bp, human
gagcttcactgagcgggcac

SEQ ID NO: 59407 - DNA, 20 bp, human
gtcgcgagcacgttgctagt

SEQ ID NO: 59408 - DNA, 20 bp, human
gacactggctcgacccggaa

SEQ ID NO: 59409 - DNA, 20 bp, human
gcgagtgtggacgacccgtc

SEQ ID NO: 59410 - DNA, 20 bp, human
gttcactgagcgggcactgg

SEQ ID NO: 59411 - DNA, 20 bp, human
gccgaccccacagaccccgg

SEQ ID NO: 59412 - DNA, 20 bp, human
ggcagcgggaggggtctaga

SEQ ID NO: 59413 - DNA, 20 bp, human
gtcggccgccggggtctgtg

SEQ ID NO: 59414 - DNA, 20 bp, human
gtgaagggttacagcaaagg

SEQ ID NO: 59415 - DNA, 20 bp, human
gcggtgaagggttacagcaa

SEQ ID NO: 59416 - DNA, 20 bp, human
gctgaggctctgcagacccg

SEQ ID NO: 59417 - DNA, 20 bp, human
gccgggaccgagctcttcca

SEQ ID NO: 59418 - DNA, 20 bp, human
gctagctgcgcaccatggcc

SEQ ID NO: 59419 - DNA, 20 bp, human
gccgaagactgcgcgacctt

SEQ ID NO: 59420 - DNA, 20 bp, human
gtctctggctgtcaactagg

SEQ ID NO: 59421 - DNA, 20 bp, human
gaacgccagcaacccggcca

SEQ ID NO: 59422 - DNA, 20 bp, human
gttgctggcgttgctgggtc

SEQ ID NO: 59423 - DNA, 20 bp, human
gcgggcagctacaagtgcaa

SEQ ID NO: 59424 - DNA, 20 bp, human
gaggtgtggcgctctgccca

SEQ ID NO: 59425 - DNA, 20 bp, human
gccgcccgggatcagggtcg

SEQ ID NO: 59426 - DNA, 20 bp, human
gccctaaccgaggaagccgg

SEQ ID NO: 59427 - DNA, 20 bp, human
gcccaaagttgcagcccggg

SEQ ID NO: 59428 - DNA, 20 bp, human
gtgggcacccggcagaccaa

SEQ ID NO: 59429 - DNA, 20 bp, human
gggcgccccatccctaaccg

SEQ ID NO: 59430 - DNA, 20 bp, human
gggaggcgagcgcgcacggg

SEQ ID NO: 59431 - DNA, 20 bp, human
gcgactcgccggtggtaggg

SEQ ID NO: 59432 - DNA, 20 bp, human
ggcttcctcggttagggatg

SEQ ID NO: 59433 - DNA, 20 bp, human
ggcccccggcttcctcggtt

SEQ ID NO: 59434 - DNA, 20 bp, human
gccagagcggagagtcccgg

SEQ ID NO: 59435 - DNA, 20 bp, human
ggcccgggtagccaagaggg

SEQ ID NO: 59436 - DNA, 20 bp, human
gagacagcccggcctcctgt

SEQ ID NO: 59437 - DNA, 20 bp, human
gcgatggtcgccgaacccac

SEQ ID NO: 59438 - DNA, 20 bp, human
gtggtcgccgaacccacagg

SEQ ID NO: 59439 - DNA, 20 bp, human
gcggcctcagagccagcctc

SEQ ID NO: 59440 - DNA, 20 bp, human
gaggtcggcggaccgtgtgg

SEQ ID NO: 59441 - DNA, 20 bp, human
ggcgcgcaggcgggttccga

SEQ ID NO: 59442 - DNA, 20 bp, human
gaccatcgcgcggcggccat

SEQ ID NO: 59443 - DNA, 20 bp, human
gagggcgaccgcctggagtg

SEQ ID NO: 59444 - DNA, 20 bp, human
ggtgaggtcggcggaccgtg

SEQ ID NO: 59445 - DNA, 20 bp, human
gagcacgcggggtcttgcgt

SEQ ID NO: 59446 - DNA, 20 bp, human
ggcgggaggagagagtggaa

SEQ ID NO: 59447 - DNA, 20 bp, human
gtaggccagcctgaagtagg

SEQ ID NO: 59448 - DNA, 20 bp, human
gggagagcgaggagtcgcgc

SEQ ID NO: 59449 - DNA, 20 bp, human
gcccggccggaacaacagac

SEQ ID NO: 59450 - DNA, 20 bp, human
ggcgcggctgccagatgtcg

SEQ ID NO: 59451 - DNA, 20 bp, human
ggcgggagctacggagagcg

SEQ ID NO: 59452 - DNA, 20 bp, human
ggagccgcgcggagagggct

SEQ ID NO: 59453 - DNA, 20 bp, human
ggctggccgtgctgctggaa

SEQ ID NO: 59454 - DNA, 20 bp, human
gcggctgccagatgtcgggg

SEQ ID NO: 59455 - DNA, 20 bp, human
ggctccgccggggttccaag

SEQ ID NO: 59456 - DNA, 20 bp, human
ggcgagcgctacgggcgcag

SEQ ID NO: 59457 - DNA, 20 bp, human
gggagaccaggtgcccgtcg

SEQ ID NO: 59458 - DNA, 20 bp, human
ggatagggcacgcccagaga

SEQ ID NO: 59459 - DNA, 20 bp, human
gacgcgggcccgcaggcaga

SEQ ID NO: 59460 - DNA, 20 bp, human
gcggagcgcagtttccagtg

SEQ ID NO: 59461 - DNA, 20 bp, human
gtccgcgctgcgagcgctac

SEQ ID NO: 59462 - DNA, 20 bp, human
ggggaagcgactctgagtcc

SEQ ID NO: 59463 - DNA, 20 bp, human
gctcagagtcgcttccccag

SEQ ID NO: 59464 - DNA, 20 bp, human
gagggctgctccgccccgac

SEQ ID NO: 59465 - DNA, 20 bp, human
ggaccaggtgcccgtcgggg

SEQ ID NO: 59466 - DNA, 20 bp, human
gggagcagcgagtcagggta

SEQ ID NO: 59467 - DNA, 20 bp, human
gagcgagtcagggtacggag

SEQ ID NO: 59468 - DNA, 20 bp, human
gacagaggagcagcgagtca

SEQ ID NO: 59469 - DNA, 20 bp, human
gtacggagcgggtagcgttg

SEQ ID NO: 59470 - DNA, 20 bp, human
gagtctattaggcatcccaa

SEQ ID NO: 59471 - DNA, 20 bp, human
ggcgaagcgagacaggccag

SEQ ID NO: 59472 - DNA, 20 bp, human
gggtggccgcgaagcgagac

SEQ ID NO: 59473 - DNA, 20 bp, human
gtgcatggaggcggatgcgg

SEQ ID NO: 59474 - DNA, 20 bp, human
gagaccacagcaaggaaaag

SEQ ID NO: 59475 - DNA, 20 bp, human
ggcgggtagcgttggggaag

SEQ ID NO: 59476 - DNA, 20 bp, human
gccggcccggagggtcccag

SEQ ID NO: 59477 - DNA, 20 bp, human
gaggcagtgcagggccggta

SEQ ID NO: 59478 - DNA, 20 bp, human
gttgcgggcgtggacagagg

SEQ ID NO: 59479 - DNA, 20 bp, human
ggtagcgcgcgatgcagcac

SEQ ID NO: 59480 - DNA, 20 bp, human
gagtgcagggccggtagggt

SEQ ID NO: 59481 - DNA, 20 bp, human
gtaaaaggccggcagaaggg

SEQ ID NO: 59482 - DNA, 20 bp, human
gaagccttgagtgacgccgg

SEQ ID NO: 59483 - DNA, 20 bp, human
gcggcggctcctaagaaagt

SEQ ID NO: 59484 - DNA, 20 bp, human
gtagaggctgcgcaagcgcg

SEQ ID NO: 59485 - DNA, 20 bp, human
gtcgcgaaggttggcgccac

SEQ ID NO: 59486 - DNA, 20 bp, human
ggaggtgtggacgctgtgta

SEQ ID NO: 59487 - DNA, 20 bp, human
ggcagctctggtctgaacat

SEQ ID NO: 59488 - DNA, 20 bp, human
ggacaaagaagtatatccag

SEQ ID NO: 59489 - DNA, 20 bp, human
gcctcagacgcttcaaactt

SEQ ID NO: 59490 - DNA, 20 bp, human
gtagcctagggagcccgact

SEQ ID NO: 59491 - DNA, 20 bp, human
gcgcttcaaacttgggaaca

SEQ ID NO: 59492 - DNA, 20 bp, human
gctcccacagaaggtgaagt

SEQ ID NO: 59493 - DNA, 20 bp, human
gaggcccgtctgctcacccc

SEQ ID NO: 59494 - DNA, 20 bp, human
gtatccaggggtgagcagac

SEQ ID NO: 59495 - DNA, 20 bp, human
ggatcagataagcccagcag

SEQ ID NO: 59496 - DNA, 20 bp, human
gctgggctcctggaccaaca

SEQ ID NO: 59497 - DNA, 20 bp, human
ggaggtcctgggcgatccag

SEQ ID NO: 59498 - DNA, 20 bp, human
gagcggggaacagggagtcg

SEQ ID NO: 59499 - DNA, 20 bp, human
ggccgctccagcagacagaa

SEQ ID NO: 59500 - DNA, 20 bp, human
gacgccctgagcttagggaa

SEQ ID NO: 59501 - DNA, 20 bp, human
gaggtccaccgtgctcatgg

SEQ ID NO: 59502 - DNA, 20 bp, human
gaggaactcctgcagaccca

SEQ ID NO: 59503 - DNA, 20 bp, human
gggatccaggagcgaggagc

SEQ ID NO: 59504 - DNA, 20 bp, human
ggcgcacgccgtgttggtcc

SEQ ID NO: 59505 - DNA, 20 bp, human
gcgtggagctgcggagcctg

SEQ ID NO: 59506 - DNA, 20 bp, human
gcggccgcggaggactggtt

SEQ ID NO: 59507 - DNA, 20 bp, human
gctcgatccggaggagatgg

SEQ ID NO: 59508 - DNA, 20 bp, human
ggactggttgggagttggta

SEQ ID NO: 59509 - DNA, 20 bp, human
gactcttccgggctgtcccg

SEQ ID NO: 59510 - DNA, 20 bp, human
gaggctgtaaacacctcccc

SEQ ID NO: 59511 - DNA, 20 bp, human
ggggaagggggtgctcgatc

SEQ ID NO: 59512 - DNA, 20 bp, human
gcgcaggggactggaagagt

SEQ ID NO: 59513 - DNA, 20 bp, human
gactcccaaccagtcctccg

SEQ ID NO: 59514 - DNA, 20 bp, human
gaaaacgcctctggaaacag

SEQ ID NO: 59515 - DNA, 20 bp, human
gcacctccgcagggctggta

SEQ ID NO: 59516 - DNA, 20 bp, human
ggtctgcgggcactatctag

SEQ ID NO: 59517 - DNA, 20 bp, human
gcaggcggaggctacagcta

SEQ ID NO: 59518 - DNA, 20 bp, human
gccaagtgcaacgggaccca

SEQ ID NO: 59519 - DNA, 20 bp, human
gacgggacccacggaactac

SEQ ID NO: 59520 - DNA, 20 bp, human
gcccacggaactacaggtgt

SEQ ID NO: 59521 - DNA, 20 bp, human
ggcacttggggacgtggtag

SEQ ID NO: 59522 - DNA, 20 bp, human
gcccgttgcacttggggacg

SEQ ID NO: 59523 - DNA, 20 bp, human
ggttggaggaggtacatgag

SEQ ID NO: 59524 - DNA, 20 bp, human
ggcggtgtcggagggtctgc

SEQ ID NO: 59525 - DNA, 20 bp, human
gaccacgtccccaagtgcaa

SEQ ID NO: 59526 - DNA, 20 bp, human
ggtgcaacactagcgggccc

SEQ ID NO: 59527 - DNA, 20 bp, human
gcttcgtgtgcaacactagc

SEQ ID NO: 59528 - DNA, 20 bp, human
gccccaacccagacaaaggg

SEQ ID NO: 59529 - DNA, 20 bp, human
gcccagacaaagggtggctc

SEQ ID NO: 59530 - DNA, 20 bp, human
gcgaagagcctagcagagca

SEQ ID NO: 59531 - DNA, 20 bp, human
gggcccccaacccagacaaa

SEQ ID NO: 59532 - DNA, 20 bp, human
gacatccacacaagctaggg

SEQ ID NO: 59533 - DNA, 20 bp, human
ggagccctctatcttcagag

SEQ ID NO: 59534 - DNA, 20 bp, human
gcccgtggcagggaggaccg

SEQ ID NO: 59535 - DNA, 20 bp, human
ggaagctccagtatagtatg

SEQ ID NO: 59536 - DNA, 20 bp, human
gtgccccgtagtaggaggtg

SEQ ID NO: 59537 - DNA, 20 bp, human
gtctaccacacctcctacta

SEQ ID NO: 59538 - DNA, 20 bp, human
gccctggccgggcatctccg

SEQ ID NO: 59539 - DNA, 20 bp, human
gggacagctgctcccgcaca

SEQ ID NO: 59540 - DNA, 20 bp, human
ggacgcacgcgtgctgtcgg

SEQ ID NO: 59541 - DNA, 20 bp, human
gcgagaccgcgagccgtgtg

SEQ ID NO: 59542 - DNA, 20 bp, human
gcccggtgccctcaagtgag

SEQ ID NO: 59543 - DNA, 20 bp, human
ggactgtcgcagtcacctcg

SEQ ID NO: 59544 - DNA, 20 bp, human
gagcacgtggcgcaaggatg

SEQ ID NO: 59545 - DNA, 20 bp, human
gtctctgagggaagcttcgg

SEQ ID NO: 59546 - DNA, 20 bp, human
ggtgggggaactacagtata

SEQ ID NO: 59547 - DNA, 20 bp, human
gtgagtacaggatagagcgt

SEQ ID NO: 59548 - DNA, 20 bp, human
gtacaggagtatatcttggt

SEQ ID NO: 59549 - DNA, 20 bp, human
gtggcagcttttaaaagtgg

SEQ ID NO: 59550 - DNA, 20 bp, human
gtaagaaaactacactgaat

SEQ ID NO: 59551 - DNA, 20 bp, human
ggagtatatcttggttggta

SEQ ID NO: 59552 - DNA, 20 bp, human
gatattacaggagtatatct

SEQ ID NO: 59553 - DNA, 20 bp, human
gtttctggagtgcacattaa

SEQ ID NO: 59554 - DNA, 20 bp, human
gaggtataggccacttgaat

SEQ ID NO: 59555 - DNA, 20 bp, human
gtctgtttatatgctggtgg

SEQ ID NO: 59556 - DNA, 20 bp, human
gcggccccggaaggtctctc

SEQ ID NO: 59557 - DNA, 20 bp, human
gttgaaggcgcgtgtctcaa

SEQ ID NO: 59558 - DNA, 20 bp, human
ggctccgcgggcttccccac

SEQ ID NO: 59559 - DNA, 20 bp, human
gccgcaaggcccccgtgaag

SEQ ID NO: 59560 - DNA, 20 bp, human
ggcaccgggagagcacgccg

SEQ ID NO: 59561 - DNA, 20 bp, human
gtaggggccagagtgcttga

SEQ ID NO: 59562 - DNA, 20 bp, human
gggcaactaccagagagcgg

SEQ ID NO: 59563 - DNA, 20 bp, human
gagctgtggccggactgggt

SEQ ID NO: 59564 - DNA, 20 bp, human
ggccttgagcgcagcccggt

SEQ ID NO: 59565 - DNA, 20 bp, human
ggtgtctcaagggagccgca

SEQ ID NO: 59566 - DNA, 20 bp, human
ggctccctcggtctgaccaa

SEQ ID NO: 59567 - DNA, 20 bp, human
gagcgccagaggctgattaa

SEQ ID NO: 59568 - DNA, 20 bp, human
gggacccttggtcagaccga

SEQ ID NO: 59569 - DNA, 20 bp, human
gctacgcagtgaggctccct

SEQ ID NO: 59570 - DNA, 20 bp, human
gctgcaggcggcgtcacgag

SEQ ID NO: 59571 - DNA, 20 bp, human
gatctgctggccattcggtg

SEQ ID NO: 59572 - DNA, 20 bp, human
gcagcagattcccttgaggg

SEQ ID NO: 59573 - DNA, 20 bp, human
ggcgcggggacgcccggctg

SEQ ID NO: 59574 - DNA, 20 bp, human
gatcgataggcgcgcaatcc

SEQ ID NO: 59575 - DNA, 20 bp, human
gcggtgcggcaaagcattct

SEQ ID NO: 59576 - DNA, 20 bp, human
gcgcccgaggcctgagccaa

SEQ ID NO: 59577 - DNA, 20 bp, human
ggcgcccacagcgtccccct

SEQ ID NO: 59578 - DNA, 20 bp, human
ggagccaagggggacgctgt

SEQ ID NO: 59579 - DNA, 20 bp, human
gcggggacccactaacctga

SEQ ID NO: 59580 - DNA, 20 bp, human
gctcaggcctcgggcgaccc

SEQ ID NO: 59581 - DNA, 20 bp, human
gcgggacaggcgagcaggaa

SEQ ID NO: 59582 - DNA, 20 bp, human
ggccaggccctcaggttagt

SEQ ID NO: 59583 - DNA, 20 bp, human
ggagcatagcgcgagaggac

SEQ ID NO: 59584 - DNA, 20 bp, human
gtgcggtctctcccgccctc

SEQ ID NO: 59585 - DNA, 20 bp, human
gcaccccgtctccggacctg

SEQ ID NO: 59586 - DNA, 20 bp, human
gggcgcgacgttggagaccg

SEQ ID NO: 59587 - DNA, 20 bp, human
gcttccgggtgagaccgtga

SEQ ID NO: 59588 - DNA, 20 bp, human
gtgaaggtgtggcgcgacgt

SEQ ID NO: 59589 - DNA, 20 bp, human
gcagtggatggaaggatgcg

SEQ ID NO: 59590 - DNA, 20 bp, human
gtggtccttctgacttggag

SEQ ID NO: 59591 - DNA, 20 bp, human
gaaggatgcgcggtgcggcg

SEQ ID NO: 59592 - DNA, 20 bp, human
gcaggaagagaaccaccatc

SEQ ID NO: 59593 - DNA, 20 bp, human
ggaccttatacgctgaccgg

SEQ ID NO: 59594 - DNA, 20 bp, human
ggaccacattcgtccaacag

SEQ ID NO: 59595 - DNA, 20 bp, human
ggaccgctgttggacgaatg

SEQ ID NO: 59596 - DNA, 20 bp, human
gggaggcgaggcaagacctg

SEQ ID NO: 59597 - DNA, 20 bp, human
ggaggcggcagcggagtagg

SEQ ID NO: 59598 - DNA, 20 bp, human
gcaggaggcggcagcggagt

SEQ ID NO: 59599 - DNA, 20 bp, human
gggcagcggagtaggaggcg

SEQ ID NO: 59600 - DNA, 20 bp, human
gggcttgcctagcactaccg

SEQ ID NO: 59601 - DNA, 20 bp, human
gggaggggcgccatcggatg

SEQ ID NO: 59602 - DNA, 20 bp, human
gtaagggcggagggcaccgt

SEQ ID NO: 59603 - DNA, 20 bp, human
ggaggccggcgtgactccgt

SEQ ID NO: 59604 - DNA, 20 bp, human
ggtagtgctaggcaagccca

SEQ ID NO: 59605 - DNA, 20 bp, human
gctcggcccggccacagccg

SEQ ID NO: 59606 - DNA, 20 bp, human
gggcccggccatggcgaccg

SEQ ID NO: 59607 - DNA, 20 bp, human
ggcgtctcccgaaggctggg

SEQ ID NO: 59608 - DNA, 20 bp, human
ggtgagtgtggcccgatggt

SEQ ID NO: 59609 - DNA, 20 bp, human
gcccgtggcgaaagagtgac

SEQ ID NO: 59610 - DNA, 20 bp, human
gactccgccgcgtctcccga

SEQ ID NO: 59611 - DNA, 20 bp, human
gcgttgcggttgtctacccc

SEQ ID NO: 59612 - DNA, 20 bp, human
gagtgtggcccgatggtcgg

SEQ ID NO: 59613 - DNA, 20 bp, human
ggtgcgcgcgtcaccatgta

SEQ ID NO: 59614 - DNA, 20 bp, human
gcgcagcttggcttgaatgg

SEQ ID NO: 59615 - DNA, 20 bp, human
gccaggtcccggtgcttctc

SEQ ID NO: 59616 - DNA, 20 bp, human
gaagctgccagcacacgccg

SEQ ID NO: 59617 - DNA, 20 bp, human
gtgcagtcctcggcgtgtgc

SEQ ID NO: 59618 - DNA, 20 bp, human
gcaggagctggcgccagcgt

SEQ ID NO: 59619 - DNA, 20 bp, human
ggctaggatggtgagggcgc

SEQ ID NO: 59620 - DNA, 20 bp, human
gccgagccgggcggctagga

SEQ ID NO: 59621 - DNA, 20 bp, human
ggcaggagagaggccggcct

SEQ ID NO: 59622 - DNA, 20 bp, human
ggccagggtggcattctcgg

SEQ ID NO: 59623 - DNA, 20 bp, human
gccagcgtcggagcccgtgt

SEQ ID NO: 59624 - DNA, 20 bp, human
gagggcgccgggcaggagag

SEQ ID NO: 59625 - DNA, 20 bp, human
ggaacgtcgcgtctgggcca

SEQ ID NO: 59626 - DNA, 20 bp, human
gaggctgccagcacaggccg

SEQ ID NO: 59627 - DNA, 20 bp, human
gtgcggtcctcggcctgtgc

SEQ ID NO: 59628 - DNA, 20 bp, human
gcaggagctggtgccggcgt

SEQ ID NO: 59629 - DNA, 20 bp, human
gtgagccagaaaccccatga

SEQ ID NO: 59630 - DNA, 20 bp, human
ggcccaggccggcccctctc

SEQ ID NO: 59631 - DNA, 20 bp, human
ggcggctgggatggtgaggg

SEQ ID NO: 59632 - DNA, 20 bp, human
ggctccgaggctgccagcac

SEQ ID NO: 59633 - DNA, 20 bp, human
gtcgcgtctgggccacggtc

SEQ ID NO: 59634 - DNA, 20 bp, human
ggctgggatggtgagggcgg

SEQ ID NO: 59635 - DNA, 20 bp, human
gcccgaccaggagctggtgc

SEQ ID NO: 59636 - DNA, 20 bp, human
gtgcggactccgctccactg

SEQ ID NO: 59637 - DNA, 20 bp, human
gtacaggcggctgctcgcgg

SEQ ID NO: 59638 - DNA, 20 bp, human
gccgcgggatgcagacgcca

SEQ ID NO: 59639 - DNA, 20 bp, human
gacactcagcttctaggcag

SEQ ID NO: 59640 - DNA, 20 bp, human
gcgtgctcagggagcgaagg

SEQ ID NO: 59641 - DNA, 20 bp, human
gtggtacaggcggctgctcg

SEQ ID NO: 59642 - DNA, 20 bp, human
gtgcgcggccaggctggtac

SEQ ID NO: 59643 - DNA, 20 bp, human
ggccgccgcccgctcctatg

SEQ ID NO: 59644 - DNA, 20 bp, human
gggtcgcacgggaaaatgca

SEQ ID NO: 59645 - DNA, 20 bp, human
ggggataaggaccacctcag

SEQ ID NO: 59646 - DNA, 20 bp, human
gttccccaccggcaatggag

SEQ ID NO: 59647 - DNA, 20 bp, human
gggttgacgttgcctctcgg

SEQ ID NO: 59648 - DNA, 20 bp, human
gttgccggtggggaagccaa

SEQ ID NO: 59649 - DNA, 20 bp, human
gcgagtacctggagtaccgg

SEQ ID NO: 59650 - DNA, 20 bp, human
gcaaccgctccattgccggt

SEQ ID NO: 59651 - DNA, 20 bp, human
gcaggcacatcgagtactcg

SEQ ID NO: 59652 - DNA, 20 bp, human
gcgaggtcagctggtccgca

SEQ ID NO: 59653 - DNA, 20 bp, human
gacctggagtaccggaggtg

SEQ ID NO: 59654 - DNA, 20 bp, human
ggagcgcgttcagaagttca

SEQ ID NO: 59655 - DNA, 20 bp, human
ggcctcacctccggtactcc

SEQ ID NO: 59656 - DNA, 20 bp, human
gaggggtctagggccaatga

SEQ ID NO: 59657 - DNA, 20 bp, human
ggtctagggccaatgaggga

SEQ ID NO: 59658 - DNA, 20 bp, human
ggagtaggcgccggtcacca

SEQ ID NO: 59659 - DNA, 20 bp, human
ggcagggtctcgggtagctg

SEQ ID NO: 59660 - DNA, 20 bp, human
ggaacttcgcaaaggagctc

SEQ ID NO: 59661 - DNA, 20 bp, human
gctcctggcccgggttccgg

SEQ ID NO: 59662 - DNA, 20 bp, human
gggtagggacaaggggtcta

SEQ ID NO: 59663 - DNA, 20 bp, human
ggaggtgttgatcctcaggg

SEQ ID NO: 59664 - DNA, 20 bp, human
gactgaagcctccggaaccc

SEQ ID NO: 59665 - DNA, 20 bp, human
gcttgcattgggcctcgagg

SEQ ID NO: 59666 - DNA, 20 bp, human
gggcgcgcgcagcctctccg

SEQ ID NO: 59667 - DNA, 20 bp, human
gggccggctgctccgcggag

SEQ ID NO: 59668 - DNA, 20 bp, human
gaggggaagccggcgaacag

SEQ ID NO: 59669 - DNA, 20 bp, human
gcctgtcagtcgggccagag

SEQ ID NO: 59670 - DNA, 20 bp, human
gggaagccggcgaacagcgg

SEQ ID NO: 59671 - DNA, 20 bp, human
gaacagcggcgagaatgcac

SEQ ID NO: 59672 - DNA, 20 bp, human
ggagaaacagccgatcccag

SEQ ID NO: 59673 - DNA, 20 bp, human
gtgctctgagccccgggtgt

SEQ ID NO: 59674 - DNA, 20 bp, human
ggacatacaccggcccctgc

SEQ ID NO: 59675 - DNA, 20 bp, human
gagctcgcaagccgcagcag

SEQ ID NO: 59676 - DNA, 20 bp, human
gacagctgcgccggtgactg

SEQ ID NO: 59677 - DNA, 20 bp, human
gggcgaccaaaagctcctgg

SEQ ID NO: 59678 - DNA, 20 bp, human
gtgaaagaagcggaaaggag

SEQ ID NO: 59679 - DNA, 20 bp, human
gctgactgtgggagacggaa

SEQ ID NO: 59680 - DNA, 20 bp, human
gcccctgcctggttcagagg

SEQ ID NO: 59681 - DNA, 20 bp, human
gcgcagctgtggggactacc

SEQ ID NO: 59682 - DNA, 20 bp, human
gggcgggcggcgggcggcaa

SEQ ID NO: 59683 - DNA, 20 bp, human
gctccaccactactcacggt

SEQ ID NO: 59684 - DNA, 20 bp, human
gaggaagggatgatacaaat

SEQ ID NO: 59685 - DNA, 20 bp, human
gccaccacttctccactgcc

SEQ ID NO: 59686 - DNA, 20 bp, human
gcacggagcgcaggactccg

SEQ ID NO: 59687 - DNA, 20 bp, human
ggctccgggtgccaggctca

SEQ ID NO: 59688 - DNA, 20 bp, human
gtcacccctgcagatgggta

SEQ ID NO: 59689 - DNA, 20 bp, human
gcttctagcggtctaggcag

SEQ ID NO: 59690 - DNA, 20 bp, human
ggcaagcggcagccggctgg

SEQ ID NO: 59691 - DNA, 20 bp, human
gcacaccttgcgccctggaa

SEQ ID NO: 59692 - DNA, 20 bp, human
gtgccaggctcacggagcgc

SEQ ID NO: 59693 - DNA, 20 bp, human
ggaagagagggggcttctag

SEQ ID NO: 59694 - DNA, 20 bp, human
gtagcggtctaggcaggggg

SEQ ID NO: 59695 - DNA, 20 bp, human
ggtcctgcgctccgtgagcc

SEQ ID NO: 59696 - DNA, 20 bp, human
gttccattgttatgctaaac

SEQ ID NO: 59697 - DNA, 20 bp, human
gcggttacccctttcctcgg

SEQ ID NO: 59698 - DNA, 20 bp, human
gaggcccagggactacttaa

SEQ ID NO: 59699 - DNA, 20 bp, human
gacaacgcggcggctcacga

SEQ ID NO: 59700 - DNA, 20 bp, human
gcatctcgcggacaacgcgg

SEQ ID NO: 59701 - DNA, 20 bp, human
gcggcatctcgcggacaacg

SEQ ID NO: 59702 - DNA, 20 bp, human
gcccgccacgggtccctcag

SEQ ID NO: 59703 - DNA, 20 bp, human
gctgagtccaggcgttctct

SEQ ID NO: 59704 - DNA, 20 bp, human
gccggctgtcaccatagaaa

SEQ ID NO: 59705 - DNA, 20 bp, human
gggcgttctctaggcaacgc

SEQ ID NO: 59706 - DNA, 20 bp, human
gcaagaatcgggaggaaact

SEQ ID NO: 59707 - DNA, 20 bp, human
gtgtcccagcaagaatcggg

SEQ ID NO: 59708 - DNA, 20 bp, human
gaaggctgcgaggcttgagg

SEQ ID NO: 59709 - DNA, 20 bp, human
ggtgtcgcacttctcccgag

SEQ ID NO: 59710 - DNA, 20 bp, human
gttgctgggacaacaaaatt

SEQ ID NO: 59711 - DNA, 20 bp, human
gggcgggtcccggacgaacg

SEQ ID NO: 59712 - DNA, 20 bp, human
gggcagggccgcgttcgtcc

SEQ ID NO: 59713 - DNA, 20 bp, human
ggacaccgccgctgattgag

SEQ ID NO: 59714 - DNA, 20 bp, human
gtgaaaggctgcgaggcttg

SEQ ID NO: 59715 - DNA, 20 bp, human
gttgttgtcccagcaagaat

SEQ ID NO: 59716 - DNA, 20 bp, human
gccgaggccgcgtcctggag

SEQ ID NO: 59717 - DNA, 20 bp, human
gccgcggctccgtcccggta

SEQ ID NO: 59718 - DNA, 20 bp, human
gccgtcgccgctccaggacg

SEQ ID NO: 59719 - DNA, 20 bp, human
gctcccccgaggccgcgtcc

SEQ ID NO: 59720 - DNA, 20 bp, human
gtggacaggagaatccctga

SEQ ID NO: 59721 - DNA, 20 bp, human
gccgaggacgacacgggagt

SEQ ID NO: 59722 - DNA, 20 bp, human
ggacggagaaaggagcccgc

SEQ ID NO: 59723 - DNA, 20 bp, human
gcgggggagccctaccggga

SEQ ID NO: 59724 - DNA, 20 bp, human
gtttggcccgaggacgacac

SEQ ID NO: 59725 - DNA, 20 bp, human
ggaatccctgagggatgaaa

SEQ ID NO: 59726 - DNA, 20 bp, human
ggctgcgtccgggagacggt

SEQ ID NO: 59727 - DNA, 20 bp, human
gcggctcgaagtcctccccg

SEQ ID NO: 59728 - DNA, 20 bp, human
gggactcgctgtggaacccg

SEQ ID NO: 59729 - DNA, 20 bp, human
ggagctgcttagagaaggca

SEQ ID NO: 59730 - DNA, 20 bp, human
ggtggaacccgcggcgcagg

SEQ ID NO: 59731 - DNA, 20 bp, human
gtcgcacccgtgcctcgggg

SEQ ID NO: 59732 - DNA, 20 bp, human
gcgagtcttcgagctctgag

SEQ ID NO: 59733 - DNA, 20 bp, human
gctgcggaacgcgcgaatgt

SEQ ID NO: 59734 - DNA, 20 bp, human
gggtgcgacggggatgtcgt

SEQ ID NO: 59735 - DNA, 20 bp, human
gcgatgagcgagagcgggtg

SEQ ID NO: 59736 - DNA, 20 bp, human
gtggccgcgggagaacgctc

SEQ ID NO: 59737 - DNA, 20 bp, human
gcgggcccgggcgtcgagga

SEQ ID NO: 59738 - DNA, 20 bp, human
ggggcgccaagtgggacgga

SEQ ID NO: 59739 - DNA, 20 bp, human
ggtggtagtgagggcaggta

SEQ ID NO: 59740 - DNA, 20 bp, human
ggaccccaggtgcactccct

SEQ ID NO: 59741 - DNA, 20 bp, human
gcacgccacagagacctgcc

SEQ ID NO: 59742 - DNA, 20 bp, human
gggagtctccggcctcaatg

SEQ ID NO: 59743 - DNA, 20 bp, human
gtgtgacccttggccaaaat

SEQ ID NO: 59744 - DNA, 20 bp, human
gtgcccggctccgcctggac

SEQ ID NO: 59745 - DNA, 20 bp, human
gctcggcggtgacttaatcc

SEQ ID NO: 59746 - DNA, 20 bp, human
gtccagaagcccagtcgcta

SEQ ID NO: 59747 - DNA, 20 bp, human
gagcccagtcgctacggtaa

SEQ ID NO: 59748 - DNA, 20 bp, human
gatgctcgaagatgttgaca

SEQ ID NO: 59749 - DNA, 20 bp, human
gcgagcatcggcagctccgg

SEQ ID NO: 59750 - DNA, 20 bp, human
ggctgttcgtgggctatcag

SEQ ID NO: 59751 - DNA, 20 bp, human
gcaccgttaccgtagcgact

SEQ ID NO: 59752 - DNA, 20 bp, human
gcacttgcgcggccttctga

SEQ ID NO: 59753 - DNA, 20 bp, human
gcagagaaatagtcatgtca

SEQ ID NO: 59754 - DNA, 20 bp, human
gaggtaactaggctttggag

SEQ ID NO: 59755 - DNA, 20 bp, human
ggggtaactggcaggtaact

SEQ ID NO: 59756 - DNA, 20 bp, human
gtaagggaaaaaaacctcta

SEQ ID NO: 59757 - DNA, 20 bp, human
ggacgtggtctgcagagacc

SEQ ID NO: 59758 - DNA, 20 bp, human
gactcctagcagggataatt

SEQ ID NO: 59759 - DNA, 20 bp, human
gaggcccattctaccagctc

SEQ ID NO: 59760 - DNA, 20 bp, human
gcagccagagctggtagaat

SEQ ID NO: 59761 - DNA, 20 bp, human
gtccagccaaacctttgcca

SEQ ID NO: 59762 - DNA, 20 bp, human
gggtaggcctatggtctact

SEQ ID NO: 59763 - DNA, 20 bp, human
gaggtttggctggaagtgtc

SEQ ID NO: 59764 - DNA, 20 bp, human
gcaggggctcctgaataagc

SEQ ID NO: 59765 - DNA, 20 bp, human
gggacctaattatccctgct

SEQ ID NO: 59766 - DNA, 20 bp, human
gacgcaggcagcatggacca

SEQ ID NO: 59767 - DNA, 20 bp, human
gtggcaacgccgtaggatca

SEQ ID NO: 59768 - DNA, 20 bp, human
ggcctgcgcatggtctccaa

SEQ ID NO: 59769 - DNA, 20 bp, human
gggagcgtctatggtcaggt

SEQ ID NO: 59770 - DNA, 20 bp, human
gcgacgctggcggtggacgc

SEQ ID NO: 59771 - DNA, 20 bp, human
gcagcgtcgaaaaaccgccg

SEQ ID NO: 59772 - DNA, 20 bp, human
gcacggttgctgggcggatg

SEQ ID NO: 59773 - DNA, 20 bp, human
gtgcagacccgacggagtgg

SEQ ID NO: 59774 - DNA, 20 bp, human
gagggcatccagcatagtcc

SEQ ID NO: 59775 - DNA, 20 bp, human
gatggaccacggttgctggg

SEQ ID NO: 59776 - DNA, 20 bp, human
ggtgctgacttggtagagca

SEQ ID NO: 59777 - DNA, 20 bp, human
gggatctaagtaggcaggtg

SEQ ID NO: 59778 - DNA, 20 bp, human
gagtaggcaggtgaggacct

SEQ ID NO: 59779 - DNA, 20 bp, human
gaggcaggtgaggacctggg

SEQ ID NO: 59780 - DNA, 20 bp, human
ggtgggaggcggatctaagt

SEQ ID NO: 59781 - DNA, 20 bp, human
gaagctggctgccgaaggcc

SEQ ID NO: 59782 - DNA, 20 bp, human
gcttggtagagcaggggacc

SEQ ID NO: 59783 - DNA, 20 bp, human
ggaggcggatctaagtaggc

SEQ ID NO: 59784 - DNA, 20 bp, human
gcaggtgaggacctgggagg

SEQ ID NO: 59785 - DNA, 20 bp, human
gaggacctgggaggaggcct

SEQ ID NO: 59786 - DNA, 20 bp, human
gtccctggacatccaaggtg

SEQ ID NO: 59787 - DNA, 20 bp, human
gatacgtccctggacatcca

SEQ ID NO: 59788 - DNA, 20 bp, human
ggccccaccttggatgtcca

SEQ ID NO: 59789 - DNA, 20 bp, human
gctcatgtcccctgagtcca

SEQ ID NO: 59790 - DNA, 20 bp, human
gcaatggacctatacgtccc

SEQ ID NO: 59791 - DNA, 20 bp, human
ggacatccaaggtggggctc

SEQ ID NO: 59792 - DNA, 20 bp, human
ggacgtataggtccattgtg

SEQ ID NO: 59793 - DNA, 20 bp, human
ggacccatttatcctcacaa

SEQ ID NO: 59794 - DNA, 20 bp, human
gggtccattgtgaggataaa

SEQ ID NO: 59795 - DNA, 20 bp, human
gcctgggctgtgggggcagt

SEQ ID NO: 59796 - DNA, 20 bp, human
gcaacaaaccaggtagaaac

SEQ ID NO: 59797 - DNA, 20 bp, human
gcacaggttcacaacaaacc

SEQ ID NO: 59798 - DNA, 20 bp, human
gcaggaaatccctaactgta

SEQ ID NO: 59799 - DNA, 20 bp, human
gaaatccctaactgtagggt

SEQ ID NO: 59800 - DNA, 20 bp, human
gtgaagagtcaggacaaatg

SEQ ID NO: 59801 - DNA, 20 bp, human
gtctaatggaagggaaatat

SEQ ID NO: 59802 - DNA, 20 bp, human
gtaccacgcacagagctgaa

SEQ ID NO: 59803 - DNA, 20 bp, human
ggaacggaacagagtcccca

SEQ ID NO: 59804 - DNA, 20 bp, human
gcagttagggatttcctgtc

SEQ ID NO: 59805 - DNA, 20 bp, human
gcgggtctcctgtttctacc

SEQ ID NO: 59806 - DNA, 20 bp, human
ggctgctctgccaataacaa

SEQ ID NO: 59807 - DNA, 20 bp, human
gcccaggatcagtaacaccc

SEQ ID NO: 59808 - DNA, 20 bp, human
gggtcgtggagactcttcac

SEQ ID NO: 59809 - DNA, 20 bp, human
gccaacatggatgcttttca

SEQ ID NO: 59810 - DNA, 20 bp, human
ggccgaggacgtagaagaaa

SEQ ID NO: 59811 - DNA, 20 bp, human
gcagatcactctgagctcat

SEQ ID NO: 59812 - DNA, 20 bp, human
gggtaagcccaaagagtgct

SEQ ID NO: 59813 - DNA, 20 bp, human
gatcactctgagctcattgg

SEQ ID NO: 59814 - DNA, 20 bp, human
gtctatgaatgtgccatgag

SEQ ID NO: 59815 - DNA, 20 bp, human
ggaacttctcgtcccgctca

SEQ ID NO: 59816 - DNA, 20 bp, human
ggacaagcaggacaacgaag

SEQ ID NO: 59817 - DNA, 20 bp, human
ggcacgtggcgcctgctcac

SEQ ID NO: 59818 - DNA, 20 bp, human
gcctggttgcacggcaccag

SEQ ID NO: 59819 - DNA, 20 bp, human
ggtacagtgccagatactac

SEQ ID NO: 59820 - DNA, 20 bp, human
ggtggccgcgcactcgtaaa

SEQ ID NO: 59821 - DNA, 20 bp, human
gctgatttgcgtgcacacca

SEQ ID NO: 59822 - DNA, 20 bp, human
ggcccgcgcgagttgcggat

SEQ ID NO: 59823 - DNA, 20 bp, human
ggctggggtgagggaaaaat

SEQ ID NO: 59824 - DNA, 20 bp, human
gccgcctggaacctgcccta

SEQ ID NO: 59825 - DNA, 20 bp, human
gtgacggcaaattagatgca

SEQ ID NO: 59826 - DNA, 20 bp, human
ggcggcgggtcggaggatca

SEQ ID NO: 59827 - DNA, 20 bp, human
ggtgaggcccgagggcccgc

SEQ ID NO: 59828 - DNA, 20 bp, human
ggaagcactggagagtgtca

SEQ ID NO: 59829 - DNA, 20 bp, human
gcagggctgggacgctccga

SEQ ID NO: 59830 - DNA, 20 bp, human
gggtgagcagaagcagaagg

SEQ ID NO: 59831 - DNA, 20 bp, human
ggccgggagactggaaattg

SEQ ID NO: 59832 - DNA, 20 bp, human
ggcctacgagcaggtccaaa

SEQ ID NO: 59833 - DNA, 20 bp, human
gcgacgcctttcagcttcag

SEQ ID NO: 59834 - DNA, 20 bp, human
gtcagaggagaccttaatta

SEQ ID NO: 59835 - DNA, 20 bp, human
gcagaggggagagctagaac

SEQ ID NO: 59836 - DNA, 20 bp, human
gtacctgagagccccgccgg

SEQ ID NO: 59837 - DNA, 20 bp, human
gctgagagccccgccggagg

SEQ ID NO: 59838 - DNA, 20 bp, human
gcggaggccgcacccgcctc

SEQ ID NO: 59839 - DNA, 20 bp, human
gtgcggcctccgggcaaatc

SEQ ID NO: 59840 - DNA, 20 bp, human
gggctcggcgtcaccagcca

SEQ ID NO: 59841 - DNA, 20 bp, human
gagggctgcagagagcggcg

SEQ ID NO: 59842 - DNA, 20 bp, human
ggtcggggcgggcccacggg

SEQ ID NO: 59843 - DNA, 20 bp, human
gtcgcgtggtgagagcttgt

SEQ ID NO: 59844 - DNA, 20 bp, human
gacatacctgagagccccgc

SEQ ID NO: 59845 - DNA, 20 bp, human
gaggccgcacccgcctccgg

SEQ ID NO: 59846 - DNA, 20 bp, human
gggccttgcgtcctctccgg

SEQ ID NO: 59847 - DNA, 20 bp, human
gggagacgtgggctcggtca

SEQ ID NO: 59848 - DNA, 20 bp, human
ggcctggccaccctgcgcag

SEQ ID NO: 59849 - DNA, 20 bp, human
gtctggccgtggggagacgt

SEQ ID NO: 59850 - DNA, 20 bp, human
gcggcaagtgcactgtttgg

SEQ ID NO: 59851 - DNA, 20 bp, human
ggcttccacagcgaacggga

SEQ ID NO: 59852 - DNA, 20 bp, human
gcgggtcggcgggcctgaca

SEQ ID NO: 59853 - DNA, 20 bp, human
gcggcaatggcggctaaggg

SEQ ID NO: 59854 - DNA, 20 bp, human
ggcccggcaatggcggctaa

SEQ ID NO: 59855 - DNA, 20 bp, human
gcctgctgggttgggaccgc

SEQ ID NO: 59856 - DNA, 20 bp, human
gcccaggcgaccgcagccag

SEQ ID NO: 59857 - DNA, 20 bp, human
gcggagcccctgggtcagga

SEQ ID NO: 59858 - DNA, 20 bp, human
gcgcagccagcggagcccct

SEQ ID NO: 59859 - DNA, 20 bp, human
gggagaagcgtggagagccc

SEQ ID NO: 59860 - DNA, 20 bp, human
gggtcaggaaggcaaggggc

SEQ ID NO: 59861 - DNA, 20 bp, human
ggcaggcgcgtacccttccc

SEQ ID NO: 59862 - DNA, 20 bp, human
gggcgggcagcggtcgtgtc

SEQ ID NO: 59863 - DNA, 20 bp, human
gtggcgagcgcggggaaaca

SEQ ID NO: 59864 - DNA, 20 bp, human
gaagcgtggagagcccgggt

SEQ ID NO: 59865 - DNA, 20 bp, human
gatgcgggaagcgattccag

SEQ ID NO: 59866 - DNA, 20 bp, human
gctgagagctccgagaggtg

SEQ ID NO: 59867 - DNA, 20 bp, human
gggccacttgccggggtgag

SEQ ID NO: 59868 - DNA, 20 bp, human
ggcgcggaggctgaagtcgt

SEQ ID NO: 59869 - DNA, 20 bp, human
gggaggctgaagtcgtaggt

SEQ ID NO: 59870 - DNA, 20 bp, human
gttctcctggccacttgccg

SEQ ID NO: 59871 - DNA, 20 bp, human
gcggtgaccgcagtgcgcgg

SEQ ID NO: 59872 - DNA, 20 bp, human
gtcgcgcccctgcagcgtgt

SEQ ID NO: 59873 - DNA, 20 bp, human
ggagtcaaaacggcccccta

SEQ ID NO: 59874 - DNA, 20 bp, human
gagagggcgcaggcgggact

SEQ ID NO: 59875 - DNA, 20 bp, human
gggggatgcccacgccgggg

SEQ ID NO: 59876 - DNA, 20 bp, human
gcagcacctgcagagctacc

SEQ ID NO: 59877 - DNA, 20 bp, human
ggtttctagcctgctcaccc

SEQ ID NO: 59878 - DNA, 20 bp, human
gtctgggacagagttgaagg

SEQ ID NO: 59879 - DNA, 20 bp, human
gcccagctccagagcactca

SEQ ID NO: 59880 - DNA, 20 bp, human
ggagacagacaagagagata

SEQ ID NO: 59881 - DNA, 20 bp, human
ggctagaaactcacgacacc

SEQ ID NO: 59882 - DNA, 20 bp, human
ggtacagagacactccagtc

SEQ ID NO: 59883 - DNA, 20 bp, human
ggggacagagacagagggta

SEQ ID NO: 59884 - DNA, 20 bp, human
gcgacaccaggtagctctgc

SEQ ID NO: 59885 - DNA, 20 bp, human
gagggtaggggacacacacc

SEQ ID NO: 59886 - DNA, 20 bp, human
ggcccactgcatctagagga

SEQ ID NO: 59887 - DNA, 20 bp, human
gtacccctccagcaactggg

SEQ ID NO: 59888 - DNA, 20 bp, human
gggccctcctctagatgcag

SEQ ID NO: 59889 - DNA, 20 bp, human
gtagaggagggccgtctgtg

SEQ ID NO: 59890 - DNA, 20 bp, human
gccacctcccagttgctgga

SEQ ID NO: 59891 - DNA, 20 bp, human
gacactccgtctcaccctct

SEQ ID NO: 59892 - DNA, 20 bp, human
ggtgggagcctcgagccctc

SEQ ID NO: 59893 - DNA, 20 bp, human
gcactacccctccagcaact

SEQ ID NO: 59894 - DNA, 20 bp, human
gcctgagatcagactcagga

SEQ ID NO: 59895 - DNA, 20 bp, human
gagtgttgcgggccgccagt

SEQ ID NO: 59896 - DNA, 20 bp, human
gcggagagggcgcactgcaa

SEQ ID NO: 59897 - DNA, 20 bp, human
gcccggacggcaaggatgtg

SEQ ID NO: 59898 - DNA, 20 bp, human
gccgctcgcagcaccggaga

SEQ ID NO: 59899 - DNA, 20 bp, human
ggagggcgcactgcaaaggc

SEQ ID NO: 59900 - DNA, 20 bp, human
gaaaggcgggcagcagaccg

SEQ ID NO: 59901 - DNA, 20 bp, human
gagcagaccgtggagagccc

SEQ ID NO: 59902 - DNA, 20 bp, human
gccagcaacagcacccggga

SEQ ID NO: 59903 - DNA, 20 bp, human
gcgctgggctccgagaacag

SEQ ID NO: 59904 - DNA, 20 bp, human
gggactggggccaaaacccg

SEQ ID NO: 59905 - DNA, 20 bp, human
gccgtccgggaggaagatct

SEQ ID NO: 59906 - DNA, 20 bp, human
gctccagggcagcatcgcgg

SEQ ID NO: 59907 - DNA, 20 bp, human
gcgctggcggctgcttagtg

SEQ ID NO: 59908 - DNA, 20 bp, human
gcgtctccagggcagcatcg

SEQ ID NO: 59909 - DNA, 20 bp, human
ggctccggcgacccaaattg

SEQ ID NO: 59910 - DNA, 20 bp, human
gcgtcctgtcgggagaccgg

SEQ ID NO: 59911 - DNA, 20 bp, human
gctggagagcagcgacgtgt

SEQ ID NO: 59912 - DNA, 20 bp, human
gcgggccagcagccgaggtg

SEQ ID NO: 59913 - DNA, 20 bp, human
ggggtcgccggagccgctgg

SEQ ID NO: 59914 - DNA, 20 bp, human
gccgtctgggaagcgaggag

SEQ ID NO: 59915 - DNA, 20 bp, human
gagctcaccggcgtcctgtc

SEQ ID NO: 59916 - DNA, 20 bp, human
gctgggagcgctcgacgtcc

SEQ ID NO: 59917 - DNA, 20 bp, human
gggctccgccgggcaacccg

SEQ ID NO: 59918 - DNA, 20 bp, human
gcagtccaggcccaacaggg

SEQ ID NO: 59919 - DNA, 20 bp, human
gggcgccgaccgcatgagga

SEQ ID NO: 59920 - DNA, 20 bp, human
gggctgatcggtgaggacgt

SEQ ID NO: 59921 - DNA, 20 bp, human
gggcaacccggggcgtgcag

SEQ ID NO: 59922 - DNA, 20 bp, human
gcgggtcccctgcaccaagg

SEQ ID NO: 59923 - DNA, 20 bp, human
gggggacctccaagattccg

SEQ ID NO: 59924 - DNA, 20 bp, human
gcacgccccgggttgcccgg

SEQ ID NO: 59925 - DNA, 20 bp, human
gggagtcgggctgatcggtg

SEQ ID NO: 59926 - DNA, 20 bp, human
gccagagacacgagcgtgtg

SEQ ID NO: 59927 - DNA, 20 bp, human
gagctgcggtggtcccgaac

SEQ ID NO: 59928 - DNA, 20 bp, human
gcgagagcgaaaccgagagg

SEQ ID NO: 59929 - DNA, 20 bp, human
ggcgcggcggcggagagcag

SEQ ID NO: 59930 - DNA, 20 bp, human
ggagcgagagcgaaaccgag

SEQ ID NO: 59931 - DNA, 20 bp, human
gtgcggtggtcccgaactgg

SEQ ID NO: 59932 - DNA, 20 bp, human
gggggtcagggaactatcgg

SEQ ID NO: 59933 - DNA, 20 bp, human
gctcgctgcgctcctagaag

SEQ ID NO: 59934 - DNA, 20 bp, human
ggcgcggctggggactgtaa

SEQ ID NO: 59935 - DNA, 20 bp, human
ggcctccaggtgacacagac

SEQ ID NO: 59936 - DNA, 20 bp, human
ggggctgcaggcgctagggt

SEQ ID NO: 59937 - DNA, 20 bp, human
gcgacggcgagacaaagcca

SEQ ID NO: 59938 - DNA, 20 bp, human
gccgcgggctgcaggcgcta

SEQ ID NO: 59939 - DNA, 20 bp, human
gagggacggggcggcaacga

SEQ ID NO: 59940 - DNA, 20 bp, human
gccccggacggcacctgagt

SEQ ID NO: 59941 - DNA, 20 bp, human
gtggccacaggtgaagcgac

SEQ ID NO: 59942 - DNA, 20 bp, human
gtcacctgcacgatctgccg

SEQ ID NO: 59943 - DNA, 20 bp, human
gcggcccagcggactcttat

SEQ ID NO: 59944 - DNA, 20 bp, human
gcgccgtctgaggtgttccc

SEQ ID NO: 59945 - DNA, 20 bp, human
gccccgacggcagaaaccgt

SEQ ID NO: 59946 - DNA, 20 bp, human
gccgcacctttagaggaggg

SEQ ID NO: 59947 - DNA, 20 bp, human
gctctacagcccctaggcag

SEQ ID NO: 59948 - DNA, 20 bp, human
gagaggcaggtccttggcgt

SEQ ID NO: 59949 - DNA, 20 bp, human
gacctgggcaatagaagagg

SEQ ID NO: 59950 - DNA, 20 bp, human
gctcacctgggcaatagaag

SEQ ID NO: 59951 - DNA, 20 bp, human
gactcggtgccgctgcctag

SEQ ID NO: 59952 - DNA, 20 bp, human
gcgtctgatccaggtaggag

SEQ ID NO: 59953 - DNA, 20 bp, human
gctgatccaggtaggagcgg

SEQ ID NO: 59954 - DNA, 20 bp, human
gggtcgcgccgctcctgctg

SEQ ID NO: 59955 - DNA, 20 bp, human
ggcgcggagcaggaactcgc

SEQ ID NO: 59956 - DNA, 20 bp, human
gggctggtgcaactccaaaa

SEQ ID NO: 59957 - DNA, 20 bp, human
gttctaatcgccgctccccg

SEQ ID NO: 59958 - DNA, 20 bp, human
gaaatggctgccgcggggag

SEQ ID NO: 59959 - DNA, 20 bp, human
ggttgtaggctagacttaat

SEQ ID NO: 59960 - DNA, 20 bp, human
gggggccgggtgcctccgag

SEQ ID NO: 59961 - DNA, 20 bp, human
ggaacgggttccagtcgctt

SEQ ID NO: 59962 - DNA, 20 bp, human
gggtgcaggcgaaggaccca

SEQ ID NO: 59963 - DNA, 20 bp, human
ggtcgcttgggggcgttggg

SEQ ID NO: 59964 - DNA, 20 bp, human
gaagggtctaagggatagcg

SEQ ID NO: 59965 - DNA, 20 bp, human
gaaatctgaggaaagaggtg

SEQ ID NO: 59966 - DNA, 20 bp, human
gagacgtggcaccacagcga

SEQ ID NO: 59967 - DNA, 20 bp, human
gactagagcggcagggatct

SEQ ID NO: 59968 - DNA, 20 bp, human
gcaagtggaagcccagctaa

SEQ ID NO: 59969 - DNA, 20 bp, human
ggttctgggtgtccatgggt

SEQ ID NO: 59970 - DNA, 20 bp, human
ggacaaacgagagtatcttc

SEQ ID NO: 59971 - DNA, 20 bp, human
ggggatgcttggccattagc

SEQ ID NO: 59972 - DNA, 20 bp, human
gcaggactggctgaggtccc

SEQ ID NO: 59973 - DNA, 20 bp, human
gccttccgtgctagctgggc

SEQ ID NO: 59974 - DNA, 20 bp, human
ggccctggtactgtaacaaa

SEQ ID NO: 59975 - DNA, 20 bp, human
gcgagagtatcttcgggaga

SEQ ID NO: 59976 - DNA, 20 bp, human
gaggaccggccaaggtccca

SEQ ID NO: 59977 - DNA, 20 bp, human
ggaaacagctggatcccgag

SEQ ID NO: 59978 - DNA, 20 bp, human
ggtatcttcaggagactgac

SEQ ID NO: 59979 - DNA, 20 bp, human
gcatgccttgggaccttggc

SEQ ID NO: 59980 - DNA, 20 bp, human
gatgggggaccggaggccac

SEQ ID NO: 59981 - DNA, 20 bp, human
ggagaggtggcacaacagag

SEQ ID NO: 59982 - DNA, 20 bp, human
gagtccatgccttgggacct

SEQ ID NO: 59983 - DNA, 20 bp, human
ggaggccacaggaccggcca

SEQ ID NO: 59984 - DNA, 20 bp, human
gggcttggagtccatgcctt

SEQ ID NO: 59985 - DNA, 20 bp, human
gggcgagagctcggaaaata

SEQ ID NO: 59986 - DNA, 20 bp, human
gaccgcggaaactggagagg

SEQ ID NO: 59987 - DNA, 20 bp, human
ggccacctctccagtttccg

SEQ ID NO: 59988 - DNA, 20 bp, human
gcaggaccggcccagttccc

SEQ ID NO: 59989 - DNA, 20 bp, human
gcatgcccggggaactgggc

SEQ ID NO: 59990 - DNA, 20 bp, human
ggagtccatgcccggggaac

SEQ ID NO: 59991 - DNA, 20 bp, human
gctacaggtactgaaaccgc

SEQ ID NO: 59992 - DNA, 20 bp, human
gtggcgagagcttggaaaac

SEQ ID NO: 59993 - DNA, 20 bp, human
gagctttttcttcctgcttt

SEQ ID NO: 59994 - DNA, 20 bp, human
gggaaccgcggaaactggag

SEQ ID NO: 59995 - DNA, 20 bp, human
gcctagcgactagagcgtca

SEQ ID NO: 59996 - DNA, 20 bp, human
ggacggtggccgcgaagcta

SEQ ID NO: 59997 - DNA, 20 bp, human
gggctaggccggaaaagggt

SEQ ID NO: 59998 - DNA, 20 bp, human
gcgcctgcggtccgccatgg

SEQ ID NO: 59999 - DNA, 20 bp, human
gagggcaccagcctccgcag

SEQ ID NO: 60000 - DNA, 20 bp, human
gcgccgcctgcggtccgcca

SEQ ID NO: 60001 - DNA, 20 bp, human
gatggccgcagagtccgctg

SEQ ID NO: 60002 - DNA, 20 bp, human
gcatctggcgaacagttggt

SEQ ID NO: 60003 - DNA, 20 bp, human
ggcaccggggccaacgtccc

SEQ ID NO: 60004 - DNA, 20 bp, human
gggccaccatggcggaccgc

SEQ ID NO: 60005 - DNA, 20 bp, human
gggcagcagatgcctaacat

SEQ ID NO: 60006 - DNA, 20 bp, human
gcggagcggagcttccacta

SEQ ID NO: 60007 - DNA, 20 bp, human
ggcctgtaaaatggaaggac

SEQ ID NO: 60008 - DNA, 20 bp, human
gtcttcacgcgggacacacg

SEQ ID NO: 60009 - DNA, 20 bp, human
gcttcctggaacttagaggt

SEQ ID NO: 60010 - DNA, 20 bp, human
gcagcaacgcggtcagctag

SEQ ID NO: 60011 - DNA, 20 bp, human
gaaatggaaggactggactg

SEQ ID NO: 60012 - DNA, 20 bp, human
gggcgaggaggcggaagctt

SEQ ID NO: 60013 - DNA, 20 bp, human
gtggccgctggcaactggca

SEQ ID NO: 60014 - DNA, 20 bp, human
gggcgcggtgcggggaaact

SEQ ID NO: 60015 - DNA, 20 bp, human
ggcgggcagcaggcggaaga

SEQ ID NO: 60016 - DNA, 20 bp, human
ggcgggagaggcgtactcgg

SEQ ID NO: 60017 - DNA, 20 bp, human
gagcgggcggcagagcaggg

SEQ ID NO: 60018 - DNA, 20 bp, human
gggagaggcgtactcggcgg

SEQ ID NO: 60019 - DNA, 20 bp, human
ggccgcgggagaggcgtact

SEQ ID NO: 60020 - DNA, 20 bp, human
gtccggcgatcgctagagaa

SEQ ID NO: 60021 - DNA, 20 bp, human
ggagcagggcggcggcgact

SEQ ID NO: 60022 - DNA, 20 bp, human
gctagagaagggctcccgga

SEQ ID NO: 60023 - DNA, 20 bp, human
gggcagccctctcagaaaga

SEQ ID NO: 60024 - DNA, 20 bp, human
gtctcagaaagagggcaacg

SEQ ID NO: 60025 - DNA, 20 bp, human
gtccctcccaaaggctgcag

SEQ ID NO: 60026 - DNA, 20 bp, human
gagagccgcgacaagccagg

SEQ ID NO: 60027 - DNA, 20 bp, human
gcacaggggcaggtgttgag

SEQ ID NO: 60028 - DNA, 20 bp, human
ggccaggcggcagctccgag

SEQ ID NO: 60029 - DNA, 20 bp, human
ggcgtggaggtgccaatgga

SEQ ID NO: 60030 - DNA, 20 bp, human
gctggcgggcgcaggatctg

SEQ ID NO: 60031 - DNA, 20 bp, human
ggctgccgcctggcttgtcg

SEQ ID NO: 60032 - DNA, 20 bp, human
gttgtcgcggctctgccaca

SEQ ID NO: 60033 - DNA, 20 bp, human
gggcagagccgcgacaagcc

SEQ ID NO: 60034 - DNA, 20 bp, human
ggggagccccgggtccggag

SEQ ID NO: 60035 - DNA, 20 bp, human
ggagcgcctggaggctcgag

SEQ ID NO: 60036 - DNA, 20 bp, human
gatccgatttgcccccggag

SEQ ID NO: 60037 - DNA, 20 bp, human
gggggcagctcgcaaacctg

SEQ ID NO: 60038 - DNA, 20 bp, human
gccggacgcccccaccacgg

SEQ ID NO: 60039 - DNA, 20 bp, human
gcactcgaggcgcctccccc

SEQ ID NO: 60040 - DNA, 20 bp, human
gagcagcccgggcgagtgcc

SEQ ID NO: 60041 - DNA, 20 bp, human
gcgctgcggcgggtggacag

SEQ ID NO: 60042 - DNA, 20 bp, human
ggggggcaaatcggatccag

SEQ ID NO: 60043 - DNA, 20 bp, human
gtccgcagctgggtggaccc

SEQ ID NO: 60044 - DNA, 20 bp, human
ggtacgtgccggggctctga

SEQ ID NO: 60045 - DNA, 20 bp, human
ggggctcacgtcaccgccac

SEQ ID NO: 60046 - DNA, 20 bp, human
gcgggcgtcagctgactgtt

SEQ ID NO: 60047 - DNA, 20 bp, human
ggaggccggtcatcagctag

SEQ ID NO: 60048 - DNA, 20 bp, human
ggaggccactagctgatgac

SEQ ID NO: 60049 - DNA, 20 bp, human
gtattgagccatggcagcgg

SEQ ID NO: 60050 - DNA, 20 bp, human
gctgccatggctcaatacaa

SEQ ID NO: 60051 - DNA, 20 bp, human
ggcgcccttgtattgagcca

SEQ ID NO: 60052 - DNA, 20 bp, human
ggcccaggcgaggcgacgag

SEQ ID NO: 60053 - DNA, 20 bp, human
gcagctagtggcctcagcct

SEQ ID NO: 60054 - DNA, 20 bp, human
gcgggcgttctccgaggctg

SEQ ID NO: 60055 - DNA, 20 bp, human
gcgcatgctccgaggctccc

SEQ ID NO: 60056 - DNA, 20 bp, human
ggggccatggcgcagtacaa

SEQ ID NO: 60057 - DNA, 20 bp, human
gcgagtgggcctctgctcgt

SEQ ID NO: 60058 - DNA, 20 bp, human
gcggctgtcgcgagagcccg

SEQ ID NO: 60059 - DNA, 20 bp, human
ggctgcagagcccatcgggt

SEQ ID NO: 60060 - DNA, 20 bp, human
gtagaggggggcccacgcaa

SEQ ID NO: 60061 - DNA, 20 bp, human
ggtgggcctctgctcgtggg

SEQ ID NO: 60062 - DNA, 20 bp, human
gtggcccgcgcctacccgat

SEQ ID NO: 60063 - DNA, 20 bp, human
ggcccaagcaccctgtcgag

SEQ ID NO: 60064 - DNA, 20 bp, human
ggcagcaaagaggaaaaacg

SEQ ID NO: 60065 - DNA, 20 bp, human
gaggcagcgggagcagatgg

SEQ ID NO: 60066 - DNA, 20 bp, human
gtgcggagcgagaagactgc

SEQ ID NO: 60067 - DNA, 20 bp, human
gcccaggccccgctcgctca

SEQ ID NO: 60068 - DNA, 20 bp, human
gccaggctacgcagaaaaag

SEQ ID NO: 60069 - DNA, 20 bp, human
gccgcggcggaacaaaaccg

SEQ ID NO: 60070 - DNA, 20 bp, human
gtccccggcgacccgaggag

SEQ ID NO: 60071 - DNA, 20 bp, human
gtgggcagcgtggacaagag

SEQ ID NO: 60072 - DNA, 20 bp, human
gagacttccccggcgacccg

SEQ ID NO: 60073 - DNA, 20 bp, human
ggcgggaggccagacttccc

SEQ ID NO: 60074 - DNA, 20 bp, human
gcgacgcgcctcagccgcgg

SEQ ID NO: 60075 - DNA, 20 bp, human
gcaatgagggcggccggagg

SEQ ID NO: 60076 - DNA, 20 bp, human
gccaacccaaaggcgaaaca

SEQ ID NO: 60077 - DNA, 20 bp, human
gaactcggcccggcgcttag

SEQ ID NO: 60078 - DNA, 20 bp, human
gcggctgcgtgaactcggcc

SEQ ID NO: 60079 - DNA, 20 bp, human
gcgggcccgggcgctaggcg

SEQ ID NO: 60080 - DNA, 20 bp, human
ggccgccgcgcctagcgccc

SEQ ID NO: 60081 - DNA, 20 bp, human
gccagcggccgggacgcaca

SEQ ID NO: 60082 - DNA, 20 bp, human
ggcgctcgccaagtcgtccg

SEQ ID NO: 60083 - DNA, 20 bp, human
gctggccccgagcgaggtcc

SEQ ID NO: 60084 - DNA, 20 bp, human
gggaggcaggcggcgtgcgg

SEQ ID NO: 60085 - DNA, 20 bp, human
ggtccgggccgtgtgcgtcc

SEQ ID NO: 60086 - DNA, 20 bp, human
gagggggtgactcgttagtg

SEQ ID NO: 60087 - DNA, 20 bp, human
gaaccgcggtaggtggtgga

SEQ ID NO: 60088 - DNA, 20 bp, human
gctgggagctggaggaaccg

SEQ ID NO: 60089 - DNA, 20 bp, human
ggagctggaggaaccgcggt

SEQ ID NO: 60090 - DNA, 20 bp, human
ggagaggttgaagattggag

SEQ ID NO: 60091 - DNA, 20 bp, human
gaagcgaactcaggacgcag

SEQ ID NO: 60092 - DNA, 20 bp, human
ggcgaaccaacgagtccctg

SEQ ID NO: 60093 - DNA, 20 bp, human
gctggaggaaccgcggtagg

SEQ ID NO: 60094 - DNA, 20 bp, human
gcccccgccccggggaccag

SEQ ID NO: 60095 - DNA, 20 bp, human
gagagcacgggacccggtgg

SEQ ID NO: 60096 - DNA, 20 bp, human
gcccagccgcaggcagatgt

SEQ ID NO: 60097 - DNA, 20 bp, human
ggccagcgtcagcagcatcg

SEQ ID NO: 60098 - DNA, 20 bp, human
gggcccagggcggaaaaggg

SEQ ID NO: 60099 - DNA, 20 bp, human
gcgagccgaacccagccacg

SEQ ID NO: 60100 - DNA, 20 bp, human
gtggggagagtcaggccgaa

SEQ ID NO: 60101 - DNA, 20 bp, human
gccacgcggcgccagcgagg

SEQ ID NO: 60102 - DNA, 20 bp, human
gctccctgcggtcctcggac

SEQ ID NO: 60103 - DNA, 20 bp, human
gcgctccccacatctgcctg

SEQ ID NO: 60104 - DNA, 20 bp, human
gccggccccgctcccgccag

SEQ ID NO: 60105 - DNA, 20 bp, human
ggcgggctccggaggctcat

SEQ ID NO: 60106 - DNA, 20 bp, human
ggagcaggccagcgagggat

SEQ ID NO: 60107 - DNA, 20 bp, human
gagaggggatggcttggtga

SEQ ID NO: 60108 - DNA, 20 bp, human
gtgccgggcggcagggactg

SEQ ID NO: 60109 - DNA, 20 bp, human
gagtggagccaggagagcgg

SEQ ID NO: 60110 - DNA, 20 bp, human
gccgcggctgcgacagagat

SEQ ID NO: 60111 - DNA, 20 bp, human
gggctggctgggcagagacg

SEQ ID NO: 60112 - DNA, 20 bp, human
gctggggcggcagcgagagg

SEQ ID NO: 60113 - DNA, 20 bp, human
ggtctgagtaccagccccaa

SEQ ID NO: 60114 - DNA, 20 bp, human
gaccatcggggtcagcatgg

SEQ ID NO: 60115 - DNA, 20 bp, human
gggagaggaggaagagtccg

SEQ ID NO: 60116 - DNA, 20 bp, human
gtgaggcgccgcggcaccgg

SEQ ID NO: 60117 - DNA, 20 bp, human
gggtgtgcaggccctaggag

SEQ ID NO: 60118 - DNA, 20 bp, human
gcagaagccggcagaactgg

SEQ ID NO: 60119 - DNA, 20 bp, human
gccatgaggcgccgcggcac

SEQ ID NO: 60120 - DNA, 20 bp, human
gcacccgcggccctgcactc

SEQ ID NO: 60121 - DNA, 20 bp, human
ggcgcagaagccggcagaac

SEQ ID NO: 60122 - DNA, 20 bp, human
ggcgaggcggagaccggccc

SEQ ID NO: 60123 - DNA, 20 bp, human
ggcagaactggaggtgctcg

SEQ ID NO: 60124 - DNA, 20 bp, human
gggcttcccggcctctgcta

SEQ ID NO: 60125 - DNA, 20 bp, human
gccgggttgggcctccagcg

SEQ ID NO: 60126 - DNA, 20 bp, human
ggtagcaactgcagaactgc

SEQ ID NO: 60127 - DNA, 20 bp, human
gtttccgcgagagaacactg

SEQ ID NO: 60128 - DNA, 20 bp, human
gccgcgagagaacactgcgg

SEQ ID NO: 60129 - DNA, 20 bp, human
gaacgtggatccctcaactc

SEQ ID NO: 60130 - DNA, 20 bp, human
gctcgcggaaaggagcccgg

SEQ ID NO: 60131 - DNA, 20 bp, human
ggtgtatgtggaaggacggg

SEQ ID NO: 60132 - DNA, 20 bp, human
gaggcaaaccgaaagtctcg

SEQ ID NO: 60133 - DNA, 20 bp, human
gggcggccgaaaggcccgag

SEQ ID NO: 60134 - DNA, 20 bp, human
ggttgagggatccacgttga

SEQ ID NO: 60135 - DNA, 20 bp, human
ggagcgtaccaaagaacctg

SEQ ID NO: 60136 - DNA, 20 bp, human
gcagagagggagcgagaaac

SEQ ID NO: 60137 - DNA, 20 bp, human
gtcaggcgttgacagctgga

SEQ ID NO: 60138 - DNA, 20 bp, human
ggatcacaaagctgctgacc

SEQ ID NO: 60139 - DNA, 20 bp, human
gccgggtcagaaagtcctga

SEQ ID NO: 60140 - DNA, 20 bp, human
ggagataggtgcaatgaagg

SEQ ID NO: 60141 - DNA, 20 bp, human
gggagcgcatgccatagact

SEQ ID NO: 60142 - DNA, 20 bp, human
gagctttgtgatcagcagag

SEQ ID NO: 60143 - DNA, 20 bp, human
gcagccgtggcaatgagatg

SEQ ID NO: 60144 - DNA, 20 bp, human
gccgggccctgactacaagc

SEQ ID NO: 60145 - DNA, 20 bp, human
ggactcacgcccagtactgg

SEQ ID NO: 60146 - DNA, 20 bp, human
gcctctgagagggcagtaca

SEQ ID NO: 60147 - DNA, 20 bp, human
gccgccgaggcgcctctgag

SEQ ID NO: 60148 - DNA, 20 bp, human
ggacgccatgacagctgtat

SEQ ID NO: 60149 - DNA, 20 bp, human
gaccccaggaccatcaccag

SEQ ID NO: 60150 - DNA, 20 bp, human
gggcgctggctgcggagaag

SEQ ID NO: 60151 - DNA, 20 bp, human
ggccacggctgtctccgggg

SEQ ID NO: 60152 - DNA, 20 bp, human
gagacagccgtggccggagt

SEQ ID NO: 60153 - DNA, 20 bp, human
ggcaggtgccggcgagatcc

SEQ ID NO: 60154 - DNA, 20 bp, human
gccggtgacgtgcctgaccg

SEQ ID NO: 60155 - DNA, 20 bp, human
gtacaaggtgaccgcctccc

SEQ ID NO: 60156 - DNA, 20 bp, human
gcactcacccgacaccacta

SEQ ID NO: 60157 - DNA, 20 bp, human
gcagcgctgaagctcggcta

SEQ ID NO: 60158 - DNA, 20 bp, human
gctctggctcaggcgaggag

SEQ ID NO: 60159 - DNA, 20 bp, human
ggctcggccttagtggtgtc

SEQ ID NO: 60160 - DNA, 20 bp, human
gtgtcgggtgagtgcgggct

SEQ ID NO: 60161 - DNA, 20 bp, human
gcagaaatgctgctgacccg

SEQ ID NO: 60162 - DNA, 20 bp, human
gcggctgtgctcggccttag

SEQ ID NO: 60163 - DNA, 20 bp, human
gagaagtcggatcgaaatcg

SEQ ID NO: 60164 - DNA, 20 bp, human
gtctgggtaccacaagaagt

SEQ ID NO: 60165 - DNA, 20 bp, human
gtcggacacgcacggcctgt

SEQ ID NO: 60166 - DNA, 20 bp, human
gcctgcggcgaaggcagcaa

SEQ ID NO: 60167 - DNA, 20 bp, human
ggctgcggcgcgaccaggcc

SEQ ID NO: 60168 - DNA, 20 bp, human
gaaggcagcaagggctccca

SEQ ID NO: 60169 - DNA, 20 bp, human
gacggcgcgggacactcaca

SEQ ID NO: 60170 - DNA, 20 bp, human
gcggcctgcagccccggaaa

SEQ ID NO: 60171 - DNA, 20 bp, human
ggcgctgtccttgcgctcgg

SEQ ID NO: 60172 - DNA, 20 bp, human
ggccggcccctagagctagg

SEQ ID NO: 60173 - DNA, 20 bp, human
gaggccagagagcgggctca

SEQ ID NO: 60174 - DNA, 20 bp, human
gcgctcggaggtgcccggcc

SEQ ID NO: 60175 - DNA, 20 bp, human
ggcgccttgagcccgctctc

SEQ ID NO: 60176 - DNA, 20 bp, human
ggtttcgccgaagcggggtg

SEQ ID NO: 60177 - DNA, 20 bp, human
gccagccgggcggctcgaag

SEQ ID NO: 60178 - DNA, 20 bp, human
gcgcaccggctgggcctgtc

SEQ ID NO: 60179 - DNA, 20 bp, human
gatcggcggggagagctcct

SEQ ID NO: 60180 - DNA, 20 bp, human
gggagcccaaggaggtcacg

SEQ ID NO: 60181 - DNA, 20 bp, human
gcctgtcgggcagctccgca

SEQ ID NO: 60182 - DNA, 20 bp, human
ggcgggcgacaaacccgcac

SEQ ID NO: 60183 - DNA, 20 bp, human
gggccacgctcggagccctg

SEQ ID NO: 60184 - DNA, 20 bp, human
ggagccgctgggagcgagcc

SEQ ID NO: 60185 - DNA, 20 bp, human
ggggcggctcgaagtggcca

SEQ ID NO: 60186 - DNA, 20 bp, human
ggtgactgctgagactgccg

SEQ ID NO: 60187 - DNA, 20 bp, human
gagcatcctgagtgaggtag

SEQ ID NO: 60188 - DNA, 20 bp, human
ggagctcctggtcgatgaag

SEQ ID NO: 60189 - DNA, 20 bp, human
ggcagtcacactgccgaccg

SEQ ID NO: 60190 - DNA, 20 bp, human
gtggctgcaaatatcaactt

SEQ ID NO: 60191 - DNA, 20 bp, human
gaggcaaggggtggaacaag

SEQ ID NO: 60192 - DNA, 20 bp, human
gctgtgacaggctttcctta

SEQ ID NO: 60193 - DNA, 20 bp, human
gggacacttttgcccagctt

SEQ ID NO: 60194 - DNA, 20 bp, human
gtgcagccactacctcactc

SEQ ID NO: 60195 - DNA, 20 bp, human
gaaacaaagcatcctgagtg

SEQ ID NO: 60196 - DNA, 20 bp, human
gaagcccacagggtacggtc

SEQ ID NO: 60197 - DNA, 20 bp, human
gcagatgcccgaacccacca

SEQ ID NO: 60198 - DNA, 20 bp, human
gatctgaagcccacagggta

SEQ ID NO: 60199 - DNA, 20 bp, human
ggcgccgcagctgctgcgag

SEQ ID NO: 60200 - DNA, 20 bp, human
gggagccgtcgtcgttaggt

SEQ ID NO: 60201 - DNA, 20 bp, human
gcatgtcaggggcacactca

SEQ ID NO: 60202 - DNA, 20 bp, human
ggaggacgctccagtttcaa

SEQ ID NO: 60203 - DNA, 20 bp, human
ggaacgggccaaggttagag

SEQ ID NO: 60204 - DNA, 20 bp, human
ggagcgcggagctagagcgg

SEQ ID NO: 60205 - DNA, 20 bp, human
gcgggcatctgaagcccaca

SEQ ID NO: 60206 - DNA, 20 bp, human
ggcggcgtcacggcacacat

SEQ ID NO: 60207 - DNA, 20 bp, human
ggaagtctgtccacacaagg

SEQ ID NO: 60208 - DNA, 20 bp, human
gagcagcaggcggcatccgg

SEQ ID NO: 60209 - DNA, 20 bp, human
gtccacacaaggcggcgtca

SEQ ID NO: 60210 - DNA, 20 bp, human
ggccagcatggaattccccc

SEQ ID NO: 60211 - DNA, 20 bp, human
ggactcccggactcgagcta

SEQ ID NO: 60212 - DNA, 20 bp, human
gccgcctgctgctctggacg

SEQ ID NO: 60213 - DNA, 20 bp, human
ggcaccagaaggaagactcg

SEQ ID NO: 60214 - DNA, 20 bp, human
gaggcgatcttcccagagag

SEQ ID NO: 60215 - DNA, 20 bp, human
gagtgtccagacctgctcga

SEQ ID NO: 60216 - DNA, 20 bp, human
gcccgccgcgctgcagtcag

SEQ ID NO: 60217 - DNA, 20 bp, human
gcgtcgagctccgcctggag

SEQ ID NO: 60218 - DNA, 20 bp, human
ggagccccgagacgtgacct

SEQ ID NO: 60219 - DNA, 20 bp, human
ggcgaggagtctctgtccgg

SEQ ID NO: 60220 - DNA, 20 bp, human
ggggcgatgtgtgattacca

SEQ ID NO: 60221 - DNA, 20 bp, human
gggcctacctggaggtaata

SEQ ID NO: 60222 - DNA, 20 bp, human
gtccgcctctgactgcagcg

SEQ ID NO: 60223 - DNA, 20 bp, human
ggaaagccccgaaaacacca

SEQ ID NO: 60224 - DNA, 20 bp, human
ggcctctgactgcagcgcgg

SEQ ID NO: 60225 - DNA, 20 bp, human
gcctgccgtccggcacctgg

SEQ ID NO: 60226 - DNA, 20 bp, human
gccgcatggcgagggagcgg

SEQ ID NO: 60227 - DNA, 20 bp, human
gccgtactcggcccactccg

SEQ ID NO: 60228 - DNA, 20 bp, human
gcgcgcggcccgcatggcga

SEQ ID NO: 60229 - DNA, 20 bp, human
ggggcccgcgttaaaggcga

SEQ ID NO: 60230 - DNA, 20 bp, human
gctgcaggcgcttggagaag

SEQ ID NO: 60231 - DNA, 20 bp, human
ggcctttaacgcgggcccgg

SEQ ID NO: 60232 - DNA, 20 bp, human
ggccgcagccgccgcatggt

SEQ ID NO: 60233 - DNA, 20 bp, human
ggagtgggccgagtacggag

SEQ ID NO: 60234 - DNA, 20 bp, human
gtccgggcgcggggatgctg

SEQ ID NO: 60235 - DNA, 20 bp, human
gcgagtggctccggaaggac

SEQ ID NO: 60236 - DNA, 20 bp, human
gtacgcgagtgcggaactcg

SEQ ID NO: 60237 - DNA, 20 bp, human
gcggctgcgtccccattcgg

SEQ ID NO: 60238 - DNA, 20 bp, human
gtggcacccgccggggacat

SEQ ID NO: 60239 - DNA, 20 bp, human
ggccacccaagtccccggga

SEQ ID NO: 60240 - DNA, 20 bp, human
gcacctgcgtggagtgccag

SEQ ID NO: 60241 - DNA, 20 bp, human
ggccttcccggggacttggg

SEQ ID NO: 60242 - DNA, 20 bp, human
ggcgctcggagaggacaccc

SEQ ID NO: 60243 - DNA, 20 bp, human
gtgtcgggaacccatgtccc

SEQ ID NO: 60244 - DNA, 20 bp, human
gcgccccggtcccccgaatg

SEQ ID NO: 60245 - DNA, 20 bp, human
gtggcgagggtaggacggag

SEQ ID NO: 60246 - DNA, 20 bp, human
gcactctgggccgtataata

SEQ ID NO: 60247 - DNA, 20 bp, human
gcacaacggcagcactggtg

SEQ ID NO: 60248 - DNA, 20 bp, human
gaaactgtagtcctagtgac

SEQ ID NO: 60249 - DNA, 20 bp, human
gagggaccagtggtgctcct

SEQ ID NO: 60250 - DNA, 20 bp, human
gaggctctgaggcaacagtg

SEQ ID NO: 60251 - DNA, 20 bp, human
gtggttgtctttcagcacaa

SEQ ID NO: 60252 - DNA, 20 bp, human
gactggtgaggcaggtctct

SEQ ID NO: 60253 - DNA, 20 bp, human
gtccaagacgtagagatgca

SEQ ID NO: 60254 - DNA, 20 bp, human
gttcagcacaacggcagcac

SEQ ID NO: 60255 - DNA, 20 bp, human
ggtccagaagaaaacctctc

SEQ ID NO: 60256 - DNA, 20 bp, human
ggtgtccgaatggtgacagt

SEQ ID NO: 60257 - DNA, 20 bp, human
gtggtggtgccaggagattt

SEQ ID NO: 60258 - DNA, 20 bp, human
ggccggtttgccaaggggag

SEQ ID NO: 60259 - DNA, 20 bp, human
ggtgaacagcatgtcagatg

SEQ ID NO: 60260 - DNA, 20 bp, human
ggacttctgcctaaatctcc

SEQ ID NO: 60261 - DNA, 20 bp, human
gtaactgcccatctccctac

SEQ ID NO: 60262 - DNA, 20 bp, human
ggggccagaaccatgacgtc

SEQ ID NO: 60263 - DNA, 20 bp, human
gatggggccggtttgccaag

SEQ ID NO: 60264 - DNA, 20 bp, human
gagctgtgggctgtgtaata

SEQ ID NO: 60265 - DNA, 20 bp, human
gtgccaaggggagaggtcgc

SEQ ID NO: 60266 - DNA, 20 bp, human
ggcagtgggattgccagtta

SEQ ID NO: 60267 - DNA, 20 bp, human
ggcagtggatggttcaggtt

SEQ ID NO: 60268 - DNA, 20 bp, human
gggattgccagttaaggttg

SEQ ID NO: 60269 - DNA, 20 bp, human
gttgtggaatcaaagagcaa

SEQ ID NO: 60270 - DNA, 20 bp, human
ggtggtttagcagcagtgga

SEQ ID NO: 60271 - DNA, 20 bp, human
gtgctttgggccgtgtaata

SEQ ID NO: 60272 - DNA, 20 bp, human
gagggcacagtctggatcca

SEQ ID NO: 60273 - DNA, 20 bp, human
gcactaagcagggcacagtc

SEQ ID NO: 60274 - DNA, 20 bp, human
ggcccaaagcagccccgcaa

SEQ ID NO: 60275 - DNA, 20 bp, human
gagcaaaggctgttgtgaag

SEQ ID NO: 60276 - DNA, 20 bp, human
gtggggctgaaatagatctc

SEQ ID NO: 60277 - DNA, 20 bp, human
gagtcacttaccaacaggtg

SEQ ID NO: 60278 - DNA, 20 bp, human
ggtggaaacgtgctatttgg

SEQ ID NO: 60279 - DNA, 20 bp, human
gtaagagaagaacggcactg

SEQ ID NO: 60280 - DNA, 20 bp, human
ggatctcctggatgtcgact

SEQ ID NO: 60281 - DNA, 20 bp, human
gagagtggaaacgtgctatt

SEQ ID NO: 60282 - DNA, 20 bp, human
gattaattctggtaattcga

SEQ ID NO: 60283 - DNA, 20 bp, human
gcaccaggtgttaagtctct

SEQ ID NO: 60284 - DNA, 20 bp, human
gagccgagagacttaacacc

SEQ ID NO: 60285 - DNA, 20 bp, human
ggagaagaacggcactgggg

SEQ ID NO: 60286 - DNA, 20 bp, human
gagcagagggagaaagcgag

SEQ ID NO: 60287 - DNA, 20 bp, human
gtgggaagaagccgagatgg

SEQ ID NO: 60288 - DNA, 20 bp, human
gtgtccccgtccgacgggag

SEQ ID NO: 60289 - DNA, 20 bp, human
gtaggtgagttacagacgga

SEQ ID NO: 60290 - DNA, 20 bp, human
gaagtcaggaggaggtcgag

SEQ ID NO: 60291 - DNA, 20 bp, human
ggagcaacttcgtacaggta

SEQ ID NO: 60292 - DNA, 20 bp, human
ggatggggccggcaattcgg

SEQ ID NO: 60293 - DNA, 20 bp, human
gcgctgccccgggctcgact

SEQ ID NO: 60294 - DNA, 20 bp, human
ggtgagttacagacggaagg

SEQ ID NO: 60295 - DNA, 20 bp, human
gcccgtccgacgggagcgga

SEQ ID NO: 60296 - DNA, 20 bp, human
gcactgtgtgggggacgatc

SEQ ID NO: 60297 - DNA, 20 bp, human
ggagactcgggcctccgcca

SEQ ID NO: 60298 - DNA, 20 bp, human
gggtgccttgagccgctcca

SEQ ID NO: 60299 - DNA, 20 bp, human
gacatgggcagcggacggag

SEQ ID NO: 60300 - DNA, 20 bp, human
gctccagggcaccccgaagt

SEQ ID NO: 60301 - DNA, 20 bp, human
gtgggggacgatcaggaggg

SEQ ID NO: 60302 - DNA, 20 bp, human
gcaagatcccccagcacggg

SEQ ID NO: 60303 - DNA, 20 bp, human
gggtgccctggagcggctca

SEQ ID NO: 60304 - DNA, 20 bp, human
gttgacccgtggggcttcac

SEQ ID NO: 60305 - DNA, 20 bp, human
gcctgccagggtggacagca

SEQ ID NO: 60306 - DNA, 20 bp, human
gcctactcttccatccccag

SEQ ID NO: 60307 - DNA, 20 bp, human
gggatagggagccagaccgg

SEQ ID NO: 60308 - DNA, 20 bp, human
gggtctggctccctatcccc

SEQ ID NO: 60309 - DNA, 20 bp, human
gatggggccttctgagatgg

SEQ ID NO: 60310 - DNA, 20 bp, human
gacgcagctggggccttctg

SEQ ID NO: 60311 - DNA, 20 bp, human
gggtggccccggcccctggt

SEQ ID NO: 60312 - DNA, 20 bp, human
gggcaggcagccgggggata

SEQ ID NO: 60313 - DNA, 20 bp, human
ggggaaaaggccgggcctat

SEQ ID NO: 60314 - DNA, 20 bp, human
ggaggagccaatccaggtgg

SEQ ID NO: 60315 - DNA, 20 bp, human
gtgggggacacagccttctg

SEQ ID NO: 60316 - DNA, 20 bp, human
gtgagctctgggtcctcagg

SEQ ID NO: 60317 - DNA, 20 bp, human
gcaggatgcagacataatga

SEQ ID NO: 60318 - DNA, 20 bp, human
gcatcctggccggtgagaag

SEQ ID NO: 60319 - DNA, 20 bp, human
ggtatgtgcaaataaaggag

SEQ ID NO: 60320 - DNA, 20 bp, human
gatgcagacataatgatggc

SEQ ID NO: 60321 - DNA, 20 bp, human
ggcataggacaatgaaacaa

SEQ ID NO: 60322 - DNA, 20 bp, human
ggaccccatgattctataaa

SEQ ID NO: 60323 - DNA, 20 bp, human
gttcccccttctcaccggcc

SEQ ID NO: 60324 - DNA, 20 bp, human
gaacatgtggctttgagctc

SEQ ID NO: 60325 - DNA, 20 bp, human
ggagataactgtatccactc

SEQ ID NO: 60326 - DNA, 20 bp, human
ggtaggagaagccccgtctg

SEQ ID NO: 60327 - DNA, 20 bp, human
ggagtccatccctgaaactg

SEQ ID NO: 60328 - DNA, 20 bp, human
gctgggtgacagctgtctgt

SEQ ID NO: 60329 - DNA, 20 bp, human
gcatttctacacatgctcag

SEQ ID NO: 60330 - DNA, 20 bp, human
gcctggagcgggcctaggtg

SEQ ID NO: 60331 - DNA, 20 bp, human
gctagtggacctggaatgca

SEQ ID NO: 60332 - DNA, 20 bp, human
gggagagccgaaccctggag

SEQ ID NO: 60333 - DNA, 20 bp, human
gcaccacggagtcaagaaac

SEQ ID NO: 60334 - DNA, 20 bp, human
gggagcgggcctaggtgtgg

SEQ ID NO: 60335 - DNA, 20 bp, human
gtggatggagagccgaaccc

SEQ ID NO: 60336 - DNA, 20 bp, human
gggtagctctatcatacggt

SEQ ID NO: 60337 - DNA, 20 bp, human
gtgcaggtagctctatcata

SEQ ID NO: 60338 - DNA, 20 bp, human
gctggccctgagctccacga

SEQ ID NO: 60339 - DNA, 20 bp, human
gatacggtaggcacaaatgg

SEQ ID NO: 60340 - DNA, 20 bp, human
ggcagatcacatcaacatcc

SEQ ID NO: 60341 - DNA, 20 bp, human
gctgcaggtcatctgttcta

SEQ ID NO: 60342 - DNA, 20 bp, human
gagagaaaaccagaaggtct

SEQ ID NO: 60343 - DNA, 20 bp, human
ggacagcccgtaagtaaatg

SEQ ID NO: 60344 - DNA, 20 bp, human
gatcatacggtaggcacaaa

SEQ ID NO: 60345 - DNA, 20 bp, human
gattggttcttggtaagaat

SEQ ID NO: 60346 - DNA, 20 bp, human
gggtctgtcaccgaacacgt

SEQ ID NO: 60347 - DNA, 20 bp, human
gaggcaggaaaagcggaaga

SEQ ID NO: 60348 - DNA, 20 bp, human
gaactgataccgggttggag

SEQ ID NO: 60349 - DNA, 20 bp, human
ggcgcgcggtggtgttggtg

SEQ ID NO: 60350 - DNA, 20 bp, human
gggaagggatgtcttaaaag

SEQ ID NO: 60351 - DNA, 20 bp, human
gtcctgggaagaggaggcgt

SEQ ID NO: 60352 - DNA, 20 bp, human
gcgcagagcggaggaaggtc

SEQ ID NO: 60353 - DNA, 20 bp, human
ggagcgaaaaccaacgtgtt

SEQ ID NO: 60354 - DNA, 20 bp, human
ggggaaccggagcgctccgg

SEQ ID NO: 60355 - DNA, 20 bp, human
ggtcgctttagaggctcagt

SEQ ID NO: 60356 - DNA, 20 bp, human
gtgagggaattgctatgaag

SEQ ID NO: 60357 - DNA, 20 bp, human
gggaattgctatgaaggggc

SEQ ID NO: 60358 - DNA, 20 bp, human
ggcgcgcggtggtgttggtg

SEQ ID NO: 60359 - DNA, 20 bp, human
gggtctgtcaccgaacacgt

SEQ ID NO: 60360 - DNA, 20 bp, human
gcccgggcgcgcggtggtgt

SEQ ID NO: 60361 - DNA, 20 bp, human
gaggcaggaaaagcggaaga

SEQ ID NO: 60362 - DNA, 20 bp, human
gtcctgggaagaggaggcgt

SEQ ID NO: 60363 - DNA, 20 bp, human
gggaagggatgtcttaaaag

SEQ ID NO: 60364 - DNA, 20 bp, human
ggtcgctttagaggctcagt

SEQ ID NO: 60365 - DNA, 20 bp, human
gcgcagagcggaggaaggtc

SEQ ID NO: 60366 - DNA, 20 bp, human
gggagtcagaatatgtatca

SEQ ID NO: 60367 - DNA, 20 bp, human
gaaagaagacaggaactaca

SEQ ID NO: 60368 - DNA, 20 bp, human
ggtgtgtgtaagaaagggag

SEQ ID NO: 60369 - DNA, 20 bp, human
gtgtgtgtgtgtgtaagaaa

SEQ ID NO: 60370 - DNA, 20 bp, human
gccagctaagaagatctaaa

SEQ ID NO: 60371 - DNA, 20 bp, human
gctgcaacaacagacacttc

SEQ ID NO: 60372 - DNA, 20 bp, human
ggtacttaaggcctcaaact

SEQ ID NO: 60373 - DNA, 20 bp, human
gaaaatcttcaaaaattctc

SEQ ID NO: 60374 - DNA, 20 bp, human
gttaacagactagactccac

SEQ ID NO: 60375 - DNA, 20 bp, human
ggttaatatcataaactgcc

SEQ ID NO: 60376 - DNA, 20 bp, human
gggtctgtcaccgaacacgt

SEQ ID NO: 60377 - DNA, 20 bp, human
gaggcaggaaaagcggaaga

SEQ ID NO: 60378 - DNA, 20 bp, human
gaactgataccgggttggag

SEQ ID NO: 60379 - DNA, 20 bp, human
ggcgcgcggtggtgttggtg

SEQ ID NO: 60380 - DNA, 20 bp, human
gggaagggatgtcttaaaag

SEQ ID NO: 60381 - DNA, 20 bp, human
gtcctgggaagaggaggcgt

SEQ ID NO: 60382 - DNA, 20 bp, human
gcgcagagcggaggaaggtc

SEQ ID NO: 60383 - DNA, 20 bp, human
ggagcgaaaaccaacgtgtt

SEQ ID NO: 60384 - DNA, 20 bp, human
ggggaaccggagcgctccgg

SEQ ID NO: 60385 - DNA, 20 bp, human
gccgcggacccgcagagcgg

SEQ ID NO: 60386 - DNA, 20 bp, human
ggccagagggaggcctgcaa

SEQ ID NO: 60387 - DNA, 20 bp, human
gtcagcgccaggcatcagct

SEQ ID NO: 60388 - DNA, 20 bp, human
gtcagctgggaagctggcgt

SEQ ID NO: 60389 - DNA, 20 bp, human
gcagtctgacatggagaagg

SEQ ID NO: 60390 - DNA, 20 bp, human
gggagggtccccacgccaga

SEQ ID NO: 60391 - DNA, 20 bp, human
gagaaggcggagtccttccg

SEQ ID NO: 60392 - DNA, 20 bp, human
gtagctctcggagtgccagg

SEQ ID NO: 60393 - DNA, 20 bp, human
gtcgcactcctgaccccgga

SEQ ID NO: 60394 - DNA, 20 bp, human
ggtctggacggccgagctgg

SEQ ID NO: 60395 - DNA, 20 bp, human
gccgcccctggccctgtacc

SEQ ID NO: 60396 - DNA, 20 bp, human
gggatgccatcgctgcggaa

SEQ ID NO: 60397 - DNA, 20 bp, human
gtggcatcccgggtgagtat

SEQ ID NO: 60398 - DNA, 20 bp, human
gccggggccgatactcaccc

SEQ ID NO: 60399 - DNA, 20 bp, human
ggcggcgccagagggtacct

SEQ ID NO: 60400 - DNA, 20 bp, human
ggcagcgtctccttccccgg

SEQ ID NO: 60401 - DNA, 20 bp, human
gggcagggccgggacttgag

SEQ ID NO: 60402 - DNA, 20 bp, human
gcttgagcggaggaccgagt

SEQ ID NO: 60403 - DNA, 20 bp, human
gagggtgccttgcttgggag

SEQ ID NO: 60404 - DNA, 20 bp, human
ggcgagagggtgccttgctt

SEQ ID NO: 60405 - DNA, 20 bp, human
ggcggaacgagaaggtactt

SEQ ID NO: 60406 - DNA, 20 bp, human
gagtctgaggcacaacccgg

SEQ ID NO: 60407 - DNA, 20 bp, human
ggacagtctgaggcacaacc

SEQ ID NO: 60408 - DNA, 20 bp, human
ggaccagtcagggcaagcag

SEQ ID NO: 60409 - DNA, 20 bp, human
gtcccgaaggcgaccagtca

SEQ ID NO: 60410 - DNA, 20 bp, human
gctgaggcacaacccggcgg

SEQ ID NO: 60411 - DNA, 20 bp, human
gggtccgagaacaatcccca

SEQ ID NO: 60412 - DNA, 20 bp, human
gcgatttatctgacagtctg

SEQ ID NO: 60413 - DNA, 20 bp, human
gcagcgcaaagggatcccga

SEQ ID NO: 60414 - DNA, 20 bp, human
gtcggaccccgtgaggtcgg

SEQ ID NO: 60415 - DNA, 20 bp, human
gcggccgcgggagcctggac

SEQ ID NO: 60416 - DNA, 20 bp, human
gggctctcgggttctccgta

SEQ ID NO: 60417 - DNA, 20 bp, human
gcccgcttaggccccgatag

SEQ ID NO: 60418 - DNA, 20 bp, human
gcggcggagggagacgaagc

SEQ ID NO: 60419 - DNA, 20 bp, human
ggcagctctgcaaggtccgt

SEQ ID NO: 60420 - DNA, 20 bp, human
gggagggagacgaagcgggt

SEQ ID NO: 60421 - DNA, 20 bp, human
gcgagaaggaagcggatcca

SEQ ID NO: 60422 - DNA, 20 bp, human
ggggagacgaagcgggtagg

SEQ ID NO: 60423 - DNA, 20 bp, human
gctgaggcgccggcgaagag

SEQ ID NO: 60424 - DNA, 20 bp, human
gcggctctgcggggattcta

SEQ ID NO: 60425 - DNA, 20 bp, human
gctttcgaggagctctccca

SEQ ID NO: 60426 - DNA, 20 bp, human
ggccggcagactcataaata

SEQ ID NO: 60427 - DNA, 20 bp, human
gcggccgccgaggacctggt

SEQ ID NO: 60428 - DNA, 20 bp, human
gcctcccaccaggtcctcgg

SEQ ID NO: 60429 - DNA, 20 bp, human
gcgcggccgcgccaccctcg

SEQ ID NO: 60430 - DNA, 20 bp, human
gctctccctgaagtcttcgg

SEQ ID NO: 60431 - DNA, 20 bp, human
ggccccgggaccctgcacgg

SEQ ID NO: 60432 - DNA, 20 bp, human
ggcagactcataaataagga

SEQ ID NO: 60433 - DNA, 20 bp, human
gtggaagggacagcgcgtca

SEQ ID NO: 60434 - DNA, 20 bp, human
gagactctccctgaagtctt

SEQ ID NO: 60435 - DNA, 20 bp, human
gcggccgccgtgcagggtcc

SEQ ID NO: 60436 - DNA, 20 bp, human
gagggtgcactcctaggagg

SEQ ID NO: 60437 - DNA, 20 bp, human
gccgcgtgcagcgcacccag

SEQ ID NO: 60438 - DNA, 20 bp, human
ggcgcggagggtgcactcct

SEQ ID NO: 60439 - DNA, 20 bp, human
gggtctgtctgcctccgcgg

SEQ ID NO: 60440 - DNA, 20 bp, human
gggagcggcgctgcgaggaa

SEQ ID NO: 60441 - DNA, 20 bp, human
gcgtgctccgcggaggaaac

SEQ ID NO: 60442 - DNA, 20 bp, human
gcgaatagggacaaaactca

SEQ ID NO: 60443 - DNA, 20 bp, human
gccaacggctggagcagcac

SEQ ID NO: 60444 - DNA, 20 bp, human
ggctccagcgcccgggcgga

SEQ ID NO: 60445 - DNA, 20 bp, human
ggtacagccagtttcctccg

SEQ ID NO: 60446 - DNA, 20 bp, human
ggccgcgccggcgaggacat

SEQ ID NO: 60447 - DNA, 20 bp, human
gcccagagcgcggcactcac

SEQ ID NO: 60448 - DNA, 20 bp, human
gtcgccggcgcggctgggtg

SEQ ID NO: 60449 - DNA, 20 bp, human
gggtcactcactctgagtag

SEQ ID NO: 60450 - DNA, 20 bp, human
gcggctgcccatgtcctcgc

SEQ ID NO: 60451 - DNA, 20 bp, human
gcagatggttaacctaccca

SEQ ID NO: 60452 - DNA, 20 bp, human
gctctcaggagataggcgtg

SEQ ID NO: 60453 - DNA, 20 bp, human
gctcactctgagtagtgggt

SEQ ID NO: 60454 - DNA, 20 bp, human
gcgcccgcggcatgtcacat

SEQ ID NO: 60455 - DNA, 20 bp, human
gcacggattgccaggggtaa

SEQ ID NO: 60456 - DNA, 20 bp, human
gttattgtctgagccaggaa

SEQ ID NO: 60457 - DNA, 20 bp, human
gagccaggaagggggccatc

SEQ ID NO: 60458 - DNA, 20 bp, human
gtctgcagtcgcagttggag

SEQ ID NO: 60459 - DNA, 20 bp, human
ggggggccatcaggttcaac

SEQ ID NO: 60460 - DNA, 20 bp, human
gatacgacaagttctaataa

SEQ ID NO: 60461 - DNA, 20 bp, human
gaggaaccatgataaactca

SEQ ID NO: 60462 - DNA, 20 bp, human
gcttggttattgtctgagcc

SEQ ID NO: 60463 - DNA, 20 bp, human
ggttcctctgcagtcgcagt

SEQ ID NO: 60464 - DNA, 20 bp, human
gctgcaccttgagtttatca

SEQ ID NO: 60465 - DNA, 20 bp, human
gttgccaagacagaacaaac

SEQ ID NO: 60466 - DNA, 20 bp, human
gaccaaccagtttgatgact

SEQ ID NO: 60467 - DNA, 20 bp, human
gttagtctctcatctttcct

SEQ ID NO: 60468 - DNA, 20 bp, human
gggagcaggcggcctcccgg

SEQ ID NO: 60469 - DNA, 20 bp, human
gaacacaccacggaggagtg

SEQ ID NO: 60470 - DNA, 20 bp, human
gctcccaggaccggcgtgca

SEQ ID NO: 60471 - DNA, 20 bp, human
ggggctcccgcacccccggg

SEQ ID NO: 60472 - DNA, 20 bp, human
gactccagctccctacagtc

SEQ ID NO: 60473 - DNA, 20 bp, human
gtgccctgcacgccggtcct

SEQ ID NO: 60474 - DNA, 20 bp, human
gcaaatggaacacaccacgg

SEQ ID NO: 60475 - DNA, 20 bp, human
gaagtaggtgccggactgta

SEQ ID NO: 60476 - DNA, 20 bp, human
gtctcgtgggaggaagtcca

SEQ ID NO: 60477 - DNA, 20 bp, human
gctgggaggcaaaccttcgg

SEQ ID NO: 60478 - DNA, 20 bp, human
gccgctgggaaaagtctcgt

SEQ ID NO: 60479 - DNA, 20 bp, human
gttcctgggaggcaaacctt

SEQ ID NO: 60480 - DNA, 20 bp, human
gcggcggacgggagggatag

SEQ ID NO: 60481 - DNA, 20 bp, human
gatcccgcctgcgctcccaa

SEQ ID NO: 60482 - DNA, 20 bp, human
gcaggcgcttgctgcttcct

SEQ ID NO: 60483 - DNA, 20 bp, human
gcctcggcgcactcctacac

SEQ ID NO: 60484 - DNA, 20 bp, human
gcggcttggggcaagtaagt

SEQ ID NO: 60485 - DNA, 20 bp, human
gctgggaaaagtctcgtggg

SEQ ID NO: 60486 - DNA, 20 bp, human
gacacacacagcgagcgggc

SEQ ID NO: 60487 - DNA, 20 bp, human
gtcggagatgacccgcaggt

SEQ ID NO: 60488 - DNA, 20 bp, human
gcgctgtgccgcagcaccag

SEQ ID NO: 60489 - DNA, 20 bp, human
ggccagcccaggtccaggtc

SEQ ID NO: 60490 - DNA, 20 bp, human
gagagctgaagctgccgtgg

SEQ ID NO: 60491 - DNA, 20 bp, human
ggtcatgtagtccacatcca

SEQ ID NO: 60492 - DNA, 20 bp, human
gagagcaggctgaggcggtc

SEQ ID NO: 60493 - DNA, 20 bp, human
ggtgagctctcccgccacca

SEQ ID NO: 60494 - DNA, 20 bp, human
gtgccacacacacagcgagc

SEQ ID NO: 60495 - DNA, 20 bp, human
ggtctatgtcagaggccatg

SEQ ID NO: 60496 - DNA, 20 bp, human
gccctcggacagcagagcca

SEQ ID NO: 60497 - DNA, 20 bp, human
gctggcgaaggtggccccta

SEQ ID NO: 60498 - DNA, 20 bp, human
ggccagccaagctccaacag

SEQ ID NO: 60499 - DNA, 20 bp, human
gccgcacggcgacaggcagg

SEQ ID NO: 60500 - DNA, 20 bp, human
gtcgagtccgagcgccgcca

SEQ ID NO: 60501 - DNA, 20 bp, human
gtctaccagggcgcctaccg

SEQ ID NO: 60502 - DNA, 20 bp, human
ggccatggctctgctgtccg

SEQ ID NO: 60503 - DNA, 20 bp, human
ggctggcccgccttctacca

SEQ ID NO: 60504 - DNA, 20 bp, human
gacggcgacaggcaggcggc

SEQ ID NO: 60505 - DNA, 20 bp, human
gaatggcgtgcacctcatcg

SEQ ID NO: 60506 - DNA, 20 bp, human
gctgcccgcgtccacatcgg

SEQ ID NO: 60507 - DNA, 20 bp, human
gggagccaccaccaccgatg

SEQ ID NO: 60508 - DNA, 20 bp, human
ggaccctacgtggccatccg

SEQ ID NO: 60509 - DNA, 20 bp, human
gctgataggcagaccctacg

SEQ ID NO: 60510 - DNA, 20 bp, human
gaggctgcccgcgtccacat

SEQ ID NO: 60511 - DNA, 20 bp, human
gggccatccgaggcctccgg

SEQ ID NO: 60512 - DNA, 20 bp, human
gcgtgattgtcagaacagtg

SEQ ID NO: 60513 - DNA, 20 bp, human
gggcctcggatggccacgta

SEQ ID NO: 60514 - DNA, 20 bp, human
gggccctgcagatgtccaaa

SEQ ID NO: 60515 - DNA, 20 bp, human
gctcggaatatagaaagccg

SEQ ID NO: 60516 - DNA, 20 bp, human
gccgtccagcccaggtccag

SEQ ID NO: 60517 - DNA, 20 bp, human
gcgcacctggagccgccgag

SEQ ID NO: 60518 - DNA, 20 bp, human
ggctgtgggacctcggaccg

SEQ ID NO: 60519 - DNA, 20 bp, human
gtaccgcgagcggctcaagg

SEQ ID NO: 60520 - DNA, 20 bp, human
gcacccgcccaaggacgaga

SEQ ID NO: 60521 - DNA, 20 bp, human
gagaggaggcacctcggtgt

SEQ ID NO: 60522 - DNA, 20 bp, human
gggggacggcgtcctcgtag

SEQ ID NO: 60523 - DNA, 20 bp, human
gcctcggtgtcggaacggtc

SEQ ID NO: 60524 - DNA, 20 bp, human
gcgccggcgccggctgagtc

SEQ ID NO: 60525 - DNA, 20 bp, human
gacctgggctggacggacac

SEQ ID NO: 60526 - DNA, 20 bp, human
gccgctcggtaagcaagtcc

SEQ ID NO: 60527 - DNA, 20 bp, human
gatgggttccctgcacgtag

SEQ ID NO: 60528 - DNA, 20 bp, human
gagcggtgggccacgtccca

SEQ ID NO: 60529 - DNA, 20 bp, human
ggcgagacccgggatccggg

SEQ ID NO: 60530 - DNA, 20 bp, human
gtgggatgggaagaaagtaa

SEQ ID NO: 60531 - DNA, 20 bp, human
ggcggagcggggcgcacacg

SEQ ID NO: 60532 - DNA, 20 bp, human
gaagtaagggatcggaacag

SEQ ID NO: 60533 - DNA, 20 bp, human
gacagcggtgagggagcggt

SEQ ID NO: 60534 - DNA, 20 bp, human
ggggcttccgggtaagggag

SEQ ID NO: 60535 - DNA, 20 bp, human
gcggggccgggaactcaggt

SEQ ID NO: 60536 - DNA, 20 bp, human
gggccgcgcgacccagagag

SEQ ID NO: 60537 - DNA, 20 bp, human
gggagccgaccgccgcccag

SEQ ID NO: 60538 - DNA, 20 bp, human
gcgcgcgacccagagagggg

SEQ ID NO: 60539 - DNA, 20 bp, human
gcctcgcggtccggtcggtc

SEQ ID NO: 60540 - DNA, 20 bp, human
gcgcggcctagctggagtct

SEQ ID NO: 60541 - DNA, 20 bp, human
ggagtggctgccggaccgac

SEQ ID NO: 60542 - DNA, 20 bp, human
ggcggccccggcccaggtgt

SEQ ID NO: 60543 - DNA, 20 bp, human
gtggccaccccagtccacgg

SEQ ID NO: 60544 - DNA, 20 bp, human
gaccggaccgcgaggccgct

SEQ ID NO: 60545 - DNA, 20 bp, human
gccgcgaggccgctgggcgg

SEQ ID NO: 60546 - DNA, 20 bp, human
gccgagccgggactgtccag

SEQ ID NO: 60547 - DNA, 20 bp, human
gtcgggagcagggaaatcac

SEQ ID NO: 60548 - DNA, 20 bp, human
gcgcagacctggaggcgcac

SEQ ID NO: 60549 - DNA, 20 bp, human
gccagtgggagcaggcgccc

SEQ ID NO: 60550 - DNA, 20 bp, human
gggccaatgggactgcgcca

SEQ ID NO: 60551 - DNA, 20 bp, human
gtccaggtctgcgctggccg

SEQ ID NO: 60552 - DNA, 20 bp, human
gatgggactgcgccagggcg

SEQ ID NO: 60553 - DNA, 20 bp, human
ggagcagggaaatcacgggt

SEQ ID NO: 60554 - DNA, 20 bp, human
gcgagccgaatcgtgcggtg

SEQ ID NO: 60555 - DNA, 20 bp, human
gtgggaaagcagagccgagc

SEQ ID NO: 60556 - DNA, 20 bp, human
gagcgcagcgggcagactag

SEQ ID NO: 60557 - DNA, 20 bp, human
gctcagagcgcgacctggac

SEQ ID NO: 60558 - DNA, 20 bp, human
gccgcgccccgagacttcta

SEQ ID NO: 60559 - DNA, 20 bp, human
gcgctgcaggtgagccaggt

SEQ ID NO: 60560 - DNA, 20 bp, human
gccgggcgagcaacaagcac

SEQ ID NO: 60561 - DNA, 20 bp, human
gacaggtgagtcaccctacc

SEQ ID NO: 60562 - DNA, 20 bp, human
gaggatctcagagcgcgacc

SEQ ID NO: 60563 - DNA, 20 bp, human
ggcggcaacagctcccgctt

SEQ ID NO: 60564 - DNA, 20 bp, human
gcaacaagcaccggagctgg

SEQ ID NO: 60565 - DNA, 20 bp, human
gttgctcgcccggcccaagc

SEQ ID NO: 60566 - DNA, 20 bp, human
gcaggttagttataaatcct

SEQ ID NO: 60567 - DNA, 20 bp, human
ggattttccttgtctcatgc

SEQ ID NO: 60568 - DNA, 20 bp, human
ggactccatctcaggataca

SEQ ID NO: 60569 - DNA, 20 bp, human
gggacttgctgtggatcctc

SEQ ID NO: 60570 - DNA, 20 bp, human
gcctgagatggagtcacctg

SEQ ID NO: 60571 - DNA, 20 bp, human
ggcaagtcctaaccagggat

SEQ ID NO: 60572 - DNA, 20 bp, human
gccacagcaagtcctaacca

SEQ ID NO: 60573 - DNA, 20 bp, human
gcagtccctgtatcctgaga

SEQ ID NO: 60574 - DNA, 20 bp, human
ggattgaagaaggacgctag

SEQ ID NO: 60575 - DNA, 20 bp, human
gtgtttttaggcagaatcaa

SEQ ID NO: 60576 - DNA, 20 bp, human
ggtcaggaggaacgtcgtgg

SEQ ID NO: 60577 - DNA, 20 bp, human
gtggggcaggtcctgggtag

SEQ ID NO: 60578 - DNA, 20 bp, human
gcctgggctcccgccggtca

SEQ ID NO: 60579 - DNA, 20 bp, human
gggggtcaggaggaacgtcg

SEQ ID NO: 60580 - DNA, 20 bp, human
ggccaggatgattgttatga

SEQ ID NO: 60581 - DNA, 20 bp, human
gtgacccccgggggaccccc

SEQ ID NO: 60582 - DNA, 20 bp, human
ggccctcataacaatcatcc

SEQ ID NO: 60583 - DNA, 20 bp, human
gcgttcctcctgacccccgg

SEQ ID NO: 60584 - DNA, 20 bp, human
ggggtcccccgggggtcagg

SEQ ID NO: 60585 - DNA, 20 bp, human
ggcagcgttgccggcagacc

SEQ ID NO: 60586 - DNA, 20 bp, human
ggctagcggagaggtccgcg

SEQ ID NO: 60587 - DNA, 20 bp, human
gttaaagacagtaatccttc

SEQ ID NO: 60588 - DNA, 20 bp, human
gggcggggcctcagccttgc

SEQ ID NO: 60589 - DNA, 20 bp, human
gcaccgcgctcagtaggacg

SEQ ID NO: 60590 - DNA, 20 bp, human
gtgccagcggaaggagcgca

SEQ ID NO: 60591 - DNA, 20 bp, human
gacctgaccggcgagagccc

SEQ ID NO: 60592 - DNA, 20 bp, human
gccagcccgcggggcaagaa

SEQ ID NO: 60593 - DNA, 20 bp, human
gcgtgtgcctcccaagacgg

SEQ ID NO: 60594 - DNA, 20 bp, human
gccgcccacctgccagcgga

SEQ ID NO: 60595 - DNA, 20 bp, human
gcctggtcaccgcgctcagt

SEQ ID NO: 60596 - DNA, 20 bp, human
gggagcccgaaagggcgggt

SEQ ID NO: 60597 - DNA, 20 bp, human
ggggccgcggcgcgatgagt

SEQ ID NO: 60598 - DNA, 20 bp, human
gccgcgggggttccaatcgt

SEQ ID NO: 60599 - DNA, 20 bp, human
ggagcacgcgagaaaaatgg

SEQ ID NO: 60600 - DNA, 20 bp, human
ggcggaggagcccgaaaggg

SEQ ID NO: 60601 - DNA, 20 bp, human
ggagcggcgtccaggttggg

SEQ ID NO: 60602 - DNA, 20 bp, human
ggccttggttcgctgcagcg

SEQ ID NO: 60603 - DNA, 20 bp, human
ggggcaacggcgcggtccgg

SEQ ID NO: 60604 - DNA, 20 bp, human
ggccccgctgcagcgaacca

SEQ ID NO: 60605 - DNA, 20 bp, human
ggccagagcggcgtccaggt

SEQ ID NO: 60606 - DNA, 20 bp, human
ggccgcgctgcgcaaggaga

SEQ ID NO: 60607 - DNA, 20 bp, human
gacaaagcgaggcctgcggg

SEQ ID NO: 60608 - DNA, 20 bp, human
ggcccgggcggagcgttgga

SEQ ID NO: 60609 - DNA, 20 bp, human
ggcgctgagtcgaggttgac

SEQ ID NO: 60610 - DNA, 20 bp, human
gggacttgcaggcaccagtt

SEQ ID NO: 60611 - DNA, 20 bp, human
ggcccccgctcgcattaagg

SEQ ID NO: 60612 - DNA, 20 bp, human
gggcaccagttgggttgcaa

SEQ ID NO: 60613 - DNA, 20 bp, human
gcgaggttgacaggacgacg

SEQ ID NO: 60614 - DNA, 20 bp, human
gtccctccaacgctccgccc

SEQ ID NO: 60615 - DNA, 20 bp, human
gcgcccggcgcctctgccga

SEQ ID NO: 60616 - DNA, 20 bp, human
gggttgctgcggtggtgacg

SEQ ID NO: 60617 - DNA, 20 bp, human
gtcggcctgggggtcgtcgc

SEQ ID NO: 60618 - DNA, 20 bp, human
gagggaaacggagcagtgac

SEQ ID NO: 60619 - DNA, 20 bp, human
gctcccgggcaggacgatgg

SEQ ID NO: 60620 - DNA, 20 bp, human
gtcgcctcagcagcaccctc

SEQ ID NO: 60621 - DNA, 20 bp, human
ggagcgcccgcgagtactcc

SEQ ID NO: 60622 - DNA, 20 bp, human
gggtgctgctgaggcgacga

SEQ ID NO: 60623 - DNA, 20 bp, human
gtgaggcgacgatggccgag

SEQ ID NO: 60624 - DNA, 20 bp, human
ggccacgagagagaccagct

SEQ ID NO: 60625 - DNA, 20 bp, human
gatcgtcctgcccgggaggg

SEQ ID NO: 60626 - DNA, 20 bp, human
gctcgggcttgaaaacatgg

SEQ ID NO: 60627 - DNA, 20 bp, human
gggcctcgggcttgaaaaca

SEQ ID NO: 60628 - DNA, 20 bp, human
gtgatctgggggctgtgtca

SEQ ID NO: 60629 - DNA, 20 bp, human
gaagatgactcagtgaggag

SEQ ID NO: 60630 - DNA, 20 bp, human
gacacagcccccagatcaca

SEQ ID NO: 60631 - DNA, 20 bp, human
gggggctgtgtcagggcagc

SEQ ID NO: 60632 - DNA, 20 bp, human
gggaaaagcagaagcggtgt

SEQ ID NO: 60633 - DNA, 20 bp, human
gcctgcgccatgtgatctgg

SEQ ID NO: 60634 - DNA, 20 bp, human
ggaacctgcgccatgtgatc

SEQ ID NO: 60635 - DNA, 20 bp, human
gaggtgcagggctatgcgtc

SEQ ID NO: 60636 - DNA, 20 bp, human
gcaagagcagcagcgattgg

SEQ ID NO: 60637 - DNA, 20 bp, human
ggtccgtctccccaagacca

SEQ ID NO: 60638 - DNA, 20 bp, human
gcgggcggcgctgaactgtc

SEQ ID NO: 60639 - DNA, 20 bp, human
gcaagaccacggaggagtaa

SEQ ID NO: 60640 - DNA, 20 bp, human
gcgtctccccaagaccacgg

SEQ ID NO: 60641 - DNA, 20 bp, human
gtgtactcggttggcccggg

SEQ ID NO: 60642 - DNA, 20 bp, human
gtcgctgctgctcttgtact

SEQ ID NO: 60643 - DNA, 20 bp, human
gtcttgtactcggttggccc

SEQ ID NO: 60644 - DNA, 20 bp, human
gtttccggcggcccgaaact

SEQ ID NO: 60645 - DNA, 20 bp, human
gacggattcggcccgcccag

SEQ ID NO: 60646 - DNA, 20 bp, human
gggcagtgcggaagcctagg

SEQ ID NO: 60647 - DNA, 20 bp, human
gctcactatccggactgtgt

SEQ ID NO: 60648 - DNA, 20 bp, human
ggaaaaggcccaggccgggt

SEQ ID NO: 60649 - DNA, 20 bp, human
gtagtgaggtcaggacccca

SEQ ID NO: 60650 - DNA, 20 bp, human
ggcagccacctccccagtta

SEQ ID NO: 60651 - DNA, 20 bp, human
gttgcgggggcccaaggacg

SEQ ID NO: 60652 - DNA, 20 bp, human
gcgggctttcaggctcccgg

SEQ ID NO: 60653 - DNA, 20 bp, human
gactggggaggtggctgctc

SEQ ID NO: 60654 - DNA, 20 bp, human
gactgtgtaggcacaggaaa

SEQ ID NO: 60655 - DNA, 20 bp, human
ggagacccggtggcgtgggt

SEQ ID NO: 60656 - DNA, 20 bp, human
gactgggtccccacagaagg

SEQ ID NO: 60657 - DNA, 20 bp, human
gccatcgcctagcaaccggg

SEQ ID NO: 60658 - DNA, 20 bp, human
gatgctggagaagcagacgg

SEQ ID NO: 60659 - DNA, 20 bp, human
gttccaggtggaggcgagaa

SEQ ID NO: 60660 - DNA, 20 bp, human
gtcgctgcctgtgtatctgg

SEQ ID NO: 60661 - DNA, 20 bp, human
gggggcaccaacaaagatga

SEQ ID NO: 60662 - DNA, 20 bp, human
ggtgagagcagggatggcat

SEQ ID NO: 60663 - DNA, 20 bp, human
gaggtggaggcaccgtggga

SEQ ID NO: 60664 - DNA, 20 bp, human
gccaggcctcccccttctgt

SEQ ID NO: 60665 - DNA, 20 bp, human
gtcttccctgagctggatgg

SEQ ID NO: 60666 - DNA, 20 bp, human
gcgaggctgctgagagacgg

SEQ ID NO: 60667 - DNA, 20 bp, human
gaggaagttgatcaatcccg

SEQ ID NO: 60668 - DNA, 20 bp, human
gtggggcaagccgaacccag

SEQ ID NO: 60669 - DNA, 20 bp, human
ggggtcctaagtcacgtggg

SEQ ID NO: 60670 - DNA, 20 bp, human
gtgggctcttcgtaaacctg

SEQ ID NO: 60671 - DNA, 20 bp, human
gttgggacagtcgccaggga

SEQ ID NO: 60672 - DNA, 20 bp, human
ggagagacggtggcgcgatt

SEQ ID NO: 60673 - DNA, 20 bp, human
gtaagtcacgtggggggtgt

SEQ ID NO: 60674 - DNA, 20 bp, human
gtgggccgagacaagcctaa

SEQ ID NO: 60675 - DNA, 20 bp, human
gtcggggtcctaagtcacgt

SEQ ID NO: 60676 - DNA, 20 bp, human
ggcacgcctgctaggatcag

SEQ ID NO: 60677 - DNA, 20 bp, human
gcagagcgctggtagatgag

SEQ ID NO: 60678 - DNA, 20 bp, human
gcaggtgagtcacttccgag

SEQ ID NO: 60679 - DNA, 20 bp, human
gcgcctgctaggatcagcgg

SEQ ID NO: 60680 - DNA, 20 bp, human
ggtggtggttccgcgatggt

SEQ ID NO: 60681 - DNA, 20 bp, human
ggtggttccgcgatggtagg

SEQ ID NO: 60682 - DNA, 20 bp, human
gccgccgccgcctaccatcg

SEQ ID NO: 60683 - DNA, 20 bp, human
ggttccgcgatggtaggcgg

SEQ ID NO: 60684 - DNA, 20 bp, human
gctgctaggatcagcggtgg

SEQ ID NO: 60685 - DNA, 20 bp, human
ggagcatccactgacgctag

SEQ ID NO: 60686 - DNA, 20 bp, human
gagagaagctcggggagtgg

SEQ ID NO: 60687 - DNA, 20 bp, human
gacgcgttgccggcgaagag

SEQ ID NO: 60688 - DNA, 20 bp, human
ggagctagcagtgcagacag

SEQ ID NO: 60689 - DNA, 20 bp, human
gagaggggagcctgacgact

SEQ ID NO: 60690 - DNA, 20 bp, human
gaagcgaggagagaagctcg

SEQ ID NO: 60691 - DNA, 20 bp, human
ggtcaggctcccctcttcgc

SEQ ID NO: 60692 - DNA, 20 bp, human
gaggaggaggggctcaagat

SEQ ID NO: 60693 - DNA, 20 bp, human
gagcatggagtgtgacctca

SEQ ID NO: 60694 - DNA, 20 bp, human
gggagtcgttggaagatcta

SEQ ID NO: 60695 - DNA, 20 bp, human
gttagagttgaggggttaag

SEQ ID NO: 60696 - DNA, 20 bp, human
gcaaaggaccatgagagggc

SEQ ID NO: 60697 - DNA, 20 bp, human
ggtccccaaccgacgatgga

SEQ ID NO: 60698 - DNA, 20 bp, human
ggcacgtctccctccatcgt

SEQ ID NO: 60699 - DNA, 20 bp, human
gaccatgagagggccggagc

SEQ ID NO: 60700 - DNA, 20 bp, human
gccgggtccccaaccgacga

SEQ ID NO: 60701 - DNA, 20 bp, human
ggtcggcgccggagggatcg

SEQ ID NO: 60702 - DNA, 20 bp, human
gcccggctccggccctctca

SEQ ID NO: 60703 - DNA, 20 bp, human
gggacacactggaggcgctg

SEQ ID NO: 60704 - DNA, 20 bp, human
ggccgacggagttaagcggg

SEQ ID NO: 60705 - DNA, 20 bp, human
gggagcggcccttctagcac

SEQ ID NO: 60706 - DNA, 20 bp, human
gccagggcctgcgaggacag

SEQ ID NO: 60707 - DNA, 20 bp, human
ggcggtgaaggcggaagcgt

SEQ ID NO: 60708 - DNA, 20 bp, human
gcgagaccacactttcatgg

SEQ ID NO: 60709 - DNA, 20 bp, human
gtgcgaggacaggggtgtca

SEQ ID NO: 60710 - DNA, 20 bp, human
gtgaaggcggaagcgtggga

SEQ ID NO: 60711 - DNA, 20 bp, human
gactttcatggaggcggtga

SEQ ID NO: 60712 - DNA, 20 bp, human
gcggtaaacacggagcggga

SEQ ID NO: 60713 - DNA, 20 bp, human
ggcgccggcgacggtaaaca

SEQ ID NO: 60714 - DNA, 20 bp, human
gccgctgcctcggtccccac

SEQ ID NO: 60715 - DNA, 20 bp, human
gggcgacggtaaacacggag

SEQ ID NO: 60716 - DNA, 20 bp, human
gtgtgaggaagcggcatcag

SEQ ID NO: 60717 - DNA, 20 bp, human
gggccggctgacctgcacac

SEQ ID NO: 60718 - DNA, 20 bp, human
ggcttcctcacagaacctgc

SEQ ID NO: 60719 - DNA, 20 bp, human
gaagtcccggggacactcct

SEQ ID NO: 60720 - DNA, 20 bp, human
ggcatgtgtgcagtgggtag

SEQ ID NO: 60721 - DNA, 20 bp, human
gcacacatgcacaagtcccg

SEQ ID NO: 60722 - DNA, 20 bp, human
gcagggtgtgaagcgctgag

SEQ ID NO: 60723 - DNA, 20 bp, human
gtggactccaaagccaagaa

SEQ ID NO: 60724 - DNA, 20 bp, human
gtttttctaagagagcgtcg

SEQ ID NO: 60725 - DNA, 20 bp, human
gtctcgggctgcccgtgtgc

SEQ ID NO: 60726 - DNA, 20 bp, human
gcgggccctagggatcaccc

SEQ ID NO: 60727 - DNA, 20 bp, human
ggctgcctgggtgatcccta

SEQ ID NO: 60728 - DNA, 20 bp, human
gaggccctgagggtgggcta

SEQ ID NO: 60729 - DNA, 20 bp, human
gggccgagggggggagaagt

SEQ ID NO: 60730 - DNA, 20 bp, human
ggccccagcgtcgtcgcctg

SEQ ID NO: 60731 - DNA, 20 bp, human
ggccccaggcgacgacgctg

SEQ ID NO: 60732 - DNA, 20 bp, human
ggcgccctcaaagaacctgc

SEQ ID NO: 60733 - DNA, 20 bp, human
gccgccgacctgtgaggaaa

SEQ ID NO: 60734 - DNA, 20 bp, human
gaggaccctcccgggcccta

SEQ ID NO: 60735 - DNA, 20 bp, human
gcgcaggcacgaggccctct

SEQ ID NO: 60736 - DNA, 20 bp, human
gctcctgcccacaggatccg

SEQ ID NO: 60737 - DNA, 20 bp, human
gaaccagccacggatcctgt

SEQ ID NO: 60738 - DNA, 20 bp, human
gggttgtcctgggaagctag

SEQ ID NO: 60739 - DNA, 20 bp, human
gtagaggcgatccccgaacc

SEQ ID NO: 60740 - DNA, 20 bp, human
ggtccctcgataaaatggtc

SEQ ID NO: 60741 - DNA, 20 bp, human
gcgataaaatggtcaggaac

SEQ ID NO: 60742 - DNA, 20 bp, human
gtgcccacaggatccgtggc

SEQ ID NO: 60743 - DNA, 20 bp, human
gcagagcagctcttctccat

SEQ ID NO: 60744 - DNA, 20 bp, human
gagggccttaggcttccccg

SEQ ID NO: 60745 - DNA, 20 bp, human
gataaattgagcctccaact

SEQ ID NO: 60746 - DNA, 20 bp, human
gccgagggcgtctcacctga

SEQ ID NO: 60747 - DNA, 20 bp, human
gtcagaggacctgcagaggc

SEQ ID NO: 60748 - DNA, 20 bp, human
gggccctcggaggagcttcg

SEQ ID NO: 60749 - DNA, 20 bp, human
gcctctgagggagcaacatc

SEQ ID NO: 60750 - DNA, 20 bp, human
gtgggtcctggggaccactc

SEQ ID NO: 60751 - DNA, 20 bp, human
ggctgctctcgtgagaacag

SEQ ID NO: 60752 - DNA, 20 bp, human
gacgcacctgtttctgacag

SEQ ID NO: 60753 - DNA, 20 bp, human
ggggccaggctctgtcccaa

SEQ ID NO: 60754 - DNA, 20 bp, human
gttccccgcatccccaccga

SEQ ID NO: 60755 - DNA, 20 bp, human
gaggtgagacgccctcggtg

SEQ ID NO: 60756 - DNA, 20 bp, human
gcgagggaaggaggacgcga

SEQ ID NO: 60757 - DNA, 20 bp, human
ggtgacagggcaccgaggga

SEQ ID NO: 60758 - DNA, 20 bp, human
gcgagggcagccaggcccta

SEQ ID NO: 60759 - DNA, 20 bp, human
ggtggccgcgcggggatctt

SEQ ID NO: 60760 - DNA, 20 bp, human
gttgggtgacagggcaccga

SEQ ID NO: 60761 - DNA, 20 bp, human
ggacagagctgggcttgtaa

SEQ ID NO: 60762 - DNA, 20 bp, human
gacagggcaccgagggaagg

SEQ ID NO: 60763 - DNA, 20 bp, human
gccaggtgggaggtgcgagg

SEQ ID NO: 60764 - DNA, 20 bp, human
gctccctgctccctagggcc

SEQ ID NO: 60765 - DNA, 20 bp, human
gcgatgcccgcaccataggc

SEQ ID NO: 60766 - DNA, 20 bp, human
ggagttcgggacccacgagt

SEQ ID NO: 60767 - DNA, 20 bp, human
ggggacccacgagtcggaca

SEQ ID NO: 60768 - DNA, 20 bp, human
gaaggccatgtccgactcgt

SEQ ID NO: 60769 - DNA, 20 bp, human
gttggcgcctacagccccgg

SEQ ID NO: 60770 - DNA, 20 bp, human
ggccttggcgcctacagccc

SEQ ID NO: 60771 - DNA, 20 bp, human
gcggggaagacggcccagga

SEQ ID NO: 60772 - DNA, 20 bp, human
gctggccgcagccaatagga

SEQ ID NO: 60773 - DNA, 20 bp, human
ggcaggtctcgggaaactaa

SEQ ID NO: 60774 - DNA, 20 bp, human
gaccccaggcccgcctgaca

SEQ ID NO: 60775 - DNA, 20 bp, human
gctcggcccaggccctccgg

SEQ ID NO: 60776 - DNA, 20 bp, human
ggcgtcgaacgcagaggagg

SEQ ID NO: 60777 - DNA, 20 bp, human
gcggaggccccacgtcgata

SEQ ID NO: 60778 - DNA, 20 bp, human
gcaacgcagcggcaacatac

SEQ ID NO: 60779 - DNA, 20 bp, human
gtgcccccggcccctagcag

SEQ ID NO: 60780 - DNA, 20 bp, human
gcgcagcggcaacataccgg

SEQ ID NO: 60781 - DNA, 20 bp, human
ggctgcgttgaggtaggatg

SEQ ID NO: 60782 - DNA, 20 bp, human
gtggataccgtatcgacgtg

SEQ ID NO: 60783 - DNA, 20 bp, human
gagcgcgctggcgggaggtt

SEQ ID NO: 60784 - DNA, 20 bp, human
gtagttgtgttcagccgggg

SEQ ID NO: 60785 - DNA, 20 bp, human
gctcccaggatgcagcgcgc

SEQ ID NO: 60786 - DNA, 20 bp, human
gtcccgcggtcgcccggcag

SEQ ID NO: 60787 - DNA, 20 bp, human
gggtctggccgacacgtcag

SEQ ID NO: 60788 - DNA, 20 bp, human
gcggaagggagcccccggag

SEQ ID NO: 60789 - DNA, 20 bp, human
ggagggcgaccggctcaaag

SEQ ID NO: 60790 - DNA, 20 bp, human
gagccaccgcccgggatctg

SEQ ID NO: 60791 - DNA, 20 bp, human
gaggccgcagaacgcagcga

SEQ ID NO: 60792 - DNA, 20 bp, human
gcacggctcccacgagtccg

SEQ ID NO: 60793 - DNA, 20 bp, human
gggacgaggccagctgtaga

SEQ ID NO: 60794 - DNA, 20 bp, human
ggcgaggaccacccggtaag

SEQ ID NO: 60795 - DNA, 20 bp, human
ggacacgtcagcggcgagag

SEQ ID NO: 60796 - DNA, 20 bp, human
ggaaagtcgaaaactacggg

SEQ ID NO: 60797 - DNA, 20 bp, human
gcgggaaagtcgaaaactac

SEQ ID NO: 60798 - DNA, 20 bp, human
gcggtgagtaagtggagcaa

SEQ ID NO: 60799 - DNA, 20 bp, human
gcttagagattaggccgcag

SEQ ID NO: 60800 - DNA, 20 bp, human
gcgaaaactacgggcggcga

SEQ ID NO: 60801 - DNA, 20 bp, human
gcggcccggacttagagatt

SEQ ID NO: 60802 - DNA, 20 bp, human
gatcgccgcttcggttaata

SEQ ID NO: 60803 - DNA, 20 bp, human
gttatccgtattaaccgaag

SEQ ID NO: 60804 - DNA, 20 bp, human
gtaaaatgcggaaacgagaa

SEQ ID NO: 60805 - DNA, 20 bp, human
gggaagttggcgtcacgtca

SEQ ID NO: 60806 - DNA, 20 bp, human
gctggctgaggcggacgatg

SEQ ID NO: 60807 - DNA, 20 bp, human
gagccccgggcccggatggt

SEQ ID NO: 60808 - DNA, 20 bp, human
gctcctgggtccctatccgg

SEQ ID NO: 60809 - DNA, 20 bp, human
ggacgatgcggtgggaacct

SEQ ID NO: 60810 - DNA, 20 bp, human
gtattcggcagaaccaacat

SEQ ID NO: 60811 - DNA, 20 bp, human
ggttgacagtgacttctggg

SEQ ID NO: 60812 - DNA, 20 bp, human
gcgaagaggtgcagggacct

SEQ ID NO: 60813 - DNA, 20 bp, human
gcagaaggttctggctgagg

SEQ ID NO: 60814 - DNA, 20 bp, human
gcagtgacttctgggcggtg

SEQ ID NO: 60815 - DNA, 20 bp, human
gctcacctgctgaactctga

SEQ ID NO: 60816 - DNA, 20 bp, human
ggaacggctgcggcttcggg

SEQ ID NO: 60817 - DNA, 20 bp, human
gttgggagaccggagaaacc

SEQ ID NO: 60818 - DNA, 20 bp, human
ggacagcgcgggaacggctg

SEQ ID NO: 60819 - DNA, 20 bp, human
gctccggtctcccaacgccg

SEQ ID NO: 60820 - DNA, 20 bp, human
gccgcgctgtcggaaaggga

SEQ ID NO: 60821 - DNA, 20 bp, human
ggctgggagcccttcgactg

SEQ ID NO: 60822 - DNA, 20 bp, human
ggccccttagcaggtatggg

SEQ ID NO: 60823 - DNA, 20 bp, human
gctttccgacagcgcgggaa

SEQ ID NO: 60824 - DNA, 20 bp, human
gcgtcaggcccctgcacgac

SEQ ID NO: 60825 - DNA, 20 bp, human
gggaggagccggtcgtgcag

SEQ ID NO: 60826 - DNA, 20 bp, human
gctgcagaagggattccatg

SEQ ID NO: 60827 - DNA, 20 bp, human
ggggtcccaggtgctgacgt

SEQ ID NO: 60828 - DNA, 20 bp, human
gcattcgcacggctctggag

SEQ ID NO: 60829 - DNA, 20 bp, human
gctgaggcaagcgctcccac

SEQ ID NO: 60830 - DNA, 20 bp, human
gtcttggagtgtctcctcat

SEQ ID NO: 60831 - DNA, 20 bp, human
gcacaggctgctgagaaacc

SEQ ID NO: 60832 - DNA, 20 bp, human
gaagctcggaaaagcgatcc

SEQ ID NO: 60833 - DNA, 20 bp, human
ggcggctgcacaaccagtgg

SEQ ID NO: 60834 - DNA, 20 bp, human
gcaaggtgaaagcggaagta

SEQ ID NO: 60835 - DNA, 20 bp, human
gcttggggccgacgagacaa

SEQ ID NO: 60836 - DNA, 20 bp, human
gtctcaacctcgcctctggt

SEQ ID NO: 60837 - DNA, 20 bp, human
ggcccgctcggctctcgcgg

SEQ ID NO: 60838 - DNA, 20 bp, human
gcgcagacccggccaaccag

SEQ ID NO: 60839 - DNA, 20 bp, human
gcacagcctcgagaaagggt

SEQ ID NO: 60840 - DNA, 20 bp, human
gccggggtcgtgtctgactg

SEQ ID NO: 60841 - DNA, 20 bp, human
gcccgccagaccacctctgt

SEQ ID NO: 60842 - DNA, 20 bp, human
ggtggtctggcgggacatgg

SEQ ID NO: 60843 - DNA, 20 bp, human
gaggccacagcctcgagaaa

SEQ ID NO: 60844 - DNA, 20 bp, human
gagtcgcacggccggcggtg

SEQ ID NO: 60845 - DNA, 20 bp, human
gccagaagcggacttaggaa

SEQ ID NO: 60846 - DNA, 20 bp, human
ggtggcggcgttgggttgag

SEQ ID NO: 60847 - DNA, 20 bp, human
ggaaccgcgaaagctgaggc

SEQ ID NO: 60848 - DNA, 20 bp, human
gagccgctctgcagtcacct

SEQ ID NO: 60849 - DNA, 20 bp, human
gacgggtaacggaagtgtgg

SEQ ID NO: 60850 - DNA, 20 bp, human
gacagaaggggctccgactg

SEQ ID NO: 60851 - DNA, 20 bp, human
gccgactgaggcacacccct

SEQ ID NO: 60852 - DNA, 20 bp, human
gagcggctcgcgaggtgctc

SEQ ID NO: 60853 - DNA, 20 bp, human
gtgaagccaagatccgagaa

SEQ ID NO: 60854 - DNA, 20 bp, human
gccgccggcgggaaacgccg

SEQ ID NO: 60855 - DNA, 20 bp, human
ggttacgggtaacggaagtg

SEQ ID NO: 60856 - DNA, 20 bp, human
gtccggacttcgagccatgg

SEQ ID NO: 60857 - DNA, 20 bp, human
gcttcgagccatggcggtga

SEQ ID NO: 60858 - DNA, 20 bp, human
gaccgccatggctcgaagtc

SEQ ID NO: 60859 - DNA, 20 bp, human
gcaaactcggggaagggcta

SEQ ID NO: 60860 - DNA, 20 bp, human
ggcgggacactgaacgaaga

SEQ ID NO: 60861 - DNA, 20 bp, human
gaagaaggaagccaaactcg

SEQ ID NO: 60862 - DNA, 20 bp, human
gctcgcttccgtcaccgcca

SEQ ID NO: 60863 - DNA, 20 bp, human
gttctccggacttcgagcca

SEQ ID NO: 60864 - DNA, 20 bp, human
gtccagcgcggcgaccaccg

SEQ ID NO: 60865 - DNA, 20 bp, human
gggaagccaaactcggggaa

SEQ ID NO: 60866 - DNA, 20 bp, human
gatggggatcggaaccgtag

SEQ ID NO: 60867 - DNA, 20 bp, human
ggaaggaaaccgatggggat

SEQ ID NO: 60868 - DNA, 20 bp, human
gctttcctgaagggaaccag

SEQ ID NO: 60869 - DNA, 20 bp, human
gttaggccgacaaccaccga

SEQ ID NO: 60870 - DNA, 20 bp, human
gtggttgtcggcctaatgag

SEQ ID NO: 60871 - DNA, 20 bp, human
gatctgacagaagccttcgg

SEQ ID NO: 60872 - DNA, 20 bp, human
gagcagcagctcaaccgcta

SEQ ID NO: 60873 - DNA, 20 bp, human
gcgcggcgtacgaggctgag

SEQ ID NO: 60874 - DNA, 20 bp, human
gatgaccacggcggcaataa

SEQ ID NO: 60875 - DNA, 20 bp, human
gtgtcggcctaatgagcgga

SEQ ID NO: 60876 - DNA, 20 bp, human
gagaggcgttaggagtccgg

SEQ ID NO: 60877 - DNA, 20 bp, human
gccgggcctcccttactctg

SEQ ID NO: 60878 - DNA, 20 bp, human
ggccagggccggcgtcgcta

SEQ ID NO: 60879 - DNA, 20 bp, human
ggcctccgcgggcgaacccc

SEQ ID NO: 60880 - DNA, 20 bp, human
ggacaacccggaggcgaagt

SEQ ID NO: 60881 - DNA, 20 bp, human
gaggagtaaatggaaccgtc

SEQ ID NO: 60882 - DNA, 20 bp, human
gagagccccgaggtatgggt

SEQ ID NO: 60883 - DNA, 20 bp, human
gctggagagccccgaggtat

SEQ ID NO: 60884 - DNA, 20 bp, human
gtggagccccagagtaaggg

SEQ ID NO: 60885 - DNA, 20 bp, human
gtaaaatcatgagtaggagg

SEQ ID NO: 60886 - DNA, 20 bp, human
gtcttcagagcgtgggtcac

SEQ ID NO: 60887 - DNA, 20 bp, human
gaattctgtcttcagagcgt

SEQ ID NO: 60888 - DNA, 20 bp, human
gcagacttggtccttttcaa

SEQ ID NO: 60889 - DNA, 20 bp, human
gaaagttcttacctcttgaa

SEQ ID NO: 60890 - DNA, 20 bp, human
gtctgtgaaaaccgttgaaa

SEQ ID NO: 60891 - DNA, 20 bp, human
gttgtcttacgcccttcaag

SEQ ID NO: 60892 - DNA, 20 bp, human
gcttgggtaaaaatcgtatt

SEQ ID NO: 60893 - DNA, 20 bp, human
gctttattttatgtagactt

SEQ ID NO: 60894 - DNA, 20 bp, human
ggcaattatagccggatcag

SEQ ID NO: 60895 - DNA, 20 bp, human
gtttacttcctcaatgggtt

SEQ ID NO: 60896 - DNA, 20 bp, human
gcggcgcagctattgctgga

SEQ ID NO: 60897 - DNA, 20 bp, human
gtcaggcctcgctctcccac

SEQ ID NO: 60898 - DNA, 20 bp, human
ggcgaccggctgctgaagag

SEQ ID NO: 60899 - DNA, 20 bp, human
gcggctgctgaagagcggac

SEQ ID NO: 60900 - DNA, 20 bp, human
ggcgagtgaagagagcgcga

SEQ ID NO: 60901 - DNA, 20 bp, human
gagtgaagagagcgcgacgg

SEQ ID NO: 60902 - DNA, 20 bp, human
gttcagcagccggtcgcggg

SEQ ID NO: 60903 - DNA, 20 bp, human
ggagcccggggagccgcctg

SEQ ID NO: 60904 - DNA, 20 bp, human
gggaccgcgtgggggacgta

SEQ ID NO: 60905 - DNA, 20 bp, human
gcgctagaggtggcgaaggt

SEQ ID NO: 60906 - DNA, 20 bp, human
gcggagccggggaaggtcgg

SEQ ID NO: 60907 - DNA, 20 bp, human
gttcctccagcacgaggatg

SEQ ID NO: 60908 - DNA, 20 bp, human
gggcggagcccgccaaggtg

SEQ ID NO: 60909 - DNA, 20 bp, human
gggcgcgcgggggttgcaaa

SEQ ID NO: 60910 - DNA, 20 bp, human
gcgtttgggagccgaaagac

SEQ ID NO: 60911 - DNA, 20 bp, human
gtatatccggctcggagact

SEQ ID NO: 60912 - DNA, 20 bp, human
ggcgtcggcggagcccgcca

SEQ ID NO: 60913 - DNA, 20 bp, human
gagcgcttcccgtagcctcg

SEQ ID NO: 60914 - DNA, 20 bp, human
gacgattggggtgcagccgg

SEQ ID NO: 60915 - DNA, 20 bp, human
gggtgggtgtgaggccgggt

SEQ ID NO: 60916 - DNA, 20 bp, human
gcgctcgccggcctcagagg

SEQ ID NO: 60917 - DNA, 20 bp, human
gcggcgagcgggaagtgcag

SEQ ID NO: 60918 - DNA, 20 bp, human
gctactcgcgcagggaggag

SEQ ID NO: 60919 - DNA, 20 bp, human
gctgaggtccgagccatcaa

SEQ ID NO: 60920 - DNA, 20 bp, human
ggcgcggtgaacaatgaccg

SEQ ID NO: 60921 - DNA, 20 bp, human
gccgccggcgctgtggaggt

SEQ ID NO: 60922 - DNA, 20 bp, human
gctgcggcggctccctctcc

SEQ ID NO: 60923 - DNA, 20 bp, human
ggctcgggctccgggatcgg

SEQ ID NO: 60924 - DNA, 20 bp, human
gcggcaacttgtgcgagtcc

SEQ ID NO: 60925 - DNA, 20 bp, human
ggggaggagcggcgcaaagc

SEQ ID NO: 60926 - DNA, 20 bp, human
ggacgccgacgcgagtctgg

SEQ ID NO: 60927 - DNA, 20 bp, human
gggccctgccggcctccacg

SEQ ID NO: 60928 - DNA, 20 bp, human
gccggtggggctgtagaccg

SEQ ID NO: 60929 - DNA, 20 bp, human
gctgctgcttgcgactgcgg

SEQ ID NO: 60930 - DNA, 20 bp, human
gcccaccggcctcctccacg

SEQ ID NO: 60931 - DNA, 20 bp, human
gggcgacgccgacgcgagtc

SEQ ID NO: 60932 - DNA, 20 bp, human
gggccgggcgggaccatctc

SEQ ID NO: 60933 - DNA, 20 bp, human
gggcgaggccggtgaggacg

SEQ ID NO: 60934 - DNA, 20 bp, human
gcggctgctgcttgcgactg

SEQ ID NO: 60935 - DNA, 20 bp, human
ggtccctatggcccactctg

SEQ ID NO: 60936 - DNA, 20 bp, human
gcaggctcgttcgctctcac

SEQ ID NO: 60937 - DNA, 20 bp, human
gacctgcgtaggggcctctg

SEQ ID NO: 60938 - DNA, 20 bp, human
ggggagggcggggaaataag

SEQ ID NO: 60939 - DNA, 20 bp, human
gcgcgggtatctctgaagtt

SEQ ID NO: 60940 - DNA, 20 bp, human
gtgggtcccgagcctccggg

SEQ ID NO: 60941 - DNA, 20 bp, human
gctcagggcgacctgcgtag

SEQ ID NO: 60942 - DNA, 20 bp, human
gcagcagccgctccacgcgg

SEQ ID NO: 60943 - DNA, 20 bp, human
gcctggcggacggatatcgg

SEQ ID NO: 60944 - DNA, 20 bp, human
ggccctcccgccgcgtggag

SEQ ID NO: 60945 - DNA, 20 bp, human
gtgctgggtcccgagcctcc

SEQ ID NO: 60946 - DNA, 20 bp, human
gagcacactggaaggagtca

SEQ ID NO: 60947 - DNA, 20 bp, human
gacactggaaggagtcatgg

SEQ ID NO: 60948 - DNA, 20 bp, human
gattgaggcacggtcagcgt

SEQ ID NO: 60949 - DNA, 20 bp, human
gagcgtgtccgggcccgggt

SEQ ID NO: 60950 - DNA, 20 bp, human
gtacgtcgcaacctgcgtga

SEQ ID NO: 60951 - DNA, 20 bp, human
gggagtcatggcggatggtc

SEQ ID NO: 60952 - DNA, 20 bp, human
gtgggtagagggtacgatga

SEQ ID NO: 60953 - DNA, 20 bp, human
gggctggaggcgtctgatgg

SEQ ID NO: 60954 - DNA, 20 bp, human
gcccgtggcaaggggactgt

SEQ ID NO: 60955 - DNA, 20 bp, human
gcacggtcagcgtgggtaga

SEQ ID NO: 60956 - DNA, 20 bp, human
gggtcctacgcgcttcgcta

SEQ ID NO: 60957 - DNA, 20 bp, human
gggaagcatccgggacttca

SEQ ID NO: 60958 - DNA, 20 bp, human
gtagggccgccactcactgt

SEQ ID NO: 60959 - DNA, 20 bp, human
gtcactgtaggtgcggccca

SEQ ID NO: 60960 - DNA, 20 bp, human
ggcgtagggcccaacgtata

SEQ ID NO: 60961 - DNA, 20 bp, human
gacgctcgggatgcaacccc

SEQ ID NO: 60962 - DNA, 20 bp, human
gcacgcttcacgctgacagt

SEQ ID NO: 60963 - DNA, 20 bp, human
gccgcacctacagtgagtgg

SEQ ID NO: 60964 - DNA, 20 bp, human
ggccctacgcctcttctcgg

SEQ ID NO: 60965 - DNA, 20 bp, human
gagaacaggaaggaaacccg

SEQ ID NO: 60966 - DNA, 20 bp, human
gcaccaacccgcgggagaag

SEQ ID NO: 60967 - DNA, 20 bp, human
gagaagaggcagctccgcct

SEQ ID NO: 60968 - DNA, 20 bp, human
gtggagcgcagtggtctccg

SEQ ID NO: 60969 - DNA, 20 bp, human
gtatccccgggactaagacg

SEQ ID NO: 60970 - DNA, 20 bp, human
gacctcaacgtggagcgcag

SEQ ID NO: 60971 - DNA, 20 bp, human
gacggggtaagcctccaccc

SEQ ID NO: 60972 - DNA, 20 bp, human
gtggcacggaacacaccctg

SEQ ID NO: 60973 - DNA, 20 bp, human
gcctttggcttggcttgtca

SEQ ID NO: 60974 - DNA, 20 bp, human
gcccgctcagtacggagttg

SEQ ID NO: 60975 - DNA, 20 bp, human
gcgggtgctcagaacgctgg

SEQ ID NO: 60976 - DNA, 20 bp, human
gcccaggcccaatcctacca

SEQ ID NO: 60977 - DNA, 20 bp, human
gctcagtcctgtagaggctg

SEQ ID NO: 60978 - DNA, 20 bp, human
gtggttgccttggtaggatt

SEQ ID NO: 60979 - DNA, 20 bp, human
gctggaggcaccaggcataa

SEQ ID NO: 60980 - DNA, 20 bp, human
ggcagcggtagtggaggcag

SEQ ID NO: 60981 - DNA, 20 bp, human
gctccgagaggtaagcctgc

SEQ ID NO: 60982 - DNA, 20 bp, human
gtgggcacagaggttggaca

SEQ ID NO: 60983 - DNA, 20 bp, human
ggaagagctgaaacatcccc

SEQ ID NO: 60984 - DNA, 20 bp, human
gggcacagcagtctgccggc

SEQ ID NO: 60985 - DNA, 20 bp, human
gcttcttctcagtcctgtag

SEQ ID NO: 60986 - DNA, 20 bp, human
gggagagcgaggctggagcg

SEQ ID NO: 60987 - DNA, 20 bp, human
ggccgcggtttaaatagcgt

SEQ ID NO: 60988 - DNA, 20 bp, human
gtgaagcgcggcggagaggg

SEQ ID NO: 60989 - DNA, 20 bp, human
gggctgaagcgcggcggaga

SEQ ID NO: 60990 - DNA, 20 bp, human
ggccccgggcgcctccgaag

SEQ ID NO: 60991 - DNA, 20 bp, human
ggccgaggcccagcccgaag

SEQ ID NO: 60992 - DNA, 20 bp, human
gggtccgcggcctcccccac

SEQ ID NO: 60993 - DNA, 20 bp, human
ggcgtcggcgccggcctaga

SEQ ID NO: 60994 - DNA, 20 bp, human
gggcccggccccgtatccag

SEQ ID NO: 60995 - DNA, 20 bp, human
gggctgctcgtacctggtga

SEQ ID NO: 60996 - DNA, 20 bp, human
gcgtccgggcggctatctag

SEQ ID NO: 60997 - DNA, 20 bp, human
gccccccgcggcctcctcat

SEQ ID NO: 60998 - DNA, 20 bp, human
ggcggcggcggcacagaggg

SEQ ID NO: 60999 - DNA, 20 bp, human
ggggaagatggcggactcgg

SEQ ID NO: 61000 - DNA, 20 bp, human
gctccctctcccacaggagg

SEQ ID NO: 61001 - DNA, 20 bp, human
gcggtggctagccgatgagg

SEQ ID NO: 61002 - DNA, 20 bp, human
gactcggtggctagccgatg

SEQ ID NO: 61003 - DNA, 20 bp, human
ggctgggaagatggcggact

SEQ ID NO: 61004 - DNA, 20 bp, human
ggggccccgagaccgactga

SEQ ID NO: 61005 - DNA, 20 bp, human
gggcacagagggtggaacgc

SEQ ID NO: 61006 - DNA, 20 bp, human
gctggcaagtcgggactgtg

SEQ ID NO: 61007 - DNA, 20 bp, human
gttttcgggctggggacata

SEQ ID NO: 61008 - DNA, 20 bp, human
gactgagctgctcaaagtgg

SEQ ID NO: 61009 - DNA, 20 bp, human
gtcccaacacggaacgaaac

SEQ ID NO: 61010 - DNA, 20 bp, human
ggggttcagttgagatacgg

SEQ ID NO: 61011 - DNA, 20 bp, human
ggcccaaccctcatatctca

SEQ ID NO: 61012 - DNA, 20 bp, human
gaaccctgagatatgagggt

SEQ ID NO: 61013 - DNA, 20 bp, human
gtataaaccctgagatatga

SEQ ID NO: 61014 - DNA, 20 bp, human
ggaagggccttgggacccta

SEQ ID NO: 61015 - DNA, 20 bp, human
gctcaatggttagcatagaa

SEQ ID NO: 61016 - DNA, 20 bp, human
gctgctcctgtacgtagtca

SEQ ID NO: 61017 - DNA, 20 bp, human
gaggacgagcttgggcttag

SEQ ID NO: 61018 - DNA, 20 bp, human
gcaagaccgtgactacgtac

SEQ ID NO: 61019 - DNA, 20 bp, human
gtgtgctctaaggtgagtgg

SEQ ID NO: 61020 - DNA, 20 bp, human
ggtcacggtcttgtgctcta

SEQ ID NO: 61021 - DNA, 20 bp, human
ggtgagtggaggacgagctt

SEQ ID NO: 61022 - DNA, 20 bp, human
gcttctcggggaagctgtca

SEQ ID NO: 61023 - DNA, 20 bp, human
gggcaggtagaacggctcag

SEQ ID NO: 61024 - DNA, 20 bp, human
gaaagtctaggatgtgatac

SEQ ID NO: 61025 - DNA, 20 bp, human
gtgagaagcgcagcttctcg

SEQ ID NO: 61026 - DNA, 20 bp, human
gcaatcactccgggtggtcg

SEQ ID NO: 61027 - DNA, 20 bp, human
gccccgcggcgcgttttcct

SEQ ID NO: 61028 - DNA, 20 bp, human
gttgcccggcagagcgcggt

SEQ ID NO: 61029 - DNA, 20 bp, human
ggccgggcaatcactccggg

SEQ ID NO: 61030 - DNA, 20 bp, human
gtctgccgggcaatcactcc

SEQ ID NO: 61031 - DNA, 20 bp, human
gagcgcggtaggtgtcaacg

SEQ ID NO: 61032 - DNA, 20 bp, human
gaccacccggagtgattgcc

SEQ ID NO: 61033 - DNA, 20 bp, human
gggaagcgcctgggcgtcgt

SEQ ID NO: 61034 - DNA, 20 bp, human
gacggaggcccacgacgccc

SEQ ID NO: 61035 - DNA, 20 bp, human
gcgaggttagagcaaggcaa

SEQ ID NO: 61036 - DNA, 20 bp, human
gtgaggctcggagtcgccgg

SEQ ID NO: 61037 - DNA, 20 bp, human
ggcccgcggcgtccccggtt

SEQ ID NO: 61038 - DNA, 20 bp, human
ggcggcggcgacacagatac

SEQ ID NO: 61039 - DNA, 20 bp, human
ggcgccgcaacaccaaaccg

SEQ ID NO: 61040 - DNA, 20 bp, human
ggggcagttggccggaagtg

SEQ ID NO: 61041 - DNA, 20 bp, human
gggccggccgggaggacagg

SEQ ID NO: 61042 - DNA, 20 bp, human
gctgtgaggctcggagtcgc

SEQ ID NO: 61043 - DNA, 20 bp, human
ggcgcagcaggcggaagtag

SEQ ID NO: 61044 - DNA, 20 bp, human
gccaggcctgcgagaggcac

SEQ ID NO: 61045 - DNA, 20 bp, human
gaccaaaccggggacgccgc

SEQ ID NO: 61046 - DNA, 20 bp, human
gctggagccgagaacccgta

SEQ ID NO: 61047 - DNA, 20 bp, human
gccgcaactcctcaactcgg

SEQ ID NO: 61048 - DNA, 20 bp, human
ggggcacgtcctgacaaact

SEQ ID NO: 61049 - DNA, 20 bp, human
gactcggcggctggctgcct

SEQ ID NO: 61050 - DNA, 20 bp, human
gcaggagctgcgcatccctc

SEQ ID NO: 61051 - DNA, 20 bp, human
gagcgagtcgccgcagccgg

SEQ ID NO: 61052 - DNA, 20 bp, human
gtgctcccgggccctcgttc

SEQ ID NO: 61053 - DNA, 20 bp, human
gggacatgctgaagatcccg

SEQ ID NO: 61054 - DNA, 20 bp, human
ggggagcagccaagtttgtc

SEQ ID NO: 61055 - DNA, 20 bp, human
ggcagccagccgccgagttg

SEQ ID NO: 61056 - DNA, 20 bp, human
gtcgtgcggcaggtaccatg

SEQ ID NO: 61057 - DNA, 20 bp, human
gagcccggcgagctcccgga

SEQ ID NO: 61058 - DNA, 20 bp, human
ggcggcgtgtcagaaaggat

SEQ ID NO: 61059 - DNA, 20 bp, human
gggacgcgcgagcccggcga

SEQ ID NO: 61060 - DNA, 20 bp, human
gaccgcgcgggaccgatccg

SEQ ID NO: 61061 - DNA, 20 bp, human
ggctgcggtgcggactctgt

SEQ ID NO: 61062 - DNA, 20 bp, human
gccggcctcgcggtctcctg

SEQ ID NO: 61063 - DNA, 20 bp, human
gaggcccggtccctgctcgg

SEQ ID NO: 61064 - DNA, 20 bp, human
gggaaggcggcgtgtcagaa

SEQ ID NO: 61065 - DNA, 20 bp, human
gaaggatcggaccccagcaa

SEQ ID NO: 61066 - DNA, 20 bp, human
ggctggcgcccctctcacga

SEQ ID NO: 61067 - DNA, 20 bp, human
ggagtctctgcacctccctc

SEQ ID NO: 61068 - DNA, 20 bp, human
gcagtgaggtagccagtccg

SEQ ID NO: 61069 - DNA, 20 bp, human
gaggtgcagagactcggagc

SEQ ID NO: 61070 - DNA, 20 bp, human
gagcctggccctcgtgagag

SEQ ID NO: 61071 - DNA, 20 bp, human
ggcaccctcccctacctgaa

SEQ ID NO: 61072 - DNA, 20 bp, human
gcaaagcaggctggagttgg

SEQ ID NO: 61073 - DNA, 20 bp, human
gagcctttaagaggacatgg

SEQ ID NO: 61074 - DNA, 20 bp, human
gtctccagaaagcccaagtg

SEQ ID NO: 61075 - DNA, 20 bp, human
gctgctgagaaagttggagt

SEQ ID NO: 61076 - DNA, 20 bp, human
ggctgctgagttctcataca

SEQ ID NO: 61077 - DNA, 20 bp, human
ggtgtgaagtggaagcccag

SEQ ID NO: 61078 - DNA, 20 bp, human
ggcgtctgttgcagtcacct

SEQ ID NO: 61079 - DNA, 20 bp, human
gagcagaaagcacacctcta

SEQ ID NO: 61080 - DNA, 20 bp, human
ggggcaacactagtccttag

SEQ ID NO: 61081 - DNA, 20 bp, human
gtacacggtagcattataaa

SEQ ID NO: 61082 - DNA, 20 bp, human
gctactctggctgttgacgt

SEQ ID NO: 61083 - DNA, 20 bp, human
gctgcaacagacgcagatat

SEQ ID NO: 61084 - DNA, 20 bp, human
gggtgatgcccattctactc

SEQ ID NO: 61085 - DNA, 20 bp, human
gtcaacagccagagtagaat

SEQ ID NO: 61086 - DNA, 20 bp, human
ggagcctgtaggtgaagccg

SEQ ID NO: 61087 - DNA, 20 bp, human
ggaggggtccgggaaaacgg

SEQ ID NO: 61088 - DNA, 20 bp, human
ggcgccccggcttcacctac

SEQ ID NO: 61089 - DNA, 20 bp, human
gcagcactcgcacttcggtg

SEQ ID NO: 61090 - DNA, 20 bp, human
ggtactgcggagtgacctca

SEQ ID NO: 61091 - DNA, 20 bp, human
gtcctgcatctggtgtccaa

SEQ ID NO: 61092 - DNA, 20 bp, human
ggaacgctccctcgccgctc

SEQ ID NO: 61093 - DNA, 20 bp, human
ggggcaggcctgggtccacg

SEQ ID NO: 61094 - DNA, 20 bp, human
gcaaccaggagctggtactg

SEQ ID NO: 61095 - DNA, 20 bp, human
gaagccggggcgcgtctgga

SEQ ID NO: 61096 - DNA, 20 bp, human
ggctatggctaaggatgcac

SEQ ID NO: 61097 - DNA, 20 bp, human
gggccctcccaacaccaagg

SEQ ID NO: 61098 - DNA, 20 bp, human
ggctgttctcttgtaagcta

SEQ ID NO: 61099 - DNA, 20 bp, human
ggatcccctaaaatacccct

SEQ ID NO: 61100 - DNA, 20 bp, human
ggactgtggtggcttggata

SEQ ID NO: 61101 - DNA, 20 bp, human
gtaaggatgcacagggtgcc

SEQ ID NO: 61102 - DNA, 20 bp, human
gacagttggctgtagcctag

SEQ ID NO: 61103 - DNA, 20 bp, human
ggcggagatggaaatgtccc

SEQ ID NO: 61104 - DNA, 20 bp, human
gtctgttgcaaaatactcag

SEQ ID NO: 61105 - DNA, 20 bp, human
ggaaaatgaattggaggatt

SEQ ID NO: 61106 - DNA, 20 bp, human
gaggcagctcgcgcaggacg

SEQ ID NO: 61107 - DNA, 20 bp, human
ggagcctacagggaaagata

SEQ ID NO: 61108 - DNA, 20 bp, human
gcccattcttacctgaacgg

SEQ ID NO: 61109 - DNA, 20 bp, human
gggccttggctggatccgaa

SEQ ID NO: 61110 - DNA, 20 bp, human
gggccccattcttacctgaa

SEQ ID NO: 61111 - DNA, 20 bp, human
ggcgcgtcagtacagaccgt

SEQ ID NO: 61112 - DNA, 20 bp, human
ggtcccagctaccgcgaaga

SEQ ID NO: 61113 - DNA, 20 bp, human
gagcagccttaccttgatct

SEQ ID NO: 61114 - DNA, 20 bp, human
ggaggctacatgagcctaca

SEQ ID NO: 61115 - DNA, 20 bp, human
gcaacctgctacaagccctt

SEQ ID NO: 61116 - DNA, 20 bp, human
gcacaaagagcggggcggag

SEQ ID NO: 61117 - DNA, 20 bp, human
gcaggcgccgacacaaagag

SEQ ID NO: 61118 - DNA, 20 bp, human
gtcccgcgggccccagagta

SEQ ID NO: 61119 - DNA, 20 bp, human
ggccgacacaaagagcgggg

SEQ ID NO: 61120 - DNA, 20 bp, human
gacatcacgcggccttctcc

SEQ ID NO: 61121 - DNA, 20 bp, human
gcaggctccgcgcctccggg

SEQ ID NO: 61122 - DNA, 20 bp, human
ggtgatgtcattgctccccg

SEQ ID NO: 61123 - DNA, 20 bp, human
ggcgcaggactcacctgggg

SEQ ID NO: 61124 - DNA, 20 bp, human
gagggctgggctccgatccc

SEQ ID NO: 61125 - DNA, 20 bp, human
ggcgccgcccgcatgggaag

SEQ ID NO: 61126 - DNA, 20 bp, human
ggcaacagccaccaaagcgg

SEQ ID NO: 61127 - DNA, 20 bp, human
gaccaaagcgggggctgaaa

SEQ ID NO: 61128 - DNA, 20 bp, human
ggccataagtagagaggaca

SEQ ID NO: 61129 - DNA, 20 bp, human
gtcccacccgagcaaaaaca

SEQ ID NO: 61130 - DNA, 20 bp, human
gccaggttcacttaaagtaa

SEQ ID NO: 61131 - DNA, 20 bp, human
gaggtaagtgggaactacgg

SEQ ID NO: 61132 - DNA, 20 bp, human
gacattagtaagagacaagg

SEQ ID NO: 61133 - DNA, 20 bp, human
gtggacacagcccactgcag

SEQ ID NO: 61134 - DNA, 20 bp, human
gaaccctgccataagtagag

SEQ ID NO: 61135 - DNA, 20 bp, human
gtccctttcagcccccgctt

SEQ ID NO: 61136 - DNA, 20 bp, human
ggtgagctgggtgtaaaggc

SEQ ID NO: 61137 - DNA, 20 bp, human
gccagatgtgtccctcctgg

SEQ ID NO: 61138 - DNA, 20 bp, human
gccaccagcacctagcatgt

SEQ ID NO: 61139 - DNA, 20 bp, human
gagctgggtgtaaaggcagg

SEQ ID NO: 61140 - DNA, 20 bp, human
gtacacccagctcactgctg

SEQ ID NO: 61141 - DNA, 20 bp, human
ggcagtgtggtggtggtcgg

SEQ ID NO: 61142 - DNA, 20 bp, human
gacacatctggggctctatg

SEQ ID NO: 61143 - DNA, 20 bp, human
gctgggtgaagactagtggg

SEQ ID NO: 61144 - DNA, 20 bp, human
gcatctggggctctatgagg

SEQ ID NO: 61145 - DNA, 20 bp, human
gtgctaggtgctggtggtct

SEQ ID NO: 61146 - DNA, 20 bp, human
gcttgcttaggggtggtctc

SEQ ID NO: 61147 - DNA, 20 bp, human
gcgcccagcccggccaggac

SEQ ID NO: 61148 - DNA, 20 bp, human
ggcggagtctcgggacggag

SEQ ID NO: 61149 - DNA, 20 bp, human
gataggccgggcgctcagaa

SEQ ID NO: 61150 - DNA, 20 bp, human
gaagcccgtacaggatcgat

SEQ ID NO: 61151 - DNA, 20 bp, human
gtagtctgagaagcccgtac

SEQ ID NO: 61152 - DNA, 20 bp, human
gggcgacccgaatggagcca

SEQ ID NO: 61153 - DNA, 20 bp, human
gcgtctggcctcccgcggaa

SEQ ID NO: 61154 - DNA, 20 bp, human
ggccggccctggctccattc

SEQ ID NO: 61155 - DNA, 20 bp, human
gacgggcttctcagactatg

SEQ ID NO: 61156 - DNA, 20 bp, human
gacgggttccagtctcctgt

SEQ ID NO: 61157 - DNA, 20 bp, human
gtccggagccgcacaaacca

SEQ ID NO: 61158 - DNA, 20 bp, human
gggcaggaggcggcactcaa

SEQ ID NO: 61159 - DNA, 20 bp, human
gtgtgcggctccggagtccg

SEQ ID NO: 61160 - DNA, 20 bp, human
gctcgccatgaagccaggtc

SEQ ID NO: 61161 - DNA, 20 bp, human
gcacacagctccaggaccca

SEQ ID NO: 61162 - DNA, 20 bp, human
gtgccaggccagaatcggag

SEQ ID NO: 61163 - DNA, 20 bp, human
gcgtggagttgtgaacgccg

SEQ ID NO: 61164 - DNA, 20 bp, human
gtgcgaaagccccggactcg

SEQ ID NO: 61165 - DNA, 20 bp, human
gttgtgaacgccgcggactc

SEQ ID NO: 61166 - DNA, 20 bp, human
gcgcccagcggtgaccccgg

SEQ ID NO: 61167 - DNA, 20 bp, human
gcacctccgccggacagggt

SEQ ID NO: 61168 - DNA, 20 bp, human
gaagctccggcggcgcccag

SEQ ID NO: 61169 - DNA, 20 bp, human
gccaggtaagcgggccgggt

SEQ ID NO: 61170 - DNA, 20 bp, human
gaggttggcctgaggataaa

SEQ ID NO: 61171 - DNA, 20 bp, human
ggatccgacgcccgagccag

SEQ ID NO: 61172 - DNA, 20 bp, human
gccgccggacagggtaggtg

SEQ ID NO: 61173 - DNA, 20 bp, human
gtgccaacccaggagagcga

SEQ ID NO: 61174 - DNA, 20 bp, human
gtcctcaggccaacctggag

SEQ ID NO: 61175 - DNA, 20 bp, human
gcggtaagccctctgcaggt

SEQ ID NO: 61176 - DNA, 20 bp, human
gggtgggcggcggcggacaa

SEQ ID NO: 61177 - DNA, 20 bp, human
gccacgctccggccgagcct

SEQ ID NO: 61178 - DNA, 20 bp, human
gctcggcgctgacagtccgg

SEQ ID NO: 61179 - DNA, 20 bp, human
gtgctaggactggggtagga

SEQ ID NO: 61180 - DNA, 20 bp, human
ggggtcgggaccctaagctg

SEQ ID NO: 61181 - DNA, 20 bp, human
ggcggcggcggacaaaggcg

SEQ ID NO: 61182 - DNA, 20 bp, human
ggtaggacggtgtgtttgag

SEQ ID NO: 61183 - DNA, 20 bp, human
gcccgggacgcccctacctc

SEQ ID NO: 61184 - DNA, 20 bp, human
gctgctggcggccggaggta

SEQ ID NO: 61185 - DNA, 20 bp, human
ggctggatttgctaggactg

SEQ ID NO: 61186 - DNA, 20 bp, human
gcgccgagcgcagtgccccg

SEQ ID NO: 61187 - DNA, 20 bp, human
ggggtgggcagtgggaccag

SEQ ID NO: 61188 - DNA, 20 bp, human
ggtcggcgcgtcgagagccc

SEQ ID NO: 61189 - DNA, 20 bp, human
gtgcgaggcgcggaccgacg

SEQ ID NO: 61190 - DNA, 20 bp, human
ggaccgacggggatgagtcc

SEQ ID NO: 61191 - DNA, 20 bp, human
gggatgagtccgggcgggag

SEQ ID NO: 61192 - DNA, 20 bp, human
gcgacgcgccgacggccggg

SEQ ID NO: 61193 - DNA, 20 bp, human
ggaccagaggggatgactgg

SEQ ID NO: 61194 - DNA, 20 bp, human
gctcgcagctcaggactcgg

SEQ ID NO: 61195 - DNA, 20 bp, human
ggggccgcgtgcactcaccg

SEQ ID NO: 61196 - DNA, 20 bp, human
gcgagtcgtggagaggacac

SEQ ID NO: 61197 - DNA, 20 bp, human
gggccgagcgagtcgtggag

SEQ ID NO: 61198 - DNA, 20 bp, human
gagaggggccgagcgagtcg

SEQ ID NO: 61199 - DNA, 20 bp, human
gagccccgagggcccagagg

SEQ ID NO: 61200 - DNA, 20 bp, human
gcaaaagccagcatcagaga

SEQ ID NO: 61201 - DNA, 20 bp, human
gcgggtgttttattccagag

SEQ ID NO: 61202 - DNA, 20 bp, human
gggacatgccaggaataaaa

SEQ ID NO: 61203 - DNA, 20 bp, human
gaggacacggggagagcgcc

SEQ ID NO: 61204 - DNA, 20 bp, human
ggggacccccggaggagctc

SEQ ID NO: 61205 - DNA, 20 bp, human
gcggaggagctcgggcacgt

SEQ ID NO: 61206 - DNA, 20 bp, human
gcgcatcgctgggacaaact

SEQ ID NO: 61207 - DNA, 20 bp, human
gcctgggctaaggacgaggg

SEQ ID NO: 61208 - DNA, 20 bp, human
gtcgcgcggactgtctcgtg

SEQ ID NO: 61209 - DNA, 20 bp, human
ggcccctgggctaaggacga

SEQ ID NO: 61210 - DNA, 20 bp, human
ggcgcacctggaccctcgca

SEQ ID NO: 61211 - DNA, 20 bp, human
ggctgggacaaactcggcag

SEQ ID NO: 61212 - DNA, 20 bp, human
gcgagacagtccgcgcgagg

SEQ ID NO: 61213 - DNA, 20 bp, human
gagagcgcgcgcggagagct

SEQ ID NO: 61214 - DNA, 20 bp, human
gcactgacctgggaagcccg

SEQ ID NO: 61215 - DNA, 20 bp, human
gccgggccttgcgagggtcc

SEQ ID NO: 61216 - DNA, 20 bp, human
gggagccgcggcagagactg

SEQ ID NO: 61217 - DNA, 20 bp, human
gagactgtgggtgccacaag

SEQ ID NO: 61218 - DNA, 20 bp, human
gagccgagcagtggctgtag

SEQ ID NO: 61219 - DNA, 20 bp, human
ggcttccagcctggcggaga

SEQ ID NO: 61220 - DNA, 20 bp, human
gggctgtagcggccacgact

SEQ ID NO: 61221 - DNA, 20 bp, human
ggtgggtgccacaagcggac

SEQ ID NO: 61222 - DNA, 20 bp, human
gcagctgggacagctgcgag

SEQ ID NO: 61223 - DNA, 20 bp, human
gggccgctacagccactgct

SEQ ID NO: 61224 - DNA, 20 bp, human
ggcggctccgactcccgagg

SEQ ID NO: 61225 - DNA, 20 bp, human
gcggtggcatcgcccggagt

SEQ ID NO: 61226 - DNA, 20 bp, human
gcgtgcggccagcaagagag

SEQ ID NO: 61227 - DNA, 20 bp, human
ggctcgctcggagtcccaca

SEQ ID NO: 61228 - DNA, 20 bp, human
gtcgcttcgcgggcagtcag

SEQ ID NO: 61229 - DNA, 20 bp, human
gggcaacgaagcgcgggtag

SEQ ID NO: 61230 - DNA, 20 bp, human
ggaagcgcgggtagcggctg

SEQ ID NO: 61231 - DNA, 20 bp, human
ggaggtctccagctagagca

SEQ ID NO: 61232 - DNA, 20 bp, human
gtcttgctggccgcacgccc

SEQ ID NO: 61233 - DNA, 20 bp, human
gccgctcactgcgctagacc

SEQ ID NO: 61234 - DNA, 20 bp, human
ggcccgcgaagcgagacgcg

SEQ ID NO: 61235 - DNA, 20 bp, human
gccacagggcaacgaagcgc

SEQ ID NO: 61236 - DNA, 20 bp, human
gggcgggcgccactagaagg

SEQ ID NO: 61237 - DNA, 20 bp, human
ggctgagggccaaacagcga

SEQ ID NO: 61238 - DNA, 20 bp, human
ggcgggaacgcaaagccgag

SEQ ID NO: 61239 - DNA, 20 bp, human
ggctgcccggctgcgaacaa

SEQ ID NO: 61240 - DNA, 20 bp, human
gcgcgggactcagcgctgca

SEQ ID NO: 61241 - DNA, 20 bp, human
ggccactagaaggcggagag

SEQ ID NO: 61242 - DNA, 20 bp, human
ggcggggcgcgatctccacc

SEQ ID NO: 61243 - DNA, 20 bp, human
ggagaaggcgcgcccggcac

SEQ ID NO: 61244 - DNA, 20 bp, human
gtgcggcgggcgccactaga

SEQ ID NO: 61245 - DNA, 20 bp, human
gcgcccggcacggggtgtgg

SEQ ID NO: 61246 - DNA, 20 bp, human
ggcgctgcggacactcgggg

SEQ ID NO: 61247 - DNA, 20 bp, human
gcgagcgctgcggacactcg

SEQ ID NO: 61248 - DNA, 20 bp, human
gacatcagacggacagacag

SEQ ID NO: 61249 - DNA, 20 bp, human
gcgcccaaggcccgactcac

SEQ ID NO: 61250 - DNA, 20 bp, human
gcaggcagacagacaggacg

SEQ ID NO: 61251 - DNA, 20 bp, human
gcagcgctcgtggtgcaact

SEQ ID NO: 61252 - DNA, 20 bp, human
gaggtgcgggcggcaagaga

SEQ ID NO: 61253 - DNA, 20 bp, human
ggtcaaagccatctcttcgg

SEQ ID NO: 61254 - DNA, 20 bp, human
gcgacagcccaggaagacta

SEQ ID NO: 61255 - DNA, 20 bp, human
ggaccaggcgcccttcgaca

SEQ ID NO: 61256 - DNA, 20 bp, human
gcttatcggcttccacactg

SEQ ID NO: 61257 - DNA, 20 bp, human
ggggctgcagctccgcagtg

SEQ ID NO: 61258 - DNA, 20 bp, human
gggccctgccaggatctcta

SEQ ID NO: 61259 - DNA, 20 bp, human
gactcacaggtgggccagac

SEQ ID NO: 61260 - DNA, 20 bp, human
gaaaccttgcttacttctga

SEQ ID NO: 61261 - DNA, 20 bp, human
gggtttcctgccgggagaaa

SEQ ID NO: 61262 - DNA, 20 bp, human
gttgcgcacagccgaggaga

SEQ ID NO: 61263 - DNA, 20 bp, human
gagtcctggggagcaggcat

SEQ ID NO: 61264 - DNA, 20 bp, human
gggcgtcaggccaaagggac

SEQ ID NO: 61265 - DNA, 20 bp, human
ggctgtgcgcaaggccggtc

SEQ ID NO: 61266 - DNA, 20 bp, human
ggcggctgcacagtgacgag

SEQ ID NO: 61267 - DNA, 20 bp, human
gcacagtgacgagagggcca

SEQ ID NO: 61268 - DNA, 20 bp, human
gagctcggggccagcagatc

SEQ ID NO: 61269 - DNA, 20 bp, human
gtggccttggggcaagctcg

SEQ ID NO: 61270 - DNA, 20 bp, human
gtccgagctcggggtcgcgg

SEQ ID NO: 61271 - DNA, 20 bp, human
gggggtcgaggtctcggacg

SEQ ID NO: 61272 - DNA, 20 bp, human
gcttggtcgtcagcttcgtc

SEQ ID NO: 61273 - DNA, 20 bp, human
gcgtctggagagcggcctgg

SEQ ID NO: 61274 - DNA, 20 bp, human
ggcgaccccgagctcggaag

SEQ ID NO: 61275 - DNA, 20 bp, human
ggtcagcttcgtctggagag

SEQ ID NO: 61276 - DNA, 20 bp, human
gcctgggcaccgggctcgtg

SEQ ID NO: 61277 - DNA, 20 bp, human
ggggcaccgggctcgtgagg

SEQ ID NO: 61278 - DNA, 20 bp, human
gcaccgggctcgtgaggcgg

SEQ ID NO: 61279 - DNA, 20 bp, human
gcgcgcagcgggaccgtggc

SEQ ID NO: 61280 - DNA, 20 bp, human
gcggcgcggcctgggacccc

SEQ ID NO: 61281 - DNA, 20 bp, human
gcgcgcgcgagcgccggctc

SEQ ID NO: 61282 - DNA, 20 bp, human
ggcgcccagagtccgtcgtc

SEQ ID NO: 61283 - DNA, 20 bp, human
gcgcgcggccatggaggcca

SEQ ID NO: 61284 - DNA, 20 bp, human
gcgcgcgcgcagcgggaccg

SEQ ID NO: 61285 - DNA, 20 bp, human
ggccgcgcgtgcgccccgtc

SEQ ID NO: 61286 - DNA, 20 bp, human
ggcagtgagaggcttgcggg

SEQ ID NO: 61287 - DNA, 20 bp, human
gcgacacacagtcccagggt

SEQ ID NO: 61288 - DNA, 20 bp, human
gtctcgagcaggaccgagtc

SEQ ID NO: 61289 - DNA, 20 bp, human
ggtgcggccccgcctccggg

SEQ ID NO: 61290 - DNA, 20 bp, human
gtccagcggtgacagaccct

SEQ ID NO: 61291 - DNA, 20 bp, human
gagcctggaaagcgtggctg

SEQ ID NO: 61292 - DNA, 20 bp, human
gggtctgtcaccgctggaag

SEQ ID NO: 61293 - DNA, 20 bp, human
gtgaggccctgaggtcgaag

SEQ ID NO: 61294 - DNA, 20 bp, human
gggcacctggagatgcgatg

SEQ ID NO: 61295 - DNA, 20 bp, human
ggccccgacacacagtccca

SEQ ID NO: 61296 - DNA, 20 bp, human
ggctacgcaatgccaacccg

SEQ ID NO: 61297 - DNA, 20 bp, human
gtagttcttcagcctcgggt

SEQ ID NO: 61298 - DNA, 20 bp, human
gacaagaagtacctgaggag

SEQ ID NO: 61299 - DNA, 20 bp, human
gagtgccagagagcctgagg

SEQ ID NO: 61300 - DNA, 20 bp, human
gctccccgcgctgggactag

SEQ ID NO: 61301 - DNA, 20 bp, human
gaggctgaagaactacttca

SEQ ID NO: 61302 - DNA, 20 bp, human
ggcattgcgtagcgaggcca

SEQ ID NO: 61303 - DNA, 20 bp, human
gtcggacttgtaggcgatca

SEQ ID NO: 61304 - DNA, 20 bp, human
gtttggacaagaagtacctg

SEQ ID NO: 61305 - DNA, 20 bp, human
gtccgtcaggccttgggcca

SEQ ID NO: 61306 - DNA, 20 bp, human
gaaaagcgggcgagagacaa

SEQ ID NO: 61307 - DNA, 20 bp, human
gccgccggcccgcggagcag

SEQ ID NO: 61308 - DNA, 20 bp, human
gcgcacggcgctcacatccc

SEQ ID NO: 61309 - DNA, 20 bp, human
gccggcccgcggagcagcgg

SEQ ID NO: 61310 - DNA, 20 bp, human
gccccgggggccgggcgcac

SEQ ID NO: 61311 - DNA, 20 bp, human
gggcgtgggtagagccgagg

SEQ ID NO: 61312 - DNA, 20 bp, human
gcgcggcgtgggtagagccg

SEQ ID NO: 61313 - DNA, 20 bp, human
gacggcgctcacatcccggg

SEQ ID NO: 61314 - DNA, 20 bp, human
gctcgtcgcctgcccgaggc

SEQ ID NO: 61315 - DNA, 20 bp, human
gccccgccccgggctccgca

SEQ ID NO: 61316 - DNA, 20 bp, human
gtggcttgattctggacaag

SEQ ID NO: 61317 - DNA, 20 bp, human
gccaccacttcgctcagagg

SEQ ID NO: 61318 - DNA, 20 bp, human
gagagggaagaggaacctga

SEQ ID NO: 61319 - DNA, 20 bp, human
gtgaagctggagaatgcggt

SEQ ID NO: 61320 - DNA, 20 bp, human
ggggcgcaggaacataacgg

SEQ ID NO: 61321 - DNA, 20 bp, human
gtccggtgctcggtacctga

SEQ ID NO: 61322 - DNA, 20 bp, human
gctggggcgcaggaacataa

SEQ ID NO: 61323 - DNA, 20 bp, human
ggccgtcaggtaccgagcac

SEQ ID NO: 61324 - DNA, 20 bp, human
gtagccgcctctgagcgaag

SEQ ID NO: 61325 - DNA, 20 bp, human
gagcaccggaggggccgaga

SEQ ID NO: 61326 - DNA, 20 bp, human
gccgggaagggcttacgtaa

SEQ ID NO: 61327 - DNA, 20 bp, human
gcgccgccgccgcccgggaa

SEQ ID NO: 61328 - DNA, 20 bp, human
gcgctttgcagggaaccagg

SEQ ID NO: 61329 - DNA, 20 bp, human
gcggaaaggagctccccggt

SEQ ID NO: 61330 - DNA, 20 bp, human
gctccccggtgggagaggat

SEQ ID NO: 61331 - DNA, 20 bp, human
gccctcggcagcgcacggaa

SEQ ID NO: 61332 - DNA, 20 bp, human
gcgccccaagcctcccaccg

SEQ ID NO: 61333 - DNA, 20 bp, human
gcgcacggaaaggagctccc

SEQ ID NO: 61334 - DNA, 20 bp, human
gctccgcggcggccacaatg

SEQ ID NO: 61335 - DNA, 20 bp, human
gaggagcccgggccgaggta

SEQ ID NO: 61336 - DNA, 20 bp, human
gcgcgccaggtgctgagagg

SEQ ID NO: 61337 - DNA, 20 bp, human
gggccgaggatagcaggaag

SEQ ID NO: 61338 - DNA, 20 bp, human
ggcagcggcgcagtcctcgg

SEQ ID NO: 61339 - DNA, 20 bp, human
ggctcagtcagtcagcggag

SEQ ID NO: 61340 - DNA, 20 bp, human
gagccggctcagtcagtcag

SEQ ID NO: 61341 - DNA, 20 bp, human
gccgccggagtgcccgacgg

SEQ ID NO: 61342 - DNA, 20 bp, human
gggaagggcgacccctccgg

SEQ ID NO: 61343 - DNA, 20 bp, human
ggggaagccgggagaacgat

SEQ ID NO: 61344 - DNA, 20 bp, human
gcacacgggcacacacgcga

SEQ ID NO: 61345 - DNA, 20 bp, human
gtatagaaggccccgaggag

SEQ ID NO: 61346 - DNA, 20 bp, human
gcctcccacctgcccggcta

SEQ ID NO: 61347 - DNA, 20 bp, human
gcatccctagccgggcaggt

SEQ ID NO: 61348 - DNA, 20 bp, human
ggggcccagccaaggaaccg

SEQ ID NO: 61349 - DNA, 20 bp, human
gggaggagcctggaccctca

SEQ ID NO: 61350 - DNA, 20 bp, human
gggctagggatgctcgaagc

SEQ ID NO: 61351 - DNA, 20 bp, human
gcgagcatccctagccgggc

SEQ ID NO: 61352 - DNA, 20 bp, human
gggagagacggggacaactc

SEQ ID NO: 61353 - DNA, 20 bp, human
gatgcaagggaacccgggtc

SEQ ID NO: 61354 - DNA, 20 bp, human
gcctcaggggacggagagac

SEQ ID NO: 61355 - DNA, 20 bp, human
gcgccggcgggtccgaaccg

SEQ ID NO: 61356 - DNA, 20 bp, human
gcccgggccgtagcagcgcg

SEQ ID NO: 61357 - DNA, 20 bp, human
ggcgcgaccctcgggagata

SEQ ID NO: 61358 - DNA, 20 bp, human
gccccctccccgggaaccgg

SEQ ID NO: 61359 - DNA, 20 bp, human
gcttgaaccccggaaacggt

SEQ ID NO: 61360 - DNA, 20 bp, human
gccccagccccgcgctgcta

SEQ ID NO: 61361 - DNA, 20 bp, human
gctccccgggaaccggcggt

SEQ ID NO: 61362 - DNA, 20 bp, human
ggcagggggtcgcagtccag

SEQ ID NO: 61363 - DNA, 20 bp, human
gcgggaaggggccagttaaa

SEQ ID NO: 61364 - DNA, 20 bp, human
ggccccgcgctgctacggcc

SEQ ID NO: 61365 - DNA, 20 bp, human
gagtccaggggcgggcccag

SEQ ID NO: 61366 - DNA, 20 bp, human
ggccggcgccgtgtgacttc

SEQ ID NO: 61367 - DNA, 20 bp, human
gcccacagcccgaagtcaca

SEQ ID NO: 61368 - DNA, 20 bp, human
gtgcatagaaacaaaactgg

SEQ ID NO: 61369 - DNA, 20 bp, human
ggctgtcaccccgactccag

SEQ ID NO: 61370 - DNA, 20 bp, human
gtgcggacccagcccggtag

SEQ ID NO: 61371 - DNA, 20 bp, human
gggggcagctaggcagacgc

SEQ ID NO: 61372 - DNA, 20 bp, human
ggctggcgtcaccaggacaa

SEQ ID NO: 61373 - DNA, 20 bp, human
ggacccagcccggtaggggt

SEQ ID NO: 61374 - DNA, 20 bp, human
gcttcggccatggtgagtct

SEQ ID NO: 61375 - DNA, 20 bp, human
gccggggaggggtaacctgg

SEQ ID NO: 61376 - DNA, 20 bp, human
ggctggtgggaagagacggg

SEQ ID NO: 61377 - DNA, 20 bp, human
gagtctggcagccccgccag

SEQ ID NO: 61378 - DNA, 20 bp, human
gggcagccccgccagtgggt

SEQ ID NO: 61379 - DNA, 20 bp, human
ggcggcgttgctggcaggtg

SEQ ID NO: 61380 - DNA, 20 bp, human
gacgggaacaagagacctct

SEQ ID NO: 61381 - DNA, 20 bp, human
gtagcgacgagcagtcgttg

SEQ ID NO: 61382 - DNA, 20 bp, human
ggccgtcacccacccactgg

SEQ ID NO: 61383 - DNA, 20 bp, human
ggagcggagtgcacagaccg

SEQ ID NO: 61384 - DNA, 20 bp, human
gacccgccggccccatgagg

SEQ ID NO: 61385 - DNA, 20 bp, human
gggcttctgggtcgcaagaa

SEQ ID NO: 61386 - DNA, 20 bp, human
gtggagtccggccgtccggt

SEQ ID NO: 61387 - DNA, 20 bp, human
gggccggctccgcgcactgg

SEQ ID NO: 61388 - DNA, 20 bp, human
gctccgcgcactggaggcac

SEQ ID NO: 61389 - DNA, 20 bp, human
ggaacacgcccgagcgaggc

SEQ ID NO: 61390 - DNA, 20 bp, human
gtggaggcacaggagcgcct

SEQ ID NO: 61391 - DNA, 20 bp, human
gctcgggtagcactgatcac

SEQ ID NO: 61392 - DNA, 20 bp, human
gcgcggagccggcctcgctc

SEQ ID NO: 61393 - DNA, 20 bp, human
ggcaggaacacgcccgagcg

SEQ ID NO: 61394 - DNA, 20 bp, human
gcaggagcgcctaggcacgg

SEQ ID NO: 61395 - DNA, 20 bp, human
gcgcgcgtctggctcttcgg

SEQ ID NO: 61396 - DNA, 20 bp, human
gctctggcttccctcttggg

SEQ ID NO: 61397 - DNA, 20 bp, human
gttatgtgcatggtgagcag

SEQ ID NO: 61398 - DNA, 20 bp, human
gcccgaaggtggagccatct

SEQ ID NO: 61399 - DNA, 20 bp, human
ggaaggagaagaggtgcagc

SEQ ID NO: 61400 - DNA, 20 bp, human
gcacataacccagctcaacc

SEQ ID NO: 61401 - DNA, 20 bp, human
gaggcactcccggttgagct

SEQ ID NO: 61402 - DNA, 20 bp, human
gagagggaagccagagctag

SEQ ID NO: 61403 - DNA, 20 bp, human
gctagtttgaggcgccccga

SEQ ID NO: 61404 - DNA, 20 bp, human
ggcgcctcaaactaggccca

SEQ ID NO: 61405 - DNA, 20 bp, human
gcggctggagtgccagcaga

SEQ ID NO: 61406 - DNA, 20 bp, human
gccagcgcctcggatgcggg

SEQ ID NO: 61407 - DNA, 20 bp, human
ggtgcaggaagcttacgcgg

SEQ ID NO: 61408 - DNA, 20 bp, human
gcaggtgcaggaagcttacg

SEQ ID NO: 61409 - DNA, 20 bp, human
ggagagactacctcagcgag

SEQ ID NO: 61410 - DNA, 20 bp, human
ggccccgcccggcactcctg

SEQ ID NO: 61411 - DNA, 20 bp, human
gcgcccccggcagcaggtaa

SEQ ID NO: 61412 - DNA, 20 bp, human
gacggtccgcggtccctccc

SEQ ID NO: 61413 - DNA, 20 bp, human
gccccggcagcaggtaacgg

SEQ ID NO: 61414 - DNA, 20 bp, human
ggcagcaggtaacggcggag

SEQ ID NO: 61415 - DNA, 20 bp, human
ggagtctaaaatggcgccca

SEQ ID NO: 61416 - DNA, 20 bp, human
ggcacgtcagcagttctcaa

SEQ ID NO: 61417 - DNA, 20 bp, human
gggatgtcagagggaaatca

SEQ ID NO: 61418 - DNA, 20 bp, human
gaggcagcgcgagaaggcct

SEQ ID NO: 61419 - DNA, 20 bp, human
ggtagcgtagaaagagcccg

SEQ ID NO: 61420 - DNA, 20 bp, human
gacccggaaggaagacgcgg

SEQ ID NO: 61421 - DNA, 20 bp, human
ggtgccgcatctagagagtc

SEQ ID NO: 61422 - DNA, 20 bp, human
gagcccggcctagcgcgacc

SEQ ID NO: 61423 - DNA, 20 bp, human
gggcgacccgcagtcccccg

SEQ ID NO: 61424 - DNA, 20 bp, human
gaagacagagacccacggga

SEQ ID NO: 61425 - DNA, 20 bp, human
ggcctccgcgtcttccttcc

SEQ ID NO: 61426 - DNA, 20 bp, human
gggcgagggtgtctatggag

SEQ ID NO: 61427 - DNA, 20 bp, human
gcccgcggcgagggtgtcta

SEQ ID NO: 61428 - DNA, 20 bp, human
ggagggtgtctatggagagg

SEQ ID NO: 61429 - DNA, 20 bp, human
ggtagggccgctctccttag

SEQ ID NO: 61430 - DNA, 20 bp, human
gccagggcttcgaggaggta

SEQ ID NO: 61431 - DNA, 20 bp, human
gtcccctgccgagggcctgg

SEQ ID NO: 61432 - DNA, 20 bp, human
gggcacccagggcttcgagg

SEQ ID NO: 61433 - DNA, 20 bp, human
gcgagggcggccagtgacgc

SEQ ID NO: 61434 - DNA, 20 bp, human
ggaggctgaggcagtggcga

SEQ ID NO: 61435 - DNA, 20 bp, human
gcccgagagcacgtccgagg

SEQ ID NO: 61436 - DNA, 20 bp, human
gggcccgcccaccagctcag

SEQ ID NO: 61437 - DNA, 20 bp, human
gtcagaggcagagttctccg

SEQ ID NO: 61438 - DNA, 20 bp, human
gatgtagccgagcgcggaca

SEQ ID NO: 61439 - DNA, 20 bp, human
gttctccgcggtgtctccta

SEQ ID NO: 61440 - DNA, 20 bp, human
ggaaaccctaggagacaccg

SEQ ID NO: 61441 - DNA, 20 bp, human
gaaccaggcgaagcaggtag

SEQ ID NO: 61442 - DNA, 20 bp, human
gccctctgacaagaaaccct

SEQ ID NO: 61443 - DNA, 20 bp, human
ggagaactctgcctctgagc

SEQ ID NO: 61444 - DNA, 20 bp, human
gggacagagtcccagagcca

SEQ ID NO: 61445 - DNA, 20 bp, human
ggagcgaaaagagactgctg

SEQ ID NO: 61446 - DNA, 20 bp, human
gagcgttacctgcccaggaa

SEQ ID NO: 61447 - DNA, 20 bp, human
gctgcgtcggacctgccggg

SEQ ID NO: 61448 - DNA, 20 bp, human
gaagccccagggagcggaac

SEQ ID NO: 61449 - DNA, 20 bp, human
ggggcagccatgaccaccga

SEQ ID NO: 61450 - DNA, 20 bp, human
gtcgcccgttccgctccctg

SEQ ID NO: 61451 - DNA, 20 bp, human
gcgagcgccgtcggtggtca

SEQ ID NO: 61452 - DNA, 20 bp, human
gggcgttgagaggaaccggg

SEQ ID NO: 61453 - DNA, 20 bp, human
gcttccccgagcgccgtcgg

SEQ ID NO: 61454 - DNA, 20 bp, human
gggcccgccgccgagcgtag

SEQ ID NO: 61455 - DNA, 20 bp, human
gccgaggaagggcccgacgc

SEQ ID NO: 61456 - DNA, 20 bp, human
gggcgcggtgagcctctggg

SEQ ID NO: 61457 - DNA, 20 bp, human
gggcatgacggctacaggat

SEQ ID NO: 61458 - DNA, 20 bp, human
gtgcagctaacggtcccgtc

SEQ ID NO: 61459 - DNA, 20 bp, human
gccgggacactccatagctg

SEQ ID NO: 61460 - DNA, 20 bp, human
ggagtgtcccgggagacggc

SEQ ID NO: 61461 - DNA, 20 bp, human
gcgggagacggcgggcatga

SEQ ID NO: 61462 - DNA, 20 bp, human
ggcgcggcggccacttgttg

SEQ ID NO: 61463 - DNA, 20 bp, human
gtatggagtgtcccgggaga

SEQ ID NO: 61464 - DNA, 20 bp, human
gtccggggacccgcaacaag

SEQ ID NO: 61465 - DNA, 20 bp, human
gcgtcgggcgggctttcctc

SEQ ID NO: 61466 - DNA, 20 bp, human
ggactggcagcagaggacag

SEQ ID NO: 61467 - DNA, 20 bp, human
gcttgaagccggatccccag

SEQ ID NO: 61468 - DNA, 20 bp, human
ggcggacgggaagcagccac

SEQ ID NO: 61469 - DNA, 20 bp, human
gcctgctcggcggaccagat

SEQ ID NO: 61470 - DNA, 20 bp, human
ggcgggtcgcaaggagtcac

SEQ ID NO: 61471 - DNA, 20 bp, human
gctgttagcccggaagatat

SEQ ID NO: 61472 - DNA, 20 bp, human
gggagctgcgtagctgagta

SEQ ID NO: 61473 - DNA, 20 bp, human
gggtgggctagtgggagcct

SEQ ID NO: 61474 - DNA, 20 bp, human
ggcttgtacctgggacccat

SEQ ID NO: 61475 - DNA, 20 bp, human
ggtgcgaaaccccagcttga

SEQ ID NO: 61476 - DNA, 20 bp, human
gtggagccgcagcagccggt

SEQ ID NO: 61477 - DNA, 20 bp, human
gccgcacgccgcaatcctac

SEQ ID NO: 61478 - DNA, 20 bp, human
ggctgctgcggctccagcgg

SEQ ID NO: 61479 - DNA, 20 bp, human
gcaggcagctgtccgccccc

SEQ ID NO: 61480 - DNA, 20 bp, human
gcgcggagcatgtatctccg

SEQ ID NO: 61481 - DNA, 20 bp, human
gtttacgggagggtaaacca

SEQ ID NO: 61482 - DNA, 20 bp, human
ggcagcagccggtaggattg

SEQ ID NO: 61483 - DNA, 20 bp, human
ggcggctccgcacgatcccc

SEQ ID NO: 61484 - DNA, 20 bp, human
gcagctgcctggggatcgtg

SEQ ID NO: 61485 - DNA, 20 bp, human
ggcagctgtccgcccccggg

SEQ ID NO: 61486 - DNA, 20 bp, human
gactcgcctgggtctccggt

SEQ ID NO: 61487 - DNA, 20 bp, human
gagccgccaaccggagaccc

SEQ ID NO: 61488 - DNA, 20 bp, human
gggtcccgccgactcgcgag

SEQ ID NO: 61489 - DNA, 20 bp, human
gacacgcacagcgagcttcg

SEQ ID NO: 61490 - DNA, 20 bp, human
gcggctgaagagacagatcc

SEQ ID NO: 61491 - DNA, 20 bp, human
gctccggttggcggctcgga

SEQ ID NO: 61492 - DNA, 20 bp, human
gctcaggagcggaacaacgt

SEQ ID NO: 61493 - DNA, 20 bp, human
ggactcgcgagcggcgtctc

SEQ ID NO: 61494 - DNA, 20 bp, human
ggcggccgcgacactcgcct

SEQ ID NO: 61495 - DNA, 20 bp, human
gcgacactcgcctgggtctc

SEQ ID NO: 61496 - DNA, 20 bp, human
gtccagtcgccatagagaca

SEQ ID NO: 61497 - DNA, 20 bp, human
gggtatggaagaacgaccgg

SEQ ID NO: 61498 - DNA, 20 bp, human
gtcaccacaggaccgcgcca

SEQ ID NO: 61499 - DNA, 20 bp, human
ggagacaaggagttcaccac

SEQ ID NO: 61500 - DNA, 20 bp, human
gggtgaactccttgtctcta

SEQ ID NO: 61501 - DNA, 20 bp, human
gggacaggtgcaggtccaag

SEQ ID NO: 61502 - DNA, 20 bp, human
gcagccctggcgcggtcctg

SEQ ID NO: 61503 - DNA, 20 bp, human
gcgctgcgcgggcccagcag

SEQ ID NO: 61504 - DNA, 20 bp, human
gtctctatggcgactggacg

SEQ ID NO: 61505 - DNA, 20 bp, human
gtgcgcgcacctgccaggac

SEQ ID NO: 61506 - DNA, 20 bp, human
ggagggagacaagctaaaag

SEQ ID NO: 61507 - DNA, 20 bp, human
gagcgcttgaggcttgaaga

SEQ ID NO: 61508 - DNA, 20 bp, human
gtactgagcataataggact

SEQ ID NO: 61509 - DNA, 20 bp, human
gaacatgatactgggctctg

SEQ ID NO: 61510 - DNA, 20 bp, human
ggtggcaacgtcagcgcttg

SEQ ID NO: 61511 - DNA, 20 bp, human
gcactgtagcccaaatgaga

SEQ ID NO: 61512 - DNA, 20 bp, human
gttgtaatatcatcagacaa

SEQ ID NO: 61513 - DNA, 20 bp, human
gtaggcatataattatctgt

SEQ ID NO: 61514 - DNA, 20 bp, human
gcaaaaagctaatgcttggt

SEQ ID NO: 61515 - DNA, 20 bp, human
ggagcactgataaagctcat

SEQ ID NO: 61516 - DNA, 20 bp, human
gtcttggaccgggaacaagg

SEQ ID NO: 61517 - DNA, 20 bp, human
gggacaactggcacataagt

SEQ ID NO: 61518 - DNA, 20 bp, human
gacccccgacgagtcagcaa

SEQ ID NO: 61519 - DNA, 20 bp, human
gggtgccatgcacaagacgt

SEQ ID NO: 61520 - DNA, 20 bp, human
gccctcagctggacatagag

SEQ ID NO: 61521 - DNA, 20 bp, human
gtggagatgcagcctccccg

SEQ ID NO: 61522 - DNA, 20 bp, human
gccatcttggaccgggaaca

SEQ ID NO: 61523 - DNA, 20 bp, human
ggtagggcctcagcactcac

SEQ ID NO: 61524 - DNA, 20 bp, human
ggcctttgctgactcgtcgg

SEQ ID NO: 61525 - DNA, 20 bp, human
gcagggggcgaacctgtagt

SEQ ID NO: 61526 - DNA, 20 bp, human
ggacgagcgcagggatggag

SEQ ID NO: 61527 - DNA, 20 bp, human
gcctgggccacgccgatcac

SEQ ID NO: 61528 - DNA, 20 bp, human
ggttctgggaggcagtcgag

SEQ ID NO: 61529 - DNA, 20 bp, human
gggcggtcggtcctctcccg

SEQ ID NO: 61530 - DNA, 20 bp, human
gtcgaggggctccccgtgat

SEQ ID NO: 61531 - DNA, 20 bp, human
gacgctgcaaaccaacacgt

SEQ ID NO: 61532 - DNA, 20 bp, human
gctgcctcccagaacaaagt

SEQ ID NO: 61533 - DNA, 20 bp, human
gggctgttgcgcccacgtgt

SEQ ID NO: 61534 - DNA, 20 bp, human
gtttcccactttgttctggg

SEQ ID NO: 61535 - DNA, 20 bp, human
ggtgagcgccgggacaggta

SEQ ID NO: 61536 - DNA, 20 bp, human
ggaagctaccgatgacacag

SEQ ID NO: 61537 - DNA, 20 bp, human
gcggcagcgagctcctcctc

SEQ ID NO: 61538 - DNA, 20 bp, human
gcgcagcgtgtgggtcctcg

SEQ ID NO: 61539 - DNA, 20 bp, human
gcggagctcgcggaggaagt

SEQ ID NO: 61540 - DNA, 20 bp, human
gagctcgcggaggaagtcgg

SEQ ID NO: 61541 - DNA, 20 bp, human
gccaggaaggcgcagcgtgt

SEQ ID NO: 61542 - DNA, 20 bp, human
gcgtggcctcggctgctagg

SEQ ID NO: 61543 - DNA, 20 bp, human
gctgccccccgaggccagga

SEQ ID NO: 61544 - DNA, 20 bp, human
gctcgctgccgggggacgct

SEQ ID NO: 61545 - DNA, 20 bp, human
gcccccgcgcaggaccccgg

SEQ ID NO: 61546 - DNA, 20 bp, human
gcggtcgcgagaggaggagc

SEQ ID NO: 61547 - DNA, 20 bp, human
gggagggcggtcgcgagagg

SEQ ID NO: 61548 - DNA, 20 bp, human
ggccgggaccgacacagacg

SEQ ID NO: 61549 - DNA, 20 bp, human
gtgcggagggcggtcgcgag

SEQ ID NO: 61550 - DNA, 20 bp, human
ggccagcgaagccctagagg

SEQ ID NO: 61551 - DNA, 20 bp, human
ggggcgagcgctgcacagag

SEQ ID NO: 61552 - DNA, 20 bp, human
ggaagagctgatgaaagaaa

SEQ ID NO: 61553 - DNA, 20 bp, human
gccgcagcgatggacggaga

SEQ ID NO: 61554 - DNA, 20 bp, human
gcgccctccgcagcgatgga

SEQ ID NO: 61555 - DNA, 20 bp, human
gggaccccaaggaacccacg

SEQ ID NO: 61556 - DNA, 20 bp, human
gaggtacgcggacaagatgg

SEQ ID NO: 61557 - DNA, 20 bp, human
gcccaggtacgcggacaaga

SEQ ID NO: 61558 - DNA, 20 bp, human
ggtcgacagcgcgatggagg

SEQ ID NO: 61559 - DNA, 20 bp, human
ggcagtcgacagcgcgatgg

SEQ ID NO: 61560 - DNA, 20 bp, human
gcagccgggtcctccgtcaa

SEQ ID NO: 61561 - DNA, 20 bp, human
gcgcggcggccccaggtacg

SEQ ID NO: 61562 - DNA, 20 bp, human
ggcagcagtcgacagcgcga

SEQ ID NO: 61563 - DNA, 20 bp, human
ggcgagctgtgccagagcag

SEQ ID NO: 61564 - DNA, 20 bp, human
gctggagacacggccgatgt

SEQ ID NO: 61565 - DNA, 20 bp, human
gagctgaggcccgctacctc

SEQ ID NO: 61566 - DNA, 20 bp, human
gggtaggtaggtgtcagtca

SEQ ID NO: 61567 - DNA, 20 bp, human
gcccgccggaaccagtccta

SEQ ID NO: 61568 - DNA, 20 bp, human
ggccggaaccagtcctacgg

SEQ ID NO: 61569 - DNA, 20 bp, human
gggtgaggaatggagccggt

SEQ ID NO: 61570 - DNA, 20 bp, human
gccggcgggctggtgaggaa

SEQ ID NO: 61571 - DNA, 20 bp, human
gtcggaagaagagccagata

SEQ ID NO: 61572 - DNA, 20 bp, human
gcaaagtccccggggtaggt

SEQ ID NO: 61573 - DNA, 20 bp, human
gactcgccgcagcagcctac

SEQ ID NO: 61574 - DNA, 20 bp, human
gctccgagccgccgtaggac

SEQ ID NO: 61575 - DNA, 20 bp, human
ggtgctccgcgggtctacgg

SEQ ID NO: 61576 - DNA, 20 bp, human
ggtcccgagacccctgccag

SEQ ID NO: 61577 - DNA, 20 bp, human
ggccgagggaccgcaagcag

SEQ ID NO: 61578 - DNA, 20 bp, human
gccagaggcttcacagtcgg

SEQ ID NO: 61579 - DNA, 20 bp, human
ggagatgcccagctcgagga

SEQ ID NO: 61580 - DNA, 20 bp, human
ggcggttgtcgcagctgaag

SEQ ID NO: 61581 - DNA, 20 bp, human
gactccactagcaggaaaac

SEQ ID NO: 61582 - DNA, 20 bp, human
gccggagtctgacgagagaa

SEQ ID NO: 61583 - DNA, 20 bp, human
gcaggggtctcgggaccccc

SEQ ID NO: 61584 - DNA, 20 bp, human
gggtccctttgctaaggagg

SEQ ID NO: 61585 - DNA, 20 bp, human
gatcaggtccaaccaagagg

SEQ ID NO: 61586 - DNA, 20 bp, human
ggcacctgacggcgaccagg

SEQ ID NO: 61587 - DNA, 20 bp, human
ggcctgtgggagggtcaggt

SEQ ID NO: 61588 - DNA, 20 bp, human
gttggcgccgcaggcgcgtt

SEQ ID NO: 61589 - DNA, 20 bp, human
gaggtaggtgcggggtgcag

SEQ ID NO: 61590 - DNA, 20 bp, human
gggttcattcagggagctgc

SEQ ID NO: 61591 - DNA, 20 bp, human
gcggggcctgtgggagggtc

SEQ ID NO: 61592 - DNA, 20 bp, human
gggggacggggcctgtggga

SEQ ID NO: 61593 - DNA, 20 bp, human
ggggcttccctgaggcgcgc

SEQ ID NO: 61594 - DNA, 20 bp, human
gtccgcgggcgcgtcaggta

SEQ ID NO: 61595 - DNA, 20 bp, human
gcctgaggcgcgccgggagg

SEQ ID NO: 61596 - DNA, 20 bp, human
gggcctggcggggggaccat

SEQ ID NO: 61597 - DNA, 20 bp, human
gcaaggtgggatctcggaag

SEQ ID NO: 61598 - DNA, 20 bp, human
gcaacccctgcggccaaggt

SEQ ID NO: 61599 - DNA, 20 bp, human
gtgggcgcctcggtctccag

SEQ ID NO: 61600 - DNA, 20 bp, human
gggtgcggctggcagaatca

SEQ ID NO: 61601 - DNA, 20 bp, human
gccggtactaggggccgcag

SEQ ID NO: 61602 - DNA, 20 bp, human
gcccgctaccgctcccactg

SEQ ID NO: 61603 - DNA, 20 bp, human
gagaggaagtccaggatgct

SEQ ID NO: 61604 - DNA, 20 bp, human
gccggagccggaacccgaag

SEQ ID NO: 61605 - DNA, 20 bp, human
gcggcacagctagggcatcc

SEQ ID NO: 61606 - DNA, 20 bp, human
gtgtcgctgggtagagccgg

SEQ ID NO: 61607 - DNA, 20 bp, human
ggcagcggcggaggagcgga

SEQ ID NO: 61608 - DNA, 20 bp, human
ggcggaggagcggatggcag

SEQ ID NO: 61609 - DNA, 20 bp, human
gcccagccggctacagatct

SEQ ID NO: 61610 - DNA, 20 bp, human
gggcgtcagtcagcaggagt

SEQ ID NO: 61611 - DNA, 20 bp, human
gagccggctacagatctggg

SEQ ID NO: 61612 - DNA, 20 bp, human
ggtagagccggaggccaaag

SEQ ID NO: 61613 - DNA, 20 bp, human
gaggaatcaagcccccaaga

SEQ ID NO: 61614 - DNA, 20 bp, human
gtcctgctgactgacgccaa

SEQ ID NO: 61615 - DNA, 20 bp, human
gtgacgccaagggagagttc

SEQ ID NO: 61616 - DNA, 20 bp, human
gtgaggagcaggggatcggt

SEQ ID NO: 61617 - DNA, 20 bp, human
gtcggtgggcagcgactcta

SEQ ID NO: 61618 - DNA, 20 bp, human
ggcagcgactctagggtcag

SEQ ID NO: 61619 - DNA, 20 bp, human
gtgcaccgggccaggcaaga

SEQ ID NO: 61620 - DNA, 20 bp, human
gagggtcagcggcgccgtct

SEQ ID NO: 61621 - DNA, 20 bp, human
gggactgaccccaaccgggc

SEQ ID NO: 61622 - DNA, 20 bp, human
ggtccaaaaaggataagatg

SEQ ID NO: 61623 - DNA, 20 bp, human
ggaagctcgggtcctgtcag

SEQ ID NO: 61624 - DNA, 20 bp, human
gttgcaagtgggcctcaccg

SEQ ID NO: 61625 - DNA, 20 bp, human
gtggctccgcaggatgaggg

SEQ ID NO: 61626 - DNA, 20 bp, human
gtaaggaactcacagaggct

SEQ ID NO: 61627 - DNA, 20 bp, human
ggtactctgctggagtggtg

SEQ ID NO: 61628 - DNA, 20 bp, human
gccactccagcagagtacta

SEQ ID NO: 61629 - DNA, 20 bp, human
gcagagagaccccaacacat

SEQ ID NO: 61630 - DNA, 20 bp, human
gtggttctggagctttatca

SEQ ID NO: 61631 - DNA, 20 bp, human
ggtttggtgctcgtctgaca

SEQ ID NO: 61632 - DNA, 20 bp, human
gtaagagaaatcccagctac

SEQ ID NO: 61633 - DNA, 20 bp, human
ggagttccttactcttagtt

SEQ ID NO: 61634 - DNA, 20 bp, human
ggtgagaagttaatgcaggg

SEQ ID NO: 61635 - DNA, 20 bp, human
gtacgtattgtaataaaata

SEQ ID NO: 61636 - DNA, 20 bp, human
gccgtccgggcgccctgaga

SEQ ID NO: 61637 - DNA, 20 bp, human
ggagcgtcgccgggacagag

SEQ ID NO: 61638 - DNA, 20 bp, human
gcgcggcggacgccctctca

SEQ ID NO: 61639 - DNA, 20 bp, human
gcgccatttgctgacctcaa

SEQ ID NO: 61640 - DNA, 20 bp, human
ggccgggcccgtcaacccca

SEQ ID NO: 61641 - DNA, 20 bp, human
ggcggaggaggcggttcgga

SEQ ID NO: 61642 - DNA, 20 bp, human
gggcgaggacacgagcgcgg

SEQ ID NO: 61643 - DNA, 20 bp, human
gcaaactgggggggacacgg

SEQ ID NO: 61644 - DNA, 20 bp, human
gcgtcccgggtcggccgtcc

SEQ ID NO: 61645 - DNA, 20 bp, human
ggcgcccggacggccgaccc

SEQ ID NO: 61646 - DNA, 20 bp, human
gtctccaccagcagctcggg

SEQ ID NO: 61647 - DNA, 20 bp, human
ggctggagcgtgcgcacagg

SEQ ID NO: 61648 - DNA, 20 bp, human
gccccgcgcgctcaccctca

SEQ ID NO: 61649 - DNA, 20 bp, human
ggggccccgcgcccaactgg

SEQ ID NO: 61650 - DNA, 20 bp, human
gcggccgggggccaccagtt

SEQ ID NO: 61651 - DNA, 20 bp, human
ggggcccgtcgcgcggatgt

SEQ ID NO: 61652 - DNA, 20 bp, human
gcaccgacaccatctggagg

SEQ ID NO: 61653 - DNA, 20 bp, human
gcggcaacgcctcctccaga

SEQ ID NO: 61654 - DNA, 20 bp, human
gcgcgctggagcgtgcgcac

SEQ ID NO: 61655 - DNA, 20 bp, human
gaggctagcgccggggtcgg

SEQ ID NO: 61656 - DNA, 20 bp, human
gccgagcgcccacagacccg

SEQ ID NO: 61657 - DNA, 20 bp, human
gcgcgggcggaggtcaccag

SEQ ID NO: 61658 - DNA, 20 bp, human
gggccgcaccccgggtctgt

SEQ ID NO: 61659 - DNA, 20 bp, human
gcccctgaggtgacggttgt

SEQ ID NO: 61660 - DNA, 20 bp, human
gccgcgctgccatctcctca

SEQ ID NO: 61661 - DNA, 20 bp, human
ggggactgcgcccagaatga

SEQ ID NO: 61662 - DNA, 20 bp, human
ggtcgccacagacgacctaa

SEQ ID NO: 61663 - DNA, 20 bp, human
ggcgcccagaatgaaggctc

SEQ ID NO: 61664 - DNA, 20 bp, human
gcagcaccgctgggcgcctg

SEQ ID NO: 61665 - DNA, 20 bp, human
gaggccgcgccgtctccggg

SEQ ID NO: 61666 - DNA, 20 bp, human
gagggagaccctgacccgga

SEQ ID NO: 61667 - DNA, 20 bp, human
gaacggcgcggggcaccctg

SEQ ID NO: 61668 - DNA, 20 bp, human
gcgcggggcaccctgcgggg

SEQ ID NO: 61669 - DNA, 20 bp, human
ggaggagggagaccctgacc

SEQ ID NO: 61670 - DNA, 20 bp, human
gcgcagggacggcgaatgag

SEQ ID NO: 61671 - DNA, 20 bp, human
gacccggagggtgggactac

SEQ ID NO: 61672 - DNA, 20 bp, human
ggcttcctggatgagaagag

SEQ ID NO: 61673 - DNA, 20 bp, human
gtactgccgcgcagcactcc

SEQ ID NO: 61674 - DNA, 20 bp, human
ggcaggactggcggtccccc

SEQ ID NO: 61675 - DNA, 20 bp, human
gagaccctgacccggagggt

SEQ ID NO: 61676 - DNA, 20 bp, human
gtcaatgactaggaagaagg

SEQ ID NO: 61677 - DNA, 20 bp, human
ggccggactcctcccaccag

SEQ ID NO: 61678 - DNA, 20 bp, human
gccgctcagatagttctcgg

SEQ ID NO: 61679 - DNA, 20 bp, human
gctcgggttcgagctcccgg

SEQ ID NO: 61680 - DNA, 20 bp, human
gccacagggccggatagaag

SEQ ID NO: 61681 - DNA, 20 bp, human
ggtgccgcagccccgaccgc

SEQ ID NO: 61682 - DNA, 20 bp, human
gcgagacgcggaggcagatg

SEQ ID NO: 61683 - DNA, 20 bp, human
gttcgagctcccggcggtcg

SEQ ID NO: 61684 - DNA, 20 bp, human
gccgccgctcagatagttct

SEQ ID NO: 61685 - DNA, 20 bp, human
gggagctcgaacccgagccg

SEQ ID NO: 61686 - DNA, 20 bp, human
gggtgctcggtccgactcag

SEQ ID NO: 61687 - DNA, 20 bp, human
gcagcccgacgcagtggtgg

SEQ ID NO: 61688 - DNA, 20 bp, human
gtcggtccgactcagcggtg

SEQ ID NO: 61689 - DNA, 20 bp, human
gcaccagcccgacgcagtgg

SEQ ID NO: 61690 - DNA, 20 bp, human
gctgcaccagcccgacgcag

SEQ ID NO: 61691 - DNA, 20 bp, human
gccacttacgggacccaggg

SEQ ID NO: 61692 - DNA, 20 bp, human
gcgaggcgaccccagtccag

SEQ ID NO: 61693 - DNA, 20 bp, human
gctgaagccgaggagattca

SEQ ID NO: 61694 - DNA, 20 bp, human
gccgcgggccacggagggtc

SEQ ID NO: 61695 - DNA, 20 bp, human
gacggagggtcgggcgggta

SEQ ID NO: 61696 - DNA, 20 bp, human
gtcgcgcggaggaaactcta

SEQ ID NO: 61697 - DNA, 20 bp, human
gcacctcagcgtgagaagga

SEQ ID NO: 61698 - DNA, 20 bp, human
gcagtttcaaagagagtctc

SEQ ID NO: 61699 - DNA, 20 bp, human
ggcgtcccaagatggcgtcg

SEQ ID NO: 61700 - DNA, 20 bp, human
gtccgcgcgaagaggaaaac

SEQ ID NO: 61701 - DNA, 20 bp, human
gcggcggtggcgtcccaaga

SEQ ID NO: 61702 - DNA, 20 bp, human
gagaccgggtgaccagtaac

SEQ ID NO: 61703 - DNA, 20 bp, human
ggcctcacctcagcgtgaga

SEQ ID NO: 61704 - DNA, 20 bp, human
gcgctaagacaaccaggaag

SEQ ID NO: 61705 - DNA, 20 bp, human
gtacgggtaagaagccgggg

SEQ ID NO: 61706 - DNA, 20 bp, human
gacaataacaggcggagggt

SEQ ID NO: 61707 - DNA, 20 bp, human
gagggtcggcgtaggtgagg

SEQ ID NO: 61708 - DNA, 20 bp, human
ggagctccttgagagatcag

SEQ ID NO: 61709 - DNA, 20 bp, human
gacaggcggagggtcggcgt

SEQ ID NO: 61710 - DNA, 20 bp, human
gcggagggtcggcgtaggtg

SEQ ID NO: 61711 - DNA, 20 bp, human
gggtgaggcggcggctgagt

SEQ ID NO: 61712 - DNA, 20 bp, human
gcaaccacaataacaggcgg

SEQ ID NO: 61713 - DNA, 20 bp, human
gggaagtgcctcagcggtag

SEQ ID NO: 61714 - DNA, 20 bp, human
gccctctcaaccacaataac

SEQ ID NO: 61715 - DNA, 20 bp, human
gtcggccagtaaagtgaagg

SEQ ID NO: 61716 - DNA, 20 bp, human
gccgctcgggctgcagggac

SEQ ID NO: 61717 - DNA, 20 bp, human
ggctccgacgccaactccat

SEQ ID NO: 61718 - DNA, 20 bp, human
gggacgttgcagaagtacct

SEQ ID NO: 61719 - DNA, 20 bp, human
gggagcaacagctgcgcggg

SEQ ID NO: 61720 - DNA, 20 bp, human
gacgtcccgccaaggaagat

SEQ ID NO: 61721 - DNA, 20 bp, human
ggtcggagcaacagctgcgc

SEQ ID NO: 61722 - DNA, 20 bp, human
gcccggggcgcccatggagt

SEQ ID NO: 61723 - DNA, 20 bp, human
gcgttcgctgaaccccgctc

SEQ ID NO: 61724 - DNA, 20 bp, human
gccagagcaaggcgcagacc

SEQ ID NO: 61725 - DNA, 20 bp, human
gcacagctgccaaccaggga

SEQ ID NO: 61726 - DNA, 20 bp, human
gccacgctgcgggcaagcca

SEQ ID NO: 61727 - DNA, 20 bp, human
gtggaggcggccatcctcag

SEQ ID NO: 61728 - DNA, 20 bp, human
gggccccctgcggagcacca

SEQ ID NO: 61729 - DNA, 20 bp, human
ggcgcgtacgacctcacggg

SEQ ID NO: 61730 - DNA, 20 bp, human
gagggggcccgaacatctca

SEQ ID NO: 61731 - DNA, 20 bp, human
ggtgactacactgccaggaa

SEQ ID NO: 61732 - DNA, 20 bp, human
ggtccccaggggccccatga

SEQ ID NO: 61733 - DNA, 20 bp, human
gcgctgcgggcaagccatgg

SEQ ID NO: 61734 - DNA, 20 bp, human
gagacgcgtcacccacgctg

SEQ ID NO: 61735 - DNA, 20 bp, human
ggtggcgcgtacgacctcac

SEQ ID NO: 61736 - DNA, 20 bp, human
gggacagcgttctgttggga

SEQ ID NO: 61737 - DNA, 20 bp, human
ggttgcatcagctgcagtag

SEQ ID NO: 61738 - DNA, 20 bp, human
gtgatgggtggggggatctg

SEQ ID NO: 61739 - DNA, 20 bp, human
gtaagcggattgccgggagg

SEQ ID NO: 61740 - DNA, 20 bp, human
gaagtaagcggattgccggg

SEQ ID NO: 61741 - DNA, 20 bp, human
gtagaggacagcgttctgtt

SEQ ID NO: 61742 - DNA, 20 bp, human
gtggtgaggaaacaagtgga

SEQ ID NO: 61743 - DNA, 20 bp, human
gagtggaaggcctagaatcc

SEQ ID NO: 61744 - DNA, 20 bp, human
ggttacaacatggtgatggg

SEQ ID NO: 61745 - DNA, 20 bp, human
gccatgacgaggacattcag

SEQ ID NO: 61746 - DNA, 20 bp, human
gcgcgggccgaggaaagcaa

SEQ ID NO: 61747 - DNA, 20 bp, human
gaacccggcgggaggaagga

SEQ ID NO: 61748 - DNA, 20 bp, human
gggcctccggagggctgtga

SEQ ID NO: 61749 - DNA, 20 bp, human
gcccaacggggagggattct

SEQ ID NO: 61750 - DNA, 20 bp, human
gcagccagtcgcagcgggag

SEQ ID NO: 61751 - DNA, 20 bp, human
gtagccgcggcggccaccca

SEQ ID NO: 61752 - DNA, 20 bp, human
gaggggcgcacgaacccggc

SEQ ID NO: 61753 - DNA, 20 bp, human
gcccgcgaggccgcccaacg

SEQ ID NO: 61754 - DNA, 20 bp, human
gcgggaggggcgcacgaacc

SEQ ID NO: 61755 - DNA, 20 bp, human
gagggaggcagcaccgaggt

SEQ ID NO: 61756 - DNA, 20 bp, human
gggcggcggcgtttgagtgg

SEQ ID NO: 61757 - DNA, 20 bp, human
gggcggcggcggcgtttgag

SEQ ID NO: 61758 - DNA, 20 bp, human
gtgccagtcccgggcataaa

SEQ ID NO: 61759 - DNA, 20 bp, human
ggtcctcgagtgaggcgagg

SEQ ID NO: 61760 - DNA, 20 bp, human
gtcgctcccaacccaagggc

SEQ ID NO: 61761 - DNA, 20 bp, human
gttccagccagcccttgggt

SEQ ID NO: 61762 - DNA, 20 bp, human
gggaggaagatggcggctcc

SEQ ID NO: 61763 - DNA, 20 bp, human
gctatcgccgtcctcgagtg

SEQ ID NO: 61764 - DNA, 20 bp, human
gggttctcgtcccctcaccc

SEQ ID NO: 61765 - DNA, 20 bp, human
gtgggttcgctcccaaccca

SEQ ID NO: 61766 - DNA, 20 bp, human
ggccatagcccgcatcccag

SEQ ID NO: 61767 - DNA, 20 bp, human
gggcgggccgttcaaaccta

SEQ ID NO: 61768 - DNA, 20 bp, human
ggcccgccatagctcctcgg

SEQ ID NO: 61769 - DNA, 20 bp, human
gccccacgcgaagctggcgt

SEQ ID NO: 61770 - DNA, 20 bp, human
ggggccgttcaaacctaagg

SEQ ID NO: 61771 - DNA, 20 bp, human
gccccacgccagcttcgcgt

SEQ ID NO: 61772 - DNA, 20 bp, human
gttctccccggcccatccag

SEQ ID NO: 61773 - DNA, 20 bp, human
gtgactcccccgaggagcta

SEQ ID NO: 61774 - DNA, 20 bp, human
gcgccgggagacccgctaac

SEQ ID NO: 61775 - DNA, 20 bp, human
gggagctatggcgggcgggt

SEQ ID NO: 61776 - DNA, 20 bp, human
ggtgggagtggcaagagggt

SEQ ID NO: 61777 - DNA, 20 bp, human
gcgccgcggcacgatccgtt

SEQ ID NO: 61778 - DNA, 20 bp, human
gtccaggcaagcgcaggtcc

SEQ ID NO: 61779 - DNA, 20 bp, human
gctaggtgggagtggcaaga

SEQ ID NO: 61780 - DNA, 20 bp, human
gtgcagcttgggcggcccaa

SEQ ID NO: 61781 - DNA, 20 bp, human
ggccgggaccgacacagacg

SEQ ID NO: 61782 - DNA, 20 bp, human
gggtccaggcggtgcagctt

SEQ ID NO: 61783 - DNA, 20 bp, human
gtctcctgcctaggtgggag

SEQ ID NO: 61784 - DNA, 20 bp, human
gcctcccgcggaggtccaaa

SEQ ID NO: 61785 - DNA, 20 bp, human
ggcggccgagcgcaggtgac

SEQ ID NO: 61786 - DNA, 20 bp, human
gcggcggttggcactgacag

SEQ ID NO: 61787 - DNA, 20 bp, human
gcctctccgcggcgcgccag

SEQ ID NO: 61788 - DNA, 20 bp, human
gcggttggcactgacagggg

SEQ ID NO: 61789 - DNA, 20 bp, human
gggttgagggcacgaagcaa

SEQ ID NO: 61790 - DNA, 20 bp, human
ggtgccctcaacccgcatgg

SEQ ID NO: 61791 - DNA, 20 bp, human
ggcgcgccccgcctcactga

SEQ ID NO: 61792 - DNA, 20 bp, human
gctcatcgccgtgcaggcag

SEQ ID NO: 61793 - DNA, 20 bp, human
ggccagcggctccgccatgc

SEQ ID NO: 61794 - DNA, 20 bp, human
gcgccggggagcgggactgg

SEQ ID NO: 61795 - DNA, 20 bp, human
gccggctggtgaggcgatgg

SEQ ID NO: 61796 - DNA, 20 bp, human
gaggctggagaggagcgagt

SEQ ID NO: 61797 - DNA, 20 bp, human
gccgcgcgctgcatctccct

SEQ ID NO: 61798 - DNA, 20 bp, human
gggtaggagggagaaatcag

SEQ ID NO: 61799 - DNA, 20 bp, human
ggggaaacccgcgtagccga

SEQ ID NO: 61800 - DNA, 20 bp, human
gtcgggacgagaacccggaa

SEQ ID NO: 61801 - DNA, 20 bp, human
gtcagggttaggatgagtga

SEQ ID NO: 61802 - DNA, 20 bp, human
gggtagtagtagaagaatgg

SEQ ID NO: 61803 - DNA, 20 bp, human
gatggtgagagcccaggcgc

SEQ ID NO: 61804 - DNA, 20 bp, human
gaacctgcggcgagggtatg

SEQ ID NO: 61805 - DNA, 20 bp, human
ggacgagaacccggaagggg

SEQ ID NO: 61806 - DNA, 20 bp, human
ggagagggtcacactcccgt

SEQ ID NO: 61807 - DNA, 20 bp, human
gctgcagctccggagcctac

SEQ ID NO: 61808 - DNA, 20 bp, human
gtgaccctctcgcctcctgg

SEQ ID NO: 61809 - DNA, 20 bp, human
ggtcacactcccgtaggctc

SEQ ID NO: 61810 - DNA, 20 bp, human
gttcccgccaggaggcgaga

SEQ ID NO: 61811 - DNA, 20 bp, human
gtcaagagcttcccgccagg

SEQ ID NO: 61812 - DNA, 20 bp, human
gggcagctgcccgacagatg

SEQ ID NO: 61813 - DNA, 20 bp, human
gtacccaccaggcgtccccg

SEQ ID NO: 61814 - DNA, 20 bp, human
gaggccgcggggacgcctgg

SEQ ID NO: 61815 - DNA, 20 bp, human
gattagtgggatagaacagg

SEQ ID NO: 61816 - DNA, 20 bp, human
gggtgattagccctgacccg

SEQ ID NO: 61817 - DNA, 20 bp, human
gagcagggcgggactcaggt

SEQ ID NO: 61818 - DNA, 20 bp, human
gcgggatgcgaagagctatg

SEQ ID NO: 61819 - DNA, 20 bp, human
gcccgcgcgggacacaagga

SEQ ID NO: 61820 - DNA, 20 bp, human
gggaaggattcgaattccgg

SEQ ID NO: 61821 - DNA, 20 bp, human
gatgcgaagagctatgggga

SEQ ID NO: 61822 - DNA, 20 bp, human
gattcggagggatagatcgg

SEQ ID NO: 61823 - DNA, 20 bp, human
gcgcggcctagtaggtagaa

SEQ ID NO: 61824 - DNA, 20 bp, human
ggaagctaccgcggcctagt

SEQ ID NO: 61825 - DNA, 20 bp, human
gtggggaaggattcgaattc

SEQ ID NO: 61826 - DNA, 20 bp, human
gacgtggagtctgcctcagg

SEQ ID NO: 61827 - DNA, 20 bp, human
ggagcagcggggtggccgta

SEQ ID NO: 61828 - DNA, 20 bp, human
gggtggaggaaccgctccgg

SEQ ID NO: 61829 - DNA, 20 bp, human
gggagcggttcctccacctg

SEQ ID NO: 61830 - DNA, 20 bp, human
gtgcgggtcgtggcatccca

SEQ ID NO: 61831 - DNA, 20 bp, human
gaggaggccggtccagaaga

SEQ ID NO: 61832 - DNA, 20 bp, human
ggcgcgcgtaaatcctagag

SEQ ID NO: 61833 - DNA, 20 bp, human
gaggccggtccagaagacgg

SEQ ID NO: 61834 - DNA, 20 bp, human
gcggggctggagtccacggt

SEQ ID NO: 61835 - DNA, 20 bp, human
gtggagtccacggtcggcgt

SEQ ID NO: 61836 - DNA, 20 bp, human
gcgccgcgggaagacgaacc

SEQ ID NO: 61837 - DNA, 20 bp, human
gtcccaggttcgtcttcccg

SEQ ID NO: 61838 - DNA, 20 bp, human
gcggcccctaaccctcgccg

SEQ ID NO: 61839 - DNA, 20 bp, human
gccaccccggccacatcccg

SEQ ID NO: 61840 - DNA, 20 bp, human
ggacacgcaggccgcagcga

SEQ ID NO: 61841 - DNA, 20 bp, human
gagacagcttcaggacacgc

SEQ ID NO: 61842 - DNA, 20 bp, human
gttcccgcggcgagggttag

SEQ ID NO: 61843 - DNA, 20 bp, human
gggcaagcgccggatctcgc

SEQ ID NO: 61844 - DNA, 20 bp, human
gggacgcgacctgggcgcag

SEQ ID NO: 61845 - DNA, 20 bp, human
gagggcccgggccctcgctg

SEQ ID NO: 61846 - DNA, 20 bp, human
ggcgcccgcccctctcctga

SEQ ID NO: 61847 - DNA, 20 bp, human
gcaggaggcgccctcaggag

SEQ ID NO: 61848 - DNA, 20 bp, human
gccagcgtcggctccgtctc

SEQ ID NO: 61849 - DNA, 20 bp, human
gaggcgggcaggcggcctaa

SEQ ID NO: 61850 - DNA, 20 bp, human
gaaaggaaccgggcctctcg

SEQ ID NO: 61851 - DNA, 20 bp, human
gccgtctcgggcacctccag

SEQ ID NO: 61852 - DNA, 20 bp, human
gcaggcggcctaaaggaacc

SEQ ID NO: 61853 - DNA, 20 bp, human
gtgcgcgcggagtcatcgat

SEQ ID NO: 61854 - DNA, 20 bp, human
ggaaccgggcctctcggggt

SEQ ID NO: 61855 - DNA, 20 bp, human
gtcgatcggccgaccccgag

SEQ ID NO: 61856 - DNA, 20 bp, human
gcagccttgccgtctcctcg

SEQ ID NO: 61857 - DNA, 20 bp, human
ggagccccgaggagacggca

SEQ ID NO: 61858 - DNA, 20 bp, human
ggcatcttgagtgacagtag

SEQ ID NO: 61859 - DNA, 20 bp, human
gacgtcaaaattgggatagt

SEQ ID NO: 61860 - DNA, 20 bp, human
gctacgaccctcagaactca

SEQ ID NO: 61861 - DNA, 20 bp, human
gggaggtaccctgagttctg

SEQ ID NO: 61862 - DNA, 20 bp, human
gcccagaggccaattcgtcg

SEQ ID NO: 61863 - DNA, 20 bp, human
gtcggccaactggcaagcac

SEQ ID NO: 61864 - DNA, 20 bp, human
gtggagatcgcaggtcgctc

SEQ ID NO: 61865 - DNA, 20 bp, human
gcggagcctaacgtcacttc

SEQ ID NO: 61866 - DNA, 20 bp, human
gaccagcagctgcaacaaga

SEQ ID NO: 61867 - DNA, 20 bp, human
gatcgtaaacaagtccaagg

SEQ ID NO: 61868 - DNA, 20 bp, human
gattctcctgctctgctctc

SEQ ID NO: 61869 - DNA, 20 bp, human
gtggacttgtttacgatgat

SEQ ID NO: 61870 - DNA, 20 bp, human
gtgcgaatgatgaacttctc

SEQ ID NO: 61871 - DNA, 20 bp, human
gaggtcagttgcattcaggt

SEQ ID NO: 61872 - DNA, 20 bp, human
gtgatgaacttctctggcaa

SEQ ID NO: 61873 - DNA, 20 bp, human
gttgcttggcttcatgtgtt

SEQ ID NO: 61874 - DNA, 20 bp, human
gaactttacagttagaagag

SEQ ID NO: 61875 - DNA, 20 bp, human
gagatacctgaattcaactt

SEQ ID NO: 61876 - DNA, 20 bp, human
ggcgtccggggtctccagta

SEQ ID NO: 61877 - DNA, 20 bp, human
gcaggtttccgcagctgagg

SEQ ID NO: 61878 - DNA, 20 bp, human
ggccagggccctctaacggg

SEQ ID NO: 61879 - DNA, 20 bp, human
gaccggagcgtcagccctac

SEQ ID NO: 61880 - DNA, 20 bp, human
gtcagccctactggagaccc

SEQ ID NO: 61881 - DNA, 20 bp, human
gtaagctccgctgcagagac

SEQ ID NO: 61882 - DNA, 20 bp, human
gtcaggccagggccctctaa

SEQ ID NO: 61883 - DNA, 20 bp, human
gtaactgcgggcccggcgta

SEQ ID NO: 61884 - DNA, 20 bp, human
gtccagtagggctgacgctc

SEQ ID NO: 61885 - DNA, 20 bp, human
gagctgagggggcagctccg

SEQ ID NO: 61886 - DNA, 20 bp, human
gcaagtgcgcagggctaaaa

SEQ ID NO: 61887 - DNA, 20 bp, human
ggcgcagggctaaaatggac

SEQ ID NO: 61888 - DNA, 20 bp, human
ggtaactgccagcagaagtc

SEQ ID NO: 61889 - DNA, 20 bp, human
gggcagttactgagagagat

SEQ ID NO: 61890 - DNA, 20 bp, human
gcacagaggaggtttctagt

SEQ ID NO: 61891 - DNA, 20 bp, human
ggatcaatgacatatcacag

SEQ ID NO: 61892 - DNA, 20 bp, human
gcttcagaccacacagggaa

SEQ ID NO: 61893 - DNA, 20 bp, human
gatcctgcagaaccactctt

SEQ ID NO: 61894 - DNA, 20 bp, human
gacagacctccttggaaaca

SEQ ID NO: 61895 - DNA, 20 bp, human
gttctcacaacgaaaatagg

SEQ ID NO: 61896 - DNA, 20 bp, human
gtgagagtagcactggacgg

SEQ ID NO: 61897 - DNA, 20 bp, human
ggcgggctggcagctagagt

SEQ ID NO: 61898 - DNA, 20 bp, human
ggaccggagacgggaccagg

SEQ ID NO: 61899 - DNA, 20 bp, human
gcgggcggaggaggcgacgg

SEQ ID NO: 61900 - DNA, 20 bp, human
gcagcagcgaacggcccggg

SEQ ID NO: 61901 - DNA, 20 bp, human
gtcgcaccggacgttgaggt

SEQ ID NO: 61902 - DNA, 20 bp, human
gcgagagctgggaccggaga

SEQ ID NO: 61903 - DNA, 20 bp, human
gggagatgtcgagggatcag

SEQ ID NO: 61904 - DNA, 20 bp, human
ggcgcagcagcgaacggccc

SEQ ID NO: 61905 - DNA, 20 bp, human
gcgggcctgggccgaaacag

SEQ ID NO: 61906 - DNA, 20 bp, human
gtgcaggtgtgcagactccc

SEQ ID NO: 61907 - DNA, 20 bp, human
gccctttgggcggacctctg

SEQ ID NO: 61908 - DNA, 20 bp, human
gaccgcacacagatgggcat

SEQ ID NO: 61909 - DNA, 20 bp, human
ggtttctaccgcacacagat

SEQ ID NO: 61910 - DNA, 20 bp, human
gcagcgccagcatggcctct

SEQ ID NO: 61911 - DNA, 20 bp, human
gctcgcatttaactttgcag

SEQ ID NO: 61912 - DNA, 20 bp, human
gaagggagcaggccttgtct

SEQ ID NO: 61913 - DNA, 20 bp, human
gagctggaggtgcagaacct

SEQ ID NO: 61914 - DNA, 20 bp, human
ggagaaagaacgtgccaagc

SEQ ID NO: 61915 - DNA, 20 bp, human
gagattcaagatcccaaggt

SEQ ID NO: 61916 - DNA, 20 bp, human
gccggtccgcagcctcacag

SEQ ID NO: 61917 - DNA, 20 bp, human
gcgccgggttcacagctact

SEQ ID NO: 61918 - DNA, 20 bp, human
gtccgggtctgtatgcgagg

SEQ ID NO: 61919 - DNA, 20 bp, human
gggacgcgcggagatgacgc

SEQ ID NO: 61920 - DNA, 20 bp, human
gcccgcctcgcatacagacc

SEQ ID NO: 61921 - DNA, 20 bp, human
gggacctgggagcaacgaat

SEQ ID NO: 61922 - DNA, 20 bp, human
gtgcgaggcggggccggtcg

SEQ ID NO: 61923 - DNA, 20 bp, human
gaggtccgggtctgtatgcg

SEQ ID NO: 61924 - DNA, 20 bp, human
gtaagagtcccctccccgac

SEQ ID NO: 61925 - DNA, 20 bp, human
gaggcgccatggctgcggag

SEQ ID NO: 61926 - DNA, 20 bp, human
ggaagagcacagggacgagg

SEQ ID NO: 61927 - DNA, 20 bp, human
gggagcgagggcatgcccaa

SEQ ID NO: 61928 - DNA, 20 bp, human
ggcatcgtcaagggagtcga

SEQ ID NO: 61929 - DNA, 20 bp, human
gcatgtgacccggtccgaca

SEQ ID NO: 61930 - DNA, 20 bp, human
gccgcggggccggcccgacg

SEQ ID NO: 61931 - DNA, 20 bp, human
gcgcagccagcggcacacct

SEQ ID NO: 61932 - DNA, 20 bp, human
gaagcgagagcggggcaagg

SEQ ID NO: 61933 - DNA, 20 bp, human
gggggcgagaggcatcgtca

SEQ ID NO: 61934 - DNA, 20 bp, human
ggaagggaaaagcgagagcg

SEQ ID NO: 61935 - DNA, 20 bp, human
gctctggcgccggatagccc

SEQ ID NO: 61936 - DNA, 20 bp, human
gcgccgcccaaccaaggacc

SEQ ID NO: 61937 - DNA, 20 bp, human
gagctgccgggtccttggtt

SEQ ID NO: 61938 - DNA, 20 bp, human
gtcccgccgggagttccacg

SEQ ID NO: 61939 - DNA, 20 bp, human
ggggtaccgccgcccaacca

SEQ ID NO: 61940 - DNA, 20 bp, human
gcggcagcggaagcgggtcc

SEQ ID NO: 61941 - DNA, 20 bp, human
gtccgccgagaggaagctcg

SEQ ID NO: 61942 - DNA, 20 bp, human
gcgcagccccgtggaactcc

SEQ ID NO: 61943 - DNA, 20 bp, human
gagccccgtggaactcccgg

SEQ ID NO: 61944 - DNA, 20 bp, human
gaggccgggggatgacgcgg

SEQ ID NO: 61945 - DNA, 20 bp, human
gaaggcgggcggggacgaca

SEQ ID NO: 61946 - DNA, 20 bp, human
gagagccccgcacagagcga

SEQ ID NO: 61947 - DNA, 20 bp, human
ggcgagacccccaaggtgta

SEQ ID NO: 61948 - DNA, 20 bp, human
gccgcggtgagagaacgctg

SEQ ID NO: 61949 - DNA, 20 bp, human
gcgcctcactccagagagag

SEQ ID NO: 61950 - DNA, 20 bp, human
gagacccccaaggtgtaggg

SEQ ID NO: 61951 - DNA, 20 bp, human
ggcgtggggcgagaccccca

SEQ ID NO: 61952 - DNA, 20 bp, human
gccccaaggtgtagggaggg

SEQ ID NO: 61953 - DNA, 20 bp, human
ggctcccgcatgtgtcgctg

SEQ ID NO: 61954 - DNA, 20 bp, human
ggtctcgccccacgccccac

SEQ ID NO: 61955 - DNA, 20 bp, human
gtcgctctcagtctcagcgg

SEQ ID NO: 61956 - DNA, 20 bp, human
ggccgcggcgccgagaaagt

SEQ ID NO: 61957 - DNA, 20 bp, human
ggtccagggccacttctccc

SEQ ID NO: 61958 - DNA, 20 bp, human
gcggcagctgcggaaggctc

SEQ ID NO: 61959 - DNA, 20 bp, human
gcggcgccgagaaagtgggt

SEQ ID NO: 61960 - DNA, 20 bp, human
gtgccaactgctggccagaa

SEQ ID NO: 61961 - DNA, 20 bp, human
gtgcggcttctgcccgtcca

SEQ ID NO: 61962 - DNA, 20 bp, human
gaggctccggcgcggtactg

SEQ ID NO: 61963 - DNA, 20 bp, human
gttcctccttcggactgaag

SEQ ID NO: 61964 - DNA, 20 bp, human
gcacttctcccgggacagtc

SEQ ID NO: 61965 - DNA, 20 bp, human
gtgccgcttcagtccgaagg

SEQ ID NO: 61966 - DNA, 20 bp, human
gggcaggtccacaatactac

SEQ ID NO: 61967 - DNA, 20 bp, human
ggggaggagagttggtgaac

SEQ ID NO: 61968 - DNA, 20 bp, human
gatctacctggcttgaggaa

SEQ ID NO: 61969 - DNA, 20 bp, human
ggcagcaaaagacgacgaac

SEQ ID NO: 61970 - DNA, 20 bp, human
gttggagtagaacctagacc

SEQ ID NO: 61971 - DNA, 20 bp, human
ggcaaaagacgacgaactgg

SEQ ID NO: 61972 - DNA, 20 bp, human
gggagagttggtgaacgggc

SEQ ID NO: 61973 - DNA, 20 bp, human
ggctggtgaacaagatgagg

SEQ ID NO: 61974 - DNA, 20 bp, human
gatgaatcgtgtggtagagg

SEQ ID NO: 61975 - DNA, 20 bp, human
gcatgctggtgaacaagatg

SEQ ID NO: 61976 - DNA, 20 bp, human
gggtggaaccgaggagaacg

SEQ ID NO: 61977 - DNA, 20 bp, human
gactgtctcgtggcacccgg

SEQ ID NO: 61978 - DNA, 20 bp, human
gccgcggcggacacttccct

SEQ ID NO: 61979 - DNA, 20 bp, human
gcggcgctccacgttctcct

SEQ ID NO: 61980 - DNA, 20 bp, human
ggcgccgacggaactcatcc

SEQ ID NO: 61981 - DNA, 20 bp, human
ggtggcacccggtggaaccg

SEQ ID NO: 61982 - DNA, 20 bp, human
ggcgccgggagcggcgaata

SEQ ID NO: 61983 - DNA, 20 bp, human
gtcatccgcgacctggtgag

SEQ ID NO: 61984 - DNA, 20 bp, human
gcacgagacagtcccgccca

SEQ ID NO: 61985 - DNA, 20 bp, human
gcagcctggatgagttccgt

SEQ ID NO: 61986 - DNA, 20 bp, human
ggtacgcgcgccctacccag

SEQ ID NO: 61987 - DNA, 20 bp, human
gcgcaatggagcttccccta

SEQ ID NO: 61988 - DNA, 20 bp, human
gagctccattgcgaccgggt

SEQ ID NO: 61989 - DNA, 20 bp, human
gaggagacaagacgcgaggc

SEQ ID NO: 61990 - DNA, 20 bp, human
ggaatcatcgcaccgcccta

SEQ ID NO: 61991 - DNA, 20 bp, human
gagcgcccacccggtcgcaa

SEQ ID NO: 61992 - DNA, 20 bp, human
ggaggccggcagcgcccacc

SEQ ID NO: 61993 - DNA, 20 bp, human
ggggaagctccattgcgacc

SEQ ID NO: 61994 - DNA, 20 bp, human
ggcgtagcctccaggtgaca

SEQ ID NO: 61995 - DNA, 20 bp, human
ggcctaggagacaagacgcg

SEQ ID NO: 61996 - DNA, 20 bp, human
gctgaaggggacacaagagg

SEQ ID NO: 61997 - DNA, 20 bp, human
gggagcatgtgtgacagcta

SEQ ID NO: 61998 - DNA, 20 bp, human
gatagtctgagacccctgaa

SEQ ID NO: 61999 - DNA, 20 bp, human
gtgaatgggctggtaagctg

SEQ ID NO: 62000 - DNA, 20 bp, human
gagctagcaacggaaggtcg

SEQ ID NO: 62001 - DNA, 20 bp, human
gaggcaagatcccaacctcc

SEQ ID NO: 62002 - DNA, 20 bp, human
ggtccgggagatgcctgaat

SEQ ID NO: 62003 - DNA, 20 bp, human
gatcttgcctctgaatgtgg

SEQ ID NO: 62004 - DNA, 20 bp, human
ggaaggagcccacctgctct

SEQ ID NO: 62005 - DNA, 20 bp, human
gtggactgagatggatggag

SEQ ID NO: 62006 - DNA, 20 bp, human
gtgaggccgtgtcagcacga

SEQ ID NO: 62007 - DNA, 20 bp, human
gcattgaaaggagagcaacg

SEQ ID NO: 62008 - DNA, 20 bp, human
gaaactcaccaagacacagg

SEQ ID NO: 62009 - DNA, 20 bp, human
gcacaggagggtggtctgtt

SEQ ID NO: 62010 - DNA, 20 bp, human
gctgaaactcaccaagacac

SEQ ID NO: 62011 - DNA, 20 bp, human
gggggtccatcgtgctgaca

SEQ ID NO: 62012 - DNA, 20 bp, human
gagaaccccatatagaaata

SEQ ID NO: 62013 - DNA, 20 bp, human
gaaggagagcaacggggctg

SEQ ID NO: 62014 - DNA, 20 bp, human
ggagccccacaagctagctt

SEQ ID NO: 62015 - DNA, 20 bp, human
gcctgctaatgtgcattgaa

SEQ ID NO: 62016 - DNA, 20 bp, human
gggctacacacagtagagta

SEQ ID NO: 62017 - DNA, 20 bp, human
gagtagagtaggggattcca

SEQ ID NO: 62018 - DNA, 20 bp, human
gctccagaggactagaatct

SEQ ID NO: 62019 - DNA, 20 bp, human
ggagccaagctagaaagcag

SEQ ID NO: 62020 - DNA, 20 bp, human
gtacttaccgaagaacagta

SEQ ID NO: 62021 - DNA, 20 bp, human
gaggactagaatctgggtgt

SEQ ID NO: 62022 - DNA, 20 bp, human
ggagtaggggattccatggc

SEQ ID NO: 62023 - DNA, 20 bp, human
gtgattcctgaaaagacggt

SEQ ID NO: 62024 - DNA, 20 bp, human
gaagaagatggctcctgcca

SEQ ID NO: 62025 - DNA, 20 bp, human
ggctccactacagagtccct

SEQ ID NO: 62026 - DNA, 20 bp, human
gccactgctggaatcatctt

SEQ ID NO: 62027 - DNA, 20 bp, human
gcaggaagagggggactctg

SEQ ID NO: 62028 - DNA, 20 bp, human
gagtctagtgccctgggtcg

SEQ ID NO: 62029 - DNA, 20 bp, human
ggtaagagcaagaccactgc

SEQ ID NO: 62030 - DNA, 20 bp, human
gatcatcttgggctggagat

SEQ ID NO: 62031 - DNA, 20 bp, human
gtgagggccaagtcaaacac

SEQ ID NO: 62032 - DNA, 20 bp, human
ggtcaaacacaggtgaagga

SEQ ID NO: 62033 - DNA, 20 bp, human
ggttgaacaagcaggtaaga

SEQ ID NO: 62034 - DNA, 20 bp, human
gtgctggaatcatcttgggc

SEQ ID NO: 62035 - DNA, 20 bp, human
ggagggggactctgtggtca

SEQ ID NO: 62036 - DNA, 20 bp, human
gcagggaccgtcagagacag

SEQ ID NO: 62037 - DNA, 20 bp, human
gggaggtcacaaccagagaa

SEQ ID NO: 62038 - DNA, 20 bp, human
gggtcacaaccagagaaggg

SEQ ID NO: 62039 - DNA, 20 bp, human
gtggggtcgaccagagcgat

SEQ ID NO: 62040 - DNA, 20 bp, human
ggcgctgggccgatcataga

SEQ ID NO: 62041 - DNA, 20 bp, human
gtgaaaatagaagctgtcag

SEQ ID NO: 62042 - DNA, 20 bp, human
gtctactggtaagtgctggg

SEQ ID NO: 62043 - DNA, 20 bp, human
gtcgaccagagcgattggca

SEQ ID NO: 62044 - DNA, 20 bp, human
gcagtgtggacagaatctcg

SEQ ID NO: 62045 - DNA, 20 bp, human
gtcgaccccaacacactagg

SEQ ID NO: 62046 - DNA, 20 bp, human
ggggagcccaatagagtcag

SEQ ID NO: 62047 - DNA, 20 bp, human
gctgaagcaaagggtctcag

SEQ ID NO: 62048 - DNA, 20 bp, human
gtggccctctgcactcaccc

SEQ ID NO: 62049 - DNA, 20 bp, human
ggccaaatagaacaggaact

SEQ ID NO: 62050 - DNA, 20 bp, human
ggacaggtgcagaggtgtaa

SEQ ID NO: 62051 - DNA, 20 bp, human
gtgaccacagagacagatct

SEQ ID NO: 62052 - DNA, 20 bp, human
gtaatgaatcctccaagcca

SEQ ID NO: 62053 - DNA, 20 bp, human
gaacggcttcagctagggag

SEQ ID NO: 62054 - DNA, 20 bp, human
gggtgcagaggtgtaagggt

SEQ ID NO: 62055 - DNA, 20 bp, human
gtagggaagggactccaggt

SEQ ID NO: 62056 - DNA, 20 bp, human
ggaaggaggtagtcagaccg

SEQ ID NO: 62057 - DNA, 20 bp, human
gagagaagacggtccaagaa

SEQ ID NO: 62058 - DNA, 20 bp, human
gggaccgtcttctctcacca

SEQ ID NO: 62059 - DNA, 20 bp, human
gtacggaagaaccaggagtt

SEQ ID NO: 62060 - DNA, 20 bp, human
gcaggagtttggcgtgacca

SEQ ID NO: 62061 - DNA, 20 bp, human
gctcttattagaatatccct

SEQ ID NO: 62062 - DNA, 20 bp, human
gtccaagaagggacgttatc

SEQ ID NO: 62063 - DNA, 20 bp, human
ggcctgataacgtcccttct

SEQ ID NO: 62064 - DNA, 20 bp, human
gtaaaaaagttggaaacaca

SEQ ID NO: 62065 - DNA, 20 bp, human
ggtctggaatcaactgccca

SEQ ID NO: 62066 - DNA, 20 bp, human
gtggagctggtggatactct

SEQ ID NO: 62067 - DNA, 20 bp, human
gagtatccaccagctccata

SEQ ID NO: 62068 - DNA, 20 bp, human
gcagctccatagggcaccca

SEQ ID NO: 62069 - DNA, 20 bp, human
gtctgacttaccccacagga

SEQ ID NO: 62070 - DNA, 20 bp, human
ggctggtggatactctgggc

SEQ ID NO: 62071 - DNA, 20 bp, human
gtgcagccatgggtgcccta

SEQ ID NO: 62072 - DNA, 20 bp, human
gccagattggaacaaggaca

SEQ ID NO: 62073 - DNA, 20 bp, human
gttggtctgacttaccccac

SEQ ID NO: 62074 - DNA, 20 bp, human
ggatgctgactggtgacgag

SEQ ID NO: 62075 - DNA, 20 bp, human
gtgtgctcccatccagaaaa

SEQ ID NO: 62076 - DNA, 20 bp, human
gtgggagcagctctacacag

SEQ ID NO: 62077 - DNA, 20 bp, human
gaggagggccggaaaccaca

SEQ ID NO: 62078 - DNA, 20 bp, human
gctgggggtcgaggtctgag

SEQ ID NO: 62079 - DNA, 20 bp, human
gctacacagtggtttctcaa

SEQ ID NO: 62080 - DNA, 20 bp, human
ggaggtgattctgtagctgg

SEQ ID NO: 62081 - DNA, 20 bp, human
gtcgccctgagagacctctc

SEQ ID NO: 62082 - DNA, 20 bp, human
gcagaaaggagagaacgcag

SEQ ID NO: 62083 - DNA, 20 bp, human
gagctaggccagctctaagt

SEQ ID NO: 62084 - DNA, 20 bp, human
gctgtcattgacactggcag

SEQ ID NO: 62085 - DNA, 20 bp, human
ggtgccagagaggtctctca

SEQ ID NO: 62086 - DNA, 20 bp, human
gacttcactgtggtgtgtcc

SEQ ID NO: 62087 - DNA, 20 bp, human
gaataagctctaataaacag

SEQ ID NO: 62088 - DNA, 20 bp, human
gccagcttggagacaacatg

SEQ ID NO: 62089 - DNA, 20 bp, human
gtggtccaaggaaaataatg

SEQ ID NO: 62090 - DNA, 20 bp, human
gaatgaggaagagagaattg

SEQ ID NO: 62091 - DNA, 20 bp, human
gtgagtccaacttaccccaa

SEQ ID NO: 62092 - DNA, 20 bp, human
gtcagaggggacagttagaa

SEQ ID NO: 62093 - DNA, 20 bp, human
gttccagttgatgggcaagt

SEQ ID NO: 62094 - DNA, 20 bp, human
gtatcaaggaaacttcactg

SEQ ID NO: 62095 - DNA, 20 bp, human
ggggtaagttggactcagag

SEQ ID NO: 62096 - DNA, 20 bp, human
ggcagcagcaaaactgtcaa

SEQ ID NO: 62097 - DNA, 20 bp, human
gatgctggggaggtgagctt

SEQ ID NO: 62098 - DNA, 20 bp, human
ggcactgtgccaacgtccag

SEQ ID NO: 62099 - DNA, 20 bp, human
gcttaaaacccactggacgt

SEQ ID NO: 62100 - DNA, 20 bp, human
ggctgctgctgggtgagtga

SEQ ID NO: 62101 - DNA, 20 bp, human
gcgtatgtgaaatgctgggg

SEQ ID NO: 62102 - DNA, 20 bp, human
ggaagcagccacaggtttct

SEQ ID NO: 62103 - DNA, 20 bp, human
gacactggtacctggagtcc

SEQ ID NO: 62104 - DNA, 20 bp, human
gttctgaccttaggaaccat

SEQ ID NO: 62105 - DNA, 20 bp, human
gggcctgctccttaccacac

SEQ ID NO: 62106 - DNA, 20 bp, human
gccaggagggagagaggaac

SEQ ID NO: 62107 - DNA, 20 bp, human
gagaccgtcaggacacccag

SEQ ID NO: 62108 - DNA, 20 bp, human
gcctgggcaaggatgagggg

SEQ ID NO: 62109 - DNA, 20 bp, human
gctcagagcgggttctgatg

SEQ ID NO: 62110 - DNA, 20 bp, human
gtggcggattctaccctaga

SEQ ID NO: 62111 - DNA, 20 bp, human
gctgggtgttcagtaagatt

SEQ ID NO: 62112 - DNA, 20 bp, human
gccagggttatccccaactg

SEQ ID NO: 62113 - DNA, 20 bp, human
gaacagaacatcaagagtct

SEQ ID NO: 62114 - DNA, 20 bp, human
gaaccctgggcaaggatgag

SEQ ID NO: 62115 - DNA, 20 bp, human
gaggaacgggaacctcagtt

SEQ ID NO: 62116 - DNA, 20 bp, human
gagaccgtcaggacacccag

SEQ ID NO: 62117 - DNA, 20 bp, human
gtggcggattctaccctaga

SEQ ID NO: 62118 - DNA, 20 bp, human
gccaggagggagagaggaac

SEQ ID NO: 62119 - DNA, 20 bp, human
gctgggtgttcagtaagatt

SEQ ID NO: 62120 - DNA, 20 bp, human
gcctgggcaaggatgagggg

SEQ ID NO: 62121 - DNA, 20 bp, human
gctagagggcaaacaaattc

SEQ ID NO: 62122 - DNA, 20 bp, human
gaacagaacatcaagagtct

SEQ ID NO: 62123 - DNA, 20 bp, human
gccagggttatccccaactg

SEQ ID NO: 62124 - DNA, 20 bp, human
gtgggtgagtcagggccccc

SEQ ID NO: 62125 - DNA, 20 bp, human
gaaccctgggcaaggatgag

SEQ ID NO: 62126 - DNA, 20 bp, human
ggtcagagacaggtattaat

SEQ ID NO: 62127 - DNA, 20 bp, human
gaggcaaaaagagaggaaac

SEQ ID NO: 62128 - DNA, 20 bp, human
ggactaagaacacttcaata

SEQ ID NO: 62129 - DNA, 20 bp, human
ggctatttctaaggcccggg

SEQ ID NO: 62130 - DNA, 20 bp, human
gaaacaggagagaagggaca

SEQ ID NO: 62131 - DNA, 20 bp, human
ggcagccttcacaggatcag

SEQ ID NO: 62132 - DNA, 20 bp, human
gggattactcatctcaaatt

SEQ ID NO: 62133 - DNA, 20 bp, human
gcaaattgggcagccttcac

SEQ ID NO: 62134 - DNA, 20 bp, human
gatgacagaaagtcagagac

SEQ ID NO: 62135 - DNA, 20 bp, human
gaattccactgatcctgtga

SEQ ID NO: 62136 - DNA, 20 bp, human
gccccatcttggcttgtcct

SEQ ID NO: 62137 - DNA, 20 bp, human
gagaatgctggttccaattg

SEQ ID NO: 62138 - DNA, 20 bp, human
gagctgtggattgagctcct

SEQ ID NO: 62139 - DNA, 20 bp, human
ggctacttctaggtaagtca

SEQ ID NO: 62140 - DNA, 20 bp, human
gctcatgagtatgccccaat

SEQ ID NO: 62141 - DNA, 20 bp, human
ggtgacagagatgggtggag

SEQ ID NO: 62142 - DNA, 20 bp, human
gtagaaattgaaaatcatag

SEQ ID NO: 62143 - DNA, 20 bp, human
gtcctcctgtctagtcggtt

SEQ ID NO: 62144 - DNA, 20 bp, human
gaggggtcccatcccttcgt

SEQ ID NO: 62145 - DNA, 20 bp, human
gcgaatgagactcccacgaa

SEQ ID NO: 62146 - DNA, 20 bp, human
gccaagccgactagacagga

SEQ ID NO: 62147 - DNA, 20 bp, human
gattccagggttctcctcta

SEQ ID NO: 62148 - DNA, 20 bp, human
gagctgtggattgagctacc

SEQ ID NO: 62149 - DNA, 20 bp, human
gctcatgactatgacccaat

SEQ ID NO: 62150 - DNA, 20 bp, human
gtagaaattaaaaaccatag

SEQ ID NO: 62151 - DNA, 20 bp, human
gactggcaggtgacagagat

SEQ ID NO: 62152 - DNA, 20 bp, human
gtgagactcccacaaaggga

SEQ ID NO: 62153 - DNA, 20 bp, human
gcgaatgagactcccacaaa

SEQ ID NO: 62154 - DNA, 20 bp, human
gggggtgtctgatgaaccca

SEQ ID NO: 62155 - DNA, 20 bp, human
gagagatgggtggagggact

SEQ ID NO: 62156 - DNA, 20 bp, human
gagttcttcaggtacgagga

SEQ ID NO: 62157 - DNA, 20 bp, human
gacgccgaggaggggctctg

SEQ ID NO: 62158 - DNA, 20 bp, human
gaccagggcccgactgaggg

SEQ ID NO: 62159 - DNA, 20 bp, human
gagcccgcagagcccctcct

SEQ ID NO: 62160 - DNA, 20 bp, human
gagacacaagaggcgacagg

SEQ ID NO: 62161 - DNA, 20 bp, human
gctcccacaggatgtgagag

SEQ ID NO: 62162 - DNA, 20 bp, human
gccgaccagggcccgactga

SEQ ID NO: 62163 - DNA, 20 bp, human
gggctcctggctcccgtgac

SEQ ID NO: 62164 - DNA, 20 bp, human
gtcaggggtgaaagttcttc

SEQ ID NO: 62165 - DNA, 20 bp, human
ggtgcccgcggtgtcccggg

SEQ ID NO: 62166 - DNA, 20 bp, human
ggcgaccaagccgcaggtgg

SEQ ID NO: 62167 - DNA, 20 bp, human
gtccagcctggaaccctggg

SEQ ID NO: 62168 - DNA, 20 bp, human
gtatcccagggggttccggg

SEQ ID NO: 62169 - DNA, 20 bp, human
gtcagcgaccaagccgcagg

SEQ ID NO: 62170 - DNA, 20 bp, human
ggcgggccagggtatcccag

SEQ ID NO: 62171 - DNA, 20 bp, human
gggctcggcccgagctcagg

SEQ ID NO: 62172 - DNA, 20 bp, human
ggtgtcagcgaccaagccgc

SEQ ID NO: 62173 - DNA, 20 bp, human
gctgggcggtggctgagatg

SEQ ID NO: 62174 - DNA, 20 bp, human
gctgggaagagggaatctgc

SEQ ID NO: 62175 - DNA, 20 bp, human
ggctccggcctgcagaccac

SEQ ID NO: 62176 - DNA, 20 bp, human
gtgtttacacagcggcgggc

SEQ ID NO: 62177 - DNA, 20 bp, human
gcgggacccagccccaccgg

SEQ ID NO: 62178 - DNA, 20 bp, human
gcgagcccgggagtccctat

SEQ ID NO: 62179 - DNA, 20 bp, human
gccgggccgtgtttacacag

SEQ ID NO: 62180 - DNA, 20 bp, human
gagacgggacccagccccac

SEQ ID NO: 62181 - DNA, 20 bp, human
ggtcccgcctgggtgaggtc

SEQ ID NO: 62182 - DNA, 20 bp, human
ggacagcccccgtccccata

SEQ ID NO: 62183 - DNA, 20 bp, human
gcagctcggacgcgaaggac

SEQ ID NO: 62184 - DNA, 20 bp, human
gtgggacaaagcgccggatg

SEQ ID NO: 62185 - DNA, 20 bp, human
gccagcctatagggactccc

SEQ ID NO: 62186 - DNA, 20 bp, human
gctccagttccggagtccag

SEQ ID NO: 62187 - DNA, 20 bp, human
gcatctccgctccagcaagg

SEQ ID NO: 62188 - DNA, 20 bp, human
gcgccaggagtccccattca

SEQ ID NO: 62189 - DNA, 20 bp, human
gggatctgctggaggacatc

SEQ ID NO: 62190 - DNA, 20 bp, human
ggcggtcagccactggactc

SEQ ID NO: 62191 - DNA, 20 bp, human
gccaagctcacttttcgggg

SEQ ID NO: 62192 - DNA, 20 bp, human
ggtgagcttggccctgaatg

SEQ ID NO: 62193 - DNA, 20 bp, human
gcagcaaggcggtcagccac

SEQ ID NO: 62194 - DNA, 20 bp, human
gaagtggcgcacaacgacga

SEQ ID NO: 62195 - DNA, 20 bp, human
gagaggccaggcctagggtg

SEQ ID NO: 62196 - DNA, 20 bp, human
gaccgggagcgcggacaacg

SEQ ID NO: 62197 - DNA, 20 bp, human
gggacatcaatcctccccga

SEQ ID NO: 62198 - DNA, 20 bp, human
gcgctggcctgctccctccg

SEQ ID NO: 62199 - DNA, 20 bp, human
gagcgagtgtgaggagacga

SEQ ID NO: 62200 - DNA, 20 bp, human
gaggtaagggcgcagctggg

SEQ ID NO: 62201 - DNA, 20 bp, human
gcgagggaggagcaccggga

SEQ ID NO: 62202 - DNA, 20 bp, human
gctgcgtccgccgggagcgg

SEQ ID NO: 62203 - DNA, 20 bp, human
gagggtctcagccggccggg

SEQ ID NO: 62204 - DNA, 20 bp, human
ggcggctgcatgatgctgaa

SEQ ID NO: 62205 - DNA, 20 bp, human
gcccttaccttcctcggcgg

SEQ ID NO: 62206 - DNA, 20 bp, human
gcagagagcatggagctgag

SEQ ID NO: 62207 - DNA, 20 bp, human
ggagtcccccagctctaaca

SEQ ID NO: 62208 - DNA, 20 bp, human
gtcttacgggcttaccaggg

SEQ ID NO: 62209 - DNA, 20 bp, human
gtggcagccaccgtattaga

SEQ ID NO: 62210 - DNA, 20 bp, human
gggggactcttcagagtcaa

SEQ ID NO: 62211 - DNA, 20 bp, human
gcccattggagcttcatagg

SEQ ID NO: 62212 - DNA, 20 bp, human
ggctgccacacggacttggg

SEQ ID NO: 62213 - DNA, 20 bp, human
gtcttcttacgggcttacca

SEQ ID NO: 62214 - DNA, 20 bp, human
gtcctcaggcaaggacatgg

SEQ ID NO: 62215 - DNA, 20 bp, human
gttgcccattggagcttcat

SEQ ID NO: 62216 - DNA, 20 bp, human
gctctctgtgatggcgacca

SEQ ID NO: 62217 - DNA, 20 bp, human
gacagagctgtgggggtcct

SEQ ID NO: 62218 - DNA, 20 bp, human
gtccaggtaagggcactcca

SEQ ID NO: 62219 - DNA, 20 bp, human
gcagacacctgtccaggtaa

SEQ ID NO: 62220 - DNA, 20 bp, human
gtcgccatcacagagagaca

SEQ ID NO: 62221 - DNA, 20 bp, human
gaggcggcagacacctgtcc

SEQ ID NO: 62222 - DNA, 20 bp, human
gccatggcagaatatctgac

SEQ ID NO: 62223 - DNA, 20 bp, human
gcagaggccccgaatggatg

SEQ ID NO: 62224 - DNA, 20 bp, human
ggtcatggtgttgtgtgggg

SEQ ID NO: 62225 - DNA, 20 bp, human
gcctcccataatggaaaccg

SEQ ID NO: 62226 - DNA, 20 bp, human
gctggagctccgggacaact

SEQ ID NO: 62227 - DNA, 20 bp, human
gatcttgctgggcccaccag

SEQ ID NO: 62228 - DNA, 20 bp, human
gcagcaagatggatctactg

SEQ ID NO: 62229 - DNA, 20 bp, human
gtgtctccctgtaggaccca

SEQ ID NO: 62230 - DNA, 20 bp, human
gtgctgggcccaccagggga

SEQ ID NO: 62231 - DNA, 20 bp, human
ggcaccctaggtgcccacct

SEQ ID NO: 62232 - DNA, 20 bp, human
gctgcccaggtgggcaccta

SEQ ID NO: 62233 - DNA, 20 bp, human
gatcctgacagtgggaatct

SEQ ID NO: 62234 - DNA, 20 bp, human
gagctccgggacaactgggc

SEQ ID NO: 62235 - DNA, 20 bp, human
gagacaagcatcctgacagt

SEQ ID NO: 62236 - DNA, 20 bp, human
gcagcatgaggaccaggtca

SEQ ID NO: 62237 - DNA, 20 bp, human
gagaagggcaaggaattcag

SEQ ID NO: 62238 - DNA, 20 bp, human
gcaacagcctcggcagcatg

SEQ ID NO: 62239 - DNA, 20 bp, human
gggataaaaggaaataacgt

SEQ ID NO: 62240 - DNA, 20 bp, human
gccacggagggctcagagtc

SEQ ID NO: 62241 - DNA, 20 bp, human
gggagtgatgataagttcta

SEQ ID NO: 62242 - DNA, 20 bp, human
gtctgtcaggtaatgctcag

SEQ ID NO: 62243 - DNA, 20 bp, human
gcctcggcagcatgaggacc

SEQ ID NO: 62244 - DNA, 20 bp, human
ggttggtagtaagaagggca

SEQ ID NO: 62245 - DNA, 20 bp, human
gctgctgctgctcgactctg

SEQ ID NO: 62246 - DNA, 20 bp, human
gcctgcagcttgggcttcaa

SEQ ID NO: 62247 - DNA, 20 bp, human
ggatgcaaagaagtaggctg

SEQ ID NO: 62248 - DNA, 20 bp, human
ggaataatcggtgttcatgg

SEQ ID NO: 62249 - DNA, 20 bp, human
gcctgctcagagtctccagt

SEQ ID NO: 62250 - DNA, 20 bp, human
gtggagcccagggactggtg

SEQ ID NO: 62251 - DNA, 20 bp, human
gccttccaggacaaagataa

SEQ ID NO: 62252 - DNA, 20 bp, human
gtgaccagcaaatggaaaag

SEQ ID NO: 62253 - DNA, 20 bp, human
gtgtactcttggtcaccaac

SEQ ID NO: 62254 - DNA, 20 bp, human
gtctactgctcccaaaaggt

SEQ ID NO: 62255 - DNA, 20 bp, human
ggaggtctactgctcccaaa

SEQ ID NO: 62256 - DNA, 20 bp, human
ggttcagagacagatagcaa

SEQ ID NO: 62257 - DNA, 20 bp, human
gaccggccgggcagagggtt

SEQ ID NO: 62258 - DNA, 20 bp, human
gccatcagctgcagtctctc

SEQ ID NO: 62259 - DNA, 20 bp, human
gccacggcctcagttcctaa

SEQ ID NO: 62260 - DNA, 20 bp, human
gggagcctcttggttgtcca

SEQ ID NO: 62261 - DNA, 20 bp, human
ggagctgcatgcagaaccaa

SEQ ID NO: 62262 - DNA, 20 bp, human
gtgcatgcagctcctaatgt

SEQ ID NO: 62263 - DNA, 20 bp, human
gcagttcctaaaggtgacca

SEQ ID NO: 62264 - DNA, 20 bp, human
gaaaccaaggtcaggatatc

SEQ ID NO: 62265 - DNA, 20 bp, human
ggagtagatgggctataatg

SEQ ID NO: 62266 - DNA, 20 bp, human
ggattggagaaggagttctg

SEQ ID NO: 62267 - DNA, 20 bp, human
gcctcatgctctgtgacgta

SEQ ID NO: 62268 - DNA, 20 bp, human
gttatgcaaaaagaaaccta

SEQ ID NO: 62269 - DNA, 20 bp, human
gagggcttttgctcatggtg

SEQ ID NO: 62270 - DNA, 20 bp, human
gagcttactgagctcactgc

SEQ ID NO: 62271 - DNA, 20 bp, human
gagtgctgctttggcaatct

SEQ ID NO: 62272 - DNA, 20 bp, human
gtggaagcctgctccaggat

SEQ ID NO: 62273 - DNA, 20 bp, human
gagttctgaggagacaagcc

SEQ ID NO: 62274 - DNA, 20 bp, human
gttggcaatctgggctgacc

SEQ ID NO: 62275 - DNA, 20 bp, human
gcaaaaagaaacctatggct

SEQ ID NO: 62276 - DNA, 20 bp, human
ggcttctcagatgtgctcct

SEQ ID NO: 62277 - DNA, 20 bp, human
gtggtcctgggtgagtaaaa

SEQ ID NO: 62278 - DNA, 20 bp, human
ggagtaaaagggctcaccat

SEQ ID NO: 62279 - DNA, 20 bp, human
gatgggccctgggtgggatc

SEQ ID NO: 62280 - DNA, 20 bp, human
ggctgtcccgatcccaccca

SEQ ID NO: 62281 - DNA, 20 bp, human
ggcaggcctggtcctttctt

SEQ ID NO: 62282 - DNA, 20 bp, human
gaaatacagtctcctaatgt

SEQ ID NO: 62283 - DNA, 20 bp, human
gaggagagagtctctcagca

SEQ ID NO: 62284 - DNA, 20 bp, human
gagagactctctcctacatt

SEQ ID NO: 62285 - DNA, 20 bp, human
ggaaaatggccacagctgga

SEQ ID NO: 62286 - DNA, 20 bp, human
gcactgagtcagacaatcta

SEQ ID NO: 62287 - DNA, 20 bp, human
gagggactccacacacccac

SEQ ID NO: 62288 - DNA, 20 bp, human
gctattgctgaggccaggaa

SEQ ID NO: 62289 - DNA, 20 bp, human
ggttcagctgcaggtcctgt

SEQ ID NO: 62290 - DNA, 20 bp, human
gacgaagttgaagacaactc

SEQ ID NO: 62291 - DNA, 20 bp, human
ggttggaaagagaacgatag

SEQ ID NO: 62292 - DNA, 20 bp, human
gtgtctgactcagtggaagt

SEQ ID NO: 62293 - DNA, 20 bp, human
gagtagtgaggaagtaaagt

SEQ ID NO: 62294 - DNA, 20 bp, human
gttgtccactcacctaaaga

SEQ ID NO: 62295 - DNA, 20 bp, human
gagtcaccgaaaaaaatgcc

SEQ ID NO: 62296 - DNA, 20 bp, human
gggcacagcggagggaacac

SEQ ID NO: 62297 - DNA, 20 bp, human
gacaggtcagaaacaggtca

SEQ ID NO: 62298 - DNA, 20 bp, human
gaggcctcaggaccgaaggt

SEQ ID NO: 62299 - DNA, 20 bp, human
gctcaggaccgaaggtgggt

SEQ ID NO: 62300 - DNA, 20 bp, human
gcctgttctggcacagcgga

SEQ ID NO: 62301 - DNA, 20 bp, human
gaaccaggcctcaggaccga

SEQ ID NO: 62302 - DNA, 20 bp, human
gtgtcagagataaattaggg

SEQ ID NO: 62303 - DNA, 20 bp, human
ggaggctgctgggggcaaca

SEQ ID NO: 62304 - DNA, 20 bp, human
ggggcatgcttgggagagat

SEQ ID NO: 62305 - DNA, 20 bp, human
gggccccatgctgctctgga

SEQ ID NO: 62306 - DNA, 20 bp, human
ggccacccagagcacaccaa

SEQ ID NO: 62307 - DNA, 20 bp, human
gtattcaggtggaataagaa

SEQ ID NO: 62308 - DNA, 20 bp, human
gagccaggctgcaagcattg

SEQ ID NO: 62309 - DNA, 20 bp, human
gcaaagaagcagtattcagg

SEQ ID NO: 62310 - DNA, 20 bp, human
gctggaattggttttgtcta

SEQ ID NO: 62311 - DNA, 20 bp, human
ggggccctctacctttccct

SEQ ID NO: 62312 - DNA, 20 bp, human
gcttcatggtgactgtgttt

SEQ ID NO: 62313 - DNA, 20 bp, human
ggagaggatatcatgatcag

SEQ ID NO: 62314 - DNA, 20 bp, human
ggcctggcttccactggaat

SEQ ID NO: 62315 - DNA, 20 bp, human
ggggtggcccagatgctact

SEQ ID NO: 62316 - DNA, 20 bp, human
gtgccgcggctggtacgaca

SEQ ID NO: 62317 - DNA, 20 bp, human
gcgcggctggtacgacaagg

SEQ ID NO: 62318 - DNA, 20 bp, human
gagctcggcgagaaaagaag

SEQ ID NO: 62319 - DNA, 20 bp, human
gtgatccgccgcctgcttgg

SEQ ID NO: 62320 - DNA, 20 bp, human
gcgcggcagcgcaggactag

SEQ ID NO: 62321 - DNA, 20 bp, human
ggcgcacggcctggccgtcg

SEQ ID NO: 62322 - DNA, 20 bp, human
gctgcttcacggcaaaggag

SEQ ID NO: 62323 - DNA, 20 bp, human
gctggagtggaagtagcgca

SEQ ID NO: 62324 - DNA, 20 bp, human
gcctatgcgccagtgttcga

SEQ ID NO: 62325 - DNA, 20 bp, human
ggaagccaggatgtgcgtcg

SEQ ID NO: 62326 - DNA, 20 bp, human
ggcagcagaagagctttggg

SEQ ID NO: 62327 - DNA, 20 bp, human
ggatgggagtgggatgtcaa

SEQ ID NO: 62328 - DNA, 20 bp, human
gcctcactgtggactcaccc

SEQ ID NO: 62329 - DNA, 20 bp, human
gctttgggtggtggagaata

SEQ ID NO: 62330 - DNA, 20 bp, human
ggctgtcagtggccacatga

SEQ ID NO: 62331 - DNA, 20 bp, human
gatcttcaggaactaggagt

SEQ ID NO: 62332 - DNA, 20 bp, human
gtcaggaactaggagtgggt

SEQ ID NO: 62333 - DNA, 20 bp, human
ggatagcagaccagaaccag

SEQ ID NO: 62334 - DNA, 20 bp, human
gggctctcttgtgctgtgga

SEQ ID NO: 62335 - DNA, 20 bp, human
gaatgggagcctgaagatgg

SEQ ID NO: 62336 - DNA, 20 bp, human
gccatcaggtcagcaaacag

SEQ ID NO: 62337 - DNA, 20 bp, human
gtaggagtggagcactggtg

SEQ ID NO: 62338 - DNA, 20 bp, human
gctgacgctgttatgagaaa

SEQ ID NO: 62339 - DNA, 20 bp, human
gtcagactttagagaatctc

SEQ ID NO: 62340 - DNA, 20 bp, human
ggactttagagaatctctgg

SEQ ID NO: 62341 - DNA, 20 bp, human
gagtgaaacaacagagcctc

SEQ ID NO: 62342 - DNA, 20 bp, human
gtatattttaaagataaaag

SEQ ID NO: 62343 - DNA, 20 bp, human
ggagcaagtgccaatttctt

SEQ ID NO: 62344 - DNA, 20 bp, human
gctttctaggagtggagcac

SEQ ID NO: 62345 - DNA, 20 bp, human
gaatatttactacagcaggg

SEQ ID NO: 62346 - DNA, 20 bp, human
gagtaggtgcttcgaggggc

SEQ ID NO: 62347 - DNA, 20 bp, human
gggcgcgactctcacctctg

SEQ ID NO: 62348 - DNA, 20 bp, human
ggcgcaggcggcggactccc

SEQ ID NO: 62349 - DNA, 20 bp, human
gtaagcgccgatgctcacgg

SEQ ID NO: 62350 - DNA, 20 bp, human
gctcgaagcacctactccac

SEQ ID NO: 62351 - DNA, 20 bp, human
gcaccggccggctggacctg

SEQ ID NO: 62352 - DNA, 20 bp, human
gagccggccggtgagcgcct

SEQ ID NO: 62353 - DNA, 20 bp, human
gtgcccagggcggcttgcgg

SEQ ID NO: 62354 - DNA, 20 bp, human
gtcacggaggggacgaaacg

SEQ ID NO: 62355 - DNA, 20 bp, human
gctccacaggtccagccggc

SEQ ID NO: 62356 - DNA, 20 bp, human
ggctgcggccatgggaatcg

SEQ ID NO: 62357 - DNA, 20 bp, human
gcatagactcaagcagatct

SEQ ID NO: 62358 - DNA, 20 bp, human
gctatggaggaaaaactccg

SEQ ID NO: 62359 - DNA, 20 bp, human
gctgggaagcgcccgacgag

SEQ ID NO: 62360 - DNA, 20 bp, human
gccatggccgcagccgcctg

SEQ ID NO: 62361 - DNA, 20 bp, human
gatgggaatcgcggaccccg

SEQ ID NO: 62362 - DNA, 20 bp, human
gatggccttggtgccgcagg

SEQ ID NO: 62363 - DNA, 20 bp, human
ggtgcgcttgaagagggcca

SEQ ID NO: 62364 - DNA, 20 bp, human
gcttggaggaaagcttgtcc

SEQ ID NO: 62365 - DNA, 20 bp, human
gagcccgtcccgcccctcgt

SEQ ID NO: 62366 - DNA, 20 bp, human
ggctccgcgatcggctctgt

SEQ ID NO: 62367 - DNA, 20 bp, human
gggagtacccgccaacaagc

SEQ ID NO: 62368 - DNA, 20 bp, human
gggaggtaggaagatagtag

SEQ ID NO: 62369 - DNA, 20 bp, human
gcattggagcgagaacccat

SEQ ID NO: 62370 - DNA, 20 bp, human
gcgacccacagagccgatcg

SEQ ID NO: 62371 - DNA, 20 bp, human
gtcgctaggactgagcagat

SEQ ID NO: 62372 - DNA, 20 bp, human
gtcaagcaccccggaccata

SEQ ID NO: 62373 - DNA, 20 bp, human
gtagaacccaggtctcccct

SEQ ID NO: 62374 - DNA, 20 bp, human
gtcccgctctccccacacta

SEQ ID NO: 62375 - DNA, 20 bp, human
gtcccctgggcagtggagag

SEQ ID NO: 62376 - DNA, 20 bp, human
ggaactgccggaagcgacgc

SEQ ID NO: 62377 - DNA, 20 bp, human
gcgacgcaggccgcgctttg

SEQ ID NO: 62378 - DNA, 20 bp, human
gcggaaggcacgcggaacct

SEQ ID NO: 62379 - DNA, 20 bp, human
gcgcgggcccggagcaggta

SEQ ID NO: 62380 - DNA, 20 bp, human
gcccggcgcgcagaaggcac

SEQ ID NO: 62381 - DNA, 20 bp, human
gagtggcggagagaccctgc

SEQ ID NO: 62382 - DNA, 20 bp, human
gctgcggtgcgacggaaggg

SEQ ID NO: 62383 - DNA, 20 bp, human
gggcacgcggaacctcggcg

SEQ ID NO: 62384 - DNA, 20 bp, human
ggcgcgccgggcccacaccc

SEQ ID NO: 62385 - DNA, 20 bp, human
gaggtcacccggaaggcacg

SEQ ID NO: 62386 - DNA, 20 bp, human
gttctactgcaggctgccag

SEQ ID NO: 62387 - DNA, 20 bp, human
gctggagaggaggacgcggg

SEQ ID NO: 62388 - DNA, 20 bp, human
ggcagcctgcagtagaaccc

SEQ ID NO: 62389 - DNA, 20 bp, human
gagggcccgggtagaatcta

SEQ ID NO: 62390 - DNA, 20 bp, human
gccgggtagaatctagggtt

SEQ ID NO: 62391 - DNA, 20 bp, human
ggacgcacaggtactgaata

SEQ ID NO: 62392 - DNA, 20 bp, human
gggttaggaagtaggaattg

SEQ ID NO: 62393 - DNA, 20 bp, human
gcggggaggcgtgagtgcca

SEQ ID NO: 62394 - DNA, 20 bp, human
ggccagcggatcccagtgag

SEQ ID NO: 62395 - DNA, 20 bp, human
ggacctggaaggtaggaacc

SEQ ID NO: 62396 - DNA, 20 bp, human
gggacgcgccggccgctggg

SEQ ID NO: 62397 - DNA, 20 bp, human
gaccaacaggaggcgccgag

SEQ ID NO: 62398 - DNA, 20 bp, human
ggcgagccgggagtccgtgg

SEQ ID NO: 62399 - DNA, 20 bp, human
gtgcagaccagcccaagtct

SEQ ID NO: 62400 - DNA, 20 bp, human
gtccagggtttcgctcagag

SEQ ID NO: 62401 - DNA, 20 bp, human
gagttgagtgctctgatcca

SEQ ID NO: 62402 - DNA, 20 bp, human
gggcgcaaaatatagacagg

SEQ ID NO: 62403 - DNA, 20 bp, human
ggctggcgtagctaagaaca

SEQ ID NO: 62404 - DNA, 20 bp, human
gagggtttcgctcagagcgg

SEQ ID NO: 62405 - DNA, 20 bp, human
gcggcgcctcctgttggttg

SEQ ID NO: 62406 - DNA, 20 bp, human
gaggggtcggagcagagctg

SEQ ID NO: 62407 - DNA, 20 bp, human
ggatgatacggaggtctgtg

SEQ ID NO: 62408 - DNA, 20 bp, human
gagtcgaaacagggatctgt

SEQ ID NO: 62409 - DNA, 20 bp, human
ggcctgcgagcgctgagtag

SEQ ID NO: 62410 - DNA, 20 bp, human
gaggttgctgttcccagcca

SEQ ID NO: 62411 - DNA, 20 bp, human
gtagagacggaggtcaacaa

SEQ ID NO: 62412 - DNA, 20 bp, human
ggaataagacgggtctatat

SEQ ID NO: 62413 - DNA, 20 bp, human
gtaggaacagatccacttgc

SEQ ID NO: 62414 - DNA, 20 bp, human
ggggtgaatggaggatgata

SEQ ID NO: 62415 - DNA, 20 bp, human
ggcgagcgctgagtaggggt

SEQ ID NO: 62416 - DNA, 20 bp, human
gtggggatcgctacccggct

SEQ ID NO: 62417 - DNA, 20 bp, human
gcactgctgggcggacacct

SEQ ID NO: 62418 - DNA, 20 bp, human
ggcagcctcggcccgagtcc

SEQ ID NO: 62419 - DNA, 20 bp, human
gaggatccctgagaaggcgt

SEQ ID NO: 62420 - DNA, 20 bp, human
gcgcgggaggagcccggact

SEQ ID NO: 62421 - DNA, 20 bp, human
gccatagaggatagtaagga

SEQ ID NO: 62422 - DNA, 20 bp, human
gttgcaggtgacaataacca

SEQ ID NO: 62423 - DNA, 20 bp, human
gccgagtgaacgcattgcct

SEQ ID NO: 62424 - DNA, 20 bp, human
gactcgggccgaggctgccc

SEQ ID NO: 62425 - DNA, 20 bp, human
gcctgccatagaggatagta

SEQ ID NO: 62426 - DNA, 20 bp, human
gggaggatcagagcccggac

SEQ ID NO: 62427 - DNA, 20 bp, human
gggatcagagcccggacggg

SEQ ID NO: 62428 - DNA, 20 bp, human
gagcgggcggcgatgagtag

SEQ ID NO: 62429 - DNA, 20 bp, human
gctcctcgggcggaacaaaa

SEQ ID NO: 62430 - DNA, 20 bp, human
ggcagccggccacctggacg

SEQ ID NO: 62431 - DNA, 20 bp, human
gggttgcctcccgcccgtcc

SEQ ID NO: 62432 - DNA, 20 bp, human
gaccctaagatggcggcgag

SEQ ID NO: 62433 - DNA, 20 bp, human
gatcttagggtctcctcggg

SEQ ID NO: 62434 - DNA, 20 bp, human
gcgccatcttagggtctcct

SEQ ID NO: 62435 - DNA, 20 bp, human
gccgtctccccgtcccccgg

SEQ ID NO: 62436 - DNA, 20 bp, human
gggaggccgagtgccgcgaa

SEQ ID NO: 62437 - DNA, 20 bp, human
ggcgccggccctggaccgag

SEQ ID NO: 62438 - DNA, 20 bp, human
gaccgaggggatctccatgg

SEQ ID NO: 62439 - DNA, 20 bp, human
gcggaacgctcccgcaagag

SEQ ID NO: 62440 - DNA, 20 bp, human
gccctacgcgaggatctccg

SEQ ID NO: 62441 - DNA, 20 bp, human
gcgcatcccgcaggaaggag

SEQ ID NO: 62442 - DNA, 20 bp, human
gagcggcgccggaacttggg

SEQ ID NO: 62443 - DNA, 20 bp, human
gtccgccatggagatcccct

SEQ ID NO: 62444 - DNA, 20 bp, human
gagggaaggcggagacgcag

SEQ ID NO: 62445 - DNA, 20 bp, human
gaagagcggcgccggaactt

SEQ ID NO: 62446 - DNA, 20 bp, human
gtgcagtccgagccgactaa

SEQ ID NO: 62447 - DNA, 20 bp, human
ggtccgagccgactaagggc

SEQ ID NO: 62448 - DNA, 20 bp, human
ggctgcctcccgcccttagt

SEQ ID NO: 62449 - DNA, 20 bp, human
gcgagccgactaagggcggg

SEQ ID NO: 62450 - DNA, 20 bp, human
gttgtctggaacagggagag

SEQ ID NO: 62451 - DNA, 20 bp, human
gacaaagcccgagtgaccag

SEQ ID NO: 62452 - DNA, 20 bp, human
gccgccaagggatgatccgc

SEQ ID NO: 62453 - DNA, 20 bp, human
gggaggcagctcgggtggcg

SEQ ID NO: 62454 - DNA, 20 bp, human
ggtggtcgatggaggagatt

SEQ ID NO: 62455 - DNA, 20 bp, human
gcgccccaaaggaatgaatc

SEQ ID NO: 62456 - DNA, 20 bp, human
ggacgccgtgaggggatcaa

SEQ ID NO: 62457 - DNA, 20 bp, human
gctcacggcgtcccacagac

SEQ ID NO: 62458 - DNA, 20 bp, human
gaggccaggtgagaccccat

SEQ ID NO: 62459 - DNA, 20 bp, human
gactggcccaaggctcacag

SEQ ID NO: 62460 - DNA, 20 bp, human
gtcgggtgtagagggagcag

SEQ ID NO: 62461 - DNA, 20 bp, human
ggagcgcgggctttggaagg

SEQ ID NO: 62462 - DNA, 20 bp, human
ggagaagggagagcgagctt

SEQ ID NO: 62463 - DNA, 20 bp, human
gcgggagcgcgggctttgga

SEQ ID NO: 62464 - DNA, 20 bp, human
gtggcgagcaggtcacgtga

SEQ ID NO: 62465 - DNA, 20 bp, human
gtggaaggcggctgaacgtc

SEQ ID NO: 62466 - DNA, 20 bp, human
gggcttgtcaggttctaggt

SEQ ID NO: 62467 - DNA, 20 bp, human
gcaacagcgcctaccgccgg

SEQ ID NO: 62468 - DNA, 20 bp, human
gcgggacccgaaggctgagg

SEQ ID NO: 62469 - DNA, 20 bp, human
ggggcaacagcgcctaccgc

SEQ ID NO: 62470 - DNA, 20 bp, human
gtgagggtacaggcaagatt

SEQ ID NO: 62471 - DNA, 20 bp, human
ggactggctccggagtctga

SEQ ID NO: 62472 - DNA, 20 bp, human
gagggctgtggcgggcgtag

SEQ ID NO: 62473 - DNA, 20 bp, human
gcccagaccccgcgacgggg

SEQ ID NO: 62474 - DNA, 20 bp, human
gggcgggtgccggcgcgaaa

SEQ ID NO: 62475 - DNA, 20 bp, human
gtgaggggttcgggcttgtc

SEQ ID NO: 62476 - DNA, 20 bp, human
ggagctgaaatctccgggaa

SEQ ID NO: 62477 - DNA, 20 bp, human
ggagggcgctgggcgatccc

SEQ ID NO: 62478 - DNA, 20 bp, human
ggcattctagactcccgaag

SEQ ID NO: 62479 - DNA, 20 bp, human
gaagggactactcggcgggt

SEQ ID NO: 62480 - DNA, 20 bp, human
gaggcccccacccctaaaat

SEQ ID NO: 62481 - DNA, 20 bp, human
ggtgaaggacgcttcagaaa

SEQ ID NO: 62482 - DNA, 20 bp, human
ggtccttcaccaaaagaatt

SEQ ID NO: 62483 - DNA, 20 bp, human
gactgaagagcagacccgtt

SEQ ID NO: 62484 - DNA, 20 bp, human
gctggaagggactactcggc

SEQ ID NO: 62485 - DNA, 20 bp, human
gaaatgttaagtgtgcccgg

SEQ ID NO: 62486 - DNA, 20 bp, human
ggaaggacctaaagggtcgg

SEQ ID NO: 62487 - DNA, 20 bp, human
gcgagactctcaggccccaa

SEQ ID NO: 62488 - DNA, 20 bp, human
gtctctcaatgggagcgagg

SEQ ID NO: 62489 - DNA, 20 bp, human
gtcctgtgacgtaggatgag

SEQ ID NO: 62490 - DNA, 20 bp, human
gtagccaacaaggctgcgaa

SEQ ID NO: 62491 - DNA, 20 bp, human
gtttcagaaaggggatgttt

SEQ ID NO: 62492 - DNA, 20 bp, human
gtgtgactagaaggacctaa

SEQ ID NO: 62493 - DNA, 20 bp, human
gcaggtgagtgggcatgtaa

SEQ ID NO: 62494 - DNA, 20 bp, human
ggcccacacctgtgactaga

SEQ ID NO: 62495 - DNA, 20 bp, human
gtcacctttcgcagccttgt

SEQ ID NO: 62496 - DNA, 20 bp, human
gcagctgctttagaacggtt

SEQ ID NO: 62497 - DNA, 20 bp, human
gacaggcaacctcaccaact

SEQ ID NO: 62498 - DNA, 20 bp, human
gatgctgagtccccaatata

SEQ ID NO: 62499 - DNA, 20 bp, human
ggctgtgtggaccatcgtga

SEQ ID NO: 62500 - DNA, 20 bp, human
gcacacgcatgctcacaaca

SEQ ID NO: 62501 - DNA, 20 bp, human
gacatggagttcaagcaaca

SEQ ID NO: 62502 - DNA, 20 bp, human
gggaatggtgccatatattg

SEQ ID NO: 62503 - DNA, 20 bp, human
gacagcattgctctgatcaa

SEQ ID NO: 62504 - DNA, 20 bp, human
ggccttttgaagtcagttac

SEQ ID NO: 62505 - DNA, 20 bp, human
ggtgtggaccatcgtgaagg

SEQ ID NO: 62506 - DNA, 20 bp, human
gcctgcggaaaaccgatgag

SEQ ID NO: 62507 - DNA, 20 bp, human
gcacatccattggcagatgg

SEQ ID NO: 62508 - DNA, 20 bp, human
ggcacttgctccacatccat

SEQ ID NO: 62509 - DNA, 20 bp, human
ggactcctaccctgaagtca

SEQ ID NO: 62510 - DNA, 20 bp, human
gcaaggagaagccatcgcgg

SEQ ID NO: 62511 - DNA, 20 bp, human
ggcacgcatggaagactcaa

SEQ ID NO: 62512 - DNA, 20 bp, human
gcaccatcaccgaaaggcca

SEQ ID NO: 62513 - DNA, 20 bp, human
gcccgggtggcgcagagaaa

SEQ ID NO: 62514 - DNA, 20 bp, human
gtggaagactcaaagggaca

SEQ ID NO: 62515 - DNA, 20 bp, human
gggccaagccgaagcgatgg

SEQ ID NO: 62516 - DNA, 20 bp, human
ggtgcactgcacggccccag

SEQ ID NO: 62517 - DNA, 20 bp, human
ggctgcctcgggacctccca

SEQ ID NO: 62518 - DNA, 20 bp, human
ggcacgccgcgccaggctgg

SEQ ID NO: 62519 - DNA, 20 bp, human
ggcctcgggacctcccacgg

SEQ ID NO: 62520 - DNA, 20 bp, human
gagatgcgtagggccggaga

SEQ ID NO: 62521 - DNA, 20 bp, human
ggcaggcaccgagcctccgt

SEQ ID NO: 62522 - DNA, 20 bp, human
ggcgtgcccggtgcactgca

SEQ ID NO: 62523 - DNA, 20 bp, human
gcgcgcagcgtggcaggcga

SEQ ID NO: 62524 - DNA, 20 bp, human
gcccattaaggcagcacctg

SEQ ID NO: 62525 - DNA, 20 bp, human
gctgccttaatgggagtaag

SEQ ID NO: 62526 - DNA, 20 bp, human
ggcgctgcctgtggccggag

SEQ ID NO: 62527 - DNA, 20 bp, human
ggcgtcactcccccaaagaa

SEQ ID NO: 62528 - DNA, 20 bp, human
gggaggtggtggaggacccg

SEQ ID NO: 62529 - DNA, 20 bp, human
ggccggcgctgcgaattcgg

SEQ ID NO: 62530 - DNA, 20 bp, human
gtcgcgcggcaacaggcgag

SEQ ID NO: 62531 - DNA, 20 bp, human
ggcttcgccagccgaggaac

SEQ ID NO: 62532 - DNA, 20 bp, human
gccagccgaggaaccggacg

SEQ ID NO: 62533 - DNA, 20 bp, human
ggtgtccgcgtccggttcct

SEQ ID NO: 62534 - DNA, 20 bp, human
gaattcgcagcgccggccac

SEQ ID NO: 62535 - DNA, 20 bp, human
gcggcagaaactcgggaggg

SEQ ID NO: 62536 - DNA, 20 bp, human
gactgaggccgggtaagaag

SEQ ID NO: 62537 - DNA, 20 bp, human
gcgtgataaggcacaagcaa

SEQ ID NO: 62538 - DNA, 20 bp, human
gcctacaggcgggcagactg

SEQ ID NO: 62539 - DNA, 20 bp, human
gtctcgggctacacccctgt

SEQ ID NO: 62540 - DNA, 20 bp, human
ggagagtctgagggtaccac

SEQ ID NO: 62541 - DNA, 20 bp, human
gaccagccaaagcctctccg

SEQ ID NO: 62542 - DNA, 20 bp, human
gccgctcccatcctacaggc

SEQ ID NO: 62543 - DNA, 20 bp, human
gcgctggagagagagtctga

SEQ ID NO: 62544 - DNA, 20 bp, human
gacccgccctgctcgtgata

SEQ ID NO: 62545 - DNA, 20 bp, human
gctacacccctgtgggccgt

SEQ ID NO: 62546 - DNA, 20 bp, human
gtccattcagccaccaatag

SEQ ID NO: 62547 - DNA, 20 bp, human
gctccttctgcccctattgg

SEQ ID NO: 62548 - DNA, 20 bp, human
ggaggaggtcagtccgactg

SEQ ID NO: 62549 - DNA, 20 bp, human
gggtcagtccgactgtggag

SEQ ID NO: 62550 - DNA, 20 bp, human
gtcacccaccccccacccac

SEQ ID NO: 62551 - DNA, 20 bp, human
ggtccgactgtggagaggat

SEQ ID NO: 62552 - DNA, 20 bp, human
gtcagtcatggaggaccacg

SEQ ID NO: 62553 - DNA, 20 bp, human
gctgggcctgggctgccagt

SEQ ID NO: 62554 - DNA, 20 bp, human
ggcagcaggaagaccccgat

SEQ ID NO: 62555 - DNA, 20 bp, human
ggcagctgtggtatcagtca

SEQ ID NO: 62556 - DNA, 20 bp, human
gtttcagttggcccaggccc

SEQ ID NO: 62557 - DNA, 20 bp, human
ggggctagaggtacccgcac

SEQ ID NO: 62558 - DNA, 20 bp, human
gggatggactgcagacgggg

SEQ ID NO: 62559 - DNA, 20 bp, human
gctcgctcacacgcagccat

SEQ ID NO: 62560 - DNA, 20 bp, human
ggtccgcaccgggcctgagt

SEQ ID NO: 62561 - DNA, 20 bp, human
ggtcaggatggactgcagac

SEQ ID NO: 62562 - DNA, 20 bp, human
gctccaggccccggggctag

SEQ ID NO: 62563 - DNA, 20 bp, human
ggtcggtccgaggccgtccc

SEQ ID NO: 62564 - DNA, 20 bp, human
ggacggcctcggaccgactc

SEQ ID NO: 62565 - DNA, 20 bp, human
gcggggcctggaggagcggt

SEQ ID NO: 62566 - DNA, 20 bp, human
gaaggagcagacccattctg

SEQ ID NO: 62567 - DNA, 20 bp, human
gtctgtggagaacaaggccc

SEQ ID NO: 62568 - DNA, 20 bp, human
ggaacagagagttctcggca

SEQ ID NO: 62569 - DNA, 20 bp, human
gccacaaactgacccatcct

SEQ ID NO: 62570 - DNA, 20 bp, human
gagggactggctggcttgta

SEQ ID NO: 62571 - DNA, 20 bp, human
gagggacagttcccactctg

SEQ ID NO: 62572 - DNA, 20 bp, human
gtgctccgcagcacaggact

SEQ ID NO: 62573 - DNA, 20 bp, human
ggccttgttctccacagaat

SEQ ID NO: 62574 - DNA, 20 bp, human
ggacgcccaggaatacagac

SEQ ID NO: 62575 - DNA, 20 bp, human
gtggcttgtaaggctcttta

SEQ ID NO: 62576 - DNA, 20 bp, human
gcagccggcaatggaaccgg

SEQ ID NO: 62577 - DNA, 20 bp, human
ggggcactggggagacctaa

SEQ ID NO: 62578 - DNA, 20 bp, human
ggaagcgaccgcgggtgaca

SEQ ID NO: 62579 - DNA, 20 bp, human
ggggcgggaagtctaggctc

SEQ ID NO: 62580 - DNA, 20 bp, human
ggagggccgattgtaatgta

SEQ ID NO: 62581 - DNA, 20 bp, human
gagctcgtagcaggaaggtg

SEQ ID NO: 62582 - DNA, 20 bp, human
gagacggtctcttcaaggac

SEQ ID NO: 62583 - DNA, 20 bp, human
gggtacatgttgatcagcag

SEQ ID NO: 62584 - DNA, 20 bp, human
gtgctggtagtaggagctca

SEQ ID NO: 62585 - DNA, 20 bp, human
ggcgaccgcgggtgacaagg

SEQ ID NO: 62586 - DNA, 20 bp, human
gcctggagatgtgggatgat

SEQ ID NO: 62587 - DNA, 20 bp, human
ggctccccgcgcagctccgg

SEQ ID NO: 62588 - DNA, 20 bp, human
ggccgatgctgagatgatac

SEQ ID NO: 62589 - DNA, 20 bp, human
gcccagctgcgctccctgaa

SEQ ID NO: 62590 - DNA, 20 bp, human
ggcagggcggcgaggtatgg

SEQ ID NO: 62591 - DNA, 20 bp, human
gcgcgcgtgtgaaggcaggg

SEQ ID NO: 62592 - DNA, 20 bp, human
ggcacctgtgcgggtcctgg

SEQ ID NO: 62593 - DNA, 20 bp, human
ggtcctgtcagagaatcccg

SEQ ID NO: 62594 - DNA, 20 bp, human
gctgccccagcgcgatcggg

SEQ ID NO: 62595 - DNA, 20 bp, human
gtcccgcggcccgtggatgg

SEQ ID NO: 62596 - DNA, 20 bp, human
gggcgcgcgactgctccggg

SEQ ID NO: 62597 - DNA, 20 bp, human
gctcggcgcccggatccgag

SEQ ID NO: 62598 - DNA, 20 bp, human
gctgctccgggcggcgatgg

SEQ ID NO: 62599 - DNA, 20 bp, human
ggcgagccgaggccgacggc

SEQ ID NO: 62600 - DNA, 20 bp, human
ggatggcggcggacggggac

SEQ ID NO: 62601 - DNA, 20 bp, human
ggggaggagctgcggccgta

SEQ ID NO: 62602 - DNA, 20 bp, human
gagggcgggaggtaccgagg

SEQ ID NO: 62603 - DNA, 20 bp, human
gagccgaggccgacggccgg

SEQ ID NO: 62604 - DNA, 20 bp, human
gaggttttcagggctcgtgg

SEQ ID NO: 62605 - DNA, 20 bp, human
gtaaattgctgggcgagccg

SEQ ID NO: 62606 - DNA, 20 bp, human
gctgcagggagccttaccca

SEQ ID NO: 62607 - DNA, 20 bp, human
ggcctacgacacgagcccca

SEQ ID NO: 62608 - DNA, 20 bp, human
gcacgaaggggatcatgcag

SEQ ID NO: 62609 - DNA, 20 bp, human
gtagcgactgctccagctcg

SEQ ID NO: 62610 - DNA, 20 bp, human
gcaagcagggaacaaggcaa

SEQ ID NO: 62611 - DNA, 20 bp, human
ggttcaatggagaaagccaa

SEQ ID NO: 62612 - DNA, 20 bp, human
gcagggagccttacccaagg

SEQ ID NO: 62613 - DNA, 20 bp, human
gcgcaggtctgtgacaagca

SEQ ID NO: 62614 - DNA, 20 bp, human
ggagccgcggaaggccagtc

SEQ ID NO: 62615 - DNA, 20 bp, human
ggacgctggcgactcagaca

SEQ ID NO: 62616 - DNA, 20 bp, human
gcaggcgcgggggaacacag

SEQ ID NO: 62617 - DNA, 20 bp, human
gcctgccctgggactttgaa

SEQ ID NO: 62618 - DNA, 20 bp, human
ggccctgggactttgaaagg

SEQ ID NO: 62619 - DNA, 20 bp, human
gtggcgcccgcgctcctctc

SEQ ID NO: 62620 - DNA, 20 bp, human
gcctctcgggaaagtgcgag

SEQ ID NO: 62621 - DNA, 20 bp, human
gcccctcaaactttaaaagg

SEQ ID NO: 62622 - DNA, 20 bp, human
gggcggcgcggctcccgtag

SEQ ID NO: 62623 - DNA, 20 bp, human
gtgcgcgccgggttaatggg

SEQ ID NO: 62624 - DNA, 20 bp, human
gtccccctttcaaagtccca

SEQ ID NO: 62625 - DNA, 20 bp, human
gtgaagtggaatgacatggg

SEQ ID NO: 62626 - DNA, 20 bp, human
gcgcaaaggcggccacatag

SEQ ID NO: 62627 - DNA, 20 bp, human
gagcgggaagcccagcgcaa

SEQ ID NO: 62628 - DNA, 20 bp, human
gcaacccaaagaccagaccc

SEQ ID NO: 62629 - DNA, 20 bp, human
gctctccttcggcctctatg

SEQ ID NO: 62630 - DNA, 20 bp, human
gtgcccccgcagctctcctt

SEQ ID NO: 62631 - DNA, 20 bp, human
ggcccccgccggcatagagt

SEQ ID NO: 62632 - DNA, 20 bp, human
ggtgggccaccgcgaagacg

SEQ ID NO: 62633 - DNA, 20 bp, human
ggcggccacatagaggccga

SEQ ID NO: 62634 - DNA, 20 bp, human
gaggccgtgctattcctggg

SEQ ID NO: 62635 - DNA, 20 bp, human
gcccaggtgacacaggacga

SEQ ID NO: 62636 - DNA, 20 bp, human
gagagacaggagctagtgtg

SEQ ID NO: 62637 - DNA, 20 bp, human
gcatggcatggacagaagca

SEQ ID NO: 62638 - DNA, 20 bp, human
ggtcagaatgccacgctcaa

SEQ ID NO: 62639 - DNA, 20 bp, human
gtcttgggattggttctgaa

SEQ ID NO: 62640 - DNA, 20 bp, human
gaaccagcactagccttagg

SEQ ID NO: 62641 - DNA, 20 bp, human
ggaaggttctgggagactgg

SEQ ID NO: 62642 - DNA, 20 bp, human
gcttcactggcccttgagcg

SEQ ID NO: 62643 - DNA, 20 bp, human
gatttctctaaggtcttcta

SEQ ID NO: 62644 - DNA, 20 bp, human
gaaagcccacaggccttcac

SEQ ID NO: 62645 - DNA, 20 bp, human
gaagctctgttcctctctcc

SEQ ID NO: 62646 - DNA, 20 bp, human
gctggtcagcatgctaaaag

SEQ ID NO: 62647 - DNA, 20 bp, human
gcagctgagactgcatgagg

SEQ ID NO: 62648 - DNA, 20 bp, human
ggagaggaagacgtcggctg

SEQ ID NO: 62649 - DNA, 20 bp, human
gtgagactgcatgaggaggg

SEQ ID NO: 62650 - DNA, 20 bp, human
ggaaggggagaggaagacgt

SEQ ID NO: 62651 - DNA, 20 bp, human
gcagctgggatgctctaagc

SEQ ID NO: 62652 - DNA, 20 bp, human
gttcaagtgaagaaggggag

SEQ ID NO: 62653 - DNA, 20 bp, human
gtcccagctgagactgcatg

SEQ ID NO: 62654 - DNA, 20 bp, human
gttagcatgctgaccagccc

SEQ ID NO: 62655 - DNA, 20 bp, human
gtcaacagtgagtgacgtca

SEQ ID NO: 62656 - DNA, 20 bp, human
gtctacgtgatgaccctgag

SEQ ID NO: 62657 - DNA, 20 bp, human
gcgcattcaggggacattcc

SEQ ID NO: 62658 - DNA, 20 bp, human
ggctgcccgcgcgcattcag

SEQ ID NO: 62659 - DNA, 20 bp, human
ggagagagtgctcatctggg

SEQ ID NO: 62660 - DNA, 20 bp, human
gcggcgcgccaccagcacca

SEQ ID NO: 62661 - DNA, 20 bp, human
gatgcgctccaggctgaccg

SEQ ID NO: 62662 - DNA, 20 bp, human
gggacattcccggcgcctgg

SEQ ID NO: 62663 - DNA, 20 bp, human
gtctgagagagtgctcatct

SEQ ID NO: 62664 - DNA, 20 bp, human
ggctgaccgcggccagcgtg

SEQ ID NO: 62665 - DNA, 20 bp, human
ggcactctctcagaccgctg

SEQ ID NO: 62666 - DNA, 20 bp, human
gaccaggcagacgatcctca

SEQ ID NO: 62667 - DNA, 20 bp, human
gataggatgggaactaggag

SEQ ID NO: 62668 - DNA, 20 bp, human
gtaatgcaccaaggctttat

SEQ ID NO: 62669 - DNA, 20 bp, human
gttcagctggagtgctcctc

SEQ ID NO: 62670 - DNA, 20 bp, human
ggcctggtcctaagtgtggt

SEQ ID NO: 62671 - DNA, 20 bp, human
ggtctgcctggtcctaagtg

SEQ ID NO: 62672 - DNA, 20 bp, human
gagtgtggtgggcacagcat

SEQ ID NO: 62673 - DNA, 20 bp, human
ggcattataatgctagttaa

SEQ ID NO: 62674 - DNA, 20 bp, human
gggctttataggtacaagga

SEQ ID NO: 62675 - DNA, 20 bp, human
gccaaggctttataggtaca

SEQ ID NO: 62676 - DNA, 20 bp, human
gtaagtctacatgaaaagga

SEQ ID NO: 62677 - DNA, 20 bp, human
gcaaggtgtcaacgacaatg

SEQ ID NO: 62678 - DNA, 20 bp, human
gggtgtcaacgacaatgagg

SEQ ID NO: 62679 - DNA, 20 bp, human
gcatttacttctagcaatac

SEQ ID NO: 62680 - DNA, 20 bp, human
gtttaaatacaataagtcag

SEQ ID NO: 62681 - DNA, 20 bp, human
gcatgaaaaggatggtttct

SEQ ID NO: 62682 - DNA, 20 bp, human
gctaggaatgacttcagaaa

SEQ ID NO: 62683 - DNA, 20 bp, human
gtatatctgagtcctctgct

SEQ ID NO: 62684 - DNA, 20 bp, human
gtttttctagttaagtccca

SEQ ID NO: 62685 - DNA, 20 bp, human
gagaggactcagatatatat

SEQ ID NO: 62686 - DNA, 20 bp, human
gcccgaatgggaatagatct

SEQ ID NO: 62687 - DNA, 20 bp, human
ggcagcggcctcaggatcgg

SEQ ID NO: 62688 - DNA, 20 bp, human
gggagcagcggcctcaggat

SEQ ID NO: 62689 - DNA, 20 bp, human
gcccggggcgagaagtcggt

SEQ ID NO: 62690 - DNA, 20 bp, human
gccggcgcccggcggagcag

SEQ ID NO: 62691 - DNA, 20 bp, human
gagtcggtcggatccaagtg

SEQ ID NO: 62692 - DNA, 20 bp, human
gggaggcgggagcctcgcag

SEQ ID NO: 62693 - DNA, 20 bp, human
gtggccccggggcgagaagt

SEQ ID NO: 62694 - DNA, 20 bp, human
ggtcccgccccccgatcctg

SEQ ID NO: 62695 - DNA, 20 bp, human
ggacgatgctccagccgcgg

SEQ ID NO: 62696 - DNA, 20 bp, human
gacgctggcctgggacagat

SEQ ID NO: 62697 - DNA, 20 bp, human
gggactctcccaacacacac

SEQ ID NO: 62698 - DNA, 20 bp, human
gagcatgggagagtgtcggt

SEQ ID NO: 62699 - DNA, 20 bp, human
gtgtggttacgagcaagcat

SEQ ID NO: 62700 - DNA, 20 bp, human
gagagtgtcggtgggacacc

SEQ ID NO: 62701 - DNA, 20 bp, human
gttggagcatgggagagtgt

SEQ ID NO: 62702 - DNA, 20 bp, human
ggtgggagggtcaccatggt

SEQ ID NO: 62703 - DNA, 20 bp, human
ggggtcctgtgcccacacac

SEQ ID NO: 62704 - DNA, 20 bp, human
gcagaccaaagcctgtgtgt

SEQ ID NO: 62705 - DNA, 20 bp, human
gaagatcagaacagattcat

SEQ ID NO: 62706 - DNA, 20 bp, human
gcttcagaagacaggtgagt

SEQ ID NO: 62707 - DNA, 20 bp, human
gccgaggctgaccagatgca

SEQ ID NO: 62708 - DNA, 20 bp, human
gggcctgggtgacatgagag

SEQ ID NO: 62709 - DNA, 20 bp, human
gagggctcggccaacacctc

SEQ ID NO: 62710 - DNA, 20 bp, human
gtgcacgaagttcagcccag

SEQ ID NO: 62711 - DNA, 20 bp, human
gctgcccgtgtccccatcga

SEQ ID NO: 62712 - DNA, 20 bp, human
gtggctgtggtggcacggaa

SEQ ID NO: 62713 - DNA, 20 bp, human
gccccatcgaaggctggcag

SEQ ID NO: 62714 - DNA, 20 bp, human
ggcccctgccagccttcgat

SEQ ID NO: 62715 - DNA, 20 bp, human
gtcgctcgccttcagaagac

SEQ ID NO: 62716 - DNA, 20 bp, human
gagatgacaagggtcaacag

SEQ ID NO: 62717 - DNA, 20 bp, human
gctctgtgctatgaactcac

SEQ ID NO: 62718 - DNA, 20 bp, human
gactcacttccactactctc

SEQ ID NO: 62719 - DNA, 20 bp, human
gtgataaagaactaactaat

SEQ ID NO: 62720 - DNA, 20 bp, human
gatttggatccataatttgt

SEQ ID NO: 62721 - DNA, 20 bp, human
gatccaggaacaattacttg

SEQ ID NO: 62722 - DNA, 20 bp, human
ggcaaagtatacaatagatg

SEQ ID NO: 62723 - DNA, 20 bp, human
gtgctgtggttttagcacaa

SEQ ID NO: 62724 - DNA, 20 bp, human
gttagagtagttcagtgctg

SEQ ID NO: 62725 - DNA, 20 bp, human
gcacgatggaaaaattatcg

SEQ ID NO: 62726 - DNA, 20 bp, human
ggggctgcgctgatgagcca

SEQ ID NO: 62727 - DNA, 20 bp, human
gctcttgaggatgaagggga

SEQ ID NO: 62728 - DNA, 20 bp, human
gcttgctcttgaggatgaag

SEQ ID NO: 62729 - DNA, 20 bp, human
gaggatgaacccaaggacga

SEQ ID NO: 62730 - DNA, 20 bp, human
gcctccctcagcggaaccct

SEQ ID NO: 62731 - DNA, 20 bp, human
gcttgaacaaatgcagcaac

SEQ ID NO: 62732 - DNA, 20 bp, human
gaccgacgaggattacatcg

SEQ ID NO: 62733 - DNA, 20 bp, human
ggattacatcgtggtcccca

SEQ ID NO: 62734 - DNA, 20 bp, human
gtcaagccccctgtctacac

SEQ ID NO: 62735 - DNA, 20 bp, human
gggcgaggcatgtggcctgg

SEQ ID NO: 62736 - DNA, 20 bp, human
ggccgcagggtcgctagagt

SEQ ID NO: 62737 - DNA, 20 bp, human
gcagcctgagcgccacacaa

SEQ ID NO: 62738 - DNA, 20 bp, human
gggagatcccgagaaatccc

SEQ ID NO: 62739 - DNA, 20 bp, human
ggccgactctagcgaccctg

SEQ ID NO: 62740 - DNA, 20 bp, human
ggagcgccacacaaaggacg

SEQ ID NO: 62741 - DNA, 20 bp, human
ggggcggcgggacggaatgt

SEQ ID NO: 62742 - DNA, 20 bp, human
gctcgcccgcccgaccccgg

SEQ ID NO: 62743 - DNA, 20 bp, human
gagcacagtcccccttggaa

SEQ ID NO: 62744 - DNA, 20 bp, human
gctcgggatctcccttccaa

SEQ ID NO: 62745 - DNA, 20 bp, human
gcccccagcacagtccccct

SEQ ID NO: 62746 - DNA, 20 bp, human
gactgagcgagtgtggagag

SEQ ID NO: 62747 - DNA, 20 bp, human
gctcgctcagtgctgtccca

SEQ ID NO: 62748 - DNA, 20 bp, human
gctgagaagaagacaccaag

SEQ ID NO: 62749 - DNA, 20 bp, human
ggccagtgtcaggcgggcac

SEQ ID NO: 62750 - DNA, 20 bp, human
gggctactgcagctctgagt

SEQ ID NO: 62751 - DNA, 20 bp, human
gattcagggccagtgtcagg

SEQ ID NO: 62752 - DNA, 20 bp, human
gtggaggaatggagataatg

SEQ ID NO: 62753 - DNA, 20 bp, human
gtccagtgcccgcctgacac

SEQ ID NO: 62754 - DNA, 20 bp, human
gtaaagagcttgtaggccga

SEQ ID NO: 62755 - DNA, 20 bp, human
gtggagagaggtacagccct

SEQ ID NO: 62756 - DNA, 20 bp, human
gcccggtaaatggtggacgt

SEQ ID NO: 62757 - DNA, 20 bp, human
gttacaagcggactttccaa

SEQ ID NO: 62758 - DNA, 20 bp, human
gttggagttgtcagaagtgg

SEQ ID NO: 62759 - DNA, 20 bp, human
gcacggtgaacaaaacccaa

SEQ ID NO: 62760 - DNA, 20 bp, human
gtgctgggaacgccagggag

SEQ ID NO: 62761 - DNA, 20 bp, human
gccgcggcgaggaagggacc

SEQ ID NO: 62762 - DNA, 20 bp, human
ggaaggtgccaaccgcagag

SEQ ID NO: 62763 - DNA, 20 bp, human
gacagagctagaggcgccgg

SEQ ID NO: 62764 - DNA, 20 bp, human
gagaagtggctcgcaggctg

SEQ ID NO: 62765 - DNA, 20 bp, human
gcaacagccgcggcgaggaa

SEQ ID NO: 62766 - DNA, 20 bp, human
gggtgcactcctctcttggg

SEQ ID NO: 62767 - DNA, 20 bp, human
gccggcgaagtcagagcact

SEQ ID NO: 62768 - DNA, 20 bp, human
gtggggactggtgacaacgt

SEQ ID NO: 62769 - DNA, 20 bp, human
ggaccctcgggaaggagtga

SEQ ID NO: 62770 - DNA, 20 bp, human
gccgggccggctctccgagg

SEQ ID NO: 62771 - DNA, 20 bp, human
gctaaccagccccccaagag

SEQ ID NO: 62772 - DNA, 20 bp, human
gtctgcagagctccccggtc

SEQ ID NO: 62773 - DNA, 20 bp, human
ggtcgccggatcaacaggac

SEQ ID NO: 62774 - DNA, 20 bp, human
ggggggctggttagattgga

SEQ ID NO: 62775 - DNA, 20 bp, human
ggacagcagttccccctcct

SEQ ID NO: 62776 - DNA, 20 bp, human
gctacagctcaaccagaagg

SEQ ID NO: 62777 - DNA, 20 bp, human
gggcaggctgagtcacgtgg

SEQ ID NO: 62778 - DNA, 20 bp, human
gcggccaggtaactcgcctg

SEQ ID NO: 62779 - DNA, 20 bp, human
gaaggctctcgccaagctag

SEQ ID NO: 62780 - DNA, 20 bp, human
gaccagcaggggtactgaag

SEQ ID NO: 62781 - DNA, 20 bp, human
gaggtaactcgcctggggta

SEQ ID NO: 62782 - DNA, 20 bp, human
gtctggttgagctgtagggt

SEQ ID NO: 62783 - DNA, 20 bp, human
gggggcccggtcctactcag

SEQ ID NO: 62784 - DNA, 20 bp, human
gggctctccctcaggagtgg

SEQ ID NO: 62785 - DNA, 20 bp, human
ggggaccttaccaaggatat

SEQ ID NO: 62786 - DNA, 20 bp, human
gggcacgagacgggcacagt

SEQ ID NO: 62787 - DNA, 20 bp, human
gaaccgcacgagagaaggag

SEQ ID NO: 62788 - DNA, 20 bp, human
gatctgcggggtcccaagag

SEQ ID NO: 62789 - DNA, 20 bp, human
gttgctttccggcacgagac

SEQ ID NO: 62790 - DNA, 20 bp, human
ggcttgcgcctctccaacag

SEQ ID NO: 62791 - DNA, 20 bp, human
gctgcggtgagagcaactcc

SEQ ID NO: 62792 - DNA, 20 bp, human
gaccagcgagaggcgatctg

SEQ ID NO: 62793 - DNA, 20 bp, human
gtaggaggtccgtcccagca

SEQ ID NO: 62794 - DNA, 20 bp, human
ggagcggttacccggagtct

SEQ ID NO: 62795 - DNA, 20 bp, human
ggccggctgcggctttccag

SEQ ID NO: 62796 - DNA, 20 bp, human
gctgttccggagggtgcctg

SEQ ID NO: 62797 - DNA, 20 bp, human
gttccggagggtgcctgcgg

SEQ ID NO: 62798 - DNA, 20 bp, human
gccgggatcgcgggcgagac

SEQ ID NO: 62799 - DNA, 20 bp, human
gagccgccgcaggcaccctc

SEQ ID NO: 62800 - DNA, 20 bp, human
ggctgtcgcgctgttccgga

SEQ ID NO: 62801 - DNA, 20 bp, human
gactagtcgaagactcggag

SEQ ID NO: 62802 - DNA, 20 bp, human
ggtggcgtcgactccgaccc

SEQ ID NO: 62803 - DNA, 20 bp, human
gccgtgccaggtttccgaca

SEQ ID NO: 62804 - DNA, 20 bp, human
gcgcggcacagtcgcagcac

SEQ ID NO: 62805 - DNA, 20 bp, human
gacagggatcaaacaggtaa

SEQ ID NO: 62806 - DNA, 20 bp, human
gccgggaagccgagactcag

SEQ ID NO: 62807 - DNA, 20 bp, human
gtggcggctgcacttctcgg

SEQ ID NO: 62808 - DNA, 20 bp, human
gcggcttgatccgccagaag

SEQ ID NO: 62809 - DNA, 20 bp, human
ggccgccagagatggcaagt

SEQ ID NO: 62810 - DNA, 20 bp, human
gtggccgcggccatcgctag

SEQ ID NO: 62811 - DNA, 20 bp, human
gccgcgcctgccgcttctgg

SEQ ID NO: 62812 - DNA, 20 bp, human
gggtgggccgggaaaaccga

SEQ ID NO: 62813 - DNA, 20 bp, human
ggaccctggagtccgctgtc

SEQ ID NO: 62814 - DNA, 20 bp, human
ggctacaggttgcccgacag

SEQ ID NO: 62815 - DNA, 20 bp, human
gtcggcttcccgggaggata

SEQ ID NO: 62816 - DNA, 20 bp, human
gtgagcgaggagaactctat

SEQ ID NO: 62817 - DNA, 20 bp, human
gcgaggagaactctatgggt

SEQ ID NO: 62818 - DNA, 20 bp, human
ggtggggctgatcagcatcc

SEQ ID NO: 62819 - DNA, 20 bp, human
gataaactccaggattccta

SEQ ID NO: 62820 - DNA, 20 bp, human
gctcattcattcctaggtac

SEQ ID NO: 62821 - DNA, 20 bp, human
gtggactctggcctgtacct

SEQ ID NO: 62822 - DNA, 20 bp, human
gacctaggaatgaatgagcg

SEQ ID NO: 62823 - DNA, 20 bp, human
gagtttatcagcctggctgt

SEQ ID NO: 62824 - DNA, 20 bp, human
gctatgggtcggtaagttta

SEQ ID NO: 62825 - DNA, 20 bp, human
ggtataaaaatatttatctg

SEQ ID NO: 62826 - DNA, 20 bp, human
gagatgtgggaagtccccag

SEQ ID NO: 62827 - DNA, 20 bp, human
gcagccccacttgacacctg

SEQ ID NO: 62828 - DNA, 20 bp, human
gtgtgtggcaggtcagggag

SEQ ID NO: 62829 - DNA, 20 bp, human
gtgagccgcaggtgtcaagt

SEQ ID NO: 62830 - DNA, 20 bp, human
gctgcggctcacccttgggg

SEQ ID NO: 62831 - DNA, 20 bp, human
ggagccacaggttttcaggg

SEQ ID NO: 62832 - DNA, 20 bp, human
gtcgcccccctgaaaacctg

SEQ ID NO: 62833 - DNA, 20 bp, human
gctcgatgtgtggcaggtca

SEQ ID NO: 62834 - DNA, 20 bp, human
gtctctgggactctacccct

SEQ ID NO: 62835 - DNA, 20 bp, human
gcgtctcctgcactcaggtc

SEQ ID NO: 62836 - DNA, 20 bp, human
gcacggccggagagacgcgg

SEQ ID NO: 62837 - DNA, 20 bp, human
ggcgcacggccggagagacg

SEQ ID NO: 62838 - DNA, 20 bp, human
gcccggccgccgccagtggt

SEQ ID NO: 62839 - DNA, 20 bp, human
gcagcagcagccggcgagga

SEQ ID NO: 62840 - DNA, 20 bp, human
gcggaggaggagacatgagc

SEQ ID NO: 62841 - DNA, 20 bp, human
gctgcagcgcgaaagcgtca

SEQ ID NO: 62842 - DNA, 20 bp, human
gggaggagacatgagccggc

SEQ ID NO: 62843 - DNA, 20 bp, human
ggcgtcacggccgctccgtc

SEQ ID NO: 62844 - DNA, 20 bp, human
gcggccgtccgggcgtccgt

SEQ ID NO: 62845 - DNA, 20 bp, human
gccgtccgggcgtccgtggg

SEQ ID NO: 62846 - DNA, 20 bp, human
ggcgctgcgtccaggatcta

SEQ ID NO: 62847 - DNA, 20 bp, human
ggtccgcaggagcctaaggg

SEQ ID NO: 62848 - DNA, 20 bp, human
gggggtccgcaggagcctaa

SEQ ID NO: 62849 - DNA, 20 bp, human
gcgtaaggcgctactatata

SEQ ID NO: 62850 - DNA, 20 bp, human
ggggctgtgagtgccgggtt

SEQ ID NO: 62851 - DNA, 20 bp, human
gccttacgggccccacgggt

SEQ ID NO: 62852 - DNA, 20 bp, human
ggccgccgcgccgtcagagc

SEQ ID NO: 62853 - DNA, 20 bp, human
ggcagctggagagcccgtgg

SEQ ID NO: 62854 - DNA, 20 bp, human
gagcgccttacgggccccac

SEQ ID NO: 62855 - DNA, 20 bp, human
gggcgcagctccggcgatgg

SEQ ID NO: 62856 - DNA, 20 bp, human
ggccgaaccgccgaactcag

SEQ ID NO: 62857 - DNA, 20 bp, human
ggaaaacccgagcgagtagg

SEQ ID NO: 62858 - DNA, 20 bp, human
ggtcgcagtgaagatccggg

SEQ ID NO: 62859 - DNA, 20 bp, human
gcgcgcggccagaaaccaca

SEQ ID NO: 62860 - DNA, 20 bp, human
gtgaggcggagagagcgggt

SEQ ID NO: 62861 - DNA, 20 bp, human
gaacccgagcgagtaggggg

SEQ ID NO: 62862 - DNA, 20 bp, human
ggccgcagcccggaaaggag

SEQ ID NO: 62863 - DNA, 20 bp, human
gaaccgccgaactcagaggc

SEQ ID NO: 62864 - DNA, 20 bp, human
gggacctggggttcacggat

SEQ ID NO: 62865 - DNA, 20 bp, human
ggccggcggcccgggacctg

SEQ ID NO: 62866 - DNA, 20 bp, human
ggctgccaatactaggacta

SEQ ID NO: 62867 - DNA, 20 bp, human
gtcctgcgctcgcccagcag

SEQ ID NO: 62868 - DNA, 20 bp, human
gacagccctagtcctagtat

SEQ ID NO: 62869 - DNA, 20 bp, human
gagctgccgctgccaatact

SEQ ID NO: 62870 - DNA, 20 bp, human
gccctccggagcgacctcag

SEQ ID NO: 62871 - DNA, 20 bp, human
ggccggctcccacctaccca

SEQ ID NO: 62872 - DNA, 20 bp, human
gggctaagggagccatggag

SEQ ID NO: 62873 - DNA, 20 bp, human
gtaggactagggctgttggc

SEQ ID NO: 62874 - DNA, 20 bp, human
gctgggcgagcgcaggagcg

SEQ ID NO: 62875 - DNA, 20 bp, human
gactcggtgtgtatgtacac

SEQ ID NO: 62876 - DNA, 20 bp, human
gtgtccaggtgagtagactc

SEQ ID NO: 62877 - DNA, 20 bp, human
ggccaggtgagaggcttcca

SEQ ID NO: 62878 - DNA, 20 bp, human
ggagccccgaaagtgagtgt

SEQ ID NO: 62879 - DNA, 20 bp, human
gccaggtgagtagactcagg

SEQ ID NO: 62880 - DNA, 20 bp, human
gagggcgtgatctgacactg

SEQ ID NO: 62881 - DNA, 20 bp, human
gctgaggatccagccgaaag

SEQ ID NO: 62882 - DNA, 20 bp, human
gtggcccacggccaggtgag

SEQ ID NO: 62883 - DNA, 20 bp, human
gcacctggacaactggaatc

SEQ ID NO: 62884 - DNA, 20 bp, human
ggccgccttgctgaggatca

SEQ ID NO: 62885 - DNA, 20 bp, human
ggcccacctggagatcaggg

SEQ ID NO: 62886 - DNA, 20 bp, human
gcaggcggcggcgcatgacc

SEQ ID NO: 62887 - DNA, 20 bp, human
ggacgagcgcgcagcgaacc

SEQ ID NO: 62888 - DNA, 20 bp, human
gacgcgcaggaagaagtgag

SEQ ID NO: 62889 - DNA, 20 bp, human
ggttaaagcgaaggctgcag

SEQ ID NO: 62890 - DNA, 20 bp, human
gccgtgtggtacaaccctgt

SEQ ID NO: 62891 - DNA, 20 bp, human
gcgtcgctcccgggcgtccg

SEQ ID NO: 62892 - DNA, 20 bp, human
gtcctgcgcgtggatcccgg

SEQ ID NO: 62893 - DNA, 20 bp, human
gagcggcggacccggctcag

SEQ ID NO: 62894 - DNA, 20 bp, human
gccgcgcgaaggcagagccg

SEQ ID NO: 62895 - DNA, 20 bp, human
ggggcagagaagcgtccgtg

SEQ ID NO: 62896 - DNA, 20 bp, human
gctggagccgagcagtgggg

SEQ ID NO: 62897 - DNA, 20 bp, human
gtcctgggcagaaagctagg

SEQ ID NO: 62898 - DNA, 20 bp, human
gtcctgtagatggacaacaa

SEQ ID NO: 62899 - DNA, 20 bp, human
gcagctggagccgagcagtg

SEQ ID NO: 62900 - DNA, 20 bp, human
ggagaaggaaaaggccagta

SEQ ID NO: 62901 - DNA, 20 bp, human
ggggaggttggggactagac

SEQ ID NO: 62902 - DNA, 20 bp, human
gaagacaataagtggttcct

SEQ ID NO: 62903 - DNA, 20 bp, human
gtcacaccagctacttgcaa

SEQ ID NO: 62904 - DNA, 20 bp, human
gggaacatggctcctactgt

SEQ ID NO: 62905 - DNA, 20 bp, human
ggggccaggagagtcccgac

SEQ ID NO: 62906 - DNA, 20 bp, human
gcggctgccgccccttccat

SEQ ID NO: 62907 - DNA, 20 bp, human
ggccgctcgggtgcagctgg

SEQ ID NO: 62908 - DNA, 20 bp, human
gacccgagcggccgcgtcaa

SEQ ID NO: 62909 - DNA, 20 bp, human
gagctggaggtggtacttcg

SEQ ID NO: 62910 - DNA, 20 bp, human
ggcggcgtctacgagcacct

SEQ ID NO: 62911 - DNA, 20 bp, human
ggagcgcggcgcccatggaa

SEQ ID NO: 62912 - DNA, 20 bp, human
ggctcctgggtggaaattaa

SEQ ID NO: 62913 - DNA, 20 bp, human
gcgtggcgcagtagagcttg

SEQ ID NO: 62914 - DNA, 20 bp, human
ggagccaggagggctttcgg

SEQ ID NO: 62915 - DNA, 20 bp, human
gagccagattaggcccatcg

SEQ ID NO: 62916 - DNA, 20 bp, human
ggtggcagcgcagcccaagg

SEQ ID NO: 62917 - DNA, 20 bp, human
gcgccgggctatatatatag

SEQ ID NO: 62918 - DNA, 20 bp, human
gcgccgctgggagagcctgg

SEQ ID NO: 62919 - DNA, 20 bp, human
ggcgggcctggcgctcaggg

SEQ ID NO: 62920 - DNA, 20 bp, human
gccgcacccactgcacccaa

SEQ ID NO: 62921 - DNA, 20 bp, human
gatgcccagcaggtagtcgc

SEQ ID NO: 62922 - DNA, 20 bp, human
gctacctgctgggcatcaag

SEQ ID NO: 62923 - DNA, 20 bp, human
gcaggagtgcgcaaccgagg

SEQ ID NO: 62924 - DNA, 20 bp, human
gccggtggcagcgcagccca

SEQ ID NO: 62925 - DNA, 20 bp, human
gtcgttggcgcgcctgccgg

SEQ ID NO: 62926 - DNA, 20 bp, human
gatagcctcggggaagagaa

SEQ ID NO: 62927 - DNA, 20 bp, human
ggcagcctctactgcagagt

SEQ ID NO: 62928 - DNA, 20 bp, human
ggaggcacgcagccgcacag

SEQ ID NO: 62929 - DNA, 20 bp, human
gcctctagggttcctatcag

SEQ ID NO: 62930 - DNA, 20 bp, human
gaggctatgtccacccggtg

SEQ ID NO: 62931 - DNA, 20 bp, human
gccagcgcggagatccgctc

SEQ ID NO: 62932 - DNA, 20 bp, human
gaagagagaggccacccgag

SEQ ID NO: 62933 - DNA, 20 bp, human
gccgggtggacatagcctcg

SEQ ID NO: 62934 - DNA, 20 bp, human
gcccgcctcgccgcaccggg

SEQ ID NO: 62935 - DNA, 20 bp, human
ggccggtccggcgccccgag

SEQ ID NO: 62936 - DNA, 20 bp, human
gccgcggccggtagagacca

SEQ ID NO: 62937 - DNA, 20 bp, human
gcggtagagaccatggctcg

SEQ ID NO: 62938 - DNA, 20 bp, human
gacacgctgctggactcgag

SEQ ID NO: 62939 - DNA, 20 bp, human
ggcactcgggttgagagcag

SEQ ID NO: 62940 - DNA, 20 bp, human
gagagagcgtccccgagcca

SEQ ID NO: 62941 - DNA, 20 bp, human
ggttgagagcagagggaccc

SEQ ID NO: 62942 - DNA, 20 bp, human
gcaacccgagtgcccgatgg

SEQ ID NO: 62943 - DNA, 20 bp, human
ggcgcgagacctggacagca

SEQ ID NO: 62944 - DNA, 20 bp, human
gaactagggacggagcaagc

SEQ ID NO: 62945 - DNA, 20 bp, human
ggagattgccggggtgaact

SEQ ID NO: 62946 - DNA, 20 bp, human
gaccaggcagacaacagaca

SEQ ID NO: 62947 - DNA, 20 bp, human
gcatttaacttaaaaaacct

SEQ ID NO: 62948 - DNA, 20 bp, human
gtaaaaaacctgggcagttc

SEQ ID NO: 62949 - DNA, 20 bp, human
gccttctgcctgttgattta

SEQ ID NO: 62950 - DNA, 20 bp, human
gtgtgtgagccttttattca

SEQ ID NO: 62951 - DNA, 20 bp, human
gattttctcctgaactgccc

SEQ ID NO: 62952 - DNA, 20 bp, human
gttaaatgtcaggattgctc

SEQ ID NO: 62953 - DNA, 20 bp, human
gttgttttgttgctaacagc

SEQ ID NO: 62954 - DNA, 20 bp, human
ggcatataataaagaagtct

SEQ ID NO: 62955 - DNA, 20 bp, human
ggctgtagaacataaagata

SEQ ID NO: 62956 - DNA, 20 bp, human
ggccggtgtgagacccgggt

SEQ ID NO: 62957 - DNA, 20 bp, human
gcggccaccggctccggcag

SEQ ID NO: 62958 - DNA, 20 bp, human
gggcgcacagcgattcggtg

SEQ ID NO: 62959 - DNA, 20 bp, human
gtccaagcccaggtgaggag

SEQ ID NO: 62960 - DNA, 20 bp, human
ggcccacccgggtctcacac

SEQ ID NO: 62961 - DNA, 20 bp, human
ggcgcgccggtgtgagaccc

SEQ ID NO: 62962 - DNA, 20 bp, human
ggcagcggcgcacagcgatt

SEQ ID NO: 62963 - DNA, 20 bp, human
gccgagcagccagcggccac

SEQ ID NO: 62964 - DNA, 20 bp, human
gggtgggcagcgccggtcgg

SEQ ID NO: 62965 - DNA, 20 bp, human
gagccagcggccaccggctc

SEQ ID NO: 62966 - DNA, 20 bp, human
ggcgcggcaacacctgttcg

SEQ ID NO: 62967 - DNA, 20 bp, human
ggcggagcgttgtagccggg

SEQ ID NO: 62968 - DNA, 20 bp, human
gacggatcctgactccagga

SEQ ID NO: 62969 - DNA, 20 bp, human
gatgcctaggcgttattata

SEQ ID NO: 62970 - DNA, 20 bp, human
gaggctcggcagatgtccat

SEQ ID NO: 62971 - DNA, 20 bp, human
gcgcccaggctgccgcgaac

SEQ ID NO: 62972 - DNA, 20 bp, human
gctcgcggagcgttgtagcc

SEQ ID NO: 62973 - DNA, 20 bp, human
gagcgaggagagccgcgtcc

SEQ ID NO: 62974 - DNA, 20 bp, human
gccgagcctctggagaatcc

SEQ ID NO: 62975 - DNA, 20 bp, human
gtccattggcttagaacggg

SEQ ID NO: 62976 - DNA, 20 bp, human
ggtcaggtagagtgcaaggg

SEQ ID NO: 62977 - DNA, 20 bp, human
gtgtgtcaggtagagtgcaa

SEQ ID NO: 62978 - DNA, 20 bp, human
gggcagtgcgagtgaattgc

SEQ ID NO: 62979 - DNA, 20 bp, human
gcagggccgtgagaaatgac

SEQ ID NO: 62980 - DNA, 20 bp, human
gtgggcctgcattccatcat

SEQ ID NO: 62981 - DNA, 20 bp, human
gagaagatggccaacttcta

SEQ ID NO: 62982 - DNA, 20 bp, human
gttccatcatgggcaggtgg

SEQ ID NO: 62983 - DNA, 20 bp, human
gggggggtagactattcaac

SEQ ID NO: 62984 - DNA, 20 bp, human
gcagatcaggaccatttcct

SEQ ID NO: 62985 - DNA, 20 bp, human
gtataaaaagaggcagaccc

SEQ ID NO: 62986 - DNA, 20 bp, human
gaggtgacttccagcctcaa

SEQ ID NO: 62987 - DNA, 20 bp, human
ggaagtcacctgctgcatat

SEQ ID NO: 62988 - DNA, 20 bp, human
gaggcaggggacgaacttca

SEQ ID NO: 62989 - DNA, 20 bp, human
ggagatggcgtcccagcctc

SEQ ID NO: 62990 - DNA, 20 bp, human
gcctactggtgtgagtacag

SEQ ID NO: 62991 - DNA, 20 bp, human
gcagcctccctgcacacgga

SEQ ID NO: 62992 - DNA, 20 bp, human
gccaggagagagaacacaag

SEQ ID NO: 62993 - DNA, 20 bp, human
gcaacacagaccagacctac

SEQ ID NO: 62994 - DNA, 20 bp, human
ggtactcacaccagtaggtc

SEQ ID NO: 62995 - DNA, 20 bp, human
gggctgggacgccatctctg

SEQ ID NO: 62996 - DNA, 20 bp, human
gagagggaacgactgcacgg

SEQ ID NO: 62997 - DNA, 20 bp, human
gaggcgccaaagccttatta

SEQ ID NO: 62998 - DNA, 20 bp, human
gccccaggacctgcggacag

SEQ ID NO: 62999 - DNA, 20 bp, human
gacttaccgagttctgggag

SEQ ID NO: 63000 - DNA, 20 bp, human
gctgcgtgtggctcagttgg

SEQ ID NO: 63001 - DNA, 20 bp, human
gaaacgtggtctgagaacag

SEQ ID NO: 63002 - DNA, 20 bp, human
gggtagagggaacgactgca

SEQ ID NO: 63003 - DNA, 20 bp, human
gggctccctgtgaatgaacg

SEQ ID NO: 63004 - DNA, 20 bp, human
gtgaatgaacgtggtatcaa

SEQ ID NO: 63005 - DNA, 20 bp, human
gcctgcgaggagaccctctg

SEQ ID NO: 63006 - DNA, 20 bp, human
gccagcccgggcgggaacaa

SEQ ID NO: 63007 - DNA, 20 bp, human
ggccacaggcgcggcgtcct

SEQ ID NO: 63008 - DNA, 20 bp, human
gccggtctgcaaggaaagtg

SEQ ID NO: 63009 - DNA, 20 bp, human
gtgcggctgcaccggcgtcc

SEQ ID NO: 63010 - DNA, 20 bp, human
gtgctcggcgcctccagccc

SEQ ID NO: 63011 - DNA, 20 bp, human
ggccggagctggtgccccgg

SEQ ID NO: 63012 - DNA, 20 bp, human
ggcagcgcgcggaggaaccc

SEQ ID NO: 63013 - DNA, 20 bp, human
gggctcccgtccgccacccg

SEQ ID NO: 63014 - DNA, 20 bp, human
ggccgaggacgccgcgcctg

SEQ ID NO: 63015 - DNA, 20 bp, human
ggcgtgcccgactgcagcac

SEQ ID NO: 63016 - DNA, 20 bp, human
gacgctggggccgcactcca

SEQ ID NO: 63017 - DNA, 20 bp, human
gcaggctcgggcatgatccg

SEQ ID NO: 63018 - DNA, 20 bp, human
gcccccacggaatgaggcag

SEQ ID NO: 63019 - DNA, 20 bp, human
ggtcccgcccccacggaatg

SEQ ID NO: 63020 - DNA, 20 bp, human
gcggccccggtccctcgcca

SEQ ID NO: 63021 - DNA, 20 bp, human
gcgcggagcgtaccctgctg

SEQ ID NO: 63022 - DNA, 20 bp, human
gtggacagcgggcgtcacaa

SEQ ID NO: 63023 - DNA, 20 bp, human
gaagccgcgctaacggccaa

SEQ ID NO: 63024 - DNA, 20 bp, human
ggcggcttcggcggttgtct

SEQ ID NO: 63025 - DNA, 20 bp, human
ggcgtccagccgaagcctgg

SEQ ID NO: 63026 - DNA, 20 bp, human
gtggcgttcaacgccatcac

SEQ ID NO: 63027 - DNA, 20 bp, human
gcgttcaacgccatcaccgg

SEQ ID NO: 63028 - DNA, 20 bp, human
gagcgccggtcggaggcggt

SEQ ID NO: 63029 - DNA, 20 bp, human
ggccggtcggaggcggtcgg

SEQ ID NO: 63030 - DNA, 20 bp, human
gcagacgcagaatcggacgg

SEQ ID NO: 63031 - DNA, 20 bp, human
ggacggaggcagcggacgga

SEQ ID NO: 63032 - DNA, 20 bp, human
ggtgtctaccccgccggtga

SEQ ID NO: 63033 - DNA, 20 bp, human
gctccgggagcgccggtcgg

SEQ ID NO: 63034 - DNA, 20 bp, human
gtcgcgaggctggagttctc

SEQ ID NO: 63035 - DNA, 20 bp, human
ggttctccgggagcgccggt

SEQ ID NO: 63036 - DNA, 20 bp, human
ggcgcgggcatgacgcccgc

SEQ ID NO: 63037 - DNA, 20 bp, human
gcggcgcccgagctttgtgg

SEQ ID NO: 63038 - DNA, 20 bp, human
gcggctggcgaagctccccg

SEQ ID NO: 63039 - DNA, 20 bp, human
gcgcggccgccacaaagctc

SEQ ID NO: 63040 - DNA, 20 bp, human
gtggcgccggcgaagaccca

SEQ ID NO: 63041 - DNA, 20 bp, human
gtacgccgcatgcagccccg

SEQ ID NO: 63042 - DNA, 20 bp, human
ggcggggacaacacaggtcg

SEQ ID NO: 63043 - DNA, 20 bp, human
ggggacaacacaggtcgcgg

SEQ ID NO: 63044 - DNA, 20 bp, human
ggcgcggcgattaccttgaa

SEQ ID NO: 63045 - DNA, 20 bp, human
gggaggagcgttgccattca

SEQ ID NO: 63046 - DNA, 20 bp, human
gccgctcgggagactacagg

SEQ ID NO: 63047 - DNA, 20 bp, human
gctcgggagactacaggagg

SEQ ID NO: 63048 - DNA, 20 bp, human
gccggcagagcaggaccgcg

SEQ ID NO: 63049 - DNA, 20 bp, human
ggcccaggctcagtgcgcgg

SEQ ID NO: 63050 - DNA, 20 bp, human
gcggacagggacgaaagcgg

SEQ ID NO: 63051 - DNA, 20 bp, human
gaggtaagaagggacccact

SEQ ID NO: 63052 - DNA, 20 bp, human
ggcgccgctcgggagactac

SEQ ID NO: 63053 - DNA, 20 bp, human
ggtccccaaggactccgagg

SEQ ID NO: 63054 - DNA, 20 bp, human
ggggcggacagggacgaaag

SEQ ID NO: 63055 - DNA, 20 bp, human
gggctgtcgcggaaccacag

SEQ ID NO: 63056 - DNA, 20 bp, human
gtcccggccgaggagcgctc

SEQ ID NO: 63057 - DNA, 20 bp, human
gcggccgcgacccctgcacg

SEQ ID NO: 63058 - DNA, 20 bp, human
ggccctgtgcagctaccctc

SEQ ID NO: 63059 - DNA, 20 bp, human
ggcgaatcaatgggtcccga

SEQ ID NO: 63060 - DNA, 20 bp, human
gagcctgcccccgcctcggt

SEQ ID NO: 63061 - DNA, 20 bp, human
gggagcgctcgggctgtctg

SEQ ID NO: 63062 - DNA, 20 bp, human
ggcgaggaatgtacccgcga

SEQ ID NO: 63063 - DNA, 20 bp, human
gtgcgctcccagccgccagg

SEQ ID NO: 63064 - DNA, 20 bp, human
ggctggcccggcaagggtgg

SEQ ID NO: 63065 - DNA, 20 bp, human
gtcattgcccaccgaggcgg

SEQ ID NO: 63066 - DNA, 20 bp, human
gcgcgaggcgtccttccctg

SEQ ID NO: 63067 - DNA, 20 bp, human
ggagttgacaaagccccgca

SEQ ID NO: 63068 - DNA, 20 bp, human
gtgacaaagccccgcaggga

SEQ ID NO: 63069 - DNA, 20 bp, human
gcatgacccgtgcccagctg

SEQ ID NO: 63070 - DNA, 20 bp, human
gcgggttcggggccccagct

SEQ ID NO: 63071 - DNA, 20 bp, human
gcgaccccaggtgggcacac

SEQ ID NO: 63072 - DNA, 20 bp, human
ggccccgagaccgggcccgg

SEQ ID NO: 63073 - DNA, 20 bp, human
gggaaggacgcctcgcggcg

SEQ ID NO: 63074 - DNA, 20 bp, human
gccgcccccgcgccccacgt

SEQ ID NO: 63075 - DNA, 20 bp, human
ggctggggggggcccacgtg

SEQ ID NO: 63076 - DNA, 20 bp, human
gctacaaggctcggagctcc

SEQ ID NO: 63077 - DNA, 20 bp, human
gtgacagtgctgacactaca

SEQ ID NO: 63078 - DNA, 20 bp, human
ggtagagaattaaattccgg

SEQ ID NO: 63079 - DNA, 20 bp, human
gttgtgtgtgaactggagag

SEQ ID NO: 63080 - DNA, 20 bp, human
ggtcagcactgtcacctctc

SEQ ID NO: 63081 - DNA, 20 bp, human
ggcactcagacatcatgagt

SEQ ID NO: 63082 - DNA, 20 bp, human
ggggacaattggagcctgag

SEQ ID NO: 63083 - DNA, 20 bp, human
ggagttggtccttgcacccc

SEQ ID NO: 63084 - DNA, 20 bp, human
gaggaaatctgcaatgccac

SEQ ID NO: 63085 - DNA, 20 bp, human
gctgcaatgccacaggtagt

SEQ ID NO: 63086 - DNA, 20 bp, human
ggtagccgcgccgaacccca

SEQ ID NO: 63087 - DNA, 20 bp, human
gcggcgggtgtgagactaag

SEQ ID NO: 63088 - DNA, 20 bp, human
ggcgcccacgtgggactgag

SEQ ID NO: 63089 - DNA, 20 bp, human
ggtcctacaagggtaagggg

SEQ ID NO: 63090 - DNA, 20 bp, human
gagactaagcggccaggagg

SEQ ID NO: 63091 - DNA, 20 bp, human
gtcctgagtagaaaggccta

SEQ ID NO: 63092 - DNA, 20 bp, human
gctcacccagaagaggacac

SEQ ID NO: 63093 - DNA, 20 bp, human
gccaggaaaatgtcctacaa

SEQ ID NO: 63094 - DNA, 20 bp, human
gaagtgggcactgatcggag

SEQ ID NO: 63095 - DNA, 20 bp, human
gcccacgtgggactgagagg

SEQ ID NO: 63096 - DNA, 20 bp, human
gtcctgggaagcagagtgtc

SEQ ID NO: 63097 - DNA, 20 bp, human
gggagtctgcttctgctact

SEQ ID NO: 63098 - DNA, 20 bp, human
gcaatgcagttacaggatcc

SEQ ID NO: 63099 - DNA, 20 bp, human
ggaagtcaggttgactagca

SEQ ID NO: 63100 - DNA, 20 bp, human
gctgactcacttctgacttt

SEQ ID NO: 63101 - DNA, 20 bp, human
gatgatagtaaccaaaactc

SEQ ID NO: 63102 - DNA, 20 bp, human
ggacttcttgcaaaagctaa

SEQ ID NO: 63103 - DNA, 20 bp, human
gtatatgctaccagactagg

SEQ ID NO: 63104 - DNA, 20 bp, human
gtcaggacatcaagagacag

SEQ ID NO: 63105 - DNA, 20 bp, human
ggataatccaataatcaaaa

SEQ ID NO: 63106 - DNA, 20 bp, human
ggaagctggctaactggtac

SEQ ID NO: 63107 - DNA, 20 bp, human
gtcgggagctgaatagtcaa

SEQ ID NO: 63108 - DNA, 20 bp, human
gcaattcagcaggatcgagg

SEQ ID NO: 63109 - DNA, 20 bp, human
ggctggagctgctttaatag

SEQ ID NO: 63110 - DNA, 20 bp, human
gccccagcagggagtgcgca

SEQ ID NO: 63111 - DNA, 20 bp, human
gttatcaccaacctctcccg

SEQ ID NO: 63112 - DNA, 20 bp, human
gagtacattgatctcctctt

SEQ ID NO: 63113 - DNA, 20 bp, human
ggactgttgttacccagtac

SEQ ID NO: 63114 - DNA, 20 bp, human
gaaagatgaagctggctaac

SEQ ID NO: 63115 - DNA, 20 bp, human
gtctcccggggctcctgtac

SEQ ID NO: 63116 - DNA, 20 bp, human
ggtctgggggagaaactgaa

SEQ ID NO: 63117 - DNA, 20 bp, human
gccccgcacgccggcactcg

SEQ ID NO: 63118 - DNA, 20 bp, human
gctggacccatcagacccgt

SEQ ID NO: 63119 - DNA, 20 bp, human
gggaatccccaggacggtct

SEQ ID NO: 63120 - DNA, 20 bp, human
gagaagccgacgggtctgat

SEQ ID NO: 63121 - DNA, 20 bp, human
gccaattctgcccggccccg

SEQ ID NO: 63122 - DNA, 20 bp, human
ggtgggggagaaggattaag

SEQ ID NO: 63123 - DNA, 20 bp, human
gcccagcccgaaaaggccta

SEQ ID NO: 63124 - DNA, 20 bp, human
gctgaagggatcgtgagagt

SEQ ID NO: 63125 - DNA, 20 bp, human
gtccaggtaagcgacagcgt

SEQ ID NO: 63126 - DNA, 20 bp, human
gcttgggtagaatttctggg

SEQ ID NO: 63127 - DNA, 20 bp, human
gcgctcgcgtcccctcgtgc

SEQ ID NO: 63128 - DNA, 20 bp, human
gaagccgggagccgaagcta

SEQ ID NO: 63129 - DNA, 20 bp, human
ggccacggacggctccgagg

SEQ ID NO: 63130 - DNA, 20 bp, human
gcaccatgtaccgagcactt

SEQ ID NO: 63131 - DNA, 20 bp, human
gtgtcagagagggtcctact

SEQ ID NO: 63132 - DNA, 20 bp, human
ggcggctggagcccgcacga

SEQ ID NO: 63133 - DNA, 20 bp, human
gagggctgaaggtcactgcg

SEQ ID NO: 63134 - DNA, 20 bp, human
ggcctcctcggagccgtccg

SEQ ID NO: 63135 - DNA, 20 bp, human
gagccgaagtgctcggtaca

SEQ ID NO: 63136 - DNA, 20 bp, human
ggtgcgagctggagactccg

SEQ ID NO: 63137 - DNA, 20 bp, human
gaggcgtcgggccagctccg

SEQ ID NO: 63138 - DNA, 20 bp, human
gggtgtcgttcgtaagtcag

SEQ ID NO: 63139 - DNA, 20 bp, human
gcccccaggacttcccagag

SEQ ID NO: 63140 - DNA, 20 bp, human
ggtacacaggccggccgggc

SEQ ID NO: 63141 - DNA, 20 bp, human
ggcatggctggtgccaagga

SEQ ID NO: 63142 - DNA, 20 bp, human
gagagccctgccagctcggg

SEQ ID NO: 63143 - DNA, 20 bp, human
ggagggtctaaggctcccgg

SEQ ID NO: 63144 - DNA, 20 bp, human
gcgagaccggggaccggaag

SEQ ID NO: 63145 - DNA, 20 bp, human
ggcgcgtacacaggccggcc

SEQ ID NO: 63146 - DNA, 20 bp, human
gagggtcgggataaactagg

SEQ ID NO: 63147 - DNA, 20 bp, human
gggcggctacgccgacacaa

SEQ ID NO: 63148 - DNA, 20 bp, human
gggctacgccgacacaacgg

SEQ ID NO: 63149 - DNA, 20 bp, human
gtccagacgcgggtccacac

SEQ ID NO: 63150 - DNA, 20 bp, human
ggtcgggataaactaggggg

SEQ ID NO: 63151 - DNA, 20 bp, human
ggctgcgggtcgcacctggg

SEQ ID NO: 63152 - DNA, 20 bp, human
ggctgctgcgggtcgcacct

SEQ ID NO: 63153 - DNA, 20 bp, human
gtgggcctgcagtgaccggg

SEQ ID NO: 63154 - DNA, 20 bp, human
gcccgacccgcactcacccg

SEQ ID NO: 63155 - DNA, 20 bp, human
ggcctgcagtgaccgggagg

SEQ ID NO: 63156 - DNA, 20 bp, human
gggtgatgacctgacgcgcg

SEQ ID NO: 63157 - DNA, 20 bp, human
gccctcaggcggccacccag

SEQ ID NO: 63158 - DNA, 20 bp, human
gtgagggacccgggaacaga

SEQ ID NO: 63159 - DNA, 20 bp, human
gctctgctctgtccggtcac

SEQ ID NO: 63160 - DNA, 20 bp, human
gacactcccaggcggcgctc

SEQ ID NO: 63161 - DNA, 20 bp, human
gggtggccgcctgagggacc

SEQ ID NO: 63162 - DNA, 20 bp, human
gcccactgggtggccgcctg

SEQ ID NO: 63163 - DNA, 20 bp, human
ggggcaaaaagtcctgtgac

SEQ ID NO: 63164 - DNA, 20 bp, human
gccggccccactgggctccg

SEQ ID NO: 63165 - DNA, 20 bp, human
gaggcacggggccacgccag

SEQ ID NO: 63166 - DNA, 20 bp, human
ggccacagccttatcagctg

SEQ ID NO: 63167 - DNA, 20 bp, human
ggttgagggaagactggtct

SEQ ID NO: 63168 - DNA, 20 bp, human
gtaggtgctgctcctgaact

SEQ ID NO: 63169 - DNA, 20 bp, human
ggaacttggtctctgagcca

SEQ ID NO: 63170 - DNA, 20 bp, human
gccctcaaccccagctgata

SEQ ID NO: 63171 - DNA, 20 bp, human
gtggcttcccatagacactc

SEQ ID NO: 63172 - DNA, 20 bp, human
gggagaaggtaaatcgaatg

SEQ ID NO: 63173 - DNA, 20 bp, human
gaatcgaatgtggagctgaa

SEQ ID NO: 63174 - DNA, 20 bp, human
gaactataagagattgtggg

SEQ ID NO: 63175 - DNA, 20 bp, human
ggttttacctgagtgtctat

SEQ ID NO: 63176 - DNA, 20 bp, human
gcctctggggatgagtcggt

SEQ ID NO: 63177 - DNA, 20 bp, human
gagggggttggaggtactca

SEQ ID NO: 63178 - DNA, 20 bp, human
gcccgcgtcctcaccaggtg

SEQ ID NO: 63179 - DNA, 20 bp, human
gggcggtgccccacctggtg

SEQ ID NO: 63180 - DNA, 20 bp, human
gtgggtccgggaagaccact

SEQ ID NO: 63181 - DNA, 20 bp, human
gggaggggtctagaccctgg

SEQ ID NO: 63182 - DNA, 20 bp, human
gggccggggactcccggacg

SEQ ID NO: 63183 - DNA, 20 bp, human
gcgctccactcggccggcag

SEQ ID NO: 63184 - DNA, 20 bp, human
gagccccgtccgggagtccc

SEQ ID NO: 63185 - DNA, 20 bp, human
ggggctgcagtcctccctct

SEQ ID NO: 63186 - DNA, 20 bp, human
ggactgcagacggaccgtgt

SEQ ID NO: 63187 - DNA, 20 bp, human
gtgcgggccgggccaagcgg

SEQ ID NO: 63188 - DNA, 20 bp, human
gctgcagtcggcagcctcgc

SEQ ID NO: 63189 - DNA, 20 bp, human
gcgagacaggcagggactcg

SEQ ID NO: 63190 - DNA, 20 bp, human
gcagagcccggcgggtacag

SEQ ID NO: 63191 - DNA, 20 bp, human
gacggaccgtgtgggcgagt

SEQ ID NO: 63192 - DNA, 20 bp, human
gcttggcccggcccgcaggt

SEQ ID NO: 63193 - DNA, 20 bp, human
gtaggagccgccgagggacg

SEQ ID NO: 63194 - DNA, 20 bp, human
gcgcaggtaggagccgccga

SEQ ID NO: 63195 - DNA, 20 bp, human
gaaccgggcgccgcgtccct

SEQ ID NO: 63196 - DNA, 20 bp, human
ggcatgtggaggtaacatag

SEQ ID NO: 63197 - DNA, 20 bp, human
gatgtacacggtataagact

SEQ ID NO: 63198 - DNA, 20 bp, human
gcgtgtacatgactcctact

SEQ ID NO: 63199 - DNA, 20 bp, human
gaagacttggaggaaatgca

SEQ ID NO: 63200 - DNA, 20 bp, human
gtaggggccagataactcct

SEQ ID NO: 63201 - DNA, 20 bp, human
gtacacggtataagacttgg

SEQ ID NO: 63202 - DNA, 20 bp, human
gaactcaagaggcaattcca

SEQ ID NO: 63203 - DNA, 20 bp, human
gttctaatggtcttaatgtg

SEQ ID NO: 63204 - DNA, 20 bp, human
ggttggaagggatcttcaga

SEQ ID NO: 63205 - DNA, 20 bp, human
gaagctgcatgcagttggaa

SEQ ID NO: 63206 - DNA, 20 bp, human
gtccggccgggcccgaaccg

SEQ ID NO: 63207 - DNA, 20 bp, human
gcgaagggcagtcagaatgg

SEQ ID NO: 63208 - DNA, 20 bp, human
gttgagtagaagctgcactg

SEQ ID NO: 63209 - DNA, 20 bp, human
gttgaggggaaactgaagag

SEQ ID NO: 63210 - DNA, 20 bp, human
gcaagggcagcgccccgtcc

SEQ ID NO: 63211 - DNA, 20 bp, human
gcgggtatctgcgcgcccaa

SEQ ID NO: 63212 - DNA, 20 bp, human
gattcgaagggcagtcagaa

SEQ ID NO: 63213 - DNA, 20 bp, human
ggcgccgctcaaggtgaggg

SEQ ID NO: 63214 - DNA, 20 bp, human
ggacggagagccggtatcag

SEQ ID NO: 63215 - DNA, 20 bp, human
gggagcgccgctcaaggtga

SEQ ID NO: 63216 - DNA, 20 bp, human
gcccgggtagctgcgcgcag

SEQ ID NO: 63217 - DNA, 20 bp, human
gagggtcctgcgccaaccag

SEQ ID NO: 63218 - DNA, 20 bp, human
ggggtagctgcgcgcagggg

SEQ ID NO: 63219 - DNA, 20 bp, human
gctcgagcgatggtcccccc

SEQ ID NO: 63220 - DNA, 20 bp, human
gcctcgcggaacgtgaacag

SEQ ID NO: 63221 - DNA, 20 bp, human
gcgttagacagaagggctcg

SEQ ID NO: 63222 - DNA, 20 bp, human
ggccgagcgcgaggtcctcg

SEQ ID NO: 63223 - DNA, 20 bp, human
gaagggctcgaggcacccgc

SEQ ID NO: 63224 - DNA, 20 bp, human
gaaggaacagctagagccgg

SEQ ID NO: 63225 - DNA, 20 bp, human
gcgcagctacccgggcgtcc

SEQ ID NO: 63226 - DNA, 20 bp, human
gtgtgtgagtccggtccggg

SEQ ID NO: 63227 - DNA, 20 bp, human
gacttgtgtgagtccggtcc

SEQ ID NO: 63228 - DNA, 20 bp, human
gcgggaggaagtttgtgcag

SEQ ID NO: 63229 - DNA, 20 bp, human
ggctcctgctggctcccgga

SEQ ID NO: 63230 - DNA, 20 bp, human
gcacaaacttcctcccggac

SEQ ID NO: 63231 - DNA, 20 bp, human
gatgcggagattgagaagga

SEQ ID NO: 63232 - DNA, 20 bp, human
gtccgaaaagacctagggaa

SEQ ID NO: 63233 - DNA, 20 bp, human
gggcagcaaacagccgcggg

SEQ ID NO: 63234 - DNA, 20 bp, human
gatgagcgcgccgctgtgtg

SEQ ID NO: 63235 - DNA, 20 bp, human
gccgcctccgaaaagaccta

SEQ ID NO: 63236 - DNA, 20 bp, human
ggaagtagccttgacacagg

SEQ ID NO: 63237 - DNA, 20 bp, human
gaaattgaaatactatcagg

SEQ ID NO: 63238 - DNA, 20 bp, human
gagcaaggggaaactccgag

SEQ ID NO: 63239 - DNA, 20 bp, human
ggatggccagggaccccagg

SEQ ID NO: 63240 - DNA, 20 bp, human
gcaccgagcgaggggcgcaa

SEQ ID NO: 63241 - DNA, 20 bp, human
gtccatctcccgggagcaag

SEQ ID NO: 63242 - DNA, 20 bp, human
gcccatcgggcacgaagtag

SEQ ID NO: 63243 - DNA, 20 bp, human
ggagcgaggggcgcaagggt

SEQ ID NO: 63244 - DNA, 20 bp, human
ggggcgcgctacccagacgc

SEQ ID NO: 63245 - DNA, 20 bp, human
gaggggaaactccgagagga

SEQ ID NO: 63246 - DNA, 20 bp, human
gggacacagccagtcgggga

SEQ ID NO: 63247 - DNA, 20 bp, human
gcagtgctcgctcctgctcg

SEQ ID NO: 63248 - DNA, 20 bp, human
ggcaggagcgagcactgctc

SEQ ID NO: 63249 - DNA, 20 bp, human
gctggtcatggcgacgcccg

SEQ ID NO: 63250 - DNA, 20 bp, human
ggcgagcgcctgggaataag

SEQ ID NO: 63251 - DNA, 20 bp, human
gctcgagcatgtggaaggtg

SEQ ID NO: 63252 - DNA, 20 bp, human
gcgggaatcctggagcagac

SEQ ID NO: 63253 - DNA, 20 bp, human
gcgggtgcgctcgggaatcc

SEQ ID NO: 63254 - DNA, 20 bp, human
gctggagcagactggcgcca

SEQ ID NO: 63255 - DNA, 20 bp, human
gcagactggcgccacggcag

SEQ ID NO: 63256 - DNA, 20 bp, human
gcctgggcggggttcgggaa

SEQ ID NO: 63257 - DNA, 20 bp, human
ggggttctgacagctgcgcg

SEQ ID NO: 63258 - DNA, 20 bp, human
ggagtgctgcgcgggtccag

SEQ ID NO: 63259 - DNA, 20 bp, human
gagctgcgcgcggtgagaag

SEQ ID NO: 63260 - DNA, 20 bp, human
ggagcgcggggaaggcggtt

SEQ ID NO: 63261 - DNA, 20 bp, human
gggaatgactgatggatcac

SEQ ID NO: 63262 - DNA, 20 bp, human
gcggggcggtacaggaaagg

SEQ ID NO: 63263 - DNA, 20 bp, human
gggccagaggccggcggaga

SEQ ID NO: 63264 - DNA, 20 bp, human
gcttggggtgcgctttaata

SEQ ID NO: 63265 - DNA, 20 bp, human
gagaaggggaaaagccctag

SEQ ID NO: 63266 - DNA, 20 bp, human
gagctgtgagtaccccctcg

SEQ ID NO: 63267 - DNA, 20 bp, human
ggaaacacctgatcatctat

SEQ ID NO: 63268 - DNA, 20 bp, human
ggccaggaacaacacccatt

SEQ ID NO: 63269 - DNA, 20 bp, human
ggcgcccaggcacagctcaa

SEQ ID NO: 63270 - DNA, 20 bp, human
gcggaccgccccaggagact

SEQ ID NO: 63271 - DNA, 20 bp, human
ggtccagggtaccaaaatag

SEQ ID NO: 63272 - DNA, 20 bp, human
ggcctaatgggtgttgttcc

SEQ ID NO: 63273 - DNA, 20 bp, human
gagggagctagcttacccca

SEQ ID NO: 63274 - DNA, 20 bp, human
ggtgtggggccgtaggacag

SEQ ID NO: 63275 - DNA, 20 bp, human
gtccagccatggcttgtaag

SEQ ID NO: 63276 - DNA, 20 bp, human
gtagaacctgcggcatacat

SEQ ID NO: 63277 - DNA, 20 bp, human
gacaaagcaactagaacctg

SEQ ID NO: 63278 - DNA, 20 bp, human
gtagttgctttgtaaggagg

SEQ ID NO: 63279 - DNA, 20 bp, human
ggaaagctggaacccaactc

SEQ ID NO: 63280 - DNA, 20 bp, human
gaacatggaccagtgaaggt

SEQ ID NO: 63281 - DNA, 20 bp, human
gctgtagctgtaagcattgg

SEQ ID NO: 63282 - DNA, 20 bp, human
gactggagccctgcaccagc

SEQ ID NO: 63283 - DNA, 20 bp, human
gttctagttgctttgtaagg

SEQ ID NO: 63284 - DNA, 20 bp, human
gtttctgtagctgtaagcat

SEQ ID NO: 63285 - DNA, 20 bp, human
gtgagctcacctaccttcac

SEQ ID NO: 63286 - DNA, 20 bp, human
ggggcgcggggtccatggca

SEQ ID NO: 63287 - DNA, 20 bp, human
gccaacgagcagctgcacgg

SEQ ID NO: 63288 - DNA, 20 bp, human
gggtgaaagcccggcctcag

SEQ ID NO: 63289 - DNA, 20 bp, human
gtgcacggaggtgcagaaga

SEQ ID NO: 63290 - DNA, 20 bp, human
gagcgggtgagggatcccta

SEQ ID NO: 63291 - DNA, 20 bp, human
gcattctcctgacaagctgg

SEQ ID NO: 63292 - DNA, 20 bp, human
gccgcgccgcccgcgctcct

SEQ ID NO: 63293 - DNA, 20 bp, human
gcaacgccaaggagcgtgag

SEQ ID NO: 63294 - DNA, 20 bp, human
gccgctccagcaccaactgg

SEQ ID NO: 63295 - DNA, 20 bp, human
gccgccaacgagcagctgca

SEQ ID NO: 63296 - DNA, 20 bp, human
gatcattgtaacaatagtat

SEQ ID NO: 63297 - DNA, 20 bp, human
gcccaaaacagctgcttgga

SEQ ID NO: 63298 - DNA, 20 bp, human
gagccagcatgccagaggct

SEQ ID NO: 63299 - DNA, 20 bp, human
gcgcggagagagaacccgat

SEQ ID NO: 63300 - DNA, 20 bp, human
ggagaaattagacagcaggt

SEQ ID NO: 63301 - DNA, 20 bp, human
gctccgcgcgttcaggtaag

SEQ ID NO: 63302 - DNA, 20 bp, human
gtgctgatgaatggaagcta

SEQ ID NO: 63303 - DNA, 20 bp, human
gggaagctagggttaagtga

SEQ ID NO: 63304 - DNA, 20 bp, human
gcgtacagaatagaaacgag

SEQ ID NO: 63305 - DNA, 20 bp, human
gcgatgctacgctaacctat

SEQ ID NO: 63306 - DNA, 20 bp, human
gcgtcaccgcatcctacctg

SEQ ID NO: 63307 - DNA, 20 bp, human
gaccagccgcaggtaggatg

SEQ ID NO: 63308 - DNA, 20 bp, human
gggtaggatgcggtgacggg

SEQ ID NO: 63309 - DNA, 20 bp, human
gcacccgggagagcaaacaa

SEQ ID NO: 63310 - DNA, 20 bp, human
gcaaccctgatgctccacag

SEQ ID NO: 63311 - DNA, 20 bp, human
gtcgttacaagaggccaccc

SEQ ID NO: 63312 - DNA, 20 bp, human
gcagtccccgcgcttttcgg

SEQ ID NO: 63313 - DNA, 20 bp, human
ggagaggagcggatccactt

SEQ ID NO: 63314 - DNA, 20 bp, human
gtgcggctggtgtgggacgc

SEQ ID NO: 63315 - DNA, 20 bp, human
gccacccgggagagcaagcg

SEQ ID NO: 63316 - DNA, 20 bp, human
gaggaggcgtcgggcaagta

SEQ ID NO: 63317 - DNA, 20 bp, human
gctgagggcccgtaccccgg

SEQ ID NO: 63318 - DNA, 20 bp, human
gagggcccgtaccccggagg

SEQ ID NO: 63319 - DNA, 20 bp, human
gaggcgtcgggcaagtacgg

SEQ ID NO: 63320 - DNA, 20 bp, human
ggcgctgagggcccgtaccc

SEQ ID NO: 63321 - DNA, 20 bp, human
gcggacaacggcgaatgtcg

SEQ ID NO: 63322 - DNA, 20 bp, human
gccgtctgcgcgcagtaacc

SEQ ID NO: 63323 - DNA, 20 bp, human
ggggagcccaggaccttgag

SEQ ID NO: 63324 - DNA, 20 bp, human
ggagccgcggaggaggcgtc

SEQ ID NO: 63325 - DNA, 20 bp, human
gctgcgggatagttgtacag

SEQ ID NO: 63326 - DNA, 20 bp, human
ggctctgacagtgttgtgaa

SEQ ID NO: 63327 - DNA, 20 bp, human
gactgttgctaggtgttgtt

SEQ ID NO: 63328 - DNA, 20 bp, human
ggttgttgggttcggagatt

SEQ ID NO: 63329 - DNA, 20 bp, human
gcacaacactgtcagagcaa

SEQ ID NO: 63330 - DNA, 20 bp, human
gccagcccaaaagaatacag

SEQ ID NO: 63331 - DNA, 20 bp, human
gtgctaggtgttgttgggtt

SEQ ID NO: 63332 - DNA, 20 bp, human
gggataaactacctacatag

SEQ ID NO: 63333 - DNA, 20 bp, human
gcggcagctcctttaaccaa

SEQ ID NO: 63334 - DNA, 20 bp, human
gggttaaaggagctgccgtc

SEQ ID NO: 63335 - DNA, 20 bp, human
gttattttggtcttacctga

SEQ ID NO: 63336 - DNA, 20 bp, human
gagagttgctggccaaagag

SEQ ID NO: 63337 - DNA, 20 bp, human
ggaggaactatcctgacagt

SEQ ID NO: 63338 - DNA, 20 bp, human
ggacaagtagaggcaggcac

SEQ ID NO: 63339 - DNA, 20 bp, human
ggccagtgatagctctgcaa

SEQ ID NO: 63340 - DNA, 20 bp, human
gcctggttgcaaactctcgg

SEQ ID NO: 63341 - DNA, 20 bp, human
ggcccctggttgcaaactct

SEQ ID NO: 63342 - DNA, 20 bp, human
gagagttgcttgcaaaatag

SEQ ID NO: 63343 - DNA, 20 bp, human
gcactgcccggagagggaag

SEQ ID NO: 63344 - DNA, 20 bp, human
gcacagcttgccagtctctg

SEQ ID NO: 63345 - DNA, 20 bp, human
gtggtcctggattccactgt

SEQ ID NO: 63346 - DNA, 20 bp, human
gaggaagagtggctctatgg

SEQ ID NO: 63347 - DNA, 20 bp, human
ggtcctgtccggcctgactt

SEQ ID NO: 63348 - DNA, 20 bp, human
gcgagactccaatcccagga

SEQ ID NO: 63349 - DNA, 20 bp, human
gagctcgagactccaatccc

SEQ ID NO: 63350 - DNA, 20 bp, human
gggacaggactcccaaccag

SEQ ID NO: 63351 - DNA, 20 bp, human
gcccaaccagaggcccgaag

SEQ ID NO: 63352 - DNA, 20 bp, human
gaggggtggatgcgcatggt

SEQ ID NO: 63353 - DNA, 20 bp, human
ggcctagtgtcggagctgag

SEQ ID NO: 63354 - DNA, 20 bp, human
gccgctgccgtcgccttcct

SEQ ID NO: 63355 - DNA, 20 bp, human
gggcccggccgccacagggg

SEQ ID NO: 63356 - DNA, 20 bp, human
gaggggccgaaccctcctcc

SEQ ID NO: 63357 - DNA, 20 bp, human
gtcctgaggagagtcaggta

SEQ ID NO: 63358 - DNA, 20 bp, human
gcactgggccatggagactg

SEQ ID NO: 63359 - DNA, 20 bp, human
gtgtagtgtgaggctcgcgg

SEQ ID NO: 63360 - DNA, 20 bp, human
ggccgagggaagccgaacta

SEQ ID NO: 63361 - DNA, 20 bp, human
ggctcagggcgctcctccag

SEQ ID NO: 63362 - DNA, 20 bp, human
gccgtgccggacgcagtaat

SEQ ID NO: 63363 - DNA, 20 bp, human
gcagggcgctcctccagcgg

SEQ ID NO: 63364 - DNA, 20 bp, human
gcaactcccaggagcctctg

SEQ ID NO: 63365 - DNA, 20 bp, human
gagctacaaagactgagatc

SEQ ID NO: 63366 - DNA, 20 bp, human
gtgaatgaaagagtaacggt

SEQ ID NO: 63367 - DNA, 20 bp, human
gcagaacgctcagaacctcc

SEQ ID NO: 63368 - DNA, 20 bp, human
gtcagaacctccgggcgact

SEQ ID NO: 63369 - DNA, 20 bp, human
gtaggagccgaagggacggg

SEQ ID NO: 63370 - DNA, 20 bp, human
gcggaagcctagtcgcccgg

SEQ ID NO: 63371 - DNA, 20 bp, human
gtcctaggagccgaagggac

SEQ ID NO: 63372 - DNA, 20 bp, human
gagccaacgaaaccgacacc

SEQ ID NO: 63373 - DNA, 20 bp, human
ggacggtcccctcctctacg

SEQ ID NO: 63374 - DNA, 20 bp, human
ggcgcctcctaggagccgaa

SEQ ID NO: 63375 - DNA, 20 bp, human
gatgaaagagtaacggtagg

SEQ ID NO: 63376 - DNA, 20 bp, human
ggtagaggcgccgtaagcag

SEQ ID NO: 63377 - DNA, 20 bp, human
gctgctcaaggtgctgctct

SEQ ID NO: 63378 - DNA, 20 bp, human
gctgctgggctgcctgctca

SEQ ID NO: 63379 - DNA, 20 bp, human
gctggggtacaggggaagtt

SEQ ID NO: 63380 - DNA, 20 bp, human
gggggccggggcccgaatcc

SEQ ID NO: 63381 - DNA, 20 bp, human
ggaacgagtgatgatgtgta

SEQ ID NO: 63382 - DNA, 20 bp, human
gggctgtaaagggcacggca

SEQ ID NO: 63383 - DNA, 20 bp, human
gtcttccaaggagatagcaa

SEQ ID NO: 63384 - DNA, 20 bp, human
gaatgactgggggctgtaaa

SEQ ID NO: 63385 - DNA, 20 bp, human
ggcaaaggttaaatgactgg

SEQ ID NO: 63386 - DNA, 20 bp, human
gtggttgttgcggggaacgc

SEQ ID NO: 63387 - DNA, 20 bp, human
ggacggtggctgacgagatc

SEQ ID NO: 63388 - DNA, 20 bp, human
gtggccgagagggcacggag

SEQ ID NO: 63389 - DNA, 20 bp, human
ggtccgggcgaagggcgata

SEQ ID NO: 63390 - DNA, 20 bp, human
gccgagagggcacggagagg

SEQ ID NO: 63391 - DNA, 20 bp, human
gtggctgacgagatccggca

SEQ ID NO: 63392 - DNA, 20 bp, human
ggggcagcatgagcttgact

SEQ ID NO: 63393 - DNA, 20 bp, human
gagctcatgctgcccaaagt

SEQ ID NO: 63394 - DNA, 20 bp, human
gcgggcgaagggcgatacgg

SEQ ID NO: 63395 - DNA, 20 bp, human
gagatccggcatggagcatc

SEQ ID NO: 63396 - DNA, 20 bp, human
gaatgtcggcgcccagaggg

SEQ ID NO: 63397 - DNA, 20 bp, human
gggaggccggggaagtccgt

SEQ ID NO: 63398 - DNA, 20 bp, human
gagttgggcggagcttagag

SEQ ID NO: 63399 - DNA, 20 bp, human
gcgtggctcagaaggaatgg

SEQ ID NO: 63400 - DNA, 20 bp, human
gccgacattttgggcagcgg

SEQ ID NO: 63401 - DNA, 20 bp, human
ggggtcttaggcaaagaggt

SEQ ID NO: 63402 - DNA, 20 bp, human
gggaagtcgaggggcccccc

SEQ ID NO: 63403 - DNA, 20 bp, human
gccagggctgcaccttttag

SEQ ID NO: 63404 - DNA, 20 bp, human
gcaaaatgtcggcgcccaga

SEQ ID NO: 63405 - DNA, 20 bp, human
gctcagaaggaatggtgggt

SEQ ID NO: 63406 - DNA, 20 bp, human
gggcgctgcggggctctgtc

SEQ ID NO: 63407 - DNA, 20 bp, human
gggcacagccgcgggagcat

SEQ ID NO: 63408 - DNA, 20 bp, human
gttccgggcgctgctcaccc

SEQ ID NO: 63409 - DNA, 20 bp, human
gtggcgtgggacgcccgcgg

SEQ ID NO: 63410 - DNA, 20 bp, human
gccctggcgtgggacgcccg

SEQ ID NO: 63411 - DNA, 20 bp, human
gagcagccagagccccgcgg

SEQ ID NO: 63412 - DNA, 20 bp, human
gcacggcgcccggcccggag

SEQ ID NO: 63413 - DNA, 20 bp, human
gcggcagtttgtgggctccg

SEQ ID NO: 63414 - DNA, 20 bp, human
gcggcccgccccggcagtcc

SEQ ID NO: 63415 - DNA, 20 bp, human
gctgcccccgcccctggcgt

SEQ ID NO: 63416 - DNA, 20 bp, human
gtgtggctgggggggcccgc

SEQ ID NO: 63417 - DNA, 20 bp, human
ggccccaggggtgctgtcta

SEQ ID NO: 63418 - DNA, 20 bp, human
gccccgggaagtgcagatgg

SEQ ID NO: 63419 - DNA, 20 bp, human
gtccctggctgcgagacctg

SEQ ID NO: 63420 - DNA, 20 bp, human
gtgcctggagttgggaccgc

SEQ ID NO: 63421 - DNA, 20 bp, human
ggtgtgttagagtctgaggg

SEQ ID NO: 63422 - DNA, 20 bp, human
ggacggagtggtgaatccgg

SEQ ID NO: 63423 - DNA, 20 bp, human
gcgctcgccctcactgccgg

SEQ ID NO: 63424 - DNA, 20 bp, human
gaccctagacagcacccctg

SEQ ID NO: 63425 - DNA, 20 bp, human
ggaaagatgagaactctgag

SEQ ID NO: 63426 - DNA, 20 bp, human
gggagccggggcaccaggac

SEQ ID NO: 63427 - DNA, 20 bp, human
gccaggacaggctgttcggg

SEQ ID NO: 63428 - DNA, 20 bp, human
gacccctgtagtccgatcgt

SEQ ID NO: 63429 - DNA, 20 bp, human
gggacaggctgttcgggtgg

SEQ ID NO: 63430 - DNA, 20 bp, human
ggctcggcacatggttctgg

SEQ ID NO: 63431 - DNA, 20 bp, human
gacctacgatcggactacag

SEQ ID NO: 63432 - DNA, 20 bp, human
gcgccgcgggaacgctgtcc

SEQ ID NO: 63433 - DNA, 20 bp, human
gaacaaggctcggcccacgg

SEQ ID NO: 63434 - DNA, 20 bp, human
gggggcgcagggtcatgact

SEQ ID NO: 63435 - DNA, 20 bp, human
gaccctccaagtggagaccc

SEQ ID NO: 63436 - DNA, 20 bp, human
ggagagctggcataagtgag

SEQ ID NO: 63437 - DNA, 20 bp, human
ggccagctctccagcaggaa

SEQ ID NO: 63438 - DNA, 20 bp, human
ggtgccacgtcttctaagaa

SEQ ID NO: 63439 - DNA, 20 bp, human
gtgacccttgagaaaagagt

SEQ ID NO: 63440 - DNA, 20 bp, human
gacttacgtggagtgaaata

SEQ ID NO: 63441 - DNA, 20 bp, human
gtcccccttcttagaagacg

SEQ ID NO: 63442 - DNA, 20 bp, human
gcatcgcaagaccaaaggag

SEQ ID NO: 63443 - DNA, 20 bp, human
ggttcaaggcttacggacaa

SEQ ID NO: 63444 - DNA, 20 bp, human
gtctgccatcgcaagaccaa

SEQ ID NO: 63445 - DNA, 20 bp, human
gggcttaactctttaaaggt

SEQ ID NO: 63446 - DNA, 20 bp, human
gtgggtattcccagagtccc

SEQ ID NO: 63447 - DNA, 20 bp, human
gacattgcgttggctttcac

SEQ ID NO: 63448 - DNA, 20 bp, human
gcgggtcccgaacctcagat

SEQ ID NO: 63449 - DNA, 20 bp, human
gccgctcggcgagaggaaat

SEQ ID NO: 63450 - DNA, 20 bp, human
gcccgcaccgaacattgcgt

SEQ ID NO: 63451 - DNA, 20 bp, human
ggccaacgcaatgttcggtg

SEQ ID NO: 63452 - DNA, 20 bp, human
gtgctagagctgacccacca

SEQ ID NO: 63453 - DNA, 20 bp, human
gggtgtagagcaccggaatg

SEQ ID NO: 63454 - DNA, 20 bp, human
ggagctgacccaccaaggcc

SEQ ID NO: 63455 - DNA, 20 bp, human
gtctgagaggtgtagagcac

SEQ ID NO: 63456 - DNA, 20 bp, human
gggcgacgcgccgaggtact

SEQ ID NO: 63457 - DNA, 20 bp, human
gggcataagggcagcatcta

SEQ ID NO: 63458 - DNA, 20 bp, human
gacggctctgcctagtacct

SEQ ID NO: 63459 - DNA, 20 bp, human
gccgggcgggtctgaatcgg

SEQ ID NO: 63460 - DNA, 20 bp, human
gcccaggagacggtgagtag

SEQ ID NO: 63461 - DNA, 20 bp, human
gggcctgggcggtggctcag

SEQ ID NO: 63462 - DNA, 20 bp, human
gcgctgggcccccgactcac

SEQ ID NO: 63463 - DNA, 20 bp, human
gcctggggcttgcggaaccc

SEQ ID NO: 63464 - DNA, 20 bp, human
ggtgcagaaatgcttctgac

SEQ ID NO: 63465 - DNA, 20 bp, human
gaacccgggcgggtctgaat

SEQ ID NO: 63466 - DNA, 20 bp, human
ggccactgcagagccggagg

SEQ ID NO: 63467 - DNA, 20 bp, human
gccgcgacaggagaagcccg

SEQ ID NO: 63468 - DNA, 20 bp, human
gaggaggcgagccggagcga

SEQ ID NO: 63469 - DNA, 20 bp, human
gcgacaggagaagcccgggg

SEQ ID NO: 63470 - DNA, 20 bp, human
gcgctcacctaggggaatgt

SEQ ID NO: 63471 - DNA, 20 bp, human
gaatgtaggcggcagctcgg

SEQ ID NO: 63472 - DNA, 20 bp, human
ggcgagccggagcgacggcg

SEQ ID NO: 63473 - DNA, 20 bp, human
ggaaagcgaagccgaaaccc

SEQ ID NO: 63474 - DNA, 20 bp, human
gaggtgagcgcggaagagga

SEQ ID NO: 63475 - DNA, 20 bp, human
gtgagcgcggaagaggatgg

SEQ ID NO: 63476 - DNA, 20 bp, human
ggcgcccccggagtcaaccc

SEQ ID NO: 63477 - DNA, 20 bp, human
gcgaggacgcgcctgcgcag

SEQ ID NO: 63478 - DNA, 20 bp, human
gcagaggcggcagcaccacc

SEQ ID NO: 63479 - DNA, 20 bp, human
gcccccggagtcaaccccgg

SEQ ID NO: 63480 - DNA, 20 bp, human
gcggtaccgcgtcctccgaa

SEQ ID NO: 63481 - DNA, 20 bp, human
gccgtagccacgccactcac

SEQ ID NO: 63482 - DNA, 20 bp, human
gacaggcgggaactgaagag

SEQ ID NO: 63483 - DNA, 20 bp, human
gaggagcctggcccgagtaa

SEQ ID NO: 63484 - DNA, 20 bp, human
ggcccggcctggtagcgacg

SEQ ID NO: 63485 - DNA, 20 bp, human
ggcaccaccggggttgactc

SEQ ID NO: 63486 - DNA, 20 bp, human
gaccggccgcgggaagacga

SEQ ID NO: 63487 - DNA, 20 bp, human
ggtccacgcccgctgtggaa

SEQ ID NO: 63488 - DNA, 20 bp, human
gggctggctcagtaaagcgg

SEQ ID NO: 63489 - DNA, 20 bp, human
gcggagaggccgaggaatag

SEQ ID NO: 63490 - DNA, 20 bp, human
gctcagtaaagcggaggcag

SEQ ID NO: 63491 - DNA, 20 bp, human
gaggaacccgaggatattgg

SEQ ID NO: 63492 - DNA, 20 bp, human
gaggccgaggaatagtggtg

SEQ ID NO: 63493 - DNA, 20 bp, human
gccacagcgggcgtggaccg

SEQ ID NO: 63494 - DNA, 20 bp, human
gcctagcccccaatatcctc

SEQ ID NO: 63495 - DNA, 20 bp, human
ggcgggctggctcagtaaag

SEQ ID NO: 63496 - DNA, 20 bp, human
gctgactgcggaccgcgagg

SEQ ID NO: 63497 - DNA, 20 bp, human
gggcgcggcggcactgactg

SEQ ID NO: 63498 - DNA, 20 bp, human
gcggcgccgctgcccatgga

SEQ ID NO: 63499 - DNA, 20 bp, human
ggacgcagcccggtccggga

SEQ ID NO: 63500 - DNA, 20 bp, human
gggcatcgccgtcccggacc

SEQ ID NO: 63501 - DNA, 20 bp, human
gaggtgctcaagcctcctcg

SEQ ID NO: 63502 - DNA, 20 bp, human
gtaaacgacgcagcccggtc

SEQ ID NO: 63503 - DNA, 20 bp, human
ggcacgcggcgcgagagctg

SEQ ID NO: 63504 - DNA, 20 bp, human
ggctctcgcgccgcgtgcag

SEQ ID NO: 63505 - DNA, 20 bp, human
gctcgcggccgtcccgccgg

SEQ ID NO: 63506 - DNA, 20 bp, human
gggacaccgccgcccgagac

SEQ ID NO: 63507 - DNA, 20 bp, human
gcgcgggcgctgccagtctc

SEQ ID NO: 63508 - DNA, 20 bp, human
ggagcgggacctgtcatccc

SEQ ID NO: 63509 - DNA, 20 bp, human
ggggcgctgccagtctcggg

SEQ ID NO: 63510 - DNA, 20 bp, human
gcgggcaaggcggagagtga

SEQ ID NO: 63511 - DNA, 20 bp, human
gtgaagggttagcggagcac

SEQ ID NO: 63512 - DNA, 20 bp, human
gtagcggagcacgggcaagg

SEQ ID NO: 63513 - DNA, 20 bp, human
gaggcggagagtgacggagt

SEQ ID NO: 63514 - DNA, 20 bp, human
gctctgccgggagaggccgg

SEQ ID NO: 63515 - DNA, 20 bp, human
ggcgcgggcggcctgctggg

SEQ ID NO: 63516 - DNA, 20 bp, human
gctacagaggccacgcggtg

SEQ ID NO: 63517 - DNA, 20 bp, human
gtgcgaggtatgatccgtaa

SEQ ID NO: 63518 - DNA, 20 bp, human
gggccacgcggtgaggtgcg

SEQ ID NO: 63519 - DNA, 20 bp, human
gtacctcgcacctcaccgcg

SEQ ID NO: 63520 - DNA, 20 bp, human
gggaagcgcacgaaacatga

SEQ ID NO: 63521 - DNA, 20 bp, human
ggtttcgtgcgcttccatta

SEQ ID NO: 63522 - DNA, 20 bp, human
gcccaccagagtcacagcca

SEQ ID NO: 63523 - DNA, 20 bp, human
gcacgtaacgggaccacgca

SEQ ID NO: 63524 - DNA, 20 bp, human
gtgcgccccgctgccctccc

SEQ ID NO: 63525 - DNA, 20 bp, human
gtggaactacagaggccacg

SEQ ID NO: 63526 - DNA, 20 bp, human
gcggccgcgggacatccacg

SEQ ID NO: 63527 - DNA, 20 bp, human
ggcgcgagtgacacgcggga

SEQ ID NO: 63528 - DNA, 20 bp, human
ggcgccccgtggatgtcccg

SEQ ID NO: 63529 - DNA, 20 bp, human
gacggggcgcgagtgacacg

SEQ ID NO: 63530 - DNA, 20 bp, human
gcaccaagcggaagcctcat

SEQ ID NO: 63531 - DNA, 20 bp, human
gacgcgtcggaactcggccg

SEQ ID NO: 63532 - DNA, 20 bp, human
ggccaggtagccgtcataat

SEQ ID NO: 63533 - DNA, 20 bp, human
ggctctaagacaagcaagaa

SEQ ID NO: 63534 - DNA, 20 bp, human
gcctgccacgcgtcggaact

SEQ ID NO: 63535 - DNA, 20 bp, human
gtttgtgcaactggacgcac

SEQ ID NO: 63536 - DNA, 20 bp, human
gggcgcaggaccccaagtgg

SEQ ID NO: 63537 - DNA, 20 bp, human
gggctccgggacccccactt

SEQ ID NO: 63538 - DNA, 20 bp, human
gcggccaatgggcacggcag

SEQ ID NO: 63539 - DNA, 20 bp, human
ggcgcctcgggaaccaggtt

SEQ ID NO: 63540 - DNA, 20 bp, human
gtgtttacggcgagacggag

SEQ ID NO: 63541 - DNA, 20 bp, human
gtccatcgggacccccccac

SEQ ID NO: 63542 - DNA, 20 bp, human
gcggccgaacctggttcccg

SEQ ID NO: 63543 - DNA, 20 bp, human
gtggggcgtcaggagagcgt

SEQ ID NO: 63544 - DNA, 20 bp, human
ggtgggggtcccggagccag

SEQ ID NO: 63545 - DNA, 20 bp, human
gcagactggtggcgtcagac

SEQ ID NO: 63546 - DNA, 20 bp, human
gggcggagctaggggaggtc

SEQ ID NO: 63547 - DNA, 20 bp, human
gcgggtagggccaggagacc

SEQ ID NO: 63548 - DNA, 20 bp, human
gctgggcagcggaagaaggg

SEQ ID NO: 63549 - DNA, 20 bp, human
ggatctgggcagcggaagaa

SEQ ID NO: 63550 - DNA, 20 bp, human
ggcgctcgggcggcacgggt

SEQ ID NO: 63551 - DNA, 20 bp, human
ggcgcccggcgcggcctcag

SEQ ID NO: 63552 - DNA, 20 bp, human
gctggggtccgggaggatct

SEQ ID NO: 63553 - DNA, 20 bp, human
gaggccgcgccgggcgccaa

SEQ ID NO: 63554 - DNA, 20 bp, human
ggaaaggcctgtccggagag

SEQ ID NO: 63555 - DNA, 20 bp, human
gacgcagcgcggcgctcggg

SEQ ID NO: 63556 - DNA, 20 bp, human
ggccttgccccacgcggaga

SEQ ID NO: 63557 - DNA, 20 bp, human
ggcgtggggcaaggctccga

SEQ ID NO: 63558 - DNA, 20 bp, human
ggcggagagggcagccggag

SEQ ID NO: 63559 - DNA, 20 bp, human
ggaatgggaaaggacgagaa

SEQ ID NO: 63560 - DNA, 20 bp, human
gggtagggggcggaacaact

SEQ ID NO: 63561 - DNA, 20 bp, human
gcggctgccctctccgcgtg

SEQ ID NO: 63562 - DNA, 20 bp, human
ggtgcgggaggcgggggtag

SEQ ID NO: 63563 - DNA, 20 bp, human
gaaggtagccgcgccaacta

SEQ ID NO: 63564 - DNA, 20 bp, human
gcaactacggacacccggtc

SEQ ID NO: 63565 - DNA, 20 bp, human
gggatgcttagtcccttcca

SEQ ID NO: 63566 - DNA, 20 bp, human
gggatccccggcaggctcag

SEQ ID NO: 63567 - DNA, 20 bp, human
gggccattgctccaagatgg

SEQ ID NO: 63568 - DNA, 20 bp, human
gggccgggcccggcaggtaa

SEQ ID NO: 63569 - DNA, 20 bp, human
gcccggggcctccatgatgg

SEQ ID NO: 63570 - DNA, 20 bp, human
gggcggccattgctccaaga

SEQ ID NO: 63571 - DNA, 20 bp, human
ggcccggcaggtaagggagg

SEQ ID NO: 63572 - DNA, 20 bp, human
ggccgctcgctcctccatca

SEQ ID NO: 63573 - DNA, 20 bp, human
gcggcgggggacagtaggaa

SEQ ID NO: 63574 - DNA, 20 bp, human
ggcgcccggcgggggacagt

SEQ ID NO: 63575 - DNA, 20 bp, human
gtccatgatggaggagcgag

SEQ ID NO: 63576 - DNA, 20 bp, human
ggagtgaggtaaggtacggg

SEQ ID NO: 63577 - DNA, 20 bp, human
ggttgagtgaggtaaggtac

SEQ ID NO: 63578 - DNA, 20 bp, human
gtgagtgccgtaaagcggag

SEQ ID NO: 63579 - DNA, 20 bp, human
gaggctcaggtcggtacccg

SEQ ID NO: 63580 - DNA, 20 bp, human
gggtaaggtacgggaggctc

SEQ ID NO: 63581 - DNA, 20 bp, human
ggtcggtacccggggatggg

SEQ ID NO: 63582 - DNA, 20 bp, human
gcaggtcggtacccggggat

SEQ ID NO: 63583 - DNA, 20 bp, human
ggaaggcgcccacccatccc

SEQ ID NO: 63584 - DNA, 20 bp, human
gagggcacccgagtcgccag

SEQ ID NO: 63585 - DNA, 20 bp, human
gtgggtgggcgccttcagac

SEQ ID NO: 63586 - DNA, 20 bp, human
gagggaaagagccggtgaag

SEQ ID NO: 63587 - DNA, 20 bp, human
gatctggttagagaagacta

SEQ ID NO: 63588 - DNA, 20 bp, human
gaggcaggtgagagtctaag

SEQ ID NO: 63589 - DNA, 20 bp, human
gagactagggtcttcctcga

SEQ ID NO: 63590 - DNA, 20 bp, human
ggagtcgcttgtcaaggatc

SEQ ID NO: 63591 - DNA, 20 bp, human
gcaaggcgggactttaagta

SEQ ID NO: 63592 - DNA, 20 bp, human
ggccatagcctgggaacagg

SEQ ID NO: 63593 - DNA, 20 bp, human
gggacatgaggaaaggaaca

SEQ ID NO: 63594 - DNA, 20 bp, human
gtaagtacggaagctgcccc

SEQ ID NO: 63595 - DNA, 20 bp, human
ggggaacacgtttattccag

SEQ ID NO: 63596 - DNA, 20 bp, human
ggagtcacgcgcctgggtgt

SEQ ID NO: 63597 - DNA, 20 bp, human
ggagcgaccacactcactcg

SEQ ID NO: 63598 - DNA, 20 bp, human
gacggcagggatgtcacccg

SEQ ID NO: 63599 - DNA, 20 bp, human
gcccctgagagcctgaaccc

SEQ ID NO: 63600 - DNA, 20 bp, human
ggcagggatgtcacccgggg

SEQ ID NO: 63601 - DNA, 20 bp, human
gcccagagcccccaagccca

SEQ ID NO: 63602 - DNA, 20 bp, human
gtggcgaggctctcaagccc

SEQ ID NO: 63603 - DNA, 20 bp, human
gagatttgaagataggttgg

SEQ ID NO: 63604 - DNA, 20 bp, human
gccaggtggacgagtaatgg

SEQ ID NO: 63605 - DNA, 20 bp, human
ggaccctgagatttgaagat

SEQ ID NO: 63606 - DNA, 20 bp, human
gggagcctgctgggtactga

SEQ ID NO: 63607 - DNA, 20 bp, human
ggagtgatgtagtagagcag

SEQ ID NO: 63608 - DNA, 20 bp, human
ggtacccagcaggctccttc

SEQ ID NO: 63609 - DNA, 20 bp, human
gcaaatagaatgtagcctga

SEQ ID NO: 63610 - DNA, 20 bp, human
ggtagcctgaaggagcctgc

SEQ ID NO: 63611 - DNA, 20 bp, human
ggtctacttactattaacca

SEQ ID NO: 63612 - DNA, 20 bp, human
gtttgctcttttggtgaaca

SEQ ID NO: 63613 - DNA, 20 bp, human
gagagtattgagtagctcca

SEQ ID NO: 63614 - DNA, 20 bp, human
gtacttactattaaccaagg

SEQ ID NO: 63615 - DNA, 20 bp, human
gtagtggcactgtcactaaa

SEQ ID NO: 63616 - DNA, 20 bp, human
gagtctagggatataagcta

SEQ ID NO: 63617 - DNA, 20 bp, human
gcaggcagcagtttaactag

SEQ ID NO: 63618 - DNA, 20 bp, human
ggggctgtccagctcaaact

SEQ ID NO: 63619 - DNA, 20 bp, human
gtgggaaccaacactgaata

SEQ ID NO: 63620 - DNA, 20 bp, human
ggcagcttgcagggtgacga

SEQ ID NO: 63621 - DNA, 20 bp, human
gaaagactcggaacagactg

SEQ ID NO: 63622 - DNA, 20 bp, human
gagactgtggaatggcctag

SEQ ID NO: 63623 - DNA, 20 bp, human
gctagtggataattagatct

SEQ ID NO: 63624 - DNA, 20 bp, human
gtatccctagacttctacta

SEQ ID NO: 63625 - DNA, 20 bp, human
gttgcagggtgacgatggat

SEQ ID NO: 63626 - DNA, 20 bp, human
gggagggtcgccctcaatgc

SEQ ID NO: 63627 - DNA, 20 bp, human
gagggcagggcgctcgcagg

SEQ ID NO: 63628 - DNA, 20 bp, human
ggggaaaccgggggacccca

SEQ ID NO: 63629 - DNA, 20 bp, human
ggaaatcccagcccccaaag

SEQ ID NO: 63630 - DNA, 20 bp, human
ggggtacggaacggagtcaa

SEQ ID NO: 63631 - DNA, 20 bp, human
ggggaccccagggtacggaa

SEQ ID NO: 63632 - DNA, 20 bp, human
gggccggggctccactttgg

SEQ ID NO: 63633 - DNA, 20 bp, human
gaccggccggggaggcgaag

SEQ ID NO: 63634 - DNA, 20 bp, human
ggcgccgggctaatccgaag

SEQ ID NO: 63635 - DNA, 20 bp, human
gggccaggcgcccgcattga

SEQ ID NO: 63636 - DNA, 20 bp, human
gagcaccccggtggcctcca

SEQ ID NO: 63637 - DNA, 20 bp, human
gacgaacggcagcaccccgg

SEQ ID NO: 63638 - DNA, 20 bp, human
gtgcgtggcgtggacctcag

SEQ ID NO: 63639 - DNA, 20 bp, human
gcaagccaggccctgactca

SEQ ID NO: 63640 - DNA, 20 bp, human
gcttgggcgtgtgacctcag

SEQ ID NO: 63641 - DNA, 20 bp, human
gggcagcgagagcggcgcca

SEQ ID NO: 63642 - DNA, 20 bp, human
gagccgagcgggacaggaag

SEQ ID NO: 63643 - DNA, 20 bp, human
ggcgtgtgacctcagagggg

SEQ ID NO: 63644 - DNA, 20 bp, human
ggccccggcgctccctagcc

SEQ ID NO: 63645 - DNA, 20 bp, human
gagcctcggtctccccgtac

SEQ ID NO: 63646 - DNA, 20 bp, human
ggcggtctgagtccctgaag

SEQ ID NO: 63647 - DNA, 20 bp, human
gccagcggcgaggaggcgag

SEQ ID NO: 63648 - DNA, 20 bp, human
gcaccccaggcgactctgtg

SEQ ID NO: 63649 - DNA, 20 bp, human
ggatgcctgcacctgccggg

SEQ ID NO: 63650 - DNA, 20 bp, human
ggagtccctgaaggggcaag

SEQ ID NO: 63651 - DNA, 20 bp, human
ggtgcaggcatccctcgggg

SEQ ID NO: 63652 - DNA, 20 bp, human
ggggacagcgaggagcagtg

SEQ ID NO: 63653 - DNA, 20 bp, human
gtcctgaattggagccgagg

SEQ ID NO: 63654 - DNA, 20 bp, human
gccgccagcctcgagagcgg

SEQ ID NO: 63655 - DNA, 20 bp, human
ggtggagatcggtcctgaat

SEQ ID NO: 63656 - DNA, 20 bp, human
gtccagctgaaggataaggg

SEQ ID NO: 63657 - DNA, 20 bp, human
gtaccatggcttgtacaaag

SEQ ID NO: 63658 - DNA, 20 bp, human
ggtccgctttgtacaagcca

SEQ ID NO: 63659 - DNA, 20 bp, human
gtggcgttggagagtgatgg

SEQ ID NO: 63660 - DNA, 20 bp, human
gtgctttacggtcgatttgc

SEQ ID NO: 63661 - DNA, 20 bp, human
gaatcgaccgtaaagcagcc

SEQ ID NO: 63662 - DNA, 20 bp, human
gccaacgccagcgctgcctc

SEQ ID NO: 63663 - DNA, 20 bp, human
ggagagtgatggcggcatgg

SEQ ID NO: 63664 - DNA, 20 bp, human
gtgcgagccagaggcagcgc

SEQ ID NO: 63665 - DNA, 20 bp, human
gtggcggcatggcggtgcgg

SEQ ID NO: 63666 - DNA, 20 bp, human
ggcagtgcccaggtacccgc

SEQ ID NO: 63667 - DNA, 20 bp, human
gtgcatctgaacacccccag

SEQ ID NO: 63668 - DNA, 20 bp, human
gggacgcgtccgccccgcgg

SEQ ID NO: 63669 - DNA, 20 bp, human
gccagactgtcccctcagtg

SEQ ID NO: 63670 - DNA, 20 bp, human
gggtgcgtgtgcattacaca

SEQ ID NO: 63671 - DNA, 20 bp, human
gcctgaatcaagggtcacag

SEQ ID NO: 63672 - DNA, 20 bp, human
gcgcccctcgtcaaggtcta

SEQ ID NO: 63673 - DNA, 20 bp, human
ggtcccgccggcgggtacct

SEQ ID NO: 63674 - DNA, 20 bp, human
ggccccatctggactgaaat

SEQ ID NO: 63675 - DNA, 20 bp, human
gctgggcactgcgccccatc

SEQ ID NO: 63676 - DNA, 20 bp, human
ggaaggaacagcatcatcaa

SEQ ID NO: 63677 - DNA, 20 bp, human
ggctagaaaagaccaggact

SEQ ID NO: 63678 - DNA, 20 bp, human
gcggcatgaggttgattgga

SEQ ID NO: 63679 - DNA, 20 bp, human
gatctgaattgactggtggg

SEQ ID NO: 63680 - DNA, 20 bp, human
gttgcagggtgcacttattt

SEQ ID NO: 63681 - DNA, 20 bp, human
gtagacaatcaaactgaaaa

SEQ ID NO: 63682 - DNA, 20 bp, human
gcacgatctgaattgactgg

SEQ ID NO: 63683 - DNA, 20 bp, human
gatttcggcatgaggttgat

SEQ ID NO: 63684 - DNA, 20 bp, human
gagacacatggaggatctca

SEQ ID NO: 63685 - DNA, 20 bp, human
gacaggaagtaattaactga

SEQ ID NO: 63686 - DNA, 20 bp, human
gggagccccgagagcaaggg

SEQ ID NO: 63687 - DNA, 20 bp, human
gaccaggcacagaaacccag

SEQ ID NO: 63688 - DNA, 20 bp, human
gcaactccagggatgactac

SEQ ID NO: 63689 - DNA, 20 bp, human
ggagtcctgtcggagtgaat

SEQ ID NO: 63690 - DNA, 20 bp, human
ggggggagccccgagagcaa

SEQ ID NO: 63691 - DNA, 20 bp, human
gggggggcattcggagacat

SEQ ID NO: 63692 - DNA, 20 bp, human
gctccgaatgcccccccacc

SEQ ID NO: 63693 - DNA, 20 bp, human
gaaatgaggtaacaggaatg

SEQ ID NO: 63694 - DNA, 20 bp, human
ggaactggaaaagtctcttt

SEQ ID NO: 63695 - DNA, 20 bp, human
ggatatggagggctccggct

SEQ ID NO: 63696 - DNA, 20 bp, human
gcgtggagcagagcagccgg

SEQ ID NO: 63697 - DNA, 20 bp, human
gacgcgggcctgcagaacaa

SEQ ID NO: 63698 - DNA, 20 bp, human
ggtccgcccggggagatgga

SEQ ID NO: 63699 - DNA, 20 bp, human
gtgcgctgcggcccggaagg

SEQ ID NO: 63700 - DNA, 20 bp, human
gatgagtagctcccactctc

SEQ ID NO: 63701 - DNA, 20 bp, human
ggagatgccggccaccgaga

SEQ ID NO: 63702 - DNA, 20 bp, human
gggccgcagcgcaactcccg

SEQ ID NO: 63703 - DNA, 20 bp, human
gctctggcccgcccgagagt

SEQ ID NO: 63704 - DNA, 20 bp, human
ggcgcaactcccgaggcctc

SEQ ID NO: 63705 - DNA, 20 bp, human
gagtagctcccactctcggg

SEQ ID NO: 63706 - DNA, 20 bp, human
gcggccagagaactcaccga

SEQ ID NO: 63707 - DNA, 20 bp, human
gcgcagagcagcaccggccg

SEQ ID NO: 63708 - DNA, 20 bp, human
ggcagcaccggccgtggctc

SEQ ID NO: 63709 - DNA, 20 bp, human
gctgctaccggagccacggc

SEQ ID NO: 63710 - DNA, 20 bp, human
gggcggccgcagagcagcac

SEQ ID NO: 63711 - DNA, 20 bp, human
ggcgcgtgcacccctgcgga

SEQ ID NO: 63712 - DNA, 20 bp, human
ggggcgggtcggcaccacag

SEQ ID NO: 63713 - DNA, 20 bp, human
gtgtccatcggtgagttctc

SEQ ID NO: 63714 - DNA, 20 bp, human
gccccgcgcgtgcacccctg

SEQ ID NO: 63715 - DNA, 20 bp, human
gttggaggcccaagggccga

SEQ ID NO: 63716 - DNA, 20 bp, human
ggcaccgctccggccctgga

SEQ ID NO: 63717 - DNA, 20 bp, human
gtaggcgctcggccgctctc

SEQ ID NO: 63718 - DNA, 20 bp, human
gagcggtgctcgggaagggc

SEQ ID NO: 63719 - DNA, 20 bp, human
ggtcgcgctgcaggtcggtc

SEQ ID NO: 63720 - DNA, 20 bp, human
ggccccggcgcgagagaagt

SEQ ID NO: 63721 - DNA, 20 bp, human
gccggagcggtgctcgggaa

SEQ ID NO: 63722 - DNA, 20 bp, human
gtgcagcgcgacctcagcga

SEQ ID NO: 63723 - DNA, 20 bp, human
ggagcggccgagcgcctagg

SEQ ID NO: 63724 - DNA, 20 bp, human
ggagccggagcccgtcgctg

SEQ ID NO: 63725 - DNA, 20 bp, human
gcagggccggagcggtgctc

SEQ ID NO: 63726 - DNA, 20 bp, human
gccgaggcggggcgaagtgg

SEQ ID NO: 63727 - DNA, 20 bp, human
ggtcgcgtctgccgcagcaa

SEQ ID NO: 63728 - DNA, 20 bp, human
gaacggggtgcggcagggtg

SEQ ID NO: 63729 - DNA, 20 bp, human
ggcagcaacggggtgcggca

SEQ ID NO: 63730 - DNA, 20 bp, human
ggccgtggcggatgcagact

SEQ ID NO: 63731 - DNA, 20 bp, human
gccggctggggtctcgggaa

SEQ ID NO: 63732 - DNA, 20 bp, human
gctgccgcagcaacggggtg

SEQ ID NO: 63733 - DNA, 20 bp, human
gtagaagggacgggccgtgg

SEQ ID NO: 63734 - DNA, 20 bp, human
gcgcgctgtggcgtccacag

SEQ ID NO: 63735 - DNA, 20 bp, human
gtggcggatgcagactggga

SEQ ID NO: 63736 - DNA, 20 bp, human
ggggaggcccgcctagggag

SEQ ID NO: 63737 - DNA, 20 bp, human
gcagacccggacaacagcag

SEQ ID NO: 63738 - DNA, 20 bp, human
gaacacaggaaaacccacag

SEQ ID NO: 63739 - DNA, 20 bp, human
ggggagggggagcccctggt

SEQ ID NO: 63740 - DNA, 20 bp, human
gcctcgggaccgcacagacc

SEQ ID NO: 63741 - DNA, 20 bp, human
gttccagcgcccgggatggg

SEQ ID NO: 63742 - DNA, 20 bp, human
ggcgacccgccccccatccc

SEQ ID NO: 63743 - DNA, 20 bp, human
gctcgttgggccccaccgtg

SEQ ID NO: 63744 - DNA, 20 bp, human
ggctcgcccgcgcccctctg

SEQ ID NO: 63745 - DNA, 20 bp, human
gttccttgctgcgcaccctc

SEQ ID NO: 63746 - DNA, 20 bp, human
gtggcgggctgcagacaaaa

SEQ ID NO: 63747 - DNA, 20 bp, human
gcaaggcctggtaggaccac

SEQ ID NO: 63748 - DNA, 20 bp, human
gaccaggccttgcaccacta

SEQ ID NO: 63749 - DNA, 20 bp, human
gctgaggtctgcgtccctag

SEQ ID NO: 63750 - DNA, 20 bp, human
ggagttgaaaagggctgtgg

SEQ ID NO: 63751 - DNA, 20 bp, human
ggggggtaaaagccacgcag

SEQ ID NO: 63752 - DNA, 20 bp, human
ggcagaggccaccctgctca

SEQ ID NO: 63753 - DNA, 20 bp, human
gtccctagtggtgcaaggcc

SEQ ID NO: 63754 - DNA, 20 bp, human
ggacgcagacctcagccctg

SEQ ID NO: 63755 - DNA, 20 bp, human
gcctgcagcctagggtgcca

SEQ ID NO: 63756 - DNA, 20 bp, human
gcgcagccgtcaggtaaaag

SEQ ID NO: 63757 - DNA, 20 bp, human
gcagggctcggtggacacgg

SEQ ID NO: 63758 - DNA, 20 bp, human
gtgggcaggagggacctcgg

SEQ ID NO: 63759 - DNA, 20 bp, human
gatgccaaacgcgcaagtga

SEQ ID NO: 63760 - DNA, 20 bp, human
gcaccacgctgtctcttcgg

SEQ ID NO: 63761 - DNA, 20 bp, human
gccaccgagccctgggatca

SEQ ID NO: 63762 - DNA, 20 bp, human
gggtggcagttctcaacgat

SEQ ID NO: 63763 - DNA, 20 bp, human
gaccagggacggaggaccag

SEQ ID NO: 63764 - DNA, 20 bp, human
ggaacgtacaactaactaca

SEQ ID NO: 63765 - DNA, 20 bp, human
gtcccagggctcggtggaca

SEQ ID NO: 63766 - DNA, 20 bp, human
gcgcagagcttgggagacgg

SEQ ID NO: 63767 - DNA, 20 bp, human
gtacactgaggagtgagcga

SEQ ID NO: 63768 - DNA, 20 bp, human
gtcagatcactcctacactg

SEQ ID NO: 63769 - DNA, 20 bp, human
gcttatggaaaacagcaagt

SEQ ID NO: 63770 - DNA, 20 bp, human
gtggactggacgcagagctt

SEQ ID NO: 63771 - DNA, 20 bp, human
gagctgccgtgggctttgtg

SEQ ID NO: 63772 - DNA, 20 bp, human
gctatagcggcagtgtatat

SEQ ID NO: 63773 - DNA, 20 bp, human
gccgtgggctttgtgtggac

SEQ ID NO: 63774 - DNA, 20 bp, human
gtgtaggagtgatctgaagc

SEQ ID NO: 63775 - DNA, 20 bp, human
gtgggctgtgtgcagtaaac

SEQ ID NO: 63776 - DNA, 20 bp, human
gcctgaggcgggctgcgatg

SEQ ID NO: 63777 - DNA, 20 bp, human
ggggtgcacgcggggagacg

SEQ ID NO: 63778 - DNA, 20 bp, human
gctggctacggcgagaacct

SEQ ID NO: 63779 - DNA, 20 bp, human
gagcctccgaggccagggcg

SEQ ID NO: 63780 - DNA, 20 bp, human
gcgccgtagccagcttctcc

SEQ ID NO: 63781 - DNA, 20 bp, human
ggtgtcccagtagctgacca

SEQ ID NO: 63782 - DNA, 20 bp, human
ggcggcggcgaacgagagga

SEQ ID NO: 63783 - DNA, 20 bp, human
gcttcatcgaggtccgcggg

SEQ ID NO: 63784 - DNA, 20 bp, human
gctccccgcggccaacgacc

SEQ ID NO: 63785 - DNA, 20 bp, human
gacgagaggacggactctgg

SEQ ID NO: 63786 - DNA, 20 bp, human
gcgaggcgcgccgctccagg

SEQ ID NO: 63787 - DNA, 20 bp, human
gtcgcggccgcagactccca

SEQ ID NO: 63788 - DNA, 20 bp, human
gcgctccaggcggcatcgca

SEQ ID NO: 63789 - DNA, 20 bp, human
gaggcgctgcgccgggtctg

SEQ ID NO: 63790 - DNA, 20 bp, human
gggaccgcggcccgagccag

SEQ ID NO: 63791 - DNA, 20 bp, human
gtccggagggcgcgaaagag

SEQ ID NO: 63792 - DNA, 20 bp, human
gggggccgcaggcaagtagt

SEQ ID NO: 63793 - DNA, 20 bp, human
gaggcgggagcggagaggtt

SEQ ID NO: 63794 - DNA, 20 bp, human
gcgggtgctgggccgtccgt

SEQ ID NO: 63795 - DNA, 20 bp, human
ggaggccgtctgcgaagtcc

SEQ ID NO: 63796 - DNA, 20 bp, human
gtccaagacccggcgacagg

SEQ ID NO: 63797 - DNA, 20 bp, human
gcaccaggcttgccccagtt

SEQ ID NO: 63798 - DNA, 20 bp, human
gccggcgacaggaggcatga

SEQ ID NO: 63799 - DNA, 20 bp, human
gccggccgaaatgacagtgc

SEQ ID NO: 63800 - DNA, 20 bp, human
gaaccccagggacaagatca

SEQ ID NO: 63801 - DNA, 20 bp, human
gccccttccacacccaactg

SEQ ID NO: 63802 - DNA, 20 bp, human
ggaggcacaatgtcaggatg

SEQ ID NO: 63803 - DNA, 20 bp, human
gctggggtttacgcactgtt

SEQ ID NO: 63804 - DNA, 20 bp, human
gcagatgacgaggaaatagg

SEQ ID NO: 63805 - DNA, 20 bp, human
ggccagagaccgaaagtgaa

SEQ ID NO: 63806 - DNA, 20 bp, human
gcccgcggggaagcgagtaa

SEQ ID NO: 63807 - DNA, 20 bp, human
gcgcgtgggtccgacccgag

SEQ ID NO: 63808 - DNA, 20 bp, human
gcacagtcgcaggcacagcg

SEQ ID NO: 63809 - DNA, 20 bp, human
ggaggacgcggagccaccga

SEQ ID NO: 63810 - DNA, 20 bp, human
gcaggcagagccacagtcgc

SEQ ID NO: 63811 - DNA, 20 bp, human
ggcagcggccggagatgcag

SEQ ID NO: 63812 - DNA, 20 bp, human
ggaagcgagtaagggcgcga

SEQ ID NO: 63813 - DNA, 20 bp, human
gatctccggccgctgcgcgt

SEQ ID NO: 63814 - DNA, 20 bp, human
gctcaccgtccaggagtccc

SEQ ID NO: 63815 - DNA, 20 bp, human
ggggtcggacccacgcgcag

SEQ ID NO: 63816 - DNA, 20 bp, human
gcgcgcccctcggcaacggg

SEQ ID NO: 63817 - DNA, 20 bp, human
gcgcggccagacgatgagga

SEQ ID NO: 63818 - DNA, 20 bp, human
ggcgggagctgagaccccgg

SEQ ID NO: 63819 - DNA, 20 bp, human
gcgcgccaccggggaaggag

SEQ ID NO: 63820 - DNA, 20 bp, human
gccaccggggaaggagcggt

SEQ ID NO: 63821 - DNA, 20 bp, human
gtagcgcggattgcggttcg

SEQ ID NO: 63822 - DNA, 20 bp, human
ggcggggagagcgccgtaag

SEQ ID NO: 63823 - DNA, 20 bp, human
ggaaggagcggtgggccgag

SEQ ID NO: 63824 - DNA, 20 bp, human
gggcgggcctcagactccac

SEQ ID NO: 63825 - DNA, 20 bp, human
gggcccgcccagaactcccg

SEQ ID NO: 63826 - DNA, 20 bp, human
ggaggactctgcgggcgaag

SEQ ID NO: 63827 - DNA, 20 bp, human
ggcccgggagaggactctgc

SEQ ID NO: 63828 - DNA, 20 bp, human
gtgcacaaggaacgcctcgt

SEQ ID NO: 63829 - DNA, 20 bp, human
ggcccgcagagtcctctccc

SEQ ID NO: 63830 - DNA, 20 bp, human
ggtgccttagcccaacccag

SEQ ID NO: 63831 - DNA, 20 bp, human
gccgcttggagtgcggactc

SEQ ID NO: 63832 - DNA, 20 bp, human
gacccaaggcaggagcggtc

SEQ ID NO: 63833 - DNA, 20 bp, human
ggagagccccaagcaaaagt

SEQ ID NO: 63834 - DNA, 20 bp, human
gcggtcacgtgtgcccgact

SEQ ID NO: 63835 - DNA, 20 bp, human
gtccggaccgctcctgcctt

SEQ ID NO: 63836 - DNA, 20 bp, human
gtgatgctgcgggtccagga

SEQ ID NO: 63837 - DNA, 20 bp, human
gcacggggctcgctcccgag

SEQ ID NO: 63838 - DNA, 20 bp, human
gggcagacaccgccaggaaa

SEQ ID NO: 63839 - DNA, 20 bp, human
gagacaccgccaggaaacgg

SEQ ID NO: 63840 - DNA, 20 bp, human
gcgccgccgccaccccgacc

SEQ ID NO: 63841 - DNA, 20 bp, human
gctcgtccgccgtttcctgg

SEQ ID NO: 63842 - DNA, 20 bp, human
gccagccccgacctgcccct

SEQ ID NO: 63843 - DNA, 20 bp, human
gtcgacgctcgctgctgcag

SEQ ID NO: 63844 - DNA, 20 bp, human
gggagcaaggagggaatcgc

SEQ ID NO: 63845 - DNA, 20 bp, human
gaggaaacggcggacgagtg

SEQ ID NO: 63846 - DNA, 20 bp, human
ggaggtaacagcgcgagctg

SEQ ID NO: 63847 - DNA, 20 bp, human
gtgcaaccgtgggacgaggc

SEQ ID NO: 63848 - DNA, 20 bp, human
gggagacactcggggcctca

SEQ ID NO: 63849 - DNA, 20 bp, human
gaacagcgcgagctgaggct

SEQ ID NO: 63850 - DNA, 20 bp, human
gccgtcctcaccgacgacag

SEQ ID NO: 63851 - DNA, 20 bp, human
gtgcagggacggcagcgagt

SEQ ID NO: 63852 - DNA, 20 bp, human
gcccttggcgcggaggctga

SEQ ID NO: 63853 - DNA, 20 bp, human
ggctggggcccttggcgcgg

SEQ ID NO: 63854 - DNA, 20 bp, human
gcgtgggacgaggccggcgg

SEQ ID NO: 63855 - DNA, 20 bp, human
ggcgctgttacctcaagccg

SEQ ID NO: 63856 - DNA, 20 bp, human
gcggctgacagcctgactcc

SEQ ID NO: 63857 - DNA, 20 bp, human
gccagaagccggacttgaag

SEQ ID NO: 63858 - DNA, 20 bp, human
ggcaacaggacccgggagtc

SEQ ID NO: 63859 - DNA, 20 bp, human
ggactgagccacttcaagtc

SEQ ID NO: 63860 - DNA, 20 bp, human
gaggagggaagcagcaccaa

SEQ ID NO: 63861 - DNA, 20 bp, human
ggaatcatcctgctgagatg

SEQ ID NO: 63862 - DNA, 20 bp, human
gagcaatggcttggatccac

SEQ ID NO: 63863 - DNA, 20 bp, human
ggaatctgtgaatccagaag

SEQ ID NO: 63864 - DNA, 20 bp, human
ggggattcacgtctaaacta

SEQ ID NO: 63865 - DNA, 20 bp, human
gttacaggacagagagcaac

SEQ ID NO: 63866 - DNA, 20 bp, human
gtaatgcgcggcggctcccg

SEQ ID NO: 63867 - DNA, 20 bp, human
gcgcgcattatgcaaagcgg

SEQ ID NO: 63868 - DNA, 20 bp, human
gccgcagcgacggcagccac

SEQ ID NO: 63869 - DNA, 20 bp, human
gcgcaggttggaaaacaccg

SEQ ID NO: 63870 - DNA, 20 bp, human
gcgccgcgcattatgcaaag

SEQ ID NO: 63871 - DNA, 20 bp, human
gtaggcaagcacggcaaggg

SEQ ID NO: 63872 - DNA, 20 bp, human
gaagcggcggcagatgcgag

SEQ ID NO: 63873 - DNA, 20 bp, human
ggcagcgggattgcaccatg

SEQ ID NO: 63874 - DNA, 20 bp, human
gcaccatggggaaccaggat

SEQ ID NO: 63875 - DNA, 20 bp, human
gggagtctcccgggagagtc

SEQ ID NO: 63876 - DNA, 20 bp, human
gggagcgcggcgtcccatcg

SEQ ID NO: 63877 - DNA, 20 bp, human
gctccgggtcgcactcacca

SEQ ID NO: 63878 - DNA, 20 bp, human
gccccgtccgtgggaccggg

SEQ ID NO: 63879 - DNA, 20 bp, human
gcggccccgtccgtgggacc

SEQ ID NO: 63880 - DNA, 20 bp, human
ggcgcggcgtcccatcgggg

SEQ ID NO: 63881 - DNA, 20 bp, human
gcgcttggagatccccggtc

SEQ ID NO: 63882 - DNA, 20 bp, human
gcaggaggtgggagcgacag

SEQ ID NO: 63883 - DNA, 20 bp, human
gagcggcacctgagtccccg

SEQ ID NO: 63884 - DNA, 20 bp, human
gggcggcgagctgcagggtt

SEQ ID NO: 63885 - DNA, 20 bp, human
ggccgcccggtcccacggac

SEQ ID NO: 63886 - DNA, 20 bp, human
ggcgcagccgtggccggcta

SEQ ID NO: 63887 - DNA, 20 bp, human
gctggcatcggcagcttcaa

SEQ ID NO: 63888 - DNA, 20 bp, human
gcccggcgcgccgccgacat

SEQ ID NO: 63889 - DNA, 20 bp, human
gttccagccctagccggcca

SEQ ID NO: 63890 - DNA, 20 bp, human
ggcccggcagaaggccgagt

SEQ ID NO: 63891 - DNA, 20 bp, human
ggagaggtggcattgtgtag

SEQ ID NO: 63892 - DNA, 20 bp, human
gagccaggcaggcgcagccg

SEQ ID NO: 63893 - DNA, 20 bp, human
gcgcctgcctggctagcacc

SEQ ID NO: 63894 - DNA, 20 bp, human
ggcgcgtggtccctcctact

SEQ ID NO: 63895 - DNA, 20 bp, human
gcgccgacatgggcaacgca

SEQ ID NO: 63896 - DNA, 20 bp, human
gccgggcgtcgggacctgag

SEQ ID NO: 63897 - DNA, 20 bp, human
gaccgaagcaaggcggacgg

SEQ ID NO: 63898 - DNA, 20 bp, human
gggaccccgactgaaagggt

SEQ ID NO: 63899 - DNA, 20 bp, human
gcctgaggggcggtacgcgg

SEQ ID NO: 63900 - DNA, 20 bp, human
gcagccgcaccgaagcaagg

SEQ ID NO: 63901 - DNA, 20 bp, human
ggagggcggaggcagcgtag

SEQ ID NO: 63902 - DNA, 20 bp, human
gcgcggcggggccccctcag

SEQ ID NO: 63903 - DNA, 20 bp, human
gggacagccgcaccgaagca

SEQ ID NO: 63904 - DNA, 20 bp, human
ggctcacagggctcaggcat

SEQ ID NO: 63905 - DNA, 20 bp, human
gcgaaagctccggagcgtgg

SEQ ID NO: 63906 - DNA, 20 bp, human
ggggactcccaagccagcac

SEQ ID NO: 63907 - DNA, 20 bp, human
gcacaggtaagtatactgtt

SEQ ID NO: 63908 - DNA, 20 bp, human
gctaataccagagtcctgcg

SEQ ID NO: 63909 - DNA, 20 bp, human
ggacaggtaagtatactgct

SEQ ID NO: 63910 - DNA, 20 bp, human
gaatcagtatgagccagtgc

SEQ ID NO: 63911 - DNA, 20 bp, human
ggaatcaaatgggaaaaact

SEQ ID NO: 63912 - DNA, 20 bp, human
gtagctttatagctcctcca

SEQ ID NO: 63913 - DNA, 20 bp, human
gacctgtcttccatgtacac

SEQ ID NO: 63914 - DNA, 20 bp, human
gacctgtgtacatggaagac

SEQ ID NO: 63915 - DNA, 20 bp, human
ggagctataaagctactcct

SEQ ID NO: 63916 - DNA, 20 bp, human
ggcctcccagcacacaacca

SEQ ID NO: 63917 - DNA, 20 bp, human
gcccttggttgtgtgctggg

SEQ ID NO: 63918 - DNA, 20 bp, human
gaaggtaaggatgatcgctg

SEQ ID NO: 63919 - DNA, 20 bp, human
gtcaaagagacggtgccaaa

SEQ ID NO: 63920 - DNA, 20 bp, human
gggtggctgtgagaaatggg

SEQ ID NO: 63921 - DNA, 20 bp, human
gactccttgacaggagctga

SEQ ID NO: 63922 - DNA, 20 bp, human
gtgaagtgctgtgtggatga

SEQ ID NO: 63923 - DNA, 20 bp, human
gcaaagaaggtagctgtgat

SEQ ID NO: 63924 - DNA, 20 bp, human
gattacttaactgggacaac

SEQ ID NO: 63925 - DNA, 20 bp, human
gttgccatcagctcctgtca

SEQ ID NO: 63926 - DNA, 20 bp, human
gacgtcctgtccaaccgtct

SEQ ID NO: 63927 - DNA, 20 bp, human
gaagaagacaaagaacgggt

SEQ ID NO: 63928 - DNA, 20 bp, human
gatagtaaagggttgagggt

SEQ ID NO: 63929 - DNA, 20 bp, human
gttcaaactgcccagacggt

SEQ ID NO: 63930 - DNA, 20 bp, human
gtaaaaggtgatatagtaaa

SEQ ID NO: 63931 - DNA, 20 bp, human
gtgtagttttataccaaata

SEQ ID NO: 63932 - DNA, 20 bp, human
gggaaaattaaaaaggtagg

SEQ ID NO: 63933 - DNA, 20 bp, human
gtgatatagtaaagggttga

SEQ ID NO: 63934 - DNA, 20 bp, human
ggtttcgcttttatccaggt

SEQ ID NO: 63935 - DNA, 20 bp, human
gcggagtttcgcttttatcc

SEQ ID NO: 63936 - DNA, 20 bp, human
ggcagaaagtatacagacta

SEQ ID NO: 63937 - DNA, 20 bp, human
ggcataacagaaaagacgaa

SEQ ID NO: 63938 - DNA, 20 bp, human
ggaagcaaagggaagttgta

SEQ ID NO: 63939 - DNA, 20 bp, human
gatctgctctatgctaacca

SEQ ID NO: 63940 - DNA, 20 bp, human
gggaaaaaaagttgtgtaag

SEQ ID NO: 63941 - DNA, 20 bp, human
gctaaccaaggtaagtgtcc

SEQ ID NO: 63942 - DNA, 20 bp, human
gattcataagatgaaatcag

SEQ ID NO: 63943 - DNA, 20 bp, human
ggatacttccgtgatcttaa

SEQ ID NO: 63944 - DNA, 20 bp, human
gaggaaacaaagttatgttg

SEQ ID NO: 63945 - DNA, 20 bp, human
gcttttggggtctcttgact

SEQ ID NO: 63946 - DNA, 20 bp, human
gtccttcagctgcgatctgg

SEQ ID NO: 63947 - DNA, 20 bp, human
gctgttgagcgcttcaggaa

SEQ ID NO: 63948 - DNA, 20 bp, human
ggcagaagcgagcacagacg

SEQ ID NO: 63949 - DNA, 20 bp, human
gtgacatcggagggctctgg

SEQ ID NO: 63950 - DNA, 20 bp, human
gcaggaaaggcggtgagatc

SEQ ID NO: 63951 - DNA, 20 bp, human
gttgagcgcttcaggaaagg

SEQ ID NO: 63952 - DNA, 20 bp, human
gactaacaggtgaagatctc

SEQ ID NO: 63953 - DNA, 20 bp, human
gaaggactgatgacatcgga

SEQ ID NO: 63954 - DNA, 20 bp, human
gtaggacaggcgacactaac

SEQ ID NO: 63955 - DNA, 20 bp, human
gccatcgagggagggagaat

SEQ ID NO: 63956 - DNA, 20 bp, human
gcacgttctccaacccaagg

SEQ ID NO: 63957 - DNA, 20 bp, human
gagagattgcagggacatcc

SEQ ID NO: 63958 - DNA, 20 bp, human
ggttggagaacgtgtgagag

SEQ ID NO: 63959 - DNA, 20 bp, human
gtgcagggacatccaggtct

SEQ ID NO: 63960 - DNA, 20 bp, human
ggtgaccacgtccctctgtc

SEQ ID NO: 63961 - DNA, 20 bp, human
gtggcagagagggtgtataa

SEQ ID NO: 63962 - DNA, 20 bp, human
gctgtctggcctccttgggt

SEQ ID NO: 63963 - DNA, 20 bp, human
gtgaagggtattccaagacc

SEQ ID NO: 63964 - DNA, 20 bp, human
gcatctgggccatgacccca

SEQ ID NO: 63965 - DNA, 20 bp, human
ggtgaaggaccctctgtcta

SEQ ID NO: 63966 - DNA, 20 bp, human
gctcagaggcggccctccac

SEQ ID NO: 63967 - DNA, 20 bp, human
gcggcccgccgcccgctcag

SEQ ID NO: 63968 - DNA, 20 bp, human
ggcctctcggagtcggagag

SEQ ID NO: 63969 - DNA, 20 bp, human
gcgctagggcctctcggagt

SEQ ID NO: 63970 - DNA, 20 bp, human
gcgctcggcgggatgttgtt

SEQ ID NO: 63971 - DNA, 20 bp, human
ggagcccgcccccgagaggt

SEQ ID NO: 63972 - DNA, 20 bp, human
gcggcgggatgttgttggga

SEQ ID NO: 63973 - DNA, 20 bp, human
ggtttcggtttcacttccgg

SEQ ID NO: 63974 - DNA, 20 bp, human
gggtgccagggcacgctcgg

SEQ ID NO: 63975 - DNA, 20 bp, human
ggttgttgggagggaaggac

SEQ ID NO: 63976 - DNA, 20 bp, human
gaggcagcgtctcagcgagg

SEQ ID NO: 63977 - DNA, 20 bp, human
ggcctcacagcccaacggtc

SEQ ID NO: 63978 - DNA, 20 bp, human
ggggcaggaaggcctatggt

SEQ ID NO: 63979 - DNA, 20 bp, human
gcacggactgccggaccgtt

SEQ ID NO: 63980 - DNA, 20 bp, human
gacgctgcctcacagcccaa

SEQ ID NO: 63981 - DNA, 20 bp, human
ggccggaccgttgggctgtg

SEQ ID NO: 63982 - DNA, 20 bp, human
gggccataaaggcctttggg

SEQ ID NO: 63983 - DNA, 20 bp, human
gggagcacaggtagtaggac

SEQ ID NO: 63984 - DNA, 20 bp, human
gtgtaaggactgctgaggat

SEQ ID NO: 63985 - DNA, 20 bp, human
gtaggaggaaagcgaagggg

SEQ ID NO: 63986 - DNA, 20 bp, human
gggggaggagagggaacccc

SEQ ID NO: 63987 - DNA, 20 bp, human
gccaggcgcgagcgggaaga

SEQ ID NO: 63988 - DNA, 20 bp, human
ggagagacgcccgcaccggg

SEQ ID NO: 63989 - DNA, 20 bp, human
ggctgaaacaggctgcctca

SEQ ID NO: 63990 - DNA, 20 bp, human
ggccggctgtgctgcacagg

SEQ ID NO: 63991 - DNA, 20 bp, human
gaaacaggctgcctcaggga

SEQ ID NO: 63992 - DNA, 20 bp, human
ggttcagccccagtccccgg

SEQ ID NO: 63993 - DNA, 20 bp, human
gtgacagccaccggggactg

SEQ ID NO: 63994 - DNA, 20 bp, human
gactgaccgcgggctgaaac

SEQ ID NO: 63995 - DNA, 20 bp, human
gagggaaccccaggcgcgag

SEQ ID NO: 63996 - DNA, 20 bp, human
gcgcagcgcacaggcttcta

SEQ ID NO: 63997 - DNA, 20 bp, human
gcgcagcgcctcagccgaca

SEQ ID NO: 63998 - DNA, 20 bp, human
gagcaggtgccacctcccaa

SEQ ID NO: 63999 - DNA, 20 bp, human
ggcgcacaggcttctagggg

SEQ ID NO: 64000 - DNA, 20 bp, human
gccactgccaggaggacggt

SEQ ID NO: 64001 - DNA, 20 bp, human
gcggaagcccctgtcggctg

SEQ ID NO: 64002 - DNA, 20 bp, human
ggagggccgagcctacgaca

SEQ ID NO: 64003 - DNA, 20 bp, human
gccgaaggcccgcagggtcg

SEQ ID NO: 64004 - DNA, 20 bp, human
ggtctctgcggggcctggga

SEQ ID NO: 64005 - DNA, 20 bp, human
ggcctgtgcgctgcgcatgg

SEQ ID NO: 64006 - DNA, 20 bp, human
gctgggctgcagctctgtca

SEQ ID NO: 64007 - DNA, 20 bp, human
ggcacctgcggggaactgtc

SEQ ID NO: 64008 - DNA, 20 bp, human
gcagggccggagctacgaca

SEQ ID NO: 64009 - DNA, 20 bp, human
gctgtccggagcaggaaccg

SEQ ID NO: 64010 - DNA, 20 bp, human
gcgagtctccgccagatccg

SEQ ID NO: 64011 - DNA, 20 bp, human
gggacccgccccggatctgg

SEQ ID NO: 64012 - DNA, 20 bp, human
ggggccacgggccactcggg

SEQ ID NO: 64013 - DNA, 20 bp, human
ggtctccgccagatccgggg

SEQ ID NO: 64014 - DNA, 20 bp, human
gagctcctgaggcgcgagct

SEQ ID NO: 64015 - DNA, 20 bp, human
ggtcccgggagagccaccca

SEQ ID NO: 64016 - DNA, 20 bp, human
gtcgcccggggtctcctcgg

SEQ ID NO: 64017 - DNA, 20 bp, human
gtcgggccaaggcggacgag

SEQ ID NO: 64018 - DNA, 20 bp, human
ggggccggcttgtccttcgg

SEQ ID NO: 64019 - DNA, 20 bp, human
gtcgcctccgaaggacaagc

SEQ ID NO: 64020 - DNA, 20 bp, human
gtccacagcaaaatggcccg

SEQ ID NO: 64021 - DNA, 20 bp, human
gcctcctgctcgggccaagg

SEQ ID NO: 64022 - DNA, 20 bp, human
gccgccgctccacagcaaaa

SEQ ID NO: 64023 - DNA, 20 bp, human
gccctacacccggagagcgg

SEQ ID NO: 64024 - DNA, 20 bp, human
gccgtcgcggggatctcggg

SEQ ID NO: 64025 - DNA, 20 bp, human
gtggtgcaggggacgcgaag

SEQ ID NO: 64026 - DNA, 20 bp, human
gcactcactggggagcccgg

SEQ ID NO: 64027 - DNA, 20 bp, human
gcggcgggctagcagctcag

SEQ ID NO: 64028 - DNA, 20 bp, human
gtcagcgggtctacctcgaa

SEQ ID NO: 64029 - DNA, 20 bp, human
gcgcccgagctgcaccacgg

SEQ ID NO: 64030 - DNA, 20 bp, human
gcggccagcgagtgagaggt

SEQ ID NO: 64031 - DNA, 20 bp, human
gcaggcgtcgggaaaagtga

SEQ ID NO: 64032 - DNA, 20 bp, human
ggcggtggcggcacctttcg

SEQ ID NO: 64033 - DNA, 20 bp, human
gctagacccccggccgagaa

SEQ ID NO: 64034 - DNA, 20 bp, human
gctgctcccccggccgtccc

SEQ ID NO: 64035 - DNA, 20 bp, human
gccgccggccagcgagtgag

SEQ ID NO: 64036 - DNA, 20 bp, human
gctacggccgggtaccgccc

SEQ ID NO: 64037 - DNA, 20 bp, human
gacccggcggagagagttgc

SEQ ID NO: 64038 - DNA, 20 bp, human
ggcgatggggaagaagtccc

SEQ ID NO: 64039 - DNA, 20 bp, human
gatggggaagaagtcccggg

SEQ ID NO: 64040 - DNA, 20 bp, human
gtgctgccccgaggacccgg

SEQ ID NO: 64041 - DNA, 20 bp, human
ggcgagcagagagcgtcggg

SEQ ID NO: 64042 - DNA, 20 bp, human
gagcgcgagcagagagcgtc

SEQ ID NO: 64043 - DNA, 20 bp, human
gtgggctccgggccgcagaa

SEQ ID NO: 64044 - DNA, 20 bp, human
gcgcgcttgggctcgcgatg

SEQ ID NO: 64045 - DNA, 20 bp, human
ggcaggatgggcctacggcc

SEQ ID NO: 64046 - DNA, 20 bp, human
gatcgctcccggccgcacac

SEQ ID NO: 64047 - DNA, 20 bp, human
gaggtcggcggcctcagtgg

SEQ ID NO: 64048 - DNA, 20 bp, human
ggcgagtgacgaggacgcac

SEQ ID NO: 64049 - DNA, 20 bp, human
gggcacttggcgccctgtgt

SEQ ID NO: 64050 - DNA, 20 bp, human
gcgctcccgccacccacaca

SEQ ID NO: 64051 - DNA, 20 bp, human
gagcgcgcagaacagacgga

SEQ ID NO: 64052 - DNA, 20 bp, human
gccgcgccggctgtcctggg

SEQ ID NO: 64053 - DNA, 20 bp, human
gacccgtagccagcactgag

SEQ ID NO: 64054 - DNA, 20 bp, human
gagcactgagcgggacgacg

SEQ ID NO: 64055 - DNA, 20 bp, human
gccccgacccgcgagtgacg

SEQ ID NO: 64056 - DNA, 20 bp, human
ggccgttctgaggcagaagg

SEQ ID NO: 64057 - DNA, 20 bp, human
gtcagaacggcgtgactcgg

SEQ ID NO: 64058 - DNA, 20 bp, human
ggccgccttctgcctcagaa

SEQ ID NO: 64059 - DNA, 20 bp, human
gcgcgccggggctctctcac

SEQ ID NO: 64060 - DNA, 20 bp, human
gaggcagaaggcggctcctc

SEQ ID NO: 64061 - DNA, 20 bp, human
gaggtagagagacaacgatc

SEQ ID NO: 64062 - DNA, 20 bp, human
ggcgctccgggagccaaacg

SEQ ID NO: 64063 - DNA, 20 bp, human
ggcctcagaacggcgtgact

SEQ ID NO: 64064 - DNA, 20 bp, human
gtcctctggcgcctcttctt

SEQ ID NO: 64065 - DNA, 20 bp, human
gagggccggggcactctcca

SEQ ID NO: 64066 - DNA, 20 bp, human
gcctggcagttcctctcccc

SEQ ID NO: 64067 - DNA, 20 bp, human
gcaggtggttaactcgcccg

SEQ ID NO: 64068 - DNA, 20 bp, human
gtatggctcaaactcctgag

SEQ ID NO: 64069 - DNA, 20 bp, human
ggtccacctcccgactgaac

SEQ ID NO: 64070 - DNA, 20 bp, human
gcgtggctgcttccagtacc

SEQ ID NO: 64071 - DNA, 20 bp, human
gccacgcaggatcaaacaga

SEQ ID NO: 64072 - DNA, 20 bp, human
gcacctcccgactgaacagg

SEQ ID NO: 64073 - DNA, 20 bp, human
gaaccacctgttcagtcggg

SEQ ID NO: 64074 - DNA, 20 bp, human
gggagtttgagccatatgtt

SEQ ID NO: 64075 - DNA, 20 bp, human
gggttaactcgcccggggag

SEQ ID NO: 64076 - DNA, 20 bp, human
gctgggcaccccgggaacac

SEQ ID NO: 64077 - DNA, 20 bp, human
gcgccgctcaaataactacc

SEQ ID NO: 64078 - DNA, 20 bp, human
gctcctggtagttatttgag

SEQ ID NO: 64079 - DNA, 20 bp, human
ggggaacacgggacccggga

SEQ ID NO: 64080 - DNA, 20 bp, human
gtgcaagagccggggactag

SEQ ID NO: 64081 - DNA, 20 bp, human
ggcgggagcagcgaaggggg

SEQ ID NO: 64082 - DNA, 20 bp, human
ggcacgccttaccttcccta

SEQ ID NO: 64083 - DNA, 20 bp, human
gccccctcccggaatctccg

SEQ ID NO: 64084 - DNA, 20 bp, human
gctggaagcctccccgccaa

SEQ ID NO: 64085 - DNA, 20 bp, human
gctaccaggagggtttgatg

SEQ ID NO: 64086 - DNA, 20 bp, human
ggggccagcgctgcagaagg

SEQ ID NO: 64087 - DNA, 20 bp, human
gccagcgctgcagaaggcgg

SEQ ID NO: 64088 - DNA, 20 bp, human
gcagcgggatgtgaccgtcc

SEQ ID NO: 64089 - DNA, 20 bp, human
gggccgcccgggcaatgcgg

SEQ ID NO: 64090 - DNA, 20 bp, human
gagaacgcacggaggtcggg

SEQ ID NO: 64091 - DNA, 20 bp, human
gcagggcggaccgcactctg

SEQ ID NO: 64092 - DNA, 20 bp, human
ggaccaaccgcgaggaccgg

SEQ ID NO: 64093 - DNA, 20 bp, human
gcccagaacgcacggaggtc

SEQ ID NO: 64094 - DNA, 20 bp, human
ggggagggcgtagagaaaat

SEQ ID NO: 64095 - DNA, 20 bp, human
gtggcccgctcgagccctgg

SEQ ID NO: 64096 - DNA, 20 bp, human
gacatgcaggcggctcgggg

SEQ ID NO: 64097 - DNA, 20 bp, human
gcgagacaggagtccctagg

SEQ ID NO: 64098 - DNA, 20 bp, human
gcgcggagccgacatgcagg

SEQ ID NO: 64099 - DNA, 20 bp, human
ggcgcgggagtcgctgtccg

SEQ ID NO: 64100 - DNA, 20 bp, human
ggtctgggggtcaaggaggt

SEQ ID NO: 64101 - DNA, 20 bp, human
ggtccgcggagccgacatgc

SEQ ID NO: 64102 - DNA, 20 bp, human
ggacagcgactcccgcgcgg

SEQ ID NO: 64103 - DNA, 20 bp, human
gaactgaaggacaggtctgg

SEQ ID NO: 64104 - DNA, 20 bp, human
ggccgacatgcaggcggctc

SEQ ID NO: 64105 - DNA, 20 bp, human
gctggggaccacaagaccct

SEQ ID NO: 64106 - DNA, 20 bp, human
ggttggacatagtactcaca

SEQ ID NO: 64107 - DNA, 20 bp, human
ggtgtggagaaatacttgta

SEQ ID NO: 64108 - DNA, 20 bp, human
gtgctgggaaatgatttgtg

SEQ ID NO: 64109 - DNA, 20 bp, human
ggttgttttgtggtagattt

SEQ ID NO: 64110 - DNA, 20 bp, human
ggttcaataggcagattcaa

SEQ ID NO: 64111 - DNA, 20 bp, human
ggctactgacttagttcaat

SEQ ID NO: 64112 - DNA, 20 bp, human
gtttgaggagttggggaata

SEQ ID NO: 64113 - DNA, 20 bp, human
gctaaatagttgtgggtagt

SEQ ID NO: 64114 - DNA, 20 bp, human
gattcttatctgtcttaaaa

SEQ ID NO: 64115 - DNA, 20 bp, human
gaatactttggtttgtaccg

SEQ ID NO: 64116 - DNA, 20 bp, human
gaagatctggaatagaaacc

SEQ ID NO: 64117 - DNA, 20 bp, human
ggtctcccttacagcagtca

SEQ ID NO: 64118 - DNA, 20 bp, human
ggcagccctgactgctgtaa

SEQ ID NO: 64119 - DNA, 20 bp, human
ggcatctttttcctgggcac

SEQ ID NO: 64120 - DNA, 20 bp, human
gttcgatagtggagctctga

SEQ ID NO: 64121 - DNA, 20 bp, human
gcactttttggaaaattagg

SEQ ID NO: 64122 - DNA, 20 bp, human
ggaactgaaagttgtactgc

SEQ ID NO: 64123 - DNA, 20 bp, human
ggtattcagttccacactgg

SEQ ID NO: 64124 - DNA, 20 bp, human
gccatctcttccctccagtg

SEQ ID NO: 64125 - DNA, 20 bp, human
gtttggaaaattaggaggcc

SEQ ID NO: 64126 - DNA, 20 bp, human
ggactgtccaaactaaaggt

SEQ ID NO: 64127 - DNA, 20 bp, human
gacaaatcagatggcatcag

SEQ ID NO: 64128 - DNA, 20 bp, human
gaccggaccgtcactaccaa

SEQ ID NO: 64129 - DNA, 20 bp, human
gggttgtcctgcatggtgac

SEQ ID NO: 64130 - DNA, 20 bp, human
gtgcagactgtccaaactaa

SEQ ID NO: 64131 - DNA, 20 bp, human
gctccatcaagtgggagatg

SEQ ID NO: 64132 - DNA, 20 bp, human
gattgccctttgaggctagt

SEQ ID NO: 64133 - DNA, 20 bp, human
gagagaaactgtgggggcag

SEQ ID NO: 64134 - DNA, 20 bp, human
gtcagctgggttgtcctgca

SEQ ID NO: 64135 - DNA, 20 bp, human
ggaggctagtgggagtcctt

SEQ ID NO: 64136 - DNA, 20 bp, human
ggttagagctctgccctccg

SEQ ID NO: 64137 - DNA, 20 bp, human
gtaatctactgcacctcgga

SEQ ID NO: 64138 - DNA, 20 bp, human
gcagacagctagtggcagat

SEQ ID NO: 64139 - DNA, 20 bp, human
ggattcctgattactcctga

SEQ ID NO: 64140 - DNA, 20 bp, human
gataatgtgagcattagggg

SEQ ID NO: 64141 - DNA, 20 bp, human
gaatttagaaacggaaacag

SEQ ID NO: 64142 - DNA, 20 bp, human
gaaagagcttaattcattat

SEQ ID NO: 64143 - DNA, 20 bp, human
gagattaaagctgagagaat

SEQ ID NO: 64144 - DNA, 20 bp, human
gtcaataagggagacggacc

SEQ ID NO: 64145 - DNA, 20 bp, human
gctgattactcctgatggaa

SEQ ID NO: 64146 - DNA, 20 bp, human
gcaggcaggggtcgctccgc

SEQ ID NO: 64147 - DNA, 20 bp, human
ggcggcgcttccgctcgggt

SEQ ID NO: 64148 - DNA, 20 bp, human
ggctagccacggccaggcag

SEQ ID NO: 64149 - DNA, 20 bp, human
ggggcctagcaagcgcccag

SEQ ID NO: 64150 - DNA, 20 bp, human
ggccgccccgccacccccat

SEQ ID NO: 64151 - DNA, 20 bp, human
gggccatgctagccacggcc

SEQ ID NO: 64152 - DNA, 20 bp, human
gcaggccgcggtgctaggtc

SEQ ID NO: 64153 - DNA, 20 bp, human
gagcttctggaacagcgtag

SEQ ID NO: 64154 - DNA, 20 bp, human
gacaaaccgacgggaggagg

SEQ ID NO: 64155 - DNA, 20 bp, human
gtcgtaaacaaaccgacggg

SEQ ID NO: 64156 - DNA, 20 bp, human
ggccggctcagtcatatgac

SEQ ID NO: 64157 - DNA, 20 bp, human
gcaagcccgggaccaggtgc

SEQ ID NO: 64158 - DNA, 20 bp, human
gggacggcgctgcctatcgc

SEQ ID NO: 64159 - DNA, 20 bp, human
gtaactgtcagcgcgcgagg

SEQ ID NO: 64160 - DNA, 20 bp, human
gtcatatgaccggcagccgg

SEQ ID NO: 64161 - DNA, 20 bp, human
gtctggcgcgggacccgagt

SEQ ID NO: 64162 - DNA, 20 bp, human
ggacgcgcctgatccgagtg

SEQ ID NO: 64163 - DNA, 20 bp, human
gccggagccacactcggatc

SEQ ID NO: 64164 - DNA, 20 bp, human
ggcgggaggaagggtcacgg

SEQ ID NO: 64165 - DNA, 20 bp, human
gatcgccggcacctggtccc

SEQ ID NO: 64166 - DNA, 20 bp, human
ggctgaacgagtgcagtcaa

SEQ ID NO: 64167 - DNA, 20 bp, human
gggtcggggaggctgcgcaa

SEQ ID NO: 64168 - DNA, 20 bp, human
gctgggaagcggcgacgtcc

SEQ ID NO: 64169 - DNA, 20 bp, human
ggcggaccgaggcgagatgg

SEQ ID NO: 64170 - DNA, 20 bp, human
gccagcggccccaagacccg

SEQ ID NO: 64171 - DNA, 20 bp, human
gacgcgaagcagcgaggtct

SEQ ID NO: 64172 - DNA, 20 bp, human
gtgcgcaagggggcgagccc

SEQ ID NO: 64173 - DNA, 20 bp, human
gccggcgccgccctgggaag

SEQ ID NO: 64174 - DNA, 20 bp, human
gccgcgtggcttaaagcagg

SEQ ID NO: 64175 - DNA, 20 bp, human
gcgttacctgtacaggacat

SEQ ID NO: 64176 - DNA, 20 bp, human
ggcgatgtgtggcgactgtg

SEQ ID NO: 64177 - DNA, 20 bp, human
gcatcgcgacgcagtcaaca

SEQ ID NO: 64178 - DNA, 20 bp, human
gccgccagggcgggtaccag

SEQ ID NO: 64179 - DNA, 20 bp, human
gcccctccagcgctagaatt

SEQ ID NO: 64180 - DNA, 20 bp, human
gcccaaccgggtgagcgact

SEQ ID NO: 64181 - DNA, 20 bp, human
gggtcccggtgacccagtag

SEQ ID NO: 64182 - DNA, 20 bp, human
gcctcgcgagaactgagata

SEQ ID NO: 64183 - DNA, 20 bp, human
gttgactgcgtcgcgatgtg

SEQ ID NO: 64184 - DNA, 20 bp, human
gtcgagcttgaggatgagac

SEQ ID NO: 64185 - DNA, 20 bp, human
ggagaaggaatatcccaacc

SEQ ID NO: 64186 - DNA, 20 bp, human
gaacaaataaacctgttctg

SEQ ID NO: 64187 - DNA, 20 bp, human
gaaaaatgtcagatgatatc

SEQ ID NO: 64188 - DNA, 20 bp, human
ggtcagatgatatcaggaaa

SEQ ID NO: 64189 - DNA, 20 bp, human
gatatgtctgaagagtatga

SEQ ID NO: 64190 - DNA, 20 bp, human
ggtgattggataagagaatt

SEQ ID NO: 64191 - DNA, 20 bp, human
gctatgattattgggaacag

SEQ ID NO: 64192 - DNA, 20 bp, human
gggggcctactagttaatca

SEQ ID NO: 64193 - DNA, 20 bp, human
gaaaaatctatataaggggt

SEQ ID NO: 64194 - DNA, 20 bp, human
ggcccctgaatatgtttgtt

SEQ ID NO: 64195 - DNA, 20 bp, human
gttttttggcctatgattat

SEQ ID NO: 64196 - DNA, 20 bp, human
gtgttgctggtcttccccag

SEQ ID NO: 64197 - DNA, 20 bp, human
gagaaactggaccccaggtc

SEQ ID NO: 64198 - DNA, 20 bp, human
gtggaattcgctccagacct

SEQ ID NO: 64199 - DNA, 20 bp, human
gggtgagcacccctcgagtt

SEQ ID NO: 64200 - DNA, 20 bp, human
ggagcacccctcgagttagg

SEQ ID NO: 64201 - DNA, 20 bp, human
gttagggtcggggtaatgtg

SEQ ID NO: 64202 - DNA, 20 bp, human
ggcgcgccctccaaccacca

SEQ ID NO: 64203 - DNA, 20 bp, human
gcaggggcggcgattagggt

SEQ ID NO: 64204 - DNA, 20 bp, human
gtccccaggggcggcgatta

SEQ ID NO: 64205 - DNA, 20 bp, human
gcgcgggtcagctgccgagt

SEQ ID NO: 64206 - DNA, 20 bp, human
gagggacagacatggctcag

SEQ ID NO: 64207 - DNA, 20 bp, human
ggtggcaccaaggaatgcgg

SEQ ID NO: 64208 - DNA, 20 bp, human
gaataaggaagcaggcccaa

SEQ ID NO: 64209 - DNA, 20 bp, human
gtgggccagggggtgatctg

SEQ ID NO: 64210 - DNA, 20 bp, human
gtacagccacccacactaga

SEQ ID NO: 64211 - DNA, 20 bp, human
gctgctgctccttctagtgt

SEQ ID NO: 64212 - DNA, 20 bp, human
gctgctccttctagtgtggg

SEQ ID NO: 64213 - DNA, 20 bp, human
gtagtgtgggtggctgtagt

SEQ ID NO: 64214 - DNA, 20 bp, human
gtcagtggcaccaaggaatg

SEQ ID NO: 64215 - DNA, 20 bp, human
gaaccaagaaggtgaactgt

SEQ ID NO: 64216 - DNA, 20 bp, human
gtaccctgtaccgaagacag

SEQ ID NO: 64217 - DNA, 20 bp, human
gtaccgaagacagaggctgt

SEQ ID NO: 64218 - DNA, 20 bp, human
gagttggcctctctctaagt

SEQ ID NO: 64219 - DNA, 20 bp, human
ggcaatagatccaggcccct

SEQ ID NO: 64220 - DNA, 20 bp, human
gggctgtggggacagcctag

SEQ ID NO: 64221 - DNA, 20 bp, human
gttgctgctgggagcataca

SEQ ID NO: 64222 - DNA, 20 bp, human
gctaagtaggcaatagatcc

SEQ ID NO: 64223 - DNA, 20 bp, human
gagcctctgtcttcggtaca

SEQ ID NO: 64224 - DNA, 20 bp, human
gcagggtagacaacgcgctc

SEQ ID NO: 64225 - DNA, 20 bp, human
gagatgcccgaaggagggaa

SEQ ID NO: 64226 - DNA, 20 bp, human
gacggggcaaatggtacctg

SEQ ID NO: 64227 - DNA, 20 bp, human
gggaattatcaggaaggacg

SEQ ID NO: 64228 - DNA, 20 bp, human
gtccagcaggcggaattatc

SEQ ID NO: 64229 - DNA, 20 bp, human
gagaaagctgggtgagttga

SEQ ID NO: 64230 - DNA, 20 bp, human
ggcaggcggaattatcagga

SEQ ID NO: 64231 - DNA, 20 bp, human
gtccaggagaaggtcatgct

SEQ ID NO: 64232 - DNA, 20 bp, human
gttggaagccatgtaaagaa

SEQ ID NO: 64233 - DNA, 20 bp, human
gtgtaagaaaaagatgccgg

SEQ ID NO: 64234 - DNA, 20 bp, human
gcttacaggattcttacctc

SEQ ID NO: 64235 - DNA, 20 bp, human
ggggtgagttgatggtatct

SEQ ID NO: 64236 - DNA, 20 bp, human
ggaggtcctgcctccaggta

SEQ ID NO: 64237 - DNA, 20 bp, human
ggagcccttcccctacctgg

SEQ ID NO: 64238 - DNA, 20 bp, human
gggacctacagcgctgttgg

SEQ ID NO: 64239 - DNA, 20 bp, human
gcctacagcgctgttggtgg

SEQ ID NO: 64240 - DNA, 20 bp, human
gcctggacctacagcgctgt

SEQ ID NO: 64241 - DNA, 20 bp, human
gcccttggttctgaccacac

SEQ ID NO: 64242 - DNA, 20 bp, human
ggtgccgctgctgacaagga

SEQ ID NO: 64243 - DNA, 20 bp, human
gtccagtgtggtcagaacca

SEQ ID NO: 64244 - DNA, 20 bp, human
gaagggtgccgctgctgaca

SEQ ID NO: 64245 - DNA, 20 bp, human
gcttgctctgtgaccttgta

SEQ ID NO: 64246 - DNA, 20 bp, human
gtatgggatggggaagatca

SEQ ID NO: 64247 - DNA, 20 bp, human
gtgaggttcggagaccatct

SEQ ID NO: 64248 - DNA, 20 bp, human
ggctctatgaggaggtacag

SEQ ID NO: 64249 - DNA, 20 bp, human
gcagaggccagacctgggta

SEQ ID NO: 64250 - DNA, 20 bp, human
ggaagacaagctctatgagg

SEQ ID NO: 64251 - DNA, 20 bp, human
gctgggaaagcagggaccgc

SEQ ID NO: 64252 - DNA, 20 bp, human
gtggacagtcatgcccacct

SEQ ID NO: 64253 - DNA, 20 bp, human
gagcagctcgtccccagccc

SEQ ID NO: 64254 - DNA, 20 bp, human
gtctagccactgggaaagca

SEQ ID NO: 64255 - DNA, 20 bp, human
ggactgtccacagctctagc

SEQ ID NO: 64256 - DNA, 20 bp, human
ggcagtgcctaacccaatag

SEQ ID NO: 64257 - DNA, 20 bp, human
gcgttgaaaaatggcgactg

SEQ ID NO: 64258 - DNA, 20 bp, human
gcctggcggccgttgaaaaa

SEQ ID NO: 64259 - DNA, 20 bp, human
gcccgacgcttcccatgtgg

SEQ ID NO: 64260 - DNA, 20 bp, human
ggcgactgtggcagagttga

SEQ ID NO: 64261 - DNA, 20 bp, human
ggagagcgcgcggaacacat

SEQ ID NO: 64262 - DNA, 20 bp, human
gaggctggtgagtgcgagca

SEQ ID NO: 64263 - DNA, 20 bp, human
gtgcgcggggagctcttatg

SEQ ID NO: 64264 - DNA, 20 bp, human
gccacaacccctattgggtt

SEQ ID NO: 64265 - DNA, 20 bp, human
gaggcccgacgcttcccatg

SEQ ID NO: 64266 - DNA, 20 bp, human
gcagatgcggttggagtacg

SEQ ID NO: 64267 - DNA, 20 bp, human
gtgctcgctgcagatgcggt

SEQ ID NO: 64268 - DNA, 20 bp, human
ggaagccaagactgagccgg

SEQ ID NO: 64269 - DNA, 20 bp, human
gccgaggggcggagacaggt

SEQ ID NO: 64270 - DNA, 20 bp, human
ggacgctccagtagatgagt

SEQ ID NO: 64271 - DNA, 20 bp, human
gcggagcggtgccggctcgg

SEQ ID NO: 64272 - DNA, 20 bp, human
gtagtaagagaggctatccc

SEQ ID NO: 64273 - DNA, 20 bp, human
ggggtgagtggtagtaagag

SEQ ID NO: 64274 - DNA, 20 bp, human
gcggaggaggagacaccggg

SEQ ID NO: 64275 - DNA, 20 bp, human
gcagatgctcgctgcagatg

SEQ ID NO: 64276 - DNA, 20 bp, human
ggaggccgagcgcagagcat

SEQ ID NO: 64277 - DNA, 20 bp, human
gtccgctggggcttactcca

SEQ ID NO: 64278 - DNA, 20 bp, human
ggcgttgtgaagaccatgac

SEQ ID NO: 64279 - DNA, 20 bp, human
gtgcgctcggcctcctgtca

SEQ ID NO: 64280 - DNA, 20 bp, human
ggcaggagccagttctactg

SEQ ID NO: 64281 - DNA, 20 bp, human
ggagtaagccccagcggagg

SEQ ID NO: 64282 - DNA, 20 bp, human
gtactggggtgggtgaatgg

SEQ ID NO: 64283 - DNA, 20 bp, human
ggggggcggggactccgaaa

SEQ ID NO: 64284 - DNA, 20 bp, human
gccgagcgcagagcattggc

SEQ ID NO: 64285 - DNA, 20 bp, human
gtgcaactgcaggtcagaaa

SEQ ID NO: 64286 - DNA, 20 bp, human
gagactcagagctacggcca

SEQ ID NO: 64287 - DNA, 20 bp, human
ggacacgcggaaccaagact

SEQ ID NO: 64288 - DNA, 20 bp, human
gggtgagccgtgggagtccc

SEQ ID NO: 64289 - DNA, 20 bp, human
gcaggctccgtaggacccag

SEQ ID NO: 64290 - DNA, 20 bp, human
gcagagctacggccacggca

SEQ ID NO: 64291 - DNA, 20 bp, human
gcgctgtccggggaagctcg

SEQ ID NO: 64292 - DNA, 20 bp, human
ggtccggcgggtcccacggg

SEQ ID NO: 64293 - DNA, 20 bp, human
ggtccggggaagctcgggga

SEQ ID NO: 64294 - DNA, 20 bp, human
gcaagtccggggtgagccgt

SEQ ID NO: 64295 - DNA, 20 bp, human
gggacccgccggacgcgtgg

SEQ ID NO: 64296 - DNA, 20 bp, human
gccagccgccaaggaaccac

SEQ ID NO: 64297 - DNA, 20 bp, human
gtcggcgcctctagaggcag

SEQ ID NO: 64298 - DNA, 20 bp, human
gctcttttcggcgcctctag

SEQ ID NO: 64299 - DNA, 20 bp, human
gcgggttccggggacagaga

SEQ ID NO: 64300 - DNA, 20 bp, human
gaggcgctcttgtcacgaca

SEQ ID NO: 64301 - DNA, 20 bp, human
ggcttaactactctctcggg

SEQ ID NO: 64302 - DNA, 20 bp, human
gcctcccgtaaatggactcc

SEQ ID NO: 64303 - DNA, 20 bp, human
gcgcctctagaggcagaggg

SEQ ID NO: 64304 - DNA, 20 bp, human
gctgtcttgggacacaccgg

SEQ ID NO: 64305 - DNA, 20 bp, human
gactcctggaactgctctga

SEQ ID NO: 64306 - DNA, 20 bp, human
ggggtggacgcagaagtcag

SEQ ID NO: 64307 - DNA, 20 bp, human
gaagtctcggaacatgcccg

SEQ ID NO: 64308 - DNA, 20 bp, human
gggcatgttccgagacttcg

SEQ ID NO: 64309 - DNA, 20 bp, human
gcggacggcgagggagaagg

SEQ ID NO: 64310 - DNA, 20 bp, human
gggcggctctgcggggtaca

SEQ ID NO: 64311 - DNA, 20 bp, human
gaagcgggcacggagacgga

SEQ ID NO: 64312 - DNA, 20 bp, human
ggagaaagcgggcacggaga

SEQ ID NO: 64313 - DNA, 20 bp, human
ggcccgagctccgggaacgg

SEQ ID NO: 64314 - DNA, 20 bp, human
ggtccaccctgcttcagaag

SEQ ID NO: 64315 - DNA, 20 bp, human
gacggagggacggacgcgga

SEQ ID NO: 64316 - DNA, 20 bp, human
gctcggcggggacagaaaga

SEQ ID NO: 64317 - DNA, 20 bp, human
gcatctcgggcagagcgcta

SEQ ID NO: 64318 - DNA, 20 bp, human
gcattgtagtgactcatctc

SEQ ID NO: 64319 - DNA, 20 bp, human
gtcagacagggccaaaaagg

SEQ ID NO: 64320 - DNA, 20 bp, human
gaccgcggagggcgaggaca

SEQ ID NO: 64321 - DNA, 20 bp, human
gtggccctgtctgaaatcgg

SEQ ID NO: 64322 - DNA, 20 bp, human
ggcgcgcagccggagctcag

SEQ ID NO: 64323 - DNA, 20 bp, human
gggacccccgatttcagaca

SEQ ID NO: 64324 - DNA, 20 bp, human
gagtagagctggcgctgaga

SEQ ID NO: 64325 - DNA, 20 bp, human
gctgaaatcgggggtcccca

SEQ ID NO: 64326 - DNA, 20 bp, human
ggcagcccgctcacttcccg

SEQ ID NO: 64327 - DNA, 20 bp, human
ggcctccgcgggaagtgagc

SEQ ID NO: 64328 - DNA, 20 bp, human
gaactgcacttgcctcgcag

SEQ ID NO: 64329 - DNA, 20 bp, human
gttcccgcggaggcgctccc

SEQ ID NO: 64330 - DNA, 20 bp, human
gtactacgcagacacgcagg

SEQ ID NO: 64331 - DNA, 20 bp, human
gagggtggctccaggatgtt

SEQ ID NO: 64332 - DNA, 20 bp, human
gccctgtgcgaagcgacggg

SEQ ID NO: 64333 - DNA, 20 bp, human
ggcgccgctggagcccgtgc

SEQ ID NO: 64334 - DNA, 20 bp, human
gcagccctgtgcgaagcgac

SEQ ID NO: 64335 - DNA, 20 bp, human
gccggccggggccacaccgg

SEQ ID NO: 64336 - DNA, 20 bp, human
gagtagctgctccagtcgga

SEQ ID NO: 64337 - DNA, 20 bp, human
gtgaggaggagaagatgggt

SEQ ID NO: 64338 - DNA, 20 bp, human
gagtgccgcagtgacgtggg

SEQ ID NO: 64339 - DNA, 20 bp, human
gaggcagagtcaaagactag

SEQ ID NO: 64340 - DNA, 20 bp, human
ggtgccgagctgccccgagg

SEQ ID NO: 64341 - DNA, 20 bp, human
gaaagacgagcgcttacctc

SEQ ID NO: 64342 - DNA, 20 bp, human
gacaagtgccgcagtgacgt

SEQ ID NO: 64343 - DNA, 20 bp, human
gggaggtgtggaccgcggag

SEQ ID NO: 64344 - DNA, 20 bp, human
gagggcacgagccgtccgac

SEQ ID NO: 64345 - DNA, 20 bp, human
ggaggaggaggtgtggaccg

SEQ ID NO: 64346 - DNA, 20 bp, human
gagcgctctggatctctcag

SEQ ID NO: 64347 - DNA, 20 bp, human
ggtaccccgggcggtcggac

SEQ ID NO: 64348 - DNA, 20 bp, human
ggagtggagctactacccgg

SEQ ID NO: 64349 - DNA, 20 bp, human
gctcgggacagccgtacccc

SEQ ID NO: 64350 - DNA, 20 bp, human
gtaaggtgtgacccgaccct

SEQ ID NO: 64351 - DNA, 20 bp, human
gccggggacgaggcatggat

SEQ ID NO: 64352 - DNA, 20 bp, human
ggccgagtggagctactacc

SEQ ID NO: 64353 - DNA, 20 bp, human
gccccgggcggtcggacggg

SEQ ID NO: 64354 - DNA, 20 bp, human
gcgcggccagggcttaaaaa

SEQ ID NO: 64355 - DNA, 20 bp, human
gcgggtcacaccttaaactt

SEQ ID NO: 64356 - DNA, 20 bp, human
ggtactggggccagaatagg

SEQ ID NO: 64357 - DNA, 20 bp, human
ggcagaaaagacccctgtag

SEQ ID NO: 64358 - DNA, 20 bp, human
gggatagccgggaagtaagt

SEQ ID NO: 64359 - DNA, 20 bp, human
gtaatgaagcgccgctacag

SEQ ID NO: 64360 - DNA, 20 bp, human
gtcggtactggggccagaat

SEQ ID NO: 64361 - DNA, 20 bp, human
gccgggaagtaagtcggtac

SEQ ID NO: 64362 - DNA, 20 bp, human
gaggagcgtcgcggaccggg

SEQ ID NO: 64363 - DNA, 20 bp, human
gggcttagtgggcgcgggag

SEQ ID NO: 64364 - DNA, 20 bp, human
ggaacggcgcgaggatagcc

SEQ ID NO: 64365 - DNA, 20 bp, human
gggagtcccggcgcggatgg

SEQ ID NO: 64366 - DNA, 20 bp, human
ggtcagcgagatgtaagagt

SEQ ID NO: 64367 - DNA, 20 bp, human
gggcccgaccagcctggcaa

SEQ ID NO: 64368 - DNA, 20 bp, human
gcgctgtacgagctcttccc

SEQ ID NO: 64369 - DNA, 20 bp, human
ggccgagtgctggattgcca

SEQ ID NO: 64370 - DNA, 20 bp, human
gtgcggcagcgtggtgatga

SEQ ID NO: 64371 - DNA, 20 bp, human
gtacatctcgctgaccgcca

SEQ ID NO: 64372 - DNA, 20 bp, human
gacgagctcttccccggccg

SEQ ID NO: 64373 - DNA, 20 bp, human
ggcgtgcaagtgagtatggt

SEQ ID NO: 64374 - DNA, 20 bp, human
gccggccgcggcatcgcccc

SEQ ID NO: 64375 - DNA, 20 bp, human
gtgtgtgctcgcggtagtag

SEQ ID NO: 64376 - DNA, 20 bp, human
gggcggctacaccgccatgc

SEQ ID NO: 64377 - DNA, 20 bp, human
gtgcggcgtgtagggcccgt

SEQ ID NO: 64378 - DNA, 20 bp, human
ggcaggcagtgtggcgagaa

SEQ ID NO: 64379 - DNA, 20 bp, human
gtctgctcgccgccgaggta

SEQ ID NO: 64380 - DNA, 20 bp, human
gcgccttcgccggcagctca

SEQ ID NO: 64381 - DNA, 20 bp, human
ggagtggtgccctacctcgg

SEQ ID NO: 64382 - DNA, 20 bp, human
gagcttccaggcgcaaacgg

SEQ ID NO: 64383 - DNA, 20 bp, human
gaccgccttgcaggaactcg

SEQ ID NO: 64384 - DNA, 20 bp, human
gagagtctcctggaaggcgc

SEQ ID NO: 64385 - DNA, 20 bp, human
gggccgccgagtccgagtcc

SEQ ID NO: 64386 - DNA, 20 bp, human
gcgctggctccaggacccgg

SEQ ID NO: 64387 - DNA, 20 bp, human
gggccgcagtccgtgcgcga

SEQ ID NO: 64388 - DNA, 20 bp, human
gaattctgctcgctcaggta

SEQ ID NO: 64389 - DNA, 20 bp, human
gagcgaatcggcagccccga

SEQ ID NO: 64390 - DNA, 20 bp, human
gcccgagggtcagcgcgccg

SEQ ID NO: 64391 - DNA, 20 bp, human
gcggcgctcgggccgagcag

SEQ ID NO: 64392 - DNA, 20 bp, human
gggcggatcggcatcctgga

SEQ ID NO: 64393 - DNA, 20 bp, human
ggggctgcgggcagctacgg

SEQ ID NO: 64394 - DNA, 20 bp, human
gagggcgttggggtcggaca

SEQ ID NO: 64395 - DNA, 20 bp, human
gccaatccctaaaagggact

SEQ ID NO: 64396 - DNA, 20 bp, human
gcaggcgcccaggaacgtgc

SEQ ID NO: 64397 - DNA, 20 bp, human
ggcccaggaacgtgcgggac

SEQ ID NO: 64398 - DNA, 20 bp, human
ggaggaaacagacatcgacg

SEQ ID NO: 64399 - DNA, 20 bp, human
gggcgcaggagttataaagt

SEQ ID NO: 64400 - DNA, 20 bp, human
gaggaggacgacgacgaggg

SEQ ID NO: 64401 - DNA, 20 bp, human
gtcggcgaggccagaggcat

SEQ ID NO: 64402 - DNA, 20 bp, human
gctaagaacagagctcggcg

SEQ ID NO: 64403 - DNA, 20 bp, human
gcagggtcatagctgtggcg

SEQ ID NO: 64404 - DNA, 20 bp, human
ggtttcctcggcgaggccag

SEQ ID NO: 64405 - DNA, 20 bp, human
gggcgaggacgaagaagacg

SEQ ID NO: 64406 - DNA, 20 bp, human
gccgaggacgaggaggagtc

SEQ ID NO: 64407 - DNA, 20 bp, human
ggacttagccgaggacgagg

SEQ ID NO: 64408 - DNA, 20 bp, human
gcgcgctctggcgtcccggg

SEQ ID NO: 64409 - DNA, 20 bp, human
gagtctggtggctgctcgga

SEQ ID NO: 64410 - DNA, 20 bp, human
ggcagacttagccgaggacg

SEQ ID NO: 64411 - DNA, 20 bp, human
gcagcagcagctccgggtga

SEQ ID NO: 64412 - DNA, 20 bp, human
ggccgaggcagacttagccg

SEQ ID NO: 64413 - DNA, 20 bp, human
gcgaacatgtcggccgactc

SEQ ID NO: 64414 - DNA, 20 bp, human
gcgccgtaggcagcgaagcc

SEQ ID NO: 64415 - DNA, 20 bp, human
gtcctcggctaagtctgcct

SEQ ID NO: 64416 - DNA, 20 bp, human
gggcagggacagtagcgggg

SEQ ID NO: 64417 - DNA, 20 bp, human
ggggctgccacggagctcag

SEQ ID NO: 64418 - DNA, 20 bp, human
gtagtaccgagcgccaggga

SEQ ID NO: 64419 - DNA, 20 bp, human
gagtgcccccgaaagatggg

SEQ ID NO: 64420 - DNA, 20 bp, human
gacgggactttcgactaccg

SEQ ID NO: 64421 - DNA, 20 bp, human
gcacggagctcaggggaaga

SEQ ID NO: 64422 - DNA, 20 bp, human
ggtcagggacgccgaagccc

SEQ ID NO: 64423 - DNA, 20 bp, human
gggcgccgagcagctcggga

SEQ ID NO: 64424 - DNA, 20 bp, human
ggggcgatgagggtgttcgg

SEQ ID NO: 64425 - DNA, 20 bp, human
gccctcctcggggttggtag

SEQ ID NO: 64426 - DNA, 20 bp, human
gcgcagggtgcaggccgtag

SEQ ID NO: 64427 - DNA, 20 bp, human
gccggcgccgcgggacccta

SEQ ID NO: 64428 - DNA, 20 bp, human
gggcgcttacagcctggcgg

SEQ ID NO: 64429 - DNA, 20 bp, human
ggcttacagcctggcggcgg

SEQ ID NO: 64430 - DNA, 20 bp, human
gtcagcatcgagaacatcat

SEQ ID NO: 64431 - DNA, 20 bp, human
ggagggcagcagcggcacag

SEQ ID NO: 64432 - DNA, 20 bp, human
gcgctcatgatgcagagctt

SEQ ID NO: 64433 - DNA, 20 bp, human
ggagcacctgcgcgagcaga

SEQ ID NO: 64434 - DNA, 20 bp, human
gtcgagaacatcataggtgg

SEQ ID NO: 64435 - DNA, 20 bp, human
gagggtgcaggccgtagggg

SEQ ID NO: 64436 - DNA, 20 bp, human
gccgccggggccaggtgatc

SEQ ID NO: 64437 - DNA, 20 bp, human
gatgtggcggccggatcacc

SEQ ID NO: 64438 - DNA, 20 bp, human
gcggccggatcacctggccc

SEQ ID NO: 64439 - DNA, 20 bp, human
gtcgcaggggatgtggcggc

SEQ ID NO: 64440 - DNA, 20 bp, human
gaagcttttataaaaggcga

SEQ ID NO: 64441 - DNA, 20 bp, human
gagcctccgggactccgatg

SEQ ID NO: 64442 - DNA, 20 bp, human
gatcgatgtcctgggagagg

SEQ ID NO: 64443 - DNA, 20 bp, human
gcgactgctctaggaactgc

SEQ ID NO: 64444 - DNA, 20 bp, human
ggcaggtgcttcagtcgcag

SEQ ID NO: 64445 - DNA, 20 bp, human
gaaaatcgatgtcctgggag

SEQ ID NO: 64446 - DNA, 20 bp, human
gccgatcacctggcccgggg

SEQ ID NO: 64447 - DNA, 20 bp, human
ggcggccgatcacctggccc

SEQ ID NO: 64448 - DNA, 20 bp, human
gggctgccgggcatcttcag

SEQ ID NO: 64449 - DNA, 20 bp, human
gcccgagagcacatcgaggg

SEQ ID NO: 64450 - DNA, 20 bp, human
gcgagcgacccctcagagtt

SEQ ID NO: 64451 - DNA, 20 bp, human
gcagaggccgccgcagacct

SEQ ID NO: 64452 - DNA, 20 bp, human
gctcggtgccaaactctgag

SEQ ID NO: 64453 - DNA, 20 bp, human
gagggcaccgccaaggtctg

SEQ ID NO: 64454 - DNA, 20 bp, human
ggcaccgccaaggtctgcgg

SEQ ID NO: 64455 - DNA, 20 bp, human
gttccccgagagcacatcga

SEQ ID NO: 64456 - DNA, 20 bp, human
gctgaggctggtcctctcca

SEQ ID NO: 64457 - DNA, 20 bp, human
ggctggcgcggtgcagacag

SEQ ID NO: 64458 - DNA, 20 bp, human
ggccggtccggtgtgtgcag

SEQ ID NO: 64459 - DNA, 20 bp, human
gtcccctgcacacaccggac

SEQ ID NO: 64460 - DNA, 20 bp, human
gggagtgacccgctagccga

SEQ ID NO: 64461 - DNA, 20 bp, human
ggcctcgccagcggtccgca

SEQ ID NO: 64462 - DNA, 20 bp, human
gggagacccacgccgtggag

SEQ ID NO: 64463 - DNA, 20 bp, human
ggcccaggcggggcgacctg

SEQ ID NO: 64464 - DNA, 20 bp, human
ggagcgagggcagttagtac

SEQ ID NO: 64465 - DNA, 20 bp, human
ggcctcgagaagcaccacgc

SEQ ID NO: 64466 - DNA, 20 bp, human
ggcagggaagccagagaacg

SEQ ID NO: 64467 - DNA, 20 bp, human
gtgcgccccgccatcggctg

SEQ ID NO: 64468 - DNA, 20 bp, human
ggggaagccagagaacgcgg

SEQ ID NO: 64469 - DNA, 20 bp, human
gtgtcgctgcgccccgccat

SEQ ID NO: 64470 - DNA, 20 bp, human
ggacggcgcgaccgctggca

SEQ ID NO: 64471 - DNA, 20 bp, human
ggttgagcgtgagattgtgg

SEQ ID NO: 64472 - DNA, 20 bp, human
gctcctgcgagcggcgacgg

SEQ ID NO: 64473 - DNA, 20 bp, human
ggtgtccatataaagcgggt

SEQ ID NO: 64474 - DNA, 20 bp, human
ggggctgccgcagccgatgg

SEQ ID NO: 64475 - DNA, 20 bp, human
gcaggggctgccgcagccga

SEQ ID NO: 64476 - DNA, 20 bp, human
gctcgggcgccgaagacatc

SEQ ID NO: 64477 - DNA, 20 bp, human
ggggcgccgaagacatcggg

SEQ ID NO: 64478 - DNA, 20 bp, human
gcgcgggcggcggggactca

SEQ ID NO: 64479 - DNA, 20 bp, human
gtgagcgcgatgtaggaata

SEQ ID NO: 64480 - DNA, 20 bp, human
gagcagcagccaccgcacgg

SEQ ID NO: 64481 - DNA, 20 bp, human
gccgagcggagatggagtga

SEQ ID NO: 64482 - DNA, 20 bp, human
gcggccgtaagacctggagg

SEQ ID NO: 64483 - DNA, 20 bp, human
ggcacggccgtaagacctgg

SEQ ID NO: 64484 - DNA, 20 bp, human
gcctcctcccggcccgtccg

SEQ ID NO: 64485 - DNA, 20 bp, human
gcgctcggctccgagattcc

SEQ ID NO: 64486 - DNA, 20 bp, human
ggctcctgaagggagacgtc

SEQ ID NO: 64487 - DNA, 20 bp, human
gggtcccagatgaccaccga

SEQ ID NO: 64488 - DNA, 20 bp, human
gagcgaggagcgctcctgaa

SEQ ID NO: 64489 - DNA, 20 bp, human
ggcgggcggcgggctcatca

SEQ ID NO: 64490 - DNA, 20 bp, human
ggcgcgtgcagcccggtccc

SEQ ID NO: 64491 - DNA, 20 bp, human
gctgcagccgtggccactcc

SEQ ID NO: 64492 - DNA, 20 bp, human
gccgccctcggtggtcatct

SEQ ID NO: 64493 - DNA, 20 bp, human
gcaggccgcggtcccactcg

SEQ ID NO: 64494 - DNA, 20 bp, human
gagacgtcgggctcgtcccc

SEQ ID NO: 64495 - DNA, 20 bp, human
ggaccgggctgcacgcgcgg

SEQ ID NO: 64496 - DNA, 20 bp, human
ggagctacaggcgcacacta

SEQ ID NO: 64497 - DNA, 20 bp, human
ggctggggagacagcgatcg

SEQ ID NO: 64498 - DNA, 20 bp, human
gggggagacagcgatcgagg

SEQ ID NO: 64499 - DNA, 20 bp, human
gagtcgtcggggggaaacgg

SEQ ID NO: 64500 - DNA, 20 bp, human
ggaccggtgggtgccgaacg

SEQ ID NO: 64501 - DNA, 20 bp, human
ggcgggcggcggcgaccggt

SEQ ID NO: 64502 - DNA, 20 bp, human
gcagcagcagcccaaagggg

SEQ ID NO: 64503 - DNA, 20 bp, human
gtgtctccccagcctcgccg

SEQ ID NO: 64504 - DNA, 20 bp, human
gcgccccgttcggcacccac

SEQ ID NO: 64505 - DNA, 20 bp, human
ggggcgggcgcgtcccggag

SEQ ID NO: 64506 - DNA, 20 bp, human
ggcgggacggtagacagcgt

SEQ ID NO: 64507 - DNA, 20 bp, human
gtggagggtgcagggcggtg

SEQ ID NO: 64508 - DNA, 20 bp, human
gggcggtggggcagtgtaga

SEQ ID NO: 64509 - DNA, 20 bp, human
gagcgcggcagagagggcaa

SEQ ID NO: 64510 - DNA, 20 bp, human
gcaaggcacgacccttctcc

SEQ ID NO: 64511 - DNA, 20 bp, human
gtggccaagtaggtgtaggg

SEQ ID NO: 64512 - DNA, 20 bp, human
gcccccactaccgggctcag

SEQ ID NO: 64513 - DNA, 20 bp, human
gggagcggcctgaatcacca

SEQ ID NO: 64514 - DNA, 20 bp, human
gctctcaggactggtcccac

SEQ ID NO: 64515 - DNA, 20 bp, human
gtggggcagtgtagaaggca

SEQ ID NO: 64516 - DNA, 20 bp, human
gtgagagccgagtaggaata

SEQ ID NO: 64517 - DNA, 20 bp, human
gggtgggcccgttgaaccag

SEQ ID NO: 64518 - DNA, 20 bp, human
ggagccgagtaggaataggg

SEQ ID NO: 64519 - DNA, 20 bp, human
ggcccgttgaaccagaggta

SEQ ID NO: 64520 - DNA, 20 bp, human
gagcatcccccagtcttggg

SEQ ID NO: 64521 - DNA, 20 bp, human
ggaagttgtcggccacgtac

SEQ ID NO: 64522 - DNA, 20 bp, human
gggtcgaaggagctcatgct

SEQ ID NO: 64523 - DNA, 20 bp, human
gagggtggcggggtcatggt

SEQ ID NO: 64524 - DNA, 20 bp, human
gcgttggggccgggcaggta

SEQ ID NO: 64525 - DNA, 20 bp, human
gtgagagtgaggcgcttgtc

SEQ ID NO: 64526 - DNA, 20 bp, human
ggtgccgcaccgaaactcac

SEQ ID NO: 64527 - DNA, 20 bp, human
gtgagcgccgagtaggagta

SEQ ID NO: 64528 - DNA, 20 bp, human
gtcgccagtgagtttcggtg

SEQ ID NO: 64529 - DNA, 20 bp, human
ggcgccgagtaggagtaggg

SEQ ID NO: 64530 - DNA, 20 bp, human
ggaagttaccagccacgtac

SEQ ID NO: 64531 - DNA, 20 bp, human
ggctggcggccaagctggat

SEQ ID NO: 64532 - DNA, 20 bp, human
gacccgaagcgtaggacttg

SEQ ID NO: 64533 - DNA, 20 bp, human
gcagcgcctaccccaaggat

SEQ ID NO: 64534 - DNA, 20 bp, human
gcccaggtcgtcgcagtagg

SEQ ID NO: 64535 - DNA, 20 bp, human
ggcggcccggcgggaagatg

SEQ ID NO: 64536 - DNA, 20 bp, human
gggagcgcccaggtacgcgg

SEQ ID NO: 64537 - DNA, 20 bp, human
gagagcagccgaagtgccgg

SEQ ID NO: 64538 - DNA, 20 bp, human
gcgaccccggcccggagcac

SEQ ID NO: 64539 - DNA, 20 bp, human
gcgcccagcgcgggtgaagg

SEQ ID NO: 64540 - DNA, 20 bp, human
gcctttgggggccaaccctg

SEQ ID NO: 64541 - DNA, 20 bp, human
ggctagcacccgcccgaccc

SEQ ID NO: 64542 - DNA, 20 bp, human
ggcacttcggctgctctcag

SEQ ID NO: 64543 - DNA, 20 bp, human
ggaaggcggagccgcagggt

SEQ ID NO: 64544 - DNA, 20 bp, human
gcccgttgagccacaggtag

SEQ ID NO: 64545 - DNA, 20 bp, human
gcgtagtcggccagcccgta

SEQ ID NO: 64546 - DNA, 20 bp, human
gggcagggcccccgagctgg

SEQ ID NO: 64547 - DNA, 20 bp, human
gagccaaatgaagagggtag

SEQ ID NO: 64548 - DNA, 20 bp, human
gagctcagagaagcgccgtc

SEQ ID NO: 64549 - DNA, 20 bp, human
gaagagggtaggggcatccg

SEQ ID NO: 64550 - DNA, 20 bp, human
ggcaggagaagcctttggag

SEQ ID NO: 64551 - DNA, 20 bp, human
gccgggccagaggaaggttc

SEQ ID NO: 64552 - DNA, 20 bp, human
gtgcgctctgagccaggtaa

SEQ ID NO: 64553 - DNA, 20 bp, human
gctcgcaacaaatggaagtg

SEQ ID NO: 64554 - DNA, 20 bp, human
ggggacggaacagtaacggg

SEQ ID NO: 64555 - DNA, 20 bp, human
gttgggagggcggtacgacg

SEQ ID NO: 64556 - DNA, 20 bp, human
gaggcgggcagacagtgtca

SEQ ID NO: 64557 - DNA, 20 bp, human
gtcccggggagccagaaggc

SEQ ID NO: 64558 - DNA, 20 bp, human
gcgaccagtctgggctcccg

SEQ ID NO: 64559 - DNA, 20 bp, human
gctcgggctccgaccagtct

SEQ ID NO: 64560 - DNA, 20 bp, human
gtcctccccggccagtacag

SEQ ID NO: 64561 - DNA, 20 bp, human
gacagtgtcagggctcggcg

SEQ ID NO: 64562 - DNA, 20 bp, human
ggctcccggggtgccccaga

SEQ ID NO: 64563 - DNA, 20 bp, human
ggcgaggaagacccctgtac

SEQ ID NO: 64564 - DNA, 20 bp, human
ggaaagaagagacccctgga

SEQ ID NO: 64565 - DNA, 20 bp, human
ggagagaggcgtcccctcca

SEQ ID NO: 64566 - DNA, 20 bp, human
gcgagcagccccgagagcgg

SEQ ID NO: 64567 - DNA, 20 bp, human
gcccccgggaaaggtcccaa

SEQ ID NO: 64568 - DNA, 20 bp, human
gggtgcgcggccccggatgt

SEQ ID NO: 64569 - DNA, 20 bp, human
gcaacggtgcctactgcgag

SEQ ID NO: 64570 - DNA, 20 bp, human
gaaccagacgtggatcccgg

SEQ ID NO: 64571 - DNA, 20 bp, human
gggcctcgaccgctcgcagt

SEQ ID NO: 64572 - DNA, 20 bp, human
gtgcctactgcgagcggtcg

SEQ ID NO: 64573 - DNA, 20 bp, human
ggcaagagcagccaacatcc

SEQ ID NO: 64574 - DNA, 20 bp, human
ggtggcatctcccgggacgg

SEQ ID NO: 64575 - DNA, 20 bp, human
gcgggtcgggaagtagttcc

SEQ ID NO: 64576 - DNA, 20 bp, human
gaacatggccgaagtcggcg

SEQ ID NO: 64577 - DNA, 20 bp, human
gccgaagtcggcgaggacag

SEQ ID NO: 64578 - DNA, 20 bp, human
ggcgcgaacatggccgaagt

SEQ ID NO: 64579 - DNA, 20 bp, human
gggcagcgcaggtagaagtg

SEQ ID NO: 64580 - DNA, 20 bp, human
gcgatcgcgcccggaggcag

SEQ ID NO: 64581 - DNA, 20 bp, human
ggccagcccagcgtcaccat

SEQ ID NO: 64582 - DNA, 20 bp, human
ggctcggagccgcgcgaaca

SEQ ID NO: 64583 - DNA, 20 bp, human
gcgcggcggccgcctcggta

SEQ ID NO: 64584 - DNA, 20 bp, human
gcggctgcggcgcacagcac

SEQ ID NO: 64585 - DNA, 20 bp, human
gtggcgccgcgagatgaagc

SEQ ID NO: 64586 - DNA, 20 bp, human
gcgcgcaccggagctgaggg

SEQ ID NO: 64587 - DNA, 20 bp, human
ggggcgtgaagatctcgagg

SEQ ID NO: 64588 - DNA, 20 bp, human
gcgccgcgcaccggagctga

SEQ ID NO: 64589 - DNA, 20 bp, human
gagatcttcacgcccccggg

SEQ ID NO: 64590 - DNA, 20 bp, human
ggtcgtcggccgccgcgcac

SEQ ID NO: 64591 - DNA, 20 bp, human
gcgggggcgtgaagatctcg

SEQ ID NO: 64592 - DNA, 20 bp, human
gcgctgcttgggcaagaacg

SEQ ID NO: 64593 - DNA, 20 bp, human
gcgtggacggcgtgttccag

SEQ ID NO: 64594 - DNA, 20 bp, human
gcccaggccgcgcgggtcgt

SEQ ID NO: 64595 - DNA, 20 bp, human
gccctcacgcaggcccatgg

SEQ ID NO: 64596 - DNA, 20 bp, human
ggaccgtacagatacagcat

SEQ ID NO: 64597 - DNA, 20 bp, human
gagcatgggcgaggcggcca

SEQ ID NO: 64598 - DNA, 20 bp, human
gagcagagggtcacgctcaa

SEQ ID NO: 64599 - DNA, 20 bp, human
gtgtacggtcccgagagacc

SEQ ID NO: 64600 - DNA, 20 bp, human
gcaactaccggcgccggaag

SEQ ID NO: 64601 - DNA, 20 bp, human
ggagagacccggcctccctc

SEQ ID NO: 64602 - DNA, 20 bp, human
gggatcgaagaggtgactca

SEQ ID NO: 64603 - DNA, 20 bp, human
gacgcaccagcgcagcgcgg

SEQ ID NO: 64604 - DNA, 20 bp, human
gcgcccatgctgtatctgta

SEQ ID NO: 64605 - DNA, 20 bp, human
gccgcgggggcgaaggccag

SEQ ID NO: 64606 - DNA, 20 bp, human
ggggtcgtgcttcgggaaac

SEQ ID NO: 64607 - DNA, 20 bp, human
gcgaggctcctggcgcacta

SEQ ID NO: 64608 - DNA, 20 bp, human
gcgtgcttcgggaaaccggg

SEQ ID NO: 64609 - DNA, 20 bp, human
gctctggcggagctgcctcc

SEQ ID NO: 64610 - DNA, 20 bp, human
gggcagctccgccagagacg

SEQ ID NO: 64611 - DNA, 20 bp, human
ggcacgacccgcgtctctgg

SEQ ID NO: 64612 - DNA, 20 bp, human
ggaagcacgacccgcgtctc

SEQ ID NO: 64613 - DNA, 20 bp, human
gcccgccggccgctccctag

SEQ ID NO: 64614 - DNA, 20 bp, human
gcgccgccgagcccaggcaa

SEQ ID NO: 64615 - DNA, 20 bp, human
ggagaccggtcgcacagtca

SEQ ID NO: 64616 - DNA, 20 bp, human
gcggcgccaatttcaaacag

SEQ ID NO: 64617 - DNA, 20 bp, human
gacgggaagaatctgagcca

SEQ ID NO: 64618 - DNA, 20 bp, human
gtgcggaggtcagacttcca

SEQ ID NO: 64619 - DNA, 20 bp, human
gtgagaaggccacggccagg

SEQ ID NO: 64620 - DNA, 20 bp, human
gcggagctacggcctaacgg

SEQ ID NO: 64621 - DNA, 20 bp, human
ggtcagggcgtctagcagca

SEQ ID NO: 64622 - DNA, 20 bp, human
gagctacggcctaacggcgg

SEQ ID NO: 64623 - DNA, 20 bp, human
gaggccgtagctccgaaggc

SEQ ID NO: 64624 - DNA, 20 bp, human
gacagtcggcctaagaaggt

SEQ ID NO: 64625 - DNA, 20 bp, human
gcctggctcggcccccaggt

SEQ ID NO: 64626 - DNA, 20 bp, human
gtgagctgcagtgagaacct

SEQ ID NO: 64627 - DNA, 20 bp, human
gcacaggacggccgagctga

SEQ ID NO: 64628 - DNA, 20 bp, human
gctgtgctgacatcaggtga

SEQ ID NO: 64629 - DNA, 20 bp, human
gcctgctcagtgaagcaggt

SEQ ID NO: 64630 - DNA, 20 bp, human
gcaagggagactcagaattc

SEQ ID NO: 64631 - DNA, 20 bp, human
gggccaagttctccatgtag

SEQ ID NO: 64632 - DNA, 20 bp, human
gagcttccccttgcccggag

SEQ ID NO: 64633 - DNA, 20 bp, human
gaacggggctcaggagtgac

SEQ ID NO: 64634 - DNA, 20 bp, human
gcctagaaaaggaactggag

SEQ ID NO: 64635 - DNA, 20 bp, human
gtggcctccacggctgactt

SEQ ID NO: 64636 - DNA, 20 bp, human
gggccggggaagacacaata

SEQ ID NO: 64637 - DNA, 20 bp, human
gagcttccagcagtcgcctc

SEQ ID NO: 64638 - DNA, 20 bp, human
gagtcgcctccgggaagacg

SEQ ID NO: 64639 - DNA, 20 bp, human
gggttgccgcgtcttcccgg

SEQ ID NO: 64640 - DNA, 20 bp, human
gtgtcgcgcggcggaaaccg

SEQ ID NO: 64641 - DNA, 20 bp, human
gggaagacgcggcaaccagc

SEQ ID NO: 64642 - DNA, 20 bp, human
gggtaatgaccgcccgggag

SEQ ID NO: 64643 - DNA, 20 bp, human
gtgagaggtaatgaccgccc

SEQ ID NO: 64644 - DNA, 20 bp, human
ggggagcgccgaccctggag

SEQ ID NO: 64645 - DNA, 20 bp, human
ggcgactgctggaagctgca

SEQ ID NO: 64646 - DNA, 20 bp, human
gcagatcgcggccggaaccc

SEQ ID NO: 64647 - DNA, 20 bp, human
gctgcagctcggccgggaga

SEQ ID NO: 64648 - DNA, 20 bp, human
ggcagcagcctgaacacgga

SEQ ID NO: 64649 - DNA, 20 bp, human
ggccgggagacggcgcgacc

SEQ ID NO: 64650 - DNA, 20 bp, human
gttctcgcggccgcattggg

SEQ ID NO: 64651 - DNA, 20 bp, human
gtaaacccgagcagattagg

SEQ ID NO: 64652 - DNA, 20 bp, human
ggcggcgacgctggactcgc

SEQ ID NO: 64653 - DNA, 20 bp, human
gaaatgcagcagcctgaaca

SEQ ID NO: 64654 - DNA, 20 bp, human
gaaaccaggtggaaataggg

SEQ ID NO: 64655 - DNA, 20 bp, human
ggcgacgctggactcgcggg

SEQ ID NO: 64656 - DNA, 20 bp, human
gcgccgctctgggaagacga

SEQ ID NO: 64657 - DNA, 20 bp, human
ggtagtctccaggaccgtct

SEQ ID NO: 64658 - DNA, 20 bp, human
ggcgggaggcgcgtccgaga

SEQ ID NO: 64659 - DNA, 20 bp, human
gtcgctcggtggccccgcta

SEQ ID NO: 64660 - DNA, 20 bp, human
gggcgcgtccgagacggtcc

SEQ ID NO: 64661 - DNA, 20 bp, human
gggccccgctaaggacgcgc

SEQ ID NO: 64662 - DNA, 20 bp, human
ggcctccgccgcggcgcgtc

SEQ ID NO: 64663 - DNA, 20 bp, human
gcggcgcggcatgggacctg

SEQ ID NO: 64664 - DNA, 20 bp, human
gagggaccccgcaggtcctg

SEQ ID NO: 64665 - DNA, 20 bp, human
gaaaaaggcgacacatgacc

SEQ ID NO: 64666 - DNA, 20 bp, human
ggcgcgagggagcccccctc

SEQ ID NO: 64667 - DNA, 20 bp, human
gtgcgacggcggccaaattg

SEQ ID NO: 64668 - DNA, 20 bp, human
gggtgggcaggggttccgga

SEQ ID NO: 64669 - DNA, 20 bp, human
gacgcgaggggcgagcgcga

SEQ ID NO: 64670 - DNA, 20 bp, human
ggccaaattgcggaacgcga

SEQ ID NO: 64671 - DNA, 20 bp, human
ggagctggacagctccagag

SEQ ID NO: 64672 - DNA, 20 bp, human
gttgtgtgttgcggggacgt

SEQ ID NO: 64673 - DNA, 20 bp, human
gtgcgcccgggtctctaccc

SEQ ID NO: 64674 - DNA, 20 bp, human
gacggttcgagctgcgacgg

SEQ ID NO: 64675 - DNA, 20 bp, human
gaaaacggttcgagctgcga

SEQ ID NO: 64676 - DNA, 20 bp, human
gggccgcttgctctccccag

SEQ ID NO: 64677 - DNA, 20 bp, human
gtgctgcctgttgaatgtgg

SEQ ID NO: 64678 - DNA, 20 bp, human
gccgcaggagagccaagagg

SEQ ID NO: 64679 - DNA, 20 bp, human
gggtcgatctccaccacctg

SEQ ID NO: 64680 - DNA, 20 bp, human
ggcagatcccgtaagtcggg

SEQ ID NO: 64681 - DNA, 20 bp, human
gcgcagccgccacattcaac

SEQ ID NO: 64682 - DNA, 20 bp, human
gtcaacaggcagcagcgcag

SEQ ID NO: 64683 - DNA, 20 bp, human
ggcggcagatcccgtaagtc

SEQ ID NO: 64684 - DNA, 20 bp, human
gcgctgctgcctgttgaatg

SEQ ID NO: 64685 - DNA, 20 bp, human
gaccccgaggagcctcgatg

SEQ ID NO: 64686 - DNA, 20 bp, human
ggaggggaaagggaagcgcc

SEQ ID NO: 64687 - DNA, 20 bp, human
gtggcggcgcgcgagctgac

SEQ ID NO: 64688 - DNA, 20 bp, human
gcgccctgctcgtggaaggg

SEQ ID NO: 64689 - DNA, 20 bp, human
gcctgctcgtggaagggagg

SEQ ID NO: 64690 - DNA, 20 bp, human
gcggcgcgcgagctgacagg

SEQ ID NO: 64691 - DNA, 20 bp, human
gacgcagggcgcctcaacct

SEQ ID NO: 64692 - DNA, 20 bp, human
gccgccgtcagcctaggttg

SEQ ID NO: 64693 - DNA, 20 bp, human
ggccgcggccgccctgctcg

SEQ ID NO: 64694 - DNA, 20 bp, human
gcgggaagcgccaagtctcc

SEQ ID NO: 64695 - DNA, 20 bp, human
gtctagcagcccgggagact

SEQ ID NO: 64696 - DNA, 20 bp, human
ggacgtgcggccagcgaacc

SEQ ID NO: 64697 - DNA, 20 bp, human
gtctgctgcgccaggttcgc

SEQ ID NO: 64698 - DNA, 20 bp, human
gtcgctggccgcacgtcttc

SEQ ID NO: 64699 - DNA, 20 bp, human
gcttcaggtcctcctgttcc

SEQ ID NO: 64700 - DNA, 20 bp, human
gtccatcgcggcctggccgg

SEQ ID NO: 64701 - DNA, 20 bp, human
gcgagagccccagccgcggg

SEQ ID NO: 64702 - DNA, 20 bp, human
gtcgcggctccatcgcggcc

SEQ ID NO: 64703 - DNA, 20 bp, human
gcccgcctcccaggaacagg

SEQ ID NO: 64704 - DNA, 20 bp, human
gaggaggacctgaagacgtg

SEQ ID NO: 64705 - DNA, 20 bp, human
ggcgcgagagccccagccgc

SEQ ID NO: 64706 - DNA, 20 bp, human
gaaacagagacgtcaggagg

SEQ ID NO: 64707 - DNA, 20 bp, human
ggagcaggaagctgagtgag

SEQ ID NO: 64708 - DNA, 20 bp, human
gagtggtaaacagagacgtc

SEQ ID NO: 64709 - DNA, 20 bp, human
gtgggagcgcaatatatgag

SEQ ID NO: 64710 - DNA, 20 bp, human
ggctcggcagaggttacagg

SEQ ID NO: 64711 - DNA, 20 bp, human
ggggagggcagcaatccggg

SEQ ID NO: 64712 - DNA, 20 bp, human
gtacaggctgtagtcgggaa

SEQ ID NO: 64713 - DNA, 20 bp, human
gagagtggcgagaagggaag

SEQ ID NO: 64714 - DNA, 20 bp, human
gctgcggctaaggagacgtt

SEQ ID NO: 64715 - DNA, 20 bp, human
ggaggctacaggctgtagtc

SEQ ID NO: 64716 - DNA, 20 bp, human
ggggaggcttcgcggagggt

SEQ ID NO: 64717 - DNA, 20 bp, human
gcggcggcggcagcattcac

SEQ ID NO: 64718 - DNA, 20 bp, human
gcgaagggagggaaagacct

SEQ ID NO: 64719 - DNA, 20 bp, human
gccccggggcgtgcagatcc

SEQ ID NO: 64720 - DNA, 20 bp, human
ggaaagcgaagagctctcgg

SEQ ID NO: 64721 - DNA, 20 bp, human
gcgacctccgcgcccagggg

SEQ ID NO: 64722 - DNA, 20 bp, human
gtcgcagccatggtcccgcc

SEQ ID NO: 64723 - DNA, 20 bp, human
gaagctgcgagcgcatcagg

SEQ ID NO: 64724 - DNA, 20 bp, human
gggcagcattcaccgggcgg

SEQ ID NO: 64725 - DNA, 20 bp, human
gcctcgtcgccggccaagtc

SEQ ID NO: 64726 - DNA, 20 bp, human
gaccccgctgggcactccag

SEQ ID NO: 64727 - DNA, 20 bp, human
gccgggaagctagtccggag

SEQ ID NO: 64728 - DNA, 20 bp, human
gccccggcgaacggcaaaga

SEQ ID NO: 64729 - DNA, 20 bp, human
gcccgctgcaaatggtctct

SEQ ID NO: 64730 - DNA, 20 bp, human
ggaccctctacctcccgcag

SEQ ID NO: 64731 - DNA, 20 bp, human
ggtggcggaaacaagacagg

SEQ ID NO: 64732 - DNA, 20 bp, human
gggaagctagtccggagcgg

SEQ ID NO: 64733 - DNA, 20 bp, human
gaaagtggcggaaacaagac

SEQ ID NO: 64734 - DNA, 20 bp, human
gctccagcggccccccgagc

SEQ ID NO: 64735 - DNA, 20 bp, human
gagctgggcctcgacccggg

SEQ ID NO: 64736 - DNA, 20 bp, human
ggccgaagcggggaataact

SEQ ID NO: 64737 - DNA, 20 bp, human
gggctctgtaaccaagtggg

SEQ ID NO: 64738 - DNA, 20 bp, human
gggcgactcctgctgcacag

SEQ ID NO: 64739 - DNA, 20 bp, human
gcggcatgcgaataccatct

SEQ ID NO: 64740 - DNA, 20 bp, human
gcaggtggctaaccagggct

SEQ ID NO: 64741 - DNA, 20 bp, human
gcggcagacactacaagctg

SEQ ID NO: 64742 - DNA, 20 bp, human
gagctgtgggtcaattgagg

SEQ ID NO: 64743 - DNA, 20 bp, human
gtgtagttgacaccaagccc

SEQ ID NO: 64744 - DNA, 20 bp, human
gttcggctctgtaaccaagt

SEQ ID NO: 64745 - DNA, 20 bp, human
gtaggcaagctggcaataag

SEQ ID NO: 64746 - DNA, 20 bp, human
gccgggaagctagtccggag

SEQ ID NO: 64747 - DNA, 20 bp, human
gggagcccagccagcgccgg

SEQ ID NO: 64748 - DNA, 20 bp, human
gagctgggcctcgacccggg

SEQ ID NO: 64749 - DNA, 20 bp, human
gggaagctagtccggagcgg

SEQ ID NO: 64750 - DNA, 20 bp, human
ggggctccgggaagctagtc

SEQ ID NO: 64751 - DNA, 20 bp, human
gcccgctgcaaatggtctct

SEQ ID NO: 64752 - DNA, 20 bp, human
ggaggcgtgaaggggcctac

SEQ ID NO: 64753 - DNA, 20 bp, human
ggggctgggggagatgcacg

SEQ ID NO: 64754 - DNA, 20 bp, human
gtctctcccctaggcgatcg

SEQ ID NO: 64755 - DNA, 20 bp, human
gcgggtcgaggcccagctct

SEQ ID NO: 64756 - DNA, 20 bp, human
ggcagaagcgagagttccgt

SEQ ID NO: 64757 - DNA, 20 bp, human
gtgtggctgccacagatcgg

SEQ ID NO: 64758 - DNA, 20 bp, human
ggagccctcagatgaagtga

SEQ ID NO: 64759 - DNA, 20 bp, human
gagcagaggtgtgtactcac

SEQ ID NO: 64760 - DNA, 20 bp, human
gacatctcatccacaactgg

SEQ ID NO: 64761 - DNA, 20 bp, human
gaggtgtgtactcactggtg

SEQ ID NO: 64762 - DNA, 20 bp, human
gaagtgtcaaataaatccta

SEQ ID NO: 64763 - DNA, 20 bp, human
gaacggtacaactccacaaa

SEQ ID NO: 64764 - DNA, 20 bp, human
gtgaaaacacccccgatctg

SEQ ID NO: 64765 - DNA, 20 bp, human
gtattgtctgagaagcagtt

SEQ ID NO: 64766 - DNA, 20 bp, human
gaagccgggagaccagacac

SEQ ID NO: 64767 - DNA, 20 bp, human
gatcagtctgggacgtgatc

SEQ ID NO: 64768 - DNA, 20 bp, human
gctttggtgtgcaacgtgag

SEQ ID NO: 64769 - DNA, 20 bp, human
gaatcagcatttaatcacta

SEQ ID NO: 64770 - DNA, 20 bp, human
gaatcactagggtatgtctt

SEQ ID NO: 64771 - DNA, 20 bp, human
gattgctttactggtagatt

SEQ ID NO: 64772 - DNA, 20 bp, human
gtatctgtaagagtttagag

SEQ ID NO: 64773 - DNA, 20 bp, human
gctgggacgtgatcgggcag

SEQ ID NO: 64774 - DNA, 20 bp, human
ggctgtaaatagttgtctga

SEQ ID NO: 64775 - DNA, 20 bp, human
ggtaaatagttgtctgatgg

SEQ ID NO: 64776 - DNA, 20 bp, human
gacagctaagaaaacatctg

SEQ ID NO: 64777 - DNA, 20 bp, human
gggctgtgaaatgcttgtct

SEQ ID NO: 64778 - DNA, 20 bp, human
gctctgcaatttacagccaa

SEQ ID NO: 64779 - DNA, 20 bp, human
ggatggtatctagtgttcaa

SEQ ID NO: 64780 - DNA, 20 bp, human
gccaaaagtgcagtgtataa

SEQ ID NO: 64781 - DNA, 20 bp, human
gttttgtaaactacttcctt

SEQ ID NO: 64782 - DNA, 20 bp, human
gagaactgtgatttcaatta

SEQ ID NO: 64783 - DNA, 20 bp, human
gaattaaggttagtaattga

SEQ ID NO: 64784 - DNA, 20 bp, human
gagcttgattaacatctgct

SEQ ID NO: 64785 - DNA, 20 bp, human
gcatctgctgtgtacagact

SEQ ID NO: 64786 - DNA, 20 bp, human
gagagcagggacactcacct

SEQ ID NO: 64787 - DNA, 20 bp, human
gtggggcccacatctggtag

SEQ ID NO: 64788 - DNA, 20 bp, human
gtgaagtggactgacagaaa

SEQ ID NO: 64789 - DNA, 20 bp, human
gcatctggtaggggagagca

SEQ ID NO: 64790 - DNA, 20 bp, human
gctgtcagtccacttcacca

SEQ ID NO: 64791 - DNA, 20 bp, human
gggtgaagtacttaatgcat

SEQ ID NO: 64792 - DNA, 20 bp, human
gtaaatggcagaagacttaa

SEQ ID NO: 64793 - DNA, 20 bp, human
gcccattggaggagatggca

SEQ ID NO: 64794 - DNA, 20 bp, human
ggtacttaatgcatgggcag

SEQ ID NO: 64795 - DNA, 20 bp, human
gccgtgattccagccaggta

SEQ ID NO: 64796 - DNA, 20 bp, human
ggcgggctccggactccgag

SEQ ID NO: 64797 - DNA, 20 bp, human
gcgagcgtcgcggaaggacc

SEQ ID NO: 64798 - DNA, 20 bp, human
gactgagcctgggctgcgag

SEQ ID NO: 64799 - DNA, 20 bp, human
ggcggccgggcgggacaggt

SEQ ID NO: 64800 - DNA, 20 bp, human
gggagcccgggccggaacca

SEQ ID NO: 64801 - DNA, 20 bp, human
gaggggctgcgactgagcct

SEQ ID NO: 64802 - DNA, 20 bp, human
ggtcgcagcccctcggagtc

SEQ ID NO: 64803 - DNA, 20 bp, human
gactgtccggtccgcaggga

SEQ ID NO: 64804 - DNA, 20 bp, human
gcgtcgcggaaggaccggga

SEQ ID NO: 64805 - DNA, 20 bp, human
gcggcgcggaagggcagccc

SEQ ID NO: 64806 - DNA, 20 bp, human
gtgactatctcggaagacca

SEQ ID NO: 64807 - DNA, 20 bp, human
gccgcggaggcgagtccccg

SEQ ID NO: 64808 - DNA, 20 bp, human
gtgggccggcccgaaggtgg

SEQ ID NO: 64809 - DNA, 20 bp, human
gagatgctgccccggaggct

SEQ ID NO: 64810 - DNA, 20 bp, human
gggagagggaggagttgggt

SEQ ID NO: 64811 - DNA, 20 bp, human
gagaccagggtagagctccc

SEQ ID NO: 64812 - DNA, 20 bp, human
gcagccttgagcacccgcgg

SEQ ID NO: 64813 - DNA, 20 bp, human
gtggaggcgagacgcagccg

SEQ ID NO: 64814 - DNA, 20 bp, human
gtattgggccggcccgaagg

SEQ ID NO: 64815 - DNA, 20 bp, human
gtgttgggtggactatgggg

SEQ ID NO: 64816 - DNA, 20 bp, human
gccactcgcgaactctactc

SEQ ID NO: 64817 - DNA, 20 bp, human
gcggagtggggacgcggagt

SEQ ID NO: 64818 - DNA, 20 bp, human
gcgagccggcgcatttgaga

SEQ ID NO: 64819 - DNA, 20 bp, human
gggtgagaccagctgtcctc

SEQ ID NO: 64820 - DNA, 20 bp, human
gggagcagaaacgtgagtag

SEQ ID NO: 64821 - DNA, 20 bp, human
gcgcgaactctactcgggag

SEQ ID NO: 64822 - DNA, 20 bp, human
ggctaaggggaggtgagatg

SEQ ID NO: 64823 - DNA, 20 bp, human
ggaggcgggcccagaagtcg

SEQ ID NO: 64824 - DNA, 20 bp, human
gggcccagaagtcgaggtgt

SEQ ID NO: 64825 - DNA, 20 bp, human
gaggggctcgcgggaccccg

SEQ ID NO: 64826 - DNA, 20 bp, human
gagcactggtctgtggtaca

SEQ ID NO: 64827 - DNA, 20 bp, human
gtctccatggccaggtccca

SEQ ID NO: 64828 - DNA, 20 bp, human
gctagaagcactgaagaaag

SEQ ID NO: 64829 - DNA, 20 bp, human
gtccttgccaaatacagagt

SEQ ID NO: 64830 - DNA, 20 bp, human
gatgcagtgtatctcatcta

SEQ ID NO: 64831 - DNA, 20 bp, human
ggtcccagtccagcagccct

SEQ ID NO: 64832 - DNA, 20 bp, human
gagcagaaagtcacttcaag

SEQ ID NO: 64833 - DNA, 20 bp, human
gattactccgactctgtatt

SEQ ID NO: 64834 - DNA, 20 bp, human
gccatctttactggagagat

SEQ ID NO: 64835 - DNA, 20 bp, human
ggcacttaaagctgtccttt

SEQ ID NO: 64836 - DNA, 20 bp, human
ggcagcagtgcagctttcag

SEQ ID NO: 64837 - DNA, 20 bp, human
gagagggtccgggctcagag

SEQ ID NO: 64838 - DNA, 20 bp, human
gagtacagcatcctgaacac

SEQ ID NO: 64839 - DNA, 20 bp, human
ggacggctgcgataatagcg

SEQ ID NO: 64840 - DNA, 20 bp, human
gcagactgattgataatcgg

SEQ ID NO: 64841 - DNA, 20 bp, human
ggtttggcgcggagcagtga

SEQ ID NO: 64842 - DNA, 20 bp, human
gtgcagctttcagagggtcc

SEQ ID NO: 64843 - DNA, 20 bp, human
gctgaaggacacacagtcgg

SEQ ID NO: 64844 - DNA, 20 bp, human
ggctcagaggggttatgatt

SEQ ID NO: 64845 - DNA, 20 bp, human
ggcccacactggcaggacag

SEQ ID NO: 64846 - DNA, 20 bp, human
ggcgcggcctcattagacca

SEQ ID NO: 64847 - DNA, 20 bp, human
gccacgggttgcagccggag

SEQ ID NO: 64848 - DNA, 20 bp, human
gccctctccagcgaccgggt

SEQ ID NO: 64849 - DNA, 20 bp, human
ggagccggtgcccctgagga

SEQ ID NO: 64850 - DNA, 20 bp, human
ggcgaacctcccagccgctc

SEQ ID NO: 64851 - DNA, 20 bp, human
gtgcaacccgtggtctaatg

SEQ ID NO: 64852 - DNA, 20 bp, human
gtgcgggcgtagggacctgg

SEQ ID NO: 64853 - DNA, 20 bp, human
gggaggggctcgggattccg

SEQ ID NO: 64854 - DNA, 20 bp, human
gctggaaggtccaacctgga

SEQ ID NO: 64855 - DNA, 20 bp, human
ggaggttcgcgcgtttctca

SEQ ID NO: 64856 - DNA, 20 bp, human
ggcacgccgtggacccctca

SEQ ID NO: 64857 - DNA, 20 bp, human
gggcagcgggccaccctcag

SEQ ID NO: 64858 - DNA, 20 bp, human
gtgtctgccgggtgaagcgg

SEQ ID NO: 64859 - DNA, 20 bp, human
gggtcgccctgaggggtcca

SEQ ID NO: 64860 - DNA, 20 bp, human
gtgctgggacctgctgggtc

SEQ ID NO: 64861 - DNA, 20 bp, human
gacctgtctgccgggtgaag

SEQ ID NO: 64862 - DNA, 20 bp, human
gcctggctggtcgccctgag

SEQ ID NO: 64863 - DNA, 20 bp, human
gatgaccgcaagccaggcaa

SEQ ID NO: 64864 - DNA, 20 bp, human
gcccggcagacaggtgctga

SEQ ID NO: 64865 - DNA, 20 bp, human
gcaggtgctgagggcacccg

SEQ ID NO: 64866 - DNA, 20 bp, human
ggccgctgccaggaatagag

SEQ ID NO: 64867 - DNA, 20 bp, human
gctaggatccagaagcccag

SEQ ID NO: 64868 - DNA, 20 bp, human
ggggcgccgggactatgtcg

SEQ ID NO: 64869 - DNA, 20 bp, human
ggtgatcccggagtctgaac

SEQ ID NO: 64870 - DNA, 20 bp, human
gccgccccgggttgggaagt

SEQ ID NO: 64871 - DNA, 20 bp, human
gcgcgcccgcgacatagtcc

SEQ ID NO: 64872 - DNA, 20 bp, human
ggccgctctattcctggcag

SEQ ID NO: 64873 - DNA, 20 bp, human
gccggcagcgctctaggccc

SEQ ID NO: 64874 - DNA, 20 bp, human
gcctgggcgcgacgacacgt

SEQ ID NO: 64875 - DNA, 20 bp, human
gcgggctccgctagccgaga

SEQ ID NO: 64876 - DNA, 20 bp, human
gtcgcagcgatacttccgga

SEQ ID NO: 64877 - DNA, 20 bp, human
gtgcggcgcggtctcaggga

SEQ ID NO: 64878 - DNA, 20 bp, human
gaaagcgtgaagtagatagg

SEQ ID NO: 64879 - DNA, 20 bp, human
gagctaagaggtaccagaga

SEQ ID NO: 64880 - DNA, 20 bp, human
gcacccagcgaaaattgcgg

SEQ ID NO: 64881 - DNA, 20 bp, human
gtactcctggggagcgtcat

SEQ ID NO: 64882 - DNA, 20 bp, human
ggctgtgcggcgcggtctca

SEQ ID NO: 64883 - DNA, 20 bp, human
gggaggttttccgagctaag

SEQ ID NO: 64884 - DNA, 20 bp, human
gaaggcaccggagttctcct

SEQ ID NO: 64885 - DNA, 20 bp, human
gtgtaaagcgtgaagtagat

SEQ ID NO: 64886 - DNA, 20 bp, human
gtgcggcgcggtctcaggga

SEQ ID NO: 64887 - DNA, 20 bp, human
gtcgcagcgatacttccgga

SEQ ID NO: 64888 - DNA, 20 bp, human
gaaagcgtgaagtagatagg

SEQ ID NO: 64889 - DNA, 20 bp, human
gtactcctggggagcgtcat

SEQ ID NO: 64890 - DNA, 20 bp, human
ggctgtgcggcgcggtctca

SEQ ID NO: 64891 - DNA, 20 bp, human
gagctaagaggtaccagaga

SEQ ID NO: 64892 - DNA, 20 bp, human
gcacccagcgaaaattgcgg

SEQ ID NO: 64893 - DNA, 20 bp, human
gagggcgcatgcgtgctgtg

SEQ ID NO: 64894 - DNA, 20 bp, human
gtattagctagctactcctg

SEQ ID NO: 64895 - DNA, 20 bp, human
gtgtaaagcgtgaagtagat

SEQ ID NO: 64896 - DNA, 20 bp, human
gtctaggtctgggtctcctg

SEQ ID NO: 64897 - DNA, 20 bp, human
gctcctggggagagtgactc

SEQ ID NO: 64898 - DNA, 20 bp, human
gtcttgctctgggtagttct

SEQ ID NO: 64899 - DNA, 20 bp, human
gtctgggtagttctaggtct

SEQ ID NO: 64900 - DNA, 20 bp, human
gaccagctgtggtcttgctc

SEQ ID NO: 64901 - DNA, 20 bp, human
gggtaagaaacatattctgg

SEQ ID NO: 64902 - DNA, 20 bp, human
gaaacatattctgggggact

SEQ ID NO: 64903 - DNA, 20 bp, human
gaaagaggttctaaacaggc

SEQ ID NO: 64904 - DNA, 20 bp, human
gatagacacacttaatacac

SEQ ID NO: 64905 - DNA, 20 bp, human
gaaaacatacaccaaggaac

SEQ ID NO: 64906 - DNA, 20 bp, human
gaggaagccaagaagcacac

SEQ ID NO: 64907 - DNA, 20 bp, human
gggagcaacaccggctctaa

SEQ ID NO: 64908 - DNA, 20 bp, human
ggcttcctgtggagcaacac

SEQ ID NO: 64909 - DNA, 20 bp, human
gcagatcaagatagaaacat

SEQ ID NO: 64910 - DNA, 20 bp, human
gcgtgtgtggctggcattta

SEQ ID NO: 64911 - DNA, 20 bp, human
gcggagactactgaatgatg

SEQ ID NO: 64912 - DNA, 20 bp, human
gaagttgtaagtcacgtgtg

SEQ ID NO: 64913 - DNA, 20 bp, human
gccggctctaagggctttcg

SEQ ID NO: 64914 - DNA, 20 bp, human
gtgtaagtcacgtgtgtggc

SEQ ID NO: 64915 - DNA, 20 bp, human
gtggagcatccacttgccac

SEQ ID NO: 64916 - DNA, 20 bp, human
ggacagagcccttctaactc

SEQ ID NO: 64917 - DNA, 20 bp, human
gcgctactccagagttagaa

SEQ ID NO: 64918 - DNA, 20 bp, human
gaacgaagtggattcttcac

SEQ ID NO: 64919 - DNA, 20 bp, human
gaagggctctgtcatatagc

SEQ ID NO: 64920 - DNA, 20 bp, human
gccacaggaatccaggaact

SEQ ID NO: 64921 - DNA, 20 bp, human
gaaagatgaagttatatgtt

SEQ ID NO: 64922 - DNA, 20 bp, human
gttaagatcttaattggctt

SEQ ID NO: 64923 - DNA, 20 bp, human
gtctaagctggtggtaagtt

SEQ ID NO: 64924 - DNA, 20 bp, human
gagttgctccacaggaatcc

SEQ ID NO: 64925 - DNA, 20 bp, human
gtggttttacagggatagga

SEQ ID NO: 64926 - DNA, 20 bp, human
gtgcccagtcgggacccgta

SEQ ID NO: 64927 - DNA, 20 bp, human
gggggcgaacttggcacaca

SEQ ID NO: 64928 - DNA, 20 bp, human
gctccctacgggtcccgact

SEQ ID NO: 64929 - DNA, 20 bp, human
gggagggctgtgggtatatt

SEQ ID NO: 64930 - DNA, 20 bp, human
gccggaagtggtgcccagtc

SEQ ID NO: 64931 - DNA, 20 bp, human
ggacagattctggagacacc

SEQ ID NO: 64932 - DNA, 20 bp, human
ggcaacccgcctctccctac

SEQ ID NO: 64933 - DNA, 20 bp, human
gaaggaaacgacgactccgg

SEQ ID NO: 64934 - DNA, 20 bp, human
gaggtatgggtcggatggag

SEQ ID NO: 64935 - DNA, 20 bp, human
gggagagtgggagcaagaat

SEQ ID NO: 64936 - DNA, 20 bp, human
gagcgcagcctgaggcggtg

SEQ ID NO: 64937 - DNA, 20 bp, human
gagcctgaggcggtgtggtg

SEQ ID NO: 64938 - DNA, 20 bp, human
gtccccgacagtggaaatcc

SEQ ID NO: 64939 - DNA, 20 bp, human
gtgagctttgggagaataag

SEQ ID NO: 64940 - DNA, 20 bp, human
ggactgttcggaagcttcag

SEQ ID NO: 64941 - DNA, 20 bp, human
gtgcagggcgggcgagtccc

SEQ ID NO: 64942 - DNA, 20 bp, human
ggcctcggcacccacgatgg

SEQ ID NO: 64943 - DNA, 20 bp, human
gcaccgcaccacaccgcctc

SEQ ID NO: 64944 - DNA, 20 bp, human
ggatgggtgtcctcaaagtg

SEQ ID NO: 64945 - DNA, 20 bp, human
gggtggctcgaccaaggagt

SEQ ID NO: 64946 - DNA, 20 bp, human
ggccggcacggacccgacag

SEQ ID NO: 64947 - DNA, 20 bp, human
ggacaaggccaggtccccgg

SEQ ID NO: 64948 - DNA, 20 bp, human
gctcctactgcagcagtcag

SEQ ID NO: 64949 - DNA, 20 bp, human
gcagtctccgccaacgcggg

SEQ ID NO: 64950 - DNA, 20 bp, human
ggaagactaagtctggaccg

SEQ ID NO: 64951 - DNA, 20 bp, human
gggcgcagcgcaggacccca

SEQ ID NO: 64952 - DNA, 20 bp, human
gagctcccggaggcccatca

SEQ ID NO: 64953 - DNA, 20 bp, human
gcggagctgaagactaagtc

SEQ ID NO: 64954 - DNA, 20 bp, human
gcccggaggcccatcaaggt

SEQ ID NO: 64955 - DNA, 20 bp, human
gcctgcttgccagctcccgg

SEQ ID NO: 64956 - DNA, 20 bp, human
gccgtctcagccgaagcggg

SEQ ID NO: 64957 - DNA, 20 bp, human
ggccggagcaggggcggacg

SEQ ID NO: 64958 - DNA, 20 bp, human
gcggcgacgacgacccgcat

SEQ ID NO: 64959 - DNA, 20 bp, human
gtgcagcagtcggtgacgct

SEQ ID NO: 64960 - DNA, 20 bp, human
gccaccgtctcagccgaagc

SEQ ID NO: 64961 - DNA, 20 bp, human
gccgcacggcttccttgatg

SEQ ID NO: 64962 - DNA, 20 bp, human
gcgccgatggacccaagccg

SEQ ID NO: 64963 - DNA, 20 bp, human
ggccctgcgctgcgccctag

SEQ ID NO: 64964 - DNA, 20 bp, human
gtcccctagggcgcagcgca

SEQ ID NO: 64965 - DNA, 20 bp, human
gccatcggcgctgctgcaag

SEQ ID NO: 64966 - DNA, 20 bp, human
gtcctgcccgccagttccaa

SEQ ID NO: 64967 - DNA, 20 bp, human
gtagaaacccttggaactgg

SEQ ID NO: 64968 - DNA, 20 bp, human
gcagagcccgacctccctgg

SEQ ID NO: 64969 - DNA, 20 bp, human
ggctgtccgccagggaggtc

SEQ ID NO: 64970 - DNA, 20 bp, human
gagttagaaacccttggaac

SEQ ID NO: 64971 - DNA, 20 bp, human
gcttctcacagggagtcctg

SEQ ID NO: 64972 - DNA, 20 bp, human
ggctctgtgtaaacagtaga

SEQ ID NO: 64973 - DNA, 20 bp, human
gtggcaagtgccagcacgga

SEQ ID NO: 64974 - DNA, 20 bp, human
gtagcggtggctgtccgcca

SEQ ID NO: 64975 - DNA, 20 bp, human
gacaaaactagtagtgagaa

SEQ ID NO: 64976 - DNA, 20 bp, human
gcctggaaagtagaagtgga

SEQ ID NO: 64977 - DNA, 20 bp, human
gcagcccgctgccttcggca

SEQ ID NO: 64978 - DNA, 20 bp, human
ggcatgcgaagtcggtcccc

SEQ ID NO: 64979 - DNA, 20 bp, human
gcgcgcgattgaggcgctag

SEQ ID NO: 64980 - DNA, 20 bp, human
gtcactggtaagccgcgtcc

SEQ ID NO: 64981 - DNA, 20 bp, human
gtgcagcccccgcgagacca

SEQ ID NO: 64982 - DNA, 20 bp, human
ggcgattgaggcgctagcgg

SEQ ID NO: 64983 - DNA, 20 bp, human
gagttcctggcacttcccgg

SEQ ID NO: 64984 - DNA, 20 bp, human
ggaggagccgaagccttccc

SEQ ID NO: 64985 - DNA, 20 bp, human
gctgtcccctggtctcgcgg

SEQ ID NO: 64986 - DNA, 20 bp, human
gcagacagctggtcggagtc

SEQ ID NO: 64987 - DNA, 20 bp, human
gcccggcgagaaggtgtgta

SEQ ID NO: 64988 - DNA, 20 bp, human
ggcgccacaaggagctgccg

SEQ ID NO: 64989 - DNA, 20 bp, human
gcaacgccaggagccatccg

SEQ ID NO: 64990 - DNA, 20 bp, human
gggcagcgcgggcagcagtg

SEQ ID NO: 64991 - DNA, 20 bp, human
gcaaagagggatctgctgag

SEQ ID NO: 64992 - DNA, 20 bp, human
gcctggcgttgggattcccg

SEQ ID NO: 64993 - DNA, 20 bp, human
ggcacccgactgggacgccc

SEQ ID NO: 64994 - DNA, 20 bp, human
gctgccggggcgtcccagtc

SEQ ID NO: 64995 - DNA, 20 bp, human
gggcttctcggcacccgact

SEQ ID NO: 64996 - DNA, 20 bp, human
ggcgggttctacagagacgt

SEQ ID NO: 64997 - DNA, 20 bp, human
gtctggacgagtatgtgagt

SEQ ID NO: 64998 - DNA, 20 bp, human
gctccgtccagcccggacag

SEQ ID NO: 64999 - DNA, 20 bp, human
gagcttggtagacttcacgt

SEQ ID NO: 65000 - DNA, 20 bp, human
gggaaccaagacgaagaggt

SEQ ID NO: 65001 - DNA, 20 bp, human
gcaagggaaccaagacgaag

SEQ ID NO: 65002 - DNA, 20 bp, human
gtgtgagtcggggcagcaca

SEQ ID NO: 65003 - DNA, 20 bp, human
gacgtaggagtactcggcca

SEQ ID NO: 65004 - DNA, 20 bp, human
gttcgccctggcccctgtcc

SEQ ID NO: 65005 - DNA, 20 bp, human
ggcttccaccggagttgcgg

SEQ ID NO: 65006 - DNA, 20 bp, human
gccctccttccagactccac

SEQ ID NO: 65007 - DNA, 20 bp, human
gtgcatcagagatagactgt

SEQ ID NO: 65008 - DNA, 20 bp, human
gcgctctctctcacgtccaa

SEQ ID NO: 65009 - DNA, 20 bp, human
gtgctcctgtggagtctgga

SEQ ID NO: 65010 - DNA, 20 bp, human
gcatttctcaagtcccctga

SEQ ID NO: 65011 - DNA, 20 bp, human
gactgagctgtgtctttagc

SEQ ID NO: 65012 - DNA, 20 bp, human
ggactgtgggactctgccta

SEQ ID NO: 65013 - DNA, 20 bp, human
gctgctgcaagagaaggttt

SEQ ID NO: 65014 - DNA, 20 bp, human
gccgatcctgctgcaagaga

SEQ ID NO: 65015 - DNA, 20 bp, human
ggggctggtcagtggagcac

SEQ ID NO: 65016 - DNA, 20 bp, human
gtgcatcagagatagactgt

SEQ ID NO: 65017 - DNA, 20 bp, human
gcgctctctctcacgtccaa

SEQ ID NO: 65018 - DNA, 20 bp, human
gcatttctcaagtcccctga

SEQ ID NO: 65019 - DNA, 20 bp, human
gactgagctgtgtctttagc

SEQ ID NO: 65020 - DNA, 20 bp, human
ggactgtgggactctgccta

SEQ ID NO: 65021 - DNA, 20 bp, human
gctgctgcaagagaaggttt

SEQ ID NO: 65022 - DNA, 20 bp, human
gccgatcctgctgcaagaga

SEQ ID NO: 65023 - DNA, 20 bp, human
ggggctggtcagtggagcac

SEQ ID NO: 65024 - DNA, 20 bp, human
gtatctctgatgcatttttg

SEQ ID NO: 65025 - DNA, 20 bp, human
gggttttattttgagatttg

SEQ ID NO: 65026 - DNA, 20 bp, human
gtgcatgagagatagactat

SEQ ID NO: 65027 - DNA, 20 bp, human
gatttctcaaagtcccctaa

SEQ ID NO: 65028 - DNA, 20 bp, human
ggagctatgtgtctttagca

SEQ ID NO: 65029 - DNA, 20 bp, human
gcgctctctcacatgtccaa

SEQ ID NO: 65030 - DNA, 20 bp, human
ggcactggatggaggaacag

SEQ ID NO: 65031 - DNA, 20 bp, human
gctgcaagagaaggtttaga

SEQ ID NO: 65032 - DNA, 20 bp, human
gaatggcttagtgcccttag

SEQ ID NO: 65033 - DNA, 20 bp, human
gatgagaagaaaccattcaa

SEQ ID NO: 65034 - DNA, 20 bp, human
gtggaggaacagtggagatc

SEQ ID NO: 65035 - DNA, 20 bp, human
gagactatgggactctgcct

SEQ ID NO: 65036 - DNA, 20 bp, human
gggtggatcgcagagactaa

SEQ ID NO: 65037 - DNA, 20 bp, human
gtcctggcgaaagcaagacg

SEQ ID NO: 65038 - DNA, 20 bp, human
gagaggaagctactaacccc

SEQ ID NO: 65039 - DNA, 20 bp, human
ggagccgtccagatccggac

SEQ ID NO: 65040 - DNA, 20 bp, human
gggagagagccgtccagatc

SEQ ID NO: 65041 - DNA, 20 bp, human
gtccggactggtcgaaagac

SEQ ID NO: 65042 - DNA, 20 bp, human
gggctggaggtgctaccccg

SEQ ID NO: 65043 - DNA, 20 bp, human
gcgaccagtccggatctgga

SEQ ID NO: 65044 - DNA, 20 bp, human
gttgctcattgtgccttggt

SEQ ID NO: 65045 - DNA, 20 bp, human
gcctacctggagagacttac

SEQ ID NO: 65046 - DNA, 20 bp, human
gccagtgagaagctcggcaa

SEQ ID NO: 65047 - DNA, 20 bp, human
gtgagaagctcggcaagggc

SEQ ID NO: 65048 - DNA, 20 bp, human
gcccgccatgggtcgcaggt

SEQ ID NO: 65049 - DNA, 20 bp, human
gttactcccaaggccatcca

SEQ ID NO: 65050 - DNA, 20 bp, human
gcactgggaagggaattgag

SEQ ID NO: 65051 - DNA, 20 bp, human
gtatggaacccagtcctgag

SEQ ID NO: 65052 - DNA, 20 bp, human
gtgggagtaaacagagccat

SEQ ID NO: 65053 - DNA, 20 bp, human
ggcccagccgggagcaactg

SEQ ID NO: 65054 - DNA, 20 bp, human
gccgagcttctcactgggaa

SEQ ID NO: 65055 - DNA, 20 bp, human
gggaaagcacagctgtgatc

SEQ ID NO: 65056 - DNA, 20 bp, human
gtaagtgtagagtgtcgggt

SEQ ID NO: 65057 - DNA, 20 bp, human
gtacccggagaaccctgagt

SEQ ID NO: 65058 - DNA, 20 bp, human
ggagcagctgcgtggacaga

SEQ ID NO: 65059 - DNA, 20 bp, human
ggaagtaagtgtagagtgtc

SEQ ID NO: 65060 - DNA, 20 bp, human
ggcagctgctccgtccagag

SEQ ID NO: 65061 - DNA, 20 bp, human
gggtccagcacagtccaccg

SEQ ID NO: 65062 - DNA, 20 bp, human
gtggacagaaggcagcacat

SEQ ID NO: 65063 - DNA, 20 bp, human
gtgggccacggggacacgtg

SEQ ID NO: 65064 - DNA, 20 bp, human
gggacagtggtgggatgcgt

SEQ ID NO: 65065 - DNA, 20 bp, human
ggtagaccacgtcccactca

SEQ ID NO: 65066 - DNA, 20 bp, human
gcgcactgtccgggacacct

SEQ ID NO: 65067 - DNA, 20 bp, human
gcctgcctctcggcacacag

SEQ ID NO: 65068 - DNA, 20 bp, human
gcgacgctgccgatgtcccg

SEQ ID NO: 65069 - DNA, 20 bp, human
gcggtgggcatgcgagaaca

SEQ ID NO: 65070 - DNA, 20 bp, human
gagaacaaggaacccactcc

SEQ ID NO: 65071 - DNA, 20 bp, human
gacgcgaggggaaggagact

SEQ ID NO: 65072 - DNA, 20 bp, human
ggccttatcctggcatggag

SEQ ID NO: 65073 - DNA, 20 bp, human
gggcctgaggaatcgaaatc

SEQ ID NO: 65074 - DNA, 20 bp, human
gcactcccggaggggattgg

SEQ ID NO: 65075 - DNA, 20 bp, human
gaaggaacccactcccggag

SEQ ID NO: 65076 - DNA, 20 bp, human
gagccctgtggagagatggg

SEQ ID NO: 65077 - DNA, 20 bp, human
gcgctttgcgaagctaggga

SEQ ID NO: 65078 - DNA, 20 bp, human
ggagcctccctagttcaggg

SEQ ID NO: 65079 - DNA, 20 bp, human
gtcgcaaagcggcacagaca

SEQ ID NO: 65080 - DNA, 20 bp, human
gcccgaggaggaagtcactt

SEQ ID NO: 65081 - DNA, 20 bp, human
ggtgggaactgtgcttaggg

SEQ ID NO: 65082 - DNA, 20 bp, human
gccccaccctgtgtgaaagg

SEQ ID NO: 65083 - DNA, 20 bp, human
ggcccttaccatccccgagg

SEQ ID NO: 65084 - DNA, 20 bp, human
gacactgaccagattgcgag

SEQ ID NO: 65085 - DNA, 20 bp, human
gttcctaacaggcagccctg

SEQ ID NO: 65086 - DNA, 20 bp, human
gtagtcttccttgctcagag

SEQ ID NO: 65087 - DNA, 20 bp, human
ggctcagaggggatagaaaa

SEQ ID NO: 65088 - DNA, 20 bp, human
gggccctccgtcatctaaga

SEQ ID NO: 65089 - DNA, 20 bp, human
gcaccagcctaaggcatcca

SEQ ID NO: 65090 - DNA, 20 bp, human
ggaatgactaggacccacca

SEQ ID NO: 65091 - DNA, 20 bp, human
ggtatctgtacaccagccta

SEQ ID NO: 65092 - DNA, 20 bp, human
gacacacaaaacaccctggt

SEQ ID NO: 65093 - DNA, 20 bp, human
ggcacacacacaaaacaccc

SEQ ID NO: 65094 - DNA, 20 bp, human
ggttacagcaagagttactt

SEQ ID NO: 65095 - DNA, 20 bp, human
gcttccctcttagatgacgg

SEQ ID NO: 65096 - DNA, 20 bp, human
ggcaggccgagagctgagtc

SEQ ID NO: 65097 - DNA, 20 bp, human
gccccaccctgtgtgaaagg

SEQ ID NO: 65098 - DNA, 20 bp, human
ggcatgggaatcggagacca

SEQ ID NO: 65099 - DNA, 20 bp, human
gcccatggggtgacagaatg

SEQ ID NO: 65100 - DNA, 20 bp, human
gaagagcctgcgggataaag

SEQ ID NO: 65101 - DNA, 20 bp, human
gaaaggctcaaggggaagat

SEQ ID NO: 65102 - DNA, 20 bp, human
ggcagccaaaatccagactt

SEQ ID NO: 65103 - DNA, 20 bp, human
ggtgggaactgtgcttaggg

SEQ ID NO: 65104 - DNA, 20 bp, human
gtccagacttagggagcaaa

SEQ ID NO: 65105 - DNA, 20 bp, human
gagggagcaaaaggctcaag

SEQ ID NO: 65106 - DNA, 20 bp, human
ggcggagatggtacacggag

SEQ ID NO: 65107 - DNA, 20 bp, human
gcaggatgccgggcactcgt

SEQ ID NO: 65108 - DNA, 20 bp, human
gtggcgggcacccaatccca

SEQ ID NO: 65109 - DNA, 20 bp, human
gttgggtgcccgccagccaa

SEQ ID NO: 65110 - DNA, 20 bp, human
gacgctgcggagatggtaca

SEQ ID NO: 65111 - DNA, 20 bp, human
gtggagcgcgcggcacccga

SEQ ID NO: 65112 - DNA, 20 bp, human
gtggaggacctgctgttcag

SEQ ID NO: 65113 - DNA, 20 bp, human
gcgtgccccgggagcatcga

SEQ ID NO: 65114 - DNA, 20 bp, human
gtacgagagccgggacgccc

SEQ ID NO: 65115 - DNA, 20 bp, human
ggggttcagagcgaaggagg

SEQ ID NO: 65116 - DNA, 20 bp, human
ggtgaagacgccctgcacta

SEQ ID NO: 65117 - DNA, 20 bp, human
gcgaggccagcaggaggcaa

SEQ ID NO: 65118 - DNA, 20 bp, human
gagagcccggcgcttgatct

SEQ ID NO: 65119 - DNA, 20 bp, human
ggcgcttgatctgggctggg

SEQ ID NO: 65120 - DNA, 20 bp, human
gggtccgccgcaaccaggaa

SEQ ID NO: 65121 - DNA, 20 bp, human
ggagctgggcacgggcactg

SEQ ID NO: 65122 - DNA, 20 bp, human
gggctggggcgacccctggg

SEQ ID NO: 65123 - DNA, 20 bp, human
gtggggctggggcgacccct

SEQ ID NO: 65124 - DNA, 20 bp, human
gggcggaccgccctagtgca

SEQ ID NO: 65125 - DNA, 20 bp, human
gaagacgccctgcactaggg

SEQ ID NO: 65126 - DNA, 20 bp, human
gccggtaggaagagtcagag

SEQ ID NO: 65127 - DNA, 20 bp, human
ggaccagagagcccaacgcc

SEQ ID NO: 65128 - DNA, 20 bp, human
ggccacagcgacacagacct

SEQ ID NO: 65129 - DNA, 20 bp, human
gacgggcggacgaggcccta

SEQ ID NO: 65130 - DNA, 20 bp, human
ggtcttgagcaccaggcgtt

SEQ ID NO: 65131 - DNA, 20 bp, human
gtccgcgatgcagagaacca

SEQ ID NO: 65132 - DNA, 20 bp, human
ggtgctcaagactttctccg

SEQ ID NO: 65133 - DNA, 20 bp, human
gggagaagcgaccttaccac

SEQ ID NO: 65134 - DNA, 20 bp, human
gcaccaggcgttgggctctc

SEQ ID NO: 65135 - DNA, 20 bp, human
gctggttcttgttcatacct

SEQ ID NO: 65136 - DNA, 20 bp, human
ggagcctgcttgcagcccaa

SEQ ID NO: 65137 - DNA, 20 bp, human
gcattctcagcgaggccgtt

SEQ ID NO: 65138 - DNA, 20 bp, human
gaagcaggctcagagtgctg

SEQ ID NO: 65139 - DNA, 20 bp, human
gaggccgttgggctgcaagc

SEQ ID NO: 65140 - DNA, 20 bp, human
ggagtgcaccacatccagct

SEQ ID NO: 65141 - DNA, 20 bp, human
gtctccccacaaatgctcat

SEQ ID NO: 65142 - DNA, 20 bp, human
gcttctttaggactgaatga

SEQ ID NO: 65143 - DNA, 20 bp, human
gaaatgtagcattctcagcg

SEQ ID NO: 65144 - DNA, 20 bp, human
gtgaacaacaataccttatt

SEQ ID NO: 65145 - DNA, 20 bp, human
gcaccccatgagcatttgtg

SEQ ID NO: 65146 - DNA, 20 bp, human
gtgcagatggacgggacaga

SEQ ID NO: 65147 - DNA, 20 bp, human
gcgggacagaaggcagtgcc

SEQ ID NO: 65148 - DNA, 20 bp, human
gcggtcagctgcgtccttag

SEQ ID NO: 65149 - DNA, 20 bp, human
ggcgggagcccgagtgcggg

SEQ ID NO: 65150 - DNA, 20 bp, human
gtgctacggtcaagaaccgg

SEQ ID NO: 65151 - DNA, 20 bp, human
gagctgaccgggaagcgacg

SEQ ID NO: 65152 - DNA, 20 bp, human
gttagcgggagcccgagtgc

SEQ ID NO: 65153 - DNA, 20 bp, human
gagccctggagaagtagctc

SEQ ID NO: 65154 - DNA, 20 bp, human
gggtgtggaagaggagatgc

SEQ ID NO: 65155 - DNA, 20 bp, human
gggaagcgacgcggaagcca

SEQ ID NO: 65156 - DNA, 20 bp, human
gggctgacgctctcggagaa

SEQ ID NO: 65157 - DNA, 20 bp, human
ggtgtagtgagtggaaacag

SEQ ID NO: 65158 - DNA, 20 bp, human
gcgcgcggacaaggacctag

SEQ ID NO: 65159 - DNA, 20 bp, human
gcatcgaggacggacagaga

SEQ ID NO: 65160 - DNA, 20 bp, human
ggcgggcacggtcgcggcca

SEQ ID NO: 65161 - DNA, 20 bp, human
gtcgggaagcagcgctgctc

SEQ ID NO: 65162 - DNA, 20 bp, human
gttggggacacgaggaccgg

SEQ ID NO: 65163 - DNA, 20 bp, human
gacagcggcaacgcgggagg

SEQ ID NO: 65164 - DNA, 20 bp, human
gcacggtcgcggccaaggct

SEQ ID NO: 65165 - DNA, 20 bp, human
ggccacacctgaaccagaag

SEQ ID NO: 65166 - DNA, 20 bp, human
gcaggagaccaagtattatg

SEQ ID NO: 65167 - DNA, 20 bp, human
gacaactgggcagaactagc

SEQ ID NO: 65168 - DNA, 20 bp, human
gaccgactgccaggccatgt

SEQ ID NO: 65169 - DNA, 20 bp, human
gttatcgatgagctatggga

SEQ ID NO: 65170 - DNA, 20 bp, human
gttcttgtggccgcaatgtt

SEQ ID NO: 65171 - DNA, 20 bp, human
gactttaactgaacacaact

SEQ ID NO: 65172 - DNA, 20 bp, human
gggatgcatcatgagacctt

SEQ ID NO: 65173 - DNA, 20 bp, human
gccatgtgggcaaagttggg

SEQ ID NO: 65174 - DNA, 20 bp, human
gtcgagagaggaaaccctag

SEQ ID NO: 65175 - DNA, 20 bp, human
gctcctcatctgcggatact

SEQ ID NO: 65176 - DNA, 20 bp, human
gactttccaacaaggagcag

SEQ ID NO: 65177 - DNA, 20 bp, human
ggaaggcctagacctggtca

SEQ ID NO: 65178 - DNA, 20 bp, human
gcaggtctaggccttcatca

SEQ ID NO: 65179 - DNA, 20 bp, human
gaagacagcggcaacagtgc

SEQ ID NO: 65180 - DNA, 20 bp, human
gagagactgcgcaggaccca

SEQ ID NO: 65181 - DNA, 20 bp, human
gtctcttgcaagtctgtccg

SEQ ID NO: 65182 - DNA, 20 bp, human
gaagcagtgattcaaacaag

SEQ ID NO: 65183 - DNA, 20 bp, human
gccacaaagggcactgacac

SEQ ID NO: 65184 - DNA, 20 bp, human
gggtaagaaaaacgagtctt

SEQ ID NO: 65185 - DNA, 20 bp, human
gagagacccctgctccttgt

SEQ ID NO: 65186 - DNA, 20 bp, human
gagggtccaggaccgtgagt

SEQ ID NO: 65187 - DNA, 20 bp, human
gcagcttgcaatggagactc

SEQ ID NO: 65188 - DNA, 20 bp, human
gggcaggacagaggagataa

SEQ ID NO: 65189 - DNA, 20 bp, human
ggggttggggcagcttgcaa

SEQ ID NO: 65190 - DNA, 20 bp, human
ggagactctggatagccaga

SEQ ID NO: 65191 - DNA, 20 bp, human
gctgctcccactcacggtcc

SEQ ID NO: 65192 - DNA, 20 bp, human
gttcttaccaaagtccccaa

SEQ ID NO: 65193 - DNA, 20 bp, human
gctcagaaacaaacctcgtg

SEQ ID NO: 65194 - DNA, 20 bp, human
gagagggcaagcctggcaca

SEQ ID NO: 65195 - DNA, 20 bp, human
gccaggtcactaaatagaga

SEQ ID NO: 65196 - DNA, 20 bp, human
gcccgagcaggaccattgat

SEQ ID NO: 65197 - DNA, 20 bp, human
gggagagaacctgcacctgg

SEQ ID NO: 65198 - DNA, 20 bp, human
gtgcctcgggtgcctatcaa

SEQ ID NO: 65199 - DNA, 20 bp, human
gccgaggcaggaaaactcaa

SEQ ID NO: 65200 - DNA, 20 bp, human
gggcggctgctacccccctc

SEQ ID NO: 65201 - DNA, 20 bp, human
ggtgtagaccacacacagag

SEQ ID NO: 65202 - DNA, 20 bp, human
ggctgctgaggcttgtgtag

SEQ ID NO: 65203 - DNA, 20 bp, human
ggggcttaagacaaacgaag

SEQ ID NO: 65204 - DNA, 20 bp, human
gagacaaacgaagtggccgg

SEQ ID NO: 65205 - DNA, 20 bp, human
gcgcagacggagccgggaga

SEQ ID NO: 65206 - DNA, 20 bp, human
gaggctgccttcgcttctca

SEQ ID NO: 65207 - DNA, 20 bp, human
gacacaccagggctagggag

SEQ ID NO: 65208 - DNA, 20 bp, human
gggcatggttacctatatca

SEQ ID NO: 65209 - DNA, 20 bp, human
ggctagggagtgggagggta

SEQ ID NO: 65210 - DNA, 20 bp, human
gcacttaccttgagaagcga

SEQ ID NO: 65211 - DNA, 20 bp, human
gggtcacttagaaccttatt

SEQ ID NO: 65212 - DNA, 20 bp, human
gaggcagcctaaccaacttc

SEQ ID NO: 65213 - DNA, 20 bp, human
gttctaagtgaccctgatat

SEQ ID NO: 65214 - DNA, 20 bp, human
gacaaaaccggaagttggtt

SEQ ID NO: 65215 - DNA, 20 bp, human
gttgtaacaaaaccggaagt

SEQ ID NO: 65216 - DNA, 20 bp, human
gtcggaaaagatgtccgtgg

SEQ ID NO: 65217 - DNA, 20 bp, human
gcgcgtgctggtggcctcgg

SEQ ID NO: 65218 - DNA, 20 bp, human
ggtggaggcagctcttgcag

SEQ ID NO: 65219 - DNA, 20 bp, human
gttgcgggaggggagaccgg

SEQ ID NO: 65220 - DNA, 20 bp, human
ggtgggggaccgaggatcgg

SEQ ID NO: 65221 - DNA, 20 bp, human
gcgcgccacgactcctccta

SEQ ID NO: 65222 - DNA, 20 bp, human
gcgggactgagcctccgccg

SEQ ID NO: 65223 - DNA, 20 bp, human
gcaggccgctcgggccgcag

SEQ ID NO: 65224 - DNA, 20 bp, human
gggtgccgtaggaggagtcg

SEQ ID NO: 65225 - DNA, 20 bp, human
gtcccccgcgaaggtgccgt

SEQ ID NO: 65226 - DNA, 20 bp, human
gctcgatctgctccaagtag

SEQ ID NO: 65227 - DNA, 20 bp, human
gggccggagagaggccttgt

SEQ ID NO: 65228 - DNA, 20 bp, human
gagaataccaaactagggag

SEQ ID NO: 65229 - DNA, 20 bp, human
gagcgcgggtcggagtctgg

SEQ ID NO: 65230 - DNA, 20 bp, human
ggggtcggacggacgaacag

SEQ ID NO: 65231 - DNA, 20 bp, human
gtaggggctccagcgcgggt

SEQ ID NO: 65232 - DNA, 20 bp, human
gtgctgttgggactcgagag

SEQ ID NO: 65233 - DNA, 20 bp, human
ggctggcccggagaagtccg

SEQ ID NO: 65234 - DNA, 20 bp, human
gcaagtaggggctccagcgc

SEQ ID NO: 65235 - DNA, 20 bp, human
gggggcagcacacatgaggg

SEQ ID NO: 65236 - DNA, 20 bp, human
gggcatccaagagaaatggt

SEQ ID NO: 65237 - DNA, 20 bp, human
gagagaaatggtgggtccgt

SEQ ID NO: 65238 - DNA, 20 bp, human
gggaggccttagctccgggc

SEQ ID NO: 65239 - DNA, 20 bp, human
gcgccgcccgcccggagcta

SEQ ID NO: 65240 - DNA, 20 bp, human
gggcaggcggcggagcaccg

SEQ ID NO: 65241 - DNA, 20 bp, human
ggggcagtggaagcatttgg

SEQ ID NO: 65242 - DNA, 20 bp, human
gtccagggcggagagggtag

SEQ ID NO: 65243 - DNA, 20 bp, human
gcgcggggcgatgtgagtcg

SEQ ID NO: 65244 - DNA, 20 bp, human
ggatgtgtccagggcggaga

SEQ ID NO: 65245 - DNA, 20 bp, human
gatgcccgtaaggaatgagg

SEQ ID NO: 65246 - DNA, 20 bp, human
gatgtctgcggcatacaaag

SEQ ID NO: 65247 - DNA, 20 bp, human
ggcggccgggagcaggtacc

SEQ ID NO: 65248 - DNA, 20 bp, human
gcacgcccggtacctgctcc

SEQ ID NO: 65249 - DNA, 20 bp, human
gaggctgggaggacgggcag

SEQ ID NO: 65250 - DNA, 20 bp, human
ggagctcccccagagtctga

SEQ ID NO: 65251 - DNA, 20 bp, human
ggaggcagcccttcagactc

SEQ ID NO: 65252 - DNA, 20 bp, human
gggcgtgatgcgcctgtcac

SEQ ID NO: 65253 - DNA, 20 bp, human
ggatccgcagagctgcctct

SEQ ID NO: 65254 - DNA, 20 bp, human
gtgcggcatacaaagaggct

SEQ ID NO: 65255 - DNA, 20 bp, human
ggctcaggatcaggcattcc

SEQ ID NO: 65256 - DNA, 20 bp, human
gcccgggccggcgctcgtaa

SEQ ID NO: 65257 - DNA, 20 bp, human
gactaggactgggaacgggt

SEQ ID NO: 65258 - DNA, 20 bp, human
ggaagagccaggcactggag

SEQ ID NO: 65259 - DNA, 20 bp, human
gcgtaacggacaccaaaccg

SEQ ID NO: 65260 - DNA, 20 bp, human
gtccgatcggaaccgatctg

SEQ ID NO: 65261 - DNA, 20 bp, human
gaggcagctgtactaggact

SEQ ID NO: 65262 - DNA, 20 bp, human
gtaaaatcagagtcggaggg

SEQ ID NO: 65263 - DNA, 20 bp, human
gctctctcccagagcccgac

SEQ ID NO: 65264 - DNA, 20 bp, human
ggaaggcggtccaggatggc

SEQ ID NO: 65265 - DNA, 20 bp, human
gggagcgaggcagctgtact

SEQ ID NO: 65266 - DNA, 20 bp, human
ggctggcaggagggacgctc

SEQ ID NO: 65267 - DNA, 20 bp, human
gggcaggagggacgctcagg

SEQ ID NO: 65268 - DNA, 20 bp, human
gctgcggctgcgaccctggc

SEQ ID NO: 65269 - DNA, 20 bp, human
gagaggcacagacgtccctg

SEQ ID NO: 65270 - DNA, 20 bp, human
gctgtgtgggctaagagctg

SEQ ID NO: 65271 - DNA, 20 bp, human
gagctcctaatgggagagaa

SEQ ID NO: 65272 - DNA, 20 bp, human
gggaaagtgcagagccgccc

SEQ ID NO: 65273 - DNA, 20 bp, human
ggccgctgcggctgcgaccc

SEQ ID NO: 65274 - DNA, 20 bp, human
gaaagctcgtgggaccccat

SEQ ID NO: 65275 - DNA, 20 bp, human
gagagctgcggccgccgctg

SEQ ID NO: 65276 - DNA, 20 bp, human
gagagctgaaggctgcatgg

SEQ ID NO: 65277 - DNA, 20 bp, human
ggccctgtgctgttcgagga

SEQ ID NO: 65278 - DNA, 20 bp, human
gagacaggaaccacatacaa

SEQ ID NO: 65279 - DNA, 20 bp, human
gccaaagcccaatagatagg

SEQ ID NO: 65280 - DNA, 20 bp, human
gctgtgctgttcgaggaggg

SEQ ID NO: 65281 - DNA, 20 bp, human
gtttaggcccacgcctacag

SEQ ID NO: 65282 - DNA, 20 bp, human
gtcagtgagaagctttatgt

SEQ ID NO: 65283 - DNA, 20 bp, human
gctgcgtcagcttaagctgg

SEQ ID NO: 65284 - DNA, 20 bp, human
gaggcccacgcctacagggg

SEQ ID NO: 65285 - DNA, 20 bp, human
ggtaggcgtgggcctaaatg

SEQ ID NO: 65286 - DNA, 20 bp, human
ggacgcttactgaataaggt

SEQ ID NO: 65287 - DNA, 20 bp, human
ggaaagacgcttactgaata

SEQ ID NO: 65288 - DNA, 20 bp, human
gatccaacaagagtgtagta

SEQ ID NO: 65289 - DNA, 20 bp, human
gtcagcctatctcagcgtgt

SEQ ID NO: 65290 - DNA, 20 bp, human
ggaagtattaccaatacgat

SEQ ID NO: 65291 - DNA, 20 bp, human
ggacccagcaaaccaatggt

SEQ ID NO: 65292 - DNA, 20 bp, human
gctaatagactcataggctt

SEQ ID NO: 65293 - DNA, 20 bp, human
gccaaagctacccatcgtat

SEQ ID NO: 65294 - DNA, 20 bp, human
gttccatactacactcttgt

SEQ ID NO: 65295 - DNA, 20 bp, human
gcttgcctacacgctgagat

SEQ ID NO: 65296 - DNA, 20 bp, human
gggccgcggcagccgaacaa

SEQ ID NO: 65297 - DNA, 20 bp, human
gcatggtggcagtagacgag

SEQ ID NO: 65298 - DNA, 20 bp, human
ggtgcgccacgatgaggaaa

SEQ ID NO: 65299 - DNA, 20 bp, human
gctccacaaagcccagctag

SEQ ID NO: 65300 - DNA, 20 bp, human
gctttgtggagcgctgcgga

SEQ ID NO: 65301 - DNA, 20 bp, human
gtagacgagaggccgctgcg

SEQ ID NO: 65302 - DNA, 20 bp, human
gagcccagctagcggcgccc

SEQ ID NO: 65303 - DNA, 20 bp, human
gaacaagtacctgacggccg

SEQ ID NO: 65304 - DNA, 20 bp, human
ggtccggggcgccgctagct

SEQ ID NO: 65305 - DNA, 20 bp, human
gggagggtgcgtgcgggccg

SEQ ID NO: 65306 - DNA, 20 bp, human
gtcggctgccgcaaggtcac

SEQ ID NO: 65307 - DNA, 20 bp, human
ggaagacgtcatagctggag

SEQ ID NO: 65308 - DNA, 20 bp, human
gggctccagtcccataaccg

SEQ ID NO: 65309 - DNA, 20 bp, human
gggtgtctgatggccaccag

SEQ ID NO: 65310 - DNA, 20 bp, human
gatggcgcctacaacatcaa

SEQ ID NO: 65311 - DNA, 20 bp, human
gcagggtgcccgtgaccttg

SEQ ID NO: 65312 - DNA, 20 bp, human
gacgtcatagctggagcggt

SEQ ID NO: 65313 - DNA, 20 bp, human
gtccagctggagttcaacga

SEQ ID NO: 65314 - DNA, 20 bp, human
gagctggaagacgtcatagc

SEQ ID NO: 65315 - DNA, 20 bp, human
gatggccctgagccaagcca

SEQ ID NO: 65316 - DNA, 20 bp, human
ggtcccccagaagcccgggt

SEQ ID NO: 65317 - DNA, 20 bp, human
gtgacgccggctgggtctgg

SEQ ID NO: 65318 - DNA, 20 bp, human
ggtcagaggcgggtcagagc

SEQ ID NO: 65319 - DNA, 20 bp, human
gtgctgccgcgggtcagagg

SEQ ID NO: 65320 - DNA, 20 bp, human
gctgacccgcctctgacccg

SEQ ID NO: 65321 - DNA, 20 bp, human
gggtcctgccgcagccagat

SEQ ID NO: 65322 - DNA, 20 bp, human
ggaccaggaagcggcagtca

SEQ ID NO: 65323 - DNA, 20 bp, human
ggggccagccgagccgaccc

SEQ ID NO: 65324 - DNA, 20 bp, human
gccagaagcccgggtcggct

SEQ ID NO: 65325 - DNA, 20 bp, human
gaggcgggtcagagcaggca

SEQ ID NO: 65326 - DNA, 20 bp, human
gccccgtggtgaggttccac

SEQ ID NO: 65327 - DNA, 20 bp, human
gggcctgtggaacctcacca

SEQ ID NO: 65328 - DNA, 20 bp, human
gtctctctgggaacatctgg

SEQ ID NO: 65329 - DNA, 20 bp, human
gaacatctggtgggtactac

SEQ ID NO: 65330 - DNA, 20 bp, human
gggccctattccaggcccta

SEQ ID NO: 65331 - DNA, 20 bp, human
gtgcctgggaagttctctct

SEQ ID NO: 65332 - DNA, 20 bp, human
gagccctcccccccgtggtg

SEQ ID NO: 65333 - DNA, 20 bp, human
ggtactacaggccctattcc

SEQ ID NO: 65334 - DNA, 20 bp, human
gggctgaggacctaagggtt

SEQ ID NO: 65335 - DNA, 20 bp, human
gtcccaaggctgaggaccta

SEQ ID NO: 65336 - DNA, 20 bp, human
gtggctaccggccgcggcaa

SEQ ID NO: 65337 - DNA, 20 bp, human
gccgcggcaaaggcagcttg

SEQ ID NO: 65338 - DNA, 20 bp, human
gctggcggggcgtcttccag

SEQ ID NO: 65339 - DNA, 20 bp, human
ggtgatggagcgctaaccgg

SEQ ID NO: 65340 - DNA, 20 bp, human
gtggtccgcggccaggaggg

SEQ ID NO: 65341 - DNA, 20 bp, human
gggccattggctaccggccg

SEQ ID NO: 65342 - DNA, 20 bp, human
ggggatgggactgggatact

SEQ ID NO: 65343 - DNA, 20 bp, human
gtggccccaagccaagatgt

SEQ ID NO: 65344 - DNA, 20 bp, human
ggggtaggggggctagatcc

SEQ ID NO: 65345 - DNA, 20 bp, human
gtcggcgggccattggctac

SEQ ID NO: 65346 - DNA, 20 bp, human
ggcggtccccgcatccgtgt

SEQ ID NO: 65347 - DNA, 20 bp, human
gcgcggttgccagggtgaaa

SEQ ID NO: 65348 - DNA, 20 bp, human
gtctctgggcgggagctaag

SEQ ID NO: 65349 - DNA, 20 bp, human
gggcctaaagcgctgcagag

SEQ ID NO: 65350 - DNA, 20 bp, human
ggacgacgaaccgtgtgagg

SEQ ID NO: 65351 - DNA, 20 bp, human
gggcaaccgcggcgtgacta

SEQ ID NO: 65352 - DNA, 20 bp, human
gcgcccggccgctctctggg

SEQ ID NO: 65353 - DNA, 20 bp, human
gagaggccagcccgagtcac

SEQ ID NO: 65354 - DNA, 20 bp, human
ggtctgggcgcggacgggtg

SEQ ID NO: 65355 - DNA, 20 bp, human
ggaaagggcggcccgcagaa

SEQ ID NO: 65356 - DNA, 20 bp, human
gtagcctgtggggcatgcag

SEQ ID NO: 65357 - DNA, 20 bp, human
gcatgcagaggtcactagga

SEQ ID NO: 65358 - DNA, 20 bp, human
gtcctttaactcagaggacc

SEQ ID NO: 65359 - DNA, 20 bp, human
gatgtgagaggctctgatga

SEQ ID NO: 65360 - DNA, 20 bp, human
ggcgaattcttgctttaaga

SEQ ID NO: 65361 - DNA, 20 bp, human
gcccattagttagaaccatt

SEQ ID NO: 65362 - DNA, 20 bp, human
gaccatttggtagaacagtt

SEQ ID NO: 65363 - DNA, 20 bp, human
gaccaaatggttctaactaa

SEQ ID NO: 65364 - DNA, 20 bp, human
gaataggcaggggtagcctg

SEQ ID NO: 65365 - DNA, 20 bp, human
gggctctgatgaaggcagac

SEQ ID NO: 65366 - DNA, 20 bp, human
gaggcaaggcagccgaccac

SEQ ID NO: 65367 - DNA, 20 bp, human
gagatgccaagactcacctg

SEQ ID NO: 65368 - DNA, 20 bp, human
ggccgaccacaggtgagtct

SEQ ID NO: 65369 - DNA, 20 bp, human
ggccaagactcacctgtggt

SEQ ID NO: 65370 - DNA, 20 bp, human
gagctgtcaccacttgaaaa

SEQ ID NO: 65371 - DNA, 20 bp, human
gtcagtctacagctcttgcc

SEQ ID NO: 65372 - DNA, 20 bp, human
gtttcagaagagaggcatat

SEQ ID NO: 65373 - DNA, 20 bp, human
gggcatctaccgttttcaag

SEQ ID NO: 65374 - DNA, 20 bp, human
gcagatttgtcaggacatgg

SEQ ID NO: 65375 - DNA, 20 bp, human
gcaacctggcttgtaaaata

SEQ ID NO: 65376 - DNA, 20 bp, human
gtcagagaaccggaatccaa

SEQ ID NO: 65377 - DNA, 20 bp, human
ggggtcatgtgacccaccaa

SEQ ID NO: 65378 - DNA, 20 bp, human
gcattcctcgggaggtcaga

SEQ ID NO: 65379 - DNA, 20 bp, human
ggaatgccagcaaagagacc

SEQ ID NO: 65380 - DNA, 20 bp, human
gatctgacttgagaactggt

SEQ ID NO: 65381 - DNA, 20 bp, human
ggcaaatgcaggaagaaatc

SEQ ID NO: 65382 - DNA, 20 bp, human
ggggagggggaacaactgca

SEQ ID NO: 65383 - DNA, 20 bp, human
gcagttcaatggcattcctc

SEQ ID NO: 65384 - DNA, 20 bp, human
gagagatctgacttgagaac

SEQ ID NO: 65385 - DNA, 20 bp, human
gattcaggacttcggtcaag

SEQ ID NO: 65386 - DNA, 20 bp, human
gaggcaggagggatctggac

SEQ ID NO: 65387 - DNA, 20 bp, human
gcaggagggatctggaccgg

SEQ ID NO: 65388 - DNA, 20 bp, human
gagggaaacagcggtcccac

SEQ ID NO: 65389 - DNA, 20 bp, human
gggagaaatagcctccgcgg

SEQ ID NO: 65390 - DNA, 20 bp, human
ggccagccacttacccccag

SEQ ID NO: 65391 - DNA, 20 bp, human
gcctggagaaatagcctccg

SEQ ID NO: 65392 - DNA, 20 bp, human
gtgaggggccgcgcagatga

SEQ ID NO: 65393 - DNA, 20 bp, human
ggtgggaagatccaaatctc

SEQ ID NO: 65394 - DNA, 20 bp, human
gggttacaggtcctaatgtt

SEQ ID NO: 65395 - DNA, 20 bp, human
gacttacccccagaggagag

SEQ ID NO: 65396 - DNA, 20 bp, human
gtcaggttaagcataatgaa

SEQ ID NO: 65397 - DNA, 20 bp, human
ggaacaacgcctattcctaa

SEQ ID NO: 65398 - DNA, 20 bp, human
gtagagaagaaagacgacag

SEQ ID NO: 65399 - DNA, 20 bp, human
gtcagggcctaacagaaatc

SEQ ID NO: 65400 - DNA, 20 bp, human
gttcttactacactcttatt

SEQ ID NO: 65401 - DNA, 20 bp, human
gataatgaaaggcatacgtt

SEQ ID NO: 65402 - DNA, 20 bp, human
ggcttaacctgatttctgtt

SEQ ID NO: 65403 - DNA, 20 bp, human
gaattttgtctccacaataa

SEQ ID NO: 65404 - DNA, 20 bp, human
gggcttatatacgtactttg

SEQ ID NO: 65405 - DNA, 20 bp, human
gcttcgtagaaaaatagaag

SEQ ID NO: 65406 - DNA, 20 bp, human
gtccggacagagggacaacg

SEQ ID NO: 65407 - DNA, 20 bp, human
ggtgctagagaaggagagcg

SEQ ID NO: 65408 - DNA, 20 bp, human
gcctggtcaggtccggacag

SEQ ID NO: 65409 - DNA, 20 bp, human
ggacaacggggtgctagaga

SEQ ID NO: 65410 - DNA, 20 bp, human
gtgagtggccgcaagctggg

SEQ ID NO: 65411 - DNA, 20 bp, human
ggctggtgaccagggaaaac

SEQ ID NO: 65412 - DNA, 20 bp, human
ggcgccgaggtacagctcca

SEQ ID NO: 65413 - DNA, 20 bp, human
gggcagggatcgccacacac

SEQ ID NO: 65414 - DNA, 20 bp, human
gggccattcctggtcaggtc

SEQ ID NO: 65415 - DNA, 20 bp, human
ggcccccgggcgccgcaaga

SEQ ID NO: 65416 - DNA, 20 bp, human
gcgcgcgtcgcagaggccag

SEQ ID NO: 65417 - DNA, 20 bp, human
ggcggagggcgcagcgatcc

SEQ ID NO: 65418 - DNA, 20 bp, human
ggtgcccagggtaagcgagt

SEQ ID NO: 65419 - DNA, 20 bp, human
gcgcgaggcaccagccgggt

SEQ ID NO: 65420 - DNA, 20 bp, human
gactgcggtcctccatgaac

SEQ ID NO: 65421 - DNA, 20 bp, human
gctcgcgcggaccatcctgg

SEQ ID NO: 65422 - DNA, 20 bp, human
gggccgcccgcgcgattcaa

SEQ ID NO: 65423 - DNA, 20 bp, human
gactccgggatggagaggag

SEQ ID NO: 65424 - DNA, 20 bp, human
gcgagcggcgcgcgtcgcag

SEQ ID NO: 65425 - DNA, 20 bp, human
gtggaggaccgcagtgccca

SEQ ID NO: 65426 - DNA, 20 bp, human
gggagacctggaccagacca

SEQ ID NO: 65427 - DNA, 20 bp, human
gctccgaggctggcgatcgg

SEQ ID NO: 65428 - DNA, 20 bp, human
gtctggtccaggtctcctgg

SEQ ID NO: 65429 - DNA, 20 bp, human
ggcgagctgtaagcggaggt

SEQ ID NO: 65430 - DNA, 20 bp, human
gggcggcagcgagctgtaag

SEQ ID NO: 65431 - DNA, 20 bp, human
gtcctggggatgctctcccg

SEQ ID NO: 65432 - DNA, 20 bp, human
gaccccgggagagcatcccc

SEQ ID NO: 65433 - DNA, 20 bp, human
gtccaccccagcacacccca

SEQ ID NO: 65434 - DNA, 20 bp, human
gggaggtcgcatttcctccg

SEQ ID NO: 65435 - DNA, 20 bp, human
ggagaagagagcgagtctga

SEQ ID NO: 65436 - DNA, 20 bp, human
ggcgaacgcagagacggcag

SEQ ID NO: 65437 - DNA, 20 bp, human
gcgcatggcgaacgcagaga

SEQ ID NO: 65438 - DNA, 20 bp, human
gaagcccacggcccaagcca

SEQ ID NO: 65439 - DNA, 20 bp, human
gacggagatgaagagagctc

SEQ ID NO: 65440 - DNA, 20 bp, human
gacggtcgcggctagaaccc

SEQ ID NO: 65441 - DNA, 20 bp, human
gcctgtagcaggcaaagcca

SEQ ID NO: 65442 - DNA, 20 bp, human
gagctccggcactatcggga

SEQ ID NO: 65443 - DNA, 20 bp, human
ggcgttcgccatgcgtcccg

SEQ ID NO: 65444 - DNA, 20 bp, human
gagagagctccggcactatc

SEQ ID NO: 65445 - DNA, 20 bp, human
gatggagctcacgaagccca

SEQ ID NO: 65446 - DNA, 20 bp, human
gagcccaggacaggtcacat

SEQ ID NO: 65447 - DNA, 20 bp, human
gcttccgagggagtatcacg

SEQ ID NO: 65448 - DNA, 20 bp, human
gggacaggtcacatgggtgg

SEQ ID NO: 65449 - DNA, 20 bp, human
gctaccccgtgatactccct

SEQ ID NO: 65450 - DNA, 20 bp, human
gggagctcacgaaagaggtg

SEQ ID NO: 65451 - DNA, 20 bp, human
ggatgcgaaaaccctctggt

SEQ ID NO: 65452 - DNA, 20 bp, human
gccgctgccgcagtgcgtag

SEQ ID NO: 65453 - DNA, 20 bp, human
gcctgaggggtggaatggag

SEQ ID NO: 65454 - DNA, 20 bp, human
ggggctttgggtagcataag

SEQ ID NO: 65455 - DNA, 20 bp, human
gcaggtcacatgggtggcgg

SEQ ID NO: 65456 - DNA, 20 bp, human
gcggccaaggccaggactcg

SEQ ID NO: 65457 - DNA, 20 bp, human
gggtcccggcggcagaaata

SEQ ID NO: 65458 - DNA, 20 bp, human
gaaggccaggactcgaggag

SEQ ID NO: 65459 - DNA, 20 bp, human
gggagggagggagcaccccg

SEQ ID NO: 65460 - DNA, 20 bp, human
gcggtccccaccgtagaccc

SEQ ID NO: 65461 - DNA, 20 bp, human
ggtggccggggtctacggtg

SEQ ID NO: 65462 - DNA, 20 bp, human
gtcacgggctccggtcccgg

SEQ ID NO: 65463 - DNA, 20 bp, human
ggtccttcggctggtttctc

SEQ ID NO: 65464 - DNA, 20 bp, human
gcgggctgtcggcgggtccc

SEQ ID NO: 65465 - DNA, 20 bp, human
gggcagggctaccccggcca

SEQ ID NO: 65466 - DNA, 20 bp, human
gttcagcaccgacagcacag

SEQ ID NO: 65467 - DNA, 20 bp, human
gtggtgaagcgggtcccaca

SEQ ID NO: 65468 - DNA, 20 bp, human
ggctgaacctgagacgcgag

SEQ ID NO: 65469 - DNA, 20 bp, human
gggaggagcgagaatcagcc

SEQ ID NO: 65470 - DNA, 20 bp, human
ggcctgaatgagcgcccagg

SEQ ID NO: 65471 - DNA, 20 bp, human
gcagttgctccagcacctga

SEQ ID NO: 65472 - DNA, 20 bp, human
ggggtcccacagggcacaga

SEQ ID NO: 65473 - DNA, 20 bp, human
ggccacctgggcgctcattc

SEQ ID NO: 65474 - DNA, 20 bp, human
gggagtgtggtatcggacgt

SEQ ID NO: 65475 - DNA, 20 bp, human
gttcagtgactgagacaaac

SEQ ID NO: 65476 - DNA, 20 bp, human
ggagaggagcatctggatca

SEQ ID NO: 65477 - DNA, 20 bp, human
gctgcccagagaggagcatc

SEQ ID NO: 65478 - DNA, 20 bp, human
gctcctgccactgactgaaa

SEQ ID NO: 65479 - DNA, 20 bp, human
ggtgctcccccctgaaaatg

SEQ ID NO: 65480 - DNA, 20 bp, human
gcgggtcgtcttcccaggat

SEQ ID NO: 65481 - DNA, 20 bp, human
gcatgctgggccacctcgtg

SEQ ID NO: 65482 - DNA, 20 bp, human
gtgtgtgaggccacacgagg

SEQ ID NO: 65483 - DNA, 20 bp, human
gcagcggctctgcccatcct

SEQ ID NO: 65484 - DNA, 20 bp, human
ggcagatctctgggcctcaa

SEQ ID NO: 65485 - DNA, 20 bp, human
gcaagcatctagggctgatg

SEQ ID NO: 65486 - DNA, 20 bp, human
gcagcaagcgccaaccgtgg

SEQ ID NO: 65487 - DNA, 20 bp, human
gagctcactgagaaggtctc

SEQ ID NO: 65488 - DNA, 20 bp, human
gctcagtgagctcttacagg

SEQ ID NO: 65489 - DNA, 20 bp, human
ggaaggtctgcggcctcacc

SEQ ID NO: 65490 - DNA, 20 bp, human
gaaccagcaagcgccaaccg

SEQ ID NO: 65491 - DNA, 20 bp, human
ggaacagaacccgccacggt

SEQ ID NO: 65492 - DNA, 20 bp, human
gcaggtcgtaaaggtagcga

SEQ ID NO: 65493 - DNA, 20 bp, human
ggggttctgttccaagctgt

SEQ ID NO: 65494 - DNA, 20 bp, human
gcttctcagtgagctcttac

SEQ ID NO: 65495 - DNA, 20 bp, human
gtggcgcttgctggtttcgg

SEQ ID NO: 65496 - DNA, 20 bp, human
gtctctggcgcagaaagtcg

SEQ ID NO: 65497 - DNA, 20 bp, human
gctaggagggagcattctca

SEQ ID NO: 65498 - DNA, 20 bp, human
gtttccagaagggcgcaggg

SEQ ID NO: 65499 - DNA, 20 bp, human
gaggtttccgaggacttctc

SEQ ID NO: 65500 - DNA, 20 bp, human
gaggctgctcgaggtttccg

SEQ ID NO: 65501 - DNA, 20 bp, human
gggcccgcccgcgctcacca

SEQ ID NO: 65502 - DNA, 20 bp, human
gagaccacaagcgacccgca

SEQ ID NO: 65503 - DNA, 20 bp, human
gcgcgggcgggcctaagcgg

SEQ ID NO: 65504 - DNA, 20 bp, human
gaggcgggagagcccgcggg

SEQ ID NO: 65505 - DNA, 20 bp, human
gggaaaatggaggctgctcg

SEQ ID NO: 65506 - DNA, 20 bp, human
ggaagtcggtgcggtagcga

SEQ ID NO: 65507 - DNA, 20 bp, human
gcacacgggcgaagtcggtg

SEQ ID NO: 65508 - DNA, 20 bp, human
ggcgagcacacgggcgaagt

SEQ ID NO: 65509 - DNA, 20 bp, human
gcaagtgcaggcgagcacac

SEQ ID NO: 65510 - DNA, 20 bp, human
gtagcggaagaagttctcca

SEQ ID NO: 65511 - DNA, 20 bp, human
gtggcgggcagcgcaagtgc

SEQ ID NO: 65512 - DNA, 20 bp, human
ggtgcgatgaaaccggaagt

SEQ ID NO: 65513 - DNA, 20 bp, human
gcagctggtacagatccagc

SEQ ID NO: 65514 - DNA, 20 bp, human
gatagacaggtacaggtagg

SEQ ID NO: 65515 - DNA, 20 bp, human
gaagaatggcggatagtgaa

SEQ ID NO: 65516 - DNA, 20 bp, human
ggaagccctacgggaagaga

SEQ ID NO: 65517 - DNA, 20 bp, human
ggtgcggtcgggtaaacaga

SEQ ID NO: 65518 - DNA, 20 bp, human
gggactcaccagagagaggt

SEQ ID NO: 65519 - DNA, 20 bp, human
gcaagcggagaggaaatcgg

SEQ ID NO: 65520 - DNA, 20 bp, human
ggtcgaaatagaagccctac

SEQ ID NO: 65521 - DNA, 20 bp, human
gggcaacaatggttagcggg

SEQ ID NO: 65522 - DNA, 20 bp, human
ggcctccatctcttcccgta

SEQ ID NO: 65523 - DNA, 20 bp, human
gagcgggaggcgaggccaag

SEQ ID NO: 65524 - DNA, 20 bp, human
gcggagaggaaatcggaggg

SEQ ID NO: 65525 - DNA, 20 bp, human
gcgcagttcggcggtcccgc

SEQ ID NO: 65526 - DNA, 20 bp, human
gttccccacttccaaggagg

SEQ ID NO: 65527 - DNA, 20 bp, human
ggcacgcggagaagctgatg

SEQ ID NO: 65528 - DNA, 20 bp, human
ggcgtgctcggtctcctccc

SEQ ID NO: 65529 - DNA, 20 bp, human
ggcccgaccccacgccaaga

SEQ ID NO: 65530 - DNA, 20 bp, human
gaccccacgccaagagggcc

SEQ ID NO: 65531 - DNA, 20 bp, human
ggactggtgaaggaaatacc

SEQ ID NO: 65532 - DNA, 20 bp, human
ggcgcagagacgccagcgaa

SEQ ID NO: 65533 - DNA, 20 bp, human
gtcatcccgggagaagtaat

SEQ ID NO: 65534 - DNA, 20 bp, human
gttcaaggccacgtcatccc

SEQ ID NO: 65535 - DNA, 20 bp, human
gtacttctcccgggatgacg

SEQ ID NO: 65536 - DNA, 20 bp, human
gcagcttgcggtggcgaagg

SEQ ID NO: 65537 - DNA, 20 bp, human
gctgagaatccggtaaactg

SEQ ID NO: 65538 - DNA, 20 bp, human
ggtggcgaaggcggctttag

SEQ ID NO: 65539 - DNA, 20 bp, human
ggaacgagagcgcgaagcta

SEQ ID NO: 65540 - DNA, 20 bp, human
gggacctggagatattagag

SEQ ID NO: 65541 - DNA, 20 bp, human
gtctcgttcctcggcagtcg

SEQ ID NO: 65542 - DNA, 20 bp, human
gggatctacgcagcttgcgg

SEQ ID NO: 65543 - DNA, 20 bp, human
ggcttcgcgctctcgttcct

SEQ ID NO: 65544 - DNA, 20 bp, human
gaagcgcaccccgactgccg

SEQ ID NO: 65545 - DNA, 20 bp, human
gacgcagcttgcggtggcga

SEQ ID NO: 65546 - DNA, 20 bp, human
gtccacccgaatgcccgggg

SEQ ID NO: 65547 - DNA, 20 bp, human
gaaacgggcgacaagtccta

SEQ ID NO: 65548 - DNA, 20 bp, human
ggaccaccgggtacccctcc

SEQ ID NO: 65549 - DNA, 20 bp, human
gaggggaccagtagacgggg

SEQ ID NO: 65550 - DNA, 20 bp, human
gcccataggcttgccccccc

SEQ ID NO: 65551 - DNA, 20 bp, human
gtagctccatcgggaccacc

SEQ ID NO: 65552 - DNA, 20 bp, human
gtgtcgcagcgtggcaaact

SEQ ID NO: 65553 - DNA, 20 bp, human
gccacgctgcgacagcccat

SEQ ID NO: 65554 - DNA, 20 bp, human
gtcccggcccgccggaacct

SEQ ID NO: 65555 - DNA, 20 bp, human
gcaccctgctccgaaaacta

SEQ ID NO: 65556 - DNA, 20 bp, human
gagacagcgggagtggttgg

SEQ ID NO: 65557 - DNA, 20 bp, human
gcaggcgcggggaacaccaa

SEQ ID NO: 65558 - DNA, 20 bp, human
gcctgcccctggagacctga

SEQ ID NO: 65559 - DNA, 20 bp, human
gtggcacaagccggtcccgg

SEQ ID NO: 65560 - DNA, 20 bp, human
ggcgcggggaacaccaatgg

SEQ ID NO: 65561 - DNA, 20 bp, human
gtgaggccaggcacttccgg

SEQ ID NO: 65562 - DNA, 20 bp, human
gctgctgcgcgtgcagacag

SEQ ID NO: 65563 - DNA, 20 bp, human
gagcgtgctgacaagccagg

SEQ ID NO: 65564 - DNA, 20 bp, human
gcactcagcgagcgcgacag

SEQ ID NO: 65565 - DNA, 20 bp, human
gccgaggccaggaccgagga

SEQ ID NO: 65566 - DNA, 20 bp, human
gcggaccagagcaggtatgg

SEQ ID NO: 65567 - DNA, 20 bp, human
ggcaggagcgtcgggtgggt

SEQ ID NO: 65568 - DNA, 20 bp, human
gctaggtagtgtgcggagag

SEQ ID NO: 65569 - DNA, 20 bp, human
gggccaccaggagcaacctg

SEQ ID NO: 65570 - DNA, 20 bp, human
gtgggcaagaagggcaaagt

SEQ ID NO: 65571 - DNA, 20 bp, human
gacttgtgcggttccaagtg

SEQ ID NO: 65572 - DNA, 20 bp, human
gctgcaggagaggtacataa

SEQ ID NO: 65573 - DNA, 20 bp, human
gacctctcctgcagaagggg

SEQ ID NO: 65574 - DNA, 20 bp, human
gcttgaaagcagatcgggaa

SEQ ID NO: 65575 - DNA, 20 bp, human
gtttccaccatgggcaagaa

SEQ ID NO: 65576 - DNA, 20 bp, human
ggcggtccacacttacctgc

SEQ ID NO: 65577 - DNA, 20 bp, human
gtagcggcctactcagtcag

SEQ ID NO: 65578 - DNA, 20 bp, human
ggaggaagtctctgaacagg

SEQ ID NO: 65579 - DNA, 20 bp, human
ggtctctgaacaggcggcag

SEQ ID NO: 65580 - DNA, 20 bp, human
gtgagaggaagtctctgaac

SEQ ID NO: 65581 - DNA, 20 bp, human
gggctcttatagtgcaacca

SEQ ID NO: 65582 - DNA, 20 bp, human
gagagcccggcaggtaagtg

SEQ ID NO: 65583 - DNA, 20 bp, human
gcacgcgtcggggttctaag

SEQ ID NO: 65584 - DNA, 20 bp, human
ggaatgtaatagagcttcga

SEQ ID NO: 65585 - DNA, 20 bp, human
gcacgcgagtgccgcagaag

SEQ ID NO: 65586 - DNA, 20 bp, human
gagaggggttcgggcctggg

SEQ ID NO: 65587 - DNA, 20 bp, human
gtacgggtccccaagcggag

SEQ ID NO: 65588 - DNA, 20 bp, human
gccggctacgggtccccaag

SEQ ID NO: 65589 - DNA, 20 bp, human
gggtccccaagcggagcggg

SEQ ID NO: 65590 - DNA, 20 bp, human
gcaaccccaggcggaagtgg

SEQ ID NO: 65591 - DNA, 20 bp, human
ggcaggagcacgagatcccg

SEQ ID NO: 65592 - DNA, 20 bp, human
gcgggactcctcgcaaatgt

SEQ ID NO: 65593 - DNA, 20 bp, human
gccccgcgctagctacactg

SEQ ID NO: 65594 - DNA, 20 bp, human
gggcatcaccagacaacccc

SEQ ID NO: 65595 - DNA, 20 bp, human
gccgggcctgggcctcgcag

SEQ ID NO: 65596 - DNA, 20 bp, human
gccggccgcgacctcatccc

SEQ ID NO: 65597 - DNA, 20 bp, human
ggcacctgcgcgttaagagt

SEQ ID NO: 65598 - DNA, 20 bp, human
gagtgggccgcgtcgctgag

SEQ ID NO: 65599 - DNA, 20 bp, human
ggtcggcccactcctccggg

SEQ ID NO: 65600 - DNA, 20 bp, human
gagaggtcggcccactcctc

SEQ ID NO: 65601 - DNA, 20 bp, human
gggctccggggatgaggtcg

SEQ ID NO: 65602 - DNA, 20 bp, human
gcgctgaggggtagcgatgc

SEQ ID NO: 65603 - DNA, 20 bp, human
gggctcgggcggcaaacagg

SEQ ID NO: 65604 - DNA, 20 bp, human
ggcgcgcttcttccacccgg

SEQ ID NO: 65605 - DNA, 20 bp, human
ggcaacagcgcgggacccgc

SEQ ID NO: 65606 - DNA, 20 bp, human
gcgcggcgcggcatactcag

SEQ ID NO: 65607 - DNA, 20 bp, human
ggccgcgggagcctgcagag

SEQ ID NO: 65608 - DNA, 20 bp, human
ggcatactcagcggcagaga

SEQ ID NO: 65609 - DNA, 20 bp, human
gtgggaggtgaaaccgacga

SEQ ID NO: 65610 - DNA, 20 bp, human
gacgcgggtaacgcagtggg

SEQ ID NO: 65611 - DNA, 20 bp, human
gcgaaacgcgggtaacgcag

SEQ ID NO: 65612 - DNA, 20 bp, human
gcggaagaacagcgctcccg

SEQ ID NO: 65613 - DNA, 20 bp, human
ggtgctgcctgcaccctcgt

SEQ ID NO: 65614 - DNA, 20 bp, human
gaaccaggcccgctgggtgg

SEQ ID NO: 65615 - DNA, 20 bp, human
gcggcctgcgccgggacatg

SEQ ID NO: 65616 - DNA, 20 bp, human
gcaggtacgtcagtccgcga

SEQ ID NO: 65617 - DNA, 20 bp, human
gtccgccgagcgccgggcga

SEQ ID NO: 65618 - DNA, 20 bp, human
gggcgctgcggcgaccctcg

SEQ ID NO: 65619 - DNA, 20 bp, human
ggccgtcgcccggcgctcgg

SEQ ID NO: 65620 - DNA, 20 bp, human
gggagcgtagaaacacctgt

SEQ ID NO: 65621 - DNA, 20 bp, human
gctctcagtttacccggcca

SEQ ID NO: 65622 - DNA, 20 bp, human
gagagcagcgccggcatcca

SEQ ID NO: 65623 - DNA, 20 bp, human
gggtgcaccggaaagctgag

SEQ ID NO: 65624 - DNA, 20 bp, human
gtgtgcataatactgagccc

SEQ ID NO: 65625 - DNA, 20 bp, human
ggagcgggctctttaacgcg

SEQ ID NO: 65626 - DNA, 20 bp, human
ggcttgagttccgcagagag

SEQ ID NO: 65627 - DNA, 20 bp, human
ggtaaggcaggaggcaggta

SEQ ID NO: 65628 - DNA, 20 bp, human
gtagggtcaaggtcagagca

SEQ ID NO: 65629 - DNA, 20 bp, human
gggccctggccgctcacctt

SEQ ID NO: 65630 - DNA, 20 bp, human
gcagggcccgaagtggtatc

SEQ ID NO: 65631 - DNA, 20 bp, human
gtcggagggggtgctcgaag

SEQ ID NO: 65632 - DNA, 20 bp, human
ggtggggaccactccagaat

SEQ ID NO: 65633 - DNA, 20 bp, human
gccacctccaaaccttagta

SEQ ID NO: 65634 - DNA, 20 bp, human
gcgaagtggtatctgggacg

SEQ ID NO: 65635 - DNA, 20 bp, human
ggtcgccatgataccgccag

SEQ ID NO: 65636 - DNA, 20 bp, human
gtggagacgacaccccaggg

SEQ ID NO: 65637 - DNA, 20 bp, human
ggccagaccgcttccgagaa

SEQ ID NO: 65638 - DNA, 20 bp, human
gccgcgtccagtcaaggtaa

SEQ ID NO: 65639 - DNA, 20 bp, human
ggtcgcgaccgagctccccg

SEQ ID NO: 65640 - DNA, 20 bp, human
gctgtccccgttctcggaag

SEQ ID NO: 65641 - DNA, 20 bp, human
gacgacaccccagggtggtt

SEQ ID NO: 65642 - DNA, 20 bp, human
gcccgttctcggaagcggtc

SEQ ID NO: 65643 - DNA, 20 bp, human
gctgggctccggaaggggaa

SEQ ID NO: 65644 - DNA, 20 bp, human
ggccttcctgggctccggaa

SEQ ID NO: 65645 - DNA, 20 bp, human
gtctggggcctaaccaccct

SEQ ID NO: 65646 - DNA, 20 bp, human
gagcgcgtagagcagctcgg

SEQ ID NO: 65647 - DNA, 20 bp, human
gaaaagcgccgaaccctcgg

SEQ ID NO: 65648 - DNA, 20 bp, human
gcaccatggcccggcagacg

SEQ ID NO: 65649 - DNA, 20 bp, human
gccgggaggacagcccgtgt

SEQ ID NO: 65650 - DNA, 20 bp, human
ggggccatggtggcgctgaa

SEQ ID NO: 65651 - DNA, 20 bp, human
gctcgggggacagcagtgcg

SEQ ID NO: 65652 - DNA, 20 bp, human
gagggaactgagacctcgtg

SEQ ID NO: 65653 - DNA, 20 bp, human
gggcctggtccgggcatcgc

SEQ ID NO: 65654 - DNA, 20 bp, human
gtggggcacggggacgagat

SEQ ID NO: 65655 - DNA, 20 bp, human
gcgggcggcgccgaccccga

SEQ ID NO: 65656 - DNA, 20 bp, human
gccccgccctgtgaagggat

SEQ ID NO: 65657 - DNA, 20 bp, human
gaggctcctatcccttcaca

SEQ ID NO: 65658 - DNA, 20 bp, human
gggtttagccagaactggaa

SEQ ID NO: 65659 - DNA, 20 bp, human
gcactgcagctgcaacagtc

SEQ ID NO: 65660 - DNA, 20 bp, human
gagactcccagagcacccca

SEQ ID NO: 65661 - DNA, 20 bp, human
ggaaatctctggtccacctc

SEQ ID NO: 65662 - DNA, 20 bp, human
gagcaccccaaggagacaac

SEQ ID NO: 65663 - DNA, 20 bp, human
gctcctatcccttcacaggg

SEQ ID NO: 65664 - DNA, 20 bp, human
gaaagtggtttagccagaac

SEQ ID NO: 65665 - DNA, 20 bp, human
gatccagctccagagcacct

SEQ ID NO: 65666 - DNA, 20 bp, human
gaggccctggttgctatggg

SEQ ID NO: 65667 - DNA, 20 bp, human
gtcagctgctagcaggacca

SEQ ID NO: 65668 - DNA, 20 bp, human
ggctgaggccctggttgcta

SEQ ID NO: 65669 - DNA, 20 bp, human
gcagggcctcagctccatgg

SEQ ID NO: 65670 - DNA, 20 bp, human
gtggacaacggcttcatggg

SEQ ID NO: 65671 - DNA, 20 bp, human
gcagccacctgtccccccca

SEQ ID NO: 65672 - DNA, 20 bp, human
gggaggctcgccacggtcgg

SEQ ID NO: 65673 - DNA, 20 bp, human
ggtagcagcaacaggaacct

SEQ ID NO: 65674 - DNA, 20 bp, human
gtgccccgcacccccgaccg

SEQ ID NO: 65675 - DNA, 20 bp, human
ggctccatgggggggacagg

SEQ ID NO: 65676 - DNA, 20 bp, human
gggcctcaaacggtaggtaa

SEQ ID NO: 65677 - DNA, 20 bp, human
gtccaggcgtcggtactcag

SEQ ID NO: 65678 - DNA, 20 bp, human
gcgcggagaagagtaactgg

SEQ ID NO: 65679 - DNA, 20 bp, human
gggacatggcctcaaacggt

SEQ ID NO: 65680 - DNA, 20 bp, human
gtgctcagtcctccaggcgt

SEQ ID NO: 65681 - DNA, 20 bp, human
gccgcggcttcccgccacag

SEQ ID NO: 65682 - DNA, 20 bp, human
gtgcagcactgcgacaaagc

SEQ ID NO: 65683 - DNA, 20 bp, human
gttgtcgcagtgctgcatcc

SEQ ID NO: 65684 - DNA, 20 bp, human
gcgtcggtactcagcggtgt

SEQ ID NO: 65685 - DNA, 20 bp, human
ggcgcggacatggcctcaaa

SEQ ID NO: 65686 - DNA, 20 bp, human
gacaggctgcgcggagggga

SEQ ID NO: 65687 - DNA, 20 bp, human
gcctcgctgccagtccggac

SEQ ID NO: 65688 - DNA, 20 bp, human
gccgcgcagcctgtccggac

SEQ ID NO: 65689 - DNA, 20 bp, human
gcggagcgcaccctccgcaa

SEQ ID NO: 65690 - DNA, 20 bp, human
gtggaagagtccagtatcag

SEQ ID NO: 65691 - DNA, 20 bp, human
gggcgtccggctatccggcc

SEQ ID NO: 65692 - DNA, 20 bp, human
gcggacgcctggcgttccag

SEQ ID NO: 65693 - DNA, 20 bp, human
gcgcaaaggcaggccacatc

SEQ ID NO: 65694 - DNA, 20 bp, human
gtcagcggaacttacaggag

SEQ ID NO: 65695 - DNA, 20 bp, human
gcggccgcccctggaacgcc

SEQ ID NO: 65696 - DNA, 20 bp, human
gctggggaggaggccgatcg

SEQ ID NO: 65697 - DNA, 20 bp, human
ggcccaggcttgggctcata

SEQ ID NO: 65698 - DNA, 20 bp, human
gatggacggccgcggacctg

SEQ ID NO: 65699 - DNA, 20 bp, human
gcgccccgcaaaggcagatt

SEQ ID NO: 65700 - DNA, 20 bp, human
gccgaagagccgatcaggag

SEQ ID NO: 65701 - DNA, 20 bp, human
gctctgctggagcccggaga

SEQ ID NO: 65702 - DNA, 20 bp, human
ggaagctgcgctgcattctg

SEQ ID NO: 65703 - DNA, 20 bp, human
ggaccccgcgctccttctcc

SEQ ID NO: 65704 - DNA, 20 bp, human
gcccctgctcggtacagaga

SEQ ID NO: 65705 - DNA, 20 bp, human
gtccagcagaggctccggcc

SEQ ID NO: 65706 - DNA, 20 bp, human
gcgcgcgcgctgctcttcta

SEQ ID NO: 65707 - DNA, 20 bp, human
gccggccgccatgtccactc

SEQ ID NO: 65708 - DNA, 20 bp, human
gccgagcgctgagggactcg

SEQ ID NO: 65709 - DNA, 20 bp, human
gcgacagcgggtaatccgag

SEQ ID NO: 65710 - DNA, 20 bp, human
ggtggaggagcgcccagctc

SEQ ID NO: 65711 - DNA, 20 bp, human
gggctccaccacagcagtac

SEQ ID NO: 65712 - DNA, 20 bp, human
ggacactgagcacccctaga

SEQ ID NO: 65713 - DNA, 20 bp, human
gggtggtgttggtccttcta

SEQ ID NO: 65714 - DNA, 20 bp, human
ggcggccggccccattaggg

SEQ ID NO: 65715 - DNA, 20 bp, human
gggaccaacaccaccctaat

SEQ ID NO: 65716 - DNA, 20 bp, human
gcgggacagagtggttgggc

SEQ ID NO: 65717 - DNA, 20 bp, human
gggtcctgctgaaggaaacc

SEQ ID NO: 65718 - DNA, 20 bp, human
ggcacctcagtgttccctct

SEQ ID NO: 65719 - DNA, 20 bp, human
gaagcctctgaggagcccca

SEQ ID NO: 65720 - DNA, 20 bp, human
gccaccctggggctcctcag

SEQ ID NO: 65721 - DNA, 20 bp, human
gccagtcaccgatgctggaa

SEQ ID NO: 65722 - DNA, 20 bp, human
gatccacctggaaggaagtg

SEQ ID NO: 65723 - DNA, 20 bp, human
gaactcaggacctccaggag

SEQ ID NO: 65724 - DNA, 20 bp, human
gagggaccctcctctcctgg

SEQ ID NO: 65725 - DNA, 20 bp, human
gtgaaccaccctggcagtaa

SEQ ID NO: 65726 - DNA, 20 bp, human
gctggagaggcagcgagcag

SEQ ID NO: 65727 - DNA, 20 bp, human
gtgggataacttacctggag

SEQ ID NO: 65728 - DNA, 20 bp, human
gaggcagcgagcagtggatg

SEQ ID NO: 65729 - DNA, 20 bp, human
gcaaggccagaaaagatgag

SEQ ID NO: 65730 - DNA, 20 bp, human
gcttaagtccaccccaggca

SEQ ID NO: 65731 - DNA, 20 bp, human
gtagaatgggataacttacc

SEQ ID NO: 65732 - DNA, 20 bp, human
gctgggctggcacaaaatcc

SEQ ID NO: 65733 - DNA, 20 bp, human
gggctggcacaaaatcccgg

SEQ ID NO: 65734 - DNA, 20 bp, human
ggtggggggaaaaggtagaa

SEQ ID NO: 65735 - DNA, 20 bp, human
gtgcatcttaagtccacccc

SEQ ID NO: 65736 - DNA, 20 bp, human
gagcggatgaggcgcttgtg

SEQ ID NO: 65737 - DNA, 20 bp, human
ggaatcaagagtagcggatg

SEQ ID NO: 65738 - DNA, 20 bp, human
ggaccgcgcgtcctacggag

SEQ ID NO: 65739 - DNA, 20 bp, human
gggctgcgcttcaacatcag

SEQ ID NO: 65740 - DNA, 20 bp, human
gacccggcgccgcggaacgg

SEQ ID NO: 65741 - DNA, 20 bp, human
gttcatccctgggaaggtac

SEQ ID NO: 65742 - DNA, 20 bp, human
gccgccttccgtctgttcta

SEQ ID NO: 65743 - DNA, 20 bp, human
gaggccctagaacagacgga

SEQ ID NO: 65744 - DNA, 20 bp, human
gaggcgtggaggagcggcac

SEQ ID NO: 65745 - DNA, 20 bp, human
ggagcaggccctagaacaga

SEQ ID NO: 65746 - DNA, 20 bp, human
gtagtccctggggtcatctg

SEQ ID NO: 65747 - DNA, 20 bp, human
gaccgcctcagatgacccca

SEQ ID NO: 65748 - DNA, 20 bp, human
gtccctggggtcatctgagg

SEQ ID NO: 65749 - DNA, 20 bp, human
ggtctcgcgatagccagccg

SEQ ID NO: 65750 - DNA, 20 bp, human
gccacggaccccgccagctc

SEQ ID NO: 65751 - DNA, 20 bp, human
gggaagcgcaagggcagccg

SEQ ID NO: 65752 - DNA, 20 bp, human
ggaaattgtggagtgagaca

SEQ ID NO: 65753 - DNA, 20 bp, human
gaggccgcagggaggtcgtg

SEQ ID NO: 65754 - DNA, 20 bp, human
ggaggtcgtggggttactgg

SEQ ID NO: 65755 - DNA, 20 bp, human
gtgcgacaagctagtccctg

SEQ ID NO: 65756 - DNA, 20 bp, human
gttaccaccgggagtggcag

SEQ ID NO: 65757 - DNA, 20 bp, human
gggctgctgatggggtcggg

SEQ ID NO: 65758 - DNA, 20 bp, human
gccgcggcctctcagctcta

SEQ ID NO: 65759 - DNA, 20 bp, human
gcggggccaggaaggatgaa

SEQ ID NO: 65760 - DNA, 20 bp, human
gcagaggcagagaaaatccg

SEQ ID NO: 65761 - DNA, 20 bp, human
ggctggcacaagatccctgg

SEQ ID NO: 65762 - DNA, 20 bp, human
gccgcggacggagtaacagc

SEQ ID NO: 65763 - DNA, 20 bp, human
gcagctggattctgaggacg

SEQ ID NO: 65764 - DNA, 20 bp, human
gcactcccggtggtaaaaga

SEQ ID NO: 65765 - DNA, 20 bp, human
gacactggcccccccaggta

SEQ ID NO: 65766 - DNA, 20 bp, human
gagacaaggatggtgatcgt

SEQ ID NO: 65767 - DNA, 20 bp, human
gagggcacggccccacccgg

SEQ ID NO: 65768 - DNA, 20 bp, human
gaaatcacggcagccgccag

SEQ ID NO: 65769 - DNA, 20 bp, human
gacccgagattctcaaatca

SEQ ID NO: 65770 - DNA, 20 bp, human
gctcttggctgactgatcct

SEQ ID NO: 65771 - DNA, 20 bp, human
gggtgccggggtaccccgag

SEQ ID NO: 65772 - DNA, 20 bp, human
gccagcttgggcctccccga

SEQ ID NO: 65773 - DNA, 20 bp, human
gcagcagcacgagggagggg

SEQ ID NO: 65774 - DNA, 20 bp, human
gagcctcgcagcctccgggt

SEQ ID NO: 65775 - DNA, 20 bp, human
gtgctggggtcagcccctcg

SEQ ID NO: 65776 - DNA, 20 bp, human
gtgcagagcagtggaccgaa

SEQ ID NO: 65777 - DNA, 20 bp, human
gctcagtcggcggccctagg

SEQ ID NO: 65778 - DNA, 20 bp, human
ggcgggtaggacgcatccta

SEQ ID NO: 65779 - DNA, 20 bp, human
gttaccccaggcgggagcag

SEQ ID NO: 65780 - DNA, 20 bp, human
gctagtgcgggtgcccccta

SEQ ID NO: 65781 - DNA, 20 bp, human
ggggaaccggctgctcgggt

SEQ ID NO: 65782 - DNA, 20 bp, human
gccccaggcgggagcagagg

SEQ ID NO: 65783 - DNA, 20 bp, human
gtactcccgaccgaacggag

SEQ ID NO: 65784 - DNA, 20 bp, human
gggctgcgacagcccctctg

SEQ ID NO: 65785 - DNA, 20 bp, human
gacgggaaagagaacagcac

SEQ ID NO: 65786 - DNA, 20 bp, human
gcttcagcgaagccggagat

SEQ ID NO: 65787 - DNA, 20 bp, human
gctgtccccaagacggagag

SEQ ID NO: 65788 - DNA, 20 bp, human
gggttcaggttgccagcagg

SEQ ID NO: 65789 - DNA, 20 bp, human
gcaggggagagcagtgaatc

SEQ ID NO: 65790 - DNA, 20 bp, human
ggcctactcaccggtcctag

SEQ ID NO: 65791 - DNA, 20 bp, human
ggatgggcagagagcgcgcg

SEQ ID NO: 65792 - DNA, 20 bp, human
gaggggtaaagcgccatccg

SEQ ID NO: 65793 - DNA, 20 bp, human
gcatctactgctgctagtgt

SEQ ID NO: 65794 - DNA, 20 bp, human
ggtagcagcttcagcgaagc

SEQ ID NO: 65795 - DNA, 20 bp, human
gcactctcccgcctactcac

SEQ ID NO: 65796 - DNA, 20 bp, human
gttgagttgggtgaagaagg

SEQ ID NO: 65797 - DNA, 20 bp, human
gtgggggaggtgcctgaata

SEQ ID NO: 65798 - DNA, 20 bp, human
gagccgccagagggcgagat

SEQ ID NO: 65799 - DNA, 20 bp, human
gtgggtcttcaaggcagtag

SEQ ID NO: 65800 - DNA, 20 bp, human
ggactgctcctgcagaatag

SEQ ID NO: 65801 - DNA, 20 bp, human
gggcgagatggggagctgat

SEQ ID NO: 65802 - DNA, 20 bp, human
gtgtaggaccgaggaggcaa

SEQ ID NO: 65803 - DNA, 20 bp, human
gtgtggtccggagccgccag

SEQ ID NO: 65804 - DNA, 20 bp, human
ggtgcctgaatagggtttga

SEQ ID NO: 65805 - DNA, 20 bp, human
gcggtgggagtcctaaatgg

SEQ ID NO: 65806 - DNA, 20 bp, human
gcccgcaacgggtccagcag

SEQ ID NO: 65807 - DNA, 20 bp, human
ggcagcgcccggggtcccaa

SEQ ID NO: 65808 - DNA, 20 bp, human
gacggcagacaggcccgcaa

SEQ ID NO: 65809 - DNA, 20 bp, human
gaagtgcgtggaggtgacca

SEQ ID NO: 65810 - DNA, 20 bp, human
gcaagggctccacggtgaag

SEQ ID NO: 65811 - DNA, 20 bp, human
gtgtctgccgttgggacccc

SEQ ID NO: 65812 - DNA, 20 bp, human
gcagtatgcactgggccata

SEQ ID NO: 65813 - DNA, 20 bp, human
gtgtgaagggggaagccact

SEQ ID NO: 65814 - DNA, 20 bp, human
gcctggtgggaagtgcgtgg

SEQ ID NO: 65815 - DNA, 20 bp, human
gttcccaccaggtcagcgga

SEQ ID NO: 65816 - DNA, 20 bp, human
gcaggaggccggctactgcg

SEQ ID NO: 65817 - DNA, 20 bp, human
gcgactgcgggtcaaggcac

SEQ ID NO: 65818 - DNA, 20 bp, human
gtgggctgggtgacgccagg

SEQ ID NO: 65819 - DNA, 20 bp, human
gccgccgggccgccctgaga

SEQ ID NO: 65820 - DNA, 20 bp, human
gggagcagcatgtggactct

SEQ ID NO: 65821 - DNA, 20 bp, human
ggggccgccctgagaaggag

SEQ ID NO: 65822 - DNA, 20 bp, human
ggcggtgcgactgcgggtca

SEQ ID NO: 65823 - DNA, 20 bp, human
gtgcggccagtggccaccag

SEQ ID NO: 65824 - DNA, 20 bp, human
gcaaggcacgggcgaaggca

SEQ ID NO: 65825 - DNA, 20 bp, human
ggagacagccgcacacccct

SEQ ID NO: 65826 - DNA, 20 bp, human
gagcaggcccgagctctggg

SEQ ID NO: 65827 - DNA, 20 bp, human
ggaggttcgcggctctaacg

SEQ ID NO: 65828 - DNA, 20 bp, human
gccgcccggcccagttcgag

SEQ ID NO: 65829 - DNA, 20 bp, human
gtccaacatggcggagctga

SEQ ID NO: 65830 - DNA, 20 bp, human
gcaactgagtggctgctggg

SEQ ID NO: 65831 - DNA, 20 bp, human
gcggcacgttgagaccccag

SEQ ID NO: 65832 - DNA, 20 bp, human
gagtcgtgaaaggaggcggt

SEQ ID NO: 65833 - DNA, 20 bp, human
gagctgacggtggaggttcg

SEQ ID NO: 65834 - DNA, 20 bp, human
gggggagtcgtgaaaggagg

SEQ ID NO: 65835 - DNA, 20 bp, human
ggatcccacctggagagtcg

SEQ ID NO: 65836 - DNA, 20 bp, human
ggcagcgggtcccgggactg

SEQ ID NO: 65837 - DNA, 20 bp, human
gtggagccgcgcacctcgac

SEQ ID NO: 65838 - DNA, 20 bp, human
ggagccgggactgcccgtcg

SEQ ID NO: 65839 - DNA, 20 bp, human
ggcacctcgacgggcagtcc

SEQ ID NO: 65840 - DNA, 20 bp, human
gaccttgtagaaggccccgt

SEQ ID NO: 65841 - DNA, 20 bp, human
ggaggtgcgcggctccaacg

SEQ ID NO: 65842 - DNA, 20 bp, human
gaggctgcgggttggagcaa

SEQ ID NO: 65843 - DNA, 20 bp, human
ggcccccggcgtctccccgg

SEQ ID NO: 65844 - DNA, 20 bp, human
gggccggagcaggaacgcgt

SEQ ID NO: 65845 - DNA, 20 bp, human
gcccagggaaggctgcgggt

SEQ ID NO: 65846 - DNA, 20 bp, human
ggcaggccaacccaagaggg

SEQ ID NO: 65847 - DNA, 20 bp, human
gggcggcccagccagaccag

SEQ ID NO: 65848 - DNA, 20 bp, human
gacgtcctgctgtgccccgg

SEQ ID NO: 65849 - DNA, 20 bp, human
ggctgtcccctgctgaaaga

SEQ ID NO: 65850 - DNA, 20 bp, human
gggggacgctcaccccaatc

SEQ ID NO: 65851 - DNA, 20 bp, human
gggcacagcaggacgtttgg

SEQ ID NO: 65852 - DNA, 20 bp, human
gctggttggagcaggacgtg

SEQ ID NO: 65853 - DNA, 20 bp, human
ggcaggggacagcccgattg

SEQ ID NO: 65854 - DNA, 20 bp, human
gcaggcaggccaacccaaga

SEQ ID NO: 65855 - DNA, 20 bp, human
ggggggccttctttcagcag

SEQ ID NO: 65856 - DNA, 20 bp, human
ggcctaggaaggctgaccag

SEQ ID NO: 65857 - DNA, 20 bp, human
gggtccagctgaccccacaa

SEQ ID NO: 65858 - DNA, 20 bp, human
ggtcatttccccaggtgaat

SEQ ID NO: 65859 - DNA, 20 bp, human
gctgggttgtcgatggacgg

SEQ ID NO: 65860 - DNA, 20 bp, human
gtgactgggttgtcgatgga

SEQ ID NO: 65861 - DNA, 20 bp, human
ggaaatgactgggttgtcga

SEQ ID NO: 65862 - DNA, 20 bp, human
gtagaccgtctgaacttggg

SEQ ID NO: 65863 - DNA, 20 bp, human
ggtgtctggctgcctccacg

SEQ ID NO: 65864 - DNA, 20 bp, human
gagaggaggccgacaggaag

SEQ ID NO: 65865 - DNA, 20 bp, human
gtgctagaccgtctgaactt

SEQ ID NO: 65866 - DNA, 20 bp, human
gcctctggccatctgacctc

SEQ ID NO: 65867 - DNA, 20 bp, human
gtcagatggccagagggtag

SEQ ID NO: 65868 - DNA, 20 bp, human
gggagctgctggttgtgtcc

SEQ ID NO: 65869 - DNA, 20 bp, human
gcactctccatccaggcccc

SEQ ID NO: 65870 - DNA, 20 bp, human
gccatggacaggtggtacct

SEQ ID NO: 65871 - DNA, 20 bp, human
gcacctgaagtgtgaagagg

SEQ ID NO: 65872 - DNA, 20 bp, human
ggcaggccagtgactccgta

SEQ ID NO: 65873 - DNA, 20 bp, human
gcaaccagcagctcctgcca

SEQ ID NO: 65874 - DNA, 20 bp, human
gatggacagacaagtaaatg

SEQ ID NO: 65875 - DNA, 20 bp, human
gtgcatctctaagggacgga

SEQ ID NO: 65876 - DNA, 20 bp, human
gtgaccaaagtcaggagatg

SEQ ID NO: 65877 - DNA, 20 bp, human
gagaggttccgggagaaatc

SEQ ID NO: 65878 - DNA, 20 bp, human
gtctggagccaggagataaa

SEQ ID NO: 65879 - DNA, 20 bp, human
gggggtgcctgggtaggtag

SEQ ID NO: 65880 - DNA, 20 bp, human
gtaatttaggggcagagaca

SEQ ID NO: 65881 - DNA, 20 bp, human
gggcaagatgtggcctggaa

SEQ ID NO: 65882 - DNA, 20 bp, human
gccccctccccagccatggg

SEQ ID NO: 65883 - DNA, 20 bp, human
gctggcagcccgatttctcc

SEQ ID NO: 65884 - DNA, 20 bp, human
gccattcaaggtcctctcct

SEQ ID NO: 65885 - DNA, 20 bp, human
gttgtaccagcggcaagatg

SEQ ID NO: 65886 - DNA, 20 bp, human
gagcgcagagaacggatctg

SEQ ID NO: 65887 - DNA, 20 bp, human
gtggagttcctggaatacga

SEQ ID NO: 65888 - DNA, 20 bp, human
gatacgagggtctcaactct

SEQ ID NO: 65889 - DNA, 20 bp, human
gaggaggctgctgggcacgt

SEQ ID NO: 65890 - DNA, 20 bp, human
gggcgagggctcacctgagc

SEQ ID NO: 65891 - DNA, 20 bp, human
ggcagagaacggatctgagg

SEQ ID NO: 65892 - DNA, 20 bp, human
gctcgccaaggtgacctcgc

SEQ ID NO: 65893 - DNA, 20 bp, human
gaggggtctgaggacagata

SEQ ID NO: 65894 - DNA, 20 bp, human
gttctctgcgctgccagctc

SEQ ID NO: 65895 - DNA, 20 bp, human
gggacgcctgctcacctgcg

SEQ ID NO: 65896 - DNA, 20 bp, human
gcggcagcctcgtggagaga

SEQ ID NO: 65897 - DNA, 20 bp, human
gcgtggagagagggacgcgg

SEQ ID NO: 65898 - DNA, 20 bp, human
gctggggcagaggagtagat

SEQ ID NO: 65899 - DNA, 20 bp, human
ggcacgagagggacttacgt

SEQ ID NO: 65900 - DNA, 20 bp, human
ggcccactgtagcccaggag

SEQ ID NO: 65901 - DNA, 20 bp, human
gatggaggtggcgcacgaga

SEQ ID NO: 65902 - DNA, 20 bp, human
gctgggactgacgcaaggag

SEQ ID NO: 65903 - DNA, 20 bp, human
gggacttacgtcggagctgg

SEQ ID NO: 65904 - DNA, 20 bp, human
gcgcgctggagagacctaag

SEQ ID NO: 65905 - DNA, 20 bp, human
gagaggaggcagagagatgt

SEQ ID NO: 65906 - DNA, 20 bp, human
gcccctccgagactcccagg

SEQ ID NO: 65907 - DNA, 20 bp, human
gctcctcatggataaagggt

SEQ ID NO: 65908 - DNA, 20 bp, human
ggtcctcctgggagtctcgg

SEQ ID NO: 65909 - DNA, 20 bp, human
ggatcggcgtcggaagagag

SEQ ID NO: 65910 - DNA, 20 bp, human
gggactcggcgggtcctcct

SEQ ID NO: 65911 - DNA, 20 bp, human
gggtcccctccgagactccc

SEQ ID NO: 65912 - DNA, 20 bp, human
ggaccggctgtgcaggtagg

SEQ ID NO: 65913 - DNA, 20 bp, human
ggaggacccgccgagtcccg

SEQ ID NO: 65914 - DNA, 20 bp, human
gaagagagaggagcctctag

SEQ ID NO: 65915 - DNA, 20 bp, human
gtgcgccgcggtccccgcct

SEQ ID NO: 65916 - DNA, 20 bp, human
gctcctcatggataaagggt

SEQ ID NO: 65917 - DNA, 20 bp, human
ggcccgactcctaggaggag

SEQ ID NO: 65918 - DNA, 20 bp, human
gcccctccgagactcccagg

SEQ ID NO: 65919 - DNA, 20 bp, human
ggaggacccgccgagtcccg

SEQ ID NO: 65920 - DNA, 20 bp, human
ggatcggcgtcggaagagag

SEQ ID NO: 65921 - DNA, 20 bp, human
gagccagcccgactcctagg

SEQ ID NO: 65922 - DNA, 20 bp, human
gggtcccctccgagactccc

SEQ ID NO: 65923 - DNA, 20 bp, human
gggactcggcgggtcctcct

SEQ ID NO: 65924 - DNA, 20 bp, human
gaagagagaggagcctctag

SEQ ID NO: 65925 - DNA, 20 bp, human
ggtcctcctgggagtctcgg

SEQ ID NO: 65926 - DNA, 20 bp, human
gaccgtggtggtagcagacg

SEQ ID NO: 65927 - DNA, 20 bp, human
gggaggtccgctcctcctgt

SEQ ID NO: 65928 - DNA, 20 bp, human
ggtgtcccagagacccggag

SEQ ID NO: 65929 - DNA, 20 bp, human
gggctggtcccgcaccgtgg

SEQ ID NO: 65930 - DNA, 20 bp, human
gggagaagggatgctcggac

SEQ ID NO: 65931 - DNA, 20 bp, human
gtcgggggggcgcattacag

SEQ ID NO: 65932 - DNA, 20 bp, human
gatgctcggacaggtcgcta

SEQ ID NO: 65933 - DNA, 20 bp, human
gcccctgctccggcccagca

SEQ ID NO: 65934 - DNA, 20 bp, human
gagcaggacggaccgatgtg

SEQ ID NO: 65935 - DNA, 20 bp, human
gttgcagggtgggagcgggt

SEQ ID NO: 65936 - DNA, 20 bp, human
ggtgagtagggcccagaccc

SEQ ID NO: 65937 - DNA, 20 bp, human
ggcgacagctagaagtgagt

SEQ ID NO: 65938 - DNA, 20 bp, human
gttaacgctagtggcaccag

SEQ ID NO: 65939 - DNA, 20 bp, human
ggcccaggaagatccactaa

SEQ ID NO: 65940 - DNA, 20 bp, human
gtgactcctgcagaagaagg

SEQ ID NO: 65941 - DNA, 20 bp, human
gcaggaagatccactaaagg

SEQ ID NO: 65942 - DNA, 20 bp, human
gaccgggacaaaaccctgcc

SEQ ID NO: 65943 - DNA, 20 bp, human
gtccaacaagaacacatgag

SEQ ID NO: 65944 - DNA, 20 bp, human
gtcctgcagaagaaggcgga

SEQ ID NO: 65945 - DNA, 20 bp, human
ggtcgcatctgctctgcatg

SEQ ID NO: 65946 - DNA, 20 bp, human
gctatgtttgtaggatggaa

SEQ ID NO: 65947 - DNA, 20 bp, human
gtggcgaaatataacacggg

SEQ ID NO: 65948 - DNA, 20 bp, human
ggagaccccgaggcgaaagt

SEQ ID NO: 65949 - DNA, 20 bp, human
ggcagatgtaaagtccctca

SEQ ID NO: 65950 - DNA, 20 bp, human
gctcatggcgaaatataaca

SEQ ID NO: 65951 - DNA, 20 bp, human
gacggggggcaacccgacag

SEQ ID NO: 65952 - DNA, 20 bp, human
ggactgagacatcctctgtc

SEQ ID NO: 65953 - DNA, 20 bp, human
gcagtgggctttagaaacgg

SEQ ID NO: 65954 - DNA, 20 bp, human
ggagatggcttgtttccagg

SEQ ID NO: 65955 - DNA, 20 bp, human
gggccagggaaatgtaggtt

SEQ ID NO: 65956 - DNA, 20 bp, human
ggggccaagcggaagaggac

SEQ ID NO: 65957 - DNA, 20 bp, human
gggatgggcggggactgtaa

SEQ ID NO: 65958 - DNA, 20 bp, human
ggacgcgcacaccaagaggg

SEQ ID NO: 65959 - DNA, 20 bp, human
gcggagggcccgcaaaggaa

SEQ ID NO: 65960 - DNA, 20 bp, human
gcacgcaggcaggaactccg

SEQ ID NO: 65961 - DNA, 20 bp, human
ggcagaaccgaaactttctg

SEQ ID NO: 65962 - DNA, 20 bp, human
gttctggggccaagcggaag

SEQ ID NO: 65963 - DNA, 20 bp, human
ggcccgctgggcaaggacgg

SEQ ID NO: 65964 - DNA, 20 bp, human
gaatgtcttagcgcaggatg

SEQ ID NO: 65965 - DNA, 20 bp, human
gaccagttccaagaccccgg

SEQ ID NO: 65966 - DNA, 20 bp, human
gcgagcagccgcgctggtgg

SEQ ID NO: 65967 - DNA, 20 bp, human
gcggctccgctcctgacaga

SEQ ID NO: 65968 - DNA, 20 bp, human
gttgcgccatctgtcaggag

SEQ ID NO: 65969 - DNA, 20 bp, human
gcgcccggcggcgagagtag

SEQ ID NO: 65970 - DNA, 20 bp, human
ggacccctcctcctcgcccg

SEQ ID NO: 65971 - DNA, 20 bp, human
gccttccgagagcaccgagg

SEQ ID NO: 65972 - DNA, 20 bp, human
gtagcagcgagcagccgcgc

SEQ ID NO: 65973 - DNA, 20 bp, human
gcgccgcgcaggtaagcagg

SEQ ID NO: 65974 - DNA, 20 bp, human
gtgcagttgcgccatctgtc

SEQ ID NO: 65975 - DNA, 20 bp, human
gcctcggccgcgccggagga

SEQ ID NO: 65976 - DNA, 20 bp, human
gcctcggccgcggcagtcgg

SEQ ID NO: 65977 - DNA, 20 bp, human
ggagcgggcgcggacaaggc

SEQ ID NO: 65978 - DNA, 20 bp, human
ggagacgtcgcgccgagagc

SEQ ID NO: 65979 - DNA, 20 bp, human
gggctgcgtgcgcgagtggg

SEQ ID NO: 65980 - DNA, 20 bp, human
gcgtgcgcgctccctcggtg

SEQ ID NO: 65981 - DNA, 20 bp, human
gccgagagcgggcgcggaca

SEQ ID NO: 65982 - DNA, 20 bp, human
ggcgagccgtagcccctccg

SEQ ID NO: 65983 - DNA, 20 bp, human
gaggttcgcagggtcgcggg

SEQ ID NO: 65984 - DNA, 20 bp, human
gcgcgggtggagaccgagga

SEQ ID NO: 65985 - DNA, 20 bp, human
gcattgctgcgggccttcgg

SEQ ID NO: 65986 - DNA, 20 bp, human
gagcgagccgagggccagga

SEQ ID NO: 65987 - DNA, 20 bp, human
gccgggagccagcgagccga

SEQ ID NO: 65988 - DNA, 20 bp, human
gtacgcagaacaggagccgg

SEQ ID NO: 65989 - DNA, 20 bp, human
gcggcggcccgggacttctt

SEQ ID NO: 65990 - DNA, 20 bp, human
ggagagttgcgctctctacg

SEQ ID NO: 65991 - DNA, 20 bp, human
gggaaggcgggacacgaccc

SEQ ID NO: 65992 - DNA, 20 bp, human
ggaggcgcctaagaagtccc

SEQ ID NO: 65993 - DNA, 20 bp, human
ggagaggagccgagaaagta

SEQ ID NO: 65994 - DNA, 20 bp, human
gagcggagcggcgccaagag

SEQ ID NO: 65995 - DNA, 20 bp, human
gcagctggcgcgccaatcgc

SEQ ID NO: 65996 - DNA, 20 bp, human
gccaggtggcgcgtctggag

SEQ ID NO: 65997 - DNA, 20 bp, human
gagcgcccaggtggcgcgtc

SEQ ID NO: 65998 - DNA, 20 bp, human
gacctgggcgctccaagaag

SEQ ID NO: 65999 - DNA, 20 bp, human
gcggcgcgagctccaactca

SEQ ID NO: 66000 - DNA, 20 bp, human
gcgcggcgcccccacagccc

SEQ ID NO: 66001 - DNA, 20 bp, human
gtgcacatcgggatctcgat

SEQ ID NO: 66002 - DNA, 20 bp, human
gctcgcaaaaaggcaaaggg

SEQ ID NO: 66003 - DNA, 20 bp, human
gtggcggcgcgggcacaccg

SEQ ID NO: 66004 - DNA, 20 bp, human
gagcccgtgcccgggagcgg

SEQ ID NO: 66005 - DNA, 20 bp, human
gctgcaggaccagccacagg

SEQ ID NO: 66006 - DNA, 20 bp, human
gcaggaggacgcaggcctag

SEQ ID NO: 66007 - DNA, 20 bp, human
gccgaccgcggcaagcaagc

SEQ ID NO: 66008 - DNA, 20 bp, human
gatagaactggtgcacctct

SEQ ID NO: 66009 - DNA, 20 bp, human
gtactcgcggccgcagagtt

SEQ ID NO: 66010 - DNA, 20 bp, human
gcgcggccgcagagttgggg

SEQ ID NO: 66011 - DNA, 20 bp, human
gcgctgggtgcagaagggag

SEQ ID NO: 66012 - DNA, 20 bp, human
gcagcagcgcgcggtgtctc

SEQ ID NO: 66013 - DNA, 20 bp, human
gccgcggcaagcaagcgggc

SEQ ID NO: 66014 - DNA, 20 bp, human
gctggttcgtgtggcccaga

SEQ ID NO: 66015 - DNA, 20 bp, human
gacaggaagaagcgcagttc

SEQ ID NO: 66016 - DNA, 20 bp, human
gcagggttaacagtctcccg

SEQ ID NO: 66017 - DNA, 20 bp, human
gggccgctccgggtacctga

SEQ ID NO: 66018 - DNA, 20 bp, human
gcggagcggccgaggaacgc

SEQ ID NO: 66019 - DNA, 20 bp, human
gcgcgcgtccctcaggtacc

SEQ ID NO: 66020 - DNA, 20 bp, human
gaaagctcgctgtcgctggg

SEQ ID NO: 66021 - DNA, 20 bp, human
gacgagaggaacgatccctg

SEQ ID NO: 66022 - DNA, 20 bp, human
gccccggcgcctggctccaa

SEQ ID NO: 66023 - DNA, 20 bp, human
gagaggaacgatccctgagg

SEQ ID NO: 66024 - DNA, 20 bp, human
ggcgcctggctccaaggggt

SEQ ID NO: 66025 - DNA, 20 bp, human
gcgcgggctcagggcggaca

SEQ ID NO: 66026 - DNA, 20 bp, human
gccgggacgggagtgtgatg

SEQ ID NO: 66027 - DNA, 20 bp, human
gaggccatggccagcatcgg

SEQ ID NO: 66028 - DNA, 20 bp, human
ggtgtgatgcggcgacgagg

SEQ ID NO: 66029 - DNA, 20 bp, human
gggacaggctgcgagggtca

SEQ ID NO: 66030 - DNA, 20 bp, human
gcggagacgccgaacggacg

SEQ ID NO: 66031 - DNA, 20 bp, human
ggcctcgcggagacgccgaa

SEQ ID NO: 66032 - DNA, 20 bp, human
ggcagggccgagcgtcccgg

SEQ ID NO: 66033 - DNA, 20 bp, human
gggcacatggagatgcggat

SEQ ID NO: 66034 - DNA, 20 bp, human
ggcgcccccgtgcaaactgg

SEQ ID NO: 66035 - DNA, 20 bp, human
gtggctgctggctggcctcg

SEQ ID NO: 66036 - DNA, 20 bp, human
gcgcgcggcggcgaccacag

SEQ ID NO: 66037 - DNA, 20 bp, human
gttccgtgctcgccagaggt

SEQ ID NO: 66038 - DNA, 20 bp, human
gggcgaccacagcggactca

SEQ ID NO: 66039 - DNA, 20 bp, human
gtgcggccgtgagtccgctg

SEQ ID NO: 66040 - DNA, 20 bp, human
ggcgacaggctgggtacccg

SEQ ID NO: 66041 - DNA, 20 bp, human
gtcgccagaggtgggcgaaa

SEQ ID NO: 66042 - DNA, 20 bp, human
ggcggttccgtgctcgccag

SEQ ID NO: 66043 - DNA, 20 bp, human
gtagaagcaggtgacccggg

SEQ ID NO: 66044 - DNA, 20 bp, human
ggcaccctttcgcccacctc

SEQ ID NO: 66045 - DNA, 20 bp, human
gggaggagagggcgagtgac

SEQ ID NO: 66046 - DNA, 20 bp, human
gtccccccagggacctgaga

SEQ ID NO: 66047 - DNA, 20 bp, human
ggccgtctcaggtccctggg

SEQ ID NO: 66048 - DNA, 20 bp, human
ggctccccgtgcggctctcg

SEQ ID NO: 66049 - DNA, 20 bp, human
gcagggacctgagacggctc

SEQ ID NO: 66050 - DNA, 20 bp, human
gccagtcccggacgcaaccc

SEQ ID NO: 66051 - DNA, 20 bp, human
gggaggaaggctgtaggccc

SEQ ID NO: 66052 - DNA, 20 bp, human
gggtccctggggggaacggt

SEQ ID NO: 66053 - DNA, 20 bp, human
ggtggaagcctcacctcggg

SEQ ID NO: 66054 - DNA, 20 bp, human
gtgtggggcgctggcggacc

SEQ ID NO: 66055 - DNA, 20 bp, human
ggctgcctcgagagccgcac

SEQ ID NO: 66056 - DNA, 20 bp, human
gagaggcccagggacgaaag

SEQ ID NO: 66057 - DNA, 20 bp, human
gtcgccggccgcgagtgcag

SEQ ID NO: 66058 - DNA, 20 bp, human
gcccagggacgaaagcggag

SEQ ID NO: 66059 - DNA, 20 bp, human
gcgccgcgaggagcaacaag

SEQ ID NO: 66060 - DNA, 20 bp, human
ggcggcaggggttctcctag

SEQ ID NO: 66061 - DNA, 20 bp, human
gtcctagcggggaccggacc

SEQ ID NO: 66062 - DNA, 20 bp, human
gcagcctgaggagtgcgacg

SEQ ID NO: 66063 - DNA, 20 bp, human
gacgccccccgcgcctggtc

SEQ ID NO: 66064 - DNA, 20 bp, human
gggagtgcgacgaggcggtt

SEQ ID NO: 66065 - DNA, 20 bp, human
gccgcctcgtcgcactcctc

SEQ ID NO: 66066 - DNA, 20 bp, human
gagccgtactggcgcatgag

SEQ ID NO: 66067 - DNA, 20 bp, human
gggtcgcagcgcatgcggtc

SEQ ID NO: 66068 - DNA, 20 bp, human
gtgtcagggttgccttgctc

SEQ ID NO: 66069 - DNA, 20 bp, human
gaggcgcacagcatggagtg

SEQ ID NO: 66070 - DNA, 20 bp, human
gcgtggccgctgcccgaagg

SEQ ID NO: 66071 - DNA, 20 bp, human
gcagccggtcgcagcgcatg

SEQ ID NO: 66072 - DNA, 20 bp, human
ggacgcggttgtagagcggg

SEQ ID NO: 66073 - DNA, 20 bp, human
ggtccatgcacagcgtgtca

SEQ ID NO: 66074 - DNA, 20 bp, human
gcctctgcgcgccgcctgga

SEQ ID NO: 66075 - DNA, 20 bp, human
gagccgatgcccttacacag

SEQ ID NO: 66076 - DNA, 20 bp, human
ggcggctcctgtccctcggg

SEQ ID NO: 66077 - DNA, 20 bp, human
gagggcgcccggacacacgt

SEQ ID NO: 66078 - DNA, 20 bp, human
gtcggcggctcctgtccctc

SEQ ID NO: 66079 - DNA, 20 bp, human
gggcagccgtactgcaccag

SEQ ID NO: 66080 - DNA, 20 bp, human
gtcgcgccgctggtgcagta

SEQ ID NO: 66081 - DNA, 20 bp, human
ggaggcggctgccgagctag

SEQ ID NO: 66082 - DNA, 20 bp, human
gccgcacgcgctgtgcatgg

SEQ ID NO: 66083 - DNA, 20 bp, human
gtggtagcctcggccccggg

SEQ ID NO: 66084 - DNA, 20 bp, human
gtggagatccccatgtgccg

SEQ ID NO: 66085 - DNA, 20 bp, human
ggcgccacggccatcccggg

SEQ ID NO: 66086 - DNA, 20 bp, human
gggctccgcggtccctaata

SEQ ID NO: 66087 - DNA, 20 bp, human
gagcgaccgccgccatatta

SEQ ID NO: 66088 - DNA, 20 bp, human
ggagcccgggatcccgtcag

SEQ ID NO: 66089 - DNA, 20 bp, human
gccgccgctgacgggatccc

SEQ ID NO: 66090 - DNA, 20 bp, human
gtccgcggtccctaatatgg

SEQ ID NO: 66091 - DNA, 20 bp, human
gggaggtcacgacttacagg

SEQ ID NO: 66092 - DNA, 20 bp, human
ggaatggtggacgctgacgg

SEQ ID NO: 66093 - DNA, 20 bp, human
gtcacggcaggccccgacgt

SEQ ID NO: 66094 - DNA, 20 bp, human
ggcggtccctaatatggcgg

SEQ ID NO: 66095 - DNA, 20 bp, human
gccgccccccgggccctagg

SEQ ID NO: 66096 - DNA, 20 bp, human
gagacgtctgcgggaccagg

SEQ ID NO: 66097 - DNA, 20 bp, human
gcgagaggaggagaacgctg

SEQ ID NO: 66098 - DNA, 20 bp, human
gagcggcggagtctccaact

SEQ ID NO: 66099 - DNA, 20 bp, human
gagagcctgtcgctccaggg

SEQ ID NO: 66100 - DNA, 20 bp, human
ggacgctaaagcggtgccag

SEQ ID NO: 66101 - DNA, 20 bp, human
gctgaggtcggtcggaccaa

SEQ ID NO: 66102 - DNA, 20 bp, human
gaggaggagaacgctgaggt

SEQ ID NO: 66103 - DNA, 20 bp, human
ggctaaagcggtgccagcgg

SEQ ID NO: 66104 - DNA, 20 bp, human
gcagctgcagctctcccagt

SEQ ID NO: 66105 - DNA, 20 bp, human
gacgtctggcggccgtgaag

SEQ ID NO: 66106 - DNA, 20 bp, human
gcggggccgaccgctctttc

SEQ ID NO: 66107 - DNA, 20 bp, human
ggcggtcggccccgccctcg

SEQ ID NO: 66108 - DNA, 20 bp, human
gcccggcccgctgtacgtcg

SEQ ID NO: 66109 - DNA, 20 bp, human
gtcctgtgggccgttgaatg

SEQ ID NO: 66110 - DNA, 20 bp, human
gcgcgagcagccacattcaa

SEQ ID NO: 66111 - DNA, 20 bp, human
gtacagcgggccgggaaaag

SEQ ID NO: 66112 - DNA, 20 bp, human
gggcgtgccccgacgtacag

SEQ ID NO: 66113 - DNA, 20 bp, human
ggaatgtggctgctcgcggt

SEQ ID NO: 66114 - DNA, 20 bp, human
ggccgggaaaagtggcactg

SEQ ID NO: 66115 - DNA, 20 bp, human
gggacgaatttgaatcctgt

SEQ ID NO: 66116 - DNA, 20 bp, human
ggcggctcggcttagtcctc

SEQ ID NO: 66117 - DNA, 20 bp, human
gagccgcagcacttgtgaga

SEQ ID NO: 66118 - DNA, 20 bp, human
gtggcagttatatagaccgg

SEQ ID NO: 66119 - DNA, 20 bp, human
gtgcggacgcagttgcgtga

SEQ ID NO: 66120 - DNA, 20 bp, human
ggctctgcaccacagcaccg

SEQ ID NO: 66121 - DNA, 20 bp, human
gacaccccggcgtacctacg

SEQ ID NO: 66122 - DNA, 20 bp, human
ggtcggttcggaccagaagg

SEQ ID NO: 66123 - DNA, 20 bp, human
gcgcgggcgcgtggcggaga

SEQ ID NO: 66124 - DNA, 20 bp, human
gcagccgcgtaggtacgccg

SEQ ID NO: 66125 - DNA, 20 bp, human
ggaggggtttgtactatcct

SEQ ID NO: 66126 - DNA, 20 bp, human
gccgggagccggaggtgtag

SEQ ID NO: 66127 - DNA, 20 bp, human
gtgtgaggcagacgaactcg

SEQ ID NO: 66128 - DNA, 20 bp, human
gcgacgtgcgacaaggacca

SEQ ID NO: 66129 - DNA, 20 bp, human
gagacgaactcgcggctctc

SEQ ID NO: 66130 - DNA, 20 bp, human
gcagagggctccgagtgcac

SEQ ID NO: 66131 - DNA, 20 bp, human
gacgcacacacggcaccgta

SEQ ID NO: 66132 - DNA, 20 bp, human
gacacacctccagccaacgg

SEQ ID NO: 66133 - DNA, 20 bp, human
gccgagttgtcggaggaagg

SEQ ID NO: 66134 - DNA, 20 bp, human
gggctcccgggctcacacac

SEQ ID NO: 66135 - DNA, 20 bp, human
gtgtgtacgggcgccgggag

SEQ ID NO: 66136 - DNA, 20 bp, human
gaagcctggaataactgcaa

SEQ ID NO: 66137 - DNA, 20 bp, human
ggccaaggaaatgaggatgg

SEQ ID NO: 66138 - DNA, 20 bp, human
gtggaagcatgagtagcccg

SEQ ID NO: 66139 - DNA, 20 bp, human
gatggggaagaggacgtaga

SEQ ID NO: 66140 - DNA, 20 bp, human
gtgatccaaagtcagagaga

SEQ ID NO: 66141 - DNA, 20 bp, human
gtggcttcctgaatagcctg

SEQ ID NO: 66142 - DNA, 20 bp, human
gtggatcatctacataaagg

SEQ ID NO: 66143 - DNA, 20 bp, human
ggacgtagaaggcattcctg

SEQ ID NO: 66144 - DNA, 20 bp, human
ggtccgtgatcgcagacctc

SEQ ID NO: 66145 - DNA, 20 bp, human
ggcccacagcttcctgaaga

SEQ ID NO: 66146 - DNA, 20 bp, human
ggagcactccattcctgtga

SEQ ID NO: 66147 - DNA, 20 bp, human
gatatgggtagcagtcattg

SEQ ID NO: 66148 - DNA, 20 bp, human
gcaagatggatttccttcac

SEQ ID NO: 66149 - DNA, 20 bp, human
ggtccaatgttggagacccc

SEQ ID NO: 66150 - DNA, 20 bp, human
gtagaaaagtgtagtaagct

SEQ ID NO: 66151 - DNA, 20 bp, human
gttcctggggtctccaacat

SEQ ID NO: 66152 - DNA, 20 bp, human
gactgctacccatatcatct

SEQ ID NO: 66153 - DNA, 20 bp, human
gaaatttaaggataaatctt

SEQ ID NO: 66154 - DNA, 20 bp, human
gaaagttctacttatgaatc

SEQ ID NO: 66155 - DNA, 20 bp, human
gtctggtgtttcaagttacc

SEQ ID NO: 66156 - DNA, 20 bp, human
gcatgactcagggccctcgg

SEQ ID NO: 66157 - DNA, 20 bp, human
gcccagcgtggactccatgg

SEQ ID NO: 66158 - DNA, 20 bp, human
gcagttgctgaaagagacca

SEQ ID NO: 66159 - DNA, 20 bp, human
ggccccggcttgctccaggg

SEQ ID NO: 66160 - DNA, 20 bp, human
gagggcggaaaccagagtcc

SEQ ID NO: 66161 - DNA, 20 bp, human
gtccgccctggagcaagccg

SEQ ID NO: 66162 - DNA, 20 bp, human
ggctgcacaaagatgctcaa

SEQ ID NO: 66163 - DNA, 20 bp, human
gaaatcagggactacagagt

SEQ ID NO: 66164 - DNA, 20 bp, human
gcagtagggaggaaaaccgg

SEQ ID NO: 66165 - DNA, 20 bp, human
gcaggccccggcttgctcca

SEQ ID NO: 66166 - DNA, 20 bp, human
ggaagccggcgagaagtgtg

SEQ ID NO: 66167 - DNA, 20 bp, human
gcggcttcccgagttctcgg

SEQ ID NO: 66168 - DNA, 20 bp, human
ggaagtgtgaggccgcggta

SEQ ID NO: 66169 - DNA, 20 bp, human
ggcggactcagacttctctc

SEQ ID NO: 66170 - DNA, 20 bp, human
gcgccgtccgagagacgagg

SEQ ID NO: 66171 - DNA, 20 bp, human
gaacaggcgagggttcccgg

SEQ ID NO: 66172 - DNA, 20 bp, human
gccgagggacagcccagagg

SEQ ID NO: 66173 - DNA, 20 bp, human
ggtagggccgcatcccgctc

SEQ ID NO: 66174 - DNA, 20 bp, human
gtccagcgcaggtgcccgag

SEQ ID NO: 66175 - DNA, 20 bp, human
gggcctcgcgcgctcgcgga

SEQ ID NO: 66176 - DNA, 20 bp, human
gtaaagaccgggaggactag

SEQ ID NO: 66177 - DNA, 20 bp, human
ggcggacgaggagaacctag

SEQ ID NO: 66178 - DNA, 20 bp, human
gcgggaggactagaggtctg

SEQ ID NO: 66179 - DNA, 20 bp, human
ggcgcccccgggcacgaccc

SEQ ID NO: 66180 - DNA, 20 bp, human
ggacgaggagaacctagagg

SEQ ID NO: 66181 - DNA, 20 bp, human
gcacgaccccggagtctccg

SEQ ID NO: 66182 - DNA, 20 bp, human
gtggccgcccgcggagactc

SEQ ID NO: 66183 - DNA, 20 bp, human
gagaggctgggggcacggct

SEQ ID NO: 66184 - DNA, 20 bp, human
gtccctcgctgaacaacggg

SEQ ID NO: 66185 - DNA, 20 bp, human
ggcaggtaggacagtgacct

SEQ ID NO: 66186 - DNA, 20 bp, human
gaggcgggcgcactgaaagg

SEQ ID NO: 66187 - DNA, 20 bp, human
ggcgaggcgggcgcactgaa

SEQ ID NO: 66188 - DNA, 20 bp, human
gctgagtccgagcgctgctg

SEQ ID NO: 66189 - DNA, 20 bp, human
ggccgccggcgagccgactg

SEQ ID NO: 66190 - DNA, 20 bp, human
gggcgagacggcacgtctgg

SEQ ID NO: 66191 - DNA, 20 bp, human
ggtccacacccctccccagt

SEQ ID NO: 66192 - DNA, 20 bp, human
gtccccagtcggctcgccgg

SEQ ID NO: 66193 - DNA, 20 bp, human
ggctggcgagacggcacgtc

SEQ ID NO: 66194 - DNA, 20 bp, human
ggacggcacgtctggaggcg

SEQ ID NO: 66195 - DNA, 20 bp, human
gctgcgcgctcggcaggcgt

SEQ ID NO: 66196 - DNA, 20 bp, human
gcggcccggcggggactagg

SEQ ID NO: 66197 - DNA, 20 bp, human
gccggcggtgcgcagctcgc

SEQ ID NO: 66198 - DNA, 20 bp, human
ggcgcgggctcgggcagctg

SEQ ID NO: 66199 - DNA, 20 bp, human
ggcggtgcgcagctcgcggg

SEQ ID NO: 66200 - DNA, 20 bp, human
gcgcagccgcacccgcctgg

SEQ ID NO: 66201 - DNA, 20 bp, human
gtcacaggtgggccgccgag

SEQ ID NO: 66202 - DNA, 20 bp, human
ggcacctgcacacctgtcac

SEQ ID NO: 66203 - DNA, 20 bp, human
gaggccggcagcatgagcgg

SEQ ID NO: 66204 - DNA, 20 bp, human
gacgagcagaccggcttggg

SEQ ID NO: 66205 - DNA, 20 bp, human
gttcacgagcagaccggctt

SEQ ID NO: 66206 - DNA, 20 bp, human
gctccctggccgctcctgta

SEQ ID NO: 66207 - DNA, 20 bp, human
gtggcgcgcccggagcccag

SEQ ID NO: 66208 - DNA, 20 bp, human
gcggcggccacgatgagtgc

SEQ ID NO: 66209 - DNA, 20 bp, human
ggcgtcgcccgcactcatcg

SEQ ID NO: 66210 - DNA, 20 bp, human
ggccactctccgtacaggag

SEQ ID NO: 66211 - DNA, 20 bp, human
gctccctccgctagagtcag

SEQ ID NO: 66212 - DNA, 20 bp, human
gagaccgccgctgactctag

SEQ ID NO: 66213 - DNA, 20 bp, human
gcgggcgacgcagtgtgcac

SEQ ID NO: 66214 - DNA, 20 bp, human
gcccgcggcagaaggaagtc

SEQ ID NO: 66215 - DNA, 20 bp, human
gcaggcgccactctccgtac

SEQ ID NO: 66216 - DNA, 20 bp, human
gccggcggaagcacgagaag

SEQ ID NO: 66217 - DNA, 20 bp, human
gagcctcagcttcttctcgg

SEQ ID NO: 66218 - DNA, 20 bp, human
gcctggaccctgtctctcac

SEQ ID NO: 66219 - DNA, 20 bp, human
ggaggtgcccgccattctca

SEQ ID NO: 66220 - DNA, 20 bp, human
gccacgtgctgtacagcggc

SEQ ID NO: 66221 - DNA, 20 bp, human
gtccctcccaagccccgaga

SEQ ID NO: 66222 - DNA, 20 bp, human
gacccagggagttgattcca

SEQ ID NO: 66223 - DNA, 20 bp, human
ggtaccaggagcgccacgga

SEQ ID NO: 66224 - DNA, 20 bp, human
gggcggtaccaggagcgcca

SEQ ID NO: 66225 - DNA, 20 bp, human
ggctgtacagcggctggctg

SEQ ID NO: 66226 - DNA, 20 bp, human
gctgggctgagggaacccag

SEQ ID NO: 66227 - DNA, 20 bp, human
ggacgcgcgggcggattcag

SEQ ID NO: 66228 - DNA, 20 bp, human
gaaccgggctggacagggct

SEQ ID NO: 66229 - DNA, 20 bp, human
gtctaaggcctcaaatgcta

SEQ ID NO: 66230 - DNA, 20 bp, human
gggttgagagggatgtggac

SEQ ID NO: 66231 - DNA, 20 bp, human
gcagagcggcgcttctcgaa

SEQ ID NO: 66232 - DNA, 20 bp, human
gtcatccccccagctagcta

SEQ ID NO: 66233 - DNA, 20 bp, human
gcaggatccatcccccaata

SEQ ID NO: 66234 - DNA, 20 bp, human
gacacgaacttcatcctccc

SEQ ID NO: 66235 - DNA, 20 bp, human
gccggtgaggacagtagcca

SEQ ID NO: 66236 - DNA, 20 bp, human
ggagccgcctgggcgcccca

SEQ ID NO: 66237 - DNA, 20 bp, human
gccccgtgagtgtagaggag

SEQ ID NO: 66238 - DNA, 20 bp, human
gctggcactgaagggcgttc

SEQ ID NO: 66239 - DNA, 20 bp, human
gcgctgggccgagtgtgcag

SEQ ID NO: 66240 - DNA, 20 bp, human
ggctgagtcactgaagacgg

SEQ ID NO: 66241 - DNA, 20 bp, human
gcattggctctggcactgaa

SEQ ID NO: 66242 - DNA, 20 bp, human
ggtgcaccgcaacccacaca

SEQ ID NO: 66243 - DNA, 20 bp, human
gagggtccccgtgagtgtag

SEQ ID NO: 66244 - DNA, 20 bp, human
gcgggggcgggtagtcgaga

SEQ ID NO: 66245 - DNA, 20 bp, human
gacgccgtcagccctgaagt

SEQ ID NO: 66246 - DNA, 20 bp, human
gagcacaacaacaacgacgg

SEQ ID NO: 66247 - DNA, 20 bp, human
gccgagcacaacaacaacga

SEQ ID NO: 66248 - DNA, 20 bp, human
ggccgctgcccgaggcacca

SEQ ID NO: 66249 - DNA, 20 bp, human
ggggcggagagtccactcac

SEQ ID NO: 66250 - DNA, 20 bp, human
ggggccgggaaccgaccggt

SEQ ID NO: 66251 - DNA, 20 bp, human
gtctgtgggagaaacaaacg

SEQ ID NO: 66252 - DNA, 20 bp, human
gccttgctgggagctagtag

SEQ ID NO: 66253 - DNA, 20 bp, human
gcccagggccgcccgagtgg

SEQ ID NO: 66254 - DNA, 20 bp, human
gccgggggccgggaaccgac

SEQ ID NO: 66255 - DNA, 20 bp, human
gcccggggacgccggaacca

SEQ ID NO: 66256 - DNA, 20 bp, human
gagtccgcgaggagagtccg

SEQ ID NO: 66257 - DNA, 20 bp, human
gcggcgcgcagtgtacatcg

SEQ ID NO: 66258 - DNA, 20 bp, human
gccgcgaggagagtccgcgg

SEQ ID NO: 66259 - DNA, 20 bp, human
gccggagaagcagggaaggt

SEQ ID NO: 66260 - DNA, 20 bp, human
gcgaggagagtccgcggtgg

SEQ ID NO: 66261 - DNA, 20 bp, human
ggactgactgaccgacggag

SEQ ID NO: 66262 - DNA, 20 bp, human
gcgagggccccggagaagca

SEQ ID NO: 66263 - DNA, 20 bp, human
gagggaaggttggcttccta

SEQ ID NO: 66264 - DNA, 20 bp, human
gacggtggcgagagccgcgg

SEQ ID NO: 66265 - DNA, 20 bp, human
gtggcttcctacggcccccg

SEQ ID NO: 66266 - DNA, 20 bp, human
ggtgggaggcgccctctccc

SEQ ID NO: 66267 - DNA, 20 bp, human
ggctggagcctggattcgag

SEQ ID NO: 66268 - DNA, 20 bp, human
ggagaggtggagtcccggga

SEQ ID NO: 66269 - DNA, 20 bp, human
gttagcagggctcggagagg

SEQ ID NO: 66270 - DNA, 20 bp, human
ggggaagaaggagggtgcaa

SEQ ID NO: 66271 - DNA, 20 bp, human
gcgcgccgaggtaagagcca

SEQ ID NO: 66272 - DNA, 20 bp, human
gggaagagaggggaagaccg

SEQ ID NO: 66273 - DNA, 20 bp, human
gaaccgcggggatggaatcg

SEQ ID NO: 66274 - DNA, 20 bp, human
ggggttagcagggctcggag

SEQ ID NO: 66275 - DNA, 20 bp, human
gatggaatcggggagcgctg

SEQ ID NO: 66276 - DNA, 20 bp, human
gccgcaggtcgaggaagtag

SEQ ID NO: 66277 - DNA, 20 bp, human
gctcatgccgctcaccaagg

SEQ ID NO: 66278 - DNA, 20 bp, human
ggttccggctcggctcagaa

SEQ ID NO: 66279 - DNA, 20 bp, human
gtgctcgatggccagttcca

SEQ ID NO: 66280 - DNA, 20 bp, human
gggcctcatgccgctcacca

SEQ ID NO: 66281 - DNA, 20 bp, human
ggcccgccgctctccatcat

SEQ ID NO: 66282 - DNA, 20 bp, human
gggcgtgattgatccgtcac

SEQ ID NO: 66283 - DNA, 20 bp, human
gccgcgccaaggtcttcccg

SEQ ID NO: 66284 - DNA, 20 bp, human
gtcccccggccgagctccag

SEQ ID NO: 66285 - DNA, 20 bp, human
ggacctgcggctctatgaca

SEQ ID NO: 66286 - DNA, 20 bp, human
gcggccgcactcacccactc

SEQ ID NO: 66287 - DNA, 20 bp, human
gtcccgcgactagaagtgtg

SEQ ID NO: 66288 - DNA, 20 bp, human
gcaccggacaggaagcgtct

SEQ ID NO: 66289 - DNA, 20 bp, human
gcgaccgcccaaggcaacgg

SEQ ID NO: 66290 - DNA, 20 bp, human
ggagcgtcgaccgactgaaa

SEQ ID NO: 66291 - DNA, 20 bp, human
gcagcggaaacaaaacacag

SEQ ID NO: 66292 - DNA, 20 bp, human
gtcacagcgccggggaccag

SEQ ID NO: 66293 - DNA, 20 bp, human
gagacagtctgcgaccggac

SEQ ID NO: 66294 - DNA, 20 bp, human
gccgcctcccaggcaccttc

SEQ ID NO: 66295 - DNA, 20 bp, human
gcggtcgacgctcaccggac

SEQ ID NO: 66296 - DNA, 20 bp, human
gcacgggggacttttcggtg

SEQ ID NO: 66297 - DNA, 20 bp, human
ggagcaggatctgccgacga

SEQ ID NO: 66298 - DNA, 20 bp, human
gaggcggccgcggcatgcta

SEQ ID NO: 66299 - DNA, 20 bp, human
gggcatgctagggccgagga

SEQ ID NO: 66300 - DNA, 20 bp, human
gccggcttgccggtcccgag

SEQ ID NO: 66301 - DNA, 20 bp, human
gaagccgggtagccgcgagg

SEQ ID NO: 66302 - DNA, 20 bp, human
ggccaggagccccggaaacc

SEQ ID NO: 66303 - DNA, 20 bp, human
gttcgggagcggcgacggga

SEQ ID NO: 66304 - DNA, 20 bp, human
gcgaccccatcgccaccccg

SEQ ID NO: 66305 - DNA, 20 bp, human
gacccgaggcgcctcgtacc

SEQ ID NO: 66306 - DNA, 20 bp, human
gccccctcgtggagaaacag

SEQ ID NO: 66307 - DNA, 20 bp, human
gcgcggaggtgaccactagg

SEQ ID NO: 66308 - DNA, 20 bp, human
gggaggtgaccactaggggg

SEQ ID NO: 66309 - DNA, 20 bp, human
ggctccgcgccgccccctag

SEQ ID NO: 66310 - DNA, 20 bp, human
gggatgctgtcgggaggaag

SEQ ID NO: 66311 - DNA, 20 bp, human
ggtctgcacccagaagtccg

SEQ ID NO: 66312 - DNA, 20 bp, human
ggaagcggtgtgacttctca

SEQ ID NO: 66313 - DNA, 20 bp, human
gggcctttaaccccccctcg

SEQ ID NO: 66314 - DNA, 20 bp, human
gctccacgagggggggttaa

SEQ ID NO: 66315 - DNA, 20 bp, human
gccaagggaagcccaggccg

SEQ ID NO: 66316 - DNA, 20 bp, human
gtagctgcagattggatatt

SEQ ID NO: 66317 - DNA, 20 bp, human
gtaagaccggggaaaagtct

SEQ ID NO: 66318 - DNA, 20 bp, human
gaggagcctgatcccacagc

SEQ ID NO: 66319 - DNA, 20 bp, human
ggagatcctgtgtccagagg

SEQ ID NO: 66320 - DNA, 20 bp, human
gagtctgggagagagaatcg

SEQ ID NO: 66321 - DNA, 20 bp, human
gtaaggccccctctggacac

SEQ ID NO: 66322 - DNA, 20 bp, human
gggtgtgaaatcttcagcaa

SEQ ID NO: 66323 - DNA, 20 bp, human
gcgggcgcgccagagcagag

SEQ ID NO: 66324 - DNA, 20 bp, human
gacttacctaaggccccctc

SEQ ID NO: 66325 - DNA, 20 bp, human
gggacgtattactactgtct

SEQ ID NO: 66326 - DNA, 20 bp, human
gcggcgcgaggtgtagaagg

SEQ ID NO: 66327 - DNA, 20 bp, human
gggctcctagcgctcctctc

SEQ ID NO: 66328 - DNA, 20 bp, human
gtcgtagtggcggtgatggg

SEQ ID NO: 66329 - DNA, 20 bp, human
gagaggctccctggaaacgg

SEQ ID NO: 66330 - DNA, 20 bp, human
gcggcggcgcgaggtgtaga

SEQ ID NO: 66331 - DNA, 20 bp, human
ggaggtgtagaaggaggcga

SEQ ID NO: 66332 - DNA, 20 bp, human
gcaagagagcgtggagcgat

SEQ ID NO: 66333 - DNA, 20 bp, human
ggaggcgaaggcgttcgtag

SEQ ID NO: 66334 - DNA, 20 bp, human
gtgctgccgagcaggtgtcc

SEQ ID NO: 66335 - DNA, 20 bp, human
gaggaggagtcaggccgggt

SEQ ID NO: 66336 - DNA, 20 bp, human
gagagagacagaccgagaga

SEQ ID NO: 66337 - DNA, 20 bp, human
gcagaagccgagctctgtca

SEQ ID NO: 66338 - DNA, 20 bp, human
gaaggagactctcagtacgg

SEQ ID NO: 66339 - DNA, 20 bp, human
gttggctaggggccactccg

SEQ ID NO: 66340 - DNA, 20 bp, human
ggcagctgtgatgctatcct

SEQ ID NO: 66341 - DNA, 20 bp, human
gggagagatgctatcgctaa

SEQ ID NO: 66342 - DNA, 20 bp, human
gtgctgacctgcttccaaag

SEQ ID NO: 66343 - DNA, 20 bp, human
gatctgagcagggagacact

SEQ ID NO: 66344 - DNA, 20 bp, human
gaacccgatttgaggaaggg

SEQ ID NO: 66345 - DNA, 20 bp, human
ggctgcagaaagccacggag

SEQ ID NO: 66346 - DNA, 20 bp, human
gtgagcagggtgcgaggaga

SEQ ID NO: 66347 - DNA, 20 bp, human
gtagatgcggagagcaccaa

SEQ ID NO: 66348 - DNA, 20 bp, human
gcaggatccaagaggcgtgt

SEQ ID NO: 66349 - DNA, 20 bp, human
gccccaagctaaaggagagg

SEQ ID NO: 66350 - DNA, 20 bp, human
gttgccccaagctaaaggag

SEQ ID NO: 66351 - DNA, 20 bp, human
gaagaggcgtgtgggcactg

SEQ ID NO: 66352 - DNA, 20 bp, human
gcgtgaacaggcttgaagta

SEQ ID NO: 66353 - DNA, 20 bp, human
ggtcgcttgccccaagctaa

SEQ ID NO: 66354 - DNA, 20 bp, human
gaggcacaggaagcgcagga

SEQ ID NO: 66355 - DNA, 20 bp, human
gagggcgaaactgaccccgg

SEQ ID NO: 66356 - DNA, 20 bp, human
gcgccccgaggagaagggtg

SEQ ID NO: 66357 - DNA, 20 bp, human
gcgcgagcggggaagaggac

SEQ ID NO: 66358 - DNA, 20 bp, human
gtcgcgctggcagcatgggg

SEQ ID NO: 66359 - DNA, 20 bp, human
ggagacgacatgtggcgctc

SEQ ID NO: 66360 - DNA, 20 bp, human
gtctcctcggggcgcctgag

SEQ ID NO: 66361 - DNA, 20 bp, human
ggacatgtggcgctcgggcg

SEQ ID NO: 66362 - DNA, 20 bp, human
gcaggcgcggaaggccggtg

SEQ ID NO: 66363 - DNA, 20 bp, human
gcgcgccctggtgccccgtc

SEQ ID NO: 66364 - DNA, 20 bp, human
gtaccggagcacctctgcag

SEQ ID NO: 66365 - DNA, 20 bp, human
gctgccagcgcgaacttccc

SEQ ID NO: 66366 - DNA, 20 bp, human
gtagcagggaggacgaccct

SEQ ID NO: 66367 - DNA, 20 bp, human
gtgggaaaggagagtctgaa

SEQ ID NO: 66368 - DNA, 20 bp, human
gtgatataggagtcacccaa

SEQ ID NO: 66369 - DNA, 20 bp, human
gcttctcacgtggaacaagg

SEQ ID NO: 66370 - DNA, 20 bp, human
gtcattgactgtctacacac

SEQ ID NO: 66371 - DNA, 20 bp, human
ggaagagctggctagcaggg

SEQ ID NO: 66372 - DNA, 20 bp, human
gcagggaggacgaccctagg

SEQ ID NO: 66373 - DNA, 20 bp, human
gtgagtcagtcagaggagcc

SEQ ID NO: 66374 - DNA, 20 bp, human
gtgcagaattcaccctccta

SEQ ID NO: 66375 - DNA, 20 bp, human
ggcatgtatttgtaacaggg

SEQ ID NO: 66376 - DNA, 20 bp, human
ggcttgcggccggacttcgg

SEQ ID NO: 66377 - DNA, 20 bp, human
ggaaaaggagaactaaggat

SEQ ID NO: 66378 - DNA, 20 bp, human
gtcaaggaatgcaacttagt

SEQ ID NO: 66379 - DNA, 20 bp, human
gcgcatgcgcaggtccattc

SEQ ID NO: 66380 - DNA, 20 bp, human
gtgcaacttagtcggctgct

SEQ ID NO: 66381 - DNA, 20 bp, human
gacaaaatcgagagagtctg

SEQ ID NO: 66382 - DNA, 20 bp, human
gaagcgttacctccgaagtc

SEQ ID NO: 66383 - DNA, 20 bp, human
gtgggttcattggtgctaag

SEQ ID NO: 66384 - DNA, 20 bp, human
gctgggcagtaattcccgaa

SEQ ID NO: 66385 - DNA, 20 bp, human
gtcttttctgcgaagattca

SEQ ID NO: 66386 - DNA, 20 bp, human
gtgcactgggcagactaagt

SEQ ID NO: 66387 - DNA, 20 bp, human
gccacatgcacccacaacta

SEQ ID NO: 66388 - DNA, 20 bp, human
gtacctctgcgcacagacag

SEQ ID NO: 66389 - DNA, 20 bp, human
gtgcacccacaactagggag

SEQ ID NO: 66390 - DNA, 20 bp, human
gcaataagcaggcatcaata

SEQ ID NO: 66391 - DNA, 20 bp, human
gcggtggatagactcctgaa

SEQ ID NO: 66392 - DNA, 20 bp, human
gtagtttttgatggaattga

SEQ ID NO: 66393 - DNA, 20 bp, human
ggacagcggcgattattaag

SEQ ID NO: 66394 - DNA, 20 bp, human
ggtgcagtaattctaatgtg

SEQ ID NO: 66395 - DNA, 20 bp, human
gtcgctggttaaagagacgg

SEQ ID NO: 66396 - DNA, 20 bp, human
gcgggaagcgcgacccacgg

SEQ ID NO: 66397 - DNA, 20 bp, human
ggcaggagcagccccggctg

SEQ ID NO: 66398 - DNA, 20 bp, human
gcggctgcgggtcgcgacgg

SEQ ID NO: 66399 - DNA, 20 bp, human
gccccggctgcgggtcgcga

SEQ ID NO: 66400 - DNA, 20 bp, human
gtgtgctgcgcccagaggta

SEQ ID NO: 66401 - DNA, 20 bp, human
gttgcgggaagcgcgaccca

SEQ ID NO: 66402 - DNA, 20 bp, human
gcccgacttcgggggtaagt

SEQ ID NO: 66403 - DNA, 20 bp, human
gcacccgcgaccctacctct

SEQ ID NO: 66404 - DNA, 20 bp, human
gcggcggcctgggcggaggg

SEQ ID NO: 66405 - DNA, 20 bp, human
ggcctaagacccgacttcgg

SEQ ID NO: 66406 - DNA, 20 bp, human
gccgtcctggtgctgaacct

SEQ ID NO: 66407 - DNA, 20 bp, human
ggcgcgcgtggagggtcccc

SEQ ID NO: 66408 - DNA, 20 bp, human
ggacggggtccgcgcaaact

SEQ ID NO: 66409 - DNA, 20 bp, human
gcgccgcgtcccgagcccaa

SEQ ID NO: 66410 - DNA, 20 bp, human
gtccgggcgagtccaacgag

SEQ ID NO: 66411 - DNA, 20 bp, human
gtccgcgcaaacttggctcc

SEQ ID NO: 66412 - DNA, 20 bp, human
gccaggacggcggacagcac

SEQ ID NO: 66413 - DNA, 20 bp, human
gctgaacctgggctgggcga

SEQ ID NO: 66414 - DNA, 20 bp, human
ggcgggcgcgtccatggccg

SEQ ID NO: 66415 - DNA, 20 bp, human
gtcccggttcccctgctccg

SEQ ID NO: 66416 - DNA, 20 bp, human
ggagtcttgcgcaggaacag

SEQ ID NO: 66417 - DNA, 20 bp, human
gcctggtgacaagcactcct

SEQ ID NO: 66418 - DNA, 20 bp, human
gataagatgcctaggaggac

SEQ ID NO: 66419 - DNA, 20 bp, human
ggaggtcgcggctcacgctc

SEQ ID NO: 66420 - DNA, 20 bp, human
ggttcctgcgcaagactccg

SEQ ID NO: 66421 - DNA, 20 bp, human
gaggaggactggaagaactt

SEQ ID NO: 66422 - DNA, 20 bp, human
ggtggtcgcgccggtctccg

SEQ ID NO: 66423 - DNA, 20 bp, human
gactcggccagcccgcggta

SEQ ID NO: 66424 - DNA, 20 bp, human
gggcgcgaccacctgcgcgg

SEQ ID NO: 66425 - DNA, 20 bp, human
gaccggcgcgaccacctgcg

SEQ ID NO: 66426 - DNA, 20 bp, human
gcagctggctgagtacagaa

SEQ ID NO: 66427 - DNA, 20 bp, human
ggttactgggagggagtgag

SEQ ID NO: 66428 - DNA, 20 bp, human
ggtgcacctcccaaacaggt

SEQ ID NO: 66429 - DNA, 20 bp, human
gaactggtgagtaaattcag

SEQ ID NO: 66430 - DNA, 20 bp, human
gctgcggagtcaaagtagag

SEQ ID NO: 66431 - DNA, 20 bp, human
gtgaaggttgagttactggg

SEQ ID NO: 66432 - DNA, 20 bp, human
gtgactccgcagaagaaaag

SEQ ID NO: 66433 - DNA, 20 bp, human
gggcagtgcacctcccaaac

SEQ ID NO: 66434 - DNA, 20 bp, human
gtaaaagaaaggggaataag

SEQ ID NO: 66435 - DNA, 20 bp, human
gtaatgaaggttgagttact

SEQ ID NO: 66436 - DNA, 20 bp, human
gaaagggcacatcttaccca

SEQ ID NO: 66437 - DNA, 20 bp, human
gtatatggggcggggactgg

SEQ ID NO: 66438 - DNA, 20 bp, human
gaggagagagcgaatatatg

SEQ ID NO: 66439 - DNA, 20 bp, human
ggatatgtgtgagggagctg

SEQ ID NO: 66440 - DNA, 20 bp, human
gaatgggtcctggcgcacac

SEQ ID NO: 66441 - DNA, 20 bp, human
gaacaaaacgacgccaaaaa

SEQ ID NO: 66442 - DNA, 20 bp, human
gttcacagaaaatgacggtg

SEQ ID NO: 66443 - DNA, 20 bp, human
ggggctgtgctgatacacgc

SEQ ID NO: 66444 - DNA, 20 bp, human
gcctgctgtcgctctaccct

SEQ ID NO: 66445 - DNA, 20 bp, human
gaccggagagatatgtgtga

SEQ ID NO: 66446 - DNA, 20 bp, human
ggcgggacaggtatctactc

SEQ ID NO: 66447 - DNA, 20 bp, human
gcgcgtgcaagcccgagaac

SEQ ID NO: 66448 - DNA, 20 bp, human
gcccgagctgggcgacaggg

SEQ ID NO: 66449 - DNA, 20 bp, human
gccccgcctggagccgcgag

SEQ ID NO: 66450 - DNA, 20 bp, human
gtccagtgtgcgccccgcgg

SEQ ID NO: 66451 - DNA, 20 bp, human
gctctgcagccgggagtgtg

SEQ ID NO: 66452 - DNA, 20 bp, human
gccctgcgccccgagctcca

SEQ ID NO: 66453 - DNA, 20 bp, human
ggcagcctcggaggaagcca

SEQ ID NO: 66454 - DNA, 20 bp, human
gcatggtgccgtggagctcg

SEQ ID NO: 66455 - DNA, 20 bp, human
ggccggtccgcgcaaccggg

SEQ ID NO: 66456 - DNA, 20 bp, human
gcccagtctaggagccggga

SEQ ID NO: 66457 - DNA, 20 bp, human
ggctgcgtgtccacatacga

SEQ ID NO: 66458 - DNA, 20 bp, human
gcagccaccctcagatggag

SEQ ID NO: 66459 - DNA, 20 bp, human
ggtccacatacgaggggaca

SEQ ID NO: 66460 - DNA, 20 bp, human
gagagagccactccatctga

SEQ ID NO: 66461 - DNA, 20 bp, human
gctgaggatgaggagaaccc

SEQ ID NO: 66462 - DNA, 20 bp, human
gcaagccctgctgggaccga

SEQ ID NO: 66463 - DNA, 20 bp, human
gtagagcccgaattaggtta

SEQ ID NO: 66464 - DNA, 20 bp, human
gcccagaagataaagtggtg

SEQ ID NO: 66465 - DNA, 20 bp, human
gcaggagtagagcccgaatt

SEQ ID NO: 66466 - DNA, 20 bp, human
gctggacgcagctcccccca

SEQ ID NO: 66467 - DNA, 20 bp, human
gggagagtgggtgactactg

SEQ ID NO: 66468 - DNA, 20 bp, human
ggggccgcgaaaaggaacag

SEQ ID NO: 66469 - DNA, 20 bp, human
ggccgctcctggctgcgact

SEQ ID NO: 66470 - DNA, 20 bp, human
gagaggttcaggacgacttc

SEQ ID NO: 66471 - DNA, 20 bp, human
gccggagatgagagcccggg

SEQ ID NO: 66472 - DNA, 20 bp, human
ggcccgcttaccagttgaag

SEQ ID NO: 66473 - DNA, 20 bp, human
gataccggagatgagagccc

SEQ ID NO: 66474 - DNA, 20 bp, human
gagcagaggagaactcgaag

SEQ ID NO: 66475 - DNA, 20 bp, human
gtctaaggagagagcagcga

SEQ ID NO: 66476 - DNA, 20 bp, human
gtatttgggacagccaacat

SEQ ID NO: 66477 - DNA, 20 bp, human
gtgaatttggaaacccatgt

SEQ ID NO: 66478 - DNA, 20 bp, human
gctgtcccaaatatgagatt

SEQ ID NO: 66479 - DNA, 20 bp, human
gtcacccaggacaattcata

SEQ ID NO: 66480 - DNA, 20 bp, human
ggtttgctgtctgtgtccta

SEQ ID NO: 66481 - DNA, 20 bp, human
ggatgccaaatctcatattt

SEQ ID NO: 66482 - DNA, 20 bp, human
ggcaggtgagtggacattta

SEQ ID NO: 66483 - DNA, 20 bp, human
gtccacgagatgtctaagaa

SEQ ID NO: 66484 - DNA, 20 bp, human
gagtggacatttagggatag

SEQ ID NO: 66485 - DNA, 20 bp, human
gatagaggatttaggaaaag

SEQ ID NO: 66486 - DNA, 20 bp, human
gctcagagcagcccgtcagg

SEQ ID NO: 66487 - DNA, 20 bp, human
ggaggcagcagatggatcaa

SEQ ID NO: 66488 - DNA, 20 bp, human
ggctgaacgcaggcatccga

SEQ ID NO: 66489 - DNA, 20 bp, human
gccatctgctgcctcctgac

SEQ ID NO: 66490 - DNA, 20 bp, human
gtggcagagcaaatcccccc

SEQ ID NO: 66491 - DNA, 20 bp, human
gcccctcagagcagcccgtc

SEQ ID NO: 66492 - DNA, 20 bp, human
gcaagccaaggtaaagtcat

SEQ ID NO: 66493 - DNA, 20 bp, human
gcagtgggatggctccccag

SEQ ID NO: 66494 - DNA, 20 bp, human
gggatcaatggtcaagccag

SEQ ID NO: 66495 - DNA, 20 bp, human
gaacgcaggcatccgaagga

SEQ ID NO: 66496 - DNA, 20 bp, human
gccccggaaaaagggaccaa

SEQ ID NO: 66497 - DNA, 20 bp, human
gatactcagtaaaccctcag

SEQ ID NO: 66498 - DNA, 20 bp, human
gcatcaagatgacacaccag

SEQ ID NO: 66499 - DNA, 20 bp, human
ggcactatgagcatcttacc

SEQ ID NO: 66500 - DNA, 20 bp, human
gcattgaagaggagcaccgc

SEQ ID NO: 66501 - DNA, 20 bp, human
gtgcttaggactgccgctga

SEQ ID NO: 66502 - DNA, 20 bp, human
gatgctcatagtgcagtcca

SEQ ID NO: 66503 - DNA, 20 bp, human
ggtcaggggaaatgcattag

SEQ ID NO: 66504 - DNA, 20 bp, human
gaaaaccttccccggaaaaa

SEQ ID NO: 66505 - DNA, 20 bp, human
ggaaactgtgatcacagtat

SEQ ID NO: 66506 - DNA, 20 bp, human
ggagggaactagcgagaacg

SEQ ID NO: 66507 - DNA, 20 bp, human
gacgccccggggaagcacgg

SEQ ID NO: 66508 - DNA, 20 bp, human
gagaagagagagattcggag

SEQ ID NO: 66509 - DNA, 20 bp, human
gcccggggcgtgaatccgga

SEQ ID NO: 66510 - DNA, 20 bp, human
gcgctcggctcggccctgac

SEQ ID NO: 66511 - DNA, 20 bp, human
gtcgcagcatggaagctcaa

SEQ ID NO: 66512 - DNA, 20 bp, human
gctggcgctcgcgtgcgaga

SEQ ID NO: 66513 - DNA, 20 bp, human
ggagcgcctgtccctccaaa

SEQ ID NO: 66514 - DNA, 20 bp, human
gcagcctccgtgcttccccg

SEQ ID NO: 66515 - DNA, 20 bp, human
ggcgagaacgaggaagcagc

SEQ ID NO: 66516 - DNA, 20 bp, human
gcagagcccggagatgccat

SEQ ID NO: 66517 - DNA, 20 bp, human
ggtcactccgtcccacccca

SEQ ID NO: 66518 - DNA, 20 bp, human
gcaaagccgatggcatctcc

SEQ ID NO: 66519 - DNA, 20 bp, human
gagggtacaagaggctgtag

SEQ ID NO: 66520 - DNA, 20 bp, human
gccagtggggatgaatgagg

SEQ ID NO: 66521 - DNA, 20 bp, human
gctccagtctccaaagccga

SEQ ID NO: 66522 - DNA, 20 bp, human
gtccgggtgtctggaccctg

SEQ ID NO: 66523 - DNA, 20 bp, human
gtggggcgctgctaagatcc

SEQ ID NO: 66524 - DNA, 20 bp, human
gtgtatgcgagctggagaca

SEQ ID NO: 66525 - DNA, 20 bp, human
ggcccggactcaggaaagcg

SEQ ID NO: 66526 - DNA, 20 bp, human
gagggttggcaggataaccc

SEQ ID NO: 66527 - DNA, 20 bp, human
gggggccctttgtcctccag

SEQ ID NO: 66528 - DNA, 20 bp, human
ggagagtcccgagggagcaa

SEQ ID NO: 66529 - DNA, 20 bp, human
gggctgtggaaggcttgcag

SEQ ID NO: 66530 - DNA, 20 bp, human
gtgtcgtgcggcccgtggcg

SEQ ID NO: 66531 - DNA, 20 bp, human
ggctccacggagagtcccga

SEQ ID NO: 66532 - DNA, 20 bp, human
ggggccgcacgacactaatt

SEQ ID NO: 66533 - DNA, 20 bp, human
gccggacctcgcctcgccac

SEQ ID NO: 66534 - DNA, 20 bp, human
gttgtcctccagtggctggt

SEQ ID NO: 66535 - DNA, 20 bp, human
gcgagcaagcaaggcgggag

SEQ ID NO: 66536 - DNA, 20 bp, human
gaggaagttgcggaaaccaa

SEQ ID NO: 66537 - DNA, 20 bp, human
gtccttggcgaggataatcc

SEQ ID NO: 66538 - DNA, 20 bp, human
gcgaagcgtcggactaccgt

SEQ ID NO: 66539 - DNA, 20 bp, human
gaggcgatcctggcgctgag

SEQ ID NO: 66540 - DNA, 20 bp, human
gatgcagacggtgaccgccg

SEQ ID NO: 66541 - DNA, 20 bp, human
gcgccaggatcgcctcacag

SEQ ID NO: 66542 - DNA, 20 bp, human
gccccactgtgaggcgatcc

SEQ ID NO: 66543 - DNA, 20 bp, human
ggctcagatcgccgaagcgt

SEQ ID NO: 66544 - DNA, 20 bp, human
gagcggaacgtagcacccgg

SEQ ID NO: 66545 - DNA, 20 bp, human
gggaaagagggatcagtgac

SEQ ID NO: 66546 - DNA, 20 bp, human
ggaggagccagcgcagtgag

SEQ ID NO: 66547 - DNA, 20 bp, human
gaagggcgcgcagcgtagta

SEQ ID NO: 66548 - DNA, 20 bp, human
ggggcgcactcgctggtggt

SEQ ID NO: 66549 - DNA, 20 bp, human
gacggtcgccgaccgaccag

SEQ ID NO: 66550 - DNA, 20 bp, human
gggctcctccgcaggatgca

SEQ ID NO: 66551 - DNA, 20 bp, human
gctcgtagacgccggcagtg

SEQ ID NO: 66552 - DNA, 20 bp, human
gtgctgtcggcgcagcgtca

SEQ ID NO: 66553 - DNA, 20 bp, human
ggtaggggcgcactcgctgg

SEQ ID NO: 66554 - DNA, 20 bp, human
gacaagcggagagcgcggag

SEQ ID NO: 66555 - DNA, 20 bp, human
ggtagtaggggcgcactcgc

SEQ ID NO: 66556 - DNA, 20 bp, human
gggtggtccccggttcgtta

SEQ ID NO: 66557 - DNA, 20 bp, human
ggcgacggccataacgaacc

SEQ ID NO: 66558 - DNA, 20 bp, human
gggtcgccgccacacctagt

SEQ ID NO: 66559 - DNA, 20 bp, human
ggcacgcagcctactaggtg

SEQ ID NO: 66560 - DNA, 20 bp, human
gccccgcacagccaagatgg

SEQ ID NO: 66561 - DNA, 20 bp, human
gcgcagcctactaggtgtgg

SEQ ID NO: 66562 - DNA, 20 bp, human
ggacgtgaccccgaaggggt

SEQ ID NO: 66563 - DNA, 20 bp, human
gggaccccgcacagccaaga

SEQ ID NO: 66564 - DNA, 20 bp, human
ggacaggcacgcagcctact

SEQ ID NO: 66565 - DNA, 20 bp, human
gggccgcgcccggtagccac

SEQ ID NO: 66566 - DNA, 20 bp, human
gcagtgcaaacggagggacg

SEQ ID NO: 66567 - DNA, 20 bp, human
ggaacaccagtgcaaacgga

SEQ ID NO: 66568 - DNA, 20 bp, human
gcacctgcgggtcccccggg

SEQ ID NO: 66569 - DNA, 20 bp, human
ggcggctcccgcagtctggg

SEQ ID NO: 66570 - DNA, 20 bp, human
gaccgccagtgtcctgtgga

SEQ ID NO: 66571 - DNA, 20 bp, human
gaccgcgcctaagacataac

SEQ ID NO: 66572 - DNA, 20 bp, human
gatctaactagggaaacatg

SEQ ID NO: 66573 - DNA, 20 bp, human
gccgaggcagcgccccccgg

SEQ ID NO: 66574 - DNA, 20 bp, human
ggagagaacaccagtgcaaa

SEQ ID NO: 66575 - DNA, 20 bp, human
gggacggtaacgactcagcg

SEQ ID NO: 66576 - DNA, 20 bp, human
gcagagggatggaagtccgg

SEQ ID NO: 66577 - DNA, 20 bp, human
gctgtccgggacctcattca

SEQ ID NO: 66578 - DNA, 20 bp, human
gccaggaatacccgatacag

SEQ ID NO: 66579 - DNA, 20 bp, human
gtcccggacaggtgcgagga

SEQ ID NO: 66580 - DNA, 20 bp, human
gccaggacaaggaggaaggt

SEQ ID NO: 66581 - DNA, 20 bp, human
gtggtctcgttcctgtcgtc

SEQ ID NO: 66582 - DNA, 20 bp, human
gcgggtattcctggcacctc

SEQ ID NO: 66583 - DNA, 20 bp, human
ggttctccacgtgggtaaag

SEQ ID NO: 66584 - DNA, 20 bp, human
gaccacgaagcaggacccaa

SEQ ID NO: 66585 - DNA, 20 bp, human
ggcgaggagggcgataaaga

SEQ ID NO: 66586 - DNA, 20 bp, human
gatgcaggctgctcctatgt

SEQ ID NO: 66587 - DNA, 20 bp, human
gatgaacaaatttccaacat

SEQ ID NO: 66588 - DNA, 20 bp, human
gaaggctgtaaagctttatt

SEQ ID NO: 66589 - DNA, 20 bp, human
gtaacagaaacacaacgatt

SEQ ID NO: 66590 - DNA, 20 bp, human
ggctttcgccatcttggccg

SEQ ID NO: 66591 - DNA, 20 bp, human
ggtattgtaactctctgagc

SEQ ID NO: 66592 - DNA, 20 bp, human
gcgcaagacttctttgcaga

SEQ ID NO: 66593 - DNA, 20 bp, human
gagacacgttgaaatgatgc

SEQ ID NO: 66594 - DNA, 20 bp, human
gcaagactccgtctcaaaag

SEQ ID NO: 66595 - DNA, 20 bp, human
gtctttgtcctcttttgaga

SEQ ID NO: 66596 - DNA, 20 bp, human
gagatggtgcacctccgggc

SEQ ID NO: 66597 - DNA, 20 bp, human
gcggaagatggtgcacctcc

SEQ ID NO: 66598 - DNA, 20 bp, human
gctcacgggcgcctacgtca

SEQ ID NO: 66599 - DNA, 20 bp, human
ggcgtcagcccggagtggaa

SEQ ID NO: 66600 - DNA, 20 bp, human
gcgcggcagccggagtggtc

SEQ ID NO: 66601 - DNA, 20 bp, human
gtcagcaaccgccggcccgg

SEQ ID NO: 66602 - DNA, 20 bp, human
gagggtcccagcgggatcgt

SEQ ID NO: 66603 - DNA, 20 bp, human
ggagctgacccggacggcga

SEQ ID NO: 66604 - DNA, 20 bp, human
gctgccgagggcgtgggtca

SEQ ID NO: 66605 - DNA, 20 bp, human
ggtggctgcgccgcaccccg

SEQ ID NO: 66606 - DNA, 20 bp, human
gccgggcggcggacacgtgg

SEQ ID NO: 66607 - DNA, 20 bp, human
gtggcggcggccacaccggg

SEQ ID NO: 66608 - DNA, 20 bp, human
ggcggacacgtggagggacc

SEQ ID NO: 66609 - DNA, 20 bp, human
gtgcgccgcatatatagcag

SEQ ID NO: 66610 - DNA, 20 bp, human
ggcgggtcggaacccggagt

SEQ ID NO: 66611 - DNA, 20 bp, human
gagaaagggccgcggcgagg

SEQ ID NO: 66612 - DNA, 20 bp, human
gccgcagctcaaggtactac

SEQ ID NO: 66613 - DNA, 20 bp, human
gcagaaccgtccctgggcag

SEQ ID NO: 66614 - DNA, 20 bp, human
gagacgcgccccgcacttac

SEQ ID NO: 66615 - DNA, 20 bp, human
gcggtggcggcggccacacc

SEQ ID NO: 66616 - DNA, 20 bp, human
ggtgatcgcagaggcagcct

SEQ ID NO: 66617 - DNA, 20 bp, human
ggcagcctgggagttggacg

SEQ ID NO: 66618 - DNA, 20 bp, human
gtgtctcccagtgatcgcag

SEQ ID NO: 66619 - DNA, 20 bp, human
gaaagagacacactcacctc

SEQ ID NO: 66620 - DNA, 20 bp, human
gctcaggcagtgggtagaaa

SEQ ID NO: 66621 - DNA, 20 bp, human
gtgatgggcgtaatctagaa

SEQ ID NO: 66622 - DNA, 20 bp, human
gttggacgtggctcaggcag

SEQ ID NO: 66623 - DNA, 20 bp, human
ggggcaggaatagatggagt

SEQ ID NO: 66624 - DNA, 20 bp, human
ggctgaactgatgccctcca

SEQ ID NO: 66625 - DNA, 20 bp, human
gactcacctcgggctgtggc

SEQ ID NO: 66626 - DNA, 20 bp, human
gtgcctgtgcctgcaccctg

SEQ ID NO: 66627 - DNA, 20 bp, human
gtccagcgaggggacagtcg

SEQ ID NO: 66628 - DNA, 20 bp, human
gcgaggcttgagctcccccg

SEQ ID NO: 66629 - DNA, 20 bp, human
ggggcctgagccgcagaccg

SEQ ID NO: 66630 - DNA, 20 bp, human
ggtctccacgccacagtgtt

SEQ ID NO: 66631 - DNA, 20 bp, human
gccccgaggtcccaccgcct

SEQ ID NO: 66632 - DNA, 20 bp, human
ggccgcagaccgaggctggg

SEQ ID NO: 66633 - DNA, 20 bp, human
gagtgtccgcgtgacggctg

SEQ ID NO: 66634 - DNA, 20 bp, human
gtctgggctccccagggtgc

SEQ ID NO: 66635 - DNA, 20 bp, human
ggctattctgagagacggac

SEQ ID NO: 66636 - DNA, 20 bp, human
ggcgctgagaggcaagccac

SEQ ID NO: 66637 - DNA, 20 bp, human
ggaggatggagggaattcca

SEQ ID NO: 66638 - DNA, 20 bp, human
gatcccatccaggcgctgag

SEQ ID NO: 66639 - DNA, 20 bp, human
gtgggaggtatggtgcgggt

SEQ ID NO: 66640 - DNA, 20 bp, human
gtggtgcgggtgggcagtaa

SEQ ID NO: 66641 - DNA, 20 bp, human
gaaatccgcacggggtccga

SEQ ID NO: 66642 - DNA, 20 bp, human
gtgcctctcagcgcctggat

SEQ ID NO: 66643 - DNA, 20 bp, human
ggggcagtaatggagacagg

SEQ ID NO: 66644 - DNA, 20 bp, human
gccgggaggagcgagcctag

SEQ ID NO: 66645 - DNA, 20 bp, human
gcaaggcagggatgatgcgg

SEQ ID NO: 66646 - DNA, 20 bp, human
gcccactcaccaggccacaa

SEQ ID NO: 66647 - DNA, 20 bp, human
ggggagcagcaagggaaatc

SEQ ID NO: 66648 - DNA, 20 bp, human
gagacgcggctagaccccag

SEQ ID NO: 66649 - DNA, 20 bp, human
gaaaccaaggataggaccag

SEQ ID NO: 66650 - DNA, 20 bp, human
ggtctccgggagtaaaagtg

SEQ ID NO: 66651 - DNA, 20 bp, human
gggctgggatctccaatcat

SEQ ID NO: 66652 - DNA, 20 bp, human
gcctccactggtcctatcct

SEQ ID NO: 66653 - DNA, 20 bp, human
gtcggagcagggagctgtcg

SEQ ID NO: 66654 - DNA, 20 bp, human
gaactcgcgatcagggacca

SEQ ID NO: 66655 - DNA, 20 bp, human
ggcagcaagggaaatcgggc

SEQ ID NO: 66656 - DNA, 20 bp, human
gcggggtgggcaggacggaa

SEQ ID NO: 66657 - DNA, 20 bp, human
gacagccgtgcagctgcgga

SEQ ID NO: 66658 - DNA, 20 bp, human
gcaccagtcgctgccggggt

SEQ ID NO: 66659 - DNA, 20 bp, human
gcttgggagggcccttccag

SEQ ID NO: 66660 - DNA, 20 bp, human
ggacggaagggctggtcgta

SEQ ID NO: 66661 - DNA, 20 bp, human
gagggctggtcgtagggatg

SEQ ID NO: 66662 - DNA, 20 bp, human
gatggggaagagcaagtacg

SEQ ID NO: 66663 - DNA, 20 bp, human
gggcactggttggagatcgg

SEQ ID NO: 66664 - DNA, 20 bp, human
gggaacaccagtcgctgccg

SEQ ID NO: 66665 - DNA, 20 bp, human
ggggcgtctagaaggagttg

SEQ ID NO: 66666 - DNA, 20 bp, human
gccggaggtccagagagtat

SEQ ID NO: 66667 - DNA, 20 bp, human
ggacccacacaatggctgag

SEQ ID NO: 66668 - DNA, 20 bp, human
gcacagcagcaagggcaccg

SEQ ID NO: 66669 - DNA, 20 bp, human
ggcgcggcccgccgaacccg

SEQ ID NO: 66670 - DNA, 20 bp, human
gcgagcgaaagctatgactg

SEQ ID NO: 66671 - DNA, 20 bp, human
gctgctgactggcaccctag

SEQ ID NO: 66672 - DNA, 20 bp, human
gagccactcagccattgtgt

SEQ ID NO: 66673 - DNA, 20 bp, human
gatggctgagtggctactct

SEQ ID NO: 66674 - DNA, 20 bp, human
gaccctcgtcccaggcagtg

SEQ ID NO: 66675 - DNA, 20 bp, human
gtgtgtgggtcacatgactc

SEQ ID NO: 66676 - DNA, 20 bp, human
ggtgcctctgcagcaagcgt

SEQ ID NO: 66677 - DNA, 20 bp, human
gcgggaacccgagcaggttc

SEQ ID NO: 66678 - DNA, 20 bp, human
gctggcgcggaccccgaaag

SEQ ID NO: 66679 - DNA, 20 bp, human
gccggctgcgcccccgacag

SEQ ID NO: 66680 - DNA, 20 bp, human
gcgccccacgcttgctgcag

SEQ ID NO: 66681 - DNA, 20 bp, human
ggttcgggagacggaatgaa

SEQ ID NO: 66682 - DNA, 20 bp, human
ggtggtcgcagagaggccct

SEQ ID NO: 66683 - DNA, 20 bp, human
gcccgcggctcgggcgtagg

SEQ ID NO: 66684 - DNA, 20 bp, human
gggccgagctaggagtcctc

SEQ ID NO: 66685 - DNA, 20 bp, human
gccgtctcccgaacctgctc

SEQ ID NO: 66686 - DNA, 20 bp, human
gccagcagctccgcgacctg

SEQ ID NO: 66687 - DNA, 20 bp, human
ggccttccgggaggagttcg

SEQ ID NO: 66688 - DNA, 20 bp, human
ggagctgcaggcgcgcgtca

SEQ ID NO: 66689 - DNA, 20 bp, human
gggccgcgtcaacctcatcg

SEQ ID NO: 66690 - DNA, 20 bp, human
gttgagacagccccaggtcg

SEQ ID NO: 66691 - DNA, 20 bp, human
gggtgcacggaagagtcccc

SEQ ID NO: 66692 - DNA, 20 bp, human
gcgaggaagtggccgggaga

SEQ ID NO: 66693 - DNA, 20 bp, human
ggacaggctgttccccacgt

SEQ ID NO: 66694 - DNA, 20 bp, human
ggctgttccccacgttggaa

SEQ ID NO: 66695 - DNA, 20 bp, human
gcctcggcggccgggacagg

SEQ ID NO: 66696 - DNA, 20 bp, human
gtggcaactgggacatcgtc

SEQ ID NO: 66697 - DNA, 20 bp, human
ggctgcaggtctcagccgaa

SEQ ID NO: 66698 - DNA, 20 bp, human
gcggctgagacctgcagcac

SEQ ID NO: 66699 - DNA, 20 bp, human
gccacttcggaggaaacggg

SEQ ID NO: 66700 - DNA, 20 bp, human
gggtctcagccgaagggcgt

SEQ ID NO: 66701 - DNA, 20 bp, human
ggtgccttagcaactaaagc

SEQ ID NO: 66702 - DNA, 20 bp, human
gcgcagtttccgacgccctt

SEQ ID NO: 66703 - DNA, 20 bp, human
gttgccagctttagttgcta

SEQ ID NO: 66704 - DNA, 20 bp, human
gttggtcccaagggctgtaa

SEQ ID NO: 66705 - DNA, 20 bp, human
ggctaaggcaccaaccactt

SEQ ID NO: 66706 - DNA, 20 bp, human
gtggcatgcgagacaaagag

SEQ ID NO: 66707 - DNA, 20 bp, human
gcttagacacttgaaactac

SEQ ID NO: 66708 - DNA, 20 bp, human
gagaaggatctagcgaaata

SEQ ID NO: 66709 - DNA, 20 bp, human
gaggagttcagtgtggatat

SEQ ID NO: 66710 - DNA, 20 bp, human
ggctacgcgtcgggtccagg

SEQ ID NO: 66711 - DNA, 20 bp, human
gcaaagagaggagttcagtg

SEQ ID NO: 66712 - DNA, 20 bp, human
ggggagcaagtggaaccctt

SEQ ID NO: 66713 - DNA, 20 bp, human
gaccaaaagcagcgccccaa

SEQ ID NO: 66714 - DNA, 20 bp, human
ggaagtctcgtgattgctct

SEQ ID NO: 66715 - DNA, 20 bp, human
gggcagaacatcctaggtgg

SEQ ID NO: 66716 - DNA, 20 bp, human
gcgaagccatagggaaagtt

SEQ ID NO: 66717 - DNA, 20 bp, human
gcctggtcaccgaagccata

SEQ ID NO: 66718 - DNA, 20 bp, human
gtgcatcatagagggccgtg

SEQ ID NO: 66719 - DNA, 20 bp, human
ggcgctggagtttgaagagc

SEQ ID NO: 66720 - DNA, 20 bp, human
ggcaatgcgagggaccaagg

SEQ ID NO: 66721 - DNA, 20 bp, human
gagcctgaacggataaccag

SEQ ID NO: 66722 - DNA, 20 bp, human
ggtggcccgctagatccggg

SEQ ID NO: 66723 - DNA, 20 bp, human
ggagtggacatcatctcctg

SEQ ID NO: 66724 - DNA, 20 bp, human
ggcaagcgcatgcatcatag

SEQ ID NO: 66725 - DNA, 20 bp, human
gtagaggtcaaagacaggca

SEQ ID NO: 66726 - DNA, 20 bp, human
gcggcggacgctcgctaggt

SEQ ID NO: 66727 - DNA, 20 bp, human
gtgtcgcggcgacgaggtgg

SEQ ID NO: 66728 - DNA, 20 bp, human
gtccaggcgtggggtctcgg

SEQ ID NO: 66729 - DNA, 20 bp, human
gaccgggacagcgtcctccc

SEQ ID NO: 66730 - DNA, 20 bp, human
gatggcaaccacgggagccg

SEQ ID NO: 66731 - DNA, 20 bp, human
gtggcagcgcgtgtggtgat

SEQ ID NO: 66732 - DNA, 20 bp, human
gccccgcggccactccccga

SEQ ID NO: 66733 - DNA, 20 bp, human
gggttgtcgcggcgacgagg

SEQ ID NO: 66734 - DNA, 20 bp, human
ggagcgtccgccggcccttc

SEQ ID NO: 66735 - DNA, 20 bp, human
ggctcccgtggttgccatgg

SEQ ID NO: 66736 - DNA, 20 bp, human
gtccaagagtacccaaatca

SEQ ID NO: 66737 - DNA, 20 bp, human
gaatgtgggtatctcatagt

SEQ ID NO: 66738 - DNA, 20 bp, human
gaactgctggatgaacccat

SEQ ID NO: 66739 - DNA, 20 bp, human
gaaatttgcatactgcaagg

SEQ ID NO: 66740 - DNA, 20 bp, human
gcctagccacctccttgatt

SEQ ID NO: 66741 - DNA, 20 bp, human
gcagtatgcaaattttctca

SEQ ID NO: 66742 - DNA, 20 bp, human
gtgatcctcatatctcccac

SEQ ID NO: 66743 - DNA, 20 bp, human
ggtagtctgtgacttcctgt

SEQ ID NO: 66744 - DNA, 20 bp, human
gttatgttactaaataatgt

SEQ ID NO: 66745 - DNA, 20 bp, human
ggtaacataaagtaacttac

SEQ ID NO: 66746 - DNA, 20 bp, human
gctcggagctgactctgagg

SEQ ID NO: 66747 - DNA, 20 bp, human
gcggccccgctccaactccg

SEQ ID NO: 66748 - DNA, 20 bp, human
ggcgcccaaagccccacgtt

SEQ ID NO: 66749 - DNA, 20 bp, human
gcagccagcagaagcggctg

SEQ ID NO: 66750 - DNA, 20 bp, human
gaccgcgagcggcagcccga

SEQ ID NO: 66751 - DNA, 20 bp, human
gaccctggacaagtcccgac

SEQ ID NO: 66752 - DNA, 20 bp, human
ggcgccgcagccgcttctgc

SEQ ID NO: 66753 - DNA, 20 bp, human
gctgccgccgccgggcggac

SEQ ID NO: 66754 - DNA, 20 bp, human
gagtctcggagctgactctg

SEQ ID NO: 66755 - DNA, 20 bp, human
gacgttgggcaggaggacca

SEQ ID NO: 66756 - DNA, 20 bp, human
gcccaggatcgccgccttct

SEQ ID NO: 66757 - DNA, 20 bp, human
gccgcgccgctcctgcgggt

SEQ ID NO: 66758 - DNA, 20 bp, human
gccagtccgacccgcaggag

SEQ ID NO: 66759 - DNA, 20 bp, human
gcaagcctcaggagacgctg

SEQ ID NO: 66760 - DNA, 20 bp, human
ggcggtgagtaccctctagg

SEQ ID NO: 66761 - DNA, 20 bp, human
gacgcccgcgaacaagcctc

SEQ ID NO: 66762 - DNA, 20 bp, human
ggagacacgagcctcgccca

SEQ ID NO: 66763 - DNA, 20 bp, human
gcgcagctctcgaggtgctg

SEQ ID NO: 66764 - DNA, 20 bp, human
gaaggcggtgagtaccctct

SEQ ID NO: 66765 - DNA, 20 bp, human
gtgcgggagcccaggacccg

SEQ ID NO: 66766 - DNA, 20 bp, human
gagttggcgggcgcatgtgg

SEQ ID NO: 66767 - DNA, 20 bp, human
gcgatctgcgcgccccaagg

SEQ ID NO: 66768 - DNA, 20 bp, human
gtgagtgcacagctctgggg

SEQ ID NO: 66769 - DNA, 20 bp, human
ggcggcggtgcagtgagatg

SEQ ID NO: 66770 - DNA, 20 bp, human
gggccgcgccgcagttcccg

SEQ ID NO: 66771 - DNA, 20 bp, human
gctccatcagagcagtggca

SEQ ID NO: 66772 - DNA, 20 bp, human
gtctgcgcgccccaaggcgg

SEQ ID NO: 66773 - DNA, 20 bp, human
ggcgcgttcgccggcaccgg

SEQ ID NO: 66774 - DNA, 20 bp, human
gatcgctggctgcagttggc

SEQ ID NO: 66775 - DNA, 20 bp, human
gcatgtgggggcgcacggcg

SEQ ID NO: 66776 - DNA, 20 bp, human
gagcctggaggcctctcact

SEQ ID NO: 66777 - DNA, 20 bp, human
gagtcccgcggcgagtgccg

SEQ ID NO: 66778 - DNA, 20 bp, human
gccgcctggtcacttctccc

SEQ ID NO: 66779 - DNA, 20 bp, human
gtccaggctggggctacgag

SEQ ID NO: 66780 - DNA, 20 bp, human
gagcccagtgagaggcctcc

SEQ ID NO: 66781 - DNA, 20 bp, human
gctggggctacgagaggagg

SEQ ID NO: 66782 - DNA, 20 bp, human
ggaggagggaccacgcgagg

SEQ ID NO: 66783 - DNA, 20 bp, human
gagggaccacgcgaggagga

SEQ ID NO: 66784 - DNA, 20 bp, human
gatgatactagcccagtgag

SEQ ID NO: 66785 - DNA, 20 bp, human
gagcgcgctccagctgcttc

SEQ ID NO: 66786 - DNA, 20 bp, human
gtccagagcaccccgaagac

SEQ ID NO: 66787 - DNA, 20 bp, human
gcatgcggcgcctgactcgt

SEQ ID NO: 66788 - DNA, 20 bp, human
ggagtcagtttccctatcgg

SEQ ID NO: 66789 - DNA, 20 bp, human
gagcgagagggaggaatccg

SEQ ID NO: 66790 - DNA, 20 bp, human
gtagcgccgcggagaggaag

SEQ ID NO: 66791 - DNA, 20 bp, human
gtctgcacttcaggtcccgt

SEQ ID NO: 66792 - DNA, 20 bp, human
gctatcggcggcagcgggca

SEQ ID NO: 66793 - DNA, 20 bp, human
ggacccgcggtgtgcatgag

SEQ ID NO: 66794 - DNA, 20 bp, human
gcctgaagtgcagaccccta

SEQ ID NO: 66795 - DNA, 20 bp, human
gcgtggcagggaaggaccga

SEQ ID NO: 66796 - DNA, 20 bp, human
gtgactggaagcgtccaaag

SEQ ID NO: 66797 - DNA, 20 bp, human
ggctgacagccgtccctctt

SEQ ID NO: 66798 - DNA, 20 bp, human
ggtgggttctcagtcaagca

SEQ ID NO: 66799 - DNA, 20 bp, human
gcaggaccaggttaagtgac

SEQ ID NO: 66800 - DNA, 20 bp, human
ggctcctaaggaagcgatac

SEQ ID NO: 66801 - DNA, 20 bp, human
gcaggtggaacaagcaaccc

SEQ ID NO: 66802 - DNA, 20 bp, human
gtctgttgatctgacctgac

SEQ ID NO: 66803 - DNA, 20 bp, human
gtggcagaaaaacttccagg

SEQ ID NO: 66804 - DNA, 20 bp, human
ggaaaaccggggtaaaggga

SEQ ID NO: 66805 - DNA, 20 bp, human
gaggttgctatgaggtgtct

SEQ ID NO: 66806 - DNA, 20 bp, human
ggggcgcaccgactaaggga

SEQ ID NO: 66807 - DNA, 20 bp, human
ggctggggcgcaccgactaa

SEQ ID NO: 66808 - DNA, 20 bp, human
ggcccagccgcccctacaca

SEQ ID NO: 66809 - DNA, 20 bp, human
gtcggcgagtccttgtgtag

SEQ ID NO: 66810 - DNA, 20 bp, human
gtctgcaggactgagcagct

SEQ ID NO: 66811 - DNA, 20 bp, human
ggcagacgggcgccccaggt

SEQ ID NO: 66812 - DNA, 20 bp, human
ggagcccacgcagcatcctc

SEQ ID NO: 66813 - DNA, 20 bp, human
gcgggcgttcggtcacctag

SEQ ID NO: 66814 - DNA, 20 bp, human
ggcgggattcaaggtgtgtt

SEQ ID NO: 66815 - DNA, 20 bp, human
gccgccggaggatgctgcgt

SEQ ID NO: 66816 - DNA, 20 bp, human
gcgcgctgctaggagaacag

SEQ ID NO: 66817 - DNA, 20 bp, human
gggcccccgggagctctata

SEQ ID NO: 66818 - DNA, 20 bp, human
ggctaggagaacagcggcag

SEQ ID NO: 66819 - DNA, 20 bp, human
gccccgggagctctatatgg

SEQ ID NO: 66820 - DNA, 20 bp, human
gtggccgccgacacaggcag

SEQ ID NO: 66821 - DNA, 20 bp, human
gcgggccggtcggaccgcca

SEQ ID NO: 66822 - DNA, 20 bp, human
gcctagcagcgcgggccggt

SEQ ID NO: 66823 - DNA, 20 bp, human
gccacttgcgtgatcctgag

SEQ ID NO: 66824 - DNA, 20 bp, human
gtcgccagcgccggctgcct

SEQ ID NO: 66825 - DNA, 20 bp, human
gcggggcgcacgacaaggaa

SEQ ID NO: 66826 - DNA, 20 bp, human
ggggcgacgtccacgagagg

SEQ ID NO: 66827 - DNA, 20 bp, human
gcggccgagttgggagaatg

SEQ ID NO: 66828 - DNA, 20 bp, human
gaggcagcactcgcgagcag

SEQ ID NO: 66829 - DNA, 20 bp, human
gccgagttgggagaatgcgg

SEQ ID NO: 66830 - DNA, 20 bp, human
gcagcactcgcgagcagcgg

SEQ ID NO: 66831 - DNA, 20 bp, human
gcgcacgccgggctccgaaa

SEQ ID NO: 66832 - DNA, 20 bp, human
gccccgccggcggccgagtt

SEQ ID NO: 66833 - DNA, 20 bp, human
gacgcgagcggaggtccggg

SEQ ID NO: 66834 - DNA, 20 bp, human
ggaggggcgacgtccacgag

SEQ ID NO: 66835 - DNA, 20 bp, human
gacgccgggctccgaaaggg

SEQ ID NO: 66836 - DNA, 20 bp, human
gcctcccgcgttgcctggag

SEQ ID NO: 66837 - DNA, 20 bp, human
gcctttcgggatctctccag

SEQ ID NO: 66838 - DNA, 20 bp, human
gtcacctgggagactccaag

SEQ ID NO: 66839 - DNA, 20 bp, human
gcagcctgcgacgtcggcag

SEQ ID NO: 66840 - DNA, 20 bp, human
gcacccgccaggtaagccgg

SEQ ID NO: 66841 - DNA, 20 bp, human
ggagctccagcctgcgacgt

SEQ ID NO: 66842 - DNA, 20 bp, human
gctcccgaagtggtcctcgg

SEQ ID NO: 66843 - DNA, 20 bp, human
ggagaggcagaaccgaggct

SEQ ID NO: 66844 - DNA, 20 bp, human
gtctccgtccagctcctcag

SEQ ID NO: 66845 - DNA, 20 bp, human
gccgggcaggcgctggacgt

SEQ ID NO: 66846 - DNA, 20 bp, human
gcggaaccgtctgcccagag

SEQ ID NO: 66847 - DNA, 20 bp, human
gctcccggtcactacaacaa

SEQ ID NO: 66848 - DNA, 20 bp, human
gccggtcactacaacaacgg

SEQ ID NO: 66849 - DNA, 20 bp, human
gccagagcggcagcgcctcc

SEQ ID NO: 66850 - DNA, 20 bp, human
ggcccgcgggacaggctcca

SEQ ID NO: 66851 - DNA, 20 bp, human
gtccggagctccggaactcg

SEQ ID NO: 66852 - DNA, 20 bp, human
gtggagcgcggggtttgact

SEQ ID NO: 66853 - DNA, 20 bp, human
gggcccccagaattctcgga

SEQ ID NO: 66854 - DNA, 20 bp, human
ggatggcagagagtgagata

SEQ ID NO: 66855 - DNA, 20 bp, human
gaactcggggaagagcgtcc

SEQ ID NO: 66856 - DNA, 20 bp, human
gagccgagcaggaggaagta

SEQ ID NO: 66857 - DNA, 20 bp, human
gcggaggccgaggaccgaga

SEQ ID NO: 66858 - DNA, 20 bp, human
ggtgcacgggaatctgcagg

SEQ ID NO: 66859 - DNA, 20 bp, human
ggacctccagaaaaatacgg

SEQ ID NO: 66860 - DNA, 20 bp, human
ggccctgagaatccggatgg

SEQ ID NO: 66861 - DNA, 20 bp, human
gcagccacccaggctttcca

SEQ ID NO: 66862 - DNA, 20 bp, human
gtcagccctgagaatccgga

SEQ ID NO: 66863 - DNA, 20 bp, human
gcagggggcttcttataaag

SEQ ID NO: 66864 - DNA, 20 bp, human
gtcagacctccagaaaaata

SEQ ID NO: 66865 - DNA, 20 bp, human
gatggcggtgaggtggactt

SEQ ID NO: 66866 - DNA, 20 bp, human
gcttgtaggaaggtggacat

SEQ ID NO: 66867 - DNA, 20 bp, human
gcgaggaagtgggcgagtct

SEQ ID NO: 66868 - DNA, 20 bp, human
ggagagctgccatgtcaaag

SEQ ID NO: 66869 - DNA, 20 bp, human
gctgctcctggagtgaccta

SEQ ID NO: 66870 - DNA, 20 bp, human
ggcaggaagcagcagtccaa

SEQ ID NO: 66871 - DNA, 20 bp, human
ggatatgttgaactgttcgg

SEQ ID NO: 66872 - DNA, 20 bp, human
ggatctcactgaatgagagg

SEQ ID NO: 66873 - DNA, 20 bp, human
gtacaagcccaagaaaaggt

SEQ ID NO: 66874 - DNA, 20 bp, human
gagcgtgcagacggagaacg

SEQ ID NO: 66875 - DNA, 20 bp, human
gatcaacactcgggtcatca

SEQ ID NO: 66876 - DNA, 20 bp, human
gcaccccatgtgctctggta

SEQ ID NO: 66877 - DNA, 20 bp, human
gcgcgaccagcagagagcga

SEQ ID NO: 66878 - DNA, 20 bp, human
gtggaggggggtcctaccga

SEQ ID NO: 66879 - DNA, 20 bp, human
ggccgtccggtggggaaacc

SEQ ID NO: 66880 - DNA, 20 bp, human
gcatggggtggcccgatctg

SEQ ID NO: 66881 - DNA, 20 bp, human
gaccagcagagagcgaaggc

SEQ ID NO: 66882 - DNA, 20 bp, human
gggaggtgagagcgaggact

SEQ ID NO: 66883 - DNA, 20 bp, human
gtgccgtaccagagcacatg

SEQ ID NO: 66884 - DNA, 20 bp, human
gctcccggggagagggtcgc

SEQ ID NO: 66885 - DNA, 20 bp, human
gactgtcgggggtagtgagg

SEQ ID NO: 66886 - DNA, 20 bp, human
gtcgccgccggaggaagatg

SEQ ID NO: 66887 - DNA, 20 bp, human
gcagcctcatcttcctccgg

SEQ ID NO: 66888 - DNA, 20 bp, human
ggtgtcggcgacggagcccg

SEQ ID NO: 66889 - DNA, 20 bp, human
ggctgtgagtctctcgccgc

SEQ ID NO: 66890 - DNA, 20 bp, human
gtacgcagtttgctggtggt

SEQ ID NO: 66891 - DNA, 20 bp, human
gctctccgcgccgggactgc

SEQ ID NO: 66892 - DNA, 20 bp, human
ggcagcgcgggtgtcggcga

SEQ ID NO: 66893 - DNA, 20 bp, human
ggtgagtctctcgccgccgg

SEQ ID NO: 66894 - DNA, 20 bp, human
gcggggtcgcggcacggcgt

SEQ ID NO: 66895 - DNA, 20 bp, human
gtccgcgccgggactgcggg

SEQ ID NO: 66896 - DNA, 20 bp, human
gcagggagtggacgaccccc

SEQ ID NO: 66897 - DNA, 20 bp, human
ggctcctcagaggccacccg

SEQ ID NO: 66898 - DNA, 20 bp, human
gtgacacactcagtcccaca

SEQ ID NO: 66899 - DNA, 20 bp, human
gacccatgggaagccacggg

SEQ ID NO: 66900 - DNA, 20 bp, human
gcagagtcagcccaatgaag

SEQ ID NO: 66901 - DNA, 20 bp, human
gcggggcataaagacaaaga

SEQ ID NO: 66902 - DNA, 20 bp, human
gccccaaagccctcttcatt

SEQ ID NO: 66903 - DNA, 20 bp, human
gcacttaggaaaaagggata

SEQ ID NO: 66904 - DNA, 20 bp, human
gctttccacaggttgctcag

SEQ ID NO: 66905 - DNA, 20 bp, human
gcttgctagaaaataccaga

SEQ ID NO: 66906 - DNA, 20 bp, human
gaggccgcgtcactctgcac

SEQ ID NO: 66907 - DNA, 20 bp, human
gcggcgctcggtgtctgtgc

SEQ ID NO: 66908 - DNA, 20 bp, human
gtgaacatcctggtgttcgt

SEQ ID NO: 66909 - DNA, 20 bp, human
ggctgcagccgtgttcatgg

SEQ ID NO: 66910 - DNA, 20 bp, human
ggcagccgacacgccaaggt

SEQ ID NO: 66911 - DNA, 20 bp, human
ggcggcagtacacggagaac

SEQ ID NO: 66912 - DNA, 20 bp, human
ggtgtcggctgcgcacccgg

SEQ ID NO: 66913 - DNA, 20 bp, human
ggacgatgcccacgaacacc

SEQ ID NO: 66914 - DNA, 20 bp, human
gacgatgcgcacgagctcct

SEQ ID NO: 66915 - DNA, 20 bp, human
ggtgcgcagccgacacgcca

SEQ ID NO: 66916 - DNA, 20 bp, human
gtagctagcaggctttatgg

SEQ ID NO: 66917 - DNA, 20 bp, human
gcccgcaacccagcacaacc

SEQ ID NO: 66918 - DNA, 20 bp, human
gagccccatgtgctagaagt

SEQ ID NO: 66919 - DNA, 20 bp, human
gcgtggactgggcattgtaa

SEQ ID NO: 66920 - DNA, 20 bp, human
ggcacaaccaggtatctgct

SEQ ID NO: 66921 - DNA, 20 bp, human
gaccaccctaaacgtggact

SEQ ID NO: 66922 - DNA, 20 bp, human
gagcaggctttatggtggct

SEQ ID NO: 66923 - DNA, 20 bp, human
gaatcactgcgtcttgaagg

SEQ ID NO: 66924 - DNA, 20 bp, human
gtagggtggtgtaaccagct

SEQ ID NO: 66925 - DNA, 20 bp, human
ggccaatgcaattatctcaa

SEQ ID NO: 66926 - DNA, 20 bp, human
gtagacagcgcgcgagggtc

SEQ ID NO: 66927 - DNA, 20 bp, human
gcgggatccgggcagaactc

SEQ ID NO: 66928 - DNA, 20 bp, human
gggaaggcggagatgcgccg

SEQ ID NO: 66929 - DNA, 20 bp, human
ggcgcgaggaagggacgtcg

SEQ ID NO: 66930 - DNA, 20 bp, human
gagcgtgagagcgtcaccgg

SEQ ID NO: 66931 - DNA, 20 bp, human
gcgggctccaccgggatcca

SEQ ID NO: 66932 - DNA, 20 bp, human
gccccgggaacctggtggaa

SEQ ID NO: 66933 - DNA, 20 bp, human
gcagagcgctcacttctcag

SEQ ID NO: 66934 - DNA, 20 bp, human
gccccggcgcctgccttccg

SEQ ID NO: 66935 - DNA, 20 bp, human
gccagcgacgtctccgcgga

SEQ ID NO: 66936 - DNA, 20 bp, human
gtcggagccgctccttcccg

SEQ ID NO: 66937 - DNA, 20 bp, human
ggcagtgcggggaagcgccg

SEQ ID NO: 66938 - DNA, 20 bp, human
ggcggggaagcgccgcggga

SEQ ID NO: 66939 - DNA, 20 bp, human
ggccgggaccttctgagaga

SEQ ID NO: 66940 - DNA, 20 bp, human
gggagtctgagcttcccccg

SEQ ID NO: 66941 - DNA, 20 bp, human
gagctggaccttctcgggaa

SEQ ID NO: 66942 - DNA, 20 bp, human
gggggtcccggcgcaaagca

SEQ ID NO: 66943 - DNA, 20 bp, human
gcgccggcgaagatctggag

SEQ ID NO: 66944 - DNA, 20 bp, human
gcccggagctggaccttctc

SEQ ID NO: 66945 - DNA, 20 bp, human
gggtgatctcgagagcactg

SEQ ID NO: 66946 - DNA, 20 bp, human
gccgctcgcggagacccaga

SEQ ID NO: 66947 - DNA, 20 bp, human
gcacctgtccagggagacgg

SEQ ID NO: 66948 - DNA, 20 bp, human
ggtcgcactaggagttgcag

SEQ ID NO: 66949 - DNA, 20 bp, human
ggcgctggctcacctgtcca

SEQ ID NO: 66950 - DNA, 20 bp, human
gcgcgagcgggaagctcccg

SEQ ID NO: 66951 - DNA, 20 bp, human
gagatgagcgcgaagagcag

SEQ ID NO: 66952 - DNA, 20 bp, human
gcgggcagcctcggggtcag

SEQ ID NO: 66953 - DNA, 20 bp, human
gcctatcccaccctcacgga

SEQ ID NO: 66954 - DNA, 20 bp, human
gtcttcctcgtgggcaccgt

SEQ ID NO: 66955 - DNA, 20 bp, human
ggctcacctgtccagggaga

SEQ ID NO: 66956 - DNA, 20 bp, human
gagattagggcaaagaccac

SEQ ID NO: 66957 - DNA, 20 bp, human
ggacagcccagggagtgtgg

SEQ ID NO: 66958 - DNA, 20 bp, human
ggtgcccagcaggaagatta

SEQ ID NO: 66959 - DNA, 20 bp, human
gggcacagcgcacctgtcca

SEQ ID NO: 66960 - DNA, 20 bp, human
ggtcctgaacagatcctcac

SEQ ID NO: 66961 - DNA, 20 bp, human
ggagagtgggggaccagaaa

SEQ ID NO: 66962 - DNA, 20 bp, human
gcccaggtgcccgtctgatg

SEQ ID NO: 66963 - DNA, 20 bp, human
ggcatccagcgtgtagatgg

SEQ ID NO: 66964 - DNA, 20 bp, human
gacgagggccccaaagagcc

SEQ ID NO: 66965 - DNA, 20 bp, human
gagccatctccccatcagac

SEQ ID NO: 66966 - DNA, 20 bp, human
ggagcgttccaaccttcgga

SEQ ID NO: 66967 - DNA, 20 bp, human
gaggccaccgggggatccgc

SEQ ID NO: 66968 - DNA, 20 bp, human
gcgcgacatgaggccaccgg

SEQ ID NO: 66969 - DNA, 20 bp, human
gtgctggcgttgctgaggat

SEQ ID NO: 66970 - DNA, 20 bp, human
gaacccgctgcaggatgagt

SEQ ID NO: 66971 - DNA, 20 bp, human
gcaacgccagcaggcgtcag

SEQ ID NO: 66972 - DNA, 20 bp, human
gggccctgcagattttccag

SEQ ID NO: 66973 - DNA, 20 bp, human
ggtggcctcatgtcgcgcag

SEQ ID NO: 66974 - DNA, 20 bp, human
gatcctgcagcgggttgtag

SEQ ID NO: 66975 - DNA, 20 bp, human
gcgccagcaggcgtcagagg

SEQ ID NO: 66976 - DNA, 20 bp, human
gggcggcgcgcgatcgaggt

SEQ ID NO: 66977 - DNA, 20 bp, human
gtcgccgggcgcgaagatgg

SEQ ID NO: 66978 - DNA, 20 bp, human
gtgcaggtgggggcacacgg

SEQ ID NO: 66979 - DNA, 20 bp, human
gcgtggggcccgcacacgtt

SEQ ID NO: 66980 - DNA, 20 bp, human
gggcctcactccccctggag

SEQ ID NO: 66981 - DNA, 20 bp, human
gggccagcgcgtgcatatag

SEQ ID NO: 66982 - DNA, 20 bp, human
gggcacacggaggcgttcac

SEQ ID NO: 66983 - DNA, 20 bp, human
gggccccccgctctccagat

SEQ ID NO: 66984 - DNA, 20 bp, human
ggggcgctcatgctgcaggc

SEQ ID NO: 66985 - DNA, 20 bp, human
gaggcggtgcctaacgtgtg

SEQ ID NO: 66986 - DNA, 20 bp, human
gagcgcgccgcggatagcac

SEQ ID NO: 66987 - DNA, 20 bp, human
gggatagcacaggcacgtcc

SEQ ID NO: 66988 - DNA, 20 bp, human
ggcgtgctgagggtcagaca

SEQ ID NO: 66989 - DNA, 20 bp, human
ggccagcccgtacatcaggt

SEQ ID NO: 66990 - DNA, 20 bp, human
gtccggccggacccctcgag

SEQ ID NO: 66991 - DNA, 20 bp, human
ggcagaagcgagactcctcg

SEQ ID NO: 66992 - DNA, 20 bp, human
gtcatgacgcggcttcttaa

SEQ ID NO: 66993 - DNA, 20 bp, human
gtgtcgggagccggacccgt

SEQ ID NO: 66994 - DNA, 20 bp, human
gccggtgcagaagaacatcc

SEQ ID NO: 66995 - DNA, 20 bp, human
gagccacagaggccgcctgg

SEQ ID NO: 66996 - DNA, 20 bp, human
gtgaggagcccggaatctgg

SEQ ID NO: 66997 - DNA, 20 bp, human
gcaaactctgcacaagatgg

SEQ ID NO: 66998 - DNA, 20 bp, human
gagtggcggcgcgtaggagg

SEQ ID NO: 66999 - DNA, 20 bp, human
gcggcgcgtaggaggcggtg

SEQ ID NO: 67000 - DNA, 20 bp, human
ggagcaaactctgcacaaga

SEQ ID NO: 67001 - DNA, 20 bp, human
gagcggcagtggcggcgcgt

SEQ ID NO: 67002 - DNA, 20 bp, human
gagagccagaagggtagtac

SEQ ID NO: 67003 - DNA, 20 bp, human
gccgcaggctgcattccccg

SEQ ID NO: 67004 - DNA, 20 bp, human
gtctaccacggggagaccgg

SEQ ID NO: 67005 - DNA, 20 bp, human
ggcagtgcgcggggtcgtcg

SEQ ID NO: 67006 - DNA, 20 bp, human
gtctgaacctagaggagcaa

SEQ ID NO: 67007 - DNA, 20 bp, human
gtgaagtgaatactcaccga

SEQ ID NO: 67008 - DNA, 20 bp, human
gcactaacgtctgaacctag

SEQ ID NO: 67009 - DNA, 20 bp, human
gtggcacattccgataccgt

SEQ ID NO: 67010 - DNA, 20 bp, human
gcccagggtccctagaaaca

SEQ ID NO: 67011 - DNA, 20 bp, human
ggaatactcaccgacggtat

SEQ ID NO: 67012 - DNA, 20 bp, human
gtgctgccgaccggtccaaa

SEQ ID NO: 67013 - DNA, 20 bp, human
gtctgtagcgagtgacccca

SEQ ID NO: 67014 - DNA, 20 bp, human
gatgtgccatttggaccggt

SEQ ID NO: 67015 - DNA, 20 bp, human
gctcccagctctcaggacaa

SEQ ID NO: 67016 - DNA, 20 bp, human
ggagcaagcgagcagaaaag

SEQ ID NO: 67017 - DNA, 20 bp, human
gagggtgtggacgtagaaag

SEQ ID NO: 67018 - DNA, 20 bp, human
gtaaggaagcgcgagcacca

SEQ ID NO: 67019 - DNA, 20 bp, human
gtgggctctacctacaagat

SEQ ID NO: 67020 - DNA, 20 bp, human
gctgctactaattagggtga

SEQ ID NO: 67021 - DNA, 20 bp, human
gtggacgtagaaaggggtgt

SEQ ID NO: 67022 - DNA, 20 bp, human
gacggggaaatactgtactc

SEQ ID NO: 67023 - DNA, 20 bp, human
gggaatgctgctactaatta

SEQ ID NO: 67024 - DNA, 20 bp, human
gtgtatgagaagaaccaaac

SEQ ID NO: 67025 - DNA, 20 bp, human
gtagaaaaaacatgcctgtt

SEQ ID NO: 67026 - DNA, 20 bp, human
gtgtgtcggccggggccact

SEQ ID NO: 67027 - DNA, 20 bp, human
gtgcgtcgccaggtgaagac

SEQ ID NO: 67028 - DNA, 20 bp, human
ggacgggcggagagaaaccc

SEQ ID NO: 67029 - DNA, 20 bp, human
gagagaaacccgggaggcta

SEQ ID NO: 67030 - DNA, 20 bp, human
ggctagggacggcctgaagg

SEQ ID NO: 67031 - DNA, 20 bp, human
gctctccgcccgtcttcacc

SEQ ID NO: 67032 - DNA, 20 bp, human
gggtctttgcagtcgtatgg

SEQ ID NO: 67033 - DNA, 20 bp, human
gggtcagcgctcggacctgg

SEQ ID NO: 67034 - DNA, 20 bp, human
gcaaggtcagcgctcggacc

SEQ ID NO: 67035 - DNA, 20 bp, human
ggctcgtagacgcggttcgg

SEQ ID NO: 67036 - DNA, 20 bp, human
gcaagtaactggttgagcac

SEQ ID NO: 67037 - DNA, 20 bp, human
gggaagctgggcttgtgtca

SEQ ID NO: 67038 - DNA, 20 bp, human
gtcctccacctttgacgctg

SEQ ID NO: 67039 - DNA, 20 bp, human
gataagacaggacaagtaac

SEQ ID NO: 67040 - DNA, 20 bp, human
gccagaccctagaataagac

SEQ ID NO: 67041 - DNA, 20 bp, human
gggtggctggctcagaaaaa

SEQ ID NO: 67042 - DNA, 20 bp, human
gtgcagggtctggcgccctc

SEQ ID NO: 67043 - DNA, 20 bp, human
gcttgtcctgtcttattcta

SEQ ID NO: 67044 - DNA, 20 bp, human
ggaagatgaaaagagttgtc

SEQ ID NO: 67045 - DNA, 20 bp, human
gtttctgagccagccaccag

SEQ ID NO: 67046 - DNA, 20 bp, human
ggggcttagggagaacccag

SEQ ID NO: 67047 - DNA, 20 bp, human
gaagtgggcgggcttaggag

SEQ ID NO: 67048 - DNA, 20 bp, human
ggtgcacacgccaggaaggg

SEQ ID NO: 67049 - DNA, 20 bp, human
gcagaaacgagggccatcgg

SEQ ID NO: 67050 - DNA, 20 bp, human
gatggaagcccagcacccct

SEQ ID NO: 67051 - DNA, 20 bp, human
gttcgacatggcctcttata

SEQ ID NO: 67052 - DNA, 20 bp, human
gaggaagggcggtagggata

SEQ ID NO: 67053 - DNA, 20 bp, human
gggaggctgcagcctgaaag

SEQ ID NO: 67054 - DNA, 20 bp, human
gtgcaccatctagggaccag

SEQ ID NO: 67055 - DNA, 20 bp, human
gtgtcgcagcaactggacaa

SEQ ID NO: 67056 - DNA, 20 bp, human
ggcttgacacaccaatcttg

SEQ ID NO: 67057 - DNA, 20 bp, human
gttcttacttacctcaagat

SEQ ID NO: 67058 - DNA, 20 bp, human
gtcccccttacagctacgta

SEQ ID NO: 67059 - DNA, 20 bp, human
gacccaccaaagtgaaaaag

SEQ ID NO: 67060 - DNA, 20 bp, human
gaaattgttaggtaacctgt

SEQ ID NO: 67061 - DNA, 20 bp, human
ggccttacgtagctgtaagg

SEQ ID NO: 67062 - DNA, 20 bp, human
gcatccaaataccttaaatc

SEQ ID NO: 67063 - DNA, 20 bp, human
gaaatagcgtgaacgaagga

SEQ ID NO: 67064 - DNA, 20 bp, human
gtaagtaagaacctgattta

SEQ ID NO: 67065 - DNA, 20 bp, human
gaccttgtttccaaacagca

SEQ ID NO: 67066 - DNA, 20 bp, human
gaggcgagtggcgaaggtgg

SEQ ID NO: 67067 - DNA, 20 bp, human
gcggcggcgggggcagtcac

SEQ ID NO: 67068 - DNA, 20 bp, human
gagggaagccaacaggcgag

SEQ ID NO: 67069 - DNA, 20 bp, human
gcaggtagggaactgagtat

SEQ ID NO: 67070 - DNA, 20 bp, human
ggccaacaggcgagtggcga

SEQ ID NO: 67071 - DNA, 20 bp, human
gacgagaggcccggcaggta

SEQ ID NO: 67072 - DNA, 20 bp, human
gaggagagggagagacgcgt

SEQ ID NO: 67073 - DNA, 20 bp, human
gcggccgggcagtcagagac

SEQ ID NO: 67074 - DNA, 20 bp, human
ggtagggaactgagtatagg

SEQ ID NO: 67075 - DNA, 20 bp, human
gaagggacaggaggaccgcg

SEQ ID NO: 67076 - DNA, 20 bp, human
gtgtggcggtacggtaaccg

SEQ ID NO: 67077 - DNA, 20 bp, human
gcctctctgttgtaaattag

SEQ ID NO: 67078 - DNA, 20 bp, human
ggggaggagatactaatcat

SEQ ID NO: 67079 - DNA, 20 bp, human
gggcggtacggtaaccgagg

SEQ ID NO: 67080 - DNA, 20 bp, human
gggcttctacggccactcac

SEQ ID NO: 67081 - DNA, 20 bp, human
gggagatactaatcatgggg

SEQ ID NO: 67082 - DNA, 20 bp, human
ggcggaagtaccccgcgggt

SEQ ID NO: 67083 - DNA, 20 bp, human
gtggaagtgacgtataacag

SEQ ID NO: 67084 - DNA, 20 bp, human
gggggttggagtatactcag

SEQ ID NO: 67085 - DNA, 20 bp, human
gtgcggtgagaacaccataa

SEQ ID NO: 67086 - DNA, 20 bp, human
gccgcctcgagcgtgtgagg

SEQ ID NO: 67087 - DNA, 20 bp, human
gagtgctgggagcgctgcta

SEQ ID NO: 67088 - DNA, 20 bp, human
ggctcctcctcacacgctcg

SEQ ID NO: 67089 - DNA, 20 bp, human
gatggcgtttctcagacccg

SEQ ID NO: 67090 - DNA, 20 bp, human
gccccagccatgccccgcag

SEQ ID NO: 67091 - DNA, 20 bp, human
gcagcactgactaatcaaca

SEQ ID NO: 67092 - DNA, 20 bp, human
ggcttcggggaagatggacc

SEQ ID NO: 67093 - DNA, 20 bp, human
ggagtcttctccgggcgtga

SEQ ID NO: 67094 - DNA, 20 bp, human
gtggacccggcgccctcgct

SEQ ID NO: 67095 - DNA, 20 bp, human
ggccgaggcgcgggtggtgc

SEQ ID NO: 67096 - DNA, 20 bp, human
ggagtacgtgagccccgact

SEQ ID NO: 67097 - DNA, 20 bp, human
gtactcctggtcgccctcgc

SEQ ID NO: 67098 - DNA, 20 bp, human
ggggcgcggctgcccagtcg

SEQ ID NO: 67099 - DNA, 20 bp, human
gtcctggtcgccctcgccgg

SEQ ID NO: 67100 - DNA, 20 bp, human
ggtgggacagagatgcgtgt

SEQ ID NO: 67101 - DNA, 20 bp, human
ggccggcgctagcgggccgg

SEQ ID NO: 67102 - DNA, 20 bp, human
ggctcctctcaaatcctctg

SEQ ID NO: 67103 - DNA, 20 bp, human
ggtccctcccaaatccgagg

SEQ ID NO: 67104 - DNA, 20 bp, human
ggccccggccccggagtatg

SEQ ID NO: 67105 - DNA, 20 bp, human
gggcgggagccggcgctagc

SEQ ID NO: 67106 - DNA, 20 bp, human
ggcccaaggcaggcgagcgt

SEQ ID NO: 67107 - DNA, 20 bp, human
ggggccccgcggacaagcac

SEQ ID NO: 67108 - DNA, 20 bp, human
gaccgacggggcgggagcag

SEQ ID NO: 67109 - DNA, 20 bp, human
ggccgcgcgggactgaccgt

SEQ ID NO: 67110 - DNA, 20 bp, human
ggaccgtcggggccccggga

SEQ ID NO: 67111 - DNA, 20 bp, human
gccctttccggactccagct

SEQ ID NO: 67112 - DNA, 20 bp, human
ggcccagctggagtccggaa

SEQ ID NO: 67113 - DNA, 20 bp, human
ggaccccggtacctggccca

SEQ ID NO: 67114 - DNA, 20 bp, human
ggaaaggggggcaaccgacg

SEQ ID NO: 67115 - DNA, 20 bp, human
gtggtgggctctccagccag

SEQ ID NO: 67116 - DNA, 20 bp, human
gagacctaggctgtagacgt

SEQ ID NO: 67117 - DNA, 20 bp, human
ggctctgtctcggaagacct

SEQ ID NO: 67118 - DNA, 20 bp, human
ggagtcatccctggaagtat

SEQ ID NO: 67119 - DNA, 20 bp, human
gaccatgtgggtacagtgta

SEQ ID NO: 67120 - DNA, 20 bp, human
gagggacaaagctgctgaac

SEQ ID NO: 67121 - DNA, 20 bp, human
gctgcagtaaacttgaggca

SEQ ID NO: 67122 - DNA, 20 bp, human
gtgaaagccaggctctgcaa

SEQ ID NO: 67123 - DNA, 20 bp, human
gtacagtgtaaggattggat

SEQ ID NO: 67124 - DNA, 20 bp, human
gtagacgtggggatttcagt

SEQ ID NO: 67125 - DNA, 20 bp, human
gaggaaacattatggatctg

SEQ ID NO: 67126 - DNA, 20 bp, human
gggacttgggaccaaagtgg

SEQ ID NO: 67127 - DNA, 20 bp, human
gctctaagcagcactggacg

SEQ ID NO: 67128 - DNA, 20 bp, human
ggaggcgaagaagacgccag

SEQ ID NO: 67129 - DNA, 20 bp, human
gggcgggcaaggagatcggg

SEQ ID NO: 67130 - DNA, 20 bp, human
gggccgcgctgagggaccgg

SEQ ID NO: 67131 - DNA, 20 bp, human
ggagcacctctaagcagcac

SEQ ID NO: 67132 - DNA, 20 bp, human
gagcggagagcgcaaaacac

SEQ ID NO: 67133 - DNA, 20 bp, human
gagaggaggacagttccccg

SEQ ID NO: 67134 - DNA, 20 bp, human
gcgcgggctgtgacagaatg

SEQ ID NO: 67135 - DNA, 20 bp, human
gggcgcactgctagcctcag

SEQ ID NO: 67136 - DNA, 20 bp, human
ggtcccgcgccggtcccggt

SEQ ID NO: 67137 - DNA, 20 bp, human
gtttacgcaccgacaccggg

SEQ ID NO: 67138 - DNA, 20 bp, human
gagagagacggctcctgtaa

SEQ ID NO: 67139 - DNA, 20 bp, human
gacggtcgcctcaagagaga

SEQ ID NO: 67140 - DNA, 20 bp, human
ggcgctccgtgtaaaagcgg

SEQ ID NO: 67141 - DNA, 20 bp, human
gcgggaaccaggtggccacc

SEQ ID NO: 67142 - DNA, 20 bp, human
ggcacttagcaagcctgtta

SEQ ID NO: 67143 - DNA, 20 bp, human
ggagcgggcaagcgggaacc

SEQ ID NO: 67144 - DNA, 20 bp, human
gacaggagccgtctctcttg

SEQ ID NO: 67145 - DNA, 20 bp, human
gagcgcgctccgtgtaaaag

SEQ ID NO: 67146 - DNA, 20 bp, human
gcactcggcggcagcttctc

SEQ ID NO: 67147 - DNA, 20 bp, human
gcgcggcccgcacccccccg

SEQ ID NO: 67148 - DNA, 20 bp, human
gaagccagggagccgctctc

SEQ ID NO: 67149 - DNA, 20 bp, human
ggctcactgtcgccccgggg

SEQ ID NO: 67150 - DNA, 20 bp, human
ggagcggagggctctcgggt

SEQ ID NO: 67151 - DNA, 20 bp, human
ggcggctccctggcttcact

SEQ ID NO: 67152 - DNA, 20 bp, human
gctgccgccgagtgaagcca

SEQ ID NO: 67153 - DNA, 20 bp, human
ggcgatgcgagagaccgcgg

SEQ ID NO: 67154 - DNA, 20 bp, human
gggcgcgatgcgagagaccg

SEQ ID NO: 67155 - DNA, 20 bp, human
gtcgggtgaccaagagcccg

SEQ ID NO: 67156 - DNA, 20 bp, human
gtatcccctgagattcacag

SEQ ID NO: 67157 - DNA, 20 bp, human
ggtccacactgctaagagtt

SEQ ID NO: 67158 - DNA, 20 bp, human
gactgggaaataagttcaca

SEQ ID NO: 67159 - DNA, 20 bp, human
gctgtcccttaccttctctt

SEQ ID NO: 67160 - DNA, 20 bp, human
ggtttggagtaaagaagcac

SEQ ID NO: 67161 - DNA, 20 bp, human
gggtaagggacagatggatg

SEQ ID NO: 67162 - DNA, 20 bp, human
ggaatctcaggggatacgtg

SEQ ID NO: 67163 - DNA, 20 bp, human
gctccaaactcttagcagtg

SEQ ID NO: 67164 - DNA, 20 bp, human
gctaactgcggtgaaggtgg

SEQ ID NO: 67165 - DNA, 20 bp, human
ggactgcctaagagaaggta

SEQ ID NO: 67166 - DNA, 20 bp, human
gaaggtgtgctgtaaaagta

SEQ ID NO: 67167 - DNA, 20 bp, human
gcttaggtgaaggacactac

SEQ ID NO: 67168 - DNA, 20 bp, human
gtgagcccaaaggtacgcag

SEQ ID NO: 67169 - DNA, 20 bp, human
gaggtgaaggacactacagg

SEQ ID NO: 67170 - DNA, 20 bp, human
gaatagattggttaaccaca

SEQ ID NO: 67171 - DNA, 20 bp, human
gaggccagatcttctttcat

SEQ ID NO: 67172 - DNA, 20 bp, human
gtatgcatcagtatagccaa

SEQ ID NO: 67173 - DNA, 20 bp, human
gtataatgaactggatccgc

SEQ ID NO: 67174 - DNA, 20 bp, human
gccacagtgtctgtaaaatc

SEQ ID NO: 67175 - DNA, 20 bp, human
gaatatgatgcactcaaatg

SEQ ID NO: 67176 - DNA, 20 bp, human
ggcccttggcagcaattccg

SEQ ID NO: 67177 - DNA, 20 bp, human
gagcccagctcgggacgcgg

SEQ ID NO: 67178 - DNA, 20 bp, human
ggcggcgttggcgcagaact

SEQ ID NO: 67179 - DNA, 20 bp, human
gacgcgggggtgagcacgac

SEQ ID NO: 67180 - DNA, 20 bp, human
gacctcggaattgctgccaa

SEQ ID NO: 67181 - DNA, 20 bp, human
gtggagcttggccccaacct

SEQ ID NO: 67182 - DNA, 20 bp, human
gcgggtgcagtagacaggca

SEQ ID NO: 67183 - DNA, 20 bp, human
ggcagcacgtaagcccgctg

SEQ ID NO: 67184 - DNA, 20 bp, human
gctgtctactgcacccgggg

SEQ ID NO: 67185 - DNA, 20 bp, human
gcacccccgcgtcccgagct

SEQ ID NO: 67186 - DNA, 20 bp, human
gcgcgggacgcatagagctg

SEQ ID NO: 67187 - DNA, 20 bp, human
gcatagagctgcggctcggg

SEQ ID NO: 67188 - DNA, 20 bp, human
gtgaaggcaggaagcgatag

SEQ ID NO: 67189 - DNA, 20 bp, human
ggaaagggtcgagctcgtga

SEQ ID NO: 67190 - DNA, 20 bp, human
gcggcctgttcccaagatga

SEQ ID NO: 67191 - DNA, 20 bp, human
gcgtgaaggtcgcagagctg

SEQ ID NO: 67192 - DNA, 20 bp, human
ggcccccctccccagacggt

SEQ ID NO: 67193 - DNA, 20 bp, human
gccggggagcccaccgtctg

SEQ ID NO: 67194 - DNA, 20 bp, human
ggggcggcgcctccctgcgg

SEQ ID NO: 67195 - DNA, 20 bp, human
ggacggtgggctccccgggc

SEQ ID NO: 67196 - DNA, 20 bp, human
ggccgcagccagcagagggt

SEQ ID NO: 67197 - DNA, 20 bp, human
gagagctggagagatcaagc

SEQ ID NO: 67198 - DNA, 20 bp, human
gctgcacacaggcggcccta

SEQ ID NO: 67199 - DNA, 20 bp, human
ggggctctcagcgagtacac

SEQ ID NO: 67200 - DNA, 20 bp, human
gtcgagtgagcagtacctgg

SEQ ID NO: 67201 - DNA, 20 bp, human
ggctgcctcctaccctctgc

SEQ ID NO: 67202 - DNA, 20 bp, human
gcagtggcaagtagcagcac

SEQ ID NO: 67203 - DNA, 20 bp, human
gagcagcagcgggaggaaag

SEQ ID NO: 67204 - DNA, 20 bp, human
gacacgggaacctcagaatc

SEQ ID NO: 67205 - DNA, 20 bp, human
gaagtcgagtgagcagtacc

SEQ ID NO: 67206 - DNA, 20 bp, human
gcacccaagtgcggagagag

SEQ ID NO: 67207 - DNA, 20 bp, human
gggtactgtgggatcttcag

SEQ ID NO: 67208 - DNA, 20 bp, human
gggagggtcacttctcccag

SEQ ID NO: 67209 - DNA, 20 bp, human
gcagcggcggcggttggtca

SEQ ID NO: 67210 - DNA, 20 bp, human
gcagagcccgaaggtactgt

SEQ ID NO: 67211 - DNA, 20 bp, human
gtcccagcggggcgacaact

SEQ ID NO: 67212 - DNA, 20 bp, human
gtttaaagcagggcgagtag

SEQ ID NO: 67213 - DNA, 20 bp, human
gcaactcggctcaatctgtg

SEQ ID NO: 67214 - DNA, 20 bp, human
ggagcggtatcagagcccga

SEQ ID NO: 67215 - DNA, 20 bp, human
gaggcaaacgcagagcgtac

SEQ ID NO: 67216 - DNA, 20 bp, human
ggccgccaggacgggatgac

SEQ ID NO: 67217 - DNA, 20 bp, human
gggccctgaaggtcacatcg

SEQ ID NO: 67218 - DNA, 20 bp, human
gcaagcagggccacctggag

SEQ ID NO: 67219 - DNA, 20 bp, human
gggctccggtcatcccgtcc

SEQ ID NO: 67220 - DNA, 20 bp, human
gccttcagggccgccaggac

SEQ ID NO: 67221 - DNA, 20 bp, human
ggcctcctcgaagacctgaa

SEQ ID NO: 67222 - DNA, 20 bp, human
gcctgaaggtcacatcgcgg

SEQ ID NO: 67223 - DNA, 20 bp, human
gcacctggagagggagtgcg

SEQ ID NO: 67224 - DNA, 20 bp, human
gccggctgctcaccgtctcg

SEQ ID NO: 67225 - DNA, 20 bp, human
gtccggtcatcccgtcctgg

SEQ ID NO: 67226 - DNA, 20 bp, human
ggctccggagacaacttccc

SEQ ID NO: 67227 - DNA, 20 bp, human
gtgctgcaggtcccggacgg

SEQ ID NO: 67228 - DNA, 20 bp, human
gcggccccggccagccctcg

SEQ ID NO: 67229 - DNA, 20 bp, human
gcggggagcggcacggccag

SEQ ID NO: 67230 - DNA, 20 bp, human
gccgggaagcagagactcgt

SEQ ID NO: 67231 - DNA, 20 bp, human
gtcccgggaacgcggaacgc

SEQ ID NO: 67232 - DNA, 20 bp, human
gccctccgaccgggacgctg

SEQ ID NO: 67233 - DNA, 20 bp, human
ggaggagacccaggcgccgc

SEQ ID NO: 67234 - DNA, 20 bp, human
gcattcccgccgagccccac

SEQ ID NO: 67235 - DNA, 20 bp, human
gcccccgcgcaccccagaga

SEQ ID NO: 67236 - DNA, 20 bp, human
gctgctcaccatgacgccag

SEQ ID NO: 67237 - DNA, 20 bp, human
gcaggcccagcggcgactcc

SEQ ID NO: 67238 - DNA, 20 bp, human
gggcctgtccgctggcgtca

SEQ ID NO: 67239 - DNA, 20 bp, human
ggttggatccctgggaccta

SEQ ID NO: 67240 - DNA, 20 bp, human
ggctgaaaccctaggtccca

SEQ ID NO: 67241 - DNA, 20 bp, human
gccccatggaatagagccgg

SEQ ID NO: 67242 - DNA, 20 bp, human
ggaaacggcgtggcttccgg

SEQ ID NO: 67243 - DNA, 20 bp, human
gcaccatgacgccagcggac

SEQ ID NO: 67244 - DNA, 20 bp, human
gggggactctcatcctggaa

SEQ ID NO: 67245 - DNA, 20 bp, human
ggcactcgggactgagacct

SEQ ID NO: 67246 - DNA, 20 bp, human
ggccccgccgcggacaccac

SEQ ID NO: 67247 - DNA, 20 bp, human
gcaggtcccggtggtgtccg

SEQ ID NO: 67248 - DNA, 20 bp, human
gggcgcggcccgcgagggaa

SEQ ID NO: 67249 - DNA, 20 bp, human
gatctgggcgatagggacat

SEQ ID NO: 67250 - DNA, 20 bp, human
ggtcccggtggtgtccgcgg

SEQ ID NO: 67251 - DNA, 20 bp, human
ggctggcaatcgctgaatct

SEQ ID NO: 67252 - DNA, 20 bp, human
gactcacagagcgccctgga

SEQ ID NO: 67253 - DNA, 20 bp, human
gtcgctgaatctgggcgata

SEQ ID NO: 67254 - DNA, 20 bp, human
gaaaatgacccagcagtgga

SEQ ID NO: 67255 - DNA, 20 bp, human
gcggacgcccggccggggtc

SEQ ID NO: 67256 - DNA, 20 bp, human
gctaggaaagggcttgaagt

SEQ ID NO: 67257 - DNA, 20 bp, human
gtgggaggtgtgtggtgcca

SEQ ID NO: 67258 - DNA, 20 bp, human
gatggcactggtctaggaaa

SEQ ID NO: 67259 - DNA, 20 bp, human
gggtgtgtggtgccacggct

SEQ ID NO: 67260 - DNA, 20 bp, human
gcaaagtcacagggattatt

SEQ ID NO: 67261 - DNA, 20 bp, human
gtattaggcaaggctgggat

SEQ ID NO: 67262 - DNA, 20 bp, human
gtggcctggtaccttgatgg

SEQ ID NO: 67263 - DNA, 20 bp, human
ggcaggtggaaggcaaggtt

SEQ ID NO: 67264 - DNA, 20 bp, human
gccagctctggagaccccaa

SEQ ID NO: 67265 - DNA, 20 bp, human
gaggttgggaataccagggt

SEQ ID NO: 67266 - DNA, 20 bp, human
ggcaagctcagtgtgatccc

SEQ ID NO: 67267 - DNA, 20 bp, human
gtgagcttgccacatcccca

SEQ ID NO: 67268 - DNA, 20 bp, human
gggcgttgtagagcagataa

SEQ ID NO: 67269 - DNA, 20 bp, human
ggtgagtggaaatcagatat

SEQ ID NO: 67270 - DNA, 20 bp, human
ggagcctggagcaagcataa

SEQ ID NO: 67271 - DNA, 20 bp, human
gggagcaagcataagggtag

SEQ ID NO: 67272 - DNA, 20 bp, human
gagctcagtgtgatcccagg

SEQ ID NO: 67273 - DNA, 20 bp, human
gttaggggagacagacctag

SEQ ID NO: 67274 - DNA, 20 bp, human
gctgggctggtggttgcgga

SEQ ID NO: 67275 - DNA, 20 bp, human
gggagggttcggccgccttg

SEQ ID NO: 67276 - DNA, 20 bp, human
gaggcgagccccaaaggtag

SEQ ID NO: 67277 - DNA, 20 bp, human
gggccctgctaggatggatg

SEQ ID NO: 67278 - DNA, 20 bp, human
gacttgagcagcgagtcccg

SEQ ID NO: 67279 - DNA, 20 bp, human
ggggccaaggcgagccccaa

SEQ ID NO: 67280 - DNA, 20 bp, human
gtgccagagaccggaaaccc

SEQ ID NO: 67281 - DNA, 20 bp, human
gagggagtatttggttacct

SEQ ID NO: 67282 - DNA, 20 bp, human
ggcgagtcccggggcgacgc

SEQ ID NO: 67283 - DNA, 20 bp, human
ggcgaggccagcgtcgcccc

SEQ ID NO: 67284 - DNA, 20 bp, human
gaaccagggtttccggtctc

SEQ ID NO: 67285 - DNA, 20 bp, human
ggcggccgcatggtgttcag

SEQ ID NO: 67286 - DNA, 20 bp, human
gttcatgtctgtgcaggagt

SEQ ID NO: 67287 - DNA, 20 bp, human
gcttacagggtaggagctgg

SEQ ID NO: 67288 - DNA, 20 bp, human
gtgtatctggcgccaagtgt

SEQ ID NO: 67289 - DNA, 20 bp, human
gccctgagcgcagtactaag

SEQ ID NO: 67290 - DNA, 20 bp, human
ggaggctggcggggcttaca

SEQ ID NO: 67291 - DNA, 20 bp, human
gggcggccggaggatgccga

SEQ ID NO: 67292 - DNA, 20 bp, human
gctggcgccagggcggccgg

SEQ ID NO: 67293 - DNA, 20 bp, human
gccagggacagcacgtccgg

SEQ ID NO: 67294 - DNA, 20 bp, human
gctgcacagacatgaagcgg

SEQ ID NO: 67295 - DNA, 20 bp, human
gggcccagggacagcacgtc

SEQ ID NO: 67296 - DNA, 20 bp, human
gacttggagggcaagtccca

SEQ ID NO: 67297 - DNA, 20 bp, human
gtgggtagcgaagagcagag

SEQ ID NO: 67298 - DNA, 20 bp, human
gccgggaccggtgtccccga

SEQ ID NO: 67299 - DNA, 20 bp, human
gtgccactccagcaactcag

SEQ ID NO: 67300 - DNA, 20 bp, human
ggcgcacccgagacccgcac

SEQ ID NO: 67301 - DNA, 20 bp, human
gctgactgttacgacttgga

SEQ ID NO: 67302 - DNA, 20 bp, human
gtcgctacccaggttggtac

SEQ ID NO: 67303 - DNA, 20 bp, human
gaagtcaccagtaccaacct

SEQ ID NO: 67304 - DNA, 20 bp, human
gagcccctgagttgctggag

SEQ ID NO: 67305 - DNA, 20 bp, human
gagggctgactgttacgact

SEQ ID NO: 67306 - DNA, 20 bp, human
ggcctgcgatatgcaaacaa

SEQ ID NO: 67307 - DNA, 20 bp, human
gcatggagggaagtagacgg

SEQ ID NO: 67308 - DNA, 20 bp, human
ggcggcgacgaagcctctcg

SEQ ID NO: 67309 - DNA, 20 bp, human
gacggcagctcgcacatgga

SEQ ID NO: 67310 - DNA, 20 bp, human
ggttccgcgcacgctcccct

SEQ ID NO: 67311 - DNA, 20 bp, human
gtcacacggaaagaatccaa

SEQ ID NO: 67312 - DNA, 20 bp, human
gggttggagaatgtgcacac

SEQ ID NO: 67313 - DNA, 20 bp, human
ggtcccgggcccgtcagtcc

SEQ ID NO: 67314 - DNA, 20 bp, human
gggacccgagccgcgagctg

SEQ ID NO: 67315 - DNA, 20 bp, human
ggagcgtgcgcggaacctcc

SEQ ID NO: 67316 - DNA, 20 bp, human
gccccggggtgagctcggtg

SEQ ID NO: 67317 - DNA, 20 bp, human
gggacaggtgtggaggtcac

SEQ ID NO: 67318 - DNA, 20 bp, human
gacctgcccggcataagctc

SEQ ID NO: 67319 - DNA, 20 bp, human
ggaagcgctgcccgaagcgg

SEQ ID NO: 67320 - DNA, 20 bp, human
ggagcactcaccagcgggca

SEQ ID NO: 67321 - DNA, 20 bp, human
gtgggaagcgctgcccgaag

SEQ ID NO: 67322 - DNA, 20 bp, human
gcagcgcccgagcttatgcc

SEQ ID NO: 67323 - DNA, 20 bp, human
gcaggtaggacagcatcgag

SEQ ID NO: 67324 - DNA, 20 bp, human
ggcccggtcggggaggaggt

SEQ ID NO: 67325 - DNA, 20 bp, human
ggcgccggcggcacaaacat

SEQ ID NO: 67326 - DNA, 20 bp, human
gaggcgcggagagaagccga

SEQ ID NO: 67327 - DNA, 20 bp, human
ggaggaagcagccgaacctc

SEQ ID NO: 67328 - DNA, 20 bp, human
gaagcagccgaacctcgggc

SEQ ID NO: 67329 - DNA, 20 bp, human
gtgcgcatggagaacggccg

SEQ ID NO: 67330 - DNA, 20 bp, human
ggcatggagaacggccgcgg

SEQ ID NO: 67331 - DNA, 20 bp, human
gcggagggtgctcccaggcg

SEQ ID NO: 67332 - DNA, 20 bp, human
gagaagccgagggcgccagc

SEQ ID NO: 67333 - DNA, 20 bp, human
gcgggagccggtagttaggc

SEQ ID NO: 67334 - DNA, 20 bp, human
gggaaggagggaaacaccgt

SEQ ID NO: 67335 - DNA, 20 bp, human
ggcgctgctggtgaataaaa

SEQ ID NO: 67336 - DNA, 20 bp, human
gattccctggcccgaggcac

SEQ ID NO: 67337 - DNA, 20 bp, human
ggcccgccactcccggcgat

SEQ ID NO: 67338 - DNA, 20 bp, human
gaggcactgggaagcaggac

SEQ ID NO: 67339 - DNA, 20 bp, human
gctcccggcgataggaagag

SEQ ID NO: 67340 - DNA, 20 bp, human
gggagtggcgggccgaccag

SEQ ID NO: 67341 - DNA, 20 bp, human
gcaggactgggaaagggatc

SEQ ID NO: 67342 - DNA, 20 bp, human
gggaagagcggtgagagcgt

SEQ ID NO: 67343 - DNA, 20 bp, human
gcgctggcgctgccccgtgg

SEQ ID NO: 67344 - DNA, 20 bp, human
gcccctccgcagagcaacgg

SEQ ID NO: 67345 - DNA, 20 bp, human
ggtggaagaagggagcgcag

SEQ ID NO: 67346 - DNA, 20 bp, human
gcggggcaaggaactttcca

SEQ ID NO: 67347 - DNA, 20 bp, human
gctccatgtgtgcggccgag

SEQ ID NO: 67348 - DNA, 20 bp, human
gctggtgcgcatgtcccggg

SEQ ID NO: 67349 - DNA, 20 bp, human
gggcagcgcgcaggttacgg

SEQ ID NO: 67350 - DNA, 20 bp, human
gacgtgcccgggccgcctcg

SEQ ID NO: 67351 - DNA, 20 bp, human
ggcgggtcggccgggcccta

SEQ ID NO: 67352 - DNA, 20 bp, human
gcgcacggctgagactggag

SEQ ID NO: 67353 - DNA, 20 bp, human
gcgcccctcggccgcacaca

SEQ ID NO: 67354 - DNA, 20 bp, human
gggccgaggggcgcattatc

SEQ ID NO: 67355 - DNA, 20 bp, human
gccccgcaggaagcgcagga

SEQ ID NO: 67356 - DNA, 20 bp, human
gctgcgccgcccgaggccgt

SEQ ID NO: 67357 - DNA, 20 bp, human
ggaaatctgcctagcaaccg

SEQ ID NO: 67358 - DNA, 20 bp, human
gggacacacccgcctctcta

SEQ ID NO: 67359 - DNA, 20 bp, human
ggcgggtgtgtccccaagag

SEQ ID NO: 67360 - DNA, 20 bp, human
ggcccgcgcagtcggtcggt

SEQ ID NO: 67361 - DNA, 20 bp, human
gcggaggcgactccctcagg

SEQ ID NO: 67362 - DNA, 20 bp, human
gcgccgcgggcgccacctga

SEQ ID NO: 67363 - DNA, 20 bp, human
gcgccgcccgcgcagtcggt

SEQ ID NO: 67364 - DNA, 20 bp, human
gcaggtcttgtggcgtcccg

SEQ ID NO: 67365 - DNA, 20 bp, human
gtcccctgcctggagagacg

SEQ ID NO: 67366 - DNA, 20 bp, human
ggagttacaccgccaccgcc

SEQ ID NO: 67367 - DNA, 20 bp, human
ggcggcggaggcgtcgaaaa

SEQ ID NO: 67368 - DNA, 20 bp, human
ggacactgcggtacagacgg

SEQ ID NO: 67369 - DNA, 20 bp, human
ggcgggcggagcagacactg

SEQ ID NO: 67370 - DNA, 20 bp, human
ggcagacactgcggtacaga

SEQ ID NO: 67371 - DNA, 20 bp, human
gggcggtgaggagcgaggaa

SEQ ID NO: 67372 - DNA, 20 bp, human
ggtacagacgggggcagcgg

SEQ ID NO: 67373 - DNA, 20 bp, human
ggaggccgaagtgaaagacc

SEQ ID NO: 67374 - DNA, 20 bp, human
gggggcgcgctagagaggaa

SEQ ID NO: 67375 - DNA, 20 bp, human
ggaccctgctgacgggacta

SEQ ID NO: 67376 - DNA, 20 bp, human
gtgactcgcgaggtgactgt

SEQ ID NO: 67377 - DNA, 20 bp, human
gtggaggacaggtaaactcg

SEQ ID NO: 67378 - DNA, 20 bp, human
gcccgcccagaggggcccga

SEQ ID NO: 67379 - DNA, 20 bp, human
ggaagaaatgtggtcgcggt

SEQ ID NO: 67380 - DNA, 20 bp, human
gacgcgcgggcgcactgcgg

SEQ ID NO: 67381 - DNA, 20 bp, human
gaatgtggtcgcggttggtg

SEQ ID NO: 67382 - DNA, 20 bp, human
gccctggcgcccgcccagag

SEQ ID NO: 67383 - DNA, 20 bp, human
gacgcgccgtggacacagac

SEQ ID NO: 67384 - DNA, 20 bp, human
gggccacggtcaaggcttcg

SEQ ID NO: 67385 - DNA, 20 bp, human
ggttacgcgcgggcgcactg

SEQ ID NO: 67386 - DNA, 20 bp, human
ggacagcaagtggaccccaa

SEQ ID NO: 67387 - DNA, 20 bp, human
gaccaaggtccggtagaggg

SEQ ID NO: 67388 - DNA, 20 bp, human
gttggaccgacgcggcccag

SEQ ID NO: 67389 - DNA, 20 bp, human
gggcggcgtcccccagtcag

SEQ ID NO: 67390 - DNA, 20 bp, human
gggtgcagcgcaccaaggtc

SEQ ID NO: 67391 - DNA, 20 bp, human
ggcgcaccaaggtccggtag

SEQ ID NO: 67392 - DNA, 20 bp, human
gttccggctagggaaagcga

SEQ ID NO: 67393 - DNA, 20 bp, human
ggggaaggcttggaccgacg

SEQ ID NO: 67394 - DNA, 20 bp, human
ggcgcgctctcgggaaggct

SEQ ID NO: 67395 - DNA, 20 bp, human
gctgctggcccacggcgcag

SEQ ID NO: 67396 - DNA, 20 bp, human
gaccatctcgggaaagctct

SEQ ID NO: 67397 - DNA, 20 bp, human
gctgtaacgaagaccatctc

SEQ ID NO: 67398 - DNA, 20 bp, human
gatagtgggagggaagcaca

SEQ ID NO: 67399 - DNA, 20 bp, human
gttcgttacaggtgtctggg

SEQ ID NO: 67400 - DNA, 20 bp, human
ggtcttcgttacaggtgtct

SEQ ID NO: 67401 - DNA, 20 bp, human
ggggaaagtaccagcatagt

SEQ ID NO: 67402 - DNA, 20 bp, human
gcaggcacaacccttcctat

SEQ ID NO: 67403 - DNA, 20 bp, human
gaaactctaactatccgcat

SEQ ID NO: 67404 - DNA, 20 bp, human
gggcttaagctcacttcact

SEQ ID NO: 67405 - DNA, 20 bp, human
gacaccaacgctctacccag

SEQ ID NO: 67406 - DNA, 20 bp, human
ggggagccacgggtcgaggg

SEQ ID NO: 67407 - DNA, 20 bp, human
gagggggagccacgggtcga

SEQ ID NO: 67408 - DNA, 20 bp, human
gcaggcccgtaggtgaacag

SEQ ID NO: 67409 - DNA, 20 bp, human
ggtggctccccctcgcaact

SEQ ID NO: 67410 - DNA, 20 bp, human
gcgcggcagctcatccgctg

SEQ ID NO: 67411 - DNA, 20 bp, human
gcaagtttgatcaggcccgt

SEQ ID NO: 67412 - DNA, 20 bp, human
gcggcgcgcgggtgccggcg

SEQ ID NO: 67413 - DNA, 20 bp, human
gtatcccgctgttcacctac

SEQ ID NO: 67414 - DNA, 20 bp, human
gggcccgccaagttgcgagg

SEQ ID NO: 67415 - DNA, 20 bp, human
ggccgcggctcgtcccccag

SEQ ID NO: 67416 - DNA, 20 bp, human
gtagagccagagaccgggac

SEQ ID NO: 67417 - DNA, 20 bp, human
gaggatgtgcagctccatcg

SEQ ID NO: 67418 - DNA, 20 bp, human
gagcagcttgatgagcgggt

SEQ ID NO: 67419 - DNA, 20 bp, human
ggcccctctgacatgaaggg

SEQ ID NO: 67420 - DNA, 20 bp, human
gcgtgcggcctgggtctagt

SEQ ID NO: 67421 - DNA, 20 bp, human
gggttcgggagcgcagatag

SEQ ID NO: 67422 - DNA, 20 bp, human
gggaagagcagcttgatgag

SEQ ID NO: 67423 - DNA, 20 bp, human
gcatcctagaacaccgggtg

SEQ ID NO: 67424 - DNA, 20 bp, human
ggaggagaggttcacacccg

SEQ ID NO: 67425 - DNA, 20 bp, human
gactcagtagtgtcaaatgg

SEQ ID NO: 67426 - DNA, 20 bp, human
ggaagccggaattacttgca

SEQ ID NO: 67427 - DNA, 20 bp, human
gtaattccggcttcccgatg

SEQ ID NO: 67428 - DNA, 20 bp, human
gtagatgaagagaagaccac

SEQ ID NO: 67429 - DNA, 20 bp, human
gcccatccacatcgggaagc

SEQ ID NO: 67430 - DNA, 20 bp, human
gttcatctaatgaccctgag

SEQ ID NO: 67431 - DNA, 20 bp, human
gtctaatgaccctgagggga

SEQ ID NO: 67432 - DNA, 20 bp, human
gtagtgcctatagctaaggc

SEQ ID NO: 67433 - DNA, 20 bp, human
gacaaggcccacagaaacct

SEQ ID NO: 67434 - DNA, 20 bp, human
gatgtgggagaccgggccat

SEQ ID NO: 67435 - DNA, 20 bp, human
ggctgcacccaggtttctgt

SEQ ID NO: 67436 - DNA, 20 bp, human
gccgcgcagtaagactctga

SEQ ID NO: 67437 - DNA, 20 bp, human
gctgggcgggactggagact

SEQ ID NO: 67438 - DNA, 20 bp, human
ggcctgcaaaggcgcctggg

SEQ ID NO: 67439 - DNA, 20 bp, human
gcaggcgcctttgcaggctg

SEQ ID NO: 67440 - DNA, 20 bp, human
ggagaaacagcagccccaac

SEQ ID NO: 67441 - DNA, 20 bp, human
gctcgcggctgcgggtggtc

SEQ ID NO: 67442 - DNA, 20 bp, human
gcccgcccaggcgcctttgc

SEQ ID NO: 67443 - DNA, 20 bp, human
gggggacagctaagatccaa

SEQ ID NO: 67444 - DNA, 20 bp, human
gtattcattacgcctaccgt

SEQ ID NO: 67445 - DNA, 20 bp, human
gttaagtgcgaacgcaggga

SEQ ID NO: 67446 - DNA, 20 bp, human
gggccgggcgagctaatcgt

SEQ ID NO: 67447 - DNA, 20 bp, human
gcgactgggcccgcagagag

SEQ ID NO: 67448 - DNA, 20 bp, human
gcggcaggccagaccggaaa

SEQ ID NO: 67449 - DNA, 20 bp, human
gcaggtgccagcccgtggga

SEQ ID NO: 67450 - DNA, 20 bp, human
gcgcccaggtgccagcccgt

SEQ ID NO: 67451 - DNA, 20 bp, human
ggcccagggtcaccttccca

SEQ ID NO: 67452 - DNA, 20 bp, human
ggaaagggctcgggtcatcc

SEQ ID NO: 67453 - DNA, 20 bp, human
ggcccgtgggaaggtgaccc

SEQ ID NO: 67454 - DNA, 20 bp, human
gcggcgcccgcatctggaat

SEQ ID NO: 67455 - DNA, 20 bp, human
ggacgatacctaacaacgac

SEQ ID NO: 67456 - DNA, 20 bp, human
gccagaagcagagcaccctt

SEQ ID NO: 67457 - DNA, 20 bp, human
gcagagcaccctttggccag

SEQ ID NO: 67458 - DNA, 20 bp, human
gcctggctcctctggccaaa

SEQ ID NO: 67459 - DNA, 20 bp, human
ggtttaagaagctgtctact

SEQ ID NO: 67460 - DNA, 20 bp, human
gtctctttaggcacaaggaa

SEQ ID NO: 67461 - DNA, 20 bp, human
gtgccccaactcctctacaa

SEQ ID NO: 67462 - DNA, 20 bp, human
gctttaggcacaaggaaggg

SEQ ID NO: 67463 - DNA, 20 bp, human
gtattggctggaagaatatt

SEQ ID NO: 67464 - DNA, 20 bp, human
gtgtacctgaggaagatggt

SEQ ID NO: 67465 - DNA, 20 bp, human
gctcctttgtagaggagttg

SEQ ID NO: 67466 - DNA, 20 bp, human
ggccgaggcgccgagcaaga

SEQ ID NO: 67467 - DNA, 20 bp, human
gccctgaccggcgcgacccg

SEQ ID NO: 67468 - DNA, 20 bp, human
gccggcgcgacccgtggcca

SEQ ID NO: 67469 - DNA, 20 bp, human
gcgcgcgctgtccctgtccc

SEQ ID NO: 67470 - DNA, 20 bp, human
gtctgctgggtcctcgccgg

SEQ ID NO: 67471 - DNA, 20 bp, human
gagctctccgcggagcgtag

SEQ ID NO: 67472 - DNA, 20 bp, human
gacccagcagacggcgtccg

SEQ ID NO: 67473 - DNA, 20 bp, human
gcccggcacctcagagacca

SEQ ID NO: 67474 - DNA, 20 bp, human
gggcggcctcctgcagcggg

SEQ ID NO: 67475 - DNA, 20 bp, human
gctctgaggtgccgggagta

SEQ ID NO: 67476 - DNA, 20 bp, human
gagctctagctgggacgcgg

SEQ ID NO: 67477 - DNA, 20 bp, human
gcggcccgaggactacgagg

SEQ ID NO: 67478 - DNA, 20 bp, human
gaggcccgagaggtcgagtg

SEQ ID NO: 67479 - DNA, 20 bp, human
gggttctgtggcttccgtag

SEQ ID NO: 67480 - DNA, 20 bp, human
gggactgcggcggaatatgg

SEQ ID NO: 67481 - DNA, 20 bp, human
gtacctgcgctggaagtcca

SEQ ID NO: 67482 - DNA, 20 bp, human
ggccgagccgcgggagtcat

SEQ ID NO: 67483 - DNA, 20 bp, human
ggggctgcctgtctaagtgg

SEQ ID NO: 67484 - DNA, 20 bp, human
gagggcgcctaggcgtgtcg

SEQ ID NO: 67485 - DNA, 20 bp, human
gggcgtgtcgaggcaagccg

SEQ ID NO: 67486 - DNA, 20 bp, human
gccgggacgggcagtagagc

SEQ ID NO: 67487 - DNA, 20 bp, human
gtccgccaggatgagtcgtc

SEQ ID NO: 67488 - DNA, 20 bp, human
gcaggatgagtcgtccggga

SEQ ID NO: 67489 - DNA, 20 bp, human
gcaggcagcgggctagactg

SEQ ID NO: 67490 - DNA, 20 bp, human
gagctgacagggaaggtacc

SEQ ID NO: 67491 - DNA, 20 bp, human
gggaacagggaggtatgcag

SEQ ID NO: 67492 - DNA, 20 bp, human
ggcagaaatcgcccctcctg

SEQ ID NO: 67493 - DNA, 20 bp, human
ggcggacaggaataagacga

SEQ ID NO: 67494 - DNA, 20 bp, human
gttgaggccgaagtcagggt

SEQ ID NO: 67495 - DNA, 20 bp, human
gaggtgggctaaggacgcag

SEQ ID NO: 67496 - DNA, 20 bp, human
ggcgatacccgggcgatcgg

SEQ ID NO: 67497 - DNA, 20 bp, human
gctgggcccccgcgataccc

SEQ ID NO: 67498 - DNA, 20 bp, human
gcacagtgagcggagagccg

SEQ ID NO: 67499 - DNA, 20 bp, human
ggatcgcccgggtatcgcgg

SEQ ID NO: 67500 - DNA, 20 bp, human
ggattaggccgctgccactc

SEQ ID NO: 67501 - DNA, 20 bp, human
gcccttgcgtggcagggact

SEQ ID NO: 67502 - DNA, 20 bp, human
gtggcagcggcctaatcccc

SEQ ID NO: 67503 - DNA, 20 bp, human
gggcgttaggacggttggag

SEQ ID NO: 67504 - DNA, 20 bp, human
gagggactgggtggggccaa

SEQ ID NO: 67505 - DNA, 20 bp, human
gacgcaaggggccaaggagg

SEQ ID NO: 67506 - DNA, 20 bp, human
gagccagtgctcgtgaacta

SEQ ID NO: 67507 - DNA, 20 bp, human
gctccttagttcacgagcac

SEQ ID NO: 67508 - DNA, 20 bp, human
gttcagtccatcactgacga

SEQ ID NO: 67509 - DNA, 20 bp, human
gcagtgatatggaacctata

SEQ ID NO: 67510 - DNA, 20 bp, human
gtcactgttccgaagttgta

SEQ ID NO: 67511 - DNA, 20 bp, human
gaacgggttcttttcatgga

SEQ ID NO: 67512 - DNA, 20 bp, human
gtgagcatttgaaatgtact

SEQ ID NO: 67513 - DNA, 20 bp, human
gtctaaatatttcatcaatg

SEQ ID NO: 67514 - DNA, 20 bp, human
gaaatggaagagttacaaac

SEQ ID NO: 67515 - DNA, 20 bp, human
gtacaaacgggttcttttca

SEQ ID NO: 67516 - DNA, 20 bp, human
ggcaggagcagagagcacta

SEQ ID NO: 67517 - DNA, 20 bp, human
ggtctccagcatagagagat

SEQ ID NO: 67518 - DNA, 20 bp, human
gctatcctggccctatcaag

SEQ ID NO: 67519 - DNA, 20 bp, human
gtctgatctgggtaagactg

SEQ ID NO: 67520 - DNA, 20 bp, human
gattgacagagcctggacgt

SEQ ID NO: 67521 - DNA, 20 bp, human
gaacctgcagccacttgata

SEQ ID NO: 67522 - DNA, 20 bp, human
gatagggccaggatagtatg

SEQ ID NO: 67523 - DNA, 20 bp, human
gggggcttcctccaacgtcc

SEQ ID NO: 67524 - DNA, 20 bp, human
ggacagagcctggacgttgg

SEQ ID NO: 67525 - DNA, 20 bp, human
gactcggaagaaaagagagg

SEQ ID NO: 67526 - DNA, 20 bp, human
gggctctgaagccattacaa

SEQ ID NO: 67527 - DNA, 20 bp, human
ggtacctcagctcagggacg

SEQ ID NO: 67528 - DNA, 20 bp, human
ggtagtggcacttagagcca

SEQ ID NO: 67529 - DNA, 20 bp, human
gaaagctacacaacactgaa

SEQ ID NO: 67530 - DNA, 20 bp, human
gcgtggagcctataacgttg

SEQ ID NO: 67531 - DNA, 20 bp, human
gagttaagcaacctttgtaa

SEQ ID NO: 67532 - DNA, 20 bp, human
gataacgttgtggcaaggat

SEQ ID NO: 67533 - DNA, 20 bp, human
gaaatgaccaggaccaaatt

SEQ ID NO: 67534 - DNA, 20 bp, human
gtctgaagtacctcagctca

SEQ ID NO: 67535 - DNA, 20 bp, human
gggtgttatcagaagtacca

SEQ ID NO: 67536 - DNA, 20 bp, human
gcacggagcaaagcactcag

SEQ ID NO: 67537 - DNA, 20 bp, human
gagggttggagacttcacac

SEQ ID NO: 67538 - DNA, 20 bp, human
ggtccacaggcggcgaccag

SEQ ID NO: 67539 - DNA, 20 bp, human
gcgcctggatcctcgagaaa

SEQ ID NO: 67540 - DNA, 20 bp, human
gcagcgcatcctggagacac

SEQ ID NO: 67541 - DNA, 20 bp, human
gtcacactggcgggtgacaa

SEQ ID NO: 67542 - DNA, 20 bp, human
gtctctagacggtccacagg

SEQ ID NO: 67543 - DNA, 20 bp, human
ggtatatgtatactagatga

SEQ ID NO: 67544 - DNA, 20 bp, human
ggcgtctctagacggtccac

SEQ ID NO: 67545 - DNA, 20 bp, human
gtagaagctgaaagtccagc

SEQ ID NO: 67546 - DNA, 20 bp, human
ggcctggagggtgacctcag

SEQ ID NO: 67547 - DNA, 20 bp, human
gttccggacacggtaagact

SEQ ID NO: 67548 - DNA, 20 bp, human
ggatgcagcttatcctgatg

SEQ ID NO: 67549 - DNA, 20 bp, human
gaccgtgacactcaacgcta

SEQ ID NO: 67550 - DNA, 20 bp, human
gaccctagcgttgagtgtca

SEQ ID NO: 67551 - DNA, 20 bp, human
ggaaacattctacaaaggat

SEQ ID NO: 67552 - DNA, 20 bp, human
ggagatttgcaagattcatt

SEQ ID NO: 67553 - DNA, 20 bp, human
ggctggctacttctcttatc

SEQ ID NO: 67554 - DNA, 20 bp, human
gttttagaaacattctacaa

SEQ ID NO: 67555 - DNA, 20 bp, human
ggtaagactggggcaagagg

SEQ ID NO: 67556 - DNA, 20 bp, human
gacctgcggtgctatagagc

SEQ ID NO: 67557 - DNA, 20 bp, human
gtcagggaacagcacatcca

SEQ ID NO: 67558 - DNA, 20 bp, human
gccaggcaattataccggaa

SEQ ID NO: 67559 - DNA, 20 bp, human
gcggctgtcactggttcaag

SEQ ID NO: 67560 - DNA, 20 bp, human
gggacctgagagagatagcc

SEQ ID NO: 67561 - DNA, 20 bp, human
gcagagaacaaggagcttcc

SEQ ID NO: 67562 - DNA, 20 bp, human
gccttgttctctgcattctg

SEQ ID NO: 67563 - DNA, 20 bp, human
gcagagtggtaactgaggaa

SEQ ID NO: 67564 - DNA, 20 bp, human
gctgcctggctatctctctc

SEQ ID NO: 67565 - DNA, 20 bp, human
gtgattcagagtggtaactg

SEQ ID NO: 67566 - DNA, 20 bp, human
gacccagagtagagatcctc

SEQ ID NO: 67567 - DNA, 20 bp, human
gcaggaattagagcacacta

SEQ ID NO: 67568 - DNA, 20 bp, human
gtccagaggatctctactct

SEQ ID NO: 67569 - DNA, 20 bp, human
gacttgggatctgcaaaaag

SEQ ID NO: 67570 - DNA, 20 bp, human
ggaaatcctggcctcttagg

SEQ ID NO: 67571 - DNA, 20 bp, human
ggaaagtgacagagcctatt

SEQ ID NO: 67572 - DNA, 20 bp, human
gtcagattaggcttcagcag

SEQ ID NO: 67573 - DNA, 20 bp, human
gagttgaccatccccaagat

SEQ ID NO: 67574 - DNA, 20 bp, human
gtacctagagctataaatgt

SEQ ID NO: 67575 - DNA, 20 bp, human
gattcctgctgtgtcagatt

SEQ ID NO: 67576 - DNA, 20 bp, human
gcaggctgtgccctcgatgg

SEQ ID NO: 67577 - DNA, 20 bp, human
gagccccgcgcagaaggtgt

SEQ ID NO: 67578 - DNA, 20 bp, human
gcgccccgcgcggacacgca

SEQ ID NO: 67579 - DNA, 20 bp, human
ggcccgtagaaagcgtcggg

SEQ ID NO: 67580 - DNA, 20 bp, human
ggcagcacgagcggccggta

SEQ ID NO: 67581 - DNA, 20 bp, human
gcgcgcagaaggtgttggta

SEQ ID NO: 67582 - DNA, 20 bp, human
ggcgcgggctcggcgcagtg

SEQ ID NO: 67583 - DNA, 20 bp, human
gccggccacttgctgtacac

SEQ ID NO: 67584 - DNA, 20 bp, human
gcccagagaggagcgccccg

SEQ ID NO: 67585 - DNA, 20 bp, human
gattagggagtcgatggaga

SEQ ID NO: 67586 - DNA, 20 bp, human
gcgggttaggcgttgagagg

SEQ ID NO: 67587 - DNA, 20 bp, human
gagccgggttaggcgttgag

SEQ ID NO: 67588 - DNA, 20 bp, human
gagcggctgccccaagacat

SEQ ID NO: 67589 - DNA, 20 bp, human
gaccctggtgggggcctgga

SEQ ID NO: 67590 - DNA, 20 bp, human
gcgcggcgcacaggaggaag

SEQ ID NO: 67591 - DNA, 20 bp, human
gcagagcccgaagccgggtt

SEQ ID NO: 67592 - DNA, 20 bp, human
ggcgcaagcggaccctggtg

SEQ ID NO: 67593 - DNA, 20 bp, human
gggtcagcccaaggtccgtg

SEQ ID NO: 67594 - DNA, 20 bp, human
gttcaggcaccgccgcacgg

SEQ ID NO: 67595 - DNA, 20 bp, human
ggcaggccctcgacaggagt

SEQ ID NO: 67596 - DNA, 20 bp, human
gggcttcgcgcgctccccag

SEQ ID NO: 67597 - DNA, 20 bp, human
gaagccggcgtacttatctc

SEQ ID NO: 67598 - DNA, 20 bp, human
ggcccgcgggaggcgacgga

SEQ ID NO: 67599 - DNA, 20 bp, human
gtcatagacgcgctcggtag

SEQ ID NO: 67600 - DNA, 20 bp, human
gccgccggagataagtacgc

SEQ ID NO: 67601 - DNA, 20 bp, human
gctcggtagaggccagcgag

SEQ ID NO: 67602 - DNA, 20 bp, human
gcgacggacggcgggacgga

SEQ ID NO: 67603 - DNA, 20 bp, human
ggatgatgcagcgcccgctg

SEQ ID NO: 67604 - DNA, 20 bp, human
ggctgcatcatcatcagcga

SEQ ID NO: 67605 - DNA, 20 bp, human
ggggcgccctctccactccg

SEQ ID NO: 67606 - DNA, 20 bp, human
ggaggtgctgcaagactctc

SEQ ID NO: 67607 - DNA, 20 bp, human
gagagggataaggaccagag

SEQ ID NO: 67608 - DNA, 20 bp, human
gatggtcacctacaggagag

SEQ ID NO: 67609 - DNA, 20 bp, human
gcacagcaagcagtagtacc

SEQ ID NO: 67610 - DNA, 20 bp, human
gagaaaaatgaagagggtcc

SEQ ID NO: 67611 - DNA, 20 bp, human
gtcttgcttatcaacaaagg

SEQ ID NO: 67612 - DNA, 20 bp, human
gcttttacatggtcacctac

SEQ ID NO: 67613 - DNA, 20 bp, human
gagtggtagccaaaagtaat

SEQ ID NO: 67614 - DNA, 20 bp, human
gaagaactggtgaatatgtt

SEQ ID NO: 67615 - DNA, 20 bp, human
gttggacatgctttagagag

SEQ ID NO: 67616 - DNA, 20 bp, human
ggtgctgggagaaaaagcac

SEQ ID NO: 67617 - DNA, 20 bp, human
gtactggaacaagaagaggg

SEQ ID NO: 67618 - DNA, 20 bp, human
gcgcagggagcaggagccaa

SEQ ID NO: 67619 - DNA, 20 bp, human
gccatgacgagcgggacgag

SEQ ID NO: 67620 - DNA, 20 bp, human
gagctgcaggtgaggctgaa

SEQ ID NO: 67621 - DNA, 20 bp, human
gcactgcggacgcgactcga

SEQ ID NO: 67622 - DNA, 20 bp, human
gtacccgggatacggaggag

SEQ ID NO: 67623 - DNA, 20 bp, human
ggtccgcgcctggtactcgg

SEQ ID NO: 67624 - DNA, 20 bp, human
gggagaaaaagcacaggcgc

SEQ ID NO: 67625 - DNA, 20 bp, human
gttcggaggagtgaactgtg

SEQ ID NO: 67626 - DNA, 20 bp, human
ggggcgaggtaggagcgatg

SEQ ID NO: 67627 - DNA, 20 bp, human
gcgagcgcgcctgcctgcct

SEQ ID NO: 67628 - DNA, 20 bp, human
gttggtagagaccttcacaa

SEQ ID NO: 67629 - DNA, 20 bp, human
gaggagccgctcaagaaatg

SEQ ID NO: 67630 - DNA, 20 bp, human
gcgcgatgcgcacggctccc

SEQ ID NO: 67631 - DNA, 20 bp, human
gtggcgcgccgcactcttct

SEQ ID NO: 67632 - DNA, 20 bp, human
gccgtcaaaagggtttaacc

SEQ ID NO: 67633 - DNA, 20 bp, human
gccaggcaagagtcaatatt

SEQ ID NO: 67634 - DNA, 20 bp, human
ggaacagtagctaagagtgt

SEQ ID NO: 67635 - DNA, 20 bp, human
gggtaggagcgatgtggcct

SEQ ID NO: 67636 - DNA, 20 bp, human
gctgctggaaagctgacgtg

SEQ ID NO: 67637 - DNA, 20 bp, human
gtctccatggagggtctgaa

SEQ ID NO: 67638 - DNA, 20 bp, human
gcggccccctcggcccacgt

SEQ ID NO: 67639 - DNA, 20 bp, human
gtaaagctgcctgccgacaa

SEQ ID NO: 67640 - DNA, 20 bp, human
gtaggtccgggataactagg

SEQ ID NO: 67641 - DNA, 20 bp, human
ggagagggccgtgaagacgc

SEQ ID NO: 67642 - DNA, 20 bp, human
gtcggcaggcagctttagtt

SEQ ID NO: 67643 - DNA, 20 bp, human
gtcgctgacgtcacttccag

SEQ ID NO: 67644 - DNA, 20 bp, human
gagtttgggatgaatttcgg

SEQ ID NO: 67645 - DNA, 20 bp, human
ggccgtgaagacgcaggcgg

SEQ ID NO: 67646 - DNA, 20 bp, human
gggcgcaaacagaagtgcag

SEQ ID NO: 67647 - DNA, 20 bp, human
ggcagtagagcctacgtcag

SEQ ID NO: 67648 - DNA, 20 bp, human
gaacagaagtgcagcggtgg

SEQ ID NO: 67649 - DNA, 20 bp, human
gcctgggaccgggaaatcta

SEQ ID NO: 67650 - DNA, 20 bp, human
ggcgcggaaggcttgatggg

SEQ ID NO: 67651 - DNA, 20 bp, human
ggcaaacagaagtgcagcgg

SEQ ID NO: 67652 - DNA, 20 bp, human
gtagagcctacgtcagaggc

SEQ ID NO: 67653 - DNA, 20 bp, human
ggcggagatggaggtaactc

SEQ ID NO: 67654 - DNA, 20 bp, human
gacggggcaggtaaccccca

SEQ ID NO: 67655 - DNA, 20 bp, human
gggcttcaccagctacccct

SEQ ID NO: 67656 - DNA, 20 bp, human
gagctcctctcacccacggc

SEQ ID NO: 67657 - DNA, 20 bp, human
gctgacacccccgctcctgt

SEQ ID NO: 67658 - DNA, 20 bp, human
ggtgcggtagccccagccgt

SEQ ID NO: 67659 - DNA, 20 bp, human
gaggtactaccaggtaagga

SEQ ID NO: 67660 - DNA, 20 bp, human
gcgggaggtactaccaggta

SEQ ID NO: 67661 - DNA, 20 bp, human
ggcctcggcagtgaaccggg

SEQ ID NO: 67662 - DNA, 20 bp, human
gctaccaggtaaggaaggtg

SEQ ID NO: 67663 - DNA, 20 bp, human
ggcggagctcctctcaccca

SEQ ID NO: 67664 - DNA, 20 bp, human
gcagacagacagctgaacag

SEQ ID NO: 67665 - DNA, 20 bp, human
gtgaaccgggaggtactacc

SEQ ID NO: 67666 - DNA, 20 bp, human
gtgcggttcagcgggttcta

SEQ ID NO: 67667 - DNA, 20 bp, human
ggcgcgcggcctcctccaga

SEQ ID NO: 67668 - DNA, 20 bp, human
gcatggctcacaggccgaaa

SEQ ID NO: 67669 - DNA, 20 bp, human
ggccacgagggccccgaacc

SEQ ID NO: 67670 - DNA, 20 bp, human
gcgagggccccgaacccggt

SEQ ID NO: 67671 - DNA, 20 bp, human
ggaaggatccagagaccccg

SEQ ID NO: 67672 - DNA, 20 bp, human
ggctgcggcttgcggttcag

SEQ ID NO: 67673 - DNA, 20 bp, human
gtcccggcgtgccaccaaag

SEQ ID NO: 67674 - DNA, 20 bp, human
ggacccggccccggccacga

SEQ ID NO: 67675 - DNA, 20 bp, human
gaagagccgccctctggagg

SEQ ID NO: 67676 - DNA, 20 bp, human
ggagagagcaagccctcttt

SEQ ID NO: 67677 - DNA, 20 bp, human
ggtgcagaagtacagagctt

SEQ ID NO: 67678 - DNA, 20 bp, human
ggtgtgctgtagaacagagc

SEQ ID NO: 67679 - DNA, 20 bp, human
gtctacagcacactaccaga

SEQ ID NO: 67680 - DNA, 20 bp, human
ggctctgtacttctgcacca

SEQ ID NO: 67681 - DNA, 20 bp, human
ggcgaagccgcaaagcgagt

SEQ ID NO: 67682 - DNA, 20 bp, human
gttactaatagtacacagag

SEQ ID NO: 67683 - DNA, 20 bp, human
gagcagaaatgtgtccatta

SEQ ID NO: 67684 - DNA, 20 bp, human
gatataaaagcagtgcgcct

SEQ ID NO: 67685 - DNA, 20 bp, human
gttataatcatcttaccttc

SEQ ID NO: 67686 - DNA, 20 bp, human
gaggacaagcgccattcaca

SEQ ID NO: 67687 - DNA, 20 bp, human
gcagcaagtatctggactcc

SEQ ID NO: 67688 - DNA, 20 bp, human
gaaccactgcacaaaatctt

SEQ ID NO: 67689 - DNA, 20 bp, human
gtgcgggttaagacattcgg

SEQ ID NO: 67690 - DNA, 20 bp, human
gattagattggtaacctcgt

SEQ ID NO: 67691 - DNA, 20 bp, human
gagtgactacagcaagtatc

SEQ ID NO: 67692 - DNA, 20 bp, human
gggtgaatgtgccctgtgaa

SEQ ID NO: 67693 - DNA, 20 bp, human
gaaaggctatgtcacactgg

SEQ ID NO: 67694 - DNA, 20 bp, human
ggtggttgatgaataccaag

SEQ ID NO: 67695 - DNA, 20 bp, human
gattcgggggcataatacta

SEQ ID NO: 67696 - DNA, 20 bp, human
ggcagcgccgcgaagacgag

SEQ ID NO: 67697 - DNA, 20 bp, human
gcccgagcgcgcccagagga

SEQ ID NO: 67698 - DNA, 20 bp, human
gctctgggcgcgctcgggtc

SEQ ID NO: 67699 - DNA, 20 bp, human
gcgcgaagacgagcggtcac

SEQ ID NO: 67700 - DNA, 20 bp, human
gccccaggaccagagaacgg

SEQ ID NO: 67701 - DNA, 20 bp, human
gggcgctgccagatcggggt

SEQ ID NO: 67702 - DNA, 20 bp, human
gtggctccccgccgtcctct

SEQ ID NO: 67703 - DNA, 20 bp, human
ggcgcgcccagaggacggcg

SEQ ID NO: 67704 - DNA, 20 bp, human
ggtttgcaccgaccccgatc

SEQ ID NO: 67705 - DNA, 20 bp, human
ggagtgtggccgctgcagtg

SEQ ID NO: 67706 - DNA, 20 bp, human
gctgtggccggagtcacctg

SEQ ID NO: 67707 - DNA, 20 bp, human
gggccggagtcacctgagga

SEQ ID NO: 67708 - DNA, 20 bp, human
ggagctcaggatggacgagt

SEQ ID NO: 67709 - DNA, 20 bp, human
ggctgggcgagaacccccag

SEQ ID NO: 67710 - DNA, 20 bp, human
gcaggttgcgtaccttcctc

SEQ ID NO: 67711 - DNA, 20 bp, human
gcgagaacccccagcggcaa

SEQ ID NO: 67712 - DNA, 20 bp, human
gctgctcaagacgccctgga

SEQ ID NO: 67713 - DNA, 20 bp, human
gccgccgggccataaaaagg

SEQ ID NO: 67714 - DNA, 20 bp, human
gagagttggttcctaatcgg

SEQ ID NO: 67715 - DNA, 20 bp, human
gggcggctgccaggttaggg

SEQ ID NO: 67716 - DNA, 20 bp, human
gtgtcggcgggagagaccca

SEQ ID NO: 67717 - DNA, 20 bp, human
gcgcagtcccgacgcgagaa

SEQ ID NO: 67718 - DNA, 20 bp, human
gtccagcctagagcccccgg

SEQ ID NO: 67719 - DNA, 20 bp, human
ggcgtccagcctagagcccc

SEQ ID NO: 67720 - DNA, 20 bp, human
gtacgtgcgtcccggcaaca

SEQ ID NO: 67721 - DNA, 20 bp, human
gcggcaacagggcgacctcc

SEQ ID NO: 67722 - DNA, 20 bp, human
ggtggccagagccggagtaa

SEQ ID NO: 67723 - DNA, 20 bp, human
gcgacaggtaggacaggagc

SEQ ID NO: 67724 - DNA, 20 bp, human
ggtctctcccgccgacaggt

SEQ ID NO: 67725 - DNA, 20 bp, human
gactccagcccttctcgcgt

SEQ ID NO: 67726 - DNA, 20 bp, human
gtggagcaggaaatgccgag

SEQ ID NO: 67727 - DNA, 20 bp, human
gacattctcccagggaccca

SEQ ID NO: 67728 - DNA, 20 bp, human
ggggcgggccgtgacccctg

SEQ ID NO: 67729 - DNA, 20 bp, human
gcccctcagccttccccagt

SEQ ID NO: 67730 - DNA, 20 bp, human
gcccccactccacacctggc

SEQ ID NO: 67731 - DNA, 20 bp, human
gcgggccgtgacccctgcgg

SEQ ID NO: 67732 - DNA, 20 bp, human
gcaaggcttctccgccgcag

SEQ ID NO: 67733 - DNA, 20 bp, human
gccattgctgggcgcttggg

SEQ ID NO: 67734 - DNA, 20 bp, human
ggagcacagtaagccctggc

SEQ ID NO: 67735 - DNA, 20 bp, human
gtccaggcagggccattgct

SEQ ID NO: 67736 - DNA, 20 bp, human
gcacagcgtgggaccatgcc

SEQ ID NO: 67737 - DNA, 20 bp, human
ggaggcagctgtgccaatca

SEQ ID NO: 67738 - DNA, 20 bp, human
gagaggtgagcagaaaccag

SEQ ID NO: 67739 - DNA, 20 bp, human
ggtgaccagaggggtttgtg

SEQ ID NO: 67740 - DNA, 20 bp, human
gtcgtacccagacaactaga

SEQ ID NO: 67741 - DNA, 20 bp, human
gaccagcggggagggaagac

SEQ ID NO: 67742 - DNA, 20 bp, human
gaacagtgtatccacagcgt

SEQ ID NO: 67743 - DNA, 20 bp, human
ggcagagtcattgtgaccag

SEQ ID NO: 67744 - DNA, 20 bp, human
gccggagcctggcaagtggg

SEQ ID NO: 67745 - DNA, 20 bp, human
ggtctagatcctgggtcagt

SEQ ID NO: 67746 - DNA, 20 bp, human
ggcaggttttggtcacaagt

SEQ ID NO: 67747 - DNA, 20 bp, human
gtccgcggcggcgcaggttt

SEQ ID NO: 67748 - DNA, 20 bp, human
ggactgggcatgctccgcgg

SEQ ID NO: 67749 - DNA, 20 bp, human
ggctagcggacgcaaagact

SEQ ID NO: 67750 - DNA, 20 bp, human
gaaagactgggcatgctccg

SEQ ID NO: 67751 - DNA, 20 bp, human
gtcctcctccgggctgacgg

SEQ ID NO: 67752 - DNA, 20 bp, human
gaccgccgtcagcccggagg

SEQ ID NO: 67753 - DNA, 20 bp, human
gccagaccggcaaagagaag

SEQ ID NO: 67754 - DNA, 20 bp, human
gagaagccagtgcaccagac

SEQ ID NO: 67755 - DNA, 20 bp, human
ggcgaccgccgtcagcccgg

SEQ ID NO: 67756 - DNA, 20 bp, human
gggcccgagagagacccgag

SEQ ID NO: 67757 - DNA, 20 bp, human
ggagagctgattccaaactg

SEQ ID NO: 67758 - DNA, 20 bp, human
gcccgagggaggccggacgg

SEQ ID NO: 67759 - DNA, 20 bp, human
gaggaaggcaccggtggctg

SEQ ID NO: 67760 - DNA, 20 bp, human
gaggccggacggcggctggg

SEQ ID NO: 67761 - DNA, 20 bp, human
gtcgctgcgcggcccctggg

SEQ ID NO: 67762 - DNA, 20 bp, human
gccgctgcggccgcagtagc

SEQ ID NO: 67763 - DNA, 20 bp, human
gggaatcagctctcccgctg

SEQ ID NO: 67764 - DNA, 20 bp, human
gcatggcagcggccgcccag

SEQ ID NO: 67765 - DNA, 20 bp, human
gctcctcgctgtgcgtggac

SEQ ID NO: 67766 - DNA, 20 bp, human
gccgtggagaggcaaatgta

SEQ ID NO: 67767 - DNA, 20 bp, human
gaagaaagccagaaatcccg

SEQ ID NO: 67768 - DNA, 20 bp, human
gagccagaaatcccgtggag

SEQ ID NO: 67769 - DNA, 20 bp, human
gaaaccctgtaggaatagag

SEQ ID NO: 67770 - DNA, 20 bp, human
ggaaaacagagtttacttaa

SEQ ID NO: 67771 - DNA, 20 bp, human
ggtcgtgaaaatcttactgc

SEQ ID NO: 67772 - DNA, 20 bp, human
gcgaccactctattcctaca

SEQ ID NO: 67773 - DNA, 20 bp, human
gcgcaagttgctttaaaaaa

SEQ ID NO: 67774 - DNA, 20 bp, human
gtgcctctccacgggatttc

SEQ ID NO: 67775 - DNA, 20 bp, human
gagacgctgttccctattcc

SEQ ID NO: 67776 - DNA, 20 bp, human
gagcaccgcggccaaggaca

SEQ ID NO: 67777 - DNA, 20 bp, human
gcaaggacaaggccccgccc

SEQ ID NO: 67778 - DNA, 20 bp, human
ggaacggcagcatcgacctc

SEQ ID NO: 67779 - DNA, 20 bp, human
ggcgctgtccatccgaagga

SEQ ID NO: 67780 - DNA, 20 bp, human
gcaatggttatggacccggg

SEQ ID NO: 67781 - DNA, 20 bp, human
gtggagaacgttcagcaccg

SEQ ID NO: 67782 - DNA, 20 bp, human
gcgagttcttgaagagtctg

SEQ ID NO: 67783 - DNA, 20 bp, human
gatctggaagctggggacaa

SEQ ID NO: 67784 - DNA, 20 bp, human
gtgaacgttctccacccgaa

SEQ ID NO: 67785 - DNA, 20 bp, human
ggcggccgcggtgcaggaag

SEQ ID NO: 67786 - DNA, 20 bp, human
gggcggcgcaggcagaccgc

SEQ ID NO: 67787 - DNA, 20 bp, human
gggcggacacgcaggtgagg

SEQ ID NO: 67788 - DNA, 20 bp, human
gggcggcggacacgcaggtg

SEQ ID NO: 67789 - DNA, 20 bp, human
gggagtcagccccggcagga

SEQ ID NO: 67790 - DNA, 20 bp, human
ggtccgccgccatcctgccg

SEQ ID NO: 67791 - DNA, 20 bp, human
ggccaacgcggccagggact

SEQ ID NO: 67792 - DNA, 20 bp, human
gaggatggcggcggacacgc

SEQ ID NO: 67793 - DNA, 20 bp, human
ggtctcaggctggactctca

SEQ ID NO: 67794 - DNA, 20 bp, human
gggcggctgcggggccaacg

SEQ ID NO: 67795 - DNA, 20 bp, human
gacccagtccctggccgcgt

SEQ ID NO: 67796 - DNA, 20 bp, human
gtctaagctacacggaccag

SEQ ID NO: 67797 - DNA, 20 bp, human
gctgaccccggagtctcagg

SEQ ID NO: 67798 - DNA, 20 bp, human
ggcccgggaccggaatggag

SEQ ID NO: 67799 - DNA, 20 bp, human
ggccgagcaggggaacacga

SEQ ID NO: 67800 - DNA, 20 bp, human
gctgcgggcgtggataggca

SEQ ID NO: 67801 - DNA, 20 bp, human
gtggagtgggcgtctgaccc

SEQ ID NO: 67802 - DNA, 20 bp, human
ggcgcggggcgggagcttgg

SEQ ID NO: 67803 - DNA, 20 bp, human
ggcgggccacgctggtgtga

SEQ ID NO: 67804 - DNA, 20 bp, human
gcgtctgaccccggagtctc

SEQ ID NO: 67805 - DNA, 20 bp, human
ggtccgtgtagcttagatgt

SEQ ID NO: 67806 - DNA, 20 bp, human
gagactctggccgggacaag

SEQ ID NO: 67807 - DNA, 20 bp, human
gcctagtggtaagtgaagag

SEQ ID NO: 67808 - DNA, 20 bp, human
gccaccatgaaattacaagt

SEQ ID NO: 67809 - DNA, 20 bp, human
ggagaggttctgattccagg

SEQ ID NO: 67810 - DNA, 20 bp, human
gatgaaattacaagtgggtg

SEQ ID NO: 67811 - DNA, 20 bp, human
gaccagaaccgtgaactgaa

SEQ ID NO: 67812 - DNA, 20 bp, human
gtgcaggttagcaggagaac

SEQ ID NO: 67813 - DNA, 20 bp, human
gtttcctggttgtgaatgat

SEQ ID NO: 67814 - DNA, 20 bp, human
gtaacctcagcctcttgtcc

SEQ ID NO: 67815 - DNA, 20 bp, human
gtagttactagactctggcc

SEQ ID NO: 67816 - DNA, 20 bp, human
gccctcctgggaactgagag

SEQ ID NO: 67817 - DNA, 20 bp, human
gggagggtaagattgcccag

SEQ ID NO: 67818 - DNA, 20 bp, human
gcctgggaactgagagaggt

SEQ ID NO: 67819 - DNA, 20 bp, human
gcagcgtgctgggaaactgg

SEQ ID NO: 67820 - DNA, 20 bp, human
gatgggcctactgggcacga

SEQ ID NO: 67821 - DNA, 20 bp, human
gttcactgctggacgcctct

SEQ ID NO: 67822 - DNA, 20 bp, human
gcgtgctgggaaactggtgg

SEQ ID NO: 67823 - DNA, 20 bp, human
gattacatgatgggcctact

SEQ ID NO: 67824 - DNA, 20 bp, human
gaataggctggtactcaaat

SEQ ID NO: 67825 - DNA, 20 bp, human
ggctgtcagcgatttaacag

SEQ ID NO: 67826 - DNA, 20 bp, human
gggcaggtcacaagtagcaa

SEQ ID NO: 67827 - DNA, 20 bp, human
gtaagctagggtcatcaagg

SEQ ID NO: 67828 - DNA, 20 bp, human
ggtctaagagttccagtcat

SEQ ID NO: 67829 - DNA, 20 bp, human
gaaactgctgagtaaagggc

SEQ ID NO: 67830 - DNA, 20 bp, human
gaactaagctagggtcatca

SEQ ID NO: 67831 - DNA, 20 bp, human
gactagttcaggcttcctat

SEQ ID NO: 67832 - DNA, 20 bp, human
gaaacagagaaactaagcta

SEQ ID NO: 67833 - DNA, 20 bp, human
gcaacaccagcgtcagagaa

SEQ ID NO: 67834 - DNA, 20 bp, human
gacaaaaactgctgagtaaa

SEQ ID NO: 67835 - DNA, 20 bp, human
gaagattgaggagtctgagt

SEQ ID NO: 67836 - DNA, 20 bp, human
gaggtgccttacgatcataa

SEQ ID NO: 67837 - DNA, 20 bp, human
ggcctggagtctggaaatgt

SEQ ID NO: 67838 - DNA, 20 bp, human
gatatctgaatgttatgggg

SEQ ID NO: 67839 - DNA, 20 bp, human
ggtagcttcacatattcata

SEQ ID NO: 67840 - DNA, 20 bp, human
gtgcatccattatgatcgta

SEQ ID NO: 67841 - DNA, 20 bp, human
gatatgtgaagctaccaata

SEQ ID NO: 67842 - DNA, 20 bp, human
ggatgcagtaaatattgtgc

SEQ ID NO: 67843 - DNA, 20 bp, human
gtggcaactttgaaggtatc

SEQ ID NO: 67844 - DNA, 20 bp, human
gttgttcatggcaactttga

SEQ ID NO: 67845 - DNA, 20 bp, human
ggtgctggttgtatatagca

SEQ ID NO: 67846 - DNA, 20 bp, human
ggtgtcaaaaactaaaatga

SEQ ID NO: 67847 - DNA, 20 bp, human
ggttctctagcacatagtaa

SEQ ID NO: 67848 - DNA, 20 bp, human
ggtggtcaaatagatgacgt

SEQ ID NO: 67849 - DNA, 20 bp, human
gatgtaagtcaaccagacag

SEQ ID NO: 67850 - DNA, 20 bp, human
gtttagtttttgacacctgg

SEQ ID NO: 67851 - DNA, 20 bp, human
gcaaaggagttgtgatatag

SEQ ID NO: 67852 - DNA, 20 bp, human
gcagatgtgcagtcgggaaa

SEQ ID NO: 67853 - DNA, 20 bp, human
ggcgtcacagatgtgcagtc

SEQ ID NO: 67854 - DNA, 20 bp, human
gctgtgacgcagccctaaat

SEQ ID NO: 67855 - DNA, 20 bp, human
gtactgtattcacgttgata

SEQ ID NO: 67856 - DNA, 20 bp, human
gtcccgtaaagggccaggga

SEQ ID NO: 67857 - DNA, 20 bp, human
gaccttaatggaactcgagg

SEQ ID NO: 67858 - DNA, 20 bp, human
gctgaagagataaagatgta

SEQ ID NO: 67859 - DNA, 20 bp, human
gaataccttaatggaactcg

SEQ ID NO: 67860 - DNA, 20 bp, human
gtccacctcgagttccatta

SEQ ID NO: 67861 - DNA, 20 bp, human
gctttcaggtagaaaaggaa

SEQ ID NO: 67862 - DNA, 20 bp, human
ggaatgcacagtctttgttg

SEQ ID NO: 67863 - DNA, 20 bp, human
ggtgaagttggccgcctcga

SEQ ID NO: 67864 - DNA, 20 bp, human
gggcaaacccttcccgtaaa

SEQ ID NO: 67865 - DNA, 20 bp, human
gcaactctttcaggtagaaa

SEQ ID NO: 67866 - DNA, 20 bp, human
gcccaccagctggtaggaga

SEQ ID NO: 67867 - DNA, 20 bp, human
gggaaggagaggaaatctct

SEQ ID NO: 67868 - DNA, 20 bp, human
gctgcaccgcgaaggcccgg

SEQ ID NO: 67869 - DNA, 20 bp, human
gccctagtcccctctagagg

SEQ ID NO: 67870 - DNA, 20 bp, human
gccgggcagaataagcgtgc

SEQ ID NO: 67871 - DNA, 20 bp, human
gctcccgcttgaggtttcag

SEQ ID NO: 67872 - DNA, 20 bp, human
gggagcgcagcatcccgcag

SEQ ID NO: 67873 - DNA, 20 bp, human
ggggcgacgcgggacggcgc

SEQ ID NO: 67874 - DNA, 20 bp, human
gggagggtcactgccagagc

SEQ ID NO: 67875 - DNA, 20 bp, human
gggccccctgaaacctcaag

SEQ ID NO: 67876 - DNA, 20 bp, human
gactccctgtgggagagcag

SEQ ID NO: 67877 - DNA, 20 bp, human
gctgatggagaatagctgaa

SEQ ID NO: 67878 - DNA, 20 bp, human
ggagaagggtgtctctgcag

SEQ ID NO: 67879 - DNA, 20 bp, human
gtgtggagcatgaggagctc

SEQ ID NO: 67880 - DNA, 20 bp, human
ggttgccctgtcagagcaca

SEQ ID NO: 67881 - DNA, 20 bp, human
gctttctgctgtctctgcac

SEQ ID NO: 67882 - DNA, 20 bp, human
gaggtggaaagactttacca

SEQ ID NO: 67883 - DNA, 20 bp, human
ggtaagtctagactccctgt

SEQ ID NO: 67884 - DNA, 20 bp, human
ggtcagagcacaaggcaaga

SEQ ID NO: 67885 - DNA, 20 bp, human
gactttctgaaagcccggga

SEQ ID NO: 67886 - DNA, 20 bp, human
gcccaagtggagtgaaactc

SEQ ID NO: 67887 - DNA, 20 bp, human
gattttgggcattataacat

SEQ ID NO: 67888 - DNA, 20 bp, human
gggacgttgcatctgaccac

SEQ ID NO: 67889 - DNA, 20 bp, human
gaccaagaggaaaatgcatg

SEQ ID NO: 67890 - DNA, 20 bp, human
ggcccctggcagctcgtggt

SEQ ID NO: 67891 - DNA, 20 bp, human
gcgtcactgtgtgctcctag

SEQ ID NO: 67892 - DNA, 20 bp, human
gtggcaagagcacgaacccg

SEQ ID NO: 67893 - DNA, 20 bp, human
gtccagagtaaggcaagaga

SEQ ID NO: 67894 - DNA, 20 bp, human
gcgagtcactgtgaaaagat

SEQ ID NO: 67895 - DNA, 20 bp, human
gctatcattgttccagagta

SEQ ID NO: 67896 - DNA, 20 bp, human
gctggacccgctctgctctc

SEQ ID NO: 67897 - DNA, 20 bp, human
gctctgctctcgggtaagcg

SEQ ID NO: 67898 - DNA, 20 bp, human
gcggctgcatgcaatcccta

SEQ ID NO: 67899 - DNA, 20 bp, human
gggggcagttcgcggccgga

SEQ ID NO: 67900 - DNA, 20 bp, human
ggagggagccggctggatgg

SEQ ID NO: 67901 - DNA, 20 bp, human
gctagggcaaaggctactcg

SEQ ID NO: 67902 - DNA, 20 bp, human
gggtcctcccgctacttaag

SEQ ID NO: 67903 - DNA, 20 bp, human
gcgggcccagcgggacacgg

SEQ ID NO: 67904 - DNA, 20 bp, human
gggaggcctgcgggacaccg

SEQ ID NO: 67905 - DNA, 20 bp, human
gcaccgctcctgagccaccg

SEQ ID NO: 67906 - DNA, 20 bp, human
gcaaccgcccgggtaagcgg

SEQ ID NO: 67907 - DNA, 20 bp, human
gaccctggcgctaggttcgt

SEQ ID NO: 67908 - DNA, 20 bp, human
gtcccagaagtcgggagcag

SEQ ID NO: 67909 - DNA, 20 bp, human
gcgggtctgctggtcgagga

SEQ ID NO: 67910 - DNA, 20 bp, human
gtgctgcgggatcacctcct

SEQ ID NO: 67911 - DNA, 20 bp, human
gtcctcggcgtgagcgacag

SEQ ID NO: 67912 - DNA, 20 bp, human
ggcccacgaacctagcgcca

SEQ ID NO: 67913 - DNA, 20 bp, human
gtggtcgaggagggcgcacg

SEQ ID NO: 67914 - DNA, 20 bp, human
ggccaggggcggcatctgag

SEQ ID NO: 67915 - DNA, 20 bp, human
ggggtcgagcgcactccgac

SEQ ID NO: 67916 - DNA, 20 bp, human
gagattatgagggtccacaa

SEQ ID NO: 67917 - DNA, 20 bp, human
ggtgctcgcgcaccccaaga

SEQ ID NO: 67918 - DNA, 20 bp, human
gggagaagtccagggcggac

SEQ ID NO: 67919 - DNA, 20 bp, human
ggcctgggccatagccacat

SEQ ID NO: 67920 - DNA, 20 bp, human
ggtcttcggagagaggcaga

SEQ ID NO: 67921 - DNA, 20 bp, human
gagtccagggcggacaggct

SEQ ID NO: 67922 - DNA, 20 bp, human
gctgcccggggtcaggacac

SEQ ID NO: 67923 - DNA, 20 bp, human
gccttgccttccgccctcaa

SEQ ID NO: 67924 - DNA, 20 bp, human
gagagggagcccgcccttga

SEQ ID NO: 67925 - DNA, 20 bp, human
gctccgaagaccagcaggca

SEQ ID NO: 67926 - DNA, 20 bp, human
ggccaccagctgcagttggt

SEQ ID NO: 67927 - DNA, 20 bp, human
ggctgaaggactgggtccag

SEQ ID NO: 67928 - DNA, 20 bp, human
ggccccgcaccccaacagac

SEQ ID NO: 67929 - DNA, 20 bp, human
gcagggcttgagggatctga

SEQ ID NO: 67930 - DNA, 20 bp, human
gacagcccggaatcagaggc

SEQ ID NO: 67931 - DNA, 20 bp, human
gcggaggtcgggggacgcaa

SEQ ID NO: 67932 - DNA, 20 bp, human
gcttccaggactgctcacct

SEQ ID NO: 67933 - DNA, 20 bp, human
gccccaccaactgcagctgg

SEQ ID NO: 67934 - DNA, 20 bp, human
gcaacagaccggctgtttct

SEQ ID NO: 67935 - DNA, 20 bp, human
ggtgggggtcagattgttgg

SEQ ID NO: 67936 - DNA, 20 bp, human
ggaccagctgcaaatgctct

SEQ ID NO: 67937 - DNA, 20 bp, human
ggtggtcccatccgggcggc

SEQ ID NO: 67938 - DNA, 20 bp, human
gagcaggagcgcgccgagta

SEQ ID NO: 67939 - DNA, 20 bp, human
gcggcgggcactaggaacag

SEQ ID NO: 67940 - DNA, 20 bp, human
gctacgagaagtgaaagggt

SEQ ID NO: 67941 - DNA, 20 bp, human
gtacggcgagtcaaagtccc

SEQ ID NO: 67942 - DNA, 20 bp, human
gctggtcactccagtctcct

SEQ ID NO: 67943 - DNA, 20 bp, human
gcaaggaggcgggcgcccta

SEQ ID NO: 67944 - DNA, 20 bp, human
gggcggccgagcgacatctc

SEQ ID NO: 67945 - DNA, 20 bp, human
ggtctctacgagaagtgaaa

SEQ ID NO: 67946 - DNA, 20 bp, human
ggaccagcgccgcacaatgg

SEQ ID NO: 67947 - DNA, 20 bp, human
gagtagaacgagaagcgagg

SEQ ID NO: 67948 - DNA, 20 bp, human
gaagcgagggggagggtcca

SEQ ID NO: 67949 - DNA, 20 bp, human
gagctctcgggaggaccgag

SEQ ID NO: 67950 - DNA, 20 bp, human
gggggaccagcgccgcacaa

SEQ ID NO: 67951 - DNA, 20 bp, human
gggccgtcctgagaagatcg

SEQ ID NO: 67952 - DNA, 20 bp, human
gagaagtccgagctctcggg

SEQ ID NO: 67953 - DNA, 20 bp, human
gccgaggggcgcgaacgtgg

SEQ ID NO: 67954 - DNA, 20 bp, human
gagacactgggagcgatcaa

SEQ ID NO: 67955 - DNA, 20 bp, human
ggacgcgcccgagaacacgc

SEQ ID NO: 67956 - DNA, 20 bp, human
gcggctccgtcggctaccgc

SEQ ID NO: 67957 - DNA, 20 bp, human
gcgggcgcaggcgacgggca

SEQ ID NO: 67958 - DNA, 20 bp, human
gctggctgctgcggatgaag

SEQ ID NO: 67959 - DNA, 20 bp, human
gccagcagcagcagctcggg

SEQ ID NO: 67960 - DNA, 20 bp, human
gggcgggcgagcgggcggta

SEQ ID NO: 67961 - DNA, 20 bp, human
ggggcgagcgggcggtatgg

SEQ ID NO: 67962 - DNA, 20 bp, human
gctggagaggcccaggacgt

SEQ ID NO: 67963 - DNA, 20 bp, human
ggcccgcccgcggtagccga

SEQ ID NO: 67964 - DNA, 20 bp, human
gacgttggagccccaggata

SEQ ID NO: 67965 - DNA, 20 bp, human
ggaggcccccacccacgttc

SEQ ID NO: 67966 - DNA, 20 bp, human
gtgcgcgccccggacctctg

SEQ ID NO: 67967 - DNA, 20 bp, human
gagggccgaagtccaggagg

SEQ ID NO: 67968 - DNA, 20 bp, human
gcgcagccgggtcccctcga

SEQ ID NO: 67969 - DNA, 20 bp, human
gcaaagggccgaagtccagg

SEQ ID NO: 67970 - DNA, 20 bp, human
gagccatggcgtggtgaggg

SEQ ID NO: 67971 - DNA, 20 bp, human
ggcgagcgctggcgcaccgg

SEQ ID NO: 67972 - DNA, 20 bp, human
gagccgagccgagcccgagt

SEQ ID NO: 67973 - DNA, 20 bp, human
gcggcaaagggccgaagtcc

SEQ ID NO: 67974 - DNA, 20 bp, human
ggtgtgcgtgcgcccgtgtg

SEQ ID NO: 67975 - DNA, 20 bp, human
gcggccggctgcgccctcga

SEQ ID NO: 67976 - DNA, 20 bp, human
ggcagatcttgagcaaactg

SEQ ID NO: 67977 - DNA, 20 bp, human
gccacctcgcggctgatgtt

SEQ ID NO: 67978 - DNA, 20 bp, human
gatggcccaggagagtaagt

SEQ ID NO: 67979 - DNA, 20 bp, human
gccgcgagcaccatgctgga

SEQ ID NO: 67980 - DNA, 20 bp, human
ggtcgccctggaagtcgtgt

SEQ ID NO: 67981 - DNA, 20 bp, human
gctgccgccaaacgcacacg

SEQ ID NO: 67982 - DNA, 20 bp, human
gtggacctacacgacttcca

SEQ ID NO: 67983 - DNA, 20 bp, human
gatgctaatgacggtctcgg

SEQ ID NO: 67984 - DNA, 20 bp, human
gctaatgacggtctcggtgg

SEQ ID NO: 67985 - DNA, 20 bp, human
gctggctctggccccgcgaa

SEQ ID NO: 67986 - DNA, 20 bp, human
gcatgcccgggcaagaactc

SEQ ID NO: 67987 - DNA, 20 bp, human
gcctacccagggcacagatg

SEQ ID NO: 67988 - DNA, 20 bp, human
gtccaggatattcctaccca

SEQ ID NO: 67989 - DNA, 20 bp, human
gcccgggcaagaactcagga

SEQ ID NO: 67990 - DNA, 20 bp, human
ggaggctcaaaggtaggtct

SEQ ID NO: 67991 - DNA, 20 bp, human
ggccctgggtaggaatatcc

SEQ ID NO: 67992 - DNA, 20 bp, human
ggtgggtgcaaatcaggcat

SEQ ID NO: 67993 - DNA, 20 bp, human
gctcgcctcggccagagaca

SEQ ID NO: 67994 - DNA, 20 bp, human
ggcaactgaggctcaaaggt

SEQ ID NO: 67995 - DNA, 20 bp, human
ggagacagggcgcccccatg

SEQ ID NO: 67996 - DNA, 20 bp, human
ggctccctcagataagacgt

SEQ ID NO: 67997 - DNA, 20 bp, human
gaccagataagcacaagtgg

SEQ ID NO: 67998 - DNA, 20 bp, human
gacaggtcaatcatgtactg

SEQ ID NO: 67999 - DNA, 20 bp, human
gtcgcaggacaaaaccaggg

SEQ ID NO: 68000 - DNA, 20 bp, human
gggtcaatcatgtactgcgg

SEQ ID NO: 68001 - DNA, 20 bp, human
ggggagccttccgttaatga

SEQ ID NO: 68002 - DNA, 20 bp, human
ggggcctaagatgtgtcctg

SEQ ID NO: 68003 - DNA, 20 bp, human
gctgcgaagggaccccactc

SEQ ID NO: 68004 - DNA, 20 bp, human
ggctccgacgtcttatctga

SEQ ID NO: 68005 - DNA, 20 bp, human
ggcgcagccttaacctgagt

SEQ ID NO: 68006 - DNA, 20 bp, human
gaaaattttccaggatcgcg

SEQ ID NO: 68007 - DNA, 20 bp, human
gctggcagtggagctctccc

SEQ ID NO: 68008 - DNA, 20 bp, human
gaagtctcgggagaccccag

SEQ ID NO: 68009 - DNA, 20 bp, human
gtggagtggctgtcagaccg

SEQ ID NO: 68010 - DNA, 20 bp, human
gagactgcccaacaattcag

SEQ ID NO: 68011 - DNA, 20 bp, human
ggcccaaagccagaattaac

SEQ ID NO: 68012 - DNA, 20 bp, human
gttgttgggcagtctggcag

SEQ ID NO: 68013 - DNA, 20 bp, human
gttccagccacgatcctgag

SEQ ID NO: 68014 - DNA, 20 bp, human
gtaacttcctctcaggatcg

SEQ ID NO: 68015 - DNA, 20 bp, human
gtctggcaagaaacgaagca

SEQ ID NO: 68016 - DNA, 20 bp, human
gggtctctggcccaagtcag

SEQ ID NO: 68017 - DNA, 20 bp, human
gacttgggccagagacccca

SEQ ID NO: 68018 - DNA, 20 bp, human
gagacgttccgggccagggg

SEQ ID NO: 68019 - DNA, 20 bp, human
gctgactgagggcttgaagg

SEQ ID NO: 68020 - DNA, 20 bp, human
gctcctgcacaactgactga

SEQ ID NO: 68021 - DNA, 20 bp, human
gcttgaaggaggcttgtata

SEQ ID NO: 68022 - DNA, 20 bp, human
gccaggattggccaaagcag

SEQ ID NO: 68023 - DNA, 20 bp, human
gagtggactttcaaaagcag

SEQ ID NO: 68024 - DNA, 20 bp, human
gtgttgggtgcccctgactt

SEQ ID NO: 68025 - DNA, 20 bp, human
ggccaccaatgccaatgcca

SEQ ID NO: 68026 - DNA, 20 bp, human
ggcacggagcggctggacag

SEQ ID NO: 68027 - DNA, 20 bp, human
gccgagctgggttccaccaa

SEQ ID NO: 68028 - DNA, 20 bp, human
ggctgcgtctccccaggagg

SEQ ID NO: 68029 - DNA, 20 bp, human
gcggccgagagcaggaccct

SEQ ID NO: 68030 - DNA, 20 bp, human
ggcatgcgaagccgcaagga

SEQ ID NO: 68031 - DNA, 20 bp, human
gcgcactccgagtccgcccg

SEQ ID NO: 68032 - DNA, 20 bp, human
gccggctcctcgggcggact

SEQ ID NO: 68033 - DNA, 20 bp, human
gagctcggcggacgacgagg

SEQ ID NO: 68034 - DNA, 20 bp, human
gcggcctcaggacgaacccc

SEQ ID NO: 68035 - DNA, 20 bp, human
gttgacagcatgtactcgtg

SEQ ID NO: 68036 - DNA, 20 bp, human
ggataggcctcgtactccag

SEQ ID NO: 68037 - DNA, 20 bp, human
gatcgcgcccctggagtacg

SEQ ID NO: 68038 - DNA, 20 bp, human
ggctccaggtgcgagcgcag

SEQ ID NO: 68039 - DNA, 20 bp, human
gacgaggcctatcactgcga

SEQ ID NO: 68040 - DNA, 20 bp, human
gcctggatgtgagagccggt

SEQ ID NO: 68041 - DNA, 20 bp, human
gcaggtagaagttactggga

SEQ ID NO: 68042 - DNA, 20 bp, human
gacagcctggatgtgagagc

SEQ ID NO: 68043 - DNA, 20 bp, human
gatcgacgcgggcaataatg

SEQ ID NO: 68044 - DNA, 20 bp, human
gcctggctgcagagaggcgg

SEQ ID NO: 68045 - DNA, 20 bp, human
gcatacaccctcgcagtgat

SEQ ID NO: 68046 - DNA, 20 bp, human
gtggcccgaggcggagacag

SEQ ID NO: 68047 - DNA, 20 bp, human
ggtggctccgggaagtcccc

SEQ ID NO: 68048 - DNA, 20 bp, human
gcggcggcgctcaggtccat

SEQ ID NO: 68049 - DNA, 20 bp, human
ggtcgcgcggacacgatcac

SEQ ID NO: 68050 - DNA, 20 bp, human
gggatgggcgggcacagaag

SEQ ID NO: 68051 - DNA, 20 bp, human
ggcgcgaccatggcccgagg

SEQ ID NO: 68052 - DNA, 20 bp, human
gtcacagaccaggcgaccca

SEQ ID NO: 68053 - DNA, 20 bp, human
gtatgttcaaaaggcgccgg

SEQ ID NO: 68054 - DNA, 20 bp, human
ggaagaggcgtaagtacctt

SEQ ID NO: 68055 - DNA, 20 bp, human
gtccgcgcgaccatggcccg

SEQ ID NO: 68056 - DNA, 20 bp, human
gccaaggcacctcccaccta

SEQ ID NO: 68057 - DNA, 20 bp, human
gggctgactgggtgacccgt

SEQ ID NO: 68058 - DNA, 20 bp, human
gttggccagtagctcaaagg

SEQ ID NO: 68059 - DNA, 20 bp, human
ggccttggccagtagctcaa

SEQ ID NO: 68060 - DNA, 20 bp, human
ggactgggtgacccgtaggt

SEQ ID NO: 68061 - DNA, 20 bp, human
gctttgtcccagaaagaagt

SEQ ID NO: 68062 - DNA, 20 bp, human
gaggtcgtgaggtaacttcc

SEQ ID NO: 68063 - DNA, 20 bp, human
ggtcatcccttagagacagt

SEQ ID NO: 68064 - DNA, 20 bp, human
gccagcgctgccccggaggt

SEQ ID NO: 68065 - DNA, 20 bp, human
gaatcagggacacacatcga

SEQ ID NO: 68066 - DNA, 20 bp, human
gactgctgcggtgaaggagg

SEQ ID NO: 68067 - DNA, 20 bp, human
ggcgactgctgcggtgaagg

SEQ ID NO: 68068 - DNA, 20 bp, human
gtgggcatcgggccgagtgg

SEQ ID NO: 68069 - DNA, 20 bp, human
gtggcaccgaggcctgacca

SEQ ID NO: 68070 - DNA, 20 bp, human
gcgcactggaccaaagatgg

SEQ ID NO: 68071 - DNA, 20 bp, human
ggacgggtggatgccgtgat

SEQ ID NO: 68072 - DNA, 20 bp, human
gggtccagcgggcaggggta

SEQ ID NO: 68073 - DNA, 20 bp, human
gcaccgcactggaccaaaga

SEQ ID NO: 68074 - DNA, 20 bp, human
ggatgggtgggcggggtcgt

SEQ ID NO: 68075 - DNA, 20 bp, human
ggcggcgactgctgcggtga

SEQ ID NO: 68076 - DNA, 20 bp, human
gtcttgggcgcgaaggaaag

SEQ ID NO: 68077 - DNA, 20 bp, human
gaccgaccgccacctcagac

SEQ ID NO: 68078 - DNA, 20 bp, human
gcgggaagagaagaactggg

SEQ ID NO: 68079 - DNA, 20 bp, human
ggggcggctcccagtgtgag

SEQ ID NO: 68080 - DNA, 20 bp, human
gtgggcaccggcctgacggt

SEQ ID NO: 68081 - DNA, 20 bp, human
gaccaccctacgaggctggg

SEQ ID NO: 68082 - DNA, 20 bp, human
gtcccgtctgaggtggcggt

SEQ ID NO: 68083 - DNA, 20 bp, human
gcttctcttcccgtctgagg

SEQ ID NO: 68084 - DNA, 20 bp, human
ggttcttctcttcccgtctg

SEQ ID NO: 68085 - DNA, 20 bp, human
gcccgcctgcccctcacact

SEQ ID NO: 68086 - DNA, 20 bp, human
gtattgcactatgaatgaag

SEQ ID NO: 68087 - DNA, 20 bp, human
gttctagttgaaattagtgt

SEQ ID NO: 68088 - DNA, 20 bp, human
gttatacacatctcgcattg

SEQ ID NO: 68089 - DNA, 20 bp, human
gatttcccaagtcttccaag

SEQ ID NO: 68090 - DNA, 20 bp, human
gatttaaatataaaggtagt

SEQ ID NO: 68091 - DNA, 20 bp, human
gaatataaaggtagtgggcc

SEQ ID NO: 68092 - DNA, 20 bp, human
gttttgttagaatttccact

SEQ ID NO: 68093 - DNA, 20 bp, human
gaagacgttatagattttac

SEQ ID NO: 68094 - DNA, 20 bp, human
gaagatccaagaacttttga

SEQ ID NO: 68095 - DNA, 20 bp, human
gttaagtgatttaaatataa

SEQ ID NO: 68096 - DNA, 20 bp, human
gtcccaggcagtgcgcccag

SEQ ID NO: 68097 - DNA, 20 bp, human
gccagaggaggcgcagagcg

SEQ ID NO: 68098 - DNA, 20 bp, human
gtctgcggagacccgatccg

SEQ ID NO: 68099 - DNA, 20 bp, human
gcccgatccgaggtaagtga

SEQ ID NO: 68100 - DNA, 20 bp, human
gtgaagggcgccctagtcag

SEQ ID NO: 68101 - DNA, 20 bp, human
gctgcctgggagcacgagac

SEQ ID NO: 68102 - DNA, 20 bp, human
gagacgcacccctctgacta

SEQ ID NO: 68103 - DNA, 20 bp, human
gtccgaggtaagtgagggag

SEQ ID NO: 68104 - DNA, 20 bp, human
gtaagtgagggagcgggccg

SEQ ID NO: 68105 - DNA, 20 bp, human
gggagttaatgtccaaccta

SEQ ID NO: 68106 - DNA, 20 bp, human
ggccctgcggagaagcgaga

SEQ ID NO: 68107 - DNA, 20 bp, human
gagagggcgagacacccgag

SEQ ID NO: 68108 - DNA, 20 bp, human
ggcgagacacccgagcggga

SEQ ID NO: 68109 - DNA, 20 bp, human
ggggaaggccggccttcgac

SEQ ID NO: 68110 - DNA, 20 bp, human
gtggccggctcctcagtcct

SEQ ID NO: 68111 - DNA, 20 bp, human
ggacacccgagcgggaaggc

SEQ ID NO: 68112 - DNA, 20 bp, human
ggccactggagggcacgtca

SEQ ID NO: 68113 - DNA, 20 bp, human
gtaatctaataccagacatg

SEQ ID NO: 68114 - DNA, 20 bp, human
ggccctctcgcttctccgca

SEQ ID NO: 68115 - DNA, 20 bp, human
gaggaggcagtggcgagaaa

SEQ ID NO: 68116 - DNA, 20 bp, human
gctgggtgagcagattcaag

SEQ ID NO: 68117 - DNA, 20 bp, human
gtggctctgtggtgggatgt

SEQ ID NO: 68118 - DNA, 20 bp, human
gcagattcaaggggctaccg

SEQ ID NO: 68119 - DNA, 20 bp, human
gggctaccgtggtgtagaaa

SEQ ID NO: 68120 - DNA, 20 bp, human
gaccgtggtgtagaaagggg

SEQ ID NO: 68121 - DNA, 20 bp, human
ggccacccctttctacacca

SEQ ID NO: 68122 - DNA, 20 bp, human
ggtgtagaaaggggtggcca

SEQ ID NO: 68123 - DNA, 20 bp, human
gccaaggtggggtttaatct

SEQ ID NO: 68124 - DNA, 20 bp, human
gtagaaaggggtggccaagg

SEQ ID NO: 68125 - DNA, 20 bp, human
gatctgctcacccagcctga

SEQ ID NO: 68126 - DNA, 20 bp, human
ggaaggcccagagcagacgt

SEQ ID NO: 68127 - DNA, 20 bp, human
gactcactcctgaagctgaa

SEQ ID NO: 68128 - DNA, 20 bp, human
gggcccagagcagacgtggg

SEQ ID NO: 68129 - DNA, 20 bp, human
gctcattaagcccaatgtat

SEQ ID NO: 68130 - DNA, 20 bp, human
gcttaaagaatagatgctga

SEQ ID NO: 68131 - DNA, 20 bp, human
gtttcaatgaaaactaggaa

SEQ ID NO: 68132 - DNA, 20 bp, human
gctcattgatgtagtatctt

SEQ ID NO: 68133 - DNA, 20 bp, human
gaattattcccttcagcttc

SEQ ID NO: 68134 - DNA, 20 bp, human
gacttcagatgccaatacat

SEQ ID NO: 68135 - DNA, 20 bp, human
ggtgatttccctaattacac

SEQ ID NO: 68136 - DNA, 20 bp, human
gagttcagagggcccggagg

SEQ ID NO: 68137 - DNA, 20 bp, human
gggccctctgaactccgctg

SEQ ID NO: 68138 - DNA, 20 bp, human
ggcggcagtagcaacgacgg

SEQ ID NO: 68139 - DNA, 20 bp, human
ggctgcggcagtagcaacga

SEQ ID NO: 68140 - DNA, 20 bp, human
gcacggcgggggtctctcga

SEQ ID NO: 68141 - DNA, 20 bp, human
ggacaagtgcgctgcaccag

SEQ ID NO: 68142 - DNA, 20 bp, human
gctgccgcagcggagttcag

SEQ ID NO: 68143 - DNA, 20 bp, human
gcggagttcagagggcccgg

SEQ ID NO: 68144 - DNA, 20 bp, human
gagggctcttccggaggtga

SEQ ID NO: 68145 - DNA, 20 bp, human
ggacatctcagtcaccgtgt

SEQ ID NO: 68146 - DNA, 20 bp, human
gggaggcagaccactcggag

SEQ ID NO: 68147 - DNA, 20 bp, human
gatgctgccttgggaaagga

SEQ ID NO: 68148 - DNA, 20 bp, human
gagggaggaggcagaccact

SEQ ID NO: 68149 - DNA, 20 bp, human
gtcccaaggcagcataaaga

SEQ ID NO: 68150 - DNA, 20 bp, human
ggaccactcggagaggagct

SEQ ID NO: 68151 - DNA, 20 bp, human
gaccgggaagggtctcgtag

SEQ ID NO: 68152 - DNA, 20 bp, human
ggtgggtccggtaagcagga

SEQ ID NO: 68153 - DNA, 20 bp, human
ggaagggaggggactctgga

SEQ ID NO: 68154 - DNA, 20 bp, human
gaggctggggggctacaggt

SEQ ID NO: 68155 - DNA, 20 bp, human
ggactcatagggctgaaccg

SEQ ID NO: 68156 - DNA, 20 bp, human
gtggctgcaggagcttctgt

SEQ ID NO: 68157 - DNA, 20 bp, human
gggcagcacagtcccgcgga

SEQ ID NO: 68158 - DNA, 20 bp, human
gtagtagagccggcccacac

SEQ ID NO: 68159 - DNA, 20 bp, human
gagcatggcatagctgccca

SEQ ID NO: 68160 - DNA, 20 bp, human
gcagaggggtaggtccaagg

SEQ ID NO: 68161 - DNA, 20 bp, human
gcgaggaggtgagccgggta

SEQ ID NO: 68162 - DNA, 20 bp, human
ggagggcatagtacagcaaa

SEQ ID NO: 68163 - DNA, 20 bp, human
gcggcccacactggctaggc

SEQ ID NO: 68164 - DNA, 20 bp, human
gaggagcttctgtgggagta

SEQ ID NO: 68165 - DNA, 20 bp, human
ggagccggcccacactggct

SEQ ID NO: 68166 - DNA, 20 bp, human
ggatggacgcctggctggaa

SEQ ID NO: 68167 - DNA, 20 bp, human
gaagagacgctggtctcctc

SEQ ID NO: 68168 - DNA, 20 bp, human
gtagagggaaaaaacatcag

SEQ ID NO: 68169 - DNA, 20 bp, human
gtggaagggcagcccgaggg

SEQ ID NO: 68170 - DNA, 20 bp, human
gtctcctcaggcgtgaagat

SEQ ID NO: 68171 - DNA, 20 bp, human
gggcccgtaatcctcgagag

SEQ ID NO: 68172 - DNA, 20 bp, human
gggttgggactgggaagtct

SEQ ID NO: 68173 - DNA, 20 bp, human
gcaggcgtgaagattggatt

SEQ ID NO: 68174 - DNA, 20 bp, human
gagaccagcgtctcttaaga

SEQ ID NO: 68175 - DNA, 20 bp, human
gaagggttgccgcccaggat

SEQ ID NO: 68176 - DNA, 20 bp, human
ggcgagcggcgagggagcag

SEQ ID NO: 68177 - DNA, 20 bp, human
gtgggtggcggggatgacag

SEQ ID NO: 68178 - DNA, 20 bp, human
gatgacagcggaggtggcag

SEQ ID NO: 68179 - DNA, 20 bp, human
gtggggtctcgtgaagccag

SEQ ID NO: 68180 - DNA, 20 bp, human
gcgtgaagccagaggctggg

SEQ ID NO: 68181 - DNA, 20 bp, human
gctgcaaccacggaccggta

SEQ ID NO: 68182 - DNA, 20 bp, human
gccggggtcccgtgcaccgg

SEQ ID NO: 68183 - DNA, 20 bp, human
gtcccgtgcaccggaggcga

SEQ ID NO: 68184 - DNA, 20 bp, human
gggtccggggtcccgtgcac

SEQ ID NO: 68185 - DNA, 20 bp, human
gcgagaccccaaccttcagt

SEQ ID NO: 68186 - DNA, 20 bp, human
gccctatgggaccccaccca

SEQ ID NO: 68187 - DNA, 20 bp, human
gcttcggctgcagtaggtgg

SEQ ID NO: 68188 - DNA, 20 bp, human
gcagtgacgcggcccaaggg

SEQ ID NO: 68189 - DNA, 20 bp, human
gctcgctgtggccccggcag

SEQ ID NO: 68190 - DNA, 20 bp, human
gaggtaatcggtccagtcca

SEQ ID NO: 68191 - DNA, 20 bp, human
gcggctgcagtaggtggtgg

SEQ ID NO: 68192 - DNA, 20 bp, human
gtcgcgaggtgcatccgctt

SEQ ID NO: 68193 - DNA, 20 bp, human
gatgggaacctacctcgcaa

SEQ ID NO: 68194 - DNA, 20 bp, human
gtctgcgtctcgaggcgagt

SEQ ID NO: 68195 - DNA, 20 bp, human
gctggctgcgtatgcgtcac

SEQ ID NO: 68196 - DNA, 20 bp, human
gggatacccgggccaacgag

SEQ ID NO: 68197 - DNA, 20 bp, human
gtgcaggcggcgggcaagga

SEQ ID NO: 68198 - DNA, 20 bp, human
gggtccgcgctgggataccc

SEQ ID NO: 68199 - DNA, 20 bp, human
gggcggcgggcaaggacggc

SEQ ID NO: 68200 - DNA, 20 bp, human
ggggcgtcagcgtatcgcgt

SEQ ID NO: 68201 - DNA, 20 bp, human
gcgcagcactccccgctcgt

SEQ ID NO: 68202 - DNA, 20 bp, human
gataaaccgcccggccgcgg

SEQ ID NO: 68203 - DNA, 20 bp, human
gctcggccggatcggcgtcg

SEQ ID NO: 68204 - DNA, 20 bp, human
gtggcccgggtatcccagcg

SEQ ID NO: 68205 - DNA, 20 bp, human
gatccggccgagccaagtaa

SEQ ID NO: 68206 - DNA, 20 bp, human
gaaccagcagactccaaaga

SEQ ID NO: 68207 - DNA, 20 bp, human
gagctggttactgacagtgt

SEQ ID NO: 68208 - DNA, 20 bp, human
ggagtcatcgttgagtcctg

SEQ ID NO: 68209 - DNA, 20 bp, human
ggaggaagggggaagcccat

SEQ ID NO: 68210 - DNA, 20 bp, human
gcacaaaacctgctggacac

SEQ ID NO: 68211 - DNA, 20 bp, human
gagcagctaacctgaccagc

SEQ ID NO: 68212 - DNA, 20 bp, human
gagctgctcttgtctaaact

SEQ ID NO: 68213 - DNA, 20 bp, human
gtgtcagtaaccagctcctc

SEQ ID NO: 68214 - DNA, 20 bp, human
gcaacaagttaatgttgctg

SEQ ID NO: 68215 - DNA, 20 bp, human
gggcagactatcatttgcat

SEQ ID NO: 68216 - DNA, 20 bp, human
ggcgtactaatagacacctt

SEQ ID NO: 68217 - DNA, 20 bp, human
gaccatggcgtgggtaccag

SEQ ID NO: 68218 - DNA, 20 bp, human
ggtaccagcggagtccgcag

SEQ ID NO: 68219 - DNA, 20 bp, human
gcaccgagggctgtacccag

SEQ ID NO: 68220 - DNA, 20 bp, human
gtccgctggtacccacgcca

SEQ ID NO: 68221 - DNA, 20 bp, human
gtgcgccgagcggaactggc

SEQ ID NO: 68222 - DNA, 20 bp, human
gcgcatgcgccgagcggaac

SEQ ID NO: 68223 - DNA, 20 bp, human
gtcaagtcgcaaggctctac

SEQ ID NO: 68224 - DNA, 20 bp, human
gggtttgaaaaccatggcgt

SEQ ID NO: 68225 - DNA, 20 bp, human
gaacgggaatagagcaccga

SEQ ID NO: 68226 - DNA, 20 bp, human
ggcgtcgccgccatggacct

SEQ ID NO: 68227 - DNA, 20 bp, human
ggcgggacgcacggcacgat

SEQ ID NO: 68228 - DNA, 20 bp, human
ggagccccgggcgcttccaa

SEQ ID NO: 68229 - DNA, 20 bp, human
gccctccgagaactcgaacg

SEQ ID NO: 68230 - DNA, 20 bp, human
gaggccgtcggggcgcccag

SEQ ID NO: 68231 - DNA, 20 bp, human
gacggcacgatgggagacgc

SEQ ID NO: 68232 - DNA, 20 bp, human
gtcaggaaatgaggccgtcg

SEQ ID NO: 68233 - DNA, 20 bp, human
gttgtgagcaggcctaagcg

SEQ ID NO: 68234 - DNA, 20 bp, human
gcagcaatgcgccaccagag

SEQ ID NO: 68235 - DNA, 20 bp, human
gagctgccgttcaggaaatg

SEQ ID NO: 68236 - DNA, 20 bp, human
ggcgtgaggctacgagcggt

SEQ ID NO: 68237 - DNA, 20 bp, human
gtagcctcacgccttaggta

SEQ ID NO: 68238 - DNA, 20 bp, human
gtaaggcgtgaggctacgag

SEQ ID NO: 68239 - DNA, 20 bp, human
gcccacgtggaagctccagg

SEQ ID NO: 68240 - DNA, 20 bp, human
gccgccccgctccctaccta

SEQ ID NO: 68241 - DNA, 20 bp, human
gtaagtctcgggcccaaggg

SEQ ID NO: 68242 - DNA, 20 bp, human
gctgacggcttgtagttatg

SEQ ID NO: 68243 - DNA, 20 bp, human
gggaccgctcggccacagca

SEQ ID NO: 68244 - DNA, 20 bp, human
gcgggcgcagtaccagttgg

SEQ ID NO: 68245 - DNA, 20 bp, human
gacgtggaagctccaggagg

SEQ ID NO: 68246 - DNA, 20 bp, human
gggcagttgtcataaatcgg

SEQ ID NO: 68247 - DNA, 20 bp, human
gctgagtacccagagttgcg

SEQ ID NO: 68248 - DNA, 20 bp, human
gggccagagtgaaagcgatt

SEQ ID NO: 68249 - DNA, 20 bp, human
gttgccgcgggtgcagtctg

SEQ ID NO: 68250 - DNA, 20 bp, human
ggctggatcccgccatcgag

SEQ ID NO: 68251 - DNA, 20 bp, human
gttgaggaaggatcgttgag

SEQ ID NO: 68252 - DNA, 20 bp, human
gcgcaaagcatgctggtctc

SEQ ID NO: 68253 - DNA, 20 bp, human
gaaaaactcctcgcaactct

SEQ ID NO: 68254 - DNA, 20 bp, human
gtgcacaaacgaagggccag

SEQ ID NO: 68255 - DNA, 20 bp, human
gtgaaggatgcacaaacgaa

SEQ ID NO: 68256 - DNA, 20 bp, human
ggacctcggtgagtacaagg

SEQ ID NO: 68257 - DNA, 20 bp, human
ggcggacctcggtgagtaca

SEQ ID NO: 68258 - DNA, 20 bp, human
gcggtgagtacaaggtggtg

SEQ ID NO: 68259 - DNA, 20 bp, human
gccagcaggttccctctccc

SEQ ID NO: 68260 - DNA, 20 bp, human
gccagtccgaacgcccaggg

SEQ ID NO: 68261 - DNA, 20 bp, human
gtcagtctgagcctggaggt

SEQ ID NO: 68262 - DNA, 20 bp, human
gcaccagtagccgcggacct

SEQ ID NO: 68263 - DNA, 20 bp, human
gtggtcagggcggaattgaa

SEQ ID NO: 68264 - DNA, 20 bp, human
gcactcagggcgttgcactg

SEQ ID NO: 68265 - DNA, 20 bp, human
gggaaactgaccggccccag

SEQ ID NO: 68266 - DNA, 20 bp, human
ggtccccgaagtcacctcgt

SEQ ID NO: 68267 - DNA, 20 bp, human
ggggggagtgggggacgcga

SEQ ID NO: 68268 - DNA, 20 bp, human
gagggaggcggctgttgccg

SEQ ID NO: 68269 - DNA, 20 bp, human
gctgggcgttggccgcgcag

SEQ ID NO: 68270 - DNA, 20 bp, human
gagcgcgcttccagtcgccc

SEQ ID NO: 68271 - DNA, 20 bp, human
gaatagtggggccctggcat

SEQ ID NO: 68272 - DNA, 20 bp, human
ggcaggggcctagttttcct

SEQ ID NO: 68273 - DNA, 20 bp, human
gaatcccgcgacaaaaggtg

SEQ ID NO: 68274 - DNA, 20 bp, human
gcacgccacgtgttccgcac

SEQ ID NO: 68275 - DNA, 20 bp, human
ggatccccgggcccccatcc

SEQ ID NO: 68276 - DNA, 20 bp, human
gatcagtgggaggacccggg

SEQ ID NO: 68277 - DNA, 20 bp, human
gccggcctctcagactccgg

SEQ ID NO: 68278 - DNA, 20 bp, human
gagatggtcaaaggaatcag

SEQ ID NO: 68279 - DNA, 20 bp, human
gcaaggaggaagggttgtcc

SEQ ID NO: 68280 - DNA, 20 bp, human
ggtcccgctgtgcttccccc

SEQ ID NO: 68281 - DNA, 20 bp, human
gggcctggcggttgagcccg

SEQ ID NO: 68282 - DNA, 20 bp, human
gaagcaaagactagctcccc

SEQ ID NO: 68283 - DNA, 20 bp, human
gcgcgccgccggagtctgag

SEQ ID NO: 68284 - DNA, 20 bp, human
gcccgcgggacgtggagaga

SEQ ID NO: 68285 - DNA, 20 bp, human
gccgcagtgaccggactcgg

SEQ ID NO: 68286 - DNA, 20 bp, human
ggtacctgaagaacagggtc

SEQ ID NO: 68287 - DNA, 20 bp, human
gcggagcgccggcccgatgg

SEQ ID NO: 68288 - DNA, 20 bp, human
gtcagaggccgagggaacgg

SEQ ID NO: 68289 - DNA, 20 bp, human
gacgctgtcgcaggcgcggt

SEQ ID NO: 68290 - DNA, 20 bp, human
gagcaggagagcgcccggaa

SEQ ID NO: 68291 - DNA, 20 bp, human
ggaaggccgaggaggaacgc

SEQ ID NO: 68292 - DNA, 20 bp, human
gcgaggaggaacgcaggaga

SEQ ID NO: 68293 - DNA, 20 bp, human
gcgcgggtacctgaagaaca

SEQ ID NO: 68294 - DNA, 20 bp, human
ggagtaggggaaggccgagg

SEQ ID NO: 68295 - DNA, 20 bp, human
gcgacagcgtcagccctgcg

SEQ ID NO: 68296 - DNA, 20 bp, human
gccctgaggagacgtaggag

SEQ ID NO: 68297 - DNA, 20 bp, human
gatctcccctgaggagacgt

SEQ ID NO: 68298 - DNA, 20 bp, human
gacgtaggagcggcgagcag

SEQ ID NO: 68299 - DNA, 20 bp, human
ggaggttgagagggacaatc

SEQ ID NO: 68300 - DNA, 20 bp, human
gcctcacttctgcctcacag

SEQ ID NO: 68301 - DNA, 20 bp, human
gtccagccgggcgctgttgg

SEQ ID NO: 68302 - DNA, 20 bp, human
gcccaccatcatctcccctg

SEQ ID NO: 68303 - DNA, 20 bp, human
ggccgctcctacgtctcctc

SEQ ID NO: 68304 - DNA, 20 bp, human
ggagacccgggccagtgagc

SEQ ID NO: 68305 - DNA, 20 bp, human
gtcctcaggggagatgatgg

SEQ ID NO: 68306 - DNA, 20 bp, human
gagggcagcaagctgaccta

SEQ ID NO: 68307 - DNA, 20 bp, human
gctgatactgacggagccta

SEQ ID NO: 68308 - DNA, 20 bp, human
ggctgacctagggacagagg

SEQ ID NO: 68309 - DNA, 20 bp, human
gcaagctgacctagggacag

SEQ ID NO: 68310 - DNA, 20 bp, human
ggcagcctgaggaaactcaa

SEQ ID NO: 68311 - DNA, 20 bp, human
gcagtatcaggcctgccaga

SEQ ID NO: 68312 - DNA, 20 bp, human
ggtgctgggtgggtgccgtc

SEQ ID NO: 68313 - DNA, 20 bp, human
gccgagagaacctccatctc

SEQ ID NO: 68314 - DNA, 20 bp, human
gctgagactcagacaggaaa

SEQ ID NO: 68315 - DNA, 20 bp, human
gatgtggagggcgatgtagt

SEQ ID NO: 68316 - DNA, 20 bp, human
ggcgagcggggccgcttcca

SEQ ID NO: 68317 - DNA, 20 bp, human
gcgccgaggacgcctcccgg

SEQ ID NO: 68318 - DNA, 20 bp, human
gccttgcgcgggcaacatgg

SEQ ID NO: 68319 - DNA, 20 bp, human
gtctggaggccgagctgacc

SEQ ID NO: 68320 - DNA, 20 bp, human
gaggccttgcgcgggcaaca

SEQ ID NO: 68321 - DNA, 20 bp, human
gtaaggccgggcctacccgg

SEQ ID NO: 68322 - DNA, 20 bp, human
gcgcggggctgggagaaatc

SEQ ID NO: 68323 - DNA, 20 bp, human
ggaagaagaggttcccgccg

SEQ ID NO: 68324 - DNA, 20 bp, human
gtcggcgacaggagaatcgg

SEQ ID NO: 68325 - DNA, 20 bp, human
gcgcgcggatgaaggctgta

SEQ ID NO: 68326 - DNA, 20 bp, human
gggacctacctgcggagtca

SEQ ID NO: 68327 - DNA, 20 bp, human
gggctcggcggacctacctg

SEQ ID NO: 68328 - DNA, 20 bp, human
gacctgcggagtcacggcgc

SEQ ID NO: 68329 - DNA, 20 bp, human
gaggcgcagaacaggctcgg

SEQ ID NO: 68330 - DNA, 20 bp, human
gtcaccgtccgggcccagga

SEQ ID NO: 68331 - DNA, 20 bp, human
ggcccgcgccgtgactccgc

SEQ ID NO: 68332 - DNA, 20 bp, human
ggaggcctgagcgcgcggag

SEQ ID NO: 68333 - DNA, 20 bp, human
gccagctgccggagctctct

SEQ ID NO: 68334 - DNA, 20 bp, human
gagggagccgagggcgctaa

SEQ ID NO: 68335 - DNA, 20 bp, human
gcctccttcctgggcccgga

SEQ ID NO: 68336 - DNA, 20 bp, human
gtaccaggtggcacttggac

SEQ ID NO: 68337 - DNA, 20 bp, human
gaggtgcagtaggcatccgg

SEQ ID NO: 68338 - DNA, 20 bp, human
gtgagctgtgtcagtggcgg

SEQ ID NO: 68339 - DNA, 20 bp, human
gaggcgcgcagagggcccac

SEQ ID NO: 68340 - DNA, 20 bp, human
ggacgtgggtcagtactctc

SEQ ID NO: 68341 - DNA, 20 bp, human
gaagccctcggagtgaccgt

SEQ ID NO: 68342 - DNA, 20 bp, human
gtcacccacggtcactccga

SEQ ID NO: 68343 - DNA, 20 bp, human
gcggcggcggcaacgacggc

SEQ ID NO: 68344 - DNA, 20 bp, human
gtggtgtgccgaggtgcagt

SEQ ID NO: 68345 - DNA, 20 bp, human
ggtcaagcccctcctcccgt

SEQ ID NO: 68346 - DNA, 20 bp, human
gttcccacctcgggaagctc

SEQ ID NO: 68347 - DNA, 20 bp, human
ggctttgcagttcccacctc

SEQ ID NO: 68348 - DNA, 20 bp, human
gtggaggccagtcccgagag

SEQ ID NO: 68349 - DNA, 20 bp, human
gcacacagttgacagagtgg

SEQ ID NO: 68350 - DNA, 20 bp, human
ggttctgccggagcttcccg

SEQ ID NO: 68351 - DNA, 20 bp, human
gtccggcagaacccaggcga

SEQ ID NO: 68352 - DNA, 20 bp, human
gtctgggactgtctccgagg

SEQ ID NO: 68353 - DNA, 20 bp, human
gccgagggggaacacaactc

SEQ ID NO: 68354 - DNA, 20 bp, human
gagtcacacagttgacagag

SEQ ID NO: 68355 - DNA, 20 bp, human
gctgccggagcttcccgagg

SEQ ID NO: 68356 - DNA, 20 bp, human
ggaagcggtcaaagtcacgc

SEQ ID NO: 68357 - DNA, 20 bp, human
gattattcacgggaaaagag

SEQ ID NO: 68358 - DNA, 20 bp, human
gcaggtaccggagcatagag

SEQ ID NO: 68359 - DNA, 20 bp, human
gaagtcccgtggcgccgggt

SEQ ID NO: 68360 - DNA, 20 bp, human
gaccggcagctgaacccacc

SEQ ID NO: 68361 - DNA, 20 bp, human
gtcgctctctggtatcccta

SEQ ID NO: 68362 - DNA, 20 bp, human
gagcacgcgtcaaagtcccg

SEQ ID NO: 68363 - DNA, 20 bp, human
gccgcttcccggtgcgttac

SEQ ID NO: 68364 - DNA, 20 bp, human
gcgcttgccatgagactcct

SEQ ID NO: 68365 - DNA, 20 bp, human
gtcagctgccggtaacgcac

SEQ ID NO: 68366 - DNA, 20 bp, human
gcgcgcgatgtctcacagct

SEQ ID NO: 68367 - DNA, 20 bp, human
ggccctgttgtcctcttccg

SEQ ID NO: 68368 - DNA, 20 bp, human
ggctgcccgaggcggtagag

SEQ ID NO: 68369 - DNA, 20 bp, human
gcggtacaccgccggaagtg

SEQ ID NO: 68370 - DNA, 20 bp, human
gggtacccagcgctgtgaca

SEQ ID NO: 68371 - DNA, 20 bp, human
gttctccgctctaccgcctc

SEQ ID NO: 68372 - DNA, 20 bp, human
ggctcggagcagtactcacc

SEQ ID NO: 68373 - DNA, 20 bp, human
gcacacctccacacttccgg

SEQ ID NO: 68374 - DNA, 20 bp, human
gcaagtctcgacgccagcct

SEQ ID NO: 68375 - DNA, 20 bp, human
ggccgcgccaaagtctgcaa

SEQ ID NO: 68376 - DNA, 20 bp, human
ggccgcgaggcgagcgaaca

SEQ ID NO: 68377 - DNA, 20 bp, human
gggctcaggctgcgctcccg

SEQ ID NO: 68378 - DNA, 20 bp, human
gcgaggccgcccgagccgcg

SEQ ID NO: 68379 - DNA, 20 bp, human
gcgcctcagaacggtgactg

SEQ ID NO: 68380 - DNA, 20 bp, human
gtgcaggcggagcaagctcg

SEQ ID NO: 68381 - DNA, 20 bp, human
gagctcggggcgcctcagaa

SEQ ID NO: 68382 - DNA, 20 bp, human
gcagagcctgagccggcctg

SEQ ID NO: 68383 - DNA, 20 bp, human
ggcacggaaccgctccgcgg

SEQ ID NO: 68384 - DNA, 20 bp, human
ggatcccgcggggacgaggg

SEQ ID NO: 68385 - DNA, 20 bp, human
gaagaaaggagactcccccg

SEQ ID NO: 68386 - DNA, 20 bp, human
ggcgcgggcccgggagtcca

SEQ ID NO: 68387 - DNA, 20 bp, human
gccaggcggcgcgttcccgg

SEQ ID NO: 68388 - DNA, 20 bp, human
gacgcgccgcctggtttcta

SEQ ID NO: 68389 - DNA, 20 bp, human
gctggtttctaaggaactgg

SEQ ID NO: 68390 - DNA, 20 bp, human
ggagtccagggcgccgccac

SEQ ID NO: 68391 - DNA, 20 bp, human
gggtccacgcctccaacctc

SEQ ID NO: 68392 - DNA, 20 bp, human
ggtggaaagggcgaatccca

SEQ ID NO: 68393 - DNA, 20 bp, human
ggaactgggggctctggaaa

SEQ ID NO: 68394 - DNA, 20 bp, human
ggccgcggagaaggccctgt

SEQ ID NO: 68395 - DNA, 20 bp, human
gcacccatccgccttaagga

SEQ ID NO: 68396 - DNA, 20 bp, human
ggcgccgacacgactccctc

SEQ ID NO: 68397 - DNA, 20 bp, human
gatccccgagggagtcgtgt

SEQ ID NO: 68398 - DNA, 20 bp, human
ggcgcggagaaggaaccgaa

SEQ ID NO: 68399 - DNA, 20 bp, human
gttggccgtcgcatccccga

SEQ ID NO: 68400 - DNA, 20 bp, human
gtgcacacacgagcttcggt

SEQ ID NO: 68401 - DNA, 20 bp, human
gagcttcggtgggcaatctg

SEQ ID NO: 68402 - DNA, 20 bp, human
gtaaggcccaaggcgacggg

SEQ ID NO: 68403 - DNA, 20 bp, human
ggggcaatctgcgggctcgg

SEQ ID NO: 68404 - DNA, 20 bp, human
ggactccctcggggatgcga

SEQ ID NO: 68405 - DNA, 20 bp, human
gcatccacgggcgggagagg

SEQ ID NO: 68406 - DNA, 20 bp, human
ggacgctggggctcctccgt

SEQ ID NO: 68407 - DNA, 20 bp, human
ggagcccacggaggagccca

SEQ ID NO: 68408 - DNA, 20 bp, human
gggagccccagcgtccgaac

SEQ ID NO: 68409 - DNA, 20 bp, human
ggctcctccgtgggctccgt

SEQ ID NO: 68410 - DNA, 20 bp, human
gggaggagagcgacctcggt

SEQ ID NO: 68411 - DNA, 20 bp, human
gtctgcccgttcggacgctg

SEQ ID NO: 68412 - DNA, 20 bp, human
ggggcgactgggagacgtgg

SEQ ID NO: 68413 - DNA, 20 bp, human
ggctccttcgcggctcgagg

SEQ ID NO: 68414 - DNA, 20 bp, human
ggccccgggcccctaccgag

SEQ ID NO: 68415 - DNA, 20 bp, human
ggagcgacctcggtcggcat

SEQ ID NO: 68416 - DNA, 20 bp, human
gaaggccaggctctgcagat

SEQ ID NO: 68417 - DNA, 20 bp, human
ggaagtgtcacgatgaagca

SEQ ID NO: 68418 - DNA, 20 bp, human
ggcatattccaggaaagcaa

SEQ ID NO: 68419 - DNA, 20 bp, human
gtgactggcattagagtccg

SEQ ID NO: 68420 - DNA, 20 bp, human
gagagttgtggtaccaagcg

SEQ ID NO: 68421 - DNA, 20 bp, human
ggatgcacacgtgagcttgg

SEQ ID NO: 68422 - DNA, 20 bp, human
ggtgcaagtttgtctaacaa

SEQ ID NO: 68423 - DNA, 20 bp, human
gtatttaatcagcttggcga

SEQ ID NO: 68424 - DNA, 20 bp, human
gcaagcgaggatgtgtttct

SEQ ID NO: 68425 - DNA, 20 bp, human
gacacttctgaaattgtgac

SEQ ID NO: 68426 - DNA, 20 bp, human
gcagtgaaagaggaaactcc

SEQ ID NO: 68427 - DNA, 20 bp, human
ggcctcgacttacccaagag

SEQ ID NO: 68428 - DNA, 20 bp, human
gaaagaggaaactccgggtc

SEQ ID NO: 68429 - DNA, 20 bp, human
gcggcgactcagctccggga

SEQ ID NO: 68430 - DNA, 20 bp, human
gctccctcggcaagacccag

SEQ ID NO: 68431 - DNA, 20 bp, human
gagcggcagcgcgaagtaca

SEQ ID NO: 68432 - DNA, 20 bp, human
ggaccctaggaaagactcag

SEQ ID NO: 68433 - DNA, 20 bp, human
gcctcggcaagacccagcgg

SEQ ID NO: 68434 - DNA, 20 bp, human
gccgccggcgactcagctcc

SEQ ID NO: 68435 - DNA, 20 bp, human
ggatggagctgaactttggg

SEQ ID NO: 68436 - DNA, 20 bp, human
ggagggctgaccccaggact

SEQ ID NO: 68437 - DNA, 20 bp, human
gtgattgtagcgggcaaggg

SEQ ID NO: 68438 - DNA, 20 bp, human
ggggcaaggggggcgtcgag

SEQ ID NO: 68439 - DNA, 20 bp, human
gacacgcacgcagagacaca

SEQ ID NO: 68440 - DNA, 20 bp, human
gccttcccggacgattggag

SEQ ID NO: 68441 - DNA, 20 bp, human
gtatacgcgtatctgtgtat

SEQ ID NO: 68442 - DNA, 20 bp, human
gcccggacgattggagggga

SEQ ID NO: 68443 - DNA, 20 bp, human
ggggcgctgacacccgtctg

SEQ ID NO: 68444 - DNA, 20 bp, human
gggcgagaatcgcaggactc

SEQ ID NO: 68445 - DNA, 20 bp, human
gtgagccgagcaagggttag

SEQ ID NO: 68446 - DNA, 20 bp, human
gtcggctcggatgcaccggg

SEQ ID NO: 68447 - DNA, 20 bp, human
ggtgcatccgagccgaacaa

SEQ ID NO: 68448 - DNA, 20 bp, human
gcgcgcgcttcggagttgga

SEQ ID NO: 68449 - DNA, 20 bp, human
ggcagcaacatcaggactac

SEQ ID NO: 68450 - DNA, 20 bp, human
ggcaacatcaggactacggg

SEQ ID NO: 68451 - DNA, 20 bp, human
gaagcccagggtgcctgcaa

SEQ ID NO: 68452 - DNA, 20 bp, human
ggcagcggtcgcgggttcag

SEQ ID NO: 68453 - DNA, 20 bp, human
gtcaggactacgggcggcag

SEQ ID NO: 68454 - DNA, 20 bp, human
gcaccggctgcgagaggcag

SEQ ID NO: 68455 - DNA, 20 bp, human
gcggcgcctacagctcgcca

SEQ ID NO: 68456 - DNA, 20 bp, human
ggccagggttcggggtccag

SEQ ID NO: 68457 - DNA, 20 bp, human
ggtgcgcacaggcctctcac

SEQ ID NO: 68458 - DNA, 20 bp, human
gacggagcagtccaagaagg

SEQ ID NO: 68459 - DNA, 20 bp, human
gcgcgacatccatgcaggga

SEQ ID NO: 68460 - DNA, 20 bp, human
gtggcggtggtggcttgacg

SEQ ID NO: 68461 - DNA, 20 bp, human
gtcactggcaacccttcctg

SEQ ID NO: 68462 - DNA, 20 bp, human
gccaaggctggactcgggag

SEQ ID NO: 68463 - DNA, 20 bp, human
gcatggatgtcgcggaggga

SEQ ID NO: 68464 - DNA, 20 bp, human
gtgctcctcagtgacaaggt

SEQ ID NO: 68465 - DNA, 20 bp, human
gcctgcatggatgtcgcgga

SEQ ID NO: 68466 - DNA, 20 bp, human
gctttaggaagcaaacacag

SEQ ID NO: 68467 - DNA, 20 bp, human
ggcagttcacctggaaaaaa

SEQ ID NO: 68468 - DNA, 20 bp, human
gtcacacttaagcttaacag

SEQ ID NO: 68469 - DNA, 20 bp, human
gagaggctgaagccttattc

SEQ ID NO: 68470 - DNA, 20 bp, human
gcaactcacggcagttcacc

SEQ ID NO: 68471 - DNA, 20 bp, human
gcttgtaaatagatactgga

SEQ ID NO: 68472 - DNA, 20 bp, human
gataacttgtaaatagatac

SEQ ID NO: 68473 - DNA, 20 bp, human
gcgcatctgcctttttttcc

SEQ ID NO: 68474 - DNA, 20 bp, human
gacaaatttatgctttaaca

SEQ ID NO: 68475 - DNA, 20 bp, human
gcataaatttgtaatttact

SEQ ID NO: 68476 - DNA, 20 bp, human
ggcgatggagccggagactc

SEQ ID NO: 68477 - DNA, 20 bp, human
gggtgtgagatgcaaccccg

SEQ ID NO: 68478 - DNA, 20 bp, human
gtaggctgaagggagtgaca

SEQ ID NO: 68479 - DNA, 20 bp, human
gcggccccggcgcggtccag

SEQ ID NO: 68480 - DNA, 20 bp, human
ggcccagggatccgacaggt

SEQ ID NO: 68481 - DNA, 20 bp, human
gccagagagtggaggattcg

SEQ ID NO: 68482 - DNA, 20 bp, human
gatcagtgagtgtccgggag

SEQ ID NO: 68483 - DNA, 20 bp, human
ggcacgcgagcggttccccg

SEQ ID NO: 68484 - DNA, 20 bp, human
gtagtagggtccctccctcc

SEQ ID NO: 68485 - DNA, 20 bp, human
gcccggcgcggtccagcggt

SEQ ID NO: 68486 - DNA, 20 bp, human
ggagcgccaggacgctacag

SEQ ID NO: 68487 - DNA, 20 bp, human
ggacgctacagcggctgaag

SEQ ID NO: 68488 - DNA, 20 bp, human
gcctgccgcgcagtcagcag

SEQ ID NO: 68489 - DNA, 20 bp, human
ggcccgcggccgcagcgtcg

SEQ ID NO: 68490 - DNA, 20 bp, human
ggaagaggcagtggcgcccg

SEQ ID NO: 68491 - DNA, 20 bp, human
gcccgaagcaaggccccggg

SEQ ID NO: 68492 - DNA, 20 bp, human
ggtgctgctgctaagttggg

SEQ ID NO: 68493 - DNA, 20 bp, human
gcgctccagccccgacgctg

SEQ ID NO: 68494 - DNA, 20 bp, human
gggaagcgaggcctcacgtg

SEQ ID NO: 68495 - DNA, 20 bp, human
ggagccccaagcatccgccg

SEQ ID NO: 68496 - DNA, 20 bp, human
gggctgcaatatggcggagg

SEQ ID NO: 68497 - DNA, 20 bp, human
gggcggctgcaatatggcgg

SEQ ID NO: 68498 - DNA, 20 bp, human
gaatatggcggaggcggaag

SEQ ID NO: 68499 - DNA, 20 bp, human
ggcgccccaatccctgacta

SEQ ID NO: 68500 - DNA, 20 bp, human
ggggccgggcggctgcaata

SEQ ID NO: 68501 - DNA, 20 bp, human
gctgagtctccggtagtggt

SEQ ID NO: 68502 - DNA, 20 bp, human
ggggcaggcagaaacggccg

SEQ ID NO: 68503 - DNA, 20 bp, human
ggccgcagcgagggaagcgg

SEQ ID NO: 68504 - DNA, 20 bp, human
ggaagcttctcccttagtca

SEQ ID NO: 68505 - DNA, 20 bp, human
gttgcagccgcccggccccg

SEQ ID NO: 68506 - DNA, 20 bp, human
gagaggacctcagctgaacc

SEQ ID NO: 68507 - DNA, 20 bp, human
gtggcgcccgcgggaacctg

SEQ ID NO: 68508 - DNA, 20 bp, human
gccccggctgccggcaggtg

SEQ ID NO: 68509 - DNA, 20 bp, human
gcaggaaccgcctcacgcac

SEQ ID NO: 68510 - DNA, 20 bp, human
gcctctgaaagccagcgtgt

SEQ ID NO: 68511 - DNA, 20 bp, human
gcgggcgcgattgccagaac

SEQ ID NO: 68512 - DNA, 20 bp, human
gtccccgcgggtgagggagg

SEQ ID NO: 68513 - DNA, 20 bp, human
ggggcgctgcttccctgtaa

SEQ ID NO: 68514 - DNA, 20 bp, human
gctgctccgccccccaggcg

SEQ ID NO: 68515 - DNA, 20 bp, human
ggcgccaggacaccccgcct

SEQ ID NO: 68516 - DNA, 20 bp, human
ggccagagagcgcaacactg

SEQ ID NO: 68517 - DNA, 20 bp, human
gacactggggcccactaccc

SEQ ID NO: 68518 - DNA, 20 bp, human
ggtcactgcgccggggtagt

SEQ ID NO: 68519 - DNA, 20 bp, human
gcgggccacggtgccctctc

SEQ ID NO: 68520 - DNA, 20 bp, human
gccctgaggctgccgcgcgg

SEQ ID NO: 68521 - DNA, 20 bp, human
gtaaccctgaggctgccgcg

SEQ ID NO: 68522 - DNA, 20 bp, human
gtgaagcagagtgtaaggaa

SEQ ID NO: 68523 - DNA, 20 bp, human
gccaggagggggaaagctcc

SEQ ID NO: 68524 - DNA, 20 bp, human
gtgatgagggtactaggacg

SEQ ID NO: 68525 - DNA, 20 bp, human
ggcagcccgagagggcaccg

SEQ ID NO: 68526 - DNA, 20 bp, human
gctcctccgcagagcaatgg

SEQ ID NO: 68527 - DNA, 20 bp, human
gtcattgagccgacccgggt

SEQ ID NO: 68528 - DNA, 20 bp, human
gagctgccgcgtctgaacgg

SEQ ID NO: 68529 - DNA, 20 bp, human
gggcggcctccgttcagacg

SEQ ID NO: 68530 - DNA, 20 bp, human
gagcttccgcccacccgggt

SEQ ID NO: 68531 - DNA, 20 bp, human
gcgtcgggaggcggagccta

SEQ ID NO: 68532 - DNA, 20 bp, human
gggcgaggtccgcgcggacc

SEQ ID NO: 68533 - DNA, 20 bp, human
gctaggaactctccgccgga

SEQ ID NO: 68534 - DNA, 20 bp, human
gtcctaagcctacctgagct

SEQ ID NO: 68535 - DNA, 20 bp, human
gttaggaccccgccctccgg

SEQ ID NO: 68536 - DNA, 20 bp, human
gcgagcgccatggccagtcc

SEQ ID NO: 68537 - DNA, 20 bp, human
gcgcccgcagagcttttgaa

SEQ ID NO: 68538 - DNA, 20 bp, human
gccgcagagcttttgaaagg

SEQ ID NO: 68539 - DNA, 20 bp, human
gactcgcgtgagactcgggt

SEQ ID NO: 68540 - DNA, 20 bp, human
ggagtctaaaggaatgaacg

SEQ ID NO: 68541 - DNA, 20 bp, human
gtgcaccatgaagaatcctg

SEQ ID NO: 68542 - DNA, 20 bp, human
gttggtgcaaggaggaaccc

SEQ ID NO: 68543 - DNA, 20 bp, human
ggcgcactcgcgtgagactc

SEQ ID NO: 68544 - DNA, 20 bp, human
gccgccaagaagcccatcat

SEQ ID NO: 68545 - DNA, 20 bp, human
gcgggaggcggcgagcgcca

SEQ ID NO: 68546 - DNA, 20 bp, human
gccgagcagagttcagaccg

SEQ ID NO: 68547 - DNA, 20 bp, human
gtggccccgcctccccccag

SEQ ID NO: 68548 - DNA, 20 bp, human
gatcggatcttggagaacag

SEQ ID NO: 68549 - DNA, 20 bp, human
gacccaggtgctctagagag

SEQ ID NO: 68550 - DNA, 20 bp, human
ggcgtgagtgtcgaaggtcg

SEQ ID NO: 68551 - DNA, 20 bp, human
gcaagtgggcgagacaacta

SEQ ID NO: 68552 - DNA, 20 bp, human
ggcagctgtgttggggacat

SEQ ID NO: 68553 - DNA, 20 bp, human
gggtgcgggtgaaggcaagt

SEQ ID NO: 68554 - DNA, 20 bp, human
gcgatcaggcccaagtcctt

SEQ ID NO: 68555 - DNA, 20 bp, human
gggaacaggagtgcgaccta

SEQ ID NO: 68556 - DNA, 20 bp, human
gagcggctgactgcccgtag

SEQ ID NO: 68557 - DNA, 20 bp, human
ggctgacgaggcccgcgtca

SEQ ID NO: 68558 - DNA, 20 bp, human
gccgtagaggaaacgacatt

SEQ ID NO: 68559 - DNA, 20 bp, human
gcggggtcgatccctcccag

SEQ ID NO: 68560 - DNA, 20 bp, human
ggtccaaaggagaggcggaa

SEQ ID NO: 68561 - DNA, 20 bp, human
gggagggatcgaccccgcag

SEQ ID NO: 68562 - DNA, 20 bp, human
ggcctcgtcagccagtaaca

SEQ ID NO: 68563 - DNA, 20 bp, human
ggcagcacattcgccacggg

SEQ ID NO: 68564 - DNA, 20 bp, human
ggaagggaccggcctgccgg

SEQ ID NO: 68565 - DNA, 20 bp, human
ggcccgccggcctccagtca

SEQ ID NO: 68566 - DNA, 20 bp, human
ggctagcacagagtccggag

SEQ ID NO: 68567 - DNA, 20 bp, human
gagggagcatctgagcgagg

SEQ ID NO: 68568 - DNA, 20 bp, human
gctgcgcagtgtgaccggga

SEQ ID NO: 68569 - DNA, 20 bp, human
gacgcctgcgcagtgtgacc

SEQ ID NO: 68570 - DNA, 20 bp, human
gccagcgacaccgcattagt

SEQ ID NO: 68571 - DNA, 20 bp, human
gacagtgctagcacagagtc

SEQ ID NO: 68572 - DNA, 20 bp, human
gtagtgggaaggattcatgt

SEQ ID NO: 68573 - DNA, 20 bp, human
ggaactgtgagcggcagtgg

SEQ ID NO: 68574 - DNA, 20 bp, human
gagttctgtggtgaaatagt

SEQ ID NO: 68575 - DNA, 20 bp, human
gcgaggccgattttccacag

SEQ ID NO: 68576 - DNA, 20 bp, human
gagccccggcggacagtggg

SEQ ID NO: 68577 - DNA, 20 bp, human
gagcagccccggcggacagt

SEQ ID NO: 68578 - DNA, 20 bp, human
gtgcctcccactgtccgccg

SEQ ID NO: 68579 - DNA, 20 bp, human
gcagtgggaggcatctgcac

SEQ ID NO: 68580 - DNA, 20 bp, human
gaaggagcaggagcggccag

SEQ ID NO: 68581 - DNA, 20 bp, human
gcccatcagggtcccaagga

SEQ ID NO: 68582 - DNA, 20 bp, human
ggagccactctggagagtgg

SEQ ID NO: 68583 - DNA, 20 bp, human
gctgtggctgggactttccc

SEQ ID NO: 68584 - DNA, 20 bp, human
gaattgggactgggatctgg

SEQ ID NO: 68585 - DNA, 20 bp, human
gaacccagacccccttcctt

SEQ ID NO: 68586 - DNA, 20 bp, human
gtatgcgagtgggtgaagga

SEQ ID NO: 68587 - DNA, 20 bp, human
gggatgaccagaccgggcgt

SEQ ID NO: 68588 - DNA, 20 bp, human
gttgagtgaggtatgcgagt

SEQ ID NO: 68589 - DNA, 20 bp, human
gtctgggctcacccgacgcc

SEQ ID NO: 68590 - DNA, 20 bp, human
gccagtcggataaagaaccc

SEQ ID NO: 68591 - DNA, 20 bp, human
ggctgggggcctctgtttct

SEQ ID NO: 68592 - DNA, 20 bp, human
gtctgggtcacacagcactg

SEQ ID NO: 68593 - DNA, 20 bp, human
ggctgctggatgaccagacc

SEQ ID NO: 68594 - DNA, 20 bp, human
ggcccagaagtgagagcagt

SEQ ID NO: 68595 - DNA, 20 bp, human
gatgtccaccagctcagaga

SEQ ID NO: 68596 - DNA, 20 bp, human
gggtcagggttaagggttcc

SEQ ID NO: 68597 - DNA, 20 bp, human
gggggtggtgcgctgctgca

SEQ ID NO: 68598 - DNA, 20 bp, human
gaggaatcggtgtctctacc

SEQ ID NO: 68599 - DNA, 20 bp, human
gtagagacaccgattcctgg

SEQ ID NO: 68600 - DNA, 20 bp, human
ggagtccgggtcagggttaa

SEQ ID NO: 68601 - DNA, 20 bp, human
gtggaggtccaaagagcctc

SEQ ID NO: 68602 - DNA, 20 bp, human
gcagccgggagtccgggtca

SEQ ID NO: 68603 - DNA, 20 bp, human
gtctttggacctccaggaat

SEQ ID NO: 68604 - DNA, 20 bp, human
gaggcccaccaagcctgggg

SEQ ID NO: 68605 - DNA, 20 bp, human
gccacctccccaggcttggt

SEQ ID NO: 68606 - DNA, 20 bp, human
ggaccttcaggagaacgaga

SEQ ID NO: 68607 - DNA, 20 bp, human
gcttcagagactctctgatc

SEQ ID NO: 68608 - DNA, 20 bp, human
gcccgtggcagtgaatctgt

SEQ ID NO: 68609 - DNA, 20 bp, human
gttctcctgaaggtcaaggg

SEQ ID NO: 68610 - DNA, 20 bp, human
ggtctctgaagaagattctg

SEQ ID NO: 68611 - DNA, 20 bp, human
gtcgttctcctgaaggtcaa

SEQ ID NO: 68612 - DNA, 20 bp, human
gtgtggggcgctctgattgt

SEQ ID NO: 68613 - DNA, 20 bp, human
gacagctgaggaaataaccg

SEQ ID NO: 68614 - DNA, 20 bp, human
gcaggcttcagcagagtgtg

SEQ ID NO: 68615 - DNA, 20 bp, human
ggctctgattgtgggcacta

SEQ ID NO: 68616 - DNA, 20 bp, human
ggctgcagagccatggcccg

SEQ ID NO: 68617 - DNA, 20 bp, human
ggaggagaggggcggctggt

SEQ ID NO: 68618 - DNA, 20 bp, human
gcatggctctgcagcccagg

SEQ ID NO: 68619 - DNA, 20 bp, human
gctctgcagcccaggaggag

SEQ ID NO: 68620 - DNA, 20 bp, human
gcagccgcccctctcctcct

SEQ ID NO: 68621 - DNA, 20 bp, human
ggcacagagtcacaggtaat

SEQ ID NO: 68622 - DNA, 20 bp, human
gtaactccctcactgctagt

SEQ ID NO: 68623 - DNA, 20 bp, human
gagaagatgcacagagtcac

SEQ ID NO: 68624 - DNA, 20 bp, human
gcacagcagctgactcctct

SEQ ID NO: 68625 - DNA, 20 bp, human
gtcactgctagtaggtccaa

SEQ ID NO: 68626 - DNA, 20 bp, human
gctctgagacacagccggaa

SEQ ID NO: 68627 - DNA, 20 bp, human
ggcagcttctgatagaccac

SEQ ID NO: 68628 - DNA, 20 bp, human
gctcctgcaccaggacttgg

SEQ ID NO: 68629 - DNA, 20 bp, human
gggctccccaggcttgaggt

SEQ ID NO: 68630 - DNA, 20 bp, human
ggactcttccaggtaagtaa

SEQ ID NO: 68631 - DNA, 20 bp, human
gtctctctggagcccctcag

SEQ ID NO: 68632 - DNA, 20 bp, human
ggagacacagccggaaaggc

SEQ ID NO: 68633 - DNA, 20 bp, human
gcacagccggaaaggctggc

SEQ ID NO: 68634 - DNA, 20 bp, human
ggggctggggcgagcactgg

SEQ ID NO: 68635 - DNA, 20 bp, human
gagagtcctggtgcctccgg

SEQ ID NO: 68636 - DNA, 20 bp, human
ggcgcagcgcctgccggaag

SEQ ID NO: 68637 - DNA, 20 bp, human
gactggcgagtaggcgccca

SEQ ID NO: 68638 - DNA, 20 bp, human
ggtaggatgcgacaacggag

SEQ ID NO: 68639 - DNA, 20 bp, human
ggacaacggagaggatgcta

SEQ ID NO: 68640 - DNA, 20 bp, human
ggaggcgtaggatgcgacaa

SEQ ID NO: 68641 - DNA, 20 bp, human
gggactgcagtagaagggat

SEQ ID NO: 68642 - DNA, 20 bp, human
ggctagggactgcagtagaa

SEQ ID NO: 68643 - DNA, 20 bp, human
ggccagccaggagagcgccc

SEQ ID NO: 68644 - DNA, 20 bp, human
gatgtagtccactggcgagt

SEQ ID NO: 68645 - DNA, 20 bp, human
gttctgggagaccccgacac

SEQ ID NO: 68646 - DNA, 20 bp, human
ggccagctggtgcagacgat

SEQ ID NO: 68647 - DNA, 20 bp, human
gctggtgcagacgatgggcg

SEQ ID NO: 68648 - DNA, 20 bp, human
gaacaggtggggtcaacagt

SEQ ID NO: 68649 - DNA, 20 bp, human
gggtcaacagtgggagagaa

SEQ ID NO: 68650 - DNA, 20 bp, human
gacctagctgcaatggctac

SEQ ID NO: 68651 - DNA, 20 bp, human
gacctgtagccattgcagct

SEQ ID NO: 68652 - DNA, 20 bp, human
gtcagaaagctcctggtccc

SEQ ID NO: 68653 - DNA, 20 bp, human
ggccaatctcagaaagctcc

SEQ ID NO: 68654 - DNA, 20 bp, human
gaccaggagctttctgagat

SEQ ID NO: 68655 - DNA, 20 bp, human
gcactgccctcttgaagcca

SEQ ID NO: 68656 - DNA, 20 bp, human
ggaaggggccaggtataaaa

SEQ ID NO: 68657 - DNA, 20 bp, human
gctctgcatgtttaggcctg

SEQ ID NO: 68658 - DNA, 20 bp, human
gcctgtttctctgcatgttt

SEQ ID NO: 68659 - DNA, 20 bp, human
gaaaaaaaaaacccagctcc

SEQ ID NO: 68660 - DNA, 20 bp, human
ggccctcttgaagccaggac

SEQ ID NO: 68661 - DNA, 20 bp, human
ggaggcggcgtcctgtagat

SEQ ID NO: 68662 - DNA, 20 bp, human
ggccaaatactgggcttaga

SEQ ID NO: 68663 - DNA, 20 bp, human
gacatgcagagaaacaggtg

SEQ ID NO: 68664 - DNA, 20 bp, human
ggaaaccggagggcaacaga

SEQ ID NO: 68665 - DNA, 20 bp, human
ggcctgtcctggcttcaaga

SEQ ID NO: 68666 - DNA, 20 bp, human
gtccgtcacgtgccaggagt

SEQ ID NO: 68667 - DNA, 20 bp, human
ggccaggagtaggcagaagt

SEQ ID NO: 68668 - DNA, 20 bp, human
ggcacgtgacggagacccct

SEQ ID NO: 68669 - DNA, 20 bp, human
ggcctactcctggcacgtga

SEQ ID NO: 68670 - DNA, 20 bp, human
gggccagaaagaaggagcga

SEQ ID NO: 68671 - DNA, 20 bp, human
ggtttcggacagggtcggtc

SEQ ID NO: 68672 - DNA, 20 bp, human
ggaagggtttcggacagggt

SEQ ID NO: 68673 - DNA, 20 bp, human
gagcaaagccactcgggagt

SEQ ID NO: 68674 - DNA, 20 bp, human
gacacatccggccagaaaga

SEQ ID NO: 68675 - DNA, 20 bp, human
gacaggaagggtttcggaca

SEQ ID NO: 68676 - DNA, 20 bp, human
gtctttgaggccgacgctag

SEQ ID NO: 68677 - DNA, 20 bp, human
gaccgaggtactgctccggc

SEQ ID NO: 68678 - DNA, 20 bp, human
gcgacgctaggggcccggaa

SEQ ID NO: 68679 - DNA, 20 bp, human
ggcccggaagggaaactgcg

SEQ ID NO: 68680 - DNA, 20 bp, human
ggccagccggagcagtacct

SEQ ID NO: 68681 - DNA, 20 bp, human
gctgcgaggcgaaggtgacc

SEQ ID NO: 68682 - DNA, 20 bp, human
gggggaccgaggtactgctc

SEQ ID NO: 68683 - DNA, 20 bp, human
gaagggaaactgcgaggcga

SEQ ID NO: 68684 - DNA, 20 bp, human
ggcccttgcccgcctgacca

SEQ ID NO: 68685 - DNA, 20 bp, human
ggcggcacaaggccctggtc

SEQ ID NO: 68686 - DNA, 20 bp, human
ggccagttcgagaactgctg

SEQ ID NO: 68687 - DNA, 20 bp, human
ggatcagaggcgaagctcgg

SEQ ID NO: 68688 - DNA, 20 bp, human
gacccgcgctctctgatcag

SEQ ID NO: 68689 - DNA, 20 bp, human
gttcgagaactgctgcggag

SEQ ID NO: 68690 - DNA, 20 bp, human
ggagaggccgagtgccgccc

SEQ ID NO: 68691 - DNA, 20 bp, human
gtcggaatgcttggcccggg

SEQ ID NO: 68692 - DNA, 20 bp, human
ggctcggaggtactggagtg

SEQ ID NO: 68693 - DNA, 20 bp, human
gaggcgaagctcggaggtac

SEQ ID NO: 68694 - DNA, 20 bp, human
gtgctgggatgaagtcttcc

SEQ ID NO: 68695 - DNA, 20 bp, human
ggcccgcgagctgccaagca

SEQ ID NO: 68696 - DNA, 20 bp, human
gaggcactgctcaaatccag

SEQ ID NO: 68697 - DNA, 20 bp, human
gctgccgcatcaggtgagag

SEQ ID NO: 68698 - DNA, 20 bp, human
gccacccctctcacctgatg

SEQ ID NO: 68699 - DNA, 20 bp, human
ggagcagtgcctcggagcag

SEQ ID NO: 68700 - DNA, 20 bp, human
gacccagcctagccccccca

SEQ ID NO: 68701 - DNA, 20 bp, human
gttggctcatctctgatcca

SEQ ID NO: 68702 - DNA, 20 bp, human
gtgagaggggtggccctggg

SEQ ID NO: 68703 - DNA, 20 bp, human
gatgcgtgggcaggcttcgg

SEQ ID NO: 68704 - DNA, 20 bp, human
ggagggatatctgccgcatc

SEQ ID NO: 68705 - DNA, 20 bp, human
gctgggctgggtgtttgctc

SEQ ID NO: 68706 - DNA, 20 bp, human
gaggatgagcctgaacctag

SEQ ID NO: 68707 - DNA, 20 bp, human
ggagcccgaacataacagga

SEQ ID NO: 68708 - DNA, 20 bp, human
gaggacccctgcggcctgac

SEQ ID NO: 68709 - DNA, 20 bp, human
gtgacgctggagatggacgc

SEQ ID NO: 68710 - DNA, 20 bp, human
gcctccccgcgggtcctgag

SEQ ID NO: 68711 - DNA, 20 bp, human
gtgggcagcctaggttggga

SEQ ID NO: 68712 - DNA, 20 bp, human
gggtctgggcagcctaggtt

SEQ ID NO: 68713 - DNA, 20 bp, human
gggctggaaggaggacaccg

SEQ ID NO: 68714 - DNA, 20 bp, human
gctcaggcaggcagcaccgt

SEQ ID NO: 68715 - DNA, 20 bp, human
gagcgagccgaaggggctgg

SEQ ID NO: 68716 - DNA, 20 bp, human
gagatagccaaggcttactg

SEQ ID NO: 68717 - DNA, 20 bp, human
gggcttactgaggctggtgg

SEQ ID NO: 68718 - DNA, 20 bp, human
gcaaggcttactgaggctgg

SEQ ID NO: 68719 - DNA, 20 bp, human
gggtggagggagccactgct

SEQ ID NO: 68720 - DNA, 20 bp, human
gctcaacacgcagaagacgt

SEQ ID NO: 68721 - DNA, 20 bp, human
ggaattggtgaggcaaagtc

SEQ ID NO: 68722 - DNA, 20 bp, human
gagccaaggcttactgaggc

SEQ ID NO: 68723 - DNA, 20 bp, human
gctttgcctcaccaattctg

SEQ ID NO: 68724 - DNA, 20 bp, human
gattctgaggcactgtcttg

SEQ ID NO: 68725 - DNA, 20 bp, human
gtagggagggactctagagc

SEQ ID NO: 68726 - DNA, 20 bp, human
ggcagaagcacaggccgggt

SEQ ID NO: 68727 - DNA, 20 bp, human
gttggcagctgtgcccggag

SEQ ID NO: 68728 - DNA, 20 bp, human
gtggaccctggaggcctctc

SEQ ID NO: 68729 - DNA, 20 bp, human
ggatcaacctcagggaggat

SEQ ID NO: 68730 - DNA, 20 bp, human
gcttgggacagcagaagcac

SEQ ID NO: 68731 - DNA, 20 bp, human
gcaccaccaacccactgtgg

SEQ ID NO: 68732 - DNA, 20 bp, human
gaaagctccaatcctccctg

SEQ ID NO: 68733 - DNA, 20 bp, human
gtcttatctaagatcaacat

SEQ ID NO: 68734 - DNA, 20 bp, human
gtaaaagatcaacctcaggg

SEQ ID NO: 68735 - DNA, 20 bp, human
gcatatgttgctgggactaa

SEQ ID NO: 68736 - DNA, 20 bp, human
gagaggcgaacgaggtccag

SEQ ID NO: 68737 - DNA, 20 bp, human
gccagtgtgaggttgaaccc

SEQ ID NO: 68738 - DNA, 20 bp, human
ggtccaggtcggccagtgtg

SEQ ID NO: 68739 - DNA, 20 bp, human
ggacgcccagcgaagagccg

SEQ ID NO: 68740 - DNA, 20 bp, human
ggagagctgcacctacgcca

SEQ ID NO: 68741 - DNA, 20 bp, human
ggaagcatcccagtccaggt

SEQ ID NO: 68742 - DNA, 20 bp, human
gggaggtcgccgaagttcca

SEQ ID NO: 68743 - DNA, 20 bp, human
gcaccaccttggcccggagt

SEQ ID NO: 68744 - DNA, 20 bp, human
gcaaggtggtggtcaccaag

SEQ ID NO: 68745 - DNA, 20 bp, human
gtgaaccccggctcttcgct

SEQ ID NO: 68746 - DNA, 20 bp, human
ggtgtgcgcgagggcaagtc

SEQ ID NO: 68747 - DNA, 20 bp, human
gcgggctgctgggtgttgat

SEQ ID NO: 68748 - DNA, 20 bp, human
gacagcggctccaagttccg

SEQ ID NO: 68749 - DNA, 20 bp, human
gctcggagagtgtgagacac

SEQ ID NO: 68750 - DNA, 20 bp, human
gcgcgagggcaagtcgggag

SEQ ID NO: 68751 - DNA, 20 bp, human
gagtgaggccgcggaggcag

SEQ ID NO: 68752 - DNA, 20 bp, human
gggctgggaaggtcccgggt

SEQ ID NO: 68753 - DNA, 20 bp, human
ggccaggagccggtcacgac

SEQ ID NO: 68754 - DNA, 20 bp, human
ggggaactcgtacgacgtag

SEQ ID NO: 68755 - DNA, 20 bp, human
ggagccgctgtagagcaggc

SEQ ID NO: 68756 - DNA, 20 bp, human
gggggcgcccgagtagaagg

SEQ ID NO: 68757 - DNA, 20 bp, human
gcggctccgcagcctctcct

SEQ ID NO: 68758 - DNA, 20 bp, human
gcgggtgaggatgtaaagtg

SEQ ID NO: 68759 - DNA, 20 bp, human
gcggccagcctgaggggcgg

SEQ ID NO: 68760 - DNA, 20 bp, human
gctcaggcgctggtgttctg

SEQ ID NO: 68761 - DNA, 20 bp, human
ggccggggcgcccgagtaga

SEQ ID NO: 68762 - DNA, 20 bp, human
gccgcgctgcgcggtctggg

SEQ ID NO: 68763 - DNA, 20 bp, human
ggcttccaaggcccccagag

SEQ ID NO: 68764 - DNA, 20 bp, human
ggcggtcccggccagcctga

SEQ ID NO: 68765 - DNA, 20 bp, human
ggttccgcacggtaagatgg

SEQ ID NO: 68766 - DNA, 20 bp, human
gtgtagcccagagaaggctc

SEQ ID NO: 68767 - DNA, 20 bp, human
gagaaggctcaggaggtaga

SEQ ID NO: 68768 - DNA, 20 bp, human
gttgcaaatcgcggtacctg

SEQ ID NO: 68769 - DNA, 20 bp, human
ggtctatgtctctcatccac

SEQ ID NO: 68770 - DNA, 20 bp, human
gtgtgacctctgacactgag

SEQ ID NO: 68771 - DNA, 20 bp, human
gatattccacttgcaaatcg

SEQ ID NO: 68772 - DNA, 20 bp, human
gccttctctgggctacagct

SEQ ID NO: 68773 - DNA, 20 bp, human
gttcaaccactcagtgtcag

SEQ ID NO: 68774 - DNA, 20 bp, human
gtgaaaatagcaatcactat

SEQ ID NO: 68775 - DNA, 20 bp, human
ggaacttatgctattaagtc

SEQ ID NO: 68776 - DNA, 20 bp, human
gcgagggcccaggaagaccg

SEQ ID NO: 68777 - DNA, 20 bp, human
ggctaacactgtgggaacca

SEQ ID NO: 68778 - DNA, 20 bp, human
gtcagggacgctaacactgt

SEQ ID NO: 68779 - DNA, 20 bp, human
ggtggcaactaggtcagtgt

SEQ ID NO: 68780 - DNA, 20 bp, human
gccggggaaggacagcaaca

SEQ ID NO: 68781 - DNA, 20 bp, human
gcactctcagaaggggatgg

SEQ ID NO: 68782 - DNA, 20 bp, human
gatcaagctggcctcggggt

SEQ ID NO: 68783 - DNA, 20 bp, human
ggcaactaggtcagtgttgg

SEQ ID NO: 68784 - DNA, 20 bp, human
ggggtctgagtccctgggca

SEQ ID NO: 68785 - DNA, 20 bp, human
gttgcaccaaagtggcaact

SEQ ID NO: 68786 - DNA, 20 bp, human
gctatcctcacagcaggaag

SEQ ID NO: 68787 - DNA, 20 bp, human
gaggctggctgaggtgtccg

SEQ ID NO: 68788 - DNA, 20 bp, human
gccatggcccgccttctggg

SEQ ID NO: 68789 - DNA, 20 bp, human
gctggctgaggtgtccgggg

SEQ ID NO: 68790 - DNA, 20 bp, human
gtgagcagctcctgtcactg

SEQ ID NO: 68791 - DNA, 20 bp, human
gcaggcaggacaggtccacg

SEQ ID NO: 68792 - DNA, 20 bp, human
ggagctgctcacaacaggtc

SEQ ID NO: 68793 - DNA, 20 bp, human
gcacccactatcctcacagc

SEQ ID NO: 68794 - DNA, 20 bp, human
gctgctcacaacaggtctgg

SEQ ID NO: 68795 - DNA, 20 bp, human
ggccttctggggggtaagta

SEQ ID NO: 68796 - DNA, 20 bp, human
ggcaggggagcgacacggaa

SEQ ID NO: 68797 - DNA, 20 bp, human
gggcttgggccgtcaggcga

SEQ ID NO: 68798 - DNA, 20 bp, human
ggccgggcaggggagcgaca

SEQ ID NO: 68799 - DNA, 20 bp, human
gtcaggcgacgggacaggtc

SEQ ID NO: 68800 - DNA, 20 bp, human
gcggcttgctcggagctgga

SEQ ID NO: 68801 - DNA, 20 bp, human
gcggaacggctggttacctg

SEQ ID NO: 68802 - DNA, 20 bp, human
gttgcgaggggagccgaaca

SEQ ID NO: 68803 - DNA, 20 bp, human
gcggctggttacctgcggtc

SEQ ID NO: 68804 - DNA, 20 bp, human
gggagccgaacaaggcagga

SEQ ID NO: 68805 - DNA, 20 bp, human
gcatgcggccgggccagctc

SEQ ID NO: 68806 - DNA, 20 bp, human
gcatgcaggcgagcaagatc

SEQ ID NO: 68807 - DNA, 20 bp, human
ggagcacacacgttcttggt

SEQ ID NO: 68808 - DNA, 20 bp, human
gcttcggctgtgagtgcaga

SEQ ID NO: 68809 - DNA, 20 bp, human
gcaagctccctattgagcaa

SEQ ID NO: 68810 - DNA, 20 bp, human
gcaacctgctgctttccctt

SEQ ID NO: 68811 - DNA, 20 bp, human
gtactttgttaagggaatgt

SEQ ID NO: 68812 - DNA, 20 bp, human
ggtttcctctcggcacacgg

SEQ ID NO: 68813 - DNA, 20 bp, human
gatttcctccgtgtgccgag

SEQ ID NO: 68814 - DNA, 20 bp, human
ggcaagatctggaacaatca

SEQ ID NO: 68815 - DNA, 20 bp, human
gagggtgggccccatggtta

SEQ ID NO: 68816 - DNA, 20 bp, human
gcatgcaggcgagcaagatc

SEQ ID NO: 68817 - DNA, 20 bp, human
ggagcacacacgttcttggt

SEQ ID NO: 68818 - DNA, 20 bp, human
gcttcggctgtgagtgcaga

SEQ ID NO: 68819 - DNA, 20 bp, human
gcaagctccctattgagcaa

SEQ ID NO: 68820 - DNA, 20 bp, human
gcaacctgctgctttccctt

SEQ ID NO: 68821 - DNA, 20 bp, human
gtactttgttaagggaatgt

SEQ ID NO: 68822 - DNA, 20 bp, human
ggtttcctctcggcacacgg

SEQ ID NO: 68823 - DNA, 20 bp, human
gatttcctccgtgtgccgag

SEQ ID NO: 68824 - DNA, 20 bp, human
ggcaagatctggaacaatca

SEQ ID NO: 68825 - DNA, 20 bp, human
gagggtgggccccatggtta

SEQ ID NO: 68826 - DNA, 20 bp, human
ggcaagggcttcataaccag

SEQ ID NO: 68827 - DNA, 20 bp, human
gaagacaacaggactgaaca

SEQ ID NO: 68828 - DNA, 20 bp, human
gactatggagtgagaaatat

SEQ ID NO: 68829 - DNA, 20 bp, human
gtgcaatgtaggaactacta

SEQ ID NO: 68830 - DNA, 20 bp, human
gctggctccacttaaggaaa

SEQ ID NO: 68831 - DNA, 20 bp, human
gtcataaccaggggctgttg

SEQ ID NO: 68832 - DNA, 20 bp, human
gagagaggaagaagaccgac

SEQ ID NO: 68833 - DNA, 20 bp, human
ggtaaaaccgagactccagt

SEQ ID NO: 68834 - DNA, 20 bp, human
ggaatttgggcattaatcgg

SEQ ID NO: 68835 - DNA, 20 bp, human
gtctcttgcttaaatctggc

SEQ ID NO: 68836 - DNA, 20 bp, human
gtgtgtgcaaaatcagagag

SEQ ID NO: 68837 - DNA, 20 bp, human
ggagcagcaatctctggaag

SEQ ID NO: 68838 - DNA, 20 bp, human
ggcacccaggtcaggattgg

SEQ ID NO: 68839 - DNA, 20 bp, human
gactgcacccaggtcaggat

SEQ ID NO: 68840 - DNA, 20 bp, human
gctggtgggaagaggaacat

SEQ ID NO: 68841 - DNA, 20 bp, human
gaagggaataggggtgtgtg

SEQ ID NO: 68842 - DNA, 20 bp, human
ggaagaggcattgatttgta

SEQ ID NO: 68843 - DNA, 20 bp, human
gaggggcacagctccatatg

SEQ ID NO: 68844 - DNA, 20 bp, human
gcaaagactgcacccaggtc

SEQ ID NO: 68845 - DNA, 20 bp, human
ggaacattgggatgtgtaag

SEQ ID NO: 68846 - DNA, 20 bp, human
ggaactgatcctctcatcag

SEQ ID NO: 68847 - DNA, 20 bp, human
gcatctgtcccactgatgag

SEQ ID NO: 68848 - DNA, 20 bp, human
gtgttgtgccctgtcctcca

SEQ ID NO: 68849 - DNA, 20 bp, human
gcagcgaacccagaagtgag

SEQ ID NO: 68850 - DNA, 20 bp, human
ggatctccatgaaactctca

SEQ ID NO: 68851 - DNA, 20 bp, human
gatgaaactctcagggagta

SEQ ID NO: 68852 - DNA, 20 bp, human
ggaagctcccagagggtgat

SEQ ID NO: 68853 - DNA, 20 bp, human
gagggtgtcctagtccgcag

SEQ ID NO: 68854 - DNA, 20 bp, human
gctgttcacagggctgaggg

SEQ ID NO: 68855 - DNA, 20 bp, human
gcagcccagtcccaggacag

SEQ ID NO: 68856 - DNA, 20 bp, human
gccacgcactctcacggagg

SEQ ID NO: 68857 - DNA, 20 bp, human
gcggccacgcactctcacgg

SEQ ID NO: 68858 - DNA, 20 bp, human
ggagcagtgtccgctggaga

SEQ ID NO: 68859 - DNA, 20 bp, human
gcagctcacaggcaagagaa

SEQ ID NO: 68860 - DNA, 20 bp, human
gtacctctgcaccagctcac

SEQ ID NO: 68861 - DNA, 20 bp, human
ggagctgtgaccaacacgtc

SEQ ID NO: 68862 - DNA, 20 bp, human
gtcccggccacgcactctca

SEQ ID NO: 68863 - DNA, 20 bp, human
gaagggaggataccagtggt

SEQ ID NO: 68864 - DNA, 20 bp, human
gggccgggagaccagaaacg

SEQ ID NO: 68865 - DNA, 20 bp, human
gagcctcggaagtagaaaaa

SEQ ID NO: 68866 - DNA, 20 bp, human
ggaagagggacttagacagg

SEQ ID NO: 68867 - DNA, 20 bp, human
gcatagaaggtgctgtggga

SEQ ID NO: 68868 - DNA, 20 bp, human
gtaagaagagggacttagac

SEQ ID NO: 68869 - DNA, 20 bp, human
ggtacccagatcactcatgg

SEQ ID NO: 68870 - DNA, 20 bp, human
gggggtacccagatcactca

SEQ ID NO: 68871 - DNA, 20 bp, human
gactgcatagaaggtgctgt

SEQ ID NO: 68872 - DNA, 20 bp, human
ggtggactctgcccttagga

SEQ ID NO: 68873 - DNA, 20 bp, human
gagtgccttgtccctcctaa

SEQ ID NO: 68874 - DNA, 20 bp, human
gaaccttcataagaaattaa

SEQ ID NO: 68875 - DNA, 20 bp, human
gtagtgcaccctccactcac

SEQ ID NO: 68876 - DNA, 20 bp, human
gagcagctgctggtccccca

SEQ ID NO: 68877 - DNA, 20 bp, human
gcggcgtcccacagtctccg

SEQ ID NO: 68878 - DNA, 20 bp, human
gcctcctgccaggaagacca

SEQ ID NO: 68879 - DNA, 20 bp, human
gggacgccgtgggaccccat

SEQ ID NO: 68880 - DNA, 20 bp, human
gcgtgtcccatggggtccca

SEQ ID NO: 68881 - DNA, 20 bp, human
gggcataaatgcagtcggag

SEQ ID NO: 68882 - DNA, 20 bp, human
gtgcggagcctcggagactg

SEQ ID NO: 68883 - DNA, 20 bp, human
gatccctccatctctcacct

SEQ ID NO: 68884 - DNA, 20 bp, human
ggacagcagaggcttggcca

SEQ ID NO: 68885 - DNA, 20 bp, human
gcagaagggctgcaagaaca

SEQ ID NO: 68886 - DNA, 20 bp, human
gggctctggcacatcacttc

SEQ ID NO: 68887 - DNA, 20 bp, human
gctgaaccaggagtgcaagg

SEQ ID NO: 68888 - DNA, 20 bp, human
ggtgaaacaggaagtcaaag

SEQ ID NO: 68889 - DNA, 20 bp, human
gcacatcacttcgggcaagg

SEQ ID NO: 68890 - DNA, 20 bp, human
ggcctgctgtgtggataacc

SEQ ID NO: 68891 - DNA, 20 bp, human
gtctctgaaccaggagtgca

SEQ ID NO: 68892 - DNA, 20 bp, human
gttgagatattaaacttcag

SEQ ID NO: 68893 - DNA, 20 bp, human
gtccaggttatccacacagc

SEQ ID NO: 68894 - DNA, 20 bp, human
ggattgggttcctctgaagg

SEQ ID NO: 68895 - DNA, 20 bp, human
gagcaagaagtatgtgaaac

SEQ ID NO: 68896 - DNA, 20 bp, human
ggcgcgagataaatcacgag

SEQ ID NO: 68897 - DNA, 20 bp, human
ggaacgaccactcaccgagg

SEQ ID NO: 68898 - DNA, 20 bp, human
gccagaacgaccactcaccg

SEQ ID NO: 68899 - DNA, 20 bp, human
gcaaggccctcctatctcaa

SEQ ID NO: 68900 - DNA, 20 bp, human
gttaggaccacctcggtgag

SEQ ID NO: 68901 - DNA, 20 bp, human
gtatctcgcgctgccggaag

SEQ ID NO: 68902 - DNA, 20 bp, human
gactacccgggtcctttaga

SEQ ID NO: 68903 - DNA, 20 bp, human
gacccgggtagttccgcttc

SEQ ID NO: 68904 - DNA, 20 bp, human
gtgccggaagcggaactacc

SEQ ID NO: 68905 - DNA, 20 bp, human
ggcgcaagcgcctttgagat

SEQ ID NO: 68906 - DNA, 20 bp, human
gcctccatcttggacaaccc

SEQ ID NO: 68907 - DNA, 20 bp, human
ggccggagggcgagcgaccc

SEQ ID NO: 68908 - DNA, 20 bp, human
gacgaacagcaggagccgga

SEQ ID NO: 68909 - DNA, 20 bp, human
ggatggagggcgctccaccg

SEQ ID NO: 68910 - DNA, 20 bp, human
ggccggcgcgcgacctgacg

SEQ ID NO: 68911 - DNA, 20 bp, human
gctgcccgggttgtccaaga

SEQ ID NO: 68912 - DNA, 20 bp, human
gctccacaccgactctccgg

SEQ ID NO: 68913 - DNA, 20 bp, human
gattacgaaggcctgatcac

SEQ ID NO: 68914 - DNA, 20 bp, human
ggtccggagccccacaggta

SEQ ID NO: 68915 - DNA, 20 bp, human
gggccgccggagagtcggtg

SEQ ID NO: 68916 - DNA, 20 bp, human
ggcgccaaagcgcggagcgg

SEQ ID NO: 68917 - DNA, 20 bp, human
gagacttggacggggcatgc

SEQ ID NO: 68918 - DNA, 20 bp, human
ggctgtaggactagaacgaa

SEQ ID NO: 68919 - DNA, 20 bp, human
ggactagaacgaaaggagtg

SEQ ID NO: 68920 - DNA, 20 bp, human
gctgccttcaacgtgagggg

SEQ ID NO: 68921 - DNA, 20 bp, human
gagagcccagggcccaacgc

SEQ ID NO: 68922 - DNA, 20 bp, human
ggctgcatcgcgcgcccgaa

SEQ ID NO: 68923 - DNA, 20 bp, human
gtggcgtgagagctggtggt

SEQ ID NO: 68924 - DNA, 20 bp, human
gtcacgccaaaatggtatct

SEQ ID NO: 68925 - DNA, 20 bp, human
ggggcgggtagacttggacg

SEQ ID NO: 68926 - DNA, 20 bp, human
gacctcggcagcgtccatgg

SEQ ID NO: 68927 - DNA, 20 bp, human
gcgccgtggcgggaaaacgg

SEQ ID NO: 68928 - DNA, 20 bp, human
gtcggcgaggaattcgacct

SEQ ID NO: 68929 - DNA, 20 bp, human
gagagcctcacggtctcctc

SEQ ID NO: 68930 - DNA, 20 bp, human
gtctcctccgggacgctgag

SEQ ID NO: 68931 - DNA, 20 bp, human
gtcgacctcggcagcgtcca

SEQ ID NO: 68932 - DNA, 20 bp, human
gctcgggcccctcagcgtcc

SEQ ID NO: 68933 - DNA, 20 bp, human
gcccaggcctcaccccgatg

SEQ ID NO: 68934 - DNA, 20 bp, human
gcgtcccggaggagacgccg

SEQ ID NO: 68935 - DNA, 20 bp, human
gccgaacgcccgggtttaca

SEQ ID NO: 68936 - DNA, 20 bp, human
gagactgggcaggatggttg

SEQ ID NO: 68937 - DNA, 20 bp, human
ggaggagcctcaggagttag

SEQ ID NO: 68938 - DNA, 20 bp, human
gagacggggaagcggagact

SEQ ID NO: 68939 - DNA, 20 bp, human
ggttaggggtgtacaagacg

SEQ ID NO: 68940 - DNA, 20 bp, human
gagggcagcgcgccccgatg

SEQ ID NO: 68941 - DNA, 20 bp, human
gtgtacacccctaactcctg

SEQ ID NO: 68942 - DNA, 20 bp, human
ggccctgggacgccgcatcg

SEQ ID NO: 68943 - DNA, 20 bp, human
gatggttggggtcaggaaag

SEQ ID NO: 68944 - DNA, 20 bp, human
gttccactcgcgtgattcgg

SEQ ID NO: 68945 - DNA, 20 bp, human
gcaagtggccgccatgtcag

SEQ ID NO: 68946 - DNA, 20 bp, human
ggcgtcgaatgggacctctg

SEQ ID NO: 68947 - DNA, 20 bp, human
ggtaaggacggggcgttcgt

SEQ ID NO: 68948 - DNA, 20 bp, human
ggttcgtggggacgcagtcg

SEQ ID NO: 68949 - DNA, 20 bp, human
gagaagttgcagggttgagt

SEQ ID NO: 68950 - DNA, 20 bp, human
gcgggagctgagaagttgca

SEQ ID NO: 68951 - DNA, 20 bp, human
ggcagccggcggtaaggacg

SEQ ID NO: 68952 - DNA, 20 bp, human
ggaccagtcggcgatcccaa

SEQ ID NO: 68953 - DNA, 20 bp, human
gcgatcccaaaggcctaagg

SEQ ID NO: 68954 - DNA, 20 bp, human
gtccacagcagccggcggta

SEQ ID NO: 68955 - DNA, 20 bp, human
gaactgctcaaggacttgcc

SEQ ID NO: 68956 - DNA, 20 bp, human
gtccagaagaaggacagata

SEQ ID NO: 68957 - DNA, 20 bp, human
gcggttctaggtactcggga

SEQ ID NO: 68958 - DNA, 20 bp, human
gggaagtctggtaagagaag

SEQ ID NO: 68959 - DNA, 20 bp, human
gttccagctcttccagaaga

SEQ ID NO: 68960 - DNA, 20 bp, human
gctcagaaggtccagaaatc

SEQ ID NO: 68961 - DNA, 20 bp, human
ggtgagaagatagtcaggtg

SEQ ID NO: 68962 - DNA, 20 bp, human
ggtccttcttctggaagagc

SEQ ID NO: 68963 - DNA, 20 bp, human
ggagatgtgagaagatagtc

SEQ ID NO: 68964 - DNA, 20 bp, human
gcttctcacatctcatatag

SEQ ID NO: 68965 - DNA, 20 bp, human
ggagatgacccgagagcaga

SEQ ID NO: 68966 - DNA, 20 bp, human
gtcagacgcggttagctcag

SEQ ID NO: 68967 - DNA, 20 bp, human
gctgcgggagaggcccggtc

SEQ ID NO: 68968 - DNA, 20 bp, human
gggccgagccgggtgcgcac

SEQ ID NO: 68969 - DNA, 20 bp, human
gcctccgcaaactccagacc

SEQ ID NO: 68970 - DNA, 20 bp, human
gtggacgcgactggaggtct

SEQ ID NO: 68971 - DNA, 20 bp, human
ggcgccgtggacgcgactgg

SEQ ID NO: 68972 - DNA, 20 bp, human
gagtttgcggagggccgagc

SEQ ID NO: 68973 - DNA, 20 bp, human
gcgccgctgcgggagaggcc

SEQ ID NO: 68974 - DNA, 20 bp, human
gaggcccggtctggagtttg

SEQ ID NO: 68975 - DNA, 20 bp, human
gaccgcgtctgaaccctcca

SEQ ID NO: 68976 - DNA, 20 bp, human
gtcttcccccgcagcttcag

SEQ ID NO: 68977 - DNA, 20 bp, human
ggatgcccctgaagctgcgg

SEQ ID NO: 68978 - DNA, 20 bp, human
gggcggacggcagcgcaggt

SEQ ID NO: 68979 - DNA, 20 bp, human
ggcttcaggggcatcttgca

SEQ ID NO: 68980 - DNA, 20 bp, human
ggccagatctcggagcaagg

SEQ ID NO: 68981 - DNA, 20 bp, human
ggccgtgttgagtccgccgg

SEQ ID NO: 68982 - DNA, 20 bp, human
gggtagtgccacgggccgag

SEQ ID NO: 68983 - DNA, 20 bp, human
ggcaaagtccgaggcgccgg

SEQ ID NO: 68984 - DNA, 20 bp, human
ggaagcgcggctgccattgg

SEQ ID NO: 68985 - DNA, 20 bp, human
gtcccccgggacgcccccgg

SEQ ID NO: 68986 - DNA, 20 bp, human
gtggcgcacgggagccccac

SEQ ID NO: 68987 - DNA, 20 bp, human
ggccccacgggcaagatcga

SEQ ID NO: 68988 - DNA, 20 bp, human
gcaggaagcggcggatccgg

SEQ ID NO: 68989 - DNA, 20 bp, human
gcacgctctgcgcaaaagat

SEQ ID NO: 68990 - DNA, 20 bp, human
ggtggcaccccgggatctga

SEQ ID NO: 68991 - DNA, 20 bp, human
ggcgtgcaaagggggcccct

SEQ ID NO: 68992 - DNA, 20 bp, human
gcggggtgccacactcccag

SEQ ID NO: 68993 - DNA, 20 bp, human
gctccatggcgggagaagtt

SEQ ID NO: 68994 - DNA, 20 bp, human
ggatcgcgcccaccgaggta

SEQ ID NO: 68995 - DNA, 20 bp, human
ggaaccccccaaccccacgg

SEQ ID NO: 68996 - DNA, 20 bp, human
ggcctcagaaggacagacaa

SEQ ID NO: 68997 - DNA, 20 bp, human
ggctgcaggagcaagtgacc

SEQ ID NO: 68998 - DNA, 20 bp, human
gtgagaggcgcagagacgga

SEQ ID NO: 68999 - DNA, 20 bp, human
gggctccacgtagagaaaga

SEQ ID NO: 69000 - DNA, 20 bp, human
ggacttgagaggtcaagggg

SEQ ID NO: 69001 - DNA, 20 bp, human
ggcctccaactgccttgtct

SEQ ID NO: 69002 - DNA, 20 bp, human
gaagtgaccaggagcaggac

SEQ ID NO: 69003 - DNA, 20 bp, human
gtctcaggtcgagcctcaga

SEQ ID NO: 69004 - DNA, 20 bp, human
ggagaaagagacgcagatgt

SEQ ID NO: 69005 - DNA, 20 bp, human
gtctctacgtggagccgcgg

SEQ ID NO: 69006 - DNA, 20 bp, human
gcaagggcgcagctccgcag

SEQ ID NO: 69007 - DNA, 20 bp, human
gcacggcctccagggagcat

SEQ ID NO: 69008 - DNA, 20 bp, human
gcggagagaggagccgcgag

SEQ ID NO: 69009 - DNA, 20 bp, human
gagagaggagccgcgagcgg

SEQ ID NO: 69010 - DNA, 20 bp, human
gaggccggccctcccgccaa

SEQ ID NO: 69011 - DNA, 20 bp, human
gcagggagcatgggcacccc

SEQ ID NO: 69012 - DNA, 20 bp, human
gcgctagtccacggcctcca

SEQ ID NO: 69013 - DNA, 20 bp, human
ggcctggcaagagcgctgtg

SEQ ID NO: 69014 - DNA, 20 bp, human
ggctgaggatgtcccgaaag

SEQ ID NO: 69015 - DNA, 20 bp, human
gggagccgcgagcggcggcg

SEQ ID NO: 69016 - DNA, 20 bp, human
gtccctgggcggccttgggg

SEQ ID NO: 69017 - DNA, 20 bp, human
gctctaacgggtcccagctg

SEQ ID NO: 69018 - DNA, 20 bp, human
gtaggacggagggaacggga

SEQ ID NO: 69019 - DNA, 20 bp, human
gaaggctgcaaggcgctgag

SEQ ID NO: 69020 - DNA, 20 bp, human
gtaacgggtcccagctgcgg

SEQ ID NO: 69021 - DNA, 20 bp, human
gctccgtcctaggccaactg

SEQ ID NO: 69022 - DNA, 20 bp, human
gtggcctaggacggagggaa

SEQ ID NO: 69023 - DNA, 20 bp, human
ggcggcgcttccgctctaac

SEQ ID NO: 69024 - DNA, 20 bp, human
gcccacctgcggggaactag

SEQ ID NO: 69025 - DNA, 20 bp, human
ggatgcagcctgacctgagg

SEQ ID NO: 69026 - DNA, 20 bp, human
gacctttccgattagaataa

SEQ ID NO: 69027 - DNA, 20 bp, human
gtcattagggggaaggcgtg

SEQ ID NO: 69028 - DNA, 20 bp, human
gtcctttattctaatcggaa

SEQ ID NO: 69029 - DNA, 20 bp, human
gttaaaactccgctgctgtt

SEQ ID NO: 69030 - DNA, 20 bp, human
ggattagtttactggatgtt

SEQ ID NO: 69031 - DNA, 20 bp, human
gttgtaatcagtaatagtct

SEQ ID NO: 69032 - DNA, 20 bp, human
gttacaaaaaagcttttacg

SEQ ID NO: 69033 - DNA, 20 bp, human
ggaataaaggattagtttac

SEQ ID NO: 69034 - DNA, 20 bp, human
gctaggtgctatcatttgtt

SEQ ID NO: 69035 - DNA, 20 bp, human
gactaatcctttattctaat

SEQ ID NO: 69036 - DNA, 20 bp, human
gttattgggtggcatcctag

SEQ ID NO: 69037 - DNA, 20 bp, human
gttccccactatggttgagt

SEQ ID NO: 69038 - DNA, 20 bp, human
gaatagatagggaactgagg

SEQ ID NO: 69039 - DNA, 20 bp, human
gggagcagcaaagaatagat

SEQ ID NO: 69040 - DNA, 20 bp, human
gcagcattcggaagatgaag

SEQ ID NO: 69041 - DNA, 20 bp, human
gctcccactcaaccatagtg

SEQ ID NO: 69042 - DNA, 20 bp, human
gcattagtctttaaccatgg

SEQ ID NO: 69043 - DNA, 20 bp, human
gcgaatgctggtacttcgtg

SEQ ID NO: 69044 - DNA, 20 bp, human
gattctccatctgggctcta

SEQ ID NO: 69045 - DNA, 20 bp, human
gtcctttcagagggacttta

SEQ ID NO: 69046 - DNA, 20 bp, human
gtcgggcgcagcgcacactg

SEQ ID NO: 69047 - DNA, 20 bp, human
ggctgcagggatggcgatca

SEQ ID NO: 69048 - DNA, 20 bp, human
gtccagacctccaggagcaa

SEQ ID NO: 69049 - DNA, 20 bp, human
gcatcaagggaagccaaacg

SEQ ID NO: 69050 - DNA, 20 bp, human
ggccttggactgtccatcaa

SEQ ID NO: 69051 - DNA, 20 bp, human
ggatggcgatcagggcgggg

SEQ ID NO: 69052 - DNA, 20 bp, human
ggcagggatggcgatcaggg

SEQ ID NO: 69053 - DNA, 20 bp, human
gcccggaccgtcaggctgta

SEQ ID NO: 69054 - DNA, 20 bp, human
gatcctgaaagaatcctagg

SEQ ID NO: 69055 - DNA, 20 bp, human
gggccaggcacaggggccga

SEQ ID NO: 69056 - DNA, 20 bp, human
gtgccgggcggcccaggtgg

SEQ ID NO: 69057 - DNA, 20 bp, human
ggcaggcaggcggtgagtcg

SEQ ID NO: 69058 - DNA, 20 bp, human
ggaattgtcattgcagggtg

SEQ ID NO: 69059 - DNA, 20 bp, human
gcacaaagttcccaaggggg

SEQ ID NO: 69060 - DNA, 20 bp, human
gcaggccacaaagttcccaa

SEQ ID NO: 69061 - DNA, 20 bp, human
ggctcccgcgggcgtcactc

SEQ ID NO: 69062 - DNA, 20 bp, human
ggcctgccgggcggcccagg

SEQ ID NO: 69063 - DNA, 20 bp, human
gccgctcgtgcggtccagca

SEQ ID NO: 69064 - DNA, 20 bp, human
gtggaggtggggacgatggc

SEQ ID NO: 69065 - DNA, 20 bp, human
gcagctttgcacttgggaag

SEQ ID NO: 69066 - DNA, 20 bp, human
gttattctggacataagggt

SEQ ID NO: 69067 - DNA, 20 bp, human
gggtgggcagatctgtgtgt

SEQ ID NO: 69068 - DNA, 20 bp, human
gggcagaggattacaacaca

SEQ ID NO: 69069 - DNA, 20 bp, human
gaggggtgaggggacatgta

SEQ ID NO: 69070 - DNA, 20 bp, human
ggctggaggaggcaatgact

SEQ ID NO: 69071 - DNA, 20 bp, human
gatgtaggggtacagaagga

SEQ ID NO: 69072 - DNA, 20 bp, human
gacatttattctggacataa

SEQ ID NO: 69073 - DNA, 20 bp, human
ggacaaaggccagatgaggg

SEQ ID NO: 69074 - DNA, 20 bp, human
ggaatggctgtgttgcaccg

SEQ ID NO: 69075 - DNA, 20 bp, human
gcatgtggacaggcaggaac

SEQ ID NO: 69076 - DNA, 20 bp, human
ggctcaagagcaaaaagcgt

SEQ ID NO: 69077 - DNA, 20 bp, human
gcccacggaaggaaagtcca

SEQ ID NO: 69078 - DNA, 20 bp, human
ggtgtgaagaagcccacgga

SEQ ID NO: 69079 - DNA, 20 bp, human
gacggaaggaaagtccaggg

SEQ ID NO: 69080 - DNA, 20 bp, human
gtggaagaggaacaactgac

SEQ ID NO: 69081 - DNA, 20 bp, human
ggggtaaggaataaactcac

SEQ ID NO: 69082 - DNA, 20 bp, human
ggactgaactccacaaaagt

SEQ ID NO: 69083 - DNA, 20 bp, human
gctgggggcatcttagaagt

SEQ ID NO: 69084 - DNA, 20 bp, human
gaagtaggctggaaccccaa

SEQ ID NO: 69085 - DNA, 20 bp, human
gtatcacaggaaatagcggg

SEQ ID NO: 69086 - DNA, 20 bp, human
gcaatacaaggagtgtccca

SEQ ID NO: 69087 - DNA, 20 bp, human
gaggaaaacttgccaataca

SEQ ID NO: 69088 - DNA, 20 bp, human
gcatgtctacaggaatccac

SEQ ID NO: 69089 - DNA, 20 bp, human
gctgagaaagaacaattggg

SEQ ID NO: 69090 - DNA, 20 bp, human
gtaattactgaatgctgtgg

SEQ ID NO: 69091 - DNA, 20 bp, human
gtaatctaagggccatatat

SEQ ID NO: 69092 - DNA, 20 bp, human
gattcagtcttgggctggga

SEQ ID NO: 69093 - DNA, 20 bp, human
gagagcacatatttctccgt

SEQ ID NO: 69094 - DNA, 20 bp, human
gttcaagttgacctaagaac

SEQ ID NO: 69095 - DNA, 20 bp, human
gaatgctgtgggggtagcgg

SEQ ID NO: 69096 - DNA, 20 bp, human
ggtgattagctctggatgtt

SEQ ID NO: 69097 - DNA, 20 bp, human
gaaagcaaggataagcagaa

SEQ ID NO: 69098 - DNA, 20 bp, human
gtattaacggtgattagctc

SEQ ID NO: 69099 - DNA, 20 bp, human
gggacatggattttagttga

SEQ ID NO: 69100 - DNA, 20 bp, human
ggatttacctaaactaagaa

SEQ ID NO: 69101 - DNA, 20 bp, human
gatctgctctataccagcaa

SEQ ID NO: 69102 - DNA, 20 bp, human
gctttttcttttgaattcta

SEQ ID NO: 69103 - DNA, 20 bp, human
gatgctgtaacttctaaaca

SEQ ID NO: 69104 - DNA, 20 bp, human
gtctgaatttgtccctttgc

SEQ ID NO: 69105 - DNA, 20 bp, human
gtagcaaatgacataaaaac

SEQ ID NO: 69106 - DNA, 20 bp, human
gagccaggtgtggcagtgac

SEQ ID NO: 69107 - DNA, 20 bp, human
gtccctgtcactgccacacc

SEQ ID NO: 69108 - DNA, 20 bp, human
gagggtttagtgggaatgtt

SEQ ID NO: 69109 - DNA, 20 bp, human
gcacagggttagggtttagt

SEQ ID NO: 69110 - DNA, 20 bp, human
gctggcttgccttgtaatca

SEQ ID NO: 69111 - DNA, 20 bp, human
gcaggcatgcacccaacacg

SEQ ID NO: 69112 - DNA, 20 bp, human
gcacagtgggccggaaatag

SEQ ID NO: 69113 - DNA, 20 bp, human
gaagacttgagggaccccct

SEQ ID NO: 69114 - DNA, 20 bp, human
gagggctgatgtggcacagt

SEQ ID NO: 69115 - DNA, 20 bp, human
gcacgcctgcagacattctc

SEQ ID NO: 69116 - DNA, 20 bp, human
gcacccagacaggtccccta

SEQ ID NO: 69117 - DNA, 20 bp, human
gcacagacatgagaccatag

SEQ ID NO: 69118 - DNA, 20 bp, human
gggcgctccccaaggtaaga

SEQ ID NO: 69119 - DNA, 20 bp, human
ggaccataggggacctgtct

SEQ ID NO: 69120 - DNA, 20 bp, human
gcagggataggcgctcccca

SEQ ID NO: 69121 - DNA, 20 bp, human
gtcaagtcaagtgagtgagg

SEQ ID NO: 69122 - DNA, 20 bp, human
ggcaagctgtcagaaagctg

SEQ ID NO: 69123 - DNA, 20 bp, human
ggggtgcgcaggcagtgcta

SEQ ID NO: 69124 - DNA, 20 bp, human
gcggttcacgccactgagca

SEQ ID NO: 69125 - DNA, 20 bp, human
ggagagccatactcggccaa

SEQ ID NO: 69126 - DNA, 20 bp, human
ggccgaggggctccgagtcg

SEQ ID NO: 69127 - DNA, 20 bp, human
gtccccgactcggagcccct

SEQ ID NO: 69128 - DNA, 20 bp, human
ggagtaccccgaagggacat

SEQ ID NO: 69129 - DNA, 20 bp, human
gtgcgctagagtaccccgaa

SEQ ID NO: 69130 - DNA, 20 bp, human
gtgggtctcggggaaccggg

SEQ ID NO: 69131 - DNA, 20 bp, human
ggcgctcctaggcgggtcct

SEQ ID NO: 69132 - DNA, 20 bp, human
gcccggcccaggacccgcct

SEQ ID NO: 69133 - DNA, 20 bp, human
ggccggggaagtggacgcga

SEQ ID NO: 69134 - DNA, 20 bp, human
gcgggaggggaaaaaggcgc

SEQ ID NO: 69135 - DNA, 20 bp, human
ggggctcctgcgctcctagg

SEQ ID NO: 69136 - DNA, 20 bp, human
ggtggctgcaaaggaggtgt

SEQ ID NO: 69137 - DNA, 20 bp, human
gcgacggcttctccatgcag

SEQ ID NO: 69138 - DNA, 20 bp, human
gccgcatcgaaggctccctg

SEQ ID NO: 69139 - DNA, 20 bp, human
gcagctgcagggcccatagc

SEQ ID NO: 69140 - DNA, 20 bp, human
gcccagaaggtccgcatcga

SEQ ID NO: 69141 - DNA, 20 bp, human
gcatagccggatgtgggaga

SEQ ID NO: 69142 - DNA, 20 bp, human
gctcgttgtggctgcaaagg

SEQ ID NO: 69143 - DNA, 20 bp, human
gcttgtgtaggtccaccaca

SEQ ID NO: 69144 - DNA, 20 bp, human
gcagggcccatagccggatg

SEQ ID NO: 69145 - DNA, 20 bp, human
gagtgaatttaaggacatcg

SEQ ID NO: 69146 - DNA, 20 bp, human
ggcagaccttgtacccacag

SEQ ID NO: 69147 - DNA, 20 bp, human
gcagcgtcgggtctaggagc

SEQ ID NO: 69148 - DNA, 20 bp, human
gaaggctccaatgagatcag

SEQ ID NO: 69149 - DNA, 20 bp, human
gagtggtgcacacagacggc

SEQ ID NO: 69150 - DNA, 20 bp, human
gacggcgggcacaccccggg

SEQ ID NO: 69151 - DNA, 20 bp, human
gactcgcggcaaactagcgt

SEQ ID NO: 69152 - DNA, 20 bp, human
gcttgtacccacagcgggaa

SEQ ID NO: 69153 - DNA, 20 bp, human
ggggagcgcctggcagcgtc

SEQ ID NO: 69154 - DNA, 20 bp, human
gctgtgccccttcccgctgt

SEQ ID NO: 69155 - DNA, 20 bp, human
gacagacggcgggcacaccc

SEQ ID NO: 69156 - DNA, 20 bp, human
ggaagggtgaggaccgaata

SEQ ID NO: 69157 - DNA, 20 bp, human
gcagctactggacccaagaa

SEQ ID NO: 69158 - DNA, 20 bp, human
ggaggctgagagcagagtca

SEQ ID NO: 69159 - DNA, 20 bp, human
gttgcctcaggacctcccgg

SEQ ID NO: 69160 - DNA, 20 bp, human
gactggacccaagaagggtg

SEQ ID NO: 69161 - DNA, 20 bp, human
gaggcacacgatgtctgaag

SEQ ID NO: 69162 - DNA, 20 bp, human
gaggacaaggaagcagctac

SEQ ID NO: 69163 - DNA, 20 bp, human
gctgcctccgggaggtcctg

SEQ ID NO: 69164 - DNA, 20 bp, human
gcaggctgtcagctgctaga

SEQ ID NO: 69165 - DNA, 20 bp, human
gttcggtcctcacccttctt

SEQ ID NO: 69166 - DNA, 20 bp, human
gctcctccccaagtagggat

SEQ ID NO: 69167 - DNA, 20 bp, human
gcaggctgggccagcacacc

SEQ ID NO: 69168 - DNA, 20 bp, human
gggagtagtcactcaggtaa

SEQ ID NO: 69169 - DNA, 20 bp, human
gtgagagcccctggggctaa

SEQ ID NO: 69170 - DNA, 20 bp, human
gcgggcaaaggtaggagcag

SEQ ID NO: 69171 - DNA, 20 bp, human
gtccccagccgggcaaaggt

SEQ ID NO: 69172 - DNA, 20 bp, human
gggtctccccagccgggcaa

SEQ ID NO: 69173 - DNA, 20 bp, human
gctaagggcggggccttcct

SEQ ID NO: 69174 - DNA, 20 bp, human
ggcatgctcagtcctgtcta

SEQ ID NO: 69175 - DNA, 20 bp, human
gccaccctgggtcctgatgg

SEQ ID NO: 69176 - DNA, 20 bp, human
gcggctgtcgggctctcgtc

SEQ ID NO: 69177 - DNA, 20 bp, human
ggtcaaaggggaccacgctg

SEQ ID NO: 69178 - DNA, 20 bp, human
gtgccagacaggagcgacag

SEQ ID NO: 69179 - DNA, 20 bp, human
gaccctctctctgtacgcag

SEQ ID NO: 69180 - DNA, 20 bp, human
gggcgcccttcgctccggct

SEQ ID NO: 69181 - DNA, 20 bp, human
gcagagagagggtccagcgc

SEQ ID NO: 69182 - DNA, 20 bp, human
gcctgcccagccggagcgaa

SEQ ID NO: 69183 - DNA, 20 bp, human
ggacaggagggtgcggatag

SEQ ID NO: 69184 - DNA, 20 bp, human
gagagagggtccagcgcggg

SEQ ID NO: 69185 - DNA, 20 bp, human
ggcgcgtggacaggagggtg

SEQ ID NO: 69186 - DNA, 20 bp, human
gcatagacctggaaccccag

SEQ ID NO: 69187 - DNA, 20 bp, human
gactaaagctgggaagacgc

SEQ ID NO: 69188 - DNA, 20 bp, human
ggtcagttcacctgccccac

SEQ ID NO: 69189 - DNA, 20 bp, human
ggtttaaaaaacaaccagtg

SEQ ID NO: 69190 - DNA, 20 bp, human
gtagtgcatgagcatagacc

SEQ ID NO: 69191 - DNA, 20 bp, human
gtctaatggccacctgccat

SEQ ID NO: 69192 - DNA, 20 bp, human
gaaacagaaatcataaccta

SEQ ID NO: 69193 - DNA, 20 bp, human
gccactgcagtgactaaagc

SEQ ID NO: 69194 - DNA, 20 bp, human
gactagatttaaatgaccct

SEQ ID NO: 69195 - DNA, 20 bp, human
gtgagggcataaccttctaa

SEQ ID NO: 69196 - DNA, 20 bp, human
ggtacagggagtccacggag

SEQ ID NO: 69197 - DNA, 20 bp, human
gccccgcgaaaggtaagcgg

SEQ ID NO: 69198 - DNA, 20 bp, human
gcgtctcgggcgaggagagg

SEQ ID NO: 69199 - DNA, 20 bp, human
gcggcttcggtggtgttgag

SEQ ID NO: 69200 - DNA, 20 bp, human
gtgcgggtacagggagtcca

SEQ ID NO: 69201 - DNA, 20 bp, human
ggactcataggggaacatgg

SEQ ID NO: 69202 - DNA, 20 bp, human
ggaggaggtgaccccgcgaa

SEQ ID NO: 69203 - DNA, 20 bp, human
gtgaccccgcgaaaggtaag

SEQ ID NO: 69204 - DNA, 20 bp, human
gaggtaagcggcggcttcgg

SEQ ID NO: 69205 - DNA, 20 bp, human
ggagcccgcaaggtgagtac

SEQ ID NO: 69206 - DNA, 20 bp, human
gatgaacccggtacctcgac

SEQ ID NO: 69207 - DNA, 20 bp, human
gatttctgcatttccagtcg

SEQ ID NO: 69208 - DNA, 20 bp, human
ggcatttccagtcgaggtac

SEQ ID NO: 69209 - DNA, 20 bp, human
gacactgggcgcaggtaagt

SEQ ID NO: 69210 - DNA, 20 bp, human
ggaccctccgaaccacgtgc

SEQ ID NO: 69211 - DNA, 20 bp, human
gctctcctagtcaaagaaaa

SEQ ID NO: 69212 - DNA, 20 bp, human
ggtctaaaaacaaaacaaga

SEQ ID NO: 69213 - DNA, 20 bp, human
gtatcccgcacgtggttcgg

SEQ ID NO: 69214 - DNA, 20 bp, human
gttatatcccgcacgtggtt

SEQ ID NO: 69215 - DNA, 20 bp, human
gaagcccgtcggaaaagcgc

SEQ ID NO: 69216 - DNA, 20 bp, human
gctgcctcggctggagactg

SEQ ID NO: 69217 - DNA, 20 bp, human
gctggagactgaggcgaagg

SEQ ID NO: 69218 - DNA, 20 bp, human
ggcgcgcctggggacaaaga

SEQ ID NO: 69219 - DNA, 20 bp, human
gactgaggcgaaggcggcag

SEQ ID NO: 69220 - DNA, 20 bp, human
ggttcccgccgagtccggag

SEQ ID NO: 69221 - DNA, 20 bp, human
ggtggatctagctagagtcg

SEQ ID NO: 69222 - DNA, 20 bp, human
ggaattgtagagcagaacct

SEQ ID NO: 69223 - DNA, 20 bp, human
gtagcggcccgctcaaactg

SEQ ID NO: 69224 - DNA, 20 bp, human
gggcgcgcggctcccaaatc

SEQ ID NO: 69225 - DNA, 20 bp, human
gcggctggagactgaggcga

SEQ ID NO: 69226 - DNA, 20 bp, human
gggcccctcaggtagtgata

SEQ ID NO: 69227 - DNA, 20 bp, human
ggcaggtggaagggctctga

SEQ ID NO: 69228 - DNA, 20 bp, human
gctgctgggggaggtactga

SEQ ID NO: 69229 - DNA, 20 bp, human
gcagctggcaagcgggaggg

SEQ ID NO: 69230 - DNA, 20 bp, human
gcaaggagtgcaccctccta

SEQ ID NO: 69231 - DNA, 20 bp, human
ggctcggccacacaccctcg

SEQ ID NO: 69232 - DNA, 20 bp, human
gccaggtggccgctgagggt

SEQ ID NO: 69233 - DNA, 20 bp, human
gcagctggctggtgtttcag

SEQ ID NO: 69234 - DNA, 20 bp, human
gcggccacacaccctcgggg

SEQ ID NO: 69235 - DNA, 20 bp, human
gcagccctatcactacctga

SEQ ID NO: 69236 - DNA, 20 bp, human
gggacacaaacatcagtgac

SEQ ID NO: 69237 - DNA, 20 bp, human
gaccgatagcctcccagtgg

SEQ ID NO: 69238 - DNA, 20 bp, human
gaggtggtactgcaacccca

SEQ ID NO: 69239 - DNA, 20 bp, human
ggccccgggaggagatcatc

SEQ ID NO: 69240 - DNA, 20 bp, human
gtcctgatgatctcctcccg

SEQ ID NO: 69241 - DNA, 20 bp, human
gggctcggcttgtcctggag

SEQ ID NO: 69242 - DNA, 20 bp, human
gccccagggctgccccctcc

SEQ ID NO: 69243 - DNA, 20 bp, human
gagaccatgtttggagtcag

SEQ ID NO: 69244 - DNA, 20 bp, human
gtccaccactgggaggctat

SEQ ID NO: 69245 - DNA, 20 bp, human
ggaaaatggtcttctcagag

SEQ ID NO: 69246 - DNA, 20 bp, human
gcccatcgctgtgcatccgg

SEQ ID NO: 69247 - DNA, 20 bp, human
gggcacctggcgctccggcg

SEQ ID NO: 69248 - DNA, 20 bp, human
gcaggggagggtccgaacac

SEQ ID NO: 69249 - DNA, 20 bp, human
ggcgcgcggagccgaatgct

SEQ ID NO: 69250 - DNA, 20 bp, human
ggatccccgagcccagcatt

SEQ ID NO: 69251 - DNA, 20 bp, human
gccgcggacgccgggacgag

SEQ ID NO: 69252 - DNA, 20 bp, human
gccgggccgcacttccagaa

SEQ ID NO: 69253 - DNA, 20 bp, human
ggagagagggcacgaacctc

SEQ ID NO: 69254 - DNA, 20 bp, human
gtgctgggctcggggatccg

SEQ ID NO: 69255 - DNA, 20 bp, human
gttggcgcggtctagagaga

SEQ ID NO: 69256 - DNA, 20 bp, human
gatcctggccaaatccgaaa

SEQ ID NO: 69257 - DNA, 20 bp, human
gaggacaggatggctgagag

SEQ ID NO: 69258 - DNA, 20 bp, human
gagtgaactcctctcagggt

SEQ ID NO: 69259 - DNA, 20 bp, human
gctgcagtgaactcctctca

SEQ ID NO: 69260 - DNA, 20 bp, human
gctcccatgggcaccaaatt

SEQ ID NO: 69261 - DNA, 20 bp, human
ggaactcctctcagggtggg

SEQ ID NO: 69262 - DNA, 20 bp, human
gcgagacgctagacccaatt

SEQ ID NO: 69263 - DNA, 20 bp, human
gcctcctaccccagcgtggt

SEQ ID NO: 69264 - DNA, 20 bp, human
ggacccaatttggtgcccat

SEQ ID NO: 69265 - DNA, 20 bp, human
ggagttcactgcagtaaaaa

SEQ ID NO: 69266 - DNA, 20 bp, human
gcggtagtgggagaccggga

SEQ ID NO: 69267 - DNA, 20 bp, human
gggcgcggtcgtagcaggtc

SEQ ID NO: 69268 - DNA, 20 bp, human
gagacgacgaacagcaccgg

SEQ ID NO: 69269 - DNA, 20 bp, human
gaagagccagaagcggtagt

SEQ ID NO: 69270 - DNA, 20 bp, human
gtgggccacctgctctggaa

SEQ ID NO: 69271 - DNA, 20 bp, human
gagcaggtctggcgacagcc

SEQ ID NO: 69272 - DNA, 20 bp, human
ggggaaggcgcggtcgtagc

SEQ ID NO: 69273 - DNA, 20 bp, human
gtgggcctcgggcagtccgg

SEQ ID NO: 69274 - DNA, 20 bp, human
gcgaagacggtcttctcggt

SEQ ID NO: 69275 - DNA, 20 bp, human
ggcggccaggcgctgctcta

SEQ ID NO: 69276 - DNA, 20 bp, human
gggtctgagccaggagtagg

SEQ ID NO: 69277 - DNA, 20 bp, human
gtaaggactcaattccacca

SEQ ID NO: 69278 - DNA, 20 bp, human
gactgcaacgtgaccatggt

SEQ ID NO: 69279 - DNA, 20 bp, human
ggcttagggccgtctcaact

SEQ ID NO: 69280 - DNA, 20 bp, human
gcacccactcccaaaagaaa

SEQ ID NO: 69281 - DNA, 20 bp, human
gcaggaatgtttcgcctcag

SEQ ID NO: 69282 - DNA, 20 bp, human
gtggagggctgtgttctcca

SEQ ID NO: 69283 - DNA, 20 bp, human
ggtggaattgagtccttaaa

SEQ ID NO: 69284 - DNA, 20 bp, human
ggacattctggaagcatgga

SEQ ID NO: 69285 - DNA, 20 bp, human
gagactcccttacatgacgg

SEQ ID NO: 69286 - DNA, 20 bp, human
gtacggactgagcttactac

SEQ ID NO: 69287 - DNA, 20 bp, human
ggtctcaggagatgttatcc

SEQ ID NO: 69288 - DNA, 20 bp, human
gagaagcaaactggcaatgt

SEQ ID NO: 69289 - DNA, 20 bp, human
gtggttgttaagatagtgta

SEQ ID NO: 69290 - DNA, 20 bp, human
ggttatcctggcattcctgt

SEQ ID NO: 69291 - DNA, 20 bp, human
gtatttcaaagggattataa

SEQ ID NO: 69292 - DNA, 20 bp, human
ggattctggcagaagcaaac

SEQ ID NO: 69293 - DNA, 20 bp, human
gcaaagggattataatggtg

SEQ ID NO: 69294 - DNA, 20 bp, human
gtaatttagagacatgtctc

SEQ ID NO: 69295 - DNA, 20 bp, human
ggaatgtaagagtttgattc

SEQ ID NO: 69296 - DNA, 20 bp, human
ggcgcggtccgagcgttcag

SEQ ID NO: 69297 - DNA, 20 bp, human
ggctgggtcacctactaatg

SEQ ID NO: 69298 - DNA, 20 bp, human
ggaagagtcaccccattagt

SEQ ID NO: 69299 - DNA, 20 bp, human
gaggctgcgcgcgggtaaag

SEQ ID NO: 69300 - DNA, 20 bp, human
ggctcggaccgcgctcgagg

SEQ ID NO: 69301 - DNA, 20 bp, human
gaacgggacctgccacactg

SEQ ID NO: 69302 - DNA, 20 bp, human
gcggccatgggggtcatgag

SEQ ID NO: 69303 - DNA, 20 bp, human
gaacgctcggaccgcgctcg

SEQ ID NO: 69304 - DNA, 20 bp, human
gaaaggggccgcctcgagcg

SEQ ID NO: 69305 - DNA, 20 bp, human
gcggcctctcatgaccccca

SEQ ID NO: 69306 - DNA, 20 bp, human
ggggctgccatgacaccagt

SEQ ID NO: 69307 - DNA, 20 bp, human
gagccgacctactggtgtca

SEQ ID NO: 69308 - DNA, 20 bp, human
gtggtgggagcggtggtcca

SEQ ID NO: 69309 - DNA, 20 bp, human
gcagctgtggggccgttggt

SEQ ID NO: 69310 - DNA, 20 bp, human
gtgccatgacaccagtaggt

SEQ ID NO: 69311 - DNA, 20 bp, human
ggtggggccgttggtgggag

SEQ ID NO: 69312 - DNA, 20 bp, human
gaccagaaagcgagtggagt

SEQ ID NO: 69313 - DNA, 20 bp, human
gaccgccgtggcctgggaaa

SEQ ID NO: 69314 - DNA, 20 bp, human
gagatcctcaacagtagtct

SEQ ID NO: 69315 - DNA, 20 bp, human
gaccgtttcccaggccacgg

SEQ ID NO: 69316 - DNA, 20 bp, human
gtgtagcgcgccctctgggt

SEQ ID NO: 69317 - DNA, 20 bp, human
gtcagccggagagcctagag

SEQ ID NO: 69318 - DNA, 20 bp, human
gatgctccagagtccccggg

SEQ ID NO: 69319 - DNA, 20 bp, human
gcgggattcagcccagacga

SEQ ID NO: 69320 - DNA, 20 bp, human
gattcagcccagacgaggga

SEQ ID NO: 69321 - DNA, 20 bp, human
gcagaacggcgcgcccagac

SEQ ID NO: 69322 - DNA, 20 bp, human
gcgccgcccggtcatagacg

SEQ ID NO: 69323 - DNA, 20 bp, human
gcccaacccgggccccaacc

SEQ ID NO: 69324 - DNA, 20 bp, human
gtccccgggcggcccaaccc

SEQ ID NO: 69325 - DNA, 20 bp, human
ggcgtccagggcggtaggtg

SEQ ID NO: 69326 - DNA, 20 bp, human
gccagcggctccggtcagtg

SEQ ID NO: 69327 - DNA, 20 bp, human
ggcagccgcgctcacctccg

SEQ ID NO: 69328 - DNA, 20 bp, human
ggcctcccgagaccccgtgg

SEQ ID NO: 69329 - DNA, 20 bp, human
gggcgacgggccccactgac

SEQ ID NO: 69330 - DNA, 20 bp, human
gtcacctccgcggtccgccc

SEQ ID NO: 69331 - DNA, 20 bp, human
gggagagcgcggctgagagc

SEQ ID NO: 69332 - DNA, 20 bp, human
gagggccgcggcccgacgct

SEQ ID NO: 69333 - DNA, 20 bp, human
ggagccttgcgccgagcgtc

SEQ ID NO: 69334 - DNA, 20 bp, human
gtcactcgagcggcccccac

SEQ ID NO: 69335 - DNA, 20 bp, human
gtccggcaccccggaggcgt

SEQ ID NO: 69336 - DNA, 20 bp, human
gtcacgaaagcagtggacag

SEQ ID NO: 69337 - DNA, 20 bp, human
gcttgtcttcacgaaagcag

SEQ ID NO: 69338 - DNA, 20 bp, human
gacagaggagtaggcaagca

SEQ ID NO: 69339 - DNA, 20 bp, human
gataagcatctctatagaga

SEQ ID NO: 69340 - DNA, 20 bp, human
gatgagaaggcttctcattc

SEQ ID NO: 69341 - DNA, 20 bp, human
gttgacagtctccaatcatt

SEQ ID NO: 69342 - DNA, 20 bp, human
gatttggtggtaaattcaaa

SEQ ID NO: 69343 - DNA, 20 bp, human
gcaatattctgagatttagg

SEQ ID NO: 69344 - DNA, 20 bp, human
ggcttcttatggccccatca

SEQ ID NO: 69345 - DNA, 20 bp, human
gttaggaggtctgcttctta

SEQ ID NO: 69346 - DNA, 20 bp, human
gcattttgcctgggagagga

SEQ ID NO: 69347 - DNA, 20 bp, human
gcatcttcaagcccatataa

SEQ ID NO: 69348 - DNA, 20 bp, human
gtaaaggatagaagctgcac

SEQ ID NO: 69349 - DNA, 20 bp, human
gttttcattttgcctgggag

SEQ ID NO: 69350 - DNA, 20 bp, human
gatgtgatatgcttagtcta

SEQ ID NO: 69351 - DNA, 20 bp, human
gctgcttcttgatactcttg

SEQ ID NO: 69352 - DNA, 20 bp, human
gcctatgaagctcataataa

SEQ ID NO: 69353 - DNA, 20 bp, human
ggcagcttctatcctttata

SEQ ID NO: 69354 - DNA, 20 bp, human
ggctcatatctaatatgcca

SEQ ID NO: 69355 - DNA, 20 bp, human
gctagataattttgatttgg

SEQ ID NO: 69356 - DNA, 20 bp, human
gcggactcccatcccaggaa

SEQ ID NO: 69357 - DNA, 20 bp, human
ggaagggtctgaatagaacc

SEQ ID NO: 69358 - DNA, 20 bp, human
gctggccggactcccatccc

SEQ ID NO: 69359 - DNA, 20 bp, human
gtggcaaggacgcctaccat

SEQ ID NO: 69360 - DNA, 20 bp, human
gcaccgtgacaatgcagctg

SEQ ID NO: 69361 - DNA, 20 bp, human
ggggctagagcactggacaa

SEQ ID NO: 69362 - DNA, 20 bp, human
gagcagcagcagagtcgggt

SEQ ID NO: 69363 - DNA, 20 bp, human
gaggaacccagaactacatc

SEQ ID NO: 69364 - DNA, 20 bp, human
ggtcacacagagaaagttta

SEQ ID NO: 69365 - DNA, 20 bp, human
gcgcagcccagatgtagttc

SEQ ID NO: 69366 - DNA, 20 bp, human
gggatgcgaaccaggaaccc

SEQ ID NO: 69367 - DNA, 20 bp, human
ggaggctggtggtcatgccg

SEQ ID NO: 69368 - DNA, 20 bp, human
ggcagcagaaccagcaacag

SEQ ID NO: 69369 - DNA, 20 bp, human
ggcaccaactgggaaagcga

SEQ ID NO: 69370 - DNA, 20 bp, human
gtggatccaagcgcaaaggg

SEQ ID NO: 69371 - DNA, 20 bp, human
ggtaacgaggtgttgagacg

SEQ ID NO: 69372 - DNA, 20 bp, human
ggcttcgcgtcacttgacta

SEQ ID NO: 69373 - DNA, 20 bp, human
gtcacttgactaaggaccca

SEQ ID NO: 69374 - DNA, 20 bp, human
gagcctcccggctctgcagt

SEQ ID NO: 69375 - DNA, 20 bp, human
ggcgggttagagggtgcctc

SEQ ID NO: 69376 - DNA, 20 bp, human
gcggcagcagcagggaacga

SEQ ID NO: 69377 - DNA, 20 bp, human
gaggagcgctgtaaacgcca

SEQ ID NO: 69378 - DNA, 20 bp, human
ggcagtagcgtcaggctgag

SEQ ID NO: 69379 - DNA, 20 bp, human
ggtccgccgtctcagactag

SEQ ID NO: 69380 - DNA, 20 bp, human
gggtcggcccaaagcacccg

SEQ ID NO: 69381 - DNA, 20 bp, human
ggcgctcctctagtctgaga

SEQ ID NO: 69382 - DNA, 20 bp, human
gctcctctagtctgagacgg

SEQ ID NO: 69383 - DNA, 20 bp, human
gtgagcgggatcagatccag

SEQ ID NO: 69384 - DNA, 20 bp, human
ggcaagagccgcggagggat

SEQ ID NO: 69385 - DNA, 20 bp, human
gcgcctggagggagcgtcga

SEQ ID NO: 69386 - DNA, 20 bp, human
gccgggctagctaggtgtag

SEQ ID NO: 69387 - DNA, 20 bp, human
gtgggcatccggaggatgtg

SEQ ID NO: 69388 - DNA, 20 bp, human
ggcaaccgctgggcatccgg

SEQ ID NO: 69389 - DNA, 20 bp, human
gaagtagagaaccctcacca

SEQ ID NO: 69390 - DNA, 20 bp, human
ggagaggctccgggctagct

SEQ ID NO: 69391 - DNA, 20 bp, human
ggaaccctcaccagggtcct

SEQ ID NO: 69392 - DNA, 20 bp, human
gtcatacctctggcgctctg

SEQ ID NO: 69393 - DNA, 20 bp, human
gtccgcgtccccacatcctc

SEQ ID NO: 69394 - DNA, 20 bp, human
gccactacccctagtctcag

SEQ ID NO: 69395 - DNA, 20 bp, human
gcggtatctcagcaaccgct

SEQ ID NO: 69396 - DNA, 20 bp, human
gctccgccggaggctccacg

SEQ ID NO: 69397 - DNA, 20 bp, human
ggaccacgtggagcctccgg

SEQ ID NO: 69398 - DNA, 20 bp, human
gcggactggagtgggaaccc

SEQ ID NO: 69399 - DNA, 20 bp, human
gtcccgcgcgcggctgagtg

SEQ ID NO: 69400 - DNA, 20 bp, human
ggctgagtgcggactggagt

SEQ ID NO: 69401 - DNA, 20 bp, human
gcgcgcggctgagtgcggac

SEQ ID NO: 69402 - DNA, 20 bp, human
ggagggctctgacggctgga

SEQ ID NO: 69403 - DNA, 20 bp, human
gcgcgggaggagagaacccg

SEQ ID NO: 69404 - DNA, 20 bp, human
ggggctgcgggcgtccacgg

SEQ ID NO: 69405 - DNA, 20 bp, human
gcgacacccggcgtgccctc

SEQ ID NO: 69406 - DNA, 20 bp, human
gacagccggctggcacaggg

SEQ ID NO: 69407 - DNA, 20 bp, human
gccggctgtcgacccaggtt

SEQ ID NO: 69408 - DNA, 20 bp, human
gacctcgggcttcctaacct

SEQ ID NO: 69409 - DNA, 20 bp, human
gacccaggttaggaagcccg

SEQ ID NO: 69410 - DNA, 20 bp, human
gagcggcgatccgtcacctg

SEQ ID NO: 69411 - DNA, 20 bp, human
ggggcacgcgccggggtggt

SEQ ID NO: 69412 - DNA, 20 bp, human
ggttaggaagcccgaggtcg

SEQ ID NO: 69413 - DNA, 20 bp, human
ggccagccggctgtcgaccc

SEQ ID NO: 69414 - DNA, 20 bp, human
ggcgatccgtcacctgagga

SEQ ID NO: 69415 - DNA, 20 bp, human
ggggcagcccgggacggcag

SEQ ID NO: 69416 - DNA, 20 bp, human
gacgccgccggccgacacgg

SEQ ID NO: 69417 - DNA, 20 bp, human
ggaggaggcagtggacatgg

SEQ ID NO: 69418 - DNA, 20 bp, human
gtgccattcggagtgaggag

SEQ ID NO: 69419 - DNA, 20 bp, human
gcggcggcgtcgggctggac

SEQ ID NO: 69420 - DNA, 20 bp, human
gtgccccgcaagagctggta

SEQ ID NO: 69421 - DNA, 20 bp, human
gggaccagggtagagagaaa

SEQ ID NO: 69422 - DNA, 20 bp, human
gacccactcctcactccgaa

SEQ ID NO: 69423 - DNA, 20 bp, human
gtgtcggccggcggcgtcca

SEQ ID NO: 69424 - DNA, 20 bp, human
ggggaggcgcgcgagcgtgt

SEQ ID NO: 69425 - DNA, 20 bp, human
ggtagagagaaagggcctcg

SEQ ID NO: 69426 - DNA, 20 bp, human
gcagctccagcctctcggca

SEQ ID NO: 69427 - DNA, 20 bp, human
gtcggtctcccggctgcgcg

SEQ ID NO: 69428 - DNA, 20 bp, human
gtcggagggcgagcagacac

SEQ ID NO: 69429 - DNA, 20 bp, human
ggcaggcgggctcctgacgg

SEQ ID NO: 69430 - DNA, 20 bp, human
ggcaaggaagcgcttgtgtg

SEQ ID NO: 69431 - DNA, 20 bp, human
ggctggagctgcggcaccgc

SEQ ID NO: 69432 - DNA, 20 bp, human
gtaacctgagcagcgtcgga

SEQ ID NO: 69433 - DNA, 20 bp, human
gcgtcgagggagatttatca

SEQ ID NO: 69434 - DNA, 20 bp, human
gctgcgcggcgctgcctggt

SEQ ID NO: 69435 - DNA, 20 bp, human
gctccccgaccgctcctcag

SEQ ID NO: 69436 - DNA, 20 bp, human
ggggcgccgcttaaagtgtg

SEQ ID NO: 69437 - DNA, 20 bp, human
ggtccttaccgccagcccca

SEQ ID NO: 69438 - DNA, 20 bp, human
gctgctccgcacactttaag

SEQ ID NO: 69439 - DNA, 20 bp, human
gggcggtaaggacctccacc

SEQ ID NO: 69440 - DNA, 20 bp, human
gcggccgactgtccagcgaa

SEQ ID NO: 69441 - DNA, 20 bp, human
ggcccctttcgctggacagt

SEQ ID NO: 69442 - DNA, 20 bp, human
gactttaagcggcgccctgg

SEQ ID NO: 69443 - DNA, 20 bp, human
ggaccttggggctggcggta

SEQ ID NO: 69444 - DNA, 20 bp, human
gacgctcgcgggcaatgaat

SEQ ID NO: 69445 - DNA, 20 bp, human
gagacactcgcgcaaagttg

SEQ ID NO: 69446 - DNA, 20 bp, human
gagcagcgccacggccgcca

SEQ ID NO: 69447 - DNA, 20 bp, human
gagcatggcccgaggcgctg

SEQ ID NO: 69448 - DNA, 20 bp, human
gaggcgctgagggaggccgt

SEQ ID NO: 69449 - DNA, 20 bp, human
ggaacagagaccccgcctac

SEQ ID NO: 69450 - DNA, 20 bp, human
gcctactccatggtgccggt

SEQ ID NO: 69451 - DNA, 20 bp, human
ggcgcatagagcatggcccg

SEQ ID NO: 69452 - DNA, 20 bp, human
gtcggccaggaaggagcgca

SEQ ID NO: 69453 - DNA, 20 bp, human
gccaggggagaagagggcgt

SEQ ID NO: 69454 - DNA, 20 bp, human
ggctctatgcgccttgggca

SEQ ID NO: 69455 - DNA, 20 bp, human
gggctctcggcgcggatatg

SEQ ID NO: 69456 - DNA, 20 bp, human
ggggcttgtttggtcagaag

SEQ ID NO: 69457 - DNA, 20 bp, human
gagaaggtttcggtcgcgag

SEQ ID NO: 69458 - DNA, 20 bp, human
ggccgccgggaaggccacac

SEQ ID NO: 69459 - DNA, 20 bp, human
ggcctgtgtggccttcccgg

SEQ ID NO: 69460 - DNA, 20 bp, human
gttcccggcggctgattcga

SEQ ID NO: 69461 - DNA, 20 bp, human
gggagaaggcgcccaactgg

SEQ ID NO: 69462 - DNA, 20 bp, human
gggagctcccctgacttcac

SEQ ID NO: 69463 - DNA, 20 bp, human
gcccagcagcgaccctcaga

SEQ ID NO: 69464 - DNA, 20 bp, human
ggaccctcagacggcatggt

SEQ ID NO: 69465 - DNA, 20 bp, human
ggcagaacgtgccaacggct

SEQ ID NO: 69466 - DNA, 20 bp, human
gcgccgcggactcaagatgg

SEQ ID NO: 69467 - DNA, 20 bp, human
gggcgtgtggacgtgtacgg

SEQ ID NO: 69468 - DNA, 20 bp, human
gggcggcgtgtggacgtgta

SEQ ID NO: 69469 - DNA, 20 bp, human
ggctcgccgcggactcaaga

SEQ ID NO: 69470 - DNA, 20 bp, human
gatgcagcgccgccgacaag

SEQ ID NO: 69471 - DNA, 20 bp, human
gaggatgttccgcttgtcgg

SEQ ID NO: 69472 - DNA, 20 bp, human
gcacacctggagcaacaacc

SEQ ID NO: 69473 - DNA, 20 bp, human
ggagtgcgtcgagctcgccg

SEQ ID NO: 69474 - DNA, 20 bp, human
ggcggaggaagagtcctgca

SEQ ID NO: 69475 - DNA, 20 bp, human
ggcccacccgccgggaaagg

SEQ ID NO: 69476 - DNA, 20 bp, human
ggcagtatagggtccctcaa

SEQ ID NO: 69477 - DNA, 20 bp, human
gatagggtccctcaagggag

SEQ ID NO: 69478 - DNA, 20 bp, human
gggggggcgtaagcagtata

SEQ ID NO: 69479 - DNA, 20 bp, human
gggaccacctgggagcagtg

SEQ ID NO: 69480 - DNA, 20 bp, human
gggcaggcgggggaccacct

SEQ ID NO: 69481 - DNA, 20 bp, human
gggtccctcaagggaggggg

SEQ ID NO: 69482 - DNA, 20 bp, human
gcctgggggtgcaataagcc

SEQ ID NO: 69483 - DNA, 20 bp, human
gggtagctggaagcaagaga

SEQ ID NO: 69484 - DNA, 20 bp, human
gagggactcatcccagaccc

SEQ ID NO: 69485 - DNA, 20 bp, human
gctcccccactgctcccagg

SEQ ID NO: 69486 - DNA, 20 bp, human
gttggcttcttgcttctcgg

SEQ ID NO: 69487 - DNA, 20 bp, human
gtgccacccaggacgatgag

SEQ ID NO: 69488 - DNA, 20 bp, human
gccccacccaccgctgtctg

SEQ ID NO: 69489 - DNA, 20 bp, human
gagctgcctcagacagcggt

SEQ ID NO: 69490 - DNA, 20 bp, human
ggtggggcctgagtactggg

SEQ ID NO: 69491 - DNA, 20 bp, human
ggccaaaagtgggatcctgg

SEQ ID NO: 69492 - DNA, 20 bp, human
gggacgatgagcggctgaga

SEQ ID NO: 69493 - DNA, 20 bp, human
gagccgctcatcgtcctggg

SEQ ID NO: 69494 - DNA, 20 bp, human
gttatggagggcgaagagga

SEQ ID NO: 69495 - DNA, 20 bp, human
gtgggtggggcctgagtact

SEQ ID NO: 69496 - DNA, 20 bp, human
gataagtgggacaccacggt

SEQ ID NO: 69497 - DNA, 20 bp, human
gtagcataagtgggacacca

SEQ ID NO: 69498 - DNA, 20 bp, human
gttgcttgccaaggggccca

SEQ ID NO: 69499 - DNA, 20 bp, human
ggctatgcccaagcccaccg

SEQ ID NO: 69500 - DNA, 20 bp, human
gggcaagcaagtgaagttcg

SEQ ID NO: 69501 - DNA, 20 bp, human
gtagctgcgactcatgccag

SEQ ID NO: 69502 - DNA, 20 bp, human
gagagcaaggtcagccgtgg

SEQ ID NO: 69503 - DNA, 20 bp, human
gagccgtgggggctaatgaa

SEQ ID NO: 69504 - DNA, 20 bp, human
gcatgccagtggcagcctga

SEQ ID NO: 69505 - DNA, 20 bp, human
gcaaagagcaaggtcagccg

SEQ ID NO: 69506 - DNA, 20 bp, human
ggagagcggcgcgggtgagt

SEQ ID NO: 69507 - DNA, 20 bp, human
gtgctcggacgcctcaccgg

SEQ ID NO: 69508 - DNA, 20 bp, human
gccggcggctctctaaatct

SEQ ID NO: 69509 - DNA, 20 bp, human
gcgggtcggactcttcggaa

SEQ ID NO: 69510 - DNA, 20 bp, human
gccttgctcggacgcctcac

SEQ ID NO: 69511 - DNA, 20 bp, human
ggagcgggacgtacctgcgg

SEQ ID NO: 69512 - DNA, 20 bp, human
gttcgagcgggacgtacctg

SEQ ID NO: 69513 - DNA, 20 bp, human
ggacgtacctgcggcggcag

SEQ ID NO: 69514 - DNA, 20 bp, human
gggaccggccggagacggat

SEQ ID NO: 69515 - DNA, 20 bp, human
gctccggccggtccgcgggt

SEQ ID NO: 69516 - DNA, 20 bp, human
gtcccgctcggaaggtgagt

SEQ ID NO: 69517 - DNA, 20 bp, human
gcgcccactcaccttccgag

SEQ ID NO: 69518 - DNA, 20 bp, human
ggaaggtgagtgggcgcggg

SEQ ID NO: 69519 - DNA, 20 bp, human
gacagagcgcgtccgcccgg

SEQ ID NO: 69520 - DNA, 20 bp, human
gccagcgccgcaccgccggg

SEQ ID NO: 69521 - DNA, 20 bp, human
gggggccggacacttccgtc

SEQ ID NO: 69522 - DNA, 20 bp, human
gcgtcctcctcccgctcgga

SEQ ID NO: 69523 - DNA, 20 bp, human
gcgattgggtccgctcccac

SEQ ID NO: 69524 - DNA, 20 bp, human
ggcggctcctcgctccggag

SEQ ID NO: 69525 - DNA, 20 bp, human
gggaagggcactcctgccag

SEQ ID NO: 69526 - DNA, 20 bp, human
gtgggtagacagagctaaac

SEQ ID NO: 69527 - DNA, 20 bp, human
ggctaggtttgcaaagctgt

SEQ ID NO: 69528 - DNA, 20 bp, human
gacactctcagaaactgcgg

SEQ ID NO: 69529 - DNA, 20 bp, human
ggccagtgatatgctataca

SEQ ID NO: 69530 - DNA, 20 bp, human
gctcaaagctgaagtcggct

SEQ ID NO: 69531 - DNA, 20 bp, human
gcttgcttataacaacagtt

SEQ ID NO: 69532 - DNA, 20 bp, human
gaccatgtatagcatatcac

SEQ ID NO: 69533 - DNA, 20 bp, human
gcataacaagttccgatcag

SEQ ID NO: 69534 - DNA, 20 bp, human
ggtgacacgcatgctttgtc

SEQ ID NO: 69535 - DNA, 20 bp, human
ggttttctcaaagctgaagt

SEQ ID NO: 69536 - DNA, 20 bp, human
gggaggagacagcccaacca

SEQ ID NO: 69537 - DNA, 20 bp, human
gtgactgcgcggaccagtaa

SEQ ID NO: 69538 - DNA, 20 bp, human
gggcaaagtcaaccctcccg

SEQ ID NO: 69539 - DNA, 20 bp, human
ggactcatcctgaggtatct

SEQ ID NO: 69540 - DNA, 20 bp, human
gcgcggaccagtaacggctg

SEQ ID NO: 69541 - DNA, 20 bp, human
gtattcttcagagccatgga

SEQ ID NO: 69542 - DNA, 20 bp, human
gcaagagaatctccattcct

SEQ ID NO: 69543 - DNA, 20 bp, human
ggcctcttgcggggaaggtg

SEQ ID NO: 69544 - DNA, 20 bp, human
gcatagaagcccacaacgaa

SEQ ID NO: 69545 - DNA, 20 bp, human
gtttatcacccagatacctc

SEQ ID NO: 69546 - DNA, 20 bp, human
ggtgcgcactggcctgtcag

SEQ ID NO: 69547 - DNA, 20 bp, human
ggccaggactaaggtgatgg

SEQ ID NO: 69548 - DNA, 20 bp, human
gagggcccagtccctacccc

SEQ ID NO: 69549 - DNA, 20 bp, human
gccctacccctggcagtagg

SEQ ID NO: 69550 - DNA, 20 bp, human
gaaacgccccctactgccag

SEQ ID NO: 69551 - DNA, 20 bp, human
ggtcagcggccggtggacca

SEQ ID NO: 69552 - DNA, 20 bp, human
gaaggcccttcgcccgggag

SEQ ID NO: 69553 - DNA, 20 bp, human
ggccccctactgccaggggt

SEQ ID NO: 69554 - DNA, 20 bp, human
ggccgcaaggcccttcgccc

SEQ ID NO: 69555 - DNA, 20 bp, human
gctggccctgtgtaatatca

SEQ ID NO: 69556 - DNA, 20 bp, human
gagcgcgcggagccggccat

SEQ ID NO: 69557 - DNA, 20 bp, human
ggcagtgcagcgcagccgcg

SEQ ID NO: 69558 - DNA, 20 bp, human
ggcaagtcaggtgagcccgc

SEQ ID NO: 69559 - DNA, 20 bp, human
gccctgtgctaggctcggtc

SEQ ID NO: 69560 - DNA, 20 bp, human
gaggaggccagacttagagt

SEQ ID NO: 69561 - DNA, 20 bp, human
ggagagctgttgtcacactt

SEQ ID NO: 69562 - DNA, 20 bp, human
ggcgcgcagcccctcagggt

SEQ ID NO: 69563 - DNA, 20 bp, human
ggttccgaaccattccgcag

SEQ ID NO: 69564 - DNA, 20 bp, human
gtgggcttcccgaccctgag

SEQ ID NO: 69565 - DNA, 20 bp, human
gccgcagcgggcgagcccgc

SEQ ID NO: 69566 - DNA, 20 bp, human
gaacctgctggccaaatgtc

SEQ ID NO: 69567 - DNA, 20 bp, human
gtctcccctccggctccggt

SEQ ID NO: 69568 - DNA, 20 bp, human
ggttataaaaacagccatca

SEQ ID NO: 69569 - DNA, 20 bp, human
gttgcccaccggagccggag

SEQ ID NO: 69570 - DNA, 20 bp, human
ggcgcatggactcggagtgg

SEQ ID NO: 69571 - DNA, 20 bp, human
gttggcatttacagccatga

SEQ ID NO: 69572 - DNA, 20 bp, human
gtagcgcatccctcatagaa

SEQ ID NO: 69573 - DNA, 20 bp, human
gaagtgctggtcctgcgatc

SEQ ID NO: 69574 - DNA, 20 bp, human
ggggatgcgctagccttcca

SEQ ID NO: 69575 - DNA, 20 bp, human
gtgtgcgcatggactcggag

SEQ ID NO: 69576 - DNA, 20 bp, human
gaggcacttgtccttgggag

SEQ ID NO: 69577 - DNA, 20 bp, human
ggcgagaggcacttgtcctt

SEQ ID NO: 69578 - DNA, 20 bp, human
gcttgctgcaggtcggacag

SEQ ID NO: 69579 - DNA, 20 bp, human
gtgcaggtcggacagcggtg

SEQ ID NO: 69580 - DNA, 20 bp, human
gagcgacacaccagctgctt

SEQ ID NO: 69581 - DNA, 20 bp, human
gcagcggtgtggcttctcgt

SEQ ID NO: 69582 - DNA, 20 bp, human
gcttgtccttgggaggggta

SEQ ID NO: 69583 - DNA, 20 bp, human
gagaagctcttgctgcaggt

SEQ ID NO: 69584 - DNA, 20 bp, human
gcctgcccctcggctccggg

SEQ ID NO: 69585 - DNA, 20 bp, human
gcaaagagctggttacactg

SEQ ID NO: 69586 - DNA, 20 bp, human
ggcccgcggagcgctctgaa

SEQ ID NO: 69587 - DNA, 20 bp, human
gcaccggcgacggaacccgc

SEQ ID NO: 69588 - DNA, 20 bp, human
gggacgaggatgaacaggac

SEQ ID NO: 69589 - DNA, 20 bp, human
gccctccggcgctcacactc

SEQ ID NO: 69590 - DNA, 20 bp, human
ggatgtgtgtgcggccgcga

SEQ ID NO: 69591 - DNA, 20 bp, human
gcccagagcgcggcgcgcac

SEQ ID NO: 69592 - DNA, 20 bp, human
gtcgccggtgtgaccctgga

SEQ ID NO: 69593 - DNA, 20 bp, human
gaaacccccatccaaacggg

SEQ ID NO: 69594 - DNA, 20 bp, human
gcagtgtggacgcggctgca

SEQ ID NO: 69595 - DNA, 20 bp, human
gcggcgcgcacgggcaccgg

SEQ ID NO: 69596 - DNA, 20 bp, human
ggttgtggagaggttcaggg

SEQ ID NO: 69597 - DNA, 20 bp, human
gcgcgtgcgggctgcatcag

SEQ ID NO: 69598 - DNA, 20 bp, human
gcggcggctgggagaggcga

SEQ ID NO: 69599 - DNA, 20 bp, human
gcgagtcagcccggtcctca

SEQ ID NO: 69600 - DNA, 20 bp, human
ggagaggcgagggttctggc

SEQ ID NO: 69601 - DNA, 20 bp, human
ggaagagcgggctaagacgc

SEQ ID NO: 69602 - DNA, 20 bp, human
gcgggctaagacgccggagg

SEQ ID NO: 69603 - DNA, 20 bp, human
ggagcgggctaagacgccgg

SEQ ID NO: 69604 - DNA, 20 bp, human
gcggggcggggccagaagag

SEQ ID NO: 69605 - DNA, 20 bp, human
gggccccaagccctcagtag

SEQ ID NO: 69606 - DNA, 20 bp, human
ggacgacgggacccaaggaa

SEQ ID NO: 69607 - DNA, 20 bp, human
ggacgggacccaaggaacgg

SEQ ID NO: 69608 - DNA, 20 bp, human
gtcacagacgacgggaccca

SEQ ID NO: 69609 - DNA, 20 bp, human
gacagggccgaggcgtagtg

SEQ ID NO: 69610 - DNA, 20 bp, human
ggctgcagtatcacagacga

SEQ ID NO: 69611 - DNA, 20 bp, human
ggcgccattcctagttaagg

SEQ ID NO: 69612 - DNA, 20 bp, human
ggccctgtgccgccttaact

SEQ ID NO: 69613 - DNA, 20 bp, human
gaggtgggcacaggaccgaa

SEQ ID NO: 69614 - DNA, 20 bp, human
gagtcacccacactacgcct

SEQ ID NO: 69615 - DNA, 20 bp, human
gcggaccccagtaccaaggt

SEQ ID NO: 69616 - DNA, 20 bp, human
gctgcgtgcggcgggaatca

SEQ ID NO: 69617 - DNA, 20 bp, human
gggctgtacggtgcgcgtga

SEQ ID NO: 69618 - DNA, 20 bp, human
gcttcgtggactgggctgta

SEQ ID NO: 69619 - DNA, 20 bp, human
gtgcgcgtgacggctgcgtg

SEQ ID NO: 69620 - DNA, 20 bp, human
gcaaggcctatgatccccaa

SEQ ID NO: 69621 - DNA, 20 bp, human
gtgcaggccggggccgacag

SEQ ID NO: 69622 - DNA, 20 bp, human
gggtaagctccacaagggcg

SEQ ID NO: 69623 - DNA, 20 bp, human
gtaccgtctaccggaaaaga

SEQ ID NO: 69624 - DNA, 20 bp, human
gcctaaggtcggacaccctc

SEQ ID NO: 69625 - DNA, 20 bp, human
ggaaacgcgccgtctggaag

SEQ ID NO: 69626 - DNA, 20 bp, human
gttagagccgggcctttcca

SEQ ID NO: 69627 - DNA, 20 bp, human
gaatgggagcccgcagagaa

SEQ ID NO: 69628 - DNA, 20 bp, human
gggctgccagtcaagatgtg

SEQ ID NO: 69629 - DNA, 20 bp, human
gggattgtcgggaggaccct

SEQ ID NO: 69630 - DNA, 20 bp, human
gcccggctctaagccatgga

SEQ ID NO: 69631 - DNA, 20 bp, human
gcagatggcgcagcatggca

SEQ ID NO: 69632 - DNA, 20 bp, human
gggcccctggcaacctgaag

SEQ ID NO: 69633 - DNA, 20 bp, human
ggtccccttcaggttgccag

SEQ ID NO: 69634 - DNA, 20 bp, human
ggagggcagatggcgcagca

SEQ ID NO: 69635 - DNA, 20 bp, human
ggacaggtggagagatacaa

SEQ ID NO: 69636 - DNA, 20 bp, human
ggcgtgcggagactgatccc

SEQ ID NO: 69637 - DNA, 20 bp, human
gtgctgctgctcgggatggt

SEQ ID NO: 69638 - DNA, 20 bp, human
ggggccatcgctgccacctg

SEQ ID NO: 69639 - DNA, 20 bp, human
gtgtgccagggccgctgaca

SEQ ID NO: 69640 - DNA, 20 bp, human
gacccgggtggcgaggaaga

SEQ ID NO: 69641 - DNA, 20 bp, human
ggttccgcaggtggcagcga

SEQ ID NO: 69642 - DNA, 20 bp, human
ggcagcagcgcaaggcgcag

SEQ ID NO: 69643 - DNA, 20 bp, human
gccacctgcggaaccgcgtg

SEQ ID NO: 69644 - DNA, 20 bp, human
gagcagaagtcagcgcaggg

SEQ ID NO: 69645 - DNA, 20 bp, human
gtgcccgggcagagggaccc

SEQ ID NO: 69646 - DNA, 20 bp, human
ggggatgtggcaaccataga

SEQ ID NO: 69647 - DNA, 20 bp, human
gaaccatagagggcactctc

SEQ ID NO: 69648 - DNA, 20 bp, human
gagagaacgccacggatatt

SEQ ID NO: 69649 - DNA, 20 bp, human
gatccagagagtgccctcta

SEQ ID NO: 69650 - DNA, 20 bp, human
gcagacgatagagaacgcca

SEQ ID NO: 69651 - DNA, 20 bp, human
gtctctggattaggtgaccc

SEQ ID NO: 69652 - DNA, 20 bp, human
gtccccggggaagctaagga

SEQ ID NO: 69653 - DNA, 20 bp, human
gctccaggggccacacaaag

SEQ ID NO: 69654 - DNA, 20 bp, human
gaaagcagcaacccttgtgg

SEQ ID NO: 69655 - DNA, 20 bp, human
gttgcatgtcagcctagtag

SEQ ID NO: 69656 - DNA, 20 bp, human
gcaggtctggacgctctccg

SEQ ID NO: 69657 - DNA, 20 bp, human
gatgatgggaccacggacag

SEQ ID NO: 69658 - DNA, 20 bp, human
ggcgaggcgtttcagcacca

SEQ ID NO: 69659 - DNA, 20 bp, human
gtcgtagataccacggacag

SEQ ID NO: 69660 - DNA, 20 bp, human
gcgctcctgaaaagcaggtc

SEQ ID NO: 69661 - DNA, 20 bp, human
gtagataccacggacagcgg

SEQ ID NO: 69662 - DNA, 20 bp, human
gaaagggaggcggggaacag

SEQ ID NO: 69663 - DNA, 20 bp, human
gagggagccaacagacacgc

SEQ ID NO: 69664 - DNA, 20 bp, human
gtgtagtccacgagttatgg

SEQ ID NO: 69665 - DNA, 20 bp, human
ggagggggtcgtagatacca

SEQ ID NO: 69666 - DNA, 20 bp, human
gtgagggctatagaatgaga

SEQ ID NO: 69667 - DNA, 20 bp, human
gggactctgcgcgctggagt

SEQ ID NO: 69668 - DNA, 20 bp, human
gctctgcgcgctggagtggg

SEQ ID NO: 69669 - DNA, 20 bp, human
gtcatggtcaggtcaaaccg

SEQ ID NO: 69670 - DNA, 20 bp, human
gatgccatgctagatagctg

SEQ ID NO: 69671 - DNA, 20 bp, human
gatagccctcattccagcac

SEQ ID NO: 69672 - DNA, 20 bp, human
gtccgagtgctgaaatttat

SEQ ID NO: 69673 - DNA, 20 bp, human
gagtcctgggcatcatggtc

SEQ ID NO: 69674 - DNA, 20 bp, human
gtttgattttcaaggaaact

SEQ ID NO: 69675 - DNA, 20 bp, human
gaagccacagctatctagca

SEQ ID NO: 69676 - DNA, 20 bp, human
gtctcacgtgggccatgata

SEQ ID NO: 69677 - DNA, 20 bp, human
gtggagagctggattccggc

SEQ ID NO: 69678 - DNA, 20 bp, human
gagcagcaacagccggaaag

SEQ ID NO: 69679 - DNA, 20 bp, human
ggaactgttgcccagcacct

SEQ ID NO: 69680 - DNA, 20 bp, human
ggcgcggcaaagggaagcgg

SEQ ID NO: 69681 - DNA, 20 bp, human
gggaatccagctctccacct

SEQ ID NO: 69682 - DNA, 20 bp, human
gctgaaaatagtcttatcca

SEQ ID NO: 69683 - DNA, 20 bp, human
gagagctggattccggcggg

SEQ ID NO: 69684 - DNA, 20 bp, human
gggtctcgggttttaaccca

SEQ ID NO: 69685 - DNA, 20 bp, human
ggacagctccccgcagtatg

SEQ ID NO: 69686 - DNA, 20 bp, human
gctggcaggctaaggccctc

SEQ ID NO: 69687 - DNA, 20 bp, human
gtaaggccctccggagccca

SEQ ID NO: 69688 - DNA, 20 bp, human
ggctcccagctggcaggcta

SEQ ID NO: 69689 - DNA, 20 bp, human
ggctcgccttgggctccgga

SEQ ID NO: 69690 - DNA, 20 bp, human
gctgacacagataaccctac

SEQ ID NO: 69691 - DNA, 20 bp, human
gatgcaaacactagccaagg

SEQ ID NO: 69692 - DNA, 20 bp, human
ggatgggcaacctgggcatc

SEQ ID NO: 69693 - DNA, 20 bp, human
gcctgaagccctccagactg

SEQ ID NO: 69694 - DNA, 20 bp, human
ggggccttagcctgccagct

SEQ ID NO: 69695 - DNA, 20 bp, human
ggggctttgtgcaaacttag

SEQ ID NO: 69696 - DNA, 20 bp, human
gtgcagcgggcgccgagcgg

SEQ ID NO: 69697 - DNA, 20 bp, human
gtcgccgggcgagatcgtgg

SEQ ID NO: 69698 - DNA, 20 bp, human
gtccgggtggagagatgcag

SEQ ID NO: 69699 - DNA, 20 bp, human
gtggaggctccgggcccagg

SEQ ID NO: 69700 - DNA, 20 bp, human
ggtggctgctaagggtgcag

SEQ ID NO: 69701 - DNA, 20 bp, human
gggacagctgcattgactgg

SEQ ID NO: 69702 - DNA, 20 bp, human
ggcgcgtcagccgagctcgg

SEQ ID NO: 69703 - DNA, 20 bp, human
gcaatcgccgggcgagatcg

SEQ ID NO: 69704 - DNA, 20 bp, human
gggcagccgggtccccgctg

SEQ ID NO: 69705 - DNA, 20 bp, human
gcggagcgcgaggagcactg

SEQ ID NO: 69706 - DNA, 20 bp, human
ggcccacctgcccgtactgc

SEQ ID NO: 69707 - DNA, 20 bp, human
ggccctcctgcagtacgggc

SEQ ID NO: 69708 - DNA, 20 bp, human
ggcagccaaaggtcttcacg

SEQ ID NO: 69709 - DNA, 20 bp, human
ggagccccgacccagccagt

SEQ ID NO: 69710 - DNA, 20 bp, human
gcggtcacttgaatgagcgg

SEQ ID NO: 69711 - DNA, 20 bp, human
gtaattccccagggactcac

SEQ ID NO: 69712 - DNA, 20 bp, human
gagaccgcagcccatcggca

SEQ ID NO: 69713 - DNA, 20 bp, human
ggcagccttatcctaaagaa

SEQ ID NO: 69714 - DNA, 20 bp, human
gtaataaggaacctccctgg

SEQ ID NO: 69715 - DNA, 20 bp, human
gctctggacgccttgaagta

SEQ ID NO: 69716 - DNA, 20 bp, human
ggccgcgcggcgccaaatca

SEQ ID NO: 69717 - DNA, 20 bp, human
gtagagctcgctgcagatcc

SEQ ID NO: 69718 - DNA, 20 bp, human
gccgggctctgaccatgatt

SEQ ID NO: 69719 - DNA, 20 bp, human
ggcagaggcgctcgagggat

SEQ ID NO: 69720 - DNA, 20 bp, human
gggcgggctcccgggatccg

SEQ ID NO: 69721 - DNA, 20 bp, human
gaggcctgcgcaccacgccg

SEQ ID NO: 69722 - DNA, 20 bp, human
gaagtcagcacagccgcgga

SEQ ID NO: 69723 - DNA, 20 bp, human
ggccggacaccgcggatccc

SEQ ID NO: 69724 - DNA, 20 bp, human
gtggtgcgcaggccttgcgg

SEQ ID NO: 69725 - DNA, 20 bp, human
ggctctactgccggacaccg

SEQ ID NO: 69726 - DNA, 20 bp, human
gtagcggccgtggaggaggt

SEQ ID NO: 69727 - DNA, 20 bp, human
gtctggcggcggcagcatgg

SEQ ID NO: 69728 - DNA, 20 bp, human
ggccctggctccgaccccga

SEQ ID NO: 69729 - DNA, 20 bp, human
gctcccggcgggcacaggaa

SEQ ID NO: 69730 - DNA, 20 bp, human
gcgccacggagcgggaccca

SEQ ID NO: 69731 - DNA, 20 bp, human
ggcagctgtagcggccgtgg

SEQ ID NO: 69732 - DNA, 20 bp, human
ggcggctgaggcagctgtag

SEQ ID NO: 69733 - DNA, 20 bp, human
ggacggctgtccaagcccgg

SEQ ID NO: 69734 - DNA, 20 bp, human
ggctgtagcggccgtggagg

SEQ ID NO: 69735 - DNA, 20 bp, human
gcgggaaggtcgcgtccccc

SEQ ID NO: 69736 - DNA, 20 bp, human
gattgccatggcaatgcggt

SEQ ID NO: 69737 - DNA, 20 bp, human
gcttgtcgtgttggtctctt

SEQ ID NO: 69738 - DNA, 20 bp, human
gtgtgggcccgggccgtcgt

SEQ ID NO: 69739 - DNA, 20 bp, human
gcgcaagccggagcccacga

SEQ ID NO: 69740 - DNA, 20 bp, human
ggcttgcgtgcggagatgag

SEQ ID NO: 69741 - DNA, 20 bp, human
gccggcgcggcggaacccct

SEQ ID NO: 69742 - DNA, 20 bp, human
ggctctgggtggccagctgt

SEQ ID NO: 69743 - DNA, 20 bp, human
gctgccctggagtagagtct

SEQ ID NO: 69744 - DNA, 20 bp, human
gggactacgccgagacaact

SEQ ID NO: 69745 - DNA, 20 bp, human
gacgacccggagctccgaca

SEQ ID NO: 69746 - DNA, 20 bp, human
gcgggcgctgacggacccgg

SEQ ID NO: 69747 - DNA, 20 bp, human
ggttctcttcgctccgccta

SEQ ID NO: 69748 - DNA, 20 bp, human
ggagcgaagagaaccggtcg

SEQ ID NO: 69749 - DNA, 20 bp, human
ggtcagcgcccgctcaacag

SEQ ID NO: 69750 - DNA, 20 bp, human
ggccggcacagggtgaccaa

SEQ ID NO: 69751 - DNA, 20 bp, human
gcgccgcgcgactccacccg

SEQ ID NO: 69752 - DNA, 20 bp, human
gcgcgactccacccgtggtg

SEQ ID NO: 69753 - DNA, 20 bp, human
ggctcctgcaagatctccga

SEQ ID NO: 69754 - DNA, 20 bp, human
gagcctcagtgcggagcctt

SEQ ID NO: 69755 - DNA, 20 bp, human
gcgcctaaggctccgcactg

SEQ ID NO: 69756 - DNA, 20 bp, human
gctgcgccgcggcctcactg

SEQ ID NO: 69757 - DNA, 20 bp, human
gagaaccacagtgggagtgg

SEQ ID NO: 69758 - DNA, 20 bp, human
gtaggggcaccctcaggaca

SEQ ID NO: 69759 - DNA, 20 bp, human
gaagctggctccagggttag

SEQ ID NO: 69760 - DNA, 20 bp, human
gggacgcccccgccaaggag

SEQ ID NO: 69761 - DNA, 20 bp, human
gctgagggtgcccctaaccc

SEQ ID NO: 69762 - DNA, 20 bp, human
ggaactagcgagaaccacag

SEQ ID NO: 69763 - DNA, 20 bp, human
ggagcgagcgagacaaggtg

SEQ ID NO: 69764 - DNA, 20 bp, human
gcaccacctcagtgaggccg

SEQ ID NO: 69765 - DNA, 20 bp, human
gcacctagcccctgtcctga

SEQ ID NO: 69766 - DNA, 20 bp, human
gcggtgctgcggccacacac

SEQ ID NO: 69767 - DNA, 20 bp, human
gtcccgggcccctccacgac

SEQ ID NO: 69768 - DNA, 20 bp, human
gcgccgcccgggccatcgac

SEQ ID NO: 69769 - DNA, 20 bp, human
gcccggggcctggtcggcgg

SEQ ID NO: 69770 - DNA, 20 bp, human
gtggcctcgcgctctccgga

SEQ ID NO: 69771 - DNA, 20 bp, human
ggatgggagcaggatccgca

SEQ ID NO: 69772 - DNA, 20 bp, human
gccgcagcaccgccaggaac

SEQ ID NO: 69773 - DNA, 20 bp, human
gggggactgagcaggtgaac

SEQ ID NO: 69774 - DNA, 20 bp, human
gaccccgctgcgcatccctg

SEQ ID NO: 69775 - DNA, 20 bp, human
ggccgcgcgcacaaacggat

SEQ ID NO: 69776 - DNA, 20 bp, human
ggggctgtgcaaatagaatg

SEQ ID NO: 69777 - DNA, 20 bp, human
gtaacaatgggttaatgtat

SEQ ID NO: 69778 - DNA, 20 bp, human
gcattggacaccaaccttag

SEQ ID NO: 69779 - DNA, 20 bp, human
gctttagtgattggcagagg

SEQ ID NO: 69780 - DNA, 20 bp, human
ggagacagcgacttgagtta

SEQ ID NO: 69781 - DNA, 20 bp, human
gtagaagcaacctctaaggt

SEQ ID NO: 69782 - DNA, 20 bp, human
ggatctttagtgattggcag

SEQ ID NO: 69783 - DNA, 20 bp, human
ggtcagccccgggcacttga

SEQ ID NO: 69784 - DNA, 20 bp, human
gattctctcctagggaaaga

SEQ ID NO: 69785 - DNA, 20 bp, human
gacggggaacagtcagcccc

SEQ ID NO: 69786 - DNA, 20 bp, human
gacgcccagccagcccgcag

SEQ ID NO: 69787 - DNA, 20 bp, human
gccatcgcctgcagtaaggg

SEQ ID NO: 69788 - DNA, 20 bp, human
gcggctgccacggagctaga

SEQ ID NO: 69789 - DNA, 20 bp, human
gttgtcggagccctaaccag

SEQ ID NO: 69790 - DNA, 20 bp, human
ggccgcggcgagcctttgag

SEQ ID NO: 69791 - DNA, 20 bp, human
ggagggacagccgagcacca

SEQ ID NO: 69792 - DNA, 20 bp, human
ggacaagtcgttcccctcaa

SEQ ID NO: 69793 - DNA, 20 bp, human
gtcccctcaaaggctcgccg

SEQ ID NO: 69794 - DNA, 20 bp, human
gcacttgccctctagctccg

SEQ ID NO: 69795 - DNA, 20 bp, human
ggggctggctgggcgtagtg

SEQ ID NO: 69796 - DNA, 20 bp, human
gtcccagcggcttcgcgcag

SEQ ID NO: 69797 - DNA, 20 bp, human
gcgaactggtagcattccag

SEQ ID NO: 69798 - DNA, 20 bp, human
ggagttgcgctggcagagag

SEQ ID NO: 69799 - DNA, 20 bp, human
ggcgaagccgctgggaaccc

SEQ ID NO: 69800 - DNA, 20 bp, human
gagcagccgaagcagcgtga

SEQ ID NO: 69801 - DNA, 20 bp, human
gctctgccagcgcaactcct

SEQ ID NO: 69802 - DNA, 20 bp, human
ggaagtcaacgcaagcaaag

SEQ ID NO: 69803 - DNA, 20 bp, human
gtgctggaaatggccgaaaa

SEQ ID NO: 69804 - DNA, 20 bp, human
gaggcagagcgttcaaatcg

SEQ ID NO: 69805 - DNA, 20 bp, human
gtcccattggaagtcccaaa

SEQ ID NO: 69806 - DNA, 20 bp, human
gtaggactgtgaggtgtcta

SEQ ID NO: 69807 - DNA, 20 bp, human
gctgtgaggtgtctagggag

SEQ ID NO: 69808 - DNA, 20 bp, human
gccggctcaccgaagaaggg

SEQ ID NO: 69809 - DNA, 20 bp, human
gctgcggcgggcggctgtga

SEQ ID NO: 69810 - DNA, 20 bp, human
gggatgtgacatgtttagag

SEQ ID NO: 69811 - DNA, 20 bp, human
gtgacatgtttagagcggag

SEQ ID NO: 69812 - DNA, 20 bp, human
gggcgccgtgcgggcggaag

SEQ ID NO: 69813 - DNA, 20 bp, human
gattccggctcaccgaagaa

SEQ ID NO: 69814 - DNA, 20 bp, human
gtttagagcggagaggactt

SEQ ID NO: 69815 - DNA, 20 bp, human
gtcggtgagccggaatggag

SEQ ID NO: 69816 - DNA, 20 bp, human
gtaggtgagcggctcggact

SEQ ID NO: 69817 - DNA, 20 bp, human
gggctcggtaacaacaggaa

SEQ ID NO: 69818 - DNA, 20 bp, human
gcggcgacttccggaccgtg

SEQ ID NO: 69819 - DNA, 20 bp, human
gcccttcctgggcctctcgg

SEQ ID NO: 69820 - DNA, 20 bp, human
gcaacccaacccgcacggtc

SEQ ID NO: 69821 - DNA, 20 bp, human
gagatggcaccggactggat

SEQ ID NO: 69822 - DNA, 20 bp, human
gcggcctgagcacagagcac

SEQ ID NO: 69823 - DNA, 20 bp, human
gcaggagcttctcagagctg

SEQ ID NO: 69824 - DNA, 20 bp, human
gacttccggaccgtgcgggt

SEQ ID NO: 69825 - DNA, 20 bp, human
gcggtccggaagtcgccgag

SEQ ID NO: 69826 - DNA, 20 bp, human
gaaagaggcttgagtcgtga

SEQ ID NO: 69827 - DNA, 20 bp, human
ggtcgtgagggcctggattc

SEQ ID NO: 69828 - DNA, 20 bp, human
gccaggagggaccagaacag

SEQ ID NO: 69829 - DNA, 20 bp, human
gacgggagagggtagaccgg

SEQ ID NO: 69830 - DNA, 20 bp, human
gactggctaggcgctggtga

SEQ ID NO: 69831 - DNA, 20 bp, human
gcgcctgggtagaggagaag

SEQ ID NO: 69832 - DNA, 20 bp, human
ggcgcctagcgtacctggaa

SEQ ID NO: 69833 - DNA, 20 bp, human
gctgagggtccggcaaaggg

SEQ ID NO: 69834 - DNA, 20 bp, human
gcgctcgggctgcggaccca

SEQ ID NO: 69835 - DNA, 20 bp, human
ggtacgctaggcgcaggatt

SEQ ID NO: 69836 - DNA, 20 bp, human
gggaaggcggcggggacttc

SEQ ID NO: 69837 - DNA, 20 bp, human
gcggccggggacaggctccg

SEQ ID NO: 69838 - DNA, 20 bp, human
ggctcgacggagaccagcta

SEQ ID NO: 69839 - DNA, 20 bp, human
gggtctccgtcgagccacgg

SEQ ID NO: 69840 - DNA, 20 bp, human
gcccagtcccgggggttcag

SEQ ID NO: 69841 - DNA, 20 bp, human
gcgccccagcatccggatca

SEQ ID NO: 69842 - DNA, 20 bp, human
gacaccaccgcggcgtcctg

SEQ ID NO: 69843 - DNA, 20 bp, human
gccgcgccggagcccagagt

SEQ ID NO: 69844 - DNA, 20 bp, human
gggcgcgcctgctcgagctc

SEQ ID NO: 69845 - DNA, 20 bp, human
ggcgcggtcccacctccggg

SEQ ID NO: 69846 - DNA, 20 bp, human
gcgcagaaaccccgttgaca

SEQ ID NO: 69847 - DNA, 20 bp, human
gccaagttcagtgtctcggg

SEQ ID NO: 69848 - DNA, 20 bp, human
gttctgcgccatcgcaacag

SEQ ID NO: 69849 - DNA, 20 bp, human
gagaccaagttcagtgtctc

SEQ ID NO: 69850 - DNA, 20 bp, human
ggccgccgcccctgttgcga

SEQ ID NO: 69851 - DNA, 20 bp, human
gttgccaaaaccaggatatt

SEQ ID NO: 69852 - DNA, 20 bp, human
gtgcgccatcgcaacagggg

SEQ ID NO: 69853 - DNA, 20 bp, human
gtcccctccccgaaggaaag

SEQ ID NO: 69854 - DNA, 20 bp, human
gagttcagtgtctcgggcgg

SEQ ID NO: 69855 - DNA, 20 bp, human
gcaccccgccgaggcgcccc

SEQ ID NO: 69856 - DNA, 20 bp, human
gaaaggaagaactcagccac

SEQ ID NO: 69857 - DNA, 20 bp, human
ggcgcacgagcgggtacgtt

SEQ ID NO: 69858 - DNA, 20 bp, human
ggcgctgggtccaccgaagt

SEQ ID NO: 69859 - DNA, 20 bp, human
gggctacaggagcgcacgag

SEQ ID NO: 69860 - DNA, 20 bp, human
gtacgttgggcgggacttcc

SEQ ID NO: 69861 - DNA, 20 bp, human
ggttgggcgggacttccggg

SEQ ID NO: 69862 - DNA, 20 bp, human
gcaggaaccgtcccacctcc

SEQ ID NO: 69863 - DNA, 20 bp, human
gcacgagcgggtacgttggg

SEQ ID NO: 69864 - DNA, 20 bp, human
gccggggaccgccgaggaaa

SEQ ID NO: 69865 - DNA, 20 bp, human
ggcaagctaaggtggatgca

SEQ ID NO: 69866 - DNA, 20 bp, human
gtacatggccacaagcggag

SEQ ID NO: 69867 - DNA, 20 bp, human
gagcggtacatggccacaag

SEQ ID NO: 69868 - DNA, 20 bp, human
gatggccacaagcggagggg

SEQ ID NO: 69869 - DNA, 20 bp, human
gctcagactccccgcgacta

SEQ ID NO: 69870 - DNA, 20 bp, human
ggcggaggggaggtgcgtga

SEQ ID NO: 69871 - DNA, 20 bp, human
gccgccagcgaggcccgggg

SEQ ID NO: 69872 - DNA, 20 bp, human
ggcccggcgccactacagcg

SEQ ID NO: 69873 - DNA, 20 bp, human
gggccaccgcctcgctgtag

SEQ ID NO: 69874 - DNA, 20 bp, human
gggaggcccggcgccctggg

SEQ ID NO: 69875 - DNA, 20 bp, human
gcagcaacagcgcttcgccc

SEQ ID NO: 69876 - DNA, 20 bp, human
gcgactaggaaggaagggtc

SEQ ID NO: 69877 - DNA, 20 bp, human
ggccaggtagcggtacatcg

SEQ ID NO: 69878 - DNA, 20 bp, human
ggcggaggaggggtgcgtga

SEQ ID NO: 69879 - DNA, 20 bp, human
gaggaaggaagggtccggcg

SEQ ID NO: 69880 - DNA, 20 bp, human
gcagcgctttggccaggtag

SEQ ID NO: 69881 - DNA, 20 bp, human
gggccaccaactcgctgtag

SEQ ID NO: 69882 - DNA, 20 bp, human
gtgcgtgacggtcgcggaac

SEQ ID NO: 69883 - DNA, 20 bp, human
ggcgagccccggctgcgagg

SEQ ID NO: 69884 - DNA, 20 bp, human
ggaggggtgcgtgacggtcg

SEQ ID NO: 69885 - DNA, 20 bp, human
gtcgcagccggggctcgcat

SEQ ID NO: 69886 - DNA, 20 bp, human
ggctctgcagagtcgagagt

SEQ ID NO: 69887 - DNA, 20 bp, human
ggagcgtgtgagcagtactg

SEQ ID NO: 69888 - DNA, 20 bp, human
ggacgggtccaagccaccag

SEQ ID NO: 69889 - DNA, 20 bp, human
gggaccccccaacccctcgg

SEQ ID NO: 69890 - DNA, 20 bp, human
gtgcgccctggggctcgcag

SEQ ID NO: 69891 - DNA, 20 bp, human
ggtggcggtgcggtcccctg

SEQ ID NO: 69892 - DNA, 20 bp, human
gccggagaggccgcagcgta

SEQ ID NO: 69893 - DNA, 20 bp, human
gtctcaggcatgggccggag

SEQ ID NO: 69894 - DNA, 20 bp, human
gcccctgtggagcgcaaaca

SEQ ID NO: 69895 - DNA, 20 bp, human
ggccgaagcgccgcccctgg

SEQ ID NO: 69896 - DNA, 20 bp, human
gtgctgaactggctgcatca

SEQ ID NO: 69897 - DNA, 20 bp, human
gtctgagcataacacaatac

SEQ ID NO: 69898 - DNA, 20 bp, human
gctgcgagactctgctgaac

SEQ ID NO: 69899 - DNA, 20 bp, human
ggggatccatgctacatgag

SEQ ID NO: 69900 - DNA, 20 bp, human
gacgatgagcaacacccttc

SEQ ID NO: 69901 - DNA, 20 bp, human
gacaactatgctcaaggaaa

SEQ ID NO: 69902 - DNA, 20 bp, human
gttaatttgactcacttaag

SEQ ID NO: 69903 - DNA, 20 bp, human
ggctcagaaatttctggagg

SEQ ID NO: 69904 - DNA, 20 bp, human
ggtaatgtggaccttgtact

SEQ ID NO: 69905 - DNA, 20 bp, human
gtgtggaccttgtactaggc

SEQ ID NO: 69906 - DNA, 20 bp, human
gtatctctccagccaaaatt

SEQ ID NO: 69907 - DNA, 20 bp, human
ggagagataagtaccctctg

SEQ ID NO: 69908 - DNA, 20 bp, human
gagtagttctgtgagactcc

SEQ ID NO: 69909 - DNA, 20 bp, human
gactttggctcagttgccat

SEQ ID NO: 69910 - DNA, 20 bp, human
gtgccgatgtgaaattccaa

SEQ ID NO: 69911 - DNA, 20 bp, human
gaggcaatcaggaccatggt

SEQ ID NO: 69912 - DNA, 20 bp, human
gagccaaagtgttcctggtc

SEQ ID NO: 69913 - DNA, 20 bp, human
gtccaaggcaatcaggacca

SEQ ID NO: 69914 - DNA, 20 bp, human
gtttgtgggtactagatagt

SEQ ID NO: 69915 - DNA, 20 bp, human
gtcagtatggacattcttgg

SEQ ID NO: 69916 - DNA, 20 bp, human
ggtcacaacaggaaacagac

SEQ ID NO: 69917 - DNA, 20 bp, human
gagattcaccgaggctccgg

SEQ ID NO: 69918 - DNA, 20 bp, human
gctgggtttggagtcacaac

SEQ ID NO: 69919 - DNA, 20 bp, human
gagcgcgaagtgaacacgga

SEQ ID NO: 69920 - DNA, 20 bp, human
gatcagatggtgtcacaaga

SEQ ID NO: 69921 - DNA, 20 bp, human
gattttggagcttcacacgt

SEQ ID NO: 69922 - DNA, 20 bp, human
gaatcacagcagattcaccg

SEQ ID NO: 69923 - DNA, 20 bp, human
gatcttggaattaactggcc

SEQ ID NO: 69924 - DNA, 20 bp, human
gagcagattcaccgaggctc

SEQ ID NO: 69925 - DNA, 20 bp, human
gctgtgattttgtaggctgc

SEQ ID NO: 69926 - DNA, 20 bp, human
gcacaggctttgtagaccag

SEQ ID NO: 69927 - DNA, 20 bp, human
gcagcaggcagtgtgcctac

SEQ ID NO: 69928 - DNA, 20 bp, human
gtctttccaagggtttgcag

SEQ ID NO: 69929 - DNA, 20 bp, human
gctgctgcagtttctcagta

SEQ ID NO: 69930 - DNA, 20 bp, human
gaattcaaaaggatacgcac

SEQ ID NO: 69931 - DNA, 20 bp, human
gcttggaaagagcactcccc

SEQ ID NO: 69932 - DNA, 20 bp, human
gtgtctatggacagaacgtc

SEQ ID NO: 69933 - DNA, 20 bp, human
gttgtagaagctgctcaata

SEQ ID NO: 69934 - DNA, 20 bp, human
gttctgtagctaatactcta

SEQ ID NO: 69935 - DNA, 20 bp, human
gtattactatggagatctag

SEQ ID NO: 69936 - DNA, 20 bp, human
gcactaagggctaattagag

SEQ ID NO: 69937 - DNA, 20 bp, human
ggagttcagtccagaactga

SEQ ID NO: 69938 - DNA, 20 bp, human
gatatttacaatataatggt

SEQ ID NO: 69939 - DNA, 20 bp, human
gagcccttagtggaaacagg

SEQ ID NO: 69940 - DNA, 20 bp, human
gtggtgggcatttgttaatg

SEQ ID NO: 69941 - DNA, 20 bp, human
gtttgtttgcattgtgatat

SEQ ID NO: 69942 - DNA, 20 bp, human
ggaaaaataattactagcat

SEQ ID NO: 69943 - DNA, 20 bp, human
gattagcccttagtggaaac

SEQ ID NO: 69944 - DNA, 20 bp, human
gtataattgcagaaagggat

SEQ ID NO: 69945 - DNA, 20 bp, human
gagctgaaaaccctcagttc

SEQ ID NO: 69946 - DNA, 20 bp, human
ggcaccgcggccggagctgt

SEQ ID NO: 69947 - DNA, 20 bp, human
gtggagaacggaagtactag

SEQ ID NO: 69948 - DNA, 20 bp, human
gcagcccacagctccggccg

SEQ ID NO: 69949 - DNA, 20 bp, human
gcggaagtgacgtcatccta

SEQ ID NO: 69950 - DNA, 20 bp, human
gcgcatcaccgggcattacg

SEQ ID NO: 69951 - DNA, 20 bp, human
ggtgacgtcatcctaaggta

SEQ ID NO: 69952 - DNA, 20 bp, human
gaacggaagtactagggggt

SEQ ID NO: 69953 - DNA, 20 bp, human
ggtctctccgaaactccggg

SEQ ID NO: 69954 - DNA, 20 bp, human
gtggtaagtctgcgccgcca

SEQ ID NO: 69955 - DNA, 20 bp, human
ggcccagggaccgcttctga

SEQ ID NO: 69956 - DNA, 20 bp, human
gagaggaggacgtggctggg

SEQ ID NO: 69957 - DNA, 20 bp, human
gatgtggtctgcagaagagg

SEQ ID NO: 69958 - DNA, 20 bp, human
gcactatccttggaccctgg

SEQ ID NO: 69959 - DNA, 20 bp, human
gcttgaggcagagtatccag

SEQ ID NO: 69960 - DNA, 20 bp, human
gctgcaccgggcactatcct

SEQ ID NO: 69961 - DNA, 20 bp, human
gtagtgcccggtgcagcatg

SEQ ID NO: 69962 - DNA, 20 bp, human
gggcttcaggaagtctcctg

SEQ ID NO: 69963 - DNA, 20 bp, human
gagggtccaaggatagtgcc

SEQ ID NO: 69964 - DNA, 20 bp, human
gtggccctgagccctcagag

SEQ ID NO: 69965 - DNA, 20 bp, human
ggagggaaaaagcacaactg

SEQ ID NO: 69966 - DNA, 20 bp, human
ggcggctcggcgacttggtg

SEQ ID NO: 69967 - DNA, 20 bp, human
gccgtgcgtcggcggtggtt

SEQ ID NO: 69968 - DNA, 20 bp, human
gttcccggcggcccgtgcgt

SEQ ID NO: 69969 - DNA, 20 bp, human
gggaccggacctgcgagatc

SEQ ID NO: 69970 - DNA, 20 bp, human
gcggctgtgagtctgcggct

SEQ ID NO: 69971 - DNA, 20 bp, human
ggaagccccaacaagacccc

SEQ ID NO: 69972 - DNA, 20 bp, human
gccggcggcccgtgcgtcgg

SEQ ID NO: 69973 - DNA, 20 bp, human
gggccgagggtggccacgtc

SEQ ID NO: 69974 - DNA, 20 bp, human
gcggccagatctcgcaggtc

SEQ ID NO: 69975 - DNA, 20 bp, human
gtactggcggcccccgtgaa

SEQ ID NO: 69976 - DNA, 20 bp, human
gggactgcatcgggaagggt

SEQ ID NO: 69977 - DNA, 20 bp, human
gaagcccagggcgatcagga

SEQ ID NO: 69978 - DNA, 20 bp, human
gaggaggggagcctgcatca

SEQ ID NO: 69979 - DNA, 20 bp, human
gaggcagcaggccttatcat

SEQ ID NO: 69980 - DNA, 20 bp, human
gcctgcatcagggactgcat

SEQ ID NO: 69981 - DNA, 20 bp, human
gatcagggactgcatcggga

SEQ ID NO: 69982 - DNA, 20 bp, human
gcctcagggcattcgagcag

SEQ ID NO: 69983 - DNA, 20 bp, human
gcagggcggagttaactgca

SEQ ID NO: 69984 - DNA, 20 bp, human
gctcccctcctgatcgccct

SEQ ID NO: 69985 - DNA, 20 bp, human
ggcaaggtctgtggcggcag

SEQ ID NO: 69986 - DNA, 20 bp, human
gacccctcgaaggtacgtgg

SEQ ID NO: 69987 - DNA, 20 bp, human
ggcggcgcgaccggacgctg

SEQ ID NO: 69988 - DNA, 20 bp, human
gctcgtccgtctccgagtca

SEQ ID NO: 69989 - DNA, 20 bp, human
gctttgttgcgaaagcgagg

SEQ ID NO: 69990 - DNA, 20 bp, human
gcagcaggcgcagggtgcca

SEQ ID NO: 69991 - DNA, 20 bp, human
gtgtcaccctgactcggaga

SEQ ID NO: 69992 - DNA, 20 bp, human
gtgctagagcgcggcgcgac

SEQ ID NO: 69993 - DNA, 20 bp, human
gcaacaaagcgcgggacgga

SEQ ID NO: 69994 - DNA, 20 bp, human
ggcgaccggacgctgcgggc

SEQ ID NO: 69995 - DNA, 20 bp, human
ggcgagggggcgaggtgctg

SEQ ID NO: 69996 - DNA, 20 bp, human
gggccgccacagtctgacag

SEQ ID NO: 69997 - DNA, 20 bp, human
ggcccccagagaaagaccag

SEQ ID NO: 69998 - DNA, 20 bp, human
ggtgcgcccctgtcagactg

SEQ ID NO: 69999 - DNA, 20 bp, human
gcgcccctgtcagactgtgg

SEQ ID NO: 70000 - DNA, 20 bp, human
gcctacgcgccgctactcgt

SEQ ID NO: 70001 - DNA, 20 bp, human
gccctctcggcgtcccggaa

SEQ ID NO: 70002 - DNA, 20 bp, human
ggaaggggtctgctgccggg

SEQ ID NO: 70003 - DNA, 20 bp, human
gcgggacatggcacacgcac

SEQ ID NO: 70004 - DNA, 20 bp, human
ggaccgcagcccacgagtag

SEQ ID NO: 70005 - DNA, 20 bp, human
ggggtctgctgccgggaggt

SEQ ID NO: 70006 - DNA, 20 bp, human
gcccgcccgcccgacggaga

SEQ ID NO: 70007 - DNA, 20 bp, human
gacgtccgctcgctccccgg

SEQ ID NO: 70008 - DNA, 20 bp, human
gcgacggagacggtgaggag

SEQ ID NO: 70009 - DNA, 20 bp, human
gcgaggggcccggaagtact

SEQ ID NO: 70010 - DNA, 20 bp, human
ggggctcgggccccagacca

SEQ ID NO: 70011 - DNA, 20 bp, human
ggcgcccaggaccccatcga

SEQ ID NO: 70012 - DNA, 20 bp, human
ggcgcctggccctctcagtc

SEQ ID NO: 70013 - DNA, 20 bp, human
ggagtgactccggactgaga

SEQ ID NO: 70014 - DNA, 20 bp, human
gcggcgagtccaccactggg

SEQ ID NO: 70015 - DNA, 20 bp, human
gccggaagtactcggctcag

SEQ ID NO: 70016 - DNA, 20 bp, human
ggggacccctgactggacgg

SEQ ID NO: 70017 - DNA, 20 bp, human
gggcctgcttaggcacccgg

SEQ ID NO: 70018 - DNA, 20 bp, human
gcgccgccgaatccccaaca

SEQ ID NO: 70019 - DNA, 20 bp, human
ggcccgcggcgccaagatgg

SEQ ID NO: 70020 - DNA, 20 bp, human
gcaacaaggagcgaagcccg

SEQ ID NO: 70021 - DNA, 20 bp, human
gccccgggatgggtccaccg

SEQ ID NO: 70022 - DNA, 20 bp, human
gcctgcggcgtggtcccccc

SEQ ID NO: 70023 - DNA, 20 bp, human
gcgggatgggtccaccgagg

SEQ ID NO: 70024 - DNA, 20 bp, human
gcctgcgggtcgcacccctg

SEQ ID NO: 70025 - DNA, 20 bp, human
ggcgcgggctcggcctccag

SEQ ID NO: 70026 - DNA, 20 bp, human
gcttaaaggcgcccgagtgt

SEQ ID NO: 70027 - DNA, 20 bp, human
gttgagggagccctccgatg

SEQ ID NO: 70028 - DNA, 20 bp, human
gctgacggccggaaggaaaa

SEQ ID NO: 70029 - DNA, 20 bp, human
gaggggtctgccccatcgga

SEQ ID NO: 70030 - DNA, 20 bp, human
ggccaggtggaagatgctcg

SEQ ID NO: 70031 - DNA, 20 bp, human
gggccaagtactctagctat

SEQ ID NO: 70032 - DNA, 20 bp, human
gtggtgagttgccgctggga

SEQ ID NO: 70033 - DNA, 20 bp, human
gccaggcgccggggcaggaa

SEQ ID NO: 70034 - DNA, 20 bp, human
ggtaggcgacaggccgctga

SEQ ID NO: 70035 - DNA, 20 bp, human
gatgctgccctgaggcgtgg

SEQ ID NO: 70036 - DNA, 20 bp, human
ggcggaactaagaaaagaag

SEQ ID NO: 70037 - DNA, 20 bp, human
ggagtagatacccctcacca

SEQ ID NO: 70038 - DNA, 20 bp, human
gcctgtggacagaacaatca

SEQ ID NO: 70039 - DNA, 20 bp, human
gacagaacaatcatggtcag

SEQ ID NO: 70040 - DNA, 20 bp, human
gcaggggccaggggttctat

SEQ ID NO: 70041 - DNA, 20 bp, human
gcttctaggcgtggggaccg

SEQ ID NO: 70042 - DNA, 20 bp, human
gtccgctgtcttctaggcgt

SEQ ID NO: 70043 - DNA, 20 bp, human
ggtggggaccggggctgtag

SEQ ID NO: 70044 - DNA, 20 bp, human
ggggcgggctgtgcagtagg

SEQ ID NO: 70045 - DNA, 20 bp, human
gcgggaagggggcccaactg

SEQ ID NO: 70046 - DNA, 20 bp, human
gacgcagcagagccgggtag

SEQ ID NO: 70047 - DNA, 20 bp, human
gctgcggcggcaggaaatcg

SEQ ID NO: 70048 - DNA, 20 bp, human
gccgtcctgagagccaggag

SEQ ID NO: 70049 - DNA, 20 bp, human
gcgactccccagggctacag

SEQ ID NO: 70050 - DNA, 20 bp, human
gcctggctctcaggacggag

SEQ ID NO: 70051 - DNA, 20 bp, human
gcagcactgccgactcccca

SEQ ID NO: 70052 - DNA, 20 bp, human
gcgacgcggaaccgaggcgg

SEQ ID NO: 70053 - DNA, 20 bp, human
ggcagggcgacgcggaaccg

SEQ ID NO: 70054 - DNA, 20 bp, human
gcgatccccgggcccagata

SEQ ID NO: 70055 - DNA, 20 bp, human
gagggtgccacgactgctga

SEQ ID NO: 70056 - DNA, 20 bp, human
gcatgtggcagctcacccaa

SEQ ID NO: 70057 - DNA, 20 bp, human
gtcggagcgtggggaccctt

SEQ ID NO: 70058 - DNA, 20 bp, human
ggccatggagctcccattgg

SEQ ID NO: 70059 - DNA, 20 bp, human
gctagccatggagctcccat

SEQ ID NO: 70060 - DNA, 20 bp, human
ggcaggagcctggacctgaa

SEQ ID NO: 70061 - DNA, 20 bp, human
ggaggacgagaattcacctg

SEQ ID NO: 70062 - DNA, 20 bp, human
gtcctctccaggacagtgag

SEQ ID NO: 70063 - DNA, 20 bp, human
gtggcactggctgccaccaa

SEQ ID NO: 70064 - DNA, 20 bp, human
gtgagcgcgcatggtggcac

SEQ ID NO: 70065 - DNA, 20 bp, human
ggccagtagctcctcgggta

SEQ ID NO: 70066 - DNA, 20 bp, human
gcacactgcggggctccgag

SEQ ID NO: 70067 - DNA, 20 bp, human
gaggctcagatggctggagg

SEQ ID NO: 70068 - DNA, 20 bp, human
ggggaggctcagatggctgg

SEQ ID NO: 70069 - DNA, 20 bp, human
gccccagggaagcggagttg

SEQ ID NO: 70070 - DNA, 20 bp, human
ggcggcgggcacgcacactg

SEQ ID NO: 70071 - DNA, 20 bp, human
gtgggacccctgagcatagt

SEQ ID NO: 70072 - DNA, 20 bp, human
gcactcccctcggagcccca

SEQ ID NO: 70073 - DNA, 20 bp, human
ggcccaagcagctgacgagg

SEQ ID NO: 70074 - DNA, 20 bp, human
ggaaactgacctgtgcccct

SEQ ID NO: 70075 - DNA, 20 bp, human
gaccccccaactatgctcag

SEQ ID NO: 70076 - DNA, 20 bp, human
gttggacatgaacttgtcta

SEQ ID NO: 70077 - DNA, 20 bp, human
gctagtccgctggcaaactt

SEQ ID NO: 70078 - DNA, 20 bp, human
gaagatggtaagtgaggaac

SEQ ID NO: 70079 - DNA, 20 bp, human
gagagacccaagtttgccag

SEQ ID NO: 70080 - DNA, 20 bp, human
gagctttaaatgagactgag

SEQ ID NO: 70081 - DNA, 20 bp, human
gcaggtggagggggaagttg

SEQ ID NO: 70082 - DNA, 20 bp, human
gtctcatttaaagctcccac

SEQ ID NO: 70083 - DNA, 20 bp, human
gctggcgttagctagtccgc

SEQ ID NO: 70084 - DNA, 20 bp, human
gagaaatcttgctccgaagg

SEQ ID NO: 70085 - DNA, 20 bp, human
gaatttttcagtaaaaccag

SEQ ID NO: 70086 - DNA, 20 bp, human
gcgggcactccagcgaccgt

SEQ ID NO: 70087 - DNA, 20 bp, human
gctgggcctccgggacaagt

SEQ ID NO: 70088 - DNA, 20 bp, human
gggcccagcgccaggctagg

SEQ ID NO: 70089 - DNA, 20 bp, human
ggcaggaagtgggtacgcag

SEQ ID NO: 70090 - DNA, 20 bp, human
gtcacctacgctgatcccca

SEQ ID NO: 70091 - DNA, 20 bp, human
gcgaccgtggggatcagcgt

SEQ ID NO: 70092 - DNA, 20 bp, human
gcgtccgagcctaccaaccg

SEQ ID NO: 70093 - DNA, 20 bp, human
gcagctgtcaaagtaggacg

SEQ ID NO: 70094 - DNA, 20 bp, human
gcgggcgagcggagttagca

SEQ ID NO: 70095 - DNA, 20 bp, human
ggggaaagcgagtcgtctag

SEQ ID NO: 70096 - DNA, 20 bp, human
gaggagcttgcagtagcggg

SEQ ID NO: 70097 - DNA, 20 bp, human
ggaagggagctagtggtaaa

SEQ ID NO: 70098 - DNA, 20 bp, human
gggaaggagcttgcagtagc

SEQ ID NO: 70099 - DNA, 20 bp, human
ggggtggcggcaggggtaag

SEQ ID NO: 70100 - DNA, 20 bp, human
gggatttttgctgggattag

SEQ ID NO: 70101 - DNA, 20 bp, human
ggattgtgggaccaacacag

SEQ ID NO: 70102 - DNA, 20 bp, human
gcacaatccctggcaatgag

SEQ ID NO: 70103 - DNA, 20 bp, human
gttggacagagtcagttgtg

SEQ ID NO: 70104 - DNA, 20 bp, human
gttgcgagaagacacgtgcg

SEQ ID NO: 70105 - DNA, 20 bp, human
ggagaagacacgtgcgcgga

SEQ ID NO: 70106 - DNA, 20 bp, human
ggggccagcagccgtctacc

SEQ ID NO: 70107 - DNA, 20 bp, human
gcgccctgacgccggatcca

SEQ ID NO: 70108 - DNA, 20 bp, human
ggggctcagtcagaaggtac

SEQ ID NO: 70109 - DNA, 20 bp, human
gagggatggccagcgactag

SEQ ID NO: 70110 - DNA, 20 bp, human
ggaacgcgacaccgggtaga

SEQ ID NO: 70111 - DNA, 20 bp, human
gcaacacagaacgcgacacc

SEQ ID NO: 70112 - DNA, 20 bp, human
gggccctggatccggcgtca

SEQ ID NO: 70113 - DNA, 20 bp, human
gcccgaactcaggccggacc

SEQ ID NO: 70114 - DNA, 20 bp, human
gatccggcgtcagggcgacc

SEQ ID NO: 70115 - DNA, 20 bp, human
gctcgccccgagggtgacca

SEQ ID NO: 70116 - DNA, 20 bp, human
gtcttgaggctgctccgctt

SEQ ID NO: 70117 - DNA, 20 bp, human
gtgtcctgctccgacctaag

SEQ ID NO: 70118 - DNA, 20 bp, human
gcagcacctgccaggacgtg

SEQ ID NO: 70119 - DNA, 20 bp, human
gctcaagagccgagccgagg

SEQ ID NO: 70120 - DNA, 20 bp, human
gcttcccctaggccacccaa

SEQ ID NO: 70121 - DNA, 20 bp, human
gggacgtgaggtgtctttaa

SEQ ID NO: 70122 - DNA, 20 bp, human
gcccggcccacgccagctcc

SEQ ID NO: 70123 - DNA, 20 bp, human
gacacgtcggtcccgttggg

SEQ ID NO: 70124 - DNA, 20 bp, human
gtgaggtccgcatctatgcg

SEQ ID NO: 70125 - DNA, 20 bp, human
gggacgttcggaagtcgcag

SEQ ID NO: 70126 - DNA, 20 bp, human
gacccctgcaaagagcaatg

SEQ ID NO: 70127 - DNA, 20 bp, human
gtgtggcccaccgggagcgt

SEQ ID NO: 70128 - DNA, 20 bp, human
ggtagaagaaggaagtgtag

SEQ ID NO: 70129 - DNA, 20 bp, human
gggtaaggaatgcaccgtca

SEQ ID NO: 70130 - DNA, 20 bp, human
ggccccattgctctttgcag

SEQ ID NO: 70131 - DNA, 20 bp, human
ggaggccaccagccgtaaca

SEQ ID NO: 70132 - DNA, 20 bp, human
gtctttgcaggggtagaaga

SEQ ID NO: 70133 - DNA, 20 bp, human
gaccatattaggacaaggac

SEQ ID NO: 70134 - DNA, 20 bp, human
gcgtggctgcgattacccta

SEQ ID NO: 70135 - DNA, 20 bp, human
gttgaccccacgctcccggt

SEQ ID NO: 70136 - DNA, 20 bp, human
gagcaacagcagcggagcgc

SEQ ID NO: 70137 - DNA, 20 bp, human
gagcgcgggccccagcgccg

SEQ ID NO: 70138 - DNA, 20 bp, human
gatgccacaggccccgacca

SEQ ID NO: 70139 - DNA, 20 bp, human
gtacgacgcgtggctgcccg

SEQ ID NO: 70140 - DNA, 20 bp, human
gcggctgcggagggtatctg

SEQ ID NO: 70141 - DNA, 20 bp, human
gccgaatggagcaacagcag

SEQ ID NO: 70142 - DNA, 20 bp, human
ggtcgtagagtccctggtcg

SEQ ID NO: 70143 - DNA, 20 bp, human
gacggcgacagtacgagacg

SEQ ID NO: 70144 - DNA, 20 bp, human
gcgggctctgcgccccacag

SEQ ID NO: 70145 - DNA, 20 bp, human
gccacgcgtcgtagagtccc

SEQ ID NO: 70146 - DNA, 20 bp, human
gccgcagccggcaggcccgg

SEQ ID NO: 70147 - DNA, 20 bp, human
gcggcgctgtcgctcggttg

SEQ ID NO: 70148 - DNA, 20 bp, human
gcgctgtcgctcggttgcgg

SEQ ID NO: 70149 - DNA, 20 bp, human
gcggcggcgcgggctgagtg

SEQ ID NO: 70150 - DNA, 20 bp, human
gcccagcctgctaggttgtc

SEQ ID NO: 70151 - DNA, 20 bp, human
gcagcgccggacaacctagc

SEQ ID NO: 70152 - DNA, 20 bp, human
gcgctcggttgcggcggctg

SEQ ID NO: 70153 - DNA, 20 bp, human
gccagccgcggactcccgcg

SEQ ID NO: 70154 - DNA, 20 bp, human
gtgggagcgcagcccgcgac

SEQ ID NO: 70155 - DNA, 20 bp, human
gcggcccgacccggacaggc

SEQ ID NO: 70156 - DNA, 20 bp, human
gggcctcggagcgactgcag

SEQ ID NO: 70157 - DNA, 20 bp, human
gctccgccgggcccgagtgg

SEQ ID NO: 70158 - DNA, 20 bp, human
gggacgcggcctgaggcgag

SEQ ID NO: 70159 - DNA, 20 bp, human
ggcggcggcggaccacggag

SEQ ID NO: 70160 - DNA, 20 bp, human
gggcggccgggcgacgagtg

SEQ ID NO: 70161 - DNA, 20 bp, human
gtgaggggccatgtccgggg

SEQ ID NO: 70162 - DNA, 20 bp, human
gcgccttctggtcgaactcg

SEQ ID NO: 70163 - DNA, 20 bp, human
gcgccgctgcagtcgctccg

SEQ ID NO: 70164 - DNA, 20 bp, human
gcagcagcgcgtcgatgtcg

SEQ ID NO: 70165 - DNA, 20 bp, human
gggccgcgagttcgaccaga

SEQ ID NO: 70166 - DNA, 20 bp, human
gctccggcaccgaggctcga

SEQ ID NO: 70167 - DNA, 20 bp, human
gcggcaccgaggctcgaggg

SEQ ID NO: 70168 - DNA, 20 bp, human
gccggctgcctgctgacgag

SEQ ID NO: 70169 - DNA, 20 bp, human
ggcagatgcggatcatccac

SEQ ID NO: 70170 - DNA, 20 bp, human
gggtgccgggccgggaatgg

SEQ ID NO: 70171 - DNA, 20 bp, human
ggcgacacagcggaccaggg

SEQ ID NO: 70172 - DNA, 20 bp, human
gccagcgacacagcggacca

SEQ ID NO: 70173 - DNA, 20 bp, human
gcacgttgctgtagatggtg

SEQ ID NO: 70174 - DNA, 20 bp, human
ggagcagcaacgcaagtcca

SEQ ID NO: 70175 - DNA, 20 bp, human
gtctacagcaacgtgatcaa

SEQ ID NO: 70176 - DNA, 20 bp, human
gcagcatgcgacgggcacag

SEQ ID NO: 70177 - DNA, 20 bp, human
gtagtctgcggtcactgctg

SEQ ID NO: 70178 - DNA, 20 bp, human
gcgggaggtaggcgcggagt

SEQ ID NO: 70179 - DNA, 20 bp, human
gtaagacgcctggacctccg

SEQ ID NO: 70180 - DNA, 20 bp, human
gcacccggccagcatgcgac

SEQ ID NO: 70181 - DNA, 20 bp, human
gtggaggcaaaggacctggc

SEQ ID NO: 70182 - DNA, 20 bp, human
gcggagtgggttggaggcaa

SEQ ID NO: 70183 - DNA, 20 bp, human
ggagggcgagtcgagaagtt

SEQ ID NO: 70184 - DNA, 20 bp, human
gagactaagactgagtggaa

SEQ ID NO: 70185 - DNA, 20 bp, human
gaccgcagactaagactgag

SEQ ID NO: 70186 - DNA, 20 bp, human
gggaagtctaggtccctggg

SEQ ID NO: 70187 - DNA, 20 bp, human
gatcctccgtcaggcaccag

SEQ ID NO: 70188 - DNA, 20 bp, human
gggcaaccgggtgcgcaggg

SEQ ID NO: 70189 - DNA, 20 bp, human
gcagcgagcgggccatggtg

SEQ ID NO: 70190 - DNA, 20 bp, human
gccagccggcaggggtgtcg

SEQ ID NO: 70191 - DNA, 20 bp, human
ggggtgagtccagggtcggt

SEQ ID NO: 70192 - DNA, 20 bp, human
gaggaagcccggctcggcgg

SEQ ID NO: 70193 - DNA, 20 bp, human
ggtttcaggcaaggaagtct

SEQ ID NO: 70194 - DNA, 20 bp, human
gcaaggaagtctaggtccct

SEQ ID NO: 70195 - DNA, 20 bp, human
gggggtgacccccaaggaaa

SEQ ID NO: 70196 - DNA, 20 bp, human
gcgacccccgggccccgacc

SEQ ID NO: 70197 - DNA, 20 bp, human
ggcggagagagaccagacac

SEQ ID NO: 70198 - DNA, 20 bp, human
ggtgcgggctccaagcacag

SEQ ID NO: 70199 - DNA, 20 bp, human
gagctgctgctgctcggtaa

SEQ ID NO: 70200 - DNA, 20 bp, human
gcttctcgccgtcctcacgg

SEQ ID NO: 70201 - DNA, 20 bp, human
gcccaggcgcgagtccgagg

SEQ ID NO: 70202 - DNA, 20 bp, human
ggccgctgcactcccgccgg

SEQ ID NO: 70203 - DNA, 20 bp, human
ggaccagacaccgggagagg

SEQ ID NO: 70204 - DNA, 20 bp, human
gatcgaccgcaacctccgtg

SEQ ID NO: 70205 - DNA, 20 bp, human
ggagcccaggcgcgagtccg

SEQ ID NO: 70206 - DNA, 20 bp, human
gctgcgggaagcactcgggt

SEQ ID NO: 70207 - DNA, 20 bp, human
ggccctctgcgggaagcact

SEQ ID NO: 70208 - DNA, 20 bp, human
gggggtctgggatgagacag

SEQ ID NO: 70209 - DNA, 20 bp, human
gccccacacggcccacggcc

SEQ ID NO: 70210 - DNA, 20 bp, human
gtgtctgggaccccacacct

SEQ ID NO: 70211 - DNA, 20 bp, human
gaggggtctggtctagagtc

SEQ ID NO: 70212 - DNA, 20 bp, human
gctgcgggaggacggagaga

SEQ ID NO: 70213 - DNA, 20 bp, human
gagttccgagcgactgcggg

SEQ ID NO: 70214 - DNA, 20 bp, human
gtctggtctagagtctgggc

SEQ ID NO: 70215 - DNA, 20 bp, human
gggcagttccgagcgactgc

SEQ ID NO: 70216 - DNA, 20 bp, human
ggccaccgcccagcaataga

SEQ ID NO: 70217 - DNA, 20 bp, human
gtgggcgctaagggagctga

SEQ ID NO: 70218 - DNA, 20 bp, human
gggcaccgtctattgctggg

SEQ ID NO: 70219 - DNA, 20 bp, human
gctgtagagggtgtgactcc

SEQ ID NO: 70220 - DNA, 20 bp, human
gtcctagctgaggccccaga

SEQ ID NO: 70221 - DNA, 20 bp, human
gcaccacggaaactgcggct

SEQ ID NO: 70222 - DNA, 20 bp, human
ggctaagggagctgacggag

SEQ ID NO: 70223 - DNA, 20 bp, human
gtgaggcaccgtctattgct

SEQ ID NO: 70224 - DNA, 20 bp, human
gacggaaactgcggctcggc

SEQ ID NO: 70225 - DNA, 20 bp, human
gtgcgggaattaggctgtag

SEQ ID NO: 70226 - DNA, 20 bp, human
ggcaccgggatcccagacca

SEQ ID NO: 70227 - DNA, 20 bp, human
gcgacggctgaggaatagca

SEQ ID NO: 70228 - DNA, 20 bp, human
ggcgccaccggggtcccaga

SEQ ID NO: 70229 - DNA, 20 bp, human
gcctggcgggcgaagactcg

SEQ ID NO: 70230 - DNA, 20 bp, human
ggtgactggtgagcctcgga

SEQ ID NO: 70231 - DNA, 20 bp, human
gggatcccagaccagggagg

SEQ ID NO: 70232 - DNA, 20 bp, human
gggagggggcgcacgtccga

SEQ ID NO: 70233 - DNA, 20 bp, human
gccacctcggctgtctccag

SEQ ID NO: 70234 - DNA, 20 bp, human
gccgggatcccagaccaggg

SEQ ID NO: 70235 - DNA, 20 bp, human
gtcagggagctgacccccca

SEQ ID NO: 70236 - DNA, 20 bp, human
gccacctcggctgtctccag

SEQ ID NO: 70237 - DNA, 20 bp, human
gcacaatgaacggagacggg

SEQ ID NO: 70238 - DNA, 20 bp, human
ggcaagacgacggaagacca

SEQ ID NO: 70239 - DNA, 20 bp, human
gcccggctagtggtgagaga

SEQ ID NO: 70240 - DNA, 20 bp, human
gtctccgctggagacagccg

SEQ ID NO: 70241 - DNA, 20 bp, human
gagagagttggagacgtgtg

SEQ ID NO: 70242 - DNA, 20 bp, human
gagggacgtggggcgaaccc

SEQ ID NO: 70243 - DNA, 20 bp, human
gacgtgtgcggctcctgcga

SEQ ID NO: 70244 - DNA, 20 bp, human
gcgagggcgccggtctccgc

SEQ ID NO: 70245 - DNA, 20 bp, human
ggctcctgggtaaggccgag

SEQ ID NO: 70246 - DNA, 20 bp, human
gaacaagcgcgcgcgcgcct

SEQ ID NO: 70247 - DNA, 20 bp, human
gctctgcgcacccggctccg

SEQ ID NO: 70248 - DNA, 20 bp, human
gtgagcctaccggagagaga

SEQ ID NO: 70249 - DNA, 20 bp, human
gcagccagccgggagctcga

SEQ ID NO: 70250 - DNA, 20 bp, human
ggcgcggactgcaggcactg

SEQ ID NO: 70251 - DNA, 20 bp, human
gcatcgctcggtgagcctac

SEQ ID NO: 70252 - DNA, 20 bp, human
gcgcagccggagccgacaga

SEQ ID NO: 70253 - DNA, 20 bp, human
gctctccctctctctccggt

SEQ ID NO: 70254 - DNA, 20 bp, human
gcgcaccgacggctgaagag

SEQ ID NO: 70255 - DNA, 20 bp, human
gtctggggctccggagccaa

SEQ ID NO: 70256 - DNA, 20 bp, human
gactggagcacagatccggg

SEQ ID NO: 70257 - DNA, 20 bp, human
ggctccgcgcctggcaatcg

SEQ ID NO: 70258 - DNA, 20 bp, human
ggagcacagatccgggaggg

SEQ ID NO: 70259 - DNA, 20 bp, human
gctccttccccgggaacagg

SEQ ID NO: 70260 - DNA, 20 bp, human
gcgccaggcgcacggcgtag

SEQ ID NO: 70261 - DNA, 20 bp, human
gctgaactggagcacagatc

SEQ ID NO: 70262 - DNA, 20 bp, human
gaggggagcctcgcaggcgg

SEQ ID NO: 70263 - DNA, 20 bp, human
gaggcgcgggcgtctgagcg

SEQ ID NO: 70264 - DNA, 20 bp, human
gggcgggccgcctgttcccg

SEQ ID NO: 70265 - DNA, 20 bp, human
gggcgagagctcattcaccg

SEQ ID NO: 70266 - DNA, 20 bp, human
ggccgaggcaataagagcgg

SEQ ID NO: 70267 - DNA, 20 bp, human
gccggccgaggcaataagag

SEQ ID NO: 70268 - DNA, 20 bp, human
gccctcggcctcggctcgag

SEQ ID NO: 70269 - DNA, 20 bp, human
gcggcccgggggccctcgaa

SEQ ID NO: 70270 - DNA, 20 bp, human
gctggtccgcctcggcccgg

SEQ ID NO: 70271 - DNA, 20 bp, human
ggctgctgctgggtaagggc

SEQ ID NO: 70272 - DNA, 20 bp, human
gaaggacaagcaggtctacc

SEQ ID NO: 70273 - DNA, 20 bp, human
ggggtgtcggtcggaccgag

SEQ ID NO: 70274 - DNA, 20 bp, human
gggccgaggcggaccagagc

SEQ ID NO: 70275 - DNA, 20 bp, human
gccatcagccccctcggcct

SEQ ID NO: 70276 - DNA, 20 bp, human
gggcagagccgtctggagag

SEQ ID NO: 70277 - DNA, 20 bp, human
ggtggtgtcctagtccccca

SEQ ID NO: 70278 - DNA, 20 bp, human
ggtggttcttctggatggag

SEQ ID NO: 70279 - DNA, 20 bp, human
gtggttggcacgcacttctg

SEQ ID NO: 70280 - DNA, 20 bp, human
gcctgctgctgggaccatgg

SEQ ID NO: 70281 - DNA, 20 bp, human
gacgcacttctggggagggt

SEQ ID NO: 70282 - DNA, 20 bp, human
gatgagcctgtgacagagta

SEQ ID NO: 70283 - DNA, 20 bp, human
ggtgggatgtccagccctgg

SEQ ID NO: 70284 - DNA, 20 bp, human
ggactaggacaccacctgtc

SEQ ID NO: 70285 - DNA, 20 bp, human
gtaggggtgtgggcccaggt

SEQ ID NO: 70286 - DNA, 20 bp, human
gggtcgttgagtcccctcgt

SEQ ID NO: 70287 - DNA, 20 bp, human
ggaagaaaggaagccaacga

SEQ ID NO: 70288 - DNA, 20 bp, human
ggtgctcttcccggactcac

SEQ ID NO: 70289 - DNA, 20 bp, human
gctcaactgttctgggacag

SEQ ID NO: 70290 - DNA, 20 bp, human
gccggcacctgaaagagacg

SEQ ID NO: 70291 - DNA, 20 bp, human
ggtcctggtggataatcctg

SEQ ID NO: 70292 - DNA, 20 bp, human
ggatgatggcgataaactcg

SEQ ID NO: 70293 - DNA, 20 bp, human
ggcgcgtacgatggccagga

SEQ ID NO: 70294 - DNA, 20 bp, human
gcaccaggacgggtactcgc

SEQ ID NO: 70295 - DNA, 20 bp, human
gagcgcctcgtggggaagtg

SEQ ID NO: 70296 - DNA, 20 bp, human
gccctagccagactgtgtag

SEQ ID NO: 70297 - DNA, 20 bp, human
gtaaaagctggtctgtacga

SEQ ID NO: 70298 - DNA, 20 bp, human
gctcaccccatgggaaggaa

SEQ ID NO: 70299 - DNA, 20 bp, human
gtaggtctccagttgaagta

SEQ ID NO: 70300 - DNA, 20 bp, human
ggcctaaacagccaccccaa

SEQ ID NO: 70301 - DNA, 20 bp, human
ggaactggccaagaggtcca

SEQ ID NO: 70302 - DNA, 20 bp, human
gagctggtctgtacgatggc

SEQ ID NO: 70303 - DNA, 20 bp, human
gtcctctcctctacacagtc

SEQ ID NO: 70304 - DNA, 20 bp, human
gaatccctagactaagaagt

SEQ ID NO: 70305 - DNA, 20 bp, human
gccttacgagagaggattag

SEQ ID NO: 70306 - DNA, 20 bp, human
ggctgtggtttggacatagg

SEQ ID NO: 70307 - DNA, 20 bp, human
gacagctgtggtttggacat

SEQ ID NO: 70308 - DNA, 20 bp, human
gcattagggaatggactgct

SEQ ID NO: 70309 - DNA, 20 bp, human
ggcctccttgcttaacaaaa

SEQ ID NO: 70310 - DNA, 20 bp, human
ggtatctaccaccacaagat

SEQ ID NO: 70311 - DNA, 20 bp, human
gccgtaaagctgctactatt

SEQ ID NO: 70312 - DNA, 20 bp, human
gtccacttcccatcttgtgg

SEQ ID NO: 70313 - DNA, 20 bp, human
gacctttttgttaagcaagg

SEQ ID NO: 70314 - DNA, 20 bp, human
ggccaaaagatcaaaagaac

SEQ ID NO: 70315 - DNA, 20 bp, human
gtaagattctgctttgacta

SEQ ID NO: 70316 - DNA, 20 bp, human
ggctgaggcgggtctcccta

SEQ ID NO: 70317 - DNA, 20 bp, human
gcgtcagggatgcccctcag

SEQ ID NO: 70318 - DNA, 20 bp, human
ggccgggcgcccccaagcag

SEQ ID NO: 70319 - DNA, 20 bp, human
gcaggggtgggggacaccaa

SEQ ID NO: 70320 - DNA, 20 bp, human
gccccaagcagcggctgatg

SEQ ID NO: 70321 - DNA, 20 bp, human
gttcaggcaaggccctgcat

SEQ ID NO: 70322 - DNA, 20 bp, human
ggccaggcgagctgcgggag

SEQ ID NO: 70323 - DNA, 20 bp, human
gctccctagggggaggatca

SEQ ID NO: 70324 - DNA, 20 bp, human
gggcggttgaggacccggga

SEQ ID NO: 70325 - DNA, 20 bp, human
gggcgggtctccctaggggg

SEQ ID NO: 70326 - DNA, 20 bp, human
ggctggaggcgtctgagggg

SEQ ID NO: 70327 - DNA, 20 bp, human
gcgcctccagccatcgggat

SEQ ID NO: 70328 - DNA, 20 bp, human
ggcccgcggcgcgagaacaa

SEQ ID NO: 70329 - DNA, 20 bp, human
gcagcccccggccccccctt

SEQ ID NO: 70330 - DNA, 20 bp, human
gctcagacgcctccagccat

SEQ ID NO: 70331 - DNA, 20 bp, human
gtccgaaggcccgaaggtgg

SEQ ID NO: 70332 - DNA, 20 bp, human
gaggaagacgcggccccgac

SEQ ID NO: 70333 - DNA, 20 bp, human
gaagacgcggccccgaccgg

SEQ ID NO: 70334 - DNA, 20 bp, human
ggcgtctgaggggcggacgg

SEQ ID NO: 70335 - DNA, 20 bp, human
gccgcgcgggccgcctatcg

SEQ ID NO: 70336 - DNA, 20 bp, human
ggagcaggcgttcccgactc

SEQ ID NO: 70337 - DNA, 20 bp, human
gaagtcgggaaaagacgcag

SEQ ID NO: 70338 - DNA, 20 bp, human
ggattcgcgtagcctcaggt

SEQ ID NO: 70339 - DNA, 20 bp, human
ggagttcaagccggccgccc

SEQ ID NO: 70340 - DNA, 20 bp, human
gtacgagctcacaaggccca

SEQ ID NO: 70341 - DNA, 20 bp, human
ggcgtgcacggagttcaagc

SEQ ID NO: 70342 - DNA, 20 bp, human
ggtgaggccaggcaaggagc

SEQ ID NO: 70343 - DNA, 20 bp, human
ggttcccgactccggcaaga

SEQ ID NO: 70344 - DNA, 20 bp, human
gagctccaggcccgcgtgca

SEQ ID NO: 70345 - DNA, 20 bp, human
gcctctgagggcgagagtcc

SEQ ID NO: 70346 - DNA, 20 bp, human
gcgacagtggaggacacgag

SEQ ID NO: 70347 - DNA, 20 bp, human
gcacgaggggtgctccccgg

SEQ ID NO: 70348 - DNA, 20 bp, human
gcaacttccgagggagcaag

SEQ ID NO: 70349 - DNA, 20 bp, human
ggcgctgtcttcctccgcgg

SEQ ID NO: 70350 - DNA, 20 bp, human
ggcggcgctgtcttcctccg

SEQ ID NO: 70351 - DNA, 20 bp, human
gcgggagaccgaaggaagag

SEQ ID NO: 70352 - DNA, 20 bp, human
gttgccagcgaaggtacctg

SEQ ID NO: 70353 - DNA, 20 bp, human
gtgctccctcggaagttggg

SEQ ID NO: 70354 - DNA, 20 bp, human
ggagggagcaagaggcagtc

SEQ ID NO: 70355 - DNA, 20 bp, human
gccagcgaaggtacctgtgg

SEQ ID NO: 70356 - DNA, 20 bp, human
gtgcaaggcggcggcaggag

SEQ ID NO: 70357 - DNA, 20 bp, human
ggtcgctgcagcgacgagga

SEQ ID NO: 70358 - DNA, 20 bp, human
gcgagcctaggcctcaaccc

SEQ ID NO: 70359 - DNA, 20 bp, human
gtgcgagctgatgtacacgt

SEQ ID NO: 70360 - DNA, 20 bp, human
ggcagcgacgaggatggcac

SEQ ID NO: 70361 - DNA, 20 bp, human
gctctttcactgcaaggcgg

SEQ ID NO: 70362 - DNA, 20 bp, human
gggccacactacgaaggaga

SEQ ID NO: 70363 - DNA, 20 bp, human
ggtgtgtcgctgcagcgacg

SEQ ID NO: 70364 - DNA, 20 bp, human
gcagctcgcagctgctagga

SEQ ID NO: 70365 - DNA, 20 bp, human
gagggtcatctgctcagtca

SEQ ID NO: 70366 - DNA, 20 bp, human
gagcctgggcaggtgacggg

SEQ ID NO: 70367 - DNA, 20 bp, human
ggcgcgggcgtcgcagctga

SEQ ID NO: 70368 - DNA, 20 bp, human
gtaaggaggctcccaggaac

SEQ ID NO: 70369 - DNA, 20 bp, human
ggagcaactgcgtcaggaag

SEQ ID NO: 70370 - DNA, 20 bp, human
gagtctggtgtgggcacgaa

SEQ ID NO: 70371 - DNA, 20 bp, human
gacacagggaaacgactggg

SEQ ID NO: 70372 - DNA, 20 bp, human
gttctggggccccaggggta

SEQ ID NO: 70373 - DNA, 20 bp, human
gaagacacagggaaacgact

SEQ ID NO: 70374 - DNA, 20 bp, human
gccatggctgacaggtcgag

SEQ ID NO: 70375 - DNA, 20 bp, human
gacaggtcgaggggtcactc

SEQ ID NO: 70376 - DNA, 20 bp, human
ggttattttgggggcacgca

SEQ ID NO: 70377 - DNA, 20 bp, human
gtggcagctgggcgcgacac

SEQ ID NO: 70378 - DNA, 20 bp, human
gccggggagcgaggaacggt

SEQ ID NO: 70379 - DNA, 20 bp, human
ggcctgagctccctccaggt

SEQ ID NO: 70380 - DNA, 20 bp, human
gtgagctgcgctctccacgc

SEQ ID NO: 70381 - DNA, 20 bp, human
gggggagtgacgagaaacca

SEQ ID NO: 70382 - DNA, 20 bp, human
ggcgccgcgagccacccctg

SEQ ID NO: 70383 - DNA, 20 bp, human
ggagctcgccgcctacctgg

SEQ ID NO: 70384 - DNA, 20 bp, human
ggccggcgcaggcacttccc

SEQ ID NO: 70385 - DNA, 20 bp, human
gacgccggctccgcgctcca

SEQ ID NO: 70386 - DNA, 20 bp, human
gcgcgaagatggcaaccgag

SEQ ID NO: 70387 - DNA, 20 bp, human
gtcttcgcgcggggacgcag

SEQ ID NO: 70388 - DNA, 20 bp, human
ggacccccgccgccagctag

SEQ ID NO: 70389 - DNA, 20 bp, human
ggcgaggccgagagcctcaa

SEQ ID NO: 70390 - DNA, 20 bp, human
gcggcggtggggccctcgga

SEQ ID NO: 70391 - DNA, 20 bp, human
gaggtgcccggaccctccga

SEQ ID NO: 70392 - DNA, 20 bp, human
gcctgcctggaagctgcgaa

SEQ ID NO: 70393 - DNA, 20 bp, human
ggccagctagcggaggaccg

SEQ ID NO: 70394 - DNA, 20 bp, human
gcctgccctccgcatgggag

SEQ ID NO: 70395 - DNA, 20 bp, human
gccccgccgccagctagcgg

SEQ ID NO: 70396 - DNA, 20 bp, human
gcccgagcgcggaaaccgag

SEQ ID NO: 70397 - DNA, 20 bp, human
gagcggggcggggcgagaga

SEQ ID NO: 70398 - DNA, 20 bp, human
gagcaggggaggggatgtag

SEQ ID NO: 70399 - DNA, 20 bp, human
gcgagagccgggtccagtgt

SEQ ID NO: 70400 - DNA, 20 bp, human
ggccccgccccgctcctaac

SEQ ID NO: 70401 - DNA, 20 bp, human
gaacagtgctgtccaatcag

SEQ ID NO: 70402 - DNA, 20 bp, human
gcccaccccgagccacacgg

SEQ ID NO: 70403 - DNA, 20 bp, human
gcctggcaggcgagctgtcc

SEQ ID NO: 70404 - DNA, 20 bp, human
gcaccgcgctcctcgggcga

SEQ ID NO: 70405 - DNA, 20 bp, human
gccaggggacaagtcaacct

SEQ ID NO: 70406 - DNA, 20 bp, human
gccctccgaggaactgacca

SEQ ID NO: 70407 - DNA, 20 bp, human
gagttcctcggagggcgcaa

SEQ ID NO: 70408 - DNA, 20 bp, human
gagccctgggtccaccctcc

SEQ ID NO: 70409 - DNA, 20 bp, human
gcggagggcgcaagggatgc

SEQ ID NO: 70410 - DNA, 20 bp, human
gtggagtgggcgcaccccca

SEQ ID NO: 70411 - DNA, 20 bp, human
gccggaccgggcgccagcgg

SEQ ID NO: 70412 - DNA, 20 bp, human
gggatgagcaggaatcgcga

SEQ ID NO: 70413 - DNA, 20 bp, human
gctcccggcccgcgcgtcgc

SEQ ID NO: 70414 - DNA, 20 bp, human
ggccgtggtcagttcctcgg

SEQ ID NO: 70415 - DNA, 20 bp, human
gtggtaggatgagagcgaga

SEQ ID NO: 70416 - DNA, 20 bp, human
gagcggagccgctggaagag

SEQ ID NO: 70417 - DNA, 20 bp, human
gagcttcgccgctcttccag

SEQ ID NO: 70418 - DNA, 20 bp, human
gaccgggctcgggctagctc

SEQ ID NO: 70419 - DNA, 20 bp, human
gctgcccgggtgctagatga

SEQ ID NO: 70420 - DNA, 20 bp, human
gctcgggctagctctggcag

SEQ ID NO: 70421 - DNA, 20 bp, human
gtagcccgagcccggttctg

SEQ ID NO: 70422 - DNA, 20 bp, human
ggggaaatcctaggaggtag

SEQ ID NO: 70423 - DNA, 20 bp, human
gaaatcctaggaggtagagg

SEQ ID NO: 70424 - DNA, 20 bp, human
ggccagagctagcccgagcc

SEQ ID NO: 70425 - DNA, 20 bp, human
gggcaaatcttcgatgtgaa

SEQ ID NO: 70426 - DNA, 20 bp, human
ggccgggactcggtctctaa

SEQ ID NO: 70427 - DNA, 20 bp, human
ggcccttagagaccgagtcc

SEQ ID NO: 70428 - DNA, 20 bp, human
gggaggcaagcgagctcaag

SEQ ID NO: 70429 - DNA, 20 bp, human
gtagccccagccacagccgt

SEQ ID NO: 70430 - DNA, 20 bp, human
gcggcgcccggaggagcaag

SEQ ID NO: 70431 - DNA, 20 bp, human
gcggccgcaggctggcgagg

SEQ ID NO: 70432 - DNA, 20 bp, human
gagaggtcggagccgtctcc

SEQ ID NO: 70433 - DNA, 20 bp, human
gttgcgggaagccgccccca

SEQ ID NO: 70434 - DNA, 20 bp, human
ggaccgagtcccggcggcga

SEQ ID NO: 70435 - DNA, 20 bp, human
gcggcgcgcgcgccctcgac

SEQ ID NO: 70436 - DNA, 20 bp, human
gtaccttgaaaaggtgacag

SEQ ID NO: 70437 - DNA, 20 bp, human
ggggctgggcagcaaggact

SEQ ID NO: 70438 - DNA, 20 bp, human
gaccctacactcagccccgt

SEQ ID NO: 70439 - DNA, 20 bp, human
gcggcagctgcgcgaaggta

SEQ ID NO: 70440 - DNA, 20 bp, human
gtggccctcgctctcactcg

SEQ ID NO: 70441 - DNA, 20 bp, human
ggctgcgcgaaggtagggct

SEQ ID NO: 70442 - DNA, 20 bp, human
gcgcccacggggctgagtgt

SEQ ID NO: 70443 - DNA, 20 bp, human
gagggacaatgacaacggcc

SEQ ID NO: 70444 - DNA, 20 bp, human
gcttgaaaaggtgacagcgg

SEQ ID NO: 70445 - DNA, 20 bp, human
ggccccgggcgcctgttcat

SEQ ID NO: 70446 - DNA, 20 bp, human
gagcccagcccagcagtagt

SEQ ID NO: 70447 - DNA, 20 bp, human
gcagtagtaggagttgccca

SEQ ID NO: 70448 - DNA, 20 bp, human
gggcaactcctactactgct

SEQ ID NO: 70449 - DNA, 20 bp, human
ggacatcgcttcaggactag

SEQ ID NO: 70450 - DNA, 20 bp, human
gaggagttgcccacggagcg

SEQ ID NO: 70451 - DNA, 20 bp, human
gtgggtggggactagtccct

SEQ ID NO: 70452 - DNA, 20 bp, human
ggaccaagcctcgggagcta

SEQ ID NO: 70453 - DNA, 20 bp, human
ggctgagtcgaaatccatct

SEQ ID NO: 70454 - DNA, 20 bp, human
gctcctactactgctgggct

SEQ ID NO: 70455 - DNA, 20 bp, human
gcgcctgcacagatcagctc

SEQ ID NO: 70456 - DNA, 20 bp, human
gggctcactggagcagacag

SEQ ID NO: 70457 - DNA, 20 bp, human
gtctggcctggccctcccca

SEQ ID NO: 70458 - DNA, 20 bp, human
ggaaactgagaccagacctc

SEQ ID NO: 70459 - DNA, 20 bp, human
ggggcaagcacgcaagatgg

SEQ ID NO: 70460 - DNA, 20 bp, human
gtatacgaaaggaggcccct

SEQ ID NO: 70461 - DNA, 20 bp, human
gctggatggctggtacctga

SEQ ID NO: 70462 - DNA, 20 bp, human
ggaagcagtgactatacgaa

SEQ ID NO: 70463 - DNA, 20 bp, human
gagctcaagcactgtctgga

SEQ ID NO: 70464 - DNA, 20 bp, human
gctgcagctcaagcactgtc

SEQ ID NO: 70465 - DNA, 20 bp, human
gggatgagacagtccactgg

SEQ ID NO: 70466 - DNA, 20 bp, human
gaggcttccgaggcgtccct

SEQ ID NO: 70467 - DNA, 20 bp, human
gcggcgaggcccccactccg

SEQ ID NO: 70468 - DNA, 20 bp, human
gggcggcgtgaggaccacac

SEQ ID NO: 70469 - DNA, 20 bp, human
gcccggcccgcgccccgatg

SEQ ID NO: 70470 - DNA, 20 bp, human
ggcgcgtccaggggcttccg

SEQ ID NO: 70471 - DNA, 20 bp, human
gcccctcggagcgcgtccag

SEQ ID NO: 70472 - DNA, 20 bp, human
ggacgcggaagggaaactcg

SEQ ID NO: 70473 - DNA, 20 bp, human
ggcggcatcgctccgcatcg

SEQ ID NO: 70474 - DNA, 20 bp, human
gagagccgtctccctaggtc

SEQ ID NO: 70475 - DNA, 20 bp, human
ggcctcatgccggagggacc

SEQ ID NO: 70476 - DNA, 20 bp, human
gcggccacggttcaacccag

SEQ ID NO: 70477 - DNA, 20 bp, human
gccaagggaggtagagacgg

SEQ ID NO: 70478 - DNA, 20 bp, human
gcggaggaggaccggaatgt

SEQ ID NO: 70479 - DNA, 20 bp, human
gggaagtgaggggagatact

SEQ ID NO: 70480 - DNA, 20 bp, human
gccggcggcgggtgaccagg

SEQ ID NO: 70481 - DNA, 20 bp, human
gtggcccctgggttgaaccg

SEQ ID NO: 70482 - DNA, 20 bp, human
gcgcgcgccgctgagttgtc

SEQ ID NO: 70483 - DNA, 20 bp, human
gggaaagtcctggggcggaa

SEQ ID NO: 70484 - DNA, 20 bp, human
ggagatactgggtgaggcgt

SEQ ID NO: 70485 - DNA, 20 bp, human
ggagggaaggcagagcttgt

SEQ ID NO: 70486 - DNA, 20 bp, human
gggggcccgagcgcaggtaa

SEQ ID NO: 70487 - DNA, 20 bp, human
gggacccgggctgcaactgg

SEQ ID NO: 70488 - DNA, 20 bp, human
gggactccacttagaaatca

SEQ ID NO: 70489 - DNA, 20 bp, human
gagggttcggctgcgcggcg

SEQ ID NO: 70490 - DNA, 20 bp, human
ggtaagggcgcccgcgaacc

SEQ ID NO: 70491 - DNA, 20 bp, human
gaggctggagttgcaggtcc

SEQ ID NO: 70492 - DNA, 20 bp, human
ggcagccgaaccctccgccc

SEQ ID NO: 70493 - DNA, 20 bp, human
ggctggccctgatttctaag

SEQ ID NO: 70494 - DNA, 20 bp, human
gctggggaaggattgggtct

SEQ ID NO: 70495 - DNA, 20 bp, human
gcgcccgcgaaccgggccag

SEQ ID NO: 70496 - DNA, 20 bp, human
gaacaagaggagcgatggag

SEQ ID NO: 70497 - DNA, 20 bp, human
ggcacggatggaggtagcta

SEQ ID NO: 70498 - DNA, 20 bp, human
gacaggaacaagaggagcga

SEQ ID NO: 70499 - DNA, 20 bp, human
gatagtgcaaggatgcccct

SEQ ID NO: 70500 - DNA, 20 bp, human
gaaggatgcccctgggaaca

SEQ ID NO: 70501 - DNA, 20 bp, human
gaacaggtgcgagggtggaa

SEQ ID NO: 70502 - DNA, 20 bp, human
gtgggaacagggctgggcaa

SEQ ID NO: 70503 - DNA, 20 bp, human
gggctcggagccatagtgca

SEQ ID NO: 70504 - DNA, 20 bp, human
gggatggaggtagctaaggc

SEQ ID NO: 70505 - DNA, 20 bp, human
gcgatggaggggtgcacgga

SEQ ID NO: 70506 - DNA, 20 bp, human
ggattctaaatcaaggaggt

SEQ ID NO: 70507 - DNA, 20 bp, human
ggagatactgtgggagtacc

SEQ ID NO: 70508 - DNA, 20 bp, human
ggtaccaggttagaaaacat

SEQ ID NO: 70509 - DNA, 20 bp, human
ggagagagctcatatgaaat

SEQ ID NO: 70510 - DNA, 20 bp, human
gatatgaaattggttatcgt

SEQ ID NO: 70511 - DNA, 20 bp, human
gggtcctcaatattgattac

SEQ ID NO: 70512 - DNA, 20 bp, human
gctcaagaaagaagtgacac

SEQ ID NO: 70513 - DNA, 20 bp, human
gtttaagctagagatactgt

SEQ ID NO: 70514 - DNA, 20 bp, human
gttggcaaaccattttcctc

SEQ ID NO: 70515 - DNA, 20 bp, human
gcaggttagaaaacattggc

SEQ ID NO: 70516 - DNA, 20 bp, human
ggtcataccagaggactgtg

SEQ ID NO: 70517 - DNA, 20 bp, human
gcgggaagacatgaccagag

SEQ ID NO: 70518 - DNA, 20 bp, human
ggcggcagcaagaggggtca

SEQ ID NO: 70519 - DNA, 20 bp, human
gaccagagaggttgccagag

SEQ ID NO: 70520 - DNA, 20 bp, human
ggcagaggaagccaaggtcg

SEQ ID NO: 70521 - DNA, 20 bp, human
ggggatggggtcggagactg

SEQ ID NO: 70522 - DNA, 20 bp, human
gatgctcattccgggacaag

SEQ ID NO: 70523 - DNA, 20 bp, human
ggctggcctgctataggggg

SEQ ID NO: 70524 - DNA, 20 bp, human
ggtgttagcaagcctgcgaa

SEQ ID NO: 70525 - DNA, 20 bp, human
ggggcaggcatgctcattcc

SEQ ID NO: 70526 - DNA, 20 bp, human
ggagtccaggacaagtgact

SEQ ID NO: 70527 - DNA, 20 bp, human
ggaggggctgaggttgcact

SEQ ID NO: 70528 - DNA, 20 bp, human
gctctccaagtcacttgtcc

SEQ ID NO: 70529 - DNA, 20 bp, human
gagagagagacaagggggtc

SEQ ID NO: 70530 - DNA, 20 bp, human
gtttcagctgatgaagaact

SEQ ID NO: 70531 - DNA, 20 bp, human
gtaccacatgcaattattgt

SEQ ID NO: 70532 - DNA, 20 bp, human
gggctgaggttgcactgggc

SEQ ID NO: 70533 - DNA, 20 bp, human
gtctactcttagtatcactg

SEQ ID NO: 70534 - DNA, 20 bp, human
gaatattataatatactacc

SEQ ID NO: 70535 - DNA, 20 bp, human
gcactgcagggttatcagga

SEQ ID NO: 70536 - DNA, 20 bp, human
ggggcccgggaccctagagg

SEQ ID NO: 70537 - DNA, 20 bp, human
gtccgggagggtcccaaata

SEQ ID NO: 70538 - DNA, 20 bp, human
ggctagccccgcctcctcta

SEQ ID NO: 70539 - DNA, 20 bp, human
ggtctgggaggactgaacat

SEQ ID NO: 70540 - DNA, 20 bp, human
gcaggggcccgggaccctag

SEQ ID NO: 70541 - DNA, 20 bp, human
gtgaggcggcgggagctcgg

SEQ ID NO: 70542 - DNA, 20 bp, human
gcgggaccctagaggaggcg

SEQ ID NO: 70543 - DNA, 20 bp, human
gcccccacgcacatccggga

SEQ ID NO: 70544 - DNA, 20 bp, human
gggggggcagtcagttgagg

SEQ ID NO: 70545 - DNA, 20 bp, human
ggaatccctccagctagcac

SEQ ID NO: 70546 - DNA, 20 bp, human
gccagcacaaacccaggtac

SEQ ID NO: 70547 - DNA, 20 bp, human
ggtgcgaggtccggcttacg

SEQ ID NO: 70548 - DNA, 20 bp, human
gaggcggcagggctgatcga

SEQ ID NO: 70549 - DNA, 20 bp, human
gggaaggagggttactcgag

SEQ ID NO: 70550 - DNA, 20 bp, human
gagtatagggaagggctccg

SEQ ID NO: 70551 - DNA, 20 bp, human
ggcacaaacccaggtacagg

SEQ ID NO: 70552 - DNA, 20 bp, human
gcaggcgggtgtcttcggcc

SEQ ID NO: 70553 - DNA, 20 bp, human
gcggcagggctgatcgaggg

SEQ ID NO: 70554 - DNA, 20 bp, human
gggtccggcgtggttcaggc

SEQ ID NO: 70555 - DNA, 20 bp, human
gtggttcaggcgggtgtctt

SEQ ID NO: 70556 - DNA, 20 bp, human
gtcacacgtggcgccagcgg

SEQ ID NO: 70557 - DNA, 20 bp, human
gggagaggaacactgagtct

SEQ ID NO: 70558 - DNA, 20 bp, human
gagtgcgtgacgctcgtcag

SEQ ID NO: 70559 - DNA, 20 bp, human
gagttcacacgtggcgccag

SEQ ID NO: 70560 - DNA, 20 bp, human
gagggccaaggcctacgcgt

SEQ ID NO: 70561 - DNA, 20 bp, human
gcgagagttggaagtcccta

SEQ ID NO: 70562 - DNA, 20 bp, human
ggcggtgacgcactttacgg

SEQ ID NO: 70563 - DNA, 20 bp, human
gagtggcttcagttcacacg

SEQ ID NO: 70564 - DNA, 20 bp, human
ggtaaggccgggcccagggc

SEQ ID NO: 70565 - DNA, 20 bp, human
gggcccggcagctgaccaag

SEQ ID NO: 70566 - DNA, 20 bp, human
ggcggggatctgagaagcga

SEQ ID NO: 70567 - DNA, 20 bp, human
gcgagggcaacacgacaact

SEQ ID NO: 70568 - DNA, 20 bp, human
gacaggagtcgacccaccaa

SEQ ID NO: 70569 - DNA, 20 bp, human
gcgggacacactgtgtagag

SEQ ID NO: 70570 - DNA, 20 bp, human
ggtagaagggaccggaagag

SEQ ID NO: 70571 - DNA, 20 bp, human
ggatcgtcctcaagatagtg

SEQ ID NO: 70572 - DNA, 20 bp, human
gcttccagggtagaagggac

SEQ ID NO: 70573 - DNA, 20 bp, human
gggagggagatgtctctaca

SEQ ID NO: 70574 - DNA, 20 bp, human
gcggcctgggatccggaagt

SEQ ID NO: 70575 - DNA, 20 bp, human
gccgccaacctggaatagag

SEQ ID NO: 70576 - DNA, 20 bp, human
gggcccaggtagccatggtg

SEQ ID NO: 70577 - DNA, 20 bp, human
gaggagggcccaggtagcca

SEQ ID NO: 70578 - DNA, 20 bp, human
ggctccctgcccataaaaca

SEQ ID NO: 70579 - DNA, 20 bp, human
ggagcatggctgcaaggagc

SEQ ID NO: 70580 - DNA, 20 bp, human
gcatcaggatcgatcccgag

SEQ ID NO: 70581 - DNA, 20 bp, human
gcgaggggaaggccttacct

SEQ ID NO: 70582 - DNA, 20 bp, human
gcttcaccacgcagatgcgg

SEQ ID NO: 70583 - DNA, 20 bp, human
gccataaaacagggtgtgaa

SEQ ID NO: 70584 - DNA, 20 bp, human
gcacgcagatgcggaggcag

SEQ ID NO: 70585 - DNA, 20 bp, human
gccttggccaggccagtgac

SEQ ID NO: 70586 - DNA, 20 bp, human
gtaccggacccgctccctgg

SEQ ID NO: 70587 - DNA, 20 bp, human
gcacagggccgggcacgtca

SEQ ID NO: 70588 - DNA, 20 bp, human
gtactggtccgggagccctt

SEQ ID NO: 70589 - DNA, 20 bp, human
ggcactgcgagtgccccgtg

SEQ ID NO: 70590 - DNA, 20 bp, human
gtcagctctgcggatctcag

SEQ ID NO: 70591 - DNA, 20 bp, human
ggaccgttcccagcgaagga

SEQ ID NO: 70592 - DNA, 20 bp, human
ggggctcccggaccagtacg

SEQ ID NO: 70593 - DNA, 20 bp, human
gtggaacgggtgggacacca

SEQ ID NO: 70594 - DNA, 20 bp, human
ggaccagtacgcggacgggg

SEQ ID NO: 70595 - DNA, 20 bp, human
gctggacccctagcctcacg

SEQ ID NO: 70596 - DNA, 20 bp, human
ggcttccgtcctggctgaga

SEQ ID NO: 70597 - DNA, 20 bp, human
gcccagcaggagcaccacca

SEQ ID NO: 70598 - DNA, 20 bp, human
gcgcccgggatcctgtgtag

SEQ ID NO: 70599 - DNA, 20 bp, human
gctgggcgcctaccgagtag

SEQ ID NO: 70600 - DNA, 20 bp, human
gagccgctacacaggatccc

SEQ ID NO: 70601 - DNA, 20 bp, human
gcgccgccctaggcgaagta

SEQ ID NO: 70602 - DNA, 20 bp, human
ggacggccctacttcgccta

SEQ ID NO: 70603 - DNA, 20 bp, human
ggtggtgggccggaggaata

SEQ ID NO: 70604 - DNA, 20 bp, human
gggccctacttcgcctaggg

SEQ ID NO: 70605 - DNA, 20 bp, human
gagcacgacagcgctgggac

SEQ ID NO: 70606 - DNA, 20 bp, human
gtgggccactagagcaggtg

SEQ ID NO: 70607 - DNA, 20 bp, human
ggggaggcgtccgtgtaagt

SEQ ID NO: 70608 - DNA, 20 bp, human
gtccgtgtaagtgggtagca

SEQ ID NO: 70609 - DNA, 20 bp, human
ggccctgctacccacttaca

SEQ ID NO: 70610 - DNA, 20 bp, human
gccagaagtagagaggtcat

SEQ ID NO: 70611 - DNA, 20 bp, human
gcatgctgggccactagagc

SEQ ID NO: 70612 - DNA, 20 bp, human
ggcgctccggcccgcgagga

SEQ ID NO: 70613 - DNA, 20 bp, human
ggcccgcgcggtcgtcggtg

SEQ ID NO: 70614 - DNA, 20 bp, human
gcccgaccccgagtgccgta

SEQ ID NO: 70615 - DNA, 20 bp, human
gtcttcctccagaagtagag

SEQ ID NO: 70616 - DNA, 20 bp, human
gagctggggtcgctctcggg

SEQ ID NO: 70617 - DNA, 20 bp, human
gaacttaccggcagacccaa

SEQ ID NO: 70618 - DNA, 20 bp, human
ggcgctccactggtcagctg

SEQ ID NO: 70619 - DNA, 20 bp, human
gaggcaaacgcgcagctgag

SEQ ID NO: 70620 - DNA, 20 bp, human
gcaccccccgctaaacttac

SEQ ID NO: 70621 - DNA, 20 bp, human
gtgggtgctcaggaacctcg

SEQ ID NO: 70622 - DNA, 20 bp, human
gggtccgcgagtggcaatac

SEQ ID NO: 70623 - DNA, 20 bp, human
gcggacccggatgcagataa

SEQ ID NO: 70624 - DNA, 20 bp, human
ggaagccgcgagagaggaga

SEQ ID NO: 70625 - DNA, 20 bp, human
ggtcagctggggtcgctctc

SEQ ID NO: 70626 - DNA, 20 bp, human
gagggccgcgcgcaggcgag

SEQ ID NO: 70627 - DNA, 20 bp, human
gagggcctctacgggtgagg

SEQ ID NO: 70628 - DNA, 20 bp, human
gcgcgcggccctgcgtgagg

SEQ ID NO: 70629 - DNA, 20 bp, human
ggcctctgccccctcacgca

SEQ ID NO: 70630 - DNA, 20 bp, human
ggggaaccgcggcccagacg

SEQ ID NO: 70631 - DNA, 20 bp, human
ggtgctgtgcacactggtgg

SEQ ID NO: 70632 - DNA, 20 bp, human
gcgcagggcctctacgggtg

SEQ ID NO: 70633 - DNA, 20 bp, human
gggtccctcctcacccgtag

SEQ ID NO: 70634 - DNA, 20 bp, human
ggccgaccgcagggcctcta

SEQ ID NO: 70635 - DNA, 20 bp, human
gcgcgtgcgttcaacttcct

SEQ ID NO: 70636 - DNA, 20 bp, human
gtcgccggagctgcaatgag

SEQ ID NO: 70637 - DNA, 20 bp, human
gctgtgggacaggcaggtat

SEQ ID NO: 70638 - DNA, 20 bp, human
gtgcaatgagcggcgcccgg

SEQ ID NO: 70639 - DNA, 20 bp, human
gtcagcgagccgccattcag

SEQ ID NO: 70640 - DNA, 20 bp, human
ggcgcgcaggtcacagcctc

SEQ ID NO: 70641 - DNA, 20 bp, human
ggaccggggcccctgaatgg

SEQ ID NO: 70642 - DNA, 20 bp, human
gctctcgcccggccagaccc

SEQ ID NO: 70643 - DNA, 20 bp, human
ggcgccgctcattgcagctc

SEQ ID NO: 70644 - DNA, 20 bp, human
gacgtagagcccatacctgt

SEQ ID NO: 70645 - DNA, 20 bp, human
gcccgaccggggcccctgaa

SEQ ID NO: 70646 - DNA, 20 bp, human
gctccgggccgtaactctca

SEQ ID NO: 70647 - DNA, 20 bp, human
gcgagagcccgaggagcaac

SEQ ID NO: 70648 - DNA, 20 bp, human
gggtgcagcgaagatgaagg

SEQ ID NO: 70649 - DNA, 20 bp, human
gcacccgtgtctggtgagtg

SEQ ID NO: 70650 - DNA, 20 bp, human
gctcctcactcaccagacac

SEQ ID NO: 70651 - DNA, 20 bp, human
ggcggctcctgttgctcctc

SEQ ID NO: 70652 - DNA, 20 bp, human
gcggccgggccactcaccgc

SEQ ID NO: 70653 - DNA, 20 bp, human
ggttacctctcggaaaggaa

SEQ ID NO: 70654 - DNA, 20 bp, human
gggcccggagtctaaagcat

SEQ ID NO: 70655 - DNA, 20 bp, human
gagtgaggagcgctgttggc

SEQ ID NO: 70656 - DNA, 20 bp, human
gtgctggctgaaccatctgt

SEQ ID NO: 70657 - DNA, 20 bp, human
gtggctctctgcctctaaac

SEQ ID NO: 70658 - DNA, 20 bp, human
gcctacttcaagggaagatt

SEQ ID NO: 70659 - DNA, 20 bp, human
gctgcctctaaacaggtaaa

SEQ ID NO: 70660 - DNA, 20 bp, human
gcccaaagcctggatctctg

SEQ ID NO: 70661 - DNA, 20 bp, human
gacattacatggctacccca

SEQ ID NO: 70662 - DNA, 20 bp, human
gaagccttttacctgtttag

SEQ ID NO: 70663 - DNA, 20 bp, human
gagtactcaacctacttcaa

SEQ ID NO: 70664 - DNA, 20 bp, human
ggtaatgctaggaagactga

SEQ ID NO: 70665 - DNA, 20 bp, human
gcagcccaagggctaaatcc

SEQ ID NO: 70666 - DNA, 20 bp, human
ggaaggctccccactcacca

SEQ ID NO: 70667 - DNA, 20 bp, human
gagtggggagccttccctaa

SEQ ID NO: 70668 - DNA, 20 bp, human
gtccagaagtggaagaaagt

SEQ ID NO: 70669 - DNA, 20 bp, human
gccctaagggctaggacacc

SEQ ID NO: 70670 - DNA, 20 bp, human
gtgaattcaggccaatggat

SEQ ID NO: 70671 - DNA, 20 bp, human
gcctggcatgggagggataa

SEQ ID NO: 70672 - DNA, 20 bp, human
gcagcaggccacggagaaaa

SEQ ID NO: 70673 - DNA, 20 bp, human
gctcatccacagctcttcct

SEQ ID NO: 70674 - DNA, 20 bp, human
gtcaggggagttctcaatgt

SEQ ID NO: 70675 - DNA, 20 bp, human
gtccaggtgtcctagccctt

SEQ ID NO: 70676 - DNA, 20 bp, human
ggctctgtcctgggaaaata

SEQ ID NO: 70677 - DNA, 20 bp, human
gcctcgtgatagccagggag

SEQ ID NO: 70678 - DNA, 20 bp, human
gaggggcctcgtgatagcca

SEQ ID NO: 70679 - DNA, 20 bp, human
gaccaccatcatgaaggctg

SEQ ID NO: 70680 - DNA, 20 bp, human
gaggcttgaagctctgtcct

SEQ ID NO: 70681 - DNA, 20 bp, human
ggaggttgccctgcatcagt

SEQ ID NO: 70682 - DNA, 20 bp, human
ggccccagccttcatgatgg

SEQ ID NO: 70683 - DNA, 20 bp, human
gatcagcctggaccgctccc

SEQ ID NO: 70684 - DNA, 20 bp, human
gacagcatcccactgatgca

SEQ ID NO: 70685 - DNA, 20 bp, human
gtaactctccagcataccat

SEQ ID NO: 70686 - DNA, 20 bp, human
gctccagccaccggccttca

SEQ ID NO: 70687 - DNA, 20 bp, human
gacgggacggagggacgcac

SEQ ID NO: 70688 - DNA, 20 bp, human
ggtcagcccaagagatagag

SEQ ID NO: 70689 - DNA, 20 bp, human
gcgagaggccgaccagccga

SEQ ID NO: 70690 - DNA, 20 bp, human
ggccgtgccttgaaggccgg

SEQ ID NO: 70691 - DNA, 20 bp, human
gaccaggacgaagtgctcgg

SEQ ID NO: 70692 - DNA, 20 bp, human
gtaagacagccagttcgggg

SEQ ID NO: 70693 - DNA, 20 bp, human
gggcataaagggcctcaggt

SEQ ID NO: 70694 - DNA, 20 bp, human
gaaagccgtgccttgaaggc

SEQ ID NO: 70695 - DNA, 20 bp, human
gccccgccggagccgacctg

SEQ ID NO: 70696 - DNA, 20 bp, human
ggaggccactgggagaataa

SEQ ID NO: 70697 - DNA, 20 bp, human
gagatgtctaacccccaggg

SEQ ID NO: 70698 - DNA, 20 bp, human
ggacagatgtctaaccccca

SEQ ID NO: 70699 - DNA, 20 bp, human
gaggccccttattctcccag

SEQ ID NO: 70700 - DNA, 20 bp, human
ggctgaaagggtgagagtgg

SEQ ID NO: 70701 - DNA, 20 bp, human
gccgcgcacctgcctctctc

SEQ ID NO: 70702 - DNA, 20 bp, human
gggctcgggcaaccctgacc

SEQ ID NO: 70703 - DNA, 20 bp, human
ggaccctgggcgtctggtca

SEQ ID NO: 70704 - DNA, 20 bp, human
gagtgagatccaaactgccg

SEQ ID NO: 70705 - DNA, 20 bp, human
gggactccgggaatgcgagc

SEQ ID NO: 70706 - DNA, 20 bp, human
gggcccaaagtcactggcga

SEQ ID NO: 70707 - DNA, 20 bp, human
gccagcccaaagtcacccgg

SEQ ID NO: 70708 - DNA, 20 bp, human
gcgggaggtccggtttgggg

SEQ ID NO: 70709 - DNA, 20 bp, human
gggggggccccgggagtcac

SEQ ID NO: 70710 - DNA, 20 bp, human
ggcgatcccggcaaccactg

SEQ ID NO: 70711 - DNA, 20 bp, human
gagggaggtcggacttcggg

SEQ ID NO: 70712 - DNA, 20 bp, human
ggagaccaaagaaccccggg

SEQ ID NO: 70713 - DNA, 20 bp, human
gggctgactgacttccgcag

SEQ ID NO: 70714 - DNA, 20 bp, human
gtttgggcccgtgactcccg

SEQ ID NO: 70715 - DNA, 20 bp, human
gagggtcgagtctggagcgg

SEQ ID NO: 70716 - DNA, 20 bp, human
gatgggcgggggaggctcga

SEQ ID NO: 70717 - DNA, 20 bp, human
gggagacgtggccgtgagag

SEQ ID NO: 70718 - DNA, 20 bp, human
gccgcccggcccggatgctc

SEQ ID NO: 70719 - DNA, 20 bp, human
gagacaaacaaggaagtaca

SEQ ID NO: 70720 - DNA, 20 bp, human
ggcaagcactgcccgagtgg

SEQ ID NO: 70721 - DNA, 20 bp, human
gggatgctccggcggagacg

SEQ ID NO: 70722 - DNA, 20 bp, human
gggtggttcgtgggaagtcg

SEQ ID NO: 70723 - DNA, 20 bp, human
ggacgtggccgtgagagggg

SEQ ID NO: 70724 - DNA, 20 bp, human
ggcagctgaaaggcgtgaca

SEQ ID NO: 70725 - DNA, 20 bp, human
gctcacggccacgtctccgc

SEQ ID NO: 70726 - DNA, 20 bp, human
ggccgcggcggcgacgacaa

SEQ ID NO: 70727 - DNA, 20 bp, human
gaccggcccgcggacgaaag

SEQ ID NO: 70728 - DNA, 20 bp, human
gggcccgcggacgaaagagg

SEQ ID NO: 70729 - DNA, 20 bp, human
gaggtattcggaaccagggg

SEQ ID NO: 70730 - DNA, 20 bp, human
gaagaggtattcggaaccag

SEQ ID NO: 70731 - DNA, 20 bp, human
gcgcggacgaaagaggcggg

SEQ ID NO: 70732 - DNA, 20 bp, human
gggttaggggttaaaggtca

SEQ ID NO: 70733 - DNA, 20 bp, human
ggtccgcgggccggttcaag

SEQ ID NO: 70734 - DNA, 20 bp, human
ggcaggtgaactgtgcgcca

SEQ ID NO: 70735 - DNA, 20 bp, human
gcacccggaagaaagagacg

SEQ ID NO: 70736 - DNA, 20 bp, human
gtcacctgaggactccggag

SEQ ID NO: 70737 - DNA, 20 bp, human
gctgggccgcgccccctcgg

SEQ ID NO: 70738 - DNA, 20 bp, human
ggacagaccccagggctcta

SEQ ID NO: 70739 - DNA, 20 bp, human
gcccagtccgtagagccctg

SEQ ID NO: 70740 - DNA, 20 bp, human
gtcggcggctggcccggagg

SEQ ID NO: 70741 - DNA, 20 bp, human
gcgcacggaacgagatgggt

SEQ ID NO: 70742 - DNA, 20 bp, human
gctccggagaggctgcacta

SEQ ID NO: 70743 - DNA, 20 bp, human
gaggccaggcgtcagcacag

SEQ ID NO: 70744 - DNA, 20 bp, human
ggcttccgggagacgtggaa

SEQ ID NO: 70745 - DNA, 20 bp, human
gggagggcagtaaacgacgt

SEQ ID NO: 70746 - DNA, 20 bp, human
gaggaggtgagggccaatta

SEQ ID NO: 70747 - DNA, 20 bp, human
ggaccccaaagagccccggg

SEQ ID NO: 70748 - DNA, 20 bp, human
ggagggccaattaaggagca

SEQ ID NO: 70749 - DNA, 20 bp, human
ggacctcccggggctctttg

SEQ ID NO: 70750 - DNA, 20 bp, human
gctttggggtcacgtctcca

SEQ ID NO: 70751 - DNA, 20 bp, human
gcgtgaccccaaagagcccc

SEQ ID NO: 70752 - DNA, 20 bp, human
gtcaggcttggggcggcagg

SEQ ID NO: 70753 - DNA, 20 bp, human
ggagctccttgctccttaat

SEQ ID NO: 70754 - DNA, 20 bp, human
gccccgggaggtcaggcttg

SEQ ID NO: 70755 - DNA, 20 bp, human
gactttggggatgtgactcc

SEQ ID NO: 70756 - DNA, 20 bp, human
ggtgagggcggagtacggag

SEQ ID NO: 70757 - DNA, 20 bp, human
gactgagccggtgaaccctg

SEQ ID NO: 70758 - DNA, 20 bp, human
gtacggagtggagagcccca

SEQ ID NO: 70759 - DNA, 20 bp, human
ggcccagtgtgcctctggaa

SEQ ID NO: 70760 - DNA, 20 bp, human
gggagagccccagggttcac

SEQ ID NO: 70761 - DNA, 20 bp, human
ggccattccagaggcacact

SEQ ID NO: 70762 - DNA, 20 bp, human
gtctggaatggcatggactc

SEQ ID NO: 70763 - DNA, 20 bp, human
gcacaatcccaaagggccca

SEQ ID NO: 70764 - DNA, 20 bp, human
gttggagacacaatcccaaa

SEQ ID NO: 70765 - DNA, 20 bp, human
ggaccccagggtgactgagc

SEQ ID NO: 70766 - DNA, 20 bp, human
ggagggagagagactcaccg

SEQ ID NO: 70767 - DNA, 20 bp, human
gtgcggcaggacgtaagtga

SEQ ID NO: 70768 - DNA, 20 bp, human
gacgtaagtgacggcgaagg

SEQ ID NO: 70769 - DNA, 20 bp, human
gccctcgccagagcaggcgt

SEQ ID NO: 70770 - DNA, 20 bp, human
ggactcaccggggacgggaa

SEQ ID NO: 70771 - DNA, 20 bp, human
gaggacgtaagtgacggcga

SEQ ID NO: 70772 - DNA, 20 bp, human
gagaactgcgggaccctcaa

SEQ ID NO: 70773 - DNA, 20 bp, human
gtggctccccacgcctgctc

SEQ ID NO: 70774 - DNA, 20 bp, human
gagggtgggtcccagacctg

SEQ ID NO: 70775 - DNA, 20 bp, human
gctccgcagggaacttggtc

SEQ ID NO: 70776 - DNA, 20 bp, human
gatcatggccaccgaggtag

SEQ ID NO: 70777 - DNA, 20 bp, human
gctcggtggccatgatccgg

SEQ ID NO: 70778 - DNA, 20 bp, human
ggggcggggctcctctccgg

SEQ ID NO: 70779 - DNA, 20 bp, human
gtctccgcggtgctgacccc

SEQ ID NO: 70780 - DNA, 20 bp, human
gtcgggccgtgaggagcctc

SEQ ID NO: 70781 - DNA, 20 bp, human
gccgcgcccgaggctcctca

SEQ ID NO: 70782 - DNA, 20 bp, human
gggcggctgggtccaggcaa

SEQ ID NO: 70783 - DNA, 20 bp, human
ggcgctcgcccctacctcgg

SEQ ID NO: 70784 - DNA, 20 bp, human
gggcgctgtccgctgtgctg

SEQ ID NO: 70785 - DNA, 20 bp, human
gcgcgggcccgggctcaggt

SEQ ID NO: 70786 - DNA, 20 bp, human
gcacccagggacaactggcg

SEQ ID NO: 70787 - DNA, 20 bp, human
gcgccctcgccagttgtccc

SEQ ID NO: 70788 - DNA, 20 bp, human
gccacaatggcagaagaaac

SEQ ID NO: 70789 - DNA, 20 bp, human
ggcccagggaggtccaactt

SEQ ID NO: 70790 - DNA, 20 bp, human
gaaagtcacccagggacaac

SEQ ID NO: 70791 - DNA, 20 bp, human
gagggaggtccaacttgggg

SEQ ID NO: 70792 - DNA, 20 bp, human
gatcagcgctcgctgggatt

SEQ ID NO: 70793 - DNA, 20 bp, human
gtcaggagtagtatggactg

SEQ ID NO: 70794 - DNA, 20 bp, human
ggtgtgcgtcaggagtagta

SEQ ID NO: 70795 - DNA, 20 bp, human
ggggttagcgggccatgacc

SEQ ID NO: 70796 - DNA, 20 bp, human
gacccaccgctgctcttcag

SEQ ID NO: 70797 - DNA, 20 bp, human
gacccctgaagagcagcggt

SEQ ID NO: 70798 - DNA, 20 bp, human
gcacgacccctgaagagcag

SEQ ID NO: 70799 - DNA, 20 bp, human
gcagctccagagacacgtaa

SEQ ID NO: 70800 - DNA, 20 bp, human
gcgtaaagggacagagattg

SEQ ID NO: 70801 - DNA, 20 bp, human
gtgctccagaaggtacttac

SEQ ID NO: 70802 - DNA, 20 bp, human
ggctcttcaggggtcgtgga

SEQ ID NO: 70803 - DNA, 20 bp, human
gaggcaccgtccccaaaagt

SEQ ID NO: 70804 - DNA, 20 bp, human
gactccgtgaatagagggaa

SEQ ID NO: 70805 - DNA, 20 bp, human
ggtctgagcatcctatctcc

SEQ ID NO: 70806 - DNA, 20 bp, human
gatgtagtctgtgaattaag

SEQ ID NO: 70807 - DNA, 20 bp, human
gtgaaatgctgaagctctgt

SEQ ID NO: 70808 - DNA, 20 bp, human
ggctgttgctcaggcattcc

SEQ ID NO: 70809 - DNA, 20 bp, human
gtgaaaaaacacagtcatct

SEQ ID NO: 70810 - DNA, 20 bp, human
ggaatgagagggaagagcgg

SEQ ID NO: 70811 - DNA, 20 bp, human
gcaggaatgagagggaagag

SEQ ID NO: 70812 - DNA, 20 bp, human
gtatggctgctgccactgga

SEQ ID NO: 70813 - DNA, 20 bp, human
ggatagtgggtgagttctca

SEQ ID NO: 70814 - DNA, 20 bp, human
ggtctttggttgccatccag

SEQ ID NO: 70815 - DNA, 20 bp, human
gagtcatcttggaaagtaga

SEQ ID NO: 70816 - DNA, 20 bp, human
gtagcccggaagctgaatag

SEQ ID NO: 70817 - DNA, 20 bp, human
gcttgagagcccgcacgtag

SEQ ID NO: 70818 - DNA, 20 bp, human
ggcacccgcccgcctgtcgt

SEQ ID NO: 70819 - DNA, 20 bp, human
ggtgcgcgtgcgccaggtag

SEQ ID NO: 70820 - DNA, 20 bp, human
ggcggtgtgccgctacgtgc

SEQ ID NO: 70821 - DNA, 20 bp, human
gccctggcggcggcaacctg

SEQ ID NO: 70822 - DNA, 20 bp, human
ggcgcacgcgcactgagctg

SEQ ID NO: 70823 - DNA, 20 bp, human
gggcaatactctcgcatccc

SEQ ID NO: 70824 - DNA, 20 bp, human
gagcccagcgagatccgagc

SEQ ID NO: 70825 - DNA, 20 bp, human
gacataccgcaagcggagta

SEQ ID NO: 70826 - DNA, 20 bp, human
gtgcgtacggaggccgactt

SEQ ID NO: 70827 - DNA, 20 bp, human
gggtggaaggtgtcgcgtac

SEQ ID NO: 70828 - DNA, 20 bp, human
gcgggcttcccgagctgacg

SEQ ID NO: 70829 - DNA, 20 bp, human
gctagtggctgagtccctgg

SEQ ID NO: 70830 - DNA, 20 bp, human
ggtgcggacaggactgacct

SEQ ID NO: 70831 - DNA, 20 bp, human
gagctgacgtggcttgaatt

SEQ ID NO: 70832 - DNA, 20 bp, human
gccaggactgaatccgggag

SEQ ID NO: 70833 - DNA, 20 bp, human
gtcccagaggagaaacgtac

SEQ ID NO: 70834 - DNA, 20 bp, human
gtaggcctggtaggtgaagg

SEQ ID NO: 70835 - DNA, 20 bp, human
gctccaggaacaaggccgtg

SEQ ID NO: 70836 - DNA, 20 bp, human
gcagccggctctgaagtatg

SEQ ID NO: 70837 - DNA, 20 bp, human
gcgtgggtgacacgtaagtt

SEQ ID NO: 70838 - DNA, 20 bp, human
gacgtaagttgggcaggagg

SEQ ID NO: 70839 - DNA, 20 bp, human
gagcggtgtcactgacgggt

SEQ ID NO: 70840 - DNA, 20 bp, human
ggcacagcggtgtcactgac

SEQ ID NO: 70841 - DNA, 20 bp, human
ggactccaagaactgcccgg

SEQ ID NO: 70842 - DNA, 20 bp, human
ggccagaatagccgggccgt

SEQ ID NO: 70843 - DNA, 20 bp, human
gtggccaacgggattccggg

SEQ ID NO: 70844 - DNA, 20 bp, human
gcatctggggacaggcgcga

SEQ ID NO: 70845 - DNA, 20 bp, human
ggcgcaccccctcccttagg

SEQ ID NO: 70846 - DNA, 20 bp, human
ggccggccggagctcgaggc

SEQ ID NO: 70847 - DNA, 20 bp, human
gcggctcgctccccaagacc

SEQ ID NO: 70848 - DNA, 20 bp, human
ggacgcggcggcgctggacg

SEQ ID NO: 70849 - DNA, 20 bp, human
gcgcatcgcctgagactgca

SEQ ID NO: 70850 - DNA, 20 bp, human
gcgccgccggcctcgagctc

SEQ ID NO: 70851 - DNA, 20 bp, human
gtacgggccctgggcaaagg

SEQ ID NO: 70852 - DNA, 20 bp, human
ggccggcctcgagctccggc

SEQ ID NO: 70853 - DNA, 20 bp, human
gccccttgccctgcgatgag

SEQ ID NO: 70854 - DNA, 20 bp, human
gggcggcgggagagcgaccc

SEQ ID NO: 70855 - DNA, 20 bp, human
gtactcggtgcaggaaggtg

SEQ ID NO: 70856 - DNA, 20 bp, human
gactgcggccacaggcagga

SEQ ID NO: 70857 - DNA, 20 bp, human
gtttcggggactgcggccac

SEQ ID NO: 70858 - DNA, 20 bp, human
gagcaggacgacgacgacaa

SEQ ID NO: 70859 - DNA, 20 bp, human
gagagggtcgcaggaccgac

SEQ ID NO: 70860 - DNA, 20 bp, human
gaacaccccgagctccaagg

SEQ ID NO: 70861 - DNA, 20 bp, human
gcgccaggtgagctccaggt

SEQ ID NO: 70862 - DNA, 20 bp, human
gacgcggctgaccctgatgg

SEQ ID NO: 70863 - DNA, 20 bp, human
gcgaaacaccccgagctcca

SEQ ID NO: 70864 - DNA, 20 bp, human
ggggcgactccaaggaaacg

SEQ ID NO: 70865 - DNA, 20 bp, human
gaggagcgccttcctgcctg

SEQ ID NO: 70866 - DNA, 20 bp, human
gaccccacccccgtcctagt

SEQ ID NO: 70867 - DNA, 20 bp, human
gtaagcgcactaagcctatc

SEQ ID NO: 70868 - DNA, 20 bp, human
gctatctggcactgtgaata

SEQ ID NO: 70869 - DNA, 20 bp, human
gttctctgcatcgaaggatc

SEQ ID NO: 70870 - DNA, 20 bp, human
ggaagtttgtgctctctgcg

SEQ ID NO: 70871 - DNA, 20 bp, human
gtattccttctctgcatcga

SEQ ID NO: 70872 - DNA, 20 bp, human
gctccccccctgccccgcga

SEQ ID NO: 70873 - DNA, 20 bp, human
gatcactaggcaacctacct

SEQ ID NO: 70874 - DNA, 20 bp, human
gtcacctactaggacggggg

SEQ ID NO: 70875 - DNA, 20 bp, human
ggaaactttaaaccttcgcg

SEQ ID NO: 70876 - DNA, 20 bp, human
gatgctgtgctggcaccctg

SEQ ID NO: 70877 - DNA, 20 bp, human
gaagccccccaggctgagtg

SEQ ID NO: 70878 - DNA, 20 bp, human
gtccacccggaaagcccccc

SEQ ID NO: 70879 - DNA, 20 bp, human
gtagaactgggttgccacaa

SEQ ID NO: 70880 - DNA, 20 bp, human
gagggcccacaggtagctag

SEQ ID NO: 70881 - DNA, 20 bp, human
ggcagctggtacatggtcac

SEQ ID NO: 70882 - DNA, 20 bp, human
gggaacctgccaggccccct

SEQ ID NO: 70883 - DNA, 20 bp, human
gggagttgctcagggcccac

SEQ ID NO: 70884 - DNA, 20 bp, human
gtcccacccgctggagggta

SEQ ID NO: 70885 - DNA, 20 bp, human
gatgccgcactcagcctggg

SEQ ID NO: 70886 - DNA, 20 bp, human
gggcctgcgagacagagcta

SEQ ID NO: 70887 - DNA, 20 bp, human
ggccgcgcacacccatcgcc

SEQ ID NO: 70888 - DNA, 20 bp, human
gcagcacctcggaaagccca

SEQ ID NO: 70889 - DNA, 20 bp, human
ggtgtttccggaagacgtgg

SEQ ID NO: 70890 - DNA, 20 bp, human
gtgaagccgggaaacagccc

SEQ ID NO: 70891 - DNA, 20 bp, human
gtgcgtgtttccggaagacg

SEQ ID NO: 70892 - DNA, 20 bp, human
gcctgggagaagagtctgtg

SEQ ID NO: 70893 - DNA, 20 bp, human
gagtcgggagaaatgaagcc

SEQ ID NO: 70894 - DNA, 20 bp, human
ggccagccagggacttgtag

SEQ ID NO: 70895 - DNA, 20 bp, human
ggacagcggcgacagcacct

SEQ ID NO: 70896 - DNA, 20 bp, human
ggattccacggaaacggctt

SEQ ID NO: 70897 - DNA, 20 bp, human
gggtgcgtggcggaagttaa

SEQ ID NO: 70898 - DNA, 20 bp, human
gcggcctgattccacggaaa

SEQ ID NO: 70899 - DNA, 20 bp, human
gaatagaatgggagtagcca

SEQ ID NO: 70900 - DNA, 20 bp, human
gggaatcaggccggctggtg

SEQ ID NO: 70901 - DNA, 20 bp, human
ggttgttggctgacttccgg

SEQ ID NO: 70902 - DNA, 20 bp, human
ggaaggtcgggtctgagggt

SEQ ID NO: 70903 - DNA, 20 bp, human
ggctgttgttggctgacttc

SEQ ID NO: 70904 - DNA, 20 bp, human
gagacagctacttcagctcc

SEQ ID NO: 70905 - DNA, 20 bp, human
gccgaggtggaagcgcggtt

SEQ ID NO: 70906 - DNA, 20 bp, human
gcattctcgggaaaactcgg

SEQ ID NO: 70907 - DNA, 20 bp, human
gtggaaccacagcgcgtcag

SEQ ID NO: 70908 - DNA, 20 bp, human
gactgaagggtaagaagcat

SEQ ID NO: 70909 - DNA, 20 bp, human
gtgggcgcggcctcattctc

SEQ ID NO: 70910 - DNA, 20 bp, human
gaaaacgagaaagtactgaa

SEQ ID NO: 70911 - DNA, 20 bp, human
gcacagcgcgtcagtgggcg

SEQ ID NO: 70912 - DNA, 20 bp, human
gcccagaaaactgaaatcag

SEQ ID NO: 70913 - DNA, 20 bp, human
gcctcattctcgggaaaact

SEQ ID NO: 70914 - DNA, 20 bp, human
gtcaggaagctctcccggag

SEQ ID NO: 70915 - DNA, 20 bp, human
gtctcgggaaaactcggcgg

SEQ ID NO: 70916 - DNA, 20 bp, human
gcatggaccgcccgccgaca

SEQ ID NO: 70917 - DNA, 20 bp, human
gaggggacccccgcgcgcgc

SEQ ID NO: 70918 - DNA, 20 bp, human
gcagaaccgcaggagtaacg

SEQ ID NO: 70919 - DNA, 20 bp, human
ggctgaagctgaggcggcaa

SEQ ID NO: 70920 - DNA, 20 bp, human
ggaagctgaggcggcaacgg

SEQ ID NO: 70921 - DNA, 20 bp, human
gcggcaacggcggcgacaca

SEQ ID NO: 70922 - DNA, 20 bp, human
gagcggacatcacttatgag

SEQ ID NO: 70923 - DNA, 20 bp, human
gagcacagtcacagaaccgc

SEQ ID NO: 70924 - DNA, 20 bp, human
gaacggcgcgaggtgaaggg

SEQ ID NO: 70925 - DNA, 20 bp, human
ggagatcgatccagaccaag

SEQ ID NO: 70926 - DNA, 20 bp, human
gttccctaagggagacaccc

SEQ ID NO: 70927 - DNA, 20 bp, human
ggggccgatggcgcaaggtt

SEQ ID NO: 70928 - DNA, 20 bp, human
gcgccatcggcccgggccac

SEQ ID NO: 70929 - DNA, 20 bp, human
gggaagtgagcctacagccg

SEQ ID NO: 70930 - DNA, 20 bp, human
gtgctgcaggaatcaacggt

SEQ ID NO: 70931 - DNA, 20 bp, human
ggagatttgggcacttttgg

SEQ ID NO: 70932 - DNA, 20 bp, human
gagggagacaccccggctgt

SEQ ID NO: 70933 - DNA, 20 bp, human
gctgcagcaatcttccctaa

SEQ ID NO: 70934 - DNA, 20 bp, human
gccgcggccggggaaaaacc

SEQ ID NO: 70935 - DNA, 20 bp, human
gagtcgcggctgcgagattt

SEQ ID NO: 70936 - DNA, 20 bp, human
ggcgtcgggtcggtccgggt

SEQ ID NO: 70937 - DNA, 20 bp, human
gtcggtccgggtaggcgcag

SEQ ID NO: 70938 - DNA, 20 bp, human
ggcgcagcgggactggacct

SEQ ID NO: 70939 - DNA, 20 bp, human
gggaggagcgccattcccgg

SEQ ID NO: 70940 - DNA, 20 bp, human
gtactggcgtcgggtcggtc

SEQ ID NO: 70941 - DNA, 20 bp, human
gagtgcgtcccgactggtag

SEQ ID NO: 70942 - DNA, 20 bp, human
gccgggaggagcgccattcc

SEQ ID NO: 70943 - DNA, 20 bp, human
gcacccaggcggaaacactc

SEQ ID NO: 70944 - DNA, 20 bp, human
gccatggcagcggctccgct

SEQ ID NO: 70945 - DNA, 20 bp, human
ggcggcaactcaccccgtgg

SEQ ID NO: 70946 - DNA, 20 bp, human
gtccgcggctgtaggaggac

SEQ ID NO: 70947 - DNA, 20 bp, human
gcgtcccaagtgctacgcgg

SEQ ID NO: 70948 - DNA, 20 bp, human
gtagagcaggcggtgcgctg

SEQ ID NO: 70949 - DNA, 20 bp, human
gctacgcggaggattagagc

SEQ ID NO: 70950 - DNA, 20 bp, human
gcgcggaggattagagcagg

SEQ ID NO: 70951 - DNA, 20 bp, human
gtggcggcgggcgatcggtg

SEQ ID NO: 70952 - DNA, 20 bp, human
gccacgtcccaagtgctacg

SEQ ID NO: 70953 - DNA, 20 bp, human
gcgccccctggccgagtcgc

SEQ ID NO: 70954 - DNA, 20 bp, human
gcgatcggtgtggccgagcc

SEQ ID NO: 70955 - DNA, 20 bp, human
gctttgcgaggagcccatgg

SEQ ID NO: 70956 - DNA, 20 bp, human
gcgttggacgacaaagatgg

SEQ ID NO: 70957 - DNA, 20 bp, human
ggcagggaccagcagttact

SEQ ID NO: 70958 - DNA, 20 bp, human
gcctcgtaggacgcacccgg

SEQ ID NO: 70959 - DNA, 20 bp, human
gtgacgttggacgacaaaga

SEQ ID NO: 70960 - DNA, 20 bp, human
gcgtcctacgagggtgagag

SEQ ID NO: 70961 - DNA, 20 bp, human
gtgagggcgagaaggcctcc

SEQ ID NO: 70962 - DNA, 20 bp, human
gcccctatcccggctgacgt

SEQ ID NO: 70963 - DNA, 20 bp, human
gggcgtgtgagcgggacgtg

SEQ ID NO: 70964 - DNA, 20 bp, human
ggggccttggggataccgaa

SEQ ID NO: 70965 - DNA, 20 bp, human
ggacgacaaagatggcggca

SEQ ID NO: 70966 - DNA, 20 bp, human
gtcgccggccccgcaggcca

SEQ ID NO: 70967 - DNA, 20 bp, human
gtagacctcgagaggagaca

SEQ ID NO: 70968 - DNA, 20 bp, human
ggctgtgaggacgtgttccg

SEQ ID NO: 70969 - DNA, 20 bp, human
gctggttggtagacctcgag

SEQ ID NO: 70970 - DNA, 20 bp, human
gtcgagaggagacacggagt

SEQ ID NO: 70971 - DNA, 20 bp, human
ggccccgcaggccacggctc

SEQ ID NO: 70972 - DNA, 20 bp, human
gaagccggaaaccggaaggg

SEQ ID NO: 70973 - DNA, 20 bp, human
gggagagtcagggcacgtac

SEQ ID NO: 70974 - DNA, 20 bp, human
gcaaggattaagcacttcgg

SEQ ID NO: 70975 - DNA, 20 bp, human
ggctggggcctggagacgtg

SEQ ID NO: 70976 - DNA, 20 bp, human
ggaacctcggcaaagactga

SEQ ID NO: 70977 - DNA, 20 bp, human
ggtctggccgttgcgactgg

SEQ ID NO: 70978 - DNA, 20 bp, human
ggaggaggctggatccacga

SEQ ID NO: 70979 - DNA, 20 bp, human
gagtggagcggacccaaccc

SEQ ID NO: 70980 - DNA, 20 bp, human
ggtgtctcctccagtcgcaa

SEQ ID NO: 70981 - DNA, 20 bp, human
ggcccccgccggctaggtga

SEQ ID NO: 70982 - DNA, 20 bp, human
gtgccggagcttgtagagag

SEQ ID NO: 70983 - DNA, 20 bp, human
ggattcctagtctctcgata

SEQ ID NO: 70984 - DNA, 20 bp, human
gcaggtctggccgttgcgac

SEQ ID NO: 70985 - DNA, 20 bp, human
gggtgccatatcgagagact

SEQ ID NO: 70986 - DNA, 20 bp, human
gctgccaaggttccaggaag

SEQ ID NO: 70987 - DNA, 20 bp, human
gccatgaacactgaaagggt

SEQ ID NO: 70988 - DNA, 20 bp, human
gctgggcagaagcggaacac

SEQ ID NO: 70989 - DNA, 20 bp, human
ggagcagagacacatagtct

SEQ ID NO: 70990 - DNA, 20 bp, human
gcagagagcatggaatgacc

SEQ ID NO: 70991 - DNA, 20 bp, human
gctgcccggcccagccttgg

SEQ ID NO: 70992 - DNA, 20 bp, human
ggggaacactgtcctcctag

SEQ ID NO: 70993 - DNA, 20 bp, human
gctgcctcttcctggaacct

SEQ ID NO: 70994 - DNA, 20 bp, human
ggcccccaagcatagagttg

SEQ ID NO: 70995 - DNA, 20 bp, human
ggctaggcatctacctctat

SEQ ID NO: 70996 - DNA, 20 bp, human
gccccagggcaccctatcaa

SEQ ID NO: 70997 - DNA, 20 bp, human
gggcgagcggacacacacac

SEQ ID NO: 70998 - DNA, 20 bp, human
ggcgtgcaacgcaatcccta

SEQ ID NO: 70999 - DNA, 20 bp, human
gcagggccatggtggaccgt

SEQ ID NO: 71000 - DNA, 20 bp, human
ggcggggaccagagggatgt

SEQ ID NO: 71001 - DNA, 20 bp, human
gaggggtgcggatagtactg

SEQ ID NO: 71002 - DNA, 20 bp, human
gcagtaagggaaagccgagg

SEQ ID NO: 71003 - DNA, 20 bp, human
gccggctcctgctgaaggta

SEQ ID NO: 71004 - DNA, 20 bp, human
gagagggatgtgggatcctg

SEQ ID NO: 71005 - DNA, 20 bp, human
gggcccagtgcggggaccag

SEQ ID NO: 71006 - DNA, 20 bp, human
gaggcacagagcgtcttcta

SEQ ID NO: 71007 - DNA, 20 bp, human
gagagaaggacggagtcgag

SEQ ID NO: 71008 - DNA, 20 bp, human
gcaggcagaaagacctccga

SEQ ID NO: 71009 - DNA, 20 bp, human
gccatggaggactaagccag

SEQ ID NO: 71010 - DNA, 20 bp, human
gcatggggctagaagagaga

SEQ ID NO: 71011 - DNA, 20 bp, human
ggagaggcatgaggacctgt

SEQ ID NO: 71012 - DNA, 20 bp, human
gtgtctttcggcaggtctgg

SEQ ID NO: 71013 - DNA, 20 bp, human
gctggaagcgaagctgcagg

SEQ ID NO: 71014 - DNA, 20 bp, human
ggaggttctcactcaggtgg

SEQ ID NO: 71015 - DNA, 20 bp, human
ggtacaggaggttctcactc

SEQ ID NO: 71016 - DNA, 20 bp, human
gggagcccatggcgagaaga

SEQ ID NO: 71017 - DNA, 20 bp, human
gccagactcaccggagccca

SEQ ID NO: 71018 - DNA, 20 bp, human
ggtgagtctggagtccggtc

SEQ ID NO: 71019 - DNA, 20 bp, human
gccgggacgccgggcatcag

SEQ ID NO: 71020 - DNA, 20 bp, human
ggagccctccagacataagg

SEQ ID NO: 71021 - DNA, 20 bp, human
ggcgtccccgcgcagctaca

SEQ ID NO: 71022 - DNA, 20 bp, human
gaggcctaggctcaggatcc

SEQ ID NO: 71023 - DNA, 20 bp, human
ggctaggcgtctggggataa

SEQ ID NO: 71024 - DNA, 20 bp, human
ggagcagccgggggcccgac

SEQ ID NO: 71025 - DNA, 20 bp, human
ggctgccgtcttctcgccat

SEQ ID NO: 71026 - DNA, 20 bp, human
gcgctttgtgttctcatcgg

SEQ ID NO: 71027 - DNA, 20 bp, human
gacagcaggctgcattccca

SEQ ID NO: 71028 - DNA, 20 bp, human
ggaacgctttgtgttctcat

SEQ ID NO: 71029 - DNA, 20 bp, human
gaacctctggaagacttcag

SEQ ID NO: 71030 - DNA, 20 bp, human
ggataacttcctacaacctc

SEQ ID NO: 71031 - DNA, 20 bp, human
gggaagagggtggcgtccgt

SEQ ID NO: 71032 - DNA, 20 bp, human
gctggagcatcgcagatgac

SEQ ID NO: 71033 - DNA, 20 bp, human
ggcctcctggggcttaaagc

SEQ ID NO: 71034 - DNA, 20 bp, human
gctatgagacagcagggata

SEQ ID NO: 71035 - DNA, 20 bp, human
ggaagtcttccagaggttgt

SEQ ID NO: 71036 - DNA, 20 bp, human
ggtcagaatgcaggagacca

SEQ ID NO: 71037 - DNA, 20 bp, human
gccatcctttccataaggtg

SEQ ID NO: 71038 - DNA, 20 bp, human
ggcccaccatcctttccata

SEQ ID NO: 71039 - DNA, 20 bp, human
ggatgcctgggtcagaatgc

SEQ ID NO: 71040 - DNA, 20 bp, human
gactcagagctagaagtcaa

SEQ ID NO: 71041 - DNA, 20 bp, human
gcatgcctcaccttatggaa

SEQ ID NO: 71042 - DNA, 20 bp, human
ggctcccactgccctttcag

SEQ ID NO: 71043 - DNA, 20 bp, human
gtaactcagtcaccttgtgc

SEQ ID NO: 71044 - DNA, 20 bp, human
gacctgcatgcctcacctta

SEQ ID NO: 71045 - DNA, 20 bp, human
gtctaatctcccaaagatat

SEQ ID NO: 71046 - DNA, 20 bp, human
gatcatgaggcgctgcagga

SEQ ID NO: 71047 - DNA, 20 bp, human
gggatgtgcgtgaggttggt

SEQ ID NO: 71048 - DNA, 20 bp, human
ggtggctgtcggagatcatg

SEQ ID NO: 71049 - DNA, 20 bp, human
gcgaatccagagacacaagg

SEQ ID NO: 71050 - DNA, 20 bp, human
gtggaactgcagctccgtca

SEQ ID NO: 71051 - DNA, 20 bp, human
gggtcatgccgctgaagctc

SEQ ID NO: 71052 - DNA, 20 bp, human
gctggctctgcaggacgccg

SEQ ID NO: 71053 - DNA, 20 bp, human
gccccgaatccagagacaca

SEQ ID NO: 71054 - DNA, 20 bp, human
gtgctcttcggaatgggccg

SEQ ID NO: 71055 - DNA, 20 bp, human
gacctgacccacctgcccaa

SEQ ID NO: 71056 - DNA, 20 bp, human
gagacagaagagggcggtcg

SEQ ID NO: 71057 - DNA, 20 bp, human
ggcggtcggggatggagaca

SEQ ID NO: 71058 - DNA, 20 bp, human
gagtcctgagggtcagatct

SEQ ID NO: 71059 - DNA, 20 bp, human
gctgtcttggtgagtcctga

SEQ ID NO: 71060 - DNA, 20 bp, human
gagaagagggcggtcgggga

SEQ ID NO: 71061 - DNA, 20 bp, human
gctgggaaatgctgaaggac

SEQ ID NO: 71062 - DNA, 20 bp, human
gtgttgggtggggaaacggg

SEQ ID NO: 71063 - DNA, 20 bp, human
ggaacagagtatcctagcat

SEQ ID NO: 71064 - DNA, 20 bp, human
gtttcccagatctgaccctc

SEQ ID NO: 71065 - DNA, 20 bp, human
gccccacccaacaaatgaag

SEQ ID NO: 71066 - DNA, 20 bp, human
ggacaggagcacctgaccaa

SEQ ID NO: 71067 - DNA, 20 bp, human
gtgtctggcctgaaaggtcc

SEQ ID NO: 71068 - DNA, 20 bp, human
ggcagggaggggaactcagt

SEQ ID NO: 71069 - DNA, 20 bp, human
gggcctgggtggcaactcta

SEQ ID NO: 71070 - DNA, 20 bp, human
gacctgaccaaaggcttcac

SEQ ID NO: 71071 - DNA, 20 bp, human
ggccatgctgggtaatacgg

SEQ ID NO: 71072 - DNA, 20 bp, human
gtgctcctgtctggcctgaa

SEQ ID NO: 71073 - DNA, 20 bp, human
gcagtgttagcccagatgag

SEQ ID NO: 71074 - DNA, 20 bp, human
gctggcctctgacaccacac

SEQ ID NO: 71075 - DNA, 20 bp, human
ggtgcccagggccaccggtg

SEQ ID NO: 71076 - DNA, 20 bp, human
gacagctcagacctgtctgg

SEQ ID NO: 71077 - DNA, 20 bp, human
gaggctgccagtgacaggtt

SEQ ID NO: 71078 - DNA, 20 bp, human
gtctggaggctgccagtgac

SEQ ID NO: 71079 - DNA, 20 bp, human
gcagacagctcagacctgtc

SEQ ID NO: 71080 - DNA, 20 bp, human
gattgcagggacctccagtt

SEQ ID NO: 71081 - DNA, 20 bp, human
ggaagaagcaagaccatggt

SEQ ID NO: 71082 - DNA, 20 bp, human
gcagagaagaagcaagacca

SEQ ID NO: 71083 - DNA, 20 bp, human
gcagtgacaggttaggttta

SEQ ID NO: 71084 - DNA, 20 bp, human
gctactccaaaggtcccaag

SEQ ID NO: 71085 - DNA, 20 bp, human
gagggacctccagttgggcc

SEQ ID NO: 71086 - DNA, 20 bp, human
ggtcccagagacgctcgcga

SEQ ID NO: 71087 - DNA, 20 bp, human
gcgcgttgaggcgcagcact

SEQ ID NO: 71088 - DNA, 20 bp, human
gctaccgccgcggtgcccac

SEQ ID NO: 71089 - DNA, 20 bp, human
ggctgtgagagaggacggag

SEQ ID NO: 71090 - DNA, 20 bp, human
ggcaccgcggcggtagttgg

SEQ ID NO: 71091 - DNA, 20 bp, human
gcagcctgtgggcaccgcgg

SEQ ID NO: 71092 - DNA, 20 bp, human
ggcgggtccccgggtctgac

SEQ ID NO: 71093 - DNA, 20 bp, human
gtccgacaggaggcccatgg

SEQ ID NO: 71094 - DNA, 20 bp, human
gggtctgggagacctaaacc

SEQ ID NO: 71095 - DNA, 20 bp, human
gccgcggcggtagttggagg

SEQ ID NO: 71096 - DNA, 20 bp, human
gcgcgatcagcagcgaagaa

SEQ ID NO: 71097 - DNA, 20 bp, human
gagtgggtatcagtcagtta

SEQ ID NO: 71098 - DNA, 20 bp, human
ggaaagtcggaggcctagga

SEQ ID NO: 71099 - DNA, 20 bp, human
gcatccgcggtggcggacac

SEQ ID NO: 71100 - DNA, 20 bp, human
gcagggcccggccagggagt

SEQ ID NO: 71101 - DNA, 20 bp, human
gcccgagccctggtaagcgg

SEQ ID NO: 71102 - DNA, 20 bp, human
gtggatagggttgacgttcg

SEQ ID NO: 71103 - DNA, 20 bp, human
gcagcgtgcagctcatatta

SEQ ID NO: 71104 - DNA, 20 bp, human
gggtctcttgccatccgcgg

SEQ ID NO: 71105 - DNA, 20 bp, human
ggctcgctgaagaaagtcgg

SEQ ID NO: 71106 - DNA, 20 bp, human
ggctagggtgcgaactgcca

SEQ ID NO: 71107 - DNA, 20 bp, human
ggagcgctcagtccaatcaa

SEQ ID NO: 71108 - DNA, 20 bp, human
gtggccgggactggaagtgc

SEQ ID NO: 71109 - DNA, 20 bp, human
gctcgggtgtcagggaatag

SEQ ID NO: 71110 - DNA, 20 bp, human
ggggaacattgaggcagtaa

SEQ ID NO: 71111 - DNA, 20 bp, human
gctgagagcagccggtatgc

SEQ ID NO: 71112 - DNA, 20 bp, human
gcttctgcagcagccgaagc

SEQ ID NO: 71113 - DNA, 20 bp, human
gatcggtcgggctcgtgcag

SEQ ID NO: 71114 - DNA, 20 bp, human
gtgttccctagggacccagg

SEQ ID NO: 71115 - DNA, 20 bp, human
gcgcgccggttgcgtcatca

SEQ ID NO: 71116 - DNA, 20 bp, human
gacaggcaataaggacccag

SEQ ID NO: 71117 - DNA, 20 bp, human
ggctacacagcaacacgtat

SEQ ID NO: 71118 - DNA, 20 bp, human
gtcatcccagcaggtctctg

SEQ ID NO: 71119 - DNA, 20 bp, human
ggtcactccctagaagatct

SEQ ID NO: 71120 - DNA, 20 bp, human
gcggaagcggaagccaggta

SEQ ID NO: 71121 - DNA, 20 bp, human
ggggcacaacgagaagccac

SEQ ID NO: 71122 - DNA, 20 bp, human
ggaggataggccagtcccct

SEQ ID NO: 71123 - DNA, 20 bp, human
gtcatgaggcaggagcccgg

SEQ ID NO: 71124 - DNA, 20 bp, human
gctctccccgagatcttcta

SEQ ID NO: 71125 - DNA, 20 bp, human
gccagtgcgctaacctgagg

SEQ ID NO: 71126 - DNA, 20 bp, human
gtctcttgcggctctctgta

SEQ ID NO: 71127 - DNA, 20 bp, human
gagcagtccacgccttgtgg

SEQ ID NO: 71128 - DNA, 20 bp, human
gcaaggcgtggactgctcaa

SEQ ID NO: 71129 - DNA, 20 bp, human
gcggcgaggccaggtcagaa

SEQ ID NO: 71130 - DNA, 20 bp, human
ggactgctcaagggaaggag

SEQ ID NO: 71131 - DNA, 20 bp, human
ggctccgcaaagccgccaca

SEQ ID NO: 71132 - DNA, 20 bp, human
gtgtgaggtgagaggcgcgg

SEQ ID NO: 71133 - DNA, 20 bp, human
gtcccggctctgctcaaaca

SEQ ID NO: 71134 - DNA, 20 bp, human
gtggtgtgaggtgagaggcg

SEQ ID NO: 71135 - DNA, 20 bp, human
gaggcgcggtggtcgctccc

SEQ ID NO: 71136 - DNA, 20 bp, human
gcagcaggagaccagccagt

SEQ ID NO: 71137 - DNA, 20 bp, human
gaggcgggctcattccatgg

SEQ ID NO: 71138 - DNA, 20 bp, human
gtcaggatctcgatgtggac

SEQ ID NO: 71139 - DNA, 20 bp, human
ggagtctcaggatctcgatg

SEQ ID NO: 71140 - DNA, 20 bp, human
ggaaaggctacatcccggag

SEQ ID NO: 71141 - DNA, 20 bp, human
gacaaaagaacggtaagatg

SEQ ID NO: 71142 - DNA, 20 bp, human
gtatactgcttgcctcccac

SEQ ID NO: 71143 - DNA, 20 bp, human
ggatgaacgtgcgaatgact

SEQ ID NO: 71144 - DNA, 20 bp, human
ggggtgtgggagtcacatca

SEQ ID NO: 71145 - DNA, 20 bp, human
gggtgagtcagagacgaggg

SEQ ID NO: 71146 - DNA, 20 bp, human
ggtcagctatgggaccgggc

SEQ ID NO: 71147 - DNA, 20 bp, human
gaagaagatctggtcagcta

SEQ ID NO: 71148 - DNA, 20 bp, human
gcaaggccgccgtagcgagg

SEQ ID NO: 71149 - DNA, 20 bp, human
gagtgacagcgaagaagatc

SEQ ID NO: 71150 - DNA, 20 bp, human
gcaagcgtggccgaacaagg

SEQ ID NO: 71151 - DNA, 20 bp, human
gcgacagagagaggtttaca

SEQ ID NO: 71152 - DNA, 20 bp, human
gatctggtcagctatgggac

SEQ ID NO: 71153 - DNA, 20 bp, human
ggagctcagacttgaaaccg

SEQ ID NO: 71154 - DNA, 20 bp, human
ggcgtggccgaacaaggggg

SEQ ID NO: 71155 - DNA, 20 bp, human
ggggaacacggcgacgaggg

SEQ ID NO: 71156 - DNA, 20 bp, human
ggctctacggcgctgaaccg

SEQ ID NO: 71157 - DNA, 20 bp, human
ggtcaggtaagagagctgtc

SEQ ID NO: 71158 - DNA, 20 bp, human
ggtaagagagctgtcaggta

SEQ ID NO: 71159 - DNA, 20 bp, human
ggagctgtcaggtaagggtc

SEQ ID NO: 71160 - DNA, 20 bp, human
gatgcgcagcgcgcgctcta

SEQ ID NO: 71161 - DNA, 20 bp, human
gcaaccggtagaatgataaa

SEQ ID NO: 71162 - DNA, 20 bp, human
gtctgcactaggaaactggt

SEQ ID NO: 71163 - DNA, 20 bp, human
ggtaagggtctggggacaac

SEQ ID NO: 71164 - DNA, 20 bp, human
gccggaagtccgacgctggt

SEQ ID NO: 71165 - DNA, 20 bp, human
gccacagacgcaaccaccca

SEQ ID NO: 71166 - DNA, 20 bp, human
gactccaactacaacagcac

SEQ ID NO: 71167 - DNA, 20 bp, human
ggtagttggagtctgttcac

SEQ ID NO: 71168 - DNA, 20 bp, human
gtcgccggtgctgttgtagt

SEQ ID NO: 71169 - DNA, 20 bp, human
gcgctccgctggacctggaa

SEQ ID NO: 71170 - DNA, 20 bp, human
gtgttgacaacactagggac

SEQ ID NO: 71171 - DNA, 20 bp, human
ggagcctggcctcgaagctc

SEQ ID NO: 71172 - DNA, 20 bp, human
ggctggacctggaatggagg

SEQ ID NO: 71173 - DNA, 20 bp, human
gttgattgttgacaacacta

SEQ ID NO: 71174 - DNA, 20 bp, human
gcggctgctggagctccgat

SEQ ID NO: 71175 - DNA, 20 bp, human
gactgctctttggaagtcgc

SEQ ID NO: 71176 - DNA, 20 bp, human
gtgagagtcggcccaaaaag

SEQ ID NO: 71177 - DNA, 20 bp, human
gaagccccggcggtgagagt

SEQ ID NO: 71178 - DNA, 20 bp, human
ggagtcggcccaaaaagcgg

SEQ ID NO: 71179 - DNA, 20 bp, human
ggctgcagcccgccccagag

SEQ ID NO: 71180 - DNA, 20 bp, human
ggcggggatcggctcttcta

SEQ ID NO: 71181 - DNA, 20 bp, human
gtggctgcggcagctggtga

SEQ ID NO: 71182 - DNA, 20 bp, human
ggggccgactctcaccgccg

SEQ ID NO: 71183 - DNA, 20 bp, human
gccggcccagaccggaaatg

SEQ ID NO: 71184 - DNA, 20 bp, human
ggctcatttgggctcacgag

SEQ ID NO: 71185 - DNA, 20 bp, human
gaaaaagcggcggccgttgg

SEQ ID NO: 71186 - DNA, 20 bp, human
gggccgagcgcaacacggag

SEQ ID NO: 71187 - DNA, 20 bp, human
ggagagaagctggccctcag

SEQ ID NO: 71188 - DNA, 20 bp, human
ggctgggtcggtaggaatta

SEQ ID NO: 71189 - DNA, 20 bp, human
gagacttcggctacctacgg

SEQ ID NO: 71190 - DNA, 20 bp, human
gccggtggctggattctcac

SEQ ID NO: 71191 - DNA, 20 bp, human
gatgtgacaatccaagatgg

SEQ ID NO: 71192 - DNA, 20 bp, human
gcgcagacttcggctaccta

SEQ ID NO: 71193 - DNA, 20 bp, human
ggaggaggcgacagtttacc

SEQ ID NO: 71194 - DNA, 20 bp, human
gtgcggatgagacagcgacc

SEQ ID NO: 71195 - DNA, 20 bp, human
gtggccctcagcggctgggt

SEQ ID NO: 71196 - DNA, 20 bp, human
gggagcggacccagcaatga

SEQ ID NO: 71197 - DNA, 20 bp, human
ggctcccttcccccgaacgg

SEQ ID NO: 71198 - DNA, 20 bp, human
gcgcgttacgtgctctggag

SEQ ID NO: 71199 - DNA, 20 bp, human
ggacccagcaatgacggtaa

SEQ ID NO: 71200 - DNA, 20 bp, human
gagatggcggcgcacaagtc

SEQ ID NO: 71201 - DNA, 20 bp, human
ggccccttaccgtcattgct

SEQ ID NO: 71202 - DNA, 20 bp, human
ggctccgcggaaacatgtgc

SEQ ID NO: 71203 - DNA, 20 bp, human
gtccgactaccaccgttcgg

SEQ ID NO: 71204 - DNA, 20 bp, human
ggccctggaagttaagagac

SEQ ID NO: 71205 - DNA, 20 bp, human
gagcaaggaagcctagggaa

SEQ ID NO: 71206 - DNA, 20 bp, human
gcaggagggaaggagcgaac

SEQ ID NO: 71207 - DNA, 20 bp, human
ggtcgtcctgagaggagtga

SEQ ID NO: 71208 - DNA, 20 bp, human
gcggagagcgtcgtcctgag

SEQ ID NO: 71209 - DNA, 20 bp, human
gggctcccaggggacaagag

SEQ ID NO: 71210 - DNA, 20 bp, human
gtcccaggggacaagagggg

SEQ ID NO: 71211 - DNA, 20 bp, human
gcagatcgggcagacctgga

SEQ ID NO: 71212 - DNA, 20 bp, human
gttcgttgaagcgggagaag

SEQ ID NO: 71213 - DNA, 20 bp, human
gcccttcgccggcacagatc

SEQ ID NO: 71214 - DNA, 20 bp, human
ggcgaagggctggctcccag

SEQ ID NO: 71215 - DNA, 20 bp, human
gaggagtgaaggcggcaaaa

SEQ ID NO: 71216 - DNA, 20 bp, human
gacccagacgggcagagcct

SEQ ID NO: 71217 - DNA, 20 bp, human
ggcatggtgtctccacccag

SEQ ID NO: 71218 - DNA, 20 bp, human
gctggccccgctgtccccac

SEQ ID NO: 71219 - DNA, 20 bp, human
ggtagcctctccaggatctg

SEQ ID NO: 71220 - DNA, 20 bp, human
gtccactagaacagcgacaa

SEQ ID NO: 71221 - DNA, 20 bp, human
ggctgggaaatcacccctgg

SEQ ID NO: 71222 - DNA, 20 bp, human
gtggagctcccagccctaat

SEQ ID NO: 71223 - DNA, 20 bp, human
gtcagagggatagagaaatg

SEQ ID NO: 71224 - DNA, 20 bp, human
gtcgctgttctagtggaggt

SEQ ID NO: 71225 - DNA, 20 bp, human
gcctggctgaagagcacaag

SEQ ID NO: 71226 - DNA, 20 bp, human
ggggtttgaggggtcgggag

SEQ ID NO: 71227 - DNA, 20 bp, human
gggactgagactggttgtgg

SEQ ID NO: 71228 - DNA, 20 bp, human
gggccgagcactgagagcgt

SEQ ID NO: 71229 - DNA, 20 bp, human
gagaacattgcggatcgggt

SEQ ID NO: 71230 - DNA, 20 bp, human
gaggctgcccgccgacggag

SEQ ID NO: 71231 - DNA, 20 bp, human
gaggcgcccgacgtagaggg

SEQ ID NO: 71232 - DNA, 20 bp, human
gtgactcggcccgggtggag

SEQ ID NO: 71233 - DNA, 20 bp, human
ggccgagtcaatacctagag

SEQ ID NO: 71234 - DNA, 20 bp, human
gaccagtctcagtcccaaaa

SEQ ID NO: 71235 - DNA, 20 bp, human
gtagccccggcggcttggtt

SEQ ID NO: 71236 - DNA, 20 bp, human
gggcccacaaggtccaggag

SEQ ID NO: 71237 - DNA, 20 bp, human
gcagcttgtcgacccggcag

SEQ ID NO: 71238 - DNA, 20 bp, human
gcaagccggatcgcctggag

SEQ ID NO: 71239 - DNA, 20 bp, human
ggacgcgcacacgagaagta

SEQ ID NO: 71240 - DNA, 20 bp, human
ggggtcggaacgctcacctg

SEQ ID NO: 71241 - DNA, 20 bp, human
gcaaggggcgggctgtggga

SEQ ID NO: 71242 - DNA, 20 bp, human
gcgacgaccgaagttaaagt

SEQ ID NO: 71243 - DNA, 20 bp, human
gtgggcgcgtatgaatgagt

SEQ ID NO: 71244 - DNA, 20 bp, human
gtataggtccgacccgagag

SEQ ID NO: 71245 - DNA, 20 bp, human
gccgcccggtgcctaaccaa

SEQ ID NO: 71246 - DNA, 20 bp, human
ggaggtccgaacgctcgctc

SEQ ID NO: 71247 - DNA, 20 bp, human
gtgccccaggcggagatctc

SEQ ID NO: 71248 - DNA, 20 bp, human
gggagatctcgggtgagtga

SEQ ID NO: 71249 - DNA, 20 bp, human
gagccgcgtcgggaagacca

SEQ ID NO: 71250 - DNA, 20 bp, human
gagacaacaaaagccggcgg

SEQ ID NO: 71251 - DNA, 20 bp, human
gcggagacaacaaaagccgg

SEQ ID NO: 71252 - DNA, 20 bp, human
gcacccgagatctccgcctg

SEQ ID NO: 71253 - DNA, 20 bp, human
ggcgaggtccgccagatcta

SEQ ID NO: 71254 - DNA, 20 bp, human
ggccagatctacggagccaa

SEQ ID NO: 71255 - DNA, 20 bp, human
gcccggccaggatccgagag

SEQ ID NO: 71256 - DNA, 20 bp, human
ggaccaggaccgggacacag

SEQ ID NO: 71257 - DNA, 20 bp, human
ggcacgatagctggaccagg

SEQ ID NO: 71258 - DNA, 20 bp, human
gggagaacagacattactgt

SEQ ID NO: 71259 - DNA, 20 bp, human
gcgagcacgatagctggacc

SEQ ID NO: 71260 - DNA, 20 bp, human
ggacggcaaagtgggtccta

SEQ ID NO: 71261 - DNA, 20 bp, human
gaggagattgagggtagcgg

SEQ ID NO: 71262 - DNA, 20 bp, human
gcaatggagtaggagattga

SEQ ID NO: 71263 - DNA, 20 bp, human
gtataacggtcactctgaaa

SEQ ID NO: 71264 - DNA, 20 bp, human
gtcctcacctgagatcaggg

SEQ ID NO: 71265 - DNA, 20 bp, human
gtgcccaagcccacgtgaga

SEQ ID NO: 71266 - DNA, 20 bp, human
gctgcagcccggactcaagt

SEQ ID NO: 71267 - DNA, 20 bp, human
gccggagcgagagcagtccc

SEQ ID NO: 71268 - DNA, 20 bp, human
gctgggcacttgggagtggt

SEQ ID NO: 71269 - DNA, 20 bp, human
gggctgggtctactgaggga

SEQ ID NO: 71270 - DNA, 20 bp, human
gcagagcgccctgtgtagag

SEQ ID NO: 71271 - DNA, 20 bp, human
gtggcataactactgcagag

SEQ ID NO: 71272 - DNA, 20 bp, human
ggctcgcagccgctctacac

SEQ ID NO: 71273 - DNA, 20 bp, human
ggcacgactacagcccggcg

SEQ ID NO: 71274 - DNA, 20 bp, human
gggtgacaggtggcgtccgg

SEQ ID NO: 71275 - DNA, 20 bp, human
gagggcgcacgactacagcc

SEQ ID NO: 71276 - DNA, 20 bp, human
gacgccggccagtcaatcag

SEQ ID NO: 71277 - DNA, 20 bp, human
ggaagggcacagccgcgcgg

SEQ ID NO: 71278 - DNA, 20 bp, human
gggacgagcggaccagcgca

SEQ ID NO: 71279 - DNA, 20 bp, human
gccgctcgtccggctggact

SEQ ID NO: 71280 - DNA, 20 bp, human
gcccgtccggtcccaaaggt

SEQ ID NO: 71281 - DNA, 20 bp, human
ggactagcgagtggagctgg

SEQ ID NO: 71282 - DNA, 20 bp, human
gcggacgggaagcggcgcta

SEQ ID NO: 71283 - DNA, 20 bp, human
gggcacagccgcgcggcgga

SEQ ID NO: 71284 - DNA, 20 bp, human
gggagtcggggactagcgag

SEQ ID NO: 71285 - DNA, 20 bp, human
ggcttcccgtccggtcccaa

SEQ ID NO: 71286 - DNA, 20 bp, human
gaaccagggccagaaggagg

SEQ ID NO: 71287 - DNA, 20 bp, human
gctgcgggcggacccaacca

SEQ ID NO: 71288 - DNA, 20 bp, human
gggaggcagcgaaagcccac

SEQ ID NO: 71289 - DNA, 20 bp, human
gcagggcgagtggggtccac

SEQ ID NO: 71290 - DNA, 20 bp, human
gacgcacagacctggcccgt

SEQ ID NO: 71291 - DNA, 20 bp, human
gagcagttagctcttcccgg

SEQ ID NO: 71292 - DNA, 20 bp, human
gggctcgcagcagctaacct

SEQ ID NO: 71293 - DNA, 20 bp, human
gcctagccgagaagagtggg

SEQ ID NO: 71294 - DNA, 20 bp, human
ggaggatggacgcacagacc

SEQ ID NO: 71295 - DNA, 20 bp, human
gtagctgctgcgagccgagc

SEQ ID NO: 71296 - DNA, 20 bp, human
gttggggatatacgagatct

SEQ ID NO: 71297 - DNA, 20 bp, human
gcaaaggtgggagcgcgcgc

SEQ ID NO: 71298 - DNA, 20 bp, human
ggacgatggcaagccaacaa

SEQ ID NO: 71299 - DNA, 20 bp, human
gtcctggagacagtcactgg

SEQ ID NO: 71300 - DNA, 20 bp, human
gcggagtgtgcggcaaaggt

SEQ ID NO: 71301 - DNA, 20 bp, human
gatttcaggaggactctcac

SEQ ID NO: 71302 - DNA, 20 bp, human
gatggcaagccaacaagggc

SEQ ID NO: 71303 - DNA, 20 bp, human
gttgcaccgtttccatctgg

SEQ ID NO: 71304 - DNA, 20 bp, human
gtctagcccccagatggaaa

SEQ ID NO: 71305 - DNA, 20 bp, human
gttataagccagatggacga

SEQ ID NO: 71306 - DNA, 20 bp, human
ggaccgcgggcagaggtacc

SEQ ID NO: 71307 - DNA, 20 bp, human
gcgccagcgctccccccagg

SEQ ID NO: 71308 - DNA, 20 bp, human
gaggcagcccagcagaagcg

SEQ ID NO: 71309 - DNA, 20 bp, human
gcctcgccagcgctcccccc

SEQ ID NO: 71310 - DNA, 20 bp, human
ggcccgagagcgaggaccgc

SEQ ID NO: 71311 - DNA, 20 bp, human
gactagcgaacccggaggtg

SEQ ID NO: 71312 - DNA, 20 bp, human
gagcagggtgcgtggagcat

SEQ ID NO: 71313 - DNA, 20 bp, human
ggaagcagccacgctcaaac

SEQ ID NO: 71314 - DNA, 20 bp, human
gtatgcagagtactgagtcg

SEQ ID NO: 71315 - DNA, 20 bp, human
gttcctgccgctcgacgccg

SEQ ID NO: 71316 - DNA, 20 bp, human
ggccggctcaggcagagacg

SEQ ID NO: 71317 - DNA, 20 bp, human
gaggcagagacgcggcacca

SEQ ID NO: 71318 - DNA, 20 bp, human
gcagtgacctggcagtagaa

SEQ ID NO: 71319 - DNA, 20 bp, human
gctagccggcagaggagcta

SEQ ID NO: 71320 - DNA, 20 bp, human
gggagtggaggtgataagga

SEQ ID NO: 71321 - DNA, 20 bp, human
gggccccccaagacagaggt

SEQ ID NO: 71322 - DNA, 20 bp, human
ggccgcgtctctgcctgagc

SEQ ID NO: 71323 - DNA, 20 bp, human
ggcaagaaagtctgcattgt

SEQ ID NO: 71324 - DNA, 20 bp, human
gccccaagacagaggtgggt

SEQ ID NO: 71325 - DNA, 20 bp, human
gtcctgacccccgccctcct

SEQ ID NO: 71326 - DNA, 20 bp, human
ggggtggccgcgaccattgg

SEQ ID NO: 71327 - DNA, 20 bp, human
gcgggccgaatgtagccgcc

SEQ ID NO: 71328 - DNA, 20 bp, human
gaggctgaacaggcggaggt

SEQ ID NO: 71329 - DNA, 20 bp, human
gcagggaagcacggtccagg

SEQ ID NO: 71330 - DNA, 20 bp, human
gtctgtgcgctcagtaacgg

SEQ ID NO: 71331 - DNA, 20 bp, human
gtgacccaggagatccgccg

SEQ ID NO: 71332 - DNA, 20 bp, human
gttcggcccggccatggcag

SEQ ID NO: 71333 - DNA, 20 bp, human
gccacgatgcacactttcag

SEQ ID NO: 71334 - DNA, 20 bp, human
ggcgggcaaggctgaacagg

SEQ ID NO: 71335 - DNA, 20 bp, human
ggctgcgggcaaggctgaac

SEQ ID NO: 71336 - DNA, 20 bp, human
gtgtaactcgagcgccgggc

SEQ ID NO: 71337 - DNA, 20 bp, human
ggtcagcgcagggacccgca

SEQ ID NO: 71338 - DNA, 20 bp, human
ggccgaggctctgattctgg

SEQ ID NO: 71339 - DNA, 20 bp, human
gacactcgcccgggtcagaa

SEQ ID NO: 71340 - DNA, 20 bp, human
ggcctgggcccgaggtatcc

SEQ ID NO: 71341 - DNA, 20 bp, human
gagaatcagagcctcggccc

SEQ ID NO: 71342 - DNA, 20 bp, human
gcagtcttggcggtaggtgg

SEQ ID NO: 71343 - DNA, 20 bp, human
gtgctcccagcgaggcgcgc

SEQ ID NO: 71344 - DNA, 20 bp, human
gtctcactcttgcttcggaa

SEQ ID NO: 71345 - DNA, 20 bp, human
gagatgcggctagtctgata

SEQ ID NO: 71346 - DNA, 20 bp, human
gagaggaagagacccgccct

SEQ ID NO: 71347 - DNA, 20 bp, human
gggcagactcactggctcag

SEQ ID NO: 71348 - DNA, 20 bp, human
gcacccgctcccctagtcag

SEQ ID NO: 71349 - DNA, 20 bp, human
ggcccgcgagggaaggttcc

SEQ ID NO: 71350 - DNA, 20 bp, human
ggtgccataccactgactag

SEQ ID NO: 71351 - DNA, 20 bp, human
gcagaacgtgacggaatact

SEQ ID NO: 71352 - DNA, 20 bp, human
gtgggtgctgctctcaccag

SEQ ID NO: 71353 - DNA, 20 bp, human
ggctcccctagtcagtggta

SEQ ID NO: 71354 - DNA, 20 bp, human
gcattcggcaggtccagcag

SEQ ID NO: 71355 - DNA, 20 bp, human
ggcgagggaaggttcccggc

SEQ ID NO: 71356 - DNA, 20 bp, human
gccgaggcccaggaacagag

SEQ ID NO: 71357 - DNA, 20 bp, human
gaccagcagatagaggacca

SEQ ID NO: 71358 - DNA, 20 bp, human
gagcgagctcaccacttccg

SEQ ID NO: 71359 - DNA, 20 bp, human
ggggtttgaggggacgccat

SEQ ID NO: 71360 - DNA, 20 bp, human
gtggcagtcactgaagcctg

SEQ ID NO: 71361 - DNA, 20 bp, human
gtgcaagccgctctgttcct

SEQ ID NO: 71362 - DNA, 20 bp, human
gataggcatctgaaacacag

SEQ ID NO: 71363 - DNA, 20 bp, human
gctggctggtctgacaggtg

SEQ ID NO: 71364 - DNA, 20 bp, human
gagggagaatcactgcacag

SEQ ID NO: 71365 - DNA, 20 bp, human
gtggggagatgtctctacgt

SEQ ID NO: 71366 - DNA, 20 bp, human
gcaagcagcccagtaacaga

SEQ ID NO: 71367 - DNA, 20 bp, human
ggagagggtggacttgacgg

SEQ ID NO: 71368 - DNA, 20 bp, human
ggaatgaccaagacccagag

SEQ ID NO: 71369 - DNA, 20 bp, human
gccagagagggtggacttga

SEQ ID NO: 71370 - DNA, 20 bp, human
ggtctctaccttctgttact

SEQ ID NO: 71371 - DNA, 20 bp, human
gagtgggccaagcatgaagg

SEQ ID NO: 71372 - DNA, 20 bp, human
gtaagtagatgctgttgcag

SEQ ID NO: 71373 - DNA, 20 bp, human
gaaggtagagacatttaccc

SEQ ID NO: 71374 - DNA, 20 bp, human
gtaacctcattccagaggag

SEQ ID NO: 71375 - DNA, 20 bp, human
ggaataatgaattcagtagg

SEQ ID NO: 71376 - DNA, 20 bp, human
gctgcggagcgcgagaccca

SEQ ID NO: 71377 - DNA, 20 bp, human
ggaacgaggccggagagtgt

SEQ ID NO: 71378 - DNA, 20 bp, human
ggagacccaaggcagctaga

SEQ ID NO: 71379 - DNA, 20 bp, human
gacctgtaaggactccgaca

SEQ ID NO: 71380 - DNA, 20 bp, human
gtgggaaacatggcgaccga

SEQ ID NO: 71381 - DNA, 20 bp, human
gagagtgtcggaacgctctg

SEQ ID NO: 71382 - DNA, 20 bp, human
gcgcagagaagggccaccac

SEQ ID NO: 71383 - DNA, 20 bp, human
gagtccttacaggtaaccgg

SEQ ID NO: 71384 - DNA, 20 bp, human
gcgcccaggccagccgagag

SEQ ID NO: 71385 - DNA, 20 bp, human
gggaggcggcagaacgaggc

SEQ ID NO: 71386 - DNA, 20 bp, human
ggccgaggaggaaggagcgc

SEQ ID NO: 71387 - DNA, 20 bp, human
ggtaccttctagtcccgcca

SEQ ID NO: 71388 - DNA, 20 bp, human
gagtgagacgcgagccgagg

SEQ ID NO: 71389 - DNA, 20 bp, human
gcggccatggcgggactaga

SEQ ID NO: 71390 - DNA, 20 bp, human
gctgagtgagacgcgagccg

SEQ ID NO: 71391 - DNA, 20 bp, human
ggcactccaaggagactcca

SEQ ID NO: 71392 - DNA, 20 bp, human
gcggcagcgcgcagcaagcg

SEQ ID NO: 71393 - DNA, 20 bp, human
gctcgtaacgaagcagaccc

SEQ ID NO: 71394 - DNA, 20 bp, human
gggcccgcccgcacctgaag

SEQ ID NO: 71395 - DNA, 20 bp, human
gcgcagcaagcgaggcgcgt

SEQ ID NO: 71396 - DNA, 20 bp, human
gctgcggtaagtgggatgaa

SEQ ID NO: 71397 - DNA, 20 bp, human
gtcagggacacagcagcgtc

SEQ ID NO: 71398 - DNA, 20 bp, human
ggggtagtaggacagtgagt

SEQ ID NO: 71399 - DNA, 20 bp, human
gagggtgagtagggtgttca

SEQ ID NO: 71400 - DNA, 20 bp, human
ggtagggtgagtagggtagt

SEQ ID NO: 71401 - DNA, 20 bp, human
ggcagcgtccggcgagatga

SEQ ID NO: 71402 - DNA, 20 bp, human
gctctggagctgcggtaagt

SEQ ID NO: 71403 - DNA, 20 bp, human
gccatcctcgggccccaggg

SEQ ID NO: 71404 - DNA, 20 bp, human
gcagccatcctcgggcccca

SEQ ID NO: 71405 - DNA, 20 bp, human
gggcgagatgaaggcgctcg

SEQ ID NO: 71406 - DNA, 20 bp, human
gccaccgcagagatttccaa

SEQ ID NO: 71407 - DNA, 20 bp, human
ggtgaagccgaatgaaattg

SEQ ID NO: 71408 - DNA, 20 bp, human
gagcgcgccggcctgggaaa

SEQ ID NO: 71409 - DNA, 20 bp, human
gctaggacttgaagacacta

SEQ ID NO: 71410 - DNA, 20 bp, human
gactgagaagaagtgtctct

SEQ ID NO: 71411 - DNA, 20 bp, human
gctgtgggaattgcgaagag

SEQ ID NO: 71412 - DNA, 20 bp, human
ggcggtgggcgtaagcggga

SEQ ID NO: 71413 - DNA, 20 bp, human
ggtgggcgtaagcgggaggg

SEQ ID NO: 71414 - DNA, 20 bp, human
ggagggtgttttgccgctga

SEQ ID NO: 71415 - DNA, 20 bp, human
gtcggccagccgcctccgtg

SEQ ID NO: 71416 - DNA, 20 bp, human
gcagcggcagaaagcctcgt

SEQ ID NO: 71417 - DNA, 20 bp, human
gtcggctaccatgcccagag

SEQ ID NO: 71418 - DNA, 20 bp, human
gcgcgcgcacgggaacgcag

SEQ ID NO: 71419 - DNA, 20 bp, human
gtcgtaggcagcgcgcacgg

SEQ ID NO: 71420 - DNA, 20 bp, human
gggacgcgcggggaaagcgt

SEQ ID NO: 71421 - DNA, 20 bp, human
ggagagagggcgctgctctg

SEQ ID NO: 71422 - DNA, 20 bp, human
ggccatggcccgggcaacga

SEQ ID NO: 71423 - DNA, 20 bp, human
gcggtgcagcgagaaagacg

SEQ ID NO: 71424 - DNA, 20 bp, human
gggcatggtagccgactgcg

SEQ ID NO: 71425 - DNA, 20 bp, human
gcgagaaagacgcggagaga

SEQ ID NO: 71426 - DNA, 20 bp, human
ggtagccatggaagagaata

SEQ ID NO: 71427 - DNA, 20 bp, human
gtactgaagaaaggtagcca

SEQ ID NO: 71428 - DNA, 20 bp, human
gaccagattctactgaagaa

SEQ ID NO: 71429 - DNA, 20 bp, human
gcaagtgaggaacagactaa

SEQ ID NO: 71430 - DNA, 20 bp, human
gtcttccatattctcttcca

SEQ ID NO: 71431 - DNA, 20 bp, human
gacttgccgagctgggtcaa

SEQ ID NO: 71432 - DNA, 20 bp, human
gacctttcttcagtagaatc

SEQ ID NO: 71433 - DNA, 20 bp, human
ggaggaacagactaaaggag

SEQ ID NO: 71434 - DNA, 20 bp, human
gcctcacttgcagtaatgtc

SEQ ID NO: 71435 - DNA, 20 bp, human
gttggagttagttaaaaatt

SEQ ID NO: 71436 - DNA, 20 bp, human
gtgcagagaagcaggacctc

SEQ ID NO: 71437 - DNA, 20 bp, human
ggcgcgtacacctcgcccaa

SEQ ID NO: 71438 - DNA, 20 bp, human
gtggtcactcgctctcctct

SEQ ID NO: 71439 - DNA, 20 bp, human
ggaatagcgaggcgattaca

SEQ ID NO: 71440 - DNA, 20 bp, human
gcatgaaaacgtgggaactc

SEQ ID NO: 71441 - DNA, 20 bp, human
gcgacccactgtaaacagtc

SEQ ID NO: 71442 - DNA, 20 bp, human
gtggggagcaagttgaaacg

SEQ ID NO: 71443 - DNA, 20 bp, human
gtggcacctggaggcgaggg

SEQ ID NO: 71444 - DNA, 20 bp, human
ggaaaacgtgggaactcggg

SEQ ID NO: 71445 - DNA, 20 bp, human
gagaggcgatggcgatgggg

SEQ ID NO: 71446 - DNA, 20 bp, human
ggtgtaaataagagacggag

SEQ ID NO: 71447 - DNA, 20 bp, human
ggacgggtgtaaataagaga

SEQ ID NO: 71448 - DNA, 20 bp, human
gggtgcctacagtctcaatg

SEQ ID NO: 71449 - DNA, 20 bp, human
gtacttggctagaagaaatg

SEQ ID NO: 71450 - DNA, 20 bp, human
gggctctgagacaatcccta

SEQ ID NO: 71451 - DNA, 20 bp, human
gttgagactgtaggcaccac

SEQ ID NO: 71452 - DNA, 20 bp, human
gtgggatcctcggtgacgta

SEQ ID NO: 71453 - DNA, 20 bp, human
gaggcagccatacgtcaccg

SEQ ID NO: 71454 - DNA, 20 bp, human
gtggctagaagaaatgaggt

SEQ ID NO: 71455 - DNA, 20 bp, human
ggtctcaatgcggctccagt

SEQ ID NO: 71456 - DNA, 20 bp, human
gaagaggatttggagggtac

SEQ ID NO: 71457 - DNA, 20 bp, human
ggcccccgaaagccatgcgc

SEQ ID NO: 71458 - DNA, 20 bp, human
ggtgcaagtaggtactggag

SEQ ID NO: 71459 - DNA, 20 bp, human
gggaccttcagtgactggag

SEQ ID NO: 71460 - DNA, 20 bp, human
ggcggaaggccaggaagaaa

SEQ ID NO: 71461 - DNA, 20 bp, human
gtccaggtgcaagtaggtac

SEQ ID NO: 71462 - DNA, 20 bp, human
gacagacacactgggtgccg

SEQ ID NO: 71463 - DNA, 20 bp, human
gagggtcacagaaacagact

SEQ ID NO: 71464 - DNA, 20 bp, human
gaccggcgcatggctttcgg

SEQ ID NO: 71465 - DNA, 20 bp, human
ggaaggtccctcagaaactc

SEQ ID NO: 71466 - DNA, 20 bp, human
gcccagtacgtatacctcgt

SEQ ID NO: 71467 - DNA, 20 bp, human
gtcggagcggcccctgccat

SEQ ID NO: 71468 - DNA, 20 bp, human
ggtctcagctgttccgcctg

SEQ ID NO: 71469 - DNA, 20 bp, human
gcagcgtcactcgcctcagg

SEQ ID NO: 71470 - DNA, 20 bp, human
gggccagcgtcactcgcctc

SEQ ID NO: 71471 - DNA, 20 bp, human
gcgctgcgcctggggcccaa

SEQ ID NO: 71472 - DNA, 20 bp, human
ggcgccggagacgagactga

SEQ ID NO: 71473 - DNA, 20 bp, human
gtcgcgcaaaaggagataac

SEQ ID NO: 71474 - DNA, 20 bp, human
gcgtccacggcacactcgta

SEQ ID NO: 71475 - DNA, 20 bp, human
gtgcgcctggggcccaacgg

SEQ ID NO: 71476 - DNA, 20 bp, human
gcgcgaaggctaagggagtg

SEQ ID NO: 71477 - DNA, 20 bp, human
ggggcgtcgcgcgaaggcta

SEQ ID NO: 71478 - DNA, 20 bp, human
gtgaccagctgcgcataccg

SEQ ID NO: 71479 - DNA, 20 bp, human
gtccgggagccaacatgcct

SEQ ID NO: 71480 - DNA, 20 bp, human
ggctaagggagtgtggcggg

SEQ ID NO: 71481 - DNA, 20 bp, human
gctcagtgggcgtcgcgcga

SEQ ID NO: 71482 - DNA, 20 bp, human
gctcccaggagggtaaagtg

SEQ ID NO: 71483 - DNA, 20 bp, human
gaccgaggcatgttggctcc

SEQ ID NO: 71484 - DNA, 20 bp, human
gcactttcccggagctcagt

SEQ ID NO: 71485 - DNA, 20 bp, human
gcagaaaacgagatacagaa

SEQ ID NO: 71486 - DNA, 20 bp, human
gtcttggtggacgggcccag

SEQ ID NO: 71487 - DNA, 20 bp, human
gtcacggacgcaggcactca

SEQ ID NO: 71488 - DNA, 20 bp, human
gacccattcttgccagacag

SEQ ID NO: 71489 - DNA, 20 bp, human
gaagaagcttcacaagagaa

SEQ ID NO: 71490 - DNA, 20 bp, human
gtatcctctgaactagaggt

SEQ ID NO: 71491 - DNA, 20 bp, human
gcagccaatggccagagaat

SEQ ID NO: 71492 - DNA, 20 bp, human
gagtgttcttctggcatctg

SEQ ID NO: 71493 - DNA, 20 bp, human
gttcttgccagacagtggtt

SEQ ID NO: 71494 - DNA, 20 bp, human
gagaacactgttgctcttgg

SEQ ID NO: 71495 - DNA, 20 bp, human
ggctgaattctcacggacgc

SEQ ID NO: 71496 - DNA, 20 bp, human
gaagcagccaacggagatca

SEQ ID NO: 71497 - DNA, 20 bp, human
ggagaatgagtcagcatgtc

SEQ ID NO: 71498 - DNA, 20 bp, human
gtgaatggtgaataccaaac

SEQ ID NO: 71499 - DNA, 20 bp, human
gtgtctggaacactgtggta

SEQ ID NO: 71500 - DNA, 20 bp, human
gagccgtcacagaagatata

SEQ ID NO: 71501 - DNA, 20 bp, human
gcactgtggtaagggcgcgg

SEQ ID NO: 71502 - DNA, 20 bp, human
ggaacactgtggtaagggcg

SEQ ID NO: 71503 - DNA, 20 bp, human
gaagcggcatgtcctctagg

SEQ ID NO: 71504 - DNA, 20 bp, human
ggaagatatatggctccctc

SEQ ID NO: 71505 - DNA, 20 bp, human
gaatatggccaagcagccaa

SEQ ID NO: 71506 - DNA, 20 bp, human
ggaaccgggaaggtacaccc

SEQ ID NO: 71507 - DNA, 20 bp, human
gggttccagaatgaaatgga

SEQ ID NO: 71508 - DNA, 20 bp, human
gtccagaatgaaatggaggg

SEQ ID NO: 71509 - DNA, 20 bp, human
gtggagggtggtgttcagaa

SEQ ID NO: 71510 - DNA, 20 bp, human
gcagctgtagcgaaccctgt

SEQ ID NO: 71511 - DNA, 20 bp, human
gtttcattctggaaccggga

SEQ ID NO: 71512 - DNA, 20 bp, human
gagaagctattgtcatgcct

SEQ ID NO: 71513 - DNA, 20 bp, human
gtaccagttaaatttctgtg

SEQ ID NO: 71514 - DNA, 20 bp, human
ggtttagggacgatcctaca

SEQ ID NO: 71515 - DNA, 20 bp, human
gttatgagctgtaattatgt

SEQ ID NO: 71516 - DNA, 20 bp, human
gagagcactcctccactcta

SEQ ID NO: 71517 - DNA, 20 bp, human
gcctggccccagccgtagag

SEQ ID NO: 71518 - DNA, 20 bp, human
gaccagtgagagtagtgtag

SEQ ID NO: 71519 - DNA, 20 bp, human
ggacggcagcatggagggta

SEQ ID NO: 71520 - DNA, 20 bp, human
gccagcgacggcagcatgga

SEQ ID NO: 71521 - DNA, 20 bp, human
gcgggctgcacagaacacca

SEQ ID NO: 71522 - DNA, 20 bp, human
ggacggcagcctgaaggcca

SEQ ID NO: 71523 - DNA, 20 bp, human
gggccaaggaaggaagcacg

SEQ ID NO: 71524 - DNA, 20 bp, human
ggcctctacactactctcac

SEQ ID NO: 71525 - DNA, 20 bp, human
gcacaatccaggtgccatag

SEQ ID NO: 71526 - DNA, 20 bp, human
gcagcctcccgagtccgtgg

SEQ ID NO: 71527 - DNA, 20 bp, human
gttgcccccacggactcggg

SEQ ID NO: 71528 - DNA, 20 bp, human
ggatcgaagggccccgaggt

SEQ ID NO: 71529 - DNA, 20 bp, human
gtggccgctctggcgcccgt

SEQ ID NO: 71530 - DNA, 20 bp, human
ggggaggcgggggagccgac

SEQ ID NO: 71531 - DNA, 20 bp, human
gcgcggccagcctaggaccg

SEQ ID NO: 71532 - DNA, 20 bp, human
ggccctgagtgaggaattca

SEQ ID NO: 71533 - DNA, 20 bp, human
ggagccgacgggcgccagag

SEQ ID NO: 71534 - DNA, 20 bp, human
gggtgatgctggaacaaaca

SEQ ID NO: 71535 - DNA, 20 bp, human
gaggtggtccagtggctcag

SEQ ID NO: 71536 - DNA, 20 bp, human
gggactaagacccagttggg

SEQ ID NO: 71537 - DNA, 20 bp, human
gcgggagccccgcggagtgg

SEQ ID NO: 71538 - DNA, 20 bp, human
gatggagcctcgcccccgaa

SEQ ID NO: 71539 - DNA, 20 bp, human
ggggtgtagtccccaagaga

SEQ ID NO: 71540 - DNA, 20 bp, human
gatggcagtgagcgagagga

SEQ ID NO: 71541 - DNA, 20 bp, human
gaccccgctgtgcggctcca

SEQ ID NO: 71542 - DNA, 20 bp, human
ggaccccagcgaggcggacc

SEQ ID NO: 71543 - DNA, 20 bp, human
ggcctcgcccccgaagggag

SEQ ID NO: 71544 - DNA, 20 bp, human
gtctcgctcactgccatctc

SEQ ID NO: 71545 - DNA, 20 bp, human
gcccgggacgagaccactcc

SEQ ID NO: 71546 - DNA, 20 bp, human
gctggcacatcagaacaatg

SEQ ID NO: 71547 - DNA, 20 bp, human
gtctaggcaatctacctccc

SEQ ID NO: 71548 - DNA, 20 bp, human
gcctgaagatggttaaataa

SEQ ID NO: 71549 - DNA, 20 bp, human
gggttcctgtgttatcacag

SEQ ID NO: 71550 - DNA, 20 bp, human
gcacaagtatactgaaggaa

SEQ ID NO: 71551 - DNA, 20 bp, human
gcaggcttgtctacctgcac

SEQ ID NO: 71552 - DNA, 20 bp, human
gccgcttactaactataatg

SEQ ID NO: 71553 - DNA, 20 bp, human
gctttaacaagtatctttgg

SEQ ID NO: 71554 - DNA, 20 bp, human
gctcttcacaccagaactcg

SEQ ID NO: 71555 - DNA, 20 bp, human
gtgagccacaagtatactga

SEQ ID NO: 71556 - DNA, 20 bp, human
gtggaccctgcggttcccat

SEQ ID NO: 71557 - DNA, 20 bp, human
ggagtcaagttagccccgaa

SEQ ID NO: 71558 - DNA, 20 bp, human
gactgcctatgggaaccgca

SEQ ID NO: 71559 - DNA, 20 bp, human
gcatggggctgactgcctat

SEQ ID NO: 71560 - DNA, 20 bp, human
ggacctgggactactcactg

SEQ ID NO: 71561 - DNA, 20 bp, human
gcctctccaaaggaagtcac

SEQ ID NO: 71562 - DNA, 20 bp, human
gcacaggctgggctcttgta

SEQ ID NO: 71563 - DNA, 20 bp, human
gggcagtcagccccatgtgc

SEQ ID NO: 71564 - DNA, 20 bp, human
gcctggggagctgccattcg

SEQ ID NO: 71565 - DNA, 20 bp, human
gtgcagcactcctgcacatg

SEQ ID NO: 71566 - DNA, 20 bp, human
ggcaaacagtacagaatcac

SEQ ID NO: 71567 - DNA, 20 bp, human
gagaatcacaggaagtataa

SEQ ID NO: 71568 - DNA, 20 bp, human
gaatgaaagaagtactaaac

SEQ ID NO: 71569 - DNA, 20 bp, human
ggatctggtcatttgagggt

SEQ ID NO: 71570 - DNA, 20 bp, human
gctctgctcttagctttatg

SEQ ID NO: 71571 - DNA, 20 bp, human
ggaaacacttacctgagaac

SEQ ID NO: 71572 - DNA, 20 bp, human
ggtggttcagaaaaatttaa

SEQ ID NO: 71573 - DNA, 20 bp, human
gaattgcttgaaattgtgtg

SEQ ID NO: 71574 - DNA, 20 bp, human
gttatggggcttattgatcc

SEQ ID NO: 71575 - DNA, 20 bp, human
ggcagaaaagaaggtgactg

SEQ ID NO: 71576 - DNA, 20 bp, human
ggcacttgcgtggtgatctg

SEQ ID NO: 71577 - DNA, 20 bp, human
gtctacccccaagactaaaa

SEQ ID NO: 71578 - DNA, 20 bp, human
gcagcagtgcctcaggtaag

SEQ ID NO: 71579 - DNA, 20 bp, human
gtataccgttttagtcttgg

SEQ ID NO: 71580 - DNA, 20 bp, human
ggatagagcggagtgcgatg

SEQ ID NO: 71581 - DNA, 20 bp, human
gaactaagtcctcttacctg

SEQ ID NO: 71582 - DNA, 20 bp, human
gggccacgggagtctttgtg

SEQ ID NO: 71583 - DNA, 20 bp, human
ggctttgctcccggtcccgg

SEQ ID NO: 71584 - DNA, 20 bp, human
gtcccggtcccgggggaagg

SEQ ID NO: 71585 - DNA, 20 bp, human
ggaaggccgagctgctgccg

SEQ ID NO: 71586 - DNA, 20 bp, human
gcaccttggatggctgtcag

SEQ ID NO: 71587 - DNA, 20 bp, human
ggctgtcaggggctcagtag

SEQ ID NO: 71588 - DNA, 20 bp, human
gtatccacaggcccctcagt

SEQ ID NO: 71589 - DNA, 20 bp, human
gttctcaggtcagcctcctc

SEQ ID NO: 71590 - DNA, 20 bp, human
gtagcttctgcaggaagaag

SEQ ID NO: 71591 - DNA, 20 bp, human
gcaatccaggtcactctgaa

SEQ ID NO: 71592 - DNA, 20 bp, human
gtgggaacctgcaccttgga

SEQ ID NO: 71593 - DNA, 20 bp, human
gtgtaaaatggggtgagtct

SEQ ID NO: 71594 - DNA, 20 bp, human
gcacagacctggtgatatcc

SEQ ID NO: 71595 - DNA, 20 bp, human
gggaagtcgggaggcgtctg

SEQ ID NO: 71596 - DNA, 20 bp, human
gacaggcagtcagttctcac

SEQ ID NO: 71597 - DNA, 20 bp, human
gcagttctcactgggcccct

SEQ ID NO: 71598 - DNA, 20 bp, human
gggtgtaggacatctactca

SEQ ID NO: 71599 - DNA, 20 bp, human
gcatcacgtggcacctccca

SEQ ID NO: 71600 - DNA, 20 bp, human
ggctttaatggctcactcct

SEQ ID NO: 71601 - DNA, 20 bp, human
gagatctagcagcccagagg

SEQ ID NO: 71602 - DNA, 20 bp, human
gcagatcggcttctcgcaac

SEQ ID NO: 71603 - DNA, 20 bp, human
gagtagatctagcagcccag

SEQ ID NO: 71604 - DNA, 20 bp, human
gtttgaaatgggagtccaag

SEQ ID NO: 71605 - DNA, 20 bp, human
ggaggtgccacgtgatggtg

SEQ ID NO: 71606 - DNA, 20 bp, human
gctctgctgcaggaagaaga

SEQ ID NO: 71607 - DNA, 20 bp, human
ggaccagacttcaaatgctg

SEQ ID NO: 71608 - DNA, 20 bp, human
ggacaccatgatctatatac

SEQ ID NO: 71609 - DNA, 20 bp, human
gtgagatgggatatgacata

SEQ ID NO: 71610 - DNA, 20 bp, human
gcaggtgaggtgaacctcga

SEQ ID NO: 71611 - DNA, 20 bp, human
gccatgatctatatactggc

SEQ ID NO: 71612 - DNA, 20 bp, human
gaactccagaagagaaaggt

SEQ ID NO: 71613 - DNA, 20 bp, human
gacgggagacactgactgac

SEQ ID NO: 71614 - DNA, 20 bp, human
gcaaatgctggggctcttgc

SEQ ID NO: 71615 - DNA, 20 bp, human
ggaggggcaaatagtgagat

SEQ ID NO: 71616 - DNA, 20 bp, human
ggggatgactctgtgagact

SEQ ID NO: 71617 - DNA, 20 bp, human
gatgactctgtgagactggg

SEQ ID NO: 71618 - DNA, 20 bp, human
gctgggaggatcatagctgg

SEQ ID NO: 71619 - DNA, 20 bp, human
gagactgggaggatcatagc

SEQ ID NO: 71620 - DNA, 20 bp, human
gtcgcgttttcaggcaggac

SEQ ID NO: 71621 - DNA, 20 bp, human
gctttgtagcaagacctcag

SEQ ID NO: 71622 - DNA, 20 bp, human
gaacagcagcgcggctctca

SEQ ID NO: 71623 - DNA, 20 bp, human
gggctctcacgcccagtgga

SEQ ID NO: 71624 - DNA, 20 bp, human
gagtgacttaggagcccctg

SEQ ID NO: 71625 - DNA, 20 bp, human
gcaggggctctcacgcccag

SEQ ID NO: 71626 - DNA, 20 bp, human
gcttctgtgtgggccgagaa

SEQ ID NO: 71627 - DNA, 20 bp, human
ggagatggccacaccaatca

SEQ ID NO: 71628 - DNA, 20 bp, human
gggcaggacttcacttacca

SEQ ID NO: 71629 - DNA, 20 bp, human
gacctgtaggatcccaaaga

SEQ ID NO: 71630 - DNA, 20 bp, human
gcttcgctggcagtccaggc

SEQ ID NO: 71631 - DNA, 20 bp, human
gtgtgtgggccgagaagggc

SEQ ID NO: 71632 - DNA, 20 bp, human
gaccctgtgcagcctgcgga

SEQ ID NO: 71633 - DNA, 20 bp, human
gtgcacagggtcttctgtgt

SEQ ID NO: 71634 - DNA, 20 bp, human
ggccatctttgggatcctac

SEQ ID NO: 71635 - DNA, 20 bp, human
ggccatccgcaggctgcaca

SEQ ID NO: 71636 - DNA, 20 bp, human
gccccgaccggaacaaagag

SEQ ID NO: 71637 - DNA, 20 bp, human
ggcgcggggcgcgcactccg

SEQ ID NO: 71638 - DNA, 20 bp, human
ggcactccgcggcaggtgag

SEQ ID NO: 71639 - DNA, 20 bp, human
gcctcaaacgcacccccgac

SEQ ID NO: 71640 - DNA, 20 bp, human
ggacgggagtcggacgcgag

SEQ ID NO: 71641 - DNA, 20 bp, human
gcaggggccgccatcctcga

SEQ ID NO: 71642 - DNA, 20 bp, human
gaggatgtgcacgcgcgcgg

SEQ ID NO: 71643 - DNA, 20 bp, human
gccgtgcgcacggggcagtc

SEQ ID NO: 71644 - DNA, 20 bp, human
ggccgggctccggagcgggc

SEQ ID NO: 71645 - DNA, 20 bp, human
ggtgggagttcgatggaaat

SEQ ID NO: 71646 - DNA, 20 bp, human
gcggagctcgagccacatcc

SEQ ID NO: 71647 - DNA, 20 bp, human
gaggcgccacggataatcca

SEQ ID NO: 71648 - DNA, 20 bp, human
gcgggaggtgcgcgcagagg

SEQ ID NO: 71649 - DNA, 20 bp, human
gaaggacgcgcgggtctggg

SEQ ID NO: 71650 - DNA, 20 bp, human
gtcgggctgcacaaagccag

SEQ ID NO: 71651 - DNA, 20 bp, human
gcggcgacagcggggacccg

SEQ ID NO: 71652 - DNA, 20 bp, human
gagccaaactcaaccatctc

SEQ ID NO: 71653 - DNA, 20 bp, human
gcgcggccagtgtcacctcg

SEQ ID NO: 71654 - DNA, 20 bp, human
gtcacagccccgcgcacgag

SEQ ID NO: 71655 - DNA, 20 bp, human
gccacctgctgtggccgaag

SEQ ID NO: 71656 - DNA, 20 bp, human
gctccatccatggcacggag

SEQ ID NO: 71657 - DNA, 20 bp, human
ggcgctgggctgggacctag

SEQ ID NO: 71658 - DNA, 20 bp, human
gcgcggggcgatgggttgat

SEQ ID NO: 71659 - DNA, 20 bp, human
gccatggcacggagcggcgg

SEQ ID NO: 71660 - DNA, 20 bp, human
gcgcagctgcaagtgctcgg

SEQ ID NO: 71661 - DNA, 20 bp, human
ggcccagcgagcaggcgacg

SEQ ID NO: 71662 - DNA, 20 bp, human
ggccccggcggggaggacgt

SEQ ID NO: 71663 - DNA, 20 bp, human
gccgcacgcctgggtccctc

SEQ ID NO: 71664 - DNA, 20 bp, human
ggctgcctccatccatggca

SEQ ID NO: 71665 - DNA, 20 bp, human
ggtgcgggaggagtgctcag

SEQ ID NO: 71666 - DNA, 20 bp, human
gcggctgcgctgggcctcta

SEQ ID NO: 71667 - DNA, 20 bp, human
gctcgcgccgggcggtagag

SEQ ID NO: 71668 - DNA, 20 bp, human
gcccatgcggccgtgacccc

SEQ ID NO: 71669 - DNA, 20 bp, human
gagcggcgctgggacccatg

SEQ ID NO: 71670 - DNA, 20 bp, human
ggtcgcgggagatactcaca

SEQ ID NO: 71671 - DNA, 20 bp, human
gggcgaccggagccttatgg

SEQ ID NO: 71672 - DNA, 20 bp, human
gcggctgcaagcacgatggg

SEQ ID NO: 71673 - DNA, 20 bp, human
gtactcacagggtgaccgtg

SEQ ID NO: 71674 - DNA, 20 bp, human
ggcgcagccgcagcggacaa

SEQ ID NO: 71675 - DNA, 20 bp, human
gaggcggtgctcgcgccggg

SEQ ID NO: 71676 - DNA, 20 bp, human
gacggcgcaaggtgaaccct

SEQ ID NO: 71677 - DNA, 20 bp, human
ggcgagaagctgaggaagta

SEQ ID NO: 71678 - DNA, 20 bp, human
gccgtttctggagagttcat

SEQ ID NO: 71679 - DNA, 20 bp, human
gggctggtgctgaggagacc

SEQ ID NO: 71680 - DNA, 20 bp, human
gagggggacccaagtaccta

SEQ ID NO: 71681 - DNA, 20 bp, human
ggcaaggtgaaccctgggcg

SEQ ID NO: 71682 - DNA, 20 bp, human
gtactcctcagtgcctcgag

SEQ ID NO: 71683 - DNA, 20 bp, human
gctgcacggagggaataaac

SEQ ID NO: 71684 - DNA, 20 bp, human
gctccggaatcaacacctgg

SEQ ID NO: 71685 - DNA, 20 bp, human
ggtgtaaagcctaataagaa

SEQ ID NO: 71686 - DNA, 20 bp, human
gcacctggtgcacaagtact

SEQ ID NO: 71687 - DNA, 20 bp, human
ggacagccaccagcacccta

SEQ ID NO: 71688 - DNA, 20 bp, human
ggaatgcctcagactggaca

SEQ ID NO: 71689 - DNA, 20 bp, human
ggacctctgtccctgccacc

SEQ ID NO: 71690 - DNA, 20 bp, human
gagtctgaggcattccacca

SEQ ID NO: 71691 - DNA, 20 bp, human
gcttttgaggctaatccagt

SEQ ID NO: 71692 - DNA, 20 bp, human
gcaccctaaggttccaggca

SEQ ID NO: 71693 - DNA, 20 bp, human
gtgccgtgcctggaacctta

SEQ ID NO: 71694 - DNA, 20 bp, human
gcccataaatggcaccttgg

SEQ ID NO: 71695 - DNA, 20 bp, human
gagagtatgcaccttttatt

SEQ ID NO: 71696 - DNA, 20 bp, human
gggcatcagatgttaaaatc

SEQ ID NO: 71697 - DNA, 20 bp, human
gctagtgctacgcgagtggt

SEQ ID NO: 71698 - DNA, 20 bp, human
gttctcagcagttaatttat

SEQ ID NO: 71699 - DNA, 20 bp, human
gatcactagtgctacgcgag

SEQ ID NO: 71700 - DNA, 20 bp, human
gccatgctcaaaccatattg

SEQ ID NO: 71701 - DNA, 20 bp, human
gacctcaggtgaagcatttc

SEQ ID NO: 71702 - DNA, 20 bp, human
gcaaaccatattgtggaata

SEQ ID NO: 71703 - DNA, 20 bp, human
gtaatctttgagcgtctctc

SEQ ID NO: 71704 - DNA, 20 bp, human
gggaataaggagtggtattc

SEQ ID NO: 71705 - DNA, 20 bp, human
gcaacacaataatgatcatt

SEQ ID NO: 71706 - DNA, 20 bp, human
gggtgcgaggctagccacgc

SEQ ID NO: 71707 - DNA, 20 bp, human
ggggccctgggtaagtcgct

SEQ ID NO: 71708 - DNA, 20 bp, human
gagagcccagcgacttaccc

SEQ ID NO: 71709 - DNA, 20 bp, human
gccatctggaccagtagcca

SEQ ID NO: 71710 - DNA, 20 bp, human
ggcttccgtgattggtcggg

SEQ ID NO: 71711 - DNA, 20 bp, human
gagtgccccccgaccaatca

SEQ ID NO: 71712 - DNA, 20 bp, human
ggaccaatcacggaagcaag

SEQ ID NO: 71713 - DNA, 20 bp, human
ggtccctcccgagagaaccc

SEQ ID NO: 71714 - DNA, 20 bp, human
ggcgaggctagccacgcagg

SEQ ID NO: 71715 - DNA, 20 bp, human
ggtaaccccacaagcagcac

SEQ ID NO: 71716 - DNA, 20 bp, human
gcgcgacctgcgcccgggga

SEQ ID NO: 71717 - DNA, 20 bp, human
ggccgctctcgagctccttc

SEQ ID NO: 71718 - DNA, 20 bp, human
gaccagaaggagctcgagag

SEQ ID NO: 71719 - DNA, 20 bp, human
ggcgcaggtcgcggtcacag

SEQ ID NO: 71720 - DNA, 20 bp, human
gacctgactgagacaaacgg

SEQ ID NO: 71721 - DNA, 20 bp, human
ggctgtcttggagacctaat

SEQ ID NO: 71722 - DNA, 20 bp, human
ggaacttgagccagaccaga

SEQ ID NO: 71723 - DNA, 20 bp, human
gacctgcgcccggggacggg

SEQ ID NO: 71724 - DNA, 20 bp, human
gcctgagggtctgtgagaac

SEQ ID NO: 71725 - DNA, 20 bp, human
gcgaggaagaaacacccatt

SEQ ID NO: 71726 - DNA, 20 bp, human
gcagctccgtgcgacagcag

SEQ ID NO: 71727 - DNA, 20 bp, human
gggccgctaggtcggagtgg

SEQ ID NO: 71728 - DNA, 20 bp, human
gcagcgagcatggccttact

SEQ ID NO: 71729 - DNA, 20 bp, human
gaggccgccgccaccgggag

SEQ ID NO: 71730 - DNA, 20 bp, human
gaggcggccgctaggcccgg

SEQ ID NO: 71731 - DNA, 20 bp, human
gggcggccgctaggtcggag

SEQ ID NO: 71732 - DNA, 20 bp, human
gcggccgctaggcccggagg

SEQ ID NO: 71733 - DNA, 20 bp, human
ggccgtgagcagatccgata

SEQ ID NO: 71734 - DNA, 20 bp, human
gcaggcgccgaacccccggg

SEQ ID NO: 71735 - DNA, 20 bp, human
gacgctggaacccacgtcaa

SEQ ID NO: 71736 - DNA, 20 bp, human
gcacacacgcccaaggtgtg

SEQ ID NO: 71737 - DNA, 20 bp, human
ggagccccggggccgaagga

SEQ ID NO: 71738 - DNA, 20 bp, human
gagcgaggatgtgagccccg

SEQ ID NO: 71739 - DNA, 20 bp, human
gcctcgctgcctcacacctt

SEQ ID NO: 71740 - DNA, 20 bp, human
gagcaggagagggattctct

SEQ ID NO: 71741 - DNA, 20 bp, human
ggccatcccagccagggagg

SEQ ID NO: 71742 - DNA, 20 bp, human
gaggaccgtagggcccgtgg

SEQ ID NO: 71743 - DNA, 20 bp, human
gaggaaaggaacctcctccc

SEQ ID NO: 71744 - DNA, 20 bp, human
gccggtgagggaggaccgta

SEQ ID NO: 71745 - DNA, 20 bp, human
ggcgcgggaggtgtcccccg

SEQ ID NO: 71746 - DNA, 20 bp, human
ggagccggctctcccatcag

SEQ ID NO: 71747 - DNA, 20 bp, human
gaggtcctcaggccgctgat

SEQ ID NO: 71748 - DNA, 20 bp, human
gaggcggacgccaggtcctc

SEQ ID NO: 71749 - DNA, 20 bp, human
gcgctccagcctcaagggga

SEQ ID NO: 71750 - DNA, 20 bp, human
gctcaggtcgtggggacccg

SEQ ID NO: 71751 - DNA, 20 bp, human
ggagagccggctcaggtcgt

SEQ ID NO: 71752 - DNA, 20 bp, human
gtccaggacagaccggatag

SEQ ID NO: 71753 - DNA, 20 bp, human
gccccagagccaaggatggg

SEQ ID NO: 71754 - DNA, 20 bp, human
gagagccggctgatacccgt

SEQ ID NO: 71755 - DNA, 20 bp, human
ggacacccccaacccctatc

SEQ ID NO: 71756 - DNA, 20 bp, human
ggagcagccagaagacgaag

SEQ ID NO: 71757 - DNA, 20 bp, human
gggacgctcgggcctcatcg

SEQ ID NO: 71758 - DNA, 20 bp, human
gcagcctgcagccccgagac

SEQ ID NO: 71759 - DNA, 20 bp, human
gtagaacacggtgtagacga

SEQ ID NO: 71760 - DNA, 20 bp, human
gtgcgcggagacccccgcgg

SEQ ID NO: 71761 - DNA, 20 bp, human
ggaaaaactgcaggcacaca

SEQ ID NO: 71762 - DNA, 20 bp, human
ggcggccgtgagccccgatg

SEQ ID NO: 71763 - DNA, 20 bp, human
gggccaagcttcacgtaggg

SEQ ID NO: 71764 - DNA, 20 bp, human
ggcacggccggggtcagcgt

SEQ ID NO: 71765 - DNA, 20 bp, human
gcgtgagggtgaaaaactgc

SEQ ID NO: 71766 - DNA, 20 bp, human
gaggagccgagacccccggg

SEQ ID NO: 71767 - DNA, 20 bp, human
gcacagctgcaggtaggcaa

SEQ ID NO: 71768 - DNA, 20 bp, human
gagcgagcgcgggaaggaag

SEQ ID NO: 71769 - DNA, 20 bp, human
gaacagcgcggcgtagagca

SEQ ID NO: 71770 - DNA, 20 bp, human
ggtctcggctcctcctgctg

SEQ ID NO: 71771 - DNA, 20 bp, human
ggcgagcgcctcaaatgctc

SEQ ID NO: 71772 - DNA, 20 bp, human
ggcacggacaccctcatgag

SEQ ID NO: 71773 - DNA, 20 bp, human
gccttacctccgccaggtag

SEQ ID NO: 71774 - DNA, 20 bp, human
ggagcgggcggccggagcaa

SEQ ID NO: 71775 - DNA, 20 bp, human
gagctgcaaaaaacaactct

SEQ ID NO: 71776 - DNA, 20 bp, human
gagtggagcgggtccgaggt

SEQ ID NO: 71777 - DNA, 20 bp, human
gcccctcacctggtaaaccg

SEQ ID NO: 71778 - DNA, 20 bp, human
gcgagccggcgaccagagtc

SEQ ID NO: 71779 - DNA, 20 bp, human
gtagggttgcccggcacttg

SEQ ID NO: 71780 - DNA, 20 bp, human
gggcgccagggaacgcacgg

SEQ ID NO: 71781 - DNA, 20 bp, human
gaacgcacgggggaggacgg

SEQ ID NO: 71782 - DNA, 20 bp, human
gaagaggctgtagtagacca

SEQ ID NO: 71783 - DNA, 20 bp, human
gaggcgcacagacgggctcc

SEQ ID NO: 71784 - DNA, 20 bp, human
gggggaggacgggggattct

SEQ ID NO: 71785 - DNA, 20 bp, human
gaggacgggggattctgggt

SEQ ID NO: 71786 - DNA, 20 bp, human
ggctctgcatgcatttgcaa

SEQ ID NO: 71787 - DNA, 20 bp, human
gggacagctcaccaagcaaa

SEQ ID NO: 71788 - DNA, 20 bp, human
gaggtaagtgcagatgactt

SEQ ID NO: 71789 - DNA, 20 bp, human
ggttgaaacagaatcctatt

SEQ ID NO: 71790 - DNA, 20 bp, human
gttctataaaggaggagttg

SEQ ID NO: 71791 - DNA, 20 bp, human
gtagccatcactgagaaatc

SEQ ID NO: 71792 - DNA, 20 bp, human
gtaaagcacacttaatttgt

SEQ ID NO: 71793 - DNA, 20 bp, human
gaatgcagtaatagagttaa

SEQ ID NO: 71794 - DNA, 20 bp, human
ggtttcaacagcagggcagc

SEQ ID NO: 71795 - DNA, 20 bp, human
gacatttacccataaatatt

SEQ ID NO: 71796 - DNA, 20 bp, human
gctaacaacgctgggatcca

SEQ ID NO: 71797 - DNA, 20 bp, human
gctggattcagagcgaggag

SEQ ID NO: 71798 - DNA, 20 bp, human
gcatggagcaaaagatccag

SEQ ID NO: 71799 - DNA, 20 bp, human
gttcttcagacggaacacaa

SEQ ID NO: 71800 - DNA, 20 bp, human
gcactgagctggacatctcc

SEQ ID NO: 71801 - DNA, 20 bp, human
gggctccatctcttgaacca

SEQ ID NO: 71802 - DNA, 20 bp, human
gggatccatggttcaagaga

SEQ ID NO: 71803 - DNA, 20 bp, human
gctccgaataaggccatcca

SEQ ID NO: 71804 - DNA, 20 bp, human
gaagctgggacctccgaata

SEQ ID NO: 71805 - DNA, 20 bp, human
gatagaaggcctgttctggg

SEQ ID NO: 71806 - DNA, 20 bp, human
gctaggcgcggggaggccat

SEQ ID NO: 71807 - DNA, 20 bp, human
gccgagaaggtcgcaggcag

SEQ ID NO: 71808 - DNA, 20 bp, human
gaggccgtgcgcccttatcc

SEQ ID NO: 71809 - DNA, 20 bp, human
gcgtggctgcgtcccgcgtg

SEQ ID NO: 71810 - DNA, 20 bp, human
gggacgagaggcccgcgggt

SEQ ID NO: 71811 - DNA, 20 bp, human
ggtgatggagtgaggacgag

SEQ ID NO: 71812 - DNA, 20 bp, human
gagcagaaggtccctaggcg

SEQ ID NO: 71813 - DNA, 20 bp, human
gaaggtccctaggcgcgggg

SEQ ID NO: 71814 - DNA, 20 bp, human
ggtgaggacgagaggcccgc

SEQ ID NO: 71815 - DNA, 20 bp, human
gcgtccgcgaacacagccca

SEQ ID NO: 71816 - DNA, 20 bp, human
gcagggcgcccgggtcccag

SEQ ID NO: 71817 - DNA, 20 bp, human
gggaagagcaggccctctga

SEQ ID NO: 71818 - DNA, 20 bp, human
gagaaggcgcacccacacag

SEQ ID NO: 71819 - DNA, 20 bp, human
gagcgagggcgtgacgtcca

SEQ ID NO: 71820 - DNA, 20 bp, human
gtcgctgctgcccactgtgt

SEQ ID NO: 71821 - DNA, 20 bp, human
gggtggtgaagactgcaggt

SEQ ID NO: 71822 - DNA, 20 bp, human
gcgcggaaggctgcgaggaa

SEQ ID NO: 71823 - DNA, 20 bp, human
ggccaggatcaggactctct

SEQ ID NO: 71824 - DNA, 20 bp, human
gccgccccggccccacccca

SEQ ID NO: 71825 - DNA, 20 bp, human
gaagcaagaaccccatcagg

SEQ ID NO: 71826 - DNA, 20 bp, human
gcactcaccggcttgctggg

SEQ ID NO: 71827 - DNA, 20 bp, human
gctgctctcctgggccacta

SEQ ID NO: 71828 - DNA, 20 bp, human
gggctctcccatgtccgaca

SEQ ID NO: 71829 - DNA, 20 bp, human
gagcggtcccctcctggcaa

SEQ ID NO: 71830 - DNA, 20 bp, human
gagcctgggtcgggtcggtg

SEQ ID NO: 71831 - DNA, 20 bp, human
gtcaccggcttgctgggcgg

SEQ ID NO: 71832 - DNA, 20 bp, human
gccgaaagcagtcaccatag

SEQ ID NO: 71833 - DNA, 20 bp, human
gtgtgtacacagggcccggg

SEQ ID NO: 71834 - DNA, 20 bp, human
gccccactcaccggcttgct

SEQ ID NO: 71835 - DNA, 20 bp, human
ggtggtgccctgtcggacat

SEQ ID NO: 71836 - DNA, 20 bp, human
ggaggtggccaccagagctc

SEQ ID NO: 71837 - DNA, 20 bp, human
gcagcatggcgggacagagg

SEQ ID NO: 71838 - DNA, 20 bp, human
ggagcagcatggcgggacag

SEQ ID NO: 71839 - DNA, 20 bp, human
gcaggtcctcaccagagctc

SEQ ID NO: 71840 - DNA, 20 bp, human
ggactctgtgcagcacaggt

SEQ ID NO: 71841 - DNA, 20 bp, human
gctgtcggtgagcagcatgg

SEQ ID NO: 71842 - DNA, 20 bp, human
gccctcctgtcagtgactgg

SEQ ID NO: 71843 - DNA, 20 bp, human
gccactgtcggtgagcagca

SEQ ID NO: 71844 - DNA, 20 bp, human
gttagaagatcggagcggga

SEQ ID NO: 71845 - DNA, 20 bp, human
gacttagagatgtccaccgg

SEQ ID NO: 71846 - DNA, 20 bp, human
gtggggcagatcaacactca

SEQ ID NO: 71847 - DNA, 20 bp, human
gtagccgggagcaggtagtg

SEQ ID NO: 71848 - DNA, 20 bp, human
ggtgccatcaggacccctgt

SEQ ID NO: 71849 - DNA, 20 bp, human
ggtgttgatctgccccacag

SEQ ID NO: 71850 - DNA, 20 bp, human
gctgcagccagcaggcttga

SEQ ID NO: 71851 - DNA, 20 bp, human
ggcagatcaacactcaaggc

SEQ ID NO: 71852 - DNA, 20 bp, human
gtgccccacaggggtcctga

SEQ ID NO: 71853 - DNA, 20 bp, human
gccaagctgtagtgcccaca

SEQ ID NO: 71854 - DNA, 20 bp, human
ggaccatcctgcggaaccaa

SEQ ID NO: 71855 - DNA, 20 bp, human
ggctgctggtgaccatcctg

SEQ ID NO: 71856 - DNA, 20 bp, human
ggcgagcgcgagccagtcag

SEQ ID NO: 71857 - DNA, 20 bp, human
gtgcacaagctccctctgac

SEQ ID NO: 71858 - DNA, 20 bp, human
ggtcagatctaaaggagaca

SEQ ID NO: 71859 - DNA, 20 bp, human
gacaaggagaacatctagag

SEQ ID NO: 71860 - DNA, 20 bp, human
gagaacacagcggttcagat

SEQ ID NO: 71861 - DNA, 20 bp, human
ggttccagagctggattcaa

SEQ ID NO: 71862 - DNA, 20 bp, human
gatctagaggggaacttggt

SEQ ID NO: 71863 - DNA, 20 bp, human
gcaaaggatccagacatcat

SEQ ID NO: 71864 - DNA, 20 bp, human
ggaacatctagaggggaact

SEQ ID NO: 71865 - DNA, 20 bp, human
gtagcttgagtcagatctaa

SEQ ID NO: 71866 - DNA, 20 bp, human
gaaagagcagatgccaaatc

SEQ ID NO: 71867 - DNA, 20 bp, human
ggatacgactggccacacaa

SEQ ID NO: 71868 - DNA, 20 bp, human
gtaagtaaactcaccagatt

SEQ ID NO: 71869 - DNA, 20 bp, human
gatattgacggagatcatgt

SEQ ID NO: 71870 - DNA, 20 bp, human
ggagcgttgcatttcaaacc

SEQ ID NO: 71871 - DNA, 20 bp, human
gtggggaaccttgttctcat

SEQ ID NO: 71872 - DNA, 20 bp, human
gacagaggtgtaaggaacat

SEQ ID NO: 71873 - DNA, 20 bp, human
gtataaaagaagcttccttg

SEQ ID NO: 71874 - DNA, 20 bp, human
gcaacgctcccatgagaaca

SEQ ID NO: 71875 - DNA, 20 bp, human
ggactggccacacaatggcc

SEQ ID NO: 71876 - DNA, 20 bp, human
ggaccccagcccagcaagat

SEQ ID NO: 71877 - DNA, 20 bp, human
gagagggagatggattcggg

SEQ ID NO: 71878 - DNA, 20 bp, human
gaaaggcacacgcacagaga

SEQ ID NO: 71879 - DNA, 20 bp, human
gcacgcgtacaggtccgcca

SEQ ID NO: 71880 - DNA, 20 bp, human
gcgccggcggcagaattgag

SEQ ID NO: 71881 - DNA, 20 bp, human
gacgcgggaaaccaaagtgg

SEQ ID NO: 71882 - DNA, 20 bp, human
gtgctgtgccgcctgtgcgg

SEQ ID NO: 71883 - DNA, 20 bp, human
gagatgggcacggaaatgtt

SEQ ID NO: 71884 - DNA, 20 bp, human
gcggacctgtacgcgtgcgg

SEQ ID NO: 71885 - DNA, 20 bp, human
gtcctccgggacaaggatgg

SEQ ID NO: 71886 - DNA, 20 bp, human
gctggagttagagtctgcaa

SEQ ID NO: 71887 - DNA, 20 bp, human
ggtgtggataaaccagtcag

SEQ ID NO: 71888 - DNA, 20 bp, human
gagtacgccgtagctcggat

SEQ ID NO: 71889 - DNA, 20 bp, human
gggccaccacaacgattgtc

SEQ ID NO: 71890 - DNA, 20 bp, human
gctccagtcctgggaatcag

SEQ ID NO: 71891 - DNA, 20 bp, human
ggaggatgccaatcacacac

SEQ ID NO: 71892 - DNA, 20 bp, human
gaagctgtgaagagtgatgc

SEQ ID NO: 71893 - DNA, 20 bp, human
gtcagagggcaggtaccctc

SEQ ID NO: 71894 - DNA, 20 bp, human
gttcctatgcaaaagagccc

SEQ ID NO: 71895 - DNA, 20 bp, human
gagcctgacaatcgttgtgg

SEQ ID NO: 71896 - DNA, 20 bp, human
ggtggccagcacccagacac

SEQ ID NO: 71897 - DNA, 20 bp, human
gctaccatggaagctgacct

SEQ ID NO: 71898 - DNA, 20 bp, human
ggacaccggcgcagacccag

SEQ ID NO: 71899 - DNA, 20 bp, human
ggtgcccacactggtaccct

SEQ ID NO: 71900 - DNA, 20 bp, human
gccagaggggcaggcggact

SEQ ID NO: 71901 - DNA, 20 bp, human
ggcacccaggtcagcttcca

SEQ ID NO: 71902 - DNA, 20 bp, human
gcagcggtcgaggctgaggg

SEQ ID NO: 71903 - DNA, 20 bp, human
gaagctgacctgggtgccac

SEQ ID NO: 71904 - DNA, 20 bp, human
gccccaaatggacactacca

SEQ ID NO: 71905 - DNA, 20 bp, human
ggcggactgggcggtgccca

SEQ ID NO: 71906 - DNA, 20 bp, human
ggcccggcgcagcagcggag

SEQ ID NO: 71907 - DNA, 20 bp, human
gccgtccgagggcccacgag

SEQ ID NO: 71908 - DNA, 20 bp, human
gacggaccccgcgaccgata

SEQ ID NO: 71909 - DNA, 20 bp, human
gcgccccctgggcttctcag

SEQ ID NO: 71910 - DNA, 20 bp, human
gcccgatgcagggggacgga

SEQ ID NO: 71911 - DNA, 20 bp, human
gcggggccgagcccacctag

SEQ ID NO: 71912 - DNA, 20 bp, human
gcggcggcggcggcgcctag

SEQ ID NO: 71913 - DNA, 20 bp, human
gcgtcccctgagaagcccag

SEQ ID NO: 71914 - DNA, 20 bp, human
gtgcagggggacggagggag

SEQ ID NO: 71915 - DNA, 20 bp, human
gccggcgcgctccgctaggt

SEQ ID NO: 71916 - DNA, 20 bp, human
gggcacgttccgataaagta

SEQ ID NO: 71917 - DNA, 20 bp, human
gtgagctgacagggccgcat

SEQ ID NO: 71918 - DNA, 20 bp, human
ggaagagtctaagaaagaca

SEQ ID NO: 71919 - DNA, 20 bp, human
ggttccgataaagtaaggtg

SEQ ID NO: 71920 - DNA, 20 bp, human
ggagcttcccaaactaggga

SEQ ID NO: 71921 - DNA, 20 bp, human
gggcagttctgtctccggag

SEQ ID NO: 71922 - DNA, 20 bp, human
gggtggacgcccgtgcagtg

SEQ ID NO: 71923 - DNA, 20 bp, human
gagggtaccctcgggataaa

SEQ ID NO: 71924 - DNA, 20 bp, human
ggtgatctcacacgttccac

SEQ ID NO: 71925 - DNA, 20 bp, human
gagacagcaggtccagacaa

SEQ ID NO: 71926 - DNA, 20 bp, human
gcgccccgcgcacacctcag

SEQ ID NO: 71927 - DNA, 20 bp, human
gacggcggcgcaggcctctg

SEQ ID NO: 71928 - DNA, 20 bp, human
gaggaacttgaggtgagcag

SEQ ID NO: 71929 - DNA, 20 bp, human
ggcgttcgcggggctggaag

SEQ ID NO: 71930 - DNA, 20 bp, human
gcgagacgccgggggaccgt

SEQ ID NO: 71931 - DNA, 20 bp, human
gccacgccaggctcccggcg

SEQ ID NO: 71932 - DNA, 20 bp, human
gcgggcttggcgcttctcgg

SEQ ID NO: 71933 - DNA, 20 bp, human
gacgggagagtactgtaatt

SEQ ID NO: 71934 - DNA, 20 bp, human
gcacgcatcagggatgcgag

SEQ ID NO: 71935 - DNA, 20 bp, human
gggtgagcacagcgacctta

SEQ ID NO: 71936 - DNA, 20 bp, human
gcgcctcggtgcccagacgg

SEQ ID NO: 71937 - DNA, 20 bp, human
gatggccacggtccagaaga

SEQ ID NO: 71938 - DNA, 20 bp, human
ggcgcctggacgcgagccta

SEQ ID NO: 71939 - DNA, 20 bp, human
gcgccgccgtctgggcaccg

SEQ ID NO: 71940 - DNA, 20 bp, human
ggcgccgcgaggacagaagc

SEQ ID NO: 71941 - DNA, 20 bp, human
gacccacctgacgacatgga

SEQ ID NO: 71942 - DNA, 20 bp, human
gaggtacaagtagagcgcaa

SEQ ID NO: 71943 - DNA, 20 bp, human
gactccgtagaagtaggagg

SEQ ID NO: 71944 - DNA, 20 bp, human
gagcactccgtagaagtagg

SEQ ID NO: 71945 - DNA, 20 bp, human
gcatgtcgtcaggtgggtgg

SEQ ID NO: 71946 - DNA, 20 bp, human
gcatggcctcgcgctcccag

SEQ ID NO: 71947 - DNA, 20 bp, human
ggcagaaatcaagtcacctg

SEQ ID NO: 71948 - DNA, 20 bp, human
gcggagtagcgaaggccggg

SEQ ID NO: 71949 - DNA, 20 bp, human
gcctgcggcgggtgagacta

SEQ ID NO: 71950 - DNA, 20 bp, human
gctcgcagcctggagccgag

SEQ ID NO: 71951 - DNA, 20 bp, human
gcagatggcacccagtccaa

SEQ ID NO: 71952 - DNA, 20 bp, human
ggggaggcgggaacgacctg

SEQ ID NO: 71953 - DNA, 20 bp, human
gtcgaggaggagccagtgcc

SEQ ID NO: 71954 - DNA, 20 bp, human
gcgggccgagagacggactc

SEQ ID NO: 71955 - DNA, 20 bp, human
gtggagccgagcgggttaca

SEQ ID NO: 71956 - DNA, 20 bp, human
gaaatgcgggcgtcagagac

SEQ ID NO: 71957 - DNA, 20 bp, human
gtcccgaagcaggaaggctc

SEQ ID NO: 71958 - DNA, 20 bp, human
gcgttcagcgcgcctgggag

SEQ ID NO: 71959 - DNA, 20 bp, human
gcccgaggctgggacgccgg

SEQ ID NO: 71960 - DNA, 20 bp, human
ggcactcacccgaggatcga

SEQ ID NO: 71961 - DNA, 20 bp, human
ggccgacagccatcgatcct

SEQ ID NO: 71962 - DNA, 20 bp, human
gctccctcgggcggtcacct

SEQ ID NO: 71963 - DNA, 20 bp, human
gtgagtgcgggcgcaggtgg

SEQ ID NO: 71964 - DNA, 20 bp, human
ggccccgcgcgctcccggga

SEQ ID NO: 71965 - DNA, 20 bp, human
gtccccatcccgaagcagga

SEQ ID NO: 71966 - DNA, 20 bp, human
gaccagcacgcggacccggg

SEQ ID NO: 71967 - DNA, 20 bp, human
ggggcggcgccggagaaacg

SEQ ID NO: 71968 - DNA, 20 bp, human
ggccaccagcacgcggaccc

SEQ ID NO: 71969 - DNA, 20 bp, human
gccgcgggaggagcgaagcg

SEQ ID NO: 71970 - DNA, 20 bp, human
ggcgcccctctcggaggtca

SEQ ID NO: 71971 - DNA, 20 bp, human
gccgggtgctcaccgaggag

SEQ ID NO: 71972 - DNA, 20 bp, human
gcagccctgacctccgagag

SEQ ID NO: 71973 - DNA, 20 bp, human
gcggcgccggagaaacgggg

SEQ ID NO: 71974 - DNA, 20 bp, human
ggagagctggagctctttgt

SEQ ID NO: 71975 - DNA, 20 bp, human
ggcggcctggggcttctgag

SEQ ID NO: 71976 - DNA, 20 bp, human
ggtcgggagtgcggtctcca

SEQ ID NO: 71977 - DNA, 20 bp, human
ggcaatggccagccagaggg

SEQ ID NO: 71978 - DNA, 20 bp, human
ggagcccgagagagccgcgt

SEQ ID NO: 71979 - DNA, 20 bp, human
ggtggtgactcggggaggag

SEQ ID NO: 71980 - DNA, 20 bp, human
ggtgggtgggaaggggtcca

SEQ ID NO: 71981 - DNA, 20 bp, human
ggagagccgcgtcgggagtg

SEQ ID NO: 71982 - DNA, 20 bp, human
ggctgcgcccagcactgcca

SEQ ID NO: 71983 - DNA, 20 bp, human
gggagagatcagaggaaggt

SEQ ID NO: 71984 - DNA, 20 bp, human
gggccggcctaggggagagg

SEQ ID NO: 71985 - DNA, 20 bp, human
gggacggtggtgactcgggg

SEQ ID NO: 71986 - DNA, 20 bp, human
gcaccaccgacacccacggg

SEQ ID NO: 71987 - DNA, 20 bp, human
gcaggcatctggctcctcta

SEQ ID NO: 71988 - DNA, 20 bp, human
ggaagggacaggggtctgcg

SEQ ID NO: 71989 - DNA, 20 bp, human
ggctgctggtccgggaggaa

SEQ ID NO: 71990 - DNA, 20 bp, human
gaggcagccttgacccatag

SEQ ID NO: 71991 - DNA, 20 bp, human
gtgccaccaccgacacccac

SEQ ID NO: 71992 - DNA, 20 bp, human
gggaccagcagctagaggta

SEQ ID NO: 71993 - DNA, 20 bp, human
ggcaggtgatctccgcccgt

SEQ ID NO: 71994 - DNA, 20 bp, human
ggagccctgcccagggagac

SEQ ID NO: 71995 - DNA, 20 bp, human
gctctgcaagcccccatcag

SEQ ID NO: 71996 - DNA, 20 bp, human
gaagccagcagcctgcaatg

SEQ ID NO: 71997 - DNA, 20 bp, human
ggcagtagcaaccccattgc

SEQ ID NO: 71998 - DNA, 20 bp, human
gcagagaagcatgagctgtt

SEQ ID NO: 71999 - DNA, 20 bp, human
ggctcacagaagatagcccc

SEQ ID NO: 72000 - DNA, 20 bp, human
gcttataactgggtggatag

SEQ ID NO: 72001 - DNA, 20 bp, human
ggttgtagatcttcacaaca

SEQ ID NO: 72002 - DNA, 20 bp, human
ggtagaggaaagtcatctta

SEQ ID NO: 72003 - DNA, 20 bp, human
gcctattgtaatgtttgtag

SEQ ID NO: 72004 - DNA, 20 bp, human
gttttctatgggaatcacag

SEQ ID NO: 72005 - DNA, 20 bp, human
gactcaatcttataactggg

SEQ ID NO: 72006 - DNA, 20 bp, human
gtgggagtgggagtgtatag

SEQ ID NO: 72007 - DNA, 20 bp, human
gcagctagttggacacccca

SEQ ID NO: 72008 - DNA, 20 bp, human
ggatggacgccagaaagagg

SEQ ID NO: 72009 - DNA, 20 bp, human
ggagtgggagtgtatagtgg

SEQ ID NO: 72010 - DNA, 20 bp, human
gagcagcagaggtggtgttg

SEQ ID NO: 72011 - DNA, 20 bp, human
gtgggcagcacacagccttg

SEQ ID NO: 72012 - DNA, 20 bp, human
gagggaaagcaggcaccgga

SEQ ID NO: 72013 - DNA, 20 bp, human
ggcaggcagacgggtagcag

SEQ ID NO: 72014 - DNA, 20 bp, human
gccggaggggtgcactgggt

SEQ ID NO: 72015 - DNA, 20 bp, human
gttggcagtggcatgaagat

SEQ ID NO: 72016 - DNA, 20 bp, human
gtagccctgtgggtattcta

SEQ ID NO: 72017 - DNA, 20 bp, human
gacttgtagtaagtcagcaa

SEQ ID NO: 72018 - DNA, 20 bp, human
gtcttgtgccaggtctcata

SEQ ID NO: 72019 - DNA, 20 bp, human
gtttctctagagtaactaca

SEQ ID NO: 72020 - DNA, 20 bp, human
gtaaccatagaatacccaca

SEQ ID NO: 72021 - DNA, 20 bp, human
ggtagagactcagacagatg

SEQ ID NO: 72022 - DNA, 20 bp, human
ggggccttaaaataaacaag

SEQ ID NO: 72023 - DNA, 20 bp, human
ggggaatatattagccctgt

SEQ ID NO: 72024 - DNA, 20 bp, human
gagctctcatgatgtcccag

SEQ ID NO: 72025 - DNA, 20 bp, human
gtggtacacgtgtaattagc

SEQ ID NO: 72026 - DNA, 20 bp, human
gtgctgactgggatccagga

SEQ ID NO: 72027 - DNA, 20 bp, human
gccggaccgggcctccccga

SEQ ID NO: 72028 - DNA, 20 bp, human
ggcctcgccatgggacataa

SEQ ID NO: 72029 - DNA, 20 bp, human
gaggcacccgaaacccacgg

SEQ ID NO: 72030 - DNA, 20 bp, human
gtgcaggtcgtcatcttcat

SEQ ID NO: 72031 - DNA, 20 bp, human
gcgagcctgtaccctcgggg

SEQ ID NO: 72032 - DNA, 20 bp, human
gaagatgacgacctgcacgg

SEQ ID NO: 72033 - DNA, 20 bp, human
ggagacgtgaggggacccgt

SEQ ID NO: 72034 - DNA, 20 bp, human
gcacggtggtggtgaactgg

SEQ ID NO: 72035 - DNA, 20 bp, human
gctccgagcctgtaccctcg

SEQ ID NO: 72036 - DNA, 20 bp, human
gcggcctcggccccctctag

SEQ ID NO: 72037 - DNA, 20 bp, human
ggagctggcaccagcgtgag

SEQ ID NO: 72038 - DNA, 20 bp, human
ggaagaaggaacgccagcat

SEQ ID NO: 72039 - DNA, 20 bp, human
ggaaggaacgccagcatagg

SEQ ID NO: 72040 - DNA, 20 bp, human
ggatgcccagcagctatcac

SEQ ID NO: 72041 - DNA, 20 bp, human
ggctccccccaagcctacag

SEQ ID NO: 72042 - DNA, 20 bp, human
ggccagcataggaggcgtgg

SEQ ID NO: 72043 - DNA, 20 bp, human
ggagcgctatgaagcgcgtg

SEQ ID NO: 72044 - DNA, 20 bp, human
gagcccagcagcccccacat

SEQ ID NO: 72045 - DNA, 20 bp, human
gaaattggcggcctgggcaa

SEQ ID NO: 72046 - DNA, 20 bp, human
gtaacgcttggcgtcggagt

SEQ ID NO: 72047 - DNA, 20 bp, human
gtggcgtcggagttggtgct

SEQ ID NO: 72048 - DNA, 20 bp, human
gccagtgtaacgcttggcgt

SEQ ID NO: 72049 - DNA, 20 bp, human
ggatatcccttcgacagaag

SEQ ID NO: 72050 - DNA, 20 bp, human
gtaaacataacaaactatgt

SEQ ID NO: 72051 - DNA, 20 bp, human
gtagtttccagtgtaacgct

SEQ ID NO: 72052 - DNA, 20 bp, human
ggattatatagcctatttca

SEQ ID NO: 72053 - DNA, 20 bp, human
gggtctcactatggtgctcc

SEQ ID NO: 72054 - DNA, 20 bp, human
gaggaagtgctctctgaaat

SEQ ID NO: 72055 - DNA, 20 bp, human
gacacagacttttgatggac

SEQ ID NO: 72056 - DNA, 20 bp, human
ggcggctgcccgccccacgt

SEQ ID NO: 72057 - DNA, 20 bp, human
gtgcggaacacgatcactag

SEQ ID NO: 72058 - DNA, 20 bp, human
ggccccacgtcggcagctgg

SEQ ID NO: 72059 - DNA, 20 bp, human
gcggctgggagccgaggcgt

SEQ ID NO: 72060 - DNA, 20 bp, human
gacctggagacgggcatggg

SEQ ID NO: 72061 - DNA, 20 bp, human
gagcagctgccgcgaatggt

SEQ ID NO: 72062 - DNA, 20 bp, human
gcgaggcgtcggtgcagacc

SEQ ID NO: 72063 - DNA, 20 bp, human
gtcccccagctgccgacgtg

SEQ ID NO: 72064 - DNA, 20 bp, human
gggccaccagcagcacgtga

SEQ ID NO: 72065 - DNA, 20 bp, human
gcgcccaacgtggcagggag

SEQ ID NO: 72066 - DNA, 20 bp, human
ggctacttcccggatgagaa

SEQ ID NO: 72067 - DNA, 20 bp, human
ggagaccacctaggaatggt

SEQ ID NO: 72068 - DNA, 20 bp, human
gccggcaggtccaggctatg

SEQ ID NO: 72069 - DNA, 20 bp, human
gggcggccgtgaagccagca

SEQ ID NO: 72070 - DNA, 20 bp, human
ggttggagaccacctaggaa

SEQ ID NO: 72071 - DNA, 20 bp, human
gcacacccaccattcctagg

SEQ ID NO: 72072 - DNA, 20 bp, human
gggctgaggaatgaagtgcc

SEQ ID NO: 72073 - DNA, 20 bp, human
gtggggggcccttggctgtg

SEQ ID NO: 72074 - DNA, 20 bp, human
gtcatccctaggaaaacctg

SEQ ID NO: 72075 - DNA, 20 bp, human
gctgctgaggctctgtaggg

SEQ ID NO: 72076 - DNA, 20 bp, human
gtctcaggatagaatctcag

SEQ ID NO: 72077 - DNA, 20 bp, human
gctcaggggtagaattccta

SEQ ID NO: 72078 - DNA, 20 bp, human
gactctctctgctgactggt

SEQ ID NO: 72079 - DNA, 20 bp, human
gtacatatcagtgactcgtt

SEQ ID NO: 72080 - DNA, 20 bp, human
gtcaggataacttagtatga

SEQ ID NO: 72081 - DNA, 20 bp, human
ggttaaaacttacttcagtt

SEQ ID NO: 72082 - DNA, 20 bp, human
gctaataattcctatagcat

SEQ ID NO: 72083 - DNA, 20 bp, human
ggtttactctctctgctgac

SEQ ID NO: 72084 - DNA, 20 bp, human
gtggcatgttgttttaagag

SEQ ID NO: 72085 - DNA, 20 bp, human
gtgcagacctccttttatgg

SEQ ID NO: 72086 - DNA, 20 bp, human
ggaagcaggctgtgagccaa

SEQ ID NO: 72087 - DNA, 20 bp, human
gcacagcctgcttcctgtta

SEQ ID NO: 72088 - DNA, 20 bp, human
gagcctctaaccagcatcta

SEQ ID NO: 72089 - DNA, 20 bp, human
gccccttgaagcctggaaag

SEQ ID NO: 72090 - DNA, 20 bp, human
gtgtctccctaacaggaagc

SEQ ID NO: 72091 - DNA, 20 bp, human
gccctctttccaggcttcaa

SEQ ID NO: 72092 - DNA, 20 bp, human
gtcaggaatagcccttgcat

SEQ ID NO: 72093 - DNA, 20 bp, human
ggacaagatgacgctgtgca

SEQ ID NO: 72094 - DNA, 20 bp, human
ggagaatgccataaaccacc

SEQ ID NO: 72095 - DNA, 20 bp, human
gccggatgaaggtatgtgat

SEQ ID NO: 72096 - DNA, 20 bp, human
gcgcgacggacactccccaa

SEQ ID NO: 72097 - DNA, 20 bp, human
gcactccccaagggccaaat

SEQ ID NO: 72098 - DNA, 20 bp, human
gctttccgcctagtgagagg

SEQ ID NO: 72099 - DNA, 20 bp, human
gcggaccgcctctcactagg

SEQ ID NO: 72100 - DNA, 20 bp, human
gaatcggaccgcctctcact

SEQ ID NO: 72101 - DNA, 20 bp, human
gaaactttccgcctagtgag

SEQ ID NO: 72102 - DNA, 20 bp, human
ggcgggagagccgattaatg

SEQ ID NO: 72103 - DNA, 20 bp, human
gctagtctggcctcccaggt

SEQ ID NO: 72104 - DNA, 20 bp, human
gactgaagtagtaaaggagt

SEQ ID NO: 72105 - DNA, 20 bp, human
gatccatcagatcaacgcga

SEQ ID NO: 72106 - DNA, 20 bp, human
ggagacctgagggagaacat

SEQ ID NO: 72107 - DNA, 20 bp, human
ggcgcggtaagttcccctgt

SEQ ID NO: 72108 - DNA, 20 bp, human
gagccaagcaggagtgggaa

SEQ ID NO: 72109 - DNA, 20 bp, human
gcaagcgctggcctgacgtc

SEQ ID NO: 72110 - DNA, 20 bp, human
gaacttaccgcgcttcaccc

SEQ ID NO: 72111 - DNA, 20 bp, human
gctcaggagcctcctatcta

SEQ ID NO: 72112 - DNA, 20 bp, human
gtggcccacaggccaagcca

SEQ ID NO: 72113 - DNA, 20 bp, human
gggctggggccagcccacag

SEQ ID NO: 72114 - DNA, 20 bp, human
gcccggacctcgccttccta

SEQ ID NO: 72115 - DNA, 20 bp, human
gtaccgcgcttcacccgggc

SEQ ID NO: 72116 - DNA, 20 bp, human
gccagagtgtgtgcacgtac

SEQ ID NO: 72117 - DNA, 20 bp, human
gctgtgcagtctggaaatcg

SEQ ID NO: 72118 - DNA, 20 bp, human
ggtactgcagaactaagaca

SEQ ID NO: 72119 - DNA, 20 bp, human
gtgcagaactaagacacgga

SEQ ID NO: 72120 - DNA, 20 bp, human
gtagtggtaattgtagtgaa

SEQ ID NO: 72121 - DNA, 20 bp, human
ggaggagataaaggagtagg

SEQ ID NO: 72122 - DNA, 20 bp, human
gcagggagaagagggggctt

SEQ ID NO: 72123 - DNA, 20 bp, human
gctcccccgtctcaaatgaa

SEQ ID NO: 72124 - DNA, 20 bp, human
gttcctttcatttgagacgg

SEQ ID NO: 72125 - DNA, 20 bp, human
gttggaattcatcgtcagag

SEQ ID NO: 72126 - DNA, 20 bp, human
gttcagaggaaagcctgttc

SEQ ID NO: 72127 - DNA, 20 bp, human
ggaacggcactgcttttcag

SEQ ID NO: 72128 - DNA, 20 bp, human
gctgcaaaagctgcccgaac

SEQ ID NO: 72129 - DNA, 20 bp, human
gcttttgaaccggcatagtg

SEQ ID NO: 72130 - DNA, 20 bp, human
gagcagctgtatactataat

SEQ ID NO: 72131 - DNA, 20 bp, human
gtatacagctgcttttgaac

SEQ ID NO: 72132 - DNA, 20 bp, human
gagattcagtctttctaaaa

SEQ ID NO: 72133 - DNA, 20 bp, human
gaacatgtagtgctgcttag

SEQ ID NO: 72134 - DNA, 20 bp, human
gtcacttgttagtagaggac

SEQ ID NO: 72135 - DNA, 20 bp, human
gaatttttaccccactatgc

SEQ ID NO: 72136 - DNA, 20 bp, human
ggccagcagccacaccacaa

SEQ ID NO: 72137 - DNA, 20 bp, human
gctgcgcggagtgcagccct

SEQ ID NO: 72138 - DNA, 20 bp, human
gcagcagctctgagcaggag

SEQ ID NO: 72139 - DNA, 20 bp, human
gctgctgccgcctgcgccca

SEQ ID NO: 72140 - DNA, 20 bp, human
ggcctcgagcagcttcacca

SEQ ID NO: 72141 - DNA, 20 bp, human
gcttcaccacggccaggtag

SEQ ID NO: 72142 - DNA, 20 bp, human
ggccgtggtgaagctgctcg

SEQ ID NO: 72143 - DNA, 20 bp, human
gccaaccccgagtagtccca

SEQ ID NO: 72144 - DNA, 20 bp, human
gggatgtagacgtagccgta

SEQ ID NO: 72145 - DNA, 20 bp, human
gagtcccagggcgctgaccc

SEQ ID NO: 72146 - DNA, 20 bp, human
ggcgcgcaccatgaactcgt

SEQ ID NO: 72147 - DNA, 20 bp, human
ggcgctcagggtccgcaacc

SEQ ID NO: 72148 - DNA, 20 bp, human
ggcctggcggggctactggt

SEQ ID NO: 72149 - DNA, 20 bp, human
ggagcggagacagagctcgc

SEQ ID NO: 72150 - DNA, 20 bp, human
gcaggtgcctgcccgtgagg

SEQ ID NO: 72151 - DNA, 20 bp, human
ggagccagcgactgagcgtg

SEQ ID NO: 72152 - DNA, 20 bp, human
gaagagagcgggagggtgcg

SEQ ID NO: 72153 - DNA, 20 bp, human
ggacagagctcgcgggcatg

SEQ ID NO: 72154 - DNA, 20 bp, human
ggccgccgcccggcgaccac

SEQ ID NO: 72155 - DNA, 20 bp, human
gcccgcgccgcctcacgggc

SEQ ID NO: 72156 - DNA, 20 bp, human
gtcgagcagcaggtagtacg

SEQ ID NO: 72157 - DNA, 20 bp, human
gaccattcctgagatggcgg

SEQ ID NO: 72158 - DNA, 20 bp, human
gcgcaccattcctgagatgg

SEQ ID NO: 72159 - DNA, 20 bp, human
gcgccagcatgacggccggg

SEQ ID NO: 72160 - DNA, 20 bp, human
ggcgcgcaccattcctgaga

SEQ ID NO: 72161 - DNA, 20 bp, human
gcgaacgcgagcgagccggg

SEQ ID NO: 72162 - DNA, 20 bp, human
gcagcccgtcggccaggcac

SEQ ID NO: 72163 - DNA, 20 bp, human
gcgacctgtgcctggccgac

SEQ ID NO: 72164 - DNA, 20 bp, human
gcgccgcgccgccagcatga

SEQ ID NO: 72165 - DNA, 20 bp, human
ggcgagctccccgtcctgcg

SEQ ID NO: 72166 - DNA, 20 bp, human
ggaaggaggcatctgactca

SEQ ID NO: 72167 - DNA, 20 bp, human
ggggcaccaggggtcctgaa

SEQ ID NO: 72168 - DNA, 20 bp, human
gctactcaccgctcaggacc

SEQ ID NO: 72169 - DNA, 20 bp, human
ggcccaaaatccaggtgtcc

SEQ ID NO: 72170 - DNA, 20 bp, human
gatccaggtatccaggcagg

SEQ ID NO: 72171 - DNA, 20 bp, human
gcaggggtccgaacagcagg

SEQ ID NO: 72172 - DNA, 20 bp, human
gggcccgctactcaccgctc

SEQ ID NO: 72173 - DNA, 20 bp, human
gaagggcacgcaggatgctg

SEQ ID NO: 72174 - DNA, 20 bp, human
gagagtcaggcccaaaatcc

SEQ ID NO: 72175 - DNA, 20 bp, human
gaagccggcaggaggcgtct

SEQ ID NO: 72176 - DNA, 20 bp, human
ggaaggccatccccacgctg

SEQ ID NO: 72177 - DNA, 20 bp, human
gccgagggtggaccacacgg

SEQ ID NO: 72178 - DNA, 20 bp, human
gtaccggtccaaagccacgg

SEQ ID NO: 72179 - DNA, 20 bp, human
gtggaggctcaggtagaagg

SEQ ID NO: 72180 - DNA, 20 bp, human
gtctactctgtggcaggaaa

SEQ ID NO: 72181 - DNA, 20 bp, human
gcagctggagcaggtacagg

SEQ ID NO: 72182 - DNA, 20 bp, human
gggccgccgtggctttggac

SEQ ID NO: 72183 - DNA, 20 bp, human
gggtctgctgggcaacgcgg

SEQ ID NO: 72184 - DNA, 20 bp, human
gtgagcaggtagacagcgta

SEQ ID NO: 72185 - DNA, 20 bp, human
gtggacctcagccgcagcgt

SEQ ID NO: 72186 - DNA, 20 bp, human
gacaggataaccacagtcag

SEQ ID NO: 72187 - DNA, 20 bp, human
ggataaccacagtcagtggg

SEQ ID NO: 72188 - DNA, 20 bp, human
gaagtagctgaggaacacaa

SEQ ID NO: 72189 - DNA, 20 bp, human
gggagaccgtgcgtgccata

SEQ ID NO: 72190 - DNA, 20 bp, human
gtgtctgcgtccattgtcgt

SEQ ID NO: 72191 - DNA, 20 bp, human
gtggatgactgtcttccgta

SEQ ID NO: 72192 - DNA, 20 bp, human
ggctcgcccgctgcacagtg

SEQ ID NO: 72193 - DNA, 20 bp, human
gggctgtacgcactgctact

SEQ ID NO: 72194 - DNA, 20 bp, human
gaaccacagtcagtgggcgg

SEQ ID NO: 72195 - DNA, 20 bp, human
gctggagacaatatagtaca

SEQ ID NO: 72196 - DNA, 20 bp, human
gggaaggccacaggagcatc

SEQ ID NO: 72197 - DNA, 20 bp, human
ggctcagtgttcccaagtgg

SEQ ID NO: 72198 - DNA, 20 bp, human
gggcctgctcaagaccaatc

SEQ ID NO: 72199 - DNA, 20 bp, human
gtaatagcaagttcaagctt

SEQ ID NO: 72200 - DNA, 20 bp, human
gtaagcctagagggtcaatt

SEQ ID NO: 72201 - DNA, 20 bp, human
gtaatgtgcaataagcctag

SEQ ID NO: 72202 - DNA, 20 bp, human
ggttcctagtgagaaattga

SEQ ID NO: 72203 - DNA, 20 bp, human
ggcatgaagatacaggtctg

SEQ ID NO: 72204 - DNA, 20 bp, human
gtgatggtgtagagtcactt

SEQ ID NO: 72205 - DNA, 20 bp, human
gtaagattctctggactagt

SEQ ID NO: 72206 - DNA, 20 bp, human
gcaggttcgcctgaagtaaa

SEQ ID NO: 72207 - DNA, 20 bp, human
gagacgagtctcagtgtcta

SEQ ID NO: 72208 - DNA, 20 bp, human
gtcagctgggctcttccatc

SEQ ID NO: 72209 - DNA, 20 bp, human
gacttaaatgttatatggtc

SEQ ID NO: 72210 - DNA, 20 bp, human
gtgtgagtatttcttgattt

SEQ ID NO: 72211 - DNA, 20 bp, human
gcgtcttggttgtgtcagct

SEQ ID NO: 72212 - DNA, 20 bp, human
gaccaaacttaaatgttata

SEQ ID NO: 72213 - DNA, 20 bp, human
gaacgtgattcatggtgata

SEQ ID NO: 72214 - DNA, 20 bp, human
ggggctcttccatccggtcg

SEQ ID NO: 72215 - DNA, 20 bp, human
gcaaattttagctgaaataa

SEQ ID NO: 72216 - DNA, 20 bp, human
gccccgctgggaggccccta

SEQ ID NO: 72217 - DNA, 20 bp, human
gcacagtggctgtctgagaa

SEQ ID NO: 72218 - DNA, 20 bp, human
ggcgaggtgaggctgtgaca

SEQ ID NO: 72219 - DNA, 20 bp, human
ggtcacacactccacccggg

SEQ ID NO: 72220 - DNA, 20 bp, human
gtgggaggcccctagggcag

SEQ ID NO: 72221 - DNA, 20 bp, human
ggggttctcagagcgaggtg

SEQ ID NO: 72222 - DNA, 20 bp, human
ggtgccgcccactgccctag

SEQ ID NO: 72223 - DNA, 20 bp, human
ggtggctgtctgagaagggc

SEQ ID NO: 72224 - DNA, 20 bp, human
ggacgggggttctcagagcg

SEQ ID NO: 72225 - DNA, 20 bp, human
gggctgggggaagtgaagct

SEQ ID NO: 72226 - DNA, 20 bp, human
gggcagtatcaggaccgggt

SEQ ID NO: 72227 - DNA, 20 bp, human
gatcaggaccgggtgggaca

SEQ ID NO: 72228 - DNA, 20 bp, human
gtgggacacggctcccacca

SEQ ID NO: 72229 - DNA, 20 bp, human
gagacggcagtatcaggacc

SEQ ID NO: 72230 - DNA, 20 bp, human
gtggagctggaagtgactaa

SEQ ID NO: 72231 - DNA, 20 bp, human
gcagttggtgactccttggt

SEQ ID NO: 72232 - DNA, 20 bp, human
gcatgtgcagggcttcacgt

SEQ ID NO: 72233 - DNA, 20 bp, human
gtgactaaaggaaggaaccc

SEQ ID NO: 72234 - DNA, 20 bp, human
ggctggaagtgactaaagga

SEQ ID NO: 72235 - DNA, 20 bp, human
gaagagaagacggcagtatc

SEQ ID NO: 72236 - DNA, 20 bp, human
gccgcagagaaggaaatcgt

SEQ ID NO: 72237 - DNA, 20 bp, human
gggcactgtccaccgacgag

SEQ ID NO: 72238 - DNA, 20 bp, human
gggccaccacccccacccaa

SEQ ID NO: 72239 - DNA, 20 bp, human
gagagggcgccgctcgtcgg

SEQ ID NO: 72240 - DNA, 20 bp, human
gtggcagtgactagctcccg

SEQ ID NO: 72241 - DNA, 20 bp, human
gaagtcgctggggttaggtg

SEQ ID NO: 72242 - DNA, 20 bp, human
ggactagctcccgcggctag

SEQ ID NO: 72243 - DNA, 20 bp, human
gggacagtgccgctagccgc

SEQ ID NO: 72244 - DNA, 20 bp, human
gcaaaggcagtgaggagtgt

SEQ ID NO: 72245 - DNA, 20 bp, human
gcagcaaggtatgccctcca

SEQ ID NO: 72246 - DNA, 20 bp, human
gtgctcatccagccatgcgg

SEQ ID NO: 72247 - DNA, 20 bp, human
gtctcggtcaccggatacag

SEQ ID NO: 72248 - DNA, 20 bp, human
gaccagcgccagaagcatga

SEQ ID NO: 72249 - DNA, 20 bp, human
gtagggctggtggccaccaa

SEQ ID NO: 72250 - DNA, 20 bp, human
gtcctgctcatccagccatg

SEQ ID NO: 72251 - DNA, 20 bp, human
gggtactccgcccactcctc

SEQ ID NO: 72252 - DNA, 20 bp, human
gagcagagccgatccaagag

SEQ ID NO: 72253 - DNA, 20 bp, human
gcagtatgtgcctgaggagt

SEQ ID NO: 72254 - DNA, 20 bp, human
ggccacagccaccgcatggc

SEQ ID NO: 72255 - DNA, 20 bp, human
gtgcagggggcccaagagct

SEQ ID NO: 72256 - DNA, 20 bp, human
gtgctggagcagcccaacct

SEQ ID NO: 72257 - DNA, 20 bp, human
ggagcagcccaacctaggag

SEQ ID NO: 72258 - DNA, 20 bp, human
gcctgggcctctcctaggtt

SEQ ID NO: 72259 - DNA, 20 bp, human
ggtgcgccctcggcgaagag

SEQ ID NO: 72260 - DNA, 20 bp, human
gacctgggtgacccgaatgg

SEQ ID NO: 72261 - DNA, 20 bp, human
gtgatgctgtagaactccat

SEQ ID NO: 72262 - DNA, 20 bp, human
gagcacctgggtgacccgaa

SEQ ID NO: 72263 - DNA, 20 bp, human
gaaggaggtgacagaccaca

SEQ ID NO: 72264 - DNA, 20 bp, human
gagaggcccaggaggcgcct

SEQ ID NO: 72265 - DNA, 20 bp, human
gacatcttggtgttcctcat

SEQ ID NO: 72266 - DNA, 20 bp, human
gaggtccccggtcttgacaa

SEQ ID NO: 72267 - DNA, 20 bp, human
gaccggggacctggacgcag

SEQ ID NO: 72268 - DNA, 20 bp, human
ggaggtcccacaacagacgg

SEQ ID NO: 72269 - DNA, 20 bp, human
gtgcgcgcggcgactggacg

SEQ ID NO: 72270 - DNA, 20 bp, human
gcccccgcggggcagaacag

SEQ ID NO: 72271 - DNA, 20 bp, human
gcgcgccgttgtcaagaccg

SEQ ID NO: 72272 - DNA, 20 bp, human
ggagtcagagacatccgcag

SEQ ID NO: 72273 - DNA, 20 bp, human
ggcgcggcgactggacgggg

SEQ ID NO: 72274 - DNA, 20 bp, human
ggaaggaaagacacgtccag

SEQ ID NO: 72275 - DNA, 20 bp, human
gcccacaacagacgggggtg

SEQ ID NO: 72276 - DNA, 20 bp, human
ggtgttgaggatgcacatgt

SEQ ID NO: 72277 - DNA, 20 bp, human
gatgatgtcggagaaggcca

SEQ ID NO: 72278 - DNA, 20 bp, human
gcagagggacagcatgatgt

SEQ ID NO: 72279 - DNA, 20 bp, human
gtgagggtgacggcggtgaa

SEQ ID NO: 72280 - DNA, 20 bp, human
gccaaagggcgcgaagaaca

SEQ ID NO: 72281 - DNA, 20 bp, human
gtacgtggtcaccttggtgg

SEQ ID NO: 72282 - DNA, 20 bp, human
ggacagcatgatgtcggaga

SEQ ID NO: 72283 - DNA, 20 bp, human
gcgcacagcatgacgccaaa

SEQ ID NO: 72284 - DNA, 20 bp, human
gcagtgcgtgctgggctaca

SEQ ID NO: 72285 - DNA, 20 bp, human
gtgccagcgcacggtgatga

SEQ ID NO: 72286 - DNA, 20 bp, human
ggagctcctggtgacagaac

SEQ ID NO: 72287 - DNA, 20 bp, human
gcagagacttgcaaccccta

SEQ ID NO: 72288 - DNA, 20 bp, human
ggctctctgactctcagaga

SEQ ID NO: 72289 - DNA, 20 bp, human
ggcagggatgttcaatatga

SEQ ID NO: 72290 - DNA, 20 bp, human
gccaggcttgcggggaattt

SEQ ID NO: 72291 - DNA, 20 bp, human
gcagccaatacagccatagg

SEQ ID NO: 72292 - DNA, 20 bp, human
gagagggaggcacgctttcc

SEQ ID NO: 72293 - DNA, 20 bp, human
gtccccgaatagagaatcta

SEQ ID NO: 72294 - DNA, 20 bp, human
gtagggggtgggaaccgcta

SEQ ID NO: 72295 - DNA, 20 bp, human
gacagaatactaccaccccc

SEQ ID NO: 72296 - DNA, 20 bp, human
ggtggacacctgtggagtag

SEQ ID NO: 72297 - DNA, 20 bp, human
ggttctgaaacactcatgtg

SEQ ID NO: 72298 - DNA, 20 bp, human
gagagacttgagcactctct

SEQ ID NO: 72299 - DNA, 20 bp, human
gaatgactcgtggacacctg

SEQ ID NO: 72300 - DNA, 20 bp, human
gatccaggtggactgaatgg

SEQ ID NO: 72301 - DNA, 20 bp, human
gtgacactgtctactgaagc

SEQ ID NO: 72302 - DNA, 20 bp, human
gctggcaagtcaatgactcg

SEQ ID NO: 72303 - DNA, 20 bp, human
ggcggtgtttaacagatgct

SEQ ID NO: 72304 - DNA, 20 bp, human
ggacatccaccacactgtag

SEQ ID NO: 72305 - DNA, 20 bp, human
gcacttctccactactccac

SEQ ID NO: 72306 - DNA, 20 bp, human
gcagcctgggagccttcccg

SEQ ID NO: 72307 - DNA, 20 bp, human
gtggtccggtgcagctgaga

SEQ ID NO: 72308 - DNA, 20 bp, human
gggtcgggaaacctccccat

SEQ ID NO: 72309 - DNA, 20 bp, human
gtgagctacatgccccggga

SEQ ID NO: 72310 - DNA, 20 bp, human
gagggttgcagcatcatgtc

SEQ ID NO: 72311 - DNA, 20 bp, human
ggctgcaccggaccaccaac

SEQ ID NO: 72312 - DNA, 20 bp, human
gaggctcccaggctgcctat

SEQ ID NO: 72313 - DNA, 20 bp, human
gacctccccataggcagcct

SEQ ID NO: 72314 - DNA, 20 bp, human
gcacaagagcaaggtcaggt

SEQ ID NO: 72315 - DNA, 20 bp, human
gagaggctgttacctgttgg

SEQ ID NO: 72316 - DNA, 20 bp, human
gcgagtgagctggagagcgt

SEQ ID NO: 72317 - DNA, 20 bp, human
gctgccctgccgtaggagat

SEQ ID NO: 72318 - DNA, 20 bp, human
gcagcccatctcctacggca

SEQ ID NO: 72319 - DNA, 20 bp, human
gcagctagtgcggagaggga

SEQ ID NO: 72320 - DNA, 20 bp, human
ggcagggcagacagctagtg

SEQ ID NO: 72321 - DNA, 20 bp, human
ggcagacagctagtgcggag

SEQ ID NO: 72322 - DNA, 20 bp, human
ggcagcaggtacccaaacaa

SEQ ID NO: 72323 - DNA, 20 bp, human
ggctctccagctcactcggc

SEQ ID NO: 72324 - DNA, 20 bp, human
gtggcaggttaagcctctgg

SEQ ID NO: 72325 - DNA, 20 bp, human
gtttcaggatccacccccag

SEQ ID NO: 72326 - DNA, 20 bp, human
ggcggagccggcacagcgac

SEQ ID NO: 72327 - DNA, 20 bp, human
gggtctgggaggagagacta

SEQ ID NO: 72328 - DNA, 20 bp, human
ggagtgagagatacagttgg

SEQ ID NO: 72329 - DNA, 20 bp, human
gaggggagaaagatatccag

SEQ ID NO: 72330 - DNA, 20 bp, human
gctgggctccaggactctcc

SEQ ID NO: 72331 - DNA, 20 bp, human
gggtcgcgccgccacaaccc

SEQ ID NO: 72332 - DNA, 20 bp, human
ggagagtcccgcctgggttg

SEQ ID NO: 72333 - DNA, 20 bp, human
gtcctgggagagtcccgcct

SEQ ID NO: 72334 - DNA, 20 bp, human
gcgggtgcgtgtgcaaatac

SEQ ID NO: 72335 - DNA, 20 bp, human
ggcgccgccacaacccaggc

SEQ ID NO: 72336 - DNA, 20 bp, human
gctgagaggagctatcacat

SEQ ID NO: 72337 - DNA, 20 bp, human
gtggagaagcatcagctgag

SEQ ID NO: 72338 - DNA, 20 bp, human
gggcgtgggcaactctgctg

SEQ ID NO: 72339 - DNA, 20 bp, human
gaagctagggaagatttcca

SEQ ID NO: 72340 - DNA, 20 bp, human
gatcttccctagcttaggag

SEQ ID NO: 72341 - DNA, 20 bp, human
ggcgtgcccctcctaagcta

SEQ ID NO: 72342 - DNA, 20 bp, human
ggcaactgtgtcctgggcgt

SEQ ID NO: 72343 - DNA, 20 bp, human
gcccccattcctggcctagt

SEQ ID NO: 72344 - DNA, 20 bp, human
gcttcagcatacaggctgat

SEQ ID NO: 72345 - DNA, 20 bp, human
gctgatgggcaactgtgtcc

SEQ ID NO: 72346 - DNA, 20 bp, human
gaggcccagcggcatgatgg

SEQ ID NO: 72347 - DNA, 20 bp, human
gcccagcggcatgatggagg

SEQ ID NO: 72348 - DNA, 20 bp, human
gcatccttgcacccctccat

SEQ ID NO: 72349 - DNA, 20 bp, human
ggccagtaccatctccgaca

SEQ ID NO: 72350 - DNA, 20 bp, human
gccctgcgctgggatgtaga

SEQ ID NO: 72351 - DNA, 20 bp, human
ggcggcggagaggaagcgag

SEQ ID NO: 72352 - DNA, 20 bp, human
gccagcaactcagcccctgt

SEQ ID NO: 72353 - DNA, 20 bp, human
gaggcccatggaggggtgca

SEQ ID NO: 72354 - DNA, 20 bp, human
gggccaagcccccaagagga

SEQ ID NO: 72355 - DNA, 20 bp, human
gctgcgcgacgcgctctacc

SEQ ID NO: 72356 - DNA, 20 bp, human
ggcggcggcggcgatacagg

SEQ ID NO: 72357 - DNA, 20 bp, human
gctgaaagtgaggagcatcg

SEQ ID NO: 72358 - DNA, 20 bp, human
gagagaacaacgctgccagg

SEQ ID NO: 72359 - DNA, 20 bp, human
gcaacgctgccaggcggagg

SEQ ID NO: 72360 - DNA, 20 bp, human
gaaggcctaaccgctcagac

SEQ ID NO: 72361 - DNA, 20 bp, human
gtaaccgctcagacgggcag

SEQ ID NO: 72362 - DNA, 20 bp, human
gtcggtcggcgccacacggt

SEQ ID NO: 72363 - DNA, 20 bp, human
ggcgcccgcggaagagccca

SEQ ID NO: 72364 - DNA, 20 bp, human
gccgaaaacccaagcttctc

SEQ ID NO: 72365 - DNA, 20 bp, human
gggactggagttatttcggt

SEQ ID NO: 72366 - DNA, 20 bp, human
gccagccccgaggacgcgag

SEQ ID NO: 72367 - DNA, 20 bp, human
gcaaggggccagacccgtcc

SEQ ID NO: 72368 - DNA, 20 bp, human
ggtgctagacgccaactccc

SEQ ID NO: 72369 - DNA, 20 bp, human
ggcaccgccgcagcccgacc

SEQ ID NO: 72370 - DNA, 20 bp, human
gctgggtctcaggaccccaa

SEQ ID NO: 72371 - DNA, 20 bp, human
gaagcgctcggcgccaggac

SEQ ID NO: 72372 - DNA, 20 bp, human
gggcccgggaacatcctgaa

SEQ ID NO: 72373 - DNA, 20 bp, human
gtggccggctgtgcgagtct

SEQ ID NO: 72374 - DNA, 20 bp, human
ggagccgggctcccgggagt

SEQ ID NO: 72375 - DNA, 20 bp, human
gcggctccgcgcgcctggtc

SEQ ID NO: 72376 - DNA, 20 bp, human
gacatcaccggaagaaatat

SEQ ID NO: 72377 - DNA, 20 bp, human
gtctaaagccaggggctggt

SEQ ID NO: 72378 - DNA, 20 bp, human
gagaaaccaacactgctgag

SEQ ID NO: 72379 - DNA, 20 bp, human
gtctcttcttgacttgatgc

SEQ ID NO: 72380 - DNA, 20 bp, human
gtagctctaaagccaggggc

SEQ ID NO: 72381 - DNA, 20 bp, human
gtggaccattgtacagatga

SEQ ID NO: 72382 - DNA, 20 bp, human
gccctggctttagagctatc

SEQ ID NO: 72383 - DNA, 20 bp, human
gttaccactgctcaaagtag

SEQ ID NO: 72384 - DNA, 20 bp, human
gccatagatatagaaaaagg

SEQ ID NO: 72385 - DNA, 20 bp, human
gtacttacccatatttcttc

SEQ ID NO: 72386 - DNA, 20 bp, human
ggagtgcgtggcaagaagta

SEQ ID NO: 72387 - DNA, 20 bp, human
ggctgggatcgtggctgcaa

SEQ ID NO: 72388 - DNA, 20 bp, human
gggagggagagctgggatcg

SEQ ID NO: 72389 - DNA, 20 bp, human
gtggtctctgcaaccaggtg

SEQ ID NO: 72390 - DNA, 20 bp, human
gcgtggctgcaagggtgccc

SEQ ID NO: 72391 - DNA, 20 bp, human
ggctgcgggaagtcgctgga

SEQ ID NO: 72392 - DNA, 20 bp, human
ggcccagagaggctaatgca

SEQ ID NO: 72393 - DNA, 20 bp, human
gtcaggctgcgggaagtcgc

SEQ ID NO: 72394 - DNA, 20 bp, human
gcgggttgtgacccattcat

SEQ ID NO: 72395 - DNA, 20 bp, human
gcagtgtggtctctgcaacc

SEQ ID NO: 72396 - DNA, 20 bp, human
ggaagggtgaggtgacggta

SEQ ID NO: 72397 - DNA, 20 bp, human
gcggcaagacgcgggcgcag

SEQ ID NO: 72398 - DNA, 20 bp, human
gagtcctgcatcatccagag

SEQ ID NO: 72399 - DNA, 20 bp, human
gaatgccgcagaggggtggt

SEQ ID NO: 72400 - DNA, 20 bp, human
gccgcggctcccgggatgcg

SEQ ID NO: 72401 - DNA, 20 bp, human
gctcccgggatgcgcggagg

SEQ ID NO: 72402 - DNA, 20 bp, human
ggggagccgcggcaagacgc

SEQ ID NO: 72403 - DNA, 20 bp, human
gaaagaatgccgcagagggg

SEQ ID NO: 72404 - DNA, 20 bp, human
gccacggccgagcagagcct

SEQ ID NO: 72405 - DNA, 20 bp, human
ggcaaaagaatgccgcagag

SEQ ID NO: 72406 - DNA, 20 bp, human
gcggtggggatcgaaagcgg

SEQ ID NO: 72407 - DNA, 20 bp, human
gcggctgcagcatcgcggtg

SEQ ID NO: 72408 - DNA, 20 bp, human
gtcgcggtggggatcgaaag

SEQ ID NO: 72409 - DNA, 20 bp, human
gggtcggtgagtctcggagg

SEQ ID NO: 72410 - DNA, 20 bp, human
gggacgcagctctggagacg

SEQ ID NO: 72411 - DNA, 20 bp, human
gacccacacggagtgatagc

SEQ ID NO: 72412 - DNA, 20 bp, human
ggcaggtcggtgagtctcgg

SEQ ID NO: 72413 - DNA, 20 bp, human
gagacgcgcaggcgacgtcc

SEQ ID NO: 72414 - DNA, 20 bp, human
gcactggagagcagcgggaa

SEQ ID NO: 72415 - DNA, 20 bp, human
gacagcttctgactaacgca

SEQ ID NO: 72416 - DNA, 20 bp, human
ggcaggggcgcggggcgtag

SEQ ID NO: 72417 - DNA, 20 bp, human
gacgccacgaggagagaaga

SEQ ID NO: 72418 - DNA, 20 bp, human
gagcagcgcgaggaaagcgg

SEQ ID NO: 72419 - DNA, 20 bp, human
gaggctgaagcgaggcgcag

SEQ ID NO: 72420 - DNA, 20 bp, human
gcctcgtggcgtggcaggat

SEQ ID NO: 72421 - DNA, 20 bp, human
ggaaggaaagatacagtgtt

SEQ ID NO: 72422 - DNA, 20 bp, human
ggcgcggggcgtaggggcga

SEQ ID NO: 72423 - DNA, 20 bp, human
ggcgctgctatccaacgcac

SEQ ID NO: 72424 - DNA, 20 bp, human
gcacggccagtaccatcacc

SEQ ID NO: 72425 - DNA, 20 bp, human
gagcgccatgggccccggcg

SEQ ID NO: 72426 - DNA, 20 bp, human
gtcacactgactaaagatat

SEQ ID NO: 72427 - DNA, 20 bp, human
gtgcatgacaccaactacag

SEQ ID NO: 72428 - DNA, 20 bp, human
gtgacaccaactacagtggg

SEQ ID NO: 72429 - DNA, 20 bp, human
gtggcataaactactcatac

SEQ ID NO: 72430 - DNA, 20 bp, human
gagatagacattctcctgag

SEQ ID NO: 72431 - DNA, 20 bp, human
gtgaacaatataaccttagt

SEQ ID NO: 72432 - DNA, 20 bp, human
gctaagtctatattcccctc

SEQ ID NO: 72433 - DNA, 20 bp, human
gataactattttccagaatt

SEQ ID NO: 72434 - DNA, 20 bp, human
gcttttcctcccactgtagt

SEQ ID NO: 72435 - DNA, 20 bp, human
gtagacttagagacattttc

SEQ ID NO: 72436 - DNA, 20 bp, human
gaggccgtcccgaggagcca

SEQ ID NO: 72437 - DNA, 20 bp, human
ggagctggcgtgccgaccgc

SEQ ID NO: 72438 - DNA, 20 bp, human
gcccgccaccagcccgcggt

SEQ ID NO: 72439 - DNA, 20 bp, human
gagcatacaaggccgtcccg

SEQ ID NO: 72440 - DNA, 20 bp, human
ggctgagtcccagaacccca

SEQ ID NO: 72441 - DNA, 20 bp, human
gcgctccctagcagcctggt

SEQ ID NO: 72442 - DNA, 20 bp, human
ggagccaccgagccccacga

SEQ ID NO: 72443 - DNA, 20 bp, human
ggcggggcgcacagcataca

SEQ ID NO: 72444 - DNA, 20 bp, human
gggtggctcgcaccaagggg

SEQ ID NO: 72445 - DNA, 20 bp, human
gtcgtcggcccggccctcgt

SEQ ID NO: 72446 - DNA, 20 bp, human
ggatccctaactctctcctt

SEQ ID NO: 72447 - DNA, 20 bp, human
gtcctttctggtggacagtt

SEQ ID NO: 72448 - DNA, 20 bp, human
gaaagagcagtcctttctgg

SEQ ID NO: 72449 - DNA, 20 bp, human
gggcctgggaatggttcagg

SEQ ID NO: 72450 - DNA, 20 bp, human
gggacagttaggcttcaagc

SEQ ID NO: 72451 - DNA, 20 bp, human
gtcaggaggatactgaatta

SEQ ID NO: 72452 - DNA, 20 bp, human
gagaacctaaggagagagtt

SEQ ID NO: 72453 - DNA, 20 bp, human
gcacgatgctgaatagagag

SEQ ID NO: 72454 - DNA, 20 bp, human
gatcctcctgaaccattccc

SEQ ID NO: 72455 - DNA, 20 bp, human
gtagagagaggggactcctg

SEQ ID NO: 72456 - DNA, 20 bp, human
gatgctcagtcaaggcacta

SEQ ID NO: 72457 - DNA, 20 bp, human
gcagctctggagtcaggtag

SEQ ID NO: 72458 - DNA, 20 bp, human
ggtgccttgactgagcatcc

SEQ ID NO: 72459 - DNA, 20 bp, human
ggttcctgctggttccacag

SEQ ID NO: 72460 - DNA, 20 bp, human
ggtctcccccagtaacgcag

SEQ ID NO: 72461 - DNA, 20 bp, human
gagacggtgccgctgcgaca

SEQ ID NO: 72462 - DNA, 20 bp, human
gaggacgcggctggagctca

SEQ ID NO: 72463 - DNA, 20 bp, human
ggcgtcctcccctgtcgcag

SEQ ID NO: 72464 - DNA, 20 bp, human
ggggagggggcgggcgtcac

SEQ ID NO: 72465 - DNA, 20 bp, human
gtccccgcatttgtagtggg

SEQ ID NO: 72466 - DNA, 20 bp, human
gtctcctgccaggcgactac

SEQ ID NO: 72467 - DNA, 20 bp, human
gctcccctaccagacaaggt

SEQ ID NO: 72468 - DNA, 20 bp, human
gcaaaggacaatctctaaag

SEQ ID NO: 72469 - DNA, 20 bp, human
gagttgttccagtagtcgcc

SEQ ID NO: 72470 - DNA, 20 bp, human
gatgactcataactaagagt

SEQ ID NO: 72471 - DNA, 20 bp, human
gacatctcccctaccagaca

SEQ ID NO: 72472 - DNA, 20 bp, human
gagacaccgtatgaggtgaa

SEQ ID NO: 72473 - DNA, 20 bp, human
gggaaacagttgaagcttca

SEQ ID NO: 72474 - DNA, 20 bp, human
gtaagctttgaaactaaggt

SEQ ID NO: 72475 - DNA, 20 bp, human
ggctgtccattcacctcata

SEQ ID NO: 72476 - DNA, 20 bp, human
ggcaggagagagcttcgagt

SEQ ID NO: 72477 - DNA, 20 bp, human
gcagctggggaaaatcccat

SEQ ID NO: 72478 - DNA, 20 bp, human
gcagcagcagcaagaatgct

SEQ ID NO: 72479 - DNA, 20 bp, human
ggcaccctgtgctcagaagc

SEQ ID NO: 72480 - DNA, 20 bp, human
ggagatatgttgccagctgg

SEQ ID NO: 72481 - DNA, 20 bp, human
gctgcccaggaccatgtgtg

SEQ ID NO: 72482 - DNA, 20 bp, human
gtaggtattgctctgtccta

SEQ ID NO: 72483 - DNA, 20 bp, human
gagaagcgggcacttgctcc

SEQ ID NO: 72484 - DNA, 20 bp, human
gcaggtatcggggaagccct

SEQ ID NO: 72485 - DNA, 20 bp, human
ggcaggaactagcagctgca

SEQ ID NO: 72486 - DNA, 20 bp, human
ggcaaatcgcacaccctctc

SEQ ID NO: 72487 - DNA, 20 bp, human
gagggcgattcggtaaaggg

SEQ ID NO: 72488 - DNA, 20 bp, human
gtcactctggcacccagaga

SEQ ID NO: 72489 - DNA, 20 bp, human
gggagagggcgattcggtaa

SEQ ID NO: 72490 - DNA, 20 bp, human
gctccacttcccactccccg

SEQ ID NO: 72491 - DNA, 20 bp, human
gcatgatgctggagtcgatg

SEQ ID NO: 72492 - DNA, 20 bp, human
gtgctgtggcctcggggagt

SEQ ID NO: 72493 - DNA, 20 bp, human
ggacgctgattggctgactg

SEQ ID NO: 72494 - DNA, 20 bp, human
gggccacaggccccctcaca

SEQ ID NO: 72495 - DNA, 20 bp, human
gagtcccggctgcagcacct

SEQ ID NO: 72496 - DNA, 20 bp, human
ggtctcgctcctctcttacg

SEQ ID NO: 72497 - DNA, 20 bp, human
gctccacttcccactcccgg

SEQ ID NO: 72498 - DNA, 20 bp, human
ggtgctgtggcctccgggag

SEQ ID NO: 72499 - DNA, 20 bp, human
gagggcgattcggtgaaggg

SEQ ID NO: 72500 - DNA, 20 bp, human
ggagagggcgattcggtgaa

SEQ ID NO: 72501 - DNA, 20 bp, human
gcatgatgctggagtcgatc

SEQ ID NO: 72502 - DNA, 20 bp, human
ggaaggcagaccgtgtgagg

SEQ ID NO: 72503 - DNA, 20 bp, human
gcggaggccacagcacgctg

SEQ ID NO: 72504 - DNA, 20 bp, human
gggccacaggccccctcaca

SEQ ID NO: 72505 - DNA, 20 bp, human
gggagaaggcagaccgtgtg

SEQ ID NO: 72506 - DNA, 20 bp, human
gccctgggcgtcgccatcct

SEQ ID NO: 72507 - DNA, 20 bp, human
gaggcctggctctgagacag

SEQ ID NO: 72508 - DNA, 20 bp, human
gcacagtgccctggagatag

SEQ ID NO: 72509 - DNA, 20 bp, human
gggactgacccaaagggaca

SEQ ID NO: 72510 - DNA, 20 bp, human
gacctgaggtcgggagcagg

SEQ ID NO: 72511 - DNA, 20 bp, human
gctcctggcgtgggcaaggc

SEQ ID NO: 72512 - DNA, 20 bp, human
gggacgggattcagacactc

SEQ ID NO: 72513 - DNA, 20 bp, human
gcggccacggggggtatcgg

SEQ ID NO: 72514 - DNA, 20 bp, human
gctccctgactccccaacct

SEQ ID NO: 72515 - DNA, 20 bp, human
gagcccaggttggggagtca

SEQ ID NO: 72516 - DNA, 20 bp, human
ggagtacggacgggagtcag

SEQ ID NO: 72517 - DNA, 20 bp, human
ggcgggcaaggagtacggac

SEQ ID NO: 72518 - DNA, 20 bp, human
ggcagcgcgggcaaggagta

SEQ ID NO: 72519 - DNA, 20 bp, human
gggagtcagaggcagagcga

SEQ ID NO: 72520 - DNA, 20 bp, human
gcctcctcctgatcctgtag

SEQ ID NO: 72521 - DNA, 20 bp, human
gatgctgaggcgctcccctg

SEQ ID NO: 72522 - DNA, 20 bp, human
gtagtaagaatcagcagcgc

SEQ ID NO: 72523 - DNA, 20 bp, human
gctaccactacaggatcagg

SEQ ID NO: 72524 - DNA, 20 bp, human
gtagggttccggtttcaaac

SEQ ID NO: 72525 - DNA, 20 bp, human
ggacatccgcgcgctcccgg

SEQ ID NO: 72526 - DNA, 20 bp, human
gtcccgggcgccccccaaca

SEQ ID NO: 72527 - DNA, 20 bp, human
gtaccgagagacggctgtgg

SEQ ID NO: 72528 - DNA, 20 bp, human
gccccatagccagggatctc

SEQ ID NO: 72529 - DNA, 20 bp, human
gggagccgggcgctagagag

SEQ ID NO: 72530 - DNA, 20 bp, human
ggcccgcgcgcagccctcga

SEQ ID NO: 72531 - DNA, 20 bp, human
gtcggtaccgaaaccgtcga

SEQ ID NO: 72532 - DNA, 20 bp, human
gggatcgctgggaaagcggt

SEQ ID NO: 72533 - DNA, 20 bp, human
gtctagcgcccggctccgaa

SEQ ID NO: 72534 - DNA, 20 bp, human
gcggtaccgagagacggctg

SEQ ID NO: 72535 - DNA, 20 bp, human
gcggtttcggtaccgagaga

SEQ ID NO: 72536 - DNA, 20 bp, human
gcggatcgcggggaaagcag

SEQ ID NO: 72537 - DNA, 20 bp, human
gttcccgggcgcccccacag

SEQ ID NO: 72538 - DNA, 20 bp, human
ggtggctccaagtgagccag

SEQ ID NO: 72539 - DNA, 20 bp, human
gggagccaggcgcttgagag

SEQ ID NO: 72540 - DNA, 20 bp, human
gtctgcaccaaagtaggcag

SEQ ID NO: 72541 - DNA, 20 bp, human
ggcccgggaaggccgttggg

SEQ ID NO: 72542 - DNA, 20 bp, human
ggccccccaacggccttccc

SEQ ID NO: 72543 - DNA, 20 bp, human
gagctctcctctggctcact

SEQ ID NO: 72544 - DNA, 20 bp, human
gtcaagcgcctggctccgac

SEQ ID NO: 72545 - DNA, 20 bp, human
ggcggagcgggagccgctgt

SEQ ID NO: 72546 - DNA, 20 bp, human
gagagggagaaagatctcag

SEQ ID NO: 72547 - DNA, 20 bp, human
gtaccctagtgccaaggcgt

SEQ ID NO: 72548 - DNA, 20 bp, human
gaaggtctcccccagcactg

SEQ ID NO: 72549 - DNA, 20 bp, human
ggcgagctcctcagtgctgg

SEQ ID NO: 72550 - DNA, 20 bp, human
gaagatctcagaggacccga

SEQ ID NO: 72551 - DNA, 20 bp, human
gagggcgggatagctgtcca

SEQ ID NO: 72552 - DNA, 20 bp, human
ggagagcaaagagataatca

SEQ ID NO: 72553 - DNA, 20 bp, human
gggaagcagcaccaagttca

SEQ ID NO: 72554 - DNA, 20 bp, human
gactgctcagagtgcgaggg

SEQ ID NO: 72555 - DNA, 20 bp, human
gccgaaggtactgggagtgg

SEQ ID NO: 72556 - DNA, 20 bp, human
gaacaggaacacccagccat

SEQ ID NO: 72557 - DNA, 20 bp, human
ggctccgccttggctgccaa

SEQ ID NO: 72558 - DNA, 20 bp, human
gttgtgagcagccaaaactc

SEQ ID NO: 72559 - DNA, 20 bp, human
gacccagccattggcagcca

SEQ ID NO: 72560 - DNA, 20 bp, human
ggtacagatgcagcctggct

SEQ ID NO: 72561 - DNA, 20 bp, human
gctcaagaggaaatcactca

SEQ ID NO: 72562 - DNA, 20 bp, human
gcctcaacaggataatccat

SEQ ID NO: 72563 - DNA, 20 bp, human
gatcccttgtagaaaggtgg

SEQ ID NO: 72564 - DNA, 20 bp, human
gcccacctgcggtcaaagtc

SEQ ID NO: 72565 - DNA, 20 bp, human
gagaacacgaagctggcctc

SEQ ID NO: 72566 - DNA, 20 bp, human
gggcccgagtcacatctctg

SEQ ID NO: 72567 - DNA, 20 bp, human
ggcagtgaagctggacccgc

SEQ ID NO: 72568 - DNA, 20 bp, human
gtgaagctggacccgcaggc

SEQ ID NO: 72569 - DNA, 20 bp, human
gctccacgcacgcccgcctg

SEQ ID NO: 72570 - DNA, 20 bp, human
gagcagagccgtagaggggt

SEQ ID NO: 72571 - DNA, 20 bp, human
ggggagactgtgcccggacc

SEQ ID NO: 72572 - DNA, 20 bp, human
gagatccaagtctcccagga

SEQ ID NO: 72573 - DNA, 20 bp, human
gatctgggcgaggggaacca

SEQ ID NO: 72574 - DNA, 20 bp, human
gatgacgagtcactaggaca

SEQ ID NO: 72575 - DNA, 20 bp, human
ggcgggcgtgcgtggagcgg

SEQ ID NO: 72576 - DNA, 20 bp, human
gccagccggaaagtacgagt

SEQ ID NO: 72577 - DNA, 20 bp, human
gtcagcctggaggtgagtcg

SEQ ID NO: 72578 - DNA, 20 bp, human
gaaggcagcagcccttacct

SEQ ID NO: 72579 - DNA, 20 bp, human
gtccgccgcccggaagagtc

SEQ ID NO: 72580 - DNA, 20 bp, human
gccgacccgactcttccggg

SEQ ID NO: 72581 - DNA, 20 bp, human
gtctgcgctccgggacacgt

SEQ ID NO: 72582 - DNA, 20 bp, human
gcggaagagtcgggtcggga

SEQ ID NO: 72583 - DNA, 20 bp, human
gctcgcgcgggcctgtcccc

SEQ ID NO: 72584 - DNA, 20 bp, human
ggccaggacgaaggtgacaa

SEQ ID NO: 72585 - DNA, 20 bp, human
gggagagcgcgctccgagtt

SEQ ID NO: 72586 - DNA, 20 bp, human
gtccagagtggacacggaga

SEQ ID NO: 72587 - DNA, 20 bp, human
gacagcctaagcttccagag

SEQ ID NO: 72588 - DNA, 20 bp, human
ggacaggcagataaattact

SEQ ID NO: 72589 - DNA, 20 bp, human
gtgcactgcttgaaggagac

SEQ ID NO: 72590 - DNA, 20 bp, human
gtatatcagactccagaaca

SEQ ID NO: 72591 - DNA, 20 bp, human
gggacacggagaaggtaagt

SEQ ID NO: 72592 - DNA, 20 bp, human
gaccttctccgtgtccactc

SEQ ID NO: 72593 - DNA, 20 bp, human
gaaggtaagttggaattggg

SEQ ID NO: 72594 - DNA, 20 bp, human
gtatccccagaccagatggc

SEQ ID NO: 72595 - DNA, 20 bp, human
gtggtctggggataactgaa

SEQ ID NO: 72596 - DNA, 20 bp, human
ggcagccacaaagtcatcag

SEQ ID NO: 72597 - DNA, 20 bp, human
gcgtctgggagagtcttctg

SEQ ID NO: 72598 - DNA, 20 bp, human
gaaacaacctccaagtgcag

SEQ ID NO: 72599 - DNA, 20 bp, human
gatgatatgtcccggagaag

SEQ ID NO: 72600 - DNA, 20 bp, human
gcccagacgaccacaaatcc

SEQ ID NO: 72601 - DNA, 20 bp, human
ggttgtttcattatacatag

SEQ ID NO: 72602 - DNA, 20 bp, human
gggtgaaataggaatcttgc

SEQ ID NO: 72603 - DNA, 20 bp, human
gctccgggacatatcataat

SEQ ID NO: 72604 - DNA, 20 bp, human
gcgggacatatcataattgg

SEQ ID NO: 72605 - DNA, 20 bp, human
gtactcacccaacacactcc

SEQ ID NO: 72606 - DNA, 20 bp, human
ggaggacgccctccccccag

SEQ ID NO: 72607 - DNA, 20 bp, human
ggccctgggccgaacatcag

SEQ ID NO: 72608 - DNA, 20 bp, human
ggccgaacaaagccagcggg

SEQ ID NO: 72609 - DNA, 20 bp, human
gtcctgggcgagatgcgctc

SEQ ID NO: 72610 - DNA, 20 bp, human
ggcgggaggacccgcagact

SEQ ID NO: 72611 - DNA, 20 bp, human
gcttcgaggaccctggacag

SEQ ID NO: 72612 - DNA, 20 bp, human
gcgcccgcccggaaagacag

SEQ ID NO: 72613 - DNA, 20 bp, human
gggtgcttcccgccactggg

SEQ ID NO: 72614 - DNA, 20 bp, human
ggaacaaagccagcgggcgg

SEQ ID NO: 72615 - DNA, 20 bp, human
ggccgggcccctctgatgtt

SEQ ID NO: 72616 - DNA, 20 bp, human
gcagcgactgcaggcaaatg

SEQ ID NO: 72617 - DNA, 20 bp, human
ggacaggacaggacaatgag

SEQ ID NO: 72618 - DNA, 20 bp, human
gccgcggcacctggcacctg

SEQ ID NO: 72619 - DNA, 20 bp, human
gtaggcggcgcagtaggctg

SEQ ID NO: 72620 - DNA, 20 bp, human
gcggcgggcgagagggtgag

SEQ ID NO: 72621 - DNA, 20 bp, human
gggcgcagtaggctgaggga

SEQ ID NO: 72622 - DNA, 20 bp, human
ggtgggccggggtaatgatg

SEQ ID NO: 72623 - DNA, 20 bp, human
ggcggccccggcgggcgaga

SEQ ID NO: 72624 - DNA, 20 bp, human
gcagaccttctcaggagcaa

SEQ ID NO: 72625 - DNA, 20 bp, human
gagtgcgatgcggccaccgg

SEQ ID NO: 72626 - DNA, 20 bp, human
ggaagacgcctgctgatcgt

SEQ ID NO: 72627 - DNA, 20 bp, human
gccatcctgcgctctaggag

SEQ ID NO: 72628 - DNA, 20 bp, human
gtgggcagcgctggacagat

SEQ ID NO: 72629 - DNA, 20 bp, human
gcctggtggtgtgctctgta

SEQ ID NO: 72630 - DNA, 20 bp, human
ggcctgagcatccgagagag

SEQ ID NO: 72631 - DNA, 20 bp, human
ggcctgacggatgaacagtc

SEQ ID NO: 72632 - DNA, 20 bp, human
gcggagctcgctccgggacc

SEQ ID NO: 72633 - DNA, 20 bp, human
gcccgccggagccatcggtg

SEQ ID NO: 72634 - DNA, 20 bp, human
gctccgggaccgggctgaga

SEQ ID NO: 72635 - DNA, 20 bp, human
ggccaggcggaggtgcgcag

SEQ ID NO: 72636 - DNA, 20 bp, human
gggctgcgcgctgcgatcgg

SEQ ID NO: 72637 - DNA, 20 bp, human
gtggacggcacgccgcggcg

SEQ ID NO: 72638 - DNA, 20 bp, human
gtaaacacctgaaccggcag

SEQ ID NO: 72639 - DNA, 20 bp, human
gtcgctgccccggaagtgga

SEQ ID NO: 72640 - DNA, 20 bp, human
gggaagtggacggcacgccg

SEQ ID NO: 72641 - DNA, 20 bp, human
gtcgcagcgcgcagccacgg

SEQ ID NO: 72642 - DNA, 20 bp, human
ggccagccagctctgtgtca

SEQ ID NO: 72643 - DNA, 20 bp, human
gcctgcgccaggagtcggtc

SEQ ID NO: 72644 - DNA, 20 bp, human
gacggcacgccgcggcgggg

SEQ ID NO: 72645 - DNA, 20 bp, human
ggccagctctgtgtcagggt

SEQ ID NO: 72646 - DNA, 20 bp, human
ggaagggcagtcgtccgcgc

SEQ ID NO: 72647 - DNA, 20 bp, human
gcagagaaggcgggtaggaa

SEQ ID NO: 72648 - DNA, 20 bp, human
gaagcgcagagaaggcgggt

SEQ ID NO: 72649 - DNA, 20 bp, human
gggggacgcacggcccagaa

SEQ ID NO: 72650 - DNA, 20 bp, human
ggcaggccccgtctgaggtc

SEQ ID NO: 72651 - DNA, 20 bp, human
gccatcgcggcaatagggaa

SEQ ID NO: 72652 - DNA, 20 bp, human
ggccgtgcgtccccctgcta

SEQ ID NO: 72653 - DNA, 20 bp, human
gtgagccggggccatagcag

SEQ ID NO: 72654 - DNA, 20 bp, human
gagcgggagcgcaagcggca

SEQ ID NO: 72655 - DNA, 20 bp, human
ggccatagcagggggacgca

SEQ ID NO: 72656 - DNA, 20 bp, human
ggacggacaggcggacagca

SEQ ID NO: 72657 - DNA, 20 bp, human
gcgaggcgcggacggacagg

SEQ ID NO: 72658 - DNA, 20 bp, human
gaggctgcagttgggaacaa

SEQ ID NO: 72659 - DNA, 20 bp, human
gcacctggcaggggcaccgt

SEQ ID NO: 72660 - DNA, 20 bp, human
gaggcgcctctactccaggt

SEQ ID NO: 72661 - DNA, 20 bp, human
gcgggcgaacgaggcgcgga

SEQ ID NO: 72662 - DNA, 20 bp, human
gcgccaggcgcctctactcc

SEQ ID NO: 72663 - DNA, 20 bp, human
gcttcctcggcgcctccccg

SEQ ID NO: 72664 - DNA, 20 bp, human
gaggacgggcgaacgaggcg

SEQ ID NO: 72665 - DNA, 20 bp, human
gaccccacggtgcccctgcc

SEQ ID NO: 72666 - DNA, 20 bp, human
ggagcggcgggacccctagg

SEQ ID NO: 72667 - DNA, 20 bp, human
ggacgctccgggaaagcgag

SEQ ID NO: 72668 - DNA, 20 bp, human
gcggcgggacccctaggtgg

SEQ ID NO: 72669 - DNA, 20 bp, human
gcgcccccggcaggtcacgt

SEQ ID NO: 72670 - DNA, 20 bp, human
ggcgtccctccgccacctag

SEQ ID NO: 72671 - DNA, 20 bp, human
ggcggagcggcgggacccct

SEQ ID NO: 72672 - DNA, 20 bp, human
gtggtcacggcccctcccca

SEQ ID NO: 72673 - DNA, 20 bp, human
ggtacgcggtgaaggtgcag

SEQ ID NO: 72674 - DNA, 20 bp, human
gaggagggcggtgttgagac

SEQ ID NO: 72675 - DNA, 20 bp, human
gggtgttgagaccggcggag

SEQ ID NO: 72676 - DNA, 20 bp, human
gagggaggtgagaggacctg

SEQ ID NO: 72677 - DNA, 20 bp, human
gtggcatcagggcccccctc

SEQ ID NO: 72678 - DNA, 20 bp, human
ggatcgccaaggccgagtgg

SEQ ID NO: 72679 - DNA, 20 bp, human
gagcttcctgctcagtaccc

SEQ ID NO: 72680 - DNA, 20 bp, human
gtcctggtcagcccccccac

SEQ ID NO: 72681 - DNA, 20 bp, human
ggcagatcgccaaggccgag

SEQ ID NO: 72682 - DNA, 20 bp, human
gggatgcctgggtactgagc

SEQ ID NO: 72683 - DNA, 20 bp, human
gttgggtgggaagagaatgg

SEQ ID NO: 72684 - DNA, 20 bp, human
ggtccattctagtcaagcag

SEQ ID NO: 72685 - DNA, 20 bp, human
gctgtgtggcgggtccctgg

SEQ ID NO: 72686 - DNA, 20 bp, human
gccgtagcagagggaactcc

SEQ ID NO: 72687 - DNA, 20 bp, human
gaggccagctgcggtgaaga

SEQ ID NO: 72688 - DNA, 20 bp, human
gccactggcacatgggacaa

SEQ ID NO: 72689 - DNA, 20 bp, human
gagggctgaggggttaggta

SEQ ID NO: 72690 - DNA, 20 bp, human
gctcccagtgaggccagctg

SEQ ID NO: 72691 - DNA, 20 bp, human
ggagggggcagccgtagcag

SEQ ID NO: 72692 - DNA, 20 bp, human
gggcttagtgggccagggct

SEQ ID NO: 72693 - DNA, 20 bp, human
gtcaccgcagctggcctcac

SEQ ID NO: 72694 - DNA, 20 bp, human
ggaatggcgacagctgggtc

SEQ ID NO: 72695 - DNA, 20 bp, human
gcagctgggtctggcttagt

SEQ ID NO: 72696 - DNA, 20 bp, human
gcagctggtgcctggtgaaa

SEQ ID NO: 72697 - DNA, 20 bp, human
ggcgcacggggaggctgttg

SEQ ID NO: 72698 - DNA, 20 bp, human
gagcggaacagagacgtgca

SEQ ID NO: 72699 - DNA, 20 bp, human
gtcccagccagcaggatcag

SEQ ID NO: 72700 - DNA, 20 bp, human
gagcctcgggtgtgtcccaa

SEQ ID NO: 72701 - DNA, 20 bp, human
gggctgtccagggctcccga

SEQ ID NO: 72702 - DNA, 20 bp, human
ggaggggcaggcctgcgcac

SEQ ID NO: 72703 - DNA, 20 bp, human
ggtcagagccccacctccac

SEQ ID NO: 72704 - DNA, 20 bp, human
ggctggcccaccccagcgtc

SEQ ID NO: 72705 - DNA, 20 bp, human
gaagggcatgacagcagcca

SEQ ID NO: 72706 - DNA, 20 bp, human
gtgcggcgagggcctaccag

SEQ ID NO: 72707 - DNA, 20 bp, human
gggtgggtgtgcgagcgcag

SEQ ID NO: 72708 - DNA, 20 bp, human
gcgcttgcggagagaaaccc

SEQ ID NO: 72709 - DNA, 20 bp, human
gaagcgcgcgatgcagcggg

SEQ ID NO: 72710 - DNA, 20 bp, human
gcgtgcctgtcgcccctggt

SEQ ID NO: 72711 - DNA, 20 bp, human
gccgcaagcgcgcgatgcag

SEQ ID NO: 72712 - DNA, 20 bp, human
ggatcgagctcgagctgcag

SEQ ID NO: 72713 - DNA, 20 bp, human
gcaccagtaagtgaacgggc

SEQ ID NO: 72714 - DNA, 20 bp, human
ggaggcctcggcggtgctca

SEQ ID NO: 72715 - DNA, 20 bp, human
gatgaacccgcaggtgaagg

SEQ ID NO: 72716 - DNA, 20 bp, human
gccgccggccagttaaaagg

SEQ ID NO: 72717 - DNA, 20 bp, human
ggccccgaacaagcactgta

SEQ ID NO: 72718 - DNA, 20 bp, human
ggaacaagcactgtaagggg

SEQ ID NO: 72719 - DNA, 20 bp, human
gccgccgccggccagttaaa

SEQ ID NO: 72720 - DNA, 20 bp, human
gtctccgcgcatggagccga

SEQ ID NO: 72721 - DNA, 20 bp, human
ggcagctacgagcaacagaa

SEQ ID NO: 72722 - DNA, 20 bp, human
ggctccatgcgcggagagtc

SEQ ID NO: 72723 - DNA, 20 bp, human
gcctccatgcgcaatcccaa

SEQ ID NO: 72724 - DNA, 20 bp, human
gggacgtgcagtagtggctg

SEQ ID NO: 72725 - DNA, 20 bp, human
ggcgccggcggtgtgctggt

SEQ ID NO: 72726 - DNA, 20 bp, human
gctcactctgcgcttcacca

SEQ ID NO: 72727 - DNA, 20 bp, human
ggacctggaaccagccctca

SEQ ID NO: 72728 - DNA, 20 bp, human
gctctaataggctcataagt

SEQ ID NO: 72729 - DNA, 20 bp, human
ggtggagagaaacacagacc

SEQ ID NO: 72730 - DNA, 20 bp, human
gcatgtgacataccaagaga

SEQ ID NO: 72731 - DNA, 20 bp, human
gcagagtgagccccgcagag

SEQ ID NO: 72732 - DNA, 20 bp, human
ggtagctcaggtgggataaa

SEQ ID NO: 72733 - DNA, 20 bp, human
gttgagctgggtgaagtccc

SEQ ID NO: 72734 - DNA, 20 bp, human
gagctgggtgaagtcccggg

SEQ ID NO: 72735 - DNA, 20 bp, human
gcaaggaccaccaggcgcct

SEQ ID NO: 72736 - DNA, 20 bp, human
gagcaaggcgaccctcgagg

SEQ ID NO: 72737 - DNA, 20 bp, human
gaggcgggcagaatgactaa

SEQ ID NO: 72738 - DNA, 20 bp, human
gtgcagcagccgggccatgg

SEQ ID NO: 72739 - DNA, 20 bp, human
gcggggtgggggcacactca

SEQ ID NO: 72740 - DNA, 20 bp, human
gcggacggtggccagggatc

SEQ ID NO: 72741 - DNA, 20 bp, human
ggagcgccggacacctcaga

SEQ ID NO: 72742 - DNA, 20 bp, human
gtgtagcaaggcgaccctcg

SEQ ID NO: 72743 - DNA, 20 bp, human
gggacacctcagacggacgg

SEQ ID NO: 72744 - DNA, 20 bp, human
ggccggacacctcagacgga

SEQ ID NO: 72745 - DNA, 20 bp, human
gctcagacggacggtggcca

SEQ ID NO: 72746 - DNA, 20 bp, human
gaggcggccgaggctcatcg

SEQ ID NO: 72747 - DNA, 20 bp, human
gccggaccagaagtacaagg

SEQ ID NO: 72748 - DNA, 20 bp, human
ggagcagcgccggcttcagt

SEQ ID NO: 72749 - DNA, 20 bp, human
gcctgaggcaggaagggatc

SEQ ID NO: 72750 - DNA, 20 bp, human
gagtcgcgcagtcctgacta

SEQ ID NO: 72751 - DNA, 20 bp, human
ggcgccgctagcggggacaa

SEQ ID NO: 72752 - DNA, 20 bp, human
gcagcgccggcttcagtagg

SEQ ID NO: 72753 - DNA, 20 bp, human
gtccccacgccggcgagcgg

SEQ ID NO: 72754 - DNA, 20 bp, human
ggaagggatcgggagcgggt

SEQ ID NO: 72755 - DNA, 20 bp, human
gccgctagcggcgctcgggg

SEQ ID NO: 72756 - DNA, 20 bp, human
gcaaagcaggctaggagaag

SEQ ID NO: 72757 - DNA, 20 bp, human
gcagcgatgggctttagagt

SEQ ID NO: 72758 - DNA, 20 bp, human
ggagggcagggtctagaagt

SEQ ID NO: 72759 - DNA, 20 bp, human
ggtggccagagaggtctcca

SEQ ID NO: 72760 - DNA, 20 bp, human
ggtcatgactacacagttaa

SEQ ID NO: 72761 - DNA, 20 bp, human
ggcaaggaatacccatccat

SEQ ID NO: 72762 - DNA, 20 bp, human
gatgggctttagagtaggtg

SEQ ID NO: 72763 - DNA, 20 bp, human
ggtttggaggagaagctgag

SEQ ID NO: 72764 - DNA, 20 bp, human
gggacttgtttgcacaaagc

SEQ ID NO: 72765 - DNA, 20 bp, human
gccctgtgactggcctgtgg

SEQ ID NO: 72766 - DNA, 20 bp, human
ggcctggaactgctggaaca

SEQ ID NO: 72767 - DNA, 20 bp, human
ggctatcaaggggccaccag

SEQ ID NO: 72768 - DNA, 20 bp, human
gacaggctctaggctatcaa

SEQ ID NO: 72769 - DNA, 20 bp, human
ggttatggaccagcatgaag

SEQ ID NO: 72770 - DNA, 20 bp, human
ggaactgctggaacatggct

SEQ ID NO: 72771 - DNA, 20 bp, human
gcaaaaggggctgaaatcct

SEQ ID NO: 72772 - DNA, 20 bp, human
gggcaaaggggaatgtgctg

SEQ ID NO: 72773 - DNA, 20 bp, human
gctgtggatcccaacaaatg

SEQ ID NO: 72774 - DNA, 20 bp, human
gggagttttagacgactctg

SEQ ID NO: 72775 - DNA, 20 bp, human
gacagcgctactccaagtta

SEQ ID NO: 72776 - DNA, 20 bp, human
gccggaacaagccatggtgg

SEQ ID NO: 72777 - DNA, 20 bp, human
gcgcgcaggccgcagcccac

SEQ ID NO: 72778 - DNA, 20 bp, human
gccacctccggaacaagcca

SEQ ID NO: 72779 - DNA, 20 bp, human
gaaggtgccggtagcgaagt

SEQ ID NO: 72780 - DNA, 20 bp, human
gcgtcgcgagggcaaagacg

SEQ ID NO: 72781 - DNA, 20 bp, human
gccccgctgcccaaaggtgc

SEQ ID NO: 72782 - DNA, 20 bp, human
gggcccggcccgcggctacg

SEQ ID NO: 72783 - DNA, 20 bp, human
gtcggcgcccacttcgctac

SEQ ID NO: 72784 - DNA, 20 bp, human
gcaagccatggtggcggcga

SEQ ID NO: 72785 - DNA, 20 bp, human
gcccgtgaatggcaaaggct

SEQ ID NO: 72786 - DNA, 20 bp, human
ggctgcaagaggctccatgt

SEQ ID NO: 72787 - DNA, 20 bp, human
gccatgttggaggattctag

SEQ ID NO: 72788 - DNA, 20 bp, human
gttagcgggtaagctgcaag

SEQ ID NO: 72789 - DNA, 20 bp, human
gtgggcccggaacattttag

SEQ ID NO: 72790 - DNA, 20 bp, human
ggcaagaggctccatgttgg

SEQ ID NO: 72791 - DNA, 20 bp, human
gctgcaaatacctttgctct

SEQ ID NO: 72792 - DNA, 20 bp, human
gttacccgctaaaatgttcc

SEQ ID NO: 72793 - DNA, 20 bp, human
gcagctcctccttgaattcc

SEQ ID NO: 72794 - DNA, 20 bp, human
gttttatgcctttgaagtga

SEQ ID NO: 72795 - DNA, 20 bp, human
gtgttccgggcccagagcaa

SEQ ID NO: 72796 - DNA, 20 bp, human
gccgcatccatgttcgagta

SEQ ID NO: 72797 - DNA, 20 bp, human
gaacatggatgcggcgcggt

SEQ ID NO: 72798 - DNA, 20 bp, human
gacgccgcggcggcctccgg

SEQ ID NO: 72799 - DNA, 20 bp, human
ggcaccggcctggccttccg

SEQ ID NO: 72800 - DNA, 20 bp, human
gtgagcgcgaggccgaactg

SEQ ID NO: 72801 - DNA, 20 bp, human
gcccctgcctggtaagccag

SEQ ID NO: 72802 - DNA, 20 bp, human
gttgtgcgggcggttgggtc

SEQ ID NO: 72803 - DNA, 20 bp, human
gaggcccccgacctctgcag

SEQ ID NO: 72804 - DNA, 20 bp, human
gagcggccgctgcagaggtc

SEQ ID NO: 72805 - DNA, 20 bp, human
gcggccagagccatgtgcag

SEQ ID NO: 72806 - DNA, 20 bp, human
gcgagcacagggctgaagaa

SEQ ID NO: 72807 - DNA, 20 bp, human
gggtaagtagaggagggata

SEQ ID NO: 72808 - DNA, 20 bp, human
ggacctccggagctgtaacg

SEQ ID NO: 72809 - DNA, 20 bp, human
gcggaggtcccaggacatat

SEQ ID NO: 72810 - DNA, 20 bp, human
gcctcatcagaaactggcag

SEQ ID NO: 72811 - DNA, 20 bp, human
ggagccgcctgcccgagctg

SEQ ID NO: 72812 - DNA, 20 bp, human
ggctgttgacggcaactcca

SEQ ID NO: 72813 - DNA, 20 bp, human
gtctcctggtaagtagagga

SEQ ID NO: 72814 - DNA, 20 bp, human
gcattgattaggagattata

SEQ ID NO: 72815 - DNA, 20 bp, human
ggcagcagctgggggagcca

SEQ ID NO: 72816 - DNA, 20 bp, human
ggtcggagcgccctccatcg

SEQ ID NO: 72817 - DNA, 20 bp, human
ggtagggaaagggctcgcag

SEQ ID NO: 72818 - DNA, 20 bp, human
gaggcccgcggcttacctga

SEQ ID NO: 72819 - DNA, 20 bp, human
gcggagggagccgcgatgga

SEQ ID NO: 72820 - DNA, 20 bp, human
ggtaggctaaagccacagat

SEQ ID NO: 72821 - DNA, 20 bp, human
gggcttacctgacggacagt

SEQ ID NO: 72822 - DNA, 20 bp, human
gggcgctccgactgtccgtc

SEQ ID NO: 72823 - DNA, 20 bp, human
gtggggcaggttcccatctg

SEQ ID NO: 72824 - DNA, 20 bp, human
gcctgccccagcgaggcccg

SEQ ID NO: 72825 - DNA, 20 bp, human
gtgtccgtcaggtaagccgc

SEQ ID NO: 72826 - DNA, 20 bp, human
gctcctcggtggcctcgctc

SEQ ID NO: 72827 - DNA, 20 bp, human
gcggcttaaagcggtcatcc

SEQ ID NO: 72828 - DNA, 20 bp, human
gagccggagcgaggccaccg

SEQ ID NO: 72829 - DNA, 20 bp, human
gcaccgaggagggcgggtaa

SEQ ID NO: 72830 - DNA, 20 bp, human
ggcagcatcggggcaaggaa

SEQ ID NO: 72831 - DNA, 20 bp, human
ggcctcgctccggcttaaag

SEQ ID NO: 72832 - DNA, 20 bp, human
ggactgggagtcgataccgc

SEQ ID NO: 72833 - DNA, 20 bp, human
gcgggaagtgcctgccccgt

SEQ ID NO: 72834 - DNA, 20 bp, human
gcgggccccgggagacgcct

SEQ ID NO: 72835 - DNA, 20 bp, human
gaccccttacccgccctcct

SEQ ID NO: 72836 - DNA, 20 bp, human
gggacctggacacgtcggag

SEQ ID NO: 72837 - DNA, 20 bp, human
ggccgcggacctggacacgt

SEQ ID NO: 72838 - DNA, 20 bp, human
gcgggccgcgccaagctccc

SEQ ID NO: 72839 - DNA, 20 bp, human
gccggcctggatgcgctggg

SEQ ID NO: 72840 - DNA, 20 bp, human
gggtgcgcaggccaagcaag

SEQ ID NO: 72841 - DNA, 20 bp, human
gcggccccgggagcttggcg

SEQ ID NO: 72842 - DNA, 20 bp, human
ggccacaagattgtccatat

SEQ ID NO: 72843 - DNA, 20 bp, human
gccagctgagaatactcact

SEQ ID NO: 72844 - DNA, 20 bp, human
gagctgggacccatccaagg

SEQ ID NO: 72845 - DNA, 20 bp, human
gcatcggggccgtgtctgga

SEQ ID NO: 72846 - DNA, 20 bp, human
gttcaccctaacatgacgct

SEQ ID NO: 72847 - DNA, 20 bp, human
gctcagtgctgaacatgcta

SEQ ID NO: 72848 - DNA, 20 bp, human
gtggagactccgctagatcg

SEQ ID NO: 72849 - DNA, 20 bp, human
gtgttcgcaggtctgattag

SEQ ID NO: 72850 - DNA, 20 bp, human
gagtgctgaacatgctaagg

SEQ ID NO: 72851 - DNA, 20 bp, human
gggaacccgagcgtcatgtt

SEQ ID NO: 72852 - DNA, 20 bp, human
gcgggttccctgcaagagag

SEQ ID NO: 72853 - DNA, 20 bp, human
gtcatgttagggtgaagcag

SEQ ID NO: 72854 - DNA, 20 bp, human
ggacaccccagcccacaccg

SEQ ID NO: 72855 - DNA, 20 bp, human
gggccccacaaggtctgcag

SEQ ID NO: 72856 - DNA, 20 bp, human
ggaaaagctgctactctctg

SEQ ID NO: 72857 - DNA, 20 bp, human
gtgagacagacggaggtagg

SEQ ID NO: 72858 - DNA, 20 bp, human
gccagcaggcacggagaggg

SEQ ID NO: 72859 - DNA, 20 bp, human
gcctgacaggacgagaggaa

SEQ ID NO: 72860 - DNA, 20 bp, human
gatggtagggcccatctgag

SEQ ID NO: 72861 - DNA, 20 bp, human
gatgtatctgagacagacgg

SEQ ID NO: 72862 - DNA, 20 bp, human
gcagaacctgacaggacgag

SEQ ID NO: 72863 - DNA, 20 bp, human
gggatgtgctacgaggaccc

SEQ ID NO: 72864 - DNA, 20 bp, human
gatggctccagaagagcacg

SEQ ID NO: 72865 - DNA, 20 bp, human
gagagtagcagcttttccca

SEQ ID NO: 72866 - DNA, 20 bp, human
ggtctcctgggagcagaaag

SEQ ID NO: 72867 - DNA, 20 bp, human
ggcagaaagaggagaacacc

SEQ ID NO: 72868 - DNA, 20 bp, human
gagaggagaacaccaggcag

SEQ ID NO: 72869 - DNA, 20 bp, human
gggatgaataggagtctcct

SEQ ID NO: 72870 - DNA, 20 bp, human
gccagtgtctaaaccagaag

SEQ ID NO: 72871 - DNA, 20 bp, human
gcatcaaagaccagctcaga

SEQ ID NO: 72872 - DNA, 20 bp, human
ggaagaggtaccttctgagc

SEQ ID NO: 72873 - DNA, 20 bp, human
gcttcagggagactccccaa

SEQ ID NO: 72874 - DNA, 20 bp, human
gggagtctccctgaagctct

SEQ ID NO: 72875 - DNA, 20 bp, human
gggaggcagggcatcacaag

SEQ ID NO: 72876 - DNA, 20 bp, human
ggaggaggaggcacagttaa

SEQ ID NO: 72877 - DNA, 20 bp, human
gcagactgcagggctgacta

SEQ ID NO: 72878 - DNA, 20 bp, human
ggttactgcatttcagagta

SEQ ID NO: 72879 - DNA, 20 bp, human
gttcgaccttgggatcatgg

SEQ ID NO: 72880 - DNA, 20 bp, human
gcttgcaccctctttcagag

SEQ ID NO: 72881 - DNA, 20 bp, human
gttgtgttatggactgggta

SEQ ID NO: 72882 - DNA, 20 bp, human
gcctctttcagagtggtaca

SEQ ID NO: 72883 - DNA, 20 bp, human
gaaattggaagggattggag

SEQ ID NO: 72884 - DNA, 20 bp, human
ggtctgtaggcaaaccacac

SEQ ID NO: 72885 - DNA, 20 bp, human
gaatccaaattggaagggat

SEQ ID NO: 72886 - DNA, 20 bp, human
gctgctggagccccgagcag

SEQ ID NO: 72887 - DNA, 20 bp, human
ggtagcctgaaagctgtaca

SEQ ID NO: 72888 - DNA, 20 bp, human
gagcagcggcatggagtccg

SEQ ID NO: 72889 - DNA, 20 bp, human
gagaccgtcctcgactgcag

SEQ ID NO: 72890 - DNA, 20 bp, human
ggactccatgccgctgctcg

SEQ ID NO: 72891 - DNA, 20 bp, human
gggagccccgagcagcggca

SEQ ID NO: 72892 - DNA, 20 bp, human
gagaggaagcaggaagctgt

SEQ ID NO: 72893 - DNA, 20 bp, human
gacacagccaataactggag

SEQ ID NO: 72894 - DNA, 20 bp, human
gagacacactcaaggtaggg

SEQ ID NO: 72895 - DNA, 20 bp, human
ggactgtcccaagcagactg

SEQ ID NO: 72896 - DNA, 20 bp, human
ggccggacgcccctcagaga

SEQ ID NO: 72897 - DNA, 20 bp, human
gagccagcgccgtctctgag

SEQ ID NO: 72898 - DNA, 20 bp, human
gctgagtcggcggagggtca

SEQ ID NO: 72899 - DNA, 20 bp, human
gcggggaacgcggggagtcg

SEQ ID NO: 72900 - DNA, 20 bp, human
gccctgtagggagtcggaga

SEQ ID NO: 72901 - DNA, 20 bp, human
gagcaggccctgtagggagt

SEQ ID NO: 72902 - DNA, 20 bp, human
gtataaagggaggcgacccg

SEQ ID NO: 72903 - DNA, 20 bp, human
gcgcccctcagagacggcgc

SEQ ID NO: 72904 - DNA, 20 bp, human
ggccgtctctgaggggcgtc

SEQ ID NO: 72905 - DNA, 20 bp, human
gtccgagtcgggagtccggg

SEQ ID NO: 72906 - DNA, 20 bp, human
gcagagagggaagcgagctg

SEQ ID NO: 72907 - DNA, 20 bp, human
ggtgctcggaggcgggactg

SEQ ID NO: 72908 - DNA, 20 bp, human
gggaggcgcggcgggcggaa

SEQ ID NO: 72909 - DNA, 20 bp, human
ggagccgcgcgcggcaggta

SEQ ID NO: 72910 - DNA, 20 bp, human
gcggaaactttgggctccac

SEQ ID NO: 72911 - DNA, 20 bp, human
gggggctgcgcggaaacttt

SEQ ID NO: 72912 - DNA, 20 bp, human
ggcgcggcaggtacggagtt

SEQ ID NO: 72913 - DNA, 20 bp, human
ggagggaagcgagctgcggc

SEQ ID NO: 72914 - DNA, 20 bp, human
ggtcgcccgcagccacgcgg

SEQ ID NO: 72915 - DNA, 20 bp, human
gtttccgcgcagcccctggg

SEQ ID NO: 72916 - DNA, 20 bp, human
gggagcgcccagtccctcgg

SEQ ID NO: 72917 - DNA, 20 bp, human
gtgagtacctggagagcggg

SEQ ID NO: 72918 - DNA, 20 bp, human
gtactcagcctccgagggac

SEQ ID NO: 72919 - DNA, 20 bp, human
gcctgttgtgctccaggacc

SEQ ID NO: 72920 - DNA, 20 bp, human
gggcgctcctgaggagcggg

SEQ ID NO: 72921 - DNA, 20 bp, human
gcggatggcgtccccagagg

SEQ ID NO: 72922 - DNA, 20 bp, human
ggctctccaggtactcaggt

SEQ ID NO: 72923 - DNA, 20 bp, human
gacggagcagcgcccggtcc

SEQ ID NO: 72924 - DNA, 20 bp, human
ggcccggatggcgtccccag

SEQ ID NO: 72925 - DNA, 20 bp, human
ggctgagtattgcagccggg

SEQ ID NO: 72926 - DNA, 20 bp, human
gggtaggagccagctcaaag

SEQ ID NO: 72927 - DNA, 20 bp, human
gggccgagctatctgcgagg

SEQ ID NO: 72928 - DNA, 20 bp, human
gggtgaggaggcggtcctag

SEQ ID NO: 72929 - DNA, 20 bp, human
gtgggcagcgccacacacct

SEQ ID NO: 72930 - DNA, 20 bp, human
ggcggccagcggcgaatccc

SEQ ID NO: 72931 - DNA, 20 bp, human
gcgcgggtcccgtccggaag

SEQ ID NO: 72932 - DNA, 20 bp, human
gccgcctgcgctcggggccc

SEQ ID NO: 72933 - DNA, 20 bp, human
gccacacctgcagagcgctc

SEQ ID NO: 72934 - DNA, 20 bp, human
gcgcggccgagctatctgcg

SEQ ID NO: 72935 - DNA, 20 bp, human
ggggaggcgaggtgccggct

SEQ ID NO: 72936 - DNA, 20 bp, human
gtgctgcttcggcgaccggg

SEQ ID NO: 72937 - DNA, 20 bp, human
gttctcgcgggacaccgacg

SEQ ID NO: 72938 - DNA, 20 bp, human
ggtgcaaaccctcccgatga

SEQ ID NO: 72939 - DNA, 20 bp, human
gcctggcttccgctccccgt

SEQ ID NO: 72940 - DNA, 20 bp, human
gtgcttcggcgaccgggcgg

SEQ ID NO: 72941 - DNA, 20 bp, human
gccgaagcagcaatacctcc

SEQ ID NO: 72942 - DNA, 20 bp, human
gttggctctgggcagtccgg

SEQ ID NO: 72943 - DNA, 20 bp, human
gtattgctgcttcggcgacc

SEQ ID NO: 72944 - DNA, 20 bp, human
ggcgccacggtgagtacggg

SEQ ID NO: 72945 - DNA, 20 bp, human
gagaggaaaaggcacgagag

SEQ ID NO: 72946 - DNA, 20 bp, human
ggagggacgattaagagcag

SEQ ID NO: 72947 - DNA, 20 bp, human
ggctgggacagcaggccgat

SEQ ID NO: 72948 - DNA, 20 bp, human
gaatcagggcgaaagaaggt

SEQ ID NO: 72949 - DNA, 20 bp, human
ggccaccctgaagcaggaga

SEQ ID NO: 72950 - DNA, 20 bp, human
ggacagcaggccgattggca

SEQ ID NO: 72951 - DNA, 20 bp, human
gaaagaaggtgggtgagcac

SEQ ID NO: 72952 - DNA, 20 bp, human
gggactcgctccggcactct

SEQ ID NO: 72953 - DNA, 20 bp, human
ggtgtaatcagggcgaaaga

SEQ ID NO: 72954 - DNA, 20 bp, human
ggcgctgggttgcttcagca

SEQ ID NO: 72955 - DNA, 20 bp, human
gtctcttctgggactcgctc

SEQ ID NO: 72956 - DNA, 20 bp, human
gccccgagcgtcaggacacc

SEQ ID NO: 72957 - DNA, 20 bp, human
gtgggaccacgtcttcaggg

SEQ ID NO: 72958 - DNA, 20 bp, human
gcgggctgcggggagatgtg

SEQ ID NO: 72959 - DNA, 20 bp, human
ggagcgctggaaaccaggat

SEQ ID NO: 72960 - DNA, 20 bp, human
gcctggaatctggacacaca

SEQ ID NO: 72961 - DNA, 20 bp, human
gggctgggaccacgtcttca

SEQ ID NO: 72962 - DNA, 20 bp, human
ggccgggtgtcctgacgctc

SEQ ID NO: 72963 - DNA, 20 bp, human
gtccctaccggcctccagac

SEQ ID NO: 72964 - DNA, 20 bp, human
gggacgaaaagagggcgggt

SEQ ID NO: 72965 - DNA, 20 bp, human
gttcaggtaagaacccaagc

SEQ ID NO: 72966 - DNA, 20 bp, human
gaggcagccaagccagccag

SEQ ID NO: 72967 - DNA, 20 bp, human
gcccttctaataaggtgcag

SEQ ID NO: 72968 - DNA, 20 bp, human
gagaggtggaaagtgtgcag

SEQ ID NO: 72969 - DNA, 20 bp, human
gagcattggcccttctaata

SEQ ID NO: 72970 - DNA, 20 bp, human
ggacaagtccacttaatgaa

SEQ ID NO: 72971 - DNA, 20 bp, human
gtggttgttgttgtagctct

SEQ ID NO: 72972 - DNA, 20 bp, human
ggcctctccctgccgggcag

SEQ ID NO: 72973 - DNA, 20 bp, human
gtgacttacgaagacagctg

SEQ ID NO: 72974 - DNA, 20 bp, human
gatcaaaggcgcagcccagg

SEQ ID NO: 72975 - DNA, 20 bp, human
gaggacacccgttcattaag

SEQ ID NO: 72976 - DNA, 20 bp, human
ggcgctagcacctcggagtc

SEQ ID NO: 72977 - DNA, 20 bp, human
gctagcacctcggagtcggg

SEQ ID NO: 72978 - DNA, 20 bp, human
ggagagacgccagccgccgg

SEQ ID NO: 72979 - DNA, 20 bp, human
gcgtctcgctcccgccacaa

SEQ ID NO: 72980 - DNA, 20 bp, human
ggcgcagggaacggcactgg

SEQ ID NO: 72981 - DNA, 20 bp, human
gacggccgggtcccttcggt

SEQ ID NO: 72982 - DNA, 20 bp, human
gctccggccgcccgactccg

SEQ ID NO: 72983 - DNA, 20 bp, human
gcagcacggccgggtccctt

SEQ ID NO: 72984 - DNA, 20 bp, human
gcgcgagggcagaggaccag

SEQ ID NO: 72985 - DNA, 20 bp, human
gccagagagacgccagccgc

SEQ ID NO: 72986 - DNA, 20 bp, human
gagcgggaccgagagtgacg

SEQ ID NO: 72987 - DNA, 20 bp, human
ggaccgggcgacccagtgca

SEQ ID NO: 72988 - DNA, 20 bp, human
gacccggcagggatgtgagt

SEQ ID NO: 72989 - DNA, 20 bp, human
ggggaccgagagtgacgcgg

SEQ ID NO: 72990 - DNA, 20 bp, human
gtgggtctgcagggaaacgt

SEQ ID NO: 72991 - DNA, 20 bp, human
ggcaccaggagcgtgttcgg

SEQ ID NO: 72992 - DNA, 20 bp, human
gtgccgcgcgtggaactgag

SEQ ID NO: 72993 - DNA, 20 bp, human
gacggccgccgcgtcactct

SEQ ID NO: 72994 - DNA, 20 bp, human
ggcactcggtgcgccttccg

SEQ ID NO: 72995 - DNA, 20 bp, human
ggtgttcgggggcctccggg

SEQ ID NO: 72996 - DNA, 20 bp, human
ggattcagagctaagtctcc

SEQ ID NO: 72997 - DNA, 20 bp, human
gccggcgagacgtccactca

SEQ ID NO: 72998 - DNA, 20 bp, human
gcaggaccgaaagccctgag

SEQ ID NO: 72999 - DNA, 20 bp, human
gagagaagcgcgccggctga

SEQ ID NO: 73000 - DNA, 20 bp, human
gcccgggtaattcaagctgt

SEQ ID NO: 73001 - DNA, 20 bp, human
gtatgcgtgggtgtaacata

SEQ ID NO: 73002 - DNA, 20 bp, human
ggctgttggcgtgtgtctgg

SEQ ID NO: 73003 - DNA, 20 bp, human
ggccggcgcgcttctcttat

SEQ ID NO: 73004 - DNA, 20 bp, human
ggcggtcgaactgaaagcgg

SEQ ID NO: 73005 - DNA, 20 bp, human
ggctgcggtcgaactgaaag

SEQ ID NO: 73006 - DNA, 20 bp, human
gacagtacacccgatccggg

SEQ ID NO: 73007 - DNA, 20 bp, human
gccggagcggcggccccgac

SEQ ID NO: 73008 - DNA, 20 bp, human
ggcggcggccccgacgggtt

SEQ ID NO: 73009 - DNA, 20 bp, human
gtgggacagtacacccgatc

SEQ ID NO: 73010 - DNA, 20 bp, human
gcctcggggaaactcgacac

SEQ ID NO: 73011 - DNA, 20 bp, human
gggccaggttgggtcccctc

SEQ ID NO: 73012 - DNA, 20 bp, human
gcctcctccgcggccaggtt

SEQ ID NO: 73013 - DNA, 20 bp, human
ggtacacccgatccgggggg

SEQ ID NO: 73014 - DNA, 20 bp, human
ggggaaactcgacaccggag

SEQ ID NO: 73015 - DNA, 20 bp, human
gcgcccgaggggacccaacc

SEQ ID NO: 73016 - DNA, 20 bp, human
ggcggagtcctcctggatcg

SEQ ID NO: 73017 - DNA, 20 bp, human
ggagctgagaccattcctaa

SEQ ID NO: 73018 - DNA, 20 bp, human
gagaaagtggcggacttggg

SEQ ID NO: 73019 - DNA, 20 bp, human
gtgtgtgagagcgcccgaga

SEQ ID NO: 73020 - DNA, 20 bp, human
gagggcctactggaaaagtg

SEQ ID NO: 73021 - DNA, 20 bp, human
gagttgccatcagcccaaag

SEQ ID NO: 73022 - DNA, 20 bp, human
ggagcagaaagtggcggact

SEQ ID NO: 73023 - DNA, 20 bp, human
gccctaaacgccagatcggt

SEQ ID NO: 73024 - DNA, 20 bp, human
gacatggggcccgagctcgg

SEQ ID NO: 73025 - DNA, 20 bp, human
ggtaagtggatcacacgcgc

SEQ ID NO: 73026 - DNA, 20 bp, human
gcagcagcgctggcgctgat

SEQ ID NO: 73027 - DNA, 20 bp, human
ggctgattggctacaggtac

SEQ ID NO: 73028 - DNA, 20 bp, human
ggctccgacgatcagcactg

SEQ ID NO: 73029 - DNA, 20 bp, human
ggagcctcagtgctgatcgt

SEQ ID NO: 73030 - DNA, 20 bp, human
gccttcagaggatcaaaaag

SEQ ID NO: 73031 - DNA, 20 bp, human
gtagaggtgagtgtttccct

SEQ ID NO: 73032 - DNA, 20 bp, human
gggcagagaatgtctgtgtc

SEQ ID NO: 73033 - DNA, 20 bp, human
ggacgaccccaatcccatcg

SEQ ID NO: 73034 - DNA, 20 bp, human
gcagagcgtggaggctggat

SEQ ID NO: 73035 - DNA, 20 bp, human
ggaggtatacctccagtcgc

SEQ ID NO: 73036 - DNA, 20 bp, human
ggctgcactgcggatgagac

SEQ ID NO: 73037 - DNA, 20 bp, human
gagaccggtgcgactcatga

SEQ ID NO: 73038 - DNA, 20 bp, human
ggacctggcagtacagaagc

SEQ ID NO: 73039 - DNA, 20 bp, human
gacgctcccacaggacatgt

SEQ ID NO: 73040 - DNA, 20 bp, human
gccggcccagctacattccc

SEQ ID NO: 73041 - DNA, 20 bp, human
ggcgagcgcgaccctaccct

SEQ ID NO: 73042 - DNA, 20 bp, human
gaccctcggcgggtatcctg

SEQ ID NO: 73043 - DNA, 20 bp, human
gccccctgccaaacgtccaa

SEQ ID NO: 73044 - DNA, 20 bp, human
gggccagcttctgtactgcc

SEQ ID NO: 73045 - DNA, 20 bp, human
gacaccttcatgagtcgcac

SEQ ID NO: 73046 - DNA, 20 bp, human
ggagccagcagagcagtcca

SEQ ID NO: 73047 - DNA, 20 bp, human
ggactaaggggcgcacacaa

SEQ ID NO: 73048 - DNA, 20 bp, human
ggaggaagcagcagaattcc

SEQ ID NO: 73049 - DNA, 20 bp, human
gggggcgcacacaaaggcta

SEQ ID NO: 73050 - DNA, 20 bp, human
gtggatccgcctggactaag

SEQ ID NO: 73051 - DNA, 20 bp, human
ggctggctcggagaggacct

SEQ ID NO: 73052 - DNA, 20 bp, human
gctgctgcttcctcaggcct

SEQ ID NO: 73053 - DNA, 20 bp, human
gctgctctgctggctcggag

SEQ ID NO: 73054 - DNA, 20 bp, human
gacctggcgggtccacagcc

SEQ ID NO: 73055 - DNA, 20 bp, human
gctgagtgggccagtgtcca

SEQ ID NO: 73056 - DNA, 20 bp, human
gctgtgctgcggtaacagaa

SEQ ID NO: 73057 - DNA, 20 bp, human
gctccagctagcatgaggac

SEQ ID NO: 73058 - DNA, 20 bp, human
ggctccctaaagctgtgctg

SEQ ID NO: 73059 - DNA, 20 bp, human
ggacttgggcttacagccag

SEQ ID NO: 73060 - DNA, 20 bp, human
gcttctcctgatcggatgag

SEQ ID NO: 73061 - DNA, 20 bp, human
gtccagatcggtgagtgagg

SEQ ID NO: 73062 - DNA, 20 bp, human
gacagtcagtaccggggagg

SEQ ID NO: 73063 - DNA, 20 bp, human
gttgggcttacagccagagg

SEQ ID NO: 73064 - DNA, 20 bp, human
gcggtaacagaagggagact

SEQ ID NO: 73065 - DNA, 20 bp, human
gagcaaaacagtcagtaccg

SEQ ID NO: 73066 - DNA, 20 bp, human
gccccgctccagaagtccgg

SEQ ID NO: 73067 - DNA, 20 bp, human
gctccagaagtccggaggac

SEQ ID NO: 73068 - DNA, 20 bp, human
ggacttctggagcggggaca

SEQ ID NO: 73069 - DNA, 20 bp, human
gcagcaggacctgggaaata

SEQ ID NO: 73070 - DNA, 20 bp, human
gctgctaaaacctgaagtgg

SEQ ID NO: 73071 - DNA, 20 bp, human
gtaacagcatacagataggt

SEQ ID NO: 73072 - DNA, 20 bp, human
gtgtgtgtgagtgcatggga

SEQ ID NO: 73073 - DNA, 20 bp, human
gaaacagccaaagaaggaag

SEQ ID NO: 73074 - DNA, 20 bp, human
gggctgaatgcagttttcag

SEQ ID NO: 73075 - DNA, 20 bp, human
gcgctgtggtcccagtgtct

SEQ ID NO: 73076 - DNA, 20 bp, human
gaggacagggacccaccgca

SEQ ID NO: 73077 - DNA, 20 bp, human
gcgcagggaaagccttgccg

SEQ ID NO: 73078 - DNA, 20 bp, human
gcgagaccactgccccggca

SEQ ID NO: 73079 - DNA, 20 bp, human
ggcgcaagcgagccagccgt

SEQ ID NO: 73080 - DNA, 20 bp, human
gagagatcctgggagcgaga

SEQ ID NO: 73081 - DNA, 20 bp, human
gaatctgagcctcaacgagg

SEQ ID NO: 73082 - DNA, 20 bp, human
gggaggaggaggactagtgt

SEQ ID NO: 73083 - DNA, 20 bp, human
ggagcctctgggacaagaga

SEQ ID NO: 73084 - DNA, 20 bp, human
gacgaagctgacaagagcat

SEQ ID NO: 73085 - DNA, 20 bp, human
gggaccgggcagagatggtg

SEQ ID NO: 73086 - DNA, 20 bp, human
gggtaaggtgtgctccgatg

SEQ ID NO: 73087 - DNA, 20 bp, human
gccgcagtctccatagccct

SEQ ID NO: 73088 - DNA, 20 bp, human
gggacagaaaacctctccca

SEQ ID NO: 73089 - DNA, 20 bp, human
gagcagcgtgcaaataggta

SEQ ID NO: 73090 - DNA, 20 bp, human
ggactgcgggaaaaatctgg

SEQ ID NO: 73091 - DNA, 20 bp, human
gctatgggctgagaacgcat

SEQ ID NO: 73092 - DNA, 20 bp, human
gggagactgcgggaaaaatc

SEQ ID NO: 73093 - DNA, 20 bp, human
gctgctcggaaaggctccca

SEQ ID NO: 73094 - DNA, 20 bp, human
gttccgttggaatacaccca

SEQ ID NO: 73095 - DNA, 20 bp, human
gggctcgcgatggattgcta

SEQ ID NO: 73096 - DNA, 20 bp, human
gcacgcactggcatatccag

SEQ ID NO: 73097 - DNA, 20 bp, human
gcccggcgaggagcgaactg

SEQ ID NO: 73098 - DNA, 20 bp, human
gggcccgcaccgacacgcac

SEQ ID NO: 73099 - DNA, 20 bp, human
gtggctgtgtgtctgagccc

SEQ ID NO: 73100 - DNA, 20 bp, human
ggcggctagagcggcttcgg

SEQ ID NO: 73101 - DNA, 20 bp, human
gcatggaagcgctgacgctg

SEQ ID NO: 73102 - DNA, 20 bp, human
ggcgcttcccgcggctagag

SEQ ID NO: 73103 - DNA, 20 bp, human
gccgatgtggatgatggagt

SEQ ID NO: 73104 - DNA, 20 bp, human
ggcgcgcggctcatccaccc

SEQ ID NO: 73105 - DNA, 20 bp, human
ggtggcagcggcgcttcccg

SEQ ID NO: 73106 - DNA, 20 bp, human
gtccgcgcctcacgcagaaa

SEQ ID NO: 73107 - DNA, 20 bp, human
ggccaaactgcaaacaactc

SEQ ID NO: 73108 - DNA, 20 bp, human
gcgcggaacgcagcttggcg

SEQ ID NO: 73109 - DNA, 20 bp, human
gcccagcaaaccggctcccc

SEQ ID NO: 73110 - DNA, 20 bp, human
ggattctctgcgggctgtag

SEQ ID NO: 73111 - DNA, 20 bp, human
ggagcagccagattccacca

SEQ ID NO: 73112 - DNA, 20 bp, human
gacagcccgcagagaatcac

SEQ ID NO: 73113 - DNA, 20 bp, human
ggcccaagagcagtagaggc

SEQ ID NO: 73114 - DNA, 20 bp, human
gtgaggcgcggaacgcagct

SEQ ID NO: 73115 - DNA, 20 bp, human
gttgcgaaggaggtttcctc

SEQ ID NO: 73116 - DNA, 20 bp, human
gggcggatccgtggcgcaga

SEQ ID NO: 73117 - DNA, 20 bp, human
gtccagatggggaaggacca

SEQ ID NO: 73118 - DNA, 20 bp, human
ggggtagccgagcccaggaa

SEQ ID NO: 73119 - DNA, 20 bp, human
ggcgcgctcgctccattcct

SEQ ID NO: 73120 - DNA, 20 bp, human
ggcgcgcgctcgcagggcag

SEQ ID NO: 73121 - DNA, 20 bp, human
gctcggagggtgcccaccca

SEQ ID NO: 73122 - DNA, 20 bp, human
ggtgcgtggccctaaagagt

SEQ ID NO: 73123 - DNA, 20 bp, human
ggcagaggtgcgtggagtcg

SEQ ID NO: 73124 - DNA, 20 bp, human
gggcaggtgccgaagggcag

SEQ ID NO: 73125 - DNA, 20 bp, human
gcaattgtaggaaggaaagt

SEQ ID NO: 73126 - DNA, 20 bp, human
gcaccccaggcagctcatgg

SEQ ID NO: 73127 - DNA, 20 bp, human
ggctgcctggggtgagtaag

SEQ ID NO: 73128 - DNA, 20 bp, human
ggcagctgcggcagcgggtc

SEQ ID NO: 73129 - DNA, 20 bp, human
gaggcgaccaccaccgaaag

SEQ ID NO: 73130 - DNA, 20 bp, human
gcccaagccgccggcagctg

SEQ ID NO: 73131 - DNA, 20 bp, human
gaggccaccatgagctgcct

SEQ ID NO: 73132 - DNA, 20 bp, human
gtcatggtggcctctttcgg

SEQ ID NO: 73133 - DNA, 20 bp, human
gcggctctgcagcggagcat

SEQ ID NO: 73134 - DNA, 20 bp, human
ggcagctctcggctctgcag

SEQ ID NO: 73135 - DNA, 20 bp, human
ggaccagcggcggctgggaa

SEQ ID NO: 73136 - DNA, 20 bp, human
gagctcgagggaacccgcgt

SEQ ID NO: 73137 - DNA, 20 bp, human
gtccccacggagcgagctcg

SEQ ID NO: 73138 - DNA, 20 bp, human
gacagggtgagttggtgcag

SEQ ID NO: 73139 - DNA, 20 bp, human
ggagagggtacagggtgagt

SEQ ID NO: 73140 - DNA, 20 bp, human
gggaaccggagcatccagag

SEQ ID NO: 73141 - DNA, 20 bp, human
gactaacgaagaaggagaga

SEQ ID NO: 73142 - DNA, 20 bp, human
gccagcaggttaactgggag

SEQ ID NO: 73143 - DNA, 20 bp, human
gctgcggcccatggaagagg

SEQ ID NO: 73144 - DNA, 20 bp, human
gtccggcagcggctgtatct

SEQ ID NO: 73145 - DNA, 20 bp, human
gcaagttgggtgcatctctc

SEQ ID NO: 73146 - DNA, 20 bp, human
gaagtgggtgccgtgcgtgt

SEQ ID NO: 73147 - DNA, 20 bp, human
gggagccgaacgctagatcg

SEQ ID NO: 73148 - DNA, 20 bp, human
ggtgaccgcagacacgatca

SEQ ID NO: 73149 - DNA, 20 bp, human
gctgggttcgggtagaaatg

SEQ ID NO: 73150 - DNA, 20 bp, human
gtaacggtgcgcctgaagac

SEQ ID NO: 73151 - DNA, 20 bp, human
gtgttagtcggagagcatcc

SEQ ID NO: 73152 - DNA, 20 bp, human
ggtttctgtgcccacacgca

SEQ ID NO: 73153 - DNA, 20 bp, human
ggtgagcagatcagaatcca

SEQ ID NO: 73154 - DNA, 20 bp, human
ggtgggacatccatgttagt

SEQ ID NO: 73155 - DNA, 20 bp, human
gtcgcgcggccggacattgt

SEQ ID NO: 73156 - DNA, 20 bp, human
ggcccgggcgatagcatcgg

SEQ ID NO: 73157 - DNA, 20 bp, human
gcgggcgatagcatcggcgg

SEQ ID NO: 73158 - DNA, 20 bp, human
gcgagcccgggcgatagcat

SEQ ID NO: 73159 - DNA, 20 bp, human
ggccagggagcggtcatcgt

SEQ ID NO: 73160 - DNA, 20 bp, human
gtaccgatccggatgacgtg

SEQ ID NO: 73161 - DNA, 20 bp, human
gttcccaaaccagactccgg

SEQ ID NO: 73162 - DNA, 20 bp, human
gtggcggcgcctccggagtc

SEQ ID NO: 73163 - DNA, 20 bp, human
gcgcgagtccgggatccaga

SEQ ID NO: 73164 - DNA, 20 bp, human
gctcgcacaaagccccggag

SEQ ID NO: 73165 - DNA, 20 bp, human
ggcctagagctgccgcccca

SEQ ID NO: 73166 - DNA, 20 bp, human
gcttcagctgcgggcggatc

SEQ ID NO: 73167 - DNA, 20 bp, human
gtcttccgcagcagccgtgg

SEQ ID NO: 73168 - DNA, 20 bp, human
ggtgaagactggaggaacta

SEQ ID NO: 73169 - DNA, 20 bp, human
gaggaactacgggagcagag

SEQ ID NO: 73170 - DNA, 20 bp, human
ggacggaccggggtgaagac

SEQ ID NO: 73171 - DNA, 20 bp, human
ggctgaaggcagtctgtgtc

SEQ ID NO: 73172 - DNA, 20 bp, human
gcagcgcggaggggactcgg

SEQ ID NO: 73173 - DNA, 20 bp, human
gggaccggggtgaagactgg

SEQ ID NO: 73174 - DNA, 20 bp, human
ggcggagacgtcagaagtcg

SEQ ID NO: 73175 - DNA, 20 bp, human
ggactgccttcagctgcggg

SEQ ID NO: 73176 - DNA, 20 bp, human
gggatcctggagcccggacc

SEQ ID NO: 73177 - DNA, 20 bp, human
gtcagaggctgggtgtctag

SEQ ID NO: 73178 - DNA, 20 bp, human
gggacccggcgagtgaggga

SEQ ID NO: 73179 - DNA, 20 bp, human
gcgtatgggttctcctgggt

SEQ ID NO: 73180 - DNA, 20 bp, human
gcacagcacccgccaggcac

SEQ ID NO: 73181 - DNA, 20 bp, human
gtggtgtcaggggcccttca

SEQ ID NO: 73182 - DNA, 20 bp, human
gaggctgggtgtctagtggc

SEQ ID NO: 73183 - DNA, 20 bp, human
gatacagcgcaacatcagtg

SEQ ID NO: 73184 - DNA, 20 bp, human
gcgggaaagatgcatggacc

SEQ ID NO: 73185 - DNA, 20 bp, human
ggcatggacccggcgagtga

SEQ ID NO: 73186 - DNA, 20 bp, human
gcgtgaaccaggccaacaag

SEQ ID NO: 73187 - DNA, 20 bp, human
gccggaaccagcgccgtccg

SEQ ID NO: 73188 - DNA, 20 bp, human
ggacggcgctggttccggtc

SEQ ID NO: 73189 - DNA, 20 bp, human
ggtcgccgcagcgtccggac

SEQ ID NO: 73190 - DNA, 20 bp, human
gggttccggtccggacgctg

SEQ ID NO: 73191 - DNA, 20 bp, human
ggcaggcgcatggtgctcat

SEQ ID NO: 73192 - DNA, 20 bp, human
gcgccacgtctcccccggag

SEQ ID NO: 73193 - DNA, 20 bp, human
gggacgtcggccgagggaag

SEQ ID NO: 73194 - DNA, 20 bp, human
gaccaggccaacaagcggca

SEQ ID NO: 73195 - DNA, 20 bp, human
gaccccaagatcgtcaacat

SEQ ID NO: 73196 - DNA, 20 bp, human
gccggcgcgctcagaggacc

SEQ ID NO: 73197 - DNA, 20 bp, human
gtagcgggagctccactcca

SEQ ID NO: 73198 - DNA, 20 bp, human
ggccactgctgagaactatg

SEQ ID NO: 73199 - DNA, 20 bp, human
gctcgtgggtggccaacctg

SEQ ID NO: 73200 - DNA, 20 bp, human
gacgagccagcagtaggaga

SEQ ID NO: 73201 - DNA, 20 bp, human
gccgcaacccagctccgggc

SEQ ID NO: 73202 - DNA, 20 bp, human
gggttgcggagagggtgctc

SEQ ID NO: 73203 - DNA, 20 bp, human
ggggtcagcccaccaacgag

SEQ ID NO: 73204 - DNA, 20 bp, human
gcacccacgagaagctaact

SEQ ID NO: 73205 - DNA, 20 bp, human
ggagaaagaggaggtaacga

SEQ ID NO: 73206 - DNA, 20 bp, human
ggattcgcgtgtcccccgga

SEQ ID NO: 73207 - DNA, 20 bp, human
ggatatgcaagcgagaagaa

SEQ ID NO: 73208 - DNA, 20 bp, human
gctctagacggacagattaa

SEQ ID NO: 73209 - DNA, 20 bp, human
gggggaaaaagaggcggtca

SEQ ID NO: 73210 - DNA, 20 bp, human
ggcaagcgagaagaagggac

SEQ ID NO: 73211 - DNA, 20 bp, human
gccaaagcgtccccttccta

SEQ ID NO: 73212 - DNA, 20 bp, human
gaagcgtccccttcctaagg

SEQ ID NO: 73213 - DNA, 20 bp, human
ggcttctacaaaccaaggta

SEQ ID NO: 73214 - DNA, 20 bp, human
gaccatgctccaccgaggga

SEQ ID NO: 73215 - DNA, 20 bp, human
ggaatgaccatgctccaccg

SEQ ID NO: 73216 - DNA, 20 bp, human
gcgagagccaccgtcacccg

SEQ ID NO: 73217 - DNA, 20 bp, human
ggtccccgccctgcccgcgt

SEQ ID NO: 73218 - DNA, 20 bp, human
gcttgagccgcgggtgacgg

SEQ ID NO: 73219 - DNA, 20 bp, human
ggcaggaaacaggagactcg

SEQ ID NO: 73220 - DNA, 20 bp, human
ggaggggcggctcaccggaa

SEQ ID NO: 73221 - DNA, 20 bp, human
ggcaccgccaagacctggac

SEQ ID NO: 73222 - DNA, 20 bp, human
gggtcgcgggacgcacctgg

SEQ ID NO: 73223 - DNA, 20 bp, human
gaagtccccttggacgacca

SEQ ID NO: 73224 - DNA, 20 bp, human
gccgggccacaggaaaatcg

SEQ ID NO: 73225 - DNA, 20 bp, human
gatgtgagcgggtatgagtg

SEQ ID NO: 73226 - DNA, 20 bp, human
gagcctgcagaccctatcag

SEQ ID NO: 73227 - DNA, 20 bp, human
gctcaccagagacaggacgt

SEQ ID NO: 73228 - DNA, 20 bp, human
gaccagagacaggacgtggg

SEQ ID NO: 73229 - DNA, 20 bp, human
gagtcgtagccccagacctc

SEQ ID NO: 73230 - DNA, 20 bp, human
ggtgagggagatgaccacca

SEQ ID NO: 73231 - DNA, 20 bp, human
gccctcagacctaggtgtgt

SEQ ID NO: 73232 - DNA, 20 bp, human
ggacacgcagcacctcacgg

SEQ ID NO: 73233 - DNA, 20 bp, human
gctctgccatgcctgaggtc

SEQ ID NO: 73234 - DNA, 20 bp, human
ggatgcaggtgccgctgata

SEQ ID NO: 73235 - DNA, 20 bp, human
gacctcccacgtcctgtctc

SEQ ID NO: 73236 - DNA, 20 bp, human
gcctccgaggaagcaagcgg

SEQ ID NO: 73237 - DNA, 20 bp, human
ggctcctccgaggaagcaag

SEQ ID NO: 73238 - DNA, 20 bp, human
gagcagccggagttcctcgg

SEQ ID NO: 73239 - DNA, 20 bp, human
gcagtcgcgttgctcctccg

SEQ ID NO: 73240 - DNA, 20 bp, human
gagctgcgcgcgggacctgg

SEQ ID NO: 73241 - DNA, 20 bp, human
gatgccaggcggagggacct

SEQ ID NO: 73242 - DNA, 20 bp, human
ggcaggagggtggccaacag

SEQ ID NO: 73243 - DNA, 20 bp, human
ggcgactggccagcaaaggg

SEQ ID NO: 73244 - DNA, 20 bp, human
ggcaagcggcggtggcgact

SEQ ID NO: 73245 - DNA, 20 bp, human
gctgggaccgcttcaccgag

SEQ ID NO: 73246 - DNA, 20 bp, human
gtcgggccgagcctcgggaa

SEQ ID NO: 73247 - DNA, 20 bp, human
gacccgcgccgtggtcccgg

SEQ ID NO: 73248 - DNA, 20 bp, human
gggaccacggcgcgggtgga

SEQ ID NO: 73249 - DNA, 20 bp, human
ggccacggggcgcaaccacc

SEQ ID NO: 73250 - DNA, 20 bp, human
gcggagggcgcgtcggaacc

SEQ ID NO: 73251 - DNA, 20 bp, human
gaccaccgggaccacggcgc

SEQ ID NO: 73252 - DNA, 20 bp, human
ggcgcgtcggaacctggccg

SEQ ID NO: 73253 - DNA, 20 bp, human
ggcctcgggaaaggcgagca

SEQ ID NO: 73254 - DNA, 20 bp, human
ggccctgctcgcctttcccg

SEQ ID NO: 73255 - DNA, 20 bp, human
gctggtgcctccgggcgtgg

SEQ ID NO: 73256 - DNA, 20 bp, human
gcgcacccgcacccgctcgg

SEQ ID NO: 73257 - DNA, 20 bp, human
gcgtggggcgaggcgggtag

SEQ ID NO: 73258 - DNA, 20 bp, human
ggggcgtgcggggaacaaag

SEQ ID NO: 73259 - DNA, 20 bp, human
gggaccaacttactgacccg

SEQ ID NO: 73260 - DNA, 20 bp, human
ggtggcactggcaccgagag

SEQ ID NO: 73261 - DNA, 20 bp, human
gagcggccgccgagcgggtg

SEQ ID NO: 73262 - DNA, 20 bp, human
gggcagctcgcggccagagg

SEQ ID NO: 73263 - DNA, 20 bp, human
gtgcggctcggaagacgcag

SEQ ID NO: 73264 - DNA, 20 bp, human
gggggctgcggccgtggcac

SEQ ID NO: 73265 - DNA, 20 bp, human
gtggggtacgccgggaacag

SEQ ID NO: 73266 - DNA, 20 bp, human
gggagaaaggtagtcccagt

SEQ ID NO: 73267 - DNA, 20 bp, human
ggacctctgcatcagccaag

SEQ ID NO: 73268 - DNA, 20 bp, human
gttctgaggcgacttactaa

SEQ ID NO: 73269 - DNA, 20 bp, human
gcgaacacaaccgagatgta

SEQ ID NO: 73270 - DNA, 20 bp, human
gtcgcctcagaatttgacaa

SEQ ID NO: 73271 - DNA, 20 bp, human
gaggtccgctacatgtcatc

SEQ ID NO: 73272 - DNA, 20 bp, human
gactgcaacagactcgctga

SEQ ID NO: 73273 - DNA, 20 bp, human
gtttgccagatgacatgtag

SEQ ID NO: 73274 - DNA, 20 bp, human
gctgtggcaaagtgtactca

SEQ ID NO: 73275 - DNA, 20 bp, human
gtcaggactcgcacagctgg

SEQ ID NO: 73276 - DNA, 20 bp, human
gggctcccgagggagttggt

SEQ ID NO: 73277 - DNA, 20 bp, human
gtacgtacccgcctctccag

SEQ ID NO: 73278 - DNA, 20 bp, human
gcaagcagcgtggctcccga

SEQ ID NO: 73279 - DNA, 20 bp, human
ggtgagtgtccgacccagag

SEQ ID NO: 73280 - DNA, 20 bp, human
ggaggcgggtacgtaatggg

SEQ ID NO: 73281 - DNA, 20 bp, human
ggcgggtctggaggttccga

SEQ ID NO: 73282 - DNA, 20 bp, human
gtacgtaatggggggtctgt

SEQ ID NO: 73283 - DNA, 20 bp, human
ggatctgcacagctgcctgg

SEQ ID NO: 73284 - DNA, 20 bp, human
gcttgggctctcacccctct

SEQ ID NO: 73285 - DNA, 20 bp, human
gccatcctgctacaggacag

SEQ ID NO: 73286 - DNA, 20 bp, human
ggaggagtttcagcggatgc

SEQ ID NO: 73287 - DNA, 20 bp, human
gccacccggctaggcgaccg

SEQ ID NO: 73288 - DNA, 20 bp, human
ggtggtgggagcccttgaga

SEQ ID NO: 73289 - DNA, 20 bp, human
gtgcaggtgccgctcgcggt

SEQ ID NO: 73290 - DNA, 20 bp, human
gtggtctttcccaccgcgag

SEQ ID NO: 73291 - DNA, 20 bp, human
gatggcgcaagctctgtctg

SEQ ID NO: 73292 - DNA, 20 bp, human
gagggaaggagatcctgaga

SEQ ID NO: 73293 - DNA, 20 bp, human
gcggatgcaggtgccgctcg

SEQ ID NO: 73294 - DNA, 20 bp, human
gcgcggtgggaaagaccacc

SEQ ID NO: 73295 - DNA, 20 bp, human
gtggattccgagatactctg

SEQ ID NO: 73296 - DNA, 20 bp, human
gtccccaggaaccctcgaca

SEQ ID NO: 73297 - DNA, 20 bp, human
gcgtctctctcgtccagcaa

SEQ ID NO: 73298 - DNA, 20 bp, human
ggacgccctggccctgtcga

SEQ ID NO: 73299 - DNA, 20 bp, human
ggagctctggaaagacatcg

SEQ ID NO: 73300 - DNA, 20 bp, human
gggaaccctcgacagggcca

SEQ ID NO: 73301 - DNA, 20 bp, human
gctggacgagagagacgccc

SEQ ID NO: 73302 - DNA, 20 bp, human
gactcacacttggacagcgg

SEQ ID NO: 73303 - DNA, 20 bp, human
gtgtgcttggagcagcccat

SEQ ID NO: 73304 - DNA, 20 bp, human
gctctcgtccagcaagggca

SEQ ID NO: 73305 - DNA, 20 bp, human
ggccctgtcgagggttcctg

SEQ ID NO: 73306 - DNA, 20 bp, human
gcggccggcgacccgctccc

SEQ ID NO: 73307 - DNA, 20 bp, human
gcgggcgggctcggcgctaa

SEQ ID NO: 73308 - DNA, 20 bp, human
gcccggcgagctatgcacgg

SEQ ID NO: 73309 - DNA, 20 bp, human
ggtctcgcagaatccgccgg

SEQ ID NO: 73310 - DNA, 20 bp, human
gccggcgacccgctcccggg

SEQ ID NO: 73311 - DNA, 20 bp, human
gactgaggaggcggaacagg

SEQ ID NO: 73312 - DNA, 20 bp, human
gccctgtccgaagtgagcca

SEQ ID NO: 73313 - DNA, 20 bp, human
gggcggattctgcgagaccg

SEQ ID NO: 73314 - DNA, 20 bp, human
gcggcggcggcgccaggaca

SEQ ID NO: 73315 - DNA, 20 bp, human
gggcgagctatgcacggggg

SEQ ID NO: 73316 - DNA, 20 bp, human
gctgctcgcgacccactcgc

SEQ ID NO: 73317 - DNA, 20 bp, human
ggagtgacagagacacgcgg

SEQ ID NO: 73318 - DNA, 20 bp, human
gggcagcgggcatcctgcac

SEQ ID NO: 73319 - DNA, 20 bp, human
ggggggaggggggacacaga

SEQ ID NO: 73320 - DNA, 20 bp, human
gacagagacacgcggagggt

SEQ ID NO: 73321 - DNA, 20 bp, human
gatgcccgctgccggcgagt

SEQ ID NO: 73322 - DNA, 20 bp, human
ggacagtcggcggtcagcaa

SEQ ID NO: 73323 - DNA, 20 bp, human
gaagcatccgagggagccgg

SEQ ID NO: 73324 - DNA, 20 bp, human
gagcaggacacttcggagag

SEQ ID NO: 73325 - DNA, 20 bp, human
gtgcagagggggaaactctt

SEQ ID NO: 73326 - DNA, 20 bp, human
gggattcggggcccaggaag

SEQ ID NO: 73327 - DNA, 20 bp, human
gcctgggccccgaatcccgg

SEQ ID NO: 73328 - DNA, 20 bp, human
gcgatcggcgcggctcggcg

SEQ ID NO: 73329 - DNA, 20 bp, human
ggctcgcagtgaccgcgccg

SEQ ID NO: 73330 - DNA, 20 bp, human
ggaaggtgaggcggccgggt

SEQ ID NO: 73331 - DNA, 20 bp, human
gcaggccgccgccctcgcgg

SEQ ID NO: 73332 - DNA, 20 bp, human
gggaagacgacgggccggaa

SEQ ID NO: 73333 - DNA, 20 bp, human
gggtcaggccgccgccctcg

SEQ ID NO: 73334 - DNA, 20 bp, human
ggcgaacacggtgctactca

SEQ ID NO: 73335 - DNA, 20 bp, human
gtacacctctcccctggagg

SEQ ID NO: 73336 - DNA, 20 bp, human
gcgggtgagacaacgtccaa

SEQ ID NO: 73337 - DNA, 20 bp, human
gacgttgtctcacccgggaa

SEQ ID NO: 73338 - DNA, 20 bp, human
gaagggttgcgggttccccg

SEQ ID NO: 73339 - DNA, 20 bp, human
gagcacggggcgcactccca

SEQ ID NO: 73340 - DNA, 20 bp, human
gactgggagctggccgagga

SEQ ID NO: 73341 - DNA, 20 bp, human
gctagaggacgtgcagaact

SEQ ID NO: 73342 - DNA, 20 bp, human
gaaggcggcaaccttcctag

SEQ ID NO: 73343 - DNA, 20 bp, human
gagggaaagcacaagagggc

SEQ ID NO: 73344 - DNA, 20 bp, human
gcaaagacagcgcgctgcag

SEQ ID NO: 73345 - DNA, 20 bp, human
gtgcgggttccccggggcag

SEQ ID NO: 73346 - DNA, 20 bp, human
gaccgtctggattagagctg

SEQ ID NO: 73347 - DNA, 20 bp, human
gccgcctgcggggctgaagt

SEQ ID NO: 73348 - DNA, 20 bp, human
ggcctcagctctaatccaga

SEQ ID NO: 73349 - DNA, 20 bp, human
gtacctgagtacctgagtcg

SEQ ID NO: 73350 - DNA, 20 bp, human
gcctctgtccccaagcgggt

SEQ ID NO: 73351 - DNA, 20 bp, human
gcccgcaggcggctgagatt

SEQ ID NO: 73352 - DNA, 20 bp, human
gcgggcgaggagagcacagg

SEQ ID NO: 73353 - DNA, 20 bp, human
gagaggaccgtggccacgct

SEQ ID NO: 73354 - DNA, 20 bp, human
ggtcggggtagacagcgcta

SEQ ID NO: 73355 - DNA, 20 bp, human
ggatgagaatgagggcggag

SEQ ID NO: 73356 - DNA, 20 bp, human
ggctctggcgcggagagaat

SEQ ID NO: 73357 - DNA, 20 bp, human
gagcctgggccacaaaatct

SEQ ID NO: 73358 - DNA, 20 bp, human
gagaatcggagtggagcggg

SEQ ID NO: 73359 - DNA, 20 bp, human
gggcgcggagagaatcggag

SEQ ID NO: 73360 - DNA, 20 bp, human
gagagccagcgcgccaggta

SEQ ID NO: 73361 - DNA, 20 bp, human
gggagagaatcggagtggag

SEQ ID NO: 73362 - DNA, 20 bp, human
gcaagtcgcaagtctcccag

SEQ ID NO: 73363 - DNA, 20 bp, human
gaggtaagggccaaaaaggt

SEQ ID NO: 73364 - DNA, 20 bp, human
ggggccaaaaaggtcggcag

SEQ ID NO: 73365 - DNA, 20 bp, human
gtggcgcgctggctctggcg

SEQ ID NO: 73366 - DNA, 20 bp, human
gtgcgaggtaagggtcccag

SEQ ID NO: 73367 - DNA, 20 bp, human
gtcctcccagacacagacgt

SEQ ID NO: 73368 - DNA, 20 bp, human
ggagcccagagctgagatgg

SEQ ID NO: 73369 - DNA, 20 bp, human
gccagggtgcgagaggtgaa

SEQ ID NO: 73370 - DNA, 20 bp, human
gccttaggcagtgcatgcaa

SEQ ID NO: 73371 - DNA, 20 bp, human
gctggctgggcgccctccag

SEQ ID NO: 73372 - DNA, 20 bp, human
gcttataagagggagggtgg

SEQ ID NO: 73373 - DNA, 20 bp, human
ggaggacgtgtccctctgga

SEQ ID NO: 73374 - DNA, 20 bp, human
ggccagggtacctagacgag

SEQ ID NO: 73375 - DNA, 20 bp, human
gacactgcgagcccctggag

SEQ ID NO: 73376 - DNA, 20 bp, human
ggaccaccagggtcggatca

SEQ ID NO: 73377 - DNA, 20 bp, human
ggctcccctgggctatccaa

SEQ ID NO: 73378 - DNA, 20 bp, human
gggagcgggaccaccaagcg

SEQ ID NO: 73379 - DNA, 20 bp, human
gggttcaccagatctcacca

SEQ ID NO: 73380 - DNA, 20 bp, human
gctccctgatccgaccctgg

SEQ ID NO: 73381 - DNA, 20 bp, human
gttgttggctctacttgaaa

SEQ ID NO: 73382 - DNA, 20 bp, human
gccctggggaccaccagggt

SEQ ID NO: 73383 - DNA, 20 bp, human
gagctccagcatctctgtct

SEQ ID NO: 73384 - DNA, 20 bp, human
gtgtctgggctatcacaaca

SEQ ID NO: 73385 - DNA, 20 bp, human
gatctggtgaacccctgaga

SEQ ID NO: 73386 - DNA, 20 bp, human
gagagacgagagagcgagga

SEQ ID NO: 73387 - DNA, 20 bp, human
gacctaccccgaggacatgg

SEQ ID NO: 73388 - DNA, 20 bp, human
gccccctctggggtgagaag

SEQ ID NO: 73389 - DNA, 20 bp, human
gggagagccgggaagcgcaa

SEQ ID NO: 73390 - DNA, 20 bp, human
ggagagccctggccttccgg

SEQ ID NO: 73391 - DNA, 20 bp, human
gctcacctaccccgaggaca

SEQ ID NO: 73392 - DNA, 20 bp, human
gaggaggcacgagaccaatc

SEQ ID NO: 73393 - DNA, 20 bp, human
gagcgagagacgagagagcg

SEQ ID NO: 73394 - DNA, 20 bp, human
gctccacctccggaaggcca

SEQ ID NO: 73395 - DNA, 20 bp, human
gccacacctccacctccgga

SEQ ID NO: 73396 - DNA, 20 bp, human
gtgctgagtagctcatagtg

SEQ ID NO: 73397 - DNA, 20 bp, human
ggagccctcgggtggtttgt

SEQ ID NO: 73398 - DNA, 20 bp, human
gagtagctcatagtgtggtt

SEQ ID NO: 73399 - DNA, 20 bp, human
gagctcatagtgtggtttgg

SEQ ID NO: 73400 - DNA, 20 bp, human
ggctcccacaaaccacccga

SEQ ID NO: 73401 - DNA, 20 bp, human
gtcatagtgtggtttggggg

SEQ ID NO: 73402 - DNA, 20 bp, human
gattcgaaaccacgcgcacc

SEQ ID NO: 73403 - DNA, 20 bp, human
ggaaaaaggcgcgagcaatg

SEQ ID NO: 73404 - DNA, 20 bp, human
gtgctcgcagcgcagccaac

SEQ ID NO: 73405 - DNA, 20 bp, human
gtgggccacggggatcagca

SEQ ID NO: 73406 - DNA, 20 bp, human
gcagcggtatcctatatccg

SEQ ID NO: 73407 - DNA, 20 bp, human
gctcttggctatagttacca

SEQ ID NO: 73408 - DNA, 20 bp, human
gctatagttaccacggatat

SEQ ID NO: 73409 - DNA, 20 bp, human
gagagcaatcaagcaagggg

SEQ ID NO: 73410 - DNA, 20 bp, human
ggatggagagcaatcaagca

SEQ ID NO: 73411 - DNA, 20 bp, human
ggggagcacgtgccgcgctc

SEQ ID NO: 73412 - DNA, 20 bp, human
gagctgcgtctgcccgagcg

SEQ ID NO: 73413 - DNA, 20 bp, human
gcggcacgtgctcccggcgc

SEQ ID NO: 73414 - DNA, 20 bp, human
ggacccaggagggcaagtgg

SEQ ID NO: 73415 - DNA, 20 bp, human
ggctctctcgcgccagcgcc

SEQ ID NO: 73416 - DNA, 20 bp, human
gacttgtcctgaaccgacag

SEQ ID NO: 73417 - DNA, 20 bp, human
ggcagcagcgccacgagcag

SEQ ID NO: 73418 - DNA, 20 bp, human
gcctgcgccagccacgccag

SEQ ID NO: 73419 - DNA, 20 bp, human
gcacctgcgccagccgctgt

SEQ ID NO: 73420 - DNA, 20 bp, human
gagcggctggcgcaggtgac

SEQ ID NO: 73421 - DNA, 20 bp, human
ggacaagtctgtgacagatg

SEQ ID NO: 73422 - DNA, 20 bp, human
ggatggaccccgaggaagag

SEQ ID NO: 73423 - DNA, 20 bp, human
ggtcctgaaccgacagcggc

SEQ ID NO: 73424 - DNA, 20 bp, human
gtaactccccagagccgaag

SEQ ID NO: 73425 - DNA, 20 bp, human
gtggcgcaggtgactggctt

SEQ ID NO: 73426 - DNA, 20 bp, human
gaacggtggtgggctcgccg

SEQ ID NO: 73427 - DNA, 20 bp, human
gccctgaagggcccggacct

SEQ ID NO: 73428 - DNA, 20 bp, human
ggagagagcgagcagcaagc

SEQ ID NO: 73429 - DNA, 20 bp, human
ggtcccagcggagtgccctg

SEQ ID NO: 73430 - DNA, 20 bp, human
gcgcggcgcctgccagcctg

SEQ ID NO: 73431 - DNA, 20 bp, human
ggagggaaaacgggatccac

SEQ ID NO: 73432 - DNA, 20 bp, human
gcactcaatccggatcgagg

SEQ ID NO: 73433 - DNA, 20 bp, human
gggtgacgtccccctcgatc

SEQ ID NO: 73434 - DNA, 20 bp, human
gggcactccgctgggaccct

SEQ ID NO: 73435 - DNA, 20 bp, human
gcagcccagcactggggaga

SEQ ID NO: 73436 - DNA, 20 bp, human
gcatgaaggcgcccgttggg

SEQ ID NO: 73437 - DNA, 20 bp, human
gttcccggagcgaggcatga

SEQ ID NO: 73438 - DNA, 20 bp, human
gaggcatgaaggcgcccgtt

SEQ ID NO: 73439 - DNA, 20 bp, human
gcggcttggaggacgattcc

SEQ ID NO: 73440 - DNA, 20 bp, human
gggagagagccgctatgcac

SEQ ID NO: 73441 - DNA, 20 bp, human
gggagatgaaccaagaactt

SEQ ID NO: 73442 - DNA, 20 bp, human
gtgcactgggtaggaatgag

SEQ ID NO: 73443 - DNA, 20 bp, human
gagggagacggagaaaaaat

SEQ ID NO: 73444 - DNA, 20 bp, human
ggccgctatgcactggaaaa

SEQ ID NO: 73445 - DNA, 20 bp, human
gctccggtgccggagggaga

SEQ ID NO: 73446 - DNA, 20 bp, human
gccgcgtgaggcgagcacag

SEQ ID NO: 73447 - DNA, 20 bp, human
gagcacagcggccgcacttg

SEQ ID NO: 73448 - DNA, 20 bp, human
gcgcacttgtggctgatctc

SEQ ID NO: 73449 - DNA, 20 bp, human
ggaaggagagtgggcaccag

SEQ ID NO: 73450 - DNA, 20 bp, human
gcggaggtgacgggaatggg

SEQ ID NO: 73451 - DNA, 20 bp, human
ggccgcccggcagcagaaag

SEQ ID NO: 73452 - DNA, 20 bp, human
gctgtgagagaaatagcggg

SEQ ID NO: 73453 - DNA, 20 bp, human
gggctgatctctgggctgag

SEQ ID NO: 73454 - DNA, 20 bp, human
ggggaggaggaacccccgag

SEQ ID NO: 73455 - DNA, 20 bp, human
gagtctgtgagagaaatagc

SEQ ID NO: 73456 - DNA, 20 bp, human
gtcggacgcaggtaggagag

SEQ ID NO: 73457 - DNA, 20 bp, human
gtgcccaaggaccgcggagt

SEQ ID NO: 73458 - DNA, 20 bp, human
gcgcggagtcggacgcaggt

SEQ ID NO: 73459 - DNA, 20 bp, human
ggtccgactccgcggtcctt

SEQ ID NO: 73460 - DNA, 20 bp, human
gggaccgcggagtcggacgc

SEQ ID NO: 73461 - DNA, 20 bp, human
gtgagaccttggcttctcga

SEQ ID NO: 73462 - DNA, 20 bp, human
gcccgcaacaagaggaagta

SEQ ID NO: 73463 - DNA, 20 bp, human
ggtggtgactgaacctggtc

SEQ ID NO: 73464 - DNA, 20 bp, human
gtggcttctcgaaggtagta

SEQ ID NO: 73465 - DNA, 20 bp, human
gacccggttgctgctgccca

SEQ ID NO: 73466 - DNA, 20 bp, human
gcggctgactagggactcat

SEQ ID NO: 73467 - DNA, 20 bp, human
ggccgcagcagtagcaccag

SEQ ID NO: 73468 - DNA, 20 bp, human
gctggtgacccggacctcgg

SEQ ID NO: 73469 - DNA, 20 bp, human
gccgcgcggcaaccactggg

SEQ ID NO: 73470 - DNA, 20 bp, human
gcggcggcggagctcctccg

SEQ ID NO: 73471 - DNA, 20 bp, human
gccagcgccagcaggaccag

SEQ ID NO: 73472 - DNA, 20 bp, human
gagactggtgacccggacct

SEQ ID NO: 73473 - DNA, 20 bp, human
gggatcagcggaccagcctg

SEQ ID NO: 73474 - DNA, 20 bp, human
gaccagcctgcggctgacta

SEQ ID NO: 73475 - DNA, 20 bp, human
gtgccagacaggttgagact

SEQ ID NO: 73476 - DNA, 20 bp, human
ggcgtgcgcggcgactgcga

SEQ ID NO: 73477 - DNA, 20 bp, human
gcgacctcccgctccgatgg

SEQ ID NO: 73478 - DNA, 20 bp, human
ggaggcagccgcaacttgtg

SEQ ID NO: 73479 - DNA, 20 bp, human
gtcggcgctcacgggcgcag

SEQ ID NO: 73480 - DNA, 20 bp, human
ggcggctcagtgcgtgaggt

SEQ ID NO: 73481 - DNA, 20 bp, human
gtcagtgcgtgaggttggcg

SEQ ID NO: 73482 - DNA, 20 bp, human
gcacgtgcgcgtgtggtcca

SEQ ID NO: 73483 - DNA, 20 bp, human
gtcacggtctcggcgctcac

SEQ ID NO: 73484 - DNA, 20 bp, human
gagcagagcaggccccagcg

SEQ ID NO: 73485 - DNA, 20 bp, human
ggcgtgtggtccagggcctg

SEQ ID NO: 73486 - DNA, 20 bp, human
gcccagcctgtggtacctgt

SEQ ID NO: 73487 - DNA, 20 bp, human
gcccgcccacagcgaccgta

SEQ ID NO: 73488 - DNA, 20 bp, human
gcgtgagtgcacggtcgtag

SEQ ID NO: 73489 - DNA, 20 bp, human
ggcgagagctatctgagcgt

SEQ ID NO: 73490 - DNA, 20 bp, human
gtacaacagtgcccggataa

SEQ ID NO: 73491 - DNA, 20 bp, human
gggagcgtgaggactctgag

SEQ ID NO: 73492 - DNA, 20 bp, human
gatggccgtacggtcgctgt

SEQ ID NO: 73493 - DNA, 20 bp, human
gaagtctcttaagcccccaa

SEQ ID NO: 73494 - DNA, 20 bp, human
gttaggtcacacggagtgag

SEQ ID NO: 73495 - DNA, 20 bp, human
gcggataacggagaaaggac

SEQ ID NO: 73496 - DNA, 20 bp, human
gtttcctgatatttagaatc

SEQ ID NO: 73497 - DNA, 20 bp, human
gacatagaggatccccgggt

SEQ ID NO: 73498 - DNA, 20 bp, human
gtcttagtaaactgcagcca

SEQ ID NO: 73499 - DNA, 20 bp, human
gatatcaggaaagacgctgt

SEQ ID NO: 73500 - DNA, 20 bp, human
gcgatgactggtcccacccg

SEQ ID NO: 73501 - DNA, 20 bp, human
ggacgctgtgggaaaatagc

SEQ ID NO: 73502 - DNA, 20 bp, human
ggaatctggaggtttaaagt

SEQ ID NO: 73503 - DNA, 20 bp, human
gaactgcagggatgacatag

SEQ ID NO: 73504 - DNA, 20 bp, human
ggaaagaactgatgcagagt

SEQ ID NO: 73505 - DNA, 20 bp, human
ggatgttgcagtgcatgaaa

SEQ ID NO: 73506 - DNA, 20 bp, human
gtgccggccatggactccgg

SEQ ID NO: 73507 - DNA, 20 bp, human
gcggccatggactccggagg

SEQ ID NO: 73508 - DNA, 20 bp, human
gcgcacacggagggacggag

SEQ ID NO: 73509 - DNA, 20 bp, human
gggcagcagagaggcacgga

SEQ ID NO: 73510 - DNA, 20 bp, human
ggaggcggcgcagggcctga

SEQ ID NO: 73511 - DNA, 20 bp, human
gcagctacagccaggtacgt

SEQ ID NO: 73512 - DNA, 20 bp, human
ggcgtgccggccatggactc

SEQ ID NO: 73513 - DNA, 20 bp, human
gtctcgcgccaggtccctca

SEQ ID NO: 73514 - DNA, 20 bp, human
gtccagcagcgatggtggaa

SEQ ID NO: 73515 - DNA, 20 bp, human
gcgaggcgcacacggaggga

SEQ ID NO: 73516 - DNA, 20 bp, human
gggagccgggaggcgaactt

SEQ ID NO: 73517 - DNA, 20 bp, human
gtaagcgccccggagccggg

SEQ ID NO: 73518 - DNA, 20 bp, human
gccgagggcgcaggtgggtt

SEQ ID NO: 73519 - DNA, 20 bp, human
ggacgggccgggcaaagtcc

SEQ ID NO: 73520 - DNA, 20 bp, human
gggcgcttaagtccttccgg

SEQ ID NO: 73521 - DNA, 20 bp, human
gacttaagcgccccggagcc

SEQ ID NO: 73522 - DNA, 20 bp, human
ggcgggaaaaccggtccctg

SEQ ID NO: 73523 - DNA, 20 bp, human
gcgggcccgcgaccccccag

SEQ ID NO: 73524 - DNA, 20 bp, human
gcggcgtcgtcgaagtcctc

SEQ ID NO: 73525 - DNA, 20 bp, human
gcaggccgctcgaatccgta

SEQ ID NO: 73526 - DNA, 20 bp, human
gcgagagggttcgaagatgg

SEQ ID NO: 73527 - DNA, 20 bp, human
ggatggcggcgcgcaagggt

SEQ ID NO: 73528 - DNA, 20 bp, human
gcaccgagcgcagactggta

SEQ ID NO: 73529 - DNA, 20 bp, human
gccgggtgtcagcagcgaga

SEQ ID NO: 73530 - DNA, 20 bp, human
gacatagtccgggatcacct

SEQ ID NO: 73531 - DNA, 20 bp, human
gcagcgagagggttcgaaga

SEQ ID NO: 73532 - DNA, 20 bp, human
gggcggcgcgcaagggtcgg

SEQ ID NO: 73533 - DNA, 20 bp, human
gcggcgcacgtgtgaaaccg

SEQ ID NO: 73534 - DNA, 20 bp, human
gtgtgaaaccggggaaccca

SEQ ID NO: 73535 - DNA, 20 bp, human
gcgaagatggcggcgcgcaa

SEQ ID NO: 73536 - DNA, 20 bp, human
ggtgctgccatcactagaat

SEQ ID NO: 73537 - DNA, 20 bp, human
gcaagggctgccagtgagaa

SEQ ID NO: 73538 - DNA, 20 bp, human
ggatcgcgtcctctcacagt

SEQ ID NO: 73539 - DNA, 20 bp, human
gagcttgctggtgttagcaa

SEQ ID NO: 73540 - DNA, 20 bp, human
gtggactagtgcagtaacaa

SEQ ID NO: 73541 - DNA, 20 bp, human
gtggctctgatattgctatc

SEQ ID NO: 73542 - DNA, 20 bp, human
gcacagtgggcgagttctga

SEQ ID NO: 73543 - DNA, 20 bp, human
gccatctatcccacagatac

SEQ ID NO: 73544 - DNA, 20 bp, human
ggatgaagccagaaagtgac

SEQ ID NO: 73545 - DNA, 20 bp, human
gctgccagtgagaagggttt

SEQ ID NO: 73546 - DNA, 20 bp, human
ggtgcaccaacagttctggt

SEQ ID NO: 73547 - DNA, 20 bp, human
ggaagagtgatggcaaaccc

SEQ ID NO: 73548 - DNA, 20 bp, human
gcggtaccaaccagaactgt

SEQ ID NO: 73549 - DNA, 20 bp, human
gtggccgcctgccaaggtgt

SEQ ID NO: 73550 - DNA, 20 bp, human
gaatactcgaccgctgtagg

SEQ ID NO: 73551 - DNA, 20 bp, human
ggttctggttggtaccggag

SEQ ID NO: 73552 - DNA, 20 bp, human
gctctgagcagtcagcttag

SEQ ID NO: 73553 - DNA, 20 bp, human
ggagggtaatgcctacacct

SEQ ID NO: 73554 - DNA, 20 bp, human
ggaagcaggtctttgaggat

SEQ ID NO: 73555 - DNA, 20 bp, human
gaactgttggtgcaccaaat

SEQ ID NO: 73556 - DNA, 20 bp, human
ggggcgtcgccgccctgaga

SEQ ID NO: 73557 - DNA, 20 bp, human
gtcgcccggacacgaccacc

SEQ ID NO: 73558 - DNA, 20 bp, human
gcccggacacgaccaccggg

SEQ ID NO: 73559 - DNA, 20 bp, human
gatgctgagggaaccgccag

SEQ ID NO: 73560 - DNA, 20 bp, human
gcgaccaccgggcggctctg

SEQ ID NO: 73561 - DNA, 20 bp, human
gtccttcccgaggtcgaagt

SEQ ID NO: 73562 - DNA, 20 bp, human
gccaggcgcctcaggcccca

SEQ ID NO: 73563 - DNA, 20 bp, human
gcagccacggcggaaggtct

SEQ ID NO: 73564 - DNA, 20 bp, human
ggaggtcgaagtcggcgacc

SEQ ID NO: 73565 - DNA, 20 bp, human
gtaccccccggactccgacc

SEQ ID NO: 73566 - DNA, 20 bp, human
gcgagcgcgaccctacctgg

SEQ ID NO: 73567 - DNA, 20 bp, human
gggctaaggaccgcagtggg

SEQ ID NO: 73568 - DNA, 20 bp, human
ggtcccgacgcccccaggta

SEQ ID NO: 73569 - DNA, 20 bp, human
ggacagagccttaaagtggg

SEQ ID NO: 73570 - DNA, 20 bp, human
ggaggacagagccttaaagt

SEQ ID NO: 73571 - DNA, 20 bp, human
gtgcagggccgggaagacga

SEQ ID NO: 73572 - DNA, 20 bp, human
gaaggcgccatagtccgagg

SEQ ID NO: 73573 - DNA, 20 bp, human
gactgctgggcgcccagcgg

SEQ ID NO: 73574 - DNA, 20 bp, human
gtagaaggcgccatagtccg

SEQ ID NO: 73575 - DNA, 20 bp, human
gcatgggctaaggaccgcag

SEQ ID NO: 73576 - DNA, 20 bp, human
gggtcggcccgggttcgcag

SEQ ID NO: 73577 - DNA, 20 bp, human
ggggccgcccggcaccccgg

SEQ ID NO: 73578 - DNA, 20 bp, human
gctctgggtgcgccagccgg

SEQ ID NO: 73579 - DNA, 20 bp, human
ggggagcgccccggaacctc

SEQ ID NO: 73580 - DNA, 20 bp, human
gacgagcgcctgcggagcga

SEQ ID NO: 73581 - DNA, 20 bp, human
gctggagaggatgtgctcga

SEQ ID NO: 73582 - DNA, 20 bp, human
gccagagacaagggcaccgc

SEQ ID NO: 73583 - DNA, 20 bp, human
ggcgccccggaacctccggc

SEQ ID NO: 73584 - DNA, 20 bp, human
gaggatgtgctcgatggaga

SEQ ID NO: 73585 - DNA, 20 bp, human
ggcgccagccggaggttccg

SEQ ID NO: 73586 - DNA, 20 bp, human
gtagggctcactgggtctgt

SEQ ID NO: 73587 - DNA, 20 bp, human
gtatccagcagctgggtctg

SEQ ID NO: 73588 - DNA, 20 bp, human
gtgagggcctagggctcact

SEQ ID NO: 73589 - DNA, 20 bp, human
gaagcagcctgtcctggcaa

SEQ ID NO: 73590 - DNA, 20 bp, human
gccacccacggggataactg

SEQ ID NO: 73591 - DNA, 20 bp, human
gagcatcccacatccaccac

SEQ ID NO: 73592 - DNA, 20 bp, human
gactgggtctgtaggttgag

SEQ ID NO: 73593 - DNA, 20 bp, human
gaagtgcctgtggtggatgt

SEQ ID NO: 73594 - DNA, 20 bp, human
gtgggtcctatccagcagct

SEQ ID NO: 73595 - DNA, 20 bp, human
ggaactcccctagagtccag

SEQ ID NO: 73596 - DNA, 20 bp, human
gctgggcagaagggatatag

SEQ ID NO: 73597 - DNA, 20 bp, human
gttagcttcctgagattcag

SEQ ID NO: 73598 - DNA, 20 bp, human
gttgatgaacagaggaacca

SEQ ID NO: 73599 - DNA, 20 bp, human
gccccaacgttgatgaacag

SEQ ID NO: 73600 - DNA, 20 bp, human
gggtggccaaaggtaggatg

SEQ ID NO: 73601 - DNA, 20 bp, human
gggggaaggtggccaaaggt

SEQ ID NO: 73602 - DNA, 20 bp, human
ggacagtacccgggaaccac

SEQ ID NO: 73603 - DNA, 20 bp, human
ggggaagaaacgaccagttg

SEQ ID NO: 73604 - DNA, 20 bp, human
gttcctgagattcagaggcc

SEQ ID NO: 73605 - DNA, 20 bp, human
gaccacaggcccatctcaag

SEQ ID NO: 73606 - DNA, 20 bp, human
ggctgaggacttgagagcta

SEQ ID NO: 73607 - DNA, 20 bp, human
gccgcaggaggtctgaagat

SEQ ID NO: 73608 - DNA, 20 bp, human
gggaggtctgaagattggaa

SEQ ID NO: 73609 - DNA, 20 bp, human
ggtaagtctggaactagttc

SEQ ID NO: 73610 - DNA, 20 bp, human
gtggaaaaataagcacagga

SEQ ID NO: 73611 - DNA, 20 bp, human
gatttccagaagagtaagtc

SEQ ID NO: 73612 - DNA, 20 bp, human
gaaaatagcacaattgagta

SEQ ID NO: 73613 - DNA, 20 bp, human
gagttccagacttactcttc

SEQ ID NO: 73614 - DNA, 20 bp, human
gatttctacttgaccgcagg

SEQ ID NO: 73615 - DNA, 20 bp, human
gaaattgtcagacaaactcc

SEQ ID NO: 73616 - DNA, 20 bp, human
gctgtctcggagtgcggctg

SEQ ID NO: 73617 - DNA, 20 bp, human
ggggcctccgctgggatagg

SEQ ID NO: 73618 - DNA, 20 bp, human
gcaggtgccccctatcccag

SEQ ID NO: 73619 - DNA, 20 bp, human
gctgggtctgctgaaagtgg

SEQ ID NO: 73620 - DNA, 20 bp, human
gtggcgcgtctgctctccct

SEQ ID NO: 73621 - DNA, 20 bp, human
ggcacctgggccactgtgga

SEQ ID NO: 73622 - DNA, 20 bp, human
ggccttctgggcgaacgctg

SEQ ID NO: 73623 - DNA, 20 bp, human
ggccccgagggtggcgcgtc

SEQ ID NO: 73624 - DNA, 20 bp, human
ggccagacgcgccaccctcg

SEQ ID NO: 73625 - DNA, 20 bp, human
ggtgccccctatcccagcgg

SEQ ID NO: 73626 - DNA, 20 bp, human
gagagggcaggtaaagtggg

SEQ ID NO: 73627 - DNA, 20 bp, human
gtaagtgcgtgcgggctaga

SEQ ID NO: 73628 - DNA, 20 bp, human
ggggccccgcagctccacct

SEQ ID NO: 73629 - DNA, 20 bp, human
gcagcatgtatcagccgagg

SEQ ID NO: 73630 - DNA, 20 bp, human
gttagacaaacactgggcga

SEQ ID NO: 73631 - DNA, 20 bp, human
gctccagcatgtatcagccg

SEQ ID NO: 73632 - DNA, 20 bp, human
gggctagagggcaggtaaag

SEQ ID NO: 73633 - DNA, 20 bp, human
gagggcgggcaggcgaccaa

SEQ ID NO: 73634 - DNA, 20 bp, human
gggggagtctccgagagctg

SEQ ID NO: 73635 - DNA, 20 bp, human
gaaactgcttatctcacccg

SEQ ID NO: 73636 - DNA, 20 bp, human
gacccctctgctggcaagag

SEQ ID NO: 73637 - DNA, 20 bp, human
gtgccagcagaggggtaagg

SEQ ID NO: 73638 - DNA, 20 bp, human
ggagaggcatagggagccct

SEQ ID NO: 73639 - DNA, 20 bp, human
gtcccctcttgccagcagag

SEQ ID NO: 73640 - DNA, 20 bp, human
gatgaaaaggtaataggcca

SEQ ID NO: 73641 - DNA, 20 bp, human
ggagggccagacaccagcca

SEQ ID NO: 73642 - DNA, 20 bp, human
gaaggtaataggccaaggta

SEQ ID NO: 73643 - DNA, 20 bp, human
gtttagcgtgaggatgaatc

SEQ ID NO: 73644 - DNA, 20 bp, human
gggtgtgtggtggattggag

SEQ ID NO: 73645 - DNA, 20 bp, human
gagcttggaaatgcactata

SEQ ID NO: 73646 - DNA, 20 bp, human
gccggagcgcgagtgcacct

SEQ ID NO: 73647 - DNA, 20 bp, human
ggcgccaactgccccaactc

SEQ ID NO: 73648 - DNA, 20 bp, human
gggcggtggaggagcggcta

SEQ ID NO: 73649 - DNA, 20 bp, human
gtgcgtggtgaggaaagcgg

SEQ ID NO: 73650 - DNA, 20 bp, human
gggagctccgcgcgcgaagt

SEQ ID NO: 73651 - DNA, 20 bp, human
gggccgctgccaggcgccag

SEQ ID NO: 73652 - DNA, 20 bp, human
gagccgctggcgcctggcag

SEQ ID NO: 73653 - DNA, 20 bp, human
gctcgggtgcctgagatcgg

SEQ ID NO: 73654 - DNA, 20 bp, human
ggcgccaacgccacggccaa

SEQ ID NO: 73655 - DNA, 20 bp, human
gcgccagcggctcctagccg

SEQ ID NO: 73656 - DNA, 20 bp, human
ggcagcagcgacgccagcat

SEQ ID NO: 73657 - DNA, 20 bp, human
gtcgggatcgtcaggatcgt

SEQ ID NO: 73658 - DNA, 20 bp, human
gggagcgaagccgccatggc

SEQ ID NO: 73659 - DNA, 20 bp, human
gaaagccggctcccaggtcc

SEQ ID NO: 73660 - DNA, 20 bp, human
gcggagtcgcggctggggaa

SEQ ID NO: 73661 - DNA, 20 bp, human
gtggcgggtgccggccatgg

SEQ ID NO: 73662 - DNA, 20 bp, human
gtcttggcgggtgccggcca

SEQ ID NO: 73663 - DNA, 20 bp, human
ggctgaggcggccggagtcg

SEQ ID NO: 73664 - DNA, 20 bp, human
gcccatatgtgcggaaaagc

SEQ ID NO: 73665 - DNA, 20 bp, human
ggtccgcagccccatatgtg

SEQ ID NO: 73666 - DNA, 20 bp, human
ggctgggccgtgagtactag

SEQ ID NO: 73667 - DNA, 20 bp, human
gtactagtggcgcccgtgta

SEQ ID NO: 73668 - DNA, 20 bp, human
gcgggcgccactagtactca

SEQ ID NO: 73669 - DNA, 20 bp, human
ggagcggcgcggcctggaag

SEQ ID NO: 73670 - DNA, 20 bp, human
gagcccaagccagagcggcg

SEQ ID NO: 73671 - DNA, 20 bp, human
gcacggcccagcttcacccc

SEQ ID NO: 73672 - DNA, 20 bp, human
gggcccagcttcaccccggg

SEQ ID NO: 73673 - DNA, 20 bp, human
gccgtgtagggtggtgatta

SEQ ID NO: 73674 - DNA, 20 bp, human
gggccgcgccgctctggctt

SEQ ID NO: 73675 - DNA, 20 bp, human
gtggaagaggccagggcccg

SEQ ID NO: 73676 - DNA, 20 bp, human
gggagtcgcgagtcagtcag

SEQ ID NO: 73677 - DNA, 20 bp, human
gggcccggcgaactagaggg

SEQ ID NO: 73678 - DNA, 20 bp, human
gaggggcccggcgaactaga

SEQ ID NO: 73679 - DNA, 20 bp, human
gcgcccgggccaagtgacaa

SEQ ID NO: 73680 - DNA, 20 bp, human
ggtcgcgagtcagtcagagg

SEQ ID NO: 73681 - DNA, 20 bp, human
gtcctgacccgggcgaatgc

SEQ ID NO: 73682 - DNA, 20 bp, human
gctcctggcgcaatgaggag

SEQ ID NO: 73683 - DNA, 20 bp, human
gcacagagcagctcctgacc

SEQ ID NO: 73684 - DNA, 20 bp, human
gccggcgaactagagggcgg

SEQ ID NO: 73685 - DNA, 20 bp, human
gcgagtcagtcagaggcggg

SEQ ID NO: 73686 - DNA, 20 bp, human
gggcgactggagccgaccgg

SEQ ID NO: 73687 - DNA, 20 bp, human
gcgccgggcgcgcaggtgag

SEQ ID NO: 73688 - DNA, 20 bp, human
gtccagtcgcctccggagga

SEQ ID NO: 73689 - DNA, 20 bp, human
gctcttcttccttcctccgg

SEQ ID NO: 73690 - DNA, 20 bp, human
gcggctccagtcgcctccgg

SEQ ID NO: 73691 - DNA, 20 bp, human
gagcccctagcccttctcgg

SEQ ID NO: 73692 - DNA, 20 bp, human
ggaggggcggcccccgagaa

SEQ ID NO: 73693 - DNA, 20 bp, human
gcccgcgcccgtgttaagag

SEQ ID NO: 73694 - DNA, 20 bp, human
gcaatacctgaatgaggcgg

SEQ ID NO: 73695 - DNA, 20 bp, human
gggaggcgactggagccgac

SEQ ID NO: 73696 - DNA, 20 bp, human
gagtgccgcagcagcaggta

SEQ ID NO: 73697 - DNA, 20 bp, human
gggaccaccagctacggtct

SEQ ID NO: 73698 - DNA, 20 bp, human
gggtatcgtccaggaggcaa

SEQ ID NO: 73699 - DNA, 20 bp, human
gccaccagctacggtctggg

SEQ ID NO: 73700 - DNA, 20 bp, human
gtgctggggagtccactcag

SEQ ID NO: 73701 - DNA, 20 bp, human
ggcgcgggcgagataggacc

SEQ ID NO: 73702 - DNA, 20 bp, human
gtccaagggaccaaagagtg

SEQ ID NO: 73703 - DNA, 20 bp, human
gtgcaggggaccaccagcta

SEQ ID NO: 73704 - DNA, 20 bp, human
gggcacaggtatcgtccagg

SEQ ID NO: 73705 - DNA, 20 bp, human
gtcaggtgctagcagcacag

SEQ ID NO: 73706 - DNA, 20 bp, human
gtgactgagggaaggcggcg

SEQ ID NO: 73707 - DNA, 20 bp, human
gagctagcgacaaagatccc

SEQ ID NO: 73708 - DNA, 20 bp, human
gctcgcgacgacgacagagg

SEQ ID NO: 73709 - DNA, 20 bp, human
gacactcgcgacgacgacag

SEQ ID NO: 73710 - DNA, 20 bp, human
ggcgacgacgacagaggcgg

SEQ ID NO: 73711 - DNA, 20 bp, human
ggcgagtgtggagtcgggac

SEQ ID NO: 73712 - DNA, 20 bp, human
gtcgtcgcgagtgtggagtc

SEQ ID NO: 73713 - DNA, 20 bp, human
gaagatccccggcgtcgccg

SEQ ID NO: 73714 - DNA, 20 bp, human
gtggcggcgccgccaactgg

SEQ ID NO: 73715 - DNA, 20 bp, human
ggacagagagcgggaaatgg

SEQ ID NO: 73716 - DNA, 20 bp, human
ggcggcggcagcagcagata

SEQ ID NO: 73717 - DNA, 20 bp, human
ggctgcattcgcaactgcgg

SEQ ID NO: 73718 - DNA, 20 bp, human
gaaccttagctgcaccgcgg

SEQ ID NO: 73719 - DNA, 20 bp, human
ggatgctgcattcgcaactg

SEQ ID NO: 73720 - DNA, 20 bp, human
gtgagtcgggccccgcagga

SEQ ID NO: 73721 - DNA, 20 bp, human
gccggcgcgggataccctca

SEQ ID NO: 73722 - DNA, 20 bp, human
gggtaaaaggatgggacggg

SEQ ID NO: 73723 - DNA, 20 bp, human
ggcaagagcgaagggccaag

SEQ ID NO: 73724 - DNA, 20 bp, human
gggagggtgggcggctgagt

SEQ ID NO: 73725 - DNA, 20 bp, human
gtgggcctcggccaccgcag

SEQ ID NO: 73726 - DNA, 20 bp, human
gccgatcaccaggtagtcat

SEQ ID NO: 73727 - DNA, 20 bp, human
gccccgcccgaacaaaccgg

SEQ ID NO: 73728 - DNA, 20 bp, human
gtccgtgcggaagcagacgc

SEQ ID NO: 73729 - DNA, 20 bp, human
gctatggcgatcctgtcccc

SEQ ID NO: 73730 - DNA, 20 bp, human
gaggtagtcataggaggcca

SEQ ID NO: 73731 - DNA, 20 bp, human
gtcggaatggggagttgcgg

SEQ ID NO: 73732 - DNA, 20 bp, human
gaggagagagaggcgtccgg

SEQ ID NO: 73733 - DNA, 20 bp, human
gtcgccataggaacgagcac

SEQ ID NO: 73734 - DNA, 20 bp, human
gatcaccaggtagtcatagg

SEQ ID NO: 73735 - DNA, 20 bp, human
gagcttgtggctctccacca

SEQ ID NO: 73736 - DNA, 20 bp, human
ggggccgggagaaccgttcg

SEQ ID NO: 73737 - DNA, 20 bp, human
gagcctgggtagcggcgcga

SEQ ID NO: 73738 - DNA, 20 bp, human
gaggccccgaggcaacgaca

SEQ ID NO: 73739 - DNA, 20 bp, human
gggaggaaaggcgaactagt

SEQ ID NO: 73740 - DNA, 20 bp, human
gcccgaggcaacgacacggt

SEQ ID NO: 73741 - DNA, 20 bp, human
gccgggagaaccgttcgcgg

SEQ ID NO: 73742 - DNA, 20 bp, human
gcgacaccggcccgatctaa

SEQ ID NO: 73743 - DNA, 20 bp, human
gagaaccgttcgcggaggaa

SEQ ID NO: 73744 - DNA, 20 bp, human
gcgccgctacccaggctcag

SEQ ID NO: 73745 - DNA, 20 bp, human
gcgagcgggcccgtgaagtg

SEQ ID NO: 73746 - DNA, 20 bp, human
gttcagttgtcgagccagga

SEQ ID NO: 73747 - DNA, 20 bp, human
gttaaacgctgtcaccgtcc

SEQ ID NO: 73748 - DNA, 20 bp, human
gggaattcagttgtcgagcc

SEQ ID NO: 73749 - DNA, 20 bp, human
gtactcatattgtgccgtct

SEQ ID NO: 73750 - DNA, 20 bp, human
gtgtgccgtcttggtgtgct

SEQ ID NO: 73751 - DNA, 20 bp, human
gctgtgaaaatacaaaactc

SEQ ID NO: 73752 - DNA, 20 bp, human
gccattaaatgctgaagccc

SEQ ID NO: 73753 - DNA, 20 bp, human
gttctaggaggctagagagg

SEQ ID NO: 73754 - DNA, 20 bp, human
gtgacactgtaattctatat

SEQ ID NO: 73755 - DNA, 20 bp, human
gcatattagcatatttttct

SEQ ID NO: 73756 - DNA, 20 bp, human
gttcggttgtccagccacaa

SEQ ID NO: 73757 - DNA, 20 bp, human
gcatattagtgtatttttct

SEQ ID NO: 73758 - DNA, 20 bp, human
gttaaatgctgtcacctttg

SEQ ID NO: 73759 - DNA, 20 bp, human
gatgctgtcacctttgtggc

SEQ ID NO: 73760 - DNA, 20 bp, human
gaaaaattagtttgaatgtt

SEQ ID NO: 73761 - DNA, 20 bp, human
gggctggacaaccgaattcc

SEQ ID NO: 73762 - DNA, 20 bp, human
gaattagtttgaatgttagg

SEQ ID NO: 73763 - DNA, 20 bp, human
ggcctcagcatttaaaggta

SEQ ID NO: 73764 - DNA, 20 bp, human
gcaaactttttcttgtgcta

SEQ ID NO: 73765 - DNA, 20 bp, human
gttctaggaggctagagagg

SEQ ID NO: 73766 - DNA, 20 bp, human
gtagttcctgaaggacaggt

SEQ ID NO: 73767 - DNA, 20 bp, human
ggtgccaggccacatgccaa

SEQ ID NO: 73768 - DNA, 20 bp, human
gctggcagggtcacacattt

SEQ ID NO: 73769 - DNA, 20 bp, human
gaacttgagtaaagtctagc

SEQ ID NO: 73770 - DNA, 20 bp, human
ggtaagagtggtatcattgt

SEQ ID NO: 73771 - DNA, 20 bp, human
gaacagctaacatacacatc

SEQ ID NO: 73772 - DNA, 20 bp, human
gactagatttaaagctggca

SEQ ID NO: 73773 - DNA, 20 bp, human
gattcattcctgtgattcac

SEQ ID NO: 73774 - DNA, 20 bp, human
gattatactagatttaaagc

SEQ ID NO: 73775 - DNA, 20 bp, human
gcaacctttggcatgtggcc

SEQ ID NO: 73776 - DNA, 20 bp, human
gagacctggagtccactcgg

SEQ ID NO: 73777 - DNA, 20 bp, human
ggcacaaagcgccaggtcag

SEQ ID NO: 73778 - DNA, 20 bp, human
ggcggctccaggcctccgag

SEQ ID NO: 73779 - DNA, 20 bp, human
gagcgccaggtcagcggtcc

SEQ ID NO: 73780 - DNA, 20 bp, human
gaggcctccgagtggactcc

SEQ ID NO: 73781 - DNA, 20 bp, human
gagcccatgcaggggcgtag

SEQ ID NO: 73782 - DNA, 20 bp, human
ggaagggggcgaccgcagga

SEQ ID NO: 73783 - DNA, 20 bp, human
gagagagaaagggcgaggaa

SEQ ID NO: 73784 - DNA, 20 bp, human
gtgccgctacgcccctgcat

SEQ ID NO: 73785 - DNA, 20 bp, human
ggccttgtaaaacgagccgg

SEQ ID NO: 73786 - DNA, 20 bp, human
gtaaggtacctcgactccgg

SEQ ID NO: 73787 - DNA, 20 bp, human
gccatccggcctcttccgtt

SEQ ID NO: 73788 - DNA, 20 bp, human
gaaagcctgaaaagctatca

SEQ ID NO: 73789 - DNA, 20 bp, human
ggcctcttccgttgggatag

SEQ ID NO: 73790 - DNA, 20 bp, human
gtctcgtccaccaaaatcac

SEQ ID NO: 73791 - DNA, 20 bp, human
ggacgagaactagaactgaa

SEQ ID NO: 73792 - DNA, 20 bp, human
gtccactatcccaacggaag

SEQ ID NO: 73793 - DNA, 20 bp, human
ggcagctaaaacccatctca

SEQ ID NO: 73794 - DNA, 20 bp, human
gccatctcacggactccatc

SEQ ID NO: 73795 - DNA, 20 bp, human
gatataaggtacctcgactc

SEQ ID NO: 73796 - DNA, 20 bp, human
gggctagagaggagcatgtg

SEQ ID NO: 73797 - DNA, 20 bp, human
gagcatgtgaggcaatgtag

SEQ ID NO: 73798 - DNA, 20 bp, human
gtgatcctgtaatactatat

SEQ ID NO: 73799 - DNA, 20 bp, human
gctctgtcactgtcgtggct

SEQ ID NO: 73800 - DNA, 20 bp, human
gacagccaatatagtattac

SEQ ID NO: 73801 - DNA, 20 bp, human
gttaaactctgtcactgtcg

SEQ ID NO: 73802 - DNA, 20 bp, human
gattagcatatttttctggg

SEQ ID NO: 73803 - DNA, 20 bp, human
gaattagtttgaatgtcagg

SEQ ID NO: 73804 - DNA, 20 bp, human
gcatattagcatatttttct

SEQ ID NO: 73805 - DNA, 20 bp, human
ggtgccatcttggtgtgttt

SEQ ID NO: 73806 - DNA, 20 bp, human
gaattagctgttttcttatc

SEQ ID NO: 73807 - DNA, 20 bp, human
ggtaatctctctggagaatc

SEQ ID NO: 73808 - DNA, 20 bp, human
gtccgccggattatgaatga

SEQ ID NO: 73809 - DNA, 20 bp, human
gggagtttgaggcggcccca

SEQ ID NO: 73810 - DNA, 20 bp, human
gcccgcaccttcagcaggag

SEQ ID NO: 73811 - DNA, 20 bp, human
ggtttgaggcggccccaggg

SEQ ID NO: 73812 - DNA, 20 bp, human
gccaggtaaagagggcgctc

SEQ ID NO: 73813 - DNA, 20 bp, human
ggactggctagggggaaact

SEQ ID NO: 73814 - DNA, 20 bp, human
gccagggcgggagaaaaatc

SEQ ID NO: 73815 - DNA, 20 bp, human
ggccgtcattcataatccgg

SEQ ID NO: 73816 - DNA, 20 bp, human
gacgtcatagaagagctcca

SEQ ID NO: 73817 - DNA, 20 bp, human
gccatcgttgggctaagagg

SEQ ID NO: 73818 - DNA, 20 bp, human
ggccacaggagcgaagatcc

SEQ ID NO: 73819 - DNA, 20 bp, human
gagaagagctccacggtgcg

SEQ ID NO: 73820 - DNA, 20 bp, human
gctgcttgccttaacccctt

SEQ ID NO: 73821 - DNA, 20 bp, human
gctgccatcgttgggctaag

SEQ ID NO: 73822 - DNA, 20 bp, human
gcttgccttaaccccttggg

SEQ ID NO: 73823 - DNA, 20 bp, human
gagctccacggtgcgcggca

SEQ ID NO: 73824 - DNA, 20 bp, human
gcttccggagcctgcagcat

SEQ ID NO: 73825 - DNA, 20 bp, human
ggtgcagagcaggggttatg

SEQ ID NO: 73826 - DNA, 20 bp, human
ggtataagagctccggagag

SEQ ID NO: 73827 - DNA, 20 bp, human
gccgctggacggtgggacga

SEQ ID NO: 73828 - DNA, 20 bp, human
gcccagtaccccagtatcat

SEQ ID NO: 73829 - DNA, 20 bp, human
ggacaggcctaaaccgagca

SEQ ID NO: 73830 - DNA, 20 bp, human
ggggcagagcccgaacacga

SEQ ID NO: 73831 - DNA, 20 bp, human
gctcggtttaggcctgtctg

SEQ ID NO: 73832 - DNA, 20 bp, human
ggccccgcctgtcccctctc

SEQ ID NO: 73833 - DNA, 20 bp, human
gagagctccggagaggggac

SEQ ID NO: 73834 - DNA, 20 bp, human
gagctgcgggacggactcta

SEQ ID NO: 73835 - DNA, 20 bp, human
gtgagcgagggtccgctgga

SEQ ID NO: 73836 - DNA, 20 bp, human
gcagccacacgcacagacag

SEQ ID NO: 73837 - DNA, 20 bp, human
ggtgccaacttagtgtgagg

SEQ ID NO: 73838 - DNA, 20 bp, human
ggggcagggcccagactcga

SEQ ID NO: 73839 - DNA, 20 bp, human
ggggtgagccagggtccgct

SEQ ID NO: 73840 - DNA, 20 bp, human
gctgccccctcacactaagt

SEQ ID NO: 73841 - DNA, 20 bp, human
gcagacaggcctcagcgggg

SEQ ID NO: 73842 - DNA, 20 bp, human
ggtgaggcaggaacgagagg

SEQ ID NO: 73843 - DNA, 20 bp, human
gtaatggcaccctcgagtct

SEQ ID NO: 73844 - DNA, 20 bp, human
ggagagatggcccacagctc

SEQ ID NO: 73845 - DNA, 20 bp, human
gggcaccaagcaaccgatag

SEQ ID NO: 73846 - DNA, 20 bp, human
gtgagagatagccctaagga

SEQ ID NO: 73847 - DNA, 20 bp, human
gcctgtgagagatagcccta

SEQ ID NO: 73848 - DNA, 20 bp, human
gttgctccctgaacactcgg

SEQ ID NO: 73849 - DNA, 20 bp, human
gtggggttcccggcacgcag

SEQ ID NO: 73850 - DNA, 20 bp, human
gtggggaccggctctaggga

SEQ ID NO: 73851 - DNA, 20 bp, human
gaaggtccggaagcactagg

SEQ ID NO: 73852 - DNA, 20 bp, human
gcaggttgctggatcctcac

SEQ ID NO: 73853 - DNA, 20 bp, human
gagcaaggtccggaagcact

SEQ ID NO: 73854 - DNA, 20 bp, human
gtgaactgcgacctcctctg

SEQ ID NO: 73855 - DNA, 20 bp, human
ggaacactcggaggtggcgg

SEQ ID NO: 73856 - DNA, 20 bp, human
gacagggcccgcgatcccag

SEQ ID NO: 73857 - DNA, 20 bp, human
gactcgcacgacatggtgac

SEQ ID NO: 73858 - DNA, 20 bp, human
gtccgagccttcgaggacta

SEQ ID NO: 73859 - DNA, 20 bp, human
gggatggcgtgcgccagctg

SEQ ID NO: 73860 - DNA, 20 bp, human
gatagacgactcgcacgaca

SEQ ID NO: 73861 - DNA, 20 bp, human
gcgggtactgggatattcgt

SEQ ID NO: 73862 - DNA, 20 bp, human
gcgagtcgtctatggttctc

SEQ ID NO: 73863 - DNA, 20 bp, human
ggcccgcgatcccagaggct

SEQ ID NO: 73864 - DNA, 20 bp, human
gagcggctctaccgttgaga

SEQ ID NO: 73865 - DNA, 20 bp, human
ggtggctcggcagctcgaaa

SEQ ID NO: 73866 - DNA, 20 bp, human
gcaggttgctggatcctcac

SEQ ID NO: 73867 - DNA, 20 bp, human
gtgagagatagccctaagga

SEQ ID NO: 73868 - DNA, 20 bp, human
gcctgtgagagatagcccta

SEQ ID NO: 73869 - DNA, 20 bp, human
gttgctccctgaacactcgg

SEQ ID NO: 73870 - DNA, 20 bp, human
gtgaactgcgacctcctctg

SEQ ID NO: 73871 - DNA, 20 bp, human
gtggggttcccggcacgcag

SEQ ID NO: 73872 - DNA, 20 bp, human
gtggggaccggctctaggga

SEQ ID NO: 73873 - DNA, 20 bp, human
gtccaaccaacaggcgcggg

SEQ ID NO: 73874 - DNA, 20 bp, human
ggaacactcggaggtggcgg

SEQ ID NO: 73875 - DNA, 20 bp, human
gtggatcctcactggctgga

SEQ ID NO: 73876 - DNA, 20 bp, human
gtaagcgagggtcctctggt

SEQ ID NO: 73877 - DNA, 20 bp, human
gcagacaggcatcagcggag

SEQ ID NO: 73878 - DNA, 20 bp, human
ggtacgtgcagtatagacta

SEQ ID NO: 73879 - DNA, 20 bp, human
ggcggggctcagactttgag

SEQ ID NO: 73880 - DNA, 20 bp, human
gaggaccctcgcttacccca

SEQ ID NO: 73881 - DNA, 20 bp, human
ggggcagggcccggacacga

SEQ ID NO: 73882 - DNA, 20 bp, human
gacatccgtggggtaagcga

SEQ ID NO: 73883 - DNA, 20 bp, human
ggtggaaaagaagtacacgc

SEQ ID NO: 73884 - DNA, 20 bp, human
gcgagggtcctctggtgggt

SEQ ID NO: 73885 - DNA, 20 bp, human
gtgcagtatagactaggggc

SEQ ID NO: 73886 - DNA, 20 bp, human
gcgcaggccgagctcctctg

SEQ ID NO: 73887 - DNA, 20 bp, human
gcctgcagcaggctcccgga

SEQ ID NO: 73888 - DNA, 20 bp, human
gaaggccaagggaatcaggt

SEQ ID NO: 73889 - DNA, 20 bp, human
gcgctgcgccacgatgtccg

SEQ ID NO: 73890 - DNA, 20 bp, human
gcaggtgggcacccaggcgg

SEQ ID NO: 73891 - DNA, 20 bp, human
ggagctgcagtgggacgcgg

SEQ ID NO: 73892 - DNA, 20 bp, human
gatgggacaaagacaggtct

SEQ ID NO: 73893 - DNA, 20 bp, human
gtggagagaacgctctggac

SEQ ID NO: 73894 - DNA, 20 bp, human
gaggcgattacggcccagag

SEQ ID NO: 73895 - DNA, 20 bp, human
gaatcccctgcaaaccccag

SEQ ID NO: 73896 - DNA, 20 bp, human
ggaggctagtcagcccggtg

SEQ ID NO: 73897 - DNA, 20 bp, human
gcctgcagagcagcgatgga

SEQ ID NO: 73898 - DNA, 20 bp, human
ggcgggtcctgtgagaatag

SEQ ID NO: 73899 - DNA, 20 bp, human
ggagcgagctccttcctcac

SEQ ID NO: 73900 - DNA, 20 bp, human
gcccagggccagtcccggag

SEQ ID NO: 73901 - DNA, 20 bp, human
ggcttcctgcagagcagcga

SEQ ID NO: 73902 - DNA, 20 bp, human
gtgcaggaagccagccccca

SEQ ID NO: 73903 - DNA, 20 bp, human
gggtaaggcctcagtagtgt

SEQ ID NO: 73904 - DNA, 20 bp, human
gtctgtggagcagtcaggta

SEQ ID NO: 73905 - DNA, 20 bp, human
gaaggagaggctagtcagcc

SEQ ID NO: 73906 - DNA, 20 bp, human
gggccgcgcgtactcactgg

SEQ ID NO: 73907 - DNA, 20 bp, human
gtcactggtggcgaagactg

SEQ ID NO: 73908 - DNA, 20 bp, human
ggcgggccgcgcgtactcac

SEQ ID NO: 73909 - DNA, 20 bp, human
gctggtggcgaagactgcgg

SEQ ID NO: 73910 - DNA, 20 bp, human
gggttcggatctctccgggt

SEQ ID NO: 73911 - DNA, 20 bp, human
gcacacgacggagggataag

SEQ ID NO: 73912 - DNA, 20 bp, human
gcggggtaaaagccacacga

SEQ ID NO: 73913 - DNA, 20 bp, human
gcgaggtaggagcatgtgtc

SEQ ID NO: 73914 - DNA, 20 bp, human
gcggcctccgagccttataa

SEQ ID NO: 73915 - DNA, 20 bp, human
gagctctgagccccatcccc

SEQ ID NO: 73916 - DNA, 20 bp, human
gtacagctccaggcccatag

SEQ ID NO: 73917 - DNA, 20 bp, human
ggtcggtcggtccccactat

SEQ ID NO: 73918 - DNA, 20 bp, human
gcgacctgaccggaaaccag

SEQ ID NO: 73919 - DNA, 20 bp, human
gcaggtccaggtacagctcc

SEQ ID NO: 73920 - DNA, 20 bp, human
gcagacaggaggacaaaaac

SEQ ID NO: 73921 - DNA, 20 bp, human
gcccctgaggccgaataaag

SEQ ID NO: 73922 - DNA, 20 bp, human
gggggaccgaccgacctgac

SEQ ID NO: 73923 - DNA, 20 bp, human
gggcaaagatgtaaacagcg

SEQ ID NO: 73924 - DNA, 20 bp, human
gtaaacagcgcggcagggct

SEQ ID NO: 73925 - DNA, 20 bp, human
gcagggagatccaagagtcg

SEQ ID NO: 73926 - DNA, 20 bp, human
gtctaggcccatggcggggg

SEQ ID NO: 73927 - DNA, 20 bp, human
gacagcggggatggcagtga

SEQ ID NO: 73928 - DNA, 20 bp, human
gagctctaggcccatggcgg

SEQ ID NO: 73929 - DNA, 20 bp, human
gtccttgccgcccccgccat

SEQ ID NO: 73930 - DNA, 20 bp, human
gcaggtcaagaaacagctct

SEQ ID NO: 73931 - DNA, 20 bp, human
gcacggtgcgcagctctaag

SEQ ID NO: 73932 - DNA, 20 bp, human
gagcagctgtggcaggatcc

SEQ ID NO: 73933 - DNA, 20 bp, human
ggcgggcggcgagacgctca

SEQ ID NO: 73934 - DNA, 20 bp, human
gcttcttcccgaggtcttct

SEQ ID NO: 73935 - DNA, 20 bp, human
gagaaacagctctaggccca

SEQ ID NO: 73936 - DNA, 20 bp, human
gtctaggcccatggcggggg

SEQ ID NO: 73937 - DNA, 20 bp, human
gacagcggggatggcagtga

SEQ ID NO: 73938 - DNA, 20 bp, human
gagctctaggcccatggcgg

SEQ ID NO: 73939 - DNA, 20 bp, human
gtccttgccgcccccgccat

SEQ ID NO: 73940 - DNA, 20 bp, human
gcacggtgcgcagctctaag

SEQ ID NO: 73941 - DNA, 20 bp, human
gcaggtcaagaaacagctct

SEQ ID NO: 73942 - DNA, 20 bp, human
gacaaagcccagaagacctc

SEQ ID NO: 73943 - DNA, 20 bp, human
gcttcttcccgaggtcttct

SEQ ID NO: 73944 - DNA, 20 bp, human
ggcgggcggcgagacgctca

SEQ ID NO: 73945 - DNA, 20 bp, human
gagaaacagctctaggccca

SEQ ID NO: 73946 - DNA, 20 bp, human
gtgggacctgccgacgacta

SEQ ID NO: 73947 - DNA, 20 bp, human
gttacccggacgaaagacac

SEQ ID NO: 73948 - DNA, 20 bp, human
ggaagccttagtggagggag

SEQ ID NO: 73949 - DNA, 20 bp, human
gttcgtccgggtaaagcgag

SEQ ID NO: 73950 - DNA, 20 bp, human
gagggctgcgagaaattggg

SEQ ID NO: 73951 - DNA, 20 bp, human
gctcactgagccttagtcgt

SEQ ID NO: 73952 - DNA, 20 bp, human
gtagggagtgcgtagcaggg

SEQ ID NO: 73953 - DNA, 20 bp, human
gtgaagggctgcgagaaatt

SEQ ID NO: 73954 - DNA, 20 bp, human
gcgagccagaggcgaccgga

SEQ ID NO: 73955 - DNA, 20 bp, human
gcgacgtttggaagccttag

SEQ ID NO: 73956 - DNA, 20 bp, human
ggtactgcgagccgaagggt

SEQ ID NO: 73957 - DNA, 20 bp, human
ggaacgcgcggctgagacct

SEQ ID NO: 73958 - DNA, 20 bp, human
gggcagtactgcgagccgaa

SEQ ID NO: 73959 - DNA, 20 bp, human
gcagtagcctctgctgccgt

SEQ ID NO: 73960 - DNA, 20 bp, human
gaggcttccttcccaccctt

SEQ ID NO: 73961 - DNA, 20 bp, human
ggcgagaagaaggcgcccga

SEQ ID NO: 73962 - DNA, 20 bp, human
ggccgcgcgttcagcctcct

SEQ ID NO: 73963 - DNA, 20 bp, human
ggcaccccgcgctctttggg

SEQ ID NO: 73964 - DNA, 20 bp, human
ggctctttgggcggtgccca

SEQ ID NO: 73965 - DNA, 20 bp, human
gactagcgagtccaccagga

SEQ ID NO: 73966 - DNA, 20 bp, human
gcaagcccttggggacgcag

SEQ ID NO: 73967 - DNA, 20 bp, human
ggcgcccacagacccccgag

SEQ ID NO: 73968 - DNA, 20 bp, human
gtgaggaccagccctctccg

SEQ ID NO: 73969 - DNA, 20 bp, human
ggcacctgcactcctctcgg

SEQ ID NO: 73970 - DNA, 20 bp, human
gcgtgtctgcgcggctccca

SEQ ID NO: 73971 - DNA, 20 bp, human
ggtgcgaagtgacgcagaga

SEQ ID NO: 73972 - DNA, 20 bp, human
gcgcagaggtgttggcgtct

SEQ ID NO: 73973 - DNA, 20 bp, human
gaccggggccggaggcagtg

SEQ ID NO: 73974 - DNA, 20 bp, human
gacacggacatcaccaatgg

SEQ ID NO: 73975 - DNA, 20 bp, human
ggagcgcgacatgtcgagag

SEQ ID NO: 73976 - DNA, 20 bp, human
gtcgcgcaggctgagaggac

SEQ ID NO: 73977 - DNA, 20 bp, human
gctgcgcggagatcccagag

SEQ ID NO: 73978 - DNA, 20 bp, human
gaggctgagaggacgggtgg

SEQ ID NO: 73979 - DNA, 20 bp, human
gccctcgcgcgggagaaggg

SEQ ID NO: 73980 - DNA, 20 bp, human
gtcgccctcgcgcgggagaa

SEQ ID NO: 73981 - DNA, 20 bp, human
ggaggaggtgagtaggctcc

SEQ ID NO: 73982 - DNA, 20 bp, human
gcttcctcgcgcaggctgag

SEQ ID NO: 73983 - DNA, 20 bp, human
ggaagggaggccgggcgtcc

SEQ ID NO: 73984 - DNA, 20 bp, human
gcagccaactcaggccaacc

SEQ ID NO: 73985 - DNA, 20 bp, human
ggaggaagaagcggagcgcc

SEQ ID NO: 73986 - DNA, 20 bp, human
ggagaagcgggcggaccgga

SEQ ID NO: 73987 - DNA, 20 bp, human
gggtggctcgcgcagcttgt

SEQ ID NO: 73988 - DNA, 20 bp, human
gttgttggctcgctatataa

SEQ ID NO: 73989 - DNA, 20 bp, human
gcgcagggagcggtgaccgg

SEQ ID NO: 73990 - DNA, 20 bp, human
gctgcagcaacggccggacc

SEQ ID NO: 73991 - DNA, 20 bp, human
ggcctgaacgaagcccccgc

SEQ ID NO: 73992 - DNA, 20 bp, human
gccgaaccacgtccttacca

SEQ ID NO: 73993 - DNA, 20 bp, human
gaaacaccgtggtaaggacg

SEQ ID NO: 73994 - DNA, 20 bp, human
gtcggcaaatacaaacaccg

SEQ ID NO: 73995 - DNA, 20 bp, human
gacacaacacaaacaagagg

SEQ ID NO: 73996 - DNA, 20 bp, human
gatggcctgcctcaacccgg

SEQ ID NO: 73997 - DNA, 20 bp, human
gctgcctcaacccggtggta

SEQ ID NO: 73998 - DNA, 20 bp, human
gtccctctacacagagcctg

SEQ ID NO: 73999 - DNA, 20 bp, human
ggacctcaggctctgtgtag

SEQ ID NO: 74000 - DNA, 20 bp, human
ggccctcggagggaaacact

SEQ ID NO: 74001 - DNA, 20 bp, human
gtgaggtcttccttaccacc

SEQ ID NO: 74002 - DNA, 20 bp, human
gaaagacactaaaaacatgt

SEQ ID NO: 74003 - DNA, 20 bp, human
ggggagcgccctgggactcc

SEQ ID NO: 74004 - DNA, 20 bp, human
gtgacagcacctccagcacc

SEQ ID NO: 74005 - DNA, 20 bp, human
gtgttggaggaagctgctga

SEQ ID NO: 74006 - DNA, 20 bp, human
ggagtcggagtgcgttggtg

SEQ ID NO: 74007 - DNA, 20 bp, human
gcgcggggccttgccggcaa

SEQ ID NO: 74008 - DNA, 20 bp, human
ggagaggtggtcggagaagt

SEQ ID NO: 74009 - DNA, 20 bp, human
ggcccacagaacccacctag

SEQ ID NO: 74010 - DNA, 20 bp, human
gcacctggctgaaaatacgg

SEQ ID NO: 74011 - DNA, 20 bp, human
gggtcgtcagctcagttctg

SEQ ID NO: 74012 - DNA, 20 bp, human
gacagaagccgccacgagcc

SEQ ID NO: 74013 - DNA, 20 bp, human
ggaagtaggaacctcctgcc

SEQ ID NO: 74014 - DNA, 20 bp, human
gtgggctgaagacctcccct

SEQ ID NO: 74015 - DNA, 20 bp, human
gcacagaacccacctagggg

SEQ ID NO: 74016 - DNA, 20 bp, human
gctcggcgggacatactaac

SEQ ID NO: 74017 - DNA, 20 bp, human
ggcgggacatactaaccggc

SEQ ID NO: 74018 - DNA, 20 bp, human
ggcctccgggcagcctcgta

SEQ ID NO: 74019 - DNA, 20 bp, human
ggccatcttcacggcgactg

SEQ ID NO: 74020 - DNA, 20 bp, human
gctggtagacgccatcttca

SEQ ID NO: 74021 - DNA, 20 bp, human
gtacggcccaaacaacccga

SEQ ID NO: 74022 - DNA, 20 bp, human
gccagacggcaggactgtca

SEQ ID NO: 74023 - DNA, 20 bp, human
ggcccaccaggacccacata

SEQ ID NO: 74024 - DNA, 20 bp, human
gaccgcagtcgccgtgaaga

SEQ ID NO: 74025 - DNA, 20 bp, human
gggagaaattacggaccctc

SEQ ID NO: 74026 - DNA, 20 bp, human
ggtcgcacacgggccgctcc

SEQ ID NO: 74027 - DNA, 20 bp, human
gcccccagcgcttcaactac

SEQ ID NO: 74028 - DNA, 20 bp, human
gccgtgtgcgacctcgggta

SEQ ID NO: 74029 - DNA, 20 bp, human
gggccagggaactccgaaca

SEQ ID NO: 74030 - DNA, 20 bp, human
ggaacaaggaacagggaaca

SEQ ID NO: 74031 - DNA, 20 bp, human
ggccggtagttgaagcgctg

SEQ ID NO: 74032 - DNA, 20 bp, human
gaccgaacgcgtctcgtgga

SEQ ID NO: 74033 - DNA, 20 bp, human
gttccttgttcggagttccc

SEQ ID NO: 74034 - DNA, 20 bp, human
ggcggcccgtgtgcgacctc

SEQ ID NO: 74035 - DNA, 20 bp, human
gcccaactgggagagtccga

SEQ ID NO: 74036 - DNA, 20 bp, human
ggcccctacctgagtgagaa

SEQ ID NO: 74037 - DNA, 20 bp, human
ggcacccgatcgggaagtgg

SEQ ID NO: 74038 - DNA, 20 bp, human
gcaggtcggggtctcaccac

SEQ ID NO: 74039 - DNA, 20 bp, human
ggagggtgcagtgccggcgt

SEQ ID NO: 74040 - DNA, 20 bp, human
ggagctcctagcacccgatc

SEQ ID NO: 74041 - DNA, 20 bp, human
gtgaggcggcgactggaccc

SEQ ID NO: 74042 - DNA, 20 bp, human
ggtctcaccactggcggtgg

SEQ ID NO: 74043 - DNA, 20 bp, human
gcgaggcggaggcgcaggaa

SEQ ID NO: 74044 - DNA, 20 bp, human
gctagcacccgatcgggaag

SEQ ID NO: 74045 - DNA, 20 bp, human
ggcctaaagacaatgctccg

SEQ ID NO: 74046 - DNA, 20 bp, human
ggagcgaggaccccaaccct

SEQ ID NO: 74047 - DNA, 20 bp, human
ggccagaggcgcctagggtt

SEQ ID NO: 74048 - DNA, 20 bp, human
gccagcgccagaggcgccta

SEQ ID NO: 74049 - DNA, 20 bp, human
gctccagaccgggagagact

SEQ ID NO: 74050 - DNA, 20 bp, human
gacagagacccgacaccgag

SEQ ID NO: 74051 - DNA, 20 bp, human
gccccaaccctaggcgcctc

SEQ ID NO: 74052 - DNA, 20 bp, human
ggagacccgacaccgagcgg

SEQ ID NO: 74053 - DNA, 20 bp, human
gcagggctgggattaagctg

SEQ ID NO: 74054 - DNA, 20 bp, human
gctccaagtctctcccggtc

SEQ ID NO: 74055 - DNA, 20 bp, human
gggaagccgccgctcggtgt

SEQ ID NO: 74056 - DNA, 20 bp, human
ggcggggaactcgacttgac

SEQ ID NO: 74057 - DNA, 20 bp, human
ggcgctgagaggcgaagagc

SEQ ID NO: 74058 - DNA, 20 bp, human
ggagcgggcgtccggaacaa

SEQ ID NO: 74059 - DNA, 20 bp, human
gtcctcggttcccagtgttc

SEQ ID NO: 74060 - DNA, 20 bp, human
gcagtgcgcaggcgcagtcc

SEQ ID NO: 74061 - DNA, 20 bp, human
ggcagattcagagtagtaac

SEQ ID NO: 74062 - DNA, 20 bp, human
gccttacctgccagaacact

SEQ ID NO: 74063 - DNA, 20 bp, human
gccggcgccaaacagaacac

SEQ ID NO: 74064 - DNA, 20 bp, human
gaaggacaagccgcgctgag

SEQ ID NO: 74065 - DNA, 20 bp, human
gtgagaaagagatctagtcc

SEQ ID NO: 74066 - DNA, 20 bp, human
gcgagaccccctagtaacag

SEQ ID NO: 74067 - DNA, 20 bp, human
gaccgaagaatgcaggcggg

SEQ ID NO: 74068 - DNA, 20 bp, human
gggaagaggccgaaacccag

SEQ ID NO: 74069 - DNA, 20 bp, human
gcaccgcctctgttactagg

SEQ ID NO: 74070 - DNA, 20 bp, human
gacagcgacgctgggaacag

SEQ ID NO: 74071 - DNA, 20 bp, human
gccaaagccaggatcagatt

SEQ ID NO: 74072 - DNA, 20 bp, human
gagaatgcaggcgggcgggt

SEQ ID NO: 74073 - DNA, 20 bp, human
ggcacatttcctgacgggaa

SEQ ID NO: 74074 - DNA, 20 bp, human
gcgggaagggcttctctgtc

SEQ ID NO: 74075 - DNA, 20 bp, human
gggggtctcgcctccatcgc

SEQ ID NO: 74076 - DNA, 20 bp, human
gagaggtggggcaggccgtc

SEQ ID NO: 74077 - DNA, 20 bp, human
gtctgtgaggcgcagaggtg

SEQ ID NO: 74078 - DNA, 20 bp, human
gggccgtctggctagctagg

SEQ ID NO: 74079 - DNA, 20 bp, human
gtaacgggaatcacaccagt

SEQ ID NO: 74080 - DNA, 20 bp, human
gccgcgtgtggaagtctgtg

SEQ ID NO: 74081 - DNA, 20 bp, human
gttccctatgagcccaggca

SEQ ID NO: 74082 - DNA, 20 bp, human
gggaagtctgtgaggcgcag

SEQ ID NO: 74083 - DNA, 20 bp, human
gcaccagtaggcttatgctg

SEQ ID NO: 74084 - DNA, 20 bp, human
gtgccctgcctgggctcata

SEQ ID NO: 74085 - DNA, 20 bp, human
ggtatgggattcaggctcag

SEQ ID NO: 74086 - DNA, 20 bp, human
gagccgcctagctagtcaga

SEQ ID NO: 74087 - DNA, 20 bp, human
ggcaggccgtctgactagct

SEQ ID NO: 74088 - DNA, 20 bp, human
gcggctgagagtccttctag

SEQ ID NO: 74089 - DNA, 20 bp, human
gtctgtgaggcgcagaggtg

SEQ ID NO: 74090 - DNA, 20 bp, human
gccgcgtgtggaagtctgtg

SEQ ID NO: 74091 - DNA, 20 bp, human
gcttccacacgcggactcac

SEQ ID NO: 74092 - DNA, 20 bp, human
gagcggcggagaggagtgtc

SEQ ID NO: 74093 - DNA, 20 bp, human
gggaagtctgtgaggcgcag

SEQ ID NO: 74094 - DNA, 20 bp, human
gtaacgggaatcacaccagt

SEQ ID NO: 74095 - DNA, 20 bp, human
gggccgtctgactagctagg

SEQ ID NO: 74096 - DNA, 20 bp, human
gagccgcctagctagtcaga

SEQ ID NO: 74097 - DNA, 20 bp, human
ggcaggccgtctgactagct

SEQ ID NO: 74098 - DNA, 20 bp, human
gcggctgagagtccttctag

SEQ ID NO: 74099 - DNA, 20 bp, human
gtctgtgaggcgcagaggtg

SEQ ID NO: 74100 - DNA, 20 bp, human
gccgcgtgtggaagtctgtg

SEQ ID NO: 74101 - DNA, 20 bp, human
gcttccacacgcggactcac

SEQ ID NO: 74102 - DNA, 20 bp, human
gagcggcggagaggagtgtc

SEQ ID NO: 74103 - DNA, 20 bp, human
gggaagtctgtgaggcgcag

SEQ ID NO: 74104 - DNA, 20 bp, human
gtaacgggaatcacaccagt

SEQ ID NO: 74105 - DNA, 20 bp, human
gggccgtctgactagctagg

SEQ ID NO: 74106 - DNA, 20 bp, human
ggaccgagacagccgagccc

SEQ ID NO: 74107 - DNA, 20 bp, human
ggtcgaagtcccgccctgca

SEQ ID NO: 74108 - DNA, 20 bp, human
gagacggtgaggaccctgca

SEQ ID NO: 74109 - DNA, 20 bp, human
gcagagcaagtggtggtcag

SEQ ID NO: 74110 - DNA, 20 bp, human
ggccatggtttcagacggtg

SEQ ID NO: 74111 - DNA, 20 bp, human
gtggatcgcctcctgtgtac

SEQ ID NO: 74112 - DNA, 20 bp, human
gtcctcaccgtctgaaacca

SEQ ID NO: 74113 - DNA, 20 bp, human
gcagagatcgtgacagacag

SEQ ID NO: 74114 - DNA, 20 bp, human
gcagggcgggacttcgactc

SEQ ID NO: 74115 - DNA, 20 bp, human
gtgctctgcgctgaggtgct

SEQ ID NO: 74116 - DNA, 20 bp, human
ggaggatcgacagagtggtg

SEQ ID NO: 74117 - DNA, 20 bp, human
gagactcggggtgcgcgagg

SEQ ID NO: 74118 - DNA, 20 bp, human
gcgccgtacttagcagaagt

SEQ ID NO: 74119 - DNA, 20 bp, human
gagatttgggaagcatggag

SEQ ID NO: 74120 - DNA, 20 bp, human
gagcccacttctgctaagta

SEQ ID NO: 74121 - DNA, 20 bp, human
ggcgaggaggatcgacagag

SEQ ID NO: 74122 - DNA, 20 bp, human
gagtggtgaggggacctagg

SEQ ID NO: 74123 - DNA, 20 bp, human
gagactggtctgaccaggat

SEQ ID NO: 74124 - DNA, 20 bp, human
gtgaggggacctaggagggc

SEQ ID NO: 74125 - DNA, 20 bp, human
gagcgacggcccgagactcg

SEQ ID NO: 74126 - DNA, 20 bp, human
gtgtgtggcgagcgtccgag

SEQ ID NO: 74127 - DNA, 20 bp, human
gggacgctcgccacacacct

SEQ ID NO: 74128 - DNA, 20 bp, human
gatctgtgggccgaggtgtg

SEQ ID NO: 74129 - DNA, 20 bp, human
gcactctgccggcaacgccg

SEQ ID NO: 74130 - DNA, 20 bp, human
gcggcgcaggcgcactctgc

SEQ ID NO: 74131 - DNA, 20 bp, human
ggtggggtgtgggaacactg

SEQ ID NO: 74132 - DNA, 20 bp, human
gggaagggcccggagagagt

SEQ ID NO: 74133 - DNA, 20 bp, human
gtaatcgtgggtttcctgtg

SEQ ID NO: 74134 - DNA, 20 bp, human
gttcctttggccaggaacta

SEQ ID NO: 74135 - DNA, 20 bp, human
gccctagcgcgatggcgtat

SEQ ID NO: 74136 - DNA, 20 bp, human
ggagcgcgaccgacacgcac

SEQ ID NO: 74137 - DNA, 20 bp, human
ggcgaggggcccgtgcgtgt

SEQ ID NO: 74138 - DNA, 20 bp, human
ggaagcgggggggcgaccgg

SEQ ID NO: 74139 - DNA, 20 bp, human
gtccgatcactgggggacag

SEQ ID NO: 74140 - DNA, 20 bp, human
ggcagaggccggggtgaccg

SEQ ID NO: 74141 - DNA, 20 bp, human
gagagggactcacccgagtg

SEQ ID NO: 74142 - DNA, 20 bp, human
ggccttgatccgatcactgg

SEQ ID NO: 74143 - DNA, 20 bp, human
gtcccccagtgatcggatca

SEQ ID NO: 74144 - DNA, 20 bp, human
ggcccacactcgcctcccct

SEQ ID NO: 74145 - DNA, 20 bp, human
gcctggaggcggccgcactc

SEQ ID NO: 74146 - DNA, 20 bp, human
gcccagtcacgtgcctcccc

SEQ ID NO: 74147 - DNA, 20 bp, human
gcggaggcggaggggatcgg

SEQ ID NO: 74148 - DNA, 20 bp, human
ggaagagccggtggcaagga

SEQ ID NO: 74149 - DNA, 20 bp, human
gagcgcttggggatcctcca

SEQ ID NO: 74150 - DNA, 20 bp, human
gccacctccagaagagccgg

SEQ ID NO: 74151 - DNA, 20 bp, human
gccccaagcgctcctgccag

SEQ ID NO: 74152 - DNA, 20 bp, human
gcctgtaacaccttgagagg

SEQ ID NO: 74153 - DNA, 20 bp, human
gccgccgagcgccagccccc

SEQ ID NO: 74154 - DNA, 20 bp, human
gtccccgggcacccaaaagc

SEQ ID NO: 74155 - DNA, 20 bp, human
gccccccacctgcccgggag

SEQ ID NO: 74156 - DNA, 20 bp, human
gggggcaatggtcgtacgca

SEQ ID NO: 74157 - DNA, 20 bp, human
gtccctgctggcaggaccag

SEQ ID NO: 74158 - DNA, 20 bp, human
ggagggcgagtggcgagcag

SEQ ID NO: 74159 - DNA, 20 bp, human
gcccgctcggccaatcagga

SEQ ID NO: 74160 - DNA, 20 bp, human
gggaccagaggtgtgagggt

SEQ ID NO: 74161 - DNA, 20 bp, human
gagcagccgatggccgaggg

SEQ ID NO: 74162 - DNA, 20 bp, human
gggcaggaccagaggtgtga

SEQ ID NO: 74163 - DNA, 20 bp, human
gagagaaaaaggagggcgag

SEQ ID NO: 74164 - DNA, 20 bp, human
gagcacgcttcggggcgtgt

SEQ ID NO: 74165 - DNA, 20 bp, human
gacgcttcggggcgtgtggg

SEQ ID NO: 74166 - DNA, 20 bp, human
gggggcaatggtcgtaggca

SEQ ID NO: 74167 - DNA, 20 bp, human
gtccctgctggcaggaccag

SEQ ID NO: 74168 - DNA, 20 bp, human
gggaccagaggtgtgagggt

SEQ ID NO: 74169 - DNA, 20 bp, human
ggagggcgagtggcgagcag

SEQ ID NO: 74170 - DNA, 20 bp, human
gggcaggaccagaggtgtga

SEQ ID NO: 74171 - DNA, 20 bp, human
gccgcgggggcaatggtcgt

SEQ ID NO: 74172 - DNA, 20 bp, human
gagcagccgatggccgaggg

SEQ ID NO: 74173 - DNA, 20 bp, human
gcccgctcggccaatcagga

SEQ ID NO: 74174 - DNA, 20 bp, human
gagagaaaaaggagggcgag

SEQ ID NO: 74175 - DNA, 20 bp, human
gagcacgcttcggggcgtgt

SEQ ID NO: 74176 - DNA, 20 bp, human
gccggccgtggtcgccgagt

SEQ ID NO: 74177 - DNA, 20 bp, human
ggccctggccacgactgcag

SEQ ID NO: 74178 - DNA, 20 bp, human
ggcccctgccatggatatca

SEQ ID NO: 74179 - DNA, 20 bp, human
ggactgcagtggctaccccg

SEQ ID NO: 74180 - DNA, 20 bp, human
gaccacggccggcggatcca

SEQ ID NO: 74181 - DNA, 20 bp, human
gcgagacacgtgccgggaac

SEQ ID NO: 74182 - DNA, 20 bp, human
ggtcgcgcgaaggttcagca

SEQ ID NO: 74183 - DNA, 20 bp, human
gcacctgtgcaagcacacgg

SEQ ID NO: 74184 - DNA, 20 bp, human
ggggcgaggctgccaaccct

SEQ ID NO: 74185 - DNA, 20 bp, human
gtatcaaggtcgcagaacga

SEQ ID NO: 74186 - DNA, 20 bp, human
ggaagtagcaatggacgcgc

SEQ ID NO: 74187 - DNA, 20 bp, human
ggacgcgctggagtcgttgt

SEQ ID NO: 74188 - DNA, 20 bp, human
gggacgaagtcgctctggag

SEQ ID NO: 74189 - DNA, 20 bp, human
gcggcggtaaggctaatctg

SEQ ID NO: 74190 - DNA, 20 bp, human
gccgccgactgaagtagcaa

SEQ ID NO: 74191 - DNA, 20 bp, human
ggcagggccctggagtccga

SEQ ID NO: 74192 - DNA, 20 bp, human
gccaactccatcggactcca

SEQ ID NO: 74193 - DNA, 20 bp, human
gttgttggacgaagtcgctc

SEQ ID NO: 74194 - DNA, 20 bp, human
gggtcctggagctgtaggtc

SEQ ID NO: 74195 - DNA, 20 bp, human
gctccccccgccaactccat

SEQ ID NO: 74196 - DNA, 20 bp, human
ggccccccacacacccgctg

SEQ ID NO: 74197 - DNA, 20 bp, human
gggtgagtgtatcgccgcag

SEQ ID NO: 74198 - DNA, 20 bp, human
gcacgcccaggactgaagaa

SEQ ID NO: 74199 - DNA, 20 bp, human
ggtgcacggtggccacagta

SEQ ID NO: 74200 - DNA, 20 bp, human
gatcgccgcagcgggtgtgt

SEQ ID NO: 74201 - DNA, 20 bp, human
gccgaggcttgcagagatgg

SEQ ID NO: 74202 - DNA, 20 bp, human
gggccacagtagggaaggtg

SEQ ID NO: 74203 - DNA, 20 bp, human
gtcctctcccgcacaggcta

SEQ ID NO: 74204 - DNA, 20 bp, human
gtagacttccggaaggactt

SEQ ID NO: 74205 - DNA, 20 bp, human
gtccggaaggactttggcga

SEQ ID NO: 74206 - DNA, 20 bp, human
gttctctgtcccggttcctg

SEQ ID NO: 74207 - DNA, 20 bp, human
gcggcgaggtagcttctgga

SEQ ID NO: 74208 - DNA, 20 bp, human
gcgctggtaagttaaatggg

SEQ ID NO: 74209 - DNA, 20 bp, human
gcccacacctaagggtatga

SEQ ID NO: 74210 - DNA, 20 bp, human
ggccccggcgaggtagcttc

SEQ ID NO: 74211 - DNA, 20 bp, human
gtgaaggcaacaagagtgaa

SEQ ID NO: 74212 - DNA, 20 bp, human
ggtgaggcgatgctaggcca

SEQ ID NO: 74213 - DNA, 20 bp, human
gtctgggtcccccacaccta

SEQ ID NO: 74214 - DNA, 20 bp, human
gctcttccggttctctgtcc

SEQ ID NO: 74215 - DNA, 20 bp, human
gagaccctgtaaacatgtca

SEQ ID NO: 74216 - DNA, 20 bp, human
gtgaggggagaaaaccgccg

SEQ ID NO: 74217 - DNA, 20 bp, human
ggccggatctcgcttctcag

SEQ ID NO: 74218 - DNA, 20 bp, human
gacggcggcaccgggcgggt

SEQ ID NO: 74219 - DNA, 20 bp, human
gccgccgagtcaccatgagg

SEQ ID NO: 74220 - DNA, 20 bp, human
ggccccttccgggtccggaa

SEQ ID NO: 74221 - DNA, 20 bp, human
gcgaggtgcggtggataacc

SEQ ID NO: 74222 - DNA, 20 bp, human
ggcggtggataaccaggtcc

SEQ ID NO: 74223 - DNA, 20 bp, human
gagccgttccggacccggaa

SEQ ID NO: 74224 - DNA, 20 bp, human
gtgtacggactcgtcccgag

SEQ ID NO: 74225 - DNA, 20 bp, human
ggggagaaaaccgccgcgga

SEQ ID NO: 74226 - DNA, 20 bp, human
gtagccagcgagggacccgg

SEQ ID NO: 74227 - DNA, 20 bp, human
gcctgccagacgcacaggga

SEQ ID NO: 74228 - DNA, 20 bp, human
ggggccctgccagacgcaca

SEQ ID NO: 74229 - DNA, 20 bp, human
gcgccgtccccgtggagctg

SEQ ID NO: 74230 - DNA, 20 bp, human
gtactagccagcgagggacc

SEQ ID NO: 74231 - DNA, 20 bp, human
gtggtgtgcgtggagtaccc

SEQ ID NO: 74232 - DNA, 20 bp, human
gcgtctggcagggcccgcca

SEQ ID NO: 74233 - DNA, 20 bp, human
ggctggctagtaggagagac

SEQ ID NO: 74234 - DNA, 20 bp, human
gcgctcccgcctcagctcca

SEQ ID NO: 74235 - DNA, 20 bp, human
gcattggctgaagtcgaggg

SEQ ID NO: 74236 - DNA, 20 bp, human
gggcgtggccagtgactaga

SEQ ID NO: 74237 - DNA, 20 bp, human
gaggcgccgcgggaccatgg

SEQ ID NO: 74238 - DNA, 20 bp, human
gaagcccgtactcaagatgg

SEQ ID NO: 74239 - DNA, 20 bp, human
ggcggacgagcggagtccag

SEQ ID NO: 74240 - DNA, 20 bp, human
gtagcacgcgagcggccaag

SEQ ID NO: 74241 - DNA, 20 bp, human
gggccagtgactagaaggcg

SEQ ID NO: 74242 - DNA, 20 bp, human
gcaggagcaagaagccggtg

SEQ ID NO: 74243 - DNA, 20 bp, human
gcgccgcgggaccatggcgg

SEQ ID NO: 74244 - DNA, 20 bp, human
gctgaagcccgtactcaaga

SEQ ID NO: 74245 - DNA, 20 bp, human
gagtaccgggaagttacctt

SEQ ID NO: 74246 - DNA, 20 bp, human
gatctcggcgggagacggga

SEQ ID NO: 74247 - DNA, 20 bp, human
gggctcgggggcgaacatag

SEQ ID NO: 74248 - DNA, 20 bp, human
ggacgcgggggagccaaggt

SEQ ID NO: 74249 - DNA, 20 bp, human
gcgaacatagaggccgggac

SEQ ID NO: 74250 - DNA, 20 bp, human
ggggaccggcgagtccatcg

SEQ ID NO: 74251 - DNA, 20 bp, human
gaggtgggtgcggggaccat

SEQ ID NO: 74252 - DNA, 20 bp, human
gccagcaaggtaggcccggg

SEQ ID NO: 74253 - DNA, 20 bp, human
gagccgaggggttacgatct

SEQ ID NO: 74254 - DNA, 20 bp, human
ggctctgccacgtggaacgg

SEQ ID NO: 74255 - DNA, 20 bp, human
ggtcccggagactagcaggt

SEQ ID NO: 74256 - DNA, 20 bp, human
gcttccgcaagaaggtttcc

SEQ ID NO: 74257 - DNA, 20 bp, human
gtgtcagcgctaaggggacc

SEQ ID NO: 74258 - DNA, 20 bp, human
gacgcaactgcaatgcacca

SEQ ID NO: 74259 - DNA, 20 bp, human
gaggccaggaaaccttcttg

SEQ ID NO: 74260 - DNA, 20 bp, human
gtgtcagtaagcggtgacag

SEQ ID NO: 74261 - DNA, 20 bp, human
gaccatggctgcaacaggcc

SEQ ID NO: 74262 - DNA, 20 bp, human
gagcgccactacaggagggg

SEQ ID NO: 74263 - DNA, 20 bp, human
ggccgccacgaagacagtag

SEQ ID NO: 74264 - DNA, 20 bp, human
gaacaggctgtggacattaa

SEQ ID NO: 74265 - DNA, 20 bp, human
gacaaagcgccactacagga

SEQ ID NO: 74266 - DNA, 20 bp, human
ggacacggcagtggcagtaa

SEQ ID NO: 74267 - DNA, 20 bp, human
gtgctcaggccggccggaca

SEQ ID NO: 74268 - DNA, 20 bp, human
gacggcagtggcagtaaggg

SEQ ID NO: 74269 - DNA, 20 bp, human
gcggtgtcgagaccccaggg

SEQ ID NO: 74270 - DNA, 20 bp, human
ggagcacctgagaagtggta

SEQ ID NO: 74271 - DNA, 20 bp, human
gttccggtgtcgagacccca

SEQ ID NO: 74272 - DNA, 20 bp, human
gttcaggtcccgggacccca

SEQ ID NO: 74273 - DNA, 20 bp, human
ggccgtgggcggaaccctca

SEQ ID NO: 74274 - DNA, 20 bp, human
ggaggtgagcacctgagaag

SEQ ID NO: 74275 - DNA, 20 bp, human
gccggccggcctgagcagag

SEQ ID NO: 74276 - DNA, 20 bp, human
gccacacaggcaggtcgggc

SEQ ID NO: 74277 - DNA, 20 bp, human
gcagaaggagacccagatat

SEQ ID NO: 74278 - DNA, 20 bp, human
ggcacaatctggaaccggag

SEQ ID NO: 74279 - DNA, 20 bp, human
gcgcaggttgtaaatccatg

SEQ ID NO: 74280 - DNA, 20 bp, human
ggcgaatcagcgcacctggg

SEQ ID NO: 74281 - DNA, 20 bp, human
gtcagtgtcaagtagaccga

SEQ ID NO: 74282 - DNA, 20 bp, human
ggcatccgaagccgagggaa

SEQ ID NO: 74283 - DNA, 20 bp, human
gagcatctcggtgaccggga

SEQ ID NO: 74284 - DNA, 20 bp, human
gcaatctggaaccggagggg

SEQ ID NO: 74285 - DNA, 20 bp, human
gacggcagaagggaacgctg

SEQ ID NO: 74286 - DNA, 20 bp, human
ggtgcatacggctgccggca

SEQ ID NO: 74287 - DNA, 20 bp, human
gggaaatgatcccgagtacg

SEQ ID NO: 74288 - DNA, 20 bp, human
ggggccccgggtgacgatgt

SEQ ID NO: 74289 - DNA, 20 bp, human
gtggtgccgtccgccaaggt

SEQ ID NO: 74290 - DNA, 20 bp, human
gccggcagccgtatgcacgc

SEQ ID NO: 74291 - DNA, 20 bp, human
ggggggaccccgacatgtga

SEQ ID NO: 74292 - DNA, 20 bp, human
gggaccccgacatgtgaggg

SEQ ID NO: 74293 - DNA, 20 bp, human
ggtcacccggggcccctcca

SEQ ID NO: 74294 - DNA, 20 bp, human
ggcccgacggcggaagttcc

SEQ ID NO: 74295 - DNA, 20 bp, human
gtgagggcccccagagatgg

SEQ ID NO: 74296 - DNA, 20 bp, human
gagatgggtggatatagata

SEQ ID NO: 74297 - DNA, 20 bp, human
gggcgatggtgtagacagat

SEQ ID NO: 74298 - DNA, 20 bp, human
gcagggtggtggtatagata

SEQ ID NO: 74299 - DNA, 20 bp, human
ggattgtggtatagacaggg

SEQ ID NO: 74300 - DNA, 20 bp, human
gtggtaaagctctggatggg

SEQ ID NO: 74301 - DNA, 20 bp, human
gtggtatagatagggcagtg

SEQ ID NO: 74302 - DNA, 20 bp, human
gggtggattgtatagacggg

SEQ ID NO: 74303 - DNA, 20 bp, human
gagacgggtggtggtataga

SEQ ID NO: 74304 - DNA, 20 bp, human
gcagtggggatggtctagac

SEQ ID NO: 74305 - DNA, 20 bp, human
ggtggatatagatacggcag

SEQ ID NO: 74306 - DNA, 20 bp, human
gcccgcgagccggacggcca

SEQ ID NO: 74307 - DNA, 20 bp, human
ggttcctcgccccctacggg

SEQ ID NO: 74308 - DNA, 20 bp, human
gaggtgagaggcgattctca

SEQ ID NO: 74309 - DNA, 20 bp, human
gaggtcttgcctcccgtagg

SEQ ID NO: 74310 - DNA, 20 bp, human
gtctgcccgtcttctgggaa

SEQ ID NO: 74311 - DNA, 20 bp, human
gcacgcgcaacccaggccac

SEQ ID NO: 74312 - DNA, 20 bp, human
ggcggttcctcgccccctac

SEQ ID NO: 74313 - DNA, 20 bp, human
gcaactcccagcaggcgtcg

SEQ ID NO: 74314 - DNA, 20 bp, human
gggagctgacgtagtcgatg

SEQ ID NO: 74315 - DNA, 20 bp, human
gtgaaggtcttgcctcccgt

SEQ ID NO: 74316 - DNA, 20 bp, human
gggggtgagggagcatgata

SEQ ID NO: 74317 - DNA, 20 bp, human
ggcagagacctagatgcaga

SEQ ID NO: 74318 - DNA, 20 bp, human
gtgaggaaaacagctacgga

SEQ ID NO: 74319 - DNA, 20 bp, human
gttcagggaattgagtaata

SEQ ID NO: 74320 - DNA, 20 bp, human
gaaggtgaggaaaacagcta

SEQ ID NO: 74321 - DNA, 20 bp, human
gtctgaggcaatgactaaaa

SEQ ID NO: 74322 - DNA, 20 bp, human
gccctaaaaagcctggtctg

SEQ ID NO: 74323 - DNA, 20 bp, human
gttaaggacgtgcaaactca

SEQ ID NO: 74324 - DNA, 20 bp, human
gttttagggaacctgagctc

SEQ ID NO: 74325 - DNA, 20 bp, human
gcccagcaaaggacccaact

SEQ ID NO: 74326 - DNA, 20 bp, human
gacgcgggttgccgattggt

SEQ ID NO: 74327 - DNA, 20 bp, human
gttgcccggtgggcccggtg

SEQ ID NO: 74328 - DNA, 20 bp, human
gttcagccctcggctcacag

SEQ ID NO: 74329 - DNA, 20 bp, human
gaaggtggggtcagggtcgg

SEQ ID NO: 74330 - DNA, 20 bp, human
gctgccgctttgggtaaggt

SEQ ID NO: 74331 - DNA, 20 bp, human
ggagtacgtgtcagggccca

SEQ ID NO: 74332 - DNA, 20 bp, human
ggaaggccgcggccaggtct

SEQ ID NO: 74333 - DNA, 20 bp, human
gtcgtctgccgctttgggta

SEQ ID NO: 74334 - DNA, 20 bp, human
gacgatgcaggacgcgcctc

SEQ ID NO: 74335 - DNA, 20 bp, human
ggcaggctgaaggctcatcg

SEQ ID NO: 74336 - DNA, 20 bp, human
gcaattcctattttgcgtac

SEQ ID NO: 74337 - DNA, 20 bp, human
ggttttcccttagtgcatag

SEQ ID NO: 74338 - DNA, 20 bp, human
gggtaaggaaaggcaccccg

SEQ ID NO: 74339 - DNA, 20 bp, human
gtgtccaccgaggtaaggaa

SEQ ID NO: 74340 - DNA, 20 bp, human
ggtgtgtgtccaccgaggta

SEQ ID NO: 74341 - DNA, 20 bp, human
gagggtatggatgtagtcgg

SEQ ID NO: 74342 - DNA, 20 bp, human
ggtgcctttccttacctcgg

SEQ ID NO: 74343 - DNA, 20 bp, human
ggccaaggaggccctcgagt

SEQ ID NO: 74344 - DNA, 20 bp, human
gattgcttagaggcgccccg

SEQ ID NO: 74345 - DNA, 20 bp, human
ggcaatgcagcgaaacaggt

SEQ ID NO: 74346 - DNA, 20 bp, human
ggtggattagaagagagatg

SEQ ID NO: 74347 - DNA, 20 bp, human
gagagaacagagttagcaaa

SEQ ID NO: 74348 - DNA, 20 bp, human
gaatcccaagggccaaaact

SEQ ID NO: 74349 - DNA, 20 bp, human
gtctctaggactgtgagtgg

SEQ ID NO: 74350 - DNA, 20 bp, human
gtcggtggtgaggatcataa

SEQ ID NO: 74351 - DNA, 20 bp, human
ggtggtccccatcaaaaatc

SEQ ID NO: 74352 - DNA, 20 bp, human
gtgtgtcaacaggagcgctg

SEQ ID NO: 74353 - DNA, 20 bp, human
gccgtgagtcaagcggctgt

SEQ ID NO: 74354 - DNA, 20 bp, human
gtctgctatagttctgtctc

SEQ ID NO: 74355 - DNA, 20 bp, human
gagtatatccgtgagtcaag

SEQ ID NO: 74356 - DNA, 20 bp, human
gccgacagctggggagtaca

SEQ ID NO: 74357 - DNA, 20 bp, human
gttgagtgcttaagaggtct

SEQ ID NO: 74358 - DNA, 20 bp, human
ggaacttctggtggtcaggg

SEQ ID NO: 74359 - DNA, 20 bp, human
gggtgaggtggaacttctgg

SEQ ID NO: 74360 - DNA, 20 bp, human
gcagctggggagtacaaggc

SEQ ID NO: 74361 - DNA, 20 bp, human
ggaggtctaggcaccttaca

SEQ ID NO: 74362 - DNA, 20 bp, human
gggaccagggcctttcttga

SEQ ID NO: 74363 - DNA, 20 bp, human
ggggtcacaagaagcctgat

SEQ ID NO: 74364 - DNA, 20 bp, human
gcaaggtgtgatgaaatcac

SEQ ID NO: 74365 - DNA, 20 bp, human
gctccccagagagatcgcag

SEQ ID NO: 74366 - DNA, 20 bp, human
gccgtcggccagccagtacg

SEQ ID NO: 74367 - DNA, 20 bp, human
gaagggcctgatggatcaga

SEQ ID NO: 74368 - DNA, 20 bp, human
gacttcaacaaggtgagcag

SEQ ID NO: 74369 - DNA, 20 bp, human
ggtgatggagggaaagtcag

SEQ ID NO: 74370 - DNA, 20 bp, human
gagtgctggagggacccctc

SEQ ID NO: 74371 - DNA, 20 bp, human
ggaactggcggaactcatag

SEQ ID NO: 74372 - DNA, 20 bp, human
gttcaggcctgagcaaagaa

SEQ ID NO: 74373 - DNA, 20 bp, human
gcattgctcaggccttcagg

SEQ ID NO: 74374 - DNA, 20 bp, human
gcaatgggcaacgtgatgga

SEQ ID NO: 74375 - DNA, 20 bp, human
gtcctcacccccagctggtc

SEQ ID NO: 74376 - DNA, 20 bp, human
gggaggaagagggccctagt

SEQ ID NO: 74377 - DNA, 20 bp, human
gtcagtcacccaggagatga

SEQ ID NO: 74378 - DNA, 20 bp, human
gctagccctgaggagcatca

SEQ ID NO: 74379 - DNA, 20 bp, human
gtccctgaggacacttgtgg

SEQ ID NO: 74380 - DNA, 20 bp, human
gagccgaggagtggggaact

SEQ ID NO: 74381 - DNA, 20 bp, human
gctgatggatctctccaact

SEQ ID NO: 74382 - DNA, 20 bp, human
gctctccctgaggacacttg

SEQ ID NO: 74383 - DNA, 20 bp, human
ggagaaagagccgaggagtg

SEQ ID NO: 74384 - DNA, 20 bp, human
ggaggagcatcagggagcaa

SEQ ID NO: 74385 - DNA, 20 bp, human
gtggggtaaggcaccctgaa

SEQ ID NO: 74386 - DNA, 20 bp, human
ggcagaacacttcctagggt

SEQ ID NO: 74387 - DNA, 20 bp, human
gacatgcagaacacttccta

SEQ ID NO: 74388 - DNA, 20 bp, human
gtacatcccactgaatggag

SEQ ID NO: 74389 - DNA, 20 bp, human
gtagactgtgagtcaagatg

SEQ ID NO: 74390 - DNA, 20 bp, human
gcagttttagtgaggagtaa

SEQ ID NO: 74391 - DNA, 20 bp, human
gcttaagtgaaaacaacctg

SEQ ID NO: 74392 - DNA, 20 bp, human
ggaagacctctccattcagt

SEQ ID NO: 74393 - DNA, 20 bp, human
gcaggcaactcacagcttgt

SEQ ID NO: 74394 - DNA, 20 bp, human
gtacacaagagacccatgtg

SEQ ID NO: 74395 - DNA, 20 bp, human
gcagtctacagcttttcctc

SEQ ID NO: 74396 - DNA, 20 bp, human
ggaacagccacccctctctc

SEQ ID NO: 74397 - DNA, 20 bp, human
ggcagcagtgcccgagagag

SEQ ID NO: 74398 - DNA, 20 bp, human
gatagtggagccacagtgag

SEQ ID NO: 74399 - DNA, 20 bp, human
ggaccagacctgggcactag

SEQ ID NO: 74400 - DNA, 20 bp, human
gctctcaggggaccagacct

SEQ ID NO: 74401 - DNA, 20 bp, human
gctttcttccaggttgatag

SEQ ID NO: 74402 - DNA, 20 bp, human
gtggctgttctggatgccag

SEQ ID NO: 74403 - DNA, 20 bp, human
gagaggaggtactctctcag

SEQ ID NO: 74404 - DNA, 20 bp, human
gctgttacagaacctttgtg

SEQ ID NO: 74405 - DNA, 20 bp, human
gaggttctgtaacaggccat

SEQ ID NO: 74406 - DNA, 20 bp, human
ggatgggagacggtggacag

SEQ ID NO: 74407 - DNA, 20 bp, human
ggaactgtgggagcataaca

SEQ ID NO: 74408 - DNA, 20 bp, human
gggaggaccacggccactcc

SEQ ID NO: 74409 - DNA, 20 bp, human
gcagcggcagggggaaccca

SEQ ID NO: 74410 - DNA, 20 bp, human
ggtgctggtcacagaggtca

SEQ ID NO: 74411 - DNA, 20 bp, human
ggggctgcagggctgcatca

SEQ ID NO: 74412 - DNA, 20 bp, human
gagacggtggacagcggcag

SEQ ID NO: 74413 - DNA, 20 bp, human
gaccagcacgggcctttgag

SEQ ID NO: 74414 - DNA, 20 bp, human
gggaacccagggagcgcgat

SEQ ID NO: 74415 - DNA, 20 bp, human
ggggagcgcgatgggctgca

SEQ ID NO: 74416 - DNA, 20 bp, human
gcctcccgccccagccgaag

SEQ ID NO: 74417 - DNA, 20 bp, human
gcttccgcttcggctggggc

SEQ ID NO: 74418 - DNA, 20 bp, human
gcctgccggctgggaaacta

SEQ ID NO: 74419 - DNA, 20 bp, human
ggggaaggtccgggtagcag

SEQ ID NO: 74420 - DNA, 20 bp, human
ggccggcaggcggagtgagg

SEQ ID NO: 74421 - DNA, 20 bp, human
gggcatgggagctcccaagg

SEQ ID NO: 74422 - DNA, 20 bp, human
gggtgccggaactatcgtac

SEQ ID NO: 74423 - DNA, 20 bp, human
ggagaccgcgctcaacactg

SEQ ID NO: 74424 - DNA, 20 bp, human
gaaagagcgggacccggcag

SEQ ID NO: 74425 - DNA, 20 bp, human
gtggggcggggcctaaggag

SEQ ID NO: 74426 - DNA, 20 bp, human
ggaccgcggtcacacactct

SEQ ID NO: 74427 - DNA, 20 bp, human
ggctgcggcccaagcagaag

SEQ ID NO: 74428 - DNA, 20 bp, human
gcgcgctcccgctcacgggg

SEQ ID NO: 74429 - DNA, 20 bp, human
gtacctggagaccagcccgg

SEQ ID NO: 74430 - DNA, 20 bp, human
ggagcccgggccccaaggtg

SEQ ID NO: 74431 - DNA, 20 bp, human
gtccaggtagtcggagccca

SEQ ID NO: 74432 - DNA, 20 bp, human
gccagcagagcctagacagg

SEQ ID NO: 74433 - DNA, 20 bp, human
gctcggagcctccccgtgag

SEQ ID NO: 74434 - DNA, 20 bp, human
gctccgagagtgtgtgaccg

SEQ ID NO: 74435 - DNA, 20 bp, human
gcgccgcgctcccgctcacg

SEQ ID NO: 74436 - DNA, 20 bp, human
gagagagcaggcgtcagggg

SEQ ID NO: 74437 - DNA, 20 bp, human
gacccactaggctcagacta

SEQ ID NO: 74438 - DNA, 20 bp, human
gccacaggtgtcctccgcct

SEQ ID NO: 74439 - DNA, 20 bp, human
gccccgcgcgagtgcaccct

SEQ ID NO: 74440 - DNA, 20 bp, human
ggcaggcagtgagcgggaga

SEQ ID NO: 74441 - DNA, 20 bp, human
gccctgggcactcgcggcag

SEQ ID NO: 74442 - DNA, 20 bp, human
ggctagagcagcgagcagcc

SEQ ID NO: 74443 - DNA, 20 bp, human
gaccgacaggtgccactgca

SEQ ID NO: 74444 - DNA, 20 bp, human
gggcagcggcacttacgctt

SEQ ID NO: 74445 - DNA, 20 bp, human
ggtgagatcacgcccggctg

SEQ ID NO: 74446 - DNA, 20 bp, human
gggaggcagcccccacgcag

SEQ ID NO: 74447 - DNA, 20 bp, human
gggtacggccgaagggaccc

SEQ ID NO: 74448 - DNA, 20 bp, human
gtgagcgccagcggaaggga

SEQ ID NO: 74449 - DNA, 20 bp, human
ggggagaggctgggcatcgg

SEQ ID NO: 74450 - DNA, 20 bp, human
gacgcagaggtacggccgaa

SEQ ID NO: 74451 - DNA, 20 bp, human
gtctgcaccgggagccgggg

SEQ ID NO: 74452 - DNA, 20 bp, human
gcagcggctacagcgcaacc

SEQ ID NO: 74453 - DNA, 20 bp, human
gctacagcgcaaccgggccg

SEQ ID NO: 74454 - DNA, 20 bp, human
gcttgcccgcgcccagtcag

SEQ ID NO: 74455 - DNA, 20 bp, human
gcaatcagggcgggccaagg

SEQ ID NO: 74456 - DNA, 20 bp, human
gggctgagggactccactag

SEQ ID NO: 74457 - DNA, 20 bp, human
gccagatggacagcctctag

SEQ ID NO: 74458 - DNA, 20 bp, human
gttgctctgttgggctccta

SEQ ID NO: 74459 - DNA, 20 bp, human
gcccagaggtagtaacagag

SEQ ID NO: 74460 - DNA, 20 bp, human
gttgggctcctagggaggca

SEQ ID NO: 74461 - DNA, 20 bp, human
ggagtgagcacagcataata

SEQ ID NO: 74462 - DNA, 20 bp, human
gacggcccatgtgaccagtt

SEQ ID NO: 74463 - DNA, 20 bp, human
gcatgaccagagagaagcgt

SEQ ID NO: 74464 - DNA, 20 bp, human
gcatgcccaactggtcacat

SEQ ID NO: 74465 - DNA, 20 bp, human
gcaagtgggcacaaggagta

SEQ ID NO: 74466 - DNA, 20 bp, human
gcccccggtgaggggtcaca

SEQ ID NO: 74467 - DNA, 20 bp, human
gaggctgggaagactaactg

SEQ ID NO: 74468 - DNA, 20 bp, human
ggcccacggcccccggtgag

SEQ ID NO: 74469 - DNA, 20 bp, human
gtgtgggcgggcgtcaaaag

SEQ ID NO: 74470 - DNA, 20 bp, human
gcatttacagggaagtccgg

SEQ ID NO: 74471 - DNA, 20 bp, human
gctgcgcccgccgagcgggt

SEQ ID NO: 74472 - DNA, 20 bp, human
gctgctaccgccccctccgg

SEQ ID NO: 74473 - DNA, 20 bp, human
gcggcttctgcgaacacaga

SEQ ID NO: 74474 - DNA, 20 bp, human
ggagaccccggcctccccta

SEQ ID NO: 74475 - DNA, 20 bp, human
ggttacggggagaaccctag

SEQ ID NO: 74476 - DNA, 20 bp, human
ggcatccgcagaccaagact

SEQ ID NO: 74477 - DNA, 20 bp, human
gagcgtctcagctcccaggt

SEQ ID NO: 74478 - DNA, 20 bp, human
ggcagaccaagacttggatt

SEQ ID NO: 74479 - DNA, 20 bp, human
ggcctgcgcatgcagaccac

SEQ ID NO: 74480 - DNA, 20 bp, human
gacagactggagtccttgac

SEQ ID NO: 74481 - DNA, 20 bp, human
gagtcaagatttgagctcaa

SEQ ID NO: 74482 - DNA, 20 bp, human
ggttgacaaattccattaat

SEQ ID NO: 74483 - DNA, 20 bp, human
gttgacttaaagtatctcga

SEQ ID NO: 74484 - DNA, 20 bp, human
gtaaatcctaatccaagtct

SEQ ID NO: 74485 - DNA, 20 bp, human
gcaggattgtgaatgcatag

SEQ ID NO: 74486 - DNA, 20 bp, human
gacttgggcagagctccccg

SEQ ID NO: 74487 - DNA, 20 bp, human
ggcgaagacaatgaaccccg

SEQ ID NO: 74488 - DNA, 20 bp, human
gcttgcaacttggtacaggg

SEQ ID NO: 74489 - DNA, 20 bp, human
gctggagcagccccaagggt

SEQ ID NO: 74490 - DNA, 20 bp, human
gtaccccccgtaggatccgg

SEQ ID NO: 74491 - DNA, 20 bp, human
gctcgcgccacgagccactg

SEQ ID NO: 74492 - DNA, 20 bp, human
gatccggaagcaacccgaag

SEQ ID NO: 74493 - DNA, 20 bp, human
gctgcttgcaacttggtaca

SEQ ID NO: 74494 - DNA, 20 bp, human
gagagtcctgggctaccgac

SEQ ID NO: 74495 - DNA, 20 bp, human
ggcgcggccccagtggctcg

SEQ ID NO: 74496 - DNA, 20 bp, human
ggaggtggccccggatgctg

SEQ ID NO: 74497 - DNA, 20 bp, human
ggctgtcacgtaggttcagt

SEQ ID NO: 74498 - DNA, 20 bp, human
ggtcacgtaggttcagtggg

SEQ ID NO: 74499 - DNA, 20 bp, human
gccgcgccgggccagcggta

SEQ ID NO: 74500 - DNA, 20 bp, human
gtaggttcagtgggcggaag

SEQ ID NO: 74501 - DNA, 20 bp, human
gagggtgactcgggtcgagg

SEQ ID NO: 74502 - DNA, 20 bp, human
gctgtgggccctgagaacgg

SEQ ID NO: 74503 - DNA, 20 bp, human
gggagctctggagggcggac

SEQ ID NO: 74504 - DNA, 20 bp, human
gcaggattctgcctactccg

SEQ ID NO: 74505 - DNA, 20 bp, human
gcggtgcggcgctgtcacgt

SEQ ID NO: 74506 - DNA, 20 bp, human
gactactaggacctagggag

SEQ ID NO: 74507 - DNA, 20 bp, human
gagcctggcgatctccactc

SEQ ID NO: 74508 - DNA, 20 bp, human
ggaaacactactaggaccta

SEQ ID NO: 74509 - DNA, 20 bp, human
gtcgccaggctcggaggaac

SEQ ID NO: 74510 - DNA, 20 bp, human
gtgagagaggcagtcgggtc

SEQ ID NO: 74511 - DNA, 20 bp, human
ggtgtgcgggagggaactct

SEQ ID NO: 74512 - DNA, 20 bp, human
ggggagtcgtccagcactaa

SEQ ID NO: 74513 - DNA, 20 bp, human
gagtcgtccagcactaaagg

SEQ ID NO: 74514 - DNA, 20 bp, human
gcagtcggagcgagaaccca

SEQ ID NO: 74515 - DNA, 20 bp, human
gtcaagtagcttcttctgga

SEQ ID NO: 74516 - DNA, 20 bp, human
ggcagacggtggccgagcgg

SEQ ID NO: 74517 - DNA, 20 bp, human
gcaggcaaccgccgaccccc

SEQ ID NO: 74518 - DNA, 20 bp, human
gaatccgccccggccctcca

SEQ ID NO: 74519 - DNA, 20 bp, human
gccagctcggagacgcccag

SEQ ID NO: 74520 - DNA, 20 bp, human
gttcttagcgccgcagacgg

SEQ ID NO: 74521 - DNA, 20 bp, human
ggaccgggaagcatggcccg

SEQ ID NO: 74522 - DNA, 20 bp, human
gtgtgggaggtgcgatctcg

SEQ ID NO: 74523 - DNA, 20 bp, human
gaacggcccgagcgccgccc

SEQ ID NO: 74524 - DNA, 20 bp, human
gtaccggcggccgctgtggg

SEQ ID NO: 74525 - DNA, 20 bp, human
gagcgggggaccgggaagca

SEQ ID NO: 74526 - DNA, 20 bp, human
gtcacacagtagctgccggg

SEQ ID NO: 74527 - DNA, 20 bp, human
gcggctggcgaaaagcactg

SEQ ID NO: 74528 - DNA, 20 bp, human
gtggtccaggccccagtcac

SEQ ID NO: 74529 - DNA, 20 bp, human
gacgagggagctagaagcag

SEQ ID NO: 74530 - DNA, 20 bp, human
gtgctctgcaaaactggcat

SEQ ID NO: 74531 - DNA, 20 bp, human
gagtcacagggctctacacc

SEQ ID NO: 74532 - DNA, 20 bp, human
gtagctccctcgtacgagga

SEQ ID NO: 74533 - DNA, 20 bp, human
gcaggtgtgctctgcaaaac

SEQ ID NO: 74534 - DNA, 20 bp, human
ggttctggctgacgttgtac

SEQ ID NO: 74535 - DNA, 20 bp, human
gcagctgctcaagctggtcc

SEQ ID NO: 74536 - DNA, 20 bp, human
gccgcgcgctcaagggtcag

SEQ ID NO: 74537 - DNA, 20 bp, human
gcggcgtgtcggacaggtac

SEQ ID NO: 74538 - DNA, 20 bp, human
gacctaggcgagcgcagtcg

SEQ ID NO: 74539 - DNA, 20 bp, human
gcgaactggagcggagggag

SEQ ID NO: 74540 - DNA, 20 bp, human
gccgccccgacgaactggag

SEQ ID NO: 74541 - DNA, 20 bp, human
ggcgacgccggcgcctctca

SEQ ID NO: 74542 - DNA, 20 bp, human
ggcgagccaggaagccaccg

SEQ ID NO: 74543 - DNA, 20 bp, human
gccctggaagaaggaacggg

SEQ ID NO: 74544 - DNA, 20 bp, human
gaggcggtgtccaggcttcc

SEQ ID NO: 74545 - DNA, 20 bp, human
gggtgtccaggcttccgggc

SEQ ID NO: 74546 - DNA, 20 bp, human
ggctgcgagactggagaagt

SEQ ID NO: 74547 - DNA, 20 bp, human
gggtgtagggagcgagacac

SEQ ID NO: 74548 - DNA, 20 bp, human
gaagttggcgaggtgagtcg

SEQ ID NO: 74549 - DNA, 20 bp, human
gggccagcccgggagttcgg

SEQ ID NO: 74550 - DNA, 20 bp, human
gccggcgcctccgaactccc

SEQ ID NO: 74551 - DNA, 20 bp, human
ggcccctctgcgcatcgcgg

SEQ ID NO: 74552 - DNA, 20 bp, human
gccggggactggggtcgtgg

SEQ ID NO: 74553 - DNA, 20 bp, human
gcagtctcgcagcgccccgg

SEQ ID NO: 74554 - DNA, 20 bp, human
ggagacacgggtccgcagat

SEQ ID NO: 74555 - DNA, 20 bp, human
gaagctccgcagcaaggcgg

SEQ ID NO: 74556 - DNA, 20 bp, human
gagagaagccggcaccggga

SEQ ID NO: 74557 - DNA, 20 bp, human
gtcccgcctggaacccccag

SEQ ID NO: 74558 - DNA, 20 bp, human
gcgcggccagcgaggaggca

SEQ ID NO: 74559 - DNA, 20 bp, human
gggccagcgaggaggcacgg

SEQ ID NO: 74560 - DNA, 20 bp, human
ggactcagagaagccggcac

SEQ ID NO: 74561 - DNA, 20 bp, human
gtcctgccgggaacactccg

SEQ ID NO: 74562 - DNA, 20 bp, human
gcgccgtgagagcaagagga

SEQ ID NO: 74563 - DNA, 20 bp, human
gggccgctataagagcgcac

SEQ ID NO: 74564 - DNA, 20 bp, human
gagcgtgcgcggccacgtga

SEQ ID NO: 74565 - DNA, 20 bp, human
ggcgggagtccggggcgcag

SEQ ID NO: 74566 - DNA, 20 bp, human
gggagtacggaggacagacg

SEQ ID NO: 74567 - DNA, 20 bp, human
gggccgaggcagccagagcg

SEQ ID NO: 74568 - DNA, 20 bp, human
gggaggctgccggagtacgg

SEQ ID NO: 74569 - DNA, 20 bp, human
gggcagccagagcgcggaag

SEQ ID NO: 74570 - DNA, 20 bp, human
ggacggaggctgccggagta

SEQ ID NO: 74571 - DNA, 20 bp, human
gccagagcgcggaagaggtg

SEQ ID NO: 74572 - DNA, 20 bp, human
ggccagggcaccgagtgctg

SEQ ID NO: 74573 - DNA, 20 bp, human
gaccgagtgctggggaatac

SEQ ID NO: 74574 - DNA, 20 bp, human
gctgccgggaagagagaccc

SEQ ID NO: 74575 - DNA, 20 bp, human
ggtaggccaggagcgcttag

SEQ ID NO: 74576 - DNA, 20 bp, human
ggccagggtgcgggaaccag

SEQ ID NO: 74577 - DNA, 20 bp, human
gcccgggtctccgtcgaggg

SEQ ID NO: 74578 - DNA, 20 bp, human
gacgtgtccccccagacggg

SEQ ID NO: 74579 - DNA, 20 bp, human
ggttcccgcaccctggccgg

SEQ ID NO: 74580 - DNA, 20 bp, human
gcgctcgcagccgccggcca

SEQ ID NO: 74581 - DNA, 20 bp, human
ggcccccgggtctccgtcga

SEQ ID NO: 74582 - DNA, 20 bp, human
gtgggagactcagccctggg

SEQ ID NO: 74583 - DNA, 20 bp, human
gggagagccgccgccctcga

SEQ ID NO: 74584 - DNA, 20 bp, human
gctgcgggccgcagtcggag

SEQ ID NO: 74585 - DNA, 20 bp, human
gcacctacctcgcacttggg

SEQ ID NO: 74586 - DNA, 20 bp, human
ggagttattaacgaagatgt

SEQ ID NO: 74587 - DNA, 20 bp, human
gaatacatttattcacagag

SEQ ID NO: 74588 - DNA, 20 bp, human
ggaagatgttggtagctata

SEQ ID NO: 74589 - DNA, 20 bp, human
ggctaccaatgtgggggaaa

SEQ ID NO: 74590 - DNA, 20 bp, human
ggataacagctagcaggcta

SEQ ID NO: 74591 - DNA, 20 bp, human
gtgacacttgcagttgtctt

SEQ ID NO: 74592 - DNA, 20 bp, human
gggaaccagctcatgatctc

SEQ ID NO: 74593 - DNA, 20 bp, human
gctcatgatctcaggatgta

SEQ ID NO: 74594 - DNA, 20 bp, human
gataagatagaactaaaata

SEQ ID NO: 74595 - DNA, 20 bp, human
gttgctttgtttgagttata

SEQ ID NO: 74596 - DNA, 20 bp, human
ggagttattaacaaaggtgt

SEQ ID NO: 74597 - DNA, 20 bp, human
ggataacagctagtaggcta

SEQ ID NO: 74598 - DNA, 20 bp, human
gtgtgggggaaatgacacaa

SEQ ID NO: 74599 - DNA, 20 bp, human
gaataagatagaactgaaat

SEQ ID NO: 74600 - DNA, 20 bp, human
gaactgcaagtgtcagtgtc

SEQ ID NO: 74601 - DNA, 20 bp, human
gactaaagagttattaacaa

SEQ ID NO: 74602 - DNA, 20 bp, human
gatgatggccgcaggaaggt

SEQ ID NO: 74603 - DNA, 20 bp, human
gctggaagataacagctagt

SEQ ID NO: 74604 - DNA, 20 bp, human
gtgacacttgcagttgtctt

SEQ ID NO: 74605 - DNA, 20 bp, human
gggaaccagctcatgatctc

SEQ ID NO: 74606 - DNA, 20 bp, human
gtccagctcggagcgcgtgg

SEQ ID NO: 74607 - DNA, 20 bp, human
gcgcggcccgcagcagccag

SEQ ID NO: 74608 - DNA, 20 bp, human
gcgggcgacacgccctggga

SEQ ID NO: 74609 - DNA, 20 bp, human
gggcacggaccgggacacca

SEQ ID NO: 74610 - DNA, 20 bp, human
gtcagcccgggcagagaccg

SEQ ID NO: 74611 - DNA, 20 bp, human
ggtctccctaaagaacagtt

SEQ ID NO: 74612 - DNA, 20 bp, human
gtccgtgccgggcctccagg

SEQ ID NO: 74613 - DNA, 20 bp, human
gtccccaggacccttcccca

SEQ ID NO: 74614 - DNA, 20 bp, human
ggggggagggtcgcgctccc

SEQ ID NO: 74615 - DNA, 20 bp, human
gcccaggcgccggggaaccg

SEQ ID NO: 74616 - DNA, 20 bp, human
gtattaacaaaggtgttata

SEQ ID NO: 74617 - DNA, 20 bp, human
gggagccagctcgtgatctc

SEQ ID NO: 74618 - DNA, 20 bp, human
gacatcctgagatcacgagc

SEQ ID NO: 74619 - DNA, 20 bp, human
gactaaagagttattaacaa

SEQ ID NO: 74620 - DNA, 20 bp, human
ggctaccaatgtgggggaaa

SEQ ID NO: 74621 - DNA, 20 bp, human
gaactgcaagtgtcagtgtc

SEQ ID NO: 74622 - DNA, 20 bp, human
gggattcggccataaatact

SEQ ID NO: 74623 - DNA, 20 bp, human
gtgtgggggaaatggcacaa

SEQ ID NO: 74624 - DNA, 20 bp, human
gaactcagctaccaatgtgg

SEQ ID NO: 74625 - DNA, 20 bp, human
gtgacacttgcagttgtctt

SEQ ID NO: 74626 - DNA, 20 bp, human
gttgggacctaggcagaagg

SEQ ID NO: 74627 - DNA, 20 bp, human
gaggaggacggggctactag

SEQ ID NO: 74628 - DNA, 20 bp, human
gcggccgtgagacctccagg

SEQ ID NO: 74629 - DNA, 20 bp, human
ggcagcgtcactgagcccac

SEQ ID NO: 74630 - DNA, 20 bp, human
gtgggaagccggaggtgggt

SEQ ID NO: 74631 - DNA, 20 bp, human
gtcactgcaggggcgccagt

SEQ ID NO: 74632 - DNA, 20 bp, human
ggagctggaggcctcaaagt

SEQ ID NO: 74633 - DNA, 20 bp, human
gcctgggaggtggctaacaa

SEQ ID NO: 74634 - DNA, 20 bp, human
ggcgttgggacctaggcaga

SEQ ID NO: 74635 - DNA, 20 bp, human
gcctaggtcccaacgcttcg

SEQ ID NO: 74636 - DNA, 20 bp, human
ggcccagaaagacgagaaag

SEQ ID NO: 74637 - DNA, 20 bp, human
gcttcccacagaattcctgg

SEQ ID NO: 74638 - DNA, 20 bp, human
ggtttgggtagatactgaca

SEQ ID NO: 74639 - DNA, 20 bp, human
gccaggagaagagaacttac

SEQ ID NO: 74640 - DNA, 20 bp, human
ggtgcttcccacagaattcc

SEQ ID NO: 74641 - DNA, 20 bp, human
gcaccttcactaggtgactg

SEQ ID NO: 74642 - DNA, 20 bp, human
gtgggcaggtattgtgagga

SEQ ID NO: 74643 - DNA, 20 bp, human
gccttccaccaggaattctg

SEQ ID NO: 74644 - DNA, 20 bp, human
ggaattcaaaggagtctcgg

SEQ ID NO: 74645 - DNA, 20 bp, human
gacccagggatgttacagag

SEQ ID NO: 74646 - DNA, 20 bp, human
gggcctggtccagcggacag

SEQ ID NO: 74647 - DNA, 20 bp, human
gcaagtggcgcgggaagggt

SEQ ID NO: 74648 - DNA, 20 bp, human
ggcccagtccacggccacaa

SEQ ID NO: 74649 - DNA, 20 bp, human
gtcctaccggcctggtccag

SEQ ID NO: 74650 - DNA, 20 bp, human
ggtagcagcgtctcctggaa

SEQ ID NO: 74651 - DNA, 20 bp, human
gggcgcgtcgggccgaggag

SEQ ID NO: 74652 - DNA, 20 bp, human
gtccgctggaccaggccggt

SEQ ID NO: 74653 - DNA, 20 bp, human
ggcatctgcaccaacgtcgg

SEQ ID NO: 74654 - DNA, 20 bp, human
ggggcgcgcggacaaagagg

SEQ ID NO: 74655 - DNA, 20 bp, human
ggctgtcctcgccgccctca

SEQ ID NO: 74656 - DNA, 20 bp, human
gtgggacagcagccacaatg

SEQ ID NO: 74657 - DNA, 20 bp, human
ggaaacgacaactgagagag

SEQ ID NO: 74658 - DNA, 20 bp, human
gaattggcagcaataagcat

SEQ ID NO: 74659 - DNA, 20 bp, human
gaggaactcctatagatttc

SEQ ID NO: 74660 - DNA, 20 bp, human
gcttaccttcaggaattagc

SEQ ID NO: 74661 - DNA, 20 bp, human
gattttcaggttgattgatg

SEQ ID NO: 74662 - DNA, 20 bp, human
ggaactgaaaacagattttc

SEQ ID NO: 74663 - DNA, 20 bp, human
ggctaaacattataaggctt

SEQ ID NO: 74664 - DNA, 20 bp, human
gtttaaatagcattctttct

SEQ ID NO: 74665 - DNA, 20 bp, human
gaacttgaaaattgccaaaa

SEQ ID NO: 74666 - DNA, 20 bp, human
gacaacagcagctccaacca

SEQ ID NO: 74667 - DNA, 20 bp, human
gtcaggaaggctgccctggt

SEQ ID NO: 74668 - DNA, 20 bp, human
ggataagctatcagcaggaa

SEQ ID NO: 74669 - DNA, 20 bp, human
ggggaagggatagtacccac

SEQ ID NO: 74670 - DNA, 20 bp, human
gactcacctgcatctgccct

SEQ ID NO: 74671 - DNA, 20 bp, human
gtgaccgtctccaccctcgg

SEQ ID NO: 74672 - DNA, 20 bp, human
gatccagcatcacacttggg

SEQ ID NO: 74673 - DNA, 20 bp, human
ggatggggttgggcccccga

SEQ ID NO: 74674 - DNA, 20 bp, human
gcaagagctaaaagagagca

SEQ ID NO: 74675 - DNA, 20 bp, human
gcttctctcactgtctactt

SEQ ID NO: 74676 - DNA, 20 bp, human
gacaccaacagctctgacct

SEQ ID NO: 74677 - DNA, 20 bp, human
ggtcataaaggagaggtcta

SEQ ID NO: 74678 - DNA, 20 bp, human
ggtctgagctcctctttcct

SEQ ID NO: 74679 - DNA, 20 bp, human
gtccagaaacaaatgctgga

SEQ ID NO: 74680 - DNA, 20 bp, human
gactccaggtcataaaggag

SEQ ID NO: 74681 - DNA, 20 bp, human
gaccagaaggggacaagtct

SEQ ID NO: 74682 - DNA, 20 bp, human
gtccacactccaggtcataa

SEQ ID NO: 74683 - DNA, 20 bp, human
gcttagaaaggcatttggta

SEQ ID NO: 74684 - DNA, 20 bp, human
gggtcagaagaaaggccaac

SEQ ID NO: 74685 - DNA, 20 bp, human
gacccagacttataaatctg

SEQ ID NO: 74686 - DNA, 20 bp, human
gtgatgtccgccatactgga

SEQ ID NO: 74687 - DNA, 20 bp, human
gggatcaacacatttcatct

SEQ ID NO: 74688 - DNA, 20 bp, human
gactggatggaggccataaa

SEQ ID NO: 74689 - DNA, 20 bp, human
gtggcctccatccagtatgg

SEQ ID NO: 74690 - DNA, 20 bp, human
gtgtgttgatcctgtgatga

SEQ ID NO: 74691 - DNA, 20 bp, human
gatggaggccataaatggcc

SEQ ID NO: 74692 - DNA, 20 bp, human
ggcggacatcacgtttgtgg

SEQ ID NO: 74693 - DNA, 20 bp, human
gaacgtgatgtccgccatac

SEQ ID NO: 74694 - DNA, 20 bp, human
gcatataagccccaactatt

SEQ ID NO: 74695 - DNA, 20 bp, human
gcctacaaaagtagaccaaa

SEQ ID NO: 74696 - DNA, 20 bp, human
gtgtggggaggctcggggcc

SEQ ID NO: 74697 - DNA, 20 bp, human
ggccctgtcagtaggtgagt

SEQ ID NO: 74698 - DNA, 20 bp, human
gcgctgtggagacccagtgt

SEQ ID NO: 74699 - DNA, 20 bp, human
gggctgcctgccaccaccaa

SEQ ID NO: 74700 - DNA, 20 bp, human
gggtctccacagcggcatgg

SEQ ID NO: 74701 - DNA, 20 bp, human
gcggggccagcacccacact

SEQ ID NO: 74702 - DNA, 20 bp, human
ggcgaaggagatgctgacct

SEQ ID NO: 74703 - DNA, 20 bp, human
gcacacccgaggtgcagagt

SEQ ID NO: 74704 - DNA, 20 bp, human
gctgggtctccacagcggca

SEQ ID NO: 74705 - DNA, 20 bp, human
gggtgaagcgtgaggagctc

SEQ ID NO: 74706 - DNA, 20 bp, human
gcgcggagctgggaaaaggg

SEQ ID NO: 74707 - DNA, 20 bp, human
gagactggcccggtagtcag

SEQ ID NO: 74708 - DNA, 20 bp, human
gggctcaggagcagatcccg

SEQ ID NO: 74709 - DNA, 20 bp, human
gtcaagagccactacaaggt

SEQ ID NO: 74710 - DNA, 20 bp, human
gaagggccagccctcgtcgg

SEQ ID NO: 74711 - DNA, 20 bp, human
gccggtctgtcgcttggtct

SEQ ID NO: 74712 - DNA, 20 bp, human
ggccgcccaagcgccagacg

SEQ ID NO: 74713 - DNA, 20 bp, human
gtatatcaagagccactaca

SEQ ID NO: 74714 - DNA, 20 bp, human
gaccaagcgacagaccggcg

SEQ ID NO: 74715 - DNA, 20 bp, human
gaccgggccagtctggagtg

SEQ ID NO: 74716 - DNA, 20 bp, human
gtggtgaggcccaaagccgg

SEQ ID NO: 74717 - DNA, 20 bp, human
gggcccaggcgcctcagcca

SEQ ID NO: 74718 - DNA, 20 bp, human
gactcacaaagggctgactc

SEQ ID NO: 74719 - DNA, 20 bp, human
ggactggtgaggcccaaagc

SEQ ID NO: 74720 - DNA, 20 bp, human
gggcccagtggcgaatcccg

SEQ ID NO: 74721 - DNA, 20 bp, human
gcagaccctgaagtagccgg

SEQ ID NO: 74722 - DNA, 20 bp, human
gtgagtggctgagtgtcctc

SEQ ID NO: 74723 - DNA, 20 bp, human
gtcctggccgccttgcgaag

SEQ ID NO: 74724 - DNA, 20 bp, human
gactctggcagctctcaaga

SEQ ID NO: 74725 - DNA, 20 bp, human
ggtgtggagacggaacgcga

SEQ ID NO: 74726 - DNA, 20 bp, human
gccaccctggtagaactcct

SEQ ID NO: 74727 - DNA, 20 bp, human
gtgggaaagtggcaggccta

SEQ ID NO: 74728 - DNA, 20 bp, human
ggcgtcacagcaggaccagg

SEQ ID NO: 74729 - DNA, 20 bp, human
gcagcgcttcagggtagtgg

SEQ ID NO: 74730 - DNA, 20 bp, human
ggtccagaggcacaatctgt

SEQ ID NO: 74731 - DNA, 20 bp, human
gcaatcaccaaggctgtgag

SEQ ID NO: 74732 - DNA, 20 bp, human
gtacagcaggacaatcacca

SEQ ID NO: 74733 - DNA, 20 bp, human
gcttgcgtcacagcaggacc

SEQ ID NO: 74734 - DNA, 20 bp, human
gcaggctctgacccacgccc

SEQ ID NO: 74735 - DNA, 20 bp, human
gcctgctgtgacgcaagtcc

SEQ ID NO: 74736 - DNA, 20 bp, human
gcacgcccagcgagttccag

SEQ ID NO: 74737 - DNA, 20 bp, human
gcgagttccagaggcgccag

SEQ ID NO: 74738 - DNA, 20 bp, human
ggcgccagtggaagctgcgg

SEQ ID NO: 74739 - DNA, 20 bp, human
gatggccaagaaggtgacca

SEQ ID NO: 74740 - DNA, 20 bp, human
gttccctcggcggtcgtcac

SEQ ID NO: 74741 - DNA, 20 bp, human
ggagctggggacgtagacct

SEQ ID NO: 74742 - DNA, 20 bp, human
ggacatggtagcaagaggat

SEQ ID NO: 74743 - DNA, 20 bp, human
ggttgtccccatctaagaag

SEQ ID NO: 74744 - DNA, 20 bp, human
gaccaaggctggcggctcgg

SEQ ID NO: 74745 - DNA, 20 bp, human
ggccgagggaatggccaaga

SEQ ID NO: 74746 - DNA, 20 bp, human
ggccagcaccggaggaccct

SEQ ID NO: 74747 - DNA, 20 bp, human
ggcaacgaggcccagaacag

SEQ ID NO: 74748 - DNA, 20 bp, human
gcgaggaggaggagacgccg

SEQ ID NO: 74749 - DNA, 20 bp, human
ggcccagcatgccgaggagg

SEQ ID NO: 74750 - DNA, 20 bp, human
gccccggccgccagcaccgg

SEQ ID NO: 74751 - DNA, 20 bp, human
gcgcccccggccgccagcac

SEQ ID NO: 74752 - DNA, 20 bp, human
gacccaggccccaaagtctt

SEQ ID NO: 74753 - DNA, 20 bp, human
gctcaacgcccagcatgccg

SEQ ID NO: 74754 - DNA, 20 bp, human
ggcgagagcaggtccgcccc

SEQ ID NO: 74755 - DNA, 20 bp, human
gaacgcccagcatgccgagg

SEQ ID NO: 74756 - DNA, 20 bp, human
ggccagcaccggaggaccct

SEQ ID NO: 74757 - DNA, 20 bp, human
ggcaacgaggcccagaacag

SEQ ID NO: 74758 - DNA, 20 bp, human
gcgaggaggaggagacgccg

SEQ ID NO: 74759 - DNA, 20 bp, human
ggcccagcatgccgaggagg

SEQ ID NO: 74760 - DNA, 20 bp, human
gccccggccgccagcaccgg

SEQ ID NO: 74761 - DNA, 20 bp, human
gcgcccccggccgccagcac

SEQ ID NO: 74762 - DNA, 20 bp, human
gacccaggccccaaagtctt

SEQ ID NO: 74763 - DNA, 20 bp, human
gctcaacgcccagcatgccg

SEQ ID NO: 74764 - DNA, 20 bp, human
ggcgagagcaggtccgcccc

SEQ ID NO: 74765 - DNA, 20 bp, human
gaacgcccagcatgccgagg

SEQ ID NO: 74766 - DNA, 20 bp, human
ggccagcaccggaggaccct

SEQ ID NO: 74767 - DNA, 20 bp, human
ggcaacgaggcccagaacag

SEQ ID NO: 74768 - DNA, 20 bp, human
gcgaggaggaggagacgccg

SEQ ID NO: 74769 - DNA, 20 bp, human
ggcccagcatgccgaggagg

SEQ ID NO: 74770 - DNA, 20 bp, human
gccccggccgccagcaccgg

SEQ ID NO: 74771 - DNA, 20 bp, human
gcgcccccggccgccagcac

SEQ ID NO: 74772 - DNA, 20 bp, human
gacccaggccccaaagtctt

SEQ ID NO: 74773 - DNA, 20 bp, human
gctcaacgcccagcatgccg

SEQ ID NO: 74774 - DNA, 20 bp, human
ggcgagagcaggtccgcccc

SEQ ID NO: 74775 - DNA, 20 bp, human
gaacgcccagcatgccgagg

SEQ ID NO: 74776 - DNA, 20 bp, human
gccggtcgcgggaaacaggg

SEQ ID NO: 74777 - DNA, 20 bp, human
gtcgcctacaactccagaga

SEQ ID NO: 74778 - DNA, 20 bp, human
gtgtccggtcgcgggaaaca

SEQ ID NO: 74779 - DNA, 20 bp, human
gcgctctcggcgtccggtac

SEQ ID NO: 74780 - DNA, 20 bp, human
gggccgtaaagagtttgtag

SEQ ID NO: 74781 - DNA, 20 bp, human
gtgtagaggcagttcgggtg

SEQ ID NO: 74782 - DNA, 20 bp, human
ggacggagacaaaccgctct

SEQ ID NO: 74783 - DNA, 20 bp, human
gctccctgagggcggcgtca

SEQ ID NO: 74784 - DNA, 20 bp, human
ggggggagccagctccctga

SEQ ID NO: 74785 - DNA, 20 bp, human
ggtacgttgcattccggtac

SEQ ID NO: 74786 - DNA, 20 bp, human
ggtcggtgctgcgagagcgg

SEQ ID NO: 74787 - DNA, 20 bp, human
gggaggaggacggcagaatc

SEQ ID NO: 74788 - DNA, 20 bp, human
gcgcccgtcttagaaggagg

SEQ ID NO: 74789 - DNA, 20 bp, human
ggcggtcggtgctgcgagag

SEQ ID NO: 74790 - DNA, 20 bp, human
gcaccgcccgtcttagaagg

SEQ ID NO: 74791 - DNA, 20 bp, human
ggcgggcacggggtattgtc

SEQ ID NO: 74792 - DNA, 20 bp, human
gtattgtccggctccggcgg

SEQ ID NO: 74793 - DNA, 20 bp, human
ggcgtcgggacagatctatc

SEQ ID NO: 74794 - DNA, 20 bp, human
gcagctgcggagcccgacac

SEQ ID NO: 74795 - DNA, 20 bp, human
ggggtattgtccggctccgg

SEQ ID NO: 74796 - DNA, 20 bp, human
ggtagaccggtgaagcacga

SEQ ID NO: 74797 - DNA, 20 bp, human
ggaagaccagcgccaccgtg

SEQ ID NO: 74798 - DNA, 20 bp, human
gcgggccgcggcaagactgg

SEQ ID NO: 74799 - DNA, 20 bp, human
gcggtggcgctggtcttctt

SEQ ID NO: 74800 - DNA, 20 bp, human
gacatgctagcgaggtagac

SEQ ID NO: 74801 - DNA, 20 bp, human
gggccgaaggcgccctcggg

SEQ ID NO: 74802 - DNA, 20 bp, human
ggcgtgacgatcgcccaggg

SEQ ID NO: 74803 - DNA, 20 bp, human
ggacagcagttacactgcgg

SEQ ID NO: 74804 - DNA, 20 bp, human
gggcgccttcggccccacgg

SEQ ID NO: 74805 - DNA, 20 bp, human
ggcctcccaggagtactaag

SEQ ID NO: 74806 - DNA, 20 bp, human
gggcccgcgcggcacttacg

SEQ ID NO: 74807 - DNA, 20 bp, human
gcaggaagggtcgccagggt

SEQ ID NO: 74808 - DNA, 20 bp, human
ggcgcgggcgggaagcgaag

SEQ ID NO: 74809 - DNA, 20 bp, human
ggttccagttcactcggcag

SEQ ID NO: 74810 - DNA, 20 bp, human
gcgaggagcgcggagagaaa

SEQ ID NO: 74811 - DNA, 20 bp, human
gcgtgagcccgccccaggaa

SEQ ID NO: 74812 - DNA, 20 bp, human
ggccccaggaagggtcgcca

SEQ ID NO: 74813 - DNA, 20 bp, human
ggcgccgctgccgagtgaac

SEQ ID NO: 74814 - DNA, 20 bp, human
gagcccggcccgcaccacac

SEQ ID NO: 74815 - DNA, 20 bp, human
gcgggaagcgaagaggcggg

SEQ ID NO: 74816 - DNA, 20 bp, human
ggcgtcgagggtactgagag

SEQ ID NO: 74817 - DNA, 20 bp, human
gtatctgtgcgtgtcaatgg

SEQ ID NO: 74818 - DNA, 20 bp, human
gcggcaagcggcagttctct

SEQ ID NO: 74819 - DNA, 20 bp, human
ggcgtgtcaatggcggcaag

SEQ ID NO: 74820 - DNA, 20 bp, human
gtccttgggcgataaagggg

SEQ ID NO: 74821 - DNA, 20 bp, human
gtctgggccgcggatagtag

SEQ ID NO: 74822 - DNA, 20 bp, human
ggaggggccgggggcgtcga

SEQ ID NO: 74823 - DNA, 20 bp, human
gcccacgcggcgccggtgcc

SEQ ID NO: 74824 - DNA, 20 bp, human
gggccgcggatagtagcggg

SEQ ID NO: 74825 - DNA, 20 bp, human
gagggtgggtcggctatcga

SEQ ID NO: 74826 - DNA, 20 bp, human
gaatccgagttcccggatga

SEQ ID NO: 74827 - DNA, 20 bp, human
ggcgggtggcagccattggt

SEQ ID NO: 74828 - DNA, 20 bp, human
gggtggtgggatctcaccgt

SEQ ID NO: 74829 - DNA, 20 bp, human
gcgcggtgcgacgaaggagt

SEQ ID NO: 74830 - DNA, 20 bp, human
gaaaaggctaatcggaccca

SEQ ID NO: 74831 - DNA, 20 bp, human
ggcgcgcccatcccccaccg

SEQ ID NO: 74832 - DNA, 20 bp, human
gccgcccgccgcgagatccg

SEQ ID NO: 74833 - DNA, 20 bp, human
gggagaatatagaattacca

SEQ ID NO: 74834 - DNA, 20 bp, human
gggagcagcctcggatctcg

SEQ ID NO: 74835 - DNA, 20 bp, human
ggacaggatttagaagagtg

SEQ ID NO: 74836 - DNA, 20 bp, human
gtagcaagaacagagagtga

SEQ ID NO: 74837 - DNA, 20 bp, human
gtcctctgagacaacctcgg

SEQ ID NO: 74838 - DNA, 20 bp, human
ggcttcctctgagacaacct

SEQ ID NO: 74839 - DNA, 20 bp, human
gctctgttcttgctatctaa

SEQ ID NO: 74840 - DNA, 20 bp, human
gatgctctggccttcctccg

SEQ ID NO: 74841 - DNA, 20 bp, human
ggcaagctcgccgaggccca

SEQ ID NO: 74842 - DNA, 20 bp, human
gcaggagcgcctgagcacct

SEQ ID NO: 74843 - DNA, 20 bp, human
gagaacagagagtgacggtt

SEQ ID NO: 74844 - DNA, 20 bp, human
ggagtgacggttggggacca

SEQ ID NO: 74845 - DNA, 20 bp, human
ggctgcttccgccatggctg

SEQ ID NO: 74846 - DNA, 20 bp, human
gagatggcacgaccagacaa

SEQ ID NO: 74847 - DNA, 20 bp, human
gcgggtctcccaggcagtga

SEQ ID NO: 74848 - DNA, 20 bp, human
ggtccccgcggcagttggag

SEQ ID NO: 74849 - DNA, 20 bp, human
gttgtggaccggggaagccg

SEQ ID NO: 74850 - DNA, 20 bp, human
gagcaggcgcacagccatcc

SEQ ID NO: 74851 - DNA, 20 bp, human
ggaaggtccagccatggcgg

SEQ ID NO: 74852 - DNA, 20 bp, human
gcagcatggctccacgtctc

SEQ ID NO: 74853 - DNA, 20 bp, human
gctcccaggcagtgatggtc

SEQ ID NO: 74854 - DNA, 20 bp, human
ggcaagctcgccgagtccga

SEQ ID NO: 74855 - DNA, 20 bp, human
ggctgcgtaccgaagtgccc

SEQ ID NO: 74856 - DNA, 20 bp, human
gctgaggcggcgagagacgg

SEQ ID NO: 74857 - DNA, 20 bp, human
ggttaccccagggtgcgaag

SEQ ID NO: 74858 - DNA, 20 bp, human
gcaaaaagcgagttacccca

SEQ ID NO: 74859 - DNA, 20 bp, human
gaccccagggtgcgaagcgg

SEQ ID NO: 74860 - DNA, 20 bp, human
gtttcccgctcgaaaactgg

SEQ ID NO: 74861 - DNA, 20 bp, human
gcccgggggcggtagttaag

SEQ ID NO: 74862 - DNA, 20 bp, human
gaccgaagaaagaggagcca

SEQ ID NO: 74863 - DNA, 20 bp, human
ggccgccgcttcgcaccctg

SEQ ID NO: 74864 - DNA, 20 bp, human
ggtagttaagaggcccgcgc

SEQ ID NO: 74865 - DNA, 20 bp, human
ggggatttcaccgaagaaag

SEQ ID NO: 74866 - DNA, 20 bp, human
gcttggagcgcagagcggtt

SEQ ID NO: 74867 - DNA, 20 bp, human
gtcgcagcctgagtcattag

SEQ ID NO: 74868 - DNA, 20 bp, human
gcatctgctgccgcgaggtg

SEQ ID NO: 74869 - DNA, 20 bp, human
ggggggcttggagcgcagag

SEQ ID NO: 74870 - DNA, 20 bp, human
gggtttggtcgttcgttggg

SEQ ID NO: 74871 - DNA, 20 bp, human
ggcctccgcccgtcgaggaa

SEQ ID NO: 74872 - DNA, 20 bp, human
ggaggagcggcagcctcccc

SEQ ID NO: 74873 - DNA, 20 bp, human
gagcctgagtcattagggga

SEQ ID NO: 74874 - DNA, 20 bp, human
gcgcggcagcagatggccga

SEQ ID NO: 74875 - DNA, 20 bp, human
gggcgcgcggcgccaacggt

SEQ ID NO: 74876 - DNA, 20 bp, human
ggcgagcgaagaaccgacac

SEQ ID NO: 74877 - DNA, 20 bp, human
gggatttcaacactgacctg

SEQ ID NO: 74878 - DNA, 20 bp, human
ggcctcctgcagcgcaccga

SEQ ID NO: 74879 - DNA, 20 bp, human
gggcttcaccccgcaggtag

SEQ ID NO: 74880 - DNA, 20 bp, human
gtcgttcgttggaccagtgt

SEQ ID NO: 74881 - DNA, 20 bp, human
gaggagggcgcagagcggtt

SEQ ID NO: 74882 - DNA, 20 bp, human
ggcggaagcagcgcggaggt

SEQ ID NO: 74883 - DNA, 20 bp, human
gggttcttcgctcgcgactg

SEQ ID NO: 74884 - DNA, 20 bp, human
gcgatgaggcttcaccccgc

SEQ ID NO: 74885 - DNA, 20 bp, human
gaagcaccccctctacctgc

SEQ ID NO: 74886 - DNA, 20 bp, human
gaggggaaggcgcgaggcca

SEQ ID NO: 74887 - DNA, 20 bp, human
gctcagttccgggaagccca

SEQ ID NO: 74888 - DNA, 20 bp, human
gcctccagggtcgccccgag

SEQ ID NO: 74889 - DNA, 20 bp, human
gaggacagctcggccgctcg

SEQ ID NO: 74890 - DNA, 20 bp, human
gctcctccgggacacggccg

SEQ ID NO: 74891 - DNA, 20 bp, human
gcgccccggccgtgtcccgg

SEQ ID NO: 74892 - DNA, 20 bp, human
ggacactccgataccgcccg

SEQ ID NO: 74893 - DNA, 20 bp, human
gacgggccctgcggaagagg

SEQ ID NO: 74894 - DNA, 20 bp, human
ggggccgggcccgctcccga

SEQ ID NO: 74895 - DNA, 20 bp, human
ggccgagctgtcctttccct

SEQ ID NO: 74896 - DNA, 20 bp, human
ggcggctagagcttcagcac

SEQ ID NO: 74897 - DNA, 20 bp, human
gggcacgtgaacccagtcct

SEQ ID NO: 74898 - DNA, 20 bp, human
gagctgtccccatacagacc

SEQ ID NO: 74899 - DNA, 20 bp, human
gctgctgtgccgggtctgta

SEQ ID NO: 74900 - DNA, 20 bp, human
gggctcctacgagtcatcct

SEQ ID NO: 74901 - DNA, 20 bp, human
gtagagcttcagcacaggct

SEQ ID NO: 74902 - DNA, 20 bp, human
gctctcccaggatgactcgt

SEQ ID NO: 74903 - DNA, 20 bp, human
ggttctcacacaagcggaag

SEQ ID NO: 74904 - DNA, 20 bp, human
gtagagccagggcggactgc

SEQ ID NO: 74905 - DNA, 20 bp, human
gtgactcgtaggagcctctc

SEQ ID NO: 74906 - DNA, 20 bp, human
gggaggacagcgctgcgagg

SEQ ID NO: 74907 - DNA, 20 bp, human
ggaggcgcccgggacagtca

SEQ ID NO: 74908 - DNA, 20 bp, human
gcctgggtgaaggagaaccg

SEQ ID NO: 74909 - DNA, 20 bp, human
gggcgctccatgactgtccc

SEQ ID NO: 74910 - DNA, 20 bp, human
gtgagcttgttgcagaccgg

SEQ ID NO: 74911 - DNA, 20 bp, human
gcactagaatgtaggcctgg

SEQ ID NO: 74912 - DNA, 20 bp, human
gcggagctgcgggcctccga

SEQ ID NO: 74913 - DNA, 20 bp, human
gtgtaggagatgacatgaca

SEQ ID NO: 74914 - DNA, 20 bp, human
gcagtcatggagcgccgcct

SEQ ID NO: 74915 - DNA, 20 bp, human
gagctgcgggcctccgacgg

SEQ ID NO: 74916 - DNA, 20 bp, human
gacatggagatcagacatcc

SEQ ID NO: 74917 - DNA, 20 bp, human
gtggaggctccgctccaaga

SEQ ID NO: 74918 - DNA, 20 bp, human
gacacctgttcccatgggag

SEQ ID NO: 74919 - DNA, 20 bp, human
ggacttgagccatcttggag

SEQ ID NO: 74920 - DNA, 20 bp, human
gaggaggaccaagctaggct

SEQ ID NO: 74921 - DNA, 20 bp, human
gtggtcctcctagtaaactt

SEQ ID NO: 74922 - DNA, 20 bp, human
ggactccgaagtttactagg

SEQ ID NO: 74923 - DNA, 20 bp, human
ggtcagacacctgttcccat

SEQ ID NO: 74924 - DNA, 20 bp, human
gttactaggaggaccaagct

SEQ ID NO: 74925 - DNA, 20 bp, human
gtgttgtctatgcctttagg

SEQ ID NO: 74926 - DNA, 20 bp, human
gggacagggtagggcccgga

SEQ ID NO: 74927 - DNA, 20 bp, human
ggaccactgcgggcccggga

SEQ ID NO: 74928 - DNA, 20 bp, human
ggaggggcccgggaacagta

SEQ ID NO: 74929 - DNA, 20 bp, human
gagcggcccgatagccccgg

SEQ ID NO: 74930 - DNA, 20 bp, human
ggtaggggccggacagggta

SEQ ID NO: 74931 - DNA, 20 bp, human
gcgccggtaggggccggaca

SEQ ID NO: 74932 - DNA, 20 bp, human
gcgggaccccagtctcacag

SEQ ID NO: 74933 - DNA, 20 bp, human
gcgcgtctcagcgaagccgg

SEQ ID NO: 74934 - DNA, 20 bp, human
ggtggtcgcggcggcatgaa

SEQ ID NO: 74935 - DNA, 20 bp, human
gcccggcgcccgtcgctcag

SEQ ID NO: 74936 - DNA, 20 bp, human
ggcggcggcgggtgtactgt

SEQ ID NO: 74937 - DNA, 20 bp, human
ggtactgtaggtggtcggtc

SEQ ID NO: 74938 - DNA, 20 bp, human
ggcggcgggtgtactgtagg

SEQ ID NO: 74939 - DNA, 20 bp, human
ggctccggccgcgtcaaggt

SEQ ID NO: 74940 - DNA, 20 bp, human
gtcaccctcgggcaactcca

SEQ ID NO: 74941 - DNA, 20 bp, human
gcgggcccaggcgagatgta

SEQ ID NO: 74942 - DNA, 20 bp, human
gaggccacgcgagcccggga

SEQ ID NO: 74943 - DNA, 20 bp, human
gcagccggaggcccgagacc

SEQ ID NO: 74944 - DNA, 20 bp, human
gcggccgcgtcaaggtcggg

SEQ ID NO: 74945 - DNA, 20 bp, human
gcgggtgtactgtaggtggt

SEQ ID NO: 74946 - DNA, 20 bp, human
ggtcagaggtgcagtaccag

SEQ ID NO: 74947 - DNA, 20 bp, human
gcacgcagccggcaaacaag

SEQ ID NO: 74948 - DNA, 20 bp, human
gagcaaggcaaacgcgaaat

SEQ ID NO: 74949 - DNA, 20 bp, human
gcaagcggaatcatccagca

SEQ ID NO: 74950 - DNA, 20 bp, human
gcctgaggaacgaagaacag

SEQ ID NO: 74951 - DNA, 20 bp, human
gggtccccgccagcttccgt

SEQ ID NO: 74952 - DNA, 20 bp, human
gctggaatgaaaggctccta

SEQ ID NO: 74953 - DNA, 20 bp, human
gcctagctgctgggcagcaa

SEQ ID NO: 74954 - DNA, 20 bp, human
ggctaggcatcaagtacatc

SEQ ID NO: 74955 - DNA, 20 bp, human
ggctctgcgaagttactgtc

SEQ ID NO: 74956 - DNA, 20 bp, human
gcagcgaggagacccgggca

SEQ ID NO: 74957 - DNA, 20 bp, human
gcccagagtctggctttccg

SEQ ID NO: 74958 - DNA, 20 bp, human
gcagggaagacgcgcgaggc

SEQ ID NO: 74959 - DNA, 20 bp, human
ggccgcggaaagccagactc

SEQ ID NO: 74960 - DNA, 20 bp, human
gagagcttccacctcagggt

SEQ ID NO: 74961 - DNA, 20 bp, human
gagcacgtgacggtcatcgg

SEQ ID NO: 74962 - DNA, 20 bp, human
gggtgggcggccaagcgcgt

SEQ ID NO: 74963 - DNA, 20 bp, human
gaaccttcagcgggccctgg

SEQ ID NO: 74964 - DNA, 20 bp, human
gtgcctggtgacgaaggcca

SEQ ID NO: 74965 - DNA, 20 bp, human
gcgccgccgctgccacacca

SEQ ID NO: 74966 - DNA, 20 bp, human
gcggcagcgaaagggagacg

SEQ ID NO: 74967 - DNA, 20 bp, human
gcacgggaaaccgggtccca

SEQ ID NO: 74968 - DNA, 20 bp, human
ggctcggccgcacccgttag

SEQ ID NO: 74969 - DNA, 20 bp, human
gcagtggagagcgcctctaa

SEQ ID NO: 74970 - DNA, 20 bp, human
gctcggccaggcctcacctc

SEQ ID NO: 74971 - DNA, 20 bp, human
gccaggcctcacctcgggag

SEQ ID NO: 74972 - DNA, 20 bp, human
gccggagttccaggagaatc

SEQ ID NO: 74973 - DNA, 20 bp, human
gcggagacgcagccctctgt

SEQ ID NO: 74974 - DNA, 20 bp, human
gcggatcaagaaaatatgag

SEQ ID NO: 74975 - DNA, 20 bp, human
gggcctcacctcgggagcgg

SEQ ID NO: 74976 - DNA, 20 bp, human
ggctctgcgggaccaagggg

SEQ ID NO: 74977 - DNA, 20 bp, human
gagggctcgccgtctcacct

SEQ ID NO: 74978 - DNA, 20 bp, human
ggaaactcctcggacaaggt

SEQ ID NO: 74979 - DNA, 20 bp, human
ggccgccgacctgggtacag

SEQ ID NO: 74980 - DNA, 20 bp, human
ggtccgcgaggactccctct

SEQ ID NO: 74981 - DNA, 20 bp, human
gacctgaaccttgctccgag

SEQ ID NO: 74982 - DNA, 20 bp, human
gctccgagagggagtcctcg

SEQ ID NO: 74983 - DNA, 20 bp, human
gcaaggctctgcgggaccaa

SEQ ID NO: 74984 - DNA, 20 bp, human
gggttcaggtccaagtacca

SEQ ID NO: 74985 - DNA, 20 bp, human
gccctctcggagcaaggttc

SEQ ID NO: 74986 - DNA, 20 bp, human
gcggcccgggtcatggtggt

SEQ ID NO: 74987 - DNA, 20 bp, human
ggatgccctggaggcgtcag

SEQ ID NO: 74988 - DNA, 20 bp, human
gccggcgccgaggagagcct

SEQ ID NO: 74989 - DNA, 20 bp, human
gcgcgcccctgacgcctcca

SEQ ID NO: 74990 - DNA, 20 bp, human
gccgcgctgccgggctcgag

SEQ ID NO: 74991 - DNA, 20 bp, human
ggcaggacgcgatgccctgg

SEQ ID NO: 74992 - DNA, 20 bp, human
ggcccaggactgcaaaacac

SEQ ID NO: 74993 - DNA, 20 bp, human
gacgccgggtccccagacgg

SEQ ID NO: 74994 - DNA, 20 bp, human
gggcggaggcgcagacaggg

SEQ ID NO: 74995 - DNA, 20 bp, human
ggagaccgcggtccttgcag

SEQ ID NO: 74996 - DNA, 20 bp, human
gggctgtgctgaggacccga

SEQ ID NO: 74997 - DNA, 20 bp, human
gccgccaggcagcagcgaaa

SEQ ID NO: 74998 - DNA, 20 bp, human
gggcctgccctcaccctctt

SEQ ID NO: 74999 - DNA, 20 bp, human
ggccgcaagacccctgaccc

SEQ ID NO: 75000 - DNA, 20 bp, human
gcagcacagccgtgccggtg

SEQ ID NO: 75001 - DNA, 20 bp, human
ggacgtggctgtgcccaaga

SEQ ID NO: 75002 - DNA, 20 bp, human
gccgaaggacagactgacgg

SEQ ID NO: 75003 - DNA, 20 bp, human
ggctctccacaccctaggaa

SEQ ID NO: 75004 - DNA, 20 bp, human
ggccgcccgcctcaccggca

SEQ ID NO: 75005 - DNA, 20 bp, human
gagcgggccccgccctgaag

SEQ ID NO: 75006 - DNA, 20 bp, human
gtgagctgcgcgtcctggca

SEQ ID NO: 75007 - DNA, 20 bp, human
ggtacgtgcaccgtgtatct

SEQ ID NO: 75008 - DNA, 20 bp, human
ggaggacttaagatccccag

SEQ ID NO: 75009 - DNA, 20 bp, human
gaggacgcgcagctcactgt

SEQ ID NO: 75010 - DNA, 20 bp, human
gcacgtacgtggggaatggc

SEQ ID NO: 75011 - DNA, 20 bp, human
gtacacggtgcacgtacgtg

SEQ ID NO: 75012 - DNA, 20 bp, human
gtcctcagctggtcacagga

SEQ ID NO: 75013 - DNA, 20 bp, human
gcagggaaaatgatgagcag

SEQ ID NO: 75014 - DNA, 20 bp, human
ggaacagcacctcccagggt

SEQ ID NO: 75015 - DNA, 20 bp, human
gctgggcctgctggacaacg

SEQ ID NO: 75016 - DNA, 20 bp, human
gctcctcatccacaccacgt

SEQ ID NO: 75017 - DNA, 20 bp, human
gaggcaagcggcccagatct

SEQ ID NO: 75018 - DNA, 20 bp, human
gagagccaggcctcagccta

SEQ ID NO: 75019 - DNA, 20 bp, human
gagccagacagacggcacga

SEQ ID NO: 75020 - DNA, 20 bp, human
gcaggacgtctcaggagtac

SEQ ID NO: 75021 - DNA, 20 bp, human
gaagcgggaacagagcgaca

SEQ ID NO: 75022 - DNA, 20 bp, human
gtgccatcgtgccgtctgtc

SEQ ID NO: 75023 - DNA, 20 bp, human
gggagtactggcagctgaac

SEQ ID NO: 75024 - DNA, 20 bp, human
gcgggtgtctccagtgccct

SEQ ID NO: 75025 - DNA, 20 bp, human
ggcagagctcaggacgtctc

SEQ ID NO: 75026 - DNA, 20 bp, human
gccgcccgcagggaagtccg

SEQ ID NO: 75027 - DNA, 20 bp, human
gctggcgtcaggaccatagg

SEQ ID NO: 75028 - DNA, 20 bp, human
gggcctggcgtcaggaccat

SEQ ID NO: 75029 - DNA, 20 bp, human
ggcgtcaggaccataggcgg

SEQ ID NO: 75030 - DNA, 20 bp, human
gtcaggaccataggcggtgg

SEQ ID NO: 75031 - DNA, 20 bp, human
gcctcgcccgcggcagaaac

SEQ ID NO: 75032 - DNA, 20 bp, human
ggcttcggcgacctcgcccg

SEQ ID NO: 75033 - DNA, 20 bp, human
gaaaccggtaagaagacagt

SEQ ID NO: 75034 - DNA, 20 bp, human
ggctccaacatgaacctcgt

SEQ ID NO: 75035 - DNA, 20 bp, human
gcaaagccggcgcccagtag

SEQ ID NO: 75036 - DNA, 20 bp, human
gaagctaacccggaatccag

SEQ ID NO: 75037 - DNA, 20 bp, human
gcctgggctggacgacgtga

SEQ ID NO: 75038 - DNA, 20 bp, human
gtgacggcggtggttctcct

SEQ ID NO: 75039 - DNA, 20 bp, human
gcaggggcgagtctgagccg

SEQ ID NO: 75040 - DNA, 20 bp, human
gggaagctccggggtgacgg

SEQ ID NO: 75041 - DNA, 20 bp, human
ggaaggggagggtcgcacgg

SEQ ID NO: 75042 - DNA, 20 bp, human
gcgaggaagctccggggtga

SEQ ID NO: 75043 - DNA, 20 bp, human
gccggtccagctgtgccggg

SEQ ID NO: 75044 - DNA, 20 bp, human
ggcgcccaagaacccagatc

SEQ ID NO: 75045 - DNA, 20 bp, human
ggtccagctgtgccgggggg

SEQ ID NO: 75046 - DNA, 20 bp, human
gcaccgccaaccgcaaggag

SEQ ID NO: 75047 - DNA, 20 bp, human
gggtccgtcctaagtactag

SEQ ID NO: 75048 - DNA, 20 bp, human
gcgcgcccggtgaagcgccg

SEQ ID NO: 75049 - DNA, 20 bp, human
ggggagcagcgataacccgg

SEQ ID NO: 75050 - DNA, 20 bp, human
gcgaggcaccgccaaccgca

SEQ ID NO: 75051 - DNA, 20 bp, human
gcactcgcgcagttcggcga

SEQ ID NO: 75052 - DNA, 20 bp, human
gggtgtcggcgggtacgttg

SEQ ID NO: 75053 - DNA, 20 bp, human
ggctggtcagtaccaggggg

SEQ ID NO: 75054 - DNA, 20 bp, human
gcaaccgcaaggagcggcgc

SEQ ID NO: 75055 - DNA, 20 bp, human
gaggagctggtcagtaccag

SEQ ID NO: 75056 - DNA, 20 bp, human
ggccgggggagcattttcac

SEQ ID NO: 75057 - DNA, 20 bp, human
gattgatacaaattagccgg

SEQ ID NO: 75058 - DNA, 20 bp, human
gaagtgaagtaacataggtt

SEQ ID NO: 75059 - DNA, 20 bp, human
gaggttattgctatcccaga

SEQ ID NO: 75060 - DNA, 20 bp, human
gacaccaccaacgtaaaact

SEQ ID NO: 75061 - DNA, 20 bp, human
gaatagtcatatatagactt

SEQ ID NO: 75062 - DNA, 20 bp, human
ggtaaaaatagcgataaatt

SEQ ID NO: 75063 - DNA, 20 bp, human
gaggagatcttattttggta

SEQ ID NO: 75064 - DNA, 20 bp, human
gtagagagggaaaagttctt

SEQ ID NO: 75065 - DNA, 20 bp, human
gatcattgatacaaattagc

SEQ ID NO: 75066 - DNA, 20 bp, human
gcaggtgttagggaactcag

SEQ ID NO: 75067 - DNA, 20 bp, human
ggacgcagccactcaaagcc

SEQ ID NO: 75068 - DNA, 20 bp, human
gcttggcaaagatggtccta

SEQ ID NO: 75069 - DNA, 20 bp, human
gcctagggagacaggtgtta

SEQ ID NO: 75070 - DNA, 20 bp, human
gtaatgtcttccagtcctca

SEQ ID NO: 75071 - DNA, 20 bp, human
ggctcactgccggaggtgtt

SEQ ID NO: 75072 - DNA, 20 bp, human
gtgaactgtgggtagtgatg

SEQ ID NO: 75073 - DNA, 20 bp, human
gaagcctggctcactgccgg

SEQ ID NO: 75074 - DNA, 20 bp, human
gcacttctttccctgaggac

SEQ ID NO: 75075 - DNA, 20 bp, human
gtgtatggtggaatattcgt

SEQ ID NO: 75076 - DNA, 20 bp, human
gagatgcgcccgaagaggtt

SEQ ID NO: 75077 - DNA, 20 bp, human
gccgggtcgccggccaacgt

SEQ ID NO: 75078 - DNA, 20 bp, human
gggtcgccggccaacgtagg

SEQ ID NO: 75079 - DNA, 20 bp, human
gtccagctcccgaataaagg

SEQ ID NO: 75080 - DNA, 20 bp, human
ggtcccgccgcagcagcgga

SEQ ID NO: 75081 - DNA, 20 bp, human
ggctgagggcgaaggtgcac

SEQ ID NO: 75082 - DNA, 20 bp, human
gactcgagatgcgcccgaag

SEQ ID NO: 75083 - DNA, 20 bp, human
ggctcagggccggacacccc

SEQ ID NO: 75084 - DNA, 20 bp, human
gtcctccagctcccgaataa

SEQ ID NO: 75085 - DNA, 20 bp, human
gtgggtccccgggtccgagc

SEQ ID NO: 75086 - DNA, 20 bp, human
ggatgaaacaaggatagtat

SEQ ID NO: 75087 - DNA, 20 bp, human
gtggcagaggtcctgatcct

SEQ ID NO: 75088 - DNA, 20 bp, human
gtagcacctgagatgaaaca

SEQ ID NO: 75089 - DNA, 20 bp, human
ggtcctgaaatccaggagtt

SEQ ID NO: 75090 - DNA, 20 bp, human
gaaggtataaccaaaagagg

SEQ ID NO: 75091 - DNA, 20 bp, human
gtgctcctgtaaatctggta

SEQ ID NO: 75092 - DNA, 20 bp, human
gcagagacaaacttaaggtg

SEQ ID NO: 75093 - DNA, 20 bp, human
gggaatgggaatgtccagcc

SEQ ID NO: 75094 - DNA, 20 bp, human
gaaggatagtataggctgaa

SEQ ID NO: 75095 - DNA, 20 bp, human
ggctagtgctcctgtaaatc

SEQ ID NO: 75096 - DNA, 20 bp, human
gtagtcacagggctggacac

SEQ ID NO: 75097 - DNA, 20 bp, human
ggggctgggaacccatgaag

SEQ ID NO: 75098 - DNA, 20 bp, human
gatgcgcactcaggcaccag

SEQ ID NO: 75099 - DNA, 20 bp, human
ggaggcgcatatggaaaggg

SEQ ID NO: 75100 - DNA, 20 bp, human
gtggcttagtggactgatgg

SEQ ID NO: 75101 - DNA, 20 bp, human
gatcactattccgggaccag

SEQ ID NO: 75102 - DNA, 20 bp, human
gtccagctgcttcaagaaac

SEQ ID NO: 75103 - DNA, 20 bp, human
gtttcaggtgggaactatcc

SEQ ID NO: 75104 - DNA, 20 bp, human
gggacacaggtctcttaaca

SEQ ID NO: 75105 - DNA, 20 bp, human
gagaggtgtagattgatcgg

SEQ ID NO: 75106 - DNA, 20 bp, human
gcgacggctagagctctcgg

SEQ ID NO: 75107 - DNA, 20 bp, human
ggaccctggacagacgacag

SEQ ID NO: 75108 - DNA, 20 bp, human
gcgcgagctgtcccggtcca

SEQ ID NO: 75109 - DNA, 20 bp, human
ggcatccaacagatacccag

SEQ ID NO: 75110 - DNA, 20 bp, human
ggcgccgcggacggcactgg

SEQ ID NO: 75111 - DNA, 20 bp, human
gtaagccacgtaccgtcccc

SEQ ID NO: 75112 - DNA, 20 bp, human
gggctctgctccctcacggt

SEQ ID NO: 75113 - DNA, 20 bp, human
ggagagagccaagcggaccc

SEQ ID NO: 75114 - DNA, 20 bp, human
gcgggggccgcgagctgtcc

SEQ ID NO: 75115 - DNA, 20 bp, human
gtcagactgctgccttggac

SEQ ID NO: 75116 - DNA, 20 bp, human
gggaggtctaggtcacccag

SEQ ID NO: 75117 - DNA, 20 bp, human
ggcgccaacgaccagaacct

SEQ ID NO: 75118 - DNA, 20 bp, human
gcaacggtcatggcaaaggt

SEQ ID NO: 75119 - DNA, 20 bp, human
gtaggcaacggtcatggcaa

SEQ ID NO: 75120 - DNA, 20 bp, human
gcccaggggagcaaagagcc

SEQ ID NO: 75121 - DNA, 20 bp, human
gagaacctaggcaacggtca

SEQ ID NO: 75122 - DNA, 20 bp, human
gccagtggaaaggggacctg

SEQ ID NO: 75123 - DNA, 20 bp, human
gcagcttgcttctcagacag

SEQ ID NO: 75124 - DNA, 20 bp, human
gacggactgcccttctacaa

SEQ ID NO: 75125 - DNA, 20 bp, human
gggagcaaagagccgggtgc

SEQ ID NO: 75126 - DNA, 20 bp, human
gagcggcgggatgtccatag

SEQ ID NO: 75127 - DNA, 20 bp, human
gagcggcggctgctggaccc

SEQ ID NO: 75128 - DNA, 20 bp, human
gggcgggatgtccatagcgg

SEQ ID NO: 75129 - DNA, 20 bp, human
gagccccgacgcgttctcca

SEQ ID NO: 75130 - DNA, 20 bp, human
ggcgctcggctcctcgttgg

SEQ ID NO: 75131 - DNA, 20 bp, human
gagggcgctcggctcctcgt

SEQ ID NO: 75132 - DNA, 20 bp, human
gcgatcttgccggccagcgg

SEQ ID NO: 75133 - DNA, 20 bp, human
gtaggttccaaagtcaccaa

SEQ ID NO: 75134 - DNA, 20 bp, human
gcccggactcgccgccaacg

SEQ ID NO: 75135 - DNA, 20 bp, human
ggagctttggagggtttctg

SEQ ID NO: 75136 - DNA, 20 bp, human
ggcgcagtccgggtgcgtag

SEQ ID NO: 75137 - DNA, 20 bp, human
gcgcacacccggttaagact

SEQ ID NO: 75138 - DNA, 20 bp, human
gagagacaggagagtgccag

SEQ ID NO: 75139 - DNA, 20 bp, human
ggtgcgtaggggccgctcgg

SEQ ID NO: 75140 - DNA, 20 bp, human
gggacctgcccagtcttaac

SEQ ID NO: 75141 - DNA, 20 bp, human
gcagagggatatagattcag

SEQ ID NO: 75142 - DNA, 20 bp, human
ggtgtgcggggagcgcagtc

SEQ ID NO: 75143 - DNA, 20 bp, human
gatccaagattggggagacg

SEQ ID NO: 75144 - DNA, 20 bp, human
ggcgcgggcaagatggtaag

SEQ ID NO: 75145 - DNA, 20 bp, human
gcacccggttaagactgggc

SEQ ID NO: 75146 - DNA, 20 bp, human
ggaagagcgccagtcgacgt

SEQ ID NO: 75147 - DNA, 20 bp, human
ggttagtacctgcgaagctg

SEQ ID NO: 75148 - DNA, 20 bp, human
gctggcagccgcggagaggt

SEQ ID NO: 75149 - DNA, 20 bp, human
ggtgcagtcgccggttccgg

SEQ ID NO: 75150 - DNA, 20 bp, human
gcgtcgccgatagacaccta

SEQ ID NO: 75151 - DNA, 20 bp, human
gtaacctggcagccgcggag

SEQ ID NO: 75152 - DNA, 20 bp, human
gacctgagggccaggaagta

SEQ ID NO: 75153 - DNA, 20 bp, human
gggaaccggcgactgcacag

SEQ ID NO: 75154 - DNA, 20 bp, human
gaggagggcccaacccggct

SEQ ID NO: 75155 - DNA, 20 bp, human
gtctctcagcgcccccgggt

SEQ ID NO: 75156 - DNA, 20 bp, human
gcgcaggtcgagacagcagg

SEQ ID NO: 75157 - DNA, 20 bp, human
gctcaagtggacagccggga

SEQ ID NO: 75158 - DNA, 20 bp, human
gcaccgcaggtcgagacagc

SEQ ID NO: 75159 - DNA, 20 bp, human
gccagggtgttcgggacata

SEQ ID NO: 75160 - DNA, 20 bp, human
gttccctccacagatcgagg

SEQ ID NO: 75161 - DNA, 20 bp, human
ggtcttgtagggaggagagt

SEQ ID NO: 75162 - DNA, 20 bp, human
gaggagctggtgaaacttca

SEQ ID NO: 75163 - DNA, 20 bp, human
gcctccacagatcgaggagg

SEQ ID NO: 75164 - DNA, 20 bp, human
gctgggaggacgtaaagcca

SEQ ID NO: 75165 - DNA, 20 bp, human
gaggctggggcaaccaccgc

SEQ ID NO: 75166 - DNA, 20 bp, human
gcgcacctcactagtcacga

SEQ ID NO: 75167 - DNA, 20 bp, human
gtgggaagaagtccgagcag

SEQ ID NO: 75168 - DNA, 20 bp, human
gcgcgcaccagggaaaactc

SEQ ID NO: 75169 - DNA, 20 bp, human
gctggctactaagggaactt

SEQ ID NO: 75170 - DNA, 20 bp, human
gtgccgaagctggctactaa

SEQ ID NO: 75171 - DNA, 20 bp, human
gctagtcacgaaggctgagg

SEQ ID NO: 75172 - DNA, 20 bp, human
gtcactagtcacgaaggctg

SEQ ID NO: 75173 - DNA, 20 bp, human
gcagcttcggcacttccggg

SEQ ID NO: 75174 - DNA, 20 bp, human
gttcagtgtcagtacatagt

SEQ ID NO: 75175 - DNA, 20 bp, human
ggctactaagggaacttggg

SEQ ID NO: 75176 - DNA, 20 bp, human
gcagctctctggccacagag

SEQ ID NO: 75177 - DNA, 20 bp, human
gtgggatggccgctcacaca

SEQ ID NO: 75178 - DNA, 20 bp, human
gtcatcgcagtgggtctggc

SEQ ID NO: 75179 - DNA, 20 bp, human
gcacacctgtctcatcgcag

SEQ ID NO: 75180 - DNA, 20 bp, human
gagacccactgcgatgagac

SEQ ID NO: 75181 - DNA, 20 bp, human
gggccatcccaagtacatgt

SEQ ID NO: 75182 - DNA, 20 bp, human
gacacacgtggtcacacata

SEQ ID NO: 75183 - DNA, 20 bp, human
gtctctggccacagagaggc

SEQ ID NO: 75184 - DNA, 20 bp, human
gggatttgcctgtggcacat

SEQ ID NO: 75185 - DNA, 20 bp, human
gagatacagaaatacggaca

SEQ ID NO: 75186 - DNA, 20 bp, human
ggattcggtggactacgtgc

SEQ ID NO: 75187 - DNA, 20 bp, human
ggaatctccgagcgccttga

SEQ ID NO: 75188 - DNA, 20 bp, human
gaaggcgctcggagattcgg

SEQ ID NO: 75189 - DNA, 20 bp, human
gtcaaagtggccggctggaa

SEQ ID NO: 75190 - DNA, 20 bp, human
gcgggtcacgagtgggctga

SEQ ID NO: 75191 - DNA, 20 bp, human
gtgggtgttcgggtcacgag

SEQ ID NO: 75192 - DNA, 20 bp, human
gggaaagaccccaggaaagt

SEQ ID NO: 75193 - DNA, 20 bp, human
gacacagccttcaaggcgct

SEQ ID NO: 75194 - DNA, 20 bp, human
gacattgaaggaaagacccc

SEQ ID NO: 75195 - DNA, 20 bp, human
ggcctctcaaagtggccggc

SEQ ID NO: 75196 - DNA, 20 bp, human
gggaggcagaagggcaacaa

SEQ ID NO: 75197 - DNA, 20 bp, human
ggacccccttaagttggagg

SEQ ID NO: 75198 - DNA, 20 bp, human
gggcagaagggcaacaacgg

SEQ ID NO: 75199 - DNA, 20 bp, human
gtaagacccccttaagttgg

SEQ ID NO: 75200 - DNA, 20 bp, human
gtcttaacaagtgagctggt

SEQ ID NO: 75201 - DNA, 20 bp, human
gaaggagaagtcaagacgtc

SEQ ID NO: 75202 - DNA, 20 bp, human
gagggcaacaacggcgggga

SEQ ID NO: 75203 - DNA, 20 bp, human
gtgcctcctccaacttaagg

SEQ ID NO: 75204 - DNA, 20 bp, human
gggaagactcagcagaaccc

SEQ ID NO: 75205 - DNA, 20 bp, human
gctgtctgtgtggtcccgga

SEQ ID NO: 75206 - DNA, 20 bp, human
gacaggtgcaaacccccggg

SEQ ID NO: 75207 - DNA, 20 bp, human
gccagcctggagccccgcac

SEQ ID NO: 75208 - DNA, 20 bp, human
ggcacgcgccgggtacttaa

SEQ ID NO: 75209 - DNA, 20 bp, human
ggaggtcgtagaaggtgcgg

SEQ ID NO: 75210 - DNA, 20 bp, human
gcgggaggtcgtagaaggtg

SEQ ID NO: 75211 - DNA, 20 bp, human
gcggacaggtgcaaaccccc

SEQ ID NO: 75212 - DNA, 20 bp, human
gcgcgccgggtacttaaggg

SEQ ID NO: 75213 - DNA, 20 bp, human
gagggggctcccgaaagcca

SEQ ID NO: 75214 - DNA, 20 bp, human
gacccccgggaggtcgtaga

SEQ ID NO: 75215 - DNA, 20 bp, human
gggcagcaaaaccttcctgc

SEQ ID NO: 75216 - DNA, 20 bp, human
ggcgcggaccgccgccaaca

SEQ ID NO: 75217 - DNA, 20 bp, human
gggtgatcgtagctcggaaa

SEQ ID NO: 75218 - DNA, 20 bp, human
gtccgagctacgatcacccg

SEQ ID NO: 75219 - DNA, 20 bp, human
gatcgtagctcggaaatggc

SEQ ID NO: 75220 - DNA, 20 bp, human
ggatcacccgcggctgagga

SEQ ID NO: 75221 - DNA, 20 bp, human
gggaggaggcggccagatcg

SEQ ID NO: 75222 - DNA, 20 bp, human
gaaatggcgggtaagttacc

SEQ ID NO: 75223 - DNA, 20 bp, human
gtggaaggtagacggagacc

SEQ ID NO: 75224 - DNA, 20 bp, human
gaccgggaaaagtttaccaa

SEQ ID NO: 75225 - DNA, 20 bp, human
ggctcagaagttgactgtag

SEQ ID NO: 75226 - DNA, 20 bp, human
gcggctcccgccactttact

SEQ ID NO: 75227 - DNA, 20 bp, human
gggcttgcagatagtgacgg

SEQ ID NO: 75228 - DNA, 20 bp, human
gggagttcctagtaaagtgg

SEQ ID NO: 75229 - DNA, 20 bp, human
gtcctgcggctccatagctg

SEQ ID NO: 75230 - DNA, 20 bp, human
gcgcggaagcagttcagatg

SEQ ID NO: 75231 - DNA, 20 bp, human
gccgggaggctcccagtgtt

SEQ ID NO: 75232 - DNA, 20 bp, human
ggcgccctgcatcccaacac

SEQ ID NO: 75233 - DNA, 20 bp, human
ggagagaaacgcaggtgatg

SEQ ID NO: 75234 - DNA, 20 bp, human
ggtggcgggagccgcagcta

SEQ ID NO: 75235 - DNA, 20 bp, human
gaggagagtctaagcacggg

SEQ ID NO: 75236 - DNA, 20 bp, human
gtcggacgcaccttccgcga

SEQ ID NO: 75237 - DNA, 20 bp, human
gacccggcgtccgcgcctaa

SEQ ID NO: 75238 - DNA, 20 bp, human
ggacgccgggtcccacgggt

SEQ ID NO: 75239 - DNA, 20 bp, human
gagtctagaggcagtatcac

SEQ ID NO: 75240 - DNA, 20 bp, human
gatggccgctgccaacccgt

SEQ ID NO: 75241 - DNA, 20 bp, human
gcccttacactacagtctag

SEQ ID NO: 75242 - DNA, 20 bp, human
gggaaggtgcgtccgagcca

SEQ ID NO: 75243 - DNA, 20 bp, human
gcgaaggcgccaagagtgag

SEQ ID NO: 75244 - DNA, 20 bp, human
ggggtcccacgggttggcag

SEQ ID NO: 75245 - DNA, 20 bp, human
gctgcgatcccgctcactct

SEQ ID NO: 75246 - DNA, 20 bp, human
gggcccgcgtcagtcacctc

SEQ ID NO: 75247 - DNA, 20 bp, human
gggctcctgcgagaagcaag

SEQ ID NO: 75248 - DNA, 20 bp, human
gagggccgcgcgaaccccag

SEQ ID NO: 75249 - DNA, 20 bp, human
ggcgtccaggcgctcccgtg

SEQ ID NO: 75250 - DNA, 20 bp, human
gcggccttcagccagcgctg

SEQ ID NO: 75251 - DNA, 20 bp, human
gggcaagccccagggatccg

SEQ ID NO: 75252 - DNA, 20 bp, human
gcgcgcctcgcactgcctca

SEQ ID NO: 75253 - DNA, 20 bp, human
ggaggcagcggcaagcccca

SEQ ID NO: 75254 - DNA, 20 bp, human
ggatacaccagacgcgccag

SEQ ID NO: 75255 - DNA, 20 bp, human
gttggggccgcggatccctg

SEQ ID NO: 75256 - DNA, 20 bp, human
ggctccggaacctctcgttc

SEQ ID NO: 75257 - DNA, 20 bp, human
gctttcagcttggtctttcc

SEQ ID NO: 75258 - DNA, 20 bp, human
gtgcgcccggcccgaacgag

SEQ ID NO: 75259 - DNA, 20 bp, human
gcaggtttgctttagagggt

SEQ ID NO: 75260 - DNA, 20 bp, human
gcggcccgaacgagaggttc

SEQ ID NO: 75261 - DNA, 20 bp, human
gcacgtctgagtgcagaggg

SEQ ID NO: 75262 - DNA, 20 bp, human
gaagctgaaaggcccgggaa

SEQ ID NO: 75263 - DNA, 20 bp, human
gcttggccgcccagacagaa

SEQ ID NO: 75264 - DNA, 20 bp, human
gttcggggaagaggagctct

SEQ ID NO: 75265 - DNA, 20 bp, human
gccggcgcgggcgggttctg

SEQ ID NO: 75266 - DNA, 20 bp, human
gtgggcggtcgaagagatgg

SEQ ID NO: 75267 - DNA, 20 bp, human
gggcgcgcccgtgacgtcag

SEQ ID NO: 75268 - DNA, 20 bp, human
gtagctccatgacagcgccg

SEQ ID NO: 75269 - DNA, 20 bp, human
ggcgggcgccacacttgaag

SEQ ID NO: 75270 - DNA, 20 bp, human
ggagctagcgcaggaagcgc

SEQ ID NO: 75271 - DNA, 20 bp, human
ggagtcgagtcctcaatgag

SEQ ID NO: 75272 - DNA, 20 bp, human
gctaaccaagaaggacactc

SEQ ID NO: 75273 - DNA, 20 bp, human
gcgggaactgggttgctggg

SEQ ID NO: 75274 - DNA, 20 bp, human
gtcttggttaggttaaggga

SEQ ID NO: 75275 - DNA, 20 bp, human
gggttaggttaagggaggga

SEQ ID NO: 75276 - DNA, 20 bp, human
gccttcgggtttctgattct

SEQ ID NO: 75277 - DNA, 20 bp, human
gccctcctccctcggacgcc

SEQ ID NO: 75278 - DNA, 20 bp, human
ggcacactgctcttccttaa

SEQ ID NO: 75279 - DNA, 20 bp, human
gtccttaagggcgggagtct

SEQ ID NO: 75280 - DNA, 20 bp, human
gcgcacctcggagtgtaagg

SEQ ID NO: 75281 - DNA, 20 bp, human
gggcgagggagcctgaaccg

SEQ ID NO: 75282 - DNA, 20 bp, human
gcactgctcttccttaaggg

SEQ ID NO: 75283 - DNA, 20 bp, human
gacacgcacctcggagtgta

SEQ ID NO: 75284 - DNA, 20 bp, human
gccggcctccttacactccg

SEQ ID NO: 75285 - DNA, 20 bp, human
gaccgagactcccgccctta

SEQ ID NO: 75286 - DNA, 20 bp, human
gggcggcgacgactactcag

SEQ ID NO: 75287 - DNA, 20 bp, human
gacgactactcagaggacga

SEQ ID NO: 75288 - DNA, 20 bp, human
gctcggagcgcgaaacatgg

SEQ ID NO: 75289 - DNA, 20 bp, human
gcggctcggagcgcgaaaca

SEQ ID NO: 75290 - DNA, 20 bp, human
gagaccccgcaagatcccta

SEQ ID NO: 75291 - DNA, 20 bp, human
gacatggcggggcaggacgc

SEQ ID NO: 75292 - DNA, 20 bp, human
gttgccggccagtgaagcca

SEQ ID NO: 75293 - DNA, 20 bp, human
ggatccctaaggccaggcct

SEQ ID NO: 75294 - DNA, 20 bp, human
gggcgacagcagcgtgtcca

SEQ ID NO: 75295 - DNA, 20 bp, human
gcggggcaggacgctggctg

SEQ ID NO: 75296 - DNA, 20 bp, human
gtggctaccaccctagagcg

SEQ ID NO: 75297 - DNA, 20 bp, human
gagggccattggcaaagctg

SEQ ID NO: 75298 - DNA, 20 bp, human
gacccagccacgctctaggg

SEQ ID NO: 75299 - DNA, 20 bp, human
gcgcctcccctctccaggta

SEQ ID NO: 75300 - DNA, 20 bp, human
ggtcacccagccacgctcta

SEQ ID NO: 75301 - DNA, 20 bp, human
gaagccagccctacctggag

SEQ ID NO: 75302 - DNA, 20 bp, human
gccagggcttgggacagcgg

SEQ ID NO: 75303 - DNA, 20 bp, human
ggcttgaagccagccctacc

SEQ ID NO: 75304 - DNA, 20 bp, human
gcaggcgcaggctgactagt

SEQ ID NO: 75305 - DNA, 20 bp, human
gcaccggacagatagacgtg

SEQ ID NO: 75306 - DNA, 20 bp, human
gggtcgggccttgaggtgga

SEQ ID NO: 75307 - DNA, 20 bp, human
ggtggaaggcgggaaaatgg

SEQ ID NO: 75308 - DNA, 20 bp, human
ggacatcacagtaaagaccc

SEQ ID NO: 75309 - DNA, 20 bp, human
ggaggtggaaggcgggaaaa

SEQ ID NO: 75310 - DNA, 20 bp, human
gggcgaggcgctgggtgagt

SEQ ID NO: 75311 - DNA, 20 bp, human
ggccgaggacgcggaactca

SEQ ID NO: 75312 - DNA, 20 bp, human
ggcgcgtgggaggattaaag

SEQ ID NO: 75313 - DNA, 20 bp, human
ggtccgacccgcaagcaagg

SEQ ID NO: 75314 - DNA, 20 bp, human
gacccactaccgccgatggt

SEQ ID NO: 75315 - DNA, 20 bp, human
gctgatctgtcggacagtag

SEQ ID NO: 75316 - DNA, 20 bp, human
gtaataagcaaaaagggcca

SEQ ID NO: 75317 - DNA, 20 bp, human
gaaagggccacggaagaact

SEQ ID NO: 75318 - DNA, 20 bp, human
gaaagctccacgtccaccag

SEQ ID NO: 75319 - DNA, 20 bp, human
gaatccttggtgggagatag

SEQ ID NO: 75320 - DNA, 20 bp, human
ggagtaaactgggcctctgg

SEQ ID NO: 75321 - DNA, 20 bp, human
gctattactgcatatgatgt

SEQ ID NO: 75322 - DNA, 20 bp, human
ggactacacctccttaccaa

SEQ ID NO: 75323 - DNA, 20 bp, human
ggtcgttgtggccactgagt

SEQ ID NO: 75324 - DNA, 20 bp, human
gactgggcctctggtggacg

SEQ ID NO: 75325 - DNA, 20 bp, human
ggcagtaatagcactagctg

SEQ ID NO: 75326 - DNA, 20 bp, human
gagtggaacacaacagtgaa

SEQ ID NO: 75327 - DNA, 20 bp, human
gttggtcacaggcctgatga

SEQ ID NO: 75328 - DNA, 20 bp, human
gcttatgctgggagttgcta

SEQ ID NO: 75329 - DNA, 20 bp, human
gtagaagaaggatgagagtg

SEQ ID NO: 75330 - DNA, 20 bp, human
gtgagagtgaggcttatgct

SEQ ID NO: 75331 - DNA, 20 bp, human
gcccgctagtcagatggact

SEQ ID NO: 75332 - DNA, 20 bp, human
gtcatctgagacattattag

SEQ ID NO: 75333 - DNA, 20 bp, human
gtccgagtccatctgactag

SEQ ID NO: 75334 - DNA, 20 bp, human
gccttcttctaacacagatt

SEQ ID NO: 75335 - DNA, 20 bp, human
gagtacagatgcatcatcca

SEQ ID NO: 75336 - DNA, 20 bp, human
ggtggtccattcgcagacgg

SEQ ID NO: 75337 - DNA, 20 bp, human
ggaccactggaggggttcaa

SEQ ID NO: 75338 - DNA, 20 bp, human
gcgggcggggaagaccgtga

SEQ ID NO: 75339 - DNA, 20 bp, human
gggtgatgcaacagggaccc

SEQ ID NO: 75340 - DNA, 20 bp, human
gctgcaggagttgaaggagt

SEQ ID NO: 75341 - DNA, 20 bp, human
ggcttgctttccggtagcgt

SEQ ID NO: 75342 - DNA, 20 bp, human
gaaggttcgcgtcccagtac

SEQ ID NO: 75343 - DNA, 20 bp, human
gcacactgaagaaaaactgg

SEQ ID NO: 75344 - DNA, 20 bp, human
gctgttgcatcaccccaggt

SEQ ID NO: 75345 - DNA, 20 bp, human
gtccggctcggacaagggtg

SEQ ID NO: 75346 - DNA, 20 bp, human
gtggggaccagaagagtgcc

SEQ ID NO: 75347 - DNA, 20 bp, human
gccctggcgcgctcgcggcc

SEQ ID NO: 75348 - DNA, 20 bp, human
gcaggagacagcaccatggt

SEQ ID NO: 75349 - DNA, 20 bp, human
gactcagagagaacccacca

SEQ ID NO: 75350 - DNA, 20 bp, human
gtgcgcgtgcaggtcgctca

SEQ ID NO: 75351 - DNA, 20 bp, human
gcggggagaagcagagtgag

SEQ ID NO: 75352 - DNA, 20 bp, human
gggttctctctgagtctgtg

SEQ ID NO: 75353 - DNA, 20 bp, human
ggccttgacgttggtcttgt

SEQ ID NO: 75354 - DNA, 20 bp, human
gccccaggcggccttgacgt

SEQ ID NO: 75355 - DNA, 20 bp, human
gcacgcgcacaagcttcggg

SEQ ID NO: 75356 - DNA, 20 bp, human
gtaaaccctggcgcgctcgc

SEQ ID NO: 75357 - DNA, 20 bp, human
gccctggcgcgctcgcgggc

SEQ ID NO: 75358 - DNA, 20 bp, human
gcaggagacagcaccatggt

SEQ ID NO: 75359 - DNA, 20 bp, human
gcggggagaagcagagtgag

SEQ ID NO: 75360 - DNA, 20 bp, human
gtgcgcgtgcaggtcgctca

SEQ ID NO: 75361 - DNA, 20 bp, human
ggccttgacgttggtcttgt

SEQ ID NO: 75362 - DNA, 20 bp, human
gccccaggcggccttgacgt

SEQ ID NO: 75363 - DNA, 20 bp, human
gactcagagagaacccacca

SEQ ID NO: 75364 - DNA, 20 bp, human
gcacgcgcacaagcttcggg

SEQ ID NO: 75365 - DNA, 20 bp, human
gagggagcctcacctctcca

SEQ ID NO: 75366 - DNA, 20 bp, human
gtggggaccagaagagtgcc

SEQ ID NO: 75367 - DNA, 20 bp, human
gccctggcgcgctcgcggcc

SEQ ID NO: 75368 - DNA, 20 bp, human
gcaggagacagcaccatggt

SEQ ID NO: 75369 - DNA, 20 bp, human
gactcagagagaacccacca

SEQ ID NO: 75370 - DNA, 20 bp, human
gtgcgcgtgcaggtcgctca

SEQ ID NO: 75371 - DNA, 20 bp, human
gcggggagaagcagagtgag

SEQ ID NO: 75372 - DNA, 20 bp, human
gggttctctctgagtctgtg

SEQ ID NO: 75373 - DNA, 20 bp, human
ggccttgacgttggtcttgt

SEQ ID NO: 75374 - DNA, 20 bp, human
gccccaggcggccttgacgt

SEQ ID NO: 75375 - DNA, 20 bp, human
gcacgcgcacaagcttcggg

SEQ ID NO: 75376 - DNA, 20 bp, human
gtaaaccctggcgcgctcgc

SEQ ID NO: 75377 - DNA, 20 bp, human
gccctggcgcgctcgcgggc

SEQ ID NO: 75378 - DNA, 20 bp, human
gcaggagacagcaccatggt

SEQ ID NO: 75379 - DNA, 20 bp, human
gcggggagaagcagagtgag

SEQ ID NO: 75380 - DNA, 20 bp, human
gtgcgcgtgcaggtcgctca

SEQ ID NO: 75381 - DNA, 20 bp, human
ggccttgacgttggtcttgt

SEQ ID NO: 75382 - DNA, 20 bp, human
gccccaggcggccttgacgt

SEQ ID NO: 75383 - DNA, 20 bp, human
gactcagagagaacccacca

SEQ ID NO: 75384 - DNA, 20 bp, human
gcacgcgcacaagcttcggg

SEQ ID NO: 75385 - DNA, 20 bp, human
gagggagcctcacctctcca

SEQ ID NO: 75386 - DNA, 20 bp, human
gtagaccaccagcagcctaa

SEQ ID NO: 75387 - DNA, 20 bp, human
ggaacttcagggtgagtcta

SEQ ID NO: 75388 - DNA, 20 bp, human
gagctcactcagtgtggcaa

SEQ ID NO: 75389 - DNA, 20 bp, human
gaaggagaccaatagaaact

SEQ ID NO: 75390 - DNA, 20 bp, human
gaccaccagcagcctaaggg

SEQ ID NO: 75391 - DNA, 20 bp, human
gtgtggcaaaggtgcccttg

SEQ ID NO: 75392 - DNA, 20 bp, human
ggtctgccgttactgccctg

SEQ ID NO: 75393 - DNA, 20 bp, human
gcccacccttaggctgctgg

SEQ ID NO: 75394 - DNA, 20 bp, human
gggtatcaaggttacaagac

SEQ ID NO: 75395 - DNA, 20 bp, human
gccaatagaaactgggcatg

SEQ ID NO: 75396 - DNA, 20 bp, human
gaggaccagcataaaaggca

SEQ ID NO: 75397 - DNA, 20 bp, human
gcttaaaccaacctgctcac

SEQ ID NO: 75398 - DNA, 20 bp, human
ggggtaggaaaacagcccaa

SEQ ID NO: 75399 - DNA, 20 bp, human
gaaggaggcaaatggaaact

SEQ ID NO: 75400 - DNA, 20 bp, human
gtagaccaccagtaatctga

SEQ ID NO: 75401 - DNA, 20 bp, human
gccaccagtaatctgagggt

SEQ ID NO: 75402 - DNA, 20 bp, human
gaggttataagagaggctca

SEQ ID NO: 75403 - DNA, 20 bp, human
gccaacctgctcactggagc

SEQ ID NO: 75404 - DNA, 20 bp, human
gggttggtttaagataagca

SEQ ID NO: 75405 - DNA, 20 bp, human
gtgacagcagtcttctcctc

SEQ ID NO: 75406 - DNA, 20 bp, human
ggggtaggaaaacagcccaa

SEQ ID NO: 75407 - DNA, 20 bp, human
gaggaccagcataaaaggca

SEQ ID NO: 75408 - DNA, 20 bp, human
gtgacagcagtcttctcctc

SEQ ID NO: 75409 - DNA, 20 bp, human
gtagaccaccagtaatctga

SEQ ID NO: 75410 - DNA, 20 bp, human
gccaccagtaatctgagggt

SEQ ID NO: 75411 - DNA, 20 bp, human
gaaggaggcaaatggaaact

SEQ ID NO: 75412 - DNA, 20 bp, human
ggactgctgtcaatgccctg

SEQ ID NO: 75413 - DNA, 20 bp, human
gaggttataagagaggctca

SEQ ID NO: 75414 - DNA, 20 bp, human
gcttaaaccaacctgctcac

SEQ ID NO: 75415 - DNA, 20 bp, human
gggttggtttaagataagca

SEQ ID NO: 75416 - DNA, 20 bp, human
ggctctcaggcctggcatca

SEQ ID NO: 75417 - DNA, 20 bp, human
gcaatcactagcaagctctc

SEQ ID NO: 75418 - DNA, 20 bp, human
gggtccaggggtaaacaacg

SEQ ID NO: 75419 - DNA, 20 bp, human
ggatggcagagggagacgac

SEQ ID NO: 75420 - DNA, 20 bp, human
gggctgccgtcactagcctg

SEQ ID NO: 75421 - DNA, 20 bp, human
ggccttgggcaggtaagcat

SEQ ID NO: 75422 - DNA, 20 bp, human
gtgccatgggccttgacctt

SEQ ID NO: 75423 - DNA, 20 bp, human
gagcaagatgaatgtggaag

SEQ ID NO: 75424 - DNA, 20 bp, human
gtcaaggtgagttcaggtgc

SEQ ID NO: 75425 - DNA, 20 bp, human
gggagatgctattaaaaaca

SEQ ID NO: 75426 - DNA, 20 bp, human
ggaccccgcgcgcctaggtc

SEQ ID NO: 75427 - DNA, 20 bp, human
ggcgcaagggccccaccaag

SEQ ID NO: 75428 - DNA, 20 bp, human
ggcagccgcggcctgattgt

SEQ ID NO: 75429 - DNA, 20 bp, human
gtgtgggtagggctactgac

SEQ ID NO: 75430 - DNA, 20 bp, human
gcccgtccgccagagcgcaa

SEQ ID NO: 75431 - DNA, 20 bp, human
gttcggccgaaggagctacg

SEQ ID NO: 75432 - DNA, 20 bp, human
gccatccccccgatctccgg

SEQ ID NO: 75433 - DNA, 20 bp, human
ggccgcagcgcacccggcac

SEQ ID NO: 75434 - DNA, 20 bp, human
gggcgcggcggaggactggg

SEQ ID NO: 75435 - DNA, 20 bp, human
ggcgggcgcggcggaggact

SEQ ID NO: 75436 - DNA, 20 bp, human
ggtagcaaggatggttctta

SEQ ID NO: 75437 - DNA, 20 bp, human
gggtgtaggagaaatccggt

SEQ ID NO: 75438 - DNA, 20 bp, human
gaaggttcagtgaagacctg

SEQ ID NO: 75439 - DNA, 20 bp, human
gaggaattcaaggtttagtc

SEQ ID NO: 75440 - DNA, 20 bp, human
gtccaagctttaggaattca

SEQ ID NO: 75441 - DNA, 20 bp, human
gtgattgcagctgagtagca

SEQ ID NO: 75442 - DNA, 20 bp, human
gtagaggtctttcttcccac

SEQ ID NO: 75443 - DNA, 20 bp, human
gtgcaatcaatccagccccc

SEQ ID NO: 75444 - DNA, 20 bp, human
gacacaccacaaacacaaac

SEQ ID NO: 75445 - DNA, 20 bp, human
gagtaaagacacttgtacac

SEQ ID NO: 75446 - DNA, 20 bp, human
gagatcatccaggtgcttta

SEQ ID NO: 75447 - DNA, 20 bp, human
ggccatgggtcatttcacag

SEQ ID NO: 75448 - DNA, 20 bp, human
ggacccatggcgtctggact

SEQ ID NO: 75449 - DNA, 20 bp, human
gtcctctgtgaaatgaccca

SEQ ID NO: 75450 - DNA, 20 bp, human
gctcgcttctggaacgtctg

SEQ ID NO: 75451 - DNA, 20 bp, human
gctcctagtccagacgccat

SEQ ID NO: 75452 - DNA, 20 bp, human
gggagaaaccctgggaaggt

SEQ ID NO: 75453 - DNA, 20 bp, human
gggtgcccttgagatcatcc

SEQ ID NO: 75454 - DNA, 20 bp, human
gcgttccagaagcgagtgtg

SEQ ID NO: 75455 - DNA, 20 bp, human
gtggaggagaaaccctggga

SEQ ID NO: 75456 - DNA, 20 bp, human
ggcgcgtgcaggtccgccag

SEQ ID NO: 75457 - DNA, 20 bp, human
ggcccccagagcacgtcagg

SEQ ID NO: 75458 - DNA, 20 bp, human
gaccaggtcagtgaccgggg

SEQ ID NO: 75459 - DNA, 20 bp, human
gctgctgctcaggtcggtag

SEQ ID NO: 75460 - DNA, 20 bp, human
ggcggcccccagagcacgtc

SEQ ID NO: 75461 - DNA, 20 bp, human
gcacgggcagcgcatgctgg

SEQ ID NO: 75462 - DNA, 20 bp, human
ggcccaaatcgcgcaggtct

SEQ ID NO: 75463 - DNA, 20 bp, human
gcacgaggcgcaattcgggg

SEQ ID NO: 75464 - DNA, 20 bp, human
gaaaggcctcaccggaaagt

SEQ ID NO: 75465 - DNA, 20 bp, human
gccggccggaaaggcctcac

SEQ ID NO: 75466 - DNA, 20 bp, human
gagcttgaaagacttggtaa

SEQ ID NO: 75467 - DNA, 20 bp, human
gtgaggagtaagagctgccg

SEQ ID NO: 75468 - DNA, 20 bp, human
ggctcacctgggcttcgggg

SEQ ID NO: 75469 - DNA, 20 bp, human
ggtctcccgcgagctcacct

SEQ ID NO: 75470 - DNA, 20 bp, human
gggagcagtaacccgcgcgg

SEQ ID NO: 75471 - DNA, 20 bp, human
gggcggcgctagggggtctc

SEQ ID NO: 75472 - DNA, 20 bp, human
gcgggagacgctgctccggt

SEQ ID NO: 75473 - DNA, 20 bp, human
ggtgcccgcggcgagcccac

SEQ ID NO: 75474 - DNA, 20 bp, human
gggcgacgggtttggtaagt

SEQ ID NO: 75475 - DNA, 20 bp, human
ggaagcccaggtgagctcgc

SEQ ID NO: 75476 - DNA, 20 bp, human
ggcgccctgtggaagaagct

SEQ ID NO: 75477 - DNA, 20 bp, human
gggtcctgcgagaggaacgt

SEQ ID NO: 75478 - DNA, 20 bp, human
gagaagctgggcagcaacgt

SEQ ID NO: 75479 - DNA, 20 bp, human
ggggatggcgctgtccgcgg

SEQ ID NO: 75480 - DNA, 20 bp, human
ggctgcccagcttcttccac

SEQ ID NO: 75481 - DNA, 20 bp, human
gggcgctgtccgcggaggac

SEQ ID NO: 75482 - DNA, 20 bp, human
ggtcggcgtctacacgacag

SEQ ID NO: 75483 - DNA, 20 bp, human
gggggccctcccggggacag

SEQ ID NO: 75484 - DNA, 20 bp, human
gtgggcccctgtccccggga

SEQ ID NO: 75485 - DNA, 20 bp, human
gtgggagaagtaggtcttcg

SEQ ID NO: 75486 - DNA, 20 bp, human
ggcgcgacggcaatgcctca

SEQ ID NO: 75487 - DNA, 20 bp, human
gaagccaagatggcgcatag

SEQ ID NO: 75488 - DNA, 20 bp, human
gtggcgcataggggttctcc

SEQ ID NO: 75489 - DNA, 20 bp, human
gagccgggaaaagaacgtcc

SEQ ID NO: 75490 - DNA, 20 bp, human
ggtgctgcatagcgtcatat

SEQ ID NO: 75491 - DNA, 20 bp, human
gtaaggcgccaactgcagcc

SEQ ID NO: 75492 - DNA, 20 bp, human
ggaacccctatgcgccatct

SEQ ID NO: 75493 - DNA, 20 bp, human
gcgctcggcgcagaggcctg

SEQ ID NO: 75494 - DNA, 20 bp, human
gtgcatagcgtcatatgggt

SEQ ID NO: 75495 - DNA, 20 bp, human
gggctctcccaatcccgaca

SEQ ID NO: 75496 - DNA, 20 bp, human
gtggggaggggaccatggag

SEQ ID NO: 75497 - DNA, 20 bp, human
gacagtggggagggcactgt

SEQ ID NO: 75498 - DNA, 20 bp, human
gatgatggtcctctcagtct

SEQ ID NO: 75499 - DNA, 20 bp, human
ggagtctgaccacagagtct

SEQ ID NO: 75500 - DNA, 20 bp, human
gctggccaacaccccctgta

SEQ ID NO: 75501 - DNA, 20 bp, human
gctctcctgtggccttacag

SEQ ID NO: 75502 - DNA, 20 bp, human
gacagagtctaggagagata

SEQ ID NO: 75503 - DNA, 20 bp, human
gaaggccacaggagaggaac

SEQ ID NO: 75504 - DNA, 20 bp, human
gcagtcccaccaggccctga

SEQ ID NO: 75505 - DNA, 20 bp, human
ggtggccttacagggggtgt

SEQ ID NO: 75506 - DNA, 20 bp, human
ggcccagggagtccccacaa

SEQ ID NO: 75507 - DNA, 20 bp, human
gctctccagcacggagtccg

SEQ ID NO: 75508 - DNA, 20 bp, human
gggacccaatcgctcctcta

SEQ ID NO: 75509 - DNA, 20 bp, human
gatgccgtagaggagcgatt

SEQ ID NO: 75510 - DNA, 20 bp, human
gcggggacagagcaagtgtc

SEQ ID NO: 75511 - DNA, 20 bp, human
gtcctcctcggactccgtgc

SEQ ID NO: 75512 - DNA, 20 bp, human
gtctgagaggcggtagggtg

SEQ ID NO: 75513 - DNA, 20 bp, human
gcacgacccgttgtacatgg

SEQ ID NO: 75514 - DNA, 20 bp, human
gccagagaaaggacctccct

SEQ ID NO: 75515 - DNA, 20 bp, human
gtcgtgctgccgcatcgagg

SEQ ID NO: 75516 - DNA, 20 bp, human
gctatgtgaggcgttgggac

SEQ ID NO: 75517 - DNA, 20 bp, human
gggacaactatgtgaggcgt

SEQ ID NO: 75518 - DNA, 20 bp, human
gcctcacatagttgtccatc

SEQ ID NO: 75519 - DNA, 20 bp, human
gcatagttgtccatcaggaa

SEQ ID NO: 75520 - DNA, 20 bp, human
gcagacacacacctccttgc

SEQ ID NO: 75521 - DNA, 20 bp, human
ggttgtccatcaggaagggc

SEQ ID NO: 75522 - DNA, 20 bp, human
gtgttggctatgaaccgcca

SEQ ID NO: 75523 - DNA, 20 bp, human
gagtgaatgctccagcaagg

SEQ ID NO: 75524 - DNA, 20 bp, human
gcggctgatgctcttcatgt

SEQ ID NO: 75525 - DNA, 20 bp, human
gtagaaagtcagccactgcc

SEQ ID NO: 75526 - DNA, 20 bp, human
gaaagtggcgtgtgtctgta

SEQ ID NO: 75527 - DNA, 20 bp, human
gcatagtagtccatcacgaa

SEQ ID NO: 75528 - DNA, 20 bp, human
gaacaccggcggcaacacct

SEQ ID NO: 75529 - DNA, 20 bp, human
gaaacatgaagagcaccagc

SEQ ID NO: 75530 - DNA, 20 bp, human
gctatgtgcggcgttcagac

SEQ ID NO: 75531 - DNA, 20 bp, human
ggtagtccatcacgaacggc

SEQ ID NO: 75532 - DNA, 20 bp, human
gcagacacacgccactttgc

SEQ ID NO: 75533 - DNA, 20 bp, human
gggggacatcccttgccggc

SEQ ID NO: 75534 - DNA, 20 bp, human
gatctgcctgccgttcgtga

SEQ ID NO: 75535 - DNA, 20 bp, human
gtgtttgccatgaaccgcca

SEQ ID NO: 75536 - DNA, 20 bp, human
gggttcgggttggcgactga

SEQ ID NO: 75537 - DNA, 20 bp, human
gtggcgactgaaggcggtac

SEQ ID NO: 75538 - DNA, 20 bp, human
ggcggtgaccgcagccacag

SEQ ID NO: 75539 - DNA, 20 bp, human
gcggtgaccgagtgagagga

SEQ ID NO: 75540 - DNA, 20 bp, human
gacagcggtgaccgagtgag

SEQ ID NO: 75541 - DNA, 20 bp, human
gcaggcctgaggcgggagtg

SEQ ID NO: 75542 - DNA, 20 bp, human
gtggtgacccgggtggagga

SEQ ID NO: 75543 - DNA, 20 bp, human
gcacccgggtcaccactcct

SEQ ID NO: 75544 - DNA, 20 bp, human
gcgtcacagccaggaggtac

SEQ ID NO: 75545 - DNA, 20 bp, human
gagtggggcgaggatttccg

SEQ ID NO: 75546 - DNA, 20 bp, human
gccccgaagcggcaactgta

SEQ ID NO: 75547 - DNA, 20 bp, human
gacggcagaagaagcggtaa

SEQ ID NO: 75548 - DNA, 20 bp, human
gctagagttaggccccgaag

SEQ ID NO: 75549 - DNA, 20 bp, human
gaactgtacggcagaagaag

SEQ ID NO: 75550 - DNA, 20 bp, human
ggcgctcatgcctcctccct

SEQ ID NO: 75551 - DNA, 20 bp, human
ggagggctacgactgaggaa

SEQ ID NO: 75552 - DNA, 20 bp, human
gggctacgactgaggaaggg

SEQ ID NO: 75553 - DNA, 20 bp, human
gcgggacggtctcaagatgg

SEQ ID NO: 75554 - DNA, 20 bp, human
gtaggaggaagagaataggg

SEQ ID NO: 75555 - DNA, 20 bp, human
ggagaggcggctcaagatgg

SEQ ID NO: 75556 - DNA, 20 bp, human
gagggctgctgcaggatcat

SEQ ID NO: 75557 - DNA, 20 bp, human
gggtgggatctgggcgacag

SEQ ID NO: 75558 - DNA, 20 bp, human
gcctgggggcctcgctgcaa

SEQ ID NO: 75559 - DNA, 20 bp, human
gcttaggcgggcagatcctt

SEQ ID NO: 75560 - DNA, 20 bp, human
gccagggtgggcctgaccaa

SEQ ID NO: 75561 - DNA, 20 bp, human
gcaccagctgagacaggaat

SEQ ID NO: 75562 - DNA, 20 bp, human
gtgatgctgcaggcttaggc

SEQ ID NO: 75563 - DNA, 20 bp, human
gacaggggaggagtctctga

SEQ ID NO: 75564 - DNA, 20 bp, human
ggggatctgggcgacagggg

SEQ ID NO: 75565 - DNA, 20 bp, human
gtgggcacagctcctcggag

SEQ ID NO: 75566 - DNA, 20 bp, human
gaactcgcctccagttgagg

SEQ ID NO: 75567 - DNA, 20 bp, human
gggctcccagcctcctcaac

SEQ ID NO: 75568 - DNA, 20 bp, human
gcaaggaagcagtgaccggg

SEQ ID NO: 75569 - DNA, 20 bp, human
gagaaactcgcctccagttg

SEQ ID NO: 75570 - DNA, 20 bp, human
ggcctccagttgaggaggct

SEQ ID NO: 75571 - DNA, 20 bp, human
gccgcagctcaggatctccg

SEQ ID NO: 75572 - DNA, 20 bp, human
gcgggcggtgacagctgtca

SEQ ID NO: 75573 - DNA, 20 bp, human
gattgtgggcagaggggcgg

SEQ ID NO: 75574 - DNA, 20 bp, human
gcagccgggcagcccgggtc

SEQ ID NO: 75575 - DNA, 20 bp, human
gcgggggaccggccccgtga

SEQ ID NO: 75576 - DNA, 20 bp, human
gacagtgccgcccctcccta

SEQ ID NO: 75577 - DNA, 20 bp, human
ggcgagtggagggtgcccta

SEQ ID NO: 75578 - DNA, 20 bp, human
gcagaggcttagaggcgagt

SEQ ID NO: 75579 - DNA, 20 bp, human
ggcttagaggcgagtgggaa

SEQ ID NO: 75580 - DNA, 20 bp, human
ggagcacatcagaggcttag

SEQ ID NO: 75581 - DNA, 20 bp, human
gagtggagggtgccctaggg

SEQ ID NO: 75582 - DNA, 20 bp, human
gggagccgcgggtagcccgg

SEQ ID NO: 75583 - DNA, 20 bp, human
gctgcccgcgagacgaggag

SEQ ID NO: 75584 - DNA, 20 bp, human
gaggggtcgacagcgagtgg

SEQ ID NO: 75585 - DNA, 20 bp, human
gtggcgcccgcaggccatct

SEQ ID NO: 75586 - DNA, 20 bp, human
ggccagagagggagtcggtg

SEQ ID NO: 75587 - DNA, 20 bp, human
gtccacaccgactccctctc

SEQ ID NO: 75588 - DNA, 20 bp, human
gagccgggcgcttagaacag

SEQ ID NO: 75589 - DNA, 20 bp, human
ggagaccatatgctcttcaa

SEQ ID NO: 75590 - DNA, 20 bp, human
gccctaggtactgagctggg

SEQ ID NO: 75591 - DNA, 20 bp, human
gtcagtttctcactccgaag

SEQ ID NO: 75592 - DNA, 20 bp, human
gtctaaggcctgtctcccct

SEQ ID NO: 75593 - DNA, 20 bp, human
ggggcaaggtcaccactagt

SEQ ID NO: 75594 - DNA, 20 bp, human
gggtgtggacgcgaggagcc

SEQ ID NO: 75595 - DNA, 20 bp, human
gttagaacagaggcttgcac

SEQ ID NO: 75596 - DNA, 20 bp, human
gcccggaccgcagccactaa

SEQ ID NO: 75597 - DNA, 20 bp, human
gccgccgccgctgcccttag

SEQ ID NO: 75598 - DNA, 20 bp, human
ggcttcagcaccagccgcac

SEQ ID NO: 75599 - DNA, 20 bp, human
gccgcggccgagaagcgcct

SEQ ID NO: 75600 - DNA, 20 bp, human
gagacgccgaggggccccgg

SEQ ID NO: 75601 - DNA, 20 bp, human
gccaggcgcgcagctagcag

SEQ ID NO: 75602 - DNA, 20 bp, human
gaggctgccggagctaggcg

SEQ ID NO: 75603 - DNA, 20 bp, human
ggcagtacggcttcatgcag

SEQ ID NO: 75604 - DNA, 20 bp, human
gcgcgtcctccgggcatgga

SEQ ID NO: 75605 - DNA, 20 bp, human
ggcccttagtggctgcggtc

SEQ ID NO: 75606 - DNA, 20 bp, human
gtcgcgcccgggctctcccc

SEQ ID NO: 75607 - DNA, 20 bp, human
gcaacgcctcggcccggggc

SEQ ID NO: 75608 - DNA, 20 bp, human
ggccgccggccggagcccga

SEQ ID NO: 75609 - DNA, 20 bp, human
gcggcacgagaacgacacct

SEQ ID NO: 75610 - DNA, 20 bp, human
gcagcccgaacggcgagtgc

SEQ ID NO: 75611 - DNA, 20 bp, human
ggcgcccgcactcgccgttc

SEQ ID NO: 75612 - DNA, 20 bp, human
gtcgttctcgtgccgcgggg

SEQ ID NO: 75613 - DNA, 20 bp, human
gagctggcctggctgccgcg

SEQ ID NO: 75614 - DNA, 20 bp, human
ggtgtcgttctcgtgccgcg

SEQ ID NO: 75615 - DNA, 20 bp, human
ggccgtgctcgccgcgcccg

SEQ ID NO: 75616 - DNA, 20 bp, human
ggctctagcggaggcgtcgt

SEQ ID NO: 75617 - DNA, 20 bp, human
gcaggagcgggtgaagtcag

SEQ ID NO: 75618 - DNA, 20 bp, human
ggcagccccgcgggctctag

SEQ ID NO: 75619 - DNA, 20 bp, human
ggccccgcgggctctagcgg

SEQ ID NO: 75620 - DNA, 20 bp, human
gcgccccaccaagggacccc

SEQ ID NO: 75621 - DNA, 20 bp, human
gggcaccgcctccagtccag

SEQ ID NO: 75622 - DNA, 20 bp, human
gcagcgacttccggtattgg

SEQ ID NO: 75623 - DNA, 20 bp, human
gataccggaagtcgctgtag

SEQ ID NO: 75624 - DNA, 20 bp, human
gcaggcgggggagcaacggg

SEQ ID NO: 75625 - DNA, 20 bp, human
gtggctgccgaacacccgaa

SEQ ID NO: 75626 - DNA, 20 bp, human
gggctcccgccgcaaccgag

SEQ ID NO: 75627 - DNA, 20 bp, human
ggcgcagcctgcccaagcat

SEQ ID NO: 75628 - DNA, 20 bp, human
gcccgccgggcttacatcag

SEQ ID NO: 75629 - DNA, 20 bp, human
ggcctcaggcgcccatgctt

SEQ ID NO: 75630 - DNA, 20 bp, human
ggcccgtccggcccgtcccg

SEQ ID NO: 75631 - DNA, 20 bp, human
ggccgctgatgtaagcccgg

SEQ ID NO: 75632 - DNA, 20 bp, human
gcgagcccggggactcggag

SEQ ID NO: 75633 - DNA, 20 bp, human
gcggagcccagcgacccgcc

SEQ ID NO: 75634 - DNA, 20 bp, human
ggcggccgctgatgtaagcc

SEQ ID NO: 75635 - DNA, 20 bp, human
gcccgggaggaggtgtagcg

SEQ ID NO: 75636 - DNA, 20 bp, human
ggtgtctggcgctcagggtg

SEQ ID NO: 75637 - DNA, 20 bp, human
gagggtggggtagccgggaa

SEQ ID NO: 75638 - DNA, 20 bp, human
gtcatggtgtctggcgctca

SEQ ID NO: 75639 - DNA, 20 bp, human
gcccaacccaatgtgagcca

SEQ ID NO: 75640 - DNA, 20 bp, human
ggtcacaattgacagcctca

SEQ ID NO: 75641 - DNA, 20 bp, human
gggaaactggttcaaagcaa

SEQ ID NO: 75642 - DNA, 20 bp, human
gcgctcagggtggggtagcc

SEQ ID NO: 75643 - DNA, 20 bp, human
gccacaaaggtaaagatcca

SEQ ID NO: 75644 - DNA, 20 bp, human
ggaggatgacaagagatgac

SEQ ID NO: 75645 - DNA, 20 bp, human
ggggctggaagaaaggccaa

SEQ ID NO: 75646 - DNA, 20 bp, human
ggccgaggcagcgcagccta

SEQ ID NO: 75647 - DNA, 20 bp, human
gaggcagcgcagcctaggga

SEQ ID NO: 75648 - DNA, 20 bp, human
gctgcagtcccggcccctag

SEQ ID NO: 75649 - DNA, 20 bp, human
gaggaaggccgagcctctag

SEQ ID NO: 75650 - DNA, 20 bp, human
gggcctgccggcgttcagtg

SEQ ID NO: 75651 - DNA, 20 bp, human
gacccgcggcgagggatggg

SEQ ID NO: 75652 - DNA, 20 bp, human
gggaccttcctgcacctcgg

SEQ ID NO: 75653 - DNA, 20 bp, human
gcagcccccgaggtgcagga

SEQ ID NO: 75654 - DNA, 20 bp, human
gaggagccaagagtctcggg

SEQ ID NO: 75655 - DNA, 20 bp, human
gccggagggttgcggatccc

SEQ ID NO: 75656 - DNA, 20 bp, human
gccccgggaagcaaacaaag

SEQ ID NO: 75657 - DNA, 20 bp, human
ggacatcacgggctcaagtc

SEQ ID NO: 75658 - DNA, 20 bp, human
gaggtcgctgctctcggatg

SEQ ID NO: 75659 - DNA, 20 bp, human
gatttggtgccggacatcac

SEQ ID NO: 75660 - DNA, 20 bp, human
gtgaccagttgcgacaaggg

SEQ ID NO: 75661 - DNA, 20 bp, human
ggatgttgcaccgggaagat

SEQ ID NO: 75662 - DNA, 20 bp, human
gttgcttcccgggggaggga

SEQ ID NO: 75663 - DNA, 20 bp, human
gcccgggaggagactcaccc

SEQ ID NO: 75664 - DNA, 20 bp, human
gctcccgggcagccctccta

SEQ ID NO: 75665 - DNA, 20 bp, human
ggcccggcagaagactccgg

SEQ ID NO: 75666 - DNA, 20 bp, human
ggaagtccagaggaactgtg

SEQ ID NO: 75667 - DNA, 20 bp, human
ggtggtccagagaagtccag

SEQ ID NO: 75668 - DNA, 20 bp, human
gatcatggtggactggggtc

SEQ ID NO: 75669 - DNA, 20 bp, human
ggtggactggggtctggcag

SEQ ID NO: 75670 - DNA, 20 bp, human
gtgacccagatggatcatgg

SEQ ID NO: 75671 - DNA, 20 bp, human
gaaggggactcccagagaca

SEQ ID NO: 75672 - DNA, 20 bp, human
ggtcctgagaagtaatctcc

SEQ ID NO: 75673 - DNA, 20 bp, human
gatgtgacccagatggatca

SEQ ID NO: 75674 - DNA, 20 bp, human
gagcctggagattacttctc

SEQ ID NO: 75675 - DNA, 20 bp, human
gagtggttacaggggatggt

SEQ ID NO: 75676 - DNA, 20 bp, human
gaccgactgacggtagggac

SEQ ID NO: 75677 - DNA, 20 bp, human
gggacgggaggcgagcaaga

SEQ ID NO: 75678 - DNA, 20 bp, human
gggacggaccgactgacggt

SEQ ID NO: 75679 - DNA, 20 bp, human
ggggcggacggaccgactga

SEQ ID NO: 75680 - DNA, 20 bp, human
ggcagacgcagggcacccgg

SEQ ID NO: 75681 - DNA, 20 bp, human
ggcaagatggcgcagacgca

SEQ ID NO: 75682 - DNA, 20 bp, human
gagggtgcgtcggagcgggg

SEQ ID NO: 75683 - DNA, 20 bp, human
gaaaagatgaggaagggacg

SEQ ID NO: 75684 - DNA, 20 bp, human
gttgagtgggactcctagag

SEQ ID NO: 75685 - DNA, 20 bp, human
gaggctggagcgccgatggg

SEQ ID NO: 75686 - DNA, 20 bp, human
ggcgggagcgcacagaacct

SEQ ID NO: 75687 - DNA, 20 bp, human
gcgctgccgcaggcgatcca

SEQ ID NO: 75688 - DNA, 20 bp, human
gcccaggcgcgcagaaggca

SEQ ID NO: 75689 - DNA, 20 bp, human
ggcgaggctgcagtcgaagg

SEQ ID NO: 75690 - DNA, 20 bp, human
ggagcgcacagaacctaggc

SEQ ID NO: 75691 - DNA, 20 bp, human
gggtgcacaggtcaggacgg

SEQ ID NO: 75692 - DNA, 20 bp, human
gcgcagccctggatcgcctg

SEQ ID NO: 75693 - DNA, 20 bp, human
gtgggaacccagggtgacca

SEQ ID NO: 75694 - DNA, 20 bp, human
gaggcctcggaagaggagct

SEQ ID NO: 75695 - DNA, 20 bp, human
ggggatcccaggcgcgcaga

SEQ ID NO: 75696 - DNA, 20 bp, human
gccgcggcactcacatcccg

SEQ ID NO: 75697 - DNA, 20 bp, human
gccagtggctgcctccgtgg

SEQ ID NO: 75698 - DNA, 20 bp, human
gacgactgccagggtgtgat

SEQ ID NO: 75699 - DNA, 20 bp, human
gcccgcccaccgggacccct

SEQ ID NO: 75700 - DNA, 20 bp, human
gtacgcggacgcccccacgg

SEQ ID NO: 75701 - DNA, 20 bp, human
gccgcccggtcgcggagctg

SEQ ID NO: 75702 - DNA, 20 bp, human
gggctcccaggggtcccggt

SEQ ID NO: 75703 - DNA, 20 bp, human
gagacagaaatccgccccag

SEQ ID NO: 75704 - DNA, 20 bp, human
gctctgggtgacgactgcca

SEQ ID NO: 75705 - DNA, 20 bp, human
gtagcagcgcagcggggtca

SEQ ID NO: 75706 - DNA, 20 bp, human
gggcctccacgggggaggaa

SEQ ID NO: 75707 - DNA, 20 bp, human
gtggccccctcctcgcgagt

SEQ ID NO: 75708 - DNA, 20 bp, human
ggctcggtaccacccggcag

SEQ ID NO: 75709 - DNA, 20 bp, human
ggaaagctcggaatcggagg

SEQ ID NO: 75710 - DNA, 20 bp, human
ggccgaaagctcggaatcgg

SEQ ID NO: 75711 - DNA, 20 bp, human
ggggaaggctcggtaccacc

SEQ ID NO: 75712 - DNA, 20 bp, human
gggtgccgaaagctcggaat

SEQ ID NO: 75713 - DNA, 20 bp, human
ggcaccaactcgcgaggagg

SEQ ID NO: 75714 - DNA, 20 bp, human
ggctcggccgggagagaaaa

SEQ ID NO: 75715 - DNA, 20 bp, human
gccgcccgcaggaaccgcgg

SEQ ID NO: 75716 - DNA, 20 bp, human
ggggtcgtagaaataggcca

SEQ ID NO: 75717 - DNA, 20 bp, human
ggttcgtcagctctcacccc

SEQ ID NO: 75718 - DNA, 20 bp, human
gtgtggccgtagggataggt

SEQ ID NO: 75719 - DNA, 20 bp, human
gcagctccccgatactctag

SEQ ID NO: 75720 - DNA, 20 bp, human
ggacccgcccctagagtatc

SEQ ID NO: 75721 - DNA, 20 bp, human
gtcagagggtggccgacctg

SEQ ID NO: 75722 - DNA, 20 bp, human
ggtggaagttgcccacgtcg

SEQ ID NO: 75723 - DNA, 20 bp, human
ggagctgtggccgtagggat

SEQ ID NO: 75724 - DNA, 20 bp, human
gagcacgcacggccggggag

SEQ ID NO: 75725 - DNA, 20 bp, human
ggagctggatagaagtcacc

SEQ ID NO: 75726 - DNA, 20 bp, human
gcctggctcgacgctggagt

SEQ ID NO: 75727 - DNA, 20 bp, human
gtcaaccgcgaagcacccag

SEQ ID NO: 75728 - DNA, 20 bp, human
gatactggcagtgggtcacg

SEQ ID NO: 75729 - DNA, 20 bp, human
ggaagcatcatggttcaacg

SEQ ID NO: 75730 - DNA, 20 bp, human
gcacgcgtcctggacctcat

SEQ ID NO: 75731 - DNA, 20 bp, human
ggcgcttagagggcacacaa

SEQ ID NO: 75732 - DNA, 20 bp, human
gcggcgtccatcttggatac

SEQ ID NO: 75733 - DNA, 20 bp, human
gctcgccgcggcgtccatct

SEQ ID NO: 75734 - DNA, 20 bp, human
gctgccaattctagagggtg

SEQ ID NO: 75735 - DNA, 20 bp, human
gcagtagtggccgtaaacac

SEQ ID NO: 75736 - DNA, 20 bp, human
gggaggagccgccgcaaaga

SEQ ID NO: 75737 - DNA, 20 bp, human
gggctcctccatctttgcgg

SEQ ID NO: 75738 - DNA, 20 bp, human
gcggtctccgagccatttgg

SEQ ID NO: 75739 - DNA, 20 bp, human
ggcgccttccctacaggtaa

SEQ ID NO: 75740 - DNA, 20 bp, human
ggatggaggagccgtcgagg

SEQ ID NO: 75741 - DNA, 20 bp, human
gggcccctcccttacctgta

SEQ ID NO: 75742 - DNA, 20 bp, human
gagggaaggcgcccctgtct

SEQ ID NO: 75743 - DNA, 20 bp, human
ggcccgtgagcgggacatcg

SEQ ID NO: 75744 - DNA, 20 bp, human
gcttccctacaggtaaggga

SEQ ID NO: 75745 - DNA, 20 bp, human
gcgcggacagagacagcagg

SEQ ID NO: 75746 - DNA, 20 bp, human
gaaacgctaggggcgggatc

SEQ ID NO: 75747 - DNA, 20 bp, human
gtggttgaaacgctaggggc

SEQ ID NO: 75748 - DNA, 20 bp, human
ggagggagaaggcctgagag

SEQ ID NO: 75749 - DNA, 20 bp, human
gaccggtccggcccgataag

SEQ ID NO: 75750 - DNA, 20 bp, human
gggagctggttgaaggaacg

SEQ ID NO: 75751 - DNA, 20 bp, human
ggccggctgagtgaaagggt

SEQ ID NO: 75752 - DNA, 20 bp, human
gcccgggagataggccgaaa

SEQ ID NO: 75753 - DNA, 20 bp, human
gggcagtcccctgaggagcg

SEQ ID NO: 75754 - DNA, 20 bp, human
gggagtggaaggtaccggtc

SEQ ID NO: 75755 - DNA, 20 bp, human
gcgctaggggcgggatctgg

SEQ ID NO: 75756 - DNA, 20 bp, human
gctgcagagcgactgtgaga

SEQ ID NO: 75757 - DNA, 20 bp, human
gtgtgagacggcgagaggaa

SEQ ID NO: 75758 - DNA, 20 bp, human
gtcgtcctccccgggaacag

SEQ ID NO: 75759 - DNA, 20 bp, human
gggggcagctacaggcccaa

SEQ ID NO: 75760 - DNA, 20 bp, human
gacatccccccagtcgccgg

SEQ ID NO: 75761 - DNA, 20 bp, human
gctgcagcctccggcgactg

SEQ ID NO: 75762 - DNA, 20 bp, human
gcggccgggtaggatgacaa

SEQ ID NO: 75763 - DNA, 20 bp, human
ggctctggcaggctccgggt

SEQ ID NO: 75764 - DNA, 20 bp, human
ggccggggctgtgcatccag

SEQ ID NO: 75765 - DNA, 20 bp, human
gctcacatccccccagtcgc

SEQ ID NO: 75766 - DNA, 20 bp, human
gcgatcagaggagcaggaac

SEQ ID NO: 75767 - DNA, 20 bp, human
gctcctctgatcggccgcag

SEQ ID NO: 75768 - DNA, 20 bp, human
gggacgtccaatggacaggt

SEQ ID NO: 75769 - DNA, 20 bp, human
gcaccgctgcggccgatcag

SEQ ID NO: 75770 - DNA, 20 bp, human
gctggaaggtggctgcggaa

SEQ ID NO: 75771 - DNA, 20 bp, human
gaatggacaggtaggagtgg

SEQ ID NO: 75772 - DNA, 20 bp, human
ggtccgaaaaaagccagatc

SEQ ID NO: 75773 - DNA, 20 bp, human
gggaggaaccggcggacagt

SEQ ID NO: 75774 - DNA, 20 bp, human
gttcgggacgtccaatggac

SEQ ID NO: 75775 - DNA, 20 bp, human
gtccaatggacaggtaggag

SEQ ID NO: 75776 - DNA, 20 bp, human
gataggagaagggcaccggc

SEQ ID NO: 75777 - DNA, 20 bp, human
gcacagacacagataggaga

SEQ ID NO: 75778 - DNA, 20 bp, human
gtcctgcaagtggctccagc

SEQ ID NO: 75779 - DNA, 20 bp, human
gccagcgagggtagctcctg

SEQ ID NO: 75780 - DNA, 20 bp, human
gaaaccctcagtcctgcaag

SEQ ID NO: 75781 - DNA, 20 bp, human
gaccggctggagccacttgc

SEQ ID NO: 75782 - DNA, 20 bp, human
gtatcccggaaactacaagc

SEQ ID NO: 75783 - DNA, 20 bp, human
gtcatcactgctcagtgcac

SEQ ID NO: 75784 - DNA, 20 bp, human
gctacaagcaggtgggaaat

SEQ ID NO: 75785 - DNA, 20 bp, human
gacctggcttagagttcttc

SEQ ID NO: 75786 - DNA, 20 bp, human
gtgggtaggtgggagaacca

SEQ ID NO: 75787 - DNA, 20 bp, human
gtatgaggatcgagagagaa

SEQ ID NO: 75788 - DNA, 20 bp, human
ggtgaatccacaaagcacgt

SEQ ID NO: 75789 - DNA, 20 bp, human
gtgagaccgagccaaactcc

SEQ ID NO: 75790 - DNA, 20 bp, human
gcacagtgtaagacagaaag

SEQ ID NO: 75791 - DNA, 20 bp, human
gggaagtattaatattacag

SEQ ID NO: 75792 - DNA, 20 bp, human
gcagttggaatagagcatta

SEQ ID NO: 75793 - DNA, 20 bp, human
ggcttgagaaaaatggttag

SEQ ID NO: 75794 - DNA, 20 bp, human
gcagtgtagcttgagaaaaa

SEQ ID NO: 75795 - DNA, 20 bp, human
gtccacaaagcacgttggcc

SEQ ID NO: 75796 - DNA, 20 bp, human
ggccagggagtgcgcaggac

SEQ ID NO: 75797 - DNA, 20 bp, human
ggccagtcctgcgcactccc

SEQ ID NO: 75798 - DNA, 20 bp, human
ggtgcgcaggactggcaaga

SEQ ID NO: 75799 - DNA, 20 bp, human
ggtggaaggcgtgaaaggcg

SEQ ID NO: 75800 - DNA, 20 bp, human
gtgcaggaacggctgctggt

SEQ ID NO: 75801 - DNA, 20 bp, human
gtggctgccagggagtgcgc

SEQ ID NO: 75802 - DNA, 20 bp, human
gctgaggagtacagagagag

SEQ ID NO: 75803 - DNA, 20 bp, human
ggctggtgccaactctcaga

SEQ ID NO: 75804 - DNA, 20 bp, human
gggatccctgagccactaga

SEQ ID NO: 75805 - DNA, 20 bp, human
gttctcacagatggacacgc

SEQ ID NO: 75806 - DNA, 20 bp, human
gtggcccgagaaggtcgcag

SEQ ID NO: 75807 - DNA, 20 bp, human
gagccgcaggaactgcagta

SEQ ID NO: 75808 - DNA, 20 bp, human
ggctgcttctgagcacgggt

SEQ ID NO: 75809 - DNA, 20 bp, human
ggccatgcggccaccgaccc

SEQ ID NO: 75810 - DNA, 20 bp, human
gggagtctgagcctagagcc

SEQ ID NO: 75811 - DNA, 20 bp, human
gccccggaaaagctcagtgc

SEQ ID NO: 75812 - DNA, 20 bp, human
gggctgcagtgcggacctcg

SEQ ID NO: 75813 - DNA, 20 bp, human
gtctcctctgcgaccttctc

SEQ ID NO: 75814 - DNA, 20 bp, human
gcggctggtagggcagctca

SEQ ID NO: 75815 - DNA, 20 bp, human
gctgcagccgcgccagttcc

SEQ ID NO: 75816 - DNA, 20 bp, human
gcgcgcgatgggctctgagg

SEQ ID NO: 75817 - DNA, 20 bp, human
gtcgcaagcaccggcagcag

SEQ ID NO: 75818 - DNA, 20 bp, human
gatccgcgcgatgggctctg

SEQ ID NO: 75819 - DNA, 20 bp, human
gtgcttgcgagccgcgaagt

SEQ ID NO: 75820 - DNA, 20 bp, human
gcaggtcggaggtagtccca

SEQ ID NO: 75821 - DNA, 20 bp, human
ggtcggaggtagtcccaagg

SEQ ID NO: 75822 - DNA, 20 bp, human
gatccgtgccacacctgacg

SEQ ID NO: 75823 - DNA, 20 bp, human
gctggaggctgccgacttcg

SEQ ID NO: 75824 - DNA, 20 bp, human
gagcggcggaaggaccccga

SEQ ID NO: 75825 - DNA, 20 bp, human
ggcaaagcaggaagtcaggt

SEQ ID NO: 75826 - DNA, 20 bp, human
ggcggatcggggcaaggctc

SEQ ID NO: 75827 - DNA, 20 bp, human
gcccgcgcgccgcacggacg

SEQ ID NO: 75828 - DNA, 20 bp, human
gggttgcataacaccgggaa

SEQ ID NO: 75829 - DNA, 20 bp, human
gggcaaggctccggcgcggt

SEQ ID NO: 75830 - DNA, 20 bp, human
gcgcggagcgggcagaggtg

SEQ ID NO: 75831 - DNA, 20 bp, human
ggcgcgccgcacggacgggg

SEQ ID NO: 75832 - DNA, 20 bp, human
gaggaagaggcctcgcgcag

SEQ ID NO: 75833 - DNA, 20 bp, human
gcccgccggttatataatgg

SEQ ID NO: 75834 - DNA, 20 bp, human
gggcttgggttgcataacac

SEQ ID NO: 75835 - DNA, 20 bp, human
ggcgggcgcggatcggggca

SEQ ID NO: 75836 - DNA, 20 bp, human
gggtccccgctcttgtacat

SEQ ID NO: 75837 - DNA, 20 bp, human
ggacgacgacaagcccactg

SEQ ID NO: 75838 - DNA, 20 bp, human
gaaccagctatgtcggccta

SEQ ID NO: 75839 - DNA, 20 bp, human
gtccgcagaaccagctatgt

SEQ ID NO: 75840 - DNA, 20 bp, human
ggcatgcccatgtacaagag

SEQ ID NO: 75841 - DNA, 20 bp, human
ggcccccaaacgacccaagg

SEQ ID NO: 75842 - DNA, 20 bp, human
gtggcggcggcgacgaattg

SEQ ID NO: 75843 - DNA, 20 bp, human
gtgccgtaggccgacatagc

SEQ ID NO: 75844 - DNA, 20 bp, human
gccgctgaagaggagcgcgg

SEQ ID NO: 75845 - DNA, 20 bp, human
gtctatcctcgccggccagt

SEQ ID NO: 75846 - DNA, 20 bp, human
gcaggacccccaggccccga

SEQ ID NO: 75847 - DNA, 20 bp, human
gccaggatccctagaccccg

SEQ ID NO: 75848 - DNA, 20 bp, human
ggcagggagctgcgccctag

SEQ ID NO: 75849 - DNA, 20 bp, human
gtgctgacggcgagaggccc

SEQ ID NO: 75850 - DNA, 20 bp, human
ggccggaggcgggcactgga

SEQ ID NO: 75851 - DNA, 20 bp, human
gaaggcgtgtggcatgctga

SEQ ID NO: 75852 - DNA, 20 bp, human
gccccgggcttgaaggcgtg

SEQ ID NO: 75853 - DNA, 20 bp, human
gccgctgcagccgctttccg

SEQ ID NO: 75854 - DNA, 20 bp, human
gccaccagaccacaagaacg

SEQ ID NO: 75855 - DNA, 20 bp, human
ggctgcgccctaggggtctg

SEQ ID NO: 75856 - DNA, 20 bp, human
ggctgccaggcgagacatca

SEQ ID NO: 75857 - DNA, 20 bp, human
gggggtcatggccgtcacag

SEQ ID NO: 75858 - DNA, 20 bp, human
gacaagagtagcgacaacag

SEQ ID NO: 75859 - DNA, 20 bp, human
gcgaggacgatgaggaccgg

SEQ ID NO: 75860 - DNA, 20 bp, human
gcgacaacagtggcctgaag

SEQ ID NO: 75861 - DNA, 20 bp, human
gacgcctgcgctaaaggtag

SEQ ID NO: 75862 - DNA, 20 bp, human
gggtaggggaggaccaaggt

SEQ ID NO: 75863 - DNA, 20 bp, human
gtcgctctccatcctgtcgc

SEQ ID NO: 75864 - DNA, 20 bp, human
gtgacgaggacgatgaggac

SEQ ID NO: 75865 - DNA, 20 bp, human
gattcaccaggtccccaagt

SEQ ID NO: 75866 - DNA, 20 bp, human
gggactaccaggaaggggag

SEQ ID NO: 75867 - DNA, 20 bp, human
ggaccaaggactaccaggaa

SEQ ID NO: 75868 - DNA, 20 bp, human
ggcggcgaccaaggactacc

SEQ ID NO: 75869 - DNA, 20 bp, human
gcgctgcccgagaaggaatt

SEQ ID NO: 75870 - DNA, 20 bp, human
gtggtcgccgcgaagatgcc

SEQ ID NO: 75871 - DNA, 20 bp, human
gggagcgcggcgcaattcgt

SEQ ID NO: 75872 - DNA, 20 bp, human
gctcaagccgggcggacgag

SEQ ID NO: 75873 - DNA, 20 bp, human
gctgctccgaattccttctc

SEQ ID NO: 75874 - DNA, 20 bp, human
gcagcaggcccggcaaatca

SEQ ID NO: 75875 - DNA, 20 bp, human
ggcggccgcggtactcaccc

SEQ ID NO: 75876 - DNA, 20 bp, human
ggcccgcccggtggacccca

SEQ ID NO: 75877 - DNA, 20 bp, human
ggcacgtgggagcagtccct

SEQ ID NO: 75878 - DNA, 20 bp, human
gagcagtccctggggtccac

SEQ ID NO: 75879 - DNA, 20 bp, human
gcgacttcggggccagccgg

SEQ ID NO: 75880 - DNA, 20 bp, human
ggcgccttctgggtctgggt

SEQ ID NO: 75881 - DNA, 20 bp, human
gcccagcacccgcttccggt

SEQ ID NO: 75882 - DNA, 20 bp, human
gctctcctcagagcgaggcg

SEQ ID NO: 75883 - DNA, 20 bp, human
gaaccgaaaagagagcgcgg

SEQ ID NO: 75884 - DNA, 20 bp, human
ggtccctggggtccaccggg

SEQ ID NO: 75885 - DNA, 20 bp, human
gtcctcagagcgaggcgcgg

SEQ ID NO: 75886 - DNA, 20 bp, human
gctttcctgaggacggcgta

SEQ ID NO: 75887 - DNA, 20 bp, human
gaaatccggggcttccggcg

SEQ ID NO: 75888 - DNA, 20 bp, human
ggagctcccgtggaagagga

SEQ ID NO: 75889 - DNA, 20 bp, human
gaggaaggcacggcccgtag

SEQ ID NO: 75890 - DNA, 20 bp, human
ggcccgtagtggctctaatc

SEQ ID NO: 75891 - DNA, 20 bp, human
gcggcccggctcgagaggag

SEQ ID NO: 75892 - DNA, 20 bp, human
gcaggaaaggcccccgctaa

SEQ ID NO: 75893 - DNA, 20 bp, human
gtgaggacccgcggccagtg

SEQ ID NO: 75894 - DNA, 20 bp, human
ggagggacgtcgctgcccga

SEQ ID NO: 75895 - DNA, 20 bp, human
ggcagcggggctgtctatcc

SEQ ID NO: 75896 - DNA, 20 bp, human
gcaaggcccgcgagctcggg

SEQ ID NO: 75897 - DNA, 20 bp, human
ggcttccttgtgagtcaggt

SEQ ID NO: 75898 - DNA, 20 bp, human
ggacgccctacagctgagaa

SEQ ID NO: 75899 - DNA, 20 bp, human
gcggctccgggccggttcct

SEQ ID NO: 75900 - DNA, 20 bp, human
gggtccccttctcagctgta

SEQ ID NO: 75901 - DNA, 20 bp, human
ggaatgtctatagctgccgt

SEQ ID NO: 75902 - DNA, 20 bp, human
gccgtcggcagcgtgagctg

SEQ ID NO: 75903 - DNA, 20 bp, human
gagtgctgggattacggtaa

SEQ ID NO: 75904 - DNA, 20 bp, human
gagctgagaaggggacccaa

SEQ ID NO: 75905 - DNA, 20 bp, human
gctgggcccaggaaccggcc

SEQ ID NO: 75906 - DNA, 20 bp, human
gcggggggcgagtaagccag

SEQ ID NO: 75907 - DNA, 20 bp, human
gtcctcccggggcttcggtg

SEQ ID NO: 75908 - DNA, 20 bp, human
gcgtgcggccacggcaccag

SEQ ID NO: 75909 - DNA, 20 bp, human
ggccccaccgaagccccggg

SEQ ID NO: 75910 - DNA, 20 bp, human
gcagcggcaggaccagcggg

SEQ ID NO: 75911 - DNA, 20 bp, human
ggtgttgcgcgctcactcgt

SEQ ID NO: 75912 - DNA, 20 bp, human
ggccgcgcctcggagcgtcc

SEQ ID NO: 75913 - DNA, 20 bp, human
ggagaagccgggacgctccg

SEQ ID NO: 75914 - DNA, 20 bp, human
ggggccccggctgctatata

SEQ ID NO: 75915 - DNA, 20 bp, human
gcggcaggaccagcgggcgg

SEQ ID NO: 75916 - DNA, 20 bp, human
gtaggaactgtggcgaaaca

SEQ ID NO: 75917 - DNA, 20 bp, human
gcatcttggtaaaggagaag

SEQ ID NO: 75918 - DNA, 20 bp, human
gcgcgcagccaatcccagag

SEQ ID NO: 75919 - DNA, 20 bp, human
ggggagtgcggagcgatcac

SEQ ID NO: 75920 - DNA, 20 bp, human
ggctgcgcgcacgtcacgtg

SEQ ID NO: 75921 - DNA, 20 bp, human
gctgcgcagaccatcgagtc

SEQ ID NO: 75922 - DNA, 20 bp, human
gggccccccgatcatcgaga

SEQ ID NO: 75923 - DNA, 20 bp, human
gccccagcccgggcacagga

SEQ ID NO: 75924 - DNA, 20 bp, human
gggagggacgcccgactcga

SEQ ID NO: 75925 - DNA, 20 bp, human
gtggtctgcgcagggcccgt

SEQ ID NO: 75926 - DNA, 20 bp, human
gctgcctccgaagaaaggag

SEQ ID NO: 75927 - DNA, 20 bp, human
gcggttacgaaaggaatcag

SEQ ID NO: 75928 - DNA, 20 bp, human
gaatcagcggaacccagatc

SEQ ID NO: 75929 - DNA, 20 bp, human
ggccttcgctaggaggatag

SEQ ID NO: 75930 - DNA, 20 bp, human
gttgggacgcgcttctggac

SEQ ID NO: 75931 - DNA, 20 bp, human
gcttctggacgggtagtagg

SEQ ID NO: 75932 - DNA, 20 bp, human
ggcgcttctggacgggtagt

SEQ ID NO: 75933 - DNA, 20 bp, human
gtcattgtctgaagcggcac

SEQ ID NO: 75934 - DNA, 20 bp, human
gtaggttccgtggcctaaac

SEQ ID NO: 75935 - DNA, 20 bp, human
gtgcggatagggatacaatg

SEQ ID NO: 75936 - DNA, 20 bp, human
gttgaaggaaagccttggcg

SEQ ID NO: 75937 - DNA, 20 bp, human
gtgggctccttggtaccatg

SEQ ID NO: 75938 - DNA, 20 bp, human
gaccctcacccggaaaccta

SEQ ID NO: 75939 - DNA, 20 bp, human
gcccggagatgcaaagacga

SEQ ID NO: 75940 - DNA, 20 bp, human
gggcgctacggcaagtgaag

SEQ ID NO: 75941 - DNA, 20 bp, human
gctggcatcactttgaggga

SEQ ID NO: 75942 - DNA, 20 bp, human
gcagcggagttttaatgaca

SEQ ID NO: 75943 - DNA, 20 bp, human
gccggatatctgcggaatca

SEQ ID NO: 75944 - DNA, 20 bp, human
ggtgccgcttacctggaact

SEQ ID NO: 75945 - DNA, 20 bp, human
gacgtcatctttcacgccag

SEQ ID NO: 75946 - DNA, 20 bp, human
gtcaggcagcgcagcaagcg

SEQ ID NO: 75947 - DNA, 20 bp, human
gcagcagtaggcgcgcccag

SEQ ID NO: 75948 - DNA, 20 bp, human
ggccaggcgcagctcctcac

SEQ ID NO: 75949 - DNA, 20 bp, human
gcgcgtcgccggtcactaag

SEQ ID NO: 75950 - DNA, 20 bp, human
ggcagagcgtcgtccaggtg

SEQ ID NO: 75951 - DNA, 20 bp, human
gcgcccgcccgaggcctgtg

SEQ ID NO: 75952 - DNA, 20 bp, human
ggcctggccgtggacctgtg

SEQ ID NO: 75953 - DNA, 20 bp, human
ggctcctcacaggcctcggg

SEQ ID NO: 75954 - DNA, 20 bp, human
ggccgtggcggccccacacc

SEQ ID NO: 75955 - DNA, 20 bp, human
gaccggcgacgcgggcaaga

SEQ ID NO: 75956 - DNA, 20 bp, human
gacagaccaccgagagagga

SEQ ID NO: 75957 - DNA, 20 bp, human
gcggcggcgaatgggaccgg

SEQ ID NO: 75958 - DNA, 20 bp, human
gggctgccgcgccgttaaca

SEQ ID NO: 75959 - DNA, 20 bp, human
ggcgccaggcccgggagtgc

SEQ ID NO: 75960 - DNA, 20 bp, human
ggcggacagaccaccgagag

SEQ ID NO: 75961 - DNA, 20 bp, human
gacggaccttgttaacggcg

SEQ ID NO: 75962 - DNA, 20 bp, human
ggcccagcgcacgtcaccat

SEQ ID NO: 75963 - DNA, 20 bp, human
gccggctgcagtctccctga

SEQ ID NO: 75964 - DNA, 20 bp, human
gcggaggcgaggaggacgac

SEQ ID NO: 75965 - DNA, 20 bp, human
gcgcccgtaggggagaactg

SEQ ID NO: 75966 - DNA, 20 bp, human
gttccaaatggcctcctaaa

SEQ ID NO: 75967 - DNA, 20 bp, human
gtctctgaggactgcctttt

SEQ ID NO: 75968 - DNA, 20 bp, human
ggaacctaagaaaccaagga

SEQ ID NO: 75969 - DNA, 20 bp, human
ggtgtcagctggaagatgag

SEQ ID NO: 75970 - DNA, 20 bp, human
gagaaccttgcttctctctg

SEQ ID NO: 75971 - DNA, 20 bp, human
gctgcatcttaagccttcct

SEQ ID NO: 75972 - DNA, 20 bp, human
gtttggaacctaagaaacca

SEQ ID NO: 75973 - DNA, 20 bp, human
ggaagatgaggggcaacctg

SEQ ID NO: 75974 - DNA, 20 bp, human
gacctttcagatactggcaa

SEQ ID NO: 75975 - DNA, 20 bp, human
gctgaggactgccttttagg

SEQ ID NO: 75976 - DNA, 20 bp, human
gagctgaggaggacccccaa

SEQ ID NO: 75977 - DNA, 20 bp, human
ggcaattccagactctgcta

SEQ ID NO: 75978 - DNA, 20 bp, human
gcccggtccagcaacgttac

SEQ ID NO: 75979 - DNA, 20 bp, human
ggcaggcagtcggggatcca

SEQ ID NO: 75980 - DNA, 20 bp, human
gcctcgaccggttctcccac

SEQ ID NO: 75981 - DNA, 20 bp, human
gcctggactacgggaaagtc

SEQ ID NO: 75982 - DNA, 20 bp, human
gcccacacgcccggcaaccc

SEQ ID NO: 75983 - DNA, 20 bp, human
ggaggaggacccccaaaggc

SEQ ID NO: 75984 - DNA, 20 bp, human
gtgctgccgcgaccaccctc

SEQ ID NO: 75985 - DNA, 20 bp, human
gccccaaaggcaggcagtcg

SEQ ID NO: 75986 - DNA, 20 bp, human
gggctgtcaatagcacgagg

SEQ ID NO: 75987 - DNA, 20 bp, human
gggtaggagtgcgggaggtg

SEQ ID NO: 75988 - DNA, 20 bp, human
ggggcatccgggtctcttgg

SEQ ID NO: 75989 - DNA, 20 bp, human
gctcacctcgtagtctggaa

SEQ ID NO: 75990 - DNA, 20 bp, human
gctgcaggtaggagtgcggg

SEQ ID NO: 75991 - DNA, 20 bp, human
ggacagcctgcggaacccca

SEQ ID NO: 75992 - DNA, 20 bp, human
gcttcctacgcggatgggtg

SEQ ID NO: 75993 - DNA, 20 bp, human
gggccgccgcaagcctccgt

SEQ ID NO: 75994 - DNA, 20 bp, human
gggcagctcggaactaagca

SEQ ID NO: 75995 - DNA, 20 bp, human
gcacctggccagagggactg

SEQ ID NO: 75996 - DNA, 20 bp, human
ggggaagcaatccctgagcg

SEQ ID NO: 75997 - DNA, 20 bp, human
gccttccgtgcagccgcggg

SEQ ID NO: 75998 - DNA, 20 bp, human
ggtatcagagaggaaacccg

SEQ ID NO: 75999 - DNA, 20 bp, human
gtggctgctgtgcaagttgt

SEQ ID NO: 76000 - DNA, 20 bp, human
ggagcaggagtcgtcaagtt

SEQ ID NO: 76001 - DNA, 20 bp, human
ggagcgtgccaagcactgca

SEQ ID NO: 76002 - DNA, 20 bp, human
ggtgcgggcggatggaaagt

SEQ ID NO: 76003 - DNA, 20 bp, human
gcgcgagagtgggaagatca

SEQ ID NO: 76004 - DNA, 20 bp, human
gcccccgcccgtagaaaaga

SEQ ID NO: 76005 - DNA, 20 bp, human
gaccagctgggttcccggag

SEQ ID NO: 76006 - DNA, 20 bp, human
gcaccacgggcagcgaccac

SEQ ID NO: 76007 - DNA, 20 bp, human
ggccggtggtgagaggaggg

SEQ ID NO: 76008 - DNA, 20 bp, human
gccctgcagccggtggtgag

SEQ ID NO: 76009 - DNA, 20 bp, human
gacccccctcctctcaccac

SEQ ID NO: 76010 - DNA, 20 bp, human
gtggcagggcggcaaggcgg

SEQ ID NO: 76011 - DNA, 20 bp, human
gaacaggagagactgatcca

SEQ ID NO: 76012 - DNA, 20 bp, human
ggggggcgacggagcaccac

SEQ ID NO: 76013 - DNA, 20 bp, human
ggcagcgaccaccggcggca

SEQ ID NO: 76014 - DNA, 20 bp, human
gcagtccaaatgctgggcgg

SEQ ID NO: 76015 - DNA, 20 bp, human
gtcccagtccaaatgctggg

SEQ ID NO: 76016 - DNA, 20 bp, human
gaggacgccggcccccaggt

SEQ ID NO: 76017 - DNA, 20 bp, human
gagaggcagacgcatcgggt

SEQ ID NO: 76018 - DNA, 20 bp, human
gcgagtcggcgcctacctgg

SEQ ID NO: 76019 - DNA, 20 bp, human
ggtaggcgccgactcgggag

SEQ ID NO: 76020 - DNA, 20 bp, human
gtcacgaccccggacagctc

SEQ ID NO: 76021 - DNA, 20 bp, human
gcgccgactcgggagcggag

SEQ ID NO: 76022 - DNA, 20 bp, human
ggctccctgtcgccgcggag

SEQ ID NO: 76023 - DNA, 20 bp, human
gtcactgcaaatcagccgga

SEQ ID NO: 76024 - DNA, 20 bp, human
gggtccagaggcagacgcat

SEQ ID NO: 76025 - DNA, 20 bp, human
gagcctggtcagccgcgcag

SEQ ID NO: 76026 - DNA, 20 bp, human
gcagcgaaggcggatcccag

SEQ ID NO: 76027 - DNA, 20 bp, human
ggagacgctcccgagccgga

SEQ ID NO: 76028 - DNA, 20 bp, human
gcggctccgggaaagaacgg

SEQ ID NO: 76029 - DNA, 20 bp, human
gccgcgcggctgcgagcctc

SEQ ID NO: 76030 - DNA, 20 bp, human
gtgcccggcgtcagcgaagg

SEQ ID NO: 76031 - DNA, 20 bp, human
gcttcacgcagggccgggaa

SEQ ID NO: 76032 - DNA, 20 bp, human
gaagcgagacgctcccgagc

SEQ ID NO: 76033 - DNA, 20 bp, human
gagccggctccgggaaagaa

SEQ ID NO: 76034 - DNA, 20 bp, human
gcgctcgctcgcgtccaggt

SEQ ID NO: 76035 - DNA, 20 bp, human
ggcggcgacgagcaggaaaa

SEQ ID NO: 76036 - DNA, 20 bp, human
gtccatcgcgaaccgggagg

SEQ ID NO: 76037 - DNA, 20 bp, human
gaggccgcgcaggtcgaacc

SEQ ID NO: 76038 - DNA, 20 bp, human
gtcggaagggccctgcgtgg

SEQ ID NO: 76039 - DNA, 20 bp, human
ggcgcctcggaccgtcggaa

SEQ ID NO: 76040 - DNA, 20 bp, human
gcagcctggccgacctcact

SEQ ID NO: 76041 - DNA, 20 bp, human
gcgggagcgcctcggaccgt

SEQ ID NO: 76042 - DNA, 20 bp, human
gcggcttcttgggaactcta

SEQ ID NO: 76043 - DNA, 20 bp, human
gccccgggaggggaacaaag

SEQ ID NO: 76044 - DNA, 20 bp, human
gccggacgcccggcgagtgg

SEQ ID NO: 76045 - DNA, 20 bp, human
gggatccgcgcccccacgca

SEQ ID NO: 76046 - DNA, 20 bp, human
gactcaggccgcccttcctt

SEQ ID NO: 76047 - DNA, 20 bp, human
gcggcagcggcggctagaag

SEQ ID NO: 76048 - DNA, 20 bp, human
gaggtacacctaccaccctc

SEQ ID NO: 76049 - DNA, 20 bp, human
gagccctctcgcggccgcgg

SEQ ID NO: 76050 - DNA, 20 bp, human
ggcagcccagagccctctcg

SEQ ID NO: 76051 - DNA, 20 bp, human
gcgcccgccgatacgatggg

SEQ ID NO: 76052 - DNA, 20 bp, human
gtcactcatgtcgggccggg

SEQ ID NO: 76053 - DNA, 20 bp, human
gtgccgccgcggccgcgaga

SEQ ID NO: 76054 - DNA, 20 bp, human
gggcggcctcagtgttgctg

SEQ ID NO: 76055 - DNA, 20 bp, human
gcggcgcccgccgatacgat

SEQ ID NO: 76056 - DNA, 20 bp, human
gggcggaggtgagcacctag

SEQ ID NO: 76057 - DNA, 20 bp, human
gctctgggtgaagctgacaa

SEQ ID NO: 76058 - DNA, 20 bp, human
gctagaggcgaccctgcccg

SEQ ID NO: 76059 - DNA, 20 bp, human
gacccggtaaaagacccctg

SEQ ID NO: 76060 - DNA, 20 bp, human
ggcgcctgcgtgcgcaccac

SEQ ID NO: 76061 - DNA, 20 bp, human
gaggacccgccatggcgaag

SEQ ID NO: 76062 - DNA, 20 bp, human
gtggtgggaagctctgtccg

SEQ ID NO: 76063 - DNA, 20 bp, human
gcccgggccaggacccgcca

SEQ ID NO: 76064 - DNA, 20 bp, human
ggccagctgttccccgggca

SEQ ID NO: 76065 - DNA, 20 bp, human
gcgggcgaggagctgtgcaa

SEQ ID NO: 76066 - DNA, 20 bp, human
gaggcggatcctgctcctga

SEQ ID NO: 76067 - DNA, 20 bp, human
gctgacagttggttgccgag

SEQ ID NO: 76068 - DNA, 20 bp, human
ggttggttgccgagcggcag

SEQ ID NO: 76069 - DNA, 20 bp, human
gggttgccgagcggcagagg

SEQ ID NO: 76070 - DNA, 20 bp, human
gatcctgctcctgagggcgg

SEQ ID NO: 76071 - DNA, 20 bp, human
ggggccccgaggatctcgct

SEQ ID NO: 76072 - DNA, 20 bp, human
gcgccgcgatcaccagtcca

SEQ ID NO: 76073 - DNA, 20 bp, human
ggaggccgcggacaccgacc

SEQ ID NO: 76074 - DNA, 20 bp, human
gctgatccgggtcaccgacc

SEQ ID NO: 76075 - DNA, 20 bp, human
gtcggtgtccgcggcctctg

SEQ ID NO: 76076 - DNA, 20 bp, human
gtggatctcggccccgagaa

SEQ ID NO: 76077 - DNA, 20 bp, human
gtctcggccccgagaaggga

SEQ ID NO: 76078 - DNA, 20 bp, human
ggagtgtgtgcgcgaggagg

SEQ ID NO: 76079 - DNA, 20 bp, human
gcctcgcgggagaagcgaga

SEQ ID NO: 76080 - DNA, 20 bp, human
gggctgacaattgaacctcg

SEQ ID NO: 76081 - DNA, 20 bp, human
gggggaagccgcccagagaa

SEQ ID NO: 76082 - DNA, 20 bp, human
gcgtgcgactctgaccgaac

SEQ ID NO: 76083 - DNA, 20 bp, human
gcgcgggagaagcgagaggg

SEQ ID NO: 76084 - DNA, 20 bp, human
gtcagagtcgcacggtgttc

SEQ ID NO: 76085 - DNA, 20 bp, human
gcgcgcagattagagctggg

SEQ ID NO: 76086 - DNA, 20 bp, human
ggtcagcccaatgcagactg

SEQ ID NO: 76087 - DNA, 20 bp, human
gcacacattcataccagggt

SEQ ID NO: 76088 - DNA, 20 bp, human
ggcgcgcctcagtctgcatt

SEQ ID NO: 76089 - DNA, 20 bp, human
gagagtccacatgcccaccc

SEQ ID NO: 76090 - DNA, 20 bp, human
ggcgctgtgcccggaaccac

SEQ ID NO: 76091 - DNA, 20 bp, human
gctcatcagcagactcactc

SEQ ID NO: 76092 - DNA, 20 bp, human
gaaaatccccacatgctctc

SEQ ID NO: 76093 - DNA, 20 bp, human
ggactctaatcccttcttag

SEQ ID NO: 76094 - DNA, 20 bp, human
gggccaaccgttaaagaccc

SEQ ID NO: 76095 - DNA, 20 bp, human
gcgtcaaataatatcttctt

SEQ ID NO: 76096 - DNA, 20 bp, human
gtaggaagatgccagcacaa

SEQ ID NO: 76097 - DNA, 20 bp, human
gcgctcggcgcgcccctcag

SEQ ID NO: 76098 - DNA, 20 bp, human
ggcgacacccagagctctcg

SEQ ID NO: 76099 - DNA, 20 bp, human
gtgaccgcgccggggcgcaa

SEQ ID NO: 76100 - DNA, 20 bp, human
gagacccagcccgctgcgga

SEQ ID NO: 76101 - DNA, 20 bp, human
gtgggcagcggaaaccgaaa

SEQ ID NO: 76102 - DNA, 20 bp, human
gggagccgcctcgagagctc

SEQ ID NO: 76103 - DNA, 20 bp, human
gtcccgccgtccgctacctg

SEQ ID NO: 76104 - DNA, 20 bp, human
ggggccgtggcgtaacccgg

SEQ ID NO: 76105 - DNA, 20 bp, human
gccgcgccggggcgcaaggg

SEQ ID NO: 76106 - DNA, 20 bp, human
ggccaggcgccgcgacacag

SEQ ID NO: 76107 - DNA, 20 bp, human
ggagggtccccgctgtgtcg

SEQ ID NO: 76108 - DNA, 20 bp, human
gcggggaagtgagcggagtg

SEQ ID NO: 76109 - DNA, 20 bp, human
ggcgcgggtgagtgagagcc

SEQ ID NO: 76110 - DNA, 20 bp, human
ggcctggccagtctgtgctg

SEQ ID NO: 76111 - DNA, 20 bp, human
gcccgcgctcccgcctctgg

SEQ ID NO: 76112 - DNA, 20 bp, human
gccagccccgctcccgcgag

SEQ ID NO: 76113 - DNA, 20 bp, human
gcgcggcgaggccatggtga

SEQ ID NO: 76114 - DNA, 20 bp, human
gccgcccgcgctcacatgcc

SEQ ID NO: 76115 - DNA, 20 bp, human
ggcgcgcggcgagccgggga

SEQ ID NO: 76116 - DNA, 20 bp, human
gaaacaactcgggaaaaccc

SEQ ID NO: 76117 - DNA, 20 bp, human
gagctgcttcatcctaccaa

SEQ ID NO: 76118 - DNA, 20 bp, human
gctcaccgcggaggcacccg

SEQ ID NO: 76119 - DNA, 20 bp, human
ggagcagaggtccctgaagt

SEQ ID NO: 76120 - DNA, 20 bp, human
gggccgttcccggaagttga

SEQ ID NO: 76121 - DNA, 20 bp, human
gttacagtcgtagaactgat

SEQ ID NO: 76122 - DNA, 20 bp, human
gaactcaacccaaacaactc

SEQ ID NO: 76123 - DNA, 20 bp, human
ggcagacgccttcctcaccg

SEQ ID NO: 76124 - DNA, 20 bp, human
ggaggaaggcgtctgcccgg

SEQ ID NO: 76125 - DNA, 20 bp, human
gtcctcggcgtcgatgaaca

SEQ ID NO: 76126 - DNA, 20 bp, human
gtgggccggcagcggttgtg

SEQ ID NO: 76127 - DNA, 20 bp, human
gtttggctagaaggctgggc

SEQ ID NO: 76128 - DNA, 20 bp, human
ggttgtgaggagttagctcg

SEQ ID NO: 76129 - DNA, 20 bp, human
gtgggcaagcatggaggctg

SEQ ID NO: 76130 - DNA, 20 bp, human
ggctccagtgcatctcgggt

SEQ ID NO: 76131 - DNA, 20 bp, human
ggagcaaaagctgaagaccg

SEQ ID NO: 76132 - DNA, 20 bp, human
gctagccaaatcccccgcca

SEQ ID NO: 76133 - DNA, 20 bp, human
gcggggagggagccgacccc

SEQ ID NO: 76134 - DNA, 20 bp, human
gtgcatctcgggtgggagaa

SEQ ID NO: 76135 - DNA, 20 bp, human
ggccggtgaagatttcacat

SEQ ID NO: 76136 - DNA, 20 bp, human
ggagccctgagagctaactt

SEQ ID NO: 76137 - DNA, 20 bp, human
gaggggtgggagaccaggta

SEQ ID NO: 76138 - DNA, 20 bp, human
ggctcgtgcccggagatgag

SEQ ID NO: 76139 - DNA, 20 bp, human
ggaccccaagttagctctca

SEQ ID NO: 76140 - DNA, 20 bp, human
ggctctcagggctcgcggac

SEQ ID NO: 76141 - DNA, 20 bp, human
gccaaggtggatgtagaagc

SEQ ID NO: 76142 - DNA, 20 bp, human
gcatgtgacgtaggaggtcc

SEQ ID NO: 76143 - DNA, 20 bp, human
gtgaggcttatgattggaca

SEQ ID NO: 76144 - DNA, 20 bp, human
gagaccaggtacggaggact

SEQ ID NO: 76145 - DNA, 20 bp, human
gccaaggacgagacattccg

SEQ ID NO: 76146 - DNA, 20 bp, human
gctacctgggacactcgagg

SEQ ID NO: 76147 - DNA, 20 bp, human
gcagtacgcgccctcgggag

SEQ ID NO: 76148 - DNA, 20 bp, human
gagtgtggaggaatctcgag

SEQ ID NO: 76149 - DNA, 20 bp, human
ggcccccagctcgcccccct

SEQ ID NO: 76150 - DNA, 20 bp, human
ggagaggagggtgctcaacc

SEQ ID NO: 76151 - DNA, 20 bp, human
gacactcgaggaggcacacg

SEQ ID NO: 76152 - DNA, 20 bp, human
gtacgcgccctcgggagagg

SEQ ID NO: 76153 - DNA, 20 bp, human
ggcgccaccgcctctcccga

SEQ ID NO: 76154 - DNA, 20 bp, human
gcacactcaaagtcccgtgc

SEQ ID NO: 76155 - DNA, 20 bp, human
gtgccatcggtccacccaag

SEQ ID NO: 76156 - DNA, 20 bp, human
gccggggtccgggacaccgg

SEQ ID NO: 76157 - DNA, 20 bp, human
ggagctcgcggagcggcccc

SEQ ID NO: 76158 - DNA, 20 bp, human
gtggcgtagaaagtaatgac

SEQ ID NO: 76159 - DNA, 20 bp, human
gggaagtccgaggcctgagg

SEQ ID NO: 76160 - DNA, 20 bp, human
gacccccagccgcgacccgg

SEQ ID NO: 76161 - DNA, 20 bp, human
gcccacccggtggaagtccg

SEQ ID NO: 76162 - DNA, 20 bp, human
gtgggaagcgcggctcttcg

SEQ ID NO: 76163 - DNA, 20 bp, human
gtcccctccccggagagctc

SEQ ID NO: 76164 - DNA, 20 bp, human
gccagccgcgacccggagga

SEQ ID NO: 76165 - DNA, 20 bp, human
gttgtggggacgttgacaag

SEQ ID NO: 76166 - DNA, 20 bp, human
gatcgaaactgagagctcct

SEQ ID NO: 76167 - DNA, 20 bp, human
gtggcaccctgagctctggt

SEQ ID NO: 76168 - DNA, 20 bp, human
ggagggtgctggtcctggac

SEQ ID NO: 76169 - DNA, 20 bp, human
ggctcctgggcaggctcggc

SEQ ID NO: 76170 - DNA, 20 bp, human
gggagggtgagtgcagccgg

SEQ ID NO: 76171 - DNA, 20 bp, human
ggcgatcagcgtcagtgccc

SEQ ID NO: 76172 - DNA, 20 bp, human
gtagcatcccagctgcggtg

SEQ ID NO: 76173 - DNA, 20 bp, human
gtctgccatccagaaaggac

SEQ ID NO: 76174 - DNA, 20 bp, human
gccgagtctgccatccagaa

SEQ ID NO: 76175 - DNA, 20 bp, human
ggtgcagagaccacagcgct

SEQ ID NO: 76176 - DNA, 20 bp, human
gacttgcccagagctatcag

SEQ ID NO: 76177 - DNA, 20 bp, human
ggcccgccgctgatagctct

SEQ ID NO: 76178 - DNA, 20 bp, human
ggacacgcggctgcacctcc

SEQ ID NO: 76179 - DNA, 20 bp, human
gtcgatgtccctggcagagt

SEQ ID NO: 76180 - DNA, 20 bp, human
gggtgcagccgcgtgtcggg

SEQ ID NO: 76181 - DNA, 20 bp, human
ggggcagtccccccgacacg

SEQ ID NO: 76182 - DNA, 20 bp, human
ggtccacctgcagcgagtag

SEQ ID NO: 76183 - DNA, 20 bp, human
gctgggtgcgggcagcaaac

SEQ ID NO: 76184 - DNA, 20 bp, human
gaccacctgcacggcggcgg

SEQ ID NO: 76185 - DNA, 20 bp, human
gcaggactacgaacagatgg

SEQ ID NO: 76186 - DNA, 20 bp, human
gtcagaccaaaatagcagga

SEQ ID NO: 76187 - DNA, 20 bp, human
gatgagggtcaggtgtctga

SEQ ID NO: 76188 - DNA, 20 bp, human
gttgctttaggatagatcca

SEQ ID NO: 76189 - DNA, 20 bp, human
gggctgttgagaagaattcg

SEQ ID NO: 76190 - DNA, 20 bp, human
gtattgcagcaagatggatt

SEQ ID NO: 76191 - DNA, 20 bp, human
gaatgtcttaaggtatctca

SEQ ID NO: 76192 - DNA, 20 bp, human
gaaagcatctaggctgcttg

SEQ ID NO: 76193 - DNA, 20 bp, human
ggtggattcatacatttcta

SEQ ID NO: 76194 - DNA, 20 bp, human
gtctcttcttgatgagggtc

SEQ ID NO: 76195 - DNA, 20 bp, human
gatggtgcttcaaatgagat

SEQ ID NO: 76196 - DNA, 20 bp, human
gcgacgggccacgcacgtcc

SEQ ID NO: 76197 - DNA, 20 bp, human
gcgtccgggcgtccagttcg

SEQ ID NO: 76198 - DNA, 20 bp, human
gaccaggccgggaggtgtgt

SEQ ID NO: 76199 - DNA, 20 bp, human
gcagttcggggcagcttctc

SEQ ID NO: 76200 - DNA, 20 bp, human
gcagtagcctgccggaaagg

SEQ ID NO: 76201 - DNA, 20 bp, human
ggcttctccggctggtgggt

SEQ ID NO: 76202 - DNA, 20 bp, human
gcaggtatgcatgggaggtg

SEQ ID NO: 76203 - DNA, 20 bp, human
gctttcaggcaggtatgcat

SEQ ID NO: 76204 - DNA, 20 bp, human
ggtccgagggagcgcgcgac

SEQ ID NO: 76205 - DNA, 20 bp, human
gccggaagcggggcgtccga

SEQ ID NO: 76206 - DNA, 20 bp, human
ggctgcgacgcggcacggta

SEQ ID NO: 76207 - DNA, 20 bp, human
ggctgagttgaggacgctgg

SEQ ID NO: 76208 - DNA, 20 bp, human
ggaaaaaacaaagctcgtcg

SEQ ID NO: 76209 - DNA, 20 bp, human
gcgtgcgtgcgcgggcgtca

SEQ ID NO: 76210 - DNA, 20 bp, human
ggcgtgcgcgggcgtcaggg

SEQ ID NO: 76211 - DNA, 20 bp, human
gctagcgtgcggctgcgacg

SEQ ID NO: 76212 - DNA, 20 bp, human
gcagaccgcgagccggaagg

SEQ ID NO: 76213 - DNA, 20 bp, human
gggcgctgagttgaggacgc

SEQ ID NO: 76214 - DNA, 20 bp, human
gtgagttcgtggcgctcccg

SEQ ID NO: 76215 - DNA, 20 bp, human
ggagctttgttttttcggtt

SEQ ID NO: 76216 - DNA, 20 bp, human
ggcactgggccatttcgtat

SEQ ID NO: 76217 - DNA, 20 bp, human
gcgggcagagaaactccgag

SEQ ID NO: 76218 - DNA, 20 bp, human
gtgccgtgggaaacatgtca

SEQ ID NO: 76219 - DNA, 20 bp, human
gggtggggcttgatgggtag

SEQ ID NO: 76220 - DNA, 20 bp, human
gggaggccagagggtaagaa

SEQ ID NO: 76221 - DNA, 20 bp, human
gctctgtgtgtaaaagagta

SEQ ID NO: 76222 - DNA, 20 bp, human
gggtctgaagaaaggacccg

SEQ ID NO: 76223 - DNA, 20 bp, human
gagtctggcattctttccaa

SEQ ID NO: 76224 - DNA, 20 bp, human
ggaaactccgagtggtacaa

SEQ ID NO: 76225 - DNA, 20 bp, human
gcacagagaagccagagtcg

SEQ ID NO: 76226 - DNA, 20 bp, human
gccacagctgcactaagcta

SEQ ID NO: 76227 - DNA, 20 bp, human
gccggttactgggtgtgcag

SEQ ID NO: 76228 - DNA, 20 bp, human
gctgacctgggcgctagcaa

SEQ ID NO: 76229 - DNA, 20 bp, human
gacacccagtaaccggcatc

SEQ ID NO: 76230 - DNA, 20 bp, human
gttgcaagttcagattagag

SEQ ID NO: 76231 - DNA, 20 bp, human
gcatggcatgcctccgaggg

SEQ ID NO: 76232 - DNA, 20 bp, human
gccgaaaactagaccaaatg

SEQ ID NO: 76233 - DNA, 20 bp, human
gtggcatggcatgcctccga

SEQ ID NO: 76234 - DNA, 20 bp, human
gaagccagatgccggttact

SEQ ID NO: 76235 - DNA, 20 bp, human
gtgtgaaggccttcttccct

SEQ ID NO: 76236 - DNA, 20 bp, human
gccccaagtgtgtcaccgaa

SEQ ID NO: 76237 - DNA, 20 bp, human
gggccttaccgaagagaagg

SEQ ID NO: 76238 - DNA, 20 bp, human
gggcactgcatgcatgggac

SEQ ID NO: 76239 - DNA, 20 bp, human
gcaagttaccactgagaaca

SEQ ID NO: 76240 - DNA, 20 bp, human
gcagggccttaccgaagaga

SEQ ID NO: 76241 - DNA, 20 bp, human
gtgcagtgccctgttctcag

SEQ ID NO: 76242 - DNA, 20 bp, human
gagcccttcggtgacacact

SEQ ID NO: 76243 - DNA, 20 bp, human
gtacctccttctcttcggta

SEQ ID NO: 76244 - DNA, 20 bp, human
gctaagtggtcacaatttca

SEQ ID NO: 76245 - DNA, 20 bp, human
gtttcagcaaatattctaat

SEQ ID NO: 76246 - DNA, 20 bp, human
ggtcccctgtgagtgtacga

SEQ ID NO: 76247 - DNA, 20 bp, human
gtgccctcgtacactcacag

SEQ ID NO: 76248 - DNA, 20 bp, human
ggaagccatagtggacgggt

SEQ ID NO: 76249 - DNA, 20 bp, human
gatgcagagagaacctgatc

SEQ ID NO: 76250 - DNA, 20 bp, human
ggtgacttgtatcttctgac

SEQ ID NO: 76251 - DNA, 20 bp, human
gtaagcagagatgcattggg

SEQ ID NO: 76252 - DNA, 20 bp, human
gaaaggattatcacctgatc

SEQ ID NO: 76253 - DNA, 20 bp, human
gcactgcagttccctgatga

SEQ ID NO: 76254 - DNA, 20 bp, human
gtgtggaagccatagtggac

SEQ ID NO: 76255 - DNA, 20 bp, human
gtggagtgtggaagccatag

SEQ ID NO: 76256 - DNA, 20 bp, human
gtgatgtgcaggaaagttaa

SEQ ID NO: 76257 - DNA, 20 bp, human
gtgggccgctgacatgaata

SEQ ID NO: 76258 - DNA, 20 bp, human
ggaaagttaaaggagacaat

SEQ ID NO: 76259 - DNA, 20 bp, human
gtaagtccaggattccaatt

SEQ ID NO: 76260 - DNA, 20 bp, human
gagacaagccagtgtagtcc

SEQ ID NO: 76261 - DNA, 20 bp, human
gcaatttggcagggtttact

SEQ ID NO: 76262 - DNA, 20 bp, human
gggaatgtcctgttcctctg

SEQ ID NO: 76263 - DNA, 20 bp, human
gcaaaaagttggaggaggtt

SEQ ID NO: 76264 - DNA, 20 bp, human
gttttggcgagaggaacaaa

SEQ ID NO: 76265 - DNA, 20 bp, human
gatgggtaaagaaccatccc

SEQ ID NO: 76266 - DNA, 20 bp, human
gtgggtctgtctgggctggt

SEQ ID NO: 76267 - DNA, 20 bp, human
gaggcaaggctattaatagg

SEQ ID NO: 76268 - DNA, 20 bp, human
gagaagttactagtagtacc

SEQ ID NO: 76269 - DNA, 20 bp, human
gagttactagtagtacctgg

SEQ ID NO: 76270 - DNA, 20 bp, human
gtactactagtaacttctgg

SEQ ID NO: 76271 - DNA, 20 bp, human
gctggaactatgtaccccaa

SEQ ID NO: 76272 - DNA, 20 bp, human
gaagggacatatacacaacc

SEQ ID NO: 76273 - DNA, 20 bp, human
ggaagagccctagtatggat

SEQ ID NO: 76274 - DNA, 20 bp, human
ggttacatccacaaatgcct

SEQ ID NO: 76275 - DNA, 20 bp, human
gaggtggctcaacaaataca

SEQ ID NO: 76276 - DNA, 20 bp, human
gaggggtaagtaaggaagtg

SEQ ID NO: 76277 - DNA, 20 bp, human
ggatgcacaggtgaaggtta

SEQ ID NO: 76278 - DNA, 20 bp, human
gaggcacctgggaagtttag

SEQ ID NO: 76279 - DNA, 20 bp, human
ggacaaaacttgacctggtg

SEQ ID NO: 76280 - DNA, 20 bp, human
gggtcagccttgagatgcac

SEQ ID NO: 76281 - DNA, 20 bp, human
gtgtccctcggcacttcccc

SEQ ID NO: 76282 - DNA, 20 bp, human
gagttttgtctcagccccaa

SEQ ID NO: 76283 - DNA, 20 bp, human
ggctgagacaaaacttgacc

SEQ ID NO: 76284 - DNA, 20 bp, human
ggagcctggggaagtgccga

SEQ ID NO: 76285 - DNA, 20 bp, human
gccctggtgctgaatccctg

SEQ ID NO: 76286 - DNA, 20 bp, human
gggccggccggggccgtttc

SEQ ID NO: 76287 - DNA, 20 bp, human
gacgttgtaagccgctggag

SEQ ID NO: 76288 - DNA, 20 bp, human
ggctgctgcagcaaaaataa

SEQ ID NO: 76289 - DNA, 20 bp, human
gggaaagacgtaagaggcgg

SEQ ID NO: 76290 - DNA, 20 bp, human
ggtagaagccgaggcgcccg

SEQ ID NO: 76291 - DNA, 20 bp, human
ggcagcagcgacttgtcaaa

SEQ ID NO: 76292 - DNA, 20 bp, human
gaagggaaagacgtaagagg

SEQ ID NO: 76293 - DNA, 20 bp, human
gcggagcagcgtagaagccg

SEQ ID NO: 76294 - DNA, 20 bp, human
ggaaagagacgcgaccacag

SEQ ID NO: 76295 - DNA, 20 bp, human
gtcaaagggaaagacgtaag

SEQ ID NO: 76296 - DNA, 20 bp, human
gccgaaaacggagaaacccc

SEQ ID NO: 76297 - DNA, 20 bp, human
gggcgtacgcagggtactaa

SEQ ID NO: 76298 - DNA, 20 bp, human
ggagagccccgcgccgggaa

SEQ ID NO: 76299 - DNA, 20 bp, human
gcagtcggagtcccaagctg

SEQ ID NO: 76300 - DNA, 20 bp, human
gcggcgcggggctctctgac

SEQ ID NO: 76301 - DNA, 20 bp, human
gctgtcacagcccctctcgc

SEQ ID NO: 76302 - DNA, 20 bp, human
ggcccacgagaacgccaggg

SEQ ID NO: 76303 - DNA, 20 bp, human
gcgtcgcaattcctcccggg

SEQ ID NO: 76304 - DNA, 20 bp, human
gcgcggggctctctgaccgg

SEQ ID NO: 76305 - DNA, 20 bp, human
gcgagcccacgagaacgcca

SEQ ID NO: 76306 - DNA, 20 bp, human
ggtgtgacggcgttagggag

SEQ ID NO: 76307 - DNA, 20 bp, human
ggaagaacgggaggcaagcg

SEQ ID NO: 76308 - DNA, 20 bp, human
ggcgggcggggaagaacggg

SEQ ID NO: 76309 - DNA, 20 bp, human
ggtcagcgacccggatggag

SEQ ID NO: 76310 - DNA, 20 bp, human
gggagcagcggcacagacgc

SEQ ID NO: 76311 - DNA, 20 bp, human
gggaagcccaaggtgacggg

SEQ ID NO: 76312 - DNA, 20 bp, human
gtgcaggccggcccggcata

SEQ ID NO: 76313 - DNA, 20 bp, human
ggtggccccagcgggttcgg

SEQ ID NO: 76314 - DNA, 20 bp, human
gggagcgggcggggaagaac

SEQ ID NO: 76315 - DNA, 20 bp, human
gtctctggactggacagcag

SEQ ID NO: 76316 - DNA, 20 bp, human
ggcgcaacgcctgaggcagt

SEQ ID NO: 76317 - DNA, 20 bp, human
gcagtgggcgcgctcagtcc

SEQ ID NO: 76318 - DNA, 20 bp, human
gcccggacgccgagtgagtg

SEQ ID NO: 76319 - DNA, 20 bp, human
gctctgcagcgcaacgcctg

SEQ ID NO: 76320 - DNA, 20 bp, human
gggagagaacgcctggtccc

SEQ ID NO: 76321 - DNA, 20 bp, human
gccccggcgagcagcagagt

SEQ ID NO: 76322 - DNA, 20 bp, human
gaccagctgctcgccgggag

SEQ ID NO: 76323 - DNA, 20 bp, human
gcaccgcgcgctgctccgga

SEQ ID NO: 76324 - DNA, 20 bp, human
gggcgagaggagagaacgcc

SEQ ID NO: 76325 - DNA, 20 bp, human
gtccctcaggcgcggacccc

SEQ ID NO: 76326 - DNA, 20 bp, human
gcgtgcggagacaacagcag

SEQ ID NO: 76327 - DNA, 20 bp, human
gaccacagggtcctctcgtg

SEQ ID NO: 76328 - DNA, 20 bp, human
ggctgctgctgaccaaccac

SEQ ID NO: 76329 - DNA, 20 bp, human
ggaatccggagcaggcgaca

SEQ ID NO: 76330 - DNA, 20 bp, human
gggagctgccaggtgagcgg

SEQ ID NO: 76331 - DNA, 20 bp, human
gctgagagccgaaactaacc

SEQ ID NO: 76332 - DNA, 20 bp, human
ggctgttgtctccgcacgag

SEQ ID NO: 76333 - DNA, 20 bp, human
gtcggggcccgaagagccac

SEQ ID NO: 76334 - DNA, 20 bp, human
ggggcgccgcgggccaggca

SEQ ID NO: 76335 - DNA, 20 bp, human
gcgttgggaaaacgaaactg

SEQ ID NO: 76336 - DNA, 20 bp, human
gcggctactgggcaacagag

SEQ ID NO: 76337 - DNA, 20 bp, human
gtcgttgcagagattgcggg

SEQ ID NO: 76338 - DNA, 20 bp, human
gcggccggtcacctccccca

SEQ ID NO: 76339 - DNA, 20 bp, human
gtcggtctcggactccatgg

SEQ ID NO: 76340 - DNA, 20 bp, human
gaacagaggggcgcccgcgt

SEQ ID NO: 76341 - DNA, 20 bp, human
gtggagtgtgggccacctca

SEQ ID NO: 76342 - DNA, 20 bp, human
ggggtagacgcggctcaggt

SEQ ID NO: 76343 - DNA, 20 bp, human
ggcctaggggcgggaagtcg

SEQ ID NO: 76344 - DNA, 20 bp, human
gtaaaaggcgcccgaagcgg

SEQ ID NO: 76345 - DNA, 20 bp, human
gctgtcgttgcagagattgc

SEQ ID NO: 76346 - DNA, 20 bp, human
ggggcggcccaggcgactac

SEQ ID NO: 76347 - DNA, 20 bp, human
ggcgactacaggtagcagga

SEQ ID NO: 76348 - DNA, 20 bp, human
ggaagcagctgggccgctca

SEQ ID NO: 76349 - DNA, 20 bp, human
gactacaggtagcaggaggg

SEQ ID NO: 76350 - DNA, 20 bp, human
gcaacaaggcccctacgcca

SEQ ID NO: 76351 - DNA, 20 bp, human
gggtcgccgcgcagcaggaa

SEQ ID NO: 76352 - DNA, 20 bp, human
gtctggacagcgcagggtgg

SEQ ID NO: 76353 - DNA, 20 bp, human
gagggagagaagctgaccga

SEQ ID NO: 76354 - DNA, 20 bp, human
gggccccgcggtgcggatcg

SEQ ID NO: 76355 - DNA, 20 bp, human
gcgaggaggcgcgggtgaaa

SEQ ID NO: 76356 - DNA, 20 bp, human
gcaaggagagaggtagacgg

SEQ ID NO: 76357 - DNA, 20 bp, human
gtagcgctgttccaggacca

SEQ ID NO: 76358 - DNA, 20 bp, human
gcagggcctagggatcacac

SEQ ID NO: 76359 - DNA, 20 bp, human
ggttccaggaccaaggagag

SEQ ID NO: 76360 - DNA, 20 bp, human
gccgggatggcagattccat

SEQ ID NO: 76361 - DNA, 20 bp, human
gctagggatcacacaggatc

SEQ ID NO: 76362 - DNA, 20 bp, human
gtagaggccgccagggccta

SEQ ID NO: 76363 - DNA, 20 bp, human
gctgtcttgaaaccccggga

SEQ ID NO: 76364 - DNA, 20 bp, human
gatatatatagaggccgcca

SEQ ID NO: 76365 - DNA, 20 bp, human
gatcacacaggatccggagc

SEQ ID NO: 76366 - DNA, 20 bp, human
gtgcgggaggaacccaccag

SEQ ID NO: 76367 - DNA, 20 bp, human
gcccacgcaaagggaaaccg

SEQ ID NO: 76368 - DNA, 20 bp, human
gaggtccgaaatgaggtccc

SEQ ID NO: 76369 - DNA, 20 bp, human
gccgcgcggaaccccctggt

SEQ ID NO: 76370 - DNA, 20 bp, human
gtcacctcccggcccagcag

SEQ ID NO: 76371 - DNA, 20 bp, human
gggcgccgcgcggaaccccc

SEQ ID NO: 76372 - DNA, 20 bp, human
ggccggcgcttctccagcag

SEQ ID NO: 76373 - DNA, 20 bp, human
gactcgtctggcaccagccc

SEQ ID NO: 76374 - DNA, 20 bp, human
gttccgcgcggcgcccgagg

SEQ ID NO: 76375 - DNA, 20 bp, human
gggcggggcgcgcactcgtc

SEQ ID NO: 76376 - DNA, 20 bp, human
gggggacactcgtgcgactg

SEQ ID NO: 76377 - DNA, 20 bp, human
gctgttacgtgaggcaaatt

SEQ ID NO: 76378 - DNA, 20 bp, human
gggcagttctcggatctgga

SEQ ID NO: 76379 - DNA, 20 bp, human
gctccccgctggaacctctg

SEQ ID NO: 76380 - DNA, 20 bp, human
gggctctgggtcgaaatccc

SEQ ID NO: 76381 - DNA, 20 bp, human
gcccagagggcagcaaaact

SEQ ID NO: 76382 - DNA, 20 bp, human
ggactggggcaaggtgccca

SEQ ID NO: 76383 - DNA, 20 bp, human
ggggtctcaactgttacgtg

SEQ ID NO: 76384 - DNA, 20 bp, human
gcactcgtgcgactggggca

SEQ ID NO: 76385 - DNA, 20 bp, human
gcacgagtgtccccgcgtcg

SEQ ID NO: 76386 - DNA, 20 bp, human
gtggggtcttgagggactag

SEQ ID NO: 76387 - DNA, 20 bp, human
gggtgcatggactgcaacat

SEQ ID NO: 76388 - DNA, 20 bp, human
gctccccggcaacttccgaa

SEQ ID NO: 76389 - DNA, 20 bp, human
gccttgcaaggtatagggga

SEQ ID NO: 76390 - DNA, 20 bp, human
gaccttgcaaggagttctga

SEQ ID NO: 76391 - DNA, 20 bp, human
ggcacggagcctgctgcccg

SEQ ID NO: 76392 - DNA, 20 bp, human
gggcaacttccgaaaggtct

SEQ ID NO: 76393 - DNA, 20 bp, human
gaactccttgcaaggtatag

SEQ ID NO: 76394 - DNA, 20 bp, human
ggccttcagaactccttgca

SEQ ID NO: 76395 - DNA, 20 bp, human
ggatctacccgaccatggaa

SEQ ID NO: 76396 - DNA, 20 bp, human
ggcgatccgagcccctaggg

SEQ ID NO: 76397 - DNA, 20 bp, human
ggcggcgatccgagccccta

SEQ ID NO: 76398 - DNA, 20 bp, human
ggagccgggatccgccctag

SEQ ID NO: 76399 - DNA, 20 bp, human
ggccgccacggaccacgggc

SEQ ID NO: 76400 - DNA, 20 bp, human
ggcccgcccgtggtccgtgg

SEQ ID NO: 76401 - DNA, 20 bp, human
gctggacgccctcagaaaag

SEQ ID NO: 76402 - DNA, 20 bp, human
ggatgaccgtgagacacctg

SEQ ID NO: 76403 - DNA, 20 bp, human
ggagcccctagggcggatcc

SEQ ID NO: 76404 - DNA, 20 bp, human
gagcgcgccgccacggacca

SEQ ID NO: 76405 - DNA, 20 bp, human
gcgccactcgaagctggaga

SEQ ID NO: 76406 - DNA, 20 bp, human
gtggcgcggaacaggcgacg

SEQ ID NO: 76407 - DNA, 20 bp, human
ggctacctgaagcacagcaa

SEQ ID NO: 76408 - DNA, 20 bp, human
gcgggcgagacgaggcgagc

SEQ ID NO: 76409 - DNA, 20 bp, human
gggggaggccgggcgagacg

SEQ ID NO: 76410 - DNA, 20 bp, human
gctacagcgaaggctactcg

SEQ ID NO: 76411 - DNA, 20 bp, human
gaacaggcgacgaggcgacg

SEQ ID NO: 76412 - DNA, 20 bp, human
gcggggcgcggtgggaactc

SEQ ID NO: 76413 - DNA, 20 bp, human
ggcgcgccgacgccctatat

SEQ ID NO: 76414 - DNA, 20 bp, human
gtgcaccaggactacagcga

SEQ ID NO: 76415 - DNA, 20 bp, human
gccgcagctgcggaagccgg

SEQ ID NO: 76416 - DNA, 20 bp, human
ggagtccggaagaaactcag

SEQ ID NO: 76417 - DNA, 20 bp, human
gggcgcgctgcagccaatcg

SEQ ID NO: 76418 - DNA, 20 bp, human
gcagccgtccgcgctcctcg

SEQ ID NO: 76419 - DNA, 20 bp, human
gctccagtgctggcggaggg

SEQ ID NO: 76420 - DNA, 20 bp, human
gaagccgcgaggagcgcgga

SEQ ID NO: 76421 - DNA, 20 bp, human
gcgcacgcgcggcagatcag

SEQ ID NO: 76422 - DNA, 20 bp, human
gcccggcgtctggacgagtc

SEQ ID NO: 76423 - DNA, 20 bp, human
gcccactaggactccagtgc

SEQ ID NO: 76424 - DNA, 20 bp, human
gtggccccagcgctcaactc

SEQ ID NO: 76425 - DNA, 20 bp, human
gtaagcggctataaaagggg

SEQ ID NO: 76426 - DNA, 20 bp, human
gggaggagcaatggtcaccc

SEQ ID NO: 76427 - DNA, 20 bp, human
ggtcagagccagacctgagt

SEQ ID NO: 76428 - DNA, 20 bp, human
gaaccggtccacacagggtc

SEQ ID NO: 76429 - DNA, 20 bp, human
gcggtccacacagggtccgg

SEQ ID NO: 76430 - DNA, 20 bp, human
gcgggatcgagctgagaata

SEQ ID NO: 76431 - DNA, 20 bp, human
gcccaaggtgagaggcggga

SEQ ID NO: 76432 - DNA, 20 bp, human
gataggcacttgctccactc

SEQ ID NO: 76433 - DNA, 20 bp, human
gccttgggccgcggaatata

SEQ ID NO: 76434 - DNA, 20 bp, human
ggtgggaacgaaaagagaag

SEQ ID NO: 76435 - DNA, 20 bp, human
gatcgagctgagaataggga

SEQ ID NO: 76436 - DNA, 20 bp, human
ggctctgtgcagaccacgag

SEQ ID NO: 76437 - DNA, 20 bp, human
ggctgggagacatcctctcg

SEQ ID NO: 76438 - DNA, 20 bp, human
gtcccagccctatacacgtg

SEQ ID NO: 76439 - DNA, 20 bp, human
ggctctgccccacgtgtata

SEQ ID NO: 76440 - DNA, 20 bp, human
ggagcgccttcctgaaggct

SEQ ID NO: 76441 - DNA, 20 bp, human
gttgaaaaggagcaagttga

SEQ ID NO: 76442 - DNA, 20 bp, human
gatgaaaccccacaggccct

SEQ ID NO: 76443 - DNA, 20 bp, human
ggccccacgtgtatagggct

SEQ ID NO: 76444 - DNA, 20 bp, human
gaattgaaacaattaagctg

SEQ ID NO: 76445 - DNA, 20 bp, human
ggcctgtggggtttcattaa

SEQ ID NO: 76446 - DNA, 20 bp, human
ggggtgcatggtgttcttgt

SEQ ID NO: 76447 - DNA, 20 bp, human
gtgcaccccagctctaaaga

SEQ ID NO: 76448 - DNA, 20 bp, human
ggagtagaaatgagatatca

SEQ ID NO: 76449 - DNA, 20 bp, human
gtaagaatcaggagtaagtg

SEQ ID NO: 76450 - DNA, 20 bp, human
gtaactcagttcaatcagga

SEQ ID NO: 76451 - DNA, 20 bp, human
gtcttccttctttagagctg

SEQ ID NO: 76452 - DNA, 20 bp, human
ggtggcaactgttaagaatc

SEQ ID NO: 76453 - DNA, 20 bp, human
gaatctaactcagttcaatc

SEQ ID NO: 76454 - DNA, 20 bp, human
gaagaaactgtaacacaact

SEQ ID NO: 76455 - DNA, 20 bp, human
gtcactgcacctgggcctcc

SEQ ID NO: 76456 - DNA, 20 bp, human
ggtggagtgcctgtgatcag

SEQ ID NO: 76457 - DNA, 20 bp, human
gggcgccgctcacctgacca

SEQ ID NO: 76458 - DNA, 20 bp, human
gtggccagccccctccgaga

SEQ ID NO: 76459 - DNA, 20 bp, human
gtaaggacggggccaagacc

SEQ ID NO: 76460 - DNA, 20 bp, human
gtggtctcccctctcggagg

SEQ ID NO: 76461 - DNA, 20 bp, human
ggcgctggaaggcctcgtcg

SEQ ID NO: 76462 - DNA, 20 bp, human
ggccacgtgagaccctggtc

SEQ ID NO: 76463 - DNA, 20 bp, human
gaacctaatgcagctcgagg

SEQ ID NO: 76464 - DNA, 20 bp, human
gggctccagagacgccctat

SEQ ID NO: 76465 - DNA, 20 bp, human
gggccgagctgacatcgtac

SEQ ID NO: 76466 - DNA, 20 bp, human
gacagcagcgccagcagcat

SEQ ID NO: 76467 - DNA, 20 bp, human
gtccggctcggcagaccggg

SEQ ID NO: 76468 - DNA, 20 bp, human
gtctcgtctgcgcagtgggg

SEQ ID NO: 76469 - DNA, 20 bp, human
gcatggagctgtgcgggctg

SEQ ID NO: 76470 - DNA, 20 bp, human
gagcgtgggttcagtccatg

SEQ ID NO: 76471 - DNA, 20 bp, human
gcccgcccggcccggatcag

SEQ ID NO: 76472 - DNA, 20 bp, human
gagggtgggggcaagagcgt

SEQ ID NO: 76473 - DNA, 20 bp, human
gagcggccatggagctgtgc

SEQ ID NO: 76474 - DNA, 20 bp, human
ggaaagcagccgagcggcca

SEQ ID NO: 76475 - DNA, 20 bp, human
ggggtcatcttcaccaagag

SEQ ID NO: 76476 - DNA, 20 bp, human
gccggaaccggagcaggtag

SEQ ID NO: 76477 - DNA, 20 bp, human
gaccggagcaggtagcggtg

SEQ ID NO: 76478 - DNA, 20 bp, human
ggcgcccgagggcaacggag

SEQ ID NO: 76479 - DNA, 20 bp, human
gagcggccgagcgccggaac

SEQ ID NO: 76480 - DNA, 20 bp, human
gctctgcgcgctaggccggg

SEQ ID NO: 76481 - DNA, 20 bp, human
gggagcaggtagcggtgagg

SEQ ID NO: 76482 - DNA, 20 bp, human
gtggtccgatggctcctcag

SEQ ID NO: 76483 - DNA, 20 bp, human
ggcggacagggccatggagt

SEQ ID NO: 76484 - DNA, 20 bp, human
gcagcggagggccgcaacca

SEQ ID NO: 76485 - DNA, 20 bp, human
gggacctcgcgggaccgcgg

SEQ ID NO: 76486 - DNA, 20 bp, human
gccggccgtagcctcagcag

SEQ ID NO: 76487 - DNA, 20 bp, human
gaagcggagcaccccaataa

SEQ ID NO: 76488 - DNA, 20 bp, human
gccagctagcgggtccaagg

SEQ ID NO: 76489 - DNA, 20 bp, human
gccctcggaggcagcgtcat

SEQ ID NO: 76490 - DNA, 20 bp, human
gagcaccccaataaaggagt

SEQ ID NO: 76491 - DNA, 20 bp, human
gtgggagggaaagtcggggg

SEQ ID NO: 76492 - DNA, 20 bp, human
gcctgccgcagagcccacaa

SEQ ID NO: 76493 - DNA, 20 bp, human
gaggaacagtacgtaatggg

SEQ ID NO: 76494 - DNA, 20 bp, human
gcggaagaggagctgtggga

SEQ ID NO: 76495 - DNA, 20 bp, human
gcggcaggaacagtacgtaa

SEQ ID NO: 76496 - DNA, 20 bp, human
ggcaactgcagcaagaggta

SEQ ID NO: 76497 - DNA, 20 bp, human
gctgctgccacgggagaaca

SEQ ID NO: 76498 - DNA, 20 bp, human
ggcagcaagaggtagggctc

SEQ ID NO: 76499 - DNA, 20 bp, human
gctgctgcaactgcagcaag

SEQ ID NO: 76500 - DNA, 20 bp, human
ggacaggcagtcgcacagaa

SEQ ID NO: 76501 - DNA, 20 bp, human
gcgttgggaattgcaccgac

SEQ ID NO: 76502 - DNA, 20 bp, human
gagctctggtcaagccgctc

SEQ ID NO: 76503 - DNA, 20 bp, human
gccttccccactgtctccag

SEQ ID NO: 76504 - DNA, 20 bp, human
ggggaaacccaactaggata

SEQ ID NO: 76505 - DNA, 20 bp, human
gggggccactggagacagtg

SEQ ID NO: 76506 - DNA, 20 bp, human
gccatacccaggccgaatgg

SEQ ID NO: 76507 - DNA, 20 bp, human
gcaggttgtccggagaatcg

SEQ ID NO: 76508 - DNA, 20 bp, human
gcctgggagcagctagagag

SEQ ID NO: 76509 - DNA, 20 bp, human
gcggtgcctgaaggtctctg

SEQ ID NO: 76510 - DNA, 20 bp, human
gtgaatgggagagatcttga

SEQ ID NO: 76511 - DNA, 20 bp, human
ggggcgacgccagattccag

SEQ ID NO: 76512 - DNA, 20 bp, human
gcacaggggcgcggatcctg

SEQ ID NO: 76513 - DNA, 20 bp, human
ggcggcgaggccccgcacag

SEQ ID NO: 76514 - DNA, 20 bp, human
ggctggcgacatgctaggtc

SEQ ID NO: 76515 - DNA, 20 bp, human
gcggagaatcggggctgaat

SEQ ID NO: 76516 - DNA, 20 bp, human
gagggaggagttaactacag

SEQ ID NO: 76517 - DNA, 20 bp, human
gcgaggagaggtgatctgag

SEQ ID NO: 76518 - DNA, 20 bp, human
gctgcggccagggaacccct

SEQ ID NO: 76519 - DNA, 20 bp, human
gtgagcgggatcagtgtgtg

SEQ ID NO: 76520 - DNA, 20 bp, human
gccctccccaggaaccccca

SEQ ID NO: 76521 - DNA, 20 bp, human
gatcgccgttaaacgaggag

SEQ ID NO: 76522 - DNA, 20 bp, human
gaggtgccttccagcccaag

SEQ ID NO: 76523 - DNA, 20 bp, human
ggagctggacgagaccatcg

SEQ ID NO: 76524 - DNA, 20 bp, human
gaccagaggcaaagcgtgag

SEQ ID NO: 76525 - DNA, 20 bp, human
gaggcctgccgcggtgacag

SEQ ID NO: 76526 - DNA, 20 bp, human
ggatgggagacgccactgaa

SEQ ID NO: 76527 - DNA, 20 bp, human
gtgggcaggcgcggctccgg

SEQ ID NO: 76528 - DNA, 20 bp, human
gcggcgcggtctgctcctag

SEQ ID NO: 76529 - DNA, 20 bp, human
ggcctgggcaggcgcggctc

SEQ ID NO: 76530 - DNA, 20 bp, human
gttgcggccgagcagagttg

SEQ ID NO: 76531 - DNA, 20 bp, human
gggcgtgggaaagagccgct

SEQ ID NO: 76532 - DNA, 20 bp, human
ggagcgagaacaattactcg

SEQ ID NO: 76533 - DNA, 20 bp, human
gtggacgagaccatcgacgt

SEQ ID NO: 76534 - DNA, 20 bp, human
gcgcaggagttggcgaggga

SEQ ID NO: 76535 - DNA, 20 bp, human
gtggctccctggaaatcccg

SEQ ID NO: 76536 - DNA, 20 bp, human
gtagccgcggggctgagacc

SEQ ID NO: 76537 - DNA, 20 bp, human
gagcgacccaaggagccgag

SEQ ID NO: 76538 - DNA, 20 bp, human
gggtccgtcggactccccgt

SEQ ID NO: 76539 - DNA, 20 bp, human
gttcgccatgaagcgaccca

SEQ ID NO: 76540 - DNA, 20 bp, human
gcctgccaatggcctcccct

SEQ ID NO: 76541 - DNA, 20 bp, human
gtgttgaagtggcctagggg

SEQ ID NO: 76542 - DNA, 20 bp, human
gatctgttgaagtggcctag

SEQ ID NO: 76543 - DNA, 20 bp, human
gtccagggaaaacctgccaa

SEQ ID NO: 76544 - DNA, 20 bp, human
gcagccctccagcaccgcct

SEQ ID NO: 76545 - DNA, 20 bp, human
gcctcttggcccacgtcgat

SEQ ID NO: 76546 - DNA, 20 bp, human
gggtctgcaaaagcatcagg

SEQ ID NO: 76547 - DNA, 20 bp, human
gggtctggacgcagaaagta

SEQ ID NO: 76548 - DNA, 20 bp, human
gcgcggtctgcaaaagcatc

SEQ ID NO: 76549 - DNA, 20 bp, human
ggcttgctgcgtgagtccga

SEQ ID NO: 76550 - DNA, 20 bp, human
gctgcgtccagaccccgtga

SEQ ID NO: 76551 - DNA, 20 bp, human
gagggctgcgggcgaactag

SEQ ID NO: 76552 - DNA, 20 bp, human
ggaagcgccggcctggctcg

SEQ ID NO: 76553 - DNA, 20 bp, human
gctatctgcagttcagtggt

SEQ ID NO: 76554 - DNA, 20 bp, human
gctccttgaacctggaactc

SEQ ID NO: 76555 - DNA, 20 bp, human
gtgcagaccgcggtcctgca

SEQ ID NO: 76556 - DNA, 20 bp, human
gggagacacggaggaccccc

SEQ ID NO: 76557 - DNA, 20 bp, human
ggccggctgctgtctcactg

SEQ ID NO: 76558 - DNA, 20 bp, human
gctacagaatagaggacgta

SEQ ID NO: 76559 - DNA, 20 bp, human
gggagctgacccacagagta

SEQ ID NO: 76560 - DNA, 20 bp, human
gcccacagagtagggaatca

SEQ ID NO: 76561 - DNA, 20 bp, human
gggacgagagacatccaagt

SEQ ID NO: 76562 - DNA, 20 bp, human
gtgtgggtcagctccagcca

SEQ ID NO: 76563 - DNA, 20 bp, human
gtgctgtctcactgaggtca

SEQ ID NO: 76564 - DNA, 20 bp, human
gagattggggcaccttggta

SEQ ID NO: 76565 - DNA, 20 bp, human
gacacggaggaccccctggc

SEQ ID NO: 76566 - DNA, 20 bp, human
gagctgtccgcagggaggtg

SEQ ID NO: 76567 - DNA, 20 bp, human
gctaggagctgtccgcaggg

SEQ ID NO: 76568 - DNA, 20 bp, human
gtgagccgcgggtttcacag

SEQ ID NO: 76569 - DNA, 20 bp, human
gggcttggcggtcctcagag

SEQ ID NO: 76570 - DNA, 20 bp, human
gacccgcggctcagacagat

SEQ ID NO: 76571 - DNA, 20 bp, human
gggcctaggagctgtccgca

SEQ ID NO: 76572 - DNA, 20 bp, human
gggccttagggccccgagag

SEQ ID NO: 76573 - DNA, 20 bp, human
gcgagagtggcacaagaacg

SEQ ID NO: 76574 - DNA, 20 bp, human
gcccaccgctgtgaaacccg

SEQ ID NO: 76575 - DNA, 20 bp, human
gggcgcgtcactccaccccc

SEQ ID NO: 76576 - DNA, 20 bp, human
gggcgttggggagcacgagg

SEQ ID NO: 76577 - DNA, 20 bp, human
gctggaccggcccttcccag

SEQ ID NO: 76578 - DNA, 20 bp, human
gcgaggcctgggattcagaa

SEQ ID NO: 76579 - DNA, 20 bp, human
gaggggcaggaagaaatagc

SEQ ID NO: 76580 - DNA, 20 bp, human
ggttggggagcacgaggggg

SEQ ID NO: 76581 - DNA, 20 bp, human
gggccggtgttcaagcgtcg

SEQ ID NO: 76582 - DNA, 20 bp, human
gagcacaggagcgggcgttg

SEQ ID NO: 76583 - DNA, 20 bp, human
gagcgctgcgcctctgggaa

SEQ ID NO: 76584 - DNA, 20 bp, human
gcccaggcctcgctggacca

SEQ ID NO: 76585 - DNA, 20 bp, human
gttcctcgacgcttgaacac

SEQ ID NO: 76586 - DNA, 20 bp, human
ggaaacgtgcatgtccgtag

SEQ ID NO: 76587 - DNA, 20 bp, human
gctgaagtcaccacacatag

SEQ ID NO: 76588 - DNA, 20 bp, human
ggggaagcctctgaacacag

SEQ ID NO: 76589 - DNA, 20 bp, human
ggtgcatgtccgtagtggag

SEQ ID NO: 76590 - DNA, 20 bp, human
gtcaccggaagtggtccatg

SEQ ID NO: 76591 - DNA, 20 bp, human
gtgaggctgcagcaatggga

SEQ ID NO: 76592 - DNA, 20 bp, human
gtggtgacttcaggaaaccc

SEQ ID NO: 76593 - DNA, 20 bp, human
ggagctgaagaacaagggaa

SEQ ID NO: 76594 - DNA, 20 bp, human
gtaagagctcccctccacta

SEQ ID NO: 76595 - DNA, 20 bp, human
gaaccggaatatccaaagag

SEQ ID NO: 76596 - DNA, 20 bp, human
gacgggctggcggatccctc

SEQ ID NO: 76597 - DNA, 20 bp, human
ggttgaagggggggcgagtg

SEQ ID NO: 76598 - DNA, 20 bp, human
gagggaggaagtgctaatac

SEQ ID NO: 76599 - DNA, 20 bp, human
gcccaggcatctcctccaga

SEQ ID NO: 76600 - DNA, 20 bp, human
gtattaggctaagtgggacg

SEQ ID NO: 76601 - DNA, 20 bp, human
gagttgtggattatgagata

SEQ ID NO: 76602 - DNA, 20 bp, human
gccacatggtgctgctggac

SEQ ID NO: 76603 - DNA, 20 bp, human
gcacaactattaggctaagt

SEQ ID NO: 76604 - DNA, 20 bp, human
gtgggtgaaagaatcctgtt

SEQ ID NO: 76605 - DNA, 20 bp, human
gtgtggattatgagataggg

SEQ ID NO: 76606 - DNA, 20 bp, human
gacccaggcccagcgcccca

SEQ ID NO: 76607 - DNA, 20 bp, human
ggcagcccccagacccatag

SEQ ID NO: 76608 - DNA, 20 bp, human
gcagccccggtgggggccag

SEQ ID NO: 76609 - DNA, 20 bp, human
gctcacggagccccacctgg

SEQ ID NO: 76610 - DNA, 20 bp, human
gtgcgaccagaggttcccag

SEQ ID NO: 76611 - DNA, 20 bp, human
gtgggcccctatgggtctgg

SEQ ID NO: 76612 - DNA, 20 bp, human
gctctctctggacctctgtt

SEQ ID NO: 76613 - DNA, 20 bp, human
gtctgtggcgaccctccctc

SEQ ID NO: 76614 - DNA, 20 bp, human
ggagggtcgccacagagcgt

SEQ ID NO: 76615 - DNA, 20 bp, human
ggcctggcctgggcccctat

SEQ ID NO: 76616 - DNA, 20 bp, human
gggcgcgccagctcgtagca

SEQ ID NO: 76617 - DNA, 20 bp, human
ggtgccgctgcctcgcccca

SEQ ID NO: 76618 - DNA, 20 bp, human
gaggcctgagtcatgaaagt

SEQ ID NO: 76619 - DNA, 20 bp, human
ggccgagggtccaggatcgg

SEQ ID NO: 76620 - DNA, 20 bp, human
gtcgccatggggcgaggcag

SEQ ID NO: 76621 - DNA, 20 bp, human
gtgggctggaggtcgccatg

SEQ ID NO: 76622 - DNA, 20 bp, human
gaggcggaagcggaagtcgg

SEQ ID NO: 76623 - DNA, 20 bp, human
gtgcgcgcactggagggaaa

SEQ ID NO: 76624 - DNA, 20 bp, human
gcgtagcaggggagcgcccg

SEQ ID NO: 76625 - DNA, 20 bp, human
ggcgctcccctgctacgagc

SEQ ID NO: 76626 - DNA, 20 bp, human
gcaggcggcgcccaccccag

SEQ ID NO: 76627 - DNA, 20 bp, human
ggcgccgcgcacggagatag

SEQ ID NO: 76628 - DNA, 20 bp, human
gcaggacgcaggctccgctg

SEQ ID NO: 76629 - DNA, 20 bp, human
ggcgccttccgtctaaacag

SEQ ID NO: 76630 - DNA, 20 bp, human
gacgccgggaccccacaaac

SEQ ID NO: 76631 - DNA, 20 bp, human
ggtcccgcgccccagaccgg

SEQ ID NO: 76632 - DNA, 20 bp, human
ggcgcagcgtctcctctccg

SEQ ID NO: 76633 - DNA, 20 bp, human
ggtcccggcgtcccgatccg

SEQ ID NO: 76634 - DNA, 20 bp, human
gagcgggcggcgggcatgag

SEQ ID NO: 76635 - DNA, 20 bp, human
ggccgcagcaccccgaagtc

SEQ ID NO: 76636 - DNA, 20 bp, human
ggctgcgctgctcctccaaa

SEQ ID NO: 76637 - DNA, 20 bp, human
gctccaaagggcagctccgg

SEQ ID NO: 76638 - DNA, 20 bp, human
gcgagtcccagcgacatcgg

SEQ ID NO: 76639 - DNA, 20 bp, human
gggcagctccgggggaaaga

SEQ ID NO: 76640 - DNA, 20 bp, human
ggtcccagcgacatcggcgg

SEQ ID NO: 76641 - DNA, 20 bp, human
ggccgtgcgcggacttgtcc

SEQ ID NO: 76642 - DNA, 20 bp, human
gcgggcaaaggcggggatct

SEQ ID NO: 76643 - DNA, 20 bp, human
gcgggcgaagaagacaaaag

SEQ ID NO: 76644 - DNA, 20 bp, human
ggaaagagggtggcgtcccg

SEQ ID NO: 76645 - DNA, 20 bp, human
ggtgcgcccgggcaaaggcg

SEQ ID NO: 76646 - DNA, 20 bp, human
gggtcgcacggacggacagt

SEQ ID NO: 76647 - DNA, 20 bp, human
ggctggcactgaccttgagg

SEQ ID NO: 76648 - DNA, 20 bp, human
gtgagctctggggccacggt

SEQ ID NO: 76649 - DNA, 20 bp, human
gtggagcaggagcttgaaac

SEQ ID NO: 76650 - DNA, 20 bp, human
ggaccttgaggaggccgcaa

SEQ ID NO: 76651 - DNA, 20 bp, human
gtgaggtgggcagtgtgcca

SEQ ID NO: 76652 - DNA, 20 bp, human
gcgggctcttcaccatgctc

SEQ ID NO: 76653 - DNA, 20 bp, human
gcactgcccacctcaggctc

SEQ ID NO: 76654 - DNA, 20 bp, human
gggctggacacaccccaccg

SEQ ID NO: 76655 - DNA, 20 bp, human
ggtgcggggtgtccccagtg

SEQ ID NO: 76656 - DNA, 20 bp, human
ggcgtacagcggcaccccca

SEQ ID NO: 76657 - DNA, 20 bp, human
ggcggcgtgggcgcgtacag

SEQ ID NO: 76658 - DNA, 20 bp, human
gccggggtgcgggtactgca

SEQ ID NO: 76659 - DNA, 20 bp, human
ggggccagcagctctgcgag

SEQ ID NO: 76660 - DNA, 20 bp, human
gcacgaccccctgggtaagg

SEQ ID NO: 76661 - DNA, 20 bp, human
ggcccggccgccttacccag

SEQ ID NO: 76662 - DNA, 20 bp, human
gcagtacccgcaccccgggc

SEQ ID NO: 76663 - DNA, 20 bp, human
gcgccacgaccccctgggta

SEQ ID NO: 76664 - DNA, 20 bp, human
gggcaggcggtagacggctg

SEQ ID NO: 76665 - DNA, 20 bp, human
gccgaagccgccgggtccgt

SEQ ID NO: 76666 - DNA, 20 bp, human
gtagggcactccagagacag

SEQ ID NO: 76667 - DNA, 20 bp, human
gctgcccagcaggggcacta

SEQ ID NO: 76668 - DNA, 20 bp, human
gacagtagcaggaacagaaa

SEQ ID NO: 76669 - DNA, 20 bp, human
gtgtgagaagctgcagccgc

SEQ ID NO: 76670 - DNA, 20 bp, human
gtgggctctagatgatgctg

SEQ ID NO: 76671 - DNA, 20 bp, human
gagagggaacgaaacatgag

SEQ ID NO: 76672 - DNA, 20 bp, human
gaggagtttgcggggctgta

SEQ ID NO: 76673 - DNA, 20 bp, human
gcgctcctcgggctccccta

SEQ ID NO: 76674 - DNA, 20 bp, human
gcaggcagcaggacagccga

SEQ ID NO: 76675 - DNA, 20 bp, human
gctagggcgcctggagaata

SEQ ID NO: 76676 - DNA, 20 bp, human
gcttcggctgctgcgatgag

SEQ ID NO: 76677 - DNA, 20 bp, human
ggtccgagtactgcgcgcag

SEQ ID NO: 76678 - DNA, 20 bp, human
gagagatcggaaccccgcgg

SEQ ID NO: 76679 - DNA, 20 bp, human
ggcgcacgcggcccactcgg

SEQ ID NO: 76680 - DNA, 20 bp, human
ggctgaggggtcgactccag

SEQ ID NO: 76681 - DNA, 20 bp, human
ggggggcgagggccaagagt

SEQ ID NO: 76682 - DNA, 20 bp, human
gcaccttggtaccccgacaa

SEQ ID NO: 76683 - DNA, 20 bp, human
gtgtgacttgggccttctcg

SEQ ID NO: 76684 - DNA, 20 bp, human
ggcgcgcagtactcggactt

SEQ ID NO: 76685 - DNA, 20 bp, human
ggtccttcctgcttcaggag

SEQ ID NO: 76686 - DNA, 20 bp, human
gccaccacacagattaggag

SEQ ID NO: 76687 - DNA, 20 bp, human
gagccggcagctccaagatg

SEQ ID NO: 76688 - DNA, 20 bp, human
gcggcacatgaacttctaaa

SEQ ID NO: 76689 - DNA, 20 bp, human
ggcagaccaccacacagatt

SEQ ID NO: 76690 - DNA, 20 bp, human
gccagtaccgggcagcgatg

SEQ ID NO: 76691 - DNA, 20 bp, human
gtggtgtgggtcctgagcgg

SEQ ID NO: 76692 - DNA, 20 bp, human
gcaacaagaatatgaggcag

SEQ ID NO: 76693 - DNA, 20 bp, human
ggcccagcacccaaacccct

SEQ ID NO: 76694 - DNA, 20 bp, human
gcagtgtgcgtgtccaaagc

SEQ ID NO: 76695 - DNA, 20 bp, human
gggtgctgggctgcatggtg

SEQ ID NO: 76696 - DNA, 20 bp, human
gcaagggaacaacagaagta

SEQ ID NO: 76697 - DNA, 20 bp, human
ggacccacctgtgttccaaa

SEQ ID NO: 76698 - DNA, 20 bp, human
ggaacacaggtgggtctagc

SEQ ID NO: 76699 - DNA, 20 bp, human
gtgggtcatggagagacaag

SEQ ID NO: 76700 - DNA, 20 bp, human
gcattgaaggaccacgtgac

SEQ ID NO: 76701 - DNA, 20 bp, human
gatgaagctgtgcatgggcc

SEQ ID NO: 76702 - DNA, 20 bp, human
gcttcaatgaagctgtgcat

SEQ ID NO: 76703 - DNA, 20 bp, human
gtgctgggcttcctgtcacg

SEQ ID NO: 76704 - DNA, 20 bp, human
ggaactccgcaaataatttg

SEQ ID NO: 76705 - DNA, 20 bp, human
gaagggacaagacacatgcc

SEQ ID NO: 76706 - DNA, 20 bp, human
gcggtatgaatttctaagta

SEQ ID NO: 76707 - DNA, 20 bp, human
gtgaatttctaagtaaggta

SEQ ID NO: 76708 - DNA, 20 bp, human
gtacttagcatttgactaga

SEQ ID NO: 76709 - DNA, 20 bp, human
gtgctagataaccactacta

SEQ ID NO: 76710 - DNA, 20 bp, human
gtctcagagagtaaagtcca

SEQ ID NO: 76711 - DNA, 20 bp, human
gtgcactgcgttccattctg

SEQ ID NO: 76712 - DNA, 20 bp, human
gactgcgttccattctgtgg

SEQ ID NO: 76713 - DNA, 20 bp, human
gaacaaaaggaccgtagtag

SEQ ID NO: 76714 - DNA, 20 bp, human
ggcatgaataaatcaaatat

SEQ ID NO: 76715 - DNA, 20 bp, human
gactgtcttaccagaatgtt

SEQ ID NO: 76716 - DNA, 20 bp, human
ggggagactccagctctggg

SEQ ID NO: 76717 - DNA, 20 bp, human
gctaggcgccggcgcctccg

SEQ ID NO: 76718 - DNA, 20 bp, human
ggccggcgcctagtgattct

SEQ ID NO: 76719 - DNA, 20 bp, human
gcactgaggacgtaaggagg

SEQ ID NO: 76720 - DNA, 20 bp, human
gcggaaacacactgcctcgg

SEQ ID NO: 76721 - DNA, 20 bp, human
gggaatgcagaatgacgcca

SEQ ID NO: 76722 - DNA, 20 bp, human
gggatctgagcctcccgcag

SEQ ID NO: 76723 - DNA, 20 bp, human
gtcccagaatcactaggcgc

SEQ ID NO: 76724 - DNA, 20 bp, human
ggctggccactgaggacgta

SEQ ID NO: 76725 - DNA, 20 bp, human
ggggagtgcgggttcggggt

SEQ ID NO: 76726 - DNA, 20 bp, human
gctcggcccggcagtagtgg

SEQ ID NO: 76727 - DNA, 20 bp, human
ggccgtcccaccactactgc

SEQ ID NO: 76728 - DNA, 20 bp, human
gcggctcggcccggcagtag

SEQ ID NO: 76729 - DNA, 20 bp, human
gaggccgcaagcccgagcag

SEQ ID NO: 76730 - DNA, 20 bp, human
ggcaggtgcgggaaagaaag

SEQ ID NO: 76731 - DNA, 20 bp, human
ggctgctgcagccactcccg

SEQ ID NO: 76732 - DNA, 20 bp, human
ggcaccgggacgcctagaga

SEQ ID NO: 76733 - DNA, 20 bp, human
gcggaggacgattcccggag

SEQ ID NO: 76734 - DNA, 20 bp, human
ggcgcccgccgccatcttga

SEQ ID NO: 76735 - DNA, 20 bp, human
ggagcagagggcggcaggtg

SEQ ID NO: 76736 - DNA, 20 bp, human
gggcccggctgcctgaatcc

SEQ ID NO: 76737 - DNA, 20 bp, human
gtcgcctccccccccagaaa

SEQ ID NO: 76738 - DNA, 20 bp, human
ggtcggtccttttctggggg

SEQ ID NO: 76739 - DNA, 20 bp, human
gggctgcctgaatcccgggg

SEQ ID NO: 76740 - DNA, 20 bp, human
gccggtaactgcgagagtcg

SEQ ID NO: 76741 - DNA, 20 bp, human
ggtcggtgcggtttgataag

SEQ ID NO: 76742 - DNA, 20 bp, human
gggtcaggcggcggcgccag

SEQ ID NO: 76743 - DNA, 20 bp, human
gccatgcccgcgccagcccg

SEQ ID NO: 76744 - DNA, 20 bp, human
gcccagcctccccgggattc

SEQ ID NO: 76745 - DNA, 20 bp, human
ggtcccggagcgccccgggc

SEQ ID NO: 76746 - DNA, 20 bp, human
gctccagtaccggagaccgg

SEQ ID NO: 76747 - DNA, 20 bp, human
ggcagctccgaggagccgta

SEQ ID NO: 76748 - DNA, 20 bp, human
ggtactcgcggagtgagtgg

SEQ ID NO: 76749 - DNA, 20 bp, human
ggctccgaggagccgtaagg

SEQ ID NO: 76750 - DNA, 20 bp, human
gcagccgccggctccagtac

SEQ ID NO: 76751 - DNA, 20 bp, human
gtgagtggcggccgcagaaa

SEQ ID NO: 76752 - DNA, 20 bp, human
ggaggtcaccgcggggagag

SEQ ID NO: 76753 - DNA, 20 bp, human
gcgcagtctgtgggccctcc

SEQ ID NO: 76754 - DNA, 20 bp, human
gtctggacagaagaagcgag

SEQ ID NO: 76755 - DNA, 20 bp, human
gacgcgctctcaccgctcgg

SEQ ID NO: 76756 - DNA, 20 bp, human
ggatggggcagcgcgagatg

SEQ ID NO: 76757 - DNA, 20 bp, human
gcaaggttggggtctcacag

SEQ ID NO: 76758 - DNA, 20 bp, human
ggcgaggcgctggaacggtc

SEQ ID NO: 76759 - DNA, 20 bp, human
gggggcagcgcgagatgtgg

SEQ ID NO: 76760 - DNA, 20 bp, human
gcagcagagcgagaatctcc

SEQ ID NO: 76761 - DNA, 20 bp, human
gcagagagaggtgcagcaac

SEQ ID NO: 76762 - DNA, 20 bp, human
gatggctgcagcgtcagtat

SEQ ID NO: 76763 - DNA, 20 bp, human
gctcacgcgaggcgctggaa

SEQ ID NO: 76764 - DNA, 20 bp, human
ggaggtgagtgagagagcga

SEQ ID NO: 76765 - DNA, 20 bp, human
ggcccggcggcgcaggacgg

SEQ ID NO: 76766 - DNA, 20 bp, human
gcaggccccgagctgtgcca

SEQ ID NO: 76767 - DNA, 20 bp, human
gccagcaggacagaccgacc

SEQ ID NO: 76768 - DNA, 20 bp, human
gtcgcggcccccaaatccgg

SEQ ID NO: 76769 - DNA, 20 bp, human
gacgcgaccaggacgcgggg

SEQ ID NO: 76770 - DNA, 20 bp, human
gcggctgacggcggatccag

SEQ ID NO: 76771 - DNA, 20 bp, human
gctgagacgcgaccaggacg

SEQ ID NO: 76772 - DNA, 20 bp, human
ggaccggctgccctctggag

SEQ ID NO: 76773 - DNA, 20 bp, human
ggctgccctggcacagctcg

SEQ ID NO: 76774 - DNA, 20 bp, human
gcttcaggaaaagtcattca

SEQ ID NO: 76775 - DNA, 20 bp, human
gccgcccgggccccgaccga

SEQ ID NO: 76776 - DNA, 20 bp, human
gggcggccttgtggggcggg

SEQ ID NO: 76777 - DNA, 20 bp, human
gcggcgctccgcccgccggc

SEQ ID NO: 76778 - DNA, 20 bp, human
gagccgggcgctgaggacaa

SEQ ID NO: 76779 - DNA, 20 bp, human
gcggctgtgagcggcgctcg

SEQ ID NO: 76780 - DNA, 20 bp, human
gacgcacacgaggtgagggg

SEQ ID NO: 76781 - DNA, 20 bp, human
gcttccaagatggcgctggg

SEQ ID NO: 76782 - DNA, 20 bp, human
gacgtcacaagcttccaaga

SEQ ID NO: 76783 - DNA, 20 bp, human
gcccggggcacaaagcccac

SEQ ID NO: 76784 - DNA, 20 bp, human
ggcgctcggggcgcgctagg

SEQ ID NO: 76785 - DNA, 20 bp, human
ggcgcgggtctgcggagcgg

SEQ ID NO: 76786 - DNA, 20 bp, human
ggactctgcctggcaccgcc

SEQ ID NO: 76787 - DNA, 20 bp, human
ggatcgcactagggaggatg

SEQ ID NO: 76788 - DNA, 20 bp, human
gaggcagagtcaaactggaa

SEQ ID NO: 76789 - DNA, 20 bp, human
ggtgccaggcagagtcaaac

SEQ ID NO: 76790 - DNA, 20 bp, human
gagagtcaaactggaagggc

SEQ ID NO: 76791 - DNA, 20 bp, human
gagacagctggagagcactg

SEQ ID NO: 76792 - DNA, 20 bp, human
gggagccaggacctctctta

SEQ ID NO: 76793 - DNA, 20 bp, human
gcagctcacacagtacccgt

SEQ ID NO: 76794 - DNA, 20 bp, human
gactgaggacgcggacccac

SEQ ID NO: 76795 - DNA, 20 bp, human
gccacaggcggtggagtcaa

SEQ ID NO: 76796 - DNA, 20 bp, human
gcggagccgggttggagtct

SEQ ID NO: 76797 - DNA, 20 bp, human
ggagcgggctccagagacat

SEQ ID NO: 76798 - DNA, 20 bp, human
gggcacacgtcagcctaagg

SEQ ID NO: 76799 - DNA, 20 bp, human
ggtaggcacacgtcagccta

SEQ ID NO: 76800 - DNA, 20 bp, human
gggctggagatgcgaagctg

SEQ ID NO: 76801 - DNA, 20 bp, human
gggctctcgcaggagacaag

SEQ ID NO: 76802 - DNA, 20 bp, human
gtgtcgccggctcggggagt

SEQ ID NO: 76803 - DNA, 20 bp, human
gtcggtcgaccccatgtctc

SEQ ID NO: 76804 - DNA, 20 bp, human
ggtgtgcctactccccgagc

SEQ ID NO: 76805 - DNA, 20 bp, human
gtgcgaagctggggacgccg

SEQ ID NO: 76806 - DNA, 20 bp, human
gctggccgaagcgacgaaga

SEQ ID NO: 76807 - DNA, 20 bp, human
gcctcctgtcccctcagacg

SEQ ID NO: 76808 - DNA, 20 bp, human
gcggctccgagcctctcctc

SEQ ID NO: 76809 - DNA, 20 bp, human
gcacagtgctgcctcgtctg

SEQ ID NO: 76810 - DNA, 20 bp, human
gctcctcaggtggcttgtca

SEQ ID NO: 76811 - DNA, 20 bp, human
ggcgttaatgggattggggg

SEQ ID NO: 76812 - DNA, 20 bp, human
gctgcctcgtctgaggggac

SEQ ID NO: 76813 - DNA, 20 bp, human
gatggcgacgtggacagcgg

SEQ ID NO: 76814 - DNA, 20 bp, human
ggtcgcttcggccagtgtgt

SEQ ID NO: 76815 - DNA, 20 bp, human
gggagcccggccggcgaggt

SEQ ID NO: 76816 - DNA, 20 bp, human
gttccggtgggggccgtccc

SEQ ID NO: 76817 - DNA, 20 bp, human
gcagagcgacccccgggcag

SEQ ID NO: 76818 - DNA, 20 bp, human
gcggggctctccagagccag

SEQ ID NO: 76819 - DNA, 20 bp, human
gatcatggaggccaacccac

SEQ ID NO: 76820 - DNA, 20 bp, human
gtctggagagccccgggagg

SEQ ID NO: 76821 - DNA, 20 bp, human
ggtaatgccaaggagccggt

SEQ ID NO: 76822 - DNA, 20 bp, human
gggtcgctctgactcagacg

SEQ ID NO: 76823 - DNA, 20 bp, human
ggggccgcgtctaaagggag

SEQ ID NO: 76824 - DNA, 20 bp, human
gcggtgggggccgtccctgg

SEQ ID NO: 76825 - DNA, 20 bp, human
gccatctccgccgccaggga

SEQ ID NO: 76826 - DNA, 20 bp, human
gccgggtgcgagttacgagt

SEQ ID NO: 76827 - DNA, 20 bp, human
gggctgaagggccatccagg

SEQ ID NO: 76828 - DNA, 20 bp, human
gtacgagtgggtgcgcacgg

SEQ ID NO: 76829 - DNA, 20 bp, human
gccatcgcccaggcccccgt

SEQ ID NO: 76830 - DNA, 20 bp, human
gccagccccagctagaggaa

SEQ ID NO: 76831 - DNA, 20 bp, human
gctcttgggaagtccctggt

SEQ ID NO: 76832 - DNA, 20 bp, human
gatggcccttcagccaacgg

SEQ ID NO: 76833 - DNA, 20 bp, human
gccgggaatactacctcact

SEQ ID NO: 76834 - DNA, 20 bp, human
gctacctcactgggcactct

SEQ ID NO: 76835 - DNA, 20 bp, human
gctgcaagccgtacccacca

SEQ ID NO: 76836 - DNA, 20 bp, human
ggcaaggtactgaagttcgg

SEQ ID NO: 76837 - DNA, 20 bp, human
gggccagagggatcaatatg

SEQ ID NO: 76838 - DNA, 20 bp, human
gcggggcagccagagacgta

SEQ ID NO: 76839 - DNA, 20 bp, human
gccacccttagggactgcag

SEQ ID NO: 76840 - DNA, 20 bp, human
gagcggcgactggcgagcca

SEQ ID NO: 76841 - DNA, 20 bp, human
gcgcgcaaggtactgaagtt

SEQ ID NO: 76842 - DNA, 20 bp, human
gccgcccctctggccaagag

SEQ ID NO: 76843 - DNA, 20 bp, human
gcagagggatcaatatgtgg

SEQ ID NO: 76844 - DNA, 20 bp, human
gccatatcacctaggatccc

SEQ ID NO: 76845 - DNA, 20 bp, human
ggtcgccgctccggagccct

SEQ ID NO: 76846 - DNA, 20 bp, human
gggtaagcgaaacaagccgg

SEQ ID NO: 76847 - DNA, 20 bp, human
gcagggatcggaagccggtt

SEQ ID NO: 76848 - DNA, 20 bp, human
gcgcggggcgggaagaagtg

SEQ ID NO: 76849 - DNA, 20 bp, human
gcggtcacggagtcacgaca

SEQ ID NO: 76850 - DNA, 20 bp, human
gcgaggagcgggagcttccc

SEQ ID NO: 76851 - DNA, 20 bp, human
gtgttgactgggcccgacgg

SEQ ID NO: 76852 - DNA, 20 bp, human
ggtctcgaatgagggaggag

SEQ ID NO: 76853 - DNA, 20 bp, human
gttctgaagagcgggctaag

SEQ ID NO: 76854 - DNA, 20 bp, human
gtcgagcatgggcggatgag

SEQ ID NO: 76855 - DNA, 20 bp, human
gagagcgagcgctccggtca

SEQ ID NO: 76856 - DNA, 20 bp, human
gacagagaaggcctcctact

SEQ ID NO: 76857 - DNA, 20 bp, human
ggcagccccgtcctagagag

SEQ ID NO: 76858 - DNA, 20 bp, human
gcacctgagatgggatacct

SEQ ID NO: 76859 - DNA, 20 bp, human
gggtcctactcacggaacaa

SEQ ID NO: 76860 - DNA, 20 bp, human
gctcccaggtatcccatctc

SEQ ID NO: 76861 - DNA, 20 bp, human
gactcaagtggtcctactca

SEQ ID NO: 76862 - DNA, 20 bp, human
gagtgcctctctctaggacg

SEQ ID NO: 76863 - DNA, 20 bp, human
gtggcccagccacctgagat

SEQ ID NO: 76864 - DNA, 20 bp, human
gaagctcctgaggaagactc

SEQ ID NO: 76865 - DNA, 20 bp, human
gcctataggtaagtgaagaa

SEQ ID NO: 76866 - DNA, 20 bp, human
gtccgcaaaggcactgggta

SEQ ID NO: 76867 - DNA, 20 bp, human
gatcaagagtatgatgggag

SEQ ID NO: 76868 - DNA, 20 bp, human
gatcctcatctgctgaccac

SEQ ID NO: 76869 - DNA, 20 bp, human
gttcaacacatgcttagagg

SEQ ID NO: 76870 - DNA, 20 bp, human
gttacctatagggacaaagg

SEQ ID NO: 76871 - DNA, 20 bp, human
gggtaagtacaagccttgac

SEQ ID NO: 76872 - DNA, 20 bp, human
gaggtagacttctaatgaaa

SEQ ID NO: 76873 - DNA, 20 bp, human
ggaaacatttcaatccgcaa

SEQ ID NO: 76874 - DNA, 20 bp, human
gtacttacctatagggacaa

SEQ ID NO: 76875 - DNA, 20 bp, human
gaggcttgtacttacctata

SEQ ID NO: 76876 - DNA, 20 bp, human
gcaagatctctggatcacag

SEQ ID NO: 76877 - DNA, 20 bp, human
gtcccggtgaaggtcatgaa

SEQ ID NO: 76878 - DNA, 20 bp, human
ggcgagggtaggtcgagtcg

SEQ ID NO: 76879 - DNA, 20 bp, human
gcgggagcagcgggtttagg

SEQ ID NO: 76880 - DNA, 20 bp, human
ggactagagaagagacgagg

SEQ ID NO: 76881 - DNA, 20 bp, human
ggtaggaactgcacaaggag

SEQ ID NO: 76882 - DNA, 20 bp, human
gatctctggatcacagcgga

SEQ ID NO: 76883 - DNA, 20 bp, human
gacagagtcctcccaatctt

SEQ ID NO: 76884 - DNA, 20 bp, human
gggatttggggcctaagatt

SEQ ID NO: 76885 - DNA, 20 bp, human
gagaggacagtgatgtcgga

SEQ ID NO: 76886 - DNA, 20 bp, human
gttcccgccacaaaactcac

SEQ ID NO: 76887 - DNA, 20 bp, human
gcgatcagagaggatcccgg

SEQ ID NO: 76888 - DNA, 20 bp, human
ggcgtgctcgcggctataag

SEQ ID NO: 76889 - DNA, 20 bp, human
gcaggagtccggaggaaagt

SEQ ID NO: 76890 - DNA, 20 bp, human
gaggtcgtgcaggagtccgg

SEQ ID NO: 76891 - DNA, 20 bp, human
gtgctcgcggctataagggg

SEQ ID NO: 76892 - DNA, 20 bp, human
gggtaccctggaagatacta

SEQ ID NO: 76893 - DNA, 20 bp, human
gcacgcaacacgctaagtgt

SEQ ID NO: 76894 - DNA, 20 bp, human
gagcaggtcgtgcaggagtc

SEQ ID NO: 76895 - DNA, 20 bp, human
gtgaatggggaccccagatg

SEQ ID NO: 76896 - DNA, 20 bp, human
ggaggttccagtcggggtga

SEQ ID NO: 76897 - DNA, 20 bp, human
gccttagcgtgaaggattcc

SEQ ID NO: 76898 - DNA, 20 bp, human
ggccgacagacggtaagctg

SEQ ID NO: 76899 - DNA, 20 bp, human
gtccggagatggtctgaggt

SEQ ID NO: 76900 - DNA, 20 bp, human
ggagacctggagccgacaga

SEQ ID NO: 76901 - DNA, 20 bp, human
gcctctccggagatggtctg

SEQ ID NO: 76902 - DNA, 20 bp, human
gaccccagcttaccgtctgt

SEQ ID NO: 76903 - DNA, 20 bp, human
gtggggtatgtgctctgcag

SEQ ID NO: 76904 - DNA, 20 bp, human
ggtacccgatgagggagacc

SEQ ID NO: 76905 - DNA, 20 bp, human
gtgtcctggtctccctcatc

SEQ ID NO: 76906 - DNA, 20 bp, human
ggagaggctcggaagaaggg

SEQ ID NO: 76907 - DNA, 20 bp, human
ggaggagaggctcggaagaa

SEQ ID NO: 76908 - DNA, 20 bp, human
gacagggcccgggcactccg

SEQ ID NO: 76909 - DNA, 20 bp, human
gcgcgggagagaggccgaga

SEQ ID NO: 76910 - DNA, 20 bp, human
gtctcccgcgcggcggccag

SEQ ID NO: 76911 - DNA, 20 bp, human
gccccgcggtgcggcactca

SEQ ID NO: 76912 - DNA, 20 bp, human
gctgggggcccgctggacca

SEQ ID NO: 76913 - DNA, 20 bp, human
gctgatacaggcaaggtccg

SEQ ID NO: 76914 - DNA, 20 bp, human
gccacctcagcaggcgagag

SEQ ID NO: 76915 - DNA, 20 bp, human
ggaggaacccgcagagcgtg

SEQ ID NO: 76916 - DNA, 20 bp, human
ggagcgagtagggggtcctg

SEQ ID NO: 76917 - DNA, 20 bp, human
gggcaggtgagaagtggcgc

SEQ ID NO: 76918 - DNA, 20 bp, human
gcggagccgagtgctgaccc

SEQ ID NO: 76919 - DNA, 20 bp, human
gcccgggtgagaggttcccg

SEQ ID NO: 76920 - DNA, 20 bp, human
gcgggctccgaagccatccg

SEQ ID NO: 76921 - DNA, 20 bp, human
ggccgcgggaacctctcacc

SEQ ID NO: 76922 - DNA, 20 bp, human
ggagtgctgacccgggtgag

SEQ ID NO: 76923 - DNA, 20 bp, human
gcgcccggagtccccaccca

SEQ ID NO: 76924 - DNA, 20 bp, human
gtcccgcggctcagggaaga

SEQ ID NO: 76925 - DNA, 20 bp, human
gtctggcaagtgcagaagag

SEQ ID NO: 76926 - DNA, 20 bp, human
gtccctgccggagctccgag

SEQ ID NO: 76927 - DNA, 20 bp, human
gcggaggccggcctcaaaac

SEQ ID NO: 76928 - DNA, 20 bp, human
ggtcctgccgccccgcgatc

SEQ ID NO: 76929 - DNA, 20 bp, human
gctgcagaaaggcccgtagt

SEQ ID NO: 76930 - DNA, 20 bp, human
gacgtctcgaggtaaaacgg

SEQ ID NO: 76931 - DNA, 20 bp, human
gcaaaaccggctgccactag

SEQ ID NO: 76932 - DNA, 20 bp, human
gtcgcggggcggcaggaccc

SEQ ID NO: 76933 - DNA, 20 bp, human
gggctctggtgacttgccag

SEQ ID NO: 76934 - DNA, 20 bp, human
gtgacgctgggcggtgatcc

SEQ ID NO: 76935 - DNA, 20 bp, human
gatcgctactcagctcgcag

SEQ ID NO: 76936 - DNA, 20 bp, human
gcccctgactcggctcctcg

SEQ ID NO: 76937 - DNA, 20 bp, human
ggcgcacgggagccacttgg

SEQ ID NO: 76938 - DNA, 20 bp, human
gcggcgccgtggggatcccg

SEQ ID NO: 76939 - DNA, 20 bp, human
gtcctcgcggcgacatggat

SEQ ID NO: 76940 - DNA, 20 bp, human
gaagggttgcccctaaacaa

SEQ ID NO: 76941 - DNA, 20 bp, human
ggcgagggtgtagtgagcgg

SEQ ID NO: 76942 - DNA, 20 bp, human
gtggccaagaggagcctgat

SEQ ID NO: 76943 - DNA, 20 bp, human
gcgcggcgacatggatcgga

SEQ ID NO: 76944 - DNA, 20 bp, human
gggaccccggggcatccctg

SEQ ID NO: 76945 - DNA, 20 bp, human
ggcctgatcggctgggtacc

SEQ ID NO: 76946 - DNA, 20 bp, human
ggactcacagcctcacggtc

SEQ ID NO: 76947 - DNA, 20 bp, human
gctggggctgccggaccgtg

SEQ ID NO: 76948 - DNA, 20 bp, human
ggaccggcgcgcaggtgaac

SEQ ID NO: 76949 - DNA, 20 bp, human
gctgccaccgaccagactca

SEQ ID NO: 76950 - DNA, 20 bp, human
ggacggagccggacaaaagc

SEQ ID NO: 76951 - DNA, 20 bp, human
gcttagtgagttcggaggag

SEQ ID NO: 76952 - DNA, 20 bp, human
gggagccggacaaaagcggg

SEQ ID NO: 76953 - DNA, 20 bp, human
gtggctggggtccctaccct

SEQ ID NO: 76954 - DNA, 20 bp, human
gcaagacttagtgagttcgg

SEQ ID NO: 76955 - DNA, 20 bp, human
gctggagctggcgaggtgtc

SEQ ID NO: 76956 - DNA, 20 bp, human
ggagtaggtgggcctccgta

SEQ ID NO: 76957 - DNA, 20 bp, human
gtcgggtctggcgacaacgg

SEQ ID NO: 76958 - DNA, 20 bp, human
ggcccggcggtagccccgga

SEQ ID NO: 76959 - DNA, 20 bp, human
gtgcggagcaaggggcccgg

SEQ ID NO: 76960 - DNA, 20 bp, human
ggcggaggagacgagatctg

SEQ ID NO: 76961 - DNA, 20 bp, human
gtcccctcagcggcagtgag

SEQ ID NO: 76962 - DNA, 20 bp, human
gtgagaaccagacacaccgg

SEQ ID NO: 76963 - DNA, 20 bp, human
gtcgtcgggtctggcgacaa

SEQ ID NO: 76964 - DNA, 20 bp, human
gggcctcctgctgccgtccg

SEQ ID NO: 76965 - DNA, 20 bp, human
gggagcctccccaccttcct

SEQ ID NO: 76966 - DNA, 20 bp, human
gccccgtgtacgaaggtaag

SEQ ID NO: 76967 - DNA, 20 bp, human
gtcgtacacgggggccatcg

SEQ ID NO: 76968 - DNA, 20 bp, human
gcggagacacaggctcaaga

SEQ ID NO: 76969 - DNA, 20 bp, human
gagatggcagattccgactg

SEQ ID NO: 76970 - DNA, 20 bp, human
ggctccgcaaaagttgctgg

SEQ ID NO: 76971 - DNA, 20 bp, human
gccccgagcggatccgcgga

SEQ ID NO: 76972 - DNA, 20 bp, human
ggtgctccgaaaggtaatgt

SEQ ID NO: 76973 - DNA, 20 bp, human
gagggggcgtgtgcgagggt

SEQ ID NO: 76974 - DNA, 20 bp, human
gtccgcggttcatggcaacg

SEQ ID NO: 76975 - DNA, 20 bp, human
ggagcggatccgcggagggg

SEQ ID NO: 76976 - DNA, 20 bp, human
gcagcagcagcagcggtcgg

SEQ ID NO: 76977 - DNA, 20 bp, human
gcgggcctctaggaaggtaa

SEQ ID NO: 76978 - DNA, 20 bp, human
gagagcgcgggcctctagga

SEQ ID NO: 76979 - DNA, 20 bp, human
gcgccaggacaagatggcag

SEQ ID NO: 76980 - DNA, 20 bp, human
gggccgctgccatcttgtcc

SEQ ID NO: 76981 - DNA, 20 bp, human
ggccgacgagcgcggaggag

SEQ ID NO: 76982 - DNA, 20 bp, human
gagccaggcgcttcagcagg

SEQ ID NO: 76983 - DNA, 20 bp, human
gcggccggggcgtcaggaat

SEQ ID NO: 76984 - DNA, 20 bp, human
gctacgggcgacgcagggtg

SEQ ID NO: 76985 - DNA, 20 bp, human
gtcttgtcctggcggctgag

SEQ ID NO: 76986 - DNA, 20 bp, human
gtgcggcgaagggaagcggg

SEQ ID NO: 76987 - DNA, 20 bp, human
gtccctaacagggcagtaag

SEQ ID NO: 76988 - DNA, 20 bp, human
gcgggacgcggccatcggct

SEQ ID NO: 76989 - DNA, 20 bp, human
ggcttgagcaccccagccga

SEQ ID NO: 76990 - DNA, 20 bp, human
gcctcaagcagagatgagac

SEQ ID NO: 76991 - DNA, 20 bp, human
gggctccgcgtccccagcgg

SEQ ID NO: 76992 - DNA, 20 bp, human
ggccgcactgggagaactgg

SEQ ID NO: 76993 - DNA, 20 bp, human
ggaagcagccaactgacagg

SEQ ID NO: 76994 - DNA, 20 bp, human
gtgctccgcgacgctgggga

SEQ ID NO: 76995 - DNA, 20 bp, human
gccgctgctccgcgacgctg

SEQ ID NO: 76996 - DNA, 20 bp, human
ggccccaggccccaccgaat

SEQ ID NO: 76997 - DNA, 20 bp, human
ggggttccagcgctgttgag

SEQ ID NO: 76998 - DNA, 20 bp, human
ggcgctggaacccattcggt

SEQ ID NO: 76999 - DNA, 20 bp, human
gcgaggcctagaccctgaag

SEQ ID NO: 77000 - DNA, 20 bp, human
gaacagcgctggaacccatt

SEQ ID NO: 77001 - DNA, 20 bp, human
gcggagcacgggcgagatgg

SEQ ID NO: 77002 - DNA, 20 bp, human
ggcccaggcccctgtaccac

SEQ ID NO: 77003 - DNA, 20 bp, human
gggcaaggggaccttcgggg

SEQ ID NO: 77004 - DNA, 20 bp, human
gaagcaggggccaacctcat

SEQ ID NO: 77005 - DNA, 20 bp, human
ggacacagcaggccccccag

SEQ ID NO: 77006 - DNA, 20 bp, human
gtccctccggaagaccccgg

SEQ ID NO: 77007 - DNA, 20 bp, human
gcgcgccggtcgcccagaca

SEQ ID NO: 77008 - DNA, 20 bp, human
gcagacatggcggacggcag

SEQ ID NO: 77009 - DNA, 20 bp, human
gccctccctccggaagaccc

SEQ ID NO: 77010 - DNA, 20 bp, human
gacctagccggggactgacg

SEQ ID NO: 77011 - DNA, 20 bp, human
ggtcggagccgggaaccacc

SEQ ID NO: 77012 - DNA, 20 bp, human
ggcggccggcctgcgaacag

SEQ ID NO: 77013 - DNA, 20 bp, human
gctcgccgtggacgtagtag

SEQ ID NO: 77014 - DNA, 20 bp, human
ggctggcaggtgagtgtgct

SEQ ID NO: 77015 - DNA, 20 bp, human
gagtccccggctaggtcgcg

SEQ ID NO: 77016 - DNA, 20 bp, human
gaccgggtaccgggcgtcag

SEQ ID NO: 77017 - DNA, 20 bp, human
ggcccgggagccgcctgagg

SEQ ID NO: 77018 - DNA, 20 bp, human
ggcccaagccaagaagccgg

SEQ ID NO: 77019 - DNA, 20 bp, human
gaggagcggcgcaggggatg

SEQ ID NO: 77020 - DNA, 20 bp, human
gcgggcgtcaggggcgagac

SEQ ID NO: 77021 - DNA, 20 bp, human
gggtgcccaagccaagaagc

SEQ ID NO: 77022 - DNA, 20 bp, human
gtgcgccgctcctcctcagg

SEQ ID NO: 77023 - DNA, 20 bp, human
gcgggcaacgccggaagtca

SEQ ID NO: 77024 - DNA, 20 bp, human
ggactcagagcaagagccag

SEQ ID NO: 77025 - DNA, 20 bp, human
gcgacctgggtcaaccacaa

SEQ ID NO: 77026 - DNA, 20 bp, human
gggcacggcagccactgctt

SEQ ID NO: 77027 - DNA, 20 bp, human
gtagcgggagggcagactct

SEQ ID NO: 77028 - DNA, 20 bp, human
gcggcctcggaagaagctac

SEQ ID NO: 77029 - DNA, 20 bp, human
gggcgggagccgtcaatccc

SEQ ID NO: 77030 - DNA, 20 bp, human
ggccctcttggcgcacacac

SEQ ID NO: 77031 - DNA, 20 bp, human
ggagggcaaactatgcacca

SEQ ID NO: 77032 - DNA, 20 bp, human
gggaggtacttagctcactc

SEQ ID NO: 77033 - DNA, 20 bp, human
gggatggcgtagcagcgacg

SEQ ID NO: 77034 - DNA, 20 bp, human
gcccctgggcacctgaggtc

SEQ ID NO: 77035 - DNA, 20 bp, human
ggtggatgaagccgcttcca

SEQ ID NO: 77036 - DNA, 20 bp, human
gaagcccggcgcctcaaagg

SEQ ID NO: 77037 - DNA, 20 bp, human
gaaggtggctacaaaaacta

SEQ ID NO: 77038 - DNA, 20 bp, human
gaagctcaaaaaggccacgg

SEQ ID NO: 77039 - DNA, 20 bp, human
gaccaagcccggcgcctcaa

SEQ ID NO: 77040 - DNA, 20 bp, human
gctggtaagcaagggaacgt

SEQ ID NO: 77041 - DNA, 20 bp, human
gccaccacgctccttagagg

SEQ ID NO: 77042 - DNA, 20 bp, human
ggcggccgcaggctacgacg

SEQ ID NO: 77043 - DNA, 20 bp, human
gggtataaacctgacgaagc

SEQ ID NO: 77044 - DNA, 20 bp, human
gggaacgttggtgcagacaa

SEQ ID NO: 77045 - DNA, 20 bp, human
ggatcagctctgacacggaa

SEQ ID NO: 77046 - DNA, 20 bp, human
ggagcgcaatggcctttctt

SEQ ID NO: 77047 - DNA, 20 bp, human
gtcgtagccaccggccgcta

SEQ ID NO: 77048 - DNA, 20 bp, human
ggcaggagcggtttccgaca

SEQ ID NO: 77049 - DNA, 20 bp, human
gggagcggtttccgacatgg

SEQ ID NO: 77050 - DNA, 20 bp, human
ggtggctgtctcggcaggag

SEQ ID NO: 77051 - DNA, 20 bp, human
ggcgccggtggagaaatccc

SEQ ID NO: 77052 - DNA, 20 bp, human
ggccgctaaggccttcttaa

SEQ ID NO: 77053 - DNA, 20 bp, human
ggcggccggtggctacgacg

SEQ ID NO: 77054 - DNA, 20 bp, human
gagcccaaagccaagaaggc

SEQ ID NO: 77055 - DNA, 20 bp, human
ggagacagccaccccagcgc

SEQ ID NO: 77056 - DNA, 20 bp, human
gtgcccaggcgctgcttcat

SEQ ID NO: 77057 - DNA, 20 bp, human
ggctgccgccggctatgatg

SEQ ID NO: 77058 - DNA, 20 bp, human
gttctccacatcatagccgg

SEQ ID NO: 77059 - DNA, 20 bp, human
ggccttctccgcaggaggcg

SEQ ID NO: 77060 - DNA, 20 bp, human
ggccaagcccaaggttaaaa

SEQ ID NO: 77061 - DNA, 20 bp, human
gtcaaaaactcgggtacaag

SEQ ID NO: 77062 - DNA, 20 bp, human
gctgccccaactggcttctt

SEQ ID NO: 77063 - DNA, 20 bp, human
ggctgctctgaaaaaagcgt

SEQ ID NO: 77064 - DNA, 20 bp, human
ggcactctggtgcaaacgaa

SEQ ID NO: 77065 - DNA, 20 bp, human
gcgccgatgaagcagcgcct

SEQ ID NO: 77066 - DNA, 20 bp, human
gtccggggaaggcaaaccca

SEQ ID NO: 77067 - DNA, 20 bp, human
gtgggaagacaaaaacatgt

SEQ ID NO: 77068 - DNA, 20 bp, human
gcagcttctaaggagcgcag

SEQ ID NO: 77069 - DNA, 20 bp, human
gcttgaggccaagcttgata

SEQ ID NO: 77070 - DNA, 20 bp, human
gggctggcgcagccaagcct

SEQ ID NO: 77071 - DNA, 20 bp, human
gcaggaatggtaggagcaag

SEQ ID NO: 77072 - DNA, 20 bp, human
gagcatgtcctctacgaggg

SEQ ID NO: 77073 - DNA, 20 bp, human
ggaacagcatgtcctctacg

SEQ ID NO: 77074 - DNA, 20 bp, human
gaacccaaggccaaaaaggc

SEQ ID NO: 77075 - DNA, 20 bp, human
ggccttgggtttgccttccc

SEQ ID NO: 77076 - DNA, 20 bp, human
ggagcgagagcaattcgagc

SEQ ID NO: 77077 - DNA, 20 bp, human
gtccgccctatataaacggg

SEQ ID NO: 77078 - DNA, 20 bp, human
gcaattcgagccggaagcag

SEQ ID NO: 77079 - DNA, 20 bp, human
gtctggggaagccaagccta

SEQ ID NO: 77080 - DNA, 20 bp, human
ggccaagcctaaggctaaaa

SEQ ID NO: 77081 - DNA, 20 bp, human
ggagtcttctcggcaggggc

SEQ ID NO: 77082 - DNA, 20 bp, human
gaagcccaagaaggcgacgg

SEQ ID NO: 77083 - DNA, 20 bp, human
ggcagtctcggacatgttga

SEQ ID NO: 77084 - DNA, 20 bp, human
ggcagccgctggctatgacg

SEQ ID NO: 77085 - DNA, 20 bp, human
gacgccgctgcgctccttgg

SEQ ID NO: 77086 - DNA, 20 bp, human
gcagtgtcacaggaacgagt

SEQ ID NO: 77087 - DNA, 20 bp, human
ggaatcctggtgcaaaccag

SEQ ID NO: 77088 - DNA, 20 bp, human
ggttgcgctcaagaaggcat

SEQ ID NO: 77089 - DNA, 20 bp, human
gcgaaaagcatgaaacaccc

SEQ ID NO: 77090 - DNA, 20 bp, human
gagtgctggtgtagccgcta

SEQ ID NO: 77091 - DNA, 20 bp, human
gccggaagcaccagtacccc

SEQ ID NO: 77092 - DNA, 20 bp, human
gcggcctcggggccttatat

SEQ ID NO: 77093 - DNA, 20 bp, human
gcttgagggacagtttgatg

SEQ ID NO: 77094 - DNA, 20 bp, human
gaaagcatgaaacacccggg

SEQ ID NO: 77095 - DNA, 20 bp, human
gtccaaccaagaagcgaggg

SEQ ID NO: 77096 - DNA, 20 bp, human
gaagcgcaagaggacccgta

SEQ ID NO: 77097 - DNA, 20 bp, human
gtgtctggacgagggaagca

SEQ ID NO: 77098 - DNA, 20 bp, human
ggaagagcgagacttagact

SEQ ID NO: 77099 - DNA, 20 bp, human
gcgaggagatgtctggacga

SEQ ID NO: 77100 - DNA, 20 bp, human
gtgccggaggtgtcatctaa

SEQ ID NO: 77101 - DNA, 20 bp, human
gtttgatgcgaggagatgtc

SEQ ID NO: 77102 - DNA, 20 bp, human
gcttgctttgggctttatgg

SEQ ID NO: 77103 - DNA, 20 bp, human
gagtagcagccctagaaatg

SEQ ID NO: 77104 - DNA, 20 bp, human
ggcccaaagcaagtaactta

SEQ ID NO: 77105 - DNA, 20 bp, human
gaactatgcagagcggatag

SEQ ID NO: 77106 - DNA, 20 bp, human
gtcgcgccaaggctaagact

SEQ ID NO: 77107 - DNA, 20 bp, human
gggcgcgccggtgtatctcg

SEQ ID NO: 77108 - DNA, 20 bp, human
gtatcagaagtagttatgtc

SEQ ID NO: 77109 - DNA, 20 bp, human
ggcgccggtgtatctcgcgg

SEQ ID NO: 77110 - DNA, 20 bp, human
gctttcccttggccttatga

SEQ ID NO: 77111 - DNA, 20 bp, human
gaaaactgagagccatcata

SEQ ID NO: 77112 - DNA, 20 bp, human
ggaaactacattagaacgca

SEQ ID NO: 77113 - DNA, 20 bp, human
gcaggtttgcagtttcctgt

SEQ ID NO: 77114 - DNA, 20 bp, human
gttggccatccgcaatgacg

SEQ ID NO: 77115 - DNA, 20 bp, human
gaggagcttaataaactctt

SEQ ID NO: 77116 - DNA, 20 bp, human
gcaaaaatcaccaaaaccag

SEQ ID NO: 77117 - DNA, 20 bp, human
gcaagggcaagtgatttgac

SEQ ID NO: 77118 - DNA, 20 bp, human
ggaaacgctatcaaacccaa

SEQ ID NO: 77119 - DNA, 20 bp, human
gtgattgcaatgtctggacg

SEQ ID NO: 77120 - DNA, 20 bp, human
ggccgggtgaccattgctca

SEQ ID NO: 77121 - DNA, 20 bp, human
ggagcgctgttactaaaggt

SEQ ID NO: 77122 - DNA, 20 bp, human
ggaagagcgggatttcgctt

SEQ ID NO: 77123 - DNA, 20 bp, human
gtggggagcgctgttactaa

SEQ ID NO: 77124 - DNA, 20 bp, human
gaatacgctttgctcaaggt

SEQ ID NO: 77125 - DNA, 20 bp, human
gctagtcggaggaccaaaca

SEQ ID NO: 77126 - DNA, 20 bp, human
gcgcggcaagcaaggcggaa

SEQ ID NO: 77127 - DNA, 20 bp, human
gggcggaaaggcccgagcta

SEQ ID NO: 77128 - DNA, 20 bp, human
gcgggtcttagccttagctc

SEQ ID NO: 77129 - DNA, 20 bp, human
gaattcaaaatgtccggacg

SEQ ID NO: 77130 - DNA, 20 bp, human
gcttttaaggaatacatggg

SEQ ID NO: 77131 - DNA, 20 bp, human
ggcccttttaaggaatacat

SEQ ID NO: 77132 - DNA, 20 bp, human
ggcggtgtacgcggcccaca

SEQ ID NO: 77133 - DNA, 20 bp, human
ggctaagacccgctcttcgc

SEQ ID NO: 77134 - DNA, 20 bp, human
gccgccttgcttgccgcgtc

SEQ ID NO: 77135 - DNA, 20 bp, human
gaaaacgagaactcttatat

SEQ ID NO: 77136 - DNA, 20 bp, human
ggctccagtgtacctggcag

SEQ ID NO: 77137 - DNA, 20 bp, human
gaaaagaatgggctcgatgg

SEQ ID NO: 77138 - DNA, 20 bp, human
ggttaggaagccactatgtc

SEQ ID NO: 77139 - DNA, 20 bp, human
ggtcttcttaggcagcaata

SEQ ID NO: 77140 - DNA, 20 bp, human
gaagccactatgtctggacg

SEQ ID NO: 77141 - DNA, 20 bp, human
gccagctagctctaagatct

SEQ ID NO: 77142 - DNA, 20 bp, human
gagaaaaagaatgggctcga

SEQ ID NO: 77143 - DNA, 20 bp, human
ggctaaaacgcgttcttcca

SEQ ID NO: 77144 - DNA, 20 bp, human
gattctttttctttattcag

SEQ ID NO: 77145 - DNA, 20 bp, human
gttagagctagctggcaacg

SEQ ID NO: 77146 - DNA, 20 bp, human
gcgctcgctatgtctggacg

SEQ ID NO: 77147 - DNA, 20 bp, human
ggccaagactcgctcttcta

SEQ ID NO: 77148 - DNA, 20 bp, human
ggccctagaagagcgagtct

SEQ ID NO: 77149 - DNA, 20 bp, human
gaccacaaagtgaacgggaa

SEQ ID NO: 77150 - DNA, 20 bp, human
gacaaagtgaacgggaaagg

SEQ ID NO: 77151 - DNA, 20 bp, human
ggagcaaccacaaagtgaac

SEQ ID NO: 77152 - DNA, 20 bp, human
ggcgccggtgtatctggcag

SEQ ID NO: 77153 - DNA, 20 bp, human
gaaaatcgagtccaaaccaa

SEQ ID NO: 77154 - DNA, 20 bp, human
gctgaaaagagccgttggtt

SEQ ID NO: 77155 - DNA, 20 bp, human
gcttttagagaagacgtggg

SEQ ID NO: 77156 - DNA, 20 bp, human
ggcgccggctccaacccgct

SEQ ID NO: 77157 - DNA, 20 bp, human
gctcggcataattacccttg

SEQ ID NO: 77158 - DNA, 20 bp, human
ggaaagtagccaacgaggaa

SEQ ID NO: 77159 - DNA, 20 bp, human
gtctctaagacagtgtagaa

SEQ ID NO: 77160 - DNA, 20 bp, human
gtgaccagtatgtctggacg

SEQ ID NO: 77161 - DNA, 20 bp, human
gtaaggccaaataaggagcg

SEQ ID NO: 77162 - DNA, 20 bp, human
ggaggtgacgcgggatgata

SEQ ID NO: 77163 - DNA, 20 bp, human
gggagcgaggttgtgaaaac

SEQ ID NO: 77164 - DNA, 20 bp, human
gggagaagcttattcagcag

SEQ ID NO: 77165 - DNA, 20 bp, human
gttgccacgtccagacatac

SEQ ID NO: 77166 - DNA, 20 bp, human
gtcaatcccaaaggaaccaa

SEQ ID NO: 77167 - DNA, 20 bp, human
gcgaagggcaagtagaagcc

SEQ ID NO: 77168 - DNA, 20 bp, human
gtcttgaccgtatagataat

SEQ ID NO: 77169 - DNA, 20 bp, human
gagttgctgcaaactaatcc

SEQ ID NO: 77170 - DNA, 20 bp, human
gaaaaggcctattatctata

SEQ ID NO: 77171 - DNA, 20 bp, human
gagttcttccacaaaattgt

SEQ ID NO: 77172 - DNA, 20 bp, human
gtacttctaaaccactccaa

SEQ ID NO: 77173 - DNA, 20 bp, human
gatctacgtaacctttggag

SEQ ID NO: 77174 - DNA, 20 bp, human
gggttacgtagatcagtctt

SEQ ID NO: 77175 - DNA, 20 bp, human
ggactgatctacgtaacctt

SEQ ID NO: 77176 - DNA, 20 bp, human
gcagtctttcttgaccgtaa

SEQ ID NO: 77177 - DNA, 20 bp, human
gcggtctttacttagtcttg

SEQ ID NO: 77178 - DNA, 20 bp, human
gctttttatgattgttgaag

SEQ ID NO: 77179 - DNA, 20 bp, human
gttttatgcgcttttcaact

SEQ ID NO: 77180 - DNA, 20 bp, human
ggaaaagcgcataaaaacaa

SEQ ID NO: 77181 - DNA, 20 bp, human
gtctttacttagtcttgtgg

SEQ ID NO: 77182 - DNA, 20 bp, human
gatgtctgggcgtggtaagc

SEQ ID NO: 77183 - DNA, 20 bp, human
gaaaaggtctattaccttta

SEQ ID NO: 77184 - DNA, 20 bp, human
gcacgcccagacatggcaaa

SEQ ID NO: 77185 - DNA, 20 bp, human
gtagaccttttgccatgtct

SEQ ID NO: 77186 - DNA, 20 bp, human
ggctaagacccgttcttcaa

SEQ ID NO: 77187 - DNA, 20 bp, human
gaggccaagggcaagtagcg

SEQ ID NO: 77188 - DNA, 20 bp, human
gagacccgcccttgaagaac

SEQ ID NO: 77189 - DNA, 20 bp, human
gttagcgttacgtcagtctc

SEQ ID NO: 77190 - DNA, 20 bp, human
gaagacccgttcttcaaggg

SEQ ID NO: 77191 - DNA, 20 bp, human
gacctcggtccaaaccaaaa

SEQ ID NO: 77192 - DNA, 20 bp, human
gcgggtcttcagttcccagt

SEQ ID NO: 77193 - DNA, 20 bp, human
ggaattttttacgtcatgtc

SEQ ID NO: 77194 - DNA, 20 bp, human
gcagccccgctacttgccct

SEQ ID NO: 77195 - DNA, 20 bp, human
gacctttttggtttggaccg

SEQ ID NO: 77196 - DNA, 20 bp, human
ggctctcccgcagaaatagt

SEQ ID NO: 77197 - DNA, 20 bp, human
gctcccgcagaaatagtagg

SEQ ID NO: 77198 - DNA, 20 bp, human
gacgaagaaacgataaatgg

SEQ ID NO: 77199 - DNA, 20 bp, human
gagctctggtgaacttctct

SEQ ID NO: 77200 - DNA, 20 bp, human
ggaatcactttccaatacaa

SEQ ID NO: 77201 - DNA, 20 bp, human
ggtattggaaagtgattcta

SEQ ID NO: 77202 - DNA, 20 bp, human
gatgacgaagaaacgataaa

SEQ ID NO: 77203 - DNA, 20 bp, human
gatcgtttcttcgtcatgtc

SEQ ID NO: 77204 - DNA, 20 bp, human
ggagccacctactatttctg

SEQ ID NO: 77205 - DNA, 20 bp, human
gctgaaaagagccgttgtat

SEQ ID NO: 77206 - DNA, 20 bp, human
gcaaagctaagggcaagtaa

SEQ ID NO: 77207 - DNA, 20 bp, human
ggacatggtaaaacgacctg

SEQ ID NO: 77208 - DNA, 20 bp, human
ggagcccagctctagaggag

SEQ ID NO: 77209 - DNA, 20 bp, human
gagagccaccacaaagctaa

SEQ ID NO: 77210 - DNA, 20 bp, human
ggttcttccgtagaaatggt

SEQ ID NO: 77211 - DNA, 20 bp, human
ggagccacccaccatttcta

SEQ ID NO: 77212 - DNA, 20 bp, human
ggttttaccatgtctggacg

SEQ ID NO: 77213 - DNA, 20 bp, human
gcttgcccttagctttgtgg

SEQ ID NO: 77214 - DNA, 20 bp, human
gataaaatgcgcgtccctgt

SEQ ID NO: 77215 - DNA, 20 bp, human
ggctctagaggagcgggttt

SEQ ID NO: 77216 - DNA, 20 bp, human
gaagcgcaagaggacccgta

SEQ ID NO: 77217 - DNA, 20 bp, human
ggcgagcgaggcatcacgtt

SEQ ID NO: 77218 - DNA, 20 bp, human
gtgccggaggtgtcatctaa

SEQ ID NO: 77219 - DNA, 20 bp, human
gttggcgagacttggagctg

SEQ ID NO: 77220 - DNA, 20 bp, human
ggttacacggttcttttcca

SEQ ID NO: 77221 - DNA, 20 bp, human
gtagcaggcttacttggagc

SEQ ID NO: 77222 - DNA, 20 bp, human
gacacttctgcagcgttaca

SEQ ID NO: 77223 - DNA, 20 bp, human
ggctaaacatgctgtgtctg

SEQ ID NO: 77224 - DNA, 20 bp, human
gttgtttacttggcgagact

SEQ ID NO: 77225 - DNA, 20 bp, human
gtgtgtggtagctatgccgg

SEQ ID NO: 77226 - DNA, 20 bp, human
ggggctggagcagacttaga

SEQ ID NO: 77227 - DNA, 20 bp, human
ggagcagacttagagggttc

SEQ ID NO: 77228 - DNA, 20 bp, human
gtctctgtactactctgtag

SEQ ID NO: 77229 - DNA, 20 bp, human
gctccttgtgacaaagtagg

SEQ ID NO: 77230 - DNA, 20 bp, human
gtctaagaaggctatcacta

SEQ ID NO: 77231 - DNA, 20 bp, human
gagccacctactttgtcaca

SEQ ID NO: 77232 - DNA, 20 bp, human
gcttcttagaacccttttta

SEQ ID NO: 77233 - DNA, 20 bp, human
ggctctccttgtgacaaagt

SEQ ID NO: 77234 - DNA, 20 bp, human
gtaagcacttccaaacccaa

SEQ ID NO: 77235 - DNA, 20 bp, human
gtagcttttctattctgttt

SEQ ID NO: 77236 - DNA, 20 bp, human
gcttttagtgggtatctggg

SEQ ID NO: 77237 - DNA, 20 bp, human
gatgtgtcgaaagtaaagag

SEQ ID NO: 77238 - DNA, 20 bp, human
gtggccacagctcttttagt

SEQ ID NO: 77239 - DNA, 20 bp, human
ggctcttttagtgggtatct

SEQ ID NO: 77240 - DNA, 20 bp, human
gatacccactaaaagagctg

SEQ ID NO: 77241 - DNA, 20 bp, human
gcggatttctgctacttata

SEQ ID NO: 77242 - DNA, 20 bp, human
gccatctttcttctgcgctt

SEQ ID NO: 77243 - DNA, 20 bp, human
gtttactttcgacacatttc

SEQ ID NO: 77244 - DNA, 20 bp, human
gccagacgccaaattttatt

SEQ ID NO: 77245 - DNA, 20 bp, human
gtcttaacacctaaccccaa

SEQ ID NO: 77246 - DNA, 20 bp, human
ggagcagacttggtaggttc

SEQ ID NO: 77247 - DNA, 20 bp, human
gtaaatgaacagggcctcgg

SEQ ID NO: 77248 - DNA, 20 bp, human
gtggcaaagttacttggaac

SEQ ID NO: 77249 - DNA, 20 bp, human
gcttacttggcaaagttact

SEQ ID NO: 77250 - DNA, 20 bp, human
gtctttacacctaatcccaa

SEQ ID NO: 77251 - DNA, 20 bp, human
gaaaataatcactcccgccg

SEQ ID NO: 77252 - DNA, 20 bp, human
gcatttattgaaaacatgcg

SEQ ID NO: 77253 - DNA, 20 bp, human
gtaaggctcagaagaaggac

SEQ ID NO: 77254 - DNA, 20 bp, human
gctgctcctgccccaaagaa

SEQ ID NO: 77255 - DNA, 20 bp, human
ggggcaggagcagacttggt

SEQ ID NO: 77256 - DNA, 20 bp, human
gagagcctttgggtttacta

SEQ ID NO: 77257 - DNA, 20 bp, human
gactgccttagtaaacccaa

SEQ ID NO: 77258 - DNA, 20 bp, human
gccaattgtgaaaaggtgag

SEQ ID NO: 77259 - DNA, 20 bp, human
gtatagctccaattgtgaaa

SEQ ID NO: 77260 - DNA, 20 bp, human
gtcactcgatagtacctaag

SEQ ID NO: 77261 - DNA, 20 bp, human
ggtttactaaggcagttgca

SEQ ID NO: 77262 - DNA, 20 bp, human
gttgcagggacaagtttact

SEQ ID NO: 77263 - DNA, 20 bp, human
gaaactcctgcagctgaaat

SEQ ID NO: 77264 - DNA, 20 bp, human
gagtgatacctcataaaaca

SEQ ID NO: 77265 - DNA, 20 bp, human
gcactcactgtctgggctgg

SEQ ID NO: 77266 - DNA, 20 bp, human
ggagcggacttagcaggttc

SEQ ID NO: 77267 - DNA, 20 bp, human
gctatagctgaaaaagtggg

SEQ ID NO: 77268 - DNA, 20 bp, human
gtattaccagctgcagagtg

SEQ ID NO: 77269 - DNA, 20 bp, human
gccgctcctgctccaaaaaa

SEQ ID NO: 77270 - DNA, 20 bp, human
gtcttcatacccaatcccaa

SEQ ID NO: 77271 - DNA, 20 bp, human
gactctatagctgaaaaagt

SEQ ID NO: 77272 - DNA, 20 bp, human
gtagagctcctatcgtaaac

SEQ ID NO: 77273 - DNA, 20 bp, human
gcgttagaattacttagagc

SEQ ID NO: 77274 - DNA, 20 bp, human
gttaaatgccagtttacgat

SEQ ID NO: 77275 - DNA, 20 bp, human
gtggagcccttttttggagc

SEQ ID NO: 77276 - DNA, 20 bp, human
ggcagtgtccgaaggtacca

SEQ ID NO: 77277 - DNA, 20 bp, human
gtggatgagatgccagtatc

SEQ ID NO: 77278 - DNA, 20 bp, human
gtaggtgctttaaaactcaa

SEQ ID NO: 77279 - DNA, 20 bp, human
gaacaggttcaccccgatac

SEQ ID NO: 77280 - DNA, 20 bp, human
gtctttatgtgagacttgag

SEQ ID NO: 77281 - DNA, 20 bp, human
gtcagctcctgctccgaaga

SEQ ID NO: 77282 - DNA, 20 bp, human
ggtgacagccttggtacctt

SEQ ID NO: 77283 - DNA, 20 bp, human
gttgttgtagtgggccagac

SEQ ID NO: 77284 - DNA, 20 bp, human
gaagcgcaagcgcagtcgta

SEQ ID NO: 77285 - DNA, 20 bp, human
gtggaacccttcttcggagc

SEQ ID NO: 77286 - DNA, 20 bp, human
ggacgcatgttcaaacccaa

SEQ ID NO: 77287 - DNA, 20 bp, human
ggagcggacttagctggatc

SEQ ID NO: 77288 - DNA, 20 bp, human
gtacaccagctccaaataaa

SEQ ID NO: 77289 - DNA, 20 bp, human
gtgctgttgagccttcactt

SEQ ID NO: 77290 - DNA, 20 bp, human
gagaatacaccccaaagtga

SEQ ID NO: 77291 - DNA, 20 bp, human
ggaaggctcaacagcacagc

SEQ ID NO: 77292 - DNA, 20 bp, human
ggaacatgcgtccatttatt

SEQ ID NO: 77293 - DNA, 20 bp, human
gcacagctggccgtttttgt

SEQ ID NO: 77294 - DNA, 20 bp, human
gacgcttgttgtaatgagcc

SEQ ID NO: 77295 - DNA, 20 bp, human
gcttaattgaaatcattaag

SEQ ID NO: 77296 - DNA, 20 bp, human
gaaaagcgctaacgacccaa

SEQ ID NO: 77297 - DNA, 20 bp, human
gtcatttgacggtatcactt

SEQ ID NO: 77298 - DNA, 20 bp, human
ggatctttaaatgacaacat

SEQ ID NO: 77299 - DNA, 20 bp, human
gccaagtaaactagttacct

SEQ ID NO: 77300 - DNA, 20 bp, human
ggataccgtcaaatgaccac

SEQ ID NO: 77301 - DNA, 20 bp, human
gaatgaccacaggaaaatgc

SEQ ID NO: 77302 - DNA, 20 bp, human
ggtcgttagcgcttttaccc

SEQ ID NO: 77303 - DNA, 20 bp, human
gacttccagggagatccaaa

SEQ ID NO: 77304 - DNA, 20 bp, human
ggtaaataatgagggcgttt

SEQ ID NO: 77305 - DNA, 20 bp, human
gctttaaatgacaacatggg

SEQ ID NO: 77306 - DNA, 20 bp, human
ggcgtgagcagggtatgaca

SEQ ID NO: 77307 - DNA, 20 bp, human
ggcgccggtgtatctggcag

SEQ ID NO: 77308 - DNA, 20 bp, human
ggccaagactcgctcttcta

SEQ ID NO: 77309 - DNA, 20 bp, human
gctataaagcgccaacgaaa

SEQ ID NO: 77310 - DNA, 20 bp, human
gaccacaaagtgaacgggaa

SEQ ID NO: 77311 - DNA, 20 bp, human
ggccctagaagagcgagtct

SEQ ID NO: 77312 - DNA, 20 bp, human
gggacgaaatgccggtgtca

SEQ ID NO: 77313 - DNA, 20 bp, human
gcgctcgctatgtctggacg

SEQ ID NO: 77314 - DNA, 20 bp, human
gaggaaaaacagcgtgagca

SEQ ID NO: 77315 - DNA, 20 bp, human
ggctcttaaaagagccgtta

SEQ ID NO: 77316 - DNA, 20 bp, human
gtcttaaagcccaaccccaa

SEQ ID NO: 77317 - DNA, 20 bp, human
gtagtactgagtgaggaata

SEQ ID NO: 77318 - DNA, 20 bp, human
gtcgagaaaacgggaagtaa

SEQ ID NO: 77319 - DNA, 20 bp, human
ggtcacagcactcgacacaa

SEQ ID NO: 77320 - DNA, 20 bp, human
ggtaatgggagcaaggtacc

SEQ ID NO: 77321 - DNA, 20 bp, human
gttagaacgccattacatgg

SEQ ID NO: 77322 - DNA, 20 bp, human
ggagcgaaagccatacgtac

SEQ ID NO: 77323 - DNA, 20 bp, human
ggctgggtacagcctagaag

SEQ ID NO: 77324 - DNA, 20 bp, human
gaaagtacacgtgacacaat

SEQ ID NO: 77325 - DNA, 20 bp, human
gacgttagaacgccattaca

SEQ ID NO: 77326 - DNA, 20 bp, human
ggagcagacttggccagctc

SEQ ID NO: 77327 - DNA, 20 bp, human
gtgccctcaagcgcaaaggt

SEQ ID NO: 77328 - DNA, 20 bp, human
gcgctcttcctatcactggg

SEQ ID NO: 77329 - DNA, 20 bp, human
ggcaaaggtcggaccctcta

SEQ ID NO: 77330 - DNA, 20 bp, human
gcgcaaagcagtccctgcta

SEQ ID NO: 77331 - DNA, 20 bp, human
gttctttagataatagtgag

SEQ ID NO: 77332 - DNA, 20 bp, human
gtgcgcttgactgacttaca

SEQ ID NO: 77333 - DNA, 20 bp, human
ggtcggaccctctatggtgt

SEQ ID NO: 77334 - DNA, 20 bp, human
gtagctaccaacaccataga

SEQ ID NO: 77335 - DNA, 20 bp, human
ggtccgacctttgcgcttga

SEQ ID NO: 77336 - DNA, 20 bp, human
gagaggacgaaacagcccta

SEQ ID NO: 77337 - DNA, 20 bp, human
gagtcccaaagggtacctaa

SEQ ID NO: 77338 - DNA, 20 bp, human
gggactggagcagatttgac

SEQ ID NO: 77339 - DNA, 20 bp, human
gctgcagcgagaggctcact

SEQ ID NO: 77340 - DNA, 20 bp, human
ggtacgaagcgagtcccaaa

SEQ ID NO: 77341 - DNA, 20 bp, human
ggccaggcgtgacgcttctc

SEQ ID NO: 77342 - DNA, 20 bp, human
gtggagccttttttagggac

SEQ ID NO: 77343 - DNA, 20 bp, human
gtttggggtgtgggtcacgg

SEQ ID NO: 77344 - DNA, 20 bp, human
gcaattccccgggtagcagt

SEQ ID NO: 77345 - DNA, 20 bp, human
gcttcttggagcctttttta

SEQ ID NO: 77346 - DNA, 20 bp, human
ggaagcagtgaataagcggt

SEQ ID NO: 77347 - DNA, 20 bp, human
gggagtaactgccggaaaat

SEQ ID NO: 77348 - DNA, 20 bp, human
gttaagaagcagtgaataag

SEQ ID NO: 77349 - DNA, 20 bp, human
ggtaactgccggaaaattgg

SEQ ID NO: 77350 - DNA, 20 bp, human
gctgcttcttaacgcaagtg

SEQ ID NO: 77351 - DNA, 20 bp, human
gaagttgtgcgtttaaccag

SEQ ID NO: 77352 - DNA, 20 bp, human
gcaagtgagcccgcccaccg

SEQ ID NO: 77353 - DNA, 20 bp, human
gtgaccgaacgttccgcggt

SEQ ID NO: 77354 - DNA, 20 bp, human
gccgcccaccgcggaacgtt

SEQ ID NO: 77355 - DNA, 20 bp, human
gtccaagaaggcagtgacaa

SEQ ID NO: 77356 - DNA, 20 bp, human
ggcagctgccagcaatccaa

SEQ ID NO: 77357 - DNA, 20 bp, human
ggagcagatttagccgggtc

SEQ ID NO: 77358 - DNA, 20 bp, human
ggcagctgcgagagctcact

SEQ ID NO: 77359 - DNA, 20 bp, human
gtcctccgccatgcccgacc

SEQ ID NO: 77360 - DNA, 20 bp, human
ggagcccagctctagaggag

SEQ ID NO: 77361 - DNA, 20 bp, human
ggatttagccgggtcgggca

SEQ ID NO: 77362 - DNA, 20 bp, human
gggcaggagcagatttagcc

SEQ ID NO: 77363 - DNA, 20 bp, human
gctttctctggaagcgtgag

SEQ ID NO: 77364 - DNA, 20 bp, human
ggacatggtaaaacgacctg

SEQ ID NO: 77365 - DNA, 20 bp, human
gtccaagaaagccgtaacca

SEQ ID NO: 77366 - DNA, 20 bp, human
gttacgaataagcagttcag

SEQ ID NO: 77367 - DNA, 20 bp, human
ggcgaccggccgaaatcgat

SEQ ID NO: 77368 - DNA, 20 bp, human
gaagacaaaagggaatgcat

SEQ ID NO: 77369 - DNA, 20 bp, human
gtctctgacggtccaagcaa

SEQ ID NO: 77370 - DNA, 20 bp, human
gagagagggcgtgattactg

SEQ ID NO: 77371 - DNA, 20 bp, human
gtaatcacgccctctctccg

SEQ ID NO: 77372 - DNA, 20 bp, human
gttcgttttaatgctactga

SEQ ID NO: 77373 - DNA, 20 bp, human
ggctactttacttgaaaagg

SEQ ID NO: 77374 - DNA, 20 bp, human
gattactgtggtctctctga

SEQ ID NO: 77375 - DNA, 20 bp, human
gctggtgcgcgagattgcgc

SEQ ID NO: 77376 - DNA, 20 bp, human
gttgcctgcagagacgtctg

SEQ ID NO: 77377 - DNA, 20 bp, human
gctgcaggcaagcttttctg

SEQ ID NO: 77378 - DNA, 20 bp, human
gagagacgtctgtggaggaa

SEQ ID NO: 77379 - DNA, 20 bp, human
gcacagtgcccgggcggtaa

SEQ ID NO: 77380 - DNA, 20 bp, human
gcctgcagagacgtctgtgg

SEQ ID NO: 77381 - DNA, 20 bp, human
gagagcgcgccggctaccgg

SEQ ID NO: 77382 - DNA, 20 bp, human
gcatcagtcttaaaacccaa

SEQ ID NO: 77383 - DNA, 20 bp, human
gcagagccacagtgcccggg

SEQ ID NO: 77384 - DNA, 20 bp, human
gcttttctgtggttttgcca

SEQ ID NO: 77385 - DNA, 20 bp, human
ggtcgaccgagttgctgatt

SEQ ID NO: 77386 - DNA, 20 bp, human
ggtggccggagcgctcttac

SEQ ID NO: 77387 - DNA, 20 bp, human
gctggcacgtcgcatccgtg

SEQ ID NO: 77388 - DNA, 20 bp, human
ggtccaccgagctgctgatc

SEQ ID NO: 77389 - DNA, 20 bp, human
gcgtcgcatccgtggggaaa

SEQ ID NO: 77390 - DNA, 20 bp, human
gcaaggccacggtgcccggg

SEQ ID NO: 77391 - DNA, 20 bp, human
ggacttatgccctttcccca

SEQ ID NO: 77392 - DNA, 20 bp, human
ggcgtgaatagcgcacagat

SEQ ID NO: 77393 - DNA, 20 bp, human
gtagtttccaggagatataa

SEQ ID NO: 77394 - DNA, 20 bp, human
ggtagtgaactgagagcaag

SEQ ID NO: 77395 - DNA, 20 bp, human
gactaacatagacaaccgaa

SEQ ID NO: 77396 - DNA, 20 bp, human
gcgcggcaagcaaggcggaa

SEQ ID NO: 77397 - DNA, 20 bp, human
gggcggaaaggcccgagcta

SEQ ID NO: 77398 - DNA, 20 bp, human
gcgggtcttagccttagctc

SEQ ID NO: 77399 - DNA, 20 bp, human
gaattcaaaatgtccggacg

SEQ ID NO: 77400 - DNA, 20 bp, human
gcttttaaggaatacatggg

SEQ ID NO: 77401 - DNA, 20 bp, human
ggcccttttaaggaatacat

SEQ ID NO: 77402 - DNA, 20 bp, human
ggcggtgtacgcggcccaca

SEQ ID NO: 77403 - DNA, 20 bp, human
ggctaagacccgctcttcgc

SEQ ID NO: 77404 - DNA, 20 bp, human
gccgccttgcttgccgcgtc

SEQ ID NO: 77405 - DNA, 20 bp, human
gaaaacgagaactcttatat

SEQ ID NO: 77406 - DNA, 20 bp, human
gagccctaggcgaaaacctg

SEQ ID NO: 77407 - DNA, 20 bp, human
gcggctcgtaaatccacagg

SEQ ID NO: 77408 - DNA, 20 bp, human
ggtacaaaccttaaatccaa

SEQ ID NO: 77409 - DNA, 20 bp, human
ggtctaccgagcttctaatc

SEQ ID NO: 77410 - DNA, 20 bp, human
gttactttgcagatgaacta

SEQ ID NO: 77411 - DNA, 20 bp, human
ggtggtctaatgcgtctcaa

SEQ ID NO: 77412 - DNA, 20 bp, human
gcctctccccacgaatgcgg

SEQ ID NO: 77413 - DNA, 20 bp, human
gctgagggagcgcttaaatt

SEQ ID NO: 77414 - DNA, 20 bp, human
gaccaatggagaacagcgta

SEQ ID NO: 77415 - DNA, 20 bp, human
gaatggagaacagcgtaggg

SEQ ID NO: 77416 - DNA, 20 bp, human
gtcgtgcgtgccataggaat

SEQ ID NO: 77417 - DNA, 20 bp, human
gtagcggcggatttcacgga

SEQ ID NO: 77418 - DNA, 20 bp, human
gcagctcgtaagtccactgg

SEQ ID NO: 77419 - DNA, 20 bp, human
gcacggagggcgacagtacc

SEQ ID NO: 77420 - DNA, 20 bp, human
gggactttgcctttataaat

SEQ ID NO: 77421 - DNA, 20 bp, human
ggtgcgccaacttaaaccaa

SEQ ID NO: 77422 - DNA, 20 bp, human
gaggaatgggtttcaagcaa

SEQ ID NO: 77423 - DNA, 20 bp, human
gaagattcggaccaatcaga

SEQ ID NO: 77424 - DNA, 20 bp, human
gggcgcgaaactggaagatt

SEQ ID NO: 77425 - DNA, 20 bp, human
ggcaaaagcgcgccagccac

SEQ ID NO: 77426 - DNA, 20 bp, human
gtcgtggggagagagcgtag

SEQ ID NO: 77427 - DNA, 20 bp, human
ggcgtgcagtctgcttggtg

SEQ ID NO: 77428 - DNA, 20 bp, human
gagagagcgtagaggtttcc

SEQ ID NO: 77429 - DNA, 20 bp, human
ggcgttggaaaggcaacttg

SEQ ID NO: 77430 - DNA, 20 bp, human
gtctttcaggtagtctgaga

SEQ ID NO: 77431 - DNA, 20 bp, human
gactcagccacttggcagag

SEQ ID NO: 77432 - DNA, 20 bp, human
ggcggctcggaaaagcgcgc

SEQ ID NO: 77433 - DNA, 20 bp, human
gtaaaagagcctttttaagt

SEQ ID NO: 77434 - DNA, 20 bp, human
gcagtttccactctgccaag

SEQ ID NO: 77435 - DNA, 20 bp, human
gaaagaaaaactcagccact

SEQ ID NO: 77436 - DNA, 20 bp, human
gcgagagggcttgagtctca

SEQ ID NO: 77437 - DNA, 20 bp, human
gtaccaggccgatagcgatg

SEQ ID NO: 77438 - DNA, 20 bp, human
ggaagtgaatctagctctga

SEQ ID NO: 77439 - DNA, 20 bp, human
gctggtagcggcgaatctcg

SEQ ID NO: 77440 - DNA, 20 bp, human
gcgtcgtatccgcggcgaga

SEQ ID NO: 77441 - DNA, 20 bp, human
ggactcaagccctctcgccg

SEQ ID NO: 77442 - DNA, 20 bp, human
gttagcattcaaaaagggat

SEQ ID NO: 77443 - DNA, 20 bp, human
gaatgggccctatctactac

SEQ ID NO: 77444 - DNA, 20 bp, human
gcgctatcggcctggtacag

SEQ ID NO: 77445 - DNA, 20 bp, human
ggaatctagctctgaaggca

SEQ ID NO: 77446 - DNA, 20 bp, human
gaggtacgtctacttagcca

SEQ ID NO: 77447 - DNA, 20 bp, human
gcttgcgcgccgcatccgag

SEQ ID NO: 77448 - DNA, 20 bp, human
gtgccctctcccctcggatg

SEQ ID NO: 77449 - DNA, 20 bp, human
ggcgccgcatccgaggggag

SEQ ID NO: 77450 - DNA, 20 bp, human
gacagacttcttgggctgat

SEQ ID NO: 77451 - DNA, 20 bp, human
gttggtacgggagatcgcac

SEQ ID NO: 77452 - DNA, 20 bp, human
gggggttggacagacttctt

SEQ ID NO: 77453 - DNA, 20 bp, human
gcccgtaccaagcgctgaaa

SEQ ID NO: 77454 - DNA, 20 bp, human
ggtttgctttgttcgtgcca

SEQ ID NO: 77455 - DNA, 20 bp, human
ggcgctgaaaaggtagcttc

SEQ ID NO: 77456 - DNA, 20 bp, human
gtaccggcggcaaggcaccg

SEQ ID NO: 77457 - DNA, 20 bp, human
gcgagctgtctgcttcgtcc

SEQ ID NO: 77458 - DNA, 20 bp, human
ggcgtgaatagcacagaggt

SEQ ID NO: 77459 - DNA, 20 bp, human
gcgccgagctctggaaacga

SEQ ID NO: 77460 - DNA, 20 bp, human
gcttggcgtgaatagcacag

SEQ ID NO: 77461 - DNA, 20 bp, human
gagcatagctttctcaacta

SEQ ID NO: 77462 - DNA, 20 bp, human
gtaatcccctgctctatctt

SEQ ID NO: 77463 - DNA, 20 bp, human
ggcgtgcgaggcctatctgg

SEQ ID NO: 77464 - DNA, 20 bp, human
ggaggcgtgcgaggcctatc

SEQ ID NO: 77465 - DNA, 20 bp, human
gggattatgctcgctcgcca

SEQ ID NO: 77466 - DNA, 20 bp, human
ggacgtggtaagggcgggaa

SEQ ID NO: 77467 - DNA, 20 bp, human
gctcagtgtccgctggaggt

SEQ ID NO: 77468 - DNA, 20 bp, human
gggttaaaggagcggactgt

SEQ ID NO: 77469 - DNA, 20 bp, human
gcgtataggtgacagcgtca

SEQ ID NO: 77470 - DNA, 20 bp, human
gcctacccatatgtagtgag

SEQ ID NO: 77471 - DNA, 20 bp, human
gtgtctggacgtggtaaggg

SEQ ID NO: 77472 - DNA, 20 bp, human
gggttcagaaatgcaagctg

SEQ ID NO: 77473 - DNA, 20 bp, human
gacccatatgtagtgagtgg

SEQ ID NO: 77474 - DNA, 20 bp, human
ggccacgccgggccagacgc

SEQ ID NO: 77475 - DNA, 20 bp, human
gtgctcttggttcacttctt

SEQ ID NO: 77476 - DNA, 20 bp, human
gtcagctggttagacatgtc

SEQ ID NO: 77477 - DNA, 20 bp, human
gggcaaaggcggtaaaggtt

SEQ ID NO: 77478 - DNA, 20 bp, human
ggcgtcaccgaaaagtgctg

SEQ ID NO: 77479 - DNA, 20 bp, human
gaaaccagttgggagagacc

SEQ ID NO: 77480 - DNA, 20 bp, human
gtataatagttctacatact

SEQ ID NO: 77481 - DNA, 20 bp, human
ggagactcgtggcgttctca

SEQ ID NO: 77482 - DNA, 20 bp, human
gacatctcaatggctttact

SEQ ID NO: 77483 - DNA, 20 bp, human
gaggcgccgaatggccggtt

SEQ ID NO: 77484 - DNA, 20 bp, human
ggaactattataaaccagtt

SEQ ID NO: 77485 - DNA, 20 bp, human
ggcgccttgctaggcgtggt

SEQ ID NO: 77486 - DNA, 20 bp, human
gctgcgataggaatcatgtc

SEQ ID NO: 77487 - DNA, 20 bp, human
gatcccggagcaccttacga

SEQ ID NO: 77488 - DNA, 20 bp, human
gtaggaatcatgtctggtcg

SEQ ID NO: 77489 - DNA, 20 bp, human
gggcggaaaaggcttgggga

SEQ ID NO: 77490 - DNA, 20 bp, human
gtgattcctatcgcagtgga

SEQ ID NO: 77491 - DNA, 20 bp, human
gagggcatatactacatcca

SEQ ID NO: 77492 - DNA, 20 bp, human
gatatgccctaaaacgtcag

SEQ ID NO: 77493 - DNA, 20 bp, human
gaatgccctggatgttatcc

SEQ ID NO: 77494 - DNA, 20 bp, human
gtgcgttgcgagaatgagtt

SEQ ID NO: 77495 - DNA, 20 bp, human
ggcgccatcgtaaggtgctc

SEQ ID NO: 77496 - DNA, 20 bp, human
ggactggaggagaccaagag

SEQ ID NO: 77497 - DNA, 20 bp, human
ggaagggcgggaactgactg

SEQ ID NO: 77498 - DNA, 20 bp, human
ggaaagggtctaggtaaggg

SEQ ID NO: 77499 - DNA, 20 bp, human
gggcggaaagggtctaggta

SEQ ID NO: 77500 - DNA, 20 bp, human
gtgtctggccgcggtaaggg

SEQ ID NO: 77501 - DNA, 20 bp, human
gcgcgatgctgtcacctaca

SEQ ID NO: 77502 - DNA, 20 bp, human
ggccgcggtaagggcggaaa

SEQ ID NO: 77503 - DNA, 20 bp, human
gagatgtctggccgcggtaa

SEQ ID NO: 77504 - DNA, 20 bp, human
ggtaagggcggaaagggtct

SEQ ID NO: 77505 - DNA, 20 bp, human
gcgagccaggcggcggatag

SEQ ID NO: 77506 - DNA, 20 bp, human
ggaaagggactgggtaaagg

SEQ ID NO: 77507 - DNA, 20 bp, human
gttggtgtgttggtcatgtc

SEQ ID NO: 77508 - DNA, 20 bp, human
ggttatctcgcaggacctta

SEQ ID NO: 77509 - DNA, 20 bp, human
gtttttgcggctattttcgt

SEQ ID NO: 77510 - DNA, 20 bp, human
ggacttgttagacgattggt

SEQ ID NO: 77511 - DNA, 20 bp, human
ggctcttttgcggaaaactg

SEQ ID NO: 77512 - DNA, 20 bp, human
gtcatgacttgttagacgat

SEQ ID NO: 77513 - DNA, 20 bp, human
gaaatctgaaaaacaagcga

SEQ ID NO: 77514 - DNA, 20 bp, human
gaatatacgtacctgttgac

SEQ ID NO: 77515 - DNA, 20 bp, human
ggtcctgcgagataacatcc

SEQ ID NO: 77516 - DNA, 20 bp, human
ggagacccgcggtgttctta

SEQ ID NO: 77517 - DNA, 20 bp, human
ggccgcgtcgggccaagcga

SEQ ID NO: 77518 - DNA, 20 bp, human
gtcatgtctggtagaggcaa

SEQ ID NO: 77519 - DNA, 20 bp, human
gcttcgtgtgacgaaggagg

SEQ ID NO: 77520 - DNA, 20 bp, human
gcttcgatcatgtctggtag

SEQ ID NO: 77521 - DNA, 20 bp, human
ggcccttcgtgtgacgaagg

SEQ ID NO: 77522 - DNA, 20 bp, human
gctgtaactgatgacgactt

SEQ ID NO: 77523 - DNA, 20 bp, human
ggtaaaggtttaggaaaggg

SEQ ID NO: 77524 - DNA, 20 bp, human
gtgctgcgtgacaacataca

SEQ ID NO: 77525 - DNA, 20 bp, human
gggtggtaaaggtttaggaa

SEQ ID NO: 77526 - DNA, 20 bp, human
ggccagggaagaaccctgta

SEQ ID NO: 77527 - DNA, 20 bp, human
gttcggggcaaggccggaaa

SEQ ID NO: 77528 - DNA, 20 bp, human
ggaacaccttgaacacccgg

SEQ ID NO: 77529 - DNA, 20 bp, human
gtggtacgccgtgaccaaca

SEQ ID NO: 77530 - DNA, 20 bp, human
gcttggcaccgcctttccca

SEQ ID NO: 77531 - DNA, 20 bp, human
gcttcggaagaaaacgtacg

SEQ ID NO: 77532 - DNA, 20 bp, human
gatgtcaaacgtgagccctt

SEQ ID NO: 77533 - DNA, 20 bp, human
ggaagaaccctgtaaggctt

SEQ ID NO: 77534 - DNA, 20 bp, human
gaggctttggcggttaagtg

SEQ ID NO: 77535 - DNA, 20 bp, human
ggcggtgtcaagcgcatctt

SEQ ID NO: 77536 - DNA, 20 bp, human
ggccgtggtaaaggtggaaa

SEQ ID NO: 77537 - DNA, 20 bp, human
gtgtctggccgtggtaaagg

SEQ ID NO: 77538 - DNA, 20 bp, human
ggaagttgcttagtcatgtc

SEQ ID NO: 77539 - DNA, 20 bp, human
ggcgtttaggtttcttaagt

SEQ ID NO: 77540 - DNA, 20 bp, human
gacgagtctcctcatagata

SEQ ID NO: 77541 - DNA, 20 bp, human
gctacttctcagcaaaaatc

SEQ ID NO: 77542 - DNA, 20 bp, human
gggtaaaggtggaaaaggtt

SEQ ID NO: 77543 - DNA, 20 bp, human
gtaagggcgttgctttgcct

SEQ ID NO: 77544 - DNA, 20 bp, human
gttttgcgcgataacatcca

SEQ ID NO: 77545 - DNA, 20 bp, human
ggcttagtcatgtctggccg

SEQ ID NO: 77546 - DNA, 20 bp, human
gggacgcggcaaaggaggta

SEQ ID NO: 77547 - DNA, 20 bp, human
gtaatgtcaggacgcggcaa

SEQ ID NO: 77548 - DNA, 20 bp, human
ggcgtcctgacattatcaag

SEQ ID NO: 77549 - DNA, 20 bp, human
gtagccgccgaagccataga

SEQ ID NO: 77550 - DNA, 20 bp, human
gaaaggtctgctgcctgtga

SEQ ID NO: 77551 - DNA, 20 bp, human
ggccgaagccatagagggtg

SEQ ID NO: 77552 - DNA, 20 bp, human
gctgaccacttgataatgtc

SEQ ID NO: 77553 - DNA, 20 bp, human
gggcaaaggaggtaagggcc

SEQ ID NO: 77554 - DNA, 20 bp, human
gtgacagaactcactgacaa

SEQ ID NO: 77555 - DNA, 20 bp, human
ggcctttttagagaatgact

SEQ ID NO: 77556 - DNA, 20 bp, human
ggagtggtaacactgaggag

SEQ ID NO: 77557 - DNA, 20 bp, human
gggagtggttttggtaggta

SEQ ID NO: 77558 - DNA, 20 bp, human
gctcttcagctgagaaagta

SEQ ID NO: 77559 - DNA, 20 bp, human
gcccgtagtgagcttgacag

SEQ ID NO: 77560 - DNA, 20 bp, human
gattcacccggggtcactgt

SEQ ID NO: 77561 - DNA, 20 bp, human
gaccactgtcaagctcacta

SEQ ID NO: 77562 - DNA, 20 bp, human
gggttctgagtcagttctgg

SEQ ID NO: 77563 - DNA, 20 bp, human
gtaacactgaggagtggttt

SEQ ID NO: 77564 - DNA, 20 bp, human
gaagtagggtggccctgaaa

SEQ ID NO: 77565 - DNA, 20 bp, human
ggaacacagcggcacacgtg

SEQ ID NO: 77566 - DNA, 20 bp, human
gcaaatggtaaagagaaact

SEQ ID NO: 77567 - DNA, 20 bp, human
gactgggcaaacaagcatca

SEQ ID NO: 77568 - DNA, 20 bp, human
ggaggttccggctaatcggg

SEQ ID NO: 77569 - DNA, 20 bp, human
ggcccccactttctcagctg

SEQ ID NO: 77570 - DNA, 20 bp, human
gtaataccaacattaggcat

SEQ ID NO: 77571 - DNA, 20 bp, human
ggtctctagtcgctgtaagt

SEQ ID NO: 77572 - DNA, 20 bp, human
gatagcagcacaaactcagc

SEQ ID NO: 77573 - DNA, 20 bp, human
gaaagtgggggccctaaaaa

SEQ ID NO: 77574 - DNA, 20 bp, human
gcctcgcctatgcctaatgt

SEQ ID NO: 77575 - DNA, 20 bp, human
gcgcgaggttccggctaatc

SEQ ID NO: 77576 - DNA, 20 bp, human
gtcatgggtggccctgagaa

SEQ ID NO: 77577 - DNA, 20 bp, human
gttatatacgaggagacacg

SEQ ID NO: 77578 - DNA, 20 bp, human
gcgtgtaggtaactgcatcg

SEQ ID NO: 77579 - DNA, 20 bp, human
gggccgtgtatcagagaagc

SEQ ID NO: 77580 - DNA, 20 bp, human
ggctctttcacagacttcat

SEQ ID NO: 77581 - DNA, 20 bp, human
gcagccgccaaagccataca

SEQ ID NO: 77582 - DNA, 20 bp, human
gtgccggcttctctgataca

SEQ ID NO: 77583 - DNA, 20 bp, human
gtccgacgcctggcacggcg

SEQ ID NO: 77584 - DNA, 20 bp, human
ggatacaagataaatgagac

SEQ ID NO: 77585 - DNA, 20 bp, human
gcagagaggcgttatagatt

SEQ ID NO: 77586 - DNA, 20 bp, human
gtccctcgcattgcgcgccg

SEQ ID NO: 77587 - DNA, 20 bp, human
gacagaacggcgattgtcca

SEQ ID NO: 77588 - DNA, 20 bp, human
ggccaggcaggagtttctct

SEQ ID NO: 77589 - DNA, 20 bp, human
gggcaagtgaggctgacgtc

SEQ ID NO: 77590 - DNA, 20 bp, human
ggctgacgtccggcccaagt

SEQ ID NO: 77591 - DNA, 20 bp, human
gaaactcctgcctggcgatc

SEQ ID NO: 77592 - DNA, 20 bp, human
gaccgagagaaactcctgcc

SEQ ID NO: 77593 - DNA, 20 bp, human
gctactatcgctgtcatgtc

SEQ ID NO: 77594 - DNA, 20 bp, human
ggtgactctccgtcttctta

SEQ ID NO: 77595 - DNA, 20 bp, human
gggcgactttcccgatcgcc

SEQ ID NO: 77596 - DNA, 20 bp, human
gctactatcgctgtcatgtc

SEQ ID NO: 77597 - DNA, 20 bp, human
ggccaggcaggagtttctct

SEQ ID NO: 77598 - DNA, 20 bp, human
gggcaagtgaggctgacgtc

SEQ ID NO: 77599 - DNA, 20 bp, human
ggctgacgtccggcccaagt

SEQ ID NO: 77600 - DNA, 20 bp, human
gaaactcctgcctggcgatc

SEQ ID NO: 77601 - DNA, 20 bp, human
ggcccggcccgcgtctcgaa

SEQ ID NO: 77602 - DNA, 20 bp, human
ggtgactctccgtcttctta

SEQ ID NO: 77603 - DNA, 20 bp, human
gggccgggctgggcccactt

SEQ ID NO: 77604 - DNA, 20 bp, human
gaccgagagaaactcctgcc

SEQ ID NO: 77605 - DNA, 20 bp, human
gggcgactttcccgatcgcc

SEQ ID NO: 77606 - DNA, 20 bp, human
gtagccgtaatgtcaggacg

SEQ ID NO: 77607 - DNA, 20 bp, human
gtactctcacgaaagagtag

SEQ ID NO: 77608 - DNA, 20 bp, human
gcaggacgcaaaccaagagg

SEQ ID NO: 77609 - DNA, 20 bp, human
ggtcctgttgcccaagaaaa

SEQ ID NO: 77610 - DNA, 20 bp, human
gagctcaacaagttactcgg

SEQ ID NO: 77611 - DNA, 20 bp, human
ggtgcaggacgcaaaccaag

SEQ ID NO: 77612 - DNA, 20 bp, human
gcagccgggaaatcccaata

SEQ ID NO: 77613 - DNA, 20 bp, human
gaaacggagagtcacaagcc

SEQ ID NO: 77614 - DNA, 20 bp, human
ggaccgccgccaggtacacc

SEQ ID NO: 77615 - DNA, 20 bp, human
gttataagagctaccgggag

SEQ ID NO: 77616 - DNA, 20 bp, human
ggtcctgttgcccaagaaaa

SEQ ID NO: 77617 - DNA, 20 bp, human
gaaacggagagtcacaagcc

SEQ ID NO: 77618 - DNA, 20 bp, human
gccatactcattcaccccaa

SEQ ID NO: 77619 - DNA, 20 bp, human
gcaccaaagtgtcaaatgaa

SEQ ID NO: 77620 - DNA, 20 bp, human
gctttttttgaaaacttggg

SEQ ID NO: 77621 - DNA, 20 bp, human
gaacaggacagcctggatat

SEQ ID NO: 77622 - DNA, 20 bp, human
gagcccttcatttgacactt

SEQ ID NO: 77623 - DNA, 20 bp, human
gctttggtaacagaacggcc

SEQ ID NO: 77624 - DNA, 20 bp, human
gctccgttttcttgggcaac

SEQ ID NO: 77625 - DNA, 20 bp, human
gagctctttttttgaaaact

SEQ ID NO: 77626 - DNA, 20 bp, human
ggtaagacacagtacaaacg

SEQ ID NO: 77627 - DNA, 20 bp, human
ggaaccggcaaaatccgctc

SEQ ID NO: 77628 - DNA, 20 bp, human
ggccggctgcttgactccaa

SEQ ID NO: 77629 - DNA, 20 bp, human
gccctttttaggggccggag

SEQ ID NO: 77630 - DNA, 20 bp, human
gtcttttctagtgattaggt

SEQ ID NO: 77631 - DNA, 20 bp, human
gtttctagtgattaggtggg

SEQ ID NO: 77632 - DNA, 20 bp, human
ggattttgccggttcaggca

SEQ ID NO: 77633 - DNA, 20 bp, human
ggctcgctcgctcgagtcgc

SEQ ID NO: 77634 - DNA, 20 bp, human
ggaggtccccagtgcgtcat

SEQ ID NO: 77635 - DNA, 20 bp, human
ggggccggagcggattttgc

SEQ ID NO: 77636 - DNA, 20 bp, human
gagcaccttgtacacgtaaa

SEQ ID NO: 77637 - DNA, 20 bp, human
gatcaaccacctaaccccaa

SEQ ID NO: 77638 - DNA, 20 bp, human
gtcgaagtaagagtgtgcaa

SEQ ID NO: 77639 - DNA, 20 bp, human
gaagagcctttggggttagg

SEQ ID NO: 77640 - DNA, 20 bp, human
ggaactaccgcaaaacgggc

SEQ ID NO: 77641 - DNA, 20 bp, human
ggcacactcttacttcgagc

SEQ ID NO: 77642 - DNA, 20 bp, human
gatccgaactaccgcaaaac

SEQ ID NO: 77643 - DNA, 20 bp, human
ggcataaccagcccgttttg

SEQ ID NO: 77644 - DNA, 20 bp, human
ggttacgaaagtgcagaaga

SEQ ID NO: 77645 - DNA, 20 bp, human
gttttttcgcgcaaaaatgc

SEQ ID NO: 77646 - DNA, 20 bp, human
gggcttaccagcgcagcggc

SEQ ID NO: 77647 - DNA, 20 bp, human
gccatagcgaaccaaaacac

SEQ ID NO: 77648 - DNA, 20 bp, human
gcacaggcttaccagcgcag

SEQ ID NO: 77649 - DNA, 20 bp, human
ggagcgggcttaagaagtgg

SEQ ID NO: 77650 - DNA, 20 bp, human
gggagagcgggcttaagaag

SEQ ID NO: 77651 - DNA, 20 bp, human
gagcccgctctccacggatg

SEQ ID NO: 77652 - DNA, 20 bp, human
gcgccgcatccgtggagagc

SEQ ID NO: 77653 - DNA, 20 bp, human
gtataaagacggctgcggcg

SEQ ID NO: 77654 - DNA, 20 bp, human
gggcttaagaagtggcggtt

SEQ ID NO: 77655 - DNA, 20 bp, human
gtaagaagtggcggttcggc

SEQ ID NO: 77656 - DNA, 20 bp, human
gggcttaccagcgcagcggc

SEQ ID NO: 77657 - DNA, 20 bp, human
gccatagcgaaccaaaacac

SEQ ID NO: 77658 - DNA, 20 bp, human
gcacaggcttaccagcgcag

SEQ ID NO: 77659 - DNA, 20 bp, human
ggagcgggcttaagaagtgg

SEQ ID NO: 77660 - DNA, 20 bp, human
gggagagcgggcttaagaag

SEQ ID NO: 77661 - DNA, 20 bp, human
gcgccgcatccgtggagagc

SEQ ID NO: 77662 - DNA, 20 bp, human
gagcccgctctccacggatg

SEQ ID NO: 77663 - DNA, 20 bp, human
gggcttaagaagtggcggtt

SEQ ID NO: 77664 - DNA, 20 bp, human
gtaagaagtggcggttcggc

SEQ ID NO: 77665 - DNA, 20 bp, human
gcgctggtaagcctgtgttt

SEQ ID NO: 77666 - DNA, 20 bp, human
ggcggatgcggcgggccaac

SEQ ID NO: 77667 - DNA, 20 bp, human
ggctgtctcattgataggag

SEQ ID NO: 77668 - DNA, 20 bp, human
gaagcagctggctaccaaag

SEQ ID NO: 77669 - DNA, 20 bp, human
gctcttgatgaaaacggcag

SEQ ID NO: 77670 - DNA, 20 bp, human
gcagctgctcttgatgaaaa

SEQ ID NO: 77671 - DNA, 20 bp, human
ggccatgctgtctcattgat

SEQ ID NO: 77672 - DNA, 20 bp, human
gtcatcaagagcagctgtac

SEQ ID NO: 77673 - DNA, 20 bp, human
gcttgccgccggtcgacttg

SEQ ID NO: 77674 - DNA, 20 bp, human
gtccgcggggagcgggccta

SEQ ID NO: 77675 - DNA, 20 bp, human
gcctaaggcatatttttaag

SEQ ID NO: 77676 - DNA, 20 bp, human
ggggctccagcggtcatgtc

SEQ ID NO: 77677 - DNA, 20 bp, human
gtcatgtccggcagaggaaa

SEQ ID NO: 77678 - DNA, 20 bp, human
gcgatagacagcttctgtca

SEQ ID NO: 77679 - DNA, 20 bp, human
ggctgtctatcgggctccag

SEQ ID NO: 77680 - DNA, 20 bp, human
gcctcagatgagcaagtggt

SEQ ID NO: 77681 - DNA, 20 bp, human
gcagcggtcatgtccggcag

SEQ ID NO: 77682 - DNA, 20 bp, human
gtagcctccgaagccgtaca

SEQ ID NO: 77683 - DNA, 20 bp, human
gcgatactcttgtatatcag

SEQ ID NO: 77684 - DNA, 20 bp, human
gaagtggtcggccctaaaaa

SEQ ID NO: 77685 - DNA, 20 bp, human
ggtacgcgctcaagcgccag

SEQ ID NO: 77686 - DNA, 20 bp, human
ggggctccagcggtcatgtc

SEQ ID NO: 77687 - DNA, 20 bp, human
gtcatgtccggcagaggaaa

SEQ ID NO: 77688 - DNA, 20 bp, human
gcagcggtcatgtccggcag

SEQ ID NO: 77689 - DNA, 20 bp, human
ggaaaaggcttaggcaaagg

SEQ ID NO: 77690 - DNA, 20 bp, human
ggcggaaaaggcttaggcaa

SEQ ID NO: 77691 - DNA, 20 bp, human
ggctgtctatcgggctccag

SEQ ID NO: 77692 - DNA, 20 bp, human
ggtctctcaagaccttgcgg

SEQ ID NO: 77693 - DNA, 20 bp, human
gcctcagatgagcaagtggt

SEQ ID NO: 77694 - DNA, 20 bp, human
gcgatgttggaaggtaactt

SEQ ID NO: 77695 - DNA, 20 bp, human
gtagcctccgaagccgtaca

SEQ ID NO: 77696 - DNA, 20 bp, human
gtccttgactcggaaatgtc

SEQ ID NO: 77697 - DNA, 20 bp, human
gaccgcggccagatagaccg

SEQ ID NO: 77698 - DNA, 20 bp, human
gagcgagactaaaaacaaga

SEQ ID NO: 77699 - DNA, 20 bp, human
gtccatcaaaggggccccgg

SEQ ID NO: 77700 - DNA, 20 bp, human
ggccagcgagcccttatgta

SEQ ID NO: 77701 - DNA, 20 bp, human
ggcccctttgatggacataa

SEQ ID NO: 77702 - DNA, 20 bp, human
gaccggacatttccgagtca

SEQ ID NO: 77703 - DNA, 20 bp, human
gactcggaaatgtccggtcg

SEQ ID NO: 77704 - DNA, 20 bp, human
gatcaaaggggccccggggg

SEQ ID NO: 77705 - DNA, 20 bp, human
gccaccctgcttaccacgac

SEQ ID NO: 77706 - DNA, 20 bp, human
gcgcaggagccgatttggac

SEQ ID NO: 77707 - DNA, 20 bp, human
gctcggcgtcctgaacccaa

SEQ ID NO: 77708 - DNA, 20 bp, human
gttgggcgcaggagccgatt

SEQ ID NO: 77709 - DNA, 20 bp, human
ggagccgatttggacgggtc

SEQ ID NO: 77710 - DNA, 20 bp, human
gatgccagacccgtccaaat

SEQ ID NO: 77711 - DNA, 20 bp, human
gctccaagtgaggcgttcct

SEQ ID NO: 77712 - DNA, 20 bp, human
gcccaagaagggttctaaaa

SEQ ID NO: 77713 - DNA, 20 bp, human
gagcgccgcgcgtttctgtt

SEQ ID NO: 77714 - DNA, 20 bp, human
gcgccgaggaacgcctcact

SEQ ID NO: 77715 - DNA, 20 bp, human
gcctttcttgatcgtgtggg

SEQ ID NO: 77716 - DNA, 20 bp, human
gctgcgcgcaagtcaacggg

SEQ ID NO: 77717 - DNA, 20 bp, human
ggagcaatccgctgaggtct

SEQ ID NO: 77718 - DNA, 20 bp, human
gcagactgcgcgcaagtcaa

SEQ ID NO: 77719 - DNA, 20 bp, human
gcgttgcgcaacctctcagg

SEQ ID NO: 77720 - DNA, 20 bp, human
ggtctgggcagaggacaccg

SEQ ID NO: 77721 - DNA, 20 bp, human
gggctatctcgccacctgag

SEQ ID NO: 77722 - DNA, 20 bp, human
gagcaactcttcgaccaggt

SEQ ID NO: 77723 - DNA, 20 bp, human
ggaacgttgcgcaacctctc

SEQ ID NO: 77724 - DNA, 20 bp, human
ggtggcgagatagccctcct

SEQ ID NO: 77725 - DNA, 20 bp, human
gtgcgcaacgttcaccccaa

SEQ ID NO: 77726 - DNA, 20 bp, human
gtgtctgggcgaggtaaagg

SEQ ID NO: 77727 - DNA, 20 bp, human
gtgcgactggcaatcacagt

SEQ ID NO: 77728 - DNA, 20 bp, human
ggaatgtctgggcgaggtaa

SEQ ID NO: 77729 - DNA, 20 bp, human
gatccggaaggcgacatcaa

SEQ ID NO: 77730 - DNA, 20 bp, human
gggcgaggtaaaggtggcaa

SEQ ID NO: 77731 - DNA, 20 bp, human
ggagtctgtagagaagctgt

SEQ ID NO: 77732 - DNA, 20 bp, human
ggtcccgcagcaccttccgg

SEQ ID NO: 77733 - DNA, 20 bp, human
gcgcctactcagcagaaaat

SEQ ID NO: 77734 - DNA, 20 bp, human
ggcccgattttctgctgagt

SEQ ID NO: 77735 - DNA, 20 bp, human
ggctgtgatttcagaatgtc

SEQ ID NO: 77736 - DNA, 20 bp, human
gtctcccccggggcagagta

SEQ ID NO: 77737 - DNA, 20 bp, human
gggggaggcagggcgaaggt

SEQ ID NO: 77738 - DNA, 20 bp, human
ggtgccctactctgccccgg

SEQ ID NO: 77739 - DNA, 20 bp, human
ggcggccgccagctctgacc

SEQ ID NO: 77740 - DNA, 20 bp, human
ggaggcagggcgaaggtcgg

SEQ ID NO: 77741 - DNA, 20 bp, human
gcagccgccacgctgaaggc

SEQ ID NO: 77742 - DNA, 20 bp, human
gtcgccggccttcagcgtgg

SEQ ID NO: 77743 - DNA, 20 bp, human
gccgggtgtagggactggat

SEQ ID NO: 77744 - DNA, 20 bp, human
gggcagggtggcggacggag

SEQ ID NO: 77745 - DNA, 20 bp, human
gtagcgtctttggggccggc

SEQ ID NO: 77746 - DNA, 20 bp, human
gccgggcgcgtggagacggg

SEQ ID NO: 77747 - DNA, 20 bp, human
ggggtgcaccggctgcagag

SEQ ID NO: 77748 - DNA, 20 bp, human
gccacgcgcccgggtccagc

SEQ ID NO: 77749 - DNA, 20 bp, human
gggccgcgcgggagcgctgg

SEQ ID NO: 77750 - DNA, 20 bp, human
gtccttgcccgggaggtaaa

SEQ ID NO: 77751 - DNA, 20 bp, human
gcggtgcacccgcaaggcga

SEQ ID NO: 77752 - DNA, 20 bp, human
gggccgagcgagcgcagcga

SEQ ID NO: 77753 - DNA, 20 bp, human
gcctcccgggcaaggaagga

SEQ ID NO: 77754 - DNA, 20 bp, human
gctcccccgctacctgacaa

SEQ ID NO: 77755 - DNA, 20 bp, human
gactaatgagcgacgtgcac

SEQ ID NO: 77756 - DNA, 20 bp, human
gggactcggtgaacccagca

SEQ ID NO: 77757 - DNA, 20 bp, human
gcttggagaactgtgttgga

SEQ ID NO: 77758 - DNA, 20 bp, human
gccatcccccacaggacaca

SEQ ID NO: 77759 - DNA, 20 bp, human
gggagaactgtgttggaggg

SEQ ID NO: 77760 - DNA, 20 bp, human
ggggctctggggaggacagt

SEQ ID NO: 77761 - DNA, 20 bp, human
gcaggaatgaccttagcctc

SEQ ID NO: 77762 - DNA, 20 bp, human
gaaagtgtcggtagcgtgtg

SEQ ID NO: 77763 - DNA, 20 bp, human
gaggactcgtgacatttggg

SEQ ID NO: 77764 - DNA, 20 bp, human
gacctgccaaaaaccagccg

SEQ ID NO: 77765 - DNA, 20 bp, human
gaaaaccagccgtggtctca

SEQ ID NO: 77766 - DNA, 20 bp, human
gccggccggcccctgcgtct

SEQ ID NO: 77767 - DNA, 20 bp, human
gtacattgaagcaccaaact

SEQ ID NO: 77768 - DNA, 20 bp, human
gcggacaccttgcctaagaa

SEQ ID NO: 77769 - DNA, 20 bp, human
gtccggctgccgagacgcag

SEQ ID NO: 77770 - DNA, 20 bp, human
gtccgtgggtcagagaacac

SEQ ID NO: 77771 - DNA, 20 bp, human
gggcggccagtgcccccggt

SEQ ID NO: 77772 - DNA, 20 bp, human
gaaactaggcagctggataa

SEQ ID NO: 77773 - DNA, 20 bp, human
gaagaaggggctggatccgt

SEQ ID NO: 77774 - DNA, 20 bp, human
gtgcatacgtatgtccatcc

SEQ ID NO: 77775 - DNA, 20 bp, human
ggccgaaggtaggggactct

SEQ ID NO: 77776 - DNA, 20 bp, human
gagacaagcgaggcatgggt

SEQ ID NO: 77777 - DNA, 20 bp, human
gtccgtgggtcagagaacac

SEQ ID NO: 77778 - DNA, 20 bp, human
gctagtggaaaagacaagcg

SEQ ID NO: 77779 - DNA, 20 bp, human
gaagaaggggctggatccgt

SEQ ID NO: 77780 - DNA, 20 bp, human
gccggccggcccctgcgtct

SEQ ID NO: 77781 - DNA, 20 bp, human
gtacattgaagcaccaaact

SEQ ID NO: 77782 - DNA, 20 bp, human
gcggacaccttgcctaagaa

SEQ ID NO: 77783 - DNA, 20 bp, human
ggccgaaggtaggggactct

SEQ ID NO: 77784 - DNA, 20 bp, human
ggaaaagacaagcgaggcat

SEQ ID NO: 77785 - DNA, 20 bp, human
gccatcccaaggccgaaggt

SEQ ID NO: 77786 - DNA, 20 bp, human
gaggcctgcgtgtcggagtg

SEQ ID NO: 77787 - DNA, 20 bp, human
gcgcgcagcgtacccagcat

SEQ ID NO: 77788 - DNA, 20 bp, human
ggtacgctgcgcgccatgga

SEQ ID NO: 77789 - DNA, 20 bp, human
gctccggagagggaaaaagg

SEQ ID NO: 77790 - DNA, 20 bp, human
gactggctgggtccgatgct

SEQ ID NO: 77791 - DNA, 20 bp, human
gctcctgagtgggacgagag

SEQ ID NO: 77792 - DNA, 20 bp, human
gccaaacgcggtctctgcag

SEQ ID NO: 77793 - DNA, 20 bp, human
gctgagtgggacgagagagg

SEQ ID NO: 77794 - DNA, 20 bp, human
gcagtacccaagcgccaacc

SEQ ID NO: 77795 - DNA, 20 bp, human
gcgcgcgaggccctgcagtc

SEQ ID NO: 77796 - DNA, 20 bp, human
gggaggaccacggctcgcca

SEQ ID NO: 77797 - DNA, 20 bp, human
ggcggaagacccccgagacc

SEQ ID NO: 77798 - DNA, 20 bp, human
gtgcgcggcgatcatgctgg

SEQ ID NO: 77799 - DNA, 20 bp, human
gggggcctatctgacatcca

SEQ ID NO: 77800 - DNA, 20 bp, human
gccgaacaggccctgcggaa

SEQ ID NO: 77801 - DNA, 20 bp, human
ggcaggcagcccggtctcgg

SEQ ID NO: 77802 - DNA, 20 bp, human
gccacggctcgccagggctg

SEQ ID NO: 77803 - DNA, 20 bp, human
gagctgcgcggcgatcatgc

SEQ ID NO: 77804 - DNA, 20 bp, human
gccgcagggcctgttcggga

SEQ ID NO: 77805 - DNA, 20 bp, human
ggcgatcatgctggcggtcg

SEQ ID NO: 77806 - DNA, 20 bp, human
gctggctgggcatcaggact

SEQ ID NO: 77807 - DNA, 20 bp, human
gcttgttgcggccagagtgg

SEQ ID NO: 77808 - DNA, 20 bp, human
gcaggactaggctggagtcc

SEQ ID NO: 77809 - DNA, 20 bp, human
gcttgcccagtgtcaggttg

SEQ ID NO: 77810 - DNA, 20 bp, human
gacagaaggcctcggaaacc

SEQ ID NO: 77811 - DNA, 20 bp, human
gagtggaggaagagataagt

SEQ ID NO: 77812 - DNA, 20 bp, human
gggccatcttgcccagtgtc

SEQ ID NO: 77813 - DNA, 20 bp, human
gggaaggagagggccatgaa

SEQ ID NO: 77814 - DNA, 20 bp, human
gcaggaacctgggatgccac

SEQ ID NO: 77815 - DNA, 20 bp, human
gaggcctcagcacctcgaca

SEQ ID NO: 77816 - DNA, 20 bp, human
gggcgcggccgctcagacac

SEQ ID NO: 77817 - DNA, 20 bp, human
gaactccggcgcaggagtcc

SEQ ID NO: 77818 - DNA, 20 bp, human
gcgaggcggagacgcgagag

SEQ ID NO: 77819 - DNA, 20 bp, human
gggcggagacgcgagagggg

SEQ ID NO: 77820 - DNA, 20 bp, human
gtcatcctgccgcggcccga

SEQ ID NO: 77821 - DNA, 20 bp, human
gggcccgacggcgcagagtt

SEQ ID NO: 77822 - DNA, 20 bp, human
gacattgttgcatgaaactc

SEQ ID NO: 77823 - DNA, 20 bp, human
gttgcatgaaactccggcgc

SEQ ID NO: 77824 - DNA, 20 bp, human
gcgaggcaatcatcctgccg

SEQ ID NO: 77825 - DNA, 20 bp, human
gggcgcacaaagaaggctac

SEQ ID NO: 77826 - DNA, 20 bp, human
ggaagctagtcactctcctc

SEQ ID NO: 77827 - DNA, 20 bp, human
ggctcttgtctggcaatatg

SEQ ID NO: 77828 - DNA, 20 bp, human
gtagaccgaagtgcttacct

SEQ ID NO: 77829 - DNA, 20 bp, human
gcctgccagctggttctcga

SEQ ID NO: 77830 - DNA, 20 bp, human
gtggtgtgagccaaacagga

SEQ ID NO: 77831 - DNA, 20 bp, human
ggctgccatcgagaaccagc

SEQ ID NO: 77832 - DNA, 20 bp, human
gcaccaggggaagtggacac

SEQ ID NO: 77833 - DNA, 20 bp, human
gtgaccaaaagcaacactca

SEQ ID NO: 77834 - DNA, 20 bp, human
gagtgttgcttttggtcatt

SEQ ID NO: 77835 - DNA, 20 bp, human
gctggaaagattaagccagc

SEQ ID NO: 77836 - DNA, 20 bp, human
gtgcaacactccagagtcgt

SEQ ID NO: 77837 - DNA, 20 bp, human
ggaggtctgccagcctggac

SEQ ID NO: 77838 - DNA, 20 bp, human
ggtaggagtgaacactgcac

SEQ ID NO: 77839 - DNA, 20 bp, human
ggtttggtttctcctgagat

SEQ ID NO: 77840 - DNA, 20 bp, human
gttgctcggaaaggccacaa

SEQ ID NO: 77841 - DNA, 20 bp, human
gatgcggaagcgggtgagga

SEQ ID NO: 77842 - DNA, 20 bp, human
gaggaatctctgcccatctc

SEQ ID NO: 77843 - DNA, 20 bp, human
ggtgttcactcctacgactc

SEQ ID NO: 77844 - DNA, 20 bp, human
gttggatgcggaagcgggtg

SEQ ID NO: 77845 - DNA, 20 bp, human
gtgttgcacgcttccagtcc

SEQ ID NO: 77846 - DNA, 20 bp, human
gatggcgtccgagtgcacag

SEQ ID NO: 77847 - DNA, 20 bp, human
gaagggagggagtgatcagt

SEQ ID NO: 77848 - DNA, 20 bp, human
gccagcgtcccacgtccggt

SEQ ID NO: 77849 - DNA, 20 bp, human
gcggaagcccggcacaggct

SEQ ID NO: 77850 - DNA, 20 bp, human
ggtttccggaagcccggcac

SEQ ID NO: 77851 - DNA, 20 bp, human
gcgggcttccggaaacggga

SEQ ID NO: 77852 - DNA, 20 bp, human
gccacggcgggaactaggac

SEQ ID NO: 77853 - DNA, 20 bp, human
gtgttcggccaagcgcccac

SEQ ID NO: 77854 - DNA, 20 bp, human
gccaagcgcccaccggacgt

SEQ ID NO: 77855 - DNA, 20 bp, human
gcgagtccggtggacggatg

SEQ ID NO: 77856 - DNA, 20 bp, human
gtgtgggaaagaccttaaga

SEQ ID NO: 77857 - DNA, 20 bp, human
gcgggaaggcctccctctta

SEQ ID NO: 77858 - DNA, 20 bp, human
gcaggcgcgttaagctggtt

SEQ ID NO: 77859 - DNA, 20 bp, human
ggctccagagccccacagtt

SEQ ID NO: 77860 - DNA, 20 bp, human
ggttaagctggttgggaccc

SEQ ID NO: 77861 - DNA, 20 bp, human
gagccgaaagtcaggtaaca

SEQ ID NO: 77862 - DNA, 20 bp, human
gggactgcgcttcacttcgt

SEQ ID NO: 77863 - DNA, 20 bp, human
ggggaaagaccttaagaggg

SEQ ID NO: 77864 - DNA, 20 bp, human
ggatcctgaagccgaaagtc

SEQ ID NO: 77865 - DNA, 20 bp, human
gggaacgcgggtgcacgctg

SEQ ID NO: 77866 - DNA, 20 bp, human
gaccggcaggacgcctacga

SEQ ID NO: 77867 - DNA, 20 bp, human
gcagggtccccaggtccact

SEQ ID NO: 77868 - DNA, 20 bp, human
ggcgccatgacggccatcct

SEQ ID NO: 77869 - DNA, 20 bp, human
gacgccgaggatggccgtca

SEQ ID NO: 77870 - DNA, 20 bp, human
ggacgccgcgagccagagga

SEQ ID NO: 77871 - DNA, 20 bp, human
gcaggagacacggaatgtga

SEQ ID NO: 77872 - DNA, 20 bp, human
ggtcctgccggtacccgcgg

SEQ ID NO: 77873 - DNA, 20 bp, human
gtctcggacccggagactgt

SEQ ID NO: 77874 - DNA, 20 bp, human
gccagccccgaccaacccgg

SEQ ID NO: 77875 - DNA, 20 bp, human
gagactgaccgagtggacct

SEQ ID NO: 77876 - DNA, 20 bp, human
ggacgccgagatgctggtca

SEQ ID NO: 77877 - DNA, 20 bp, human
gcggtgagtgcgggtcggga

SEQ ID NO: 77878 - DNA, 20 bp, human
gcctctgccgggaggagcga

SEQ ID NO: 77879 - DNA, 20 bp, human
ggctgtcgaacctcacgaac

SEQ ID NO: 77880 - DNA, 20 bp, human
gagcgaggggaccgcaggcg

SEQ ID NO: 77881 - DNA, 20 bp, human
gtctgaggagactctgagtc

SEQ ID NO: 77882 - DNA, 20 bp, human
ggtgcgggtcgggagggaaa

SEQ ID NO: 77883 - DNA, 20 bp, human
gggagactctgagtccgggt

SEQ ID NO: 77884 - DNA, 20 bp, human
ggactgaccgagagagcctg

SEQ ID NO: 77885 - DNA, 20 bp, human
ggagcagcaggaggacggtt

SEQ ID NO: 77886 - DNA, 20 bp, human
gtctggggagaatgtgagtc

SEQ ID NO: 77887 - DNA, 20 bp, human
ggtcgcagccagacatcctc

SEQ ID NO: 77888 - DNA, 20 bp, human
gcagccagacatcctctgga

SEQ ID NO: 77889 - DNA, 20 bp, human
gaaccgggtaaaggcgactg

SEQ ID NO: 77890 - DNA, 20 bp, human
gtctcagacggggagactct

SEQ ID NO: 77891 - DNA, 20 bp, human
gacaccctccagaggatgtc

SEQ ID NO: 77892 - DNA, 20 bp, human
gccgtctgagatccacccca

SEQ ID NO: 77893 - DNA, 20 bp, human
ggcgacgccgcgagtccgag

SEQ ID NO: 77894 - DNA, 20 bp, human
gccaccccaaggtggatctg

SEQ ID NO: 77895 - DNA, 20 bp, human
ggttccgcagatccaccttg

SEQ ID NO: 77896 - DNA, 20 bp, human
gctgtgtggcaagaaggtat

SEQ ID NO: 77897 - DNA, 20 bp, human
ggtagctcctacctactgtg

SEQ ID NO: 77898 - DNA, 20 bp, human
gttcttgccacacagtaggt

SEQ ID NO: 77899 - DNA, 20 bp, human
gagagtagaatcttgagtgg

SEQ ID NO: 77900 - DNA, 20 bp, human
gatctaaggccaccctctcg

SEQ ID NO: 77901 - DNA, 20 bp, human
gagtggtgggaagtcttatg

SEQ ID NO: 77902 - DNA, 20 bp, human
gtggctgctaccccactcct

SEQ ID NO: 77903 - DNA, 20 bp, human
gaaggccaccctctcgggga

SEQ ID NO: 77904 - DNA, 20 bp, human
gtctggcaaaacatgatcta

SEQ ID NO: 77905 - DNA, 20 bp, human
gagttcacaccattggaaag

SEQ ID NO: 77906 - DNA, 20 bp, human
ggagcggtccagggactcac

SEQ ID NO: 77907 - DNA, 20 bp, human
gcggaccggaaccgcatctc

SEQ ID NO: 77908 - DNA, 20 bp, human
gagccccgccgccggagatg

SEQ ID NO: 77909 - DNA, 20 bp, human
gagtgcgcaggcgtccggac

SEQ ID NO: 77910 - DNA, 20 bp, human
gcctgccgcgcggagagata

SEQ ID NO: 77911 - DNA, 20 bp, human
ggctaggccgcgggtagtgg

SEQ ID NO: 77912 - DNA, 20 bp, human
gggtcctggcctgaatccag

SEQ ID NO: 77913 - DNA, 20 bp, human
gctagcgtaggttcacggca

SEQ ID NO: 77914 - DNA, 20 bp, human
gcgcgcggagagataaggtg

SEQ ID NO: 77915 - DNA, 20 bp, human
gggagcgcgcgcttttcgtg

SEQ ID NO: 77916 - DNA, 20 bp, human
gtggactcccgtgagctgga

SEQ ID NO: 77917 - DNA, 20 bp, human
gcagggagacaaactatctg

SEQ ID NO: 77918 - DNA, 20 bp, human
gtaccctgaaacaggagcag

SEQ ID NO: 77919 - DNA, 20 bp, human
ggctataggaatgtatacca

SEQ ID NO: 77920 - DNA, 20 bp, human
ggagtccagtgtcccaaaca

SEQ ID NO: 77921 - DNA, 20 bp, human
ggaacagatttaatatctag

SEQ ID NO: 77922 - DNA, 20 bp, human
gcccccaaatgagtgatgtg

SEQ ID NO: 77923 - DNA, 20 bp, human
gccctggaagagctggtcca

SEQ ID NO: 77924 - DNA, 20 bp, human
ggtccaggggactgaactcc

SEQ ID NO: 77925 - DNA, 20 bp, human
gagggacagattggctaggt

SEQ ID NO: 77926 - DNA, 20 bp, human
gtctgagggccattacactc

SEQ ID NO: 77927 - DNA, 20 bp, human
ggcacattcccggccagggg

SEQ ID NO: 77928 - DNA, 20 bp, human
gcatcagggtgtggaacccc

SEQ ID NO: 77929 - DNA, 20 bp, human
gcaggggtggtagagaaatc

SEQ ID NO: 77930 - DNA, 20 bp, human
gcagtccgtgtggtgaggac

SEQ ID NO: 77931 - DNA, 20 bp, human
gccataaaccagagagcgag

SEQ ID NO: 77932 - DNA, 20 bp, human
gtgtaatggccctcagagca

SEQ ID NO: 77933 - DNA, 20 bp, human
ggaggacaggaacaaggcgg

SEQ ID NO: 77934 - DNA, 20 bp, human
gaggaccagccctgctctga

SEQ ID NO: 77935 - DNA, 20 bp, human
gaacagaactggacttgatc

SEQ ID NO: 77936 - DNA, 20 bp, human
gcacgcccaggcactgactg

SEQ ID NO: 77937 - DNA, 20 bp, human
gaccagagccacctattcaa

SEQ ID NO: 77938 - DNA, 20 bp, human
ggaggttgatacacacaata

SEQ ID NO: 77939 - DNA, 20 bp, human
gcaaggccttcaacacgccc

SEQ ID NO: 77940 - DNA, 20 bp, human
gacctattcaaggggtaggg

SEQ ID NO: 77941 - DNA, 20 bp, human
ggcctccctaccccttgaat

SEQ ID NO: 77942 - DNA, 20 bp, human
gagccacctattcaaggggt

SEQ ID NO: 77943 - DNA, 20 bp, human
ggtcatggaggaatccagtc

SEQ ID NO: 77944 - DNA, 20 bp, human
gtcaacctcagtcagtgcct

SEQ ID NO: 77945 - DNA, 20 bp, human
gacgccttgcctctttacat

SEQ ID NO: 77946 - DNA, 20 bp, human
gaggaactgaggccgagtgg

SEQ ID NO: 77947 - DNA, 20 bp, human
ggaacagtgatgaggaactg

SEQ ID NO: 77948 - DNA, 20 bp, human
ggagcacaggaacagtgatg

SEQ ID NO: 77949 - DNA, 20 bp, human
gcttcagggcgcatgttgtg

SEQ ID NO: 77950 - DNA, 20 bp, human
ggaggagctggggccatcaa

SEQ ID NO: 77951 - DNA, 20 bp, human
gaattgatgactgtgagcac

SEQ ID NO: 77952 - DNA, 20 bp, human
gatgaggaactgaggccgag

SEQ ID NO: 77953 - DNA, 20 bp, human
gagcgtcggggtgagtgatg

SEQ ID NO: 77954 - DNA, 20 bp, human
gcagcaggaaagccaaggag

SEQ ID NO: 77955 - DNA, 20 bp, human
gctctagcactggaaatggg

SEQ ID NO: 77956 - DNA, 20 bp, human
gtcactgggagaaaaaacag

SEQ ID NO: 77957 - DNA, 20 bp, human
gcagtcagggagttaagtag

SEQ ID NO: 77958 - DNA, 20 bp, human
ggttgtagatgtatctctcc

SEQ ID NO: 77959 - DNA, 20 bp, human
ggaagcgcgcgaactcctcc

SEQ ID NO: 77960 - DNA, 20 bp, human
ggggcactgagtgatcacta

SEQ ID NO: 77961 - DNA, 20 bp, human
gagatacatctacaaccggg

SEQ ID NO: 77962 - DNA, 20 bp, human
ggggagggggcggacatgag

SEQ ID NO: 77963 - DNA, 20 bp, human
ggggaggggcgagcactgag

SEQ ID NO: 77964 - DNA, 20 bp, human
ggtagcattcctgccgtccc

SEQ ID NO: 77965 - DNA, 20 bp, human
gttcctgccgtccctggaaa

SEQ ID NO: 77966 - DNA, 20 bp, human
gaacagagagaggtgcccag

SEQ ID NO: 77967 - DNA, 20 bp, human
ggagagagaataggccagta

SEQ ID NO: 77968 - DNA, 20 bp, human
ggaaacctgcagaaccatca

SEQ ID NO: 77969 - DNA, 20 bp, human
ggtcagagccactgtccggg

SEQ ID NO: 77970 - DNA, 20 bp, human
gcccaaagacactgaccact

SEQ ID NO: 77971 - DNA, 20 bp, human
ggggtacagtaaacagagag

SEQ ID NO: 77972 - DNA, 20 bp, human
ggaaaagaaggactcgctaa

SEQ ID NO: 77973 - DNA, 20 bp, human
gaagaggtcctggataacct

SEQ ID NO: 77974 - DNA, 20 bp, human
gtggggaaaatgggaccaag

SEQ ID NO: 77975 - DNA, 20 bp, human
ggtagcaagctatcctatag

SEQ ID NO: 77976 - DNA, 20 bp, human
ggggcactgagtgatcacta

SEQ ID NO: 77977 - DNA, 20 bp, human
gctgaaaagaatgagctcag

SEQ ID NO: 77978 - DNA, 20 bp, human
gactgagtgatcactaggga

SEQ ID NO: 77979 - DNA, 20 bp, human
ggcggcctgctgcggagtac

SEQ ID NO: 77980 - DNA, 20 bp, human
ggggaggggcgagcactgag

SEQ ID NO: 77981 - DNA, 20 bp, human
gctcggcgctgcagggtcat

SEQ ID NO: 77982 - DNA, 20 bp, human
gtgtgtctgcacatcctgtc

SEQ ID NO: 77983 - DNA, 20 bp, human
gctctgcgtggtgagaaaac

SEQ ID NO: 77984 - DNA, 20 bp, human
ggggagggggcggacatgag

SEQ ID NO: 77985 - DNA, 20 bp, human
ggaagcgcgcgaactcctcc

SEQ ID NO: 77986 - DNA, 20 bp, human
gccaaggcagcctcagcagt

SEQ ID NO: 77987 - DNA, 20 bp, human
gatcacggtggtcagagcga

SEQ ID NO: 77988 - DNA, 20 bp, human
ggaacgacatagagacctcc

SEQ ID NO: 77989 - DNA, 20 bp, human
gttagtgaggtttccatcag

SEQ ID NO: 77990 - DNA, 20 bp, human
gtaacaaaaagagtaggttg

SEQ ID NO: 77991 - DNA, 20 bp, human
gggctctggtttcctgaagg

SEQ ID NO: 77992 - DNA, 20 bp, human
gttgtgaggacctcaagaca

SEQ ID NO: 77993 - DNA, 20 bp, human
gttcagtgactacggcctgg

SEQ ID NO: 77994 - DNA, 20 bp, human
gattgcctcaaaaattagtg

SEQ ID NO: 77995 - DNA, 20 bp, human
gatattcagtgactacggcc

SEQ ID NO: 77996 - DNA, 20 bp, human
gtatagcctggaggtctgtg

SEQ ID NO: 77997 - DNA, 20 bp, human
gatgattgcctcaaagacta

SEQ ID NO: 77998 - DNA, 20 bp, human
ggggctcatcacggcagtca

SEQ ID NO: 77999 - DNA, 20 bp, human
gacctccaggctatagtctc

SEQ ID NO: 78000 - DNA, 20 bp, human
gggtagcaaagagagtcggt

SEQ ID NO: 78001 - DNA, 20 bp, human
gtccagagactatagcctgg

SEQ ID NO: 78002 - DNA, 20 bp, human
gatcacggcagtcagggcga

SEQ ID NO: 78003 - DNA, 20 bp, human
gtggtaaactccaatagcac

SEQ ID NO: 78004 - DNA, 20 bp, human
gagctctggtttcctaaagg

SEQ ID NO: 78005 - DNA, 20 bp, human
gagagagtcggttggagctc

SEQ ID NO: 78006 - DNA, 20 bp, human
gtgctacccgaaggtctccg

SEQ ID NO: 78007 - DNA, 20 bp, human
gctgatggatctgatgtacc

SEQ ID NO: 78008 - DNA, 20 bp, human
gcactcacggaaacatccac

SEQ ID NO: 78009 - DNA, 20 bp, human
ggataggacaaagtgagcat

SEQ ID NO: 78010 - DNA, 20 bp, human
gggcttaagcctgtaggatg

SEQ ID NO: 78011 - DNA, 20 bp, human
gagtggtagtcaacacagct

SEQ ID NO: 78012 - DNA, 20 bp, human
gtctccagagccgccactct

SEQ ID NO: 78013 - DNA, 20 bp, human
gaagacataactgagacgaa

SEQ ID NO: 78014 - DNA, 20 bp, human
gggtgacagttgctacccga

SEQ ID NO: 78015 - DNA, 20 bp, human
gcggatccccggagaccttc

SEQ ID NO: 78016 - DNA, 20 bp, human
ggcggcctgatgccgagtac

SEQ ID NO: 78017 - DNA, 20 bp, human
ggcgaaggtaaggtacgagg

SEQ ID NO: 78018 - DNA, 20 bp, human
gacccgggcggagttggaca

SEQ ID NO: 78019 - DNA, 20 bp, human
gtcggaggggcggggaccta

SEQ ID NO: 78020 - DNA, 20 bp, human
gccgcgcggtgacgccgcag

SEQ ID NO: 78021 - DNA, 20 bp, human
gcccctccaggacttccttc

SEQ ID NO: 78022 - DNA, 20 bp, human
gctcccggcacagaaactcg

SEQ ID NO: 78023 - DNA, 20 bp, human
gcgagaaacgtgcagagcgg

SEQ ID NO: 78024 - DNA, 20 bp, human
gaggcgagaaacgtgcagag

SEQ ID NO: 78025 - DNA, 20 bp, human
gttagcgaaggtaaggtacg

SEQ ID NO: 78026 - DNA, 20 bp, human
gtctgcactgggaaaatgta

SEQ ID NO: 78027 - DNA, 20 bp, human
gaaatgaccatggcactcca

SEQ ID NO: 78028 - DNA, 20 bp, human
gtgacaggacaaaatgacca

SEQ ID NO: 78029 - DNA, 20 bp, human
gcttggtctcacttacgtct

SEQ ID NO: 78030 - DNA, 20 bp, human
gtccttgggttggagtatgg

SEQ ID NO: 78031 - DNA, 20 bp, human
gcaacacagctcaaacctaa

SEQ ID NO: 78032 - DNA, 20 bp, human
gacaggtttaagcctgaagg

SEQ ID NO: 78033 - DNA, 20 bp, human
gtctcgagagccaccactgt

SEQ ID NO: 78034 - DNA, 20 bp, human
gttggggaaatgcataaccg

SEQ ID NO: 78035 - DNA, 20 bp, human
gtcccccatactccaaccca

SEQ ID NO: 78036 - DNA, 20 bp, human
gtcagtagagctcgggagtg

SEQ ID NO: 78037 - DNA, 20 bp, human
gctgctacaagccaaactgg

SEQ ID NO: 78038 - DNA, 20 bp, human
gtcttcttgggcgctctgtt

SEQ ID NO: 78039 - DNA, 20 bp, human
gttgggagtcagtagagctc

SEQ ID NO: 78040 - DNA, 20 bp, human
gagcacagggactccactta

SEQ ID NO: 78041 - DNA, 20 bp, human
gatgagcgctcaggaatcat

SEQ ID NO: 78042 - DNA, 20 bp, human
gagagcgcccaagaagaaaa

SEQ ID NO: 78043 - DNA, 20 bp, human
gtgatgaaaaatcctagcac

SEQ ID NO: 78044 - DNA, 20 bp, human
ggcattggagaaaagaccta

SEQ ID NO: 78045 - DNA, 20 bp, human
gtagtgtgacaggtattatg

SEQ ID NO: 78046 - DNA, 20 bp, human
ggcagagagggaggtaccat

SEQ ID NO: 78047 - DNA, 20 bp, human
ggagccagaagggaagtcct

SEQ ID NO: 78048 - DNA, 20 bp, human
gtccaggagtgcagcagaga

SEQ ID NO: 78049 - DNA, 20 bp, human
ggcattggccaacatagctg

SEQ ID NO: 78050 - DNA, 20 bp, human
gcttagggcaatgacttcgt

SEQ ID NO: 78051 - DNA, 20 bp, human
gtgtcagagattgttatctg

SEQ ID NO: 78052 - DNA, 20 bp, human
gggcaaagaaggagacggtc

SEQ ID NO: 78053 - DNA, 20 bp, human
gcataaagttctcagacctc

SEQ ID NO: 78054 - DNA, 20 bp, human
ggatgtgacatagatttctc

SEQ ID NO: 78055 - DNA, 20 bp, human
gtttgtcatgatttccaggt

SEQ ID NO: 78056 - DNA, 20 bp, human
gcacattccaagttataggg

SEQ ID NO: 78057 - DNA, 20 bp, human
gacccacattccaagttata

SEQ ID NO: 78058 - DNA, 20 bp, human
gtaacttcctccctataact

SEQ ID NO: 78059 - DNA, 20 bp, human
gtcctccataaaaggagctt

SEQ ID NO: 78060 - DNA, 20 bp, human
gacccaagctccttttatgg

SEQ ID NO: 78061 - DNA, 20 bp, human
gcttcatgagacttgtgtaa

SEQ ID NO: 78062 - DNA, 20 bp, human
gaaacgtcacaatttcttaa

SEQ ID NO: 78063 - DNA, 20 bp, human
gaaagaaatgatttgtgcaa

SEQ ID NO: 78064 - DNA, 20 bp, human
gagtacccaagctcctttta

SEQ ID NO: 78065 - DNA, 20 bp, human
gtgagacttgcctgcttctc

SEQ ID NO: 78066 - DNA, 20 bp, human
gtgccatgtaggaacctcca

SEQ ID NO: 78067 - DNA, 20 bp, human
gctccctggaggttcctaca

SEQ ID NO: 78068 - DNA, 20 bp, human
ggtgtaaggggcctccatac

SEQ ID NO: 78069 - DNA, 20 bp, human
gtgagaagaaatgacctgta

SEQ ID NO: 78070 - DNA, 20 bp, human
gtgtgatgaaaaggtttcat

SEQ ID NO: 78071 - DNA, 20 bp, human
ggaagaaatgacctgtatgg

SEQ ID NO: 78072 - DNA, 20 bp, human
gttacacagtctcatggaga

SEQ ID NO: 78073 - DNA, 20 bp, human
gactgtcagctttgccatgt

SEQ ID NO: 78074 - DNA, 20 bp, human
gcacaatttcttaaggcacc

SEQ ID NO: 78075 - DNA, 20 bp, human
gtttggaatgtgggtggagg

SEQ ID NO: 78076 - DNA, 20 bp, human
gctccgagaggagtaaaagg

SEQ ID NO: 78077 - DNA, 20 bp, human
gaggctgggatcatggtaga

SEQ ID NO: 78078 - DNA, 20 bp, human
gcgggagacacggagcgcca

SEQ ID NO: 78079 - DNA, 20 bp, human
gctctaccgggagtagagag

SEQ ID NO: 78080 - DNA, 20 bp, human
ggggccgggacacggaagtg

SEQ ID NO: 78081 - DNA, 20 bp, human
gttcactcggaaaatctgtg

SEQ ID NO: 78082 - DNA, 20 bp, human
gccggactcaagaagttctc

SEQ ID NO: 78083 - DNA, 20 bp, human
gcagcgtccgcagattcact

SEQ ID NO: 78084 - DNA, 20 bp, human
gaaaatctgtgcggtgtccc

SEQ ID NO: 78085 - DNA, 20 bp, human
gggatggaaacggcctctac

SEQ ID NO: 78086 - DNA, 20 bp, human
gctcagggagccgcctccgg

SEQ ID NO: 78087 - DNA, 20 bp, human
gctcatatttttcccagacg

SEQ ID NO: 78088 - DNA, 20 bp, human
gcggcggagcaggttcctca

SEQ ID NO: 78089 - DNA, 20 bp, human
ggtattgggagtggaccaca

SEQ ID NO: 78090 - DNA, 20 bp, human
gcggccgggccgcgacacag

SEQ ID NO: 78091 - DNA, 20 bp, human
gctggccctgaccgatactt

SEQ ID NO: 78092 - DNA, 20 bp, human
gcccgcccaagtatcggtca

SEQ ID NO: 78093 - DNA, 20 bp, human
gtggaccacagggtacgcca

SEQ ID NO: 78094 - DNA, 20 bp, human
gtggtccactcccaatactg

SEQ ID NO: 78095 - DNA, 20 bp, human
gcactcacccgcccaagtat

SEQ ID NO: 78096 - DNA, 20 bp, human
ggaggagacacggaacacca

SEQ ID NO: 78097 - DNA, 20 bp, human
ggtctggggagaatgagtcc

SEQ ID NO: 78098 - DNA, 20 bp, human
gggggagaatgagtccgggt

SEQ ID NO: 78099 - DNA, 20 bp, human
gcgaggccagtgagtaactc

SEQ ID NO: 78100 - DNA, 20 bp, human
ggactcggcgtgtccgagga

SEQ ID NO: 78101 - DNA, 20 bp, human
gggaaacagcccctgcgcgg

SEQ ID NO: 78102 - DNA, 20 bp, human
gcagcgactcggcgtgtccg

SEQ ID NO: 78103 - DNA, 20 bp, human
gacagcccctgcgcggagga

SEQ ID NO: 78104 - DNA, 20 bp, human
ggagggaaacagcccctgcg

SEQ ID NO: 78105 - DNA, 20 bp, human
gaagtcctcgctcacccacc

SEQ ID NO: 78106 - DNA, 20 bp, human
gccagcgcgcccacaggtac

SEQ ID NO: 78107 - DNA, 20 bp, human
ggctcgtgcgcgccacggtg

SEQ ID NO: 78108 - DNA, 20 bp, human
ggctgtgctacctgtacctg

SEQ ID NO: 78109 - DNA, 20 bp, human
gtggccgggaagaggcgacc

SEQ ID NO: 78110 - DNA, 20 bp, human
ggcacgcagccgccgcaccg

SEQ ID NO: 78111 - DNA, 20 bp, human
gctctaggcgcgcacctgtg

SEQ ID NO: 78112 - DNA, 20 bp, human
ggccgcgccgcagaaggtga

SEQ ID NO: 78113 - DNA, 20 bp, human
gcagagagaggccggaggtg

SEQ ID NO: 78114 - DNA, 20 bp, human
ggcgtcagcgacagccaggt

SEQ ID NO: 78115 - DNA, 20 bp, human
ggggactcggaccacggacc

SEQ ID NO: 78116 - DNA, 20 bp, human
gcaccaggcgggccacgaga

SEQ ID NO: 78117 - DNA, 20 bp, human
ggcggctctgcccctaacat

SEQ ID NO: 78118 - DNA, 20 bp, human
gcgaccacccggcgcaggag

SEQ ID NO: 78119 - DNA, 20 bp, human
ggcgccccgacttacttctg

SEQ ID NO: 78120 - DNA, 20 bp, human
gcggcctcagaagtaagtcg

SEQ ID NO: 78121 - DNA, 20 bp, human
gtacttctgaggccgaaacg

SEQ ID NO: 78122 - DNA, 20 bp, human
gcgacgcggcctgagaacct

SEQ ID NO: 78123 - DNA, 20 bp, human
gggattcgcgggcgaccacc

SEQ ID NO: 78124 - DNA, 20 bp, human
ggcggcgcggcagggattcg

SEQ ID NO: 78125 - DNA, 20 bp, human
gtagcggcgagtaggccctg

SEQ ID NO: 78126 - DNA, 20 bp, human
gtgtcagggccgcggcacat

SEQ ID NO: 78127 - DNA, 20 bp, human
gcagggccgcggcacatggg

SEQ ID NO: 78128 - DNA, 20 bp, human
gctagtgccagcaccggagg

SEQ ID NO: 78129 - DNA, 20 bp, human
ggctgctccccagcgctccg

SEQ ID NO: 78130 - DNA, 20 bp, human
gcccctagtgccagcaccgg

SEQ ID NO: 78131 - DNA, 20 bp, human
gaaagtactcgctctcaagg

SEQ ID NO: 78132 - DNA, 20 bp, human
ggtactcgctctcaaggcgg

SEQ ID NO: 78133 - DNA, 20 bp, human
gacgtcgccggggagcccgc

SEQ ID NO: 78134 - DNA, 20 bp, human
gtctcaaggcggtggagaaa

SEQ ID NO: 78135 - DNA, 20 bp, human
ggataaaggtgggattcagg

SEQ ID NO: 78136 - DNA, 20 bp, human
gctgaggtccatgaccgagg

SEQ ID NO: 78137 - DNA, 20 bp, human
gtctgaagggagaatcttca

SEQ ID NO: 78138 - DNA, 20 bp, human
ggcacttacctggtctgatg

SEQ ID NO: 78139 - DNA, 20 bp, human
gtaagactatttctcacgaa

SEQ ID NO: 78140 - DNA, 20 bp, human
gagcccgacggtcccccagt

SEQ ID NO: 78141 - DNA, 20 bp, human
gaggaaaagtgataaaagag

SEQ ID NO: 78142 - DNA, 20 bp, human
gtggggctctgcatacagtt

SEQ ID NO: 78143 - DNA, 20 bp, human
gcccccagtcggcattcctg

SEQ ID NO: 78144 - DNA, 20 bp, human
gctgctgaggtccatgaccg

SEQ ID NO: 78145 - DNA, 20 bp, human
ggtatctccgtcatagggaa

SEQ ID NO: 78146 - DNA, 20 bp, human
gtcaggagcgcacgactgaa

SEQ ID NO: 78147 - DNA, 20 bp, human
gtggcgagtaggggctccta

SEQ ID NO: 78148 - DNA, 20 bp, human
gcgacgtctgactggactcg

SEQ ID NO: 78149 - DNA, 20 bp, human
ggacggcgtcgacgtctgac

SEQ ID NO: 78150 - DNA, 20 bp, human
ggcgcacagtgggtatctaa

SEQ ID NO: 78151 - DNA, 20 bp, human
gtgtcttcgctggcgagtag

SEQ ID NO: 78152 - DNA, 20 bp, human
gcagtcgtgcgctcctgatc

SEQ ID NO: 78153 - DNA, 20 bp, human
gaatcgcccagggaacgcag

SEQ ID NO: 78154 - DNA, 20 bp, human
gtagggcgagtcccgtgtta

SEQ ID NO: 78155 - DNA, 20 bp, human
gcgctgagtgggatgacaag

SEQ ID NO: 78156 - DNA, 20 bp, human
ggcagtaagcggccgaccag

SEQ ID NO: 78157 - DNA, 20 bp, human
ggcagccgcgcggctcaccc

SEQ ID NO: 78158 - DNA, 20 bp, human
ggccgaccagaggctgaagt

SEQ ID NO: 78159 - DNA, 20 bp, human
gggagccctagcgccaccga

SEQ ID NO: 78160 - DNA, 20 bp, human
gtgaagttggaggcgtagaa

SEQ ID NO: 78161 - DNA, 20 bp, human
gctagcgccaccgagggagg

SEQ ID NO: 78162 - DNA, 20 bp, human
gggctgcgaacatcctgccg

SEQ ID NO: 78163 - DNA, 20 bp, human
gtaatagtccgttagttagg

SEQ ID NO: 78164 - DNA, 20 bp, human
gacccagtccggctggactg

SEQ ID NO: 78165 - DNA, 20 bp, human
gcagggagcgaggcggtgac

SEQ ID NO: 78166 - DNA, 20 bp, human
ggcagggcgccgaagaagat

SEQ ID NO: 78167 - DNA, 20 bp, human
gcagcaaccggagctggagt

SEQ ID NO: 78168 - DNA, 20 bp, human
gcccgagacagagggaacgg

SEQ ID NO: 78169 - DNA, 20 bp, human
ggagggaacggtggtgatca

SEQ ID NO: 78170 - DNA, 20 bp, human
gtcgctgagggccgagtcca

SEQ ID NO: 78171 - DNA, 20 bp, human
ggtctcgggcccacattccg

SEQ ID NO: 78172 - DNA, 20 bp, human
ggaagtgtcagggtccgggt

SEQ ID NO: 78173 - DNA, 20 bp, human
gggaaagccacgttccccta

SEQ ID NO: 78174 - DNA, 20 bp, human
gaatgtgggcccgagacaga

SEQ ID NO: 78175 - DNA, 20 bp, human
gagggccgagtccatggcga

SEQ ID NO: 78176 - DNA, 20 bp, human
gagtacgaagggctgagata

SEQ ID NO: 78177 - DNA, 20 bp, human
gagcggccggattgagagga

SEQ ID NO: 78178 - DNA, 20 bp, human
gacgcccggcggcagcaggt

SEQ ID NO: 78179 - DNA, 20 bp, human
gcgtaagcggccggattgag

SEQ ID NO: 78180 - DNA, 20 bp, human
gacgaagggctgagataggg

SEQ ID NO: 78181 - DNA, 20 bp, human
gcccaacgtcccagtacgaa

SEQ ID NO: 78182 - DNA, 20 bp, human
gcgcgtctgggtcacccact

SEQ ID NO: 78183 - DNA, 20 bp, human
gaggaagtgagcggacgctg

SEQ ID NO: 78184 - DNA, 20 bp, human
ggctgttgatatcaatatgg

SEQ ID NO: 78185 - DNA, 20 bp, human
ggaactcagcgaggattctg

SEQ ID NO: 78186 - DNA, 20 bp, human
ggcgagtaccggggacacgt

SEQ ID NO: 78187 - DNA, 20 bp, human
gggctccggccggcgagtac

SEQ ID NO: 78188 - DNA, 20 bp, human
gtcagactgtaggacgacct

SEQ ID NO: 78189 - DNA, 20 bp, human
gggtgatactgggttaagag

SEQ ID NO: 78190 - DNA, 20 bp, human
gtaagagtggaaggattgtt

SEQ ID NO: 78191 - DNA, 20 bp, human
ggactgaggatggcaacctg

SEQ ID NO: 78192 - DNA, 20 bp, human
gcgtcctacagtctgactcc

SEQ ID NO: 78193 - DNA, 20 bp, human
gatcagagagcggtgatact

SEQ ID NO: 78194 - DNA, 20 bp, human
gtctgaccaatagacgactg

SEQ ID NO: 78195 - DNA, 20 bp, human
gacggaactccggtccctgc

SEQ ID NO: 78196 - DNA, 20 bp, human
gactagagggaggcgatagt

SEQ ID NO: 78197 - DNA, 20 bp, human
gagtgtcctggttactgcag

SEQ ID NO: 78198 - DNA, 20 bp, human
gaggagggcagaaggtactg

SEQ ID NO: 78199 - DNA, 20 bp, human
gctatggcaagatcatccct

SEQ ID NO: 78200 - DNA, 20 bp, human
gagagtggggaaatactcca

SEQ ID NO: 78201 - DNA, 20 bp, human
gcttctctggatccctgagg

SEQ ID NO: 78202 - DNA, 20 bp, human
gcacaaattgggggactcag

SEQ ID NO: 78203 - DNA, 20 bp, human
ggctgggcgttaagttcccc

SEQ ID NO: 78204 - DNA, 20 bp, human
ggtccaagaaccagaatcac

SEQ ID NO: 78205 - DNA, 20 bp, human
gaatggcagattacattcta

SEQ ID NO: 78206 - DNA, 20 bp, human
gcagcaaccggtcacctcga

SEQ ID NO: 78207 - DNA, 20 bp, human
gcactgaggcaagtcccgag

SEQ ID NO: 78208 - DNA, 20 bp, human
gccggccccgggccgtccag

SEQ ID NO: 78209 - DNA, 20 bp, human
gctcgagggcggccactgga

SEQ ID NO: 78210 - DNA, 20 bp, human
ggcccgacctgcgaacctgt

SEQ ID NO: 78211 - DNA, 20 bp, human
gcaaccggtcacctcgaggg

SEQ ID NO: 78212 - DNA, 20 bp, human
gagcgcaggaagagccgcag

SEQ ID NO: 78213 - DNA, 20 bp, human
ggcgggtggccaaagcggag

SEQ ID NO: 78214 - DNA, 20 bp, human
gggcggcctgggccgaagtg

SEQ ID NO: 78215 - DNA, 20 bp, human
ggcaccaagtcacccggagg

SEQ ID NO: 78216 - DNA, 20 bp, human
gcgtcgggtccatgccccgg

SEQ ID NO: 78217 - DNA, 20 bp, human
ggggctcgcatcttgagcta

SEQ ID NO: 78218 - DNA, 20 bp, human
ggctcgtgagctgcaaacag

SEQ ID NO: 78219 - DNA, 20 bp, human
ggccctgcccaacccctgga

SEQ ID NO: 78220 - DNA, 20 bp, human
gggcgagggcagcgggattc

SEQ ID NO: 78221 - DNA, 20 bp, human
gctgcaaacagtggaaagtt

SEQ ID NO: 78222 - DNA, 20 bp, human
gccaacgtggaggccccctc

SEQ ID NO: 78223 - DNA, 20 bp, human
gttggcgctgagaatcagac

SEQ ID NO: 78224 - DNA, 20 bp, human
gactgtatggacaacttccc

SEQ ID NO: 78225 - DNA, 20 bp, human
gcgctgagggggaaaaagag

SEQ ID NO: 78226 - DNA, 20 bp, human
gccaccttaggaatctgggt

SEQ ID NO: 78227 - DNA, 20 bp, human
gggcgcaaggccaacgtgtc

SEQ ID NO: 78228 - DNA, 20 bp, human
ggtgccccccagcatccggg

SEQ ID NO: 78229 - DNA, 20 bp, human
gccagagggagccagtaaga

SEQ ID NO: 78230 - DNA, 20 bp, human
gttaggaatctgggtaggag

SEQ ID NO: 78231 - DNA, 20 bp, human
gccggccatacccgacacgt

SEQ ID NO: 78232 - DNA, 20 bp, human
ggccaccgcctcctggacga

SEQ ID NO: 78233 - DNA, 20 bp, human
gaaggccaacgtgtcgggta

SEQ ID NO: 78234 - DNA, 20 bp, human
gcgtcctcccggatgctggg

SEQ ID NO: 78235 - DNA, 20 bp, human
ggcgtcacactccagcgtca

SEQ ID NO: 78236 - DNA, 20 bp, human
gaagtgaaggcgattgagag

SEQ ID NO: 78237 - DNA, 20 bp, human
gctgagggaattgtcctctg

SEQ ID NO: 78238 - DNA, 20 bp, human
gactgacctgctgacgacag

SEQ ID NO: 78239 - DNA, 20 bp, human
gttggaggccggctgaatgg

SEQ ID NO: 78240 - DNA, 20 bp, human
gcgacgagtgcgtgaagtga

SEQ ID NO: 78241 - DNA, 20 bp, human
gggaattgtcctctgtggaa

SEQ ID NO: 78242 - DNA, 20 bp, human
ggttggtgttcagcacaact

SEQ ID NO: 78243 - DNA, 20 bp, human
gaatgcggcgaaggactacg

SEQ ID NO: 78244 - DNA, 20 bp, human
gtgctgatgagggcttgaaa

SEQ ID NO: 78245 - DNA, 20 bp, human
gacccccccacaggaagtga

SEQ ID NO: 78246 - DNA, 20 bp, human
gctccgggcccggcatcccg

SEQ ID NO: 78247 - DNA, 20 bp, human
ggttggagcgtcgcgcagtc

SEQ ID NO: 78248 - DNA, 20 bp, human
gctcagggcccggagttccg

SEQ ID NO: 78249 - DNA, 20 bp, human
ggaactccgggccctgagag

SEQ ID NO: 78250 - DNA, 20 bp, human
ggtcaggggttcaggagcta

SEQ ID NO: 78251 - DNA, 20 bp, human
ggcacccccgccccctctca

SEQ ID NO: 78252 - DNA, 20 bp, human
ggcagccgggaaagtagcga

SEQ ID NO: 78253 - DNA, 20 bp, human
ggcgggagggactgggtcag

SEQ ID NO: 78254 - DNA, 20 bp, human
ggcagggaagtcctcgaggg

SEQ ID NO: 78255 - DNA, 20 bp, human
gggtgggggagtcaagactc

SEQ ID NO: 78256 - DNA, 20 bp, human
gtgcagccggtgaagaaacg

SEQ ID NO: 78257 - DNA, 20 bp, human
ggccagccgcgtttcttcac

SEQ ID NO: 78258 - DNA, 20 bp, human
gagaaacgcggctggcccaa

SEQ ID NO: 78259 - DNA, 20 bp, human
gggcccaaggcaccggtcac

SEQ ID NO: 78260 - DNA, 20 bp, human
gtcttccgcttcttgccctt

SEQ ID NO: 78261 - DNA, 20 bp, human
gagccaacggaaaagcaggt

SEQ ID NO: 78262 - DNA, 20 bp, human
gaggggggcctggcgtactg

SEQ ID NO: 78263 - DNA, 20 bp, human
gattctgccgaatgggccca

SEQ ID NO: 78264 - DNA, 20 bp, human
gccgaatgggcccaaggcac

SEQ ID NO: 78265 - DNA, 20 bp, human
gctcgggaaagggcagatcc

SEQ ID NO: 78266 - DNA, 20 bp, human
gcccgggcggctcgcaggag

SEQ ID NO: 78267 - DNA, 20 bp, human
ggtgctgcgctcctctaatt

SEQ ID NO: 78268 - DNA, 20 bp, human
gtgaaaccgggagagagcag

SEQ ID NO: 78269 - DNA, 20 bp, human
gggagcgcagcaccggctca

SEQ ID NO: 78270 - DNA, 20 bp, human
gagcgcgcaccgcaggccgg

SEQ ID NO: 78271 - DNA, 20 bp, human
gtcccccgaaggatggcgag

SEQ ID NO: 78272 - DNA, 20 bp, human
gaggccggcggccgagctcg

SEQ ID NO: 78273 - DNA, 20 bp, human
gtaccccgcgggggcctggg

SEQ ID NO: 78274 - DNA, 20 bp, human
gtcgcaggaggggcgacgtg

SEQ ID NO: 78275 - DNA, 20 bp, human
gcaaatgcggatctgaaacc

SEQ ID NO: 78276 - DNA, 20 bp, human
gggacgtccggtgttgatgg

SEQ ID NO: 78277 - DNA, 20 bp, human
gatcaacaccggacgtccag

SEQ ID NO: 78278 - DNA, 20 bp, human
gttcgggagatgaggtgata

SEQ ID NO: 78279 - DNA, 20 bp, human
ggccggcgggcagtgtgcga

SEQ ID NO: 78280 - DNA, 20 bp, human
ggtccctgggctgaagtgga

SEQ ID NO: 78281 - DNA, 20 bp, human
gtgcgacggccgcggcgact

SEQ ID NO: 78282 - DNA, 20 bp, human
gcagtacgagggcgcggtgg

SEQ ID NO: 78283 - DNA, 20 bp, human
gggatgagcgcacgcggtga

SEQ ID NO: 78284 - DNA, 20 bp, human
gcggctgccaaaaagagaag

SEQ ID NO: 78285 - DNA, 20 bp, human
gagaggctttgaggtcgcag

SEQ ID NO: 78286 - DNA, 20 bp, human
gcggcggcgtccgcgctgac

SEQ ID NO: 78287 - DNA, 20 bp, human
gcagccagcgcggctcctat

SEQ ID NO: 78288 - DNA, 20 bp, human
gcgcgagtttccacccccgg

SEQ ID NO: 78289 - DNA, 20 bp, human
ggcccgaacgcccggcccga

SEQ ID NO: 78290 - DNA, 20 bp, human
gtagccaataggagccgcgc

SEQ ID NO: 78291 - DNA, 20 bp, human
gccgtgcgcagttcccccca

SEQ ID NO: 78292 - DNA, 20 bp, human
gtgtgtggatcctgacccgc

SEQ ID NO: 78293 - DNA, 20 bp, human
gatccacacaaaggcaaatg

SEQ ID NO: 78294 - DNA, 20 bp, human
gtgagtctggggcagcgccg

SEQ ID NO: 78295 - DNA, 20 bp, human
ggatccccgcggccgggagc

SEQ ID NO: 78296 - DNA, 20 bp, human
gaccacgctcgcgcggacca

SEQ ID NO: 78297 - DNA, 20 bp, human
gcacctccgcgggtcacccc

SEQ ID NO: 78298 - DNA, 20 bp, human
ggatgggctctagggagaca

SEQ ID NO: 78299 - DNA, 20 bp, human
gtgacccgcggaggtgggag

SEQ ID NO: 78300 - DNA, 20 bp, human
ggctgttgactagtcagaac

SEQ ID NO: 78301 - DNA, 20 bp, human
gccttaccgtgagaagatct

SEQ ID NO: 78302 - DNA, 20 bp, human
ggaccttcctacgaaagcaa

SEQ ID NO: 78303 - DNA, 20 bp, human
gcgggagccgctggttcctg

SEQ ID NO: 78304 - DNA, 20 bp, human
ggcctcgaagatgggctcta

SEQ ID NO: 78305 - DNA, 20 bp, human
gctgaagttaaaacaaggca

SEQ ID NO: 78306 - DNA, 20 bp, human
ggcagagcggccggacccaa

SEQ ID NO: 78307 - DNA, 20 bp, human
gtcacgccggagccccgtga

SEQ ID NO: 78308 - DNA, 20 bp, human
gcagaaccgggcccggtcag

SEQ ID NO: 78309 - DNA, 20 bp, human
ggtgagggaagcgtctccgt

SEQ ID NO: 78310 - DNA, 20 bp, human
gagggcgcttgcggagtcac

SEQ ID NO: 78311 - DNA, 20 bp, human
ggccccgggagccacttgct

SEQ ID NO: 78312 - DNA, 20 bp, human
gggactcggtgaagggcggg

SEQ ID NO: 78313 - DNA, 20 bp, human
gcgaacccgagggtattgga

SEQ ID NO: 78314 - DNA, 20 bp, human
gagtcaccggactcggtgaa

SEQ ID NO: 78315 - DNA, 20 bp, human
ggagaactctgcaaaacaag

SEQ ID NO: 78316 - DNA, 20 bp, human
gccagactagcgaacaatac

SEQ ID NO: 78317 - DNA, 20 bp, human
gcagcgcagggcacgacgcg

SEQ ID NO: 78318 - DNA, 20 bp, human
gggccgcagccgggaaccca

SEQ ID NO: 78319 - DNA, 20 bp, human
gcgggaacccagggcccccg

SEQ ID NO: 78320 - DNA, 20 bp, human
gcccccgaggccagatgttt

SEQ ID NO: 78321 - DNA, 20 bp, human
ggcggcggctgggcgagcag

SEQ ID NO: 78322 - DNA, 20 bp, human
gtccccagcggagtccgtcg

SEQ ID NO: 78323 - DNA, 20 bp, human
gtcgcgggccggggaactcc

SEQ ID NO: 78324 - DNA, 20 bp, human
gcggcagggcgcgctcacgg

SEQ ID NO: 78325 - DNA, 20 bp, human
gccagccgcgcagcccccgg

SEQ ID NO: 78326 - DNA, 20 bp, human
gagggagaacccgaactggt

SEQ ID NO: 78327 - DNA, 20 bp, human
gtagattgctcctggagtgt

SEQ ID NO: 78328 - DNA, 20 bp, human
ggagaacccgaactggtcgg

SEQ ID NO: 78329 - DNA, 20 bp, human
gtctgcaagagctgtagtca

SEQ ID NO: 78330 - DNA, 20 bp, human
gcggagaaagcgggatcccc

SEQ ID NO: 78331 - DNA, 20 bp, human
gaggatgatggaggccgtct

SEQ ID NO: 78332 - DNA, 20 bp, human
gagcagccaaatacctatgt

SEQ ID NO: 78333 - DNA, 20 bp, human
gggaggccgtctgggttcct

SEQ ID NO: 78334 - DNA, 20 bp, human
gtggattcagtaacgtggac

SEQ ID NO: 78335 - DNA, 20 bp, human
gcctgcaccaccgaccagtt

SEQ ID NO: 78336 - DNA, 20 bp, human
gggccaagatggcagcaatg

SEQ ID NO: 78337 - DNA, 20 bp, human
gcgcttccgcggcgactggt

SEQ ID NO: 78338 - DNA, 20 bp, human
gtctcaggccagagtcggga

SEQ ID NO: 78339 - DNA, 20 bp, human
gaatgaggaaggcgcttccg

SEQ ID NO: 78340 - DNA, 20 bp, human
gcttggcccagaatcccccg

SEQ ID NO: 78341 - DNA, 20 bp, human
gggccctgggcggggaatca

SEQ ID NO: 78342 - DNA, 20 bp, human
gacagctctcaggccagagt

SEQ ID NO: 78343 - DNA, 20 bp, human
gcactaatgaagagttggag

SEQ ID NO: 78344 - DNA, 20 bp, human
gcggggcacttacagcccgg

SEQ ID NO: 78345 - DNA, 20 bp, human
gagacctgggacgccatcct

SEQ ID NO: 78346 - DNA, 20 bp, human
ggagaagctgctggtagctg

SEQ ID NO: 78347 - DNA, 20 bp, human
gcaaggagcactgagaataa

SEQ ID NO: 78348 - DNA, 20 bp, human
gctgaggcagtgcttcaccg

SEQ ID NO: 78349 - DNA, 20 bp, human
ggatggcacattccccatgg

SEQ ID NO: 78350 - DNA, 20 bp, human
gtgcagggtctgatctgtag

SEQ ID NO: 78351 - DNA, 20 bp, human
gggcagtgcttcaccgcgga

SEQ ID NO: 78352 - DNA, 20 bp, human
gatgctcccggagaagctgc

SEQ ID NO: 78353 - DNA, 20 bp, human
gatggggaatgtgccatccg

SEQ ID NO: 78354 - DNA, 20 bp, human
ggcggcagtcggcgagggga

SEQ ID NO: 78355 - DNA, 20 bp, human
ggaggaggtgacataaaggg

SEQ ID NO: 78356 - DNA, 20 bp, human
ggctccagttaacgcagtcg

SEQ ID NO: 78357 - DNA, 20 bp, human
gagccacttcccagggccga

SEQ ID NO: 78358 - DNA, 20 bp, human
gcacctccagatctcactag

SEQ ID NO: 78359 - DNA, 20 bp, human
gactagaggccaccgaaccc

SEQ ID NO: 78360 - DNA, 20 bp, human
gggtggcctctagtgagatc

SEQ ID NO: 78361 - DNA, 20 bp, human
ggctcctgcggacctggagg

SEQ ID NO: 78362 - DNA, 20 bp, human
gtccgagcgtgcgtaaggtg

SEQ ID NO: 78363 - DNA, 20 bp, human
gtgactgcggtcatcatcgg

SEQ ID NO: 78364 - DNA, 20 bp, human
gtcgtgactgcggtcatcat

SEQ ID NO: 78365 - DNA, 20 bp, human
gcgtcggcgccggggttcgg

SEQ ID NO: 78366 - DNA, 20 bp, human
gctataaagctggtggcgaa

SEQ ID NO: 78367 - DNA, 20 bp, human
gccgccaacccacccgactc

SEQ ID NO: 78368 - DNA, 20 bp, human
ggccacgaaaggacagtccg

SEQ ID NO: 78369 - DNA, 20 bp, human
gctcaccaagcgtgaccgag

SEQ ID NO: 78370 - DNA, 20 bp, human
gggcagctgtgaccgcctag

SEQ ID NO: 78371 - DNA, 20 bp, human
gcgcgctggggagtagaact

SEQ ID NO: 78372 - DNA, 20 bp, human
gaaagggagtgagccacgaa

SEQ ID NO: 78373 - DNA, 20 bp, human
gaaagctggtggcgaagggg

SEQ ID NO: 78374 - DNA, 20 bp, human
gagggtggacgccaaaggat

SEQ ID NO: 78375 - DNA, 20 bp, human
gtgaccgcctagaggtgagt

SEQ ID NO: 78376 - DNA, 20 bp, human
ggctcccagtagcccaccaa

SEQ ID NO: 78377 - DNA, 20 bp, human
gtgggaatggtggtgtagag

SEQ ID NO: 78378 - DNA, 20 bp, human
gccactgggcatctctttca

SEQ ID NO: 78379 - DNA, 20 bp, human
gagcaggcgagcaggtgtga

SEQ ID NO: 78380 - DNA, 20 bp, human
ggctgggtttctgaactgct

SEQ ID NO: 78381 - DNA, 20 bp, human
ggttgcagaatgcgcttcac

SEQ ID NO: 78382 - DNA, 20 bp, human
gatgctgtgtttgtgagcaa

SEQ ID NO: 78383 - DNA, 20 bp, human
gctctttcaaggtttctgct

SEQ ID NO: 78384 - DNA, 20 bp, human
gattctgcaactgacaagag

SEQ ID NO: 78385 - DNA, 20 bp, human
ggccttgccaaattttgagt

SEQ ID NO: 78386 - DNA, 20 bp, human
gctgctgagacccacagcgg

SEQ ID NO: 78387 - DNA, 20 bp, human
ggacggagacgcacgaatag

SEQ ID NO: 78388 - DNA, 20 bp, human
gcttcggcggagctgacctg

SEQ ID NO: 78389 - DNA, 20 bp, human
ggggcgggcccgcgagtcct

SEQ ID NO: 78390 - DNA, 20 bp, human
gccgcagtcccaggactcgc

SEQ ID NO: 78391 - DNA, 20 bp, human
gggagacgcacgaatagagg

SEQ ID NO: 78392 - DNA, 20 bp, human
gccgggcccgtcgccaccgt

SEQ ID NO: 78393 - DNA, 20 bp, human
ggggggctattcgaacgggg

SEQ ID NO: 78394 - DNA, 20 bp, human
gtgagggggctattcgaacg

SEQ ID NO: 78395 - DNA, 20 bp, human
gggaggcgcttggagaccgg

SEQ ID NO: 78396 - DNA, 20 bp, human
ggcggcgagcccgaggagag

SEQ ID NO: 78397 - DNA, 20 bp, human
gattgcccgcccgcagggag

SEQ ID NO: 78398 - DNA, 20 bp, human
gtggtgcagggagcgagaat

SEQ ID NO: 78399 - DNA, 20 bp, human
gcagctgggccaatgaacgg

SEQ ID NO: 78400 - DNA, 20 bp, human
gggataaacagccgccaaca

SEQ ID NO: 78401 - DNA, 20 bp, human
gcaaacccgaaagggcggga

SEQ ID NO: 78402 - DNA, 20 bp, human
gggaaggggccctcgcgatg

SEQ ID NO: 78403 - DNA, 20 bp, human
gcgggcgccagaggccatat

SEQ ID NO: 78404 - DNA, 20 bp, human
gggccgccgctcctccaata

SEQ ID NO: 78405 - DNA, 20 bp, human
gtgtttatcccgctctcctc

SEQ ID NO: 78406 - DNA, 20 bp, human
ggcggaggtgcaggtcgaag

SEQ ID NO: 78407 - DNA, 20 bp, human
gcgcgcgcggtagtaacccg

SEQ ID NO: 78408 - DNA, 20 bp, human
gcaagtacaagcgtaaggag

SEQ ID NO: 78409 - DNA, 20 bp, human
gaggtgcaggtcgaagaggc

SEQ ID NO: 78410 - DNA, 20 bp, human
gagatcgatgaggacggagt

SEQ ID NO: 78411 - DNA, 20 bp, human
gcctcattggagcagcaggg

SEQ ID NO: 78412 - DNA, 20 bp, human
gcgcagggcacgacgtagcc

SEQ ID NO: 78413 - DNA, 20 bp, human
gcacctccgcggctccctct

SEQ ID NO: 78414 - DNA, 20 bp, human
gagagaggaacgtctgcaac

SEQ ID NO: 78415 - DNA, 20 bp, human
gagaagggaaaccgcgtcac

SEQ ID NO: 78416 - DNA, 20 bp, human
ggcgccggagccctaggcgt

SEQ ID NO: 78417 - DNA, 20 bp, human
gctggccctgcccacgccta

SEQ ID NO: 78418 - DNA, 20 bp, human
gcgtgacgcgccggagccct

SEQ ID NO: 78419 - DNA, 20 bp, human
gtcgttgaggagacacccaa

SEQ ID NO: 78420 - DNA, 20 bp, human
ggctcgtcttctctgtctta

SEQ ID NO: 78421 - DNA, 20 bp, human
gcaggagggtcctaagtata

SEQ ID NO: 78422 - DNA, 20 bp, human
gctgcccacgcctagggctc

SEQ ID NO: 78423 - DNA, 20 bp, human
gagtctcgtggccgtccgag

SEQ ID NO: 78424 - DNA, 20 bp, human
ggagagccgcaggcccgacc

SEQ ID NO: 78425 - DNA, 20 bp, human
gggcgcgggaatcccagctg

SEQ ID NO: 78426 - DNA, 20 bp, human
gcagcgcttagagagctcgg

SEQ ID NO: 78427 - DNA, 20 bp, human
gtccagcccaaaaccccgga

SEQ ID NO: 78428 - DNA, 20 bp, human
gccaaaaccccggaaggaac

SEQ ID NO: 78429 - DNA, 20 bp, human
gagcccagaaatggcaggat

SEQ ID NO: 78430 - DNA, 20 bp, human
ggctcggtggaagctgctaa

SEQ ID NO: 78431 - DNA, 20 bp, human
gtggaagctgctaaaggcgg

SEQ ID NO: 78432 - DNA, 20 bp, human
gtagggaaccctgcttccgt

SEQ ID NO: 78433 - DNA, 20 bp, human
gcggtggaagctgctaaagg

SEQ ID NO: 78434 - DNA, 20 bp, human
gggcctcctgcaaattccca

SEQ ID NO: 78435 - DNA, 20 bp, human
gaaacagcctgttccttccg

SEQ ID NO: 78436 - DNA, 20 bp, human
gtcgccagggagacccgtcc

SEQ ID NO: 78437 - DNA, 20 bp, human
ggccggtgcagccgccaaac

SEQ ID NO: 78438 - DNA, 20 bp, human
gcggcagtagcggcacacca

SEQ ID NO: 78439 - DNA, 20 bp, human
ggcggctgcaccggcagtag

SEQ ID NO: 78440 - DNA, 20 bp, human
gagggacacggtcgtcaccg

SEQ ID NO: 78441 - DNA, 20 bp, human
ggcgcctccgggaatgtgag

SEQ ID NO: 78442 - DNA, 20 bp, human
gcgtcaccgaggcaccggtt

SEQ ID NO: 78443 - DNA, 20 bp, human
gggcacaccacggatcgcca

SEQ ID NO: 78444 - DNA, 20 bp, human
ggaaggcgggacttacccgg

SEQ ID NO: 78445 - DNA, 20 bp, human
gaccggtttggcggctgcac

SEQ ID NO: 78446 - DNA, 20 bp, human
ggcgagccgagtgaaggtag

SEQ ID NO: 78447 - DNA, 20 bp, human
gatccgggcgagccgagtga

SEQ ID NO: 78448 - DNA, 20 bp, human
gccaagatggcggcgatcgg

SEQ ID NO: 78449 - DNA, 20 bp, human
gctcacggcgcccccgaggg

SEQ ID NO: 78450 - DNA, 20 bp, human
ggctcgccgctaccttcact

SEQ ID NO: 78451 - DNA, 20 bp, human
ggggccgtctccgccctcgg

SEQ ID NO: 78452 - DNA, 20 bp, human
gggcctcacggcgcccccga

SEQ ID NO: 78453 - DNA, 20 bp, human
ggcggcgttgaggcgggatc

SEQ ID NO: 78454 - DNA, 20 bp, human
gcacagctcgacctgaaccc

SEQ ID NO: 78455 - DNA, 20 bp, human
gcgatcggcggcgttgaggc

SEQ ID NO: 78456 - DNA, 20 bp, human
gcacgtgggcctgacagctg

SEQ ID NO: 78457 - DNA, 20 bp, human
gagctcacggtagggaccct

SEQ ID NO: 78458 - DNA, 20 bp, human
gcggcattcagctcacggta

SEQ ID NO: 78459 - DNA, 20 bp, human
gccagccctggatggagtgg

SEQ ID NO: 78460 - DNA, 20 bp, human
gcgacaatgtggtcccgaag

SEQ ID NO: 78461 - DNA, 20 bp, human
gcgcaggctgaggccgggaa

SEQ ID NO: 78462 - DNA, 20 bp, human
gctgccgtcccgcccggtag

SEQ ID NO: 78463 - DNA, 20 bp, human
gagctgacgccgggccgcag

SEQ ID NO: 78464 - DNA, 20 bp, human
ggtggagcccgggtgagacc

SEQ ID NO: 78465 - DNA, 20 bp, human
ggggctccactcacccccga

SEQ ID NO: 78466 - DNA, 20 bp, human
gcggcaagggaagtgcagat

SEQ ID NO: 78467 - DNA, 20 bp, human
gacctgagccacaaggacaa

SEQ ID NO: 78468 - DNA, 20 bp, human
ggcaggaagtccctctgggt

SEQ ID NO: 78469 - DNA, 20 bp, human
ggcagctgtcagggcaccag

SEQ ID NO: 78470 - DNA, 20 bp, human
gatcctctgccacaccacag

SEQ ID NO: 78471 - DNA, 20 bp, human
gtaccctggctccgacccag

SEQ ID NO: 78472 - DNA, 20 bp, human
ggaagcctgagcatcccacg

SEQ ID NO: 78473 - DNA, 20 bp, human
gtggtgtggcagaggatgtg

SEQ ID NO: 78474 - DNA, 20 bp, human
gcctgagcatcccacgcggt

SEQ ID NO: 78475 - DNA, 20 bp, human
ggccacaaggacaacggcaa

SEQ ID NO: 78476 - DNA, 20 bp, human
gtgcgtaagggggaaagagc

SEQ ID NO: 78477 - DNA, 20 bp, human
gtccagaaactgaaggtgac

SEQ ID NO: 78478 - DNA, 20 bp, human
gttcaagggcgccttaggaa

SEQ ID NO: 78479 - DNA, 20 bp, human
gtacagcagggcgaagggaa

SEQ ID NO: 78480 - DNA, 20 bp, human
ggtcaacatgtcctttccta

SEQ ID NO: 78481 - DNA, 20 bp, human
ggggaatggacccgagacgt

SEQ ID NO: 78482 - DNA, 20 bp, human
gcttatcagtgaggccctct

SEQ ID NO: 78483 - DNA, 20 bp, human
gcaagtagctaccaacgtct

SEQ ID NO: 78484 - DNA, 20 bp, human
gggtcattgaatcgtttcaa

SEQ ID NO: 78485 - DNA, 20 bp, human
ggaatgtaagccccacgggg

SEQ ID NO: 78486 - DNA, 20 bp, human
ggaaccaagcatgctccccc

SEQ ID NO: 78487 - DNA, 20 bp, human
gggtcctccgtagctagtga

SEQ ID NO: 78488 - DNA, 20 bp, human
ggaacgagcccagcaccggc

SEQ ID NO: 78489 - DNA, 20 bp, human
gtcgttcgtgctggctccgc

SEQ ID NO: 78490 - DNA, 20 bp, human
gcaagcatgctcccccaggc

SEQ ID NO: 78491 - DNA, 20 bp, human
gaggacgctcgagaggaggc

SEQ ID NO: 78492 - DNA, 20 bp, human
gtcaaagactggatactcta

SEQ ID NO: 78493 - DNA, 20 bp, human
gtgcggacgctccatccggc

SEQ ID NO: 78494 - DNA, 20 bp, human
gccgtagggtagttggaggg

SEQ ID NO: 78495 - DNA, 20 bp, human
gctaggacgcaagcagggtt

SEQ ID NO: 78496 - DNA, 20 bp, human
gactgcgggagtcatctcca

SEQ ID NO: 78497 - DNA, 20 bp, human
gcatctccagggagttcatg

SEQ ID NO: 78498 - DNA, 20 bp, human
gcgctcccgcatgaactccc

SEQ ID NO: 78499 - DNA, 20 bp, human
ggcactggcaatgttgggga

SEQ ID NO: 78500 - DNA, 20 bp, human
gtggtggcactggcaatgtt

SEQ ID NO: 78501 - DNA, 20 bp, human
gtgtgccagacactgctgtg

SEQ ID NO: 78502 - DNA, 20 bp, human
ggggagggtgctataggtca

SEQ ID NO: 78503 - DNA, 20 bp, human
gtacaatgagaagggtccct

SEQ ID NO: 78504 - DNA, 20 bp, human
gatcaccctctgcctgactg

SEQ ID NO: 78505 - DNA, 20 bp, human
gtgcttgaacttggtggcac

SEQ ID NO: 78506 - DNA, 20 bp, human
gcgcgaggccggcgcaacgt

SEQ ID NO: 78507 - DNA, 20 bp, human
gtccctgcagcccagcggac

SEQ ID NO: 78508 - DNA, 20 bp, human
ggacaggcgacagcgacctg

SEQ ID NO: 78509 - DNA, 20 bp, human
ggcccgtcagcgactccctc

SEQ ID NO: 78510 - DNA, 20 bp, human
gtgacgggcacgctgactgg

SEQ ID NO: 78511 - DNA, 20 bp, human
ggcctgagggagtcgctgac

SEQ ID NO: 78512 - DNA, 20 bp, human
gtagccgtgacgctgggaga

SEQ ID NO: 78513 - DNA, 20 bp, human
gtgggagagggtgggcccaa

SEQ ID NO: 78514 - DNA, 20 bp, human
gcggaaggaaggccccggga

SEQ ID NO: 78515 - DNA, 20 bp, human
gtgactggaggctggcggac

SEQ ID NO: 78516 - DNA, 20 bp, human
ggatgctacgggtgatgact

SEQ ID NO: 78517 - DNA, 20 bp, human
gaggtggagagcctcttaac

SEQ ID NO: 78518 - DNA, 20 bp, human
gcccgtagcatccggttaag

SEQ ID NO: 78519 - DNA, 20 bp, human
ggcctcttaaccggatgcta

SEQ ID NO: 78520 - DNA, 20 bp, human
gagttagaccaaaatgagcg

SEQ ID NO: 78521 - DNA, 20 bp, human
gcctcaagggataagactca

SEQ ID NO: 78522 - DNA, 20 bp, human
gcaagcggacaaggcctcaa

SEQ ID NO: 78523 - DNA, 20 bp, human
gctctccacctcgctcattt

SEQ ID NO: 78524 - DNA, 20 bp, human
gactcactgtgcacgtgcct

SEQ ID NO: 78525 - DNA, 20 bp, human
gagaaaatatcaagcggaca

SEQ ID NO: 78526 - DNA, 20 bp, human
gcacaagctcgggctgagga

SEQ ID NO: 78527 - DNA, 20 bp, human
gccgagcttgtggtgctgaa

SEQ ID NO: 78528 - DNA, 20 bp, human
ggcctcgcgtgtgtctggat

SEQ ID NO: 78529 - DNA, 20 bp, human
gtggcaatcctgcaatatgg

SEQ ID NO: 78530 - DNA, 20 bp, human
ggcaccacaagctcgggctg

SEQ ID NO: 78531 - DNA, 20 bp, human
gcgagtgcagcacagtaagt

SEQ ID NO: 78532 - DNA, 20 bp, human
gtccgatccagacacacgcg

SEQ ID NO: 78533 - DNA, 20 bp, human
gactgtgctgcactcgtggg

SEQ ID NO: 78534 - DNA, 20 bp, human
ggagcaggcgtgagcgagca

SEQ ID NO: 78535 - DNA, 20 bp, human
gatggctgaataacaggatc

SEQ ID NO: 78536 - DNA, 20 bp, human
gccaggagcgaagtgagacc

SEQ ID NO: 78537 - DNA, 20 bp, human
ggagcgaagtgagaccgggt

SEQ ID NO: 78538 - DNA, 20 bp, human
gaagtgagaccgggtcggag

SEQ ID NO: 78539 - DNA, 20 bp, human
ggcagctgcgcggagaactg

SEQ ID NO: 78540 - DNA, 20 bp, human
gtctggcgggggctccctaa

SEQ ID NO: 78541 - DNA, 20 bp, human
gccccgcgcctggacccata

SEQ ID NO: 78542 - DNA, 20 bp, human
ggggaatagagatgtctgag

SEQ ID NO: 78543 - DNA, 20 bp, human
ggaatgggcgcggagctggg

SEQ ID NO: 78544 - DNA, 20 bp, human
gagggcgggaacctacgaaa

SEQ ID NO: 78545 - DNA, 20 bp, human
gaggggaggccagggcgaat

SEQ ID NO: 78546 - DNA, 20 bp, human
gtgcgcgccgacagctgatc

SEQ ID NO: 78547 - DNA, 20 bp, human
ggccccggcggcgaccagaa

SEQ ID NO: 78548 - DNA, 20 bp, human
gaccagaacggcgacctgaa

SEQ ID NO: 78549 - DNA, 20 bp, human
gacctgaaaggcgagccagg

SEQ ID NO: 78550 - DNA, 20 bp, human
ggacggcagccgggaggacg

SEQ ID NO: 78551 - DNA, 20 bp, human
gcgccagcaggttctcgatg

SEQ ID NO: 78552 - DNA, 20 bp, human
gcggctgcccgatcagctgt

SEQ ID NO: 78553 - DNA, 20 bp, human
gcccggcccgagcagcgcac

SEQ ID NO: 78554 - DNA, 20 bp, human
gtgcccgcgcgctcaggtct

SEQ ID NO: 78555 - DNA, 20 bp, human
gtgacgagctgacggagccc

SEQ ID NO: 78556 - DNA, 20 bp, human
gctcctccgaggacacggac

SEQ ID NO: 78557 - DNA, 20 bp, human
gcttagggccgtgctggtct

SEQ ID NO: 78558 - DNA, 20 bp, human
gaggaggaggagccggacga

SEQ ID NO: 78559 - DNA, 20 bp, human
gagcctgtccgtgtcctcgg

SEQ ID NO: 78560 - DNA, 20 bp, human
ggaacccctgcgcagccatc

SEQ ID NO: 78561 - DNA, 20 bp, human
ggggacatgcaggcaccgga

SEQ ID NO: 78562 - DNA, 20 bp, human
gggcaaggaaaagggatggg

SEQ ID NO: 78563 - DNA, 20 bp, human
gtgctggtctgggcagaagc

SEQ ID NO: 78564 - DNA, 20 bp, human
gggagacccggcgagttggc

SEQ ID NO: 78565 - DNA, 20 bp, human
gttccgcgccagggacatgc

SEQ ID NO: 78566 - DNA, 20 bp, human
gggcgggggtcagggtgtag

SEQ ID NO: 78567 - DNA, 20 bp, human
gagcgctccaggtagtgcgc

SEQ ID NO: 78568 - DNA, 20 bp, human
gccggggacccggaggagag

SEQ ID NO: 78569 - DNA, 20 bp, human
ggcgcgaagagcgtccgtgg

SEQ ID NO: 78570 - DNA, 20 bp, human
gagggtgtaggggtaccacc

SEQ ID NO: 78571 - DNA, 20 bp, human
ggctcaacggagaccaccac

SEQ ID NO: 78572 - DNA, 20 bp, human
gggcggggcgagcaggcgag

SEQ ID NO: 78573 - DNA, 20 bp, human
ggccacctcccgcgacctga

SEQ ID NO: 78574 - DNA, 20 bp, human
gaccatgccggaacccgggc

SEQ ID NO: 78575 - DNA, 20 bp, human
ggccctgcccgcgcactacc

SEQ ID NO: 78576 - DNA, 20 bp, human
gtcaaagggtcggacccgag

SEQ ID NO: 78577 - DNA, 20 bp, human
gcgtcgatcggccggacagg

SEQ ID NO: 78578 - DNA, 20 bp, human
gcggctcctgcagcggtggt

SEQ ID NO: 78579 - DNA, 20 bp, human
gaaaccggccgtgctccgag

SEQ ID NO: 78580 - DNA, 20 bp, human
gtggcgccgaggagcgaggt

SEQ ID NO: 78581 - DNA, 20 bp, human
gactccgtggaaggaatgaa

SEQ ID NO: 78582 - DNA, 20 bp, human
gagcagaacgctcaaagggt

SEQ ID NO: 78583 - DNA, 20 bp, human
gtcggccggacaggcggcag

SEQ ID NO: 78584 - DNA, 20 bp, human
gaggcgtcgatcggccggac

SEQ ID NO: 78585 - DNA, 20 bp, human
ggccggagcagaacgctcaa

SEQ ID NO: 78586 - DNA, 20 bp, human
gtccaggtcccggatagcga

SEQ ID NO: 78587 - DNA, 20 bp, human
gaggtcccggatagcgaggg

SEQ ID NO: 78588 - DNA, 20 bp, human
gcaaaatgggccgcacccac

SEQ ID NO: 78589 - DNA, 20 bp, human
ggcggccgccctcgctatcc

SEQ ID NO: 78590 - DNA, 20 bp, human
ggtcgacatgttccaggtcc

SEQ ID NO: 78591 - DNA, 20 bp, human
gccccacggaacgcaccaca

SEQ ID NO: 78592 - DNA, 20 bp, human
gaacggcgcgcggcgagctg

SEQ ID NO: 78593 - DNA, 20 bp, human
gcgcatcccacagacaaaat

SEQ ID NO: 78594 - DNA, 20 bp, human
gccgaggcccgaagcccgag

SEQ ID NO: 78595 - DNA, 20 bp, human
ggcggcggtcgacatgttcc

SEQ ID NO: 78596 - DNA, 20 bp, human
gcccagcggcccgtgaatca

SEQ ID NO: 78597 - DNA, 20 bp, human
ggacgagacggacgacgatg

SEQ ID NO: 78598 - DNA, 20 bp, human
ggagtctcccccagcccatt

SEQ ID NO: 78599 - DNA, 20 bp, human
gctcccaggagagcctagag

SEQ ID NO: 78600 - DNA, 20 bp, human
gcggggctccgaggacgaga

SEQ ID NO: 78601 - DNA, 20 bp, human
gatgtaaacagaacaggcag

SEQ ID NO: 78602 - DNA, 20 bp, human
gggcggccctgctcgagtca

SEQ ID NO: 78603 - DNA, 20 bp, human
gggcaggggccctgattcac

SEQ ID NO: 78604 - DNA, 20 bp, human
ggagaaggccccctggacaa

SEQ ID NO: 78605 - DNA, 20 bp, human
gccctgtggcagccgagcca

SEQ ID NO: 78606 - DNA, 20 bp, human
gtcccggaggctcctccgaa

SEQ ID NO: 78607 - DNA, 20 bp, human
gcaggtgtctggaggctgaa

SEQ ID NO: 78608 - DNA, 20 bp, human
gttactccccggggtcccgg

SEQ ID NO: 78609 - DNA, 20 bp, human
ggggagtaacaggtgtctgg

SEQ ID NO: 78610 - DNA, 20 bp, human
gcaggcgctcaacaccgagg

SEQ ID NO: 78611 - DNA, 20 bp, human
gtccggcgacgagggctccg

SEQ ID NO: 78612 - DNA, 20 bp, human
gctgcaggcgctcaacaccg

SEQ ID NO: 78613 - DNA, 20 bp, human
ggcgctcaacaccgaggagg

SEQ ID NO: 78614 - DNA, 20 bp, human
ggccgcttgtccggcgacga

SEQ ID NO: 78615 - DNA, 20 bp, human
gctcaacaccgaggaggcgg

SEQ ID NO: 78616 - DNA, 20 bp, human
ggcccaggcacagtgatcac

SEQ ID NO: 78617 - DNA, 20 bp, human
gcggccacctgccctaccct

SEQ ID NO: 78618 - DNA, 20 bp, human
gggggtgggcgcccagggta

SEQ ID NO: 78619 - DNA, 20 bp, human
gggtgaagggaggcctgcaa

SEQ ID NO: 78620 - DNA, 20 bp, human
gccctgggcgcccaccccga

SEQ ID NO: 78621 - DNA, 20 bp, human
ggatgggcaatggtaggtgg

SEQ ID NO: 78622 - DNA, 20 bp, human
gtggtcctacaggccagcac

SEQ ID NO: 78623 - DNA, 20 bp, human
gtggcctagcctctgtgaag

SEQ ID NO: 78624 - DNA, 20 bp, human
gtcctctgggaagatctgct

SEQ ID NO: 78625 - DNA, 20 bp, human
ggggcctgggaggaatagcc

SEQ ID NO: 78626 - DNA, 20 bp, human
gcctcgggcggctgaaggag

SEQ ID NO: 78627 - DNA, 20 bp, human
gagccgcccgaggggaaccg

SEQ ID NO: 78628 - DNA, 20 bp, human
ggcctggcctaggggtcctg

SEQ ID NO: 78629 - DNA, 20 bp, human
gagcctcggttcccctcggg

SEQ ID NO: 78630 - DNA, 20 bp, human
gaggagcctcggttcccctc

SEQ ID NO: 78631 - DNA, 20 bp, human
gcggccgccgccgcatctcc

SEQ ID NO: 78632 - DNA, 20 bp, human
gcaggctgggcgaggcctcg

SEQ ID NO: 78633 - DNA, 20 bp, human
ggctttgctcaatggcgaca

SEQ ID NO: 78634 - DNA, 20 bp, human
ggttgaaagcagataccccg

SEQ ID NO: 78635 - DNA, 20 bp, human
gctcaatggcgacagggcag

SEQ ID NO: 78636 - DNA, 20 bp, human
gtgtcatgggccagttagac

SEQ ID NO: 78637 - DNA, 20 bp, human
gtggaagactgagcttccaa

SEQ ID NO: 78638 - DNA, 20 bp, human
ggtgcaaaagctcagatctg

SEQ ID NO: 78639 - DNA, 20 bp, human
gactgagcttccaaaggtgg

SEQ ID NO: 78640 - DNA, 20 bp, human
gaacactcatcacgcactct

SEQ ID NO: 78641 - DNA, 20 bp, human
gccaatactggacatggaca

SEQ ID NO: 78642 - DNA, 20 bp, human
gaagtaagtataattggaga

SEQ ID NO: 78643 - DNA, 20 bp, human
gaacattgagccaccacctt

SEQ ID NO: 78644 - DNA, 20 bp, human
gtcagaaccaatactggaca

SEQ ID NO: 78645 - DNA, 20 bp, human
gtaatgtcagaattctgtca

SEQ ID NO: 78646 - DNA, 20 bp, human
gtcagaaaacaagctcctca

SEQ ID NO: 78647 - DNA, 20 bp, human
gctcagggcaaatcgtactt

SEQ ID NO: 78648 - DNA, 20 bp, human
ggctgccaggcataatagga

SEQ ID NO: 78649 - DNA, 20 bp, human
ggcactggtgttccgtggaa

SEQ ID NO: 78650 - DNA, 20 bp, human
gatatgttgaatctttccgg

SEQ ID NO: 78651 - DNA, 20 bp, human
gaaaagtcccaaagggagtc

SEQ ID NO: 78652 - DNA, 20 bp, human
gtcatggaagatgccatatt

SEQ ID NO: 78653 - DNA, 20 bp, human
gaggtttctcaaccattcca

SEQ ID NO: 78654 - DNA, 20 bp, human
gtgcatgcactggtgttccg

SEQ ID NO: 78655 - DNA, 20 bp, human
gctggaaatacaacacaaat

SEQ ID NO: 78656 - DNA, 20 bp, human
ggttcagcggcctctttgtg

SEQ ID NO: 78657 - DNA, 20 bp, human
gcacctccgctcccctatct

SEQ ID NO: 78658 - DNA, 20 bp, human
gggagactggaagacaacca

SEQ ID NO: 78659 - DNA, 20 bp, human
gttgtgtggtgcccagatag

SEQ ID NO: 78660 - DNA, 20 bp, human
gatctgggcaccacacaaag

SEQ ID NO: 78661 - DNA, 20 bp, human
gggtcacgaagccaaagcaa

SEQ ID NO: 78662 - DNA, 20 bp, human
ggcgtccgcctcctccacat

SEQ ID NO: 78663 - DNA, 20 bp, human
gagggtgcgcgcgcgttcag

SEQ ID NO: 78664 - DNA, 20 bp, human
gactctgacggactgcgtgg

SEQ ID NO: 78665 - DNA, 20 bp, human
gggtgacgcacgcctcgggg

SEQ ID NO: 78666 - DNA, 20 bp, human
gcgcgcaacaaaggcttggg

SEQ ID NO: 78667 - DNA, 20 bp, human
ggtgcgtcggaaggcgacta

SEQ ID NO: 78668 - DNA, 20 bp, human
gtccgacgcacgcgcaacaa

SEQ ID NO: 78669 - DNA, 20 bp, human
gacaaaggcttgggcggtag

SEQ ID NO: 78670 - DNA, 20 bp, human
gaggcggggtaaaaaagaga

SEQ ID NO: 78671 - DNA, 20 bp, human
gagagagggcgaaggtaggc

SEQ ID NO: 78672 - DNA, 20 bp, human
ggcacgcgcaacaaaggctt

SEQ ID NO: 78673 - DNA, 20 bp, human
gtaggggtgcatctccacaa

SEQ ID NO: 78674 - DNA, 20 bp, human
gggtaaaaaagagagggcga

SEQ ID NO: 78675 - DNA, 20 bp, human
ggccgtcatgtctaagtcag

SEQ ID NO: 78676 - DNA, 20 bp, human
gcggagacataaagccatcc

SEQ ID NO: 78677 - DNA, 20 bp, human
gcgaatgaggcacagcgacc

SEQ ID NO: 78678 - DNA, 20 bp, human
gagccaaaagtgctgaactg

SEQ ID NO: 78679 - DNA, 20 bp, human
ggttcagttgctctcctgga

SEQ ID NO: 78680 - DNA, 20 bp, human
gtgctcggcgtggaactgtc

SEQ ID NO: 78681 - DNA, 20 bp, human
gcactgttcagttgctctcc

SEQ ID NO: 78682 - DNA, 20 bp, human
ggcggtgtttcctagagtct

SEQ ID NO: 78683 - DNA, 20 bp, human
gcagcgacccggcttgtaat

SEQ ID NO: 78684 - DNA, 20 bp, human
gacgcacgctatgtttcctt

SEQ ID NO: 78685 - DNA, 20 bp, human
gctctcttccgtttctggtc

SEQ ID NO: 78686 - DNA, 20 bp, human
gagcagcgccgggtcccgtg

SEQ ID NO: 78687 - DNA, 20 bp, human
ggcggcggcagcggctctag

SEQ ID NO: 78688 - DNA, 20 bp, human
ggaaggttctagaaaagcgg

SEQ ID NO: 78689 - DNA, 20 bp, human
gtacagcgccaggacgagtc

SEQ ID NO: 78690 - DNA, 20 bp, human
gtctagaaaagcggcggcag

SEQ ID NO: 78691 - DNA, 20 bp, human
gagcgccgggtcccgtgcgg

SEQ ID NO: 78692 - DNA, 20 bp, human
ggccccgctggggtgaaagt

SEQ ID NO: 78693 - DNA, 20 bp, human
ggagtccgcgatggaggtaa

SEQ ID NO: 78694 - DNA, 20 bp, human
gagcacctccgcacgggacc

SEQ ID NO: 78695 - DNA, 20 bp, human
gagagttgtttctcgagcag

SEQ ID NO: 78696 - DNA, 20 bp, human
gtaatacctcctccccccgg

SEQ ID NO: 78697 - DNA, 20 bp, human
gtccgggcgagcgagcaagc

SEQ ID NO: 78698 - DNA, 20 bp, human
gggccccggcgggagcggtt

SEQ ID NO: 78699 - DNA, 20 bp, human
gggggggaggaggtattagg

SEQ ID NO: 78700 - DNA, 20 bp, human
ggaccaagccgcgcctccaa

SEQ ID NO: 78701 - DNA, 20 bp, human
gcgagcgagcaagcgggcgg

SEQ ID NO: 78702 - DNA, 20 bp, human
gcggcggatcaatgtcaatg

SEQ ID NO: 78703 - DNA, 20 bp, human
gtgcacaggcggccccttgg

SEQ ID NO: 78704 - DNA, 20 bp, human
gcccggcgggagcggttggg

SEQ ID NO: 78705 - DNA, 20 bp, human
gcctgtgcagccgaaggtga

SEQ ID NO: 78706 - DNA, 20 bp, human
gtataaagggcgccacgagt

SEQ ID NO: 78707 - DNA, 20 bp, human
gccccgagcgggaatcagaa

SEQ ID NO: 78708 - DNA, 20 bp, human
gacggagcttggctgttggt

SEQ ID NO: 78709 - DNA, 20 bp, human
gtggtcggtgggttcccgtg

SEQ ID NO: 78710 - DNA, 20 bp, human
gagtcggcattgtcaggcgg

SEQ ID NO: 78711 - DNA, 20 bp, human
gagcttggctgttggtcggt

SEQ ID NO: 78712 - DNA, 20 bp, human
gggccccgcggcgtcatcgg

SEQ ID NO: 78713 - DNA, 20 bp, human
gcggcggctcctgcaaccag

SEQ ID NO: 78714 - DNA, 20 bp, human
ggcctgacaatgccgactcg

SEQ ID NO: 78715 - DNA, 20 bp, human
ggacatgaggccgtccccga

SEQ ID NO: 78716 - DNA, 20 bp, human
gctacgaccgcgaggactac

SEQ ID NO: 78717 - DNA, 20 bp, human
gcggaggtaatagaaggcat

SEQ ID NO: 78718 - DNA, 20 bp, human
ggactaggccttcgcctcgg

SEQ ID NO: 78719 - DNA, 20 bp, human
gcgcggtcgtagaaaatgaa

SEQ ID NO: 78720 - DNA, 20 bp, human
gtgagggcccggttagttag

SEQ ID NO: 78721 - DNA, 20 bp, human
gggaaagcagccgttaacac

SEQ ID NO: 78722 - DNA, 20 bp, human
gccaggttaaacctatacag

SEQ ID NO: 78723 - DNA, 20 bp, human
gcatgatcccgtagtcctcg

SEQ ID NO: 78724 - DNA, 20 bp, human
gggggactaggccttcgcct

SEQ ID NO: 78725 - DNA, 20 bp, human
gttacatgtaagaagaacgg

SEQ ID NO: 78726 - DNA, 20 bp, human
ggaagagacgaagactgagc

SEQ ID NO: 78727 - DNA, 20 bp, human
gtcatttcagaattcttgtt

SEQ ID NO: 78728 - DNA, 20 bp, human
gggtgtgaaacgatcagcag

SEQ ID NO: 78729 - DNA, 20 bp, human
ggacgaagactgagctggtt

SEQ ID NO: 78730 - DNA, 20 bp, human
gcaggttaatatctacaacc

SEQ ID NO: 78731 - DNA, 20 bp, human
ggttgtcaagaaatcggatg

SEQ ID NO: 78732 - DNA, 20 bp, human
gtacggggagaaactgactg

SEQ ID NO: 78733 - DNA, 20 bp, human
gctcctactgccgggttcta

SEQ ID NO: 78734 - DNA, 20 bp, human
gccaaaaacaggaggcggga

SEQ ID NO: 78735 - DNA, 20 bp, human
gagaaactgactgcggctcg

SEQ ID NO: 78736 - DNA, 20 bp, human
gcgtctggaggcaccgaagg

SEQ ID NO: 78737 - DNA, 20 bp, human
gcggcgccattaaagcgagg

SEQ ID NO: 78738 - DNA, 20 bp, human
gcatggtggcggcgacacag

SEQ ID NO: 78739 - DNA, 20 bp, human
gcgccattaaagcgaggagg

SEQ ID NO: 78740 - DNA, 20 bp, human
gcggcggcgccattaaagcg

SEQ ID NO: 78741 - DNA, 20 bp, human
gaaagaataagcaccagcgg

SEQ ID NO: 78742 - DNA, 20 bp, human
ggcgacacagggggcagcgg

SEQ ID NO: 78743 - DNA, 20 bp, human
gcgccgcggaccacctaaaa

SEQ ID NO: 78744 - DNA, 20 bp, human
gtagtgcagcgggagagagc

SEQ ID NO: 78745 - DNA, 20 bp, human
gaaaaaagaataagcaccag

SEQ ID NO: 78746 - DNA, 20 bp, human
gtggcgcgcagtccgggtcg

SEQ ID NO: 78747 - DNA, 20 bp, human
ggtccgggtcgcggcagcag

SEQ ID NO: 78748 - DNA, 20 bp, human
gagagacccgggaagagtgg

SEQ ID NO: 78749 - DNA, 20 bp, human
ggcggcggcggagcgttgta

SEQ ID NO: 78750 - DNA, 20 bp, human
ggcgccgcgtgggacccggg

SEQ ID NO: 78751 - DNA, 20 bp, human
gtccatagtgacggagctgt

SEQ ID NO: 78752 - DNA, 20 bp, human
gatggcggcggaagagatcc

SEQ ID NO: 78753 - DNA, 20 bp, human
gagacacaatgaagaggcgg

SEQ ID NO: 78754 - DNA, 20 bp, human
gggagctggatttaaaatgg

SEQ ID NO: 78755 - DNA, 20 bp, human
gctcccccccgggtcccacg

SEQ ID NO: 78756 - DNA, 20 bp, human
gccccaccttgaggaagacg

SEQ ID NO: 78757 - DNA, 20 bp, human
gcgggagtgtagagactcgg

SEQ ID NO: 78758 - DNA, 20 bp, human
gctgcgccgcgtcttcctca

SEQ ID NO: 78759 - DNA, 20 bp, human
gcgtccttccggctccgtcg

SEQ ID NO: 78760 - DNA, 20 bp, human
ggagcgggagtgtagagact

SEQ ID NO: 78761 - DNA, 20 bp, human
ggtgctccaagggaccaccg

SEQ ID NO: 78762 - DNA, 20 bp, human
gggtcccttggagcacctag

SEQ ID NO: 78763 - DNA, 20 bp, human
gccttggagcacctagagga

SEQ ID NO: 78764 - DNA, 20 bp, human
gccgcacacccgggacctag

SEQ ID NO: 78765 - DNA, 20 bp, human
gtcctcaaggtggggttcgg

SEQ ID NO: 78766 - DNA, 20 bp, human
gggagcaggagaccaataca

SEQ ID NO: 78767 - DNA, 20 bp, human
gcggagcgcggtccctgtat

SEQ ID NO: 78768 - DNA, 20 bp, human
gaccgcgctccgaggacacg

SEQ ID NO: 78769 - DNA, 20 bp, human
gattggtctcctgctcctag

SEQ ID NO: 78770 - DNA, 20 bp, human
gatacaaacacgatacctct

SEQ ID NO: 78771 - DNA, 20 bp, human
gcgcagccgaggaggaaaaa

SEQ ID NO: 78772 - DNA, 20 bp, human
gacacgatacctctaggagc

SEQ ID NO: 78773 - DNA, 20 bp, human
gtgtcccggcggagggtgga

SEQ ID NO: 78774 - DNA, 20 bp, human
ggcagtttcgagaactaaag

SEQ ID NO: 78775 - DNA, 20 bp, human
gacacgcggcgcagccgagg

SEQ ID NO: 78776 - DNA, 20 bp, human
gggcccgcaccgccccccca

SEQ ID NO: 78777 - DNA, 20 bp, human
gcccccacggagcaaaaacc

SEQ ID NO: 78778 - DNA, 20 bp, human
ggcagttcagcgaccacggt

SEQ ID NO: 78779 - DNA, 20 bp, human
ggtgtctaggtgagtcgcgg

SEQ ID NO: 78780 - DNA, 20 bp, human
gccacggagcaaaaaccggg

SEQ ID NO: 78781 - DNA, 20 bp, human
gccttgacccgcctaacggt

SEQ ID NO: 78782 - DNA, 20 bp, human
ggggccgagagccagcgtag

SEQ ID NO: 78783 - DNA, 20 bp, human
gtcgcgagcgcgggctccac

SEQ ID NO: 78784 - DNA, 20 bp, human
ggcccgacgacggcaggtaa

SEQ ID NO: 78785 - DNA, 20 bp, human
gctggccgacctgaaaggag

SEQ ID NO: 78786 - DNA, 20 bp, human
gacccctaagggtgaccgta

SEQ ID NO: 78787 - DNA, 20 bp, human
gtcaaacggctatagcgaga

SEQ ID NO: 78788 - DNA, 20 bp, human
gatagccgtttgagggaaga

SEQ ID NO: 78789 - DNA, 20 bp, human
ggcttcccggcactgagatg

SEQ ID NO: 78790 - DNA, 20 bp, human
gacgtgagcagaagtagttc

SEQ ID NO: 78791 - DNA, 20 bp, human
gcttacagacaatcaggcag

SEQ ID NO: 78792 - DNA, 20 bp, human
gcgcagcacaggcggcttcc

SEQ ID NO: 78793 - DNA, 20 bp, human
gcctccccttacagacaatc

SEQ ID NO: 78794 - DNA, 20 bp, human
gagtgctggtctatccattc

SEQ ID NO: 78795 - DNA, 20 bp, human
gcggtctcgggggaccccta

SEQ ID NO: 78796 - DNA, 20 bp, human
gttctcccaaccgtctccag

SEQ ID NO: 78797 - DNA, 20 bp, human
gcgggagaaggacgaaaggc

SEQ ID NO: 78798 - DNA, 20 bp, human
gtgtcaccgctggagacggt

SEQ ID NO: 78799 - DNA, 20 bp, human
gcgtgtagcgctcgccacaa

SEQ ID NO: 78800 - DNA, 20 bp, human
ggacgccgaggcccgaagta

SEQ ID NO: 78801 - DNA, 20 bp, human
gtgctgcgcagctccctaag

SEQ ID NO: 78802 - DNA, 20 bp, human
gcagccccgccgcttccaag

SEQ ID NO: 78803 - DNA, 20 bp, human
gcggggtccagttcaaagaa

SEQ ID NO: 78804 - DNA, 20 bp, human
gaccccgcgagcaccagagt

SEQ ID NO: 78805 - DNA, 20 bp, human
gcgcgccactgtacccaaaa

SEQ ID NO: 78806 - DNA, 20 bp, human
ggtctagctccgaccggctg

SEQ ID NO: 78807 - DNA, 20 bp, human
ggcgcgaacgagaaaggagg

SEQ ID NO: 78808 - DNA, 20 bp, human
gtagctccgaccggctgagg

SEQ ID NO: 78809 - DNA, 20 bp, human
ggtgagtgcgcgaacgagaa

SEQ ID NO: 78810 - DNA, 20 bp, human
gcgggctgggaggccactaa

SEQ ID NO: 78811 - DNA, 20 bp, human
ggctcacacaaagagagcgg

SEQ ID NO: 78812 - DNA, 20 bp, human
ggcccgagacaaagccatcg

SEQ ID NO: 78813 - DNA, 20 bp, human
gggagacccaaggtgaggcg

SEQ ID NO: 78814 - DNA, 20 bp, human
gaagcggccaaacaccaaag

SEQ ID NO: 78815 - DNA, 20 bp, human
gagtctctaggaccacaacg

SEQ ID NO: 78816 - DNA, 20 bp, human
gattttattttaaggcggcg

SEQ ID NO: 78817 - DNA, 20 bp, human
gaccagtggctccccctatc

SEQ ID NO: 78818 - DNA, 20 bp, human
ggacgccgcttctccgcccg

SEQ ID NO: 78819 - DNA, 20 bp, human
gagcagcctccgcgacatgg

SEQ ID NO: 78820 - DNA, 20 bp, human
gctgcgccgccatgtcgcgg

SEQ ID NO: 78821 - DNA, 20 bp, human
gcggaggctgctgccccggg

SEQ ID NO: 78822 - DNA, 20 bp, human
ggtgtccctcccccaatgag

SEQ ID NO: 78823 - DNA, 20 bp, human
ggcggccgttgggcaaacgg

SEQ ID NO: 78824 - DNA, 20 bp, human
ggcggtggccgctactacgg

SEQ ID NO: 78825 - DNA, 20 bp, human
ggcagaggaagtagctcgtg

SEQ ID NO: 78826 - DNA, 20 bp, human
gccagcccctaccagctcgg

SEQ ID NO: 78827 - DNA, 20 bp, human
gctcgccgccgagctggtag

SEQ ID NO: 78828 - DNA, 20 bp, human
ggccaacggaacagagacgg

SEQ ID NO: 78829 - DNA, 20 bp, human
ggcgcacggccggagcacgg

SEQ ID NO: 78830 - DNA, 20 bp, human
ggaagatccgaccacgccaa

SEQ ID NO: 78831 - DNA, 20 bp, human
gcgatccgggacggccggtc

SEQ ID NO: 78832 - DNA, 20 bp, human
ggatcgaaaagagcagacac

SEQ ID NO: 78833 - DNA, 20 bp, human
ggccggcggcctggaacgtg

SEQ ID NO: 78834 - DNA, 20 bp, human
gcgagcctgaccggccgtcc

SEQ ID NO: 78835 - DNA, 20 bp, human
ggctcggcggcgagcctgac

SEQ ID NO: 78836 - DNA, 20 bp, human
gcagggagcggagacggagg

SEQ ID NO: 78837 - DNA, 20 bp, human
gcgctcctccgggcagggag

SEQ ID NO: 78838 - DNA, 20 bp, human
ggctcggtaattgagaggag

SEQ ID NO: 78839 - DNA, 20 bp, human
ggcccggaggagcgaatcta

SEQ ID NO: 78840 - DNA, 20 bp, human
ggcgtctcaagaccgaggag

SEQ ID NO: 78841 - DNA, 20 bp, human
ggccaagcgtctcaagaccg

SEQ ID NO: 78842 - DNA, 20 bp, human
gtaccggctgagagaagctc

SEQ ID NO: 78843 - DNA, 20 bp, human
gtgttggctcggtaattgag

SEQ ID NO: 78844 - DNA, 20 bp, human
gtcgactactcggccgagga

SEQ ID NO: 78845 - DNA, 20 bp, human
gcccagggagacgtacgagg

SEQ ID NO: 78846 - DNA, 20 bp, human
ggcgacggagatcaaaatgg

SEQ ID NO: 78847 - DNA, 20 bp, human
gccagacgcggagaaaatgg

SEQ ID NO: 78848 - DNA, 20 bp, human
gatggcggcaggggtcgaag

SEQ ID NO: 78849 - DNA, 20 bp, human
ggcggcgacggagatcaaaa

SEQ ID NO: 78850 - DNA, 20 bp, human
gagcccagacgcggagaaaa

SEQ ID NO: 78851 - DNA, 20 bp, human
ggcggtcgggtaggcctcgg

SEQ ID NO: 78852 - DNA, 20 bp, human
gccccgaggtcaccctcccg

SEQ ID NO: 78853 - DNA, 20 bp, human
gctcacacaaagcccagacg

SEQ ID NO: 78854 - DNA, 20 bp, human
gggagcggtcgggtaggcct

SEQ ID NO: 78855 - DNA, 20 bp, human
gaggccgccaacagacctaa

SEQ ID NO: 78856 - DNA, 20 bp, human
ggctgctgctagagagctag

SEQ ID NO: 78857 - DNA, 20 bp, human
gacaccaggagggcccaaag

SEQ ID NO: 78858 - DNA, 20 bp, human
ggcactgtcattctcacctg

SEQ ID NO: 78859 - DNA, 20 bp, human
gatcacctgaataaaggcat

SEQ ID NO: 78860 - DNA, 20 bp, human
gcagctgtgcaaacaccagg

SEQ ID NO: 78861 - DNA, 20 bp, human
gtgggaaacataggtcccgc

SEQ ID NO: 78862 - DNA, 20 bp, human
gctgcaggtctcctgaccac

SEQ ID NO: 78863 - DNA, 20 bp, human
gtgaataaaggcatcggaat

SEQ ID NO: 78864 - DNA, 20 bp, human
gcagcagctgtgcaaacacc

SEQ ID NO: 78865 - DNA, 20 bp, human
gggagggcccaaaggggtct

SEQ ID NO: 78866 - DNA, 20 bp, human
ggccggcgcgagactcacca

SEQ ID NO: 78867 - DNA, 20 bp, human
gactcaccagggcagagcgg

SEQ ID NO: 78868 - DNA, 20 bp, human
ggcctcgcgctgattctcac

SEQ ID NO: 78869 - DNA, 20 bp, human
gcggccggcctagcccgaga

SEQ ID NO: 78870 - DNA, 20 bp, human
gtcatcagcacatccctctc

SEQ ID NO: 78871 - DNA, 20 bp, human
gtgcggccggatcccgcgaa

SEQ ID NO: 78872 - DNA, 20 bp, human
gccggcggggagaagcggca

SEQ ID NO: 78873 - DNA, 20 bp, human
ggggagcgaagcggctccgg

SEQ ID NO: 78874 - DNA, 20 bp, human
gtctcgcgccggcccgtggg

SEQ ID NO: 78875 - DNA, 20 bp, human
gtcgcgtctcagtccatcag

SEQ ID NO: 78876 - DNA, 20 bp, human
gcgaactcggtgaaaggaat

SEQ ID NO: 78877 - DNA, 20 bp, human
gggatccgcctggtgtcgaa

SEQ ID NO: 78878 - DNA, 20 bp, human
gatgggttcgtgctgcagag

SEQ ID NO: 78879 - DNA, 20 bp, human
gcgagttcgcgagggagacg

SEQ ID NO: 78880 - DNA, 20 bp, human
gggcgccgttcgacaccagg

SEQ ID NO: 78881 - DNA, 20 bp, human
ggcggccggcggcgatgaag

SEQ ID NO: 78882 - DNA, 20 bp, human
gggaatccccgcccaggtct

SEQ ID NO: 78883 - DNA, 20 bp, human
gtcgggagcaggcctcgagc

SEQ ID NO: 78884 - DNA, 20 bp, human
ggaccagatggagctaggag

SEQ ID NO: 78885 - DNA, 20 bp, human
gggagcaggcctcgagcagg

SEQ ID NO: 78886 - DNA, 20 bp, human
gcttcgcctcctgacaggaa

SEQ ID NO: 78887 - DNA, 20 bp, human
gaggaggtcgagaccgaggg

SEQ ID NO: 78888 - DNA, 20 bp, human
ggagacgacctgaggatcgg

SEQ ID NO: 78889 - DNA, 20 bp, human
gcgaggagcctgacgacgag

SEQ ID NO: 78890 - DNA, 20 bp, human
gagccgcacgcggagcccgg

SEQ ID NO: 78891 - DNA, 20 bp, human
gagtccagcgcctgaggtcg

SEQ ID NO: 78892 - DNA, 20 bp, human
gctggacactcgaggcctca

SEQ ID NO: 78893 - DNA, 20 bp, human
gggtcgccccggttcgtcgt

SEQ ID NO: 78894 - DNA, 20 bp, human
gggagcccggcggctactcg

SEQ ID NO: 78895 - DNA, 20 bp, human
gtcccccttcgcctcctgac

SEQ ID NO: 78896 - DNA, 20 bp, human
gcgacggttcgcaggggagg

SEQ ID NO: 78897 - DNA, 20 bp, human
gcccgcggctggggaaccaa

SEQ ID NO: 78898 - DNA, 20 bp, human
gggctgcgcggcctgaccca

SEQ ID NO: 78899 - DNA, 20 bp, human
gggtcaggcggggtaaatgg

SEQ ID NO: 78900 - DNA, 20 bp, human
gcaaggtggatctggcgcag

SEQ ID NO: 78901 - DNA, 20 bp, human
gctcggtcgacggttcgcag

SEQ ID NO: 78902 - DNA, 20 bp, human
gagatgctcgaggacgaggc

SEQ ID NO: 78903 - DNA, 20 bp, human
gcagggcctcggcaagaggg

SEQ ID NO: 78904 - DNA, 20 bp, human
ggactcgcgcggcctcaagg

SEQ ID NO: 78905 - DNA, 20 bp, human
ggcccttggttccccagccg

SEQ ID NO: 78906 - DNA, 20 bp, human
gagcccagccaggtttccac

SEQ ID NO: 78907 - DNA, 20 bp, human
gaggagggcccagatcccac

SEQ ID NO: 78908 - DNA, 20 bp, human
gtgggtgttcccagggtcag

SEQ ID NO: 78909 - DNA, 20 bp, human
gcagagctgggaattgtggg

SEQ ID NO: 78910 - DNA, 20 bp, human
gccccagtggccacaagtca

SEQ ID NO: 78911 - DNA, 20 bp, human
gccacgggcagttctgaggt

SEQ ID NO: 78912 - DNA, 20 bp, human
gggagcttgtccaggaatgt

SEQ ID NO: 78913 - DNA, 20 bp, human
gatcccactggagataccga

SEQ ID NO: 78914 - DNA, 20 bp, human
ggatgctgggtccccaagtc

SEQ ID NO: 78915 - DNA, 20 bp, human
gcagtggccacaagtcaggg

SEQ ID NO: 78916 - DNA, 20 bp, human
ggctagcgcggcggcagagt

SEQ ID NO: 78917 - DNA, 20 bp, human
gcggcgtgaagctagcgcgg

SEQ ID NO: 78918 - DNA, 20 bp, human
ggccagccgccagcctctag

SEQ ID NO: 78919 - DNA, 20 bp, human
gcagcgcgagcacctggtgt

SEQ ID NO: 78920 - DNA, 20 bp, human
gcgtgagagacgaggagtag

SEQ ID NO: 78921 - DNA, 20 bp, human
gggaggaggctgtggcggtc

SEQ ID NO: 78922 - DNA, 20 bp, human
gcacgccggcggcgctgacc

SEQ ID NO: 78923 - DNA, 20 bp, human
gagcagcagccgcaaggcgg

SEQ ID NO: 78924 - DNA, 20 bp, human
gcccgcctccggctaccgcc

SEQ ID NO: 78925 - DNA, 20 bp, human
ggcggggcccggggaatgtg

SEQ ID NO: 78926 - DNA, 20 bp, human
ggcagccccgcggaatggag

SEQ ID NO: 78927 - DNA, 20 bp, human
gccggcgccgctccattccg

SEQ ID NO: 78928 - DNA, 20 bp, human
gccccgtgcccgggctgtat

SEQ ID NO: 78929 - DNA, 20 bp, human
gcccaggggcgaagagaccg

SEQ ID NO: 78930 - DNA, 20 bp, human
ggccgcgcagccccgcggaa

SEQ ID NO: 78931 - DNA, 20 bp, human
gcagggcaccggtccccgtc

SEQ ID NO: 78932 - DNA, 20 bp, human
gtgacccgcgccctccgccg

SEQ ID NO: 78933 - DNA, 20 bp, human
gcgcggccccgcagtccctc

SEQ ID NO: 78934 - DNA, 20 bp, human
gtggagttgactgcgcccag

SEQ ID NO: 78935 - DNA, 20 bp, human
gggctcactcaccccatctc

SEQ ID NO: 78936 - DNA, 20 bp, human
gccggccgcgatgggaccgg

SEQ ID NO: 78937 - DNA, 20 bp, human
gccccaaagctgcggacctg

SEQ ID NO: 78938 - DNA, 20 bp, human
ggccgcgatgggaccggagg

SEQ ID NO: 78939 - DNA, 20 bp, human
ggttggaggaggctgcgaag

SEQ ID NO: 78940 - DNA, 20 bp, human
ggtctgagaggggactgcgt

SEQ ID NO: 78941 - DNA, 20 bp, human
gcccggacccagggactgga

SEQ ID NO: 78942 - DNA, 20 bp, human
ggacaaaggcacgggcggcg

SEQ ID NO: 78943 - DNA, 20 bp, human
gggaccggccgcgatgggac

SEQ ID NO: 78944 - DNA, 20 bp, human
gaaaggcacgggcggcgtgg

SEQ ID NO: 78945 - DNA, 20 bp, human
gggagtctaggacaacgcgg

SEQ ID NO: 78946 - DNA, 20 bp, human
ggggagaccgtacacgagct

SEQ ID NO: 78947 - DNA, 20 bp, human
gctgggaggggaagtccaag

SEQ ID NO: 78948 - DNA, 20 bp, human
ggcgctcccggggacggtgg

SEQ ID NO: 78949 - DNA, 20 bp, human
gtgggacgataagccccatg

SEQ ID NO: 78950 - DNA, 20 bp, human
gcccagcgatggccgaaacc

SEQ ID NO: 78951 - DNA, 20 bp, human
gggagggtgagtgtctgtgt

SEQ ID NO: 78952 - DNA, 20 bp, human
gtaggggagggcaagaaggt

SEQ ID NO: 78953 - DNA, 20 bp, human
gagggaaccgaaaagtccag

SEQ ID NO: 78954 - DNA, 20 bp, human
gccctgctcgagcaagttgg

SEQ ID NO: 78955 - DNA, 20 bp, human
gcagccctgctcgagcaagt

SEQ ID NO: 78956 - DNA, 20 bp, human
gggtcgacgggcaggtgtgt

SEQ ID NO: 78957 - DNA, 20 bp, human
gctcctggaggagagccggt

SEQ ID NO: 78958 - DNA, 20 bp, human
gtctgggagcgtaacagtgg

SEQ ID NO: 78959 - DNA, 20 bp, human
gcaagggcacgaggtgagaa

SEQ ID NO: 78960 - DNA, 20 bp, human
gctcctaccggctctcctcc

SEQ ID NO: 78961 - DNA, 20 bp, human
gtcatgaggctgtcgcacag

SEQ ID NO: 78962 - DNA, 20 bp, human
gatgccacctgcgggtcgac

SEQ ID NO: 78963 - DNA, 20 bp, human
gtgagtgcgaggaggcgaga

SEQ ID NO: 78964 - DNA, 20 bp, human
gccaggcaggtcgaatcctc

SEQ ID NO: 78965 - DNA, 20 bp, human
gctggtaccgagctttcctg

SEQ ID NO: 78966 - DNA, 20 bp, human
gtcgctggtggcggacccgg

SEQ ID NO: 78967 - DNA, 20 bp, human
gcgagtcacctgggccccac

SEQ ID NO: 78968 - DNA, 20 bp, human
gcgctcgctggtggcggacc

SEQ ID NO: 78969 - DNA, 20 bp, human
gaaccagggccagggatccc

SEQ ID NO: 78970 - DNA, 20 bp, human
gtggacgcgcagggtttgtt

SEQ ID NO: 78971 - DNA, 20 bp, human
gaccctgcgcgtccaggcca

SEQ ID NO: 78972 - DNA, 20 bp, human
gctaggccgagcgggaggtc

SEQ ID NO: 78973 - DNA, 20 bp, human
ggctcacctgagaccggagg

SEQ ID NO: 78974 - DNA, 20 bp, human
gtgcgggcgctcgctggtgg

SEQ ID NO: 78975 - DNA, 20 bp, human
gggtttgttgggcagaggtg

SEQ ID NO: 78976 - DNA, 20 bp, human
ggagcaccgaggacctacta

SEQ ID NO: 78977 - DNA, 20 bp, human
gaagagcccagccagaccat

SEQ ID NO: 78978 - DNA, 20 bp, human
gtcacctcgcaggctcgctg

SEQ ID NO: 78979 - DNA, 20 bp, human
gggagagtggagctaggggc

SEQ ID NO: 78980 - DNA, 20 bp, human
ggtgctgcgtctccaacccg

SEQ ID NO: 78981 - DNA, 20 bp, human
ggggaacctgaacccgtagt

SEQ ID NO: 78982 - DNA, 20 bp, human
gtgaacccgtagtaggtcct

SEQ ID NO: 78983 - DNA, 20 bp, human
gtccgagctgcgggcccagg

SEQ ID NO: 78984 - DNA, 20 bp, human
gaaccgcgcgcgccacgggt

SEQ ID NO: 78985 - DNA, 20 bp, human
gagtgggcacaggcactaag

SEQ ID NO: 78986 - DNA, 20 bp, human
ggccagcgctgggcgagagt

SEQ ID NO: 78987 - DNA, 20 bp, human
gggcgactctgggatccgtg

SEQ ID NO: 78988 - DNA, 20 bp, human
ggcgcgtggagggtcccggt

SEQ ID NO: 78989 - DNA, 20 bp, human
gtctcgcccagcgctggcag

SEQ ID NO: 78990 - DNA, 20 bp, human
gagcgctgggcgagagtcgg

SEQ ID NO: 78991 - DNA, 20 bp, human
ggcccccacgtacccaagtg

SEQ ID NO: 78992 - DNA, 20 bp, human
gaacagcgacgcctcaggcc

SEQ ID NO: 78993 - DNA, 20 bp, human
ggcgcgcggtcccgagtgaa

SEQ ID NO: 78994 - DNA, 20 bp, human
gggtccgagagagacttgcc

SEQ ID NO: 78995 - DNA, 20 bp, human
ggagtcggcggccggatccg

SEQ ID NO: 78996 - DNA, 20 bp, human
gaaaggcaagcgcaagccct

SEQ ID NO: 78997 - DNA, 20 bp, human
gaaaggtacttacgtggaag

SEQ ID NO: 78998 - DNA, 20 bp, human
gcctttgaaaggtacttacg

SEQ ID NO: 78999 - DNA, 20 bp, human
ggaagtgagggagctgtctc

SEQ ID NO: 79000 - DNA, 20 bp, human
gaggtctgccttttatgcag

SEQ ID NO: 79001 - DNA, 20 bp, human
gtgtttgacaaggggaagtg

SEQ ID NO: 79002 - DNA, 20 bp, human
gaaaactgcatggggtcgag

SEQ ID NO: 79003 - DNA, 20 bp, human
gcatggggtcgaggggaatt

SEQ ID NO: 79004 - DNA, 20 bp, human
gatctgttggaaaacggtag

SEQ ID NO: 79005 - DNA, 20 bp, human
ggaaaacggtagaggtgaaa

SEQ ID NO: 79006 - DNA, 20 bp, human
gcgcgcagggaccatgtcgg

SEQ ID NO: 79007 - DNA, 20 bp, human
gcgcagctcccggggaacca

SEQ ID NO: 79008 - DNA, 20 bp, human
gaccgcgagcggccccacag

SEQ ID NO: 79009 - DNA, 20 bp, human
ggagctgcgcagaaacccct

SEQ ID NO: 79010 - DNA, 20 bp, human
ggggaaccacggctggatgg

SEQ ID NO: 79011 - DNA, 20 bp, human
gggaccgcccagccgcgaga

SEQ ID NO: 79012 - DNA, 20 bp, human
gcccgcttccccgctcccat

SEQ ID NO: 79013 - DNA, 20 bp, human
ggaaaggactggtgaccgag

SEQ ID NO: 79014 - DNA, 20 bp, human
gagaagcgatgggagatcat

SEQ ID NO: 79015 - DNA, 20 bp, human
gggcgggacgcagcgaagga

SEQ ID NO: 79016 - DNA, 20 bp, human
ggtgcagctcttctggtctc

SEQ ID NO: 79017 - DNA, 20 bp, human
gcagcctcgtgcagctcttc

SEQ ID NO: 79018 - DNA, 20 bp, human
gttacattacgtctgagggg

SEQ ID NO: 79019 - DNA, 20 bp, human
gaggaaagcgcatgcgcgtc

SEQ ID NO: 79020 - DNA, 20 bp, human
gtgtccggaaccactgtgtc

SEQ ID NO: 79021 - DNA, 20 bp, human
gtcttgagatggggtgagta

SEQ ID NO: 79022 - DNA, 20 bp, human
gcttcaacggtcacccgctg

SEQ ID NO: 79023 - DNA, 20 bp, human
gtatattacattacgtctga

SEQ ID NO: 79024 - DNA, 20 bp, human
gacccgctggggcgcgacag

SEQ ID NO: 79025 - DNA, 20 bp, human
gcctctgttgacaagtaagt

SEQ ID NO: 79026 - DNA, 20 bp, human
gacgcccgagtgccctctct

SEQ ID NO: 79027 - DNA, 20 bp, human
gcgtcgacgagctgaggtga

SEQ ID NO: 79028 - DNA, 20 bp, human
ggtccctcgggtcctaacct

SEQ ID NO: 79029 - DNA, 20 bp, human
gttaggacccgagggaccgt

SEQ ID NO: 79030 - DNA, 20 bp, human
gactgtgaagagaatcggga

SEQ ID NO: 79031 - DNA, 20 bp, human
gcgccgaggttaggacccga

SEQ ID NO: 79032 - DNA, 20 bp, human
gcgcggggcggcgtagggga

SEQ ID NO: 79033 - DNA, 20 bp, human
gcacggccccctccaatgtc

SEQ ID NO: 79034 - DNA, 20 bp, human
gctgtaccaggcatcgatcc

SEQ ID NO: 79035 - DNA, 20 bp, human
gtcccagagaggtctgaggc

SEQ ID NO: 79036 - DNA, 20 bp, human
gttcttctccggccccatgg

SEQ ID NO: 79037 - DNA, 20 bp, human
gggaagcagacgtaagtggt

SEQ ID NO: 79038 - DNA, 20 bp, human
gcaagttgtggtccaagcta

SEQ ID NO: 79039 - DNA, 20 bp, human
gccccctgcccactaggaag

SEQ ID NO: 79040 - DNA, 20 bp, human
ggcgacgaccgcttcctagt

SEQ ID NO: 79041 - DNA, 20 bp, human
ggcttggaccacaacttgag

SEQ ID NO: 79042 - DNA, 20 bp, human
gaacagcgggagcgcactgg

SEQ ID NO: 79043 - DNA, 20 bp, human
gttaacgcgtaggggctgta

SEQ ID NO: 79044 - DNA, 20 bp, human
gaggttcccggaagtctggt

SEQ ID NO: 79045 - DNA, 20 bp, human
gaagttggcacagtcacgcc

SEQ ID NO: 79046 - DNA, 20 bp, human
ggcaatgaggcagcgtcgcc

SEQ ID NO: 79047 - DNA, 20 bp, human
gcgcagctctgcagcccgta

SEQ ID NO: 79048 - DNA, 20 bp, human
gcccgtcaggcggctccatc

SEQ ID NO: 79049 - DNA, 20 bp, human
ggctccatccggcaagaccg

SEQ ID NO: 79050 - DNA, 20 bp, human
gtgcagcccgtagggcaggt

SEQ ID NO: 79051 - DNA, 20 bp, human
gtgcgcgaaagagcacgagg

SEQ ID NO: 79052 - DNA, 20 bp, human
gagcccgtagggcaggtcgg

SEQ ID NO: 79053 - DNA, 20 bp, human
gcgtctagccacaggtctat

SEQ ID NO: 79054 - DNA, 20 bp, human
gaagaaatgtcagccagaaa

SEQ ID NO: 79055 - DNA, 20 bp, human
gggcaggtagaccccgccgt

SEQ ID NO: 79056 - DNA, 20 bp, human
gtcacggatccgcttcaaag

SEQ ID NO: 79057 - DNA, 20 bp, human
ggtggggtggtggtagacgt

SEQ ID NO: 79058 - DNA, 20 bp, human
gatagcaccgtgggcaggaa

SEQ ID NO: 79059 - DNA, 20 bp, human
gcgcgcacgggttggacctg

SEQ ID NO: 79060 - DNA, 20 bp, human
gaaattggacgagactgcgg

SEQ ID NO: 79061 - DNA, 20 bp, human
gttcaaagaggcagctgcag

SEQ ID NO: 79062 - DNA, 20 bp, human
gggctactgcggagagccca

SEQ ID NO: 79063 - DNA, 20 bp, human
gcccacggtgctatagaaat

SEQ ID NO: 79064 - DNA, 20 bp, human
gggcgcgaagacggggtctg

SEQ ID NO: 79065 - DNA, 20 bp, human
gctggcccactgctactccg

SEQ ID NO: 79066 - DNA, 20 bp, human
gcgtagagaaacatgacggt

SEQ ID NO: 79067 - DNA, 20 bp, human
gggacctcccgaggacgacg

SEQ ID NO: 79068 - DNA, 20 bp, human
gggtgggctcgatccagcgg

SEQ ID NO: 79069 - DNA, 20 bp, human
ggacggtgggctcgatccag

SEQ ID NO: 79070 - DNA, 20 bp, human
gtgcagcccctgctcggcag

SEQ ID NO: 79071 - DNA, 20 bp, human
gcctcccgaggacgacgcgg

SEQ ID NO: 79072 - DNA, 20 bp, human
gttgtcgtagagaaacatga

SEQ ID NO: 79073 - DNA, 20 bp, human
gcagcggcggcagccgacgg

SEQ ID NO: 79074 - DNA, 20 bp, human
ggcagggggcaacttctcgg

SEQ ID NO: 79075 - DNA, 20 bp, human
ggcagcggcgcagagctcgt

SEQ ID NO: 79076 - DNA, 20 bp, human
gtagtagcgcggtccccata

SEQ ID NO: 79077 - DNA, 20 bp, human
gccctggatgaaggagaaga

SEQ ID NO: 79078 - DNA, 20 bp, human
gtcatccaggggtactcggg

SEQ ID NO: 79079 - DNA, 20 bp, human
ggcagccgcccgagtacccc

SEQ ID NO: 79080 - DNA, 20 bp, human
gccggcagtcaccctcgcca

SEQ ID NO: 79081 - DNA, 20 bp, human
gccttcatccaggggtactc

SEQ ID NO: 79082 - DNA, 20 bp, human
gaggaaaaaggcgagcgcag

SEQ ID NO: 79083 - DNA, 20 bp, human
gcactgattacagccgtatg

SEQ ID NO: 79084 - DNA, 20 bp, human
gtggtctgctcaaaaggagg

SEQ ID NO: 79085 - DNA, 20 bp, human
gggcgggcaccgggctgccg

SEQ ID NO: 79086 - DNA, 20 bp, human
gcaagcgacagctgtcagag

SEQ ID NO: 79087 - DNA, 20 bp, human
ggaaggcagagctccgaagc

SEQ ID NO: 79088 - DNA, 20 bp, human
gtgggagagggcacccaggg

SEQ ID NO: 79089 - DNA, 20 bp, human
gacagccgagcccggctgga

SEQ ID NO: 79090 - DNA, 20 bp, human
gagtgtgaatgggtgagtat

SEQ ID NO: 79091 - DNA, 20 bp, human
ggagcgcgcccaatctccag

SEQ ID NO: 79092 - DNA, 20 bp, human
gggagcggagcaaaagaatg

SEQ ID NO: 79093 - DNA, 20 bp, human
gtgggtgagtatgggtaagg

SEQ ID NO: 79094 - DNA, 20 bp, human
gaagcacagccgagcccggc

SEQ ID NO: 79095 - DNA, 20 bp, human
ggcagagctccgaagcaggc

SEQ ID NO: 79096 - DNA, 20 bp, human
gccgtgctggagcagcgagg

SEQ ID NO: 79097 - DNA, 20 bp, human
ggctcgcccagggccgactg

SEQ ID NO: 79098 - DNA, 20 bp, human
gcgctcccggcgctgaatgg

SEQ ID NO: 79099 - DNA, 20 bp, human
gccctcagcatcagccgaga

SEQ ID NO: 79100 - DNA, 20 bp, human
gcggcggtgaccgggcctcg

SEQ ID NO: 79101 - DNA, 20 bp, human
ggtcaccgccgcgcagagcg

SEQ ID NO: 79102 - DNA, 20 bp, human
gctgcaacccagaaaagtta

SEQ ID NO: 79103 - DNA, 20 bp, human
gctccagcacggctcgccca

SEQ ID NO: 79104 - DNA, 20 bp, human
ggaggcggccacgctctgcg

SEQ ID NO: 79105 - DNA, 20 bp, human
gggccctgggcgagccgtgc

SEQ ID NO: 79106 - DNA, 20 bp, human
gcgcagcccgggtcagatgg

SEQ ID NO: 79107 - DNA, 20 bp, human
gaggagtacgcgcagcacag

SEQ ID NO: 79108 - DNA, 20 bp, human
ggtccgcggcgcgtagtagg

SEQ ID NO: 79109 - DNA, 20 bp, human
gcccaagcggcgccacgtac

SEQ ID NO: 79110 - DNA, 20 bp, human
ggctgcgcgtactcctcgaa

SEQ ID NO: 79111 - DNA, 20 bp, human
ggcgcgtagtaggaggcagt

SEQ ID NO: 79112 - DNA, 20 bp, human
gagcccccggcgcaagccaa

SEQ ID NO: 79113 - DNA, 20 bp, human
ggccgccgcggtagccatag

SEQ ID NO: 79114 - DNA, 20 bp, human
gcgcgtactcctcgaaggga

SEQ ID NO: 79115 - DNA, 20 bp, human
gcgcccgcgtgagggagctg

SEQ ID NO: 79116 - DNA, 20 bp, human
gggtacggctacggctacaa

SEQ ID NO: 79117 - DNA, 20 bp, human
gactccctaagcaactccag

SEQ ID NO: 79118 - DNA, 20 bp, human
gactcggcgagcatgcactc

SEQ ID NO: 79119 - DNA, 20 bp, human
ggcgccgctggagttgctta

SEQ ID NO: 79120 - DNA, 20 bp, human
ggcatgcactccggcaggta

SEQ ID NO: 79121 - DNA, 20 bp, human
ggcggcgcctcggccgacgc

SEQ ID NO: 79122 - DNA, 20 bp, human
gaaagtggccggagcccgag

SEQ ID NO: 79123 - DNA, 20 bp, human
gccctctctgctgctgatgt

SEQ ID NO: 79124 - DNA, 20 bp, human
ggcggagcagggcagcggat

SEQ ID NO: 79125 - DNA, 20 bp, human
gtggccggctggctgtacct

SEQ ID NO: 79126 - DNA, 20 bp, human
gggaggacccgagtctataa

SEQ ID NO: 79127 - DNA, 20 bp, human
gccagcaagcagggtagagg

SEQ ID NO: 79128 - DNA, 20 bp, human
gctacaggcctcaggactac

SEQ ID NO: 79129 - DNA, 20 bp, human
ggcttgctgggaaatctctg

SEQ ID NO: 79130 - DNA, 20 bp, human
gagcccaaagcacacaggtg

SEQ ID NO: 79131 - DNA, 20 bp, human
gggtgagaatggccacccca

SEQ ID NO: 79132 - DNA, 20 bp, human
gcctgtgcaaccagtctcca

SEQ ID NO: 79133 - DNA, 20 bp, human
gctgcagctggcgccggtcc

SEQ ID NO: 79134 - DNA, 20 bp, human
gtagcgagctggctggaccg

SEQ ID NO: 79135 - DNA, 20 bp, human
gcgagctggctggaccgagg

SEQ ID NO: 79136 - DNA, 20 bp, human
gacctgaagaccgcatccag

SEQ ID NO: 79137 - DNA, 20 bp, human
gcctgcgacaagacggacga

SEQ ID NO: 79138 - DNA, 20 bp, human
ggggtttggtgtaaatctgg

SEQ ID NO: 79139 - DNA, 20 bp, human
gaaaggcgcctgcgacaaga

SEQ ID NO: 79140 - DNA, 20 bp, human
ggctccgtccaaaagaaaat

SEQ ID NO: 79141 - DNA, 20 bp, human
ggagggcgcgctgcatggcg

SEQ ID NO: 79142 - DNA, 20 bp, human
ggcctgggcgccgacgccta

SEQ ID NO: 79143 - DNA, 20 bp, human
ggccgtagccggacgcaaag

SEQ ID NO: 79144 - DNA, 20 bp, human
gaaaggggctctgataaagg

SEQ ID NO: 79145 - DNA, 20 bp, human
gctgccggacaacaaatcac

SEQ ID NO: 79146 - DNA, 20 bp, human
gaggagagcgcaccgggcgt

SEQ ID NO: 79147 - DNA, 20 bp, human
gcccgcgaaggagagcgcac

SEQ ID NO: 79148 - DNA, 20 bp, human
gcaccccttctggccgacag

SEQ ID NO: 79149 - DNA, 20 bp, human
gctggagggcaagcccgcga

SEQ ID NO: 79150 - DNA, 20 bp, human
gtgccataaggccggctgga

SEQ ID NO: 79151 - DNA, 20 bp, human
gacggtgatggccaccactg

SEQ ID NO: 79152 - DNA, 20 bp, human
gcaggcgctgggcacggtga

SEQ ID NO: 79153 - DNA, 20 bp, human
gagctgcacgggctgaagtc

SEQ ID NO: 79154 - DNA, 20 bp, human
gccgtgcagcttccagtcca

SEQ ID NO: 79155 - DNA, 20 bp, human
gaaacaccgtcgccttggac

SEQ ID NO: 79156 - DNA, 20 bp, human
ggcagtatgtcacagcgctg

SEQ ID NO: 79157 - DNA, 20 bp, human
gatactgccgaaaggttgta

SEQ ID NO: 79158 - DNA, 20 bp, human
ggctgggccccgtagctcga

SEQ ID NO: 79159 - DNA, 20 bp, human
ggtcaatcagaaggagacgg

SEQ ID NO: 79160 - DNA, 20 bp, human
gatgcaagcgagggccgcta

SEQ ID NO: 79161 - DNA, 20 bp, human
ggagctacggggcccagcta

SEQ ID NO: 79162 - DNA, 20 bp, human
ggctgtgacatactgccgaa

SEQ ID NO: 79163 - DNA, 20 bp, human
ggtcaaggccgcaggagggt

SEQ ID NO: 79164 - DNA, 20 bp, human
gaggcgagcgggtcaggcca

SEQ ID NO: 79165 - DNA, 20 bp, human
ggcgctggggctcgaatcca

SEQ ID NO: 79166 - DNA, 20 bp, human
gcgggggcggggaatctagg

SEQ ID NO: 79167 - DNA, 20 bp, human
gggattcccccggcctgggt

SEQ ID NO: 79168 - DNA, 20 bp, human
gtgacagcaggcatcagcgt

SEQ ID NO: 79169 - DNA, 20 bp, human
ggtcggctcatgaggtgcgg

SEQ ID NO: 79170 - DNA, 20 bp, human
gaccctggccgcgtaccccg

SEQ ID NO: 79171 - DNA, 20 bp, human
ggtgcgggggcggggaatct

SEQ ID NO: 79172 - DNA, 20 bp, human
gcgcctccaaagtaaccata

SEQ ID NO: 79173 - DNA, 20 bp, human
gcggctggggtactcttccc

SEQ ID NO: 79174 - DNA, 20 bp, human
gctgggtggggagagcgagc

SEQ ID NO: 79175 - DNA, 20 bp, human
ggagctccgggacactcggc

SEQ ID NO: 79176 - DNA, 20 bp, human
ggaaagcaggggtacataag

SEQ ID NO: 79177 - DNA, 20 bp, human
gggtggggagattttcccct

SEQ ID NO: 79178 - DNA, 20 bp, human
gggcagagcaggcccatctt

SEQ ID NO: 79179 - DNA, 20 bp, human
gttcatccaagggaactcgg

SEQ ID NO: 79180 - DNA, 20 bp, human
gccaaaagcgagccgaagat

SEQ ID NO: 79181 - DNA, 20 bp, human
gccgaccccggaggccggaa

SEQ ID NO: 79182 - DNA, 20 bp, human
gaccccggaggccggaacgg

SEQ ID NO: 79183 - DNA, 20 bp, human
gcccatcccaggaatggagg

SEQ ID NO: 79184 - DNA, 20 bp, human
ggcttccaaaatcagccata

SEQ ID NO: 79185 - DNA, 20 bp, human
ggcggccggagaaggagacg

SEQ ID NO: 79186 - DNA, 20 bp, human
gttaactgctcgctgtggtg

SEQ ID NO: 79187 - DNA, 20 bp, human
gccagcccagaaggcagcgg

SEQ ID NO: 79188 - DNA, 20 bp, human
gcagtgccagcggaaattta

SEQ ID NO: 79189 - DNA, 20 bp, human
ggaaagaaggggccattggt

SEQ ID NO: 79190 - DNA, 20 bp, human
ggggctgtggggtgatgtag

SEQ ID NO: 79191 - DNA, 20 bp, human
gtttctttccggaggatggg

SEQ ID NO: 79192 - DNA, 20 bp, human
ggctgccttctgggctggtc

SEQ ID NO: 79193 - DNA, 20 bp, human
gacactttaactgctcgctg

SEQ ID NO: 79194 - DNA, 20 bp, human
gtgggccgccgctgccttct

SEQ ID NO: 79195 - DNA, 20 bp, human
gcacccagttctaagggact

SEQ ID NO: 79196 - DNA, 20 bp, human
gaaacaggaaaacgagtcag

SEQ ID NO: 79197 - DNA, 20 bp, human
gtgagcacgggtgagtgcgt

SEQ ID NO: 79198 - DNA, 20 bp, human
ggcatccaggggtagacgac

SEQ ID NO: 79199 - DNA, 20 bp, human
gttggctcggaggatcacgt

SEQ ID NO: 79200 - DNA, 20 bp, human
gccgcccggtctgtcccctc

SEQ ID NO: 79201 - DNA, 20 bp, human
gggccgccggcgtagtaccc

SEQ ID NO: 79202 - DNA, 20 bp, human
ggtactacgccggcggccag

SEQ ID NO: 79203 - DNA, 20 bp, human
gctggggtgcagggggttct

SEQ ID NO: 79204 - DNA, 20 bp, human
gactcgcccgggtactacgc

SEQ ID NO: 79205 - DNA, 20 bp, human
gggcaattcccagaaattaa

SEQ ID NO: 79206 - DNA, 20 bp, human
gtgaggtcgcctggtcggag

SEQ ID NO: 79207 - DNA, 20 bp, human
gagggactcgggcgaggaca

SEQ ID NO: 79208 - DNA, 20 bp, human
gcggagggggacgaagcaga

SEQ ID NO: 79209 - DNA, 20 bp, human
gtcataaatcgtgaagcaca

SEQ ID NO: 79210 - DNA, 20 bp, human
gggctgtcgccgttggtgca

SEQ ID NO: 79211 - DNA, 20 bp, human
ggcttcgtccccctccgacc

SEQ ID NO: 79212 - DNA, 20 bp, human
gagcgcgtcctcggagcctg

SEQ ID NO: 79213 - DNA, 20 bp, human
gtcgccgttggtgcagggca

SEQ ID NO: 79214 - DNA, 20 bp, human
gtcatttgggtgattttgga

SEQ ID NO: 79215 - DNA, 20 bp, human
ggcgccgtggctgtcgccgt

SEQ ID NO: 79216 - DNA, 20 bp, human
gcagtgctccgacctaggtg

SEQ ID NO: 79217 - DNA, 20 bp, human
ggacgacagtgctccgacct

SEQ ID NO: 79218 - DNA, 20 bp, human
gggagcactgtcgtccttca

SEQ ID NO: 79219 - DNA, 20 bp, human
ggaagcaacggctctcacgt

SEQ ID NO: 79220 - DNA, 20 bp, human
gttggacaccacacctaggt

SEQ ID NO: 79221 - DNA, 20 bp, human
gtcttttggacaccacacct

SEQ ID NO: 79222 - DNA, 20 bp, human
gccaaggtctgcaaaggtaa

SEQ ID NO: 79223 - DNA, 20 bp, human
gagtatcgggctgcagtcct

SEQ ID NO: 79224 - DNA, 20 bp, human
gtctctcccaagtcagagaa

SEQ ID NO: 79225 - DNA, 20 bp, human
gccggatttaaaggaatggg

SEQ ID NO: 79226 - DNA, 20 bp, human
gaaacccggcggagcagcag

SEQ ID NO: 79227 - DNA, 20 bp, human
gcagggccgggccaggacaa

SEQ ID NO: 79228 - DNA, 20 bp, human
gatccacgggtagaccggag

SEQ ID NO: 79229 - DNA, 20 bp, human
gcccgctggccagagtgacg

SEQ ID NO: 79230 - DNA, 20 bp, human
gcccgccggcgggtaatagg

SEQ ID NO: 79231 - DNA, 20 bp, human
gcaacaaatcataaacccgg

SEQ ID NO: 79232 - DNA, 20 bp, human
ggctgcatccacgggtagac

SEQ ID NO: 79233 - DNA, 20 bp, human
gctccactccggtctacccg

SEQ ID NO: 79234 - DNA, 20 bp, human
gcgcaggacaagagcgtgtt

SEQ ID NO: 79235 - DNA, 20 bp, human
ggagcagaagtgctccactc

SEQ ID NO: 79236 - DNA, 20 bp, human
ggagcagagggactcggact

SEQ ID NO: 79237 - DNA, 20 bp, human
ggcgggcgccaaggagcaga

SEQ ID NO: 79238 - DNA, 20 bp, human
ggagtcgccgggacacaccc

SEQ ID NO: 79239 - DNA, 20 bp, human
gtgtcccggcgactccgcca

SEQ ID NO: 79240 - DNA, 20 bp, human
ggagcaccgagcaaatatgg

SEQ ID NO: 79241 - DNA, 20 bp, human
gtaatgtgccccggcccctg

SEQ ID NO: 79242 - DNA, 20 bp, human
gcagcgcccgggctatggag

SEQ ID NO: 79243 - DNA, 20 bp, human
gtacaagccctgcatcgagg

SEQ ID NO: 79244 - DNA, 20 bp, human
gcagtgggtgcagccttcca

SEQ ID NO: 79245 - DNA, 20 bp, human
gcagagggactcggacttgg

SEQ ID NO: 79246 - DNA, 20 bp, human
ggccgcttacgagtcagata

SEQ ID NO: 79247 - DNA, 20 bp, human
gaagctggagcgggccccag

SEQ ID NO: 79248 - DNA, 20 bp, human
gagtcagatagggattaaat

SEQ ID NO: 79249 - DNA, 20 bp, human
ggtagcggctgtaggtctgt

SEQ ID NO: 79250 - DNA, 20 bp, human
gagagctctggccccgctag

SEQ ID NO: 79251 - DNA, 20 bp, human
gcagaagggcgacaagaagt

SEQ ID NO: 79252 - DNA, 20 bp, human
gacgagggcgacgcgcagaa

SEQ ID NO: 79253 - DNA, 20 bp, human
gtacgagatactaccactag

SEQ ID NO: 79254 - DNA, 20 bp, human
gtgtcggcctcgcctgcgtc

SEQ ID NO: 79255 - DNA, 20 bp, human
gccgcgccagtccccgctag

SEQ ID NO: 79256 - DNA, 20 bp, human
gcgaggacctctttaagtgg

SEQ ID NO: 79257 - DNA, 20 bp, human
gcggcggcggaggctatagt

SEQ ID NO: 79258 - DNA, 20 bp, human
gtagtcaccctcgccaggaa

SEQ ID NO: 79259 - DNA, 20 bp, human
gcggcggaggctatagttgg

SEQ ID NO: 79260 - DNA, 20 bp, human
gaagcgaggacctctttaag

SEQ ID NO: 79261 - DNA, 20 bp, human
gcgctttacatttcgaagaa

SEQ ID NO: 79262 - DNA, 20 bp, human
gaatataccaccacttaaag

SEQ ID NO: 79263 - DNA, 20 bp, human
gccgaaaactgtttatgaac

SEQ ID NO: 79264 - DNA, 20 bp, human
gggtcggccgcccaggtcct

SEQ ID NO: 79265 - DNA, 20 bp, human
ggccgcagtcataataattg

SEQ ID NO: 79266 - DNA, 20 bp, human
gggagaggtggcacccggac

SEQ ID NO: 79267 - DNA, 20 bp, human
gcccaggaggcgccgaacac

SEQ ID NO: 79268 - DNA, 20 bp, human
ggcgcggcggcgcccaagca

SEQ ID NO: 79269 - DNA, 20 bp, human
gattatccgggcgcttgcag

SEQ ID NO: 79270 - DNA, 20 bp, human
ggaaagccctcacaccggtc

SEQ ID NO: 79271 - DNA, 20 bp, human
gggccaggcggcggtgaagg

SEQ ID NO: 79272 - DNA, 20 bp, human
gcgtccgaaagccctcacac

SEQ ID NO: 79273 - DNA, 20 bp, human
ggccctggggctggatgtaa

SEQ ID NO: 79274 - DNA, 20 bp, human
ggggaagggaagcgctcgcg

SEQ ID NO: 79275 - DNA, 20 bp, human
gtgtaagggtggtagacgga

SEQ ID NO: 79276 - DNA, 20 bp, human
gatcgcctggaacaacctgt

SEQ ID NO: 79277 - DNA, 20 bp, human
gttaaggagcaatactacag

SEQ ID NO: 79278 - DNA, 20 bp, human
gtccttgacactaggtgggt

SEQ ID NO: 79279 - DNA, 20 bp, human
gaggagcaatactacagcgg

SEQ ID NO: 79280 - DNA, 20 bp, human
ggcgccccccctcccggatg

SEQ ID NO: 79281 - DNA, 20 bp, human
gcaggactccggcaaggggt

SEQ ID NO: 79282 - DNA, 20 bp, human
ggtcgttggccccagaacag

SEQ ID NO: 79283 - DNA, 20 bp, human
gtcaattgcggggtgatgag

SEQ ID NO: 79284 - DNA, 20 bp, human
gcaaggcaggactccggcaa

SEQ ID NO: 79285 - DNA, 20 bp, human
gtcctacccacctagtgtca

SEQ ID NO: 79286 - DNA, 20 bp, human
gaggagaccgtggagaactc

SEQ ID NO: 79287 - DNA, 20 bp, human
gtgaaaaacgaaggctccta

SEQ ID NO: 79288 - DNA, 20 bp, human
gcggtccgggaggtctccta

SEQ ID NO: 79289 - DNA, 20 bp, human
gctccgtcgcgcaaggagag

SEQ ID NO: 79290 - DNA, 20 bp, human
gtctcggtgacggtggaagg

SEQ ID NO: 79291 - DNA, 20 bp, human
gcgggtccaaaacctccatc

SEQ ID NO: 79292 - DNA, 20 bp, human
gcggagagcagaagttgccc

SEQ ID NO: 79293 - DNA, 20 bp, human
gtgtttaactcggtcaacct

SEQ ID NO: 79294 - DNA, 20 bp, human
gggggcacttgggccgagta

SEQ ID NO: 79295 - DNA, 20 bp, human
gctctcctgccggctccgga

SEQ ID NO: 79296 - DNA, 20 bp, human
gggtcgggccccgcggaaat

SEQ ID NO: 79297 - DNA, 20 bp, human
gacactgggctgccgaggta

SEQ ID NO: 79298 - DNA, 20 bp, human
gccgtgtggatgtttaccag

SEQ ID NO: 79299 - DNA, 20 bp, human
gtaaagtagaagctgccggt

SEQ ID NO: 79300 - DNA, 20 bp, human
gaccagcggccccacaaacc

SEQ ID NO: 79301 - DNA, 20 bp, human
ggcacgtgcggccgaaggga

SEQ ID NO: 79302 - DNA, 20 bp, human
gaggagcgcgggcgcgaccc

SEQ ID NO: 79303 - DNA, 20 bp, human
gtccctgtcctggccgtcgg

SEQ ID NO: 79304 - DNA, 20 bp, human
ggctgcgggtagccattgca

SEQ ID NO: 79305 - DNA, 20 bp, human
gtccgccgacggccaggaca

SEQ ID NO: 79306 - DNA, 20 bp, human
ggctacggctaccccttcgg

SEQ ID NO: 79307 - DNA, 20 bp, human
ggtagtagctgcccccgaag

SEQ ID NO: 79308 - DNA, 20 bp, human
gtgccagaggcagcgagcta

SEQ ID NO: 79309 - DNA, 20 bp, human
gccagcgccaccctgggcta

SEQ ID NO: 79310 - DNA, 20 bp, human
gtaaaaactccacttgccag

SEQ ID NO: 79311 - DNA, 20 bp, human
gcctcgtccagcgccaccct

SEQ ID NO: 79312 - DNA, 20 bp, human
ggttcacgttgtgcgacagg

SEQ ID NO: 79313 - DNA, 20 bp, human
gccccgagcatggatggtct

SEQ ID NO: 79314 - DNA, 20 bp, human
ggggtagccgtagcccaggg

SEQ ID NO: 79315 - DNA, 20 bp, human
gctccctagctcgctgcctc

SEQ ID NO: 79316 - DNA, 20 bp, human
gtacagggtcgctagctagt

SEQ ID NO: 79317 - DNA, 20 bp, human
ggcggcgctggagggatggt

SEQ ID NO: 79318 - DNA, 20 bp, human
gaggcggaggcgcctgagag

SEQ ID NO: 79319 - DNA, 20 bp, human
ggggtcgctagctagtagga

SEQ ID NO: 79320 - DNA, 20 bp, human
ggcgctggagggatggtcgg

SEQ ID NO: 79321 - DNA, 20 bp, human
gtggtgggtacagctcctgg

SEQ ID NO: 79322 - DNA, 20 bp, human
gctggcgctcagggtagcta

SEQ ID NO: 79323 - DNA, 20 bp, human
gagggcgcggaggcggtggt

SEQ ID NO: 79324 - DNA, 20 bp, human
ggagtcgctcctggagagag

SEQ ID NO: 79325 - DNA, 20 bp, human
ggcgagccggcgcctctctc

SEQ ID NO: 79326 - DNA, 20 bp, human
gctaatgaagggagcgccca

SEQ ID NO: 79327 - DNA, 20 bp, human
ggctgagacaggctcggcag

SEQ ID NO: 79328 - DNA, 20 bp, human
gcggcagcggcacagaatga

SEQ ID NO: 79329 - DNA, 20 bp, human
gcaatggttaggctcttaca

SEQ ID NO: 79330 - DNA, 20 bp, human
gtgaagggagcgcccagggc

SEQ ID NO: 79331 - DNA, 20 bp, human
gtacagggaggactgttctg

SEQ ID NO: 79332 - DNA, 20 bp, human
gtggttaggctcttacaggg

SEQ ID NO: 79333 - DNA, 20 bp, human
gccgaccctctggcccccaa

SEQ ID NO: 79334 - DNA, 20 bp, human
gagcttcggcaactccacct

SEQ ID NO: 79335 - DNA, 20 bp, human
gcaaggggcaggaggaatgc

SEQ ID NO: 79336 - DNA, 20 bp, human
gctaatgaagggagcgccca

SEQ ID NO: 79337 - DNA, 20 bp, human
ggctgagacaggctcggcag

SEQ ID NO: 79338 - DNA, 20 bp, human
gcggcagcggcacagaatga

SEQ ID NO: 79339 - DNA, 20 bp, human
gcaatggttaggctcttaca

SEQ ID NO: 79340 - DNA, 20 bp, human
gtgaagggagcgcccagggc

SEQ ID NO: 79341 - DNA, 20 bp, human
gtacagggaggactgttctg

SEQ ID NO: 79342 - DNA, 20 bp, human
gtggttaggctcttacaggg

SEQ ID NO: 79343 - DNA, 20 bp, human
gccgaccctctggcccccaa

SEQ ID NO: 79344 - DNA, 20 bp, human
gagcttcggcaactccacct

SEQ ID NO: 79345 - DNA, 20 bp, human
gcaaggggcaggaggaatgc

SEQ ID NO: 79346 - DNA, 20 bp, human
gggcgctcctcactgtcggt

SEQ ID NO: 79347 - DNA, 20 bp, human
ggctctacctaccgacagtg

SEQ ID NO: 79348 - DNA, 20 bp, human
ggccggttccctcagagcgt

SEQ ID NO: 79349 - DNA, 20 bp, human
gcggatcagcagagctcccg

SEQ ID NO: 79350 - DNA, 20 bp, human
gaattcgcctgggctgttag

SEQ ID NO: 79351 - DNA, 20 bp, human
gcgctggtgtacgggcccgg

SEQ ID NO: 79352 - DNA, 20 bp, human
ggcccacgctctgagggaac

SEQ ID NO: 79353 - DNA, 20 bp, human
ggctcctgcccacgctctga

SEQ ID NO: 79354 - DNA, 20 bp, human
ggggtactcgtgagccagag

SEQ ID NO: 79355 - DNA, 20 bp, human
gcagctggctccccgggact

SEQ ID NO: 79356 - DNA, 20 bp, human
gcaagccggacgcctacccc

SEQ ID NO: 79357 - DNA, 20 bp, human
ggctacccggactacatgta

SEQ ID NO: 79358 - DNA, 20 bp, human
gcccgtcgccgacatcgtaa

SEQ ID NO: 79359 - DNA, 20 bp, human
gacggaaaatcgctacagtc

SEQ ID NO: 79360 - DNA, 20 bp, human
gataccacggacgactgaga

SEQ ID NO: 79361 - DNA, 20 bp, human
gccgtacgggtgatatacca

SEQ ID NO: 79362 - DNA, 20 bp, human
gcgagccgtacatgtagtcc

SEQ ID NO: 79363 - DNA, 20 bp, human
ggcgtgtcggcgccgaggtg

SEQ ID NO: 79364 - DNA, 20 bp, human
gcatgtagtccgggtagctg

SEQ ID NO: 79365 - DNA, 20 bp, human
gcttggctcgagccgctgtc

SEQ ID NO: 79366 - DNA, 20 bp, human
gagggcagctcgggtagaga

SEQ ID NO: 79367 - DNA, 20 bp, human
gggcggagcggcgcagacgg

SEQ ID NO: 79368 - DNA, 20 bp, human
gcagctcgggtagagagggc

SEQ ID NO: 79369 - DNA, 20 bp, human
gcggctcactcgccatgggt

SEQ ID NO: 79370 - DNA, 20 bp, human
gcacgggccgggcgtcggag

SEQ ID NO: 79371 - DNA, 20 bp, human
gactcgccatgggttggaga

SEQ ID NO: 79372 - DNA, 20 bp, human
gggttcgtaggccccctcca

SEQ ID NO: 79373 - DNA, 20 bp, human
gcctccggctcactcgccat

SEQ ID NO: 79374 - DNA, 20 bp, human
gggtgcggcaccaggttcgt

SEQ ID NO: 79375 - DNA, 20 bp, human
ggcgcagtgcaccctggagg

SEQ ID NO: 79376 - DNA, 20 bp, human
gcggcagagaacgtccccaa

SEQ ID NO: 79377 - DNA, 20 bp, human
gtgcaaggcaaagagaccag

SEQ ID NO: 79378 - DNA, 20 bp, human
gcctcgctcagtggcccggg

SEQ ID NO: 79379 - DNA, 20 bp, human
gccaggccctggccccgttg

SEQ ID NO: 79380 - DNA, 20 bp, human
ggggcctggccctcgctcag

SEQ ID NO: 79381 - DNA, 20 bp, human
gccgcaggcccactgtcctt

SEQ ID NO: 79382 - DNA, 20 bp, human
ggaggtcccgagttgaccgt

SEQ ID NO: 79383 - DNA, 20 bp, human
ggatgctcaacctcactgac

SEQ ID NO: 79384 - DNA, 20 bp, human
gaggcagggcctttcggccg

SEQ ID NO: 79385 - DNA, 20 bp, human
gagagacgtcattaaaccca

SEQ ID NO: 79386 - DNA, 20 bp, human
gtccagggacgggaacctca

SEQ ID NO: 79387 - DNA, 20 bp, human
gctcaacgggacaagactca

SEQ ID NO: 79388 - DNA, 20 bp, human
gcgaggtcccttcgtaccag

SEQ ID NO: 79389 - DNA, 20 bp, human
gagagacgggagcagtccac

SEQ ID NO: 79390 - DNA, 20 bp, human
ggaccagcctctggtacgaa

SEQ ID NO: 79391 - DNA, 20 bp, human
gccatgtctgcgctaggtgg

SEQ ID NO: 79392 - DNA, 20 bp, human
gggaacctcagggttctcaa

SEQ ID NO: 79393 - DNA, 20 bp, human
gtgtcccgttgagaaccctg

SEQ ID NO: 79394 - DNA, 20 bp, human
ggtctaaaatatccagggac

SEQ ID NO: 79395 - DNA, 20 bp, human
ggtcccttcgtaccagaggc

SEQ ID NO: 79396 - DNA, 20 bp, human
gaccgccgaagagggaaaag

SEQ ID NO: 79397 - DNA, 20 bp, human
gggccgcgcaggcaaggaca

SEQ ID NO: 79398 - DNA, 20 bp, human
gggagcgcaccaggccttcg

SEQ ID NO: 79399 - DNA, 20 bp, human
gtcagcaggctccatactgg

SEQ ID NO: 79400 - DNA, 20 bp, human
gcggccccacccgaaacgca

SEQ ID NO: 79401 - DNA, 20 bp, human
gcagcccggcgcccccagta

SEQ ID NO: 79402 - DNA, 20 bp, human
gggacaaggccacagagtcg

SEQ ID NO: 79403 - DNA, 20 bp, human
gcgtgccgccagtagagaga

SEQ ID NO: 79404 - DNA, 20 bp, human
ggtggcgcgccggtgcatag

SEQ ID NO: 79405 - DNA, 20 bp, human
ggcctgctgaccgccgaaga

SEQ ID NO: 79406 - DNA, 20 bp, human
gggagccaggctagactcgg

SEQ ID NO: 79407 - DNA, 20 bp, human
ggtgtcgtccttgaagccag

SEQ ID NO: 79408 - DNA, 20 bp, human
gtctacagagcgggctatgt

SEQ ID NO: 79409 - DNA, 20 bp, human
gcgcgcgggtaggagatagg

SEQ ID NO: 79410 - DNA, 20 bp, human
ggagcgcagtctctacagag

SEQ ID NO: 79411 - DNA, 20 bp, human
ggcttcaaggacgacaccaa

SEQ ID NO: 79412 - DNA, 20 bp, human
ggagaagccgccgaaggcag

SEQ ID NO: 79413 - DNA, 20 bp, human
gacaccagcgtagtcatact

SEQ ID NO: 79414 - DNA, 20 bp, human
gcgggcaatagacagagtac

SEQ ID NO: 79415 - DNA, 20 bp, human
gcgggcgccactgccttcgg

SEQ ID NO: 79416 - DNA, 20 bp, human
gtccgggcgcgccgctacaa

SEQ ID NO: 79417 - DNA, 20 bp, human
gcgtgcgctcagaggtcccg

SEQ ID NO: 79418 - DNA, 20 bp, human
gcgggagctgggacatggac

SEQ ID NO: 79419 - DNA, 20 bp, human
ggaagagcccgtgcgctcag

SEQ ID NO: 79420 - DNA, 20 bp, human
ggcgagcgaaccagagagaa

SEQ ID NO: 79421 - DNA, 20 bp, human
gccggggtacgcaaagccgg

SEQ ID NO: 79422 - DNA, 20 bp, human
gccgcgatgagctaacctgt

SEQ ID NO: 79423 - DNA, 20 bp, human
gaggcgcggagagaaagccg

SEQ ID NO: 79424 - DNA, 20 bp, human
ggccgctacaacggcagaag

SEQ ID NO: 79425 - DNA, 20 bp, human
gggccccgcgcaggacacca

SEQ ID NO: 79426 - DNA, 20 bp, human
gagaggtgggctccagtcac

SEQ ID NO: 79427 - DNA, 20 bp, human
gcaaaggttagaaaaagagg

SEQ ID NO: 79428 - DNA, 20 bp, human
gacttccccgggaaatgtag

SEQ ID NO: 79429 - DNA, 20 bp, human
gtacaggcggcggtcggtcc

SEQ ID NO: 79430 - DNA, 20 bp, human
ggctctgggaaagcagaatg

SEQ ID NO: 79431 - DNA, 20 bp, human
gcaatcccgcagccggtgac

SEQ ID NO: 79432 - DNA, 20 bp, human
gaaggctgccgagctacagg

SEQ ID NO: 79433 - DNA, 20 bp, human
gctggggcgccgaccccctt

SEQ ID NO: 79434 - DNA, 20 bp, human
gtgctcctggcaggcggtgt

SEQ ID NO: 79435 - DNA, 20 bp, human
gccccttgggcagctcagtc

SEQ ID NO: 79436 - DNA, 20 bp, human
gaagcagccgccctccggga

SEQ ID NO: 79437 - DNA, 20 bp, human
gtcggtgagcagcctttcgg

SEQ ID NO: 79438 - DNA, 20 bp, human
ggccggccgtggtctacccc

SEQ ID NO: 79439 - DNA, 20 bp, human
gatggtgaactccaagtatg

SEQ ID NO: 79440 - DNA, 20 bp, human
ggtgcacgtgaattcgggta

SEQ ID NO: 79441 - DNA, 20 bp, human
ggtctacccctggatgaaga

SEQ ID NO: 79442 - DNA, 20 bp, human
gtccaggggtagaccacggc

SEQ ID NO: 79443 - DNA, 20 bp, human
gtgagtgccgtcccggaggg

SEQ ID NO: 79444 - DNA, 20 bp, human
ggtgaattcgggtaaggcta

SEQ ID NO: 79445 - DNA, 20 bp, human
gagcagggcgccgactacta

SEQ ID NO: 79446 - DNA, 20 bp, human
ggcggcggtagggaaggccg

SEQ ID NO: 79447 - DNA, 20 bp, human
gtcgccggtgcgcaccgggt

SEQ ID NO: 79448 - DNA, 20 bp, human
ggcctgagaggaaacagtgg

SEQ ID NO: 79449 - DNA, 20 bp, human
gacggaaagtcagcgtgacg

SEQ ID NO: 79450 - DNA, 20 bp, human
gggacgaggagccccgcgga

SEQ ID NO: 79451 - DNA, 20 bp, human
gaggcggcgcgaagccgagg

SEQ ID NO: 79452 - DNA, 20 bp, human
gcagagagcgagcctcgact

SEQ ID NO: 79453 - DNA, 20 bp, human
ggactttccgtgcagtgctg

SEQ ID NO: 79454 - DNA, 20 bp, human
gaccgggtcggcagcctcgg

SEQ ID NO: 79455 - DNA, 20 bp, human
gctgccgacccggtgcgcac

SEQ ID NO: 79456 - DNA, 20 bp, human
gcagcctgcgaactagtcgg

SEQ ID NO: 79457 - DNA, 20 bp, human
gcggcggacagtgtaatgtt

SEQ ID NO: 79458 - DNA, 20 bp, human
gggacagtgtaatgttgggt

SEQ ID NO: 79459 - DNA, 20 bp, human
gctgcagcctgcgaactagt

SEQ ID NO: 79460 - DNA, 20 bp, human
gctacacgaggcgaactcgg

SEQ ID NO: 79461 - DNA, 20 bp, human
ggcctcaaaatgtcttccag

SEQ ID NO: 79462 - DNA, 20 bp, human
ggagaacacggccgatctgg

SEQ ID NO: 79463 - DNA, 20 bp, human
ggagggcaccgcggaccacg

SEQ ID NO: 79464 - DNA, 20 bp, human
ggggcggcgggggaacgtac

SEQ ID NO: 79465 - DNA, 20 bp, human
gcgctgcccggcttcccggg

SEQ ID NO: 79466 - DNA, 20 bp, human
gagggcaatgacagctccca

SEQ ID NO: 79467 - DNA, 20 bp, human
gcaccccgaatagaagccaa

SEQ ID NO: 79468 - DNA, 20 bp, human
gcgcaggtcagtctttggtt

SEQ ID NO: 79469 - DNA, 20 bp, human
gcgaatagaagccaatggaa

SEQ ID NO: 79470 - DNA, 20 bp, human
ggagagagtgcagacccgag

SEQ ID NO: 79471 - DNA, 20 bp, human
gatgatgtcacggatatcgc

SEQ ID NO: 79472 - DNA, 20 bp, human
gtatggtcctgaaagcccag

SEQ ID NO: 79473 - DNA, 20 bp, human
gggtcagtctttggttgggt

SEQ ID NO: 79474 - DNA, 20 bp, human
ggatatcgcaggtcagtctt

SEQ ID NO: 79475 - DNA, 20 bp, human
gaaaaagctgtccccagagc

SEQ ID NO: 79476 - DNA, 20 bp, human
ggccattacggagctcccag

SEQ ID NO: 79477 - DNA, 20 bp, human
gcggtggcggaggcgactag

SEQ ID NO: 79478 - DNA, 20 bp, human
ggctcggcggctgggactgg

SEQ ID NO: 79479 - DNA, 20 bp, human
ggccccggcgacggaagcag

SEQ ID NO: 79480 - DNA, 20 bp, human
gagagctcggcggctgggac

SEQ ID NO: 79481 - DNA, 20 bp, human
gaccactgggagctccgtaa

SEQ ID NO: 79482 - DNA, 20 bp, human
ggccgacgccgctcccagag

SEQ ID NO: 79483 - DNA, 20 bp, human
gacgctcggcagggacaccg

SEQ ID NO: 79484 - DNA, 20 bp, human
ggagccccagatctgagggt

SEQ ID NO: 79485 - DNA, 20 bp, human
gcaggaccggccgaacgcag

SEQ ID NO: 79486 - DNA, 20 bp, human
gtccgcgtcgctgggtgagt

SEQ ID NO: 79487 - DNA, 20 bp, human
gggaggggcaactccgaggg

SEQ ID NO: 79488 - DNA, 20 bp, human
gccccactcacccagcgacg

SEQ ID NO: 79489 - DNA, 20 bp, human
ggacctccagtcccccatat

SEQ ID NO: 79490 - DNA, 20 bp, human
ggacaccgactgcgcaggga

SEQ ID NO: 79491 - DNA, 20 bp, human
gaccgactgcgcagggaagg

SEQ ID NO: 79492 - DNA, 20 bp, human
gaagcgcgcggtgctctcca

SEQ ID NO: 79493 - DNA, 20 bp, human
gatcttcttgcaaccgggag

SEQ ID NO: 79494 - DNA, 20 bp, human
gccgggaggggcaactccga

SEQ ID NO: 79495 - DNA, 20 bp, human
gagccggggccgggggatga

SEQ ID NO: 79496 - DNA, 20 bp, human
ggcggcggcgggcagcggac

SEQ ID NO: 79497 - DNA, 20 bp, human
gccgcctgccagctccggga

SEQ ID NO: 79498 - DNA, 20 bp, human
gtcgaatggcgtgtactcgt

SEQ ID NO: 79499 - DNA, 20 bp, human
gcagcggacgggcggactga

SEQ ID NO: 79500 - DNA, 20 bp, human
gagagaaacgcgggcactcc

SEQ ID NO: 79501 - DNA, 20 bp, human
gccaccgcgcagagaaacgc

SEQ ID NO: 79502 - DNA, 20 bp, human
ggcctcggcgcgcttgtccc

SEQ ID NO: 79503 - DNA, 20 bp, human
gaccggcgagcgctgcgatc

SEQ ID NO: 79504 - DNA, 20 bp, human
gctctgcgcggtggagttgt

SEQ ID NO: 79505 - DNA, 20 bp, human
gaaaaggaagccggcagcca

SEQ ID NO: 79506 - DNA, 20 bp, human
gtagtgatacaagagctgga

SEQ ID NO: 79507 - DNA, 20 bp, human
gtgctctccaaggtctgcgc

SEQ ID NO: 79508 - DNA, 20 bp, human
gggaaccgaggctggctcgc

SEQ ID NO: 79509 - DNA, 20 bp, human
gaagagctggaaggcggctc

SEQ ID NO: 79510 - DNA, 20 bp, human
gtggcgctggtgctagctgg

SEQ ID NO: 79511 - DNA, 20 bp, human
gaaatagtgtcgccttcggg

SEQ ID NO: 79512 - DNA, 20 bp, human
gccgcctaaggcggaaccac

SEQ ID NO: 79513 - DNA, 20 bp, human
gaactgaagagcccacccct

SEQ ID NO: 79514 - DNA, 20 bp, human
gtgcacacacacacatctgg

SEQ ID NO: 79515 - DNA, 20 bp, human
ggatggctccgagcctcggc

SEQ ID NO: 79516 - DNA, 20 bp, human
gggcctctagtcccagtagg

SEQ ID NO: 79517 - DNA, 20 bp, human
gccaggcctctagtcccagt

SEQ ID NO: 79518 - DNA, 20 bp, human
gctgaagatgtcccacccaa

SEQ ID NO: 79519 - DNA, 20 bp, human
gtggccatctccccttgggt

SEQ ID NO: 79520 - DNA, 20 bp, human
gaacctcctactgggactag

SEQ ID NO: 79521 - DNA, 20 bp, human
ggtcggagtgcagggagact

SEQ ID NO: 79522 - DNA, 20 bp, human
gaggggcctgagtctagaag

SEQ ID NO: 79523 - DNA, 20 bp, human
ggtttgactaagatcaatca

SEQ ID NO: 79524 - DNA, 20 bp, human
gtgtcccacccaaggggaga

SEQ ID NO: 79525 - DNA, 20 bp, human
gcgaaatgtgggaaatgtag

SEQ ID NO: 79526 - DNA, 20 bp, human
ggagcagcgtctggaccacc

SEQ ID NO: 79527 - DNA, 20 bp, human
gggcagctagccctgcgcag

SEQ ID NO: 79528 - DNA, 20 bp, human
ggcggatccaggccgtacag

SEQ ID NO: 79529 - DNA, 20 bp, human
gggtctggagagccgctgta

SEQ ID NO: 79530 - DNA, 20 bp, human
gcccagccaggagcagcgtc

SEQ ID NO: 79531 - DNA, 20 bp, human
ggggcacgtggaaggcgatg

SEQ ID NO: 79532 - DNA, 20 bp, human
gtggcttcgcgggaggtgga

SEQ ID NO: 79533 - DNA, 20 bp, human
ggctggttgtgagaaccacg

SEQ ID NO: 79534 - DNA, 20 bp, human
ggccccagaaggacaagtct

SEQ ID NO: 79535 - DNA, 20 bp, human
ggcggccatggcgctctgga

SEQ ID NO: 79536 - DNA, 20 bp, human
gggttcaaactgctcatcca

SEQ ID NO: 79537 - DNA, 20 bp, human
gccggcgcggctcagggcat

SEQ ID NO: 79538 - DNA, 20 bp, human
gggcgagtctcggagtgtgt

SEQ ID NO: 79539 - DNA, 20 bp, human
gtacctatagacaagaggag

SEQ ID NO: 79540 - DNA, 20 bp, human
gaggtgcactggcggagaca

SEQ ID NO: 79541 - DNA, 20 bp, human
gatgcacgtgaacggcaaag

SEQ ID NO: 79542 - DNA, 20 bp, human
ggcgctccagaacgctcagg

SEQ ID NO: 79543 - DNA, 20 bp, human
gagcagcagcgcctctgcaa

SEQ ID NO: 79544 - DNA, 20 bp, human
gagcgctacctatagacaag

SEQ ID NO: 79545 - DNA, 20 bp, human
gtgcactggcggagacaggg

SEQ ID NO: 79546 - DNA, 20 bp, human
gctcccgagagacataacac

SEQ ID NO: 79547 - DNA, 20 bp, human
gagaggttctgggtaagaca

SEQ ID NO: 79548 - DNA, 20 bp, human
gtactcgtcatataaaccca

SEQ ID NO: 79549 - DNA, 20 bp, human
gcacgagccagtgagaggac

SEQ ID NO: 79550 - DNA, 20 bp, human
gtacctgtgttatgtctctc

SEQ ID NO: 79551 - DNA, 20 bp, human
gtgcagtgtcttgtatccct

SEQ ID NO: 79552 - DNA, 20 bp, human
gatattactgaactccacat

SEQ ID NO: 79553 - DNA, 20 bp, human
gaaggcacagtcacataccc

SEQ ID NO: 79554 - DNA, 20 bp, human
gataatcacgagccagtgag

SEQ ID NO: 79555 - DNA, 20 bp, human
gcatattcgcatatatggag

SEQ ID NO: 79556 - DNA, 20 bp, human
gcgggtcagtctccaggcct

SEQ ID NO: 79557 - DNA, 20 bp, human
gctggagactgacccgaccc

SEQ ID NO: 79558 - DNA, 20 bp, human
gggccaggctgcctcacctg

SEQ ID NO: 79559 - DNA, 20 bp, human
gcaggaacccctctattagg

SEQ ID NO: 79560 - DNA, 20 bp, human
gcatggtggccccgcagcag

SEQ ID NO: 79561 - DNA, 20 bp, human
ggagcctcgaggtagtgccg

SEQ ID NO: 79562 - DNA, 20 bp, human
gtcctggggacctgaagagg

SEQ ID NO: 79563 - DNA, 20 bp, human
gggactccctagtatgaggg

SEQ ID NO: 79564 - DNA, 20 bp, human
gcgaccccggcactacctcg

SEQ ID NO: 79565 - DNA, 20 bp, human
ggccaggactccctagtatg

SEQ ID NO: 79566 - DNA, 20 bp, human
gagagctgccaccttgggtc

SEQ ID NO: 79567 - DNA, 20 bp, human
gagtctgggttagacatgtg

SEQ ID NO: 79568 - DNA, 20 bp, human
gcagtgagagctgccacctt

SEQ ID NO: 79569 - DNA, 20 bp, human
gtgcaacagacaccatgctg

SEQ ID NO: 79570 - DNA, 20 bp, human
ggcactcatgagtaatacac

SEQ ID NO: 79571 - DNA, 20 bp, human
ggccaggcctgtcctcattg

SEQ ID NO: 79572 - DNA, 20 bp, human
gaccaggagccgctgtaccc

SEQ ID NO: 79573 - DNA, 20 bp, human
gcagcctgctccactcacct

SEQ ID NO: 79574 - DNA, 20 bp, human
gcaggaaccgctctcaccaa

SEQ ID NO: 79575 - DNA, 20 bp, human
ggatggctgtcagaagtagc

SEQ ID NO: 79576 - DNA, 20 bp, human
gtaaatatactcaggatgcc

SEQ ID NO: 79577 - DNA, 20 bp, human
gagtcaaaaatgtaacctga

SEQ ID NO: 79578 - DNA, 20 bp, human
gaacaaagaaacgggcaaat

SEQ ID NO: 79579 - DNA, 20 bp, human
gtctgctaataaatatactc

SEQ ID NO: 79580 - DNA, 20 bp, human
gaaagatagtgaccttacca

SEQ ID NO: 79581 - DNA, 20 bp, human
gttacatttttgactttata

SEQ ID NO: 79582 - DNA, 20 bp, human
gtctttaaaaatgtacaata

SEQ ID NO: 79583 - DNA, 20 bp, human
gttgtttgtggttttgttac

SEQ ID NO: 79584 - DNA, 20 bp, human
gtgtctacaaactttggccc

SEQ ID NO: 79585 - DNA, 20 bp, human
gttaacaggggtattgtttg

SEQ ID NO: 79586 - DNA, 20 bp, human
gcgggtcgccataacggagc

SEQ ID NO: 79587 - DNA, 20 bp, human
ggggctgcgggtcgccataa

SEQ ID NO: 79588 - DNA, 20 bp, human
gcgcgggctgactgctcagg

SEQ ID NO: 79589 - DNA, 20 bp, human
gcgtgccgaggcccctccag

SEQ ID NO: 79590 - DNA, 20 bp, human
ggcgcgcgggctgactgctc

SEQ ID NO: 79591 - DNA, 20 bp, human
gggcggcagggaggacggaa

SEQ ID NO: 79592 - DNA, 20 bp, human
ggcggaggcgcagcaagagg

SEQ ID NO: 79593 - DNA, 20 bp, human
ggcgccggccggctccgtta

SEQ ID NO: 79594 - DNA, 20 bp, human
gtgcgatggtgaggttctcg

SEQ ID NO: 79595 - DNA, 20 bp, human
gcagggaaccccgcaggcgg

SEQ ID NO: 79596 - DNA, 20 bp, human
ggctctctccagagactcag

SEQ ID NO: 79597 - DNA, 20 bp, human
gagcccggaggcccacgtac

SEQ ID NO: 79598 - DNA, 20 bp, human
gaggcccacgtaccggatcg

SEQ ID NO: 79599 - DNA, 20 bp, human
gggccgggctccgaaggtgt

SEQ ID NO: 79600 - DNA, 20 bp, human
ggcgccgcgatccggtacgt

SEQ ID NO: 79601 - DNA, 20 bp, human
gctgctgaagacgggaccaa

SEQ ID NO: 79602 - DNA, 20 bp, human
gctccgggctgtcccctctg

SEQ ID NO: 79603 - DNA, 20 bp, human
gatccggtacgtgggcctcc

SEQ ID NO: 79604 - DNA, 20 bp, human
ggaggatcgccgcccccaga

SEQ ID NO: 79605 - DNA, 20 bp, human
gcgaacctcacggccaccct

SEQ ID NO: 79606 - DNA, 20 bp, human
ggctagcggaccgaacgtct

SEQ ID NO: 79607 - DNA, 20 bp, human
gtgtagctctagctagggat

SEQ ID NO: 79608 - DNA, 20 bp, human
gtgcgacttcaagcaatcag

SEQ ID NO: 79609 - DNA, 20 bp, human
gtgggctgtagctctagcta

SEQ ID NO: 79610 - DNA, 20 bp, human
gatcccgacgtccggcggga

SEQ ID NO: 79611 - DNA, 20 bp, human
ggctgcaccatcccgacgtc

SEQ ID NO: 79612 - DNA, 20 bp, human
gcggttgtcgcggcaagcat

SEQ ID NO: 79613 - DNA, 20 bp, human
gccgcgctgaccgcgaatgt

SEQ ID NO: 79614 - DNA, 20 bp, human
gccccgccacagaaccggtc

SEQ ID NO: 79615 - DNA, 20 bp, human
gagaccatccggcaaattcc

SEQ ID NO: 79616 - DNA, 20 bp, human
gtgccgcgcgcgcaggtacg

SEQ ID NO: 79617 - DNA, 20 bp, human
gtacgggactgggaaatggt

SEQ ID NO: 79618 - DNA, 20 bp, human
gggtacggggcagaagtcgc

SEQ ID NO: 79619 - DNA, 20 bp, human
gcggggcggcgcgtgaccta

SEQ ID NO: 79620 - DNA, 20 bp, human
gctggagtaggaagagacgt

SEQ ID NO: 79621 - DNA, 20 bp, human
ggtgtctggccccagctcta

SEQ ID NO: 79622 - DNA, 20 bp, human
gtagtaacaacgcggggctg

SEQ ID NO: 79623 - DNA, 20 bp, human
gggagcgcggggataccgag

SEQ ID NO: 79624 - DNA, 20 bp, human
ggcgactggtaacagcacta

SEQ ID NO: 79625 - DNA, 20 bp, human
gacatgagcagaaaaggatc

SEQ ID NO: 79626 - DNA, 20 bp, human
gtagatcggatcttgtctcc

SEQ ID NO: 79627 - DNA, 20 bp, human
gtcacagaccagcagcccgg

SEQ ID NO: 79628 - DNA, 20 bp, human
gactcaccgcgcactaagag

SEQ ID NO: 79629 - DNA, 20 bp, human
gtagtgcgcggtgagttccc

SEQ ID NO: 79630 - DNA, 20 bp, human
gggtactgccctggatgtgg

SEQ ID NO: 79631 - DNA, 20 bp, human
gctcgcagctctcagtagat

SEQ ID NO: 79632 - DNA, 20 bp, human
gcgaggtactgccctggatg

SEQ ID NO: 79633 - DNA, 20 bp, human
gagtaggtgcgtggaggaag

SEQ ID NO: 79634 - DNA, 20 bp, human
gggaaggggaggaacgcgag

SEQ ID NO: 79635 - DNA, 20 bp, human
ggagctgcgaggtactgccc

SEQ ID NO: 79636 - DNA, 20 bp, human
gggcgaggcccgattctcgg

SEQ ID NO: 79637 - DNA, 20 bp, human
gagtccggacgcacacacag

SEQ ID NO: 79638 - DNA, 20 bp, human
gacagctcggtgctctgcag

SEQ ID NO: 79639 - DNA, 20 bp, human
gcgggcctcgccctgctggg

SEQ ID NO: 79640 - DNA, 20 bp, human
gctggacctgggcaaagcct

SEQ ID NO: 79641 - DNA, 20 bp, human
gacgcccgcgccccacacct

SEQ ID NO: 79642 - DNA, 20 bp, human
gctggtggccggggactcag

SEQ ID NO: 79643 - DNA, 20 bp, human
gcctggtgtggtgcgaggag

SEQ ID NO: 79644 - DNA, 20 bp, human
gagagcaccgagctgtgtcc

SEQ ID NO: 79645 - DNA, 20 bp, human
gagtggcctggccgaggtgt

SEQ ID NO: 79646 - DNA, 20 bp, human
gcggctggcggggcagacat

SEQ ID NO: 79647 - DNA, 20 bp, human
gcgcggaaacaacttcacac

SEQ ID NO: 79648 - DNA, 20 bp, human
gtggggtctgagagtaaggg

SEQ ID NO: 79649 - DNA, 20 bp, human
gtccgctgcgcggcagctgg

SEQ ID NO: 79650 - DNA, 20 bp, human
gctctcgactctccgctgcg

SEQ ID NO: 79651 - DNA, 20 bp, human
gggtgacggacaggaacgag

SEQ ID NO: 79652 - DNA, 20 bp, human
gccgcgcaaaagaaggagag

SEQ ID NO: 79653 - DNA, 20 bp, human
ggcgcaagcacaggacgtcg

SEQ ID NO: 79654 - DNA, 20 bp, human
gttcgagcgcagcagcatct

SEQ ID NO: 79655 - DNA, 20 bp, human
ggagacaggcggggaggttc

SEQ ID NO: 79656 - DNA, 20 bp, human
gcagctctgtctacaggcaa

SEQ ID NO: 79657 - DNA, 20 bp, human
gggataggaagggcttgagg

SEQ ID NO: 79658 - DNA, 20 bp, human
gaacctgcagctctgtctac

SEQ ID NO: 79659 - DNA, 20 bp, human
ggtcactagcgagacccagt

SEQ ID NO: 79660 - DNA, 20 bp, human
gggctcgatttcctaaggta

SEQ ID NO: 79661 - DNA, 20 bp, human
ggagggcatggcttcaggga

SEQ ID NO: 79662 - DNA, 20 bp, human
ggccaagtagagagcccccg

SEQ ID NO: 79663 - DNA, 20 bp, human
ggctcacatcaagtagaatc

SEQ ID NO: 79664 - DNA, 20 bp, human
gtggctggctcgatttccta

SEQ ID NO: 79665 - DNA, 20 bp, human
gtagacgggaaggctaattg

SEQ ID NO: 79666 - DNA, 20 bp, human
gaatggccagagaccagcat

SEQ ID NO: 79667 - DNA, 20 bp, human
gtctgggctagggtaaggta

SEQ ID NO: 79668 - DNA, 20 bp, human
gcccatgggcactagtccta

SEQ ID NO: 79669 - DNA, 20 bp, human
ggggagcacccgttgcactg

SEQ ID NO: 79670 - DNA, 20 bp, human
gctaccaccctggatgacaa

SEQ ID NO: 79671 - DNA, 20 bp, human
gccatctgagcagcgttctg

SEQ ID NO: 79672 - DNA, 20 bp, human
gctccacaaccccagtgcaa

SEQ ID NO: 79673 - DNA, 20 bp, human
gccttcagcaacattcccat

SEQ ID NO: 79674 - DNA, 20 bp, human
gagacagacttagggagtca

SEQ ID NO: 79675 - DNA, 20 bp, human
ggttccattgtcatccaggg

SEQ ID NO: 79676 - DNA, 20 bp, human
gcgcgcagcgcggctaatgg

SEQ ID NO: 79677 - DNA, 20 bp, human
gtaatggaggtagagcgcgg

SEQ ID NO: 79678 - DNA, 20 bp, human
gggctaatggaggtagagcg

SEQ ID NO: 79679 - DNA, 20 bp, human
gttctggcgatggcgatcag

SEQ ID NO: 79680 - DNA, 20 bp, human
gctagggccgcaggttggag

SEQ ID NO: 79681 - DNA, 20 bp, human
gcagaagcgcaactgagagt

SEQ ID NO: 79682 - DNA, 20 bp, human
ggcgctctagggccgcaggt

SEQ ID NO: 79683 - DNA, 20 bp, human
ggggcggcgggggcgctcta

SEQ ID NO: 79684 - DNA, 20 bp, human
gcaccgcgcagcgcggctaa

SEQ ID NO: 79685 - DNA, 20 bp, human
gctcggccatctccgacccg

SEQ ID NO: 79686 - DNA, 20 bp, human
gggagcagcccccggcccag

SEQ ID NO: 79687 - DNA, 20 bp, human
gccggctacaaggactctgt

SEQ ID NO: 79688 - DNA, 20 bp, human
gctctccccgcccggattag

SEQ ID NO: 79689 - DNA, 20 bp, human
gccgcctgctgccctcccct

SEQ ID NO: 79690 - DNA, 20 bp, human
ggccaagctgccactaatcc

SEQ ID NO: 79691 - DNA, 20 bp, human
ggcagcttggcctgactctc

SEQ ID NO: 79692 - DNA, 20 bp, human
gccccgggcggagcagcccc

SEQ ID NO: 79693 - DNA, 20 bp, human
ggctgttctgtgcctgaaga

SEQ ID NO: 79694 - DNA, 20 bp, human
gctctgtgggcctgtggcat

SEQ ID NO: 79695 - DNA, 20 bp, human
ggctgccactaatccgggcg

SEQ ID NO: 79696 - DNA, 20 bp, human
ggcacgggcggcggagactc

SEQ ID NO: 79697 - DNA, 20 bp, human
gccagcgcgaggccacgggt

SEQ ID NO: 79698 - DNA, 20 bp, human
gcgcgcatgggctccgtccg

SEQ ID NO: 79699 - DNA, 20 bp, human
gccggcgccctcacacccgg

SEQ ID NO: 79700 - DNA, 20 bp, human
ggctccgtccgcggcgggtg

SEQ ID NO: 79701 - DNA, 20 bp, human
gcagacgcccccgggtgtga

SEQ ID NO: 79702 - DNA, 20 bp, human
gacccgagccgcacccgccg

SEQ ID NO: 79703 - DNA, 20 bp, human
ggcatgggctccgtccgcgg

SEQ ID NO: 79704 - DNA, 20 bp, human
gggaatccgggccccacccg

SEQ ID NO: 79705 - DNA, 20 bp, human
ggagccgcacccgccgcgga

SEQ ID NO: 79706 - DNA, 20 bp, human
ggccggtcgctgctgacccg

SEQ ID NO: 79707 - DNA, 20 bp, human
gcatcgcgacggcccaggca

SEQ ID NO: 79708 - DNA, 20 bp, human
ggcacggagccgcaggaagc

SEQ ID NO: 79709 - DNA, 20 bp, human
ggccccgggtcagcagcgac

SEQ ID NO: 79710 - DNA, 20 bp, human
gccaccaactcgagttgggt

SEQ ID NO: 79711 - DNA, 20 bp, human
gacgtgcatcgcgacggccc

SEQ ID NO: 79712 - DNA, 20 bp, human
ggacggcaggcgggaccccc

SEQ ID NO: 79713 - DNA, 20 bp, human
gcggcaaaaggaagcaccgg

SEQ ID NO: 79714 - DNA, 20 bp, human
gagcagcgaccggcgcagga

SEQ ID NO: 79715 - DNA, 20 bp, human
gcgacggcaaaaggaagcac

SEQ ID NO: 79716 - DNA, 20 bp, human
gggcacgaggctctgaccat

SEQ ID NO: 79717 - DNA, 20 bp, human
gcagtctgtgaaaaagagga

SEQ ID NO: 79718 - DNA, 20 bp, human
gctggggaactcagtccaca

SEQ ID NO: 79719 - DNA, 20 bp, human
gcggccgccggcggcaaggt

SEQ ID NO: 79720 - DNA, 20 bp, human
gtgagacgcccgcacgccgg

SEQ ID NO: 79721 - DNA, 20 bp, human
gcacgctgaaacggtcccgg

SEQ ID NO: 79722 - DNA, 20 bp, human
gcgccacgctgaaacggtcc

SEQ ID NO: 79723 - DNA, 20 bp, human
gcgaggccaagagagacccc

SEQ ID NO: 79724 - DNA, 20 bp, human
ggacgccgagcccagcgcgt

SEQ ID NO: 79725 - DNA, 20 bp, human
gcgtccgggcgctgccgagc

SEQ ID NO: 79726 - DNA, 20 bp, human
gggcctgtggggtaaaccaa

SEQ ID NO: 79727 - DNA, 20 bp, human
gcctctggccaaactaccag

SEQ ID NO: 79728 - DNA, 20 bp, human
gactgaggatgatgtgacag

SEQ ID NO: 79729 - DNA, 20 bp, human
ggaaagggctccagctgtgt

SEQ ID NO: 79730 - DNA, 20 bp, human
ggacagaggaggcggcctgt

SEQ ID NO: 79731 - DNA, 20 bp, human
gagtagaaccagaccccatg

SEQ ID NO: 79732 - DNA, 20 bp, human
gtgctgggttatgaccctgg

SEQ ID NO: 79733 - DNA, 20 bp, human
gagcccttggtttaccccac

SEQ ID NO: 79734 - DNA, 20 bp, human
gtttggtaagtccccagaaa

SEQ ID NO: 79735 - DNA, 20 bp, human
gcggtgctgggttatgaccc

SEQ ID NO: 79736 - DNA, 20 bp, human
gtggtccttgggcccggtac

SEQ ID NO: 79737 - DNA, 20 bp, human
gcccatcgggcttaggatag

SEQ ID NO: 79738 - DNA, 20 bp, human
gctgaacgtctgagcgcagg

SEQ ID NO: 79739 - DNA, 20 bp, human
ggaatcccaaagtctctctt

SEQ ID NO: 79740 - DNA, 20 bp, human
gtccttgggcccggtactgg

SEQ ID NO: 79741 - DNA, 20 bp, human
gctcgcgaaccgccagtacc

SEQ ID NO: 79742 - DNA, 20 bp, human
gccgcggctccgccgaccag

SEQ ID NO: 79743 - DNA, 20 bp, human
gtgggaacggaatcggggag

SEQ ID NO: 79744 - DNA, 20 bp, human
gccgactgggaactcgccag

SEQ ID NO: 79745 - DNA, 20 bp, human
gcagtggtggcagctccgga

SEQ ID NO: 79746 - DNA, 20 bp, human
ggccaggcagcaaggaccag

SEQ ID NO: 79747 - DNA, 20 bp, human
ggctccggagacagcctcag

SEQ ID NO: 79748 - DNA, 20 bp, human
gggctctggacacccctctg

SEQ ID NO: 79749 - DNA, 20 bp, human
gagatgtctccaaggaatat

SEQ ID NO: 79750 - DNA, 20 bp, human
gaaggtggacagagaccgaa

SEQ ID NO: 79751 - DNA, 20 bp, human
ggtcgccgggctctccgagg

SEQ ID NO: 79752 - DNA, 20 bp, human
gctcatctggatggtctcta

SEQ ID NO: 79753 - DNA, 20 bp, human
gcacccagaccgtgaaaagg

SEQ ID NO: 79754 - DNA, 20 bp, human
gggatgtttccacagagaat

SEQ ID NO: 79755 - DNA, 20 bp, human
gaatatgggcacctactccc

SEQ ID NO: 79756 - DNA, 20 bp, human
gtgagcggaggctgctgaag

SEQ ID NO: 79757 - DNA, 20 bp, human
gtgtcctgggaacagatggg

SEQ ID NO: 79758 - DNA, 20 bp, human
gacttgtcctgggaacagat

SEQ ID NO: 79759 - DNA, 20 bp, human
gccccaggaggcccagcatc

SEQ ID NO: 79760 - DNA, 20 bp, human
gggacggcaggactgtgacg

SEQ ID NO: 79761 - DNA, 20 bp, human
ggcaggactgtgacgtggag

SEQ ID NO: 79762 - DNA, 20 bp, human
ggcagcctcagcgagcgtgg

SEQ ID NO: 79763 - DNA, 20 bp, human
gtggggagcacagccctcgt

SEQ ID NO: 79764 - DNA, 20 bp, human
gatccccgccacgctcgctg

SEQ ID NO: 79765 - DNA, 20 bp, human
gccctcgtgggatggatcac

SEQ ID NO: 79766 - DNA, 20 bp, human
gggatggtttaacaaaatga

SEQ ID NO: 79767 - DNA, 20 bp, human
gtgcagtgctgttgagccgg

SEQ ID NO: 79768 - DNA, 20 bp, human
gcaacagcactgcagtcagt

SEQ ID NO: 79769 - DNA, 20 bp, human
ggcagtggcagatcatagca

SEQ ID NO: 79770 - DNA, 20 bp, human
gtgcaaagcagtaagcctag

SEQ ID NO: 79771 - DNA, 20 bp, human
ggatgcccacttggacagag

SEQ ID NO: 79772 - DNA, 20 bp, human
gcagtccttagcatgtaact

SEQ ID NO: 79773 - DNA, 20 bp, human
ggttgggagattactcacgg

SEQ ID NO: 79774 - DNA, 20 bp, human
gccacttggacagagtggtg

SEQ ID NO: 79775 - DNA, 20 bp, human
gtgagcccagttacatgcta

SEQ ID NO: 79776 - DNA, 20 bp, human
gatggacgtctggaatcagg

SEQ ID NO: 79777 - DNA, 20 bp, human
gcagatggacgtctggaatc

SEQ ID NO: 79778 - DNA, 20 bp, human
gctgaaatagtaagtaaaga

SEQ ID NO: 79779 - DNA, 20 bp, human
gtccactcttgacagtctac

SEQ ID NO: 79780 - DNA, 20 bp, human
gactatttcagatggacgtc

SEQ ID NO: 79781 - DNA, 20 bp, human
ggctgagtgaacagagtaga

SEQ ID NO: 79782 - DNA, 20 bp, human
gttacttgcagtgaggaatt

SEQ ID NO: 79783 - DNA, 20 bp, human
ggtgcaagaatcggactgtt

SEQ ID NO: 79784 - DNA, 20 bp, human
gaattgtgtcctatgaacaa

SEQ ID NO: 79785 - DNA, 20 bp, human
gcaaaaaacaccaaagtgga

SEQ ID NO: 79786 - DNA, 20 bp, human
ggccggctccggggaaagtt

SEQ ID NO: 79787 - DNA, 20 bp, human
ggcagcgaactcagaccctg

SEQ ID NO: 79788 - DNA, 20 bp, human
ggtgaacgcactcaaccaat

SEQ ID NO: 79789 - DNA, 20 bp, human
gcggcgccggtgagtcgcag

SEQ ID NO: 79790 - DNA, 20 bp, human
gacgcactcaaccaatgggc

SEQ ID NO: 79791 - DNA, 20 bp, human
gtgagctcgggcgagcagag

SEQ ID NO: 79792 - DNA, 20 bp, human
gcggagggcggctcgctcgg

SEQ ID NO: 79793 - DNA, 20 bp, human
gaaccgtagtgccagcccat

SEQ ID NO: 79794 - DNA, 20 bp, human
ggctcgcccgagctcaaaga

SEQ ID NO: 79795 - DNA, 20 bp, human
ggcgcagcctcgcccagccg

SEQ ID NO: 79796 - DNA, 20 bp, human
gagggtaagaggatgagaac

SEQ ID NO: 79797 - DNA, 20 bp, human
gaatgtcttgccagggtaag

SEQ ID NO: 79798 - DNA, 20 bp, human
gggtctactccggaaacgga

SEQ ID NO: 79799 - DNA, 20 bp, human
gtactccggaaacggaggga

SEQ ID NO: 79800 - DNA, 20 bp, human
gctaactgaatgtcttgcca

SEQ ID NO: 79801 - DNA, 20 bp, human
ggcgctatgtagcgacagat

SEQ ID NO: 79802 - DNA, 20 bp, human
ggagtggagaatcagagatg

SEQ ID NO: 79803 - DNA, 20 bp, human
gtgcacagtaaggtgagacc

SEQ ID NO: 79804 - DNA, 20 bp, human
gtaagcaaacaggtctactc

SEQ ID NO: 79805 - DNA, 20 bp, human
ggaagggaaaagggaattaa

SEQ ID NO: 79806 - DNA, 20 bp, human
gggtgcggagccaatacccg

SEQ ID NO: 79807 - DNA, 20 bp, human
gcgcgggaccgaggcgaacc

SEQ ID NO: 79808 - DNA, 20 bp, human
ggaccgaggcgaaccgggtg

SEQ ID NO: 79809 - DNA, 20 bp, human
gcgggcagggatgcagcggg

SEQ ID NO: 79810 - DNA, 20 bp, human
gggatcccgagcagcccctc

SEQ ID NO: 79811 - DNA, 20 bp, human
gccagacccggagacaaaac

SEQ ID NO: 79812 - DNA, 20 bp, human
gccggtgcacagcagtgctc

SEQ ID NO: 79813 - DNA, 20 bp, human
ggtgctgctgccgcgggtat

SEQ ID NO: 79814 - DNA, 20 bp, human
ggccggctgcgctccgggca

SEQ ID NO: 79815 - DNA, 20 bp, human
gctccgcacccggttcgcct

SEQ ID NO: 79816 - DNA, 20 bp, human
gtccggctgcacggtcgcac

SEQ ID NO: 79817 - DNA, 20 bp, human
gtgcacggtcgcaccggcag

SEQ ID NO: 79818 - DNA, 20 bp, human
gtgggtgcggaggctcgagt

SEQ ID NO: 79819 - DNA, 20 bp, human
gaggctcgagtcggccacga

SEQ ID NO: 79820 - DNA, 20 bp, human
gatgagcgcggccagcaccg

SEQ ID NO: 79821 - DNA, 20 bp, human
gtcggctgcgcgttgcgctc

SEQ ID NO: 79822 - DNA, 20 bp, human
gccaagggcccgcaaagacg

SEQ ID NO: 79823 - DNA, 20 bp, human
gccgcgctgccggccccact

SEQ ID NO: 79824 - DNA, 20 bp, human
gcagagcaggcggtgccgag

SEQ ID NO: 79825 - DNA, 20 bp, human
ggcgcccccgaagcgttcag

SEQ ID NO: 79826 - DNA, 20 bp, human
ggggctatatggcactgtaa

SEQ ID NO: 79827 - DNA, 20 bp, human
gcatacttgtcagaattgtc

SEQ ID NO: 79828 - DNA, 20 bp, human
gaggggactgtatacaactg

SEQ ID NO: 79829 - DNA, 20 bp, human
gtgattgtgctattagtatc

SEQ ID NO: 79830 - DNA, 20 bp, human
gatacatatgtaaatcagtg

SEQ ID NO: 79831 - DNA, 20 bp, human
gaattttggagggggctata

SEQ ID NO: 79832 - DNA, 20 bp, human
gatgtaaatcagtgtggtag

SEQ ID NO: 79833 - DNA, 20 bp, human
gcttgtcagaattgtctggc

SEQ ID NO: 79834 - DNA, 20 bp, human
gccatctctgacttctttgt

SEQ ID NO: 79835 - DNA, 20 bp, human
ggtcattttagcttttgtgg

SEQ ID NO: 79836 - DNA, 20 bp, human
gctcggcaggcggaacttgt

SEQ ID NO: 79837 - DNA, 20 bp, human
gcggcgcgctccccacctac

SEQ ID NO: 79838 - DNA, 20 bp, human
ggaacgcggggcttcttggt

SEQ ID NO: 79839 - DNA, 20 bp, human
gcacttggaagggaagactg

SEQ ID NO: 79840 - DNA, 20 bp, human
gggcggaacttgtaggaacg

SEQ ID NO: 79841 - DNA, 20 bp, human
gcccagccggagcgagcaac

SEQ ID NO: 79842 - DNA, 20 bp, human
ggcgtacctgttgctcgctc

SEQ ID NO: 79843 - DNA, 20 bp, human
gcctagcgccttgagccggg

SEQ ID NO: 79844 - DNA, 20 bp, human
ggcaccagcgcaccatgtgg

SEQ ID NO: 79845 - DNA, 20 bp, human
ggtggaccttacacttggaa

SEQ ID NO: 79846 - DNA, 20 bp, human
gctcaccagaggaacaagta

SEQ ID NO: 79847 - DNA, 20 bp, human
gcacttacctagctcaccag

SEQ ID NO: 79848 - DNA, 20 bp, human
gctaggtgatatgaagctaa

SEQ ID NO: 79849 - DNA, 20 bp, human
gagccctaagtacccttgag

SEQ ID NO: 79850 - DNA, 20 bp, human
gctccgctcaagggtactta

SEQ ID NO: 79851 - DNA, 20 bp, human
ggcagttcaactccgctcaa

SEQ ID NO: 79852 - DNA, 20 bp, human
gcaaagaggcactagataca

SEQ ID NO: 79853 - DNA, 20 bp, human
ggatgtgctctaaggcaaag

SEQ ID NO: 79854 - DNA, 20 bp, human
gaagtccaggatgtgctcta

SEQ ID NO: 79855 - DNA, 20 bp, human
gtttcagggtgctgcgagtt

SEQ ID NO: 79856 - DNA, 20 bp, human
gtcctgaaggggctgcaaga

SEQ ID NO: 79857 - DNA, 20 bp, human
gcttctgatcaaggacgaca

SEQ ID NO: 79858 - DNA, 20 bp, human
gtggggcttcttctcctgaa

SEQ ID NO: 79859 - DNA, 20 bp, human
gagccctgctggcttcttac

SEQ ID NO: 79860 - DNA, 20 bp, human
ggtctgaaggcttctaactg

SEQ ID NO: 79861 - DNA, 20 bp, human
ggtggctcccaactctctgt

SEQ ID NO: 79862 - DNA, 20 bp, human
gtccctcttgcagccccttc

SEQ ID NO: 79863 - DNA, 20 bp, human
ggagagttgggagccacgat

SEQ ID NO: 79864 - DNA, 20 bp, human
gtagggtccaatggcccctg

SEQ ID NO: 79865 - DNA, 20 bp, human
gcaggttcctggtcccatcg

SEQ ID NO: 79866 - DNA, 20 bp, human
gggcggtgctcgtcacctcc

SEQ ID NO: 79867 - DNA, 20 bp, human
ggccggggactgcatgacgg

SEQ ID NO: 79868 - DNA, 20 bp, human
gcagggagctctgaaaggat

SEQ ID NO: 79869 - DNA, 20 bp, human
ggaaaccgaggccctctgga

SEQ ID NO: 79870 - DNA, 20 bp, human
gctgcgagctgtgcggtgtg

SEQ ID NO: 79871 - DNA, 20 bp, human
ggaacccaaggcggtaggaa

SEQ ID NO: 79872 - DNA, 20 bp, human
ggggcggggcgcgcagtcac

SEQ ID NO: 79873 - DNA, 20 bp, human
gggggactgcatgacggcgg

SEQ ID NO: 79874 - DNA, 20 bp, human
gctcaaaagagaagaaccca

SEQ ID NO: 79875 - DNA, 20 bp, human
gtaagccaccgagggcgctg

SEQ ID NO: 79876 - DNA, 20 bp, human
ggaggagaagcggacaccag

SEQ ID NO: 79877 - DNA, 20 bp, human
gcgcggccgcgagcaaagga

SEQ ID NO: 79878 - DNA, 20 bp, human
gcggggactgaggcagtaga

SEQ ID NO: 79879 - DNA, 20 bp, human
gccgccagcagctgcaactt

SEQ ID NO: 79880 - DNA, 20 bp, human
gtcccgctcgaagctaggtg

SEQ ID NO: 79881 - DNA, 20 bp, human
gactggagaggcgagaaggg

SEQ ID NO: 79882 - DNA, 20 bp, human
ggggcggcatcataatcctg

SEQ ID NO: 79883 - DNA, 20 bp, human
gcgctgccgccggagcaagt

SEQ ID NO: 79884 - DNA, 20 bp, human
gagccgcagcgccggtggag

SEQ ID NO: 79885 - DNA, 20 bp, human
gggatcaagacataccgcgg

SEQ ID NO: 79886 - DNA, 20 bp, human
gcacgacagccgggtctcag

SEQ ID NO: 79887 - DNA, 20 bp, human
ggaacctcacgactctgcag

SEQ ID NO: 79888 - DNA, 20 bp, human
gagtccagaacgccagacaa

SEQ ID NO: 79889 - DNA, 20 bp, human
gttccagagcagaggtgcta

SEQ ID NO: 79890 - DNA, 20 bp, human
gagggaccggttgatctgta

SEQ ID NO: 79891 - DNA, 20 bp, human
gggcaggacgcaggtgtaga

SEQ ID NO: 79892 - DNA, 20 bp, human
gtctgctctggaagtcccga

SEQ ID NO: 79893 - DNA, 20 bp, human
gctgtcgtggcggcgactcc

SEQ ID NO: 79894 - DNA, 20 bp, human
gtctggaagtcccgagggac

SEQ ID NO: 79895 - DNA, 20 bp, human
gagtcgccgccacgacagcc

SEQ ID NO: 79896 - DNA, 20 bp, human
gcggcccggagggatcacag

SEQ ID NO: 79897 - DNA, 20 bp, human
ggcgcggcccaggaccctat

SEQ ID NO: 79898 - DNA, 20 bp, human
gggctggcgggtggaccgga

SEQ ID NO: 79899 - DNA, 20 bp, human
gggagtggttggaaccggag

SEQ ID NO: 79900 - DNA, 20 bp, human
gcagtgccagggggtcccgg

SEQ ID NO: 79901 - DNA, 20 bp, human
gtggcgggtggaccggacgg

SEQ ID NO: 79902 - DNA, 20 bp, human
gctataggccatggctccat

SEQ ID NO: 79903 - DNA, 20 bp, human
gccgctcacgaaacgctcgg

SEQ ID NO: 79904 - DNA, 20 bp, human
gcctcggaaaccatgacccc

SEQ ID NO: 79905 - DNA, 20 bp, human
gcccaggaccctataggcca

SEQ ID NO: 79906 - DNA, 20 bp, human
gtctgctcgcaggcgctcac

SEQ ID NO: 79907 - DNA, 20 bp, human
ggcgcctgcgagcagagtgg

SEQ ID NO: 79908 - DNA, 20 bp, human
ggccacacgtgggacgccga

SEQ ID NO: 79909 - DNA, 20 bp, human
ggccctcggcgtcccacgtg

SEQ ID NO: 79910 - DNA, 20 bp, human
ggctggccgccgccacacgt

SEQ ID NO: 79911 - DNA, 20 bp, human
gctcgggcagagggactcgg

SEQ ID NO: 79912 - DNA, 20 bp, human
gactggctcggtccccgtga

SEQ ID NO: 79913 - DNA, 20 bp, human
gccggccccgagagacttct

SEQ ID NO: 79914 - DNA, 20 bp, human
ggctgagagaacctgaactc

SEQ ID NO: 79915 - DNA, 20 bp, human
gcgctcaccggctgcctcct

SEQ ID NO: 79916 - DNA, 20 bp, human
gcctctgcggggaagtgccg

SEQ ID NO: 79917 - DNA, 20 bp, human
ggaagtgccggggctgctcg

SEQ ID NO: 79918 - DNA, 20 bp, human
ggagccggccggggacatcg

SEQ ID NO: 79919 - DNA, 20 bp, human
gtgctcgaggctcagttctt

SEQ ID NO: 79920 - DNA, 20 bp, human
gagttcttaggactgcaagg

SEQ ID NO: 79921 - DNA, 20 bp, human
gagagagctgtggaccgagg

SEQ ID NO: 79922 - DNA, 20 bp, human
gcggtgcgcacagtctagag

SEQ ID NO: 79923 - DNA, 20 bp, human
gcgcccgcgggcagcgcatg

SEQ ID NO: 79924 - DNA, 20 bp, human
gctggaacggaaagtcggga

SEQ ID NO: 79925 - DNA, 20 bp, human
gctgcagaggcgaactgcgc

SEQ ID NO: 79926 - DNA, 20 bp, human
ggcagcggggaaggaactcc

SEQ ID NO: 79927 - DNA, 20 bp, human
gggcggctgaaaccatgtcc

SEQ ID NO: 79928 - DNA, 20 bp, human
gcccggcagaaagttagcag

SEQ ID NO: 79929 - DNA, 20 bp, human
gcggcgtcccgagctcccaa

SEQ ID NO: 79930 - DNA, 20 bp, human
ggggctgcaacagcgcgcgg

SEQ ID NO: 79931 - DNA, 20 bp, human
ggcggcggcgcggccagagg

SEQ ID NO: 79932 - DNA, 20 bp, human
gccccggcgctgcccggaca

SEQ ID NO: 79933 - DNA, 20 bp, human
ggcgggccaccgggccatcg

SEQ ID NO: 79934 - DNA, 20 bp, human
gggagcggaggcgtgcgcta

SEQ ID NO: 79935 - DNA, 20 bp, human
gctgtcccgctgcgccaggg

SEQ ID NO: 79936 - DNA, 20 bp, human
ggcgcgcccaagtgatggag

SEQ ID NO: 79937 - DNA, 20 bp, human
gcgtggcgcgggcacggcac

SEQ ID NO: 79938 - DNA, 20 bp, human
gagctgggcacgtctccggg

SEQ ID NO: 79939 - DNA, 20 bp, human
gggctcggcggagagcgagt

SEQ ID NO: 79940 - DNA, 20 bp, human
gctcctgcgcgcccaagtga

SEQ ID NO: 79941 - DNA, 20 bp, human
gaggctcgaggacgcaggaa

SEQ ID NO: 79942 - DNA, 20 bp, human
gccgcacagcttggcaccgg

SEQ ID NO: 79943 - DNA, 20 bp, human
gactctgcagctggtcgcca

SEQ ID NO: 79944 - DNA, 20 bp, human
gtctccgccgagcctagccc

SEQ ID NO: 79945 - DNA, 20 bp, human
gggcgcgggcacggcacggg

SEQ ID NO: 79946 - DNA, 20 bp, human
gcgggcacccacggactgag

SEQ ID NO: 79947 - DNA, 20 bp, human
gagcacaagccgggcaccca

SEQ ID NO: 79948 - DNA, 20 bp, human
gcgcgcgccgctcagtccgt

SEQ ID NO: 79949 - DNA, 20 bp, human
gctggagcggcgcgacccca

SEQ ID NO: 79950 - DNA, 20 bp, human
ggcgaccccatggcaggtag

SEQ ID NO: 79951 - DNA, 20 bp, human
gagcccagcgcgcggacgtc

SEQ ID NO: 79952 - DNA, 20 bp, human
gccgggcgcagagcacaagc

SEQ ID NO: 79953 - DNA, 20 bp, human
gtagcacctgtcgaagaagt

SEQ ID NO: 79954 - DNA, 20 bp, human
gggccgccgctacctgccat

SEQ ID NO: 79955 - DNA, 20 bp, human
gagcaggcgggcgcgcatct

SEQ ID NO: 79956 - DNA, 20 bp, human
ggcgcagagcgttctcggcg

SEQ ID NO: 79957 - DNA, 20 bp, human
ggaagtgattccgccctcag

SEQ ID NO: 79958 - DNA, 20 bp, human
gaggcgggcagccagcgact

SEQ ID NO: 79959 - DNA, 20 bp, human
ggcggcggactgcggagacg

SEQ ID NO: 79960 - DNA, 20 bp, human
ggggcggcgcagagcgttct

SEQ ID NO: 79961 - DNA, 20 bp, human
ggcgaaccccggcactccgg

SEQ ID NO: 79962 - DNA, 20 bp, human
ggcggactgcggagacgcgg

SEQ ID NO: 79963 - DNA, 20 bp, human
gggcgaggccgctagcaggc

SEQ ID NO: 79964 - DNA, 20 bp, human
gtccgccctcaggggagtgg

SEQ ID NO: 79965 - DNA, 20 bp, human
gacggcaagagacgccacgg

SEQ ID NO: 79966 - DNA, 20 bp, human
gttcgcgcgggccctcctag

SEQ ID NO: 79967 - DNA, 20 bp, human
gtcgaggccgcctaccgggt

SEQ ID NO: 79968 - DNA, 20 bp, human
ggcgtctccgatagcaagtc

SEQ ID NO: 79969 - DNA, 20 bp, human
gcggccggctcattccccca

SEQ ID NO: 79970 - DNA, 20 bp, human
gcgaaaggcgtcttcttccc

SEQ ID NO: 79971 - DNA, 20 bp, human
gtagggtctccggaggggtg

SEQ ID NO: 79972 - DNA, 20 bp, human
gttcggggcttgtccaggag

SEQ ID NO: 79973 - DNA, 20 bp, human
ggacagcagcgcgaaaagcg

SEQ ID NO: 79974 - DNA, 20 bp, human
gagccgcggggggtagagaa

SEQ ID NO: 79975 - DNA, 20 bp, human
gcccggctagggtctccgga

SEQ ID NO: 79976 - DNA, 20 bp, human
gacgtattggaggacgatca

SEQ ID NO: 79977 - DNA, 20 bp, human
ggagctggcattctgtgccg

SEQ ID NO: 79978 - DNA, 20 bp, human
ggaggacgatcacggcaaat

SEQ ID NO: 79979 - DNA, 20 bp, human
gcggcgcgcactcacctgga

SEQ ID NO: 79980 - DNA, 20 bp, human
ggccggggcacacgtattgg

SEQ ID NO: 79981 - DNA, 20 bp, human
ggccgggtaagcgggaaacc

SEQ ID NO: 79982 - DNA, 20 bp, human
gcgccaggctgagaccgtcc

SEQ ID NO: 79983 - DNA, 20 bp, human
gaggtagacttcgacatcaa

SEQ ID NO: 79984 - DNA, 20 bp, human
gtgtgccggggcacacgtat

SEQ ID NO: 79985 - DNA, 20 bp, human
gccgggtcccgctcgactac

SEQ ID NO: 79986 - DNA, 20 bp, human
gtgctccccgaagttggtgc

SEQ ID NO: 79987 - DNA, 20 bp, human
gcaggcgccgccggaggagt

SEQ ID NO: 79988 - DNA, 20 bp, human
gtgaagcgcggcacgaatcg

SEQ ID NO: 79989 - DNA, 20 bp, human
gctccttcttgccaggccgg

SEQ ID NO: 79990 - DNA, 20 bp, human
gcggccccccgaggtccctc

SEQ ID NO: 79991 - DNA, 20 bp, human
ggccccccgagggacctcgg

SEQ ID NO: 79992 - DNA, 20 bp, human
gccccccgaggtccctcggg

SEQ ID NO: 79993 - DNA, 20 bp, human
ggtccctcggggggcccccg

SEQ ID NO: 79994 - DNA, 20 bp, human
ggtacatgatgaccacgaag

SEQ ID NO: 79995 - DNA, 20 bp, human
gcggggcggcgggggcaact

SEQ ID NO: 79996 - DNA, 20 bp, human
ggggcgactgagcggacaaa

SEQ ID NO: 79997 - DNA, 20 bp, human
gtaggcgggagggacccgga

SEQ ID NO: 79998 - DNA, 20 bp, human
ggtctcgtcgcgagaagcag

SEQ ID NO: 79999 - DNA, 20 bp, human
gtgtgtgaggagttgaaggg

SEQ ID NO: 80000 - DNA, 20 bp, human
gcaaacggaagtgtaggtta

SEQ ID NO: 80001 - DNA, 20 bp, human
ggcggcccggggcgactgag

SEQ ID NO: 80002 - DNA, 20 bp, human
ggccgggctggggcacccgg

SEQ ID NO: 80003 - DNA, 20 bp, human
gcgcgagaagcagcggcccg

SEQ ID NO: 80004 - DNA, 20 bp, human
gaccgccaagctgggcatcg

SEQ ID NO: 80005 - DNA, 20 bp, human
gtcacctcggtggtaaggga

SEQ ID NO: 80006 - DNA, 20 bp, human
gggagccctgcagtactggg

SEQ ID NO: 80007 - DNA, 20 bp, human
gcgtcagtggggggtcccgt

SEQ ID NO: 80008 - DNA, 20 bp, human
ggcggcccatacgggaatcg

SEQ ID NO: 80009 - DNA, 20 bp, human
gggaccctgcgatcctcggg

SEQ ID NO: 80010 - DNA, 20 bp, human
ggcctcccggcggcccatac

SEQ ID NO: 80011 - DNA, 20 bp, human
gcaggacctcaggccccccg

SEQ ID NO: 80012 - DNA, 20 bp, human
gtggccgggggcgtcagtgg

SEQ ID NO: 80013 - DNA, 20 bp, human
gcatgtggaccgctggccgg

SEQ ID NO: 80014 - DNA, 20 bp, human
gcgctggccgggggcgtcag

SEQ ID NO: 80015 - DNA, 20 bp, human
gagctccgcgattcccgtat

SEQ ID NO: 80016 - DNA, 20 bp, human
gccgccggccagatgtggcg

SEQ ID NO: 80017 - DNA, 20 bp, human
gccacggctagataggccgc

SEQ ID NO: 80018 - DNA, 20 bp, human
gctgcagcgctcggcactgt

SEQ ID NO: 80019 - DNA, 20 bp, human
gataggccgccggccagatg

SEQ ID NO: 80020 - DNA, 20 bp, human
gtctagccgtggtcactcgt

SEQ ID NO: 80021 - DNA, 20 bp, human
gagaaggcgggactgatggg

SEQ ID NO: 80022 - DNA, 20 bp, human
gaagagaaggcgggactgat

SEQ ID NO: 80023 - DNA, 20 bp, human
ggctgaagtagtctcgagtg

SEQ ID NO: 80024 - DNA, 20 bp, human
gatgtggcgggggagagccg

SEQ ID NO: 80025 - DNA, 20 bp, human
gctcccccgccacatctggc

SEQ ID NO: 80026 - DNA, 20 bp, human
gaggctgctgcctgcttagg

SEQ ID NO: 80027 - DNA, 20 bp, human
gccctgatgtcacaattcag

SEQ ID NO: 80028 - DNA, 20 bp, human
gctacaggctgtggacaggg

SEQ ID NO: 80029 - DNA, 20 bp, human
gcatgaagagccccagaatg

SEQ ID NO: 80030 - DNA, 20 bp, human
gaggccagctccctgtcgga

SEQ ID NO: 80031 - DNA, 20 bp, human
gtcataaaagccatccgaca

SEQ ID NO: 80032 - DNA, 20 bp, human
gattgtgacatcagggacgg

SEQ ID NO: 80033 - DNA, 20 bp, human
gctatgaagagactgataag

SEQ ID NO: 80034 - DNA, 20 bp, human
ggaagagccccagaatgggg

SEQ ID NO: 80035 - DNA, 20 bp, human
ggtccacagcctgtagctgg

SEQ ID NO: 80036 - DNA, 20 bp, human
gtgggaggcgaagaccaggc

SEQ ID NO: 80037 - DNA, 20 bp, human
gcgagaagagaggaccgtgg

SEQ ID NO: 80038 - DNA, 20 bp, human
gctgctgggaggcgaagacc

SEQ ID NO: 80039 - DNA, 20 bp, human
ggaccgcaccccctcccgta

SEQ ID NO: 80040 - DNA, 20 bp, human
ggaagccctgcagaacgcat

SEQ ID NO: 80041 - DNA, 20 bp, human
gcagatggatagacgggtgg

SEQ ID NO: 80042 - DNA, 20 bp, human
ggcccgccgaggtcaagaag

SEQ ID NO: 80043 - DNA, 20 bp, human
gccccacccccgctggacag

SEQ ID NO: 80044 - DNA, 20 bp, human
gaagcagcccggccgaaatg

SEQ ID NO: 80045 - DNA, 20 bp, human
gcgaaatgcgggagaaatgg

SEQ ID NO: 80046 - DNA, 20 bp, human
gaacaggactgactccccat

SEQ ID NO: 80047 - DNA, 20 bp, human
ggcggagaccgggtgagcac

SEQ ID NO: 80048 - DNA, 20 bp, human
gagagagagcttctaggccg

SEQ ID NO: 80049 - DNA, 20 bp, human
gctcgcgcggtgctcatcac

SEQ ID NO: 80050 - DNA, 20 bp, human
ggcggagtgcgggggtacac

SEQ ID NO: 80051 - DNA, 20 bp, human
gggctcctcagcgcaagagt

SEQ ID NO: 80052 - DNA, 20 bp, human
gctggcgcagccgaccacgt

SEQ ID NO: 80053 - DNA, 20 bp, human
gaccggcctggggcgcgaga

SEQ ID NO: 80054 - DNA, 20 bp, human
gcggtggtgcgatcagcaaa

SEQ ID NO: 80055 - DNA, 20 bp, human
ggacaacgcgatccagccgg

SEQ ID NO: 80056 - DNA, 20 bp, human
gcaggcccagggagcacgag

SEQ ID NO: 80057 - DNA, 20 bp, human
gggatctgaagccagacgta

SEQ ID NO: 80058 - DNA, 20 bp, human
gccgatgcccgaggaacagc

SEQ ID NO: 80059 - DNA, 20 bp, human
gaagtgcaggccgatgcccg

SEQ ID NO: 80060 - DNA, 20 bp, human
gctgcacttggccgtacgtc

SEQ ID NO: 80061 - DNA, 20 bp, human
gacgttgcagctggacgtaa

SEQ ID NO: 80062 - DNA, 20 bp, human
gagggccgcgtggacgtgct

SEQ ID NO: 80063 - DNA, 20 bp, human
ggtaagggactcaaaatccg

SEQ ID NO: 80064 - DNA, 20 bp, human
ggtccagctgcaacgtctcc

SEQ ID NO: 80065 - DNA, 20 bp, human
gcctgggcctgggaacatgt

SEQ ID NO: 80066 - DNA, 20 bp, human
gcaagatggcagcagcgtgt

SEQ ID NO: 80067 - DNA, 20 bp, human
ggcccaacggccacaatacc

SEQ ID NO: 80068 - DNA, 20 bp, human
gggagtggccggcgacaaga

SEQ ID NO: 80069 - DNA, 20 bp, human
ggcagcgtgtcggagcgtga

SEQ ID NO: 80070 - DNA, 20 bp, human
ggtcggagcgtgaaggtaga

SEQ ID NO: 80071 - DNA, 20 bp, human
gggtgaaagtcagcactccg

SEQ ID NO: 80072 - DNA, 20 bp, human
ggcgctgtcccggcccgtaa

SEQ ID NO: 80073 - DNA, 20 bp, human
ggacagcgtggggatggtct

SEQ ID NO: 80074 - DNA, 20 bp, human
gttgtcgccggccactccac

SEQ ID NO: 80075 - DNA, 20 bp, human
gtgtcccggcccgtaaagga

SEQ ID NO: 80076 - DNA, 20 bp, human
gctaacaccagaaagagtag

SEQ ID NO: 80077 - DNA, 20 bp, human
ggcagagatgaggtaaaggg

SEQ ID NO: 80078 - DNA, 20 bp, human
gagcttcacgaaggactcta

SEQ ID NO: 80079 - DNA, 20 bp, human
gtcatctctgcaaagcaggg

SEQ ID NO: 80080 - DNA, 20 bp, human
gcccagcccagcggaaggaa

SEQ ID NO: 80081 - DNA, 20 bp, human
ggggagcagacgatcagtaa

SEQ ID NO: 80082 - DNA, 20 bp, human
gtatccttagggcaaaaatg

SEQ ID NO: 80083 - DNA, 20 bp, human
gaagagtaggggcgagagca

SEQ ID NO: 80084 - DNA, 20 bp, human
gaacgctcgcagccacaaaa

SEQ ID NO: 80085 - DNA, 20 bp, human
gagacacatccacaaattaa

SEQ ID NO: 80086 - DNA, 20 bp, human
ggtacgaaatacgcagggct

SEQ ID NO: 80087 - DNA, 20 bp, human
gggcgccggccgtgacggtg

SEQ ID NO: 80088 - DNA, 20 bp, human
ggaggaggcgccggccgtga

SEQ ID NO: 80089 - DNA, 20 bp, human
gtcatcctcaccgtcacggc

SEQ ID NO: 80090 - DNA, 20 bp, human
gcggtgaggatgacactaat

SEQ ID NO: 80091 - DNA, 20 bp, human
gagagcgagtgaatgaatcc

SEQ ID NO: 80092 - DNA, 20 bp, human
ggcacaggagcctgagaaag

SEQ ID NO: 80093 - DNA, 20 bp, human
gagtgtcatcctcaccgtca

SEQ ID NO: 80094 - DNA, 20 bp, human
gcacaagccccagagactta

SEQ ID NO: 80095 - DNA, 20 bp, human
ggacagccaagggagccagg

SEQ ID NO: 80096 - DNA, 20 bp, human
gggactgaaccagaaggaag

SEQ ID NO: 80097 - DNA, 20 bp, human
gtagcagcttggaaggagac

SEQ ID NO: 80098 - DNA, 20 bp, human
gtcctccctaggactacaca

SEQ ID NO: 80099 - DNA, 20 bp, human
ggtcaggttagttagatgaa

SEQ ID NO: 80100 - DNA, 20 bp, human
ggatggtgatcagaagcaga

SEQ ID NO: 80101 - DNA, 20 bp, human
gtagacagtacctcctccct

SEQ ID NO: 80102 - DNA, 20 bp, human
gtatacagactaagggacca

SEQ ID NO: 80103 - DNA, 20 bp, human
gtccttgtgtagtcctaggg

SEQ ID NO: 80104 - DNA, 20 bp, human
gctgtctacacagagctcta

SEQ ID NO: 80105 - DNA, 20 bp, human
gcaggttgatagaaagactc

SEQ ID NO: 80106 - DNA, 20 bp, human
gggtgtagctacaaaaccag

SEQ ID NO: 80107 - DNA, 20 bp, human
gtcacctccaaagccccgtg

SEQ ID NO: 80108 - DNA, 20 bp, human
gcgcatcaaatcctcaatag

SEQ ID NO: 80109 - DNA, 20 bp, human
gcgtgtggcgctgtaggcta

SEQ ID NO: 80110 - DNA, 20 bp, human
ggcagggtctccgaaggcag

SEQ ID NO: 80111 - DNA, 20 bp, human
ggtcagacccggctcaccga

SEQ ID NO: 80112 - DNA, 20 bp, human
gcaggatccagcctctattg

SEQ ID NO: 80113 - DNA, 20 bp, human
gcggcctcacggggctttgg

SEQ ID NO: 80114 - DNA, 20 bp, human
gggaatggctctgtcagtcg

SEQ ID NO: 80115 - DNA, 20 bp, human
gtttgatgcgacggcctcac

SEQ ID NO: 80116 - DNA, 20 bp, human
gtcagggccagtgagtctag

SEQ ID NO: 80117 - DNA, 20 bp, human
gactggccctgagcacttga

SEQ ID NO: 80118 - DNA, 20 bp, human
gctttgcccgctagactcac

SEQ ID NO: 80119 - DNA, 20 bp, human
gatgcacctcctggaaaaaa

SEQ ID NO: 80120 - DNA, 20 bp, human
gaggatcaagccccaaaaag

SEQ ID NO: 80121 - DNA, 20 bp, human
ggagtctagcgggcaaaggc

SEQ ID NO: 80122 - DNA, 20 bp, human
ggacacagcatggatctgcc

SEQ ID NO: 80123 - DNA, 20 bp, human
ggcgggcaaaggctggctgg

SEQ ID NO: 80124 - DNA, 20 bp, human
gtgtcccacatagtactgtg

SEQ ID NO: 80125 - DNA, 20 bp, human
gcatgaaaaatacttgggtg

SEQ ID NO: 80126 - DNA, 20 bp, human
gacacagagagccacggcca

SEQ ID NO: 80127 - DNA, 20 bp, human
gttgcggtcaatgggacagt

SEQ ID NO: 80128 - DNA, 20 bp, human
gactgtttcagccctggccg

SEQ ID NO: 80129 - DNA, 20 bp, human
gggtcaatgggacagtgggc

SEQ ID NO: 80130 - DNA, 20 bp, human
ggctctctgtgtatgcctcc

SEQ ID NO: 80131 - DNA, 20 bp, human
gtcctgggaccacgctgctc

SEQ ID NO: 80132 - DNA, 20 bp, human
gttgaccgcaagaaagactt

SEQ ID NO: 80133 - DNA, 20 bp, human
ggaatctcacgcacttcgcc

SEQ ID NO: 80134 - DNA, 20 bp, human
gaacagttcttcatcctcac

SEQ ID NO: 80135 - DNA, 20 bp, human
gacagggctgctggtgtgcc

SEQ ID NO: 80136 - DNA, 20 bp, human
gtgcggctgcgcgcgtatgc

SEQ ID NO: 80137 - DNA, 20 bp, human
gtggtactggtcaccggcgc

SEQ ID NO: 80138 - DNA, 20 bp, human
gacgccgactgcgggacagg

SEQ ID NO: 80139 - DNA, 20 bp, human
gtcccgcagtcggcgtccag

SEQ ID NO: 80140 - DNA, 20 bp, human
gcccgcccgtcgaacctcag

SEQ ID NO: 80141 - DNA, 20 bp, human
gagctgaggtcaccccgctg

SEQ ID NO: 80142 - DNA, 20 bp, human
gatgcccacagataagggtc

SEQ ID NO: 80143 - DNA, 20 bp, human
gccgactgcgggacaggagg

SEQ ID NO: 80144 - DNA, 20 bp, human
gctccctgacccttatctgt

SEQ ID NO: 80145 - DNA, 20 bp, human
gggctgctgattgcaaaact

SEQ ID NO: 80146 - DNA, 20 bp, human
gttggagtgggcagcagttg

SEQ ID NO: 80147 - DNA, 20 bp, human
gccagtcctagagacttgaa

SEQ ID NO: 80148 - DNA, 20 bp, human
ggaggaagccgactgctgcc

SEQ ID NO: 80149 - DNA, 20 bp, human
ggcaagtccggtatgtaggt

SEQ ID NO: 80150 - DNA, 20 bp, human
gcccttacccacctacatac

SEQ ID NO: 80151 - DNA, 20 bp, human
gataagagcaatgcagaggt

SEQ ID NO: 80152 - DNA, 20 bp, human
gacttacaaatagggactct

SEQ ID NO: 80153 - DNA, 20 bp, human
ggtactctcccaaacttcat

SEQ ID NO: 80154 - DNA, 20 bp, human
gctacataccggacttgctt

SEQ ID NO: 80155 - DNA, 20 bp, human
gcctctgaaaacgggattct

SEQ ID NO: 80156 - DNA, 20 bp, human
ggtaggtcaaaatcaatgcg

SEQ ID NO: 80157 - DNA, 20 bp, human
ggtgtagtttatgggtcggg

SEQ ID NO: 80158 - DNA, 20 bp, human
gggaggtgtagtttatgggt

SEQ ID NO: 80159 - DNA, 20 bp, human
gtcaagggaggtgtagttta

SEQ ID NO: 80160 - DNA, 20 bp, human
gttaaacatactttgtgcac

SEQ ID NO: 80161 - DNA, 20 bp, human
gaacagattgtttttttaac

SEQ ID NO: 80162 - DNA, 20 bp, human
ggtcattatagaatcaaggg

SEQ ID NO: 80163 - DNA, 20 bp, human
ggctgggaggtcaatttagt

SEQ ID NO: 80164 - DNA, 20 bp, human
gcctgtcattatagaatcaa

SEQ ID NO: 80165 - DNA, 20 bp, human
gtacaggtaaactgttctaa

SEQ ID NO: 80166 - DNA, 20 bp, human
gagcaggtgaggcctccttt

SEQ ID NO: 80167 - DNA, 20 bp, human
gggtgaggcctcctttgggt

SEQ ID NO: 80168 - DNA, 20 bp, human
ggcctctgccaacccaaagg

SEQ ID NO: 80169 - DNA, 20 bp, human
ggcactgagctaaatgaaac

SEQ ID NO: 80170 - DNA, 20 bp, human
ggccgcctctgccaacccaa

SEQ ID NO: 80171 - DNA, 20 bp, human
ggcctcctttgggttggcag

SEQ ID NO: 80172 - DNA, 20 bp, human
gagaggcggcagcggatcag

SEQ ID NO: 80173 - DNA, 20 bp, human
gcaggggtccgagagagcag

SEQ ID NO: 80174 - DNA, 20 bp, human
gtcaccggggctagcaggtg

SEQ ID NO: 80175 - DNA, 20 bp, human
gaggcctcacctgctagccc

SEQ ID NO: 80176 - DNA, 20 bp, human
ggaccaaggccagtgcggag

SEQ ID NO: 80177 - DNA, 20 bp, human
gggccagtgcggagcggagt

SEQ ID NO: 80178 - DNA, 20 bp, human
gccttggtcacaggttgagg

SEQ ID NO: 80179 - DNA, 20 bp, human
gtcagacacgtcagcctgga

SEQ ID NO: 80180 - DNA, 20 bp, human
gaaccgactccgctccgcac

SEQ ID NO: 80181 - DNA, 20 bp, human
gggagctgagacgccatggc

SEQ ID NO: 80182 - DNA, 20 bp, human
gtgcgacctggaccgggcag

SEQ ID NO: 80183 - DNA, 20 bp, human
gagcggcacaggagacggtg

SEQ ID NO: 80184 - DNA, 20 bp, human
gtccaggtcgcaggcagcta

SEQ ID NO: 80185 - DNA, 20 bp, human
gaaggcagcatggttccctc

SEQ ID NO: 80186 - DNA, 20 bp, human
gcagctactcctgcagtggt

SEQ ID NO: 80187 - DNA, 20 bp, human
ggtagcaggaatcactcacc

SEQ ID NO: 80188 - DNA, 20 bp, human
gaaacactgcatgtatgtgg

SEQ ID NO: 80189 - DNA, 20 bp, human
gcatggccatccaaagtagc

SEQ ID NO: 80190 - DNA, 20 bp, human
gatacatgcagtgtttaaga

SEQ ID NO: 80191 - DNA, 20 bp, human
gttggatggccatgacgggc

SEQ ID NO: 80192 - DNA, 20 bp, human
ggctaaaaagagatgtcaaa

SEQ ID NO: 80193 - DNA, 20 bp, human
gtaaaagctggacagaagag

SEQ ID NO: 80194 - DNA, 20 bp, human
gagacttgccacaggaaatg

SEQ ID NO: 80195 - DNA, 20 bp, human
gcttctcacctcatttcctg

SEQ ID NO: 80196 - DNA, 20 bp, human
gctccagggatgaggcagta

SEQ ID NO: 80197 - DNA, 20 bp, human
gtctagcgtgacccagaaga

SEQ ID NO: 80198 - DNA, 20 bp, human
gtcatccctggaggaaggac

SEQ ID NO: 80199 - DNA, 20 bp, human
gtccatcttaaactctgcat

SEQ ID NO: 80200 - DNA, 20 bp, human
gccatgaccccacaactgcc

SEQ ID NO: 80201 - DNA, 20 bp, human
gactactcctggcagttgtg

SEQ ID NO: 80202 - DNA, 20 bp, human
gcagaggatcgtccgcctgt

SEQ ID NO: 80203 - DNA, 20 bp, human
gaggatcgtccgcctgttgg

SEQ ID NO: 80204 - DNA, 20 bp, human
gcttttaacaatctaagtta

SEQ ID NO: 80205 - DNA, 20 bp, human
gtaaactctgcatgggtgtg

SEQ ID NO: 80206 - DNA, 20 bp, human
gcagccctggacgaaagaag

SEQ ID NO: 80207 - DNA, 20 bp, human
gggcccctccaggccagtct

SEQ ID NO: 80208 - DNA, 20 bp, human
gggaggagccagcggaagga

SEQ ID NO: 80209 - DNA, 20 bp, human
ggagaccttggctcatccag

SEQ ID NO: 80210 - DNA, 20 bp, human
gtctgggcaccctgggatag

SEQ ID NO: 80211 - DNA, 20 bp, human
ggtgccctggagcggtgacg

SEQ ID NO: 80212 - DNA, 20 bp, human
gcagcctcgtcaccgctcca

SEQ ID NO: 80213 - DNA, 20 bp, human
gggagggcagagctgatcct

SEQ ID NO: 80214 - DNA, 20 bp, human
gggccctcttctttcgtcca

SEQ ID NO: 80215 - DNA, 20 bp, human
gggcatggccgactctgcac

SEQ ID NO: 80216 - DNA, 20 bp, human
ggggtctggcgggaccggtt

SEQ ID NO: 80217 - DNA, 20 bp, human
gccggcaaagtcttccaaac

SEQ ID NO: 80218 - DNA, 20 bp, human
ggcgtggtgagagctcagag

SEQ ID NO: 80219 - DNA, 20 bp, human
ggcatgcgccggcgacaacg

SEQ ID NO: 80220 - DNA, 20 bp, human
gcagctccggcggccgagac

SEQ ID NO: 80221 - DNA, 20 bp, human
gcgcgtacgcgggtcacgtg

SEQ ID NO: 80222 - DNA, 20 bp, human
gcgcgcgggtctggcgggac

SEQ ID NO: 80223 - DNA, 20 bp, human
ggaacaggggtgcagcgccg

SEQ ID NO: 80224 - DNA, 20 bp, human
ggcggccgcgcgggtctggc

SEQ ID NO: 80225 - DNA, 20 bp, human
gacggggttcgcggtttggg

SEQ ID NO: 80226 - DNA, 20 bp, human
gcgtagatcagaggaggtgg

SEQ ID NO: 80227 - DNA, 20 bp, human
ggactttcgtagatcagagg

SEQ ID NO: 80228 - DNA, 20 bp, human
ggcaggggcggggataaatg

SEQ ID NO: 80229 - DNA, 20 bp, human
gtacccaacaccgggtaagg

SEQ ID NO: 80230 - DNA, 20 bp, human
gtttcgtagatcagaggagg

SEQ ID NO: 80231 - DNA, 20 bp, human
gcatgactttcgtagatcag

SEQ ID NO: 80232 - DNA, 20 bp, human
ggcgagcagagagctaaagc

SEQ ID NO: 80233 - DNA, 20 bp, human
gtacccccttacccggtgtt

SEQ ID NO: 80234 - DNA, 20 bp, human
gcgtgtgagttctaggtgaa

SEQ ID NO: 80235 - DNA, 20 bp, human
ggaggtcaaggatactgcct

SEQ ID NO: 80236 - DNA, 20 bp, human
ggtgtccgggtcgctcacga

SEQ ID NO: 80237 - DNA, 20 bp, human
ggtccacagcttggtcagga

SEQ ID NO: 80238 - DNA, 20 bp, human
gtgcccccgccagagaaggg

SEQ ID NO: 80239 - DNA, 20 bp, human
gcgcgcccgttgcaagatgg

SEQ ID NO: 80240 - DNA, 20 bp, human
gccgcgcgtaagctgaagtg

SEQ ID NO: 80241 - DNA, 20 bp, human
ggagcgcgcccgttgcaaga

SEQ ID NO: 80242 - DNA, 20 bp, human
gccctgcccccgccagagaa

SEQ ID NO: 80243 - DNA, 20 bp, human
ggctgtgtgtgcgcagcggg

SEQ ID NO: 80244 - DNA, 20 bp, human
gacagccccggggcccagca

SEQ ID NO: 80245 - DNA, 20 bp, human
gagacccagagccttaagtt

SEQ ID NO: 80246 - DNA, 20 bp, human
gctgcgttgtgggcgttctc

SEQ ID NO: 80247 - DNA, 20 bp, human
gcgccgctaccaccgcgttc

SEQ ID NO: 80248 - DNA, 20 bp, human
gcacccgaacgcggtggtag

SEQ ID NO: 80249 - DNA, 20 bp, human
gattctacacccgaacgcgg

SEQ ID NO: 80250 - DNA, 20 bp, human
gcgcggaccggaccgttaag

SEQ ID NO: 80251 - DNA, 20 bp, human
gtgaggaggcggttattcag

SEQ ID NO: 80252 - DNA, 20 bp, human
gcatcacctggagccaggta

SEQ ID NO: 80253 - DNA, 20 bp, human
gcaaattctacacccgaacg

SEQ ID NO: 80254 - DNA, 20 bp, human
gaggcagccccttaacggtc

SEQ ID NO: 80255 - DNA, 20 bp, human
gggatgagtgtgcagtaaag

SEQ ID NO: 80256 - DNA, 20 bp, human
ggtgagcgcggcagtggccc

SEQ ID NO: 80257 - DNA, 20 bp, human
ggccctggcagctggcggag

SEQ ID NO: 80258 - DNA, 20 bp, human
gctgggagtgagcgcggcag

SEQ ID NO: 80259 - DNA, 20 bp, human
gcgcgctctgggagtgagcg

SEQ ID NO: 80260 - DNA, 20 bp, human
ggcgccacgtgcacacgggc

SEQ ID NO: 80261 - DNA, 20 bp, human
gcgggctgatggcgtcacaa

SEQ ID NO: 80262 - DNA, 20 bp, human
gggcccagcccgtgtgcacg

SEQ ID NO: 80263 - DNA, 20 bp, human
gcgccggcgccacgtgcaca

SEQ ID NO: 80264 - DNA, 20 bp, human
gggcaaccgaaaggcagcgc

SEQ ID NO: 80265 - DNA, 20 bp, human
gcgatcagggaggccgccgc

SEQ ID NO: 80266 - DNA, 20 bp, human
gacccggcaggcctcctcag

SEQ ID NO: 80267 - DNA, 20 bp, human
ggacgctcaggcgaacggag

SEQ ID NO: 80268 - DNA, 20 bp, human
gcaggcgaacggagcggagg

SEQ ID NO: 80269 - DNA, 20 bp, human
ggctcaggcgaacggagcgg

SEQ ID NO: 80270 - DNA, 20 bp, human
ggcagcggccatgggcgaag

SEQ ID NO: 80271 - DNA, 20 bp, human
ggaggcctgccgggttagtg

SEQ ID NO: 80272 - DNA, 20 bp, human
gacagaccgggtccccgcgt

SEQ ID NO: 80273 - DNA, 20 bp, human
ggcgccgacgctcaggcgaa

SEQ ID NO: 80274 - DNA, 20 bp, human
gacgctaagtcccgaagcag

SEQ ID NO: 80275 - DNA, 20 bp, human
gcatgggagcgtgggatgga

SEQ ID NO: 80276 - DNA, 20 bp, human
ggaggtgcgcgcagccgctt

SEQ ID NO: 80277 - DNA, 20 bp, human
gggagggaccccgggaccac

SEQ ID NO: 80278 - DNA, 20 bp, human
gctgcggccgaagaagggtt

SEQ ID NO: 80279 - DNA, 20 bp, human
ggcatggtgcagtctcggcc

SEQ ID NO: 80280 - DNA, 20 bp, human
gtcggcccggctctgcgctc

SEQ ID NO: 80281 - DNA, 20 bp, human
gcacggcccagtctcaggag

SEQ ID NO: 80282 - DNA, 20 bp, human
ggaagggctggtctagctca

SEQ ID NO: 80283 - DNA, 20 bp, human
gagagtccgagggaccttcg

SEQ ID NO: 80284 - DNA, 20 bp, human
ggggtagggtgggaactaaa

SEQ ID NO: 80285 - DNA, 20 bp, human
gctgaagacctagagtccga

SEQ ID NO: 80286 - DNA, 20 bp, human
ggatgggcgccggcaggagc

SEQ ID NO: 80287 - DNA, 20 bp, human
gaacggtccctggtacgcgg

SEQ ID NO: 80288 - DNA, 20 bp, human
ggagggatcgagaacggtgt

SEQ ID NO: 80289 - DNA, 20 bp, human
gtccctggtacgcggcggat

SEQ ID NO: 80290 - DNA, 20 bp, human
gcagggcgaggcgaaggccg

SEQ ID NO: 80291 - DNA, 20 bp, human
gctcgccgcggccgtcccag

SEQ ID NO: 80292 - DNA, 20 bp, human
ggccggggagggatcgagaa

SEQ ID NO: 80293 - DNA, 20 bp, human
ggcagctcggcctcgaagag

SEQ ID NO: 80294 - DNA, 20 bp, human
gtgaggtgcacgagcagctg

SEQ ID NO: 80295 - DNA, 20 bp, human
gcaccttgcggaagccgtag

SEQ ID NO: 80296 - DNA, 20 bp, human
gcagtccagtggggagtcgg

SEQ ID NO: 80297 - DNA, 20 bp, human
gatggcgacggcgtgtggtg

SEQ ID NO: 80298 - DNA, 20 bp, human
gcaggtctgcatctacggtg

SEQ ID NO: 80299 - DNA, 20 bp, human
ggtcgccatgcagtccagtg

SEQ ID NO: 80300 - DNA, 20 bp, human
ggctgcctccgactccccac

SEQ ID NO: 80301 - DNA, 20 bp, human
gtggctacagcctgacccat

SEQ ID NO: 80302 - DNA, 20 bp, human
gacggtgtggcagggcccct

SEQ ID NO: 80303 - DNA, 20 bp, human
gagatgcccgacagcccctt

SEQ ID NO: 80304 - DNA, 20 bp, human
gtgctggggaccgacagtgt

SEQ ID NO: 80305 - DNA, 20 bp, human
gagaatgtgcacatgcagat

SEQ ID NO: 80306 - DNA, 20 bp, human
gcagtccagtggggagtcgg

SEQ ID NO: 80307 - DNA, 20 bp, human
gatggcgacggcgtgtggtg

SEQ ID NO: 80308 - DNA, 20 bp, human
gcaggtctgcatctacggtg

SEQ ID NO: 80309 - DNA, 20 bp, human
ggtcgccatgcagtccagtg

SEQ ID NO: 80310 - DNA, 20 bp, human
ggctgcctccgactccccac

SEQ ID NO: 80311 - DNA, 20 bp, human
gtggctacagcctgacccat

SEQ ID NO: 80312 - DNA, 20 bp, human
gacggtgtggcagggcccct

SEQ ID NO: 80313 - DNA, 20 bp, human
gagatgcccgacagcccctt

SEQ ID NO: 80314 - DNA, 20 bp, human
gtgctggggaccgacagtgt

SEQ ID NO: 80315 - DNA, 20 bp, human
gagaatgtgcacatgcagat

SEQ ID NO: 80316 - DNA, 20 bp, human
gtagataagtgtacatgctt

SEQ ID NO: 80317 - DNA, 20 bp, human
ggtgtgaacacaccttccct

SEQ ID NO: 80318 - DNA, 20 bp, human
gagtttgggaaccattgtga

SEQ ID NO: 80319 - DNA, 20 bp, human
gaaagaaattttggaaacaa

SEQ ID NO: 80320 - DNA, 20 bp, human
gtaacttggactttctaaca

SEQ ID NO: 80321 - DNA, 20 bp, human
gtgtcattgttactcagttt

SEQ ID NO: 80322 - DNA, 20 bp, human
gatttctttatctactcttc

SEQ ID NO: 80323 - DNA, 20 bp, human
gagcagttaattcatctttg

SEQ ID NO: 80324 - DNA, 20 bp, human
gcacaatggagacctagtgg

SEQ ID NO: 80325 - DNA, 20 bp, human
gcttatctagaccatcacaa

SEQ ID NO: 80326 - DNA, 20 bp, human
gtagataagtgtacatgctt

SEQ ID NO: 80327 - DNA, 20 bp, human
ggtgtgaacacaccttccct

SEQ ID NO: 80328 - DNA, 20 bp, human
gagtttgggaaccattgtga

SEQ ID NO: 80329 - DNA, 20 bp, human
gaaagaaattttggaaacaa

SEQ ID NO: 80330 - DNA, 20 bp, human
gtaacttggactttctaaca

SEQ ID NO: 80331 - DNA, 20 bp, human
gtgtcattgttactcagttt

SEQ ID NO: 80332 - DNA, 20 bp, human
gatttctttatctactcttc

SEQ ID NO: 80333 - DNA, 20 bp, human
gagcagttaattcatctttg

SEQ ID NO: 80334 - DNA, 20 bp, human
gcacaatggagacctagtgg

SEQ ID NO: 80335 - DNA, 20 bp, human
gcttatctagaccatcacaa

SEQ ID NO: 80336 - DNA, 20 bp, human
gcgagggcctcggccatcca

SEQ ID NO: 80337 - DNA, 20 bp, human
gactggcacagctacagcga

SEQ ID NO: 80338 - DNA, 20 bp, human
ggctcttgggtcacatacct

SEQ ID NO: 80339 - DNA, 20 bp, human
gtcgaggagacagaacgtgg

SEQ ID NO: 80340 - DNA, 20 bp, human
gggagacccttggatggccg

SEQ ID NO: 80341 - DNA, 20 bp, human
gctcgagggctgaggctctt

SEQ ID NO: 80342 - DNA, 20 bp, human
gcaaggtctgcacgtcaatg

SEQ ID NO: 80343 - DNA, 20 bp, human
gagaccttgaatcgaaaccc

SEQ ID NO: 80344 - DNA, 20 bp, human
ggtgggtagcggggaagtag

SEQ ID NO: 80345 - DNA, 20 bp, human
gggcatgggggagagcttcg

SEQ ID NO: 80346 - DNA, 20 bp, human
gccgcgcgggagggcacccg

SEQ ID NO: 80347 - DNA, 20 bp, human
gttgcttcagcgtcccggtg

SEQ ID NO: 80348 - DNA, 20 bp, human
gaccaacggcacagccacac

SEQ ID NO: 80349 - DNA, 20 bp, human
gacttagccaaggtgacggg

SEQ ID NO: 80350 - DNA, 20 bp, human
gggtcacttagccaaggtga

SEQ ID NO: 80351 - DNA, 20 bp, human
ggcgtgtgcgcgcttccggg

SEQ ID NO: 80352 - DNA, 20 bp, human
gggtccccaacgaacacccc

SEQ ID NO: 80353 - DNA, 20 bp, human
gccacaaccacccgtcacct

SEQ ID NO: 80354 - DNA, 20 bp, human
gggaggcctcgggaccgctg

SEQ ID NO: 80355 - DNA, 20 bp, human
gggaagcgcgcacacgctcg

SEQ ID NO: 80356 - DNA, 20 bp, human
ggtcactccggcgcagtgtt

SEQ ID NO: 80357 - DNA, 20 bp, human
ggttgggactgtctgggtat

SEQ ID NO: 80358 - DNA, 20 bp, human
gcgcagtgttgggactgtct

SEQ ID NO: 80359 - DNA, 20 bp, human
ggccgcgtccggaagtggag

SEQ ID NO: 80360 - DNA, 20 bp, human
gatagggtgagggtagtggt

SEQ ID NO: 80361 - DNA, 20 bp, human
gtagctctctcgagtcactc

SEQ ID NO: 80362 - DNA, 20 bp, human
gacgtaatagtgagcaacgt

SEQ ID NO: 80363 - DNA, 20 bp, human
gcggctacggggcgtcggag

SEQ ID NO: 80364 - DNA, 20 bp, human
gtgactcagcacggccttgt

SEQ ID NO: 80365 - DNA, 20 bp, human
gcaccccgacatctagacta

SEQ ID NO: 80366 - DNA, 20 bp, human
gaggcggctcctgcgatcga

SEQ ID NO: 80367 - DNA, 20 bp, human
gtgtgaggatccgaacccag

SEQ ID NO: 80368 - DNA, 20 bp, human
gggactcgcacagctcccgg

SEQ ID NO: 80369 - DNA, 20 bp, human
gaggatccgaacccaggggt

SEQ ID NO: 80370 - DNA, 20 bp, human
gggatggccgaaggttgcgg

SEQ ID NO: 80371 - DNA, 20 bp, human
gagatactattagatctgta

SEQ ID NO: 80372 - DNA, 20 bp, human
ggacctgcttgcggtgtagt

SEQ ID NO: 80373 - DNA, 20 bp, human
gcgaggtcgctgagacctcc

SEQ ID NO: 80374 - DNA, 20 bp, human
gctgcttgcggtgtagtggg

SEQ ID NO: 80375 - DNA, 20 bp, human
gcgcttctcgaaggtcctgg

SEQ ID NO: 80376 - DNA, 20 bp, human
gcgcggacagagacccgcac

SEQ ID NO: 80377 - DNA, 20 bp, human
gctgcccggcggctcagaca

SEQ ID NO: 80378 - DNA, 20 bp, human
gcagagacccgcacgggcac

SEQ ID NO: 80379 - DNA, 20 bp, human
gggaggcgccacccgaggca

SEQ ID NO: 80380 - DNA, 20 bp, human
gcgggagcgctgctctgacg

SEQ ID NO: 80381 - DNA, 20 bp, human
ggaccaaccaggcgcctcag

SEQ ID NO: 80382 - DNA, 20 bp, human
gcgcagccccggaccgcgag

SEQ ID NO: 80383 - DNA, 20 bp, human
ggcgcgaccagccccgcagg

SEQ ID NO: 80384 - DNA, 20 bp, human
gcgcgcgccgtggaaaagtg

SEQ ID NO: 80385 - DNA, 20 bp, human
gccgagcgccgccgcggacg

SEQ ID NO: 80386 - DNA, 20 bp, human
gggatcgcggcggctggacg

SEQ ID NO: 80387 - DNA, 20 bp, human
gtgcgggcccgggatcgcgg

SEQ ID NO: 80388 - DNA, 20 bp, human
gtcccgggcccgcagctcgt

SEQ ID NO: 80389 - DNA, 20 bp, human
gtcgttggccgtgcccgctg

SEQ ID NO: 80390 - DNA, 20 bp, human
gagggccgggcgcacgtcga

SEQ ID NO: 80391 - DNA, 20 bp, human
ggcagctgtgcgagggacag

SEQ ID NO: 80392 - DNA, 20 bp, human
gctccagggagccaaactga

SEQ ID NO: 80393 - DNA, 20 bp, human
gggagccaaactgagggacc

SEQ ID NO: 80394 - DNA, 20 bp, human
gaggtttccacctcagacct

SEQ ID NO: 80395 - DNA, 20 bp, human
ggacccggtgcctaggtctg

SEQ ID NO: 80396 - DNA, 20 bp, human
gctgttcggcgggactgtga

SEQ ID NO: 80397 - DNA, 20 bp, human
gatcttaggtgggttcccgg

SEQ ID NO: 80398 - DNA, 20 bp, human
ggagctacatccggatctgt

SEQ ID NO: 80399 - DNA, 20 bp, human
gtcatcacaagcctgttcgg

SEQ ID NO: 80400 - DNA, 20 bp, human
gaagagcaacaaggaccccc

SEQ ID NO: 80401 - DNA, 20 bp, human
gccagagagatgacgatctt

SEQ ID NO: 80402 - DNA, 20 bp, human
gcaggccaaggtaggataga

SEQ ID NO: 80403 - DNA, 20 bp, human
ggagagatgacgatcttagg

SEQ ID NO: 80404 - DNA, 20 bp, human
ggatgactgtaccagacgtg

SEQ ID NO: 80405 - DNA, 20 bp, human
gacccctttgtggaggaagg

SEQ ID NO: 80406 - DNA, 20 bp, human
ggcgggaacgtgaagctccg

SEQ ID NO: 80407 - DNA, 20 bp, human
ggcggccatcggagttcacc

SEQ ID NO: 80408 - DNA, 20 bp, human
gcggcagcggcaggaatgag

SEQ ID NO: 80409 - DNA, 20 bp, human
ggaccccccgggacacccag

SEQ ID NO: 80410 - DNA, 20 bp, human
gctgtctccgggaccccccc

SEQ ID NO: 80411 - DNA, 20 bp, human
gacagctaccggccgcccaa

SEQ ID NO: 80412 - DNA, 20 bp, human
gagctccgcggtgcctgatg

SEQ ID NO: 80413 - DNA, 20 bp, human
ggtagacgcgcggggtccca

SEQ ID NO: 80414 - DNA, 20 bp, human
ggccgcccaacggccccatc

SEQ ID NO: 80415 - DNA, 20 bp, human
ggcggggtcccagggcgtca

SEQ ID NO: 80416 - DNA, 20 bp, human
gcgggagtcactctcgaaaa

SEQ ID NO: 80417 - DNA, 20 bp, human
gtcactctcgaaaaaggtag

SEQ ID NO: 80418 - DNA, 20 bp, human
ggggcaagcggtccggataa

SEQ ID NO: 80419 - DNA, 20 bp, human
gtgggaagccttgggacaac

SEQ ID NO: 80420 - DNA, 20 bp, human
gagtgactcccgttgtccca

SEQ ID NO: 80421 - DNA, 20 bp, human
gccggataacggctagcctg

SEQ ID NO: 80422 - DNA, 20 bp, human
gccgacagagagcagggaac

SEQ ID NO: 80423 - DNA, 20 bp, human
gagcccaggggcaagcggtc

SEQ ID NO: 80424 - DNA, 20 bp, human
gagccgcacaggttcgctct

SEQ ID NO: 80425 - DNA, 20 bp, human
gagcggagccgacagagagc

SEQ ID NO: 80426 - DNA, 20 bp, human
gtcactctcgaaagacgaag

SEQ ID NO: 80427 - DNA, 20 bp, human
gagtgactcccgcggtccca

SEQ ID NO: 80428 - DNA, 20 bp, human
gagcctgaggagctgctgcg

SEQ ID NO: 80429 - DNA, 20 bp, human
gtggaaagccttgggaccgc

SEQ ID NO: 80430 - DNA, 20 bp, human
ggggcgcgcggtccggaaaa

SEQ ID NO: 80431 - DNA, 20 bp, human
gccggaaaacggccagcctg

SEQ ID NO: 80432 - DNA, 20 bp, human
gtgggctccgctctgagact

SEQ ID NO: 80433 - DNA, 20 bp, human
ggactgggggctggaaacgg

SEQ ID NO: 80434 - DNA, 20 bp, human
gcgccggaaactcaacacgc

SEQ ID NO: 80435 - DNA, 20 bp, human
gagagcggagcccacagagc

SEQ ID NO: 80436 - DNA, 20 bp, human
gcgggagtcactctcgaaaa

SEQ ID NO: 80437 - DNA, 20 bp, human
gtcactctcgaaaaaggtag

SEQ ID NO: 80438 - DNA, 20 bp, human
ggggcaagcggtccggataa

SEQ ID NO: 80439 - DNA, 20 bp, human
gtgggaagccttgggacaac

SEQ ID NO: 80440 - DNA, 20 bp, human
gagtgactcccgttgtccca

SEQ ID NO: 80441 - DNA, 20 bp, human
gccggataacggctagcctg

SEQ ID NO: 80442 - DNA, 20 bp, human
gccgacagagagcagggaac

SEQ ID NO: 80443 - DNA, 20 bp, human
gagcccaggggcaagcggtc

SEQ ID NO: 80444 - DNA, 20 bp, human
gagccgcacaggttcgctct

SEQ ID NO: 80445 - DNA, 20 bp, human
gagcggagccgacagagagc

SEQ ID NO: 80446 - DNA, 20 bp, human
gtcactctcgaaagacgaag

SEQ ID NO: 80447 - DNA, 20 bp, human
gagtgactcccgcggtccca

SEQ ID NO: 80448 - DNA, 20 bp, human
gagcctgaggagctgctgcg

SEQ ID NO: 80449 - DNA, 20 bp, human
gtggaaagccttgggaccgc

SEQ ID NO: 80450 - DNA, 20 bp, human
ggggcgcgcggtccggaaaa

SEQ ID NO: 80451 - DNA, 20 bp, human
gccggaaaacggccagcctg

SEQ ID NO: 80452 - DNA, 20 bp, human
gtgggctccgctctgagact

SEQ ID NO: 80453 - DNA, 20 bp, human
ggactgggggctggaaacgg

SEQ ID NO: 80454 - DNA, 20 bp, human
gcgccggaaactcaacacgc

SEQ ID NO: 80455 - DNA, 20 bp, human
gagagcggagcccacagagc

SEQ ID NO: 80456 - DNA, 20 bp, human
gcctaattgacaggaagggt

SEQ ID NO: 80457 - DNA, 20 bp, human
gagcgcctaattgacaggaa

SEQ ID NO: 80458 - DNA, 20 bp, human
ggccaacgcccacatacctc

SEQ ID NO: 80459 - DNA, 20 bp, human
ggagactaggtgagccagta

SEQ ID NO: 80460 - DNA, 20 bp, human
gggcgttggctgatccgggt

SEQ ID NO: 80461 - DNA, 20 bp, human
ggcttcagcgcctaattgac

SEQ ID NO: 80462 - DNA, 20 bp, human
ggcgaaggcgtcgggagact

SEQ ID NO: 80463 - DNA, 20 bp, human
gtgaacctgaaaggctcagt

SEQ ID NO: 80464 - DNA, 20 bp, human
ggattgattgtgaacctgaa

SEQ ID NO: 80465 - DNA, 20 bp, human
ggctgggcctgcgcagttgt

SEQ ID NO: 80466 - DNA, 20 bp, human
ggtgcaagtagagtacaagg

SEQ ID NO: 80467 - DNA, 20 bp, human
gaccagggagatgaactccg

SEQ ID NO: 80468 - DNA, 20 bp, human
gcgttaggacgggaaaacca

SEQ ID NO: 80469 - DNA, 20 bp, human
gctgaaaggcgagcgacgtt

SEQ ID NO: 80470 - DNA, 20 bp, human
gcgtggtgcttggttcgagg

SEQ ID NO: 80471 - DNA, 20 bp, human
gactccgcggagtcaactaa

SEQ ID NO: 80472 - DNA, 20 bp, human
gggcagacatcctgactgaa

SEQ ID NO: 80473 - DNA, 20 bp, human
gaggcgagcgacgttaggac

SEQ ID NO: 80474 - DNA, 20 bp, human
gtggccgttagttgactccg

SEQ ID NO: 80475 - DNA, 20 bp, human
ggacctaggcaagcctgtgg

SEQ ID NO: 80476 - DNA, 20 bp, human
ggatctcgttgcgacgagag

SEQ ID NO: 80477 - DNA, 20 bp, human
ggcagtagccggcgccatgt

SEQ ID NO: 80478 - DNA, 20 bp, human
gagcagcgagggtcccagac

SEQ ID NO: 80479 - DNA, 20 bp, human
gtccgagccgaggtcccggt

SEQ ID NO: 80480 - DNA, 20 bp, human
ggcagaggaggcgccggtag

SEQ ID NO: 80481 - DNA, 20 bp, human
gtaggtcagggacccccagt

SEQ ID NO: 80482 - DNA, 20 bp, human
ggcgcctaagtccttccagt

SEQ ID NO: 80483 - DNA, 20 bp, human
gtctcggttgcagtacccac

SEQ ID NO: 80484 - DNA, 20 bp, human
gttgggccgaggctactgag

SEQ ID NO: 80485 - DNA, 20 bp, human
gccgaggtcccggtaggtca

SEQ ID NO: 80486 - DNA, 20 bp, human
ggcagggagtcggaaacccg

SEQ ID NO: 80487 - DNA, 20 bp, human
gaggcggccgaaccgcagta

SEQ ID NO: 80488 - DNA, 20 bp, human
gcacgttaggggaaaatccg

SEQ ID NO: 80489 - DNA, 20 bp, human
gcaggacaaacgttaaggac

SEQ ID NO: 80490 - DNA, 20 bp, human
gagacccaggctgcgggacg

SEQ ID NO: 80491 - DNA, 20 bp, human
gggtcccagtaaccgccggt

SEQ ID NO: 80492 - DNA, 20 bp, human
ggcagacaggacaaacgtta

SEQ ID NO: 80493 - DNA, 20 bp, human
gtgccacccggcggtctcta

SEQ ID NO: 80494 - DNA, 20 bp, human
gttcggccgcctccaaccgg

SEQ ID NO: 80495 - DNA, 20 bp, human
gttgctgtcgcgagaagtgg

SEQ ID NO: 80496 - DNA, 20 bp, human
ggcgacggtgaggtcgacgc

SEQ ID NO: 80497 - DNA, 20 bp, human
gagggcaggtctagaaatac

SEQ ID NO: 80498 - DNA, 20 bp, human
gcacgaaccaggcgaagggc

SEQ ID NO: 80499 - DNA, 20 bp, human
gggtctagaaatacaggccg

SEQ ID NO: 80500 - DNA, 20 bp, human
gtggcagaaaaacccgacag

SEQ ID NO: 80501 - DNA, 20 bp, human
gagccgagtaggcgacggtg

SEQ ID NO: 80502 - DNA, 20 bp, human
ggtgctgatgtccctctgtc

SEQ ID NO: 80503 - DNA, 20 bp, human
gatataagccgagtaggcga

SEQ ID NO: 80504 - DNA, 20 bp, human
gacagacagattgacctatt

SEQ ID NO: 80505 - DNA, 20 bp, human
ggtgtttcgcgagtgtgaga

SEQ ID NO: 80506 - DNA, 20 bp, human
gtagctgacagtagcattgg

SEQ ID NO: 80507 - DNA, 20 bp, human
gagaaggttcgggcagatcg

SEQ ID NO: 80508 - DNA, 20 bp, human
gtatctctggccattcacta

SEQ ID NO: 80509 - DNA, 20 bp, human
gtgcctggttccttagtgaa

SEQ ID NO: 80510 - DNA, 20 bp, human
gggtgcgggaaggtgcggaa

SEQ ID NO: 80511 - DNA, 20 bp, human
gggccattcactaaggaacc

SEQ ID NO: 80512 - DNA, 20 bp, human
gggttcgcgaaagttcgcgg

SEQ ID NO: 80513 - DNA, 20 bp, human
gctttagctgacagtagcat

SEQ ID NO: 80514 - DNA, 20 bp, human
gcaaaaggataaaaagccgg

SEQ ID NO: 80515 - DNA, 20 bp, human
gcgggcgagaggctctcaac

SEQ ID NO: 80516 - DNA, 20 bp, human
gcaggcgagttcaatgagac

SEQ ID NO: 80517 - DNA, 20 bp, human
ggttatcgtgaggcggagcg

SEQ ID NO: 80518 - DNA, 20 bp, human
gggcctggctccaataacga

SEQ ID NO: 80519 - DNA, 20 bp, human
ggaacagctctgaagaacca

SEQ ID NO: 80520 - DNA, 20 bp, human
gccggcaggacggaaatgta

SEQ ID NO: 80521 - DNA, 20 bp, human
gctggactaagcagggaact

SEQ ID NO: 80522 - DNA, 20 bp, human
gtggcgtgcttccagtatgg

SEQ ID NO: 80523 - DNA, 20 bp, human
gggagccaggcctacacccc

SEQ ID NO: 80524 - DNA, 20 bp, human
gggtgggactggactaagca

SEQ ID NO: 80525 - DNA, 20 bp, human
gtgagcagaggttttacctg

SEQ ID NO: 80526 - DNA, 20 bp, human
gggataaatggaggagtacg

SEQ ID NO: 80527 - DNA, 20 bp, human
gcagcaaacaagcgctccga

SEQ ID NO: 80528 - DNA, 20 bp, human
ggagctgcgcgatgcggtgg

SEQ ID NO: 80529 - DNA, 20 bp, human
gtatcatggcggataaatgg

SEQ ID NO: 80530 - DNA, 20 bp, human
gaaagagctgcgcgatgcgg

SEQ ID NO: 80531 - DNA, 20 bp, human
gtaccaggtagtggtcctca

SEQ ID NO: 80532 - DNA, 20 bp, human
gtcagcagggcccaagccgg

SEQ ID NO: 80533 - DNA, 20 bp, human
ggacccggcagcgctaacta

SEQ ID NO: 80534 - DNA, 20 bp, human
ggttctgtggctgaatggaa

SEQ ID NO: 80535 - DNA, 20 bp, human
gctgcagcagcccgtctcgt

SEQ ID NO: 80536 - DNA, 20 bp, human
gatgctggctgactctgctc

SEQ ID NO: 80537 - DNA, 20 bp, human
gactgcggggctctcgatgg

SEQ ID NO: 80538 - DNA, 20 bp, human
gagtggtcgcagtggttagg

SEQ ID NO: 80539 - DNA, 20 bp, human
gtcagccggcaactcagcag

SEQ ID NO: 80540 - DNA, 20 bp, human
ggggcgtgcggttgaaacgg

SEQ ID NO: 80541 - DNA, 20 bp, human
gggcctggggagttaaacgt

SEQ ID NO: 80542 - DNA, 20 bp, human
gcagcggggtctcggagatc

SEQ ID NO: 80543 - DNA, 20 bp, human
ggcgaagtggttgacatcca

SEQ ID NO: 80544 - DNA, 20 bp, human
gacgtctgctcagaaaagtg

SEQ ID NO: 80545 - DNA, 20 bp, human
ggtcgaagaggcggctatgc

SEQ ID NO: 80546 - DNA, 20 bp, human
gccccccaaaggcaagcacg

SEQ ID NO: 80547 - DNA, 20 bp, human
ggaagagggaaatcagactg

SEQ ID NO: 80548 - DNA, 20 bp, human
ggagggaaatcagactgcgg

SEQ ID NO: 80549 - DNA, 20 bp, human
ggagtcctggcgccaggtcg

SEQ ID NO: 80550 - DNA, 20 bp, human
gaagaacacacaggtggcgg

SEQ ID NO: 80551 - DNA, 20 bp, human
ggcagcctggacgtgcagag

SEQ ID NO: 80552 - DNA, 20 bp, human
gcggaaatacacgtgagtcc

SEQ ID NO: 80553 - DNA, 20 bp, human
gtcctcgtgcttgcctttgg

SEQ ID NO: 80554 - DNA, 20 bp, human
gcttgcctttggggggaaga

SEQ ID NO: 80555 - DNA, 20 bp, human
ggttacattacacaccgggt

SEQ ID NO: 80556 - DNA, 20 bp, human
gcgcgcgaccccggactcca

SEQ ID NO: 80557 - DNA, 20 bp, human
ggcggcctccgtggagtccg

SEQ ID NO: 80558 - DNA, 20 bp, human
gagcaggcggagctgcgggt

SEQ ID NO: 80559 - DNA, 20 bp, human
gctggcaccagagggtatgg

SEQ ID NO: 80560 - DNA, 20 bp, human
gcgggcaaggcagaaggacg

SEQ ID NO: 80561 - DNA, 20 bp, human
ggggtcgggacgctctgcgt

SEQ ID NO: 80562 - DNA, 20 bp, human
gctgctcgccgcggcctccg

SEQ ID NO: 80563 - DNA, 20 bp, human
gtggcctcaaagagtttcgt

SEQ ID NO: 80564 - DNA, 20 bp, human
gcagagctaacgggagtccc

SEQ ID NO: 80565 - DNA, 20 bp, human
gcagctccgcctgctcgccg

SEQ ID NO: 80566 - DNA, 20 bp, human
gccagctgcccggagagcca

SEQ ID NO: 80567 - DNA, 20 bp, human
gagggctcgataggaggtgg

SEQ ID NO: 80568 - DNA, 20 bp, human
gtccgaggtgcagccccaac

SEQ ID NO: 80569 - DNA, 20 bp, human
ggctctccgggcagctggag

SEQ ID NO: 80570 - DNA, 20 bp, human
gcagcagaagccctggtccg

SEQ ID NO: 80571 - DNA, 20 bp, human
gagagccagggctcgatagg

SEQ ID NO: 80572 - DNA, 20 bp, human
gcggagagccagggctcgat

SEQ ID NO: 80573 - DNA, 20 bp, human
gaggaggaggaggcaccaaa

SEQ ID NO: 80574 - DNA, 20 bp, human
ggggacaaggaggcacaccc

SEQ ID NO: 80575 - DNA, 20 bp, human
gggtcgcgctgcgcctgttg

SEQ ID NO: 80576 - DNA, 20 bp, human
gggggctcgccactgactga

SEQ ID NO: 80577 - DNA, 20 bp, human
gtctcctccagtggactcag

SEQ ID NO: 80578 - DNA, 20 bp, human
gttccactgccttcagtcag

SEQ ID NO: 80579 - DNA, 20 bp, human
gggcagaaggaggctgttca

SEQ ID NO: 80580 - DNA, 20 bp, human
ggacagtacaaactaccaga

SEQ ID NO: 80581 - DNA, 20 bp, human
gacgcactggaatctctatg

SEQ ID NO: 80582 - DNA, 20 bp, human
gctgccgctgagtccactgg

SEQ ID NO: 80583 - DNA, 20 bp, human
ggcagtggaaggttggcaga

SEQ ID NO: 80584 - DNA, 20 bp, human
gtacaaactaccagatggtg

SEQ ID NO: 80585 - DNA, 20 bp, human
gctgcctgggccaaccatcg

SEQ ID NO: 80586 - DNA, 20 bp, human
ggttagaccggggtcgggac

SEQ ID NO: 80587 - DNA, 20 bp, human
gaacagaagtacccggaggg

SEQ ID NO: 80588 - DNA, 20 bp, human
ggtccgggcgccgaaagtcc

SEQ ID NO: 80589 - DNA, 20 bp, human
ggaaggcctgggtcactcta

SEQ ID NO: 80590 - DNA, 20 bp, human
ggctggtcaaagaggcgtcc

SEQ ID NO: 80591 - DNA, 20 bp, human
gacgcaggggcactgcaacg

SEQ ID NO: 80592 - DNA, 20 bp, human
gacccaggccttccattctc

SEQ ID NO: 80593 - DNA, 20 bp, human
gcaggggcactgcaacgcgg

SEQ ID NO: 80594 - DNA, 20 bp, human
gggtgcgcgcaggtagtagg

SEQ ID NO: 80595 - DNA, 20 bp, human
ggccgaaagtccgggcaacg

SEQ ID NO: 80596 - DNA, 20 bp, human
gaggcgggcgagggctggac

SEQ ID NO: 80597 - DNA, 20 bp, human
ggtggccacagggacagatg

SEQ ID NO: 80598 - DNA, 20 bp, human
ggtggccaccaagacagatg

SEQ ID NO: 80599 - DNA, 20 bp, human
ggcctggcacgctcgcccag

SEQ ID NO: 80600 - DNA, 20 bp, human
ggaaaacaggtgggcctcta

SEQ ID NO: 80601 - DNA, 20 bp, human
gtctgtggctcatccacgga

SEQ ID NO: 80602 - DNA, 20 bp, human
gcacagcctgcagccatgtg

SEQ ID NO: 80603 - DNA, 20 bp, human
gaggccaggggctccgagtg

SEQ ID NO: 80604 - DNA, 20 bp, human
ggcgtgccaggctccgactg

SEQ ID NO: 80605 - DNA, 20 bp, human
gctgtcttggtggccacaca

SEQ ID NO: 80606 - DNA, 20 bp, human
ggaaccgctgaggtctagag

SEQ ID NO: 80607 - DNA, 20 bp, human
gcaggagcttaataaaccca

SEQ ID NO: 80608 - DNA, 20 bp, human
ggctccgctctagacctcag

SEQ ID NO: 80609 - DNA, 20 bp, human
ggcgcaggcggcttgggtag

SEQ ID NO: 80610 - DNA, 20 bp, human
gtccagcaggcgagaggaga

SEQ ID NO: 80611 - DNA, 20 bp, human
gacacaaccgtccctggcag

SEQ ID NO: 80612 - DNA, 20 bp, human
gatctgaccgtcagccatgg

SEQ ID NO: 80613 - DNA, 20 bp, human
ggcactgcctcacgacagac

SEQ ID NO: 80614 - DNA, 20 bp, human
gccatcatccagcaggcgag

SEQ ID NO: 80615 - DNA, 20 bp, human
gaaccgtccctggcagtggt

SEQ ID NO: 80616 - DNA, 20 bp, human
gtgactcggatgcagagagt

SEQ ID NO: 80617 - DNA, 20 bp, human
gtgggtcagaggccagtgtg

SEQ ID NO: 80618 - DNA, 20 bp, human
ggatgccacccggctctcgt

SEQ ID NO: 80619 - DNA, 20 bp, human
gaggcccacgctgggacacc

SEQ ID NO: 80620 - DNA, 20 bp, human
gccgggcagctgtgggtcag

SEQ ID NO: 80621 - DNA, 20 bp, human
gttctccaacgagagccggg

SEQ ID NO: 80622 - DNA, 20 bp, human
gcagcagcaactggacgtca

SEQ ID NO: 80623 - DNA, 20 bp, human
ggacccacagctgcccggag

SEQ ID NO: 80624 - DNA, 20 bp, human
gggtaggactcaggttggac

SEQ ID NO: 80625 - DNA, 20 bp, human
ggttggaagccttagagccg

SEQ ID NO: 80626 - DNA, 20 bp, human
gagccgggcgggagtcgccg

SEQ ID NO: 80627 - DNA, 20 bp, human
ggtggtgcagcttcgggtct

SEQ ID NO: 80628 - DNA, 20 bp, human
gtgcgtgaaacagcactcgt

SEQ ID NO: 80629 - DNA, 20 bp, human
ggggtgccacgagagtcaac

SEQ ID NO: 80630 - DNA, 20 bp, human
gtgagagccggcgtttccgt

SEQ ID NO: 80631 - DNA, 20 bp, human
ggccggaacccaaggcggag

SEQ ID NO: 80632 - DNA, 20 bp, human
gaggcaaacggccccacgag

SEQ ID NO: 80633 - DNA, 20 bp, human
ggccgcaacgatcacaggag

SEQ ID NO: 80634 - DNA, 20 bp, human
gtcagggtcggacctcagcc

SEQ ID NO: 80635 - DNA, 20 bp, human
gcccatcattagctaaatag

SEQ ID NO: 80636 - DNA, 20 bp, human
gggttgttgccagggagagt

SEQ ID NO: 80637 - DNA, 20 bp, human
ggcggcggcttgaggacccg

SEQ ID NO: 80638 - DNA, 20 bp, human
ggacgcacgcagtggagatg

SEQ ID NO: 80639 - DNA, 20 bp, human
gactttgtctgtaggagcag

SEQ ID NO: 80640 - DNA, 20 bp, human
ggcagctctggcgtcctgat

SEQ ID NO: 80641 - DNA, 20 bp, human
gttgtctgtaggagcagcgg

SEQ ID NO: 80642 - DNA, 20 bp, human
ggtcaccgctgaagcagctc

SEQ ID NO: 80643 - DNA, 20 bp, human
gtgagaaggcggcgtttcag

SEQ ID NO: 80644 - DNA, 20 bp, human
ggtatttccggttaagatgg

SEQ ID NO: 80645 - DNA, 20 bp, human
ggtcagacgaaggctcaagg

SEQ ID NO: 80646 - DNA, 20 bp, human
gttcggaaagaaggacacgt

SEQ ID NO: 80647 - DNA, 20 bp, human
ggggagggtggtgtacgtga

SEQ ID NO: 80648 - DNA, 20 bp, human
gcccccagcaaggtcaagac

SEQ ID NO: 80649 - DNA, 20 bp, human
gcgcgggagggacaactcgt

SEQ ID NO: 80650 - DNA, 20 bp, human
ggctcctgcgacccccgagt

SEQ ID NO: 80651 - DNA, 20 bp, human
ggaggaggaaggcccactcg

SEQ ID NO: 80652 - DNA, 20 bp, human
gggatccgcgtcgcacgtga

SEQ ID NO: 80653 - DNA, 20 bp, human
gggccgacttcagggaaccg

SEQ ID NO: 80654 - DNA, 20 bp, human
gtccagctggaccgcagagg

SEQ ID NO: 80655 - DNA, 20 bp, human
ggtatcccagctgcctgcgg

SEQ ID NO: 80656 - DNA, 20 bp, human
ggcgctagcacaccctgcgc

SEQ ID NO: 80657 - DNA, 20 bp, human
gtagttctttcacctcggct

SEQ ID NO: 80658 - DNA, 20 bp, human
ggcccgatggcaccttggag

SEQ ID NO: 80659 - DNA, 20 bp, human
gtggtctggttgctcaccgg

SEQ ID NO: 80660 - DNA, 20 bp, human
ggcccagcccaacaaaagag

SEQ ID NO: 80661 - DNA, 20 bp, human
gcggactgcgagtctctttg

SEQ ID NO: 80662 - DNA, 20 bp, human
gttgaccttggaataaacta

SEQ ID NO: 80663 - DNA, 20 bp, human
ggagactcgcagtccggccc

SEQ ID NO: 80664 - DNA, 20 bp, human
gtcgggcgctggtcactgag

SEQ ID NO: 80665 - DNA, 20 bp, human
gccctgggggagaaaagggt

SEQ ID NO: 80666 - DNA, 20 bp, human
gcggactgcgagtctctttg

SEQ ID NO: 80667 - DNA, 20 bp, human
ggcccgatggcaccttggag

SEQ ID NO: 80668 - DNA, 20 bp, human
gtggtctggttgctcaccgg

SEQ ID NO: 80669 - DNA, 20 bp, human
ggcccagcccaacaaaagag

SEQ ID NO: 80670 - DNA, 20 bp, human
gttgaccttggaataaacta

SEQ ID NO: 80671 - DNA, 20 bp, human
ggagactcgcagtccggccc

SEQ ID NO: 80672 - DNA, 20 bp, human
gtcgggcgctggtcactgag

SEQ ID NO: 80673 - DNA, 20 bp, human
gccctgggggagaaaagggt

SEQ ID NO: 80674 - DNA, 20 bp, human
gcgtgtgctgccggtgtgta

SEQ ID NO: 80675 - DNA, 20 bp, human
gcgcgcgtgcaaagagccct

SEQ ID NO: 80676 - DNA, 20 bp, human
gaacgtggccgagagaccca

SEQ ID NO: 80677 - DNA, 20 bp, human
gccgggccggcgccaccctg

SEQ ID NO: 80678 - DNA, 20 bp, human
gcgagtgctggagtctcgct

SEQ ID NO: 80679 - DNA, 20 bp, human
ggacccacgggctcccacac

SEQ ID NO: 80680 - DNA, 20 bp, human
gccagtcaggacccttcgtg

SEQ ID NO: 80681 - DNA, 20 bp, human
gagtctcgctgggcatggtc

SEQ ID NO: 80682 - DNA, 20 bp, human
gcccgagctggccggcgagc

SEQ ID NO: 80683 - DNA, 20 bp, human
gcgcgctgtcccgagctggc

SEQ ID NO: 80684 - DNA, 20 bp, human
gactccagcactcggcaacg

SEQ ID NO: 80685 - DNA, 20 bp, human
gggtccggcctaccattcct

SEQ ID NO: 80686 - DNA, 20 bp, human
gtgcctgcctcactctgccg

SEQ ID NO: 80687 - DNA, 20 bp, human
gtacataaggctgaggaagt

SEQ ID NO: 80688 - DNA, 20 bp, human
gtgcgagccgcggcagagtg

SEQ ID NO: 80689 - DNA, 20 bp, human
gcggccagggcagaaagcgg

SEQ ID NO: 80690 - DNA, 20 bp, human
gacgcggccagggcagaaag

SEQ ID NO: 80691 - DNA, 20 bp, human
gggagtctgcgagggtggat

SEQ ID NO: 80692 - DNA, 20 bp, human
gcaccggtcgctgaactcat

SEQ ID NO: 80693 - DNA, 20 bp, human
gaccggtgcaccccgtaagt

SEQ ID NO: 80694 - DNA, 20 bp, human
gcgaggtgcggagcgacctg

SEQ ID NO: 80695 - DNA, 20 bp, human
gaggcaggcaacccgaggtg

SEQ ID NO: 80696 - DNA, 20 bp, human
gcggtccgaccagggaaggt

SEQ ID NO: 80697 - DNA, 20 bp, human
gtccttatcccgaggaacaa

SEQ ID NO: 80698 - DNA, 20 bp, human
gccggaagaccaagccgggt

SEQ ID NO: 80699 - DNA, 20 bp, human
ggccggtcttagggtgtcag

SEQ ID NO: 80700 - DNA, 20 bp, human
gcatcactgggcatacccca

SEQ ID NO: 80701 - DNA, 20 bp, human
ggacggagacagcgcctacc

SEQ ID NO: 80702 - DNA, 20 bp, human
gcccccggtccgaccaggga

SEQ ID NO: 80703 - DNA, 20 bp, human
gaacccccccggtccgacca

SEQ ID NO: 80704 - DNA, 20 bp, human
gtgggcgccagcggagaaac

SEQ ID NO: 80705 - DNA, 20 bp, human
gccgggccggggataccgtg

SEQ ID NO: 80706 - DNA, 20 bp, human
ggctaggtaggaaacatgag

SEQ ID NO: 80707 - DNA, 20 bp, human
gcgccacgcgccgacaatgg

SEQ ID NO: 80708 - DNA, 20 bp, human
gagggttcagaagaactaag

SEQ ID NO: 80709 - DNA, 20 bp, human
gggctgcgtcggcctgagca

SEQ ID NO: 80710 - DNA, 20 bp, human
gcgtcgccacgcgccgacaa

SEQ ID NO: 80711 - DNA, 20 bp, human
gcgcagcgccctggacctag

SEQ ID NO: 80712 - DNA, 20 bp, human
gccgccgccgaccggatctg

SEQ ID NO: 80713 - DNA, 20 bp, human
gcctacctagctcaggagca

SEQ ID NO: 80714 - DNA, 20 bp, human
gccgacgcagccgccattgt

SEQ ID NO: 80715 - DNA, 20 bp, human
gcgcgccgacacgcccacta

SEQ ID NO: 80716 - DNA, 20 bp, human
gtgtacacattacagcatca

SEQ ID NO: 80717 - DNA, 20 bp, human
gtacatcagccatatagaaa

SEQ ID NO: 80718 - DNA, 20 bp, human
gtgtgtacaattttgtactc

SEQ ID NO: 80719 - DNA, 20 bp, human
gagagatgtccttttctata

SEQ ID NO: 80720 - DNA, 20 bp, human
gagaaattatggtattctat

SEQ ID NO: 80721 - DNA, 20 bp, human
gacagtcctattagaaatta

SEQ ID NO: 80722 - DNA, 20 bp, human
ggaataccataatttctaat

SEQ ID NO: 80723 - DNA, 20 bp, human
gtttgtgtgtgagtttttaa

SEQ ID NO: 80724 - DNA, 20 bp, human
gaaatgtaaattatttattt

SEQ ID NO: 80725 - DNA, 20 bp, human
ggactctcctcttgagtaaa

SEQ ID NO: 80726 - DNA, 20 bp, human
gaagtagatatcaggtatct

SEQ ID NO: 80727 - DNA, 20 bp, human
gaaaatagtttacgactaag

SEQ ID NO: 80728 - DNA, 20 bp, human
gtgaggtcccaccatcagcg

SEQ ID NO: 80729 - DNA, 20 bp, human
ggatatcaggtatctaggca

SEQ ID NO: 80730 - DNA, 20 bp, human
gttaaatacatcagccatct

SEQ ID NO: 80731 - DNA, 20 bp, human
gagagatgtcctttcctaga

SEQ ID NO: 80732 - DNA, 20 bp, human
gatcttcagatgccaataaa

SEQ ID NO: 80733 - DNA, 20 bp, human
gtgtattacatcctcgctga

SEQ ID NO: 80734 - DNA, 20 bp, human
gaaataaaaagagttcattg

SEQ ID NO: 80735 - DNA, 20 bp, human
gattgctggtgttaattcat

SEQ ID NO: 80736 - DNA, 20 bp, human
gatgtagaaagctccaaagg

SEQ ID NO: 80737 - DNA, 20 bp, human
gtgatcgaggtgcaccgagt

SEQ ID NO: 80738 - DNA, 20 bp, human
gttcctctcgaaagaggcgg

SEQ ID NO: 80739 - DNA, 20 bp, human
ggcaccattagcaaggatca

SEQ ID NO: 80740 - DNA, 20 bp, human
gaaagaggcgggggcacaag

SEQ ID NO: 80741 - DNA, 20 bp, human
ggagtgtgaatggagagtcg

SEQ ID NO: 80742 - DNA, 20 bp, human
ggccatcttgcgcttcgcct

SEQ ID NO: 80743 - DNA, 20 bp, human
gaaccagcatgagcagcagc

SEQ ID NO: 80744 - DNA, 20 bp, human
ggccgccctggaggtgatcg

SEQ ID NO: 80745 - DNA, 20 bp, human
ggctcatgctggttctctat

SEQ ID NO: 80746 - DNA, 20 bp, human
ggctccggagcgcagctctt

SEQ ID NO: 80747 - DNA, 20 bp, human
gatggagcggacgaaggaga

SEQ ID NO: 80748 - DNA, 20 bp, human
ggctggggcgaggagagcca

SEQ ID NO: 80749 - DNA, 20 bp, human
gaggagagccatggaggaac

SEQ ID NO: 80750 - DNA, 20 bp, human
gcagtgtacatggtgctgat

SEQ ID NO: 80751 - DNA, 20 bp, human
gatgcccaagagctgcgctc

SEQ ID NO: 80752 - DNA, 20 bp, human
ggtggagcgcactgagcacc

SEQ ID NO: 80753 - DNA, 20 bp, human
gcggccggtgacagtgtaca

SEQ ID NO: 80754 - DNA, 20 bp, human
gtacactgtggcaatcacaa

SEQ ID NO: 80755 - DNA, 20 bp, human
ggagggagcagaggataagt

SEQ ID NO: 80756 - DNA, 20 bp, human
gccttctgcttcacactggt

SEQ ID NO: 80757 - DNA, 20 bp, human
gcaggtgtgggtgatggtat

SEQ ID NO: 80758 - DNA, 20 bp, human
gtggccaaagttccaggtgt

SEQ ID NO: 80759 - DNA, 20 bp, human
ggtgcagcacgtgatgtcag

SEQ ID NO: 80760 - DNA, 20 bp, human
gtggtataggcgatgctgat

SEQ ID NO: 80761 - DNA, 20 bp, human
gacggaaaggaccacggcaa

SEQ ID NO: 80762 - DNA, 20 bp, human
gagggagccaatcaggtagt

SEQ ID NO: 80763 - DNA, 20 bp, human
gtcatccttctgcttcacac

SEQ ID NO: 80764 - DNA, 20 bp, human
gatggaaaccaagaggtcgg

SEQ ID NO: 80765 - DNA, 20 bp, human
gtgtggtctgttctggtgta

SEQ ID NO: 80766 - DNA, 20 bp, human
ggtgcggcgagacagaacct

SEQ ID NO: 80767 - DNA, 20 bp, human
gcagcccgaggcaccgctgg

SEQ ID NO: 80768 - DNA, 20 bp, human
gcagtccaggcgcccagact

SEQ ID NO: 80769 - DNA, 20 bp, human
gcggcgcgccgggcagcccg

SEQ ID NO: 80770 - DNA, 20 bp, human
gctgccaccagcggtgcctc

SEQ ID NO: 80771 - DNA, 20 bp, human
ggctgcgcttcgccgagtct

SEQ ID NO: 80772 - DNA, 20 bp, human
gtggagtacctggagtgggt

SEQ ID NO: 80773 - DNA, 20 bp, human
gactccaggtactccagctc

SEQ ID NO: 80774 - DNA, 20 bp, human
gagggaagccaaggtcgtcc

SEQ ID NO: 80775 - DNA, 20 bp, human
ggcaccgtccacaaggtgag

SEQ ID NO: 80776 - DNA, 20 bp, human
ggagagagagctggattatg

SEQ ID NO: 80777 - DNA, 20 bp, human
gagaaaatctgtgactgcaa

SEQ ID NO: 80778 - DNA, 20 bp, human
gaaaatggatacctgtaaca

SEQ ID NO: 80779 - DNA, 20 bp, human
gataattgcagcgatcacaa

SEQ ID NO: 80780 - DNA, 20 bp, human
gtgccagcccagacagagtg

SEQ ID NO: 80781 - DNA, 20 bp, human
gatagctgagagatgcaaga

SEQ ID NO: 80782 - DNA, 20 bp, human
gctgtttaacagttcctctg

SEQ ID NO: 80783 - DNA, 20 bp, human
gttttctcttcccttgttac

SEQ ID NO: 80784 - DNA, 20 bp, human
gcatctctcagctatagctt

SEQ ID NO: 80785 - DNA, 20 bp, human
gtggtgtccctcactctgtc

SEQ ID NO: 80786 - DNA, 20 bp, human
ggaagagctgtctgcaccaa

SEQ ID NO: 80787 - DNA, 20 bp, human
gggatcctgttggcttcctc

SEQ ID NO: 80788 - DNA, 20 bp, human
gcaacaggatcctagcagtg

SEQ ID NO: 80789 - DNA, 20 bp, human
gtcgcacaaaagaactgcat

SEQ ID NO: 80790 - DNA, 20 bp, human
gcccagccgagccgtgccag

SEQ ID NO: 80791 - DNA, 20 bp, human
gatcctagcagtgcgggagc

SEQ ID NO: 80792 - DNA, 20 bp, human
gtggcaattcagcttaagaa

SEQ ID NO: 80793 - DNA, 20 bp, human
ggccaagcatgatttcaaac

SEQ ID NO: 80794 - DNA, 20 bp, human
gagccagctcccgcactgct

SEQ ID NO: 80795 - DNA, 20 bp, human
gtgctgaggcgagccgcaca

SEQ ID NO: 80796 - DNA, 20 bp, human
gaaaataacaacgaaaccag

SEQ ID NO: 80797 - DNA, 20 bp, human
ggaggctcagaataagtcaa

SEQ ID NO: 80798 - DNA, 20 bp, human
gctcagaataagtcaatggg

SEQ ID NO: 80799 - DNA, 20 bp, human
gcagttgccttgagaagaaa

SEQ ID NO: 80800 - DNA, 20 bp, human
gtttcctttagtttgagaga

SEQ ID NO: 80801 - DNA, 20 bp, human
gagaataagtcaatgggagg

SEQ ID NO: 80802 - DNA, 20 bp, human
gtttccttctctcaaactaa

SEQ ID NO: 80803 - DNA, 20 bp, human
gattactaaacacaattatt

SEQ ID NO: 80804 - DNA, 20 bp, human
gtttcaaccgcctgtgctgg

SEQ ID NO: 80805 - DNA, 20 bp, human
gaatggtctaatcttccttt

SEQ ID NO: 80806 - DNA, 20 bp, human
gccgctccaaaggcagtatc

SEQ ID NO: 80807 - DNA, 20 bp, human
gagcgtccgggaggaagacc

SEQ ID NO: 80808 - DNA, 20 bp, human
gagatcggtgcatctgagga

SEQ ID NO: 80809 - DNA, 20 bp, human
ggcgcacggtcacccaaagg

SEQ ID NO: 80810 - DNA, 20 bp, human
gcgggaggaagaccaggcag

SEQ ID NO: 80811 - DNA, 20 bp, human
ggcggcagctagacgagaaa

SEQ ID NO: 80812 - DNA, 20 bp, human
gctcggctgcaatcgcccag

SEQ ID NO: 80813 - DNA, 20 bp, human
gaaggcagtatcgggaagat

SEQ ID NO: 80814 - DNA, 20 bp, human
gggcgctctggtgcttgcgg

SEQ ID NO: 80815 - DNA, 20 bp, human
gagcaatctagccgctccaa

SEQ ID NO: 80816 - DNA, 20 bp, human
ggctggctgggacatgaggt

SEQ ID NO: 80817 - DNA, 20 bp, human
gtcaggacgaggcccaccaa

SEQ ID NO: 80818 - DNA, 20 bp, human
ggtggccacgagaggcaggc

SEQ ID NO: 80819 - DNA, 20 bp, human
gaggcaagctggcccttggt

SEQ ID NO: 80820 - DNA, 20 bp, human
gcctcgtcctgagcactcgg

SEQ ID NO: 80821 - DNA, 20 bp, human
gaaagacaggcaccaggagg

SEQ ID NO: 80822 - DNA, 20 bp, human
gggttaagctagagagagtt

SEQ ID NO: 80823 - DNA, 20 bp, human
gggagtgcctccgagtgctc

SEQ ID NO: 80824 - DNA, 20 bp, human
gaaggagaggagccccctcc

SEQ ID NO: 80825 - DNA, 20 bp, human
gggatgcttcagtcctccga

SEQ ID NO: 80826 - DNA, 20 bp, human
gtcagccccgagctgcacac

SEQ ID NO: 80827 - DNA, 20 bp, human
gtctggcttggaagagcaag

SEQ ID NO: 80828 - DNA, 20 bp, human
gaccaggacaagagaaccgg

SEQ ID NO: 80829 - DNA, 20 bp, human
gggaaagcagagatctggct

SEQ ID NO: 80830 - DNA, 20 bp, human
ggtctatgccatcctcaacg

SEQ ID NO: 80831 - DNA, 20 bp, human
gacacaggcagaccttttgg

SEQ ID NO: 80832 - DNA, 20 bp, human
gagcctcaccacgttgagga

SEQ ID NO: 80833 - DNA, 20 bp, human
gaaccgggggaagtcttggg

SEQ ID NO: 80834 - DNA, 20 bp, human
gtgtgcgccccgtgagggac

SEQ ID NO: 80835 - DNA, 20 bp, human
gtctgcctgtgtgcagctcg

SEQ ID NO: 80836 - DNA, 20 bp, human
gaggtccaggtagactgtgg

SEQ ID NO: 80837 - DNA, 20 bp, human
gcagactgttcaggactcgg

SEQ ID NO: 80838 - DNA, 20 bp, human
gtgctaggagaggatgatac

SEQ ID NO: 80839 - DNA, 20 bp, human
gagcatggacgaacaggtcc

SEQ ID NO: 80840 - DNA, 20 bp, human
gcgttaacaagaataggaag

SEQ ID NO: 80841 - DNA, 20 bp, human
gtcatgcaggagcctatgag

SEQ ID NO: 80842 - DNA, 20 bp, human
gccccagtggacactgtgaa

SEQ ID NO: 80843 - DNA, 20 bp, human
gcaagaatataacctctcat

SEQ ID NO: 80844 - DNA, 20 bp, human
gcaatatagcatggacgaac

SEQ ID NO: 80845 - DNA, 20 bp, human
gaaggccaccacagtctacc

SEQ ID NO: 80846 - DNA, 20 bp, human
gctgacagtgaggcagagga

SEQ ID NO: 80847 - DNA, 20 bp, human
gtgagggaggggacaatctg

SEQ ID NO: 80848 - DNA, 20 bp, human
gaccaggagctcccaaaccc

SEQ ID NO: 80849 - DNA, 20 bp, human
gctttctggactcttctctg

SEQ ID NO: 80850 - DNA, 20 bp, human
gaggagctcagaccacaccc

SEQ ID NO: 80851 - DNA, 20 bp, human
gaagcagaagactgacagtg

SEQ ID NO: 80852 - DNA, 20 bp, human
gcccaaaccctggagcttaa

SEQ ID NO: 80853 - DNA, 20 bp, human
gtgagctcctttaagctcca

SEQ ID NO: 80854 - DNA, 20 bp, human
ggggaggggacaatctgagg

SEQ ID NO: 80855 - DNA, 20 bp, human
ggtccctcggaaccacactc

SEQ ID NO: 80856 - DNA, 20 bp, human
gcctgtgctggccaaagcct

SEQ ID NO: 80857 - DNA, 20 bp, human
gcagatggcagacaaggtga

SEQ ID NO: 80858 - DNA, 20 bp, human
ggtggggcagcacgtgccgg

SEQ ID NO: 80859 - DNA, 20 bp, human
ggtggtctagtggtgagcag

SEQ ID NO: 80860 - DNA, 20 bp, human
ggagcagtggaccctctgac

SEQ ID NO: 80861 - DNA, 20 bp, human
gactagaccactgcaatgtt

SEQ ID NO: 80862 - DNA, 20 bp, human
gctcagtctctgctcactac

SEQ ID NO: 80863 - DNA, 20 bp, human
gtgagtggcgacactgtagt

SEQ ID NO: 80864 - DNA, 20 bp, human
gccatgcagaaacactctcc

SEQ ID NO: 80865 - DNA, 20 bp, human
gaccactgcaatgttgggtg

SEQ ID NO: 80866 - DNA, 20 bp, human
gcaggtggaggatgaagcca

SEQ ID NO: 80867 - DNA, 20 bp, human
gaggtacttgcagcagcagg

SEQ ID NO: 80868 - DNA, 20 bp, human
ggaggctggttccatgggaa

SEQ ID NO: 80869 - DNA, 20 bp, human
ggagcagacatgtaactcct

SEQ ID NO: 80870 - DNA, 20 bp, human
gatgggaaaggattcctcct

SEQ ID NO: 80871 - DNA, 20 bp, human
gatattaggatcctaggaag

SEQ ID NO: 80872 - DNA, 20 bp, human
gtggctttgtacctcttcct

SEQ ID NO: 80873 - DNA, 20 bp, human
gaactaaatattaggatcct

SEQ ID NO: 80874 - DNA, 20 bp, human
gttaaggtacttgcagcagc

SEQ ID NO: 80875 - DNA, 20 bp, human
gatgatgctcgtgacactga

SEQ ID NO: 80876 - DNA, 20 bp, human
gaggagatgttgacttgggt

SEQ ID NO: 80877 - DNA, 20 bp, human
gaggatggcagacatcgcga

SEQ ID NO: 80878 - DNA, 20 bp, human
gacaccaaggagggctagag

SEQ ID NO: 80879 - DNA, 20 bp, human
gtgttggtgaccggacggaa

SEQ ID NO: 80880 - DNA, 20 bp, human
gtgggtggggacgctgatgt

SEQ ID NO: 80881 - DNA, 20 bp, human
ggcactcaccacatctagga

SEQ ID NO: 80882 - DNA, 20 bp, human
ggtcagcactcaccacatct

SEQ ID NO: 80883 - DNA, 20 bp, human
ggctgatgttggtgaccgga

SEQ ID NO: 80884 - DNA, 20 bp, human
ggaccaggttctaatctcag

SEQ ID NO: 80885 - DNA, 20 bp, human
gggcaaatgccatccagcag

SEQ ID NO: 80886 - DNA, 20 bp, human
gtggccgctcgaatctgcca

SEQ ID NO: 80887 - DNA, 20 bp, human
gcagcagaagctcggctcag

SEQ ID NO: 80888 - DNA, 20 bp, human
ggtgccctggcagattcgag

SEQ ID NO: 80889 - DNA, 20 bp, human
gtacccgctgccagaggcga

SEQ ID NO: 80890 - DNA, 20 bp, human
gctctggcagcgggtatgtg

SEQ ID NO: 80891 - DNA, 20 bp, human
ggcagggcgcacaggggagt

SEQ ID NO: 80892 - DNA, 20 bp, human
gtccagcgtgggatcactgt

SEQ ID NO: 80893 - DNA, 20 bp, human
gagggcagcggggaccaccg

SEQ ID NO: 80894 - DNA, 20 bp, human
gcggagcgctgctcatctga

SEQ ID NO: 80895 - DNA, 20 bp, human
gcaaccgagccggactccac

SEQ ID NO: 80896 - DNA, 20 bp, human
gggggagagacgtactctga

SEQ ID NO: 80897 - DNA, 20 bp, human
ggtcatgatcgcgctcacct

SEQ ID NO: 80898 - DNA, 20 bp, human
ggcgcctacggtggagaaca

SEQ ID NO: 80899 - DNA, 20 bp, human
ggtgtactggaagatctaca

SEQ ID NO: 80900 - DNA, 20 bp, human
ggtgagcgcgatcatgacgt

SEQ ID NO: 80901 - DNA, 20 bp, human
gaggctgccaagttccgcgt

SEQ ID NO: 80902 - DNA, 20 bp, human
gatgacagcggagagtgccc

SEQ ID NO: 80903 - DNA, 20 bp, human
gccccagccaaaaagcagcg

SEQ ID NO: 80904 - DNA, 20 bp, human
gtggagaacacggcgtagga

SEQ ID NO: 80905 - DNA, 20 bp, human
gggcaggtagaaggcgccta

SEQ ID NO: 80906 - DNA, 20 bp, human
gggagctgcagcctccgaag

SEQ ID NO: 80907 - DNA, 20 bp, human
gcgggggcaacagggacaga

SEQ ID NO: 80908 - DNA, 20 bp, human
ggcccccgccaccccttcgg

SEQ ID NO: 80909 - DNA, 20 bp, human
gtgggcggccagcagcgtgt

SEQ ID NO: 80910 - DNA, 20 bp, human
gggataaggcaggtctcggt

SEQ ID NO: 80911 - DNA, 20 bp, human
gcctgctagtgagcatccgt

SEQ ID NO: 80912 - DNA, 20 bp, human
gtgctcactagcaggaaatt

SEQ ID NO: 80913 - DNA, 20 bp, human
ggccggctgcctagagagaa

SEQ ID NO: 80914 - DNA, 20 bp, human
gggattggctctgggcacag

SEQ ID NO: 80915 - DNA, 20 bp, human
gaaactcccccactggccag

SEQ ID NO: 80916 - DNA, 20 bp, human
gcgggtctcccgagcccggg

SEQ ID NO: 80917 - DNA, 20 bp, human
ggcccgcacgcgcggaggag

SEQ ID NO: 80918 - DNA, 20 bp, human
ggtgggcgtgtggggtacca

SEQ ID NO: 80919 - DNA, 20 bp, human
ggggcggcaagataggggag

SEQ ID NO: 80920 - DNA, 20 bp, human
gggggcgggcggcaagatag

SEQ ID NO: 80921 - DNA, 20 bp, human
gagcccgggaggcgccgcga

SEQ ID NO: 80922 - DNA, 20 bp, human
gccgcggccggtgggcgtgt

SEQ ID NO: 80923 - DNA, 20 bp, human
gtccggccgggtcagagtgc

SEQ ID NO: 80924 - DNA, 20 bp, human
gagtgggaacgcggggaggt

SEQ ID NO: 80925 - DNA, 20 bp, human
gtgcggggaagtgggaacgc

SEQ ID NO: 80926 - DNA, 20 bp, human
ggagctgctgctgcgaactg

SEQ ID NO: 80927 - DNA, 20 bp, human
gcgaactgtggagctgccag

SEQ ID NO: 80928 - DNA, 20 bp, human
gcgcggagtcgagggagctc

SEQ ID NO: 80929 - DNA, 20 bp, human
gcaggagcccgcgaccgggt

SEQ ID NO: 80930 - DNA, 20 bp, human
gagagccaggcgccccccag

SEQ ID NO: 80931 - DNA, 20 bp, human
gctgggacgcgcggagtcga

SEQ ID NO: 80932 - DNA, 20 bp, human
gagtcgagggagctcgggct

SEQ ID NO: 80933 - DNA, 20 bp, human
ggcccgcgccgaccgctggg

SEQ ID NO: 80934 - DNA, 20 bp, human
ggcgcccaggagcccgcgac

SEQ ID NO: 80935 - DNA, 20 bp, human
gctcctgggacgggataccc

SEQ ID NO: 80936 - DNA, 20 bp, human
gatctgcatggcgactctgg

SEQ ID NO: 80937 - DNA, 20 bp, human
gccggtgcagcctctcggag

SEQ ID NO: 80938 - DNA, 20 bp, human
gccagcagcgagccggtgtg

SEQ ID NO: 80939 - DNA, 20 bp, human
gtgcatggcgactctggcgg

SEQ ID NO: 80940 - DNA, 20 bp, human
gccgaggctggcaccccgaa

SEQ ID NO: 80941 - DNA, 20 bp, human
gcgcgctgcaggacgatgac

SEQ ID NO: 80942 - DNA, 20 bp, human
ggggatctgcatggcgactc

SEQ ID NO: 80943 - DNA, 20 bp, human
gcacaggttggcgtaggtgt

SEQ ID NO: 80944 - DNA, 20 bp, human
ggcggcgcgcgggatctgca

SEQ ID NO: 80945 - DNA, 20 bp, human
ggtgcagcctctcggagcgg

SEQ ID NO: 80946 - DNA, 20 bp, human
gcctcgcccgccctactcag

SEQ ID NO: 80947 - DNA, 20 bp, human
gcgcccgccctactcagagg

SEQ ID NO: 80948 - DNA, 20 bp, human
ggacctcgcggcccaagaaa

SEQ ID NO: 80949 - DNA, 20 bp, human
ggtgccgcctctgagtaggg

SEQ ID NO: 80950 - DNA, 20 bp, human
gctgggtgccgcctctgagt

SEQ ID NO: 80951 - DNA, 20 bp, human
ggggaggcctcagagaactc

SEQ ID NO: 80952 - DNA, 20 bp, human
ggcagccaaggcggagctga

SEQ ID NO: 80953 - DNA, 20 bp, human
gaggatctcgatatagacca

SEQ ID NO: 80954 - DNA, 20 bp, human
ggcgaggtccctatctcgaa

SEQ ID NO: 80955 - DNA, 20 bp, human
ggacaaccgggcccagagac

SEQ ID NO: 80956 - DNA, 20 bp, human
gacacacggcgtgcgaccag

SEQ ID NO: 80957 - DNA, 20 bp, human
gaggctggcgggcgtcaggg

SEQ ID NO: 80958 - DNA, 20 bp, human
gctcaggctggcgggcgtca

SEQ ID NO: 80959 - DNA, 20 bp, human
gccagcgagggcgagccctg

SEQ ID NO: 80960 - DNA, 20 bp, human
gagtccagagggccgccaca

SEQ ID NO: 80961 - DNA, 20 bp, human
gggcgtgcgaccagcggcag

SEQ ID NO: 80962 - DNA, 20 bp, human
gcgccgtgtgtggcaccgac

SEQ ID NO: 80963 - DNA, 20 bp, human
ggcctgcagcgcgcacacgt

SEQ ID NO: 80964 - DNA, 20 bp, human
ggcgagggcgagccctgtgg

SEQ ID NO: 80965 - DNA, 20 bp, human
ggccgcaaggcgagtccaga

SEQ ID NO: 80966 - DNA, 20 bp, human
gccggagcgcgcacatgctg

SEQ ID NO: 80967 - DNA, 20 bp, human
ggagtaaagtcactgaagag

SEQ ID NO: 80968 - DNA, 20 bp, human
gcggccgagcgtgaagtctg

SEQ ID NO: 80969 - DNA, 20 bp, human
gggggcagacgcggcaacag

SEQ ID NO: 80970 - DNA, 20 bp, human
gagcgcgcacatgctggggt

SEQ ID NO: 80971 - DNA, 20 bp, human
gtggtccccagcgcgcaggt

SEQ ID NO: 80972 - DNA, 20 bp, human
gtgaagagtggaagcgagga

SEQ ID NO: 80973 - DNA, 20 bp, human
gcgccgcctgggcaaggtcc

SEQ ID NO: 80974 - DNA, 20 bp, human
gagcggcacaggtcgaacac

SEQ ID NO: 80975 - DNA, 20 bp, human
gggccgtgcctgtgcagtgg

SEQ ID NO: 80976 - DNA, 20 bp, human
gtgcagcgggcccaaactca

SEQ ID NO: 80977 - DNA, 20 bp, human
ggggacgggtccaagatgga

SEQ ID NO: 80978 - DNA, 20 bp, human
gagcaccggggcaatgaatg

SEQ ID NO: 80979 - DNA, 20 bp, human
ggcgggcccaaactcacggt

SEQ ID NO: 80980 - DNA, 20 bp, human
gtgccgggacgggtccaaga

SEQ ID NO: 80981 - DNA, 20 bp, human
gaaactcacggtcggtgcag

SEQ ID NO: 80982 - DNA, 20 bp, human
gccaagatggacggccgctc

SEQ ID NO: 80983 - DNA, 20 bp, human
gtgggacgcaaggcgccgtg

SEQ ID NO: 80984 - DNA, 20 bp, human
gccgtagcctgggacccgcc

SEQ ID NO: 80985 - DNA, 20 bp, human
gcctgggacccgccgggaca

SEQ ID NO: 80986 - DNA, 20 bp, human
gcgaggcgcgtagacaatag

SEQ ID NO: 80987 - DNA, 20 bp, human
ggctgccggcgccctctgga

SEQ ID NO: 80988 - DNA, 20 bp, human
ggggcccgggcgaccctaag

SEQ ID NO: 80989 - DNA, 20 bp, human
gaagtgcacgggctgcggag

SEQ ID NO: 80990 - DNA, 20 bp, human
ggacaatagcggctgcccag

SEQ ID NO: 80991 - DNA, 20 bp, human
gggggaaggaggggctacta

SEQ ID NO: 80992 - DNA, 20 bp, human
ggcttcctggacgggacccg

SEQ ID NO: 80993 - DNA, 20 bp, human
ggcccgtgcgggccagacgg

SEQ ID NO: 80994 - DNA, 20 bp, human
ggccgccgtctggcccgcac

SEQ ID NO: 80995 - DNA, 20 bp, human
ggcacggctaggagcgatcg

SEQ ID NO: 80996 - DNA, 20 bp, human
gtacccacagaggcccgccg

SEQ ID NO: 80997 - DNA, 20 bp, human
gggatgaaggcggctttcaa

SEQ ID NO: 80998 - DNA, 20 bp, human
gagccgcggcgggcctctgt

SEQ ID NO: 80999 - DNA, 20 bp, human
gcaggccccgtccacgatct

SEQ ID NO: 81000 - DNA, 20 bp, human
gcggccactgctcccataga

SEQ ID NO: 81001 - DNA, 20 bp, human
gcagggtggagggacgaatg

SEQ ID NO: 81002 - DNA, 20 bp, human
gttccgggcggggacactca

SEQ ID NO: 81003 - DNA, 20 bp, human
gtaggcactgtcagggtgga

SEQ ID NO: 81004 - DNA, 20 bp, human
ggccgcggctgcgccatccg

SEQ ID NO: 81005 - DNA, 20 bp, human
ggtgtccccgcccggaaaca

SEQ ID NO: 81006 - DNA, 20 bp, human
gcacgcggaatccccctcag

SEQ ID NO: 81007 - DNA, 20 bp, human
gtcctgggaagcacccgcac

SEQ ID NO: 81008 - DNA, 20 bp, human
gcaggctgtggtgcgaggtg

SEQ ID NO: 81009 - DNA, 20 bp, human
gagtttcgcgccaagatcac

SEQ ID NO: 81010 - DNA, 20 bp, human
gcaccgccaccgtgagggag

SEQ ID NO: 81011 - DNA, 20 bp, human
ggcgccaagatcaccggcaa

SEQ ID NO: 81012 - DNA, 20 bp, human
gcagcctttgccggtgatct

SEQ ID NO: 81013 - DNA, 20 bp, human
ggaaacttcatgatgccaca

SEQ ID NO: 81014 - DNA, 20 bp, human
ggcttcccaggagagtgtgg

SEQ ID NO: 81015 - DNA, 20 bp, human
ggtcagctgcagcttcaggg

SEQ ID NO: 81016 - DNA, 20 bp, human
gtcctcgtgggattcgttgg

SEQ ID NO: 81017 - DNA, 20 bp, human
ggtccggtagaggttctcgc

SEQ ID NO: 81018 - DNA, 20 bp, human
gactgcggcggcgacaacgg

SEQ ID NO: 81019 - DNA, 20 bp, human
gcccactgcggcggcgacaa

SEQ ID NO: 81020 - DNA, 20 bp, human
gaggcgttgaccgatcggtg

SEQ ID NO: 81021 - DNA, 20 bp, human
gctgactgcagtagccgcgg

SEQ ID NO: 81022 - DNA, 20 bp, human
ggcggccgaggcccaggaaa

SEQ ID NO: 81023 - DNA, 20 bp, human
gagaattctccggcttagaa

SEQ ID NO: 81024 - DNA, 20 bp, human
ggcaaaggcgggcccacacg

SEQ ID NO: 81025 - DNA, 20 bp, human
gccgcctgctgttaagatgg

SEQ ID NO: 81026 - DNA, 20 bp, human
ggagcaaggcggcccaggac

SEQ ID NO: 81027 - DNA, 20 bp, human
gctgaggctcccagtcgcag

SEQ ID NO: 81028 - DNA, 20 bp, human
gcccggcccgagcacttacc

SEQ ID NO: 81029 - DNA, 20 bp, human
gagacgacgatggtcacctg

SEQ ID NO: 81030 - DNA, 20 bp, human
ggcaggggctgcacgcggta

SEQ ID NO: 81031 - DNA, 20 bp, human
gcgcggtcaccgctgcgact

SEQ ID NO: 81032 - DNA, 20 bp, human
ggaacgggtggactgaccac

SEQ ID NO: 81033 - DNA, 20 bp, human
gcgggacacgccagagccga

SEQ ID NO: 81034 - DNA, 20 bp, human
gggggtggcccggagacggt

SEQ ID NO: 81035 - DNA, 20 bp, human
ggctgctcatgggatggtac

SEQ ID NO: 81036 - DNA, 20 bp, human
gggcagaggcctggtctgag

SEQ ID NO: 81037 - DNA, 20 bp, human
gcccaggctgacccgaccaa

SEQ ID NO: 81038 - DNA, 20 bp, human
gcaggatgggggcctaagca

SEQ ID NO: 81039 - DNA, 20 bp, human
gaggctgacccgaccaaggg

SEQ ID NO: 81040 - DNA, 20 bp, human
ggcaggggagacgcatggag

SEQ ID NO: 81041 - DNA, 20 bp, human
gactcggatgtgccctccag

SEQ ID NO: 81042 - DNA, 20 bp, human
gaggagtctctggtgcagct

SEQ ID NO: 81043 - DNA, 20 bp, human
gccactggaggaagatccaa

SEQ ID NO: 81044 - DNA, 20 bp, human
gaggggagcatggccactgg

SEQ ID NO: 81045 - DNA, 20 bp, human
ggactggcgggtgtacagga

SEQ ID NO: 81046 - DNA, 20 bp, human
gaccaggggcgggttctaag

SEQ ID NO: 81047 - DNA, 20 bp, human
ggttgtgacgcgcaaaccag

SEQ ID NO: 81048 - DNA, 20 bp, human
ggcgacgcgcgggtgctggg

SEQ ID NO: 81049 - DNA, 20 bp, human
gggcacgccacggcgttcta

SEQ ID NO: 81050 - DNA, 20 bp, human
gctgcagccgtcgcgtcctg

SEQ ID NO: 81051 - DNA, 20 bp, human
gcgacaacgttggcccccag

SEQ ID NO: 81052 - DNA, 20 bp, human
gcagcctgtgacccactagg

SEQ ID NO: 81053 - DNA, 20 bp, human
gacgcgcggggtggacctac

SEQ ID NO: 81054 - DNA, 20 bp, human
gggcgtgccgcaggacgcga

SEQ ID NO: 81055 - DNA, 20 bp, human
gtgacgcgcaaaccaggggc

SEQ ID NO: 81056 - DNA, 20 bp, human
gaggccccgtagggacaaag

SEQ ID NO: 81057 - DNA, 20 bp, human
gctcgcccggcagaagagtg

SEQ ID NO: 81058 - DNA, 20 bp, human
ggcttggaggaggccccgta

SEQ ID NO: 81059 - DNA, 20 bp, human
gcagcgctcgagagaaagtc

SEQ ID NO: 81060 - DNA, 20 bp, human
gccgctccggccgttcgccc

SEQ ID NO: 81061 - DNA, 20 bp, human
gtggaaggaacgctgccggg

SEQ ID NO: 81062 - DNA, 20 bp, human
gcgggccgcgcctgggcgaa

SEQ ID NO: 81063 - DNA, 20 bp, human
ggccagggccaccgccatcc

SEQ ID NO: 81064 - DNA, 20 bp, human
gccgcgcctgggcgaacggc

SEQ ID NO: 81065 - DNA, 20 bp, human
gtcgagcgctgacactctcc

SEQ ID NO: 81066 - DNA, 20 bp, human
ggcaagtagcctagctggag

SEQ ID NO: 81067 - DNA, 20 bp, human
ggtccgtcggcccagtaggt

SEQ ID NO: 81068 - DNA, 20 bp, human
gcacctgtgtgggagtccgt

SEQ ID NO: 81069 - DNA, 20 bp, human
gtcctcggcgagctgcccaa

SEQ ID NO: 81070 - DNA, 20 bp, human
gggccgacggactcccacac

SEQ ID NO: 81071 - DNA, 20 bp, human
ggggaggccaccgacctact

SEQ ID NO: 81072 - DNA, 20 bp, human
gcgtcggcccagtaggtcgg

SEQ ID NO: 81073 - DNA, 20 bp, human
ggagggagccgggctcccaa

SEQ ID NO: 81074 - DNA, 20 bp, human
ggggagtccgtcggcccagt

SEQ ID NO: 81075 - DNA, 20 bp, human
gtgagtctcgcacaagggag

SEQ ID NO: 81076 - DNA, 20 bp, human
ggttgtgacgcgcaaaccag

SEQ ID NO: 81077 - DNA, 20 bp, human
gaccaggggcgggttctaag

SEQ ID NO: 81078 - DNA, 20 bp, human
ggcgacgcgcgggtgctggg

SEQ ID NO: 81079 - DNA, 20 bp, human
gggcacgccacggcgttcta

SEQ ID NO: 81080 - DNA, 20 bp, human
gctgcagccgtcgcgtcctg

SEQ ID NO: 81081 - DNA, 20 bp, human
gcgacaacgttggcccccag

SEQ ID NO: 81082 - DNA, 20 bp, human
gggcgtgccgcaggacgcga

SEQ ID NO: 81083 - DNA, 20 bp, human
gacgcgcggggtggacctac

SEQ ID NO: 81084 - DNA, 20 bp, human
gtgacgcgcaaaccaggggc

SEQ ID NO: 81085 - DNA, 20 bp, human
gcagcctgtgacccactagg

SEQ ID NO: 81086 - DNA, 20 bp, human
gtggcataaatagcaaggca

SEQ ID NO: 81087 - DNA, 20 bp, human
gcaggaatgcaaaaccattc

SEQ ID NO: 81088 - DNA, 20 bp, human
ggttattaagctaaacaagg

SEQ ID NO: 81089 - DNA, 20 bp, human
gtgactcaagaaatgagagg

SEQ ID NO: 81090 - DNA, 20 bp, human
ggaatcttcagtgaaataga

SEQ ID NO: 81091 - DNA, 20 bp, human
gtcagttattaagctaaaca

SEQ ID NO: 81092 - DNA, 20 bp, human
gcataaatagcaaggcacgg

SEQ ID NO: 81093 - DNA, 20 bp, human
gtcctaaaaaagaattcaga

SEQ ID NO: 81094 - DNA, 20 bp, human
gatagatggcataaatagca

SEQ ID NO: 81095 - DNA, 20 bp, human
gaaatgtgaagtccaattta

SEQ ID NO: 81096 - DNA, 20 bp, human
ggtcaccttgtgcaaatcag

SEQ ID NO: 81097 - DNA, 20 bp, human
gatcagaggttgaatggcaa

SEQ ID NO: 81098 - DNA, 20 bp, human
ggtttgtctgaaccacgcac

SEQ ID NO: 81099 - DNA, 20 bp, human
ggtgcaaatcagaggttgaa

SEQ ID NO: 81100 - DNA, 20 bp, human
ggacaaacatgttattacag

SEQ ID NO: 81101 - DNA, 20 bp, human
gatttgcacaaggtgactaa

SEQ ID NO: 81102 - DNA, 20 bp, human
gcttgagtagtcattaaagt

SEQ ID NO: 81103 - DNA, 20 bp, human
ggcaaaggatgtcctgtgcg

SEQ ID NO: 81104 - DNA, 20 bp, human
gatgtgtattttaggctgct

SEQ ID NO: 81105 - DNA, 20 bp, human
gcagcagcaaacaaaagcaa

SEQ ID NO: 81106 - DNA, 20 bp, human
gtgggtatggagcccctcag

SEQ ID NO: 81107 - DNA, 20 bp, human
gggcggcgcatggagagtgc

SEQ ID NO: 81108 - DNA, 20 bp, human
ggtatggagcccctcagcgg

SEQ ID NO: 81109 - DNA, 20 bp, human
gcaacggacggcaacagctc

SEQ ID NO: 81110 - DNA, 20 bp, human
gtggttaccgtggcaacgga

SEQ ID NO: 81111 - DNA, 20 bp, human
ggccagacaggtagcctgaa

SEQ ID NO: 81112 - DNA, 20 bp, human
gggcggcttcaagctgggta

SEQ ID NO: 81113 - DNA, 20 bp, human
ggtgcgggcggcttcaagct

SEQ ID NO: 81114 - DNA, 20 bp, human
gtccgtggttaccgtggcaa

SEQ ID NO: 81115 - DNA, 20 bp, human
gaggacgaggacgaaaagag

SEQ ID NO: 81116 - DNA, 20 bp, human
gtagcgagagagggatcacg

SEQ ID NO: 81117 - DNA, 20 bp, human
gcggagtccgcgggatccaa

SEQ ID NO: 81118 - DNA, 20 bp, human
gagtccgcgggatccaaagg

SEQ ID NO: 81119 - DNA, 20 bp, human
gtacggccaggccacctcga

SEQ ID NO: 81120 - DNA, 20 bp, human
gtccctctctcgctaaccgt

SEQ ID NO: 81121 - DNA, 20 bp, human
ggattggcggagaagcgcag

SEQ ID NO: 81122 - DNA, 20 bp, human
ggcgcgccgcgcgagaagcg

SEQ ID NO: 81123 - DNA, 20 bp, human
ggggaatagccaggacagat

SEQ ID NO: 81124 - DNA, 20 bp, human
ggccgtccccgggagacagg

SEQ ID NO: 81125 - DNA, 20 bp, human
gagacaggcggccttccgag

SEQ ID NO: 81126 - DNA, 20 bp, human
ggcgctaggaggtagagcag

SEQ ID NO: 81127 - DNA, 20 bp, human
ggactgctcccagtagacac

SEQ ID NO: 81128 - DNA, 20 bp, human
ggagggcgcatgagtaagtg

SEQ ID NO: 81129 - DNA, 20 bp, human
gttcccgcagacaggtagtg

SEQ ID NO: 81130 - DNA, 20 bp, human
ggcagcgacccgacgtcctg

SEQ ID NO: 81131 - DNA, 20 bp, human
ggccgcgcaccggcgctagg

SEQ ID NO: 81132 - DNA, 20 bp, human
ggaggggctgctgaaccaag

SEQ ID NO: 81133 - DNA, 20 bp, human
ggcgacccgacgtcctgggg

SEQ ID NO: 81134 - DNA, 20 bp, human
gtgccggtgagccaaggagg

SEQ ID NO: 81135 - DNA, 20 bp, human
gggatccaccccaggacgtc

SEQ ID NO: 81136 - DNA, 20 bp, human
ggccaccggggcaaagaccg

SEQ ID NO: 81137 - DNA, 20 bp, human
gcaggacctggaatccacgg

SEQ ID NO: 81138 - DNA, 20 bp, human
ggctggcgactggcaggacg

SEQ ID NO: 81139 - DNA, 20 bp, human
gcgaaagctaacagaatctg

SEQ ID NO: 81140 - DNA, 20 bp, human
gggctggaggggagtcccga

SEQ ID NO: 81141 - DNA, 20 bp, human
ggagctcagaaaggccaccg

SEQ ID NO: 81142 - DNA, 20 bp, human
ggacacgctccgcctttcaa

SEQ ID NO: 81143 - DNA, 20 bp, human
gcgaaggccgctagcgacct

SEQ ID NO: 81144 - DNA, 20 bp, human
gccagccctggggccgtccc

SEQ ID NO: 81145 - DNA, 20 bp, human
gcgcacaccgtgacctccag

SEQ ID NO: 81146 - DNA, 20 bp, human
ggacagcgtgcgagctccgg

SEQ ID NO: 81147 - DNA, 20 bp, human
gtgcgcgagacgccgccgag

SEQ ID NO: 81148 - DNA, 20 bp, human
gcccagctctgggacagacg

SEQ ID NO: 81149 - DNA, 20 bp, human
gaaccgagaggagttgtgaa

SEQ ID NO: 81150 - DNA, 20 bp, human
ggacgccgccgagaggttgg

SEQ ID NO: 81151 - DNA, 20 bp, human
gcccctggcactgcgtctgt

SEQ ID NO: 81152 - DNA, 20 bp, human
gcgagacgccgccgagaggt

SEQ ID NO: 81153 - DNA, 20 bp, human
ggggccggccacccctccta

SEQ ID NO: 81154 - DNA, 20 bp, human
gcgcagtgccaggggcggta

SEQ ID NO: 81155 - DNA, 20 bp, human
ggggatgccgaggaggagat

SEQ ID NO: 81156 - DNA, 20 bp, human
gagccacggaaacatgacag

SEQ ID NO: 81157 - DNA, 20 bp, human
gcaccgctgtcatgtttccg

SEQ ID NO: 81158 - DNA, 20 bp, human
gtgagaccagtggaccagag

SEQ ID NO: 81159 - DNA, 20 bp, human
gaatagatatggcgaccgag

SEQ ID NO: 81160 - DNA, 20 bp, human
gggacctcaggtgcatagaa

SEQ ID NO: 81161 - DNA, 20 bp, human
ggttggccaagagcatgtcg

SEQ ID NO: 81162 - DNA, 20 bp, human
ggtagagccgagggaaacag

SEQ ID NO: 81163 - DNA, 20 bp, human
gcggaagtcggcgtgaggtg

SEQ ID NO: 81164 - DNA, 20 bp, human
gcctaaaggagcttgatagt

SEQ ID NO: 81165 - DNA, 20 bp, human
gcaagtgttaccaggtagca

SEQ ID NO: 81166 - DNA, 20 bp, human
gaacaagcgaggccagagca

SEQ ID NO: 81167 - DNA, 20 bp, human
gggagtggcgggtcccccag

SEQ ID NO: 81168 - DNA, 20 bp, human
ggaaccacgaggtactgcca

SEQ ID NO: 81169 - DNA, 20 bp, human
ggaaaggccgctgcccagga

SEQ ID NO: 81170 - DNA, 20 bp, human
ggagctaaaaacgaacgggt

SEQ ID NO: 81171 - DNA, 20 bp, human
gaaaccctggcagtacctcg

SEQ ID NO: 81172 - DNA, 20 bp, human
ggcggccgctaacccggacc

SEQ ID NO: 81173 - DNA, 20 bp, human
ggcacagctggctctcggtg

SEQ ID NO: 81174 - DNA, 20 bp, human
gagggcctgtaacacccacg

SEQ ID NO: 81175 - DNA, 20 bp, human
gtgagtaacagaagggccag

SEQ ID NO: 81176 - DNA, 20 bp, human
ggagggggtaaatattccag

SEQ ID NO: 81177 - DNA, 20 bp, human
gtactagttagcaaatgagg

SEQ ID NO: 81178 - DNA, 20 bp, human
gagtccaagcttgtatccac

SEQ ID NO: 81179 - DNA, 20 bp, human
gttgcttagagaaggaaatt

SEQ ID NO: 81180 - DNA, 20 bp, human
gattccagtggatacaagct

SEQ ID NO: 81181 - DNA, 20 bp, human
ggattactagttagcaaatg

SEQ ID NO: 81182 - DNA, 20 bp, human
ggaaaagtggacaatattaa

SEQ ID NO: 81183 - DNA, 20 bp, human
gctgacattgaaacattaaa

SEQ ID NO: 81184 - DNA, 20 bp, human
gtgttcagattgcttagaga

SEQ ID NO: 81185 - DNA, 20 bp, human
gacacttggtgttaaattca

SEQ ID NO: 81186 - DNA, 20 bp, human
ggaagagagggcgtacctga

SEQ ID NO: 81187 - DNA, 20 bp, human
ggaggctggaaacgaacgaa

SEQ ID NO: 81188 - DNA, 20 bp, human
gccggttgcagcgtggacgc

SEQ ID NO: 81189 - DNA, 20 bp, human
gtggtgactgaagtaaatta

SEQ ID NO: 81190 - DNA, 20 bp, human
gcaggcacgcgaggcccctc

SEQ ID NO: 81191 - DNA, 20 bp, human
ggcgtgcctggacagccccg

SEQ ID NO: 81192 - DNA, 20 bp, human
ggctgcaaccgggcgcacgg

SEQ ID NO: 81193 - DNA, 20 bp, human
gaggcgaccataaattcctg

SEQ ID NO: 81194 - DNA, 20 bp, human
gttaggcttgctggcccgcg

SEQ ID NO: 81195 - DNA, 20 bp, human
gctattaacatagactccac

SEQ ID NO: 81196 - DNA, 20 bp, human
gcggaggaccccgctctcag

SEQ ID NO: 81197 - DNA, 20 bp, human
gctcccgccccagcttgaag

SEQ ID NO: 81198 - DNA, 20 bp, human
ggcgcgtgcgccctcttact

SEQ ID NO: 81199 - DNA, 20 bp, human
gtcgcaggcgccacacctct

SEQ ID NO: 81200 - DNA, 20 bp, human
gcctccagagaggcccgatc

SEQ ID NO: 81201 - DNA, 20 bp, human
gcaaggggagccgagtaaga

SEQ ID NO: 81202 - DNA, 20 bp, human
gcggtgcccgcggccggatc

SEQ ID NO: 81203 - DNA, 20 bp, human
ggtccggcaacccctgagag

SEQ ID NO: 81204 - DNA, 20 bp, human
ggctccacgccggtgcgggt

SEQ ID NO: 81205 - DNA, 20 bp, human
gtcatggggaagctcgtctg

SEQ ID NO: 81206 - DNA, 20 bp, human
gcaagagtggggcagcggga

SEQ ID NO: 81207 - DNA, 20 bp, human
gagcagaggcgtctctaggt

SEQ ID NO: 81208 - DNA, 20 bp, human
gggaccggcacccagggaca

SEQ ID NO: 81209 - DNA, 20 bp, human
ggcttcgaggcgccactccg

SEQ ID NO: 81210 - DNA, 20 bp, human
gggtccctggccactcccct

SEQ ID NO: 81211 - DNA, 20 bp, human
gggccagggaccggcaccca

SEQ ID NO: 81212 - DNA, 20 bp, human
gggatggggtggaagctcaa

SEQ ID NO: 81213 - DNA, 20 bp, human
ggggcgcccgccctgtccct

SEQ ID NO: 81214 - DNA, 20 bp, human
gtcagcagccctagcaggaa

SEQ ID NO: 81215 - DNA, 20 bp, human
ggcccaccatatcagagcag

SEQ ID NO: 81216 - DNA, 20 bp, human
ggagtgaggaagcaggctca

SEQ ID NO: 81217 - DNA, 20 bp, human
gagtcctggagtgaggaagc

SEQ ID NO: 81218 - DNA, 20 bp, human
gtcactccaggactgccaga

SEQ ID NO: 81219 - DNA, 20 bp, human
gtcttaccctctggcagtcc

SEQ ID NO: 81220 - DNA, 20 bp, human
gtctattaaatcttaccctc

SEQ ID NO: 81221 - DNA, 20 bp, human
gtgtacttgaagtacagact

SEQ ID NO: 81222 - DNA, 20 bp, human
ggatgttattgcattgtaca

SEQ ID NO: 81223 - DNA, 20 bp, human
ggcaaaatagtatttcaatc

SEQ ID NO: 81224 - DNA, 20 bp, human
gagaacttatttacatgctt

SEQ ID NO: 81225 - DNA, 20 bp, human
ggttaataagtttagccttt

SEQ ID NO: 81226 - DNA, 20 bp, human
gccccagacccgggtcagtt

SEQ ID NO: 81227 - DNA, 20 bp, human
ggaagccgcaccgcacggtc

SEQ ID NO: 81228 - DNA, 20 bp, human
ggccattcattagctgaggg

SEQ ID NO: 81229 - DNA, 20 bp, human
gagacccgggtcagttcggc

SEQ ID NO: 81230 - DNA, 20 bp, human
gccgcctgccgaactgaccc

SEQ ID NO: 81231 - DNA, 20 bp, human
ggcccccctcagctaatgaa

SEQ ID NO: 81232 - DNA, 20 bp, human
ggagggcgtgtccagcagga

SEQ ID NO: 81233 - DNA, 20 bp, human
gttcccgattcctgtagtag

SEQ ID NO: 81234 - DNA, 20 bp, human
ggctaatgaatggcctgtcc

SEQ ID NO: 81235 - DNA, 20 bp, human
gatcgggaacggggatgtag

SEQ ID NO: 81236 - DNA, 20 bp, human
gctggagtcaagcaccaagg

SEQ ID NO: 81237 - DNA, 20 bp, human
gagggtcagacagtgtggag

SEQ ID NO: 81238 - DNA, 20 bp, human
ggggagcgaaaaccagatta

SEQ ID NO: 81239 - DNA, 20 bp, human
gggagagaaaggccttaatc

SEQ ID NO: 81240 - DNA, 20 bp, human
gttcctggagtcaagcacca

SEQ ID NO: 81241 - DNA, 20 bp, human
gtgaaaaagccaggacacaa

SEQ ID NO: 81242 - DNA, 20 bp, human
gtacaatgctgcaactatca

SEQ ID NO: 81243 - DNA, 20 bp, human
gcctttctgtggtaacaaag

SEQ ID NO: 81244 - DNA, 20 bp, human
gaggaataatttataaactg

SEQ ID NO: 81245 - DNA, 20 bp, human
gcgatccctgaagcatgctt

SEQ ID NO: 81246 - DNA, 20 bp, human
gacggtcggggacgcctggt

SEQ ID NO: 81247 - DNA, 20 bp, human
gccaggcggcggtaggtagc

SEQ ID NO: 81248 - DNA, 20 bp, human
gtgacgtcggatgagtgatc

SEQ ID NO: 81249 - DNA, 20 bp, human
gggaccccgagctccctggt

SEQ ID NO: 81250 - DNA, 20 bp, human
gcgcggtcggagcgtccctc

SEQ ID NO: 81251 - DNA, 20 bp, human
gaacacctgccggagagcag

SEQ ID NO: 81252 - DNA, 20 bp, human
ggtcggatgagtgatccgga

SEQ ID NO: 81253 - DNA, 20 bp, human
ggcaggggcggggtcactct

SEQ ID NO: 81254 - DNA, 20 bp, human
gcttcggctgacgctgacgt

SEQ ID NO: 81255 - DNA, 20 bp, human
gggagcctcccggccgcggt

SEQ ID NO: 81256 - DNA, 20 bp, human
gcagggcctcgcctggaaga

SEQ ID NO: 81257 - DNA, 20 bp, human
gtggaggtcgctcctaatag

SEQ ID NO: 81258 - DNA, 20 bp, human
gctgcctgcggccttcttcc

SEQ ID NO: 81259 - DNA, 20 bp, human
ggcgcgcgcgcggcttctcg

SEQ ID NO: 81260 - DNA, 20 bp, human
gtcgcctggaagaaggccgc

SEQ ID NO: 81261 - DNA, 20 bp, human
ggccgcctgagggggaatag

SEQ ID NO: 81262 - DNA, 20 bp, human
gggccgaacgcgacccgagg

SEQ ID NO: 81263 - DNA, 20 bp, human
ggccggaagaaccccgagca

SEQ ID NO: 81264 - DNA, 20 bp, human
gaggtcgctcctaatagagg

SEQ ID NO: 81265 - DNA, 20 bp, human
gggccggcaacccgacccca

SEQ ID NO: 81266 - DNA, 20 bp, human
ggctgctgggagccatagcg

SEQ ID NO: 81267 - DNA, 20 bp, human
gtgcaacctcagcctcgcta

SEQ ID NO: 81268 - DNA, 20 bp, human
gatctagccaagcaaggcgg

SEQ ID NO: 81269 - DNA, 20 bp, human
gagctgtttatgggaaggag

SEQ ID NO: 81270 - DNA, 20 bp, human
ggcaatctagccaagcaagg

SEQ ID NO: 81271 - DNA, 20 bp, human
gggaggtaaggctagacccc

SEQ ID NO: 81272 - DNA, 20 bp, human
gccacacgtggaggtatgca

SEQ ID NO: 81273 - DNA, 20 bp, human
ggacgcaatctagccaagca

SEQ ID NO: 81274 - DNA, 20 bp, human
ggctagagacagcgattgaa

SEQ ID NO: 81275 - DNA, 20 bp, human
gggtctggattcgaacctac

SEQ ID NO: 81276 - DNA, 20 bp, human
gccacgtgggcccctaaata

SEQ ID NO: 81277 - DNA, 20 bp, human
gtggccgatgtagaaatgtg

SEQ ID NO: 81278 - DNA, 20 bp, human
gcgtgggcccctaaataagg

SEQ ID NO: 81279 - DNA, 20 bp, human
gtccagatcacagcccacgt

SEQ ID NO: 81280 - DNA, 20 bp, human
gacgcctgccggggagaaca

SEQ ID NO: 81281 - DNA, 20 bp, human
ggggcaggaaattggtgaca

SEQ ID NO: 81282 - DNA, 20 bp, human
ggctccaagaagggtagctc

SEQ ID NO: 81283 - DNA, 20 bp, human
gtctacatcggccaccgaga

SEQ ID NO: 81284 - DNA, 20 bp, human
ggggatcccgggcaggaaat

SEQ ID NO: 81285 - DNA, 20 bp, human
gttctcgctggtaagtgcag

SEQ ID NO: 81286 - DNA, 20 bp, human
gcacaacacggatggtacca

SEQ ID NO: 81287 - DNA, 20 bp, human
gccgaaactgaaggctaagt

SEQ ID NO: 81288 - DNA, 20 bp, human
gccctgggccacaacacgga

SEQ ID NO: 81289 - DNA, 20 bp, human
gtctgtcagaatggccacca

SEQ ID NO: 81290 - DNA, 20 bp, human
gccacctgaaggctgaacta

SEQ ID NO: 81291 - DNA, 20 bp, human
gtctgatccagcataggagg

SEQ ID NO: 81292 - DNA, 20 bp, human
gagaggaaggtgccttcctg

SEQ ID NO: 81293 - DNA, 20 bp, human
gcccgaggatacagagtcag

SEQ ID NO: 81294 - DNA, 20 bp, human
ggcttgactggtctcacctg

SEQ ID NO: 81295 - DNA, 20 bp, human
gggtggtcaggccccagcat

SEQ ID NO: 81296 - DNA, 20 bp, human
gcgcctacagtgagggacag

SEQ ID NO: 81297 - DNA, 20 bp, human
ggccccgcgccagagagcca

SEQ ID NO: 81298 - DNA, 20 bp, human
gctgtaggcggtgatcctgg

SEQ ID NO: 81299 - DNA, 20 bp, human
ggcgcggggccccttagtcc

SEQ ID NO: 81300 - DNA, 20 bp, human
gggatcaccgcctacagtga

SEQ ID NO: 81301 - DNA, 20 bp, human
gagggccggctctagagata

SEQ ID NO: 81302 - DNA, 20 bp, human
gagcccctgtccctcactgt

SEQ ID NO: 81303 - DNA, 20 bp, human
ggcgctcccaactcccgggt

SEQ ID NO: 81304 - DNA, 20 bp, human
gggctcatgcgcacccagaa

SEQ ID NO: 81305 - DNA, 20 bp, human
ggcaaaaagcccggactaag

SEQ ID NO: 81306 - DNA, 20 bp, human
ggcggcggggaaagcacagg

SEQ ID NO: 81307 - DNA, 20 bp, human
ggccgcggcggggaaagcac

SEQ ID NO: 81308 - DNA, 20 bp, human
ggaaggccctggcatcgccg

SEQ ID NO: 81309 - DNA, 20 bp, human
ggagcgcgagccgaggagct

SEQ ID NO: 81310 - DNA, 20 bp, human
gcagcgtaaggaggtacccg

SEQ ID NO: 81311 - DNA, 20 bp, human
gtgggtgcggaagaacacct

SEQ ID NO: 81312 - DNA, 20 bp, human
ggtctccagggcgaagggtt

SEQ ID NO: 81313 - DNA, 20 bp, human
gaggcgtgggagcgaggcga

SEQ ID NO: 81314 - DNA, 20 bp, human
gagactcaggctcgaggtgg

SEQ ID NO: 81315 - DNA, 20 bp, human
ggaacagcgcctctgagtca

SEQ ID NO: 81316 - DNA, 20 bp, human
gatctggtcgctctgcaagg

SEQ ID NO: 81317 - DNA, 20 bp, human
gtcatcctcaaggcacggag

SEQ ID NO: 81318 - DNA, 20 bp, human
ggcatcagctctacgcgatc

SEQ ID NO: 81319 - DNA, 20 bp, human
gccggcgagggttgaagtcg

SEQ ID NO: 81320 - DNA, 20 bp, human
gcggtgtttaggaggtttag

SEQ ID NO: 81321 - DNA, 20 bp, human
gcccggtgttcaaagagctg

SEQ ID NO: 81322 - DNA, 20 bp, human
ggtgctcacagccacggtac

SEQ ID NO: 81323 - DNA, 20 bp, human
gtccctccgagccagtaccg

SEQ ID NO: 81324 - DNA, 20 bp, human
gggcgcggtgctcacagcca

SEQ ID NO: 81325 - DNA, 20 bp, human
gccgcagcagggtcagcgtg

SEQ ID NO: 81326 - DNA, 20 bp, human
gccaggaaggagagatccac

SEQ ID NO: 81327 - DNA, 20 bp, human
gggagctgcgctcacctcag

SEQ ID NO: 81328 - DNA, 20 bp, human
gcggccgagggctccgtaca

SEQ ID NO: 81329 - DNA, 20 bp, human
gtggccccgcgacggatcgg

SEQ ID NO: 81330 - DNA, 20 bp, human
gcagggacgcccgcgaggtc

SEQ ID NO: 81331 - DNA, 20 bp, human
gggacaatccctgctaggac

SEQ ID NO: 81332 - DNA, 20 bp, human
gcctgccggaggctggaaaa

SEQ ID NO: 81333 - DNA, 20 bp, human
gggctgcgccccgctcgtcg

SEQ ID NO: 81334 - DNA, 20 bp, human
gggagagatccacaggatcg

SEQ ID NO: 81335 - DNA, 20 bp, human
gttcgcggcgccagtaagtg

SEQ ID NO: 81336 - DNA, 20 bp, human
gcgccctgcacccgaggagt

SEQ ID NO: 81337 - DNA, 20 bp, human
gcgcgccgcgcagcccgcca

SEQ ID NO: 81338 - DNA, 20 bp, human
ggcgccgggcggcggactag

SEQ ID NO: 81339 - DNA, 20 bp, human
ggacgcgcctcagagcccgg

SEQ ID NO: 81340 - DNA, 20 bp, human
ggcagccggcgcgtttctcc

SEQ ID NO: 81341 - DNA, 20 bp, human
ggtagcccggagaaacgcgc

SEQ ID NO: 81342 - DNA, 20 bp, human
gcttcccgggccggcatcgg

SEQ ID NO: 81343 - DNA, 20 bp, human
gagtccgccgcccggcgcca

SEQ ID NO: 81344 - DNA, 20 bp, human
gcgagttcaggtcgcaggag

SEQ ID NO: 81345 - DNA, 20 bp, human
gctcgggcgccctgcacccg

SEQ ID NO: 81346 - DNA, 20 bp, human
ggttcttagagaaagatgaa

SEQ ID NO: 81347 - DNA, 20 bp, human
gaaacatgaagtcaggcctc

SEQ ID NO: 81348 - DNA, 20 bp, human
ggcttggagttacctgtcag

SEQ ID NO: 81349 - DNA, 20 bp, human
gttctggcaaacatgaagtc

SEQ ID NO: 81350 - DNA, 20 bp, human
gtctcaagacacagtatcaa

SEQ ID NO: 81351 - DNA, 20 bp, human
gagtggataaactagcagag

SEQ ID NO: 81352 - DNA, 20 bp, human
gagtttcaggatatggccaa

SEQ ID NO: 81353 - DNA, 20 bp, human
gcacagtgacatgagtgaca

SEQ ID NO: 81354 - DNA, 20 bp, human
ggctttgaacactgaacgcg

SEQ ID NO: 81355 - DNA, 20 bp, human
ggaggactgttaactgtttc

SEQ ID NO: 81356 - DNA, 20 bp, human
ggccgcgggagacctcggag

SEQ ID NO: 81357 - DNA, 20 bp, human
gctcggagaggagcaacctc

SEQ ID NO: 81358 - DNA, 20 bp, human
gcgctgggcgctcagagcct

SEQ ID NO: 81359 - DNA, 20 bp, human
gcttgggccgcgggagacct

SEQ ID NO: 81360 - DNA, 20 bp, human
gggcctggcaccgggaccca

SEQ ID NO: 81361 - DNA, 20 bp, human
gacctcggggcgcgggagat

SEQ ID NO: 81362 - DNA, 20 bp, human
gctcggggcgcggagaactt

SEQ ID NO: 81363 - DNA, 20 bp, human
gtcctctccgaggtctcccg

SEQ ID NO: 81364 - DNA, 20 bp, human
ggttcgcggtcctccttccc

SEQ ID NO: 81365 - DNA, 20 bp, human
ggccaccccgcccctgaccg

SEQ ID NO: 81366 - DNA, 20 bp, human
gcctgagcatggcggccacc

SEQ ID NO: 81367 - DNA, 20 bp, human
ggtccgagccctgagattcg

SEQ ID NO: 81368 - DNA, 20 bp, human
gcgggaaggactggacggaa

SEQ ID NO: 81369 - DNA, 20 bp, human
gcctgagccgagccggagtc

SEQ ID NO: 81370 - DNA, 20 bp, human
gtcgcaagacctgagcatgg

SEQ ID NO: 81371 - DNA, 20 bp, human
gccaccaggtgcctgcgctg

SEQ ID NO: 81372 - DNA, 20 bp, human
gagccaaccaggcctcccgg

SEQ ID NO: 81373 - DNA, 20 bp, human
gcttgtgcagcgcccggcgt

SEQ ID NO: 81374 - DNA, 20 bp, human
gcgctaacctggccgggagt

SEQ ID NO: 81375 - DNA, 20 bp, human
gcgcctccgggaggcctggt

SEQ ID NO: 81376 - DNA, 20 bp, human
gtggaagcccgaagcagata

SEQ ID NO: 81377 - DNA, 20 bp, human
gtacatcagggaccttcagt

SEQ ID NO: 81378 - DNA, 20 bp, human
ggcgactggctgaaacagaa

SEQ ID NO: 81379 - DNA, 20 bp, human
ggggcaaagcgaaaaaaatg

SEQ ID NO: 81380 - DNA, 20 bp, human
ggaatcatgaaagtcgccag

SEQ ID NO: 81381 - DNA, 20 bp, human
gccgaagttggaacccccgg

SEQ ID NO: 81382 - DNA, 20 bp, human
gaggccggcaagacagcgag

SEQ ID NO: 81383 - DNA, 20 bp, human
gaatggaacagttaagaacg

SEQ ID NO: 81384 - DNA, 20 bp, human
gtgaactcggaatccgaagt

SEQ ID NO: 81385 - DNA, 20 bp, human
gcgagttcagctccaactga

SEQ ID NO: 81386 - DNA, 20 bp, human
gcgaccgcgggagtgtgcgg

SEQ ID NO: 81387 - DNA, 20 bp, human
gaggtcttacctgcaaggac

SEQ ID NO: 81388 - DNA, 20 bp, human
gctcatcgggtcgtccacag

SEQ ID NO: 81389 - DNA, 20 bp, human
ggaatgaagcccgagcccgg

SEQ ID NO: 81390 - DNA, 20 bp, human
ggctagctgcgcttggcacc

SEQ ID NO: 81391 - DNA, 20 bp, human
gtcccggagcaaaacccctg

SEQ ID NO: 81392 - DNA, 20 bp, human
gcttcattctgagccgagcc

SEQ ID NO: 81393 - DNA, 20 bp, human
gggataaaagccgccccgcc

SEQ ID NO: 81394 - DNA, 20 bp, human
ggcaggtaagacctgctccg

SEQ ID NO: 81395 - DNA, 20 bp, human
gtcagaatgaagcccgagcc

SEQ ID NO: 81396 - DNA, 20 bp, human
ggcctctagggcaggccccg

SEQ ID NO: 81397 - DNA, 20 bp, human
gctcactcactccgcctcta

SEQ ID NO: 81398 - DNA, 20 bp, human
gacggccccagctagaggga

SEQ ID NO: 81399 - DNA, 20 bp, human
gggtaatcagaagcagctcc

SEQ ID NO: 81400 - DNA, 20 bp, human
gagagggagggctagatccg

SEQ ID NO: 81401 - DNA, 20 bp, human
gcagcgcggagctcccggcc

SEQ ID NO: 81402 - DNA, 20 bp, human
gatcagaagcagctccgggc

SEQ ID NO: 81403 - DNA, 20 bp, human
gggagggctagatccgcggg

SEQ ID NO: 81404 - DNA, 20 bp, human
gcgcggcggctctcgcgtcc

SEQ ID NO: 81405 - DNA, 20 bp, human
gacagacacactagtaactt

SEQ ID NO: 81406 - DNA, 20 bp, human
ggcgttgcaggtcactgtag

SEQ ID NO: 81407 - DNA, 20 bp, human
gtggtacccggagtcccgag

SEQ ID NO: 81408 - DNA, 20 bp, human
gtccaggtaagcctcgaagt

SEQ ID NO: 81409 - DNA, 20 bp, human
gaagcctcgaagtcgggaca

SEQ ID NO: 81410 - DNA, 20 bp, human
ggactcactccccagcatga

SEQ ID NO: 81411 - DNA, 20 bp, human
gccgcaggcgggagtagcag

SEQ ID NO: 81412 - DNA, 20 bp, human
ggaggcaatcgggagctccg

SEQ ID NO: 81413 - DNA, 20 bp, human
gagagttacgcgaggcaatc

SEQ ID NO: 81414 - DNA, 20 bp, human
gcacccaggcaaggatgctg

SEQ ID NO: 81415 - DNA, 20 bp, human
ggtgcgcggctgctacgagg

SEQ ID NO: 81416 - DNA, 20 bp, human
gccgggagtggggtgatccc

SEQ ID NO: 81417 - DNA, 20 bp, human
gcgcggttgtgagtagtacc

SEQ ID NO: 81418 - DNA, 20 bp, human
ggggccgggcgagagcgtag

SEQ ID NO: 81419 - DNA, 20 bp, human
gtgtgagtagtaccgggagt

SEQ ID NO: 81420 - DNA, 20 bp, human
ggtgactaggacacccgggt

SEQ ID NO: 81421 - DNA, 20 bp, human
ggcttagtcggagctccgaa

SEQ ID NO: 81422 - DNA, 20 bp, human
gagggcgcgcgcgatgaagg

SEQ ID NO: 81423 - DNA, 20 bp, human
gccgagcacggccacagcct

SEQ ID NO: 81424 - DNA, 20 bp, human
gctccgactaagcccgatcg

SEQ ID NO: 81425 - DNA, 20 bp, human
ggggagtgactaggacaccc

SEQ ID NO: 81426 - DNA, 20 bp, human
ggcgactgcgctggctaatg

SEQ ID NO: 81427 - DNA, 20 bp, human
ggcgggcgccgaggactgag

SEQ ID NO: 81428 - DNA, 20 bp, human
gggactccgggagagtgacg

SEQ ID NO: 81429 - DNA, 20 bp, human
ggtgcagaagccacgctagc

SEQ ID NO: 81430 - DNA, 20 bp, human
ggcgctggctaatgcggtac

SEQ ID NO: 81431 - DNA, 20 bp, human
ggaagcgtttgcggtgatcc

SEQ ID NO: 81432 - DNA, 20 bp, human
gagaggcctggtccagagtc

SEQ ID NO: 81433 - DNA, 20 bp, human
gagtcacccggcctgcacct

SEQ ID NO: 81434 - DNA, 20 bp, human
gcctgcgccccccgcactag

SEQ ID NO: 81435 - DNA, 20 bp, human
gcggcccctcaccagcccaa

SEQ ID NO: 81436 - DNA, 20 bp, human
gctctaattccgcagaaggc

SEQ ID NO: 81437 - DNA, 20 bp, human
gaaagctcggacctaccctg

SEQ ID NO: 81438 - DNA, 20 bp, human
ggagtctacttcagaagcgg

SEQ ID NO: 81439 - DNA, 20 bp, human
gaggcactgggagtccggtt

SEQ ID NO: 81440 - DNA, 20 bp, human
gaaacccgggaccacagggt

SEQ ID NO: 81441 - DNA, 20 bp, human
gagggagaaactgggcggtg

SEQ ID NO: 81442 - DNA, 20 bp, human
gagcggaggcactgggagtc

SEQ ID NO: 81443 - DNA, 20 bp, human
gcttgggttggaaaatcgag

SEQ ID NO: 81444 - DNA, 20 bp, human
gaactgggcggtgaggaagt

SEQ ID NO: 81445 - DNA, 20 bp, human
ggctccagcggccttcagag

SEQ ID NO: 81446 - DNA, 20 bp, human
gctctccagcttgggatggc

SEQ ID NO: 81447 - DNA, 20 bp, human
gctccgcgcggcactcacag

SEQ ID NO: 81448 - DNA, 20 bp, human
ggctggagagcgaacgagca

SEQ ID NO: 81449 - DNA, 20 bp, human
ggagggacggtggcaactgg

SEQ ID NO: 81450 - DNA, 20 bp, human
ggtggggacttgagggacgg

SEQ ID NO: 81451 - DNA, 20 bp, human
gagagtgtcccggacccgaa

SEQ ID NO: 81452 - DNA, 20 bp, human
gcgagacgagcacccgtggg

SEQ ID NO: 81453 - DNA, 20 bp, human
gggagagcgaacgagcaggg

SEQ ID NO: 81454 - DNA, 20 bp, human
gcccctcccgaaatacctag

SEQ ID NO: 81455 - DNA, 20 bp, human
gcctgcctggaccctccgcg

SEQ ID NO: 81456 - DNA, 20 bp, human
gtcaccttagagatccacgc

SEQ ID NO: 81457 - DNA, 20 bp, human
gcgggctccgagcgtggggt

SEQ ID NO: 81458 - DNA, 20 bp, human
ggggcccgcgtggatctcta

SEQ ID NO: 81459 - DNA, 20 bp, human
ggacagcggatgagaggtgt

SEQ ID NO: 81460 - DNA, 20 bp, human
gtccgcagcaacagccgcag

SEQ ID NO: 81461 - DNA, 20 bp, human
gccaagggccgcgcagacag

SEQ ID NO: 81462 - DNA, 20 bp, human
gcgcgcagacagcggatgag

SEQ ID NO: 81463 - DNA, 20 bp, human
gctgttgctgcggagccagg

SEQ ID NO: 81464 - DNA, 20 bp, human
gtggccggctcgcagtgtat

SEQ ID NO: 81465 - DNA, 20 bp, human
gcttcgcgccgagcccggga

SEQ ID NO: 81466 - DNA, 20 bp, human
gttccggccgcgggagccaa

SEQ ID NO: 81467 - DNA, 20 bp, human
gccgcgcccaaaggccagat

SEQ ID NO: 81468 - DNA, 20 bp, human
gcccgcggccggaagtgctg

SEQ ID NO: 81469 - DNA, 20 bp, human
ggctgcccggcacgaaccct

SEQ ID NO: 81470 - DNA, 20 bp, human
gggagccaagggttcgtgcc

SEQ ID NO: 81471 - DNA, 20 bp, human
gagtggcgccccttgacctg

SEQ ID NO: 81472 - DNA, 20 bp, human
gcctctcgaggcgggcagtg

SEQ ID NO: 81473 - DNA, 20 bp, human
ggcccccgccccaggtcaag

SEQ ID NO: 81474 - DNA, 20 bp, human
gggacaaagacccggagcgg

SEQ ID NO: 81475 - DNA, 20 bp, human
gagggacagggcccgggtaa

SEQ ID NO: 81476 - DNA, 20 bp, human
gtgaggccccgggacatgtc

SEQ ID NO: 81477 - DNA, 20 bp, human
gcctcactcgggtcagccag

SEQ ID NO: 81478 - DNA, 20 bp, human
gcgacttcctgcgggaaaca

SEQ ID NO: 81479 - DNA, 20 bp, human
ggaaacatggcggcattgag

SEQ ID NO: 81480 - DNA, 20 bp, human
ggtctccgccgggaaccctg

SEQ ID NO: 81481 - DNA, 20 bp, human
gggcattgagcggagtccgc

SEQ ID NO: 81482 - DNA, 20 bp, human
gccctgcccgacatgtcccg

SEQ ID NO: 81483 - DNA, 20 bp, human
ggcctcaattgggggaagag

SEQ ID NO: 81484 - DNA, 20 bp, human
gattgaggccgaggacgtga

SEQ ID NO: 81485 - DNA, 20 bp, human
ggggcgggagcacggatcct

SEQ ID NO: 81486 - DNA, 20 bp, human
gatctgcgtgtcgggacgtg

SEQ ID NO: 81487 - DNA, 20 bp, human
gtcccagggacggcagagaa

SEQ ID NO: 81488 - DNA, 20 bp, human
ggtgagtgactgcctcagaa

SEQ ID NO: 81489 - DNA, 20 bp, human
ggagagcggtatctgcgtgt

SEQ ID NO: 81490 - DNA, 20 bp, human
gcggaaccggattcccgaag

SEQ ID NO: 81491 - DNA, 20 bp, human
gaggctctcactttccgtca

SEQ ID NO: 81492 - DNA, 20 bp, human
gtgcgtgtcgggacgtgcgg

SEQ ID NO: 81493 - DNA, 20 bp, human
gtccacgagagaggaaaccg

SEQ ID NO: 81494 - DNA, 20 bp, human
gcgtcgaactctcgcgagag

SEQ ID NO: 81495 - DNA, 20 bp, human
gtgaaggtagcgaccgtcgc

SEQ ID NO: 81496 - DNA, 20 bp, human
gcacagacaaccgccggtcc

SEQ ID NO: 81497 - DNA, 20 bp, human
gccgcagactgtgctcaaag

SEQ ID NO: 81498 - DNA, 20 bp, human
gggcggagttcgggagacag

SEQ ID NO: 81499 - DNA, 20 bp, human
gctgtggccggaggctgatc

SEQ ID NO: 81500 - DNA, 20 bp, human
gctgatcaggtactgtggac

SEQ ID NO: 81501 - DNA, 20 bp, human
gagcgggcgccatccgggac

SEQ ID NO: 81502 - DNA, 20 bp, human
ggacaaccgccggtcccgga

SEQ ID NO: 81503 - DNA, 20 bp, human
ggggcgccatccgggaccgg

SEQ ID NO: 81504 - DNA, 20 bp, human
gatcaggtactgtggacggg

SEQ ID NO: 81505 - DNA, 20 bp, human
gacagtacctgatcagcctc

SEQ ID NO: 81506 - DNA, 20 bp, human
ggactcctgggtatcagatg

SEQ ID NO: 81507 - DNA, 20 bp, human
gcatatgcactaacctctct

SEQ ID NO: 81508 - DNA, 20 bp, human
gcaatgtgcaagttgaacca

SEQ ID NO: 81509 - DNA, 20 bp, human
gagttccacatctgataccc

SEQ ID NO: 81510 - DNA, 20 bp, human
gacagccttttgcaaagagg

SEQ ID NO: 81511 - DNA, 20 bp, human
gtgcatatgttttaccttgt

SEQ ID NO: 81512 - DNA, 20 bp, human
gatattaacagtaatgataa

SEQ ID NO: 81513 - DNA, 20 bp, human
gggctgtttgacttaatgca

SEQ ID NO: 81514 - DNA, 20 bp, human
gcaaacagccttttgcaaag

SEQ ID NO: 81515 - DNA, 20 bp, human
gttggaagctggagactcct

SEQ ID NO: 81516 - DNA, 20 bp, human
gagccgagcttgggttatgg

SEQ ID NO: 81517 - DNA, 20 bp, human
gctcccgcctggccccgaca

SEQ ID NO: 81518 - DNA, 20 bp, human
gggcccggaaggcgacggga

SEQ ID NO: 81519 - DNA, 20 bp, human
gacgggaaggagccgagctt

SEQ ID NO: 81520 - DNA, 20 bp, human
gcaggtggaggcctagcgag

SEQ ID NO: 81521 - DNA, 20 bp, human
ggcgcacggcctctagcgag

SEQ ID NO: 81522 - DNA, 20 bp, human
gagcgagaggacgcaaacca

SEQ ID NO: 81523 - DNA, 20 bp, human
gcgggcgcgctgctggtgat

SEQ ID NO: 81524 - DNA, 20 bp, human
gtgctggtgatgggcgtgag

SEQ ID NO: 81525 - DNA, 20 bp, human
ggccccgcgagcaggctgga

SEQ ID NO: 81526 - DNA, 20 bp, human
gagacactgaggggcaccag

SEQ ID NO: 81527 - DNA, 20 bp, human
ggaggagcagactacaagaa

SEQ ID NO: 81528 - DNA, 20 bp, human
gacaagaatggcacacgcta

SEQ ID NO: 81529 - DNA, 20 bp, human
gcaaatccacaggtaagaga

SEQ ID NO: 81530 - DNA, 20 bp, human
gaccatattgatgaagaagt

SEQ ID NO: 81531 - DNA, 20 bp, human
gacacgctatggaaaactcc

SEQ ID NO: 81532 - DNA, 20 bp, human
gctaacatggatacggagag

SEQ ID NO: 81533 - DNA, 20 bp, human
ggaaaactcttcagacactg

SEQ ID NO: 81534 - DNA, 20 bp, human
gagagaaggcagtaaaatgt

SEQ ID NO: 81535 - DNA, 20 bp, human
gtacttacctaacatggata

SEQ ID NO: 81536 - DNA, 20 bp, human
ggtctctagggcatcttcca

SEQ ID NO: 81537 - DNA, 20 bp, human
gttactgctatgtggagcaa

SEQ ID NO: 81538 - DNA, 20 bp, human
gagggcatcttccaaggcca

SEQ ID NO: 81539 - DNA, 20 bp, human
gtctctggctgccactccta

SEQ ID NO: 81540 - DNA, 20 bp, human
gtgccctagagacgctgagg

SEQ ID NO: 81541 - DNA, 20 bp, human
gaaccacctcagcgtctcta

SEQ ID NO: 81542 - DNA, 20 bp, human
gagatgccctagagacgctg

SEQ ID NO: 81543 - DNA, 20 bp, human
ggagctcagagacatggccc

SEQ ID NO: 81544 - DNA, 20 bp, human
gtataaagctccagtgtagg

SEQ ID NO: 81545 - DNA, 20 bp, human
gtgtcttcattactgctatg

SEQ ID NO: 81546 - DNA, 20 bp, human
gtgtgttgcgcagtcttcat

SEQ ID NO: 81547 - DNA, 20 bp, human
gggagggatgaagggacggt

SEQ ID NO: 81548 - DNA, 20 bp, human
ggccacagagacctcctcgt

SEQ ID NO: 81549 - DNA, 20 bp, human
ggacgcagggaagagtcgca

SEQ ID NO: 81550 - DNA, 20 bp, human
gcgacgcggccgcttcagag

SEQ ID NO: 81551 - DNA, 20 bp, human
gagaggaagggaagcacgga

SEQ ID NO: 81552 - DNA, 20 bp, human
gtctagaacccgccccggag

SEQ ID NO: 81553 - DNA, 20 bp, human
gtcatgggttcccgacgagg

SEQ ID NO: 81554 - DNA, 20 bp, human
gtcttcatgggttcccgacg

SEQ ID NO: 81555 - DNA, 20 bp, human
ggaccggccgaggccttctc

SEQ ID NO: 81556 - DNA, 20 bp, human
ggcgcgcccagactccgacc

SEQ ID NO: 81557 - DNA, 20 bp, human
gtgcagggccgtccactccc

SEQ ID NO: 81558 - DNA, 20 bp, human
gcgggtacctcagctctagg

SEQ ID NO: 81559 - DNA, 20 bp, human
gtctcacagtgcgcagtcag

SEQ ID NO: 81560 - DNA, 20 bp, human
ggtgggtcctccacctgagt

SEQ ID NO: 81561 - DNA, 20 bp, human
gtccgacccggaggcggaac

SEQ ID NO: 81562 - DNA, 20 bp, human
gggcgcttctggaggagcac

SEQ ID NO: 81563 - DNA, 20 bp, human
gggatcccgggcatcggcct

SEQ ID NO: 81564 - DNA, 20 bp, human
gtgcggccagggggtcccgg

SEQ ID NO: 81565 - DNA, 20 bp, human
ggccccggcgcccactcagg

SEQ ID NO: 81566 - DNA, 20 bp, human
gggctgccgccccccaaaca

SEQ ID NO: 81567 - DNA, 20 bp, human
gcgccgcgagccagtgcggg

SEQ ID NO: 81568 - DNA, 20 bp, human
gcagccgccagagatgaggg

SEQ ID NO: 81569 - DNA, 20 bp, human
ggttgcgcaggaacaatccg

SEQ ID NO: 81570 - DNA, 20 bp, human
gtgagaagtggcggagttgg

SEQ ID NO: 81571 - DNA, 20 bp, human
gcagatatgccagcagcggg

SEQ ID NO: 81572 - DNA, 20 bp, human
gacccagccgccagagatga

SEQ ID NO: 81573 - DNA, 20 bp, human
ggacaccgccccctacggtg

SEQ ID NO: 81574 - DNA, 20 bp, human
gatgcggcagaactccccgg

SEQ ID NO: 81575 - DNA, 20 bp, human
ggcggcacgagagggctaag

SEQ ID NO: 81576 - DNA, 20 bp, human
gggagtgtaaggccaagtga

SEQ ID NO: 81577 - DNA, 20 bp, human
gtcgagggtagagaaccctg

SEQ ID NO: 81578 - DNA, 20 bp, human
gctgcaggatggtcatggtc

SEQ ID NO: 81579 - DNA, 20 bp, human
gaggatctggcagaagacga

SEQ ID NO: 81580 - DNA, 20 bp, human
gctcttcagccatcaggatc

SEQ ID NO: 81581 - DNA, 20 bp, human
gcagctggcgccggacctaa

SEQ ID NO: 81582 - DNA, 20 bp, human
ggtgagccgagcggagtgta

SEQ ID NO: 81583 - DNA, 20 bp, human
gggcgatactcaccactcga

SEQ ID NO: 81584 - DNA, 20 bp, human
gtgacacatggtgagccgag

SEQ ID NO: 81585 - DNA, 20 bp, human
gccggcgcccctgcctccag

SEQ ID NO: 81586 - DNA, 20 bp, human
ggggccccatcggcttccgt

SEQ ID NO: 81587 - DNA, 20 bp, human
ggccttcctacggaagccga

SEQ ID NO: 81588 - DNA, 20 bp, human
gggcgccacgtcccttgcgg

SEQ ID NO: 81589 - DNA, 20 bp, human
gtaaaggccatggccgtccg

SEQ ID NO: 81590 - DNA, 20 bp, human
gcggcgggagagaaatcgct

SEQ ID NO: 81591 - DNA, 20 bp, human
ggccgcgtgaggggacacca

SEQ ID NO: 81592 - DNA, 20 bp, human
ggagtacagggtaaaggcca

SEQ ID NO: 81593 - DNA, 20 bp, human
gcccgccgccgcaagggacg

SEQ ID NO: 81594 - DNA, 20 bp, human
gaatcgcttggacttcgggg

SEQ ID NO: 81595 - DNA, 20 bp, human
ggcggcggcggagtccccgg

SEQ ID NO: 81596 - DNA, 20 bp, human
gagcgaccggacccgaaacg

SEQ ID NO: 81597 - DNA, 20 bp, human
gtccggccaagaggcacgag

SEQ ID NO: 81598 - DNA, 20 bp, human
gctccgaagagaaacgactc

SEQ ID NO: 81599 - DNA, 20 bp, human
gagcgggaccggccaggtag

SEQ ID NO: 81600 - DNA, 20 bp, human
gcgggtccggtcgctaaaca

SEQ ID NO: 81601 - DNA, 20 bp, human
gcggagtcttaggtgatcga

SEQ ID NO: 81602 - DNA, 20 bp, human
gcggtcgagaagcctatata

SEQ ID NO: 81603 - DNA, 20 bp, human
gggccaagaggcacgagcgg

SEQ ID NO: 81604 - DNA, 20 bp, human
ggcatcgtcagcatctctct

SEQ ID NO: 81605 - DNA, 20 bp, human
gcgccgacggccctgtgcag

SEQ ID NO: 81606 - DNA, 20 bp, human
gggagtccgggtcagaggtt

SEQ ID NO: 81607 - DNA, 20 bp, human
gggttcggctgcgctccgaa

SEQ ID NO: 81608 - DNA, 20 bp, human
gtgcgccgcgcgccacccgc

SEQ ID NO: 81609 - DNA, 20 bp, human
gggcgcgcggcgcatggtgg

SEQ ID NO: 81610 - DNA, 20 bp, human
gatcaggctctgggcgtcca

SEQ ID NO: 81611 - DNA, 20 bp, human
ggcgctacgccgagctctac

SEQ ID NO: 81612 - DNA, 20 bp, human
gcgggctcgcgctccccaga

SEQ ID NO: 81613 - DNA, 20 bp, human
gcatgctcccgcggagacgg

SEQ ID NO: 81614 - DNA, 20 bp, human
gggcaggggtaacggagtcc

SEQ ID NO: 81615 - DNA, 20 bp, human
gcggccgagactcattgctt

SEQ ID NO: 81616 - DNA, 20 bp, human
gagaggttggggccgaataa

SEQ ID NO: 81617 - DNA, 20 bp, human
gcagccccaggggccggatg

SEQ ID NO: 81618 - DNA, 20 bp, human
ggggccgaataacggattca

SEQ ID NO: 81619 - DNA, 20 bp, human
gtcattgcggagggccatgg

SEQ ID NO: 81620 - DNA, 20 bp, human
gcaggaagcagcggaaccgg

SEQ ID NO: 81621 - DNA, 20 bp, human
gtggccctccgcaatgacct

SEQ ID NO: 81622 - DNA, 20 bp, human
ggcccagcacgcgcgccgaa

SEQ ID NO: 81623 - DNA, 20 bp, human
gcatggctgcgccttctgct

SEQ ID NO: 81624 - DNA, 20 bp, human
gtcagccccatccggcccct

SEQ ID NO: 81625 - DNA, 20 bp, human
gcccggcccgggcggcgagt

SEQ ID NO: 81626 - DNA, 20 bp, human
gtcagggctgcaaaccgaga

SEQ ID NO: 81627 - DNA, 20 bp, human
ggaagaagagcagtcagaca

SEQ ID NO: 81628 - DNA, 20 bp, human
gccgggtgcatgaggagaaa

SEQ ID NO: 81629 - DNA, 20 bp, human
gaagagcagtcagacaagga

SEQ ID NO: 81630 - DNA, 20 bp, human
gagacacacagcgggggtca

SEQ ID NO: 81631 - DNA, 20 bp, human
gggcccctcactctccgaca

SEQ ID NO: 81632 - DNA, 20 bp, human
gtaaggtcccatccatgggg

SEQ ID NO: 81633 - DNA, 20 bp, human
ggacgccacagcagcccagg

SEQ ID NO: 81634 - DNA, 20 bp, human
gcaaggaaggaagggctcgc

SEQ ID NO: 81635 - DNA, 20 bp, human
gctccctgtcggagagtgag

SEQ ID NO: 81636 - DNA, 20 bp, human
ggccgagagtcctctgcgtg

SEQ ID NO: 81637 - DNA, 20 bp, human
ggtcgcgggtctcaccgccc

SEQ ID NO: 81638 - DNA, 20 bp, human
gtatctgcgcggggccagaa

SEQ ID NO: 81639 - DNA, 20 bp, human
gtgtcagagacgctgtggag

SEQ ID NO: 81640 - DNA, 20 bp, human
gcgggctgtcagagacgctg

SEQ ID NO: 81641 - DNA, 20 bp, human
ggctcctcgggacgcggtgg

SEQ ID NO: 81642 - DNA, 20 bp, human
ggccgctcctcgggacgcgg

SEQ ID NO: 81643 - DNA, 20 bp, human
gtggccccgcgcagataccg

SEQ ID NO: 81644 - DNA, 20 bp, human
ggcggcgctgcgggacgacc

SEQ ID NO: 81645 - DNA, 20 bp, human
gagacgctgtggaggggccg

SEQ ID NO: 81646 - DNA, 20 bp, human
gtaactaagtgactcaacca

SEQ ID NO: 81647 - DNA, 20 bp, human
gtaagttggtacttagaaga

SEQ ID NO: 81648 - DNA, 20 bp, human
gtctggggcaatagcagaat

SEQ ID NO: 81649 - DNA, 20 bp, human
gatttacttaggaagataac

SEQ ID NO: 81650 - DNA, 20 bp, human
ggttcagtcctcagttgtgg

SEQ ID NO: 81651 - DNA, 20 bp, human
ggaagtccccagaatcacaa

SEQ ID NO: 81652 - DNA, 20 bp, human
gttcagggtcatgggatgat

SEQ ID NO: 81653 - DNA, 20 bp, human
ggctattgccccagagaaaa

SEQ ID NO: 81654 - DNA, 20 bp, human
ggaaactcggtagctgtggt

SEQ ID NO: 81655 - DNA, 20 bp, human
gcttgttcagtcctcagttg

SEQ ID NO: 81656 - DNA, 20 bp, human
gtcacccaggggcaaaacta

SEQ ID NO: 81657 - DNA, 20 bp, human
gcagatgagggagcgcgatc

SEQ ID NO: 81658 - DNA, 20 bp, human
gccagaggggagaggacctg

SEQ ID NO: 81659 - DNA, 20 bp, human
gcccaggaacactcacccag

SEQ ID NO: 81660 - DNA, 20 bp, human
gtcatcagggagcctcagat

SEQ ID NO: 81661 - DNA, 20 bp, human
gcaggtcagaagctttccat

SEQ ID NO: 81662 - DNA, 20 bp, human
ggcggggtgttgcttcccta

SEQ ID NO: 81663 - DNA, 20 bp, human
gcctcccagatggaaagtta

SEQ ID NO: 81664 - DNA, 20 bp, human
gaggtccggggccacgggaa

SEQ ID NO: 81665 - DNA, 20 bp, human
ggtcctgtcccgggacccgt

SEQ ID NO: 81666 - DNA, 20 bp, human
gggagtaaagctgtaagagg

SEQ ID NO: 81667 - DNA, 20 bp, human
gcttgggaaaaggccggaga

SEQ ID NO: 81668 - DNA, 20 bp, human
gtgacaaagtctctcgccgg

SEQ ID NO: 81669 - DNA, 20 bp, human
gagctgacaaagtctctcgc

SEQ ID NO: 81670 - DNA, 20 bp, human
ggcagtgccggcgggagagc

SEQ ID NO: 81671 - DNA, 20 bp, human
gggacgaacgcgtccatcct

SEQ ID NO: 81672 - DNA, 20 bp, human
gcggcgggagagctggcttg

SEQ ID NO: 81673 - DNA, 20 bp, human
gtcgcggaccgcagcagtgc

SEQ ID NO: 81674 - DNA, 20 bp, human
gggccttttcccaagctggc

SEQ ID NO: 81675 - DNA, 20 bp, human
ggagagctggcttggggcgc

SEQ ID NO: 81676 - DNA, 20 bp, human
gggccgtccgggtcccaact

SEQ ID NO: 81677 - DNA, 20 bp, human
ggggcagcttcggaagtgga

SEQ ID NO: 81678 - DNA, 20 bp, human
gtggctcactcaggctactc

SEQ ID NO: 81679 - DNA, 20 bp, human
gagactcactcatcatggtg

SEQ ID NO: 81680 - DNA, 20 bp, human
gaagcaagactcactcatca

SEQ ID NO: 81681 - DNA, 20 bp, human
gcggggcctgcgtctctcta

SEQ ID NO: 81682 - DNA, 20 bp, human
gactcgggcagcttcggaag

SEQ ID NO: 81683 - DNA, 20 bp, human
gcctgggccaagttgggacc

SEQ ID NO: 81684 - DNA, 20 bp, human
gtaggcgcgtccctactgga

SEQ ID NO: 81685 - DNA, 20 bp, human
gtgagtcttgcttccccagg

SEQ ID NO: 81686 - DNA, 20 bp, human
gggagccgcgtgccccgaca

SEQ ID NO: 81687 - DNA, 20 bp, human
gacccttgggcgggactagg

SEQ ID NO: 81688 - DNA, 20 bp, human
gaaaggtgtggcgactgcag

SEQ ID NO: 81689 - DNA, 20 bp, human
gcagctgcgcctctcagatg

SEQ ID NO: 81690 - DNA, 20 bp, human
ggggaacaggcgccctgtcg

SEQ ID NO: 81691 - DNA, 20 bp, human
ggtcatcgcagcaggggcaa

SEQ ID NO: 81692 - DNA, 20 bp, human
gcagcgccgggaactgaaca

SEQ ID NO: 81693 - DNA, 20 bp, human
gatgcgaaagcgaaacggca

SEQ ID NO: 81694 - DNA, 20 bp, human
gctgctggacgtccccacgg

SEQ ID NO: 81695 - DNA, 20 bp, human
ggcgggatgcgaaagcgaaa

SEQ ID NO: 81696 - DNA, 20 bp, human
gacccgaaatacacctcagg

SEQ ID NO: 81697 - DNA, 20 bp, human
gtgtatttcgggtcttgctg

SEQ ID NO: 81698 - DNA, 20 bp, human
gctcaggaggctctgctcgc

SEQ ID NO: 81699 - DNA, 20 bp, human
gctggatgccgtaagtgagg

SEQ ID NO: 81700 - DNA, 20 bp, human
gaagacccgaaatacacctc

SEQ ID NO: 81701 - DNA, 20 bp, human
gcagagaagtgtacacacac

SEQ ID NO: 81702 - DNA, 20 bp, human
ggaacccgctgagtatctga

SEQ ID NO: 81703 - DNA, 20 bp, human
gagggaaccaactcttgcag

SEQ ID NO: 81704 - DNA, 20 bp, human
gccactggatgccgtaagtg

SEQ ID NO: 81705 - DNA, 20 bp, human
gagagaccacagccctttgg

SEQ ID NO: 81706 - DNA, 20 bp, human
ggtagtatcagctagagctg

SEQ ID NO: 81707 - DNA, 20 bp, human
gtgagggtagctgctctgtc

SEQ ID NO: 81708 - DNA, 20 bp, human
gtagctaggcaggcacaaaa

SEQ ID NO: 81709 - DNA, 20 bp, human
ggccactagatcaagaagta

SEQ ID NO: 81710 - DNA, 20 bp, human
gctgctctgtctggatagct

SEQ ID NO: 81711 - DNA, 20 bp, human
gtctgtctggatagctaggc

SEQ ID NO: 81712 - DNA, 20 bp, human
gtctataagggtagtgtcca

SEQ ID NO: 81713 - DNA, 20 bp, human
ggacactacccttatagaga

SEQ ID NO: 81714 - DNA, 20 bp, human
ggtgtccatggattccgtaa

SEQ ID NO: 81715 - DNA, 20 bp, human
ggtcaagcaaaactccatta

SEQ ID NO: 81716 - DNA, 20 bp, human
gttatcgagcagccacggtt

SEQ ID NO: 81717 - DNA, 20 bp, human
gaaagttcttaagagatctg

SEQ ID NO: 81718 - DNA, 20 bp, human
gggaaggagatgatgaaaag

SEQ ID NO: 81719 - DNA, 20 bp, human
ggtgtgagtgagaacatcac

SEQ ID NO: 81720 - DNA, 20 bp, human
gctgtggcttcagagactct

SEQ ID NO: 81721 - DNA, 20 bp, human
gtgtttctaggggttagatc

SEQ ID NO: 81722 - DNA, 20 bp, human
gctgatttatcgagcagcca

SEQ ID NO: 81723 - DNA, 20 bp, human
ggtcgcttacctgtttctag

SEQ ID NO: 81724 - DNA, 20 bp, human
gtttcccaatgatcctgatt

SEQ ID NO: 81725 - DNA, 20 bp, human
gcagaggttgggaaagtcag

SEQ ID NO: 81726 - DNA, 20 bp, human
gccggagcctgctgatagat

SEQ ID NO: 81727 - DNA, 20 bp, human
gctcaggagctatgaagtgt

SEQ ID NO: 81728 - DNA, 20 bp, human
ggctgtgcccatctatcagc

SEQ ID NO: 81729 - DNA, 20 bp, human
gtagatgaagccatctggag

SEQ ID NO: 81730 - DNA, 20 bp, human
gtctcctccaaggtaaactc

SEQ ID NO: 81731 - DNA, 20 bp, human
ggggcacagcagcgagtaaa

SEQ ID NO: 81732 - DNA, 20 bp, human
ggatgaactcactgtcacat

SEQ ID NO: 81733 - DNA, 20 bp, human
ggctcctgagtttaccttgg

SEQ ID NO: 81734 - DNA, 20 bp, human
gccagtcctttgagcagcaa

SEQ ID NO: 81735 - DNA, 20 bp, human
gcggttctccggctgaaggc

SEQ ID NO: 81736 - DNA, 20 bp, human
gcgcgcgcggcgccaccatg

SEQ ID NO: 81737 - DNA, 20 bp, human
ggccaccatgcggcagaagg

SEQ ID NO: 81738 - DNA, 20 bp, human
gggtaaggggacaagtaagg

SEQ ID NO: 81739 - DNA, 20 bp, human
gtgggaggagtgtgggataa

SEQ ID NO: 81740 - DNA, 20 bp, human
gaccgccttctgccgcatgg

SEQ ID NO: 81741 - DNA, 20 bp, human
gaggcatataagggtgctgg

SEQ ID NO: 81742 - DNA, 20 bp, human
gagataagggtgcaggtaag

SEQ ID NO: 81743 - DNA, 20 bp, human
gactgcaagtgaagagcagc

SEQ ID NO: 81744 - DNA, 20 bp, human
gttcagggtccggggtgtag

SEQ ID NO: 81745 - DNA, 20 bp, human
gcgccagaccctctacaccc

SEQ ID NO: 81746 - DNA, 20 bp, human
gtcctgctgcacactcgggt

SEQ ID NO: 81747 - DNA, 20 bp, human
gctctgcaggcagaaaggtc

SEQ ID NO: 81748 - DNA, 20 bp, human
gctaagtgggcagcggacag

SEQ ID NO: 81749 - DNA, 20 bp, human
gcgcctggggtcccggaccg

SEQ ID NO: 81750 - DNA, 20 bp, human
ggaactgcctgacagaaagc

SEQ ID NO: 81751 - DNA, 20 bp, human
ggaagcacgagatgagatag

SEQ ID NO: 81752 - DNA, 20 bp, human
gcagcaggatcgccccggtc

SEQ ID NO: 81753 - DNA, 20 bp, human
gcactcgcacctgggcaggt

SEQ ID NO: 81754 - DNA, 20 bp, human
gcgcggcactttggactctg

SEQ ID NO: 81755 - DNA, 20 bp, human
ggactctgcggtgtgcgcct

SEQ ID NO: 81756 - DNA, 20 bp, human
gcagaatagccagatctcag

SEQ ID NO: 81757 - DNA, 20 bp, human
gattaggcagccgttctgca

SEQ ID NO: 81758 - DNA, 20 bp, human
gaacaggttagatctcagtg

SEQ ID NO: 81759 - DNA, 20 bp, human
gcatgctatagcccaaagaa

SEQ ID NO: 81760 - DNA, 20 bp, human
gtaagcagatactcaaatcg

SEQ ID NO: 81761 - DNA, 20 bp, human
gcttctgtctgatatgggga

SEQ ID NO: 81762 - DNA, 20 bp, human
ggattcacttctgtctgata

SEQ ID NO: 81763 - DNA, 20 bp, human
gctaatttacagcaaccatg

SEQ ID NO: 81764 - DNA, 20 bp, human
gactttagacattatggcag

SEQ ID NO: 81765 - DNA, 20 bp, human
gcccaagacagtgttatata

SEQ ID NO: 81766 - DNA, 20 bp, human
ggagaagccctagaactctg

SEQ ID NO: 81767 - DNA, 20 bp, human
gaggcttggaggctccttca

SEQ ID NO: 81768 - DNA, 20 bp, human
gctctaagctatagctgtag

SEQ ID NO: 81769 - DNA, 20 bp, human
gagctatagctgtaggggag

SEQ ID NO: 81770 - DNA, 20 bp, human
gcagagcacagtgggagctt

SEQ ID NO: 81771 - DNA, 20 bp, human
gcagggtcagaaccaccagt

SEQ ID NO: 81772 - DNA, 20 bp, human
gtatagcttagagtctcctt

SEQ ID NO: 81773 - DNA, 20 bp, human
gcctaagggagctgtcccac

SEQ ID NO: 81774 - DNA, 20 bp, human
gaagggagctgtcccactgg

SEQ ID NO: 81775 - DNA, 20 bp, human
gacctcaagcagagcacagt

SEQ ID NO: 81776 - DNA, 20 bp, human
ggttcggcagggctcggttc

SEQ ID NO: 81777 - DNA, 20 bp, human
gcagaggtagaggcatagta

SEQ ID NO: 81778 - DNA, 20 bp, human
gcacttaaagatgggtctgg

SEQ ID NO: 81779 - DNA, 20 bp, human
gtcagctgttcggcagggct

SEQ ID NO: 81780 - DNA, 20 bp, human
gagtgcaattctcagctgtt

SEQ ID NO: 81781 - DNA, 20 bp, human
gaattctcagctgttcggca

SEQ ID NO: 81782 - DNA, 20 bp, human
ggaattgcactgcaaccatg

SEQ ID NO: 81783 - DNA, 20 bp, human
gaggtctcttcagcatttat

SEQ ID NO: 81784 - DNA, 20 bp, human
gcagcactaccgaatacgaa

SEQ ID NO: 81785 - DNA, 20 bp, human
gacagatttacaaccaacag

SEQ ID NO: 81786 - DNA, 20 bp, human
ggattcaagggtagacctaa

SEQ ID NO: 81787 - DNA, 20 bp, human
ggacacagagggcagtcatg

SEQ ID NO: 81788 - DNA, 20 bp, human
gacaaacttggctgattcaa

SEQ ID NO: 81789 - DNA, 20 bp, human
gttccgaaaagctggtgacc

SEQ ID NO: 81790 - DNA, 20 bp, human
gccctacggaactacatggg

SEQ ID NO: 81791 - DNA, 20 bp, human
ggaaatagctgcacacaggg

SEQ ID NO: 81792 - DNA, 20 bp, human
gtactgaaggaactatataa

SEQ ID NO: 81793 - DNA, 20 bp, human
ggtatttacttgaggcagac

SEQ ID NO: 81794 - DNA, 20 bp, human
gtacggaactacatgggggg

SEQ ID NO: 81795 - DNA, 20 bp, human
gatttcctgcaatgagagga

SEQ ID NO: 81796 - DNA, 20 bp, human
ggcgctgccatcatgaggta

SEQ ID NO: 81797 - DNA, 20 bp, human
gagcgctctgcaggccgtcc

SEQ ID NO: 81798 - DNA, 20 bp, human
gtctgcggtcgggactgtca

SEQ ID NO: 81799 - DNA, 20 bp, human
ggctctgcaggccgtccggg

SEQ ID NO: 81800 - DNA, 20 bp, human
gctgaggagagagcgatccg

SEQ ID NO: 81801 - DNA, 20 bp, human
ggctgccgagaagagccgtc

SEQ ID NO: 81802 - DNA, 20 bp, human
ggcgacccgacggctcttct

SEQ ID NO: 81803 - DNA, 20 bp, human
ggtcccgaccgcagacgcca

SEQ ID NO: 81804 - DNA, 20 bp, human
gtgggtggacaggccttccg

SEQ ID NO: 81805 - DNA, 20 bp, human
gcgggtcgcgatgggtggac

SEQ ID NO: 81806 - DNA, 20 bp, human
gagaagtgtggttttctgcg

SEQ ID NO: 81807 - DNA, 20 bp, human
gagtgaaggtttgagaagtg

SEQ ID NO: 81808 - DNA, 20 bp, human
ggtggagcgaagggccgctg

SEQ ID NO: 81809 - DNA, 20 bp, human
ggaagggccgctgtggtgtc

SEQ ID NO: 81810 - DNA, 20 bp, human
gtggtgtccggatgctggga

SEQ ID NO: 81811 - DNA, 20 bp, human
gactgacgtgagcacacacg

SEQ ID NO: 81812 - DNA, 20 bp, human
gaactgaaacgacaggggaa

SEQ ID NO: 81813 - DNA, 20 bp, human
gtgagcaccgtcccagcatc

SEQ ID NO: 81814 - DNA, 20 bp, human
gtgagaaactgaaacgacag

SEQ ID NO: 81815 - DNA, 20 bp, human
ggtgagcacacacggggcag

SEQ ID NO: 81816 - DNA, 20 bp, human
gagagaaagggttcagagtc

SEQ ID NO: 81817 - DNA, 20 bp, human
gtgagagtgaggatgtggtg

SEQ ID NO: 81818 - DNA, 20 bp, human
gggcagacaggaccccaagc

SEQ ID NO: 81819 - DNA, 20 bp, human
gagggttgcggagacacagg

SEQ ID NO: 81820 - DNA, 20 bp, human
gtggaaggccagtcctgctt

SEQ ID NO: 81821 - DNA, 20 bp, human
ggggaacaaagtatcctcag

SEQ ID NO: 81822 - DNA, 20 bp, human
gggagagggtcgaggctcag

SEQ ID NO: 81823 - DNA, 20 bp, human
gaagagggttgcggagacac

SEQ ID NO: 81824 - DNA, 20 bp, human
gggatgtggtggggtagcgg

SEQ ID NO: 81825 - DNA, 20 bp, human
gtgtggtggggtagcggagg

SEQ ID NO: 81826 - DNA, 20 bp, human
gacagcggcccgcgggacgg

SEQ ID NO: 81827 - DNA, 20 bp, human
gccgctgggaggcggatcag

SEQ ID NO: 81828 - DNA, 20 bp, human
gtctgccgcagccccccgga

SEQ ID NO: 81829 - DNA, 20 bp, human
gacgcgcgcaccgaggctca

SEQ ID NO: 81830 - DNA, 20 bp, human
ggctgcggcagacccggatg

SEQ ID NO: 81831 - DNA, 20 bp, human
gagcctgcatcgccttgtgt

SEQ ID NO: 81832 - DNA, 20 bp, human
gtcacctacaagcgactcct

SEQ ID NO: 81833 - DNA, 20 bp, human
gggagttgtttactcgtcaa

SEQ ID NO: 81834 - DNA, 20 bp, human
ggagtcgcttgtaggtgagg

SEQ ID NO: 81835 - DNA, 20 bp, human
gcaccgaggctcagggggtc

SEQ ID NO: 81836 - DNA, 20 bp, human
gtgtggttcatggtgaccag

SEQ ID NO: 81837 - DNA, 20 bp, human
gagagaaggtttgcacaatg

SEQ ID NO: 81838 - DNA, 20 bp, human
gcagcggtgatcgggttacc

SEQ ID NO: 81839 - DNA, 20 bp, human
gatggtgaccagcggtgatc

SEQ ID NO: 81840 - DNA, 20 bp, human
gcaggaagtggctatgctgg

SEQ ID NO: 81841 - DNA, 20 bp, human
gcgtgcctgaccatgtggtc

SEQ ID NO: 81842 - DNA, 20 bp, human
gggtgatcgggttaccggga

SEQ ID NO: 81843 - DNA, 20 bp, human
gcatctcgtagttgggaggc

SEQ ID NO: 81844 - DNA, 20 bp, human
ggagcaggaagtggctatgc

SEQ ID NO: 81845 - DNA, 20 bp, human
gccttgagcatctcgtagtt

SEQ ID NO: 81846 - DNA, 20 bp, human
gtccctttccccagtagttt

SEQ ID NO: 81847 - DNA, 20 bp, human
ggccccagggaatgctcaga

SEQ ID NO: 81848 - DNA, 20 bp, human
ggaaggtgcgtatggcccca

SEQ ID NO: 81849 - DNA, 20 bp, human
ggcaccctctgagcattccc

SEQ ID NO: 81850 - DNA, 20 bp, human
gggtggagctccaggctcag

SEQ ID NO: 81851 - DNA, 20 bp, human
ggtgggcacacacgggacag

SEQ ID NO: 81852 - DNA, 20 bp, human
ggcgaagaccagcggcggtc

SEQ ID NO: 81853 - DNA, 20 bp, human
gtgcccagtgcaggtttagg

SEQ ID NO: 81854 - DNA, 20 bp, human
gtgtgggcaggtggagctcc

SEQ ID NO: 81855 - DNA, 20 bp, human
gccagtaacccgaccgccgc

SEQ ID NO: 81856 - DNA, 20 bp, human
ggcgctggaacccatggaca

SEQ ID NO: 81857 - DNA, 20 bp, human
gcattgggaggcacccacag

SEQ ID NO: 81858 - DNA, 20 bp, human
ggagacggcgctggaaccca

SEQ ID NO: 81859 - DNA, 20 bp, human
gtatccccgcgaggacaccc

SEQ ID NO: 81860 - DNA, 20 bp, human
gccccggccttgccttcgtg

SEQ ID NO: 81861 - DNA, 20 bp, human
ggcgctggcctactccatca

SEQ ID NO: 81862 - DNA, 20 bp, human
gggcccatccaagagcacag

SEQ ID NO: 81863 - DNA, 20 bp, human
gctcccccgcaacctcggta

SEQ ID NO: 81864 - DNA, 20 bp, human
gggggatacgccgtgtccat

SEQ ID NO: 81865 - DNA, 20 bp, human
gccgttaagaagaggccccc

SEQ ID NO: 81866 - DNA, 20 bp, human
gcactggaagcagcttgaga

SEQ ID NO: 81867 - DNA, 20 bp, human
gaaggatgtcggacaaacca

SEQ ID NO: 81868 - DNA, 20 bp, human
gagttagagctgagttatag

SEQ ID NO: 81869 - DNA, 20 bp, human
gtagagctgagttatagagg

SEQ ID NO: 81870 - DNA, 20 bp, human
ggacatccttagccaagatc

SEQ ID NO: 81871 - DNA, 20 bp, human
ggcttgagagggcagtaact

SEQ ID NO: 81872 - DNA, 20 bp, human
gcagatgacgaatatggctg

SEQ ID NO: 81873 - DNA, 20 bp, human
gcgaatatggctgaggttca

SEQ ID NO: 81874 - DNA, 20 bp, human
ggtcggacaaaccatggtgc

SEQ ID NO: 81875 - DNA, 20 bp, human
gccttagccaagatcaggat

SEQ ID NO: 81876 - DNA, 20 bp, human
ggtatctgcaatatctacga

SEQ ID NO: 81877 - DNA, 20 bp, human
gagatattgcagatacttct

SEQ ID NO: 81878 - DNA, 20 bp, human
gtttgctttactgatggtcc

SEQ ID NO: 81879 - DNA, 20 bp, human
gctgtgtgatgcaggaggag

SEQ ID NO: 81880 - DNA, 20 bp, human
gcttctgggcttgctgagat

SEQ ID NO: 81881 - DNA, 20 bp, human
gtcagagaacctagagccca

SEQ ID NO: 81882 - DNA, 20 bp, human
ggatgggtgactctgaacct

SEQ ID NO: 81883 - DNA, 20 bp, human
gatgaatgcggactccatct

SEQ ID NO: 81884 - DNA, 20 bp, human
gtgtccatcagacaggagga

SEQ ID NO: 81885 - DNA, 20 bp, human
gatcagtaaagcaaagggcg

SEQ ID NO: 81886 - DNA, 20 bp, human
ggcatctgcaatatctatga

SEQ ID NO: 81887 - DNA, 20 bp, human
gagatattgcagatgcttct

SEQ ID NO: 81888 - DNA, 20 bp, human
gctgtgtgatgcaggaggag

SEQ ID NO: 81889 - DNA, 20 bp, human
gcttctgggcttgctgagat

SEQ ID NO: 81890 - DNA, 20 bp, human
gtcagagaacctagagccca

SEQ ID NO: 81891 - DNA, 20 bp, human
ggatgggtgactctgaacct

SEQ ID NO: 81892 - DNA, 20 bp, human
gatgaatgcggactccatct

SEQ ID NO: 81893 - DNA, 20 bp, human
gtgtccatcagacaggagga

SEQ ID NO: 81894 - DNA, 20 bp, human
gatcagtaaagcaaagggcg

SEQ ID NO: 81895 - DNA, 20 bp, human
gatccaggctgtgggtctca

SEQ ID NO: 81896 - DNA, 20 bp, human
ggcatcttcgggattcccaa

SEQ ID NO: 81897 - DNA, 20 bp, human
ggaatcccgaagatgctgct

SEQ ID NO: 81898 - DNA, 20 bp, human
gaagcaaagggcaatgccat

SEQ ID NO: 81899 - DNA, 20 bp, human
ggaggggtaacactgaacct

SEQ ID NO: 81900 - DNA, 20 bp, human
gacactgaaccttgggttgt

SEQ ID NO: 81901 - DNA, 20 bp, human
gaacccacagcctgaataac

SEQ ID NO: 81902 - DNA, 20 bp, human
gcccgaagatgctgctgggc

SEQ ID NO: 81903 - DNA, 20 bp, human
ggatgctcatggcacaaatg

SEQ ID NO: 81904 - DNA, 20 bp, human
gttgccctttgctttaatga

SEQ ID NO: 81905 - DNA, 20 bp, human
gaccagcccagcagcatctt

SEQ ID NO: 81906 - DNA, 20 bp, human
gctgtgtcacacaggcttct

SEQ ID NO: 81907 - DNA, 20 bp, human
gatctcatggaaggcagaga

SEQ ID NO: 81908 - DNA, 20 bp, human
gtgctggatcatctcatgga

SEQ ID NO: 81909 - DNA, 20 bp, human
gaatcactctttatctgatg

SEQ ID NO: 81910 - DNA, 20 bp, human
gaaatacagcccttgtgcct

SEQ ID NO: 81911 - DNA, 20 bp, human
gtcccccaggaggtgtttga

SEQ ID NO: 81912 - DNA, 20 bp, human
gtatgatttcggattccccc

SEQ ID NO: 81913 - DNA, 20 bp, human
gttgccatcaaacacctcct

SEQ ID NO: 81914 - DNA, 20 bp, human
gccaacctcctgtgtcacac

SEQ ID NO: 81915 - DNA, 20 bp, human
gttcaatgtagaatttgtct

SEQ ID NO: 81916 - DNA, 20 bp, human
gtcagagaacctggagccta

SEQ ID NO: 81917 - DNA, 20 bp, human
gatgggtgagcctaaacctt

SEQ ID NO: 81918 - DNA, 20 bp, human
gctgctagactggttgaaat

SEQ ID NO: 81919 - DNA, 20 bp, human
gtgtgtgatacagggggtgg

SEQ ID NO: 81920 - DNA, 20 bp, human
gaccagtaaagcaaaggtca

SEQ ID NO: 81921 - DNA, 20 bp, human
gtggaagcctgtgtgataca

SEQ ID NO: 81922 - DNA, 20 bp, human
gaacctggagcctaaggttt

SEQ ID NO: 81923 - DNA, 20 bp, human
ggttgcagatgctgctagac

SEQ ID NO: 81924 - DNA, 20 bp, human
ggcctgtgtgatacaggggg

SEQ ID NO: 81925 - DNA, 20 bp, human
gatgaaggaggactccattc

SEQ ID NO: 81926 - DNA, 20 bp, human
ggcatctgcaacctccccaa

SEQ ID NO: 81927 - DNA, 20 bp, human
ggagaagagcccaaggttca

SEQ ID NO: 81928 - DNA, 20 bp, human
ggtcttcagagaagagccca

SEQ ID NO: 81929 - DNA, 20 bp, human
gacaaagggcaaggccattg

SEQ ID NO: 81930 - DNA, 20 bp, human
gccaacctcctgcatcatac

SEQ ID NO: 81931 - DNA, 20 bp, human
gttgagtgaccctgaacctt

SEQ ID NO: 81932 - DNA, 20 bp, human
ggggaggttgcagatgcttc

SEQ ID NO: 81933 - DNA, 20 bp, human
ggacccacagcctgagtaac

SEQ ID NO: 81934 - DNA, 20 bp, human
ggcaagtcaatctgttctct

SEQ ID NO: 81935 - DNA, 20 bp, human
gctggaagcctgtatgatgc

SEQ ID NO: 81936 - DNA, 20 bp, human
gctgttggacttgttgagat

SEQ ID NO: 81937 - DNA, 20 bp, human
gatttcttaaaagactctgg

SEQ ID NO: 81938 - DNA, 20 bp, human
gactctgaaccttcagctct

SEQ ID NO: 81939 - DNA, 20 bp, human
gttatgtgtaggtcttaaat

SEQ ID NO: 81940 - DNA, 20 bp, human
gaagacctacacataaagca

SEQ ID NO: 81941 - DNA, 20 bp, human
gctggaggcaggcaagagaa

SEQ ID NO: 81942 - DNA, 20 bp, human
gtcagagaacctagagctga

SEQ ID NO: 81943 - DNA, 20 bp, human
gtttcttgatctgttaggaa

SEQ ID NO: 81944 - DNA, 20 bp, human
gtattatttcttgatctgtt

SEQ ID NO: 81945 - DNA, 20 bp, human
gaagaccttgctttatgtgt

SEQ ID NO: 81946 - DNA, 20 bp, human
gtcactaggctacctgaggt

SEQ ID NO: 81947 - DNA, 20 bp, human
gggttcaagttacccacctc

SEQ ID NO: 81948 - DNA, 20 bp, human
gaatatcactaggctacctg

SEQ ID NO: 81949 - DNA, 20 bp, human
ggaattcagattcccagagg

SEQ ID NO: 81950 - DNA, 20 bp, human
gggattttgcaaatatcact

SEQ ID NO: 81951 - DNA, 20 bp, human
gcatgaattcagattcccag

SEQ ID NO: 81952 - DNA, 20 bp, human
gatgaatgaggacttcatcc

SEQ ID NO: 81953 - DNA, 20 bp, human
ggatatttgcaaaatcccaa

SEQ ID NO: 81954 - DNA, 20 bp, human
gtctttactgatggtcgtgc

SEQ ID NO: 81955 - DNA, 20 bp, human
ggacccacagcctgcgtaat

SEQ ID NO: 81956 - DNA, 20 bp, human
gtggagtcctcgtacatcag

SEQ ID NO: 81957 - DNA, 20 bp, human
gtatttactggtggccctag

SEQ ID NO: 81958 - DNA, 20 bp, human
gctgtgtgatgcaggaagtg

SEQ ID NO: 81959 - DNA, 20 bp, human
ggagtctcccctgatgtacg

SEQ ID NO: 81960 - DNA, 20 bp, human
gctgcatcacacaggactcc

SEQ ID NO: 81961 - DNA, 20 bp, human
ggatggatgacccttaacct

SEQ ID NO: 81962 - DNA, 20 bp, human
ggatgtagaattcatctaga

SEQ ID NO: 81963 - DNA, 20 bp, human
gaccagtaaataaaaagtca

SEQ ID NO: 81964 - DNA, 20 bp, human
gcagatatagagtgattctt

SEQ ID NO: 81965 - DNA, 20 bp, human
ggatgataaacagttccaga

SEQ ID NO: 81966 - DNA, 20 bp, human
gtaactggtgggatctgcgg

SEQ ID NO: 81967 - DNA, 20 bp, human
gatgtaactggtgggatctg

SEQ ID NO: 81968 - DNA, 20 bp, human
gtggcgcagggcgggaggta

SEQ ID NO: 81969 - DNA, 20 bp, human
gaggaggacgaccatcatct

SEQ ID NO: 81970 - DNA, 20 bp, human
ggcgcgaacatgtaactggt

SEQ ID NO: 81971 - DNA, 20 bp, human
ggccacggcgacgagcacta

SEQ ID NO: 81972 - DNA, 20 bp, human
ggcgtgcgcgaacatgtaac

SEQ ID NO: 81973 - DNA, 20 bp, human
ggcacgcagctgggctacgg

SEQ ID NO: 81974 - DNA, 20 bp, human
gggcggtgtgacttaggacg

SEQ ID NO: 81975 - DNA, 20 bp, human
gcacaggcaagcggcaagag

SEQ ID NO: 81976 - DNA, 20 bp, human
gtactcaagacgcagaggga

SEQ ID NO: 81977 - DNA, 20 bp, human
gcggcctacgaggagcgata

SEQ ID NO: 81978 - DNA, 20 bp, human
ggagcgagagggaaccggag

SEQ ID NO: 81979 - DNA, 20 bp, human
gcgccgagccccggcctacg

SEQ ID NO: 81980 - DNA, 20 bp, human
gcccgaggctagcatctctc

SEQ ID NO: 81981 - DNA, 20 bp, human
ggcgtggagggcgcaggaca

SEQ ID NO: 81982 - DNA, 20 bp, human
gctgcgctcggggaactgtt

SEQ ID NO: 81983 - DNA, 20 bp, human
gcttccgtatcgctcctcgt

SEQ ID NO: 81984 - DNA, 20 bp, human
gccgcatactcaagacgcag

SEQ ID NO: 81985 - DNA, 20 bp, human
gcggttcccggaatcccctc

SEQ ID NO: 81986 - DNA, 20 bp, human
gctctggcacaacaggtagt

SEQ ID NO: 81987 - DNA, 20 bp, human
gccagagcaaaggcttcgaa

SEQ ID NO: 81988 - DNA, 20 bp, human
gacctgttgtgccagagcaa

SEQ ID NO: 81989 - DNA, 20 bp, human
gcaacaggagagcaatttgg

SEQ ID NO: 81990 - DNA, 20 bp, human
ggcctttgctctggcacaac

SEQ ID NO: 81991 - DNA, 20 bp, human
ggcacaacaggagagcaatt

SEQ ID NO: 81992 - DNA, 20 bp, human
gtgtagtggagaagcacaac

SEQ ID NO: 81993 - DNA, 20 bp, human
gtgaatactgcctcaaggac

SEQ ID NO: 81994 - DNA, 20 bp, human
gatttggaggagacacttgt

SEQ ID NO: 81995 - DNA, 20 bp, human
gaggcttgaatactgcctca

SEQ ID NO: 81996 - DNA, 20 bp, human
ggcacctataaagaattcag

SEQ ID NO: 81997 - DNA, 20 bp, human
gatggagtaaaacttaccaa

SEQ ID NO: 81998 - DNA, 20 bp, human
gataggtgctgataagcctt

SEQ ID NO: 81999 - DNA, 20 bp, human
gctagtctgtaattgcctca

SEQ ID NO: 82000 - DNA, 20 bp, human
gtttcagtaatagtctttca

SEQ ID NO: 82001 - DNA, 20 bp, human
gtcattgtatgctttccttg

SEQ ID NO: 82002 - DNA, 20 bp, human
gcaatttacagttctaattg

SEQ ID NO: 82003 - DNA, 20 bp, human
gactctgaacaccatgaaaa

SEQ ID NO: 82004 - DNA, 20 bp, human
gagccaacacaatagggaaa

SEQ ID NO: 82005 - DNA, 20 bp, human
gttttcaggttcccttttca

SEQ ID NO: 82006 - DNA, 20 bp, human
gtcaagctgatcaggtccaa

SEQ ID NO: 82007 - DNA, 20 bp, human
gaaataccagcagccagagg

SEQ ID NO: 82008 - DNA, 20 bp, human
gcaaaagatgggcataatat

SEQ ID NO: 82009 - DNA, 20 bp, human
gcaatgtgctgcacctcctc

SEQ ID NO: 82010 - DNA, 20 bp, human
ggtttgtatagagacttaaa

SEQ ID NO: 82011 - DNA, 20 bp, human
gttcttgtatcaagctgatc

SEQ ID NO: 82012 - DNA, 20 bp, human
gtatctagattatttagtca

SEQ ID NO: 82013 - DNA, 20 bp, human
gttgctgtagcatctctgat

SEQ ID NO: 82014 - DNA, 20 bp, human
gtctcttggctgttactgcc

SEQ ID NO: 82015 - DNA, 20 bp, human
ggcatcgttttgggttctct

SEQ ID NO: 82016 - DNA, 20 bp, human
gggttggagccagcgaccgt

SEQ ID NO: 82017 - DNA, 20 bp, human
gacgtaaggccggggctgga

SEQ ID NO: 82018 - DNA, 20 bp, human
gtcccgcaggcgctcggggt

SEQ ID NO: 82019 - DNA, 20 bp, human
gagagccatgctgctaccga

SEQ ID NO: 82020 - DNA, 20 bp, human
gcggtgacggaagtgacgta

SEQ ID NO: 82021 - DNA, 20 bp, human
ggtggcggcaaccagggaag

SEQ ID NO: 82022 - DNA, 20 bp, human
gctggtcccgcaggcgctcg

SEQ ID NO: 82023 - DNA, 20 bp, human
gcggccgggtcgggacgaga

SEQ ID NO: 82024 - DNA, 20 bp, human
gcgggtcgggacgagaggga

SEQ ID NO: 82025 - DNA, 20 bp, human
gcaagagtcggaaaaacaag

SEQ ID NO: 82026 - DNA, 20 bp, human
gcggagtgctcagatcaggt

SEQ ID NO: 82027 - DNA, 20 bp, human
ggtttgggcggcgacgtgag

SEQ ID NO: 82028 - DNA, 20 bp, human
ggcgcagccgcagcatgtgg

SEQ ID NO: 82029 - DNA, 20 bp, human
gctcgccatggcggtttggg

SEQ ID NO: 82030 - DNA, 20 bp, human
gcgccctgcgctcgccatgg

SEQ ID NO: 82031 - DNA, 20 bp, human
gggcagcagcaggaagacgg

SEQ ID NO: 82032 - DNA, 20 bp, human
gagcgggcccctctagccct

SEQ ID NO: 82033 - DNA, 20 bp, human
gtctgccgggtgctcagagt

SEQ ID NO: 82034 - DNA, 20 bp, human
gcatggccccgggcgctcgg

SEQ ID NO: 82035 - DNA, 20 bp, human
gccgccgggacacccctctc

SEQ ID NO: 82036 - DNA, 20 bp, human
gaagatgttgaaggcctgta

SEQ ID NO: 82037 - DNA, 20 bp, human
gtccactcggacaatctccc

SEQ ID NO: 82038 - DNA, 20 bp, human
gatacacccaacctatgaag

SEQ ID NO: 82039 - DNA, 20 bp, human
gaggagaaagagatttcgga

SEQ ID NO: 82040 - DNA, 20 bp, human
gtgtattgcagaaactcttg

SEQ ID NO: 82041 - DNA, 20 bp, human
gtgtagggacatttcataga

SEQ ID NO: 82042 - DNA, 20 bp, human
gatgtccctcttcataggtt

SEQ ID NO: 82043 - DNA, 20 bp, human
gaagagatttcggagggaaa

SEQ ID NO: 82044 - DNA, 20 bp, human
ggcctgggagattgtccgag

SEQ ID NO: 82045 - DNA, 20 bp, human
gactgaggagatatttccac

SEQ ID NO: 82046 - DNA, 20 bp, human
gaggctagcccacagtagaa

SEQ ID NO: 82047 - DNA, 20 bp, human
gccccgggaattgggacctg

SEQ ID NO: 82048 - DNA, 20 bp, human
gaccgtggtgctggtgactt

SEQ ID NO: 82049 - DNA, 20 bp, human
gatggctgcagcttggaccg

SEQ ID NO: 82050 - DNA, 20 bp, human
gatcgcaactgcttccccag

SEQ ID NO: 82051 - DNA, 20 bp, human
gcccagtgcagaaaggatag

SEQ ID NO: 82052 - DNA, 20 bp, human
gagcccttcccagttgtggt

SEQ ID NO: 82053 - DNA, 20 bp, human
gagcccaccacaactgggaa

SEQ ID NO: 82054 - DNA, 20 bp, human
ggcctcaggtcccaattccc

SEQ ID NO: 82055 - DNA, 20 bp, human
gagcagttgcgatttagcca

SEQ ID NO: 82056 - DNA, 20 bp, human
gatggtgacgcttggagtgg

SEQ ID NO: 82057 - DNA, 20 bp, human
gagcatggtgacgcttggag

SEQ ID NO: 82058 - DNA, 20 bp, human
gagagagaaagggagctgag

SEQ ID NO: 82059 - DNA, 20 bp, human
gatgagtcagtccctacagt

SEQ ID NO: 82060 - DNA, 20 bp, human
gatctcatgctcctactgta

SEQ ID NO: 82061 - DNA, 20 bp, human
gtcctgtcgccaggctccac

SEQ ID NO: 82062 - DNA, 20 bp, human
ggggaaagcatggtgacgct

SEQ ID NO: 82063 - DNA, 20 bp, human
gtgtgacacagacatgactg

SEQ ID NO: 82064 - DNA, 20 bp, human
gtgagcacggacagagatgt

SEQ ID NO: 82065 - DNA, 20 bp, human
gagagatcaggaatgaaact

SEQ ID NO: 82066 - DNA, 20 bp, human
gagcactggcatgcagtccc

SEQ ID NO: 82067 - DNA, 20 bp, human
ggcctccacccgcactccaa

SEQ ID NO: 82068 - DNA, 20 bp, human
gacccttggagtgcgggtgg

SEQ ID NO: 82069 - DNA, 20 bp, human
gatggtgacccttggagtgc

SEQ ID NO: 82070 - DNA, 20 bp, human
ggtgacccttggagtgcggg

SEQ ID NO: 82071 - DNA, 20 bp, human
gcatgttttcctgaagaaga

SEQ ID NO: 82072 - DNA, 20 bp, human
gatggctgacaacaggatag

SEQ ID NO: 82073 - DNA, 20 bp, human
gactgctgggaggatggtag

SEQ ID NO: 82074 - DNA, 20 bp, human
ggctgacaacaggatagggg

SEQ ID NO: 82075 - DNA, 20 bp, human
gggggaggttaactgctggg

SEQ ID NO: 82076 - DNA, 20 bp, human
gcacaggacccacagccccg

SEQ ID NO: 82077 - DNA, 20 bp, human
gccgagtgtctgggccgcag

SEQ ID NO: 82078 - DNA, 20 bp, human
ggagagcaggcagcgccggg

SEQ ID NO: 82079 - DNA, 20 bp, human
ggtgggcgctgacataggag

SEQ ID NO: 82080 - DNA, 20 bp, human
ggtgatcgcagaaggccccc

SEQ ID NO: 82081 - DNA, 20 bp, human
gacctggagccgagtcctcc

SEQ ID NO: 82082 - DNA, 20 bp, human
ggagccctgccgggaggact

SEQ ID NO: 82083 - DNA, 20 bp, human
ggaattgtgggcgctgacat

SEQ ID NO: 82084 - DNA, 20 bp, human
ggtctcgtggtgggaattgt

SEQ ID NO: 82085 - DNA, 20 bp, human
gacgcaggaccccttgggac

SEQ ID NO: 82086 - DNA, 20 bp, human
gcggtgggctaggagacggg

SEQ ID NO: 82087 - DNA, 20 bp, human
gcccgcgcccttacctggag

SEQ ID NO: 82088 - DNA, 20 bp, human
gaggcctggcaggaacggga

SEQ ID NO: 82089 - DNA, 20 bp, human
gctgcaggccgctccaggta

SEQ ID NO: 82090 - DNA, 20 bp, human
gcggcaggaaggccatggcg

SEQ ID NO: 82091 - DNA, 20 bp, human
ggagctccgggtccgagggt

SEQ ID NO: 82092 - DNA, 20 bp, human
gcagagctccgtcccaccag

SEQ ID NO: 82093 - DNA, 20 bp, human
gtggcggggcccgagcgctg

SEQ ID NO: 82094 - DNA, 20 bp, human
gcccggttctgttcagtcct

SEQ ID NO: 82095 - DNA, 20 bp, human
ggtgtggacagcagggaaag

SEQ ID NO: 82096 - DNA, 20 bp, human
ggtaggaagtcaggccctat

SEQ ID NO: 82097 - DNA, 20 bp, human
gtgacttcctacataaagta

SEQ ID NO: 82098 - DNA, 20 bp, human
gaaaaatggaggctagaata

SEQ ID NO: 82099 - DNA, 20 bp, human
gtaccctccttactttatgt

SEQ ID NO: 82100 - DNA, 20 bp, human
gcttcctacataaagtaagg

SEQ ID NO: 82101 - DNA, 20 bp, human
gtcatcctcttaaggtcata

SEQ ID NO: 82102 - DNA, 20 bp, human
ggcttttaataggaaacaca

SEQ ID NO: 82103 - DNA, 20 bp, human
ggattgttgtcatcctctta

SEQ ID NO: 82104 - DNA, 20 bp, human
gttctccctatgaccttaag

SEQ ID NO: 82105 - DNA, 20 bp, human
gtgtatgcatggcttttaat

SEQ ID NO: 82106 - DNA, 20 bp, human
gtagcgcgggagctaaggcg

SEQ ID NO: 82107 - DNA, 20 bp, human
gaagcggcgggggtaagagt

SEQ ID NO: 82108 - DNA, 20 bp, human
gctctctagcgcgggagcta

SEQ ID NO: 82109 - DNA, 20 bp, human
ggcgcgaggagcagcgccca

SEQ ID NO: 82110 - DNA, 20 bp, human
ggcccggtgccgcccagagt

SEQ ID NO: 82111 - DNA, 20 bp, human
gcggcgggggtaagagtggg

SEQ ID NO: 82112 - DNA, 20 bp, human
gtcgatcacagctcttcacg

SEQ ID NO: 82113 - DNA, 20 bp, human
gagtcttccatgcttcggca

SEQ ID NO: 82114 - DNA, 20 bp, human
gagcggaacactccccaccg

SEQ ID NO: 82115 - DNA, 20 bp, human
gtggcgagtcttccatgctt

SEQ ID NO: 82116 - DNA, 20 bp, human
gcggtaagtggtgggtatct

SEQ ID NO: 82117 - DNA, 20 bp, human
gagccagaaggagtgcagtc

SEQ ID NO: 82118 - DNA, 20 bp, human
gggaattacacacatccctc

SEQ ID NO: 82119 - DNA, 20 bp, human
gctggctcctggttcattca

SEQ ID NO: 82120 - DNA, 20 bp, human
gtagttaaaggttgttccag

SEQ ID NO: 82121 - DNA, 20 bp, human
gtcaaggtctacatagttaa

SEQ ID NO: 82122 - DNA, 20 bp, human
gtcttaacccggtaagtggt

SEQ ID NO: 82123 - DNA, 20 bp, human
gtgtagaccttgaatgaacc

SEQ ID NO: 82124 - DNA, 20 bp, human
gaggaacatcaaatactggg

SEQ ID NO: 82125 - DNA, 20 bp, human
gaaccagactgcactccttc

SEQ ID NO: 82126 - DNA, 20 bp, human
gtgagacttggccagacgac

SEQ ID NO: 82127 - DNA, 20 bp, human
ggggcgcctcgcgaagatgg

SEQ ID NO: 82128 - DNA, 20 bp, human
gtgggcagcgagctcaagtt

SEQ ID NO: 82129 - DNA, 20 bp, human
gggtgcgctgcgctgagact

SEQ ID NO: 82130 - DNA, 20 bp, human
gggccctcgagaacaaccaa

SEQ ID NO: 82131 - DNA, 20 bp, human
gacgtggccaatgactgctg

SEQ ID NO: 82132 - DNA, 20 bp, human
gcggactcccaacaggcagt

SEQ ID NO: 82133 - DNA, 20 bp, human
ggggagcgcggactcccaac

SEQ ID NO: 82134 - DNA, 20 bp, human
gcgcgggacagctgtatgag

SEQ ID NO: 82135 - DNA, 20 bp, human
gagggcaacacgctccggaa

SEQ ID NO: 82136 - DNA, 20 bp, human
gggaggagcccgagccgtaa

SEQ ID NO: 82137 - DNA, 20 bp, human
gcgacagggccagaccgtga

SEQ ID NO: 82138 - DNA, 20 bp, human
gtgggtgtgagatgaatcca

SEQ ID NO: 82139 - DNA, 20 bp, human
ggtcaacacggccctcatca

SEQ ID NO: 82140 - DNA, 20 bp, human
gggagtggcgaccgttagtg

SEQ ID NO: 82141 - DNA, 20 bp, human
gtgaatccaaggcagcgaca

SEQ ID NO: 82142 - DNA, 20 bp, human
ggccaaagtggcttgtggag

SEQ ID NO: 82143 - DNA, 20 bp, human
ggagagataaagccgagcac

SEQ ID NO: 82144 - DNA, 20 bp, human
ggtggcgaccgttagtgagg

SEQ ID NO: 82145 - DNA, 20 bp, human
gagacgctgaggcgggtagg

SEQ ID NO: 82146 - DNA, 20 bp, human
ggtcggccgccctagcccta

SEQ ID NO: 82147 - DNA, 20 bp, human
gggctcctaaggacctgggt

SEQ ID NO: 82148 - DNA, 20 bp, human
ggcaacgcgcggcggctcag

SEQ ID NO: 82149 - DNA, 20 bp, human
gccgcgcgttgccgggacaa

SEQ ID NO: 82150 - DNA, 20 bp, human
ggtgagtggccttagggcta

SEQ ID NO: 82151 - DNA, 20 bp, human
ggcctggctcctaaggacct

SEQ ID NO: 82152 - DNA, 20 bp, human
ggcagaggtgagtggcctta

SEQ ID NO: 82153 - DNA, 20 bp, human
gagtggccttagggctaggg

SEQ ID NO: 82154 - DNA, 20 bp, human
gtcctggcgcgccgttgtcc

SEQ ID NO: 82155 - DNA, 20 bp, human
gctcgctgggtcggccctga

SEQ ID NO: 82156 - DNA, 20 bp, human
gtagctcggagtgtggaatc

SEQ ID NO: 82157 - DNA, 20 bp, human
gaagtgtggaagcacgtctg

SEQ ID NO: 82158 - DNA, 20 bp, human
gggcgtggtagctcggagtg

SEQ ID NO: 82159 - DNA, 20 bp, human
gacgtgagaagaaaacggcg

SEQ ID NO: 82160 - DNA, 20 bp, human
gacatactccacccaggaaa

SEQ ID NO: 82161 - DNA, 20 bp, human
gttggccgcagcagtgttga

SEQ ID NO: 82162 - DNA, 20 bp, human
gagaaaacggcgtggtagct

SEQ ID NO: 82163 - DNA, 20 bp, human
gacacacaaattagcgagta

SEQ ID NO: 82164 - DNA, 20 bp, human
gagaagcacatactccaccc

SEQ ID NO: 82165 - DNA, 20 bp, human
gccagggcccgtgctgtgat

SEQ ID NO: 82166 - DNA, 20 bp, human
ggcaagcgcggtgagatcta

SEQ ID NO: 82167 - DNA, 20 bp, human
gtagacagcgacaactcccg

SEQ ID NO: 82168 - DNA, 20 bp, human
ggtgtacaggccccatgctg

SEQ ID NO: 82169 - DNA, 20 bp, human
gatacgagcctcctgaaggg

SEQ ID NO: 82170 - DNA, 20 bp, human
gtgtcgctgcggctgcgtgg

SEQ ID NO: 82171 - DNA, 20 bp, human
gaggagaggctgggcactag

SEQ ID NO: 82172 - DNA, 20 bp, human
gtcaggaggctcgtattaga

SEQ ID NO: 82173 - DNA, 20 bp, human
gtgaagggagggacataagt

SEQ ID NO: 82174 - DNA, 20 bp, human
gcgggttgtccaggtaacca

SEQ ID NO: 82175 - DNA, 20 bp, human
ggcgtcagtgcctgtcgctg

SEQ ID NO: 82176 - DNA, 20 bp, human
gtggcaggctggctgggtac

SEQ ID NO: 82177 - DNA, 20 bp, human
gtaaacaggctctgtatccg

SEQ ID NO: 82178 - DNA, 20 bp, human
gggctctgtatccgtggcag

SEQ ID NO: 82179 - DNA, 20 bp, human
gaagctccctgagcatgagg

SEQ ID NO: 82180 - DNA, 20 bp, human
gaccgggcggggagagacgt

SEQ ID NO: 82181 - DNA, 20 bp, human
gctcctgggtcagcgacagc

SEQ ID NO: 82182 - DNA, 20 bp, human
gtaccggctgtcgctgaccc

SEQ ID NO: 82183 - DNA, 20 bp, human
gaggcccgcgtcctgaggaa

SEQ ID NO: 82184 - DNA, 20 bp, human
gcggcaggtaggctgacctc

SEQ ID NO: 82185 - DNA, 20 bp, human
gagtgacgtcataggtaaac

SEQ ID NO: 82186 - DNA, 20 bp, human
gggttcaaggaaggacgatc

SEQ ID NO: 82187 - DNA, 20 bp, human
ggcccggtacttgtgatcgg

SEQ ID NO: 82188 - DNA, 20 bp, human
gccggcccggtacttgtgat

SEQ ID NO: 82189 - DNA, 20 bp, human
gttggctgccagcttcacca

SEQ ID NO: 82190 - DNA, 20 bp, human
gcccggctcgaggcctgaca

SEQ ID NO: 82191 - DNA, 20 bp, human
ggtacggctcgcgggagtgt

SEQ ID NO: 82192 - DNA, 20 bp, human
gctggcagccaaatgcatcc

SEQ ID NO: 82193 - DNA, 20 bp, human
ggccctacccagagggttca

SEQ ID NO: 82194 - DNA, 20 bp, human
gtcccgcgagccgtacccag

SEQ ID NO: 82195 - DNA, 20 bp, human
gaggggagggctgatctcaa

SEQ ID NO: 82196 - DNA, 20 bp, human
gcccgaattggtcctcacgg

SEQ ID NO: 82197 - DNA, 20 bp, human
gcaggcggccgcggagatgg

SEQ ID NO: 82198 - DNA, 20 bp, human
gctgcgacgaggtgtcccaa

SEQ ID NO: 82199 - DNA, 20 bp, human
ggcccccgaattggtcctca

SEQ ID NO: 82200 - DNA, 20 bp, human
gatcgatcacagggtgatag

SEQ ID NO: 82201 - DNA, 20 bp, human
ggatttgctcgacttggacg

SEQ ID NO: 82202 - DNA, 20 bp, human
gatgggagcgagtgcgaccc

SEQ ID NO: 82203 - DNA, 20 bp, human
ggtttccaggaagtgacgtc

SEQ ID NO: 82204 - DNA, 20 bp, human
gcagcttggctacctccgtg

SEQ ID NO: 82205 - DNA, 20 bp, human
ggtcccaaaggaaaaactct

SEQ ID NO: 82206 - DNA, 20 bp, human
gggagggtccccgaagagag

SEQ ID NO: 82207 - DNA, 20 bp, human
gtggaaagaaccccagccta

SEQ ID NO: 82208 - DNA, 20 bp, human
gggctgaggcggggtagggt

SEQ ID NO: 82209 - DNA, 20 bp, human
gggtgggctgaggcggggta

SEQ ID NO: 82210 - DNA, 20 bp, human
gttggcgtggaatcctaaag

SEQ ID NO: 82211 - DNA, 20 bp, human
gctagcgactgacaacaggc

SEQ ID NO: 82212 - DNA, 20 bp, human
gttgcctagcgactgacaac

SEQ ID NO: 82213 - DNA, 20 bp, human
gccacgcaggaagaagatca

SEQ ID NO: 82214 - DNA, 20 bp, human
ggcaggaggtctcacgagag

SEQ ID NO: 82215 - DNA, 20 bp, human
gaagataagggtgaaagtgg

SEQ ID NO: 82216 - DNA, 20 bp, human
gtcccgcggccaggtatcca

SEQ ID NO: 82217 - DNA, 20 bp, human
gggccgcttagtaaccggag

SEQ ID NO: 82218 - DNA, 20 bp, human
ggacgccgcccagcatcccg

SEQ ID NO: 82219 - DNA, 20 bp, human
gtacctggccgcgggatgct

SEQ ID NO: 82220 - DNA, 20 bp, human
gcgcctctccggttactaag

SEQ ID NO: 82221 - DNA, 20 bp, human
gccagcggcctcgaagagtg

SEQ ID NO: 82222 - DNA, 20 bp, human
gtccaaggccgcttagtaac

SEQ ID NO: 82223 - DNA, 20 bp, human
gccggggtgaagtaaactgt

SEQ ID NO: 82224 - DNA, 20 bp, human
gagtaaccggagaggcgcgt

SEQ ID NO: 82225 - DNA, 20 bp, human
ggaacatccagggtcccccg

SEQ ID NO: 82226 - DNA, 20 bp, human
gtccctggctaggaagacgg

SEQ ID NO: 82227 - DNA, 20 bp, human
ggtcgtggctgtactggcgg

SEQ ID NO: 82228 - DNA, 20 bp, human
gtaaccggtcgtggctgtac

SEQ ID NO: 82229 - DNA, 20 bp, human
gccggtcgtggctgtactgg

SEQ ID NO: 82230 - DNA, 20 bp, human
gttcccagcaggaccaagga

SEQ ID NO: 82231 - DNA, 20 bp, human
gaacggacagagtccagcgt

SEQ ID NO: 82232 - DNA, 20 bp, human
ggtcgcctggtaaccggtcg

SEQ ID NO: 82233 - DNA, 20 bp, human
ggaggaactcctcctcgtag

SEQ ID NO: 82234 - DNA, 20 bp, human
gttaggccgcagaggtctgt

SEQ ID NO: 82235 - DNA, 20 bp, human
gaagctgctccgctacgagg

SEQ ID NO: 82236 - DNA, 20 bp, human
ggccgaggaaaactgagcgt

SEQ ID NO: 82237 - DNA, 20 bp, human
ggcggcgcacggcagttagt

SEQ ID NO: 82238 - DNA, 20 bp, human
gcgcacggcagttagtgggt

SEQ ID NO: 82239 - DNA, 20 bp, human
gctccgccggcgcggaagga

SEQ ID NO: 82240 - DNA, 20 bp, human
gccgttgccgggatacgccg

SEQ ID NO: 82241 - DNA, 20 bp, human
gaagtcccttccactgtaag

SEQ ID NO: 82242 - DNA, 20 bp, human
ggcccacgctcagttttcct

SEQ ID NO: 82243 - DNA, 20 bp, human
gtcacctgtgtgagaatggt

SEQ ID NO: 82244 - DNA, 20 bp, human
gcagagggaaggaccgcgat

SEQ ID NO: 82245 - DNA, 20 bp, human
ggagcggatcagcatctcca

SEQ ID NO: 82246 - DNA, 20 bp, human
ggtgcgagaccagtccgcag

SEQ ID NO: 82247 - DNA, 20 bp, human
gccagtccgcaggggcgact

SEQ ID NO: 82248 - DNA, 20 bp, human
gacacactctgcgtcatgga

SEQ ID NO: 82249 - DNA, 20 bp, human
gagctccgcatcggcgtcgg

SEQ ID NO: 82250 - DNA, 20 bp, human
ggcactccggaattcatcat

SEQ ID NO: 82251 - DNA, 20 bp, human
gccggagtcggaagagaccc

SEQ ID NO: 82252 - DNA, 20 bp, human
gacgcacacactctgcgtca

SEQ ID NO: 82253 - DNA, 20 bp, human
gttctcagggaaaagcagtg

SEQ ID NO: 82254 - DNA, 20 bp, human
gtgcccagcgcgaaagactc

SEQ ID NO: 82255 - DNA, 20 bp, human
gcgcatcggcgtcggcggtt

SEQ ID NO: 82256 - DNA, 20 bp, human
gagtatcgcgggaagaggaa

SEQ ID NO: 82257 - DNA, 20 bp, human
gactcctggcgggacctacg

SEQ ID NO: 82258 - DNA, 20 bp, human
ggcgattgctctcaaatacc

SEQ ID NO: 82259 - DNA, 20 bp, human
gagtcactatggtgacgggg

SEQ ID NO: 82260 - DNA, 20 bp, human
gcgcatgcgcgaactcctgg

SEQ ID NO: 82261 - DNA, 20 bp, human
gcgcaggagcgacaataaga

SEQ ID NO: 82262 - DNA, 20 bp, human
gtaactcttagaagtcacta

SEQ ID NO: 82263 - DNA, 20 bp, human
gatggtgacggggaggtacc

SEQ ID NO: 82264 - DNA, 20 bp, human
gaggagcgacaataagatgg

SEQ ID NO: 82265 - DNA, 20 bp, human
gcaccaggtccagaggtgaa

SEQ ID NO: 82266 - DNA, 20 bp, human
gagagcccgggcgcctcctg

SEQ ID NO: 82267 - DNA, 20 bp, human
gcggaagtgacgtaactcta

SEQ ID NO: 82268 - DNA, 20 bp, human
gttgccaaggagctcgactc

SEQ ID NO: 82269 - DNA, 20 bp, human
gggagcttccgaccgcgagt

SEQ ID NO: 82270 - DNA, 20 bp, human
gaggtaacctcgccaactcg

SEQ ID NO: 82271 - DNA, 20 bp, human
gctgggagcggtctagagcc

SEQ ID NO: 82272 - DNA, 20 bp, human
ggcccgattcccctatccgg

SEQ ID NO: 82273 - DNA, 20 bp, human
gggcctagcaaccgttgcca

SEQ ID NO: 82274 - DNA, 20 bp, human
ggcgacttcgcgctagaaga

SEQ ID NO: 82275 - DNA, 20 bp, human
gggagggatgaactgtcgag

SEQ ID NO: 82276 - DNA, 20 bp, human
gtggattccgcgcttggcaa

SEQ ID NO: 82277 - DNA, 20 bp, human
gaccgccccggggccgacag

SEQ ID NO: 82278 - DNA, 20 bp, human
gcccccgcgcggaggactgt

SEQ ID NO: 82279 - DNA, 20 bp, human
gggcaggccgagtccatctg

SEQ ID NO: 82280 - DNA, 20 bp, human
gccagggacgacgcagcggt

SEQ ID NO: 82281 - DNA, 20 bp, human
ggacgcccgtcccagttcag

SEQ ID NO: 82282 - DNA, 20 bp, human
gcgacagttattcgggccca

SEQ ID NO: 82283 - DNA, 20 bp, human
gctggcgcagtaatctaact

SEQ ID NO: 82284 - DNA, 20 bp, human
gtccgcgcttggcaacggct

SEQ ID NO: 82285 - DNA, 20 bp, human
gtacctcacgctgagggaag

SEQ ID NO: 82286 - DNA, 20 bp, human
gattcagcctcgcctcaccc

SEQ ID NO: 82287 - DNA, 20 bp, human
gccctggactcctcaaccta

SEQ ID NO: 82288 - DNA, 20 bp, human
gggacgagttacagctgccg

SEQ ID NO: 82289 - DNA, 20 bp, human
gccatctgggaagagaggtg

SEQ ID NO: 82290 - DNA, 20 bp, human
gtgggctgggagtggaccag

SEQ ID NO: 82291 - DNA, 20 bp, human
ggaccggatcttcaaaccgt

SEQ ID NO: 82292 - DNA, 20 bp, human
gtgccagggccggctaacag

SEQ ID NO: 82293 - DNA, 20 bp, human
gggttcctctctccccaaga

SEQ ID NO: 82294 - DNA, 20 bp, human
ggcagcccgttacaagtcgt

SEQ ID NO: 82295 - DNA, 20 bp, human
gggagctactcgcgaggtaa

SEQ ID NO: 82296 - DNA, 20 bp, human
ggctgacagatcgcccgggt

SEQ ID NO: 82297 - DNA, 20 bp, human
gcgaggctgacagatcgccc

SEQ ID NO: 82298 - DNA, 20 bp, human
gagcggcgcggacctgaggg

SEQ ID NO: 82299 - DNA, 20 bp, human
ggaccctgcggatccggacg

SEQ ID NO: 82300 - DNA, 20 bp, human
ggagctgaccgagagcccca

SEQ ID NO: 82301 - DNA, 20 bp, human
gcgccatcttgcacccaccc

SEQ ID NO: 82302 - DNA, 20 bp, human
gcggcgcgctgcacagccat

SEQ ID NO: 82303 - DNA, 20 bp, human
gcgcccgggtgggtgcaaga

SEQ ID NO: 82304 - DNA, 20 bp, human
ggggtgcaagatggcgcaag

SEQ ID NO: 82305 - DNA, 20 bp, human
ggccaggggaagggcgagca

SEQ ID NO: 82306 - DNA, 20 bp, human
gcggcggccgaagcacgggg

SEQ ID NO: 82307 - DNA, 20 bp, human
ggcgcgctctccccccgcgg

SEQ ID NO: 82308 - DNA, 20 bp, human
gcacgcactgcggacacgac

SEQ ID NO: 82309 - DNA, 20 bp, human
gccggcgcgctctccccccg

SEQ ID NO: 82310 - DNA, 20 bp, human
ggagtcccgagcaagtgcgg

SEQ ID NO: 82311 - DNA, 20 bp, human
ggcggcggcggccgaagcac

SEQ ID NO: 82312 - DNA, 20 bp, human
gtaagggcgggcgcccggag

SEQ ID NO: 82313 - DNA, 20 bp, human
gcgcagcccgatgcagacca

SEQ ID NO: 82314 - DNA, 20 bp, human
gtccagactctgcgaaccaa

SEQ ID NO: 82315 - DNA, 20 bp, human
ggcgaccatggcacgcactg

SEQ ID NO: 82316 - DNA, 20 bp, human
ggcagatagagcctgcgcaa

SEQ ID NO: 82317 - DNA, 20 bp, human
gcacttctgcagggcttccg

SEQ ID NO: 82318 - DNA, 20 bp, human
gagatttagcaaacagaaga

SEQ ID NO: 82319 - DNA, 20 bp, human
gatgagtagaaactattgca

SEQ ID NO: 82320 - DNA, 20 bp, human
gagcacttaaataattgggt

SEQ ID NO: 82321 - DNA, 20 bp, human
gaagcagcacttaaataatt

SEQ ID NO: 82322 - DNA, 20 bp, human
gggactttattccattgcgc

SEQ ID NO: 82323 - DNA, 20 bp, human
gtggaatctgaaaaatagct

SEQ ID NO: 82324 - DNA, 20 bp, human
ggaaaaatagctcggggaga

SEQ ID NO: 82325 - DNA, 20 bp, human
ggcaatttataaataactct

SEQ ID NO: 82326 - DNA, 20 bp, human
gcgcgcgagcccccagtgtg

SEQ ID NO: 82327 - DNA, 20 bp, human
gcgccgctgccacacactgg

SEQ ID NO: 82328 - DNA, 20 bp, human
gcaccaggcgaactcgagag

SEQ ID NO: 82329 - DNA, 20 bp, human
ggagggcgcggggggatccg

SEQ ID NO: 82330 - DNA, 20 bp, human
gtcgctgaaggtcacagccg

SEQ ID NO: 82331 - DNA, 20 bp, human
gcagcgagcctgcccacggc

SEQ ID NO: 82332 - DNA, 20 bp, human
gcgcgcgggaggggcgtgga

SEQ ID NO: 82333 - DNA, 20 bp, human
gaaggagctcgccgcggcgg

SEQ ID NO: 82334 - DNA, 20 bp, human
gaggacacacacaaagcggc

SEQ ID NO: 82335 - DNA, 20 bp, human
gcacacacaaagcggcgggc

SEQ ID NO: 82336 - DNA, 20 bp, human
gggcttgtttttcctcgcct

SEQ ID NO: 82337 - DNA, 20 bp, human
ggaagtccgggtcacaggcg

SEQ ID NO: 82338 - DNA, 20 bp, human
gtaggcgcgaggactcggta

SEQ ID NO: 82339 - DNA, 20 bp, human
gccggctaggcgcgaggact

SEQ ID NO: 82340 - DNA, 20 bp, human
gggagcccccacagcgaggt

SEQ ID NO: 82341 - DNA, 20 bp, human
ggaggactcggtagggaagt

SEQ ID NO: 82342 - DNA, 20 bp, human
ggtccccgacctcgctgtgg

SEQ ID NO: 82343 - DNA, 20 bp, human
ggagcgcggcggagagaaac

SEQ ID NO: 82344 - DNA, 20 bp, human
gaacaggagcccccacagcg

SEQ ID NO: 82345 - DNA, 20 bp, human
ggctgcgacggtggcaactc

SEQ ID NO: 82346 - DNA, 20 bp, human
gcagttcgcctgctctccgg

SEQ ID NO: 82347 - DNA, 20 bp, human
gccgcagttcgcctgctctc

SEQ ID NO: 82348 - DNA, 20 bp, human
gccgaggcccgggctcgcga

SEQ ID NO: 82349 - DNA, 20 bp, human
ggactataagagccgggcgt

SEQ ID NO: 82350 - DNA, 20 bp, human
gtctccggcggagctgcgtg

SEQ ID NO: 82351 - DNA, 20 bp, human
ggcccgatggaggcgctggt

SEQ ID NO: 82352 - DNA, 20 bp, human
gtccgcgctgcgtcccggag

SEQ ID NO: 82353 - DNA, 20 bp, human
gcgacggcagagggctccgt

SEQ ID NO: 82354 - DNA, 20 bp, human
gcgggcaggcgtgggccagg

SEQ ID NO: 82355 - DNA, 20 bp, human
gcgcagctccgccggagagc

SEQ ID NO: 82356 - DNA, 20 bp, human
ggtccgaaacccctccgaga

SEQ ID NO: 82357 - DNA, 20 bp, human
gggaggggtttcggaccgaa

SEQ ID NO: 82358 - DNA, 20 bp, human
gcgcagggagacggacgaca

SEQ ID NO: 82359 - DNA, 20 bp, human
gcacaccagccctctcggag

SEQ ID NO: 82360 - DNA, 20 bp, human
gagcctcctaggccaagagg

SEQ ID NO: 82361 - DNA, 20 bp, human
gcgccgcgggcacttctcct

SEQ ID NO: 82362 - DNA, 20 bp, human
gcctaggccaagaggcggag

SEQ ID NO: 82363 - DNA, 20 bp, human
gcatcgcccagtgctcgtcc

SEQ ID NO: 82364 - DNA, 20 bp, human
ggaggtcgcgggagagttcg

SEQ ID NO: 82365 - DNA, 20 bp, human
gtggcgggagaggaaccgga

SEQ ID NO: 82366 - DNA, 20 bp, human
gaggctcgccggctccttag

SEQ ID NO: 82367 - DNA, 20 bp, human
ggccttcggagcggcacggg

SEQ ID NO: 82368 - DNA, 20 bp, human
ggagcgggccgtcccaggag

SEQ ID NO: 82369 - DNA, 20 bp, human
gtctcttccccgagagcccg

SEQ ID NO: 82370 - DNA, 20 bp, human
gcggaggaggaggagagacg

SEQ ID NO: 82371 - DNA, 20 bp, human
ggactctgccctcgccctcg

SEQ ID NO: 82372 - DNA, 20 bp, human
gggccggcggcgagagttga

SEQ ID NO: 82373 - DNA, 20 bp, human
gcgccggcccgctcctggga

SEQ ID NO: 82374 - DNA, 20 bp, human
ggctcccccggcccggtacc

SEQ ID NO: 82375 - DNA, 20 bp, human
gggggagccgcgggctctcg

SEQ ID NO: 82376 - DNA, 20 bp, human
gtaagacttaggaagactgg

SEQ ID NO: 82377 - DNA, 20 bp, human
ggagggcccagctctcgtcc

SEQ ID NO: 82378 - DNA, 20 bp, human
gccgcctcctcctaagactt

SEQ ID NO: 82379 - DNA, 20 bp, human
gagtcttcctaagtcttagg

SEQ ID NO: 82380 - DNA, 20 bp, human
gggcgggattagcaagagaa

SEQ ID NO: 82381 - DNA, 20 bp, human
gcttcctaagtcttaggagg

SEQ ID NO: 82382 - DNA, 20 bp, human
gtggggcgagagcccgggtg

SEQ ID NO: 82383 - DNA, 20 bp, human
ggactgcccggacgagagct

SEQ ID NO: 82384 - DNA, 20 bp, human
gaccgcccgcccaggcccac

SEQ ID NO: 82385 - DNA, 20 bp, human
gccacctgaaagcgcctcga

SEQ ID NO: 82386 - DNA, 20 bp, human
gaggtgagcgcggctcgact

SEQ ID NO: 82387 - DNA, 20 bp, human
gcgcgccgccagggcaaagg

SEQ ID NO: 82388 - DNA, 20 bp, human
gggtcgcgccgccagggcaa

SEQ ID NO: 82389 - DNA, 20 bp, human
gcgggagcccgaggtgagcg

SEQ ID NO: 82390 - DNA, 20 bp, human
gggcggaccccggcgcggaa

SEQ ID NO: 82391 - DNA, 20 bp, human
gggactcgcggacaccacgc

SEQ ID NO: 82392 - DNA, 20 bp, human
gacgcaggcaactttccctc

SEQ ID NO: 82393 - DNA, 20 bp, human
gcacagctcggggaacgggg

SEQ ID NO: 82394 - DNA, 20 bp, human
ggcgcggaacggaggcgact

SEQ ID NO: 82395 - DNA, 20 bp, human
gcggccggagcccccacctg

SEQ ID NO: 82396 - DNA, 20 bp, human
gcgcagtggggaaatccaga

SEQ ID NO: 82397 - DNA, 20 bp, human
ggactggccacccctagagt

SEQ ID NO: 82398 - DNA, 20 bp, human
gtgggtggcggggcactcgg

SEQ ID NO: 82399 - DNA, 20 bp, human
ggccccgccacccactctag

SEQ ID NO: 82400 - DNA, 20 bp, human
gacccctagagtgggtggcg

SEQ ID NO: 82401 - DNA, 20 bp, human
ggagcccacagtcggaaatg

SEQ ID NO: 82402 - DNA, 20 bp, human
gtcaccccacagagacaatg

SEQ ID NO: 82403 - DNA, 20 bp, human
ggccgccagcgcccttaggg

SEQ ID NO: 82404 - DNA, 20 bp, human
gggggaaatccagagggcag

SEQ ID NO: 82405 - DNA, 20 bp, human
gccacaacgcgggccgtgcg

SEQ ID NO: 82406 - DNA, 20 bp, human
ggcgcggcaactgagtcccc

SEQ ID NO: 82407 - DNA, 20 bp, human
ggcggtggccagtgctctct

SEQ ID NO: 82408 - DNA, 20 bp, human
gcagagcgcgagcttctcgg

SEQ ID NO: 82409 - DNA, 20 bp, human
gagatgctcgctggatggga

SEQ ID NO: 82410 - DNA, 20 bp, human
gcagaggcagggcgcacatc

SEQ ID NO: 82411 - DNA, 20 bp, human
gtcgcgcctggagatgtcag

SEQ ID NO: 82412 - DNA, 20 bp, human
gccaaactctgggcaagtga

SEQ ID NO: 82413 - DNA, 20 bp, human
ggggcggtggcccaaactct

SEQ ID NO: 82414 - DNA, 20 bp, human
gccgagcacgaggcggacac

SEQ ID NO: 82415 - DNA, 20 bp, human
ggcagaggttgctgctcccc

SEQ ID NO: 82416 - DNA, 20 bp, human
ggcgcggggcagcccactct

SEQ ID NO: 82417 - DNA, 20 bp, human
gggcagctcggagcccgggt

SEQ ID NO: 82418 - DNA, 20 bp, human
gccagcatgctgccgagagt

SEQ ID NO: 82419 - DNA, 20 bp, human
gaggcgctggtcatgggcga

SEQ ID NO: 82420 - DNA, 20 bp, human
gtagttgggagaaacttgga

SEQ ID NO: 82421 - DNA, 20 bp, human
gagcgccgggacgccgagta

SEQ ID NO: 82422 - DNA, 20 bp, human
ggcggtctggaacaagtagt

SEQ ID NO: 82423 - DNA, 20 bp, human
gtccgggctggcgccatact

SEQ ID NO: 82424 - DNA, 20 bp, human
gcggcgggcggcgcaaccgg

SEQ ID NO: 82425 - DNA, 20 bp, human
gcaggggcagctcggagccc

SEQ ID NO: 82426 - DNA, 20 bp, human
ggcgcgaagctgtggaatcc

SEQ ID NO: 82427 - DNA, 20 bp, human
ggggatggggcgacagtaca

SEQ ID NO: 82428 - DNA, 20 bp, human
gcgcccagatgcgagcactg

SEQ ID NO: 82429 - DNA, 20 bp, human
ggcatctacaccgagcgctg

SEQ ID NO: 82430 - DNA, 20 bp, human
gagtacacggcgcgaagctg

SEQ ID NO: 82431 - DNA, 20 bp, human
gagatgcgagcactgcggct

SEQ ID NO: 82432 - DNA, 20 bp, human
ggcgcagcggcccagagcgt

SEQ ID NO: 82433 - DNA, 20 bp, human
gtgcagcggtcgcgcctcgt

SEQ ID NO: 82434 - DNA, 20 bp, human
gacggctcgcagcgcaccac

SEQ ID NO: 82435 - DNA, 20 bp, human
gtgccagccgtcgcccgacg

SEQ ID NO: 82436 - DNA, 20 bp, human
gagcggcggagggcacacgg

SEQ ID NO: 82437 - DNA, 20 bp, human
gctcctcgcagcccacgggg

SEQ ID NO: 82438 - DNA, 20 bp, human
ggggcggccacgaggcagag

SEQ ID NO: 82439 - DNA, 20 bp, human
gcccaagcccagggcgcaag

SEQ ID NO: 82440 - DNA, 20 bp, human
ggttagcaggcgtgccggag

SEQ ID NO: 82441 - DNA, 20 bp, human
gaggatgcggcgcagcgcct

SEQ ID NO: 82442 - DNA, 20 bp, human
gccctgctccgaggagaagc

SEQ ID NO: 82443 - DNA, 20 bp, human
ggcatgaccgcccgaggact

SEQ ID NO: 82444 - DNA, 20 bp, human
gcgggcgaacggggacgtag

SEQ ID NO: 82445 - DNA, 20 bp, human
gctggaggacccgacccgga

SEQ ID NO: 82446 - DNA, 20 bp, human
gtggctgcagccgagagggt

SEQ ID NO: 82447 - DNA, 20 bp, human
gcggagaagggtgaaaacgg

SEQ ID NO: 82448 - DNA, 20 bp, human
gtgagcgggtcagaattata

SEQ ID NO: 82449 - DNA, 20 bp, human
gcggaggaggggtaatgaaa

SEQ ID NO: 82450 - DNA, 20 bp, human
gcggagccccgtagtctctt

SEQ ID NO: 82451 - DNA, 20 bp, human
ggcagtggagatggcgttgg

SEQ ID NO: 82452 - DNA, 20 bp, human
gataatgagatcggatgcag

SEQ ID NO: 82453 - DNA, 20 bp, human
gtatttcggtggttgcttgg

SEQ ID NO: 82454 - DNA, 20 bp, human
gaaagagctgcaaagcagtg

SEQ ID NO: 82455 - DNA, 20 bp, human
gcagaacaggtaagaggcgt

SEQ ID NO: 82456 - DNA, 20 bp, human
ggctctggaaggagaggacg

SEQ ID NO: 82457 - DNA, 20 bp, human
ggcgctgcgactgctctgga

SEQ ID NO: 82458 - DNA, 20 bp, human
gcctgaccatgaccccccac

SEQ ID NO: 82459 - DNA, 20 bp, human
ggctacttaagacagagggg

SEQ ID NO: 82460 - DNA, 20 bp, human
ggcggctacttaagacagag

SEQ ID NO: 82461 - DNA, 20 bp, human
ggtcaagggccagggcggaa

SEQ ID NO: 82462 - DNA, 20 bp, human
gagggctgcgcggaagctga

SEQ ID NO: 82463 - DNA, 20 bp, human
gcgtgagacccgcgtcctcc

SEQ ID NO: 82464 - DNA, 20 bp, human
gtcggaagcgtcaagggcca

SEQ ID NO: 82465 - DNA, 20 bp, human
gagcaggcgcgcgggccgga

SEQ ID NO: 82466 - DNA, 20 bp, human
gctcgccgcgggcgcacata

SEQ ID NO: 82467 - DNA, 20 bp, human
gacggcaccacctacccgag

SEQ ID NO: 82468 - DNA, 20 bp, human
gcgcagcgacggccgctcca

SEQ ID NO: 82469 - DNA, 20 bp, human
gagagccgctacccggtgtg

SEQ ID NO: 82470 - DNA, 20 bp, human
gagcgacggccgctccatgg

SEQ ID NO: 82471 - DNA, 20 bp, human
gtggcagccgctcgggtagg

SEQ ID NO: 82472 - DNA, 20 bp, human
gggcgccggccggcccgaca

SEQ ID NO: 82473 - DNA, 20 bp, human
ggcgcagctggcagccgctc

SEQ ID NO: 82474 - DNA, 20 bp, human
ggctgccgcacaccgggtag

SEQ ID NO: 82475 - DNA, 20 bp, human
gcggctctcggccctctggc

SEQ ID NO: 82476 - DNA, 20 bp, human
ggcgcagcgcgcagacgctg

SEQ ID NO: 82477 - DNA, 20 bp, human
gggagcggagcgcgaagcag

SEQ ID NO: 82478 - DNA, 20 bp, human
gcgccttgtgcaggtgaccg

SEQ ID NO: 82479 - DNA, 20 bp, human
gttgcgagttcggtgagtca

SEQ ID NO: 82480 - DNA, 20 bp, human
gggcagcgccgtccaccact

SEQ ID NO: 82481 - DNA, 20 bp, human
gcgcagcgcggcaccgtctg

SEQ ID NO: 82482 - DNA, 20 bp, human
gcccgctgcctgggagccga

SEQ ID NO: 82483 - DNA, 20 bp, human
gagcagagacaagcgcggca

SEQ ID NO: 82484 - DNA, 20 bp, human
gctggggtacgagcgaccgt

SEQ ID NO: 82485 - DNA, 20 bp, human
gggtacttaagtaccaaaag

SEQ ID NO: 82486 - DNA, 20 bp, human
gcagctcagggactgaaaca

SEQ ID NO: 82487 - DNA, 20 bp, human
gctccccgaggctgcatcgt

SEQ ID NO: 82488 - DNA, 20 bp, human
gcgaggctgcatcgtaggta

SEQ ID NO: 82489 - DNA, 20 bp, human
gggagtgtttgggaagctgg

SEQ ID NO: 82490 - DNA, 20 bp, human
gggctgcatcgtaggtaagg

SEQ ID NO: 82491 - DNA, 20 bp, human
gggtgagcccaggagtgttt

SEQ ID NO: 82492 - DNA, 20 bp, human
gggaggggtacaccttccag

SEQ ID NO: 82493 - DNA, 20 bp, human
gcctcggggagccatggctc

SEQ ID NO: 82494 - DNA, 20 bp, human
gtcagtgccagtcatatctg

SEQ ID NO: 82495 - DNA, 20 bp, human
gtgatctgggcactatggat

SEQ ID NO: 82496 - DNA, 20 bp, human
gtaggcattagctcaacctg

SEQ ID NO: 82497 - DNA, 20 bp, human
ggtgcccagaatcttcggta

SEQ ID NO: 82498 - DNA, 20 bp, human
gggacagcagcagtgcaaat

SEQ ID NO: 82499 - DNA, 20 bp, human
gagggaccataggtgagaat

SEQ ID NO: 82500 - DNA, 20 bp, human
ggtacattagggataacagt

SEQ ID NO: 82501 - DNA, 20 bp, human
gccataggtgagaatgggtg

SEQ ID NO: 82502 - DNA, 20 bp, human
gttaccttaccgaagattct

SEQ ID NO: 82503 - DNA, 20 bp, human
gttagctcaacctggggcaa

SEQ ID NO: 82504 - DNA, 20 bp, human
gtcaccagatcatgatcatg

SEQ ID NO: 82505 - DNA, 20 bp, human
ggaggttcagaggtacatta

SEQ ID NO: 82506 - DNA, 20 bp, human
gggccacgatgctgcatctt

SEQ ID NO: 82507 - DNA, 20 bp, human
gtgcccaagatgcagcatcg

SEQ ID NO: 82508 - DNA, 20 bp, human
gggtgttgggaaaagagact

SEQ ID NO: 82509 - DNA, 20 bp, human
gtaggagaattgaagaagag

SEQ ID NO: 82510 - DNA, 20 bp, human
gctacaggtaaggacaggac

SEQ ID NO: 82511 - DNA, 20 bp, human
gcttggggctaagtctgtat

SEQ ID NO: 82512 - DNA, 20 bp, human
gtccagcagacaagagctaa

SEQ ID NO: 82513 - DNA, 20 bp, human
gagtgttcaaaaggaactac

SEQ ID NO: 82514 - DNA, 20 bp, human
gcattgatggtgtacatcca

SEQ ID NO: 82515 - DNA, 20 bp, human
gtcaaaaggaactacaggta

SEQ ID NO: 82516 - DNA, 20 bp, human
gtgctctgaagcctaaccca

SEQ ID NO: 82517 - DNA, 20 bp, human
gcagaaattctgggcaccat

SEQ ID NO: 82518 - DNA, 20 bp, human
ggcttcagagcagcggacga

SEQ ID NO: 82519 - DNA, 20 bp, human
gattctgggcaccatgggtt

SEQ ID NO: 82520 - DNA, 20 bp, human
ggtgcccagaatttctggta

SEQ ID NO: 82521 - DNA, 20 bp, human
gtcactaggtcttgaccacg

SEQ ID NO: 82522 - DNA, 20 bp, human
gtctccttaccagaaattct

SEQ ID NO: 82523 - DNA, 20 bp, human
gggtcagtgactttacatag

SEQ ID NO: 82524 - DNA, 20 bp, human
ggacatcatcctgtgccccg

SEQ ID NO: 82525 - DNA, 20 bp, human
gcatagcagtgattatgagg

SEQ ID NO: 82526 - DNA, 20 bp, human
gggaccctaacggtactggt

SEQ ID NO: 82527 - DNA, 20 bp, human
ggtggtctccagccagtatg

SEQ ID NO: 82528 - DNA, 20 bp, human
gtaacggtactggtagggtg

SEQ ID NO: 82529 - DNA, 20 bp, human
gcccaggaccctaacggtac

SEQ ID NO: 82530 - DNA, 20 bp, human
gaacttggcacggccagctt

SEQ ID NO: 82531 - DNA, 20 bp, human
gcaacttcagctgaggaact

SEQ ID NO: 82532 - DNA, 20 bp, human
gcacaattcggcaggcacgg

SEQ ID NO: 82533 - DNA, 20 bp, human
gaggattcaaaggtgaggtg

SEQ ID NO: 82534 - DNA, 20 bp, human
ggcctcagatggaggtgcta

SEQ ID NO: 82535 - DNA, 20 bp, human
gagattaggattcaaaggtg

SEQ ID NO: 82536 - DNA, 20 bp, human
gtacaggttgagcagcacta

SEQ ID NO: 82537 - DNA, 20 bp, human
gacttagggcccagaagtgg

SEQ ID NO: 82538 - DNA, 20 bp, human
gtcaagctgagagcctacag

SEQ ID NO: 82539 - DNA, 20 bp, human
gcggatcacactgtgagtaa

SEQ ID NO: 82540 - DNA, 20 bp, human
ggcctacagtggccaccatc

SEQ ID NO: 82541 - DNA, 20 bp, human
gggactcactacccgctctg

SEQ ID NO: 82542 - DNA, 20 bp, human
gggctgtgttctgtggattc

SEQ ID NO: 82543 - DNA, 20 bp, human
gaccttggggaccacctcgt

SEQ ID NO: 82544 - DNA, 20 bp, human
ggttctgtggattccggtac

SEQ ID NO: 82545 - DNA, 20 bp, human
ggcctgatggtggccactgt

SEQ ID NO: 82546 - DNA, 20 bp, human
gcaagcagcagctggaaacg

SEQ ID NO: 82547 - DNA, 20 bp, human
gagtccagaataaggacctc

SEQ ID NO: 82548 - DNA, 20 bp, human
ggctgaggctctggattgac

SEQ ID NO: 82549 - DNA, 20 bp, human
gggattgactggtagtggac

SEQ ID NO: 82550 - DNA, 20 bp, human
ggactggtagtggacaggca

SEQ ID NO: 82551 - DNA, 20 bp, human
gtcactagcagtccagaata

SEQ ID NO: 82552 - DNA, 20 bp, human
ggccctaccctggcccgggt

SEQ ID NO: 82553 - DNA, 20 bp, human
gcagccagggaatgttcccc

SEQ ID NO: 82554 - DNA, 20 bp, human
ggctctggattgactggtag

SEQ ID NO: 82555 - DNA, 20 bp, human
ggcagctggaaacggggaag

SEQ ID NO: 82556 - DNA, 20 bp, human
gcggcgcagaagcgggacgt

SEQ ID NO: 82557 - DNA, 20 bp, human
gctcgctgcgggtggaactg

SEQ ID NO: 82558 - DNA, 20 bp, human
gccgccgctggccggatcgg

SEQ ID NO: 82559 - DNA, 20 bp, human
gggagtgtaagcttagtggg

SEQ ID NO: 82560 - DNA, 20 bp, human
gggctcggcctcatagtctg

SEQ ID NO: 82561 - DNA, 20 bp, human
gagcgggacgtcggcttcta

SEQ ID NO: 82562 - DNA, 20 bp, human
gaccggcccggcgcagaagc

SEQ ID NO: 82563 - DNA, 20 bp, human
gtaggggcccaggccggcgg

SEQ ID NO: 82564 - DNA, 20 bp, human
gccggggcctgactgagaat

SEQ ID NO: 82565 - DNA, 20 bp, human
gcaccggtccgctgtaacac

SEQ ID NO: 82566 - DNA, 20 bp, human
gatatttttagatatacaga

SEQ ID NO: 82567 - DNA, 20 bp, human
gtatacagaaggaatctaca

SEQ ID NO: 82568 - DNA, 20 bp, human
gagttttcagcaaacttctg

SEQ ID NO: 82569 - DNA, 20 bp, human
gaagtaaatgcaagatctaa

SEQ ID NO: 82570 - DNA, 20 bp, human
gtacaaaaatcttcctctgt

SEQ ID NO: 82571 - DNA, 20 bp, human
gcacttaaacagacgttgtt

SEQ ID NO: 82572 - DNA, 20 bp, human
gcacttttgaataagcccaa

SEQ ID NO: 82573 - DNA, 20 bp, human
gaagtcatagcattctgtat

SEQ ID NO: 82574 - DNA, 20 bp, human
gaatgctatgacttctatat

SEQ ID NO: 82575 - DNA, 20 bp, human
gatttttggtgcatgccttt

SEQ ID NO: 82576 - DNA, 20 bp, human
gttttagtttgttagctgcc

SEQ ID NO: 82577 - DNA, 20 bp, human
gaactggccaaccaaagcat

SEQ ID NO: 82578 - DNA, 20 bp, human
gattaatttaagagactcaa

SEQ ID NO: 82579 - DNA, 20 bp, human
gatttaagagactcaaggga

SEQ ID NO: 82580 - DNA, 20 bp, human
gaattactgtaagtacaaca

SEQ ID NO: 82581 - DNA, 20 bp, human
ggtcctggcggtttttatta

SEQ ID NO: 82582 - DNA, 20 bp, human
gaactggagcaaaaaaagtc

SEQ ID NO: 82583 - DNA, 20 bp, human
ggtacaacatggaatgcatt

SEQ ID NO: 82584 - DNA, 20 bp, human
gtttatttccccaaagaggc

SEQ ID NO: 82585 - DNA, 20 bp, human
ggaaaatgatcccagatcaa

SEQ ID NO: 82586 - DNA, 20 bp, human
gaccagggcaccactctcta

SEQ ID NO: 82587 - DNA, 20 bp, human
ggtgtgggctccctagagag

SEQ ID NO: 82588 - DNA, 20 bp, human
ggacagctgctgccagcgag

SEQ ID NO: 82589 - DNA, 20 bp, human
gggaaggttaatccctggag

SEQ ID NO: 82590 - DNA, 20 bp, human
gtgagccaggccccaacctc

SEQ ID NO: 82591 - DNA, 20 bp, human
gtgtggcctgacttgcagtg

SEQ ID NO: 82592 - DNA, 20 bp, human
gctggcctcatcggccctca

SEQ ID NO: 82593 - DNA, 20 bp, human
gtccagcctgaggagccggt

SEQ ID NO: 82594 - DNA, 20 bp, human
gcaaggacctctgaccctga

SEQ ID NO: 82595 - DNA, 20 bp, human
gagcaggccatgggttacca

SEQ ID NO: 82596 - DNA, 20 bp, human
gctctgggagagatccccag

SEQ ID NO: 82597 - DNA, 20 bp, human
gcctagcccaggcccttcca

SEQ ID NO: 82598 - DNA, 20 bp, human
gctgaagcggtcacaatcca

SEQ ID NO: 82599 - DNA, 20 bp, human
gcattggccttcaggttcag

SEQ ID NO: 82600 - DNA, 20 bp, human
ggatcggctgcttccaactg

SEQ ID NO: 82601 - DNA, 20 bp, human
ggtccatggctgtcacccct

SEQ ID NO: 82602 - DNA, 20 bp, human
gcaactgaggctccagggtc

SEQ ID NO: 82603 - DNA, 20 bp, human
ggctgggaaagggtgaccaa

SEQ ID NO: 82604 - DNA, 20 bp, human
gcaggctccgcaggctggat

SEQ ID NO: 82605 - DNA, 20 bp, human
gtccccaggggtgacagcca

SEQ ID NO: 82606 - DNA, 20 bp, human
gggaatgcagaccccacccc

SEQ ID NO: 82607 - DNA, 20 bp, human
gcagatgaagacccctaaca

SEQ ID NO: 82608 - DNA, 20 bp, human
gccggagccgggtctagggg

SEQ ID NO: 82609 - DNA, 20 bp, human
gtgggtaatcgggggatcag

SEQ ID NO: 82610 - DNA, 20 bp, human
ggctgctgcagacccgggga

SEQ ID NO: 82611 - DNA, 20 bp, human
gggatctccgaactgagttg

SEQ ID NO: 82612 - DNA, 20 bp, human
ggcggtacctcggctgatga

SEQ ID NO: 82613 - DNA, 20 bp, human
ggtcttgggtgggtaatcgg

SEQ ID NO: 82614 - DNA, 20 bp, human
gcgaggtaccgcagcgccgg

SEQ ID NO: 82615 - DNA, 20 bp, human
gagacctccgcccctagacc

SEQ ID NO: 82616 - DNA, 20 bp, human
gggcagtttgctgcatctgg

SEQ ID NO: 82617 - DNA, 20 bp, human
ggcatgagaagagctgtcta

SEQ ID NO: 82618 - DNA, 20 bp, human
gactggagaatctccaacat

SEQ ID NO: 82619 - DNA, 20 bp, human
gtgaaggcccgctccgatgt

SEQ ID NO: 82620 - DNA, 20 bp, human
gtgcggcgctgcctaagggt

SEQ ID NO: 82621 - DNA, 20 bp, human
gagccctcaaagctatgcag

SEQ ID NO: 82622 - DNA, 20 bp, human
gaagcactttccccaccctt

SEQ ID NO: 82623 - DNA, 20 bp, human
gagaatctccaacatcggag

SEQ ID NO: 82624 - DNA, 20 bp, human
gagggaagggtaaaacggct

SEQ ID NO: 82625 - DNA, 20 bp, human
gccgggcagtttgctgcatc

SEQ ID NO: 82626 - DNA, 20 bp, human
gtaggaagcatagggttaag

SEQ ID NO: 82627 - DNA, 20 bp, human
gtataatactaggaagcata

SEQ ID NO: 82628 - DNA, 20 bp, human
gtgacagatgcagggaaggt

SEQ ID NO: 82629 - DNA, 20 bp, human
ggaagcatagggttaagggg

SEQ ID NO: 82630 - DNA, 20 bp, human
gtgtagtgaagccagaactc

SEQ ID NO: 82631 - DNA, 20 bp, human
gcaggaggtgtcatagcagt

SEQ ID NO: 82632 - DNA, 20 bp, human
gggaagtcttccaacaaaga

SEQ ID NO: 82633 - DNA, 20 bp, human
gaaagtctgagtacttgctt

SEQ ID NO: 82634 - DNA, 20 bp, human
gtctggtctggagagatgtt

SEQ ID NO: 82635 - DNA, 20 bp, human
gggagcctcaaaagaagaac

SEQ ID NO: 82636 - DNA, 20 bp, human
gctgtgaccagaggcgttcc

SEQ ID NO: 82637 - DNA, 20 bp, human
ggggagtccaactttctcag

SEQ ID NO: 82638 - DNA, 20 bp, human
gcagggctgggtggcacggc

SEQ ID NO: 82639 - DNA, 20 bp, human
ggaccctcggcaaagcaagg

SEQ ID NO: 82640 - DNA, 20 bp, human
gtggccccaccgggaagaaa

SEQ ID NO: 82641 - DNA, 20 bp, human
gggcgagcccggaacgcctc

SEQ ID NO: 82642 - DNA, 20 bp, human
gcgaccgggagccgggtagg

SEQ ID NO: 82643 - DNA, 20 bp, human
gagctctgcgcggggaacag

SEQ ID NO: 82644 - DNA, 20 bp, human
gctgcacttggctcgtctgt

SEQ ID NO: 82645 - DNA, 20 bp, human
gagcagcaaaggcgccagag

SEQ ID NO: 82646 - DNA, 20 bp, human
gccgcggcccagagtccgat

SEQ ID NO: 82647 - DNA, 20 bp, human
ggagcagcaggcagacgcag

SEQ ID NO: 82648 - DNA, 20 bp, human
ggcgattcggctccaaactc

SEQ ID NO: 82649 - DNA, 20 bp, human
gcgaggcagagagcgcgatt

SEQ ID NO: 82650 - DNA, 20 bp, human
gctgcgcgcggtgcccaccg

SEQ ID NO: 82651 - DNA, 20 bp, human
gtgggcaccgcgcgcagcta

SEQ ID NO: 82652 - DNA, 20 bp, human
gctgcagccgatcggactct

SEQ ID NO: 82653 - DNA, 20 bp, human
gcgcgccaggtccaggatcg

SEQ ID NO: 82654 - DNA, 20 bp, human
gctcgccgcgatcctggacc

SEQ ID NO: 82655 - DNA, 20 bp, human
ggctagggagccgagaaccg

SEQ ID NO: 82656 - DNA, 20 bp, human
ggagtagtctcagaacccaa

SEQ ID NO: 82657 - DNA, 20 bp, human
gacgggccaccctacagtcc

SEQ ID NO: 82658 - DNA, 20 bp, human
gcagctagtgcctggactgt

SEQ ID NO: 82659 - DNA, 20 bp, human
ggagcccagaggggactata

SEQ ID NO: 82660 - DNA, 20 bp, human
gctgttggggcaaaggaaga

SEQ ID NO: 82661 - DNA, 20 bp, human
gacactggtagcctcactgt

SEQ ID NO: 82662 - DNA, 20 bp, human
ggcccaggcagagatatatt

SEQ ID NO: 82663 - DNA, 20 bp, human
gagcctcactgttggggcaa

SEQ ID NO: 82664 - DNA, 20 bp, human
gcagtccagtggcgtcccag

SEQ ID NO: 82665 - DNA, 20 bp, human
ggcagagatatattaggggg

SEQ ID NO: 82666 - DNA, 20 bp, human
gtctcccggcggggattgta

SEQ ID NO: 82667 - DNA, 20 bp, human
gatccccgccgggagatgga

SEQ ID NO: 82668 - DNA, 20 bp, human
gacaggtgcgttggagacag

SEQ ID NO: 82669 - DNA, 20 bp, human
gtggggaagtggccagggta

SEQ ID NO: 82670 - DNA, 20 bp, human
gaggctgggacagggttcct

SEQ ID NO: 82671 - DNA, 20 bp, human
gtcaccacgggccagggaca

SEQ ID NO: 82672 - DNA, 20 bp, human
ggagacagcggcttcaccac

SEQ ID NO: 82673 - DNA, 20 bp, human
gggggtgacttggactcgta

SEQ ID NO: 82674 - DNA, 20 bp, human
gcagggtcaaagctctgagt

SEQ ID NO: 82675 - DNA, 20 bp, human
ggcatgggcctcaaactgac

SEQ ID NO: 82676 - DNA, 20 bp, human
gcggcccccgccccaaccgt

SEQ ID NO: 82677 - DNA, 20 bp, human
gatccaggcgcacgcctcag

SEQ ID NO: 82678 - DNA, 20 bp, human
ggcttcctcttctcccgcaa

SEQ ID NO: 82679 - DNA, 20 bp, human
gggaagcggcgcgtcccctg

SEQ ID NO: 82680 - DNA, 20 bp, human
ggcgcagagctcccacggtt

SEQ ID NO: 82681 - DNA, 20 bp, human
ggccagggcaaatcgggaag

SEQ ID NO: 82682 - DNA, 20 bp, human
gaggggcggggactcgggag

SEQ ID NO: 82683 - DNA, 20 bp, human
gccctccgccagggcaaatc

SEQ ID NO: 82684 - DNA, 20 bp, human
gctgcaaggtaaaacaatag

SEQ ID NO: 82685 - DNA, 20 bp, human
gaaatcgggaaggggctccg

SEQ ID NO: 82686 - DNA, 20 bp, human
ggtcctcttccaccagctgg

SEQ ID NO: 82687 - DNA, 20 bp, human
ggaggacaagagccacgaag

SEQ ID NO: 82688 - DNA, 20 bp, human
gggatctgtcagcctccagc

SEQ ID NO: 82689 - DNA, 20 bp, human
gctttggagggcttcagcaa

SEQ ID NO: 82690 - DNA, 20 bp, human
gtccaagtccttcggagtca

SEQ ID NO: 82691 - DNA, 20 bp, human
ggacaggtaaaccctttgga

SEQ ID NO: 82692 - DNA, 20 bp, human
gcagcatcaggactctctag

SEQ ID NO: 82693 - DNA, 20 bp, human
gcagccaggcagcatgtttt

SEQ ID NO: 82694 - DNA, 20 bp, human
gtgggaacgcagaggcctca

SEQ ID NO: 82695 - DNA, 20 bp, human
gcaggcagcatgttttgggc

SEQ ID NO: 82696 - DNA, 20 bp, human
ggggatggctattggagtca

SEQ ID NO: 82697 - DNA, 20 bp, human
gcccggcatacacagaaatg

SEQ ID NO: 82698 - DNA, 20 bp, human
gttggagacaatctgaccaa

SEQ ID NO: 82699 - DNA, 20 bp, human
gaaaggaaacttatcctctt

SEQ ID NO: 82700 - DNA, 20 bp, human
gtgtatgccggggcgggttg

SEQ ID NO: 82701 - DNA, 20 bp, human
ggttgatttaaataaaatga

SEQ ID NO: 82702 - DNA, 20 bp, human
gaaaatattcttaaaatcgt

SEQ ID NO: 82703 - DNA, 20 bp, human
gaatgagattggtttgcaga

SEQ ID NO: 82704 - DNA, 20 bp, human
ggatttaaataaaatgaagg

SEQ ID NO: 82705 - DNA, 20 bp, human
ggtgtatttgaaaggaaagt

SEQ ID NO: 82706 - DNA, 20 bp, human
ggcgtagagaggacccacta

SEQ ID NO: 82707 - DNA, 20 bp, human
gcagggactggggcgtagag

SEQ ID NO: 82708 - DNA, 20 bp, human
ggctccccagctctaagcca

SEQ ID NO: 82709 - DNA, 20 bp, human
gaagcggggcagcgaggcgt

SEQ ID NO: 82710 - DNA, 20 bp, human
gcagctctaagccagggact

SEQ ID NO: 82711 - DNA, 20 bp, human
gcctggggcagcaccttagt

SEQ ID NO: 82712 - DNA, 20 bp, human
gtgtccgccgagccagtctt

SEQ ID NO: 82713 - DNA, 20 bp, human
gatgtgtggcctgccccggg

SEQ ID NO: 82714 - DNA, 20 bp, human
ggggcgcatgcccaggttga

SEQ ID NO: 82715 - DNA, 20 bp, human
gttgggtgcccgccctacga

SEQ ID NO: 82716 - DNA, 20 bp, human
gctcgccgctacacaatagg

SEQ ID NO: 82717 - DNA, 20 bp, human
gcggcgagagtggagccgag

SEQ ID NO: 82718 - DNA, 20 bp, human
gtattgtgtagcggcgagag

SEQ ID NO: 82719 - DNA, 20 bp, human
gaacgggcgcgccacagagg

SEQ ID NO: 82720 - DNA, 20 bp, human
gattatcgggaggagaggat

SEQ ID NO: 82721 - DNA, 20 bp, human
gccgaacgggcgcgccacag

SEQ ID NO: 82722 - DNA, 20 bp, human
ggggggtggggagaccagaa

SEQ ID NO: 82723 - DNA, 20 bp, human
gactggaggtatagaagtgg

SEQ ID NO: 82724 - DNA, 20 bp, human
gtccgccccctattgtgtag

SEQ ID NO: 82725 - DNA, 20 bp, human
gcgtactggaggtatagaag

SEQ ID NO: 82726 - DNA, 20 bp, human
gggagcccaagcctcacccg

SEQ ID NO: 82727 - DNA, 20 bp, human
gagccgagcggagcctagga

SEQ ID NO: 82728 - DNA, 20 bp, human
gccagagctgcgggaaactc

SEQ ID NO: 82729 - DNA, 20 bp, human
gaaggagccgggaaaccgag

SEQ ID NO: 82730 - DNA, 20 bp, human
gtccccggcgcgccttcccg

SEQ ID NO: 82731 - DNA, 20 bp, human
gccgcccgggcgagtagtgc

SEQ ID NO: 82732 - DNA, 20 bp, human
gtgaggcttgggctccgacg

SEQ ID NO: 82733 - DNA, 20 bp, human
gagcactttgcgataggatg

SEQ ID NO: 82734 - DNA, 20 bp, human
gcggggagctggggaaccgg

SEQ ID NO: 82735 - DNA, 20 bp, human
gaagtgtgatcggcacccga

SEQ ID NO: 82736 - DNA, 20 bp, human
gggtctcctggtgggctgat

SEQ ID NO: 82737 - DNA, 20 bp, human
gcgggagctgctgccgtctg

SEQ ID NO: 82738 - DNA, 20 bp, human
gcccggcggtcaggcggctc

SEQ ID NO: 82739 - DNA, 20 bp, human
ggcgggcgaggtctcctggt

SEQ ID NO: 82740 - DNA, 20 bp, human
gccccggcccggcggtcagg

SEQ ID NO: 82741 - DNA, 20 bp, human
ggcccggggccgagtgagag

SEQ ID NO: 82742 - DNA, 20 bp, human
gaccaggcagaagtgcagtc

SEQ ID NO: 82743 - DNA, 20 bp, human
ggcccgagccgcctgaccgc

SEQ ID NO: 82744 - DNA, 20 bp, human
ggcgtccgggtggctccggg

SEQ ID NO: 82745 - DNA, 20 bp, human
gggccccgcggttagcaccc

SEQ ID NO: 82746 - DNA, 20 bp, human
gctgttggagactcgattgt

SEQ ID NO: 82747 - DNA, 20 bp, human
gctgcgaacgcaaagcagtg

SEQ ID NO: 82748 - DNA, 20 bp, human
gatgccggagcgagatagta

SEQ ID NO: 82749 - DNA, 20 bp, human
gagccacagggtcctaagtg

SEQ ID NO: 82750 - DNA, 20 bp, human
ggtcgctgcggtgttgctgt

SEQ ID NO: 82751 - DNA, 20 bp, human
ggagccttactatctcgctc

SEQ ID NO: 82752 - DNA, 20 bp, human
gcaacccaggattaagtatg

SEQ ID NO: 82753 - DNA, 20 bp, human
gggcctcacttaggaccctg

SEQ ID NO: 82754 - DNA, 20 bp, human
gaggaaactacaagaagctg

SEQ ID NO: 82755 - DNA, 20 bp, human
ggaggaccctaatcctgcgc

SEQ ID NO: 82756 - DNA, 20 bp, human
gcagctctgagccctaccag

SEQ ID NO: 82757 - DNA, 20 bp, human
gtagggctcagagctggcaa

SEQ ID NO: 82758 - DNA, 20 bp, human
gtccacaaccaagacacctc

SEQ ID NO: 82759 - DNA, 20 bp, human
gaccaagacacctcgggaca

SEQ ID NO: 82760 - DNA, 20 bp, human
ggtcctgctttcccctggta

SEQ ID NO: 82761 - DNA, 20 bp, human
ggctcagagctggcaacggt

SEQ ID NO: 82762 - DNA, 20 bp, human
gacaagaacccagaaccagg

SEQ ID NO: 82763 - DNA, 20 bp, human
gtccttgtcccgaggtgtct

SEQ ID NO: 82764 - DNA, 20 bp, human
gtcccgaggtgtcttggttg

SEQ ID NO: 82765 - DNA, 20 bp, human
gagatgatgaggtgagatgt

SEQ ID NO: 82766 - DNA, 20 bp, human
gccgcgccccctcacagact

SEQ ID NO: 82767 - DNA, 20 bp, human
gcgacgggacccgaggagga

SEQ ID NO: 82768 - DNA, 20 bp, human
gccctaggacgacaagccca

SEQ ID NO: 82769 - DNA, 20 bp, human
gagacatgtctggagaccct

SEQ ID NO: 82770 - DNA, 20 bp, human
gcgcccgaaagggaaaaaca

SEQ ID NO: 82771 - DNA, 20 bp, human
gcaccagggggagcaggacg

SEQ ID NO: 82772 - DNA, 20 bp, human
gggcatgctaccagcacggg

SEQ ID NO: 82773 - DNA, 20 bp, human
gtcctttggggtcaagacag

SEQ ID NO: 82774 - DNA, 20 bp, human
ggcacagaaggcccaggtct

SEQ ID NO: 82775 - DNA, 20 bp, human
ggttcccacgaacgccaagg

SEQ ID NO: 82776 - DNA, 20 bp, human
ggactgtgggagctgactct

SEQ ID NO: 82777 - DNA, 20 bp, human
gtaaggctctaggaaagagg

SEQ ID NO: 82778 - DNA, 20 bp, human
gcctgaggacccccaaacag

SEQ ID NO: 82779 - DNA, 20 bp, human
gactaggcctccaaggatgg

SEQ ID NO: 82780 - DNA, 20 bp, human
gttgccacctgctccatcgg

SEQ ID NO: 82781 - DNA, 20 bp, human
gcacagtccgcacccagagt

SEQ ID NO: 82782 - DNA, 20 bp, human
gcaggtaagcgatccatcca

SEQ ID NO: 82783 - DNA, 20 bp, human
gcaagaggctgggttaagtc

SEQ ID NO: 82784 - DNA, 20 bp, human
gctcaatgggtgcgtcaact

SEQ ID NO: 82785 - DNA, 20 bp, human
ggggttaagtccggctggag

SEQ ID NO: 82786 - DNA, 20 bp, human
gcttctgcccgaggtggcag

SEQ ID NO: 82787 - DNA, 20 bp, human
ggcaagctgcgacttcccag

SEQ ID NO: 82788 - DNA, 20 bp, human
gctcggcgatgctcagaagt

SEQ ID NO: 82789 - DNA, 20 bp, human
gaatgcgggaatcttaacgc

SEQ ID NO: 82790 - DNA, 20 bp, human
ggccacctcgggcagaaggc

SEQ ID NO: 82791 - DNA, 20 bp, human
gctcgctagggcaagggcgt

SEQ ID NO: 82792 - DNA, 20 bp, human
gccgggccgcacccacgagg

SEQ ID NO: 82793 - DNA, 20 bp, human
gcccctggtggagtcagctg

SEQ ID NO: 82794 - DNA, 20 bp, human
gacaggtgagtccccctcgt

SEQ ID NO: 82795 - DNA, 20 bp, human
gggctggggcggccaaaccc

SEQ ID NO: 82796 - DNA, 20 bp, human
ggtgtcccaccgccacaagg

SEQ ID NO: 82797 - DNA, 20 bp, human
gaagaccccgggaaaggtga

SEQ ID NO: 82798 - DNA, 20 bp, human
gggccagggagaaagacccc

SEQ ID NO: 82799 - DNA, 20 bp, human
gcatggaggtgagccaccac

SEQ ID NO: 82800 - DNA, 20 bp, human
gggcgctgggtgctgatcgc

SEQ ID NO: 82801 - DNA, 20 bp, human
gaagggcccctaggacccac

SEQ ID NO: 82802 - DNA, 20 bp, human
gggaatgaggggccagacaa

SEQ ID NO: 82803 - DNA, 20 bp, human
ggccaaccacaagccctccc

SEQ ID NO: 82804 - DNA, 20 bp, human
ggcttgtggttggcccgtgg

SEQ ID NO: 82805 - DNA, 20 bp, human
gtgagccctgaaagctctgg

SEQ ID NO: 82806 - DNA, 20 bp, human
gccggaagcgtggtagggaa

SEQ ID NO: 82807 - DNA, 20 bp, human
ggaagggcgaccgcgaaact

SEQ ID NO: 82808 - DNA, 20 bp, human
gcggaagccggaagcgtggt

SEQ ID NO: 82809 - DNA, 20 bp, human
gcggactgtgaacgctggta

SEQ ID NO: 82810 - DNA, 20 bp, human
gccgtcagacgtgagaaggg

SEQ ID NO: 82811 - DNA, 20 bp, human
gagaagcgcggagcaggaac

SEQ ID NO: 82812 - DNA, 20 bp, human
gagcggcggactgtgaacgc

SEQ ID NO: 82813 - DNA, 20 bp, human
gagctgccaaactatatgtg

SEQ ID NO: 82814 - DNA, 20 bp, human
ggatagagcgcagtcaagtt

SEQ ID NO: 82815 - DNA, 20 bp, human
ggtagggtcagaccccgcag

SEQ ID NO: 82816 - DNA, 20 bp, human
gtgcgccgcgcggggaccca

SEQ ID NO: 82817 - DNA, 20 bp, human
gtgcaggaccaggccgacat

SEQ ID NO: 82818 - DNA, 20 bp, human
gaaagctgggaagagctccg

SEQ ID NO: 82819 - DNA, 20 bp, human
gaagggcgcagagcgggaca

SEQ ID NO: 82820 - DNA, 20 bp, human
ggcgcggcgcatcccagcct

SEQ ID NO: 82821 - DNA, 20 bp, human
ggctgctccggtacagggag

SEQ ID NO: 82822 - DNA, 20 bp, human
gcactgtcctcagaaaagag

SEQ ID NO: 82823 - DNA, 20 bp, human
gtgactgcggcaagccccct

SEQ ID NO: 82824 - DNA, 20 bp, human
gaccggagcagcgatccggg

SEQ ID NO: 82825 - DNA, 20 bp, human
gggagctagaactcctctcc

SEQ ID NO: 82826 - DNA, 20 bp, human
gccctgcagagttcaagggg

SEQ ID NO: 82827 - DNA, 20 bp, human
gggaaaagcactttacaggt

SEQ ID NO: 82828 - DNA, 20 bp, human
gtgcagagttcaaggggagg

SEQ ID NO: 82829 - DNA, 20 bp, human
ggtcagggagaagcgaaaga

SEQ ID NO: 82830 - DNA, 20 bp, human
gccaaatccagcaaacagat

SEQ ID NO: 82831 - DNA, 20 bp, human
gggaaggaaaagcactttac

SEQ ID NO: 82832 - DNA, 20 bp, human
gcgggctgaagataaacgga

SEQ ID NO: 82833 - DNA, 20 bp, human
gatgtcgggctgaagataaa

SEQ ID NO: 82834 - DNA, 20 bp, human
gttctaacccctcaaagagg

SEQ ID NO: 82835 - DNA, 20 bp, human
gttcttctaacccctcaaag

SEQ ID NO: 82836 - DNA, 20 bp, human
gtgctcctcgctgaagatgg

SEQ ID NO: 82837 - DNA, 20 bp, human
gcagttggtggtggaaacta

SEQ ID NO: 82838 - DNA, 20 bp, human
ggcagtggatctgtagctaa

SEQ ID NO: 82839 - DNA, 20 bp, human
gaggaggggacgataaatta

SEQ ID NO: 82840 - DNA, 20 bp, human
ggtttgtgcactgcagttgg

SEQ ID NO: 82841 - DNA, 20 bp, human
gcagtgcacaaacacacgtt

SEQ ID NO: 82842 - DNA, 20 bp, human
ggcgaggagcagggttagcc

SEQ ID NO: 82843 - DNA, 20 bp, human
gtaaaggacgctcagggaat

SEQ ID NO: 82844 - DNA, 20 bp, human
gagggtaatgatttttgtaa

SEQ ID NO: 82845 - DNA, 20 bp, human
gacttcctccatcttcagcg

SEQ ID NO: 82846 - DNA, 20 bp, human
gagctgccgctgtggctact

SEQ ID NO: 82847 - DNA, 20 bp, human
gagaggccgagtagccacag

SEQ ID NO: 82848 - DNA, 20 bp, human
ggcgcgctgagtccaggcga

SEQ ID NO: 82849 - DNA, 20 bp, human
ggcccggcccggcagcgaca

SEQ ID NO: 82850 - DNA, 20 bp, human
gccagctgcgcgctgagtcc

SEQ ID NO: 82851 - DNA, 20 bp, human
gcgggctggagctgccgctg

SEQ ID NO: 82852 - DNA, 20 bp, human
ggtctaccctacatctgcag

SEQ ID NO: 82853 - DNA, 20 bp, human
gcaccttccatgtcgctgcc

SEQ ID NO: 82854 - DNA, 20 bp, human
gcagaggaagagcacttaag

SEQ ID NO: 82855 - DNA, 20 bp, human
gaagagttgtcagacatggg

SEQ ID NO: 82856 - DNA, 20 bp, human
gcccgggcgctcagaggcgg

SEQ ID NO: 82857 - DNA, 20 bp, human
ggcgaggtagcagggactcg

SEQ ID NO: 82858 - DNA, 20 bp, human
gaaaggcgggagacagatca

SEQ ID NO: 82859 - DNA, 20 bp, human
ggcgcgcgcggagacacctc

SEQ ID NO: 82860 - DNA, 20 bp, human
gtggggggggatatttgggg

SEQ ID NO: 82861 - DNA, 20 bp, human
gtctcaggtgaagctgctga

SEQ ID NO: 82862 - DNA, 20 bp, human
gtgaaggaggggggagacgt

SEQ ID NO: 82863 - DNA, 20 bp, human
gcgcgcgcgcaggctgtgag

SEQ ID NO: 82864 - DNA, 20 bp, human
gcggagggttggaagatggc

SEQ ID NO: 82865 - DNA, 20 bp, human
gggactcgggggtcctaaaa

SEQ ID NO: 82866 - DNA, 20 bp, human
gccttgccggtgagaccctg

SEQ ID NO: 82867 - DNA, 20 bp, human
gtggaaacggcgagggagtg

SEQ ID NO: 82868 - DNA, 20 bp, human
ggcggccgccgccttggaaa

SEQ ID NO: 82869 - DNA, 20 bp, human
gaacggcgagggagtgcggg

SEQ ID NO: 82870 - DNA, 20 bp, human
gagaccctggggtgcgaacg

SEQ ID NO: 82871 - DNA, 20 bp, human
gcggccgcgttcgcacccca

SEQ ID NO: 82872 - DNA, 20 bp, human
gtccctcgccgtttccaagg

SEQ ID NO: 82873 - DNA, 20 bp, human
gggggtagtggagaaaatca

SEQ ID NO: 82874 - DNA, 20 bp, human
ggccgccttggaaacggcga

SEQ ID NO: 82875 - DNA, 20 bp, human
ggaaatgccgagacaggcct

SEQ ID NO: 82876 - DNA, 20 bp, human
gactgtgacggtgacgaaga

SEQ ID NO: 82877 - DNA, 20 bp, human
gacggtgacgaagacggcgg

SEQ ID NO: 82878 - DNA, 20 bp, human
gatggcggcggcgactgtga

SEQ ID NO: 82879 - DNA, 20 bp, human
ggcggcgacggcatttaaca

SEQ ID NO: 82880 - DNA, 20 bp, human
gggacggagactcagttcag

SEQ ID NO: 82881 - DNA, 20 bp, human
ggcgacggcatttaacaagg

SEQ ID NO: 82882 - DNA, 20 bp, human
gccgtgaagacgcaaacctc

SEQ ID NO: 82883 - DNA, 20 bp, human
ggcggcgacgcggcaggaca

SEQ ID NO: 82884 - DNA, 20 bp, human
ggcgggccggctgatccgga

SEQ ID NO: 82885 - DNA, 20 bp, human
gatggccgcgagaaccccga

SEQ ID NO: 82886 - DNA, 20 bp, human
ggtgaaggtctacacatcag

SEQ ID NO: 82887 - DNA, 20 bp, human
ggaatcctagatcaagccat

SEQ ID NO: 82888 - DNA, 20 bp, human
gcaccccagtcaggaggacc

SEQ ID NO: 82889 - DNA, 20 bp, human
gggagatctcgaagcatgtt

SEQ ID NO: 82890 - DNA, 20 bp, human
ggcttaactcaccaaaccca

SEQ ID NO: 82891 - DNA, 20 bp, human
gagaacgcatttactttata

SEQ ID NO: 82892 - DNA, 20 bp, human
gctagatcaagccatgggtt

SEQ ID NO: 82893 - DNA, 20 bp, human
gcttttgcaagtctgtcttg

SEQ ID NO: 82894 - DNA, 20 bp, human
ggctggccctcaccccagtc

SEQ ID NO: 82895 - DNA, 20 bp, human
gccaggagaatgtctagttc

SEQ ID NO: 82896 - DNA, 20 bp, human
ggggctcagtcccttcgggg

SEQ ID NO: 82897 - DNA, 20 bp, human
ggagcaagagatctgactcc

SEQ ID NO: 82898 - DNA, 20 bp, human
gctgctgcaactagcttaag

SEQ ID NO: 82899 - DNA, 20 bp, human
gctagcttaagaggacagct

SEQ ID NO: 82900 - DNA, 20 bp, human
ggcagccagagggtttacaa

SEQ ID NO: 82901 - DNA, 20 bp, human
gcaccagaagcctccccgaa

SEQ ID NO: 82902 - DNA, 20 bp, human
ggcaacccaggtaaccctaa

SEQ ID NO: 82903 - DNA, 20 bp, human
ggcagagctagctgtaaatg

SEQ ID NO: 82904 - DNA, 20 bp, human
gaaagggctcagtcccttcg

SEQ ID NO: 82905 - DNA, 20 bp, human
gccctaagggcaggagccaa

SEQ ID NO: 82906 - DNA, 20 bp, human
gcgaggcacggcagcatcct

SEQ ID NO: 82907 - DNA, 20 bp, human
gcgccgccagcagcactacg

SEQ ID NO: 82908 - DNA, 20 bp, human
gccagcagcactacgaggca

SEQ ID NO: 82909 - DNA, 20 bp, human
gcgcgcctccagctaccctt

SEQ ID NO: 82910 - DNA, 20 bp, human
gtgggcgcgccgcatcgtcc

SEQ ID NO: 82911 - DNA, 20 bp, human
gccagagtaagggagcaccc

SEQ ID NO: 82912 - DNA, 20 bp, human
ggccagccagggctctccac

SEQ ID NO: 82913 - DNA, 20 bp, human
gtagctggaggcgcgcaggc

SEQ ID NO: 82914 - DNA, 20 bp, human
gagcgtctgagccaagacgg

SEQ ID NO: 82915 - DNA, 20 bp, human
gcggctcatctagaagtggg

SEQ ID NO: 82916 - DNA, 20 bp, human
ggccgcggacaagctctccc

SEQ ID NO: 82917 - DNA, 20 bp, human
ggcccgggagagcttgtccg

SEQ ID NO: 82918 - DNA, 20 bp, human
ggtcagatgacagccacggt

SEQ ID NO: 82919 - DNA, 20 bp, human
gcaaggctccacgccatgga

SEQ ID NO: 82920 - DNA, 20 bp, human
gctcccaaggctccacgcca

SEQ ID NO: 82921 - DNA, 20 bp, human
gaaactcagggggagactcc

SEQ ID NO: 82922 - DNA, 20 bp, human
gacgccatggacggacgctg

SEQ ID NO: 82923 - DNA, 20 bp, human
ggtgtgcttggaggaagccg

SEQ ID NO: 82924 - DNA, 20 bp, human
gtctgggccctaaactcagg

SEQ ID NO: 82925 - DNA, 20 bp, human
gacagccacggtgggatctt

SEQ ID NO: 82926 - DNA, 20 bp, human
gagacgcggagaccgagcag

SEQ ID NO: 82927 - DNA, 20 bp, human
gcccgagagggagcgagacg

SEQ ID NO: 82928 - DNA, 20 bp, human
ggccagacagggccccgaga

SEQ ID NO: 82929 - DNA, 20 bp, human
ggctcccccggcagcggaca

SEQ ID NO: 82930 - DNA, 20 bp, human
gcacagacaggagcggatgg

SEQ ID NO: 82931 - DNA, 20 bp, human
gggagccccgagggtcagct

SEQ ID NO: 82932 - DNA, 20 bp, human
gctcctgcggcgcctctgat

SEQ ID NO: 82933 - DNA, 20 bp, human
ggagcagcttcggagacagg

SEQ ID NO: 82934 - DNA, 20 bp, human
ggcggcccagctgaccctcg

SEQ ID NO: 82935 - DNA, 20 bp, human
gctggggcctgggtcgatgg

SEQ ID NO: 82936 - DNA, 20 bp, human
gagctggatcctgatcccag

SEQ ID NO: 82937 - DNA, 20 bp, human
gtcctgatcccagtggtcag

SEQ ID NO: 82938 - DNA, 20 bp, human
gctgccagcgtgagagtggg

SEQ ID NO: 82939 - DNA, 20 bp, human
gcaccaggcctcaccttccg

SEQ ID NO: 82940 - DNA, 20 bp, human
gtgtctgccagcgtgagagt

SEQ ID NO: 82941 - DNA, 20 bp, human
gagggactgtgaccacatga

SEQ ID NO: 82942 - DNA, 20 bp, human
gcagccacccactctcacgc

SEQ ID NO: 82943 - DNA, 20 bp, human
gccaaagtcttgtcaggagt

SEQ ID NO: 82944 - DNA, 20 bp, human
gcagtagcagagcaaaagtg

SEQ ID NO: 82945 - DNA, 20 bp, human
gtagacgccaaagtcttgtc

SEQ ID NO: 82946 - DNA, 20 bp, human
gtggtgagaggaagtcctag

SEQ ID NO: 82947 - DNA, 20 bp, human
gtgagtggagtaggagacgg

SEQ ID NO: 82948 - DNA, 20 bp, human
ggaggaagtcctagaggcta

SEQ ID NO: 82949 - DNA, 20 bp, human
gtgctgggatcaccgaggta

SEQ ID NO: 82950 - DNA, 20 bp, human
gggatcaccgaggtagggtg

SEQ ID NO: 82951 - DNA, 20 bp, human
gtctgctgctgggatcaccg

SEQ ID NO: 82952 - DNA, 20 bp, human
gaactgagtggagtaggaga

SEQ ID NO: 82953 - DNA, 20 bp, human
gtcccagaactgagtggagt

SEQ ID NO: 82954 - DNA, 20 bp, human
gaagtggatggagaacgaag

SEQ ID NO: 82955 - DNA, 20 bp, human
gcagagtgtccatagcctct

SEQ ID NO: 82956 - DNA, 20 bp, human
ggcggctgcttgggaagagt

SEQ ID NO: 82957 - DNA, 20 bp, human
gagtctgcctaaggagagac

SEQ ID NO: 82958 - DNA, 20 bp, human
ggcagccgtctcctgcaaag

SEQ ID NO: 82959 - DNA, 20 bp, human
ggccacaggtctgcatccag

SEQ ID NO: 82960 - DNA, 20 bp, human
gctgtggccgcggcaggtga

SEQ ID NO: 82961 - DNA, 20 bp, human
gggctcgctcgggtgcggag

SEQ ID NO: 82962 - DNA, 20 bp, human
gggccgcagccgttccggga

SEQ ID NO: 82963 - DNA, 20 bp, human
gtctcaccgtgtgctaaata

SEQ ID NO: 82964 - DNA, 20 bp, human
gttttgggccgagctggagg

SEQ ID NO: 82965 - DNA, 20 bp, human
gcaaagaggaataagaatag

SEQ ID NO: 82966 - DNA, 20 bp, human
ggaagtgcttaccttgctct

SEQ ID NO: 82967 - DNA, 20 bp, human
gtgtatagagctaaagtgag

SEQ ID NO: 82968 - DNA, 20 bp, human
gtgcttaccttgctctgggc

SEQ ID NO: 82969 - DNA, 20 bp, human
gactttaaggaatgcacgaa

SEQ ID NO: 82970 - DNA, 20 bp, human
ggtgaaaacttagtactcta

SEQ ID NO: 82971 - DNA, 20 bp, human
ggttaatgcccatcagttaa

SEQ ID NO: 82972 - DNA, 20 bp, human
gggattcctggaagcatccc

SEQ ID NO: 82973 - DNA, 20 bp, human
gctatacagttattattagg

SEQ ID NO: 82974 - DNA, 20 bp, human
gtaaaatggacactgtacat

SEQ ID NO: 82975 - DNA, 20 bp, human
gacatctgtttcagggccat

SEQ ID NO: 82976 - DNA, 20 bp, human
gtagagccccacagccccag

SEQ ID NO: 82977 - DNA, 20 bp, human
gtggcagagaggctcccctg

SEQ ID NO: 82978 - DNA, 20 bp, human
gggtggctgaacctcgcagg

SEQ ID NO: 82979 - DNA, 20 bp, human
gttccggagtggggacgggg

SEQ ID NO: 82980 - DNA, 20 bp, human
ggtgtcacagcccatcccta

SEQ ID NO: 82981 - DNA, 20 bp, human
gggaccacccaggtcaccag

SEQ ID NO: 82982 - DNA, 20 bp, human
gagccaccccgtccccactc

SEQ ID NO: 82983 - DNA, 20 bp, human
gaagaggagccgccatgcca

SEQ ID NO: 82984 - DNA, 20 bp, human
gtgtgttccggagtggggac

SEQ ID NO: 82985 - DNA, 20 bp, human
ggccgccatgccagggtcag

SEQ ID NO: 82986 - DNA, 20 bp, human
ggtggtgggctcaaacggaa

SEQ ID NO: 82987 - DNA, 20 bp, human
ggcggagagcgcgacacgtg

SEQ ID NO: 82988 - DNA, 20 bp, human
gaccaaggctggaccctcag

SEQ ID NO: 82989 - DNA, 20 bp, human
gcgagcgccggcagagagcg

SEQ ID NO: 82990 - DNA, 20 bp, human
gggccggggcacagagtggt

SEQ ID NO: 82991 - DNA, 20 bp, human
gtctgggccggggcacagag

SEQ ID NO: 82992 - DNA, 20 bp, human
gcccggcccagagagtacct

SEQ ID NO: 82993 - DNA, 20 bp, human
gtgggctcaaacggaaggga

SEQ ID NO: 82994 - DNA, 20 bp, human
gggcccagagagtaccttgg

SEQ ID NO: 82995 - DNA, 20 bp, human
gacagagtggtgggctcaaa

SEQ ID NO: 82996 - DNA, 20 bp, human
gggagagcaggtagtccctg

SEQ ID NO: 82997 - DNA, 20 bp, human
gcatgaggcccagtgccaac

SEQ ID NO: 82998 - DNA, 20 bp, human
gccctgagggctgtagaggg

SEQ ID NO: 82999 - DNA, 20 bp, human
ggattgaggagcggatgcat

SEQ ID NO: 83000 - DNA, 20 bp, human
gggaatggctgagtaggagc

SEQ ID NO: 83001 - DNA, 20 bp, human
gcctagctatgagggctcca

SEQ ID NO: 83002 - DNA, 20 bp, human
gatggacctatggaggtgtc

SEQ ID NO: 83003 - DNA, 20 bp, human
gcaagtgagagcaatgaccg

SEQ ID NO: 83004 - DNA, 20 bp, human
gctcctcaatcctctcctgt

SEQ ID NO: 83005 - DNA, 20 bp, human
gaggagcggatgcataggct

SEQ ID NO: 83006 - DNA, 20 bp, human
gaagccctgccgggagcggt

SEQ ID NO: 83007 - DNA, 20 bp, human
ggggctcaacctcctcacaa

SEQ ID NO: 83008 - DNA, 20 bp, human
gccatcgaggacaggacgga

SEQ ID NO: 83009 - DNA, 20 bp, human
ggggtcacacggccaagtag

SEQ ID NO: 83010 - DNA, 20 bp, human
gagccccatcgaggacagga

SEQ ID NO: 83011 - DNA, 20 bp, human
gggtggccatgggggataag

SEQ ID NO: 83012 - DNA, 20 bp, human
gaggaggttgagccccatcg

SEQ ID NO: 83013 - DNA, 20 bp, human
gccgggagttgcacagacca

SEQ ID NO: 83014 - DNA, 20 bp, human
gtggccgtgtgacccctcta

SEQ ID NO: 83015 - DNA, 20 bp, human
gcaacgccccttatccccca

SEQ ID NO: 83016 - DNA, 20 bp, human
gtggcggcagcgaagtaaga

SEQ ID NO: 83017 - DNA, 20 bp, human
ggagggctgcgacttgtagt

SEQ ID NO: 83018 - DNA, 20 bp, human
gagaggctgcatggagtggc

SEQ ID NO: 83019 - DNA, 20 bp, human
gggccgggctccgaggcgag

SEQ ID NO: 83020 - DNA, 20 bp, human
ggcctggacgccagcctcct

SEQ ID NO: 83021 - DNA, 20 bp, human
gcacggccctctgacgccgt

SEQ ID NO: 83022 - DNA, 20 bp, human
gctggcgtccaggcgtgcgg

SEQ ID NO: 83023 - DNA, 20 bp, human
ggagggtcgcactcacccgt

SEQ ID NO: 83024 - DNA, 20 bp, human
gcgagcgcggggcctcgcga

SEQ ID NO: 83025 - DNA, 20 bp, human
gcattccgggcgctgaccca

SEQ ID NO: 83026 - DNA, 20 bp, human
gtggtcagaagtgtgcctgt

SEQ ID NO: 83027 - DNA, 20 bp, human
gtcagaagtgtgcctgtcgg

SEQ ID NO: 83028 - DNA, 20 bp, human
gagtgtgcctgtcggcgggg

SEQ ID NO: 83029 - DNA, 20 bp, human
gcacacttctgaccaggtta

SEQ ID NO: 83030 - DNA, 20 bp, human
gtcctcacctccccgccgac

SEQ ID NO: 83031 - DNA, 20 bp, human
gcttcagacaccgagataaa

SEQ ID NO: 83032 - DNA, 20 bp, human
gtcatagagaggcaatatca

SEQ ID NO: 83033 - DNA, 20 bp, human
gctgtgtccacctcagacca

SEQ ID NO: 83034 - DNA, 20 bp, human
gatttgaagtcgccataacc

SEQ ID NO: 83035 - DNA, 20 bp, human
gaacactctcgtgagtctaa

SEQ ID NO: 83036 - DNA, 20 bp, human
gtaactttggtaagcctcaa

SEQ ID NO: 83037 - DNA, 20 bp, human
gggctactttatagaatctt

SEQ ID NO: 83038 - DNA, 20 bp, human
gtacagatggatcaggtagg

SEQ ID NO: 83039 - DNA, 20 bp, human
gagattcgaagagaagtgta

SEQ ID NO: 83040 - DNA, 20 bp, human
gtattacagatggatcaggt

SEQ ID NO: 83041 - DNA, 20 bp, human
gttctataaagtagccattg

SEQ ID NO: 83042 - DNA, 20 bp, human
ggcaagagtgacctttctaa

SEQ ID NO: 83043 - DNA, 20 bp, human
gaagagaagtgtatggaatt

SEQ ID NO: 83044 - DNA, 20 bp, human
gacaatattacagatggatc

SEQ ID NO: 83045 - DNA, 20 bp, human
gtggaaaatggatcagaggc

SEQ ID NO: 83046 - DNA, 20 bp, human
gcacccagttccctcccggg

SEQ ID NO: 83047 - DNA, 20 bp, human
gcaccgcagccgggagggtg

SEQ ID NO: 83048 - DNA, 20 bp, human
ggtagggagtcgcacgccag

SEQ ID NO: 83049 - DNA, 20 bp, human
ggcgtccctcaccctcccag

SEQ ID NO: 83050 - DNA, 20 bp, human
gtgcagccaggactcgatgg

SEQ ID NO: 83051 - DNA, 20 bp, human
ggtaagagcgcagcgcagta

SEQ ID NO: 83052 - DNA, 20 bp, human
gggggggcgccggacttcga

SEQ ID NO: 83053 - DNA, 20 bp, human
gagtcagctgggattccccc

SEQ ID NO: 83054 - DNA, 20 bp, human
ggccagtaggatagaccgga

SEQ ID NO: 83055 - DNA, 20 bp, human
gaagtccggcgccccccggg

SEQ ID NO: 83056 - DNA, 20 bp, human
gggacaccgctggactcccc

SEQ ID NO: 83057 - DNA, 20 bp, human
ggcccgggtcacccacgtaa

SEQ ID NO: 83058 - DNA, 20 bp, human
gggagtccagcggtgtcctg

SEQ ID NO: 83059 - DNA, 20 bp, human
ggcccgccgcggggccatgg

SEQ ID NO: 83060 - DNA, 20 bp, human
gggtctccgaggccgaggtc

SEQ ID NO: 83061 - DNA, 20 bp, human
gggtcacccacgtaagggag

SEQ ID NO: 83062 - DNA, 20 bp, human
gcgcacggcccggggagatg

SEQ ID NO: 83063 - DNA, 20 bp, human
ggccgcccgctcccttacgt

SEQ ID NO: 83064 - DNA, 20 bp, human
gtagcagcgccgggagaccg

SEQ ID NO: 83065 - DNA, 20 bp, human
gcctgggcagcgctcgcccg

SEQ ID NO: 83066 - DNA, 20 bp, human
gcctctagggactcatgaag

SEQ ID NO: 83067 - DNA, 20 bp, human
gcagctggcagacacatcgg

SEQ ID NO: 83068 - DNA, 20 bp, human
ggacgggtggccactggaca

SEQ ID NO: 83069 - DNA, 20 bp, human
ggtggccacccgtcagccaa

SEQ ID NO: 83070 - DNA, 20 bp, human
ggttcaggcctgcaaagcct

SEQ ID NO: 83071 - DNA, 20 bp, human
gtgatcgaggcaagacctgt

SEQ ID NO: 83072 - DNA, 20 bp, human
gaagcagctgggaatgatcg

SEQ ID NO: 83073 - DNA, 20 bp, human
gctggcccttggctgacggg

SEQ ID NO: 83074 - DNA, 20 bp, human
ggtgcagctggcagacacat

SEQ ID NO: 83075 - DNA, 20 bp, human
gtgggccaaggaaatctcaa

SEQ ID NO: 83076 - DNA, 20 bp, human
gaggcttgatccaaaaaggg

SEQ ID NO: 83077 - DNA, 20 bp, human
gtgccggccagcccagcaga

SEQ ID NO: 83078 - DNA, 20 bp, human
gccctatgcacagtcccccg

SEQ ID NO: 83079 - DNA, 20 bp, human
gtcaggcagctgctctgtcc

SEQ ID NO: 83080 - DNA, 20 bp, human
gccaggtggccgttaccgga

SEQ ID NO: 83081 - DNA, 20 bp, human
gcattgccaaggatgagacg

SEQ ID NO: 83082 - DNA, 20 bp, human
gcaggctgtccgggaataag

SEQ ID NO: 83083 - DNA, 20 bp, human
gacgctcagttctcagacgg

SEQ ID NO: 83084 - DNA, 20 bp, human
gggtggccgttaccggaggg

SEQ ID NO: 83085 - DNA, 20 bp, human
gggcctctctgacctgaatg

SEQ ID NO: 83086 - DNA, 20 bp, human
gactcctgggaagacctcat

SEQ ID NO: 83087 - DNA, 20 bp, human
gcctgggaagacctcattgg

SEQ ID NO: 83088 - DNA, 20 bp, human
gtacgagataatggaaacaa

SEQ ID NO: 83089 - DNA, 20 bp, human
ggcaggactcaccaccaatg

SEQ ID NO: 83090 - DNA, 20 bp, human
gccaggaatactgtatatgt

SEQ ID NO: 83091 - DNA, 20 bp, human
gagaaacaacgatgactcct

SEQ ID NO: 83092 - DNA, 20 bp, human
gtcatccatccccagttgat

SEQ ID NO: 83093 - DNA, 20 bp, human
gaaacgctgggttctgacta

SEQ ID NO: 83094 - DNA, 20 bp, human
ggttctgactatggagatcc

SEQ ID NO: 83095 - DNA, 20 bp, human
gacggtccagaaatactatc

SEQ ID NO: 83096 - DNA, 20 bp, human
gtgtcccatctggagagtga

SEQ ID NO: 83097 - DNA, 20 bp, human
ggttgctgccattctctcgg

SEQ ID NO: 83098 - DNA, 20 bp, human
gattctctcggcggcatctg

SEQ ID NO: 83099 - DNA, 20 bp, human
gcggcatctggggttccagg

SEQ ID NO: 83100 - DNA, 20 bp, human
gcagattctaaaccaaacag

SEQ ID NO: 83101 - DNA, 20 bp, human
ggcagcttggcggaatggac

SEQ ID NO: 83102 - DNA, 20 bp, human
gcggcggcatctggggttcc

SEQ ID NO: 83103 - DNA, 20 bp, human
ggagaatggcagcaacagga

SEQ ID NO: 83104 - DNA, 20 bp, human
gggctgaccttgcagcttgg

SEQ ID NO: 83105 - DNA, 20 bp, human
gcagtgcaggctcctgaacg

SEQ ID NO: 83106 - DNA, 20 bp, human
gcacctggcggcaatcccac

SEQ ID NO: 83107 - DNA, 20 bp, human
gatccgagcggcatgtggag

SEQ ID NO: 83108 - DNA, 20 bp, human
ggagaggctcaccgtcatgg

SEQ ID NO: 83109 - DNA, 20 bp, human
gcctgagggaggggtcatgg

SEQ ID NO: 83110 - DNA, 20 bp, human
ggtggagaggctcaccgtca

SEQ ID NO: 83111 - DNA, 20 bp, human
ggtggcctcaggtataagag

SEQ ID NO: 83112 - DNA, 20 bp, human
gcaagcagcatccatccgag

SEQ ID NO: 83113 - DNA, 20 bp, human
gaggctcaccgtcatggtgg

SEQ ID NO: 83114 - DNA, 20 bp, human
gggattgccgccaggtgtgc

SEQ ID NO: 83115 - DNA, 20 bp, human
ggtgaggtgccccctgccct

SEQ ID NO: 83116 - DNA, 20 bp, human
ggaccggccggaggagctac

SEQ ID NO: 83117 - DNA, 20 bp, human
ggctactggagcagctgtac

SEQ ID NO: 83118 - DNA, 20 bp, human
ggagccgggggccgcacggg

SEQ ID NO: 83119 - DNA, 20 bp, human
gcgcccgcggcccagctcgg

SEQ ID NO: 83120 - DNA, 20 bp, human
gagcccgcggcgcagcaacc

SEQ ID NO: 83121 - DNA, 20 bp, human
gagctgcagcgtgtggtgga

SEQ ID NO: 83122 - DNA, 20 bp, human
gcccgagccgggggccgcac

SEQ ID NO: 83123 - DNA, 20 bp, human
gcgcggcgcagcaacccggc

SEQ ID NO: 83124 - DNA, 20 bp, human
gcagctgtacgggcgcctgg

SEQ ID NO: 83125 - DNA, 20 bp, human
gagaggccggcccggaggat

SEQ ID NO: 83126 - DNA, 20 bp, human
gaacactacatccaaggagt

SEQ ID NO: 83127 - DNA, 20 bp, human
gcttggacagcttgttagtg

SEQ ID NO: 83128 - DNA, 20 bp, human
gaccggcatgaggcctatat

SEQ ID NO: 83129 - DNA, 20 bp, human
gagacttaacactacatcca

SEQ ID NO: 83130 - DNA, 20 bp, human
gcatctcagcctaaggaact

SEQ ID NO: 83131 - DNA, 20 bp, human
gtttaacaggagtcccatat

SEQ ID NO: 83132 - DNA, 20 bp, human
gtcccatataggcctcatgc

SEQ ID NO: 83133 - DNA, 20 bp, human
gaatgtggttttcagaccac

SEQ ID NO: 83134 - DNA, 20 bp, human
gatgagtgaaacagatcact

SEQ ID NO: 83135 - DNA, 20 bp, human
gaaaagtgtcgattctggcc

SEQ ID NO: 83136 - DNA, 20 bp, human
gactctcattgatagaacac

SEQ ID NO: 83137 - DNA, 20 bp, human
ggaaattaggtcgagcctgg

SEQ ID NO: 83138 - DNA, 20 bp, human
gcactgtcatgttgcgctgg

SEQ ID NO: 83139 - DNA, 20 bp, human
gacagaaattaggtcgagcc

SEQ ID NO: 83140 - DNA, 20 bp, human
gtgacagtgaagaccctgca

SEQ ID NO: 83141 - DNA, 20 bp, human
gcttcactgtcatgttgcgc

SEQ ID NO: 83142 - DNA, 20 bp, human
gtaaggaattaggtttgatt

SEQ ID NO: 83143 - DNA, 20 bp, human
gataactagaaaagttataa

SEQ ID NO: 83144 - DNA, 20 bp, human
ggctgctactcaccatggct

SEQ ID NO: 83145 - DNA, 20 bp, human
gaattttgactcctgtctgg

SEQ ID NO: 83146 - DNA, 20 bp, human
gtccgcggtggagttcgagt

SEQ ID NO: 83147 - DNA, 20 bp, human
ggccgactcgaactccaccg

SEQ ID NO: 83148 - DNA, 20 bp, human
gccgcgccgcgggcttagag

SEQ ID NO: 83149 - DNA, 20 bp, human
gaagccggaagcgagcaaag

SEQ ID NO: 83150 - DNA, 20 bp, human
ggcagcgaacgaacgttctg

SEQ ID NO: 83151 - DNA, 20 bp, human
ggccttgggcacagatatcg

SEQ ID NO: 83152 - DNA, 20 bp, human
gctcggagcggtgggagttg

SEQ ID NO: 83153 - DNA, 20 bp, human
gagccggtgagactcgacgt

SEQ ID NO: 83154 - DNA, 20 bp, human
gtccccacgtcgagtctcac

SEQ ID NO: 83155 - DNA, 20 bp, human
gggcccgccgtcgtgactgg

SEQ ID NO: 83156 - DNA, 20 bp, human
gctcgagggccgggagatga

SEQ ID NO: 83157 - DNA, 20 bp, human
gggcagtaccgaacccacca

SEQ ID NO: 83158 - DNA, 20 bp, human
gtggcctggatcccgcgcag

SEQ ID NO: 83159 - DNA, 20 bp, human
gtcccgaacggtaaaacgaa

SEQ ID NO: 83160 - DNA, 20 bp, human
ggtcaggttgcttgagtcag

SEQ ID NO: 83161 - DNA, 20 bp, human
gtaccttaagagaccctggt

SEQ ID NO: 83162 - DNA, 20 bp, human
gacggcgctcctgcacagcg

SEQ ID NO: 83163 - DNA, 20 bp, human
ggggcatgcctgcaccctca

SEQ ID NO: 83164 - DNA, 20 bp, human
gcgacatggcctgcaattag

SEQ ID NO: 83165 - DNA, 20 bp, human
gaacccaccagggtctctta

SEQ ID NO: 83166 - DNA, 20 bp, human
gccaaggacagcaagaacca

SEQ ID NO: 83167 - DNA, 20 bp, human
gcggagccccagaaaaaggt

SEQ ID NO: 83168 - DNA, 20 bp, human
gtgctgcccccccccaaggg

SEQ ID NO: 83169 - DNA, 20 bp, human
gcccagaaaaaggtaggtgg

SEQ ID NO: 83170 - DNA, 20 bp, human
gggagacgaggaaaggctca

SEQ ID NO: 83171 - DNA, 20 bp, human
gctccagagaaaggaccact

SEQ ID NO: 83172 - DNA, 20 bp, human
ggtttgtgcactctctgtcc

SEQ ID NO: 83173 - DNA, 20 bp, human
gcggtgagtctggaaccctg

SEQ ID NO: 83174 - DNA, 20 bp, human
ggagaacagtgcctagatgg

SEQ ID NO: 83175 - DNA, 20 bp, human
gctgccctgtctggtctgtc

SEQ ID NO: 83176 - DNA, 20 bp, human
gccgctggccagccccgagt

SEQ ID NO: 83177 - DNA, 20 bp, human
ggcggccggggcgcagagaa

SEQ ID NO: 83178 - DNA, 20 bp, human
ggccctggccgagatgaaag

SEQ ID NO: 83179 - DNA, 20 bp, human
gcggccggggtcccattcag

SEQ ID NO: 83180 - DNA, 20 bp, human
gggtcccgggccaagaacaa

SEQ ID NO: 83181 - DNA, 20 bp, human
ggcgttgaccgtaaagaaga

SEQ ID NO: 83182 - DNA, 20 bp, human
gtggctggagggtaaggcga

SEQ ID NO: 83183 - DNA, 20 bp, human
gcgggccaagaacaaagggt

SEQ ID NO: 83184 - DNA, 20 bp, human
gcgcagccctgggacgaagg

SEQ ID NO: 83185 - DNA, 20 bp, human
ggaccccgcgaagagcagac

SEQ ID NO: 83186 - DNA, 20 bp, human
gtgcatggcctgaaggtggg

SEQ ID NO: 83187 - DNA, 20 bp, human
gccagtctggagctccccat

SEQ ID NO: 83188 - DNA, 20 bp, human
gggactgcggaggtagcaca

SEQ ID NO: 83189 - DNA, 20 bp, human
ggataagagccagaaggtat

SEQ ID NO: 83190 - DNA, 20 bp, human
gattaggagagactcccata

SEQ ID NO: 83191 - DNA, 20 bp, human
ggtccaggccctcagcacaa

SEQ ID NO: 83192 - DNA, 20 bp, human
ggacagcgggtgttccagtg

SEQ ID NO: 83193 - DNA, 20 bp, human
gccctcagcacaaaggacct

SEQ ID NO: 83194 - DNA, 20 bp, human
gggcctgaaggtgggtggca

SEQ ID NO: 83195 - DNA, 20 bp, human
gcccctttgagactaggtag

SEQ ID NO: 83196 - DNA, 20 bp, human
ggcctggagccgctgccaca

SEQ ID NO: 83197 - DNA, 20 bp, human
gtcacaggtgggtccgaggt

SEQ ID NO: 83198 - DNA, 20 bp, human
ggtgcagtgagagctcccac

SEQ ID NO: 83199 - DNA, 20 bp, human
gagtgtaggggcctaggagg

SEQ ID NO: 83200 - DNA, 20 bp, human
ggacccacctgtgacctcca

SEQ ID NO: 83201 - DNA, 20 bp, human
gtggtaagcgtggatgtgag

SEQ ID NO: 83202 - DNA, 20 bp, human
ggaggctgtgttagaatcta

SEQ ID NO: 83203 - DNA, 20 bp, human
gaagtttgcaggatgccctg

SEQ ID NO: 83204 - DNA, 20 bp, human
gcacagtgtaggggcctagg

SEQ ID NO: 83205 - DNA, 20 bp, human
gaggcagggtgagcccacct

SEQ ID NO: 83206 - DNA, 20 bp, human
gaattccttgctgactgtcc

SEQ ID NO: 83207 - DNA, 20 bp, human
ggccagagttggcagccagg

SEQ ID NO: 83208 - DNA, 20 bp, human
gagtcagccatggcaattag

SEQ ID NO: 83209 - DNA, 20 bp, human
gtgggagagtatcactttag

SEQ ID NO: 83210 - DNA, 20 bp, human
ggttgcgagaggaagcgatc

SEQ ID NO: 83211 - DNA, 20 bp, human
gcgagaggaagcgatctgga

SEQ ID NO: 83212 - DNA, 20 bp, human
ggtgatgtgcttagtgtaaa

SEQ ID NO: 83213 - DNA, 20 bp, human
gacagcttcgggaagaggaa

SEQ ID NO: 83214 - DNA, 20 bp, human
gccaactctggctgctaaag

SEQ ID NO: 83215 - DNA, 20 bp, human
gaagctagaaagcaattgag

SEQ ID NO: 83216 - DNA, 20 bp, human
ggagtcttggagctcctaga

SEQ ID NO: 83217 - DNA, 20 bp, human
ggtagtcccagactcctacc

SEQ ID NO: 83218 - DNA, 20 bp, human
gctcctacctggctcctaag

SEQ ID NO: 83219 - DNA, 20 bp, human
gaggccttggggctacgcat

SEQ ID NO: 83220 - DNA, 20 bp, human
gtgggactcctactctccag

SEQ ID NO: 83221 - DNA, 20 bp, human
gggagatgtagccgaccttg

SEQ ID NO: 83222 - DNA, 20 bp, human
gaaagtgaaatagagggtcg

SEQ ID NO: 83223 - DNA, 20 bp, human
gctccagaggataccagact

SEQ ID NO: 83224 - DNA, 20 bp, human
gcgcccaagtgtcaggactt

SEQ ID NO: 83225 - DNA, 20 bp, human
gcaccaaagtcctgacactt

SEQ ID NO: 83226 - DNA, 20 bp, human
ggagataaggcacccagaga

SEQ ID NO: 83227 - DNA, 20 bp, human
ggcgggtcccgggaaaaccc

SEQ ID NO: 83228 - DNA, 20 bp, human
gcacgccgtccgcgggaaaa

SEQ ID NO: 83229 - DNA, 20 bp, human
gcaggaagcgccagacgcct

SEQ ID NO: 83230 - DNA, 20 bp, human
gcgtccgcgggaaaagggca

SEQ ID NO: 83231 - DNA, 20 bp, human
gaccgtggaaagtgaaagag

SEQ ID NO: 83232 - DNA, 20 bp, human
gtccgggtccgggagtgtag

SEQ ID NO: 83233 - DNA, 20 bp, human
gctgcgaggagcacccggac

SEQ ID NO: 83234 - DNA, 20 bp, human
ggaggccaagttcagaaagt

SEQ ID NO: 83235 - DNA, 20 bp, human
ggaccgggacctccgagtca

SEQ ID NO: 83236 - DNA, 20 bp, human
ggaaatgaaggggatactca

SEQ ID NO: 83237 - DNA, 20 bp, human
gatctcaaaacactctactc

SEQ ID NO: 83238 - DNA, 20 bp, human
gtatgctggagtccactggg

SEQ ID NO: 83239 - DNA, 20 bp, human
gcagtgagatcagctgacga

SEQ ID NO: 83240 - DNA, 20 bp, human
gggaaaagatggtagaactc

SEQ ID NO: 83241 - DNA, 20 bp, human
gaaacactctactctggcaa

SEQ ID NO: 83242 - DNA, 20 bp, human
gtggtatgctggagtccact

SEQ ID NO: 83243 - DNA, 20 bp, human
gactgggagggaattagaac

SEQ ID NO: 83244 - DNA, 20 bp, human
gcatcttttccaggaaacca

SEQ ID NO: 83245 - DNA, 20 bp, human
gtggagtgatgacaggaaca

SEQ ID NO: 83246 - DNA, 20 bp, human
ggaaatggatggtcatacag

SEQ ID NO: 83247 - DNA, 20 bp, human
ggagcacttcctactgaaag

SEQ ID NO: 83248 - DNA, 20 bp, human
ggctggcagttactgaaata

SEQ ID NO: 83249 - DNA, 20 bp, human
gaataaaggattataactgg

SEQ ID NO: 83250 - DNA, 20 bp, human
gtccaggtatctctctggat

SEQ ID NO: 83251 - DNA, 20 bp, human
gcttcacttaaaaaaactga

SEQ ID NO: 83252 - DNA, 20 bp, human
gttcgttcagatacaaaagc

SEQ ID NO: 83253 - DNA, 20 bp, human
gataaactacctctttcagt

SEQ ID NO: 83254 - DNA, 20 bp, human
gtcctatccagagagatacc

SEQ ID NO: 83255 - DNA, 20 bp, human
gatccatttcacaatgtcca

SEQ ID NO: 83256 - DNA, 20 bp, human
gaagcaccaagtgagaggtg

SEQ ID NO: 83257 - DNA, 20 bp, human
gcccgcaagcaccaagtgag

SEQ ID NO: 83258 - DNA, 20 bp, human
ggcataggagcccctgatga

SEQ ID NO: 83259 - DNA, 20 bp, human
gtcacgctgtccgtcatcag

SEQ ID NO: 83260 - DNA, 20 bp, human
gcccctgacaccagacagac

SEQ ID NO: 83261 - DNA, 20 bp, human
ggtaacaggtcacctccctg

SEQ ID NO: 83262 - DNA, 20 bp, human
gacgagaagagatagagagt

SEQ ID NO: 83263 - DNA, 20 bp, human
gcccaggctatgatgtcaga

SEQ ID NO: 83264 - DNA, 20 bp, human
gacatcatagccatacacaa

SEQ ID NO: 83265 - DNA, 20 bp, human
ggcatttggtagaatgggaa

SEQ ID NO: 83266 - DNA, 20 bp, human
gttaagctgccagccagaga

SEQ ID NO: 83267 - DNA, 20 bp, human
gttggcgtttgagtcagcaa

SEQ ID NO: 83268 - DNA, 20 bp, human
ggggcatgtgatctcaacag

SEQ ID NO: 83269 - DNA, 20 bp, human
gaggcgaagaagactgactc

SEQ ID NO: 83270 - DNA, 20 bp, human
gtaggtcacataccaaacca

SEQ ID NO: 83271 - DNA, 20 bp, human
gaaatgactccctctctggc

SEQ ID NO: 83272 - DNA, 20 bp, human
gggctcccctcacagatatc

SEQ ID NO: 83273 - DNA, 20 bp, human
gtctggcaatacattaggtt

SEQ ID NO: 83274 - DNA, 20 bp, human
ggcatgggtgaatacaactg

SEQ ID NO: 83275 - DNA, 20 bp, human
ggtcacataccaaaccaggg

SEQ ID NO: 83276 - DNA, 20 bp, human
gtcgaggcacaaggcacaac

SEQ ID NO: 83277 - DNA, 20 bp, human
gcagataccaaacctcttcg

SEQ ID NO: 83278 - DNA, 20 bp, human
gcttgtgcctcgaagaggtt

SEQ ID NO: 83279 - DNA, 20 bp, human
gtgtgccttgtgcctcgaag

SEQ ID NO: 83280 - DNA, 20 bp, human
gcccttagcacctagttgta

SEQ ID NO: 83281 - DNA, 20 bp, human
gaaggcacaacaggctgctc

SEQ ID NO: 83282 - DNA, 20 bp, human
gatacttgagcaatgaagat

SEQ ID NO: 83283 - DNA, 20 bp, human
gtctctcagcatccagtgca

SEQ ID NO: 83284 - DNA, 20 bp, human
gacatgaacgtagccgtcat

SEQ ID NO: 83285 - DNA, 20 bp, human
gctaacagctgacaccctaa

SEQ ID NO: 83286 - DNA, 20 bp, human
gagacactgaggagctacca

SEQ ID NO: 83287 - DNA, 20 bp, human
gttgctgacacaggaagcaa

SEQ ID NO: 83288 - DNA, 20 bp, human
gttcctggaaccctgatccc

SEQ ID NO: 83289 - DNA, 20 bp, human
gatgccctggagaaatcagt

SEQ ID NO: 83290 - DNA, 20 bp, human
gatcagggttccaggaactc

SEQ ID NO: 83291 - DNA, 20 bp, human
gaaatcagttggagtctcca

SEQ ID NO: 83292 - DNA, 20 bp, human
gccaggaactcaggatctgc

SEQ ID NO: 83293 - DNA, 20 bp, human
gaggcaagagaaatactagc

SEQ ID NO: 83294 - DNA, 20 bp, human
gactccaactgatttctcca

SEQ ID NO: 83295 - DNA, 20 bp, human
gctccagggatcagggttcc

SEQ ID NO: 83296 - DNA, 20 bp, human
ggcgcgctccgagtcggctc

SEQ ID NO: 83297 - DNA, 20 bp, human
gccggcggccggagccgact

SEQ ID NO: 83298 - DNA, 20 bp, human
gagttcccggccgcgagggc

SEQ ID NO: 83299 - DNA, 20 bp, human
ggaggagccggagagcggcc

SEQ ID NO: 83300 - DNA, 20 bp, human
ggacggccgtggagggtgat

SEQ ID NO: 83301 - DNA, 20 bp, human
gatgggatcccagccccggg

SEQ ID NO: 83302 - DNA, 20 bp, human
gctcgcggccgggaactgcc

SEQ ID NO: 83303 - DNA, 20 bp, human
gcaagctgcgcccgccctcg

SEQ ID NO: 83304 - DNA, 20 bp, human
ggtgatgggatcccagcccc

SEQ ID NO: 83305 - DNA, 20 bp, human
gactcctcgctcggctccta

SEQ ID NO: 83306 - DNA, 20 bp, human
gccccaggtgagcagcaaca

SEQ ID NO: 83307 - DNA, 20 bp, human
gcctgctggaggtgaaagtc

SEQ ID NO: 83308 - DNA, 20 bp, human
gatgcagagctgcaggtaag

SEQ ID NO: 83309 - DNA, 20 bp, human
gaccttgttgctgctcacct

SEQ ID NO: 83310 - DNA, 20 bp, human
gtggaggtgaaagtctggcc

SEQ ID NO: 83311 - DNA, 20 bp, human
ggagagggaaaggcaaagag

SEQ ID NO: 83312 - DNA, 20 bp, human
gagctgcaggtaagaggctt

SEQ ID NO: 83313 - DNA, 20 bp, human
gtggcctggcagccttcccc

SEQ ID NO: 83314 - DNA, 20 bp, human
gtcacctggggaaggctgcc

SEQ ID NO: 83315 - DNA, 20 bp, human
gcagaaagaggcagagagac

SEQ ID NO: 83316 - DNA, 20 bp, human
gaagtccccatggccaccaa

SEQ ID NO: 83317 - DNA, 20 bp, human
ggacaggaagatctgagtag

SEQ ID NO: 83318 - DNA, 20 bp, human
gcaacggcagagccacaact

SEQ ID NO: 83319 - DNA, 20 bp, human
ggctctgctgggctacctgc

SEQ ID NO: 83320 - DNA, 20 bp, human
gatactgttgtggtcacctc

SEQ ID NO: 83321 - DNA, 20 bp, human
gagcagaatgtattttccag

SEQ ID NO: 83322 - DNA, 20 bp, human
gccacaactcgggacttctg

SEQ ID NO: 83323 - DNA, 20 bp, human
gagctctggcattagagcag

SEQ ID NO: 83324 - DNA, 20 bp, human
gctggcattagagcagcggt

SEQ ID NO: 83325 - DNA, 20 bp, human
gaattagtaactggaagctc

SEQ ID NO: 83326 - DNA, 20 bp, human
ggcggtgaggaggaaaacaa

SEQ ID NO: 83327 - DNA, 20 bp, human
ggccgggatccaggtctccg

SEQ ID NO: 83328 - DNA, 20 bp, human
gcaagggtagacccctcaaa

SEQ ID NO: 83329 - DNA, 20 bp, human
gtccgcgcctctggccaaag

SEQ ID NO: 83330 - DNA, 20 bp, human
gcggggtccgctttggccag

SEQ ID NO: 83331 - DNA, 20 bp, human
gtcctcggcgcttccagcag

SEQ ID NO: 83332 - DNA, 20 bp, human
gggatgggtgcagtgtcgcc

SEQ ID NO: 83333 - DNA, 20 bp, human
gaccaagccgcagaatctca

SEQ ID NO: 83334 - DNA, 20 bp, human
gccatcctcagccctttgag

SEQ ID NO: 83335 - DNA, 20 bp, human
gcgcggaaggaagcagtgcc

SEQ ID NO: 83336 - DNA, 20 bp, human
gtgtacaaggaaaaccccgt

SEQ ID NO: 83337 - DNA, 20 bp, human
gaactggagacagtcttgta

SEQ ID NO: 83338 - DNA, 20 bp, human
gccgcaataacagatccgac

SEQ ID NO: 83339 - DNA, 20 bp, human
gcttgtagggaagatctgta

SEQ ID NO: 83340 - DNA, 20 bp, human
gcacatagcagtactgtaca

SEQ ID NO: 83341 - DNA, 20 bp, human
ggggcactttgagaactaac

SEQ ID NO: 83342 - DNA, 20 bp, human
ggtatcttcagcaaacaatc

SEQ ID NO: 83343 - DNA, 20 bp, human
gatgaagaggcagatagaaa

SEQ ID NO: 83344 - DNA, 20 bp, human
gtcgcagacttctcacttat

SEQ ID NO: 83345 - DNA, 20 bp, human
gagaacacaggagtaaaacg

SEQ ID NO: 83346 - DNA, 20 bp, human
ggtgcgggtgggagggtagt

SEQ ID NO: 83347 - DNA, 20 bp, human
gatatgcctggagtgcgggt

SEQ ID NO: 83348 - DNA, 20 bp, human
gtctagtcactgagagacag

SEQ ID NO: 83349 - DNA, 20 bp, human
gcgcgcaaaaggaagagtct

SEQ ID NO: 83350 - DNA, 20 bp, human
ggcagcggtggcaggatgtg

SEQ ID NO: 83351 - DNA, 20 bp, human
gcttagttccgaagagggaa

SEQ ID NO: 83352 - DNA, 20 bp, human
gggagtgcaccgcttggccg

SEQ ID NO: 83353 - DNA, 20 bp, human
gcacctccgttagggcgaca

SEQ ID NO: 83354 - DNA, 20 bp, human
gtagggttcccgggaaagac

SEQ ID NO: 83355 - DNA, 20 bp, human
gtgccctgtcgccctaacgg

SEQ ID NO: 83356 - DNA, 20 bp, human
ggagtgagtagtctatgagg

SEQ ID NO: 83357 - DNA, 20 bp, human
gaggagggacctacaaagac

SEQ ID NO: 83358 - DNA, 20 bp, human
gtacccaaactgaaagacag

SEQ ID NO: 83359 - DNA, 20 bp, human
gagagagtgagtagtctatg

SEQ ID NO: 83360 - DNA, 20 bp, human
gaagacagaggggatgaact

SEQ ID NO: 83361 - DNA, 20 bp, human
gatgctgctaccagcctgtg

SEQ ID NO: 83362 - DNA, 20 bp, human
ggctttctaagagtagttga

SEQ ID NO: 83363 - DNA, 20 bp, human
gtgttagtaaatttctatgt

SEQ ID NO: 83364 - DNA, 20 bp, human
ggaacaaaagtttgagggtt

SEQ ID NO: 83365 - DNA, 20 bp, human
gtgttcccaggagtcaccaa

SEQ ID NO: 83366 - DNA, 20 bp, human
gtgaagcgcgcaggacctcg

SEQ ID NO: 83367 - DNA, 20 bp, human
gcggcctgggttccagacgt

SEQ ID NO: 83368 - DNA, 20 bp, human
gcaggctcgggtggatcccg

SEQ ID NO: 83369 - DNA, 20 bp, human
gctgcaggcaggtagacacc

SEQ ID NO: 83370 - DNA, 20 bp, human
ggcatggaagtggcatgaca

SEQ ID NO: 83371 - DNA, 20 bp, human
gctcgacccagagacggagt

SEQ ID NO: 83372 - DNA, 20 bp, human
gagacaccgggccgggagtc

SEQ ID NO: 83373 - DNA, 20 bp, human
gcgaccggctaggtgaccat

SEQ ID NO: 83374 - DNA, 20 bp, human
ggagagtggaaaatatgaca

SEQ ID NO: 83375 - DNA, 20 bp, human
gctgcgcgcttcaatcctgc

SEQ ID NO: 83376 - DNA, 20 bp, human
gcacaactctgggcccgcaa

SEQ ID NO: 83377 - DNA, 20 bp, human
gtagatgcatgccaaggagt

SEQ ID NO: 83378 - DNA, 20 bp, human
gcgaaggcccagactgatat

SEQ ID NO: 83379 - DNA, 20 bp, human
gacagaatggaaatctgcag

SEQ ID NO: 83380 - DNA, 20 bp, human
gcccagagggcctgagaact

SEQ ID NO: 83381 - DNA, 20 bp, human
gagtgattaggtgactgcgg

SEQ ID NO: 83382 - DNA, 20 bp, human
ggaatcgcagtcccactcct

SEQ ID NO: 83383 - DNA, 20 bp, human
gtcggcagatcgtctctgaa

SEQ ID NO: 83384 - DNA, 20 bp, human
ggaagcagagaggggcacca

SEQ ID NO: 83385 - DNA, 20 bp, human
gggctaccccaaggaggaga

SEQ ID NO: 83386 - DNA, 20 bp, human
ggccatggggagggcctcat

SEQ ID NO: 83387 - DNA, 20 bp, human
gtcctatgaggccctcccca

SEQ ID NO: 83388 - DNA, 20 bp, human
ggctcagttgagttagagtc

SEQ ID NO: 83389 - DNA, 20 bp, human
ggaagacctcctgtcctatg

SEQ ID NO: 83390 - DNA, 20 bp, human
gggcacggggaggcatccat

SEQ ID NO: 83391 - DNA, 20 bp, human
gtgcccgggtgctactttat

SEQ ID NO: 83392 - DNA, 20 bp, human
gtagcacccgggcagtacct

SEQ ID NO: 83393 - DNA, 20 bp, human
ggtgcctgcatggtctccca

SEQ ID NO: 83394 - DNA, 20 bp, human
gcttacctaaagccatgggg

SEQ ID NO: 83395 - DNA, 20 bp, human
gcactgagccacaaggtctg

SEQ ID NO: 83396 - DNA, 20 bp, human
gactaatagcagctcatctg

SEQ ID NO: 83397 - DNA, 20 bp, human
gaggcttcattatcaaactt

SEQ ID NO: 83398 - DNA, 20 bp, human
gtctttgtagaacttgaagt

SEQ ID NO: 83399 - DNA, 20 bp, human
gatattgtacttaccttctt

SEQ ID NO: 83400 - DNA, 20 bp, human
gggtaaaactgttttaatag

SEQ ID NO: 83401 - DNA, 20 bp, human
gaagaaaacacagctacaac

SEQ ID NO: 83402 - DNA, 20 bp, human
gcaactggagcatttactgc

SEQ ID NO: 83403 - DNA, 20 bp, human
gaacttaaatgtgagcatcc

SEQ ID NO: 83404 - DNA, 20 bp, human
gacttagtgcaatgcaagac

SEQ ID NO: 83405 - DNA, 20 bp, human
gtatgaaaatttgcacagat

SEQ ID NO: 83406 - DNA, 20 bp, human
gaggctgaaggcaagactag

SEQ ID NO: 83407 - DNA, 20 bp, human
gtccagtggaaggagtccat

SEQ ID NO: 83408 - DNA, 20 bp, human
gcactgtctgaggccagata

SEQ ID NO: 83409 - DNA, 20 bp, human
gaaagagaaacggacaagga

SEQ ID NO: 83410 - DNA, 20 bp, human
gcaggaaagagaaacggaca

SEQ ID NO: 83411 - DNA, 20 bp, human
ggcagtgtaatcataaaaag

SEQ ID NO: 83412 - DNA, 20 bp, human
ggaaatcttctcttcacggg

SEQ ID NO: 83413 - DNA, 20 bp, human
gtcagagtctgagtgcgagt

SEQ ID NO: 83414 - DNA, 20 bp, human
gcctgaaatcttctcttcac

SEQ ID NO: 83415 - DNA, 20 bp, human
gcttagtaagttgcgtggat

SEQ ID NO: 83416 - DNA, 20 bp, human
ggtccccgaccgcaagtcat

SEQ ID NO: 83417 - DNA, 20 bp, human
gaccgcaagtcataggctgt

SEQ ID NO: 83418 - DNA, 20 bp, human
gggcggccgggagcccgcat

SEQ ID NO: 83419 - DNA, 20 bp, human
gaggcttccccagaaaccaa

SEQ ID NO: 83420 - DNA, 20 bp, human
gggtctcgagaattgaggtg

SEQ ID NO: 83421 - DNA, 20 bp, human
gcagaggacgaggtgcgcgg

SEQ ID NO: 83422 - DNA, 20 bp, human
gggccgggagcccgcatggg

SEQ ID NO: 83423 - DNA, 20 bp, human
ggcccacagcctatgacttg

SEQ ID NO: 83424 - DNA, 20 bp, human
gttcgggcgggcagaggacg

SEQ ID NO: 83425 - DNA, 20 bp, human
gcatccagctgggtagccgg

SEQ ID NO: 83426 - DNA, 20 bp, human
gcaggaagctcagaaagggc

SEQ ID NO: 83427 - DNA, 20 bp, human
gaatgcatatgttggagctg

SEQ ID NO: 83428 - DNA, 20 bp, human
gattgttctagagccggccc

SEQ ID NO: 83429 - DNA, 20 bp, human
ggtgggaatagaggtttagg

SEQ ID NO: 83430 - DNA, 20 bp, human
gtagtttgggccttgaatat

SEQ ID NO: 83431 - DNA, 20 bp, human
ggcctgaattgttctagagc

SEQ ID NO: 83432 - DNA, 20 bp, human
gttcccacatcccaaagaaa

SEQ ID NO: 83433 - DNA, 20 bp, human
gccttgaatataggttaaga

SEQ ID NO: 83434 - DNA, 20 bp, human
gacttacctgtgagcaaaca

SEQ ID NO: 83435 - DNA, 20 bp, human
gaaaaggcctgcattctgtt

SEQ ID NO: 83436 - DNA, 20 bp, human
gcaacagtagagctagacct

SEQ ID NO: 83437 - DNA, 20 bp, human
gccagctccagaagatgtag

SEQ ID NO: 83438 - DNA, 20 bp, human
ggacattagcatgattatat

SEQ ID NO: 83439 - DNA, 20 bp, human
gcagtcctggcaacatggag

SEQ ID NO: 83440 - DNA, 20 bp, human
gtgaagtgaaaacgagacca

SEQ ID NO: 83441 - DNA, 20 bp, human
gcatgtggcgatcttgacct

SEQ ID NO: 83442 - DNA, 20 bp, human
gaggattgtcatctgtctga

SEQ ID NO: 83443 - DNA, 20 bp, human
ggtctgatggtcatcttctt

SEQ ID NO: 83444 - DNA, 20 bp, human
gcaatcctctccatgttgcc

SEQ ID NO: 83445 - DNA, 20 bp, human
gtccacaaatcaagctccca

SEQ ID NO: 83446 - DNA, 20 bp, human
gcggcctcagacagacccac

SEQ ID NO: 83447 - DNA, 20 bp, human
gtggtcccagcagaaaacca

SEQ ID NO: 83448 - DNA, 20 bp, human
gacgccagtgggtctgtctg

SEQ ID NO: 83449 - DNA, 20 bp, human
gctctgcacatgcggctggg

SEQ ID NO: 83450 - DNA, 20 bp, human
gtcagcagagagacgccagt

SEQ ID NO: 83451 - DNA, 20 bp, human
ggacctgtcactctgatgac

SEQ ID NO: 83452 - DNA, 20 bp, human
gcagccgcatgtgcagagtg

SEQ ID NO: 83453 - DNA, 20 bp, human
ggggccagacgccgagctta

SEQ ID NO: 83454 - DNA, 20 bp, human
gtggctgtcagccacactca

SEQ ID NO: 83455 - DNA, 20 bp, human
gtcacagtgggagggctcgg

SEQ ID NO: 83456 - DNA, 20 bp, human
gctcgagcaactggtgactg

SEQ ID NO: 83457 - DNA, 20 bp, human
gctggtcgaagacaacgtga

SEQ ID NO: 83458 - DNA, 20 bp, human
gaccctcagggataaacagt

SEQ ID NO: 83459 - DNA, 20 bp, human
gtcataaaggccaaaatgga

SEQ ID NO: 83460 - DNA, 20 bp, human
ggcctgcagtgggagctgat

SEQ ID NO: 83461 - DNA, 20 bp, human
gtggccctcttggtacaggg

SEQ ID NO: 83462 - DNA, 20 bp, human
ggagctcacagatttctgca

SEQ ID NO: 83463 - DNA, 20 bp, human
gacccactgtttatccctga

SEQ ID NO: 83464 - DNA, 20 bp, human
gaccttcatgctggctaagg

SEQ ID NO: 83465 - DNA, 20 bp, human
ggcccatcagctcccactgc

SEQ ID NO: 83466 - DNA, 20 bp, human
gtctgtgcacggcagagtag

SEQ ID NO: 83467 - DNA, 20 bp, human
ggtcagcagcgtcctcatcg

SEQ ID NO: 83468 - DNA, 20 bp, human
gctctgccgtgcacagagag

SEQ ID NO: 83469 - DNA, 20 bp, human
gcgtgcacagagagagggct

SEQ ID NO: 83470 - DNA, 20 bp, human
gtcggtccctcaaacggtgt

SEQ ID NO: 83471 - DNA, 20 bp, human
gtagccagctgtctgaactg

SEQ ID NO: 83472 - DNA, 20 bp, human
gggaggaggcagacatcctt

SEQ ID NO: 83473 - DNA, 20 bp, human
ggccaattctccattcactg

SEQ ID NO: 83474 - DNA, 20 bp, human
gcatccttcggtccctcaaa

SEQ ID NO: 83475 - DNA, 20 bp, human
gagggatcccacagtcaaga

SEQ ID NO: 83476 - DNA, 20 bp, human
gcttacctgctacaccagta

SEQ ID NO: 83477 - DNA, 20 bp, human
gcaaggtaaaagacattcta

SEQ ID NO: 83478 - DNA, 20 bp, human
gagcctagaaagcaatgttt

SEQ ID NO: 83479 - DNA, 20 bp, human
gtcatggtggttaccagcac

SEQ ID NO: 83480 - DNA, 20 bp, human
gaaggaacactaaatcatgg

SEQ ID NO: 83481 - DNA, 20 bp, human
gaagccaagctatcatggtc

SEQ ID NO: 83482 - DNA, 20 bp, human
gaaatgatcagagcaggcat

SEQ ID NO: 83483 - DNA, 20 bp, human
gtcttccttactggtgtagc

SEQ ID NO: 83484 - DNA, 20 bp, human
ggttgcaagtgtgactgttc

SEQ ID NO: 83485 - DNA, 20 bp, human
gaagcaatgtttaggcatca

SEQ ID NO: 83486 - DNA, 20 bp, human
ggctcaaagcaagtggaagt

SEQ ID NO: 83487 - DNA, 20 bp, human
gggagggttgaaggccatta

SEQ ID NO: 83488 - DNA, 20 bp, human
ggggttcctgggagagtcat

SEQ ID NO: 83489 - DNA, 20 bp, human
gaaactcggtgaacaactga

SEQ ID NO: 83490 - DNA, 20 bp, human
gggccattagggagtaagag

SEQ ID NO: 83491 - DNA, 20 bp, human
ggttcagcgcgtctctggtt

SEQ ID NO: 83492 - DNA, 20 bp, human
gaggaagcagcttacaaact

SEQ ID NO: 83493 - DNA, 20 bp, human
gcgccttgcaccagtcctgg

SEQ ID NO: 83494 - DNA, 20 bp, human
gtggagcctaacaggagtcc

SEQ ID NO: 83495 - DNA, 20 bp, human
gggagtgcacatccactagt

SEQ ID NO: 83496 - DNA, 20 bp, human
gatgacacagccaacaaggg

SEQ ID NO: 83497 - DNA, 20 bp, human
gcccttggctcagaaatata

SEQ ID NO: 83498 - DNA, 20 bp, human
ggccaacaagggtggcagcc

SEQ ID NO: 83499 - DNA, 20 bp, human
gtacaagagaacgcaatgca

SEQ ID NO: 83500 - DNA, 20 bp, human
gaaagtgagtgctgacaggc

SEQ ID NO: 83501 - DNA, 20 bp, human
gatctaaagtgagtgctgac

SEQ ID NO: 83502 - DNA, 20 bp, human
gcagtggttactgatgaaaa

SEQ ID NO: 83503 - DNA, 20 bp, human
gttgctaacaaataatgaaa

SEQ ID NO: 83504 - DNA, 20 bp, human
gataattccacttcagagcc

SEQ ID NO: 83505 - DNA, 20 bp, human
gctcatgatattccatgcag

SEQ ID NO: 83506 - DNA, 20 bp, human
gcaatcagaggcatagctgt

SEQ ID NO: 83507 - DNA, 20 bp, human
ggcacctggctaaagtccac

SEQ ID NO: 83508 - DNA, 20 bp, human
ggcatcacttacaggaccag

SEQ ID NO: 83509 - DNA, 20 bp, human
gttcaccattcaccaatcag

SEQ ID NO: 83510 - DNA, 20 bp, human
gaaggttcccgtcccagccg

SEQ ID NO: 83511 - DNA, 20 bp, human
gtgtgaaaaggggtcaaggt

SEQ ID NO: 83512 - DNA, 20 bp, human
gggtgagcatgggggattct

SEQ ID NO: 83513 - DNA, 20 bp, human
gcaaggctttgtggagattt

SEQ ID NO: 83514 - DNA, 20 bp, human
gagaagaattgaggctgctt

SEQ ID NO: 83515 - DNA, 20 bp, human
gttgaggctgcttgggagga

SEQ ID NO: 83516 - DNA, 20 bp, human
gcaggctctaggggaggcac

SEQ ID NO: 83517 - DNA, 20 bp, human
ggcctagcaggctctagggg

SEQ ID NO: 83518 - DNA, 20 bp, human
gtgggcctagcaggctctag

SEQ ID NO: 83519 - DNA, 20 bp, human
gctcgtggaagcaggctgac

SEQ ID NO: 83520 - DNA, 20 bp, human
gaggctgactggagcaggtt

SEQ ID NO: 83521 - DNA, 20 bp, human
gaaagggcaggacacctctg

SEQ ID NO: 83522 - DNA, 20 bp, human
ggcacactcagtcacaagtg

SEQ ID NO: 83523 - DNA, 20 bp, human
ggaagcaggctgactggagc

SEQ ID NO: 83524 - DNA, 20 bp, human
gtgagggagcgacccagatt

SEQ ID NO: 83525 - DNA, 20 bp, human
gtcactccctaaaaagacag

SEQ ID NO: 83526 - DNA, 20 bp, human
ggagtgacacacgctgagtg

SEQ ID NO: 83527 - DNA, 20 bp, human
gaccggcattagtatctctt

SEQ ID NO: 83528 - DNA, 20 bp, human
gacacgctgagtggggtgaa

SEQ ID NO: 83529 - DNA, 20 bp, human
gctaatgccggttagatgag

SEQ ID NO: 83530 - DNA, 20 bp, human
ggtaattaagtaatgatcgg

SEQ ID NO: 83531 - DNA, 20 bp, human
ggcccaagagatactaatgc

SEQ ID NO: 83532 - DNA, 20 bp, human
ggattgcttgtgcttggcaa

SEQ ID NO: 83533 - DNA, 20 bp, human
gggttatcctctcatctaac

SEQ ID NO: 83534 - DNA, 20 bp, human
gagagtaattaagtaatgat

SEQ ID NO: 83535 - DNA, 20 bp, human
gtagagagcgtcaacagctt

SEQ ID NO: 83536 - DNA, 20 bp, human
gaccccccctacccaggaga

SEQ ID NO: 83537 - DNA, 20 bp, human
ggtcagccatctcctgggta

SEQ ID NO: 83538 - DNA, 20 bp, human
gaggagatggctgaccaaag

SEQ ID NO: 83539 - DNA, 20 bp, human
ggccagacggcaggcgacct

SEQ ID NO: 83540 - DNA, 20 bp, human
gcaggacggaaagtgaaacc

SEQ ID NO: 83541 - DNA, 20 bp, human
gagaggctgggccccgccat

SEQ ID NO: 83542 - DNA, 20 bp, human
gaagggaggctggcatgact

SEQ ID NO: 83543 - DNA, 20 bp, human
ggaagagcagaacgaggtgc

SEQ ID NO: 83544 - DNA, 20 bp, human
gtcgcctgccgtctggccca

SEQ ID NO: 83545 - DNA, 20 bp, human
gggcgtgagtttgaagccag

SEQ ID NO: 83546 - DNA, 20 bp, human
gctgtacccagagctcgaag

SEQ ID NO: 83547 - DNA, 20 bp, human
gctgggtacagcgcccgagg

SEQ ID NO: 83548 - DNA, 20 bp, human
gtggcgagcacagggaaagg

SEQ ID NO: 83549 - DNA, 20 bp, human
gctgggtggttaacaggatg

SEQ ID NO: 83550 - DNA, 20 bp, human
gcaaggctgggccggactcg

SEQ ID NO: 83551 - DNA, 20 bp, human
gaggtcgaaccggagccccg

SEQ ID NO: 83552 - DNA, 20 bp, human
ggcgcggacccggcaaggct

SEQ ID NO: 83553 - DNA, 20 bp, human
gtccagcggacgcgtcccca

SEQ ID NO: 83554 - DNA, 20 bp, human
gacgggaagccgaaccaccc

SEQ ID NO: 83555 - DNA, 20 bp, human
gcagggacccggcgacactg

SEQ ID NO: 83556 - DNA, 20 bp, human
gagactggatggacccacaa

SEQ ID NO: 83557 - DNA, 20 bp, human
ggcatcgcgccggaggatgt

SEQ ID NO: 83558 - DNA, 20 bp, human
gcccacaagggtgacagccc

SEQ ID NO: 83559 - DNA, 20 bp, human
gccggcgcgatgccaaaaag

SEQ ID NO: 83560 - DNA, 20 bp, human
ggcgccggaggatgtgggat

SEQ ID NO: 83561 - DNA, 20 bp, human
gtgggaagatcggtccgcct

SEQ ID NO: 83562 - DNA, 20 bp, human
ggactccgatagagactgga

SEQ ID NO: 83563 - DNA, 20 bp, human
gaggctctcttgacagacca

SEQ ID NO: 83564 - DNA, 20 bp, human
gcataaactggggtccccgt

SEQ ID NO: 83565 - DNA, 20 bp, human
ggaattccgggaaggctgat

SEQ ID NO: 83566 - DNA, 20 bp, human
gtagcctgggtgcccggaga

SEQ ID NO: 83567 - DNA, 20 bp, human
gcacggtcccagcaccgggg

SEQ ID NO: 83568 - DNA, 20 bp, human
gtcccagcaccggggaggac

SEQ ID NO: 83569 - DNA, 20 bp, human
gggagagggtacgggatatg

SEQ ID NO: 83570 - DNA, 20 bp, human
gatggccacggtcccagcac

SEQ ID NO: 83571 - DNA, 20 bp, human
gtggctgagacatggggcgg

SEQ ID NO: 83572 - DNA, 20 bp, human
ggaggcagggggacatcacc

SEQ ID NO: 83573 - DNA, 20 bp, human
gtgggcccaacccctcccta

SEQ ID NO: 83574 - DNA, 20 bp, human
gctgggcccccaacccggag

SEQ ID NO: 83575 - DNA, 20 bp, human
ggagggtacgggatatgggg

SEQ ID NO: 83576 - DNA, 20 bp, human
gggcagctgcaggaataaga

SEQ ID NO: 83577 - DNA, 20 bp, human
gcacagacagactacaccca

SEQ ID NO: 83578 - DNA, 20 bp, human
gcgcttgctcttcattccct

SEQ ID NO: 83579 - DNA, 20 bp, human
gacatgattgtaatggccag

SEQ ID NO: 83580 - DNA, 20 bp, human
gcaggcaccagatctctgta

SEQ ID NO: 83581 - DNA, 20 bp, human
gaaggggccgtacagagatc

SEQ ID NO: 83582 - DNA, 20 bp, human
gtgtgggcagaattgaaaag

SEQ ID NO: 83583 - DNA, 20 bp, human
ggattgtaatggccagtggc

SEQ ID NO: 83584 - DNA, 20 bp, human
ggagatctggtgcctgccac

SEQ ID NO: 83585 - DNA, 20 bp, human
gggtgtagtctgtctgtgtc

SEQ ID NO: 83586 - DNA, 20 bp, human
gaggccaaagaggtagtatg

SEQ ID NO: 83587 - DNA, 20 bp, human
ggccgctttaacccactctg

SEQ ID NO: 83588 - DNA, 20 bp, human
gtccacagagtgggttaaag

SEQ ID NO: 83589 - DNA, 20 bp, human
gctccttgcctagtgtggat

SEQ ID NO: 83590 - DNA, 20 bp, human
gatggagccacccaatccac

SEQ ID NO: 83591 - DNA, 20 bp, human
gggcacagcctagatccagc

SEQ ID NO: 83592 - DNA, 20 bp, human
ggaggctgaggggtactcaa

SEQ ID NO: 83593 - DNA, 20 bp, human
ggatggggcaccaagtttag

SEQ ID NO: 83594 - DNA, 20 bp, human
gggccacatccctaaactct

SEQ ID NO: 83595 - DNA, 20 bp, human
gtagcgtgttgttagagtag

SEQ ID NO: 83596 - DNA, 20 bp, human
ggttggagcaggagcaggac

SEQ ID NO: 83597 - DNA, 20 bp, human
gaggcggctcatgtttggat

SEQ ID NO: 83598 - DNA, 20 bp, human
gtaggtaagatggaatgaca

SEQ ID NO: 83599 - DNA, 20 bp, human
ggaagtggatcgggatccac

SEQ ID NO: 83600 - DNA, 20 bp, human
ggacatggctgaagtcaccc

SEQ ID NO: 83601 - DNA, 20 bp, human
gactggcctgcagcagtgag

SEQ ID NO: 83602 - DNA, 20 bp, human
gactcttcagagccccacga

SEQ ID NO: 83603 - DNA, 20 bp, human
gtcttgttctggtccttcgt

SEQ ID NO: 83604 - DNA, 20 bp, human
gtcaccagcaaaggcaaagg

SEQ ID NO: 83605 - DNA, 20 bp, human
gtaaggccaaaaggcctcat

SEQ ID NO: 83606 - DNA, 20 bp, human
ggccatggcgagagagagca

SEQ ID NO: 83607 - DNA, 20 bp, human
gctctccggacctgaaacca

SEQ ID NO: 83608 - DNA, 20 bp, human
gcagccatggcgaacacatc

SEQ ID NO: 83609 - DNA, 20 bp, human
gctggtgcttccggagtctt

SEQ ID NO: 83610 - DNA, 20 bp, human
gcctctcactcaggtatcac

SEQ ID NO: 83611 - DNA, 20 bp, human
gagctatgccaggaagggat

SEQ ID NO: 83612 - DNA, 20 bp, human
ggccttgctctctctcgcca

SEQ ID NO: 83613 - DNA, 20 bp, human
gaagatgatgcccaagactc

SEQ ID NO: 83614 - DNA, 20 bp, human
gaaacggacgggcaacgtgt

SEQ ID NO: 83615 - DNA, 20 bp, human
ggaaagagcacagacgtcga

SEQ ID NO: 83616 - DNA, 20 bp, human
gagagtgctggagtgctgtc

SEQ ID NO: 83617 - DNA, 20 bp, human
gctccagcactctgcttggg

SEQ ID NO: 83618 - DNA, 20 bp, human
gtatgccacggaatctcata

SEQ ID NO: 83619 - DNA, 20 bp, human
gtgagccgtatgagattccg

SEQ ID NO: 83620 - DNA, 20 bp, human
gtattgttggcaaccttatt

SEQ ID NO: 83621 - DNA, 20 bp, human
gaacctagaaatgcctaata

SEQ ID NO: 83622 - DNA, 20 bp, human
gtcagctgggaatgtgcatc

SEQ ID NO: 83623 - DNA, 20 bp, human
gcattcacagacacatgccg

SEQ ID NO: 83624 - DNA, 20 bp, human
gtatgaaaattgagacagga

SEQ ID NO: 83625 - DNA, 20 bp, human
gttgtgagtattgatttggg

SEQ ID NO: 83626 - DNA, 20 bp, human
gccacagcacaagtcaggac

SEQ ID NO: 83627 - DNA, 20 bp, human
gcaggacaggaagaacaatc

SEQ ID NO: 83628 - DNA, 20 bp, human
gagctcgcagacaatcagag

SEQ ID NO: 83629 - DNA, 20 bp, human
gacactcccacatcttagtg

SEQ ID NO: 83630 - DNA, 20 bp, human
ggttcaaggagaaattcacg

SEQ ID NO: 83631 - DNA, 20 bp, human
gtgagccagcagaacatctg

SEQ ID NO: 83632 - DNA, 20 bp, human
gcaaggagaaattcacgtgg

SEQ ID NO: 83633 - DNA, 20 bp, human
gggaaaatccttgtgtgtac

SEQ ID NO: 83634 - DNA, 20 bp, human
gactggttgttgatagttaa

SEQ ID NO: 83635 - DNA, 20 bp, human
gtgaaataccagtacacaca

SEQ ID NO: 83636 - DNA, 20 bp, human
ggagctgggtcatctcaggt

SEQ ID NO: 83637 - DNA, 20 bp, human
gtgtgtcagggctcagtcag

SEQ ID NO: 83638 - DNA, 20 bp, human
gtcacagcccggaaagcccg

SEQ ID NO: 83639 - DNA, 20 bp, human
gtgtcgggggcgctggagaa

SEQ ID NO: 83640 - DNA, 20 bp, human
ggcacctcgggaaatactga

SEQ ID NO: 83641 - DNA, 20 bp, human
ggggcgctggagaacggcag

SEQ ID NO: 83642 - DNA, 20 bp, human
gcgaaggtgaggaccctctg

SEQ ID NO: 83643 - DNA, 20 bp, human
gggctctgctggaaacgact

SEQ ID NO: 83644 - DNA, 20 bp, human
gaggtgaggaccctctgggg

SEQ ID NO: 83645 - DNA, 20 bp, human
gggcaggggtgtggatgaga

SEQ ID NO: 83646 - DNA, 20 bp, human
gaaatcaaaacaagatcaca

SEQ ID NO: 83647 - DNA, 20 bp, human
gagttaaaccttgggaacca

SEQ ID NO: 83648 - DNA, 20 bp, human
gaattccatttgctttcctt

SEQ ID NO: 83649 - DNA, 20 bp, human
ggccttatcatttatttttc

SEQ ID NO: 83650 - DNA, 20 bp, human
gacagagctgcagctcttca

SEQ ID NO: 83651 - DNA, 20 bp, human
ggctgcagctctgtgttcgg

SEQ ID NO: 83652 - DNA, 20 bp, human
gtcacccaaaggaaagcaaa

SEQ ID NO: 83653 - DNA, 20 bp, human
gaattttacaaatcacccaa

SEQ ID NO: 83654 - DNA, 20 bp, human
gagagctgcagctctgtgtt

SEQ ID NO: 83655 - DNA, 20 bp, human
gaaataaagtttcatggagg

SEQ ID NO: 83656 - DNA, 20 bp, human
gcacgctgccgggcagataa

SEQ ID NO: 83657 - DNA, 20 bp, human
ggagtgagcaggtgccccaa

SEQ ID NO: 83658 - DNA, 20 bp, human
ggcaggcccctcggaatctg

SEQ ID NO: 83659 - DNA, 20 bp, human
gctcccaatgcaggtcccta

SEQ ID NO: 83660 - DNA, 20 bp, human
gcggcgcctgagctctcagg

SEQ ID NO: 83661 - DNA, 20 bp, human
ggcagccaggtgaagccccg

SEQ ID NO: 83662 - DNA, 20 bp, human
gagaggtggtcactcagtca

SEQ ID NO: 83663 - DNA, 20 bp, human
ggccgtaaccatagcaacca

SEQ ID NO: 83664 - DNA, 20 bp, human
gagatcctggatctaggcca

SEQ ID NO: 83665 - DNA, 20 bp, human
gagctgctcagtgtgaaatc

SEQ ID NO: 83666 - DNA, 20 bp, human
gagacgggaagcctggactg

SEQ ID NO: 83667 - DNA, 20 bp, human
gtcccgtctgatgagaaggg

SEQ ID NO: 83668 - DNA, 20 bp, human
ggcaggtgcctaagggccac

SEQ ID NO: 83669 - DNA, 20 bp, human
gaccccaagcaggtgcctaa

SEQ ID NO: 83670 - DNA, 20 bp, human
gagcctggactgtgggttgg

SEQ ID NO: 83671 - DNA, 20 bp, human
ggccaggccgtcagaggcag

SEQ ID NO: 83672 - DNA, 20 bp, human
gggcttcccgtctgatgaga

SEQ ID NO: 83673 - DNA, 20 bp, human
gcaattgactaaactctgaa

SEQ ID NO: 83674 - DNA, 20 bp, human
gcccgcccttctcatcagac

SEQ ID NO: 83675 - DNA, 20 bp, human
gggcacgtgaacaggtaaga

SEQ ID NO: 83676 - DNA, 20 bp, human
gtcataatggtagggataca

SEQ ID NO: 83677 - DNA, 20 bp, human
ggccattgttcataatggta

SEQ ID NO: 83678 - DNA, 20 bp, human
gtggcctatgctggaaagtc

SEQ ID NO: 83679 - DNA, 20 bp, human
gggtaaagatcctcgtggaa

SEQ ID NO: 83680 - DNA, 20 bp, human
gaggcctgggcaggattcat

SEQ ID NO: 83681 - DNA, 20 bp, human
gtgcagaccgaccccaagag

SEQ ID NO: 83682 - DNA, 20 bp, human
gcctgggtcagatgaaagac

SEQ ID NO: 83683 - DNA, 20 bp, human
gaccgggcatatctacagag

SEQ ID NO: 83684 - DNA, 20 bp, human
gtccctaccattatgaacaa

SEQ ID NO: 83685 - DNA, 20 bp, human
gaaaaaggtaaagatcctcg

SEQ ID NO: 83686 - DNA, 20 bp, human
gtatgctctagggcactggt

SEQ ID NO: 83687 - DNA, 20 bp, human
gggactcagctccaacagac

SEQ ID NO: 83688 - DNA, 20 bp, human
gccacagagcaggagattct

SEQ ID NO: 83689 - DNA, 20 bp, human
gacggatcccaccaggagaa

SEQ ID NO: 83690 - DNA, 20 bp, human
gagactccacggatcccacc

SEQ ID NO: 83691 - DNA, 20 bp, human
ggaggtatgctctagggcac

SEQ ID NO: 83692 - DNA, 20 bp, human
gacatacctaggaaaagtga

SEQ ID NO: 83693 - DNA, 20 bp, human
ggggaggaacccgtgtctgt

SEQ ID NO: 83694 - DNA, 20 bp, human
gagcacaaacccacagacac

SEQ ID NO: 83695 - DNA, 20 bp, human
gcatgctgggggactcagtg

SEQ ID NO: 83696 - DNA, 20 bp, human
gagtccaggggactgaatcg

SEQ ID NO: 83697 - DNA, 20 bp, human
ggaagttctgagccacatct

SEQ ID NO: 83698 - DNA, 20 bp, human
ggactatacctggcaagaaa

SEQ ID NO: 83699 - DNA, 20 bp, human
ggagccacgattcagtcccc

SEQ ID NO: 83700 - DNA, 20 bp, human
ggtctttatctacagtccag

SEQ ID NO: 83701 - DNA, 20 bp, human
gcctggagatccagatagta

SEQ ID NO: 83702 - DNA, 20 bp, human
gagcttccaaggtcagtgat

SEQ ID NO: 83703 - DNA, 20 bp, human
gctggccttcgaactcctag

SEQ ID NO: 83704 - DNA, 20 bp, human
gggtcagtgatgggttctaa

SEQ ID NO: 83705 - DNA, 20 bp, human
ggaggaaaggctccagaggg

SEQ ID NO: 83706 - DNA, 20 bp, human
gggcctacaggagatgttag

SEQ ID NO: 83707 - DNA, 20 bp, human
gtacaggagatgttagaggt

SEQ ID NO: 83708 - DNA, 20 bp, human
gctgtaggcctggcaatggc

SEQ ID NO: 83709 - DNA, 20 bp, human
ggggcaggccatctcacaag

SEQ ID NO: 83710 - DNA, 20 bp, human
gtctcctgtaggcctggcaa

SEQ ID NO: 83711 - DNA, 20 bp, human
gtcaaataggggcaggactg

SEQ ID NO: 83712 - DNA, 20 bp, human
gcctccacggagcagattct

SEQ ID NO: 83713 - DNA, 20 bp, human
gtaggggagtctacaccctg

SEQ ID NO: 83714 - DNA, 20 bp, human
gaggggtccctgatgctgag

SEQ ID NO: 83715 - DNA, 20 bp, human
ggaagcacagcgccccactc

SEQ ID NO: 83716 - DNA, 20 bp, human
ggagagctgcttctcatcgg

SEQ ID NO: 83717 - DNA, 20 bp, human
gcctttgtgggggagaactc

SEQ ID NO: 83718 - DNA, 20 bp, human
gagaactcaggagtgaaaat

SEQ ID NO: 83719 - DNA, 20 bp, human
gtgggctgaacaaatgaccc

SEQ ID NO: 83720 - DNA, 20 bp, human
ggctaaagccccaaatctgt

SEQ ID NO: 83721 - DNA, 20 bp, human
gtaccttctaagcagcactg

SEQ ID NO: 83722 - DNA, 20 bp, human
gggaggcttctcttccactt

SEQ ID NO: 83723 - DNA, 20 bp, human
ggttgaaaatgtcctttgtg

SEQ ID NO: 83724 - DNA, 20 bp, human
gctcttccacttgggaatgt

SEQ ID NO: 83725 - DNA, 20 bp, human
gtccacttgggaatgttggg

SEQ ID NO: 83726 - DNA, 20 bp, human
gggagggaaacagaaaccaa

SEQ ID NO: 83727 - DNA, 20 bp, human
ggacgctgagatcctatgtc

SEQ ID NO: 83728 - DNA, 20 bp, human
gtcctatgtcaggctgtgat

SEQ ID NO: 83729 - DNA, 20 bp, human
gacactgggaatcacctggt

SEQ ID NO: 83730 - DNA, 20 bp, human
gtatgtcaggctgtgatagg

SEQ ID NO: 83731 - DNA, 20 bp, human
ggattcccagtgtgcaccag

SEQ ID NO: 83732 - DNA, 20 bp, human
ggtgcacactgggaatcacc

SEQ ID NO: 83733 - DNA, 20 bp, human
ggctttaagaagcgcttaag

SEQ ID NO: 83734 - DNA, 20 bp, human
gaggctgtgactctcacccc

SEQ ID NO: 83735 - DNA, 20 bp, human
ggggcccagaaaagctcctg

SEQ ID NO: 83736 - DNA, 20 bp, human
ggagaactctagccatgtgt

SEQ ID NO: 83737 - DNA, 20 bp, human
gtctggggtgtcctgatcct

SEQ ID NO: 83738 - DNA, 20 bp, human
gatccaagctggcagacacg

SEQ ID NO: 83739 - DNA, 20 bp, human
gtcagaaacatcctaggatc

SEQ ID NO: 83740 - DNA, 20 bp, human
gttccccgaagagaaaccga

SEQ ID NO: 83741 - DNA, 20 bp, human
gtgagacctgctgtccgtgt

SEQ ID NO: 83742 - DNA, 20 bp, human
gaatcggggagtacaacctt

SEQ ID NO: 83743 - DNA, 20 bp, human
gaggtaaggtcccccctcca

SEQ ID NO: 83744 - DNA, 20 bp, human
gttataaaggtgatagcatt

SEQ ID NO: 83745 - DNA, 20 bp, human
ggatgagggaaaaagagggc

SEQ ID NO: 83746 - DNA, 20 bp, human
ggctagcaggaagaacagag

SEQ ID NO: 83747 - DNA, 20 bp, human
ggatttgcagtgacaatgtg

SEQ ID NO: 83748 - DNA, 20 bp, human
ggacagagttaacctccaac

SEQ ID NO: 83749 - DNA, 20 bp, human
ggagtgagagctgctcatca

SEQ ID NO: 83750 - DNA, 20 bp, human
gaactcggtgcacagagtct

SEQ ID NO: 83751 - DNA, 20 bp, human
gcagaaggtgagtacctatc

SEQ ID NO: 83752 - DNA, 20 bp, human
gaaaccctcagaaaaaagag

SEQ ID NO: 83753 - DNA, 20 bp, human
gatgtctgttacggtcaact

SEQ ID NO: 83754 - DNA, 20 bp, human
gaaggacttctctgtccggt

SEQ ID NO: 83755 - DNA, 20 bp, human
gcagtccagggcacacagcg

SEQ ID NO: 83756 - DNA, 20 bp, human
gcaggaacccgagagagctg

SEQ ID NO: 83757 - DNA, 20 bp, human
ggtagtgacacggccagtgg

SEQ ID NO: 83758 - DNA, 20 bp, human
ggccagtttcccaaaaggag

SEQ ID NO: 83759 - DNA, 20 bp, human
gagagctggaggtagtgaca

SEQ ID NO: 83760 - DNA, 20 bp, human
ggtttcccaaaaggaggggt

SEQ ID NO: 83761 - DNA, 20 bp, human
gtggccgagggaaatgaaac

SEQ ID NO: 83762 - DNA, 20 bp, human
ggaggtagtgacacggccag

SEQ ID NO: 83763 - DNA, 20 bp, human
ggtgacacggccagtggtgg

SEQ ID NO: 83764 - DNA, 20 bp, human
gtcaactagactctgagcat

SEQ ID NO: 83765 - DNA, 20 bp, human
gctcagagtctagttgaggt

SEQ ID NO: 83766 - DNA, 20 bp, human
gcggacggcgaatggagcag

SEQ ID NO: 83767 - DNA, 20 bp, human
gggcgcccaagcgggaagtg

SEQ ID NO: 83768 - DNA, 20 bp, human
gaggacttcggagagagaaa

SEQ ID NO: 83769 - DNA, 20 bp, human
gccacccccgcaggccgtcc

SEQ ID NO: 83770 - DNA, 20 bp, human
ggaggtctcactgccagcac

SEQ ID NO: 83771 - DNA, 20 bp, human
gcttcggagagagaaagggt

SEQ ID NO: 83772 - DNA, 20 bp, human
gggtcccccacttcccgctt

SEQ ID NO: 83773 - DNA, 20 bp, human
gcgcccccaggagaggacgg

SEQ ID NO: 83774 - DNA, 20 bp, human
ggcgccactgcccggagaag

SEQ ID NO: 83775 - DNA, 20 bp, human
gggccagggaagggccaccc

SEQ ID NO: 83776 - DNA, 20 bp, human
ggaatcctcagagtctggag

SEQ ID NO: 83777 - DNA, 20 bp, human
gaacaggaatcctcagagtc

SEQ ID NO: 83778 - DNA, 20 bp, human
gagaacgtttcagagccatg

SEQ ID NO: 83779 - DNA, 20 bp, human
gctttcctctccagactctg

SEQ ID NO: 83780 - DNA, 20 bp, human
ggcattggtgaaagagacct

SEQ ID NO: 83781 - DNA, 20 bp, human
gtatgcactttctttgccaa

SEQ ID NO: 83782 - DNA, 20 bp, human
gtacagtctgtaaagtgcat

SEQ ID NO: 83783 - DNA, 20 bp, human
gactctgctgatagccaatg

SEQ ID NO: 83784 - DNA, 20 bp, human
gagatctctatatatagtaa

SEQ ID NO: 83785 - DNA, 20 bp, human
ggcacttgtgggaatttctg

SEQ ID NO: 83786 - DNA, 20 bp, human
gtgcggtacggcgaagcaga

SEQ ID NO: 83787 - DNA, 20 bp, human
gtgctgggtgctgttgccag

SEQ ID NO: 83788 - DNA, 20 bp, human
gtacggcgaagcagagggct

SEQ ID NO: 83789 - DNA, 20 bp, human
gtccggaagtccgctgcccc

SEQ ID NO: 83790 - DNA, 20 bp, human
gcccatccccagcaaagatc

SEQ ID NO: 83791 - DNA, 20 bp, human
gccgtaccgcacccggaagt

SEQ ID NO: 83792 - DNA, 20 bp, human
ggacttccggatctttgctg

SEQ ID NO: 83793 - DNA, 20 bp, human
ggccaggggcagcggacttc

SEQ ID NO: 83794 - DNA, 20 bp, human
gttacactaaaaaattacgg

SEQ ID NO: 83795 - DNA, 20 bp, human
gcgtgcgcagctccgacttc

SEQ ID NO: 83796 - DNA, 20 bp, human
ggcgatgagaagcagcggca

SEQ ID NO: 83797 - DNA, 20 bp, human
gcacttactgagaaatgcgg

SEQ ID NO: 83798 - DNA, 20 bp, human
gagtgagatgtgcaaatccg

SEQ ID NO: 83799 - DNA, 20 bp, human
gtgagaacgaaccttatctc

SEQ ID NO: 83800 - DNA, 20 bp, human
ggatgtgcaaatccgtggca

SEQ ID NO: 83801 - DNA, 20 bp, human
gattgcataattatctggag

SEQ ID NO: 83802 - DNA, 20 bp, human
gggcaggtcatgttgattct

SEQ ID NO: 83803 - DNA, 20 bp, human
gaaaagtgcacccagagata

SEQ ID NO: 83804 - DNA, 20 bp, human
ggcataattatctggagcgg

SEQ ID NO: 83805 - DNA, 20 bp, human
ggtgtagtgaaattattagg

SEQ ID NO: 83806 - DNA, 20 bp, human
gatctcagccctgagaaagg

SEQ ID NO: 83807 - DNA, 20 bp, human
gtcgttcccggtgggctcga

SEQ ID NO: 83808 - DNA, 20 bp, human
gaccgccgctggcagttcca

SEQ ID NO: 83809 - DNA, 20 bp, human
ggaaggcgcctgtgccggag

SEQ ID NO: 83810 - DNA, 20 bp, human
gcggaggggagcgagcgcag

SEQ ID NO: 83811 - DNA, 20 bp, human
gggagaaggagttcatagct

SEQ ID NO: 83812 - DNA, 20 bp, human
gataggactggagatgtctg

SEQ ID NO: 83813 - DNA, 20 bp, human
gttcatagctgggctcctgg

SEQ ID NO: 83814 - DNA, 20 bp, human
ggaagctctatctcccctcc

SEQ ID NO: 83815 - DNA, 20 bp, human
gcagggctgagatgccgtcg

SEQ ID NO: 83816 - DNA, 20 bp, human
gcctctgcgggaccatggag

SEQ ID NO: 83817 - DNA, 20 bp, human
gctcctcggctaccactcca

SEQ ID NO: 83818 - DNA, 20 bp, human
gcaggctaatgggaaccggg

SEQ ID NO: 83819 - DNA, 20 bp, human
gcagactgcggtgaccaagg

SEQ ID NO: 83820 - DNA, 20 bp, human
ggttgtgtaaaggctcctgg

SEQ ID NO: 83821 - DNA, 20 bp, human
gccacacagctaggtacccg

SEQ ID NO: 83822 - DNA, 20 bp, human
gaggtacccgcggggcctca

SEQ ID NO: 83823 - DNA, 20 bp, human
ggaccatggagtggtagccg

SEQ ID NO: 83824 - DNA, 20 bp, human
ggaggaagcatgctggccgt

SEQ ID NO: 83825 - DNA, 20 bp, human
gtccagcctcccacagactg

SEQ ID NO: 83826 - DNA, 20 bp, human
gctcagggctgcgataatcg

SEQ ID NO: 83827 - DNA, 20 bp, human
ggtcagatccttctccgcag

SEQ ID NO: 83828 - DNA, 20 bp, human
gtgacagtgttccggagccg

SEQ ID NO: 83829 - DNA, 20 bp, human
gggaggtccgggagcaggaa

SEQ ID NO: 83830 - DNA, 20 bp, human
ggcgcgccaccccagtcccg

SEQ ID NO: 83831 - DNA, 20 bp, human
ggaaggatctgacagtgttc

SEQ ID NO: 83832 - DNA, 20 bp, human
ggagacgcggagggtcgagg

SEQ ID NO: 83833 - DNA, 20 bp, human
ggatctggtaacaaaaaggg

SEQ ID NO: 83834 - DNA, 20 bp, human
ggggtggcgcgctacctctg

SEQ ID NO: 83835 - DNA, 20 bp, human
gctgagtacaaacttcaccc

SEQ ID NO: 83836 - DNA, 20 bp, human
gtcctgggagtgactatggg

SEQ ID NO: 83837 - DNA, 20 bp, human
ggagttgccgagtctgtgtt

SEQ ID NO: 83838 - DNA, 20 bp, human
ggcaactccgcggaagacca

SEQ ID NO: 83839 - DNA, 20 bp, human
gcacagactcggcaactccg

SEQ ID NO: 83840 - DNA, 20 bp, human
gagagcactggctctcccat

SEQ ID NO: 83841 - DNA, 20 bp, human
gcgcggaagaccagggtcct

SEQ ID NO: 83842 - DNA, 20 bp, human
gagggtcctgggagtgacta

SEQ ID NO: 83843 - DNA, 20 bp, human
ggttactcgcagcctgccag

SEQ ID NO: 83844 - DNA, 20 bp, human
ggcggccaggagcacgggaa

SEQ ID NO: 83845 - DNA, 20 bp, human
ggcacctggatgaggaccag

SEQ ID NO: 83846 - DNA, 20 bp, human
gtccctaacagacctgagtc

SEQ ID NO: 83847 - DNA, 20 bp, human
ggggcaggggatcaatacta

SEQ ID NO: 83848 - DNA, 20 bp, human
gtgcctgactcaggtctgtt

SEQ ID NO: 83849 - DNA, 20 bp, human
gaggggatcaatactatggg

SEQ ID NO: 83850 - DNA, 20 bp, human
gcaaacccagtgcctgactc

SEQ ID NO: 83851 - DNA, 20 bp, human
gtcattcatttcatacacac

SEQ ID NO: 83852 - DNA, 20 bp, human
gaaagtggctatgctcaaaa

SEQ ID NO: 83853 - DNA, 20 bp, human
ggtttaaccaccatgacagg

SEQ ID NO: 83854 - DNA, 20 bp, human
gccaccatgacagggggcag

SEQ ID NO: 83855 - DNA, 20 bp, human
gatgctatgactgtacttgt

SEQ ID NO: 83856 - DNA, 20 bp, human
ggccaccggagcactccata

SEQ ID NO: 83857 - DNA, 20 bp, human
gagagccaggaagaaaccac

SEQ ID NO: 83858 - DNA, 20 bp, human
gccaggaagaaaccaccgga

SEQ ID NO: 83859 - DNA, 20 bp, human
gtacataatataggtaaccg

SEQ ID NO: 83860 - DNA, 20 bp, human
gacagtgagatggttccttc

SEQ ID NO: 83861 - DNA, 20 bp, human
gagcttctaggacaagagcc

SEQ ID NO: 83862 - DNA, 20 bp, human
gtatgtcctattgagaacca

SEQ ID NO: 83863 - DNA, 20 bp, human
gggtaaccgtggttctcaat

SEQ ID NO: 83864 - DNA, 20 bp, human
gagacataggaaaacgctgt

SEQ ID NO: 83865 - DNA, 20 bp, human
ggccttatggagtgctccgg

SEQ ID NO: 83866 - DNA, 20 bp, human
gagactgggagtatcaaact

SEQ ID NO: 83867 - DNA, 20 bp, human
gcagctggcaatgacaagac

SEQ ID NO: 83868 - DNA, 20 bp, human
gtcactgtgaggtaagatgg

SEQ ID NO: 83869 - DNA, 20 bp, human
gacagcactaccaacacagc

SEQ ID NO: 83870 - DNA, 20 bp, human
gacatcactgtgaggtaaga

SEQ ID NO: 83871 - DNA, 20 bp, human
ggactgcatttttaaataca

SEQ ID NO: 83872 - DNA, 20 bp, human
gattagataaatttcaatca

SEQ ID NO: 83873 - DNA, 20 bp, human
gaaatatttgtgcaagaatt

SEQ ID NO: 83874 - DNA, 20 bp, human
gaatattagtaatttcttgc

SEQ ID NO: 83875 - DNA, 20 bp, human
ggtgatgttgtgaggacatg

SEQ ID NO: 83876 - DNA, 20 bp, human
ggccacggagcacaggagca

SEQ ID NO: 83877 - DNA, 20 bp, human
ggccagaagcatcttgacag

SEQ ID NO: 83878 - DNA, 20 bp, human
gctggcctgccacggagcac

SEQ ID NO: 83879 - DNA, 20 bp, human
gatgtccaggatccccgcca

SEQ ID NO: 83880 - DNA, 20 bp, human
gatgaggatgaaaaaactcg

SEQ ID NO: 83881 - DNA, 20 bp, human
gaagcatcttgacagcggac

SEQ ID NO: 83882 - DNA, 20 bp, human
ggacaactggtcacctgcaa

SEQ ID NO: 83883 - DNA, 20 bp, human
gaaaactcggggctgactaa

SEQ ID NO: 83884 - DNA, 20 bp, human
gcagacaccttcaaatcgag

SEQ ID NO: 83885 - DNA, 20 bp, human
gcagtagctgtctttcccat

SEQ ID NO: 83886 - DNA, 20 bp, human
gcagtcccatcacaagtctg

SEQ ID NO: 83887 - DNA, 20 bp, human
gctgtgcacccagagatagt

SEQ ID NO: 83888 - DNA, 20 bp, human
gggactgggcagatgcatct

SEQ ID NO: 83889 - DNA, 20 bp, human
ggatgcctcagacttgtgat

SEQ ID NO: 83890 - DNA, 20 bp, human
gaccagaggaggtaaagcta

SEQ ID NO: 83891 - DNA, 20 bp, human
gaaggccaggacaccagagg

SEQ ID NO: 83892 - DNA, 20 bp, human
ggagctgaggtctaggccca

SEQ ID NO: 83893 - DNA, 20 bp, human
ggacaaatcacctccaggtt

SEQ ID NO: 83894 - DNA, 20 bp, human
gttgtcacccaactatctct

SEQ ID NO: 83895 - DNA, 20 bp, human
gattgaactgacctttgtgg

SEQ ID NO: 83896 - DNA, 20 bp, human
gagcgtccgctctggtcccg

SEQ ID NO: 83897 - DNA, 20 bp, human
ggagggaggggaaacccgag

SEQ ID NO: 83898 - DNA, 20 bp, human
gccttctccaaggaacccct

SEQ ID NO: 83899 - DNA, 20 bp, human
gcaggtggggacgagccggg

SEQ ID NO: 83900 - DNA, 20 bp, human
gccacctgcggcgctcccca

SEQ ID NO: 83901 - DNA, 20 bp, human
gcaggtgcaactgagaaacc

SEQ ID NO: 83902 - DNA, 20 bp, human
gtgcaggaacgaaagttcaa

SEQ ID NO: 83903 - DNA, 20 bp, human
gccgcaggtggggacgagcc

SEQ ID NO: 83904 - DNA, 20 bp, human
gttcccctccctcggcgcag

SEQ ID NO: 83905 - DNA, 20 bp, human
gctgcaaggccacgccacaa

SEQ ID NO: 83906 - DNA, 20 bp, human
ggcggtctggtggaaagtgg

SEQ ID NO: 83907 - DNA, 20 bp, human
gggcggcgcgatccagcccc

SEQ ID NO: 83908 - DNA, 20 bp, human
gaaggatcgctgtcaccccg

SEQ ID NO: 83909 - DNA, 20 bp, human
ggtgagaacagaaccactac

SEQ ID NO: 83910 - DNA, 20 bp, human
ggcgctgccgcgggcttccg

SEQ ID NO: 83911 - DNA, 20 bp, human
ggtgagacgcatctagatgc

SEQ ID NO: 83912 - DNA, 20 bp, human
gaagttggggaagatggata

SEQ ID NO: 83913 - DNA, 20 bp, human
gcaacttcccagccgaatta

SEQ ID NO: 83914 - DNA, 20 bp, human
ggtcaccccgcggcagcggg

SEQ ID NO: 83915 - DNA, 20 bp, human
ggctttaaacatggtcagta

SEQ ID NO: 83916 - DNA, 20 bp, human
gtctaggatagtgggagaga

SEQ ID NO: 83917 - DNA, 20 bp, human
gcttcgacccacttacctca

SEQ ID NO: 83918 - DNA, 20 bp, human
gtcagttgtctgctactcag

SEQ ID NO: 83919 - DNA, 20 bp, human
gcttaaaacacgaacaatgg

SEQ ID NO: 83920 - DNA, 20 bp, human
gactcagaggaaggggcggt

SEQ ID NO: 83921 - DNA, 20 bp, human
ggtgggtcgaagcggtcgaa

SEQ ID NO: 83922 - DNA, 20 bp, human
ggagtagcagacaactgaag

SEQ ID NO: 83923 - DNA, 20 bp, human
ggaggaaggggcggttggtg

SEQ ID NO: 83924 - DNA, 20 bp, human
gcgggcgtgtcctaatgtca

SEQ ID NO: 83925 - DNA, 20 bp, human
gtaaggcgccatgaggtaag

SEQ ID NO: 83926 - DNA, 20 bp, human
ggaggaggagtccggaccgg

SEQ ID NO: 83927 - DNA, 20 bp, human
gcccaacccaaatgggaggg

SEQ ID NO: 83928 - DNA, 20 bp, human
gctgcaatggcgagaagagg

SEQ ID NO: 83929 - DNA, 20 bp, human
gctgctgggtccaactgcaa

SEQ ID NO: 83930 - DNA, 20 bp, human
gcaactgcaatggcgagaag

SEQ ID NO: 83931 - DNA, 20 bp, human
ggaggaggaggagtccggac

SEQ ID NO: 83932 - DNA, 20 bp, human
gcgaggggccgcgtgcgggg

SEQ ID NO: 83933 - DNA, 20 bp, human
gcaaaagcccagccgcgggg

SEQ ID NO: 83934 - DNA, 20 bp, human
gcgcaccgcgtggcttttgg

SEQ ID NO: 83935 - DNA, 20 bp, human
gcgcccgctcgcccccggtc

SEQ ID NO: 83936 - DNA, 20 bp, human
gaggactgtggagtgatcca

SEQ ID NO: 83937 - DNA, 20 bp, human
gctcgcactcaccgggactc

SEQ ID NO: 83938 - DNA, 20 bp, human
ggctgcaggatccttctccg

SEQ ID NO: 83939 - DNA, 20 bp, human
gcggccggacgggagttccc

SEQ ID NO: 83940 - DNA, 20 bp, human
gtctccggggaactcccgtc

SEQ ID NO: 83941 - DNA, 20 bp, human
gggtaaaggcgggtcagggt

SEQ ID NO: 83942 - DNA, 20 bp, human
gtcaggcttccccaatccag

SEQ ID NO: 83943 - DNA, 20 bp, human
gcgggtcctctcgcactcac

SEQ ID NO: 83944 - DNA, 20 bp, human
gctgcgtccccggctagtgg

SEQ ID NO: 83945 - DNA, 20 bp, human
gcctgtagaggataaagctt

SEQ ID NO: 83946 - DNA, 20 bp, human
gcggccgggctccacacccc

SEQ ID NO: 83947 - DNA, 20 bp, human
gagcgaccgggcctccgaca

SEQ ID NO: 83948 - DNA, 20 bp, human
gtcctgcgtagcgaaaatgg

SEQ ID NO: 83949 - DNA, 20 bp, human
gcgccgggccggccagggaa

SEQ ID NO: 83950 - DNA, 20 bp, human
gcagagccggtccctcgggt

SEQ ID NO: 83951 - DNA, 20 bp, human
gccctctgcgtggcggtgaa

SEQ ID NO: 83952 - DNA, 20 bp, human
gcaggccgcgggtggaatcg

SEQ ID NO: 83953 - DNA, 20 bp, human
gccacggcccctctgcgtgg

SEQ ID NO: 83954 - DNA, 20 bp, human
gtccccgaagaggtccatgg

SEQ ID NO: 83955 - DNA, 20 bp, human
gaggtccccgaagaggtcca

SEQ ID NO: 83956 - DNA, 20 bp, human
gaggcagcgccatatcctgg

SEQ ID NO: 83957 - DNA, 20 bp, human
gcgggtcacgtgacacggag

SEQ ID NO: 83958 - DNA, 20 bp, human
ggtggccgcacagaaactgg

SEQ ID NO: 83959 - DNA, 20 bp, human
gtggaggcagcgccatatcc

SEQ ID NO: 83960 - DNA, 20 bp, human
ggcgtgaccttgtcacggag

SEQ ID NO: 83961 - DNA, 20 bp, human
ggggggccgaattctgctgg

SEQ ID NO: 83962 - DNA, 20 bp, human
ggcgcacaaagggcgtggtc

SEQ ID NO: 83963 - DNA, 20 bp, human
ggaggggcgtgaccttgtca

SEQ ID NO: 83964 - DNA, 20 bp, human
gcaccttcacctccaggata

SEQ ID NO: 83965 - DNA, 20 bp, human
gtagccaccacaagtcaagg

SEQ ID NO: 83966 - DNA, 20 bp, human
gacgaaaggacggtcgactt

SEQ ID NO: 83967 - DNA, 20 bp, human
gaaaggacggtcgacttcgg

SEQ ID NO: 83968 - DNA, 20 bp, human
gagtgcgccctacgaaagga

SEQ ID NO: 83969 - DNA, 20 bp, human
gttcgttagtgcctagtggt

SEQ ID NO: 83970 - DNA, 20 bp, human
ggaaaagtgcgccctacgaa

SEQ ID NO: 83971 - DNA, 20 bp, human
gctcgggccccaaagaaccc

SEQ ID NO: 83972 - DNA, 20 bp, human
gttagttcgttagtgcctag

SEQ ID NO: 83973 - DNA, 20 bp, human
gcccgagccaaccaatcgga

SEQ ID NO: 83974 - DNA, 20 bp, human
gttccaaaccacctaccact

SEQ ID NO: 83975 - DNA, 20 bp, human
gtgcctagtggtaggtggtt

SEQ ID NO: 83976 - DNA, 20 bp, human
gcggggcgggcgttgccggg

SEQ ID NO: 83977 - DNA, 20 bp, human
gtgtttatctgaggcgcgtg

SEQ ID NO: 83978 - DNA, 20 bp, human
gtggcaccaagaagaggact

SEQ ID NO: 83979 - DNA, 20 bp, human
gctgcgcggggacttccccc

SEQ ID NO: 83980 - DNA, 20 bp, human
gcctctcccagtcctcacaa

SEQ ID NO: 83981 - DNA, 20 bp, human
gtggccgtgagggagcgctg

SEQ ID NO: 83982 - DNA, 20 bp, human
gcagcccaagagaccaccaa

SEQ ID NO: 83983 - DNA, 20 bp, human
gcccccggctctggccgtga

SEQ ID NO: 83984 - DNA, 20 bp, human
gagctgcgcagcgggtgcgg

SEQ ID NO: 83985 - DNA, 20 bp, human
ggagaaaccggcgccacagg

SEQ ID NO: 83986 - DNA, 20 bp, human
gcgcggcggcgcgagttaag

SEQ ID NO: 83987 - DNA, 20 bp, human
gggcggcgcgagttaagtgg

SEQ ID NO: 83988 - DNA, 20 bp, human
gagcatctcggtcaagcgga

SEQ ID NO: 83989 - DNA, 20 bp, human
gccccgtccaggaccaatcc

SEQ ID NO: 83990 - DNA, 20 bp, human
gtggtggactcgagctgccg

SEQ ID NO: 83991 - DNA, 20 bp, human
gcccgggcctctcccgacga

SEQ ID NO: 83992 - DNA, 20 bp, human
gtgcctagcctccaggacaa

SEQ ID NO: 83993 - DNA, 20 bp, human
gcggcgcaccggaagcacag

SEQ ID NO: 83994 - DNA, 20 bp, human
gagtccggcgaactccctgg

SEQ ID NO: 83995 - DNA, 20 bp, human
gccgcagcatctcggtcaag

SEQ ID NO: 83996 - DNA, 20 bp, human
gcgccgcgccagctcacgca

SEQ ID NO: 83997 - DNA, 20 bp, human
gtccaggtcttggggcgccg

SEQ ID NO: 83998 - DNA, 20 bp, human
gctctcagcttcgggtcctg

SEQ ID NO: 83999 - DNA, 20 bp, human
gcagcttgaggagcacggtg

SEQ ID NO: 84000 - DNA, 20 bp, human
gcgtggcctttgtggagcaa

SEQ ID NO: 84001 - DNA, 20 bp, human
gggggtcggtaaccacgtca

SEQ ID NO: 84002 - DNA, 20 bp, human
gcgccgcggcggaaatcgcg

SEQ ID NO: 84003 - DNA, 20 bp, human
ggctgcggctgccgccatca

SEQ ID NO: 84004 - DNA, 20 bp, human
ggtacgcgtgggccctgacg

SEQ ID NO: 84005 - DNA, 20 bp, human
gcgcatggcgcagcaccttc

SEQ ID NO: 84006 - DNA, 20 bp, human
gtgggtccgggagaatctgt

SEQ ID NO: 84007 - DNA, 20 bp, human
ggtggaagcggcactcaaga

SEQ ID NO: 84008 - DNA, 20 bp, human
gaccaacaggagaacccaat

SEQ ID NO: 84009 - DNA, 20 bp, human
gaagcggcactcaagatggt

SEQ ID NO: 84010 - DNA, 20 bp, human
gagattctcccggacccacg

SEQ ID NO: 84011 - DNA, 20 bp, human
gcggcgcgcgctggaaggta

SEQ ID NO: 84012 - DNA, 20 bp, human
gcggcagcaccaaggcctct

SEQ ID NO: 84013 - DNA, 20 bp, human
gctgtaccgcaaggcccggg

SEQ ID NO: 84014 - DNA, 20 bp, human
gtctgcgtggtaaaccaccc

SEQ ID NO: 84015 - DNA, 20 bp, human
gtggcgcgacttctaagatt

SEQ ID NO: 84016 - DNA, 20 bp, human
gcctccggaagagacgagtg

SEQ ID NO: 84017 - DNA, 20 bp, human
gccgctgaacccggagggtg

SEQ ID NO: 84018 - DNA, 20 bp, human
gccttgagtcggaggacgtc

SEQ ID NO: 84019 - DNA, 20 bp, human
ggcagtcgcggtgctgggac

SEQ ID NO: 84020 - DNA, 20 bp, human
gaactgttcccggtcgccca

SEQ ID NO: 84021 - DNA, 20 bp, human
gtgcgggcagcacaggacct

SEQ ID NO: 84022 - DNA, 20 bp, human
gcagcgcccgctgaacccgg

SEQ ID NO: 84023 - DNA, 20 bp, human
gtaacggtctcaccttgagt

SEQ ID NO: 84024 - DNA, 20 bp, human
gcgagtagcccctctacctc

SEQ ID NO: 84025 - DNA, 20 bp, human
gcggataacgcagcaggcag

SEQ ID NO: 84026 - DNA, 20 bp, human
gagcgcaggtgtgggacggg

SEQ ID NO: 84027 - DNA, 20 bp, human
gggctccgggagttggagaa

SEQ ID NO: 84028 - DNA, 20 bp, human
ggagctgcgggagcaggcac

SEQ ID NO: 84029 - DNA, 20 bp, human
ggcccagggtccgcacccga

SEQ ID NO: 84030 - DNA, 20 bp, human
gggactaggcacagagctgc

SEQ ID NO: 84031 - DNA, 20 bp, human
gcttcccgccagcgcaggtg

SEQ ID NO: 84032 - DNA, 20 bp, human
ggcaggacaggtgagcgcca

SEQ ID NO: 84033 - DNA, 20 bp, human
gccgagcggcgaggaccagg

SEQ ID NO: 84034 - DNA, 20 bp, human
gcgggacggcgggatccggt

SEQ ID NO: 84035 - DNA, 20 bp, human
gacaggtgagcgccacggct

SEQ ID NO: 84036 - DNA, 20 bp, human
gggacgcagggagcgaccag

SEQ ID NO: 84037 - DNA, 20 bp, human
ggactcggcggcggcagggt

SEQ ID NO: 84038 - DNA, 20 bp, human
gcccgcgctccggacctggc

SEQ ID NO: 84039 - DNA, 20 bp, human
gagccgccgcctgccaggtc

SEQ ID NO: 84040 - DNA, 20 bp, human
ggtccaagatgactcggcgg

SEQ ID NO: 84041 - DNA, 20 bp, human
gccgggaaaatggaacgcgg

SEQ ID NO: 84042 - DNA, 20 bp, human
gccagtgctggcggaacccg

SEQ ID NO: 84043 - DNA, 20 bp, human
ggggccgaaggcaaaaaccg

SEQ ID NO: 84044 - DNA, 20 bp, human
ggcagggagcgaccagaggc

SEQ ID NO: 84045 - DNA, 20 bp, human
gagaaggagtgagattcggt

SEQ ID NO: 84046 - DNA, 20 bp, human
gcaagaagcccgagtagagg

SEQ ID NO: 84047 - DNA, 20 bp, human
gtcgcggccgtaggctaacg

SEQ ID NO: 84048 - DNA, 20 bp, human
gggccaagaagcccgagtag

SEQ ID NO: 84049 - DNA, 20 bp, human
gccgcggccgcggccgatgg

SEQ ID NO: 84050 - DNA, 20 bp, human
gtacggccgcgaggtgaaag

SEQ ID NO: 84051 - DNA, 20 bp, human
gagcatctcgcgcaagtcca

SEQ ID NO: 84052 - DNA, 20 bp, human
gcgtaggctaacgtggaagt

SEQ ID NO: 84053 - DNA, 20 bp, human
gcccgcgcgcctgactcgcc

SEQ ID NO: 84054 - DNA, 20 bp, human
gccaggtgggagcccacggg

SEQ ID NO: 84055 - DNA, 20 bp, human
gaagtccacggtgcccccat

SEQ ID NO: 84056 - DNA, 20 bp, human
gatgccgctgagaggaggaa

SEQ ID NO: 84057 - DNA, 20 bp, human
gcctccatgccgctgagagg

SEQ ID NO: 84058 - DNA, 20 bp, human
ggtgtgggaactggagatgt

SEQ ID NO: 84059 - DNA, 20 bp, human
ggacaggccgaacccggatc

SEQ ID NO: 84060 - DNA, 20 bp, human
ggcccctccatgccgctgag

SEQ ID NO: 84061 - DNA, 20 bp, human
ggcgccggagcagacggacg

SEQ ID NO: 84062 - DNA, 20 bp, human
gcccggatctggccagaaac

SEQ ID NO: 84063 - DNA, 20 bp, human
gcgtggatgcgcgcacctag

SEQ ID NO: 84064 - DNA, 20 bp, human
gaaacgggtcagggctctga

SEQ ID NO: 84065 - DNA, 20 bp, human
gcacctaggggtacgagacc

SEQ ID NO: 84066 - DNA, 20 bp, human
gagctgcggcctccgcatgg

SEQ ID NO: 84067 - DNA, 20 bp, human
gccctcctcgggactcgacc

SEQ ID NO: 84068 - DNA, 20 bp, human
gatgcggaggccgcagctca

SEQ ID NO: 84069 - DNA, 20 bp, human
ggaggctgaggcggtaatag

SEQ ID NO: 84070 - DNA, 20 bp, human
ggagtggcccctccatgcgg

SEQ ID NO: 84071 - DNA, 20 bp, human
gtagccggcctgcagcagtc

SEQ ID NO: 84072 - DNA, 20 bp, human
gtgcgctcactgcccagccg

SEQ ID NO: 84073 - DNA, 20 bp, human
gcaacacccgggacacgaga

SEQ ID NO: 84074 - DNA, 20 bp, human
ggggcactgtgcgaagggtt

SEQ ID NO: 84075 - DNA, 20 bp, human
gtggcgtttcgggaagttag

SEQ ID NO: 84076 - DNA, 20 bp, human
gggtcctcggagacacgcgg

SEQ ID NO: 84077 - DNA, 20 bp, human
gcgcggtcctcggagacacg

SEQ ID NO: 84078 - DNA, 20 bp, human
gtatattggcgcggcccaga

SEQ ID NO: 84079 - DNA, 20 bp, human
gggacgtgcccccactaatc

SEQ ID NO: 84080 - DNA, 20 bp, human
gctcacctgggcgaagagag

SEQ ID NO: 84081 - DNA, 20 bp, human
gccgactacctgattagtgg

SEQ ID NO: 84082 - DNA, 20 bp, human
gtggggaaaaggccagatgg

SEQ ID NO: 84083 - DNA, 20 bp, human
gacctgggcgaagagagggg

SEQ ID NO: 84084 - DNA, 20 bp, human
gacgcggcggtgtcctgtgt

SEQ ID NO: 84085 - DNA, 20 bp, human
ggacagctcggtggcagaaa

SEQ ID NO: 84086 - DNA, 20 bp, human
gtcttggtttacctttatga

SEQ ID NO: 84087 - DNA, 20 bp, human
gtgattgaggataaccttct

SEQ ID NO: 84088 - DNA, 20 bp, human
gtcacgggctagtatatagt

SEQ ID NO: 84089 - DNA, 20 bp, human
gcagtgaagattaacaaaat

SEQ ID NO: 84090 - DNA, 20 bp, human
gaaggttatcctcaatcatc

SEQ ID NO: 84091 - DNA, 20 bp, human
gactagcccgtgagatcaat

SEQ ID NO: 84092 - DNA, 20 bp, human
gtaagcagagattacacctg

SEQ ID NO: 84093 - DNA, 20 bp, human
gaggctaccaattgatctca

SEQ ID NO: 84094 - DNA, 20 bp, human
gacctttggttccttgaact

SEQ ID NO: 84095 - DNA, 20 bp, human
ggatcaattggtagccttgt

SEQ ID NO: 84096 - DNA, 20 bp, human
gaaattagcggaaagaaaaa

SEQ ID NO: 84097 - DNA, 20 bp, human
ggagggaaaaccaaaattat

SEQ ID NO: 84098 - DNA, 20 bp, human
gtcatttgggccaaaaccaa

SEQ ID NO: 84099 - DNA, 20 bp, human
gaagtgagagctactttgaa

SEQ ID NO: 84100 - DNA, 20 bp, human
ggagaaatcttcccaaaaag

SEQ ID NO: 84101 - DNA, 20 bp, human
gatgtgattgctgtaagaaa

SEQ ID NO: 84102 - DNA, 20 bp, human
gaaccagaaattactaatga

SEQ ID NO: 84103 - DNA, 20 bp, human
gtctttccgctaatttataa

SEQ ID NO: 84104 - DNA, 20 bp, human
gaaaccaaaggaatgaggag

SEQ ID NO: 84105 - DNA, 20 bp, human
gggatttggacactcaatta

SEQ ID NO: 84106 - DNA, 20 bp, human
ggagctacagaagaaaggag

SEQ ID NO: 84107 - DNA, 20 bp, human
gaacaccttgcggtaggagg

SEQ ID NO: 84108 - DNA, 20 bp, human
ggggatcggggccggacgtg

SEQ ID NO: 84109 - DNA, 20 bp, human
gtgctccgagccgaagctca

SEQ ID NO: 84110 - DNA, 20 bp, human
gcgccaggtgcacgacgagg

SEQ ID NO: 84111 - DNA, 20 bp, human
ggtacgccaggtgcacgacg

SEQ ID NO: 84112 - DNA, 20 bp, human
gctggacctgagccaggcgg

SEQ ID NO: 84113 - DNA, 20 bp, human
gatcccggcaccatgagctt

SEQ ID NO: 84114 - DNA, 20 bp, human
gaggccgaggccgagcgacg

SEQ ID NO: 84115 - DNA, 20 bp, human
gcagctcggcctccaacgcg

SEQ ID NO: 84116 - DNA, 20 bp, human
gtctcacttccgcccaggtg

SEQ ID NO: 84117 - DNA, 20 bp, human
gggtgaggcgcggtcaccct

SEQ ID NO: 84118 - DNA, 20 bp, human
gtcgggcccgggtgacccca

SEQ ID NO: 84119 - DNA, 20 bp, human
gccgcccgcccgcctggagt

SEQ ID NO: 84120 - DNA, 20 bp, human
gggtcgggcgggctcggtgt

SEQ ID NO: 84121 - DNA, 20 bp, human
gcgccgcgcagggctcgccg

SEQ ID NO: 84122 - DNA, 20 bp, human
gccccgggcggggagagtcg

SEQ ID NO: 84123 - DNA, 20 bp, human
ggcggggcggggaccaccgt

SEQ ID NO: 84124 - DNA, 20 bp, human
gcagctctgggagcgaaaca

SEQ ID NO: 84125 - DNA, 20 bp, human
gggcccgggtgaccccacgg

SEQ ID NO: 84126 - DNA, 20 bp, human
gggacgccccgggtctgaga

SEQ ID NO: 84127 - DNA, 20 bp, human
gcgcggcgaattctagaact

SEQ ID NO: 84128 - DNA, 20 bp, human
gcaggtgctggggccaaatg

SEQ ID NO: 84129 - DNA, 20 bp, human
gagggaagcgccgggccgga

SEQ ID NO: 84130 - DNA, 20 bp, human
gggatgaggacccgagggtc

SEQ ID NO: 84131 - DNA, 20 bp, human
gacctcagggcccctctcga

SEQ ID NO: 84132 - DNA, 20 bp, human
ggaccctcgacaggtggacc

SEQ ID NO: 84133 - DNA, 20 bp, human
gagggtggatgaggacccga

SEQ ID NO: 84134 - DNA, 20 bp, human
gccggcgcttccctccagcg

SEQ ID NO: 84135 - DNA, 20 bp, human
gcgcccgagggcacgactgg

SEQ ID NO: 84136 - DNA, 20 bp, human
gcccggagccaagtgggtct

SEQ ID NO: 84137 - DNA, 20 bp, human
gggtccggagtcgacaggga

SEQ ID NO: 84138 - DNA, 20 bp, human
gccggtggtatccctaggta

SEQ ID NO: 84139 - DNA, 20 bp, human
gccgcacgggaggagcaacc

SEQ ID NO: 84140 - DNA, 20 bp, human
gccttcgggactcaccgcac

SEQ ID NO: 84141 - DNA, 20 bp, human
ggcaagcggggccttaccta

SEQ ID NO: 84142 - DNA, 20 bp, human
gcgaaggcccggagccaagt

SEQ ID NO: 84143 - DNA, 20 bp, human
gtcgggactcaccgcacggg

SEQ ID NO: 84144 - DNA, 20 bp, human
gcatatgcccaggtagccag

SEQ ID NO: 84145 - DNA, 20 bp, human
gcaagtccggtggtatccct

SEQ ID NO: 84146 - DNA, 20 bp, human
gtcggccgggcctactccca

SEQ ID NO: 84147 - DNA, 20 bp, human
ggcgctccgcaaggctcgga

SEQ ID NO: 84148 - DNA, 20 bp, human
gctccgcaaggctcggacgg

SEQ ID NO: 84149 - DNA, 20 bp, human
gtgaggcaacggccagaggg

SEQ ID NO: 84150 - DNA, 20 bp, human
gagtaggcccggccgaccct

SEQ ID NO: 84151 - DNA, 20 bp, human
gctgattcatggtcaggatg

SEQ ID NO: 84152 - DNA, 20 bp, human
gctgcccgcagcccctgacc

SEQ ID NO: 84153 - DNA, 20 bp, human
gtgcggccggcgctccgtcc

SEQ ID NO: 84154 - DNA, 20 bp, human
gagccaccgtccgagccttg

SEQ ID NO: 84155 - DNA, 20 bp, human
ggcgcgcactggccgcagag

SEQ ID NO: 84156 - DNA, 20 bp, human
gactgggctgggtagaagag

SEQ ID NO: 84157 - DNA, 20 bp, human
gtttccacgttggacaagtg

SEQ ID NO: 84158 - DNA, 20 bp, human
ggagccgcacttgtccaacg

SEQ ID NO: 84159 - DNA, 20 bp, human
gaggtggagctgctccccgt

SEQ ID NO: 84160 - DNA, 20 bp, human
gccgttggcaggactcaaca

SEQ ID NO: 84161 - DNA, 20 bp, human
ggcgcaggccccctctcagg

SEQ ID NO: 84162 - DNA, 20 bp, human
gcgagtcgccggggacctcc

SEQ ID NO: 84163 - DNA, 20 bp, human
gttggacaagtgcggctcgg

SEQ ID NO: 84164 - DNA, 20 bp, human
gagtgcggctcggcggccag

SEQ ID NO: 84165 - DNA, 20 bp, human
gggtccccggcgactcggcg

SEQ ID NO: 84166 - DNA, 20 bp, human
gtagcagtagcagtgatccc

SEQ ID NO: 84167 - DNA, 20 bp, human
gcgctccagtactcccgggg

SEQ ID NO: 84168 - DNA, 20 bp, human
gggctctccccagcaacgac

SEQ ID NO: 84169 - DNA, 20 bp, human
gcgtccacgagggggaccct

SEQ ID NO: 84170 - DNA, 20 bp, human
ggagccccagggtcacccca

SEQ ID NO: 84171 - DNA, 20 bp, human
gcttgcttcatgttcaccta

SEQ ID NO: 84172 - DNA, 20 bp, human
gccttccgtccggagcccca

SEQ ID NO: 84173 - DNA, 20 bp, human
gagcagtgatcccgggcctg

SEQ ID NO: 84174 - DNA, 20 bp, human
ggtccagacagcaaagttca

SEQ ID NO: 84175 - DNA, 20 bp, human
gtccgcgcccgaaagtggcc

SEQ ID NO: 84176 - DNA, 20 bp, human
ggcggccgtgccctctcgag

SEQ ID NO: 84177 - DNA, 20 bp, human
gaccccgcagccgctcgaga

SEQ ID NO: 84178 - DNA, 20 bp, human
gggaggactggagaccgggt

SEQ ID NO: 84179 - DNA, 20 bp, human
gtctgccgagcgggactggg

SEQ ID NO: 84180 - DNA, 20 bp, human
gcgctcggggagactgtcac

SEQ ID NO: 84181 - DNA, 20 bp, human
ggagactgtcacgggagaaa

SEQ ID NO: 84182 - DNA, 20 bp, human
ggtcccgctcggcagaccct

SEQ ID NO: 84183 - DNA, 20 bp, human
gtagcgggaggctctccgtg

SEQ ID NO: 84184 - DNA, 20 bp, human
ggcggatcggcaggatgtta

SEQ ID NO: 84185 - DNA, 20 bp, human
ggcaccgagggtctgccgag

SEQ ID NO: 84186 - DNA, 20 bp, human
gcggaggcgccatattggag

SEQ ID NO: 84187 - DNA, 20 bp, human
ggggcgggcaagagcgcgag

SEQ ID NO: 84188 - DNA, 20 bp, human
gagcggtcccgcagatccat

SEQ ID NO: 84189 - DNA, 20 bp, human
ggtcgagcgggtgctgctag

SEQ ID NO: 84190 - DNA, 20 bp, human
gtagagctgagggaacaagg

SEQ ID NO: 84191 - DNA, 20 bp, human
gattggaggggacaaaactc

SEQ ID NO: 84192 - DNA, 20 bp, human
ggagcgggtgctgctagcgg

SEQ ID NO: 84193 - DNA, 20 bp, human
gagcagcacccgctcgactc

SEQ ID NO: 84194 - DNA, 20 bp, human
gctgcaggtgcagagtaagt

SEQ ID NO: 84195 - DNA, 20 bp, human
gagggaacaagggggtccag

SEQ ID NO: 84196 - DNA, 20 bp, human
gcgctgatgggtgtagacga

SEQ ID NO: 84197 - DNA, 20 bp, human
gggatcgaggccccgctgat

SEQ ID NO: 84198 - DNA, 20 bp, human
gatgggtgtagacgagggag

SEQ ID NO: 84199 - DNA, 20 bp, human
gatggctgcggggatgtatt

SEQ ID NO: 84200 - DNA, 20 bp, human
gctcatggggttgagagtgg

SEQ ID NO: 84201 - DNA, 20 bp, human
gagtcacttccggggcggat

SEQ ID NO: 84202 - DNA, 20 bp, human
gcgcgttacagtcacttccg

SEQ ID NO: 84203 - DNA, 20 bp, human
ggttacagtcacttccgggg

SEQ ID NO: 84204 - DNA, 20 bp, human
gttgcttcgagatggctgcg

SEQ ID NO: 84205 - DNA, 20 bp, human
gagtgactgtaacgcgacag

SEQ ID NO: 84206 - DNA, 20 bp, human
gcggtcgccatcttcgtccg

SEQ ID NO: 84207 - DNA, 20 bp, human
gggcacggaggactccgcgt

SEQ ID NO: 84208 - DNA, 20 bp, human
ggcgcggccgcggacgaaga

SEQ ID NO: 84209 - DNA, 20 bp, human
gcagacgggacagggacggg

SEQ ID NO: 84210 - DNA, 20 bp, human
gagatagtgctccaagtaca

SEQ ID NO: 84211 - DNA, 20 bp, human
gcctgcagacgggacaggga

SEQ ID NO: 84212 - DNA, 20 bp, human
gtcctcctgcagacgggaca

SEQ ID NO: 84213 - DNA, 20 bp, human
gggggcgggacctaatatgt

SEQ ID NO: 84214 - DNA, 20 bp, human
ggacagtaagcgcgccccac

SEQ ID NO: 84215 - DNA, 20 bp, human
gcagaccccgagcgcggccg

SEQ ID NO: 84216 - DNA, 20 bp, human
gctgtgtgtgaagcccccca

SEQ ID NO: 84217 - DNA, 20 bp, human
gctcacctggccctgctagt

SEQ ID NO: 84218 - DNA, 20 bp, human
gtcccagccacaggtaacga

SEQ ID NO: 84219 - DNA, 20 bp, human
gcccccagggcatgtcttcg

SEQ ID NO: 84220 - DNA, 20 bp, human
gttgcaggccaggcggacct

SEQ ID NO: 84221 - DNA, 20 bp, human
gaccctggcagaaggggcac

SEQ ID NO: 84222 - DNA, 20 bp, human
ggggcagccgcctgactcca

SEQ ID NO: 84223 - DNA, 20 bp, human
gcagccacaggtaacgaggg

SEQ ID NO: 84224 - DNA, 20 bp, human
ggttccccactagcagggcc

SEQ ID NO: 84225 - DNA, 20 bp, human
gtgtgagttccccactagca

SEQ ID NO: 84226 - DNA, 20 bp, human
gagccggctggtggaagagt

SEQ ID NO: 84227 - DNA, 20 bp, human
gtgatacaagagccggctgg

SEQ ID NO: 84228 - DNA, 20 bp, human
gtaatggctctaaacaactc

SEQ ID NO: 84229 - DNA, 20 bp, human
gacatgatacaagagccggc

SEQ ID NO: 84230 - DNA, 20 bp, human
gtaccacatgatacaagagc

SEQ ID NO: 84231 - DNA, 20 bp, human
gtccccactcttccaccagc

SEQ ID NO: 84232 - DNA, 20 bp, human
gctgtctgagctcctcttca

SEQ ID NO: 84233 - DNA, 20 bp, human
gctgcctgaataatataaaa

SEQ ID NO: 84234 - DNA, 20 bp, human
gttcgcaaacagtaaattca

SEQ ID NO: 84235 - DNA, 20 bp, human
ggtacctttttatattattc

SEQ ID NO: 84236 - DNA, 20 bp, human
gccagcggcgcaccatggac

SEQ ID NO: 84237 - DNA, 20 bp, human
gcggcccccagcgcccgacc

SEQ ID NO: 84238 - DNA, 20 bp, human
gcgaccgggcagcccgtcca

SEQ ID NO: 84239 - DNA, 20 bp, human
gcgggcgccctcgtcgccag

SEQ ID NO: 84240 - DNA, 20 bp, human
gtggagatcccgcacctcga

SEQ ID NO: 84241 - DNA, 20 bp, human
gggtgcgccgctggcgacga

SEQ ID NO: 84242 - DNA, 20 bp, human
gaggagctcggccgagtgga

SEQ ID NO: 84243 - DNA, 20 bp, human
gcgcagggccgtgaccatgg

SEQ ID NO: 84244 - DNA, 20 bp, human
ggtcgtgcggcggcttccgg

SEQ ID NO: 84245 - DNA, 20 bp, human
ggactcggctcgcctcgcgg

SEQ ID NO: 84246 - DNA, 20 bp, human
ggcacttctagaggacaaca

SEQ ID NO: 84247 - DNA, 20 bp, human
gcttgagcaatacagactca

SEQ ID NO: 84248 - DNA, 20 bp, human
gcccctgtgggaccccgtgg

SEQ ID NO: 84249 - DNA, 20 bp, human
gtgtggtctcaactctgtcc

SEQ ID NO: 84250 - DNA, 20 bp, human
gcttgaggggtcaagttctg

SEQ ID NO: 84251 - DNA, 20 bp, human
gtggggaagagctacagatc

SEQ ID NO: 84252 - DNA, 20 bp, human
gaatacagactcagggctca

SEQ ID NO: 84253 - DNA, 20 bp, human
gctcctggctccaaccacag

SEQ ID NO: 84254 - DNA, 20 bp, human
gcacagggcggttcagtgtt

SEQ ID NO: 84255 - DNA, 20 bp, human
gagaaaggccagaagcaatg

SEQ ID NO: 84256 - DNA, 20 bp, human
gcaggcagctggctctaaag

SEQ ID NO: 84257 - DNA, 20 bp, human
gcaagcagcaaatcctggat

SEQ ID NO: 84258 - DNA, 20 bp, human
gtagccagacatgagctgtg

SEQ ID NO: 84259 - DNA, 20 bp, human
ggaccctcacagctcatgtc

SEQ ID NO: 84260 - DNA, 20 bp, human
gcactaggtttggaagaccc

SEQ ID NO: 84261 - DNA, 20 bp, human
gatgtctggctactgacctg

SEQ ID NO: 84262 - DNA, 20 bp, human
gacggagcaactgccatccg

SEQ ID NO: 84263 - DNA, 20 bp, human
gcctccggagactacagcca

SEQ ID NO: 84264 - DNA, 20 bp, human
gatccgaggctcctgaacca

SEQ ID NO: 84265 - DNA, 20 bp, human
gtattctgggacgactggtc

SEQ ID NO: 84266 - DNA, 20 bp, human
ggcaagaggagctcaactcg

SEQ ID NO: 84267 - DNA, 20 bp, human
gcgtacttacctgggacccg

SEQ ID NO: 84268 - DNA, 20 bp, human
ggagcccgggaaagacacaa

SEQ ID NO: 84269 - DNA, 20 bp, human
gtcccgggctccctagacta

SEQ ID NO: 84270 - DNA, 20 bp, human
gcaatcgctgctcttaaagg

SEQ ID NO: 84271 - DNA, 20 bp, human
ggccggctctgcacatccgt

SEQ ID NO: 84272 - DNA, 20 bp, human
gcctgtagcaacaaagacgg

SEQ ID NO: 84273 - DNA, 20 bp, human
ggcgcacgtcagtcaggagg

SEQ ID NO: 84274 - DNA, 20 bp, human
gcgagacgaaggaagcaagt

SEQ ID NO: 84275 - DNA, 20 bp, human
gaaagggggcgcgaccactt

SEQ ID NO: 84276 - DNA, 20 bp, human
gaagtagccaagtagtccct

SEQ ID NO: 84277 - DNA, 20 bp, human
gtgaagggtggcttcactgg

SEQ ID NO: 84278 - DNA, 20 bp, human
gggctaatggagagcagtgt

SEQ ID NO: 84279 - DNA, 20 bp, human
gccatgaagggtggcttcac

SEQ ID NO: 84280 - DNA, 20 bp, human
ggctccaccccaaagaccta

SEQ ID NO: 84281 - DNA, 20 bp, human
gagcccctaggtctttgggg

SEQ ID NO: 84282 - DNA, 20 bp, human
gtctccaaggaacctggatg

SEQ ID NO: 84283 - DNA, 20 bp, human
gttcctgcccagggactact

SEQ ID NO: 84284 - DNA, 20 bp, human
ggcagtgtgggaactgcacg

SEQ ID NO: 84285 - DNA, 20 bp, human
gcatttcagggacaccatga

SEQ ID NO: 84286 - DNA, 20 bp, human
gagccgcggttcgctctctg

SEQ ID NO: 84287 - DNA, 20 bp, human
gcgaaccgcggctccaccgt

SEQ ID NO: 84288 - DNA, 20 bp, human
gaggtgaggcaactagacgt

SEQ ID NO: 84289 - DNA, 20 bp, human
gaggagcggagcagggacac

SEQ ID NO: 84290 - DNA, 20 bp, human
gctctctgcgggcgacaact

SEQ ID NO: 84291 - DNA, 20 bp, human
ggccactttcactcactgag

SEQ ID NO: 84292 - DNA, 20 bp, human
gccgcagggttgggacctca

SEQ ID NO: 84293 - DNA, 20 bp, human
gggcctcagagagcgaaccg

SEQ ID NO: 84294 - DNA, 20 bp, human
gggcgacgagcagtgagtgt

SEQ ID NO: 84295 - DNA, 20 bp, human
gcgtgggcgggcgaacggag

SEQ ID NO: 84296 - DNA, 20 bp, human
gcggcgtgggagcacctctg

SEQ ID NO: 84297 - DNA, 20 bp, human
gagcacctctggggctatgg

SEQ ID NO: 84298 - DNA, 20 bp, human
gcccgccaggctcaactcca

SEQ ID NO: 84299 - DNA, 20 bp, human
gcctcatgagtaagctgtgg

SEQ ID NO: 84300 - DNA, 20 bp, human
ggagtaagctgtggcggcgt

SEQ ID NO: 84301 - DNA, 20 bp, human
gggaagggtgggatccagta

SEQ ID NO: 84302 - DNA, 20 bp, human
gggggcctccatagccccag

SEQ ID NO: 84303 - DNA, 20 bp, human
gccctctgggatcacagtga

SEQ ID NO: 84304 - DNA, 20 bp, human
gtcgcgcttacccggctcag

SEQ ID NO: 84305 - DNA, 20 bp, human
ggtagctacggagtaggagg

SEQ ID NO: 84306 - DNA, 20 bp, human
gaagactcggagtgcgatgg

SEQ ID NO: 84307 - DNA, 20 bp, human
gaagttccaaggcccgcgct

SEQ ID NO: 84308 - DNA, 20 bp, human
gcccgcgctgggaaaaaggt

SEQ ID NO: 84309 - DNA, 20 bp, human
gatcaagacggaagtaacag

SEQ ID NO: 84310 - DNA, 20 bp, human
ggacggaagtaacagcggaa

SEQ ID NO: 84311 - DNA, 20 bp, human
ggcgctgggaaaaaggtggg

SEQ ID NO: 84312 - DNA, 20 bp, human
gacctgcgcaaagctggaag

SEQ ID NO: 84313 - DNA, 20 bp, human
ggggaagactcggagtgcga

SEQ ID NO: 84314 - DNA, 20 bp, human
gaaggcccgcgctgggaaaa

SEQ ID NO: 84315 - DNA, 20 bp, human
gtgctaaaggcgacctcgag

SEQ ID NO: 84316 - DNA, 20 bp, human
gcctcctacagcaccactac

SEQ ID NO: 84317 - DNA, 20 bp, human
ggaggcgctggcaatggact

SEQ ID NO: 84318 - DNA, 20 bp, human
gccccgggcggagaatgaaa

SEQ ID NO: 84319 - DNA, 20 bp, human
gacatccccgggctcccgta

SEQ ID NO: 84320 - DNA, 20 bp, human
ggccggggctgtacaagaag

SEQ ID NO: 84321 - DNA, 20 bp, human
gcggcgagcgcgcttacgtg

SEQ ID NO: 84322 - DNA, 20 bp, human
gcccagccgagggaacaggg

SEQ ID NO: 84323 - DNA, 20 bp, human
ggcagctgaaaggtaagcag

SEQ ID NO: 84324 - DNA, 20 bp, human
gtccagccggagccggagtg

SEQ ID NO: 84325 - DNA, 20 bp, human
gcaggggggagcagtagcag

SEQ ID NO: 84326 - DNA, 20 bp, human
ggcggggcttgctgctgagg

SEQ ID NO: 84327 - DNA, 20 bp, human
gtcacccgtagcttcttccg

SEQ ID NO: 84328 - DNA, 20 bp, human
gtagcgggagggcagactct

SEQ ID NO: 84329 - DNA, 20 bp, human
gctcccgctaccccaagcag

SEQ ID NO: 84330 - DNA, 20 bp, human
ggactctgggcgccactccc

SEQ ID NO: 84331 - DNA, 20 bp, human
ggaggtgaggcacgttgcag

SEQ ID NO: 84332 - DNA, 20 bp, human
gccgccggcccgttcatgac

SEQ ID NO: 84333 - DNA, 20 bp, human
gggcacggcagccactgctt

SEQ ID NO: 84334 - DNA, 20 bp, human
gcagccactgcttggggtag

SEQ ID NO: 84335 - DNA, 20 bp, human
gtgaagggccccggaaccag

SEQ ID NO: 84336 - DNA, 20 bp, human
gagcccgggccccagatcca

SEQ ID NO: 84337 - DNA, 20 bp, human
gccctgtggtgggtgtcgta

SEQ ID NO: 84338 - DNA, 20 bp, human
gggtcccgcgggaaagccgg

SEQ ID NO: 84339 - DNA, 20 bp, human
gcggcgcggggaccctgtgg

SEQ ID NO: 84340 - DNA, 20 bp, human
ggactcacctacccgcggag

SEQ ID NO: 84341 - DNA, 20 bp, human
gaggcgcggccagaggacga

SEQ ID NO: 84342 - DNA, 20 bp, human
gcgtcgcggacgcccggctc

SEQ ID NO: 84343 - DNA, 20 bp, human
gccatcgactcacctacccg

SEQ ID NO: 84344 - DNA, 20 bp, human
gtccttacgacacccaccac

SEQ ID NO: 84345 - DNA, 20 bp, human
gcaaccccatcgggccgctc

SEQ ID NO: 84346 - DNA, 20 bp, human
gctgcgcccggcgtctagag

SEQ ID NO: 84347 - DNA, 20 bp, human
gcccacggagcccgacccgg

SEQ ID NO: 84348 - DNA, 20 bp, human
gcgcccggcgtctagagcgg

SEQ ID NO: 84349 - DNA, 20 bp, human
ggccagtggtccacctgcgg

SEQ ID NO: 84350 - DNA, 20 bp, human
ggtggaccactggcaccgtt

SEQ ID NO: 84351 - DNA, 20 bp, human
gcggcggctggctagggctg

SEQ ID NO: 84352 - DNA, 20 bp, human
gtggccgcgggacgcagacg

SEQ ID NO: 84353 - DNA, 20 bp, human
ggggcggccgcgtcttcacg

SEQ ID NO: 84354 - DNA, 20 bp, human
gggtcgggctccgtgggccg

SEQ ID NO: 84355 - DNA, 20 bp, human
gccagccctggagccgcatc

SEQ ID NO: 84356 - DNA, 20 bp, human
ggagagagagagattaatgt

SEQ ID NO: 84357 - DNA, 20 bp, human
ggcactgaaggaaatctcct

SEQ ID NO: 84358 - DNA, 20 bp, human
gtccagcaccgaaattgtgg

SEQ ID NO: 84359 - DNA, 20 bp, human
ggatccttgcatgctggcaa

SEQ ID NO: 84360 - DNA, 20 bp, human
gttctgtaaggtacttccaa

SEQ ID NO: 84361 - DNA, 20 bp, human
gaacttagctacagcactga

SEQ ID NO: 84362 - DNA, 20 bp, human
ggcttcttaatgacagagga

SEQ ID NO: 84363 - DNA, 20 bp, human
gaaactaacaccatatctca

SEQ ID NO: 84364 - DNA, 20 bp, human
gaggaaatctcctggggctc

SEQ ID NO: 84365 - DNA, 20 bp, human
gtaaaaccagcctgagcccc

SEQ ID NO: 84366 - DNA, 20 bp, human
gtctcagggacagcgcaggt

SEQ ID NO: 84367 - DNA, 20 bp, human
gaagcgaacgcaggaaagtc

SEQ ID NO: 84368 - DNA, 20 bp, human
gagagctcagagttccacgg

SEQ ID NO: 84369 - DNA, 20 bp, human
ggccagagctcagagttcca

SEQ ID NO: 84370 - DNA, 20 bp, human
gagcgtgtctgagagcgtgg

SEQ ID NO: 84371 - DNA, 20 bp, human
gcaccgagccctaggatccc

SEQ ID NO: 84372 - DNA, 20 bp, human
ggcaggttacagctcctcct

SEQ ID NO: 84373 - DNA, 20 bp, human
ggggtaattacctctcccgg

SEQ ID NO: 84374 - DNA, 20 bp, human
gaggtgggcgcagccttgga

SEQ ID NO: 84375 - DNA, 20 bp, human
gagggtaggcgcggtgacag

SEQ ID NO: 84376 - DNA, 20 bp, human
gctgcgcgcgggccgctgtg

SEQ ID NO: 84377 - DNA, 20 bp, human
gcctcagcctgagtcggcgg

SEQ ID NO: 84378 - DNA, 20 bp, human
gtcgccgccgcgcctcacag

SEQ ID NO: 84379 - DNA, 20 bp, human
gtgccctcagcctgagtcgg

SEQ ID NO: 84380 - DNA, 20 bp, human
gactttcccagcggatctaa

SEQ ID NO: 84381 - DNA, 20 bp, human
gtgctggtcacggccaacgt

SEQ ID NO: 84382 - DNA, 20 bp, human
gcgtgaacctccagacccag

SEQ ID NO: 84383 - DNA, 20 bp, human
gcttgcagttcgggaccccg

SEQ ID NO: 84384 - DNA, 20 bp, human
ggtacagggatcagagtctg

SEQ ID NO: 84385 - DNA, 20 bp, human
gcgcgggccgctgtgaggcg

SEQ ID NO: 84386 - DNA, 20 bp, human
gcctgtggtgacagctcagg

SEQ ID NO: 84387 - DNA, 20 bp, human
gtggtgacagctcaggaggt

SEQ ID NO: 84388 - DNA, 20 bp, human
ggtcactgtcccggaacctg

SEQ ID NO: 84389 - DNA, 20 bp, human
gctgtcaccacagggcgcac

SEQ ID NO: 84390 - DNA, 20 bp, human
gggaggtaggtgacaatgtc

SEQ ID NO: 84391 - DNA, 20 bp, human
gtggatgccctcccagacaa

SEQ ID NO: 84392 - DNA, 20 bp, human
gtgacaatgtcagggagctg

SEQ ID NO: 84393 - DNA, 20 bp, human
gagaggaagagccatgtcct

SEQ ID NO: 84394 - DNA, 20 bp, human
gcagcccctgcgccacatgg

SEQ ID NO: 84395 - DNA, 20 bp, human
gtctatccttgttggaagtg

SEQ ID NO: 84396 - DNA, 20 bp, human
gcaaaggaagactctatcgt

SEQ ID NO: 84397 - DNA, 20 bp, human
gaggcgtgcgtgacgagggt

SEQ ID NO: 84398 - DNA, 20 bp, human
ggcggagcgcgcgggacggg

SEQ ID NO: 84399 - DNA, 20 bp, human
ggtgttgcgctcccgagagc

SEQ ID NO: 84400 - DNA, 20 bp, human
gcggcgggatgaggagcttg

SEQ ID NO: 84401 - DNA, 20 bp, human
ggagcgcaacactgcaggtt

SEQ ID NO: 84402 - DNA, 20 bp, human
ggtgcgcccggccctcgggt

SEQ ID NO: 84403 - DNA, 20 bp, human
gctctggaggctgggacact

SEQ ID NO: 84404 - DNA, 20 bp, human
ggcaacactgcaggttcggc

SEQ ID NO: 84405 - DNA, 20 bp, human
gacactgcaggttcggcggg

SEQ ID NO: 84406 - DNA, 20 bp, human
ggccaccaagaggcaacggg

SEQ ID NO: 84407 - DNA, 20 bp, human
gagcagccgaggccaccaag

SEQ ID NO: 84408 - DNA, 20 bp, human
gacaccaccgaggggagcgg

SEQ ID NO: 84409 - DNA, 20 bp, human
gcgaggccaccaagaggcaa

SEQ ID NO: 84410 - DNA, 20 bp, human
gagtcagtcagttaagctgg

SEQ ID NO: 84411 - DNA, 20 bp, human
gtccagcaggggaccatggt

SEQ ID NO: 84412 - DNA, 20 bp, human
ggacaaggtccatgacaggg

SEQ ID NO: 84413 - DNA, 20 bp, human
gcaggacccacacaccaccg

SEQ ID NO: 84414 - DNA, 20 bp, human
ggggcctccgctcccctcgg

SEQ ID NO: 84415 - DNA, 20 bp, human
gaaggacaaggtccatgaca

SEQ ID NO: 84416 - DNA, 20 bp, human
ggtcgacccggtactcgcgg

SEQ ID NO: 84417 - DNA, 20 bp, human
ggaagtcgacccggtactcg

SEQ ID NO: 84418 - DNA, 20 bp, human
ggccgggcctccgcgagtac

SEQ ID NO: 84419 - DNA, 20 bp, human
ggcatggacggtctctcccg

SEQ ID NO: 84420 - DNA, 20 bp, human
ggcagactccgaagtcgacc

SEQ ID NO: 84421 - DNA, 20 bp, human
ggtccaaggcggagaatctg

SEQ ID NO: 84422 - DNA, 20 bp, human
gccgccttggacggcatgga

SEQ ID NO: 84423 - DNA, 20 bp, human
gagcgccgggaagctgtcct

SEQ ID NO: 84424 - DNA, 20 bp, human
gctgcggaccgccctgggaa

SEQ ID NO: 84425 - DNA, 20 bp, human
gagaccgtccatgccgtcca

SEQ ID NO: 84426 - DNA, 20 bp, human
ggaaccgcgccgagaagcag

SEQ ID NO: 84427 - DNA, 20 bp, human
gggagaacgcgccccggcag

SEQ ID NO: 84428 - DNA, 20 bp, human
gcggcagagggaacgccccg

SEQ ID NO: 84429 - DNA, 20 bp, human
gacgccccggggcacccgac

SEQ ID NO: 84430 - DNA, 20 bp, human
gcccggggcacccgaccggt

SEQ ID NO: 84431 - DNA, 20 bp, human
ggggcgcgttctcctcctac

SEQ ID NO: 84432 - DNA, 20 bp, human
ggcctcaccaggcccgcagg

SEQ ID NO: 84433 - DNA, 20 bp, human
ggctgtctcggagaaaggcc

SEQ ID NO: 84434 - DNA, 20 bp, human
gcctgggccccaagccccaa

SEQ ID NO: 84435 - DNA, 20 bp, human
ggcgttctcctcctaccggt

SEQ ID NO: 84436 - DNA, 20 bp, human
gcagtccaggactctcccaa

SEQ ID NO: 84437 - DNA, 20 bp, human
gccctcagtcaggagcacca

SEQ ID NO: 84438 - DNA, 20 bp, human
ggagccaatgcaaaatgagg

SEQ ID NO: 84439 - DNA, 20 bp, human
gcatcactggttcccgggag

SEQ ID NO: 84440 - DNA, 20 bp, human
gcagggatcaggaaagcggg

SEQ ID NO: 84441 - DNA, 20 bp, human
ggcaaaggtggagcacagct

SEQ ID NO: 84442 - DNA, 20 bp, human
gaagggagtccaggctgccg

SEQ ID NO: 84443 - DNA, 20 bp, human
ggagcctgcagtgtatgtgg

SEQ ID NO: 84444 - DNA, 20 bp, human
gggacctgggccaggcagat

SEQ ID NO: 84445 - DNA, 20 bp, human
gggggggcactgggtctcag

SEQ ID NO: 84446 - DNA, 20 bp, human
ggagagcgcctctgaaccaa

SEQ ID NO: 84447 - DNA, 20 bp, human
gacagctaggcgcgtgagac

SEQ ID NO: 84448 - DNA, 20 bp, human
gctggagaggacagccgtgt

SEQ ID NO: 84449 - DNA, 20 bp, human
ggtgagaccggccgcccgca

SEQ ID NO: 84450 - DNA, 20 bp, human
gtaacgaggccgtcaccctt

SEQ ID NO: 84451 - DNA, 20 bp, human
gaccgagagccgaagggtga

SEQ ID NO: 84452 - DNA, 20 bp, human
gtcgtccccgcgcggtggtc

SEQ ID NO: 84453 - DNA, 20 bp, human
ggcccacctgacacaggcgt

SEQ ID NO: 84454 - DNA, 20 bp, human
gctcacgcgcctagctgtcg

SEQ ID NO: 84455 - DNA, 20 bp, human
gtgctctggccgggacccgc

SEQ ID NO: 84456 - DNA, 20 bp, human
ggcccgggcttgaggatccg

SEQ ID NO: 84457 - DNA, 20 bp, human
gggcttgaggatccgtgggc

SEQ ID NO: 84458 - DNA, 20 bp, human
gcgcccccttccccggacag

SEQ ID NO: 84459 - DNA, 20 bp, human
gacggttcccgtggagttgg

SEQ ID NO: 84460 - DNA, 20 bp, human
gggcggctgcgcggtgaacg

SEQ ID NO: 84461 - DNA, 20 bp, human
gtcgcggtggtaccaggagg

SEQ ID NO: 84462 - DNA, 20 bp, human
gggctgcgcggtgaacgagg

SEQ ID NO: 84463 - DNA, 20 bp, human
gggagggaagaggatgggta

SEQ ID NO: 84464 - DNA, 20 bp, human
gctcctcgggtgaatgatgg

SEQ ID NO: 84465 - DNA, 20 bp, human
gcgcggatggccatcttaag

SEQ ID NO: 84466 - DNA, 20 bp, human
gtggcgctcccacccagcat

SEQ ID NO: 84467 - DNA, 20 bp, human
gggacaggctgcatcagaag

SEQ ID NO: 84468 - DNA, 20 bp, human
gacacccaagacccgccggg

SEQ ID NO: 84469 - DNA, 20 bp, human
gtgggctcaggattccaggg

SEQ ID NO: 84470 - DNA, 20 bp, human
ggtgtgagccgcacaggtgt

SEQ ID NO: 84471 - DNA, 20 bp, human
gacctagtgtgcggggaacg

SEQ ID NO: 84472 - DNA, 20 bp, human
gccgagatacatcagagggt

SEQ ID NO: 84473 - DNA, 20 bp, human
gatctgcggtcatcaaatga

SEQ ID NO: 84474 - DNA, 20 bp, human
gggcagaaggacagtgatct

SEQ ID NO: 84475 - DNA, 20 bp, human
gcgggaggcagaggacctgc

SEQ ID NO: 84476 - DNA, 20 bp, human
gtggcgctcccacccagcat

SEQ ID NO: 84477 - DNA, 20 bp, human
gggacaggctgcatcagaag

SEQ ID NO: 84478 - DNA, 20 bp, human
gacacccaagacccgccggg

SEQ ID NO: 84479 - DNA, 20 bp, human
gtgggctcaggattccaggg

SEQ ID NO: 84480 - DNA, 20 bp, human
gggcagaaggacagtgatct

SEQ ID NO: 84481 - DNA, 20 bp, human
ggggcggccaggggcagcaa

SEQ ID NO: 84482 - DNA, 20 bp, human
gcgggaggcagaggacctgc

SEQ ID NO: 84483 - DNA, 20 bp, human
gaagggcctttgcgtcaggt

SEQ ID NO: 84484 - DNA, 20 bp, human
gacctagtgtgcggggaacg

SEQ ID NO: 84485 - DNA, 20 bp, human
gaagacccgccgggaggcag

SEQ ID NO: 84486 - DNA, 20 bp, human
gctcgcacgggtagagacag

SEQ ID NO: 84487 - DNA, 20 bp, human
gcggacactggccccggaag

SEQ ID NO: 84488 - DNA, 20 bp, human
gggctgggtgttcccatgga

SEQ ID NO: 84489 - DNA, 20 bp, human
gatcggcagcagccgtccat

SEQ ID NO: 84490 - DNA, 20 bp, human
gctcaggtcagaggtccccc

SEQ ID NO: 84491 - DNA, 20 bp, human
gacactggccccggaagagg

SEQ ID NO: 84492 - DNA, 20 bp, human
gcagccggccccactcgcac

SEQ ID NO: 84493 - DNA, 20 bp, human
ggcggccttgccctctcctg

SEQ ID NO: 84494 - DNA, 20 bp, human
gtcctgaggcctcaggtcag

SEQ ID NO: 84495 - DNA, 20 bp, human
gcgggtggacggccggacac

SEQ ID NO: 84496 - DNA, 20 bp, human
gtagtgcgagcggccagtgg

SEQ ID NO: 84497 - DNA, 20 bp, human
ggacaggctggtagtgcgag

SEQ ID NO: 84498 - DNA, 20 bp, human
gagctgcgccccgccaccac

SEQ ID NO: 84499 - DNA, 20 bp, human
ggccccctgaatccagctag

SEQ ID NO: 84500 - DNA, 20 bp, human
gtggtagtgcgagcggccag

SEQ ID NO: 84501 - DNA, 20 bp, human
gggagcttgcgccagtgtga

SEQ ID NO: 84502 - DNA, 20 bp, human
gccagaggccgcgcgcaaag

SEQ ID NO: 84503 - DNA, 20 bp, human
gcactcatccacatgtggac

SEQ ID NO: 84504 - DNA, 20 bp, human
gcttacttagcgtgcgagac

SEQ ID NO: 84505 - DNA, 20 bp, human
gttcccaactaggctagcag

SEQ ID NO: 84506 - DNA, 20 bp, human
gagcagccggtcctccccgg

SEQ ID NO: 84507 - DNA, 20 bp, human
gtacgcggccggctgggata

SEQ ID NO: 84508 - DNA, 20 bp, human
gccgccggctctccgaacgg

SEQ ID NO: 84509 - DNA, 20 bp, human
gcgcccgccggctctccgaa

SEQ ID NO: 84510 - DNA, 20 bp, human
gcagcagggagggacccacc

SEQ ID NO: 84511 - DNA, 20 bp, human
gagaagtggtcgtgcaatct

SEQ ID NO: 84512 - DNA, 20 bp, human
gggctctccgaacggaggcg

SEQ ID NO: 84513 - DNA, 20 bp, human
gtggcgcgggatgacagctg

SEQ ID NO: 84514 - DNA, 20 bp, human
gtccccaggcggccaatccg

SEQ ID NO: 84515 - DNA, 20 bp, human
gagcagggagggcccggaca

SEQ ID NO: 84516 - DNA, 20 bp, human
ggaggcggtagggggtacgg

SEQ ID NO: 84517 - DNA, 20 bp, human
gaggaggaagaggcggtagg

SEQ ID NO: 84518 - DNA, 20 bp, human
gggctggaggacggcgagaa

SEQ ID NO: 84519 - DNA, 20 bp, human
gtgcagcctgggaaccctgg

SEQ ID NO: 84520 - DNA, 20 bp, human
gggagagaagactcagactt

SEQ ID NO: 84521 - DNA, 20 bp, human
ggaagaggcggtagggggta

SEQ ID NO: 84522 - DNA, 20 bp, human
gcgggaagaaggctggagga

SEQ ID NO: 84523 - DNA, 20 bp, human
ggggagccaggaccactgat

SEQ ID NO: 84524 - DNA, 20 bp, human
gggctccgcttacctgagag

SEQ ID NO: 84525 - DNA, 20 bp, human
gtcccagaagatggcggagg

SEQ ID NO: 84526 - DNA, 20 bp, human
ggggcccaacgcgaacacca

SEQ ID NO: 84527 - DNA, 20 bp, human
gggcagacgggggtccatgg

SEQ ID NO: 84528 - DNA, 20 bp, human
gcaacgcgaacaccagggca

SEQ ID NO: 84529 - DNA, 20 bp, human
ggacccccgtctgcccgcct

SEQ ID NO: 84530 - DNA, 20 bp, human
ggcgcccaggcgggcagacg

SEQ ID NO: 84531 - DNA, 20 bp, human
gtgcacacgtgcagggaggt

SEQ ID NO: 84532 - DNA, 20 bp, human
gggctgcgtgcacagatcgt

SEQ ID NO: 84533 - DNA, 20 bp, human
gtagcgcgcgtacgaagtgg

SEQ ID NO: 84534 - DNA, 20 bp, human
ggcgggcagacgggggtcca

SEQ ID NO: 84535 - DNA, 20 bp, human
gaggtggggcaggtgcacgt

SEQ ID NO: 84536 - DNA, 20 bp, human
ggcagcaagtctctaaagaa

SEQ ID NO: 84537 - DNA, 20 bp, human
ggtcaactcagactctactg

SEQ ID NO: 84538 - DNA, 20 bp, human
ggtagcctaccagactgtgc

SEQ ID NO: 84539 - DNA, 20 bp, human
gggctgagaacacccagaac

SEQ ID NO: 84540 - DNA, 20 bp, human
gacaggcagtcaatgagatc

SEQ ID NO: 84541 - DNA, 20 bp, human
gtagagtctgagttgactac

SEQ ID NO: 84542 - DNA, 20 bp, human
ggtgctggtgtgtcccttct

SEQ ID NO: 84543 - DNA, 20 bp, human
gtgaaaaaccacaaacttgt

SEQ ID NO: 84544 - DNA, 20 bp, human
ggattgctggcagataggac

SEQ ID NO: 84545 - DNA, 20 bp, human
gtggcagataggaccggaac

SEQ ID NO: 84546 - DNA, 20 bp, human
gagcaggggactaaaaaatg

SEQ ID NO: 84547 - DNA, 20 bp, human
gacatgtgaaaggaaaatag

SEQ ID NO: 84548 - DNA, 20 bp, human
gtatctgtgctagctccagg

SEQ ID NO: 84549 - DNA, 20 bp, human
gctgtgggctagaatacata

SEQ ID NO: 84550 - DNA, 20 bp, human
gtccaggtggagaaggcatc

SEQ ID NO: 84551 - DNA, 20 bp, human
gcacttctgagatggcaaat

SEQ ID NO: 84552 - DNA, 20 bp, human
ggattaaatgatttcaagca

SEQ ID NO: 84553 - DNA, 20 bp, human
gatcgcatgactacttcaat

SEQ ID NO: 84554 - DNA, 20 bp, human
gctatatctgtgctagctcc

SEQ ID NO: 84555 - DNA, 20 bp, human
gatctcagaagtgcggagca

SEQ ID NO: 84556 - DNA, 20 bp, human
gaacgcggaggactagcctg

SEQ ID NO: 84557 - DNA, 20 bp, human
gccgccattgcacaacgcgg

SEQ ID NO: 84558 - DNA, 20 bp, human
gtggggtcacagggatgccg

SEQ ID NO: 84559 - DNA, 20 bp, human
gaggagtccaagccacagca

SEQ ID NO: 84560 - DNA, 20 bp, human
gcgaccgccattgcacaacg

SEQ ID NO: 84561 - DNA, 20 bp, human
ggcacaaattccacttcctg

SEQ ID NO: 84562 - DNA, 20 bp, human
ggcagtgccaggaagctgtg

SEQ ID NO: 84563 - DNA, 20 bp, human
gtaggcttcgaccttctccg

SEQ ID NO: 84564 - DNA, 20 bp, human
gcttctggcagagcaaatgc

SEQ ID NO: 84565 - DNA, 20 bp, human
gattgcacaggcctcggaga

SEQ ID NO: 84566 - DNA, 20 bp, human
ggccgcgtgggactgtagag

SEQ ID NO: 84567 - DNA, 20 bp, human
ggcgcacttcggcaaccccg

SEQ ID NO: 84568 - DNA, 20 bp, human
ggcgtgcagggcgcagagct

SEQ ID NO: 84569 - DNA, 20 bp, human
gactcgcgtggcgccggcga

SEQ ID NO: 84570 - DNA, 20 bp, human
gccaggcgcgcaggcaagcg

SEQ ID NO: 84571 - DNA, 20 bp, human
gagctgggccgagccgtcgc

SEQ ID NO: 84572 - DNA, 20 bp, human
gggacagggacgcgcgtgca

SEQ ID NO: 84573 - DNA, 20 bp, human
gtcgccgccgcggacccggt

SEQ ID NO: 84574 - DNA, 20 bp, human
gccgcggacccggtaggaaa

SEQ ID NO: 84575 - DNA, 20 bp, human
ggtgcggcagatgtacctga

SEQ ID NO: 84576 - DNA, 20 bp, human
ggagagcgctctgggacaag

SEQ ID NO: 84577 - DNA, 20 bp, human
ggctctgggacaagaggaaa

SEQ ID NO: 84578 - DNA, 20 bp, human
ggagcctcctccaagaaggg

SEQ ID NO: 84579 - DNA, 20 bp, human
gagccccggcatgacagccg

SEQ ID NO: 84580 - DNA, 20 bp, human
gtgccggcttcgctggactg

SEQ ID NO: 84581 - DNA, 20 bp, human
ggcttcaccaggaatcccct

SEQ ID NO: 84582 - DNA, 20 bp, human
gggtggagtcgagagcgctc

SEQ ID NO: 84583 - DNA, 20 bp, human
gggcggagacgggcgagctg

SEQ ID NO: 84584 - DNA, 20 bp, human
gggaaagactcggcggagac

SEQ ID NO: 84585 - DNA, 20 bp, human
gggcggcccgggaacagtcg

SEQ ID NO: 84586 - DNA, 20 bp, human
ggggcgggcggcgggagaga

SEQ ID NO: 84587 - DNA, 20 bp, human
gcgacggactagctgactgg

SEQ ID NO: 84588 - DNA, 20 bp, human
gagagggacgcgcggaccga

SEQ ID NO: 84589 - DNA, 20 bp, human
gtccgaggcggccacccaag

SEQ ID NO: 84590 - DNA, 20 bp, human
ggaccgacggactagctgac

SEQ ID NO: 84591 - DNA, 20 bp, human
gctgcgggctccgggacaga

SEQ ID NO: 84592 - DNA, 20 bp, human
ggcgggagagagggctgctc

SEQ ID NO: 84593 - DNA, 20 bp, human
gcgccgcgcgctctgatccg

SEQ ID NO: 84594 - DNA, 20 bp, human
ggccagctacaaatactgag

SEQ ID NO: 84595 - DNA, 20 bp, human
gcgggagcgcggggtctcct

SEQ ID NO: 84596 - DNA, 20 bp, human
gtccgcagggagagtctccc

SEQ ID NO: 84597 - DNA, 20 bp, human
gtctccccagagtcaccggg

SEQ ID NO: 84598 - DNA, 20 bp, human
ggagtctccctggatccctc

SEQ ID NO: 84599 - DNA, 20 bp, human
gtggggaccgctcccaagga

SEQ ID NO: 84600 - DNA, 20 bp, human
ggggcgcgtgggactccgca

SEQ ID NO: 84601 - DNA, 20 bp, human
gctggctgcggtccttccca

SEQ ID NO: 84602 - DNA, 20 bp, human
gacggtgtgataagccctaa

SEQ ID NO: 84603 - DNA, 20 bp, human
gtccagggagactctccctg

SEQ ID NO: 84604 - DNA, 20 bp, human
gcagagaccagggttcagat

SEQ ID NO: 84605 - DNA, 20 bp, human
ggcactgtcagctggcgctg

SEQ ID NO: 84606 - DNA, 20 bp, human
gtgaggaagcgcccaggccg

SEQ ID NO: 84607 - DNA, 20 bp, human
gtccggtcgcgatgggccag

SEQ ID NO: 84608 - DNA, 20 bp, human
ggccagaggtaagtgagccg

SEQ ID NO: 84609 - DNA, 20 bp, human
ggccgcggctcacttacctc

SEQ ID NO: 84610 - DNA, 20 bp, human
gaggagggagacgcacctga

SEQ ID NO: 84611 - DNA, 20 bp, human
gtgggccggcgcaccgtggt

SEQ ID NO: 84612 - DNA, 20 bp, human
gacctctggcccatcgcgac

SEQ ID NO: 84613 - DNA, 20 bp, human
gcggcaatgaggaagcgccc

SEQ ID NO: 84614 - DNA, 20 bp, human
ggcgccgcggccaaaccctc

SEQ ID NO: 84615 - DNA, 20 bp, human
ggcggcgctccggtcgcgat

SEQ ID NO: 84616 - DNA, 20 bp, human
gtctggactctcagccgcca

SEQ ID NO: 84617 - DNA, 20 bp, human
gtgcgcagtagcctcccccg

SEQ ID NO: 84618 - DNA, 20 bp, human
gccgaagcggccggaacgtc

SEQ ID NO: 84619 - DNA, 20 bp, human
gtaggagcaaggtgtaggat

SEQ ID NO: 84620 - DNA, 20 bp, human
gggctactgcgcatgtctgg

SEQ ID NO: 84621 - DNA, 20 bp, human
gacggcccgcagcctctacc

SEQ ID NO: 84622 - DNA, 20 bp, human
gggaaggtgtaggagcaagg

SEQ ID NO: 84623 - DNA, 20 bp, human
gtaggagcaaggcgggtgaa

SEQ ID NO: 84624 - DNA, 20 bp, human
gtccagccgccagcccgaag

SEQ ID NO: 84625 - DNA, 20 bp, human
gagcaaggtgtaggatggga

SEQ ID NO: 84626 - DNA, 20 bp, human
gacagacggatcggcagggc

SEQ ID NO: 84627 - DNA, 20 bp, human
gctgttcccggtggtccctt

SEQ ID NO: 84628 - DNA, 20 bp, human
gccaccgggaacagacggat

SEQ ID NO: 84629 - DNA, 20 bp, human
gcggcccgcaactccctcgg

SEQ ID NO: 84630 - DNA, 20 bp, human
gccgtttccgaagggaccac

SEQ ID NO: 84631 - DNA, 20 bp, human
ggggaacagacggatcggca

SEQ ID NO: 84632 - DNA, 20 bp, human
gcatcgaagtcctagaatgg

SEQ ID NO: 84633 - DNA, 20 bp, human
gtcccggcccgcaactccct

SEQ ID NO: 84634 - DNA, 20 bp, human
gggggtctcgagcctccagg

SEQ ID NO: 84635 - DNA, 20 bp, human
gtccgaaagcaggaaaacaa

SEQ ID NO: 84636 - DNA, 20 bp, human
gcgacgggagtcagacgctg

SEQ ID NO: 84637 - DNA, 20 bp, human
gagacgctggggatgaatga

SEQ ID NO: 84638 - DNA, 20 bp, human
gaaggcagaaccgggactgt

SEQ ID NO: 84639 - DNA, 20 bp, human
gtcgactcgaggcacaacta

SEQ ID NO: 84640 - DNA, 20 bp, human
gcgtactggtctgagaggaa

SEQ ID NO: 84641 - DNA, 20 bp, human
gctcccgtcggccaccgtac

SEQ ID NO: 84642 - DNA, 20 bp, human
gtggtgtccgagtcgactcg

SEQ ID NO: 84643 - DNA, 20 bp, human
gactgtaggaacggaaaagc

SEQ ID NO: 84644 - DNA, 20 bp, human
gcggaggagcacgcaggtct

SEQ ID NO: 84645 - DNA, 20 bp, human
ggtctggccaggctccgaca

SEQ ID NO: 84646 - DNA, 20 bp, human
gaataagcgctatgggagga

SEQ ID NO: 84647 - DNA, 20 bp, human
ggtgaggcaataagcgctat

SEQ ID NO: 84648 - DNA, 20 bp, human
gccccagagtcaggacccag

SEQ ID NO: 84649 - DNA, 20 bp, human
gagcggccatagtggaaggg

SEQ ID NO: 84650 - DNA, 20 bp, human
gcacacagaagcggccatag

SEQ ID NO: 84651 - DNA, 20 bp, human
gaggcaataagcgctatggg

SEQ ID NO: 84652 - DNA, 20 bp, human
gagaagcggccatagtggaa

SEQ ID NO: 84653 - DNA, 20 bp, human
ggagcgtctgaccctaagaa

SEQ ID NO: 84654 - DNA, 20 bp, human
gttagggtccacttcttcag

SEQ ID NO: 84655 - DNA, 20 bp, human
ggtgtccctatgggaagggt

SEQ ID NO: 84656 - DNA, 20 bp, human
gggcggcgcaccttaagaag

SEQ ID NO: 84657 - DNA, 20 bp, human
ggagggcccgcgggtaggca

SEQ ID NO: 84658 - DNA, 20 bp, human
ggctgagagggcccgcgggt

SEQ ID NO: 84659 - DNA, 20 bp, human
gccgcctccctcctagtgta

SEQ ID NO: 84660 - DNA, 20 bp, human
ggacattgagccttccggag

SEQ ID NO: 84661 - DNA, 20 bp, human
ggcgccgccatgcctacccg

SEQ ID NO: 84662 - DNA, 20 bp, human
gtagtgtacggaagctgaga

SEQ ID NO: 84663 - DNA, 20 bp, human
gcagcttccgtacactagga

SEQ ID NO: 84664 - DNA, 20 bp, human
gggtgcggggaggctagaag

SEQ ID NO: 84665 - DNA, 20 bp, human
gcggaagctgagagggcccg

SEQ ID NO: 84666 - DNA, 20 bp, human
gccgcgctgtgcgaccctcc

SEQ ID NO: 84667 - DNA, 20 bp, human
gtcgcacagcgcggacatcc

SEQ ID NO: 84668 - DNA, 20 bp, human
gctagggtcaaaaatggcca

SEQ ID NO: 84669 - DNA, 20 bp, human
gcaggacactgggtttccta

SEQ ID NO: 84670 - DNA, 20 bp, human
gtaccgagaaggctagggat

SEQ ID NO: 84671 - DNA, 20 bp, human
gacctcgagaactcacgtca

SEQ ID NO: 84672 - DNA, 20 bp, human
gttcctctcccaagagtcgg

SEQ ID NO: 84673 - DNA, 20 bp, human
gctgagaggcgcgggaccgt

SEQ ID NO: 84674 - DNA, 20 bp, human
gtacccccgactcttgggag

SEQ ID NO: 84675 - DNA, 20 bp, human
gcgggggtatctgaactctt

SEQ ID NO: 84676 - DNA, 20 bp, human
ggggtacgacggggagcact

SEQ ID NO: 84677 - DNA, 20 bp, human
gcggaggcgggggtacgacg

SEQ ID NO: 84678 - DNA, 20 bp, human
gcgcagggaagagacctcag

SEQ ID NO: 84679 - DNA, 20 bp, human
ggactccctccgcaccccgg

SEQ ID NO: 84680 - DNA, 20 bp, human
gagcgcttcagtagcgagag

SEQ ID NO: 84681 - DNA, 20 bp, human
gggacgaaccgacagacaga

SEQ ID NO: 84682 - DNA, 20 bp, human
gctatcaggaacagtaagat

SEQ ID NO: 84683 - DNA, 20 bp, human
gagctggcgaagaggggagt

SEQ ID NO: 84684 - DNA, 20 bp, human
ggaaagtggtgacaccgccg

SEQ ID NO: 84685 - DNA, 20 bp, human
ggctcccccgccccgcgtag

SEQ ID NO: 84686 - DNA, 20 bp, human
gaaaaccagcaagaaggcgg

SEQ ID NO: 84687 - DNA, 20 bp, human
gagtagcgagctctagtgag

SEQ ID NO: 84688 - DNA, 20 bp, human
gccagggcgcatgcgtaaca

SEQ ID NO: 84689 - DNA, 20 bp, human
gtcactgcttagaaaatcgg

SEQ ID NO: 84690 - DNA, 20 bp, human
gtccctcaagtggtcaaaac

SEQ ID NO: 84691 - DNA, 20 bp, human
ggggggaagatggcggtcct

SEQ ID NO: 84692 - DNA, 20 bp, human
gtcgaaagagagggctgaat

SEQ ID NO: 84693 - DNA, 20 bp, human
gaacagggcttgacagcgcg

SEQ ID NO: 84694 - DNA, 20 bp, human
gcccttatggaattggacaa

SEQ ID NO: 84695 - DNA, 20 bp, human
gagcttgcaaactctacccc

SEQ ID NO: 84696 - DNA, 20 bp, human
gcgcgggccagccggagctg

SEQ ID NO: 84697 - DNA, 20 bp, human
gggccaccctccgaacgtcc

SEQ ID NO: 84698 - DNA, 20 bp, human
ggcctggggtatgcggaacc

SEQ ID NO: 84699 - DNA, 20 bp, human
ggagtttccgggacgttcgg

SEQ ID NO: 84700 - DNA, 20 bp, human
gggggtatgcggaacccggt

SEQ ID NO: 84701 - DNA, 20 bp, human
gaccaagccctcccctccgg

SEQ ID NO: 84702 - DNA, 20 bp, human
gcggcccgcatccaagtgtc

SEQ ID NO: 84703 - DNA, 20 bp, human
gccggctccaacctgacact

SEQ ID NO: 84704 - DNA, 20 bp, human
gtcccttaaacatgcccggg

SEQ ID NO: 84705 - DNA, 20 bp, human
ggcagcttcggtgaccgaga

SEQ ID NO: 84706 - DNA, 20 bp, human
gcccacgtgagggttataat

SEQ ID NO: 84707 - DNA, 20 bp, human
ggcaccggaagacgcttcct

SEQ ID NO: 84708 - DNA, 20 bp, human
ggtcccgcgatgctctcggc

SEQ ID NO: 84709 - DNA, 20 bp, human
gtaaccctcacgtgggaacc

SEQ ID NO: 84710 - DNA, 20 bp, human
ggtggagagggaggatgcat

SEQ ID NO: 84711 - DNA, 20 bp, human
gcgtcctggttcccacgtga

SEQ ID NO: 84712 - DNA, 20 bp, human
gcagagcccacagagttcat

SEQ ID NO: 84713 - DNA, 20 bp, human
ggggaatcgtcgcacgggag

SEQ ID NO: 84714 - DNA, 20 bp, human
ggatgctctcggctggcagg

SEQ ID NO: 84715 - DNA, 20 bp, human
gaaacccaggaagcgtcttc

SEQ ID NO: 84716 - DNA, 20 bp, human
gggaatgcaatagctacgag

SEQ ID NO: 84717 - DNA, 20 bp, human
gccaagcagaggcaacatgg

SEQ ID NO: 84718 - DNA, 20 bp, human
gagccacagaggccatcgtc

SEQ ID NO: 84719 - DNA, 20 bp, human
gtcgcagctatagcttgcta

SEQ ID NO: 84720 - DNA, 20 bp, human
gaacctacagtagcaaagaa

SEQ ID NO: 84721 - DNA, 20 bp, human
ggaatcgcacgaagccacag

SEQ ID NO: 84722 - DNA, 20 bp, human
gcgagtagcgattatgagta

SEQ ID NO: 84723 - DNA, 20 bp, human
gtgctcacaccaccatacaa

SEQ ID NO: 84724 - DNA, 20 bp, human
gttcctgacgatggcctctg

SEQ ID NO: 84725 - DNA, 20 bp, human
ggctattgcattcctgacga

SEQ ID NO: 84726 - DNA, 20 bp, human
gcgcactaggcggcgaaaga

SEQ ID NO: 84727 - DNA, 20 bp, human
gcctgtagcgagtctccagt

SEQ ID NO: 84728 - DNA, 20 bp, human
gagagggcagcgccaagcgg

SEQ ID NO: 84729 - DNA, 20 bp, human
ggccgccgcggtgaacctgg

SEQ ID NO: 84730 - DNA, 20 bp, human
ggaaagagggcagcgccaag

SEQ ID NO: 84731 - DNA, 20 bp, human
gtccgacgcgcggaagccaa

SEQ ID NO: 84732 - DNA, 20 bp, human
gagctgcatcccgcactagg

SEQ ID NO: 84733 - DNA, 20 bp, human
gggggtccggaggcgctcga

SEQ ID NO: 84734 - DNA, 20 bp, human
ggtgcgccgggctccgagac

SEQ ID NO: 84735 - DNA, 20 bp, human
gcgcgcccagcgccggagac

SEQ ID NO: 84736 - DNA, 20 bp, human
gcctcgggcggccttttgag

SEQ ID NO: 84737 - DNA, 20 bp, human
gatgtgcggccgaaagcctc

SEQ ID NO: 84738 - DNA, 20 bp, human
ggtctctgagggctcctgta

SEQ ID NO: 84739 - DNA, 20 bp, human
gctcctgtaaggagtagatg

SEQ ID NO: 84740 - DNA, 20 bp, human
gagcgccgtggggtctgacc

SEQ ID NO: 84741 - DNA, 20 bp, human
gggagccctcagagacaatc

SEQ ID NO: 84742 - DNA, 20 bp, human
gtgtaccggcccggcaggag

SEQ ID NO: 84743 - DNA, 20 bp, human
gagtagatgtggtacgggat

SEQ ID NO: 84744 - DNA, 20 bp, human
gtaaggagtagatgtggtac

SEQ ID NO: 84745 - DNA, 20 bp, human
gggctagcttcagcgccgtg

SEQ ID NO: 84746 - DNA, 20 bp, human
gaggagccgggccgatagac

SEQ ID NO: 84747 - DNA, 20 bp, human
ggggcgtcaggccggtctat

SEQ ID NO: 84748 - DNA, 20 bp, human
gtactagccggccaaccctc

SEQ ID NO: 84749 - DNA, 20 bp, human
gcgctacagcggcctctcac

SEQ ID NO: 84750 - DNA, 20 bp, human
gcggcgctgcccactgggta

SEQ ID NO: 84751 - DNA, 20 bp, human
gggacagccggtgtggagga

SEQ ID NO: 84752 - DNA, 20 bp, human
gcggatcaacaacaagatgg

SEQ ID NO: 84753 - DNA, 20 bp, human
gttgttgatccgtacccagt

SEQ ID NO: 84754 - DNA, 20 bp, human
gggaccaagcggccggtgag

SEQ ID NO: 84755 - DNA, 20 bp, human
gttcggtgccagcatctggg

SEQ ID NO: 84756 - DNA, 20 bp, human
gacggaaacgccgaggaacc

SEQ ID NO: 84757 - DNA, 20 bp, human
gaaatctcccggggtccctg

SEQ ID NO: 84758 - DNA, 20 bp, human
gccgaggaacccggctgagg

SEQ ID NO: 84759 - DNA, 20 bp, human
gttggtgcgagagaaacaat

SEQ ID NO: 84760 - DNA, 20 bp, human
gcaataggacggaaacgccg

SEQ ID NO: 84761 - DNA, 20 bp, human
gtgcgagagaaacaatagga

SEQ ID NO: 84762 - DNA, 20 bp, human
gttgggaagcgcaagatcta

SEQ ID NO: 84763 - DNA, 20 bp, human
gcctatggccctagtgcccg

SEQ ID NO: 84764 - DNA, 20 bp, human
gaggtaaagctcgcgtccta

SEQ ID NO: 84765 - DNA, 20 bp, human
gcaaagctcctcgggcacta

SEQ ID NO: 84766 - DNA, 20 bp, human
gctcagtgcccaccatgtac

SEQ ID NO: 84767 - DNA, 20 bp, human
ggggcagacctcccgcacca

SEQ ID NO: 84768 - DNA, 20 bp, human
gcctgatgcctgtacatggt

SEQ ID NO: 84769 - DNA, 20 bp, human
ggggtggactgggactacag

SEQ ID NO: 84770 - DNA, 20 bp, human
gggaggggtggaattcccct

SEQ ID NO: 84771 - DNA, 20 bp, human
ggagccctctcacttcaggg

SEQ ID NO: 84772 - DNA, 20 bp, human
gatgtacaggcatcaggcaa

SEQ ID NO: 84773 - DNA, 20 bp, human
gagacgctggcacctccgtg

SEQ ID NO: 84774 - DNA, 20 bp, human
ggtggaattcccctgggaga

SEQ ID NO: 84775 - DNA, 20 bp, human
gcaggcacccctggaagggg

SEQ ID NO: 84776 - DNA, 20 bp, human
gctccaggcagagcttaacg

SEQ ID NO: 84777 - DNA, 20 bp, human
gaacggggagctactagctg

SEQ ID NO: 84778 - DNA, 20 bp, human
gagcccaggaggaaaactca

SEQ ID NO: 84779 - DNA, 20 bp, human
gctccccgttaagctctgcc

SEQ ID NO: 84780 - DNA, 20 bp, human
gtcctgggcttctgacgcaa

SEQ ID NO: 84781 - DNA, 20 bp, human
gcatttggattaatccctcg

SEQ ID NO: 84782 - DNA, 20 bp, human
gtcccttgcgtcagaagccc

SEQ ID NO: 84783 - DNA, 20 bp, human
gggtggcagtgtttatgagc

SEQ ID NO: 84784 - DNA, 20 bp, human
gtcttaatgctaataagagg

SEQ ID NO: 84785 - DNA, 20 bp, human
gctgtcttaatgctaataag

SEQ ID NO: 84786 - DNA, 20 bp, human
gggtggccgggcacatgtac

SEQ ID NO: 84787 - DNA, 20 bp, human
gggctgcggggtgccctcag

SEQ ID NO: 84788 - DNA, 20 bp, human
gcgtcgccgtcagggcccca

SEQ ID NO: 84789 - DNA, 20 bp, human
gcggagagcagaagcggtaa

SEQ ID NO: 84790 - DNA, 20 bp, human
gcgatcgagtccacccctga

SEQ ID NO: 84791 - DNA, 20 bp, human
gcggctcggttctgtctacc

SEQ ID NO: 84792 - DNA, 20 bp, human
gggacaaagtgggtaagtgg

SEQ ID NO: 84793 - DNA, 20 bp, human
gcacgcagccgttgaggaag

SEQ ID NO: 84794 - DNA, 20 bp, human
gcggcagaggaacaggagcc

SEQ ID NO: 84795 - DNA, 20 bp, human
ggccgggcacatgtacggga

SEQ ID NO: 84796 - DNA, 20 bp, human
gtgggcacccgagtcccgag

SEQ ID NO: 84797 - DNA, 20 bp, human
gatcagtaggcggcggcgtg

SEQ ID NO: 84798 - DNA, 20 bp, human
gcgcctactgatgccgaaag

SEQ ID NO: 84799 - DNA, 20 bp, human
gggagctgcgacgccaaaca

SEQ ID NO: 84800 - DNA, 20 bp, human
gagccgctttcggcatcagt

SEQ ID NO: 84801 - DNA, 20 bp, human
gccgcaaccgcggtcacgat

SEQ ID NO: 84802 - DNA, 20 bp, human
gcgagcgcgcgggagtggaa

SEQ ID NO: 84803 - DNA, 20 bp, human
gggagtgggcagcatggtag

SEQ ID NO: 84804 - DNA, 20 bp, human
ggtcgcagctccaaacgacg

SEQ ID NO: 84805 - DNA, 20 bp, human
gcgagaggcgggaggaaagt

SEQ ID NO: 84806 - DNA, 20 bp, human
gcgggccaggccgaacggaa

SEQ ID NO: 84807 - DNA, 20 bp, human
gtctcaggcggggatcctag

SEQ ID NO: 84808 - DNA, 20 bp, human
gggaggcagcggctgtagcg

SEQ ID NO: 84809 - DNA, 20 bp, human
gcccaatgaaggggactccg

SEQ ID NO: 84810 - DNA, 20 bp, human
gatgaaggggactccgagga

SEQ ID NO: 84811 - DNA, 20 bp, human
gcttaggagacccaatgaag

SEQ ID NO: 84812 - DNA, 20 bp, human
gtcactgacggctccctcct

SEQ ID NO: 84813 - DNA, 20 bp, human
gcttgtcttgtcagtcactg

SEQ ID NO: 84814 - DNA, 20 bp, human
gtctgtgtggagggagtcac

SEQ ID NO: 84815 - DNA, 20 bp, human
gagtgaggagctctcaggcg

SEQ ID NO: 84816 - DNA, 20 bp, human
gtctagcccggctgactcca

SEQ ID NO: 84817 - DNA, 20 bp, human
gcggtagcagcagctcccgt

SEQ ID NO: 84818 - DNA, 20 bp, human
gcgggctagagcagctccta

SEQ ID NO: 84819 - DNA, 20 bp, human
gccgctactgggccgaaaag

SEQ ID NO: 84820 - DNA, 20 bp, human
gtacagtgggaagctcggag

SEQ ID NO: 84821 - DNA, 20 bp, human
gcaactgagccgccgctact

SEQ ID NO: 84822 - DNA, 20 bp, human
gtgctgccatggagtcagcc

SEQ ID NO: 84823 - DNA, 20 bp, human
gcagcacggccgcaaactgg

SEQ ID NO: 84824 - DNA, 20 bp, human
gaactggcggatctaggacg

SEQ ID NO: 84825 - DNA, 20 bp, human
gccgcagtgggcgaatactg

SEQ ID NO: 84826 - DNA, 20 bp, human
gaactgttgctgctccgccg

SEQ ID NO: 84827 - DNA, 20 bp, human
gtgcggctggcgtcggtaaa

SEQ ID NO: 84828 - DNA, 20 bp, human
ggcgctaggcgtgagagaga

SEQ ID NO: 84829 - DNA, 20 bp, human
gcagggcgcgaagactgggg

SEQ ID NO: 84830 - DNA, 20 bp, human
gctaggcgtgagagagaagg

SEQ ID NO: 84831 - DNA, 20 bp, human
gggccagggcgcgaagactg

SEQ ID NO: 84832 - DNA, 20 bp, human
gtctctcacgcctagcgcaa

SEQ ID NO: 84833 - DNA, 20 bp, human
gcgcgggccgcctcacacgt

SEQ ID NO: 84834 - DNA, 20 bp, human
ggcaccccacacctggacgg

SEQ ID NO: 84835 - DNA, 20 bp, human
gacgcctagcgcaatggcgg

SEQ ID NO: 84836 - DNA, 20 bp, human
gcctccacgccgaggcgaag

SEQ ID NO: 84837 - DNA, 20 bp, human
gatgcctagaccgcagccag

SEQ ID NO: 84838 - DNA, 20 bp, human
gagctcaggatccgaagcaa

SEQ ID NO: 84839 - DNA, 20 bp, human
gcagcggcaaccggcgcgaa

SEQ ID NO: 84840 - DNA, 20 bp, human
gggcgaagaggttctatccg

SEQ ID NO: 84841 - DNA, 20 bp, human
gaaggacgcccggctagcgg

SEQ ID NO: 84842 - DNA, 20 bp, human
gaaaggaaagagaagcgcca

SEQ ID NO: 84843 - DNA, 20 bp, human
ggcggactcggtcaaacccg

SEQ ID NO: 84844 - DNA, 20 bp, human
gttgccgctgcggagcgcgg

SEQ ID NO: 84845 - DNA, 20 bp, human
gccggggctcgggtgctact

SEQ ID NO: 84846 - DNA, 20 bp, human
gcctgctccactggaccggg

SEQ ID NO: 84847 - DNA, 20 bp, human
ggaatggagagcgagttgtg

SEQ ID NO: 84848 - DNA, 20 bp, human
gtggagagcgagttgtgggg

SEQ ID NO: 84849 - DNA, 20 bp, human
gccgctgccccccggtccag

SEQ ID NO: 84850 - DNA, 20 bp, human
gggatcatccaggcgctgaa

SEQ ID NO: 84851 - DNA, 20 bp, human
gagggggcgcggagtcagag

SEQ ID NO: 84852 - DNA, 20 bp, human
ggagagcgggaccagccgtg

SEQ ID NO: 84853 - DNA, 20 bp, human
ggctgttcggcaaagatcct

SEQ ID NO: 84854 - DNA, 20 bp, human
gtccttctcccgcctcccac

SEQ ID NO: 84855 - DNA, 20 bp, human
ggtcagagtggcgcagcaag

SEQ ID NO: 84856 - DNA, 20 bp, human
ggggggccgtcattcggtgg

SEQ ID NO: 84857 - DNA, 20 bp, human
ggcgcgcgggggccgtcatt

SEQ ID NO: 84858 - DNA, 20 bp, human
ggaggcgcgcctgaaggata

SEQ ID NO: 84859 - DNA, 20 bp, human
gctgcggtcagcggattgtg

SEQ ID NO: 84860 - DNA, 20 bp, human
gtggagcctagaatctgcag

SEQ ID NO: 84861 - DNA, 20 bp, human
gggaggtggagcctgggagt

SEQ ID NO: 84862 - DNA, 20 bp, human
gcgcgcctgaaggatagggt

SEQ ID NO: 84863 - DNA, 20 bp, human
ggcctgaaggatagggtcgg

SEQ ID NO: 84864 - DNA, 20 bp, human
gactggacccggcagcccgg

SEQ ID NO: 84865 - DNA, 20 bp, human
gaggtgctggaggtgacgga

SEQ ID NO: 84866 - DNA, 20 bp, human
gcgccgcttccccttccctc

SEQ ID NO: 84867 - DNA, 20 bp, human
gtgcgcgcgcagggcctgag

SEQ ID NO: 84868 - DNA, 20 bp, human
gggcctgagcgggcgccgga

SEQ ID NO: 84869 - DNA, 20 bp, human
ggaaggggaagcggcgggta

SEQ ID NO: 84870 - DNA, 20 bp, human
gagggcgacacttagactgt

SEQ ID NO: 84871 - DNA, 20 bp, human
gctgcgctacctaaaggtca

SEQ ID NO: 84872 - DNA, 20 bp, human
ggtaaggagggcctgcgttc

SEQ ID NO: 84873 - DNA, 20 bp, human
ggaccagccccggccggaga

SEQ ID NO: 84874 - DNA, 20 bp, human
ggtcggaggaaggcctgcgg

SEQ ID NO: 84875 - DNA, 20 bp, human
gaagggatctcagacaaacg

SEQ ID NO: 84876 - DNA, 20 bp, human
ggctcctcccccgaccgcag

SEQ ID NO: 84877 - DNA, 20 bp, human
gcctcgcgggctaggactcg

SEQ ID NO: 84878 - DNA, 20 bp, human
gagactgacccagtagagag

SEQ ID NO: 84879 - DNA, 20 bp, human
gtgtggaactgactctgacg

SEQ ID NO: 84880 - DNA, 20 bp, human
gcagtagagaggggatactg

SEQ ID NO: 84881 - DNA, 20 bp, human
gtactgaggggacgacagac

SEQ ID NO: 84882 - DNA, 20 bp, human
gggggaacgggaatactgag

SEQ ID NO: 84883 - DNA, 20 bp, human
gaccggccaggagaaggatc

SEQ ID NO: 84884 - DNA, 20 bp, human
gaaccagccgctgcggtcgg

SEQ ID NO: 84885 - DNA, 20 bp, human
gactcggggacgcgagctgg

SEQ ID NO: 84886 - DNA, 20 bp, human
gctgggagctcatccccatg

SEQ ID NO: 84887 - DNA, 20 bp, human
ggagctacagaggatttggg

SEQ ID NO: 84888 - DNA, 20 bp, human
gaagcagatactctatcccg

SEQ ID NO: 84889 - DNA, 20 bp, human
gcgtgcctgcgaagcaaacc

SEQ ID NO: 84890 - DNA, 20 bp, human
gtctctgggtcgcgacggga

SEQ ID NO: 84891 - DNA, 20 bp, human
gtggggtggtgggacgcgta

SEQ ID NO: 84892 - DNA, 20 bp, human
gtaagggcttggcaggtata

SEQ ID NO: 84893 - DNA, 20 bp, human
gggtgggacgcgtaggggag

SEQ ID NO: 84894 - DNA, 20 bp, human
gggcaggtatacggaagact

SEQ ID NO: 84895 - DNA, 20 bp, human
gtgtcgaacgcgtaagtgat

SEQ ID NO: 84896 - DNA, 20 bp, human
gaggccgcggcgctgtagtg

SEQ ID NO: 84897 - DNA, 20 bp, human
gggagccccaggttctttag

SEQ ID NO: 84898 - DNA, 20 bp, human
gacagcgccgcggccttccg

SEQ ID NO: 84899 - DNA, 20 bp, human
gacgctgccccggaaggccg

SEQ ID NO: 84900 - DNA, 20 bp, human
gctctacagagtgggcgtga

SEQ ID NO: 84901 - DNA, 20 bp, human
gcgacgcacgctgccccgga

SEQ ID NO: 84902 - DNA, 20 bp, human
gggtcctaggactggagaag

SEQ ID NO: 84903 - DNA, 20 bp, human
gggatgaggtaacttatctg

SEQ ID NO: 84904 - DNA, 20 bp, human
gagaacgcgaagcgaggatg

SEQ ID NO: 84905 - DNA, 20 bp, human
gagatctggtgtggaaactg

SEQ ID NO: 84906 - DNA, 20 bp, human
gcttatcacggtaagagagg

SEQ ID NO: 84907 - DNA, 20 bp, human
gccagagctgctggttcgga

SEQ ID NO: 84908 - DNA, 20 bp, human
gcgcagggcagggagtccgt

SEQ ID NO: 84909 - DNA, 20 bp, human
gcggcggggaaaggataggt

SEQ ID NO: 84910 - DNA, 20 bp, human
gctgacggcggggaaaggat

SEQ ID NO: 84911 - DNA, 20 bp, human
gggacagccggtatctccag

SEQ ID NO: 84912 - DNA, 20 bp, human
gtgtcctgaagaggtcgtcc

SEQ ID NO: 84913 - DNA, 20 bp, human
gggagccagagctgctggtt

SEQ ID NO: 84914 - DNA, 20 bp, human
ggtcccggcgaatgcaagag

SEQ ID NO: 84915 - DNA, 20 bp, human
ggcctggtatggagaacgag

SEQ ID NO: 84916 - DNA, 20 bp, human
gagcaacgcagggaccgcgg

SEQ ID NO: 84917 - DNA, 20 bp, human
ggggaccgcggcggtaactg

SEQ ID NO: 84918 - DNA, 20 bp, human
ggagcgaaaggtccagacta

SEQ ID NO: 84919 - DNA, 20 bp, human
gcctagcaacgcagggaccg

SEQ ID NO: 84920 - DNA, 20 bp, human
gcgggtaacctagcaacgca

SEQ ID NO: 84921 - DNA, 20 bp, human
gctgctcaccgaggaacgta

SEQ ID NO: 84922 - DNA, 20 bp, human
gaactgtggctagggaaacc

SEQ ID NO: 84923 - DNA, 20 bp, human
ggagtctcgccttctgagat

SEQ ID NO: 84924 - DNA, 20 bp, human
gggccgttgggtgaaatggg

SEQ ID NO: 84925 - DNA, 20 bp, human
gtatggccgttgggtgaaat

SEQ ID NO: 84926 - DNA, 20 bp, human
gcagactcgcaggcgcccag

SEQ ID NO: 84927 - DNA, 20 bp, human
gcgcaggcgcccagaggcga

SEQ ID NO: 84928 - DNA, 20 bp, human
gctgcgggccgcagactcgc

SEQ ID NO: 84929 - DNA, 20 bp, human
gacccggctgggtaggtcgg

SEQ ID NO: 84930 - DNA, 20 bp, human
gccgcaggtgacggagctca

SEQ ID NO: 84931 - DNA, 20 bp, human
gtccgggtctgggaatccgc

SEQ ID NO: 84932 - DNA, 20 bp, human
ggtcgcttacccggctgggt

SEQ ID NO: 84933 - DNA, 20 bp, human
gtccgggcacccccgatcta

SEQ ID NO: 84934 - DNA, 20 bp, human
gggcgtcccggagagcttcc

SEQ ID NO: 84935 - DNA, 20 bp, human
gtcttgtgcggtaacaataa

SEQ ID NO: 84936 - DNA, 20 bp, human
gtccttaggagcagagtcaa

SEQ ID NO: 84937 - DNA, 20 bp, human
gggatgaacacagatgtgag

SEQ ID NO: 84938 - DNA, 20 bp, human
ggctactagcactaggacat

SEQ ID NO: 84939 - DNA, 20 bp, human
ggttcatccagccatagcat

SEQ ID NO: 84940 - DNA, 20 bp, human
gctcctaaggacaaatgggt

SEQ ID NO: 84941 - DNA, 20 bp, human
gtcaatccatatgtgaccaa

SEQ ID NO: 84942 - DNA, 20 bp, human
ggacactagctactagcact

SEQ ID NO: 84943 - DNA, 20 bp, human
gacccttcctgcctatgcta

SEQ ID NO: 84944 - DNA, 20 bp, human
gcatatggattgattgtaga

SEQ ID NO: 84945 - DNA, 20 bp, human
gagccatagcataggcagga

SEQ ID NO: 84946 - DNA, 20 bp, human
gaggtggaccaggaatgggt

SEQ ID NO: 84947 - DNA, 20 bp, human
gagggctaatgaaccatcta

SEQ ID NO: 84948 - DNA, 20 bp, human
gatctaaggacaggccatga

SEQ ID NO: 84949 - DNA, 20 bp, human
ggttactcatgccagacctt

SEQ ID NO: 84950 - DNA, 20 bp, human
gtaatgaaccatctaaggac

SEQ ID NO: 84951 - DNA, 20 bp, human
gttaggagtcaactcaatgt

SEQ ID NO: 84952 - DNA, 20 bp, human
gcatggccagatctattagg

SEQ ID NO: 84953 - DNA, 20 bp, human
gaattctgatgacagaccaa

SEQ ID NO: 84954 - DNA, 20 bp, human
gtattaggtggaccaggaat

SEQ ID NO: 84955 - DNA, 20 bp, human
gggcatgagtaacgtgagtg

SEQ ID NO: 84956 - DNA, 20 bp, human
gacctctagcctctaatcat

SEQ ID NO: 84957 - DNA, 20 bp, human
gaggggattgcagacttgaa

SEQ ID NO: 84958 - DNA, 20 bp, human
gctctaatcatgggcactaa

SEQ ID NO: 84959 - DNA, 20 bp, human
ggcccatgattagaggctag

SEQ ID NO: 84960 - DNA, 20 bp, human
gagtacagacctgagtataa

SEQ ID NO: 84961 - DNA, 20 bp, human
gacttctctagccaccactg

SEQ ID NO: 84962 - DNA, 20 bp, human
gaccaactactgcaagtcat

SEQ ID NO: 84963 - DNA, 20 bp, human
gcagaacaggccctcaaggt

SEQ ID NO: 84964 - DNA, 20 bp, human
ggcccatgacttgcagtagt

SEQ ID NO: 84965 - DNA, 20 bp, human
ggcctgttctgacttacctt

SEQ ID NO: 84966 - DNA, 20 bp, human
gaaccactgctccaaaccat

SEQ ID NO: 84967 - DNA, 20 bp, human
gggcacacaaactcccccag

SEQ ID NO: 84968 - DNA, 20 bp, human
gtggtgaactgagtaaggta

SEQ ID NO: 84969 - DNA, 20 bp, human
gtcaggtgatcatctccctc

SEQ ID NO: 84970 - DNA, 20 bp, human
gtggagatagacagtaaaag

SEQ ID NO: 84971 - DNA, 20 bp, human
gctccttggtgaactgagta

SEQ ID NO: 84972 - DNA, 20 bp, human
gtcaggaaacagcaaccaga

SEQ ID NO: 84973 - DNA, 20 bp, human
gcagttcaccaaggagaggg

SEQ ID NO: 84974 - DNA, 20 bp, human
gcacagccacctgataggtg

SEQ ID NO: 84975 - DNA, 20 bp, human
gtaaatgctgtgtaagactc

SEQ ID NO: 84976 - DNA, 20 bp, human
gctgttggagtcctgatcgg

SEQ ID NO: 84977 - DNA, 20 bp, human
gggcccgcactcctccgatc

SEQ ID NO: 84978 - DNA, 20 bp, human
ggtgcgggccggagggtgat

SEQ ID NO: 84979 - DNA, 20 bp, human
gcagccactcacggagttgt

SEQ ID NO: 84980 - DNA, 20 bp, human
ggtcctgatcggaggagtgc

SEQ ID NO: 84981 - DNA, 20 bp, human
ggtaagggtgtggcctggta

SEQ ID NO: 84982 - DNA, 20 bp, human
gtgtggcctggtaggggtga

SEQ ID NO: 84983 - DNA, 20 bp, human
ggactttactaaattaccca

SEQ ID NO: 84984 - DNA, 20 bp, human
gtcggaggagtgcgggccgg

SEQ ID NO: 84985 - DNA, 20 bp, human
gcaggtcgtaaaattcgcac

SEQ ID NO: 84986 - DNA, 20 bp, human
gtatacctgccaggagtggg

SEQ ID NO: 84987 - DNA, 20 bp, human
gctctatacctgccaggagt

SEQ ID NO: 84988 - DNA, 20 bp, human
ggacagataagtggacccta

SEQ ID NO: 84989 - DNA, 20 bp, human
ggcaggcacaggttcgaatg

SEQ ID NO: 84990 - DNA, 20 bp, human
gaccctaaggatcaaggcca

SEQ ID NO: 84991 - DNA, 20 bp, human
gaggtaagtccctactgcaa

SEQ ID NO: 84992 - DNA, 20 bp, human
ggagtaaggcccttgcagta

SEQ ID NO: 84993 - DNA, 20 bp, human
gcaggagtgggcggtggtga

SEQ ID NO: 84994 - DNA, 20 bp, human
gaatgtggcaggcccgcagg

SEQ ID NO: 84995 - DNA, 20 bp, human
ggacacgcaaaatgtgagta

SEQ ID NO: 84996 - DNA, 20 bp, human
gcaatcattctttaggcagc

SEQ ID NO: 84997 - DNA, 20 bp, human
ggggttcgcctttccaccta

SEQ ID NO: 84998 - DNA, 20 bp, human
gtggaaaggcgaaccctgag

SEQ ID NO: 84999 - DNA, 20 bp, human
gcgggaacatcctccactca

SEQ ID NO: 85000 - DNA, 20 bp, human
gccggacgccgtaggtggaa

SEQ ID NO: 85001 - DNA, 20 bp, human
gcgtccccggacgccgtagg

SEQ ID NO: 85002 - DNA, 20 bp, human
ggagaaaagcaccccactgt

SEQ ID NO: 85003 - DNA, 20 bp, human
gctgcgtccccggacgccgt

SEQ ID NO: 85004 - DNA, 20 bp, human
gagaaaggccgggagcacga

SEQ ID NO: 85005 - DNA, 20 bp, human
gggcagtcctcctcatacct

SEQ ID NO: 85006 - DNA, 20 bp, human
ggccgtatgtgggtgtcttg

SEQ ID NO: 85007 - DNA, 20 bp, human
ggcgggcgttggccgtatgt

SEQ ID NO: 85008 - DNA, 20 bp, human
ggcctcaagacacccacata

SEQ ID NO: 85009 - DNA, 20 bp, human
gtaaacacctggcacctagt

SEQ ID NO: 85010 - DNA, 20 bp, human
gaaattgggacaaatcccag

SEQ ID NO: 85011 - DNA, 20 bp, human
gtgagctggaagtcattcaa

SEQ ID NO: 85012 - DNA, 20 bp, human
gtaagtaatgggcctaaagt

SEQ ID NO: 85013 - DNA, 20 bp, human
gaaagtgacatgcacctact

SEQ ID NO: 85014 - DNA, 20 bp, human
gctactatactgggaaatga

SEQ ID NO: 85015 - DNA, 20 bp, human
gcctcacggctcagtttcga

SEQ ID NO: 85016 - DNA, 20 bp, human
gctgtgccatggctaggtca

SEQ ID NO: 85017 - DNA, 20 bp, human
gcagggaacggctacctccg

SEQ ID NO: 85018 - DNA, 20 bp, human
gggaacggctacctccgcgg

SEQ ID NO: 85019 - DNA, 20 bp, human
gcccatgacgtcgggagtgg

SEQ ID NO: 85020 - DNA, 20 bp, human
gccgttccctgacctagcca

SEQ ID NO: 85021 - DNA, 20 bp, human
gcttggaaaccgcgcctccg

SEQ ID NO: 85022 - DNA, 20 bp, human
ggaacccatgacgtcgggag

SEQ ID NO: 85023 - DNA, 20 bp, human
ggattaagatggatccgaca

SEQ ID NO: 85024 - DNA, 20 bp, human
ggcgagttggagggagtcta

SEQ ID NO: 85025 - DNA, 20 bp, human
ggagacaaatcggacactct

SEQ ID NO: 85026 - DNA, 20 bp, human
gaggagactggatcggatgc

SEQ ID NO: 85027 - DNA, 20 bp, human
gacacaacaacagcaagtag

SEQ ID NO: 85028 - DNA, 20 bp, human
ggtgactgtgggggaatgtg

SEQ ID NO: 85029 - DNA, 20 bp, human
gcacacacacacaagaaagg

SEQ ID NO: 85030 - DNA, 20 bp, human
gattgcgctctgtgattctg

SEQ ID NO: 85031 - DNA, 20 bp, human
gacagagcgcaatgtgactg

SEQ ID NO: 85032 - DNA, 20 bp, human
gtgcggacagatttcactaa

SEQ ID NO: 85033 - DNA, 20 bp, human
gacagtgtgggcttaattat

SEQ ID NO: 85034 - DNA, 20 bp, human
gtaaaacataccatttgcat

SEQ ID NO: 85035 - DNA, 20 bp, human
gaagagcttatagaacagtg

SEQ ID NO: 85036 - DNA, 20 bp, human
gcagcagaaatcaggctctg

SEQ ID NO: 85037 - DNA, 20 bp, human
gcttcagcagaccgaggctg

SEQ ID NO: 85038 - DNA, 20 bp, human
ggataatcttcagcagaccg

SEQ ID NO: 85039 - DNA, 20 bp, human
gatggtggttgataaccgaa

SEQ ID NO: 85040 - DNA, 20 bp, human
gaatccgtaaagggtcacct

SEQ ID NO: 85041 - DNA, 20 bp, human
gtcacctgggttagctagta

SEQ ID NO: 85042 - DNA, 20 bp, human
gctcattctcgccccagcct

SEQ ID NO: 85043 - DNA, 20 bp, human
gcaaccttactagctaaccc

SEQ ID NO: 85044 - DNA, 20 bp, human
gtgaggcagacctgtttaca

SEQ ID NO: 85045 - DNA, 20 bp, human
gcagagaagacaaggctact

SEQ ID NO: 85046 - DNA, 20 bp, human
gccttcagtacctttgtctc

SEQ ID NO: 85047 - DNA, 20 bp, human
ggggcttgaggcgcactatg

SEQ ID NO: 85048 - DNA, 20 bp, human
gctgcaagggtaggaaacct

SEQ ID NO: 85049 - DNA, 20 bp, human
ggtagtgaggttaaaggcaa

SEQ ID NO: 85050 - DNA, 20 bp, human
gtgtgggagcagatctgcaa

SEQ ID NO: 85051 - DNA, 20 bp, human
gtcgcgggacgcgagagaca

SEQ ID NO: 85052 - DNA, 20 bp, human
gtgaggcgcactatgtggct

SEQ ID NO: 85053 - DNA, 20 bp, human
gcgatccgtagtgaggttaa

SEQ ID NO: 85054 - DNA, 20 bp, human
gggagcagatctgcaagggt

SEQ ID NO: 85055 - DNA, 20 bp, human
gcgcggccatggcggcaccg

SEQ ID NO: 85056 - DNA, 20 bp, human
gaagacggcctagagtgagg

SEQ ID NO: 85057 - DNA, 20 bp, human
gtaccccgcaggcaacacta

SEQ ID NO: 85058 - DNA, 20 bp, human
ggggaagacggcctagagtg

SEQ ID NO: 85059 - DNA, 20 bp, human
gcctaccgcggccccagcta

SEQ ID NO: 85060 - DNA, 20 bp, human
gtgaggaagccgtgaaacct

SEQ ID NO: 85061 - DNA, 20 bp, human
gccgcgcctccaaggtttca

SEQ ID NO: 85062 - DNA, 20 bp, human
gaatctcggccgagcctggg

SEQ ID NO: 85063 - DNA, 20 bp, human
gagcccgtcaacctcgtctg

SEQ ID NO: 85064 - DNA, 20 bp, human
gcgccgcagacgaggttgac

SEQ ID NO: 85065 - DNA, 20 bp, human
gccgcgcagggcgtgtcccg

SEQ ID NO: 85066 - DNA, 20 bp, human
gccgcgagcctggccagcga

SEQ ID NO: 85067 - DNA, 20 bp, human
gtctggcgagagagcaccga

SEQ ID NO: 85068 - DNA, 20 bp, human
ggcgaccggccagggagcga

SEQ ID NO: 85069 - DNA, 20 bp, human
gaggcggcggcgaccggcca

SEQ ID NO: 85070 - DNA, 20 bp, human
gtgcgcggcgcagaggaaat

SEQ ID NO: 85071 - DNA, 20 bp, human
gtgggagctggagttgcaaa

SEQ ID NO: 85072 - DNA, 20 bp, human
gacggcgttggagaagccga

SEQ ID NO: 85073 - DNA, 20 bp, human
gaaaggaaacctgctgcggg

SEQ ID NO: 85074 - DNA, 20 bp, human
gctctcgccagagccagcca

SEQ ID NO: 85075 - DNA, 20 bp, human
gctggatattaggaattggg

SEQ ID NO: 85076 - DNA, 20 bp, human
gcagccaagcccccgaccag

SEQ ID NO: 85077 - DNA, 20 bp, human
gagacgcctcaagggatctg

SEQ ID NO: 85078 - DNA, 20 bp, human
gtgcggagagggtcagagaa

SEQ ID NO: 85079 - DNA, 20 bp, human
gtccggagtcgggagaatgt

SEQ ID NO: 85080 - DNA, 20 bp, human
gtgaccctctccgcactcac

SEQ ID NO: 85081 - DNA, 20 bp, human
ggacaggcattgtctgaaag

SEQ ID NO: 85082 - DNA, 20 bp, human
gcttgaggcgtcttgtccgg

SEQ ID NO: 85083 - DNA, 20 bp, human
ggacaatgcctgtcaaacag

SEQ ID NO: 85084 - DNA, 20 bp, human
gggccaccgcccctcaccgt

SEQ ID NO: 85085 - DNA, 20 bp, human
gtggcatcgctgggcaagtt

SEQ ID NO: 85086 - DNA, 20 bp, human
gtctccgggtggccgggtgt

SEQ ID NO: 85087 - DNA, 20 bp, human
gtcgcgctgcgccaagcggg

SEQ ID NO: 85088 - DNA, 20 bp, human
gaggccgggccggaggaatg

SEQ ID NO: 85089 - DNA, 20 bp, human
gggtgcgtccgccagactgt

SEQ ID NO: 85090 - DNA, 20 bp, human
ggtcacccgcactcccgcac

SEQ ID NO: 85091 - DNA, 20 bp, human
gcgggagtgcgggtgaccgt

SEQ ID NO: 85092 - DNA, 20 bp, human
gggcctcgcgctgcgccaag

SEQ ID NO: 85093 - DNA, 20 bp, human
gttgcagtgcaggcaccaca

SEQ ID NO: 85094 - DNA, 20 bp, human
gcttcagggccacattcctc

SEQ ID NO: 85095 - DNA, 20 bp, human
ggccgggcgcccggtcccga

SEQ ID NO: 85096 - DNA, 20 bp, human
gggtgacacggtggagacac

SEQ ID NO: 85097 - DNA, 20 bp, human
gggagacaccggctaggcca

SEQ ID NO: 85098 - DNA, 20 bp, human
gtgggtctggacctgtccca

SEQ ID NO: 85099 - DNA, 20 bp, human
gacccatggagccccccggg

SEQ ID NO: 85100 - DNA, 20 bp, human
gtcctcccggggggctccat

SEQ ID NO: 85101 - DNA, 20 bp, human
gctgagactcagagactctt

SEQ ID NO: 85102 - DNA, 20 bp, human
gttcaagtgggagatcccat

SEQ ID NO: 85103 - DNA, 20 bp, human
gggagggggtggtgacacgg

SEQ ID NO: 85104 - DNA, 20 bp, human
gttgtgtgcgaggcactgca

SEQ ID NO: 85105 - DNA, 20 bp, human
gctggacctgtcccaagggc

SEQ ID NO: 85106 - DNA, 20 bp, human
gggcccgggagacagcgctg

SEQ ID NO: 85107 - DNA, 20 bp, human
ggtcccggtgcagctccccg

SEQ ID NO: 85108 - DNA, 20 bp, human
gcgcaggtcgcggttctcct

SEQ ID NO: 85109 - DNA, 20 bp, human
ggagacagcgctggggccgg

SEQ ID NO: 85110 - DNA, 20 bp, human
ggccactgctcgggaggacg

SEQ ID NO: 85111 - DNA, 20 bp, human
ggagaaccgcgacctgcgag

SEQ ID NO: 85112 - DNA, 20 bp, human
gaccacagccactgctcggg

SEQ ID NO: 85113 - DNA, 20 bp, human
gggatccgagagcccaaatc

SEQ ID NO: 85114 - DNA, 20 bp, human
gccctgggccgccaggatgg

SEQ ID NO: 85115 - DNA, 20 bp, human
ggcgctggggccggcggcac

SEQ ID NO: 85116 - DNA, 20 bp, human
gagggaggcgagccgaccgc

SEQ ID NO: 85117 - DNA, 20 bp, human
gtgtgtccccagatgcttgt

SEQ ID NO: 85118 - DNA, 20 bp, human
gagcccagcagcccagcggt

SEQ ID NO: 85119 - DNA, 20 bp, human
gtgctgccagggccccgctg

SEQ ID NO: 85120 - DNA, 20 bp, human
gggccgccgcgtcagcacca

SEQ ID NO: 85121 - DNA, 20 bp, human
ggctgacgcggcggccgatc

SEQ ID NO: 85122 - DNA, 20 bp, human
gtcgggcgcgggatgcggcg

SEQ ID NO: 85123 - DNA, 20 bp, human
ggagagcctgctggagaatc

SEQ ID NO: 85124 - DNA, 20 bp, human
ggccgatcgggcgcgggatg

SEQ ID NO: 85125 - DNA, 20 bp, human
gcaaggggccgtgactgaca

SEQ ID NO: 85126 - DNA, 20 bp, human
gggagcgcggcaggaaataa

SEQ ID NO: 85127 - DNA, 20 bp, human
ggctgagaacgcggcgagta

SEQ ID NO: 85128 - DNA, 20 bp, human
ggatcgcggtagggaagaag

SEQ ID NO: 85129 - DNA, 20 bp, human
gcgaccaacagctgagaacg

SEQ ID NO: 85130 - DNA, 20 bp, human
ggggtctggaaggaggatcg

SEQ ID NO: 85131 - DNA, 20 bp, human
gtggaaggaggatcgcggta

SEQ ID NO: 85132 - DNA, 20 bp, human
gagctgcgtcttaggagcct

SEQ ID NO: 85133 - DNA, 20 bp, human
gggagtgagagtgccaggtg

SEQ ID NO: 85134 - DNA, 20 bp, human
gagtctctagtgccaggtgt

SEQ ID NO: 85135 - DNA, 20 bp, human
gcgcgatagggaaaaggggg

SEQ ID NO: 85136 - DNA, 20 bp, human
gcgggactccgggcacccca

SEQ ID NO: 85137 - DNA, 20 bp, human
gtgcacgaggtcggccacac

SEQ ID NO: 85138 - DNA, 20 bp, human
ggcacgaggccggctcgaag

SEQ ID NO: 85139 - DNA, 20 bp, human
ggggcgttgcggttgatcca

SEQ ID NO: 85140 - DNA, 20 bp, human
gcgactggtgccagttcggt

SEQ ID NO: 85141 - DNA, 20 bp, human
ggtctggtcgcgcacgatca

SEQ ID NO: 85142 - DNA, 20 bp, human
gcccggagtcccgcgctcac

SEQ ID NO: 85143 - DNA, 20 bp, human
gcgccggcctcccagccgtg

SEQ ID NO: 85144 - DNA, 20 bp, human
gcaccagtcggcgggctcca

SEQ ID NO: 85145 - DNA, 20 bp, human
ggtgaggatgtgcacgaggt

SEQ ID NO: 85146 - DNA, 20 bp, human
gcctagcaggtgctgagatg

SEQ ID NO: 85147 - DNA, 20 bp, human
gattgagtgacaaggacctg

SEQ ID NO: 85148 - DNA, 20 bp, human
gtgtcagtatggctaccagg

SEQ ID NO: 85149 - DNA, 20 bp, human
gggggcccctcagttcagag

SEQ ID NO: 85150 - DNA, 20 bp, human
ggactccagagagacctagc

SEQ ID NO: 85151 - DNA, 20 bp, human
gtggctacctgggtcatagg

SEQ ID NO: 85152 - DNA, 20 bp, human
gagcacctgctaggtctctc

SEQ ID NO: 85153 - DNA, 20 bp, human
gccagctgcgcactgggacg

SEQ ID NO: 85154 - DNA, 20 bp, human
gagcgcccctctgaactgag

SEQ ID NO: 85155 - DNA, 20 bp, human
gtactgtcagtatggctacc

SEQ ID NO: 85156 - DNA, 20 bp, human
gacgaacactcgggtcggag

SEQ ID NO: 85157 - DNA, 20 bp, human
ggttccacgaacactcgggt

SEQ ID NO: 85158 - DNA, 20 bp, human
ggggcccgcagacacttctg

SEQ ID NO: 85159 - DNA, 20 bp, human
ggcaggtgagatctccgcgg

SEQ ID NO: 85160 - DNA, 20 bp, human
gactccgggacgccaggacc

SEQ ID NO: 85161 - DNA, 20 bp, human
gagagccggaagacacaaaa

SEQ ID NO: 85162 - DNA, 20 bp, human
gcgtcggccggtagttacta

SEQ ID NO: 85163 - DNA, 20 bp, human
gcgtgcaggtgagatctccg

SEQ ID NO: 85164 - DNA, 20 bp, human
gaccagttccacgaacactc

SEQ ID NO: 85165 - DNA, 20 bp, human
gccccacaggcccccctagc

SEQ ID NO: 85166 - DNA, 20 bp, human
gggtcgtccagcacccagga

SEQ ID NO: 85167 - DNA, 20 bp, human
ggctccggcgcgggacgact

SEQ ID NO: 85168 - DNA, 20 bp, human
gtggtagatgtagcaggcca

SEQ ID NO: 85169 - DNA, 20 bp, human
gagcaggccatggcacgcta

SEQ ID NO: 85170 - DNA, 20 bp, human
gtctgagtccagagaacggt

SEQ ID NO: 85171 - DNA, 20 bp, human
ggcggccgccaagctccctc

SEQ ID NO: 85172 - DNA, 20 bp, human
gcagagaacggtgggtacgg

SEQ ID NO: 85173 - DNA, 20 bp, human
gcggcgcgggacgactgggt

SEQ ID NO: 85174 - DNA, 20 bp, human
gcgactgggtcggacactgc

SEQ ID NO: 85175 - DNA, 20 bp, human
ggccagcagcgctgacagga

SEQ ID NO: 85176 - DNA, 20 bp, human
gggaaggcatctgggtccca

SEQ ID NO: 85177 - DNA, 20 bp, human
gggagaacggcgtgttccta

SEQ ID NO: 85178 - DNA, 20 bp, human
gtctgcatccaacccaggaa

SEQ ID NO: 85179 - DNA, 20 bp, human
gcgttctccggtcactgcag

SEQ ID NO: 85180 - DNA, 20 bp, human
gggtatcgctgcaaagtcaa

SEQ ID NO: 85181 - DNA, 20 bp, human
gctccgggaagttcccgcca

SEQ ID NO: 85182 - DNA, 20 bp, human
gccgagccccggggacgagg

SEQ ID NO: 85183 - DNA, 20 bp, human
gcgtggaagcaggatttccg

SEQ ID NO: 85184 - DNA, 20 bp, human
gcctggccaggcggacgcag

SEQ ID NO: 85185 - DNA, 20 bp, human
gctccctggcgggaacttcc

SEQ ID NO: 85186 - DNA, 20 bp, human
ggcccgcgcccgggcaggta

SEQ ID NO: 85187 - DNA, 20 bp, human
gtccccagaaccaggaagtc

SEQ ID NO: 85188 - DNA, 20 bp, human
gagcgagctgctggcgccac

SEQ ID NO: 85189 - DNA, 20 bp, human
gggcgccacaggcatctgtc

SEQ ID NO: 85190 - DNA, 20 bp, human
gtgaccgaggcattaaggcg

SEQ ID NO: 85191 - DNA, 20 bp, human
gactaggaagcgccgcgaag

SEQ ID NO: 85192 - DNA, 20 bp, human
ggggcgcgggctgctgaagc

SEQ ID NO: 85193 - DNA, 20 bp, human
gagcacctgacagatgcctg

SEQ ID NO: 85194 - DNA, 20 bp, human
gacggaatccagggcctgag

SEQ ID NO: 85195 - DNA, 20 bp, human
ggaagcccatcggggaagtg

SEQ ID NO: 85196 - DNA, 20 bp, human
gccgggcagggaagacgggg

SEQ ID NO: 85197 - DNA, 20 bp, human
gcctccccggagggataata

SEQ ID NO: 85198 - DNA, 20 bp, human
gcagcggccaccggagagag

SEQ ID NO: 85199 - DNA, 20 bp, human
gttcatcgctcgccaatggg

SEQ ID NO: 85200 - DNA, 20 bp, human
gtggcgagcgatgaaggcgg

SEQ ID NO: 85201 - DNA, 20 bp, human
gaagacaggcggactggcaa

SEQ ID NO: 85202 - DNA, 20 bp, human
gacgggggccaggaagccgc

SEQ ID NO: 85203 - DNA, 20 bp, human
ggctgcgtgagacccgaaca

SEQ ID NO: 85204 - DNA, 20 bp, human
gcgggtcaaggccagcggtg

SEQ ID NO: 85205 - DNA, 20 bp, human
gggtgtcgcgcaggagggtg

SEQ ID NO: 85206 - DNA, 20 bp, human
gggagtggcgagctctgcca

SEQ ID NO: 85207 - DNA, 20 bp, human
ggcacgtcttgcctcgacta

SEQ ID NO: 85208 - DNA, 20 bp, human
gtcttgcctcgactaaggag

SEQ ID NO: 85209 - DNA, 20 bp, human
ggctcgccactccttagtcg

SEQ ID NO: 85210 - DNA, 20 bp, human
ggagggtcccggcgacgcag

SEQ ID NO: 85211 - DNA, 20 bp, human
ggctccgggtggcctcggtt

SEQ ID NO: 85212 - DNA, 20 bp, human
gtggagggaatcgtgaccta

SEQ ID NO: 85213 - DNA, 20 bp, human
gccggcagcctcgtccgggt

SEQ ID NO: 85214 - DNA, 20 bp, human
gtggaccgcccacccggacg

SEQ ID NO: 85215 - DNA, 20 bp, human
gatgcgcgggacgaacatag

SEQ ID NO: 85216 - DNA, 20 bp, human
gactgttctcaggcaagccg

SEQ ID NO: 85217 - DNA, 20 bp, human
gccgtcagttgaataatcgc

SEQ ID NO: 85218 - DNA, 20 bp, human
gccagatcgaaagcaaaaca

SEQ ID NO: 85219 - DNA, 20 bp, human
gtggatttgcagatgcggag

SEQ ID NO: 85220 - DNA, 20 bp, human
gaggaaactgcgaagagccg

SEQ ID NO: 85221 - DNA, 20 bp, human
gatttgcagatgcggagagg

SEQ ID NO: 85222 - DNA, 20 bp, human
gcacagcaggtctgtgtcca

SEQ ID NO: 85223 - DNA, 20 bp, human
ggttgctagggtatgtgaaa

SEQ ID NO: 85224 - DNA, 20 bp, human
gtctcgagggcatgtttctg

SEQ ID NO: 85225 - DNA, 20 bp, human
gctgtgtgtgtttctctcga

SEQ ID NO: 85226 - DNA, 20 bp, human
ggacgcggatcgaacgttgg

SEQ ID NO: 85227 - DNA, 20 bp, human
gcacggtccggcctccggct

SEQ ID NO: 85228 - DNA, 20 bp, human
gccctgcgaagcggcctctg

SEQ ID NO: 85229 - DNA, 20 bp, human
ggacagcgcgagccacggtc

SEQ ID NO: 85230 - DNA, 20 bp, human
gccatggcccacggcatctt

SEQ ID NO: 85231 - DNA, 20 bp, human
ggcacaggtagcaccactgg

SEQ ID NO: 85232 - DNA, 20 bp, human
ggtcgcacaggtagcaccac

SEQ ID NO: 85233 - DNA, 20 bp, human
ggacctgcccaagatgccgt

SEQ ID NO: 85234 - DNA, 20 bp, human
gacagctcgggccccacgat

SEQ ID NO: 85235 - DNA, 20 bp, human
gcatcttgggcaggtcgcac

SEQ ID NO: 85236 - DNA, 20 bp, human
gcgggtggggagcgaccctc

SEQ ID NO: 85237 - DNA, 20 bp, human
gcagccgcggcagacgggtt

SEQ ID NO: 85238 - DNA, 20 bp, human
gtggccgagccgttcatgag

SEQ ID NO: 85239 - DNA, 20 bp, human
gtcatgagcggcaccagggt

SEQ ID NO: 85240 - DNA, 20 bp, human
ggacaccgcggctaaggagg

SEQ ID NO: 85241 - DNA, 20 bp, human
gcgcacggctgcttcccgga

SEQ ID NO: 85242 - DNA, 20 bp, human
gacggcgcggcagctcaagc

SEQ ID NO: 85243 - DNA, 20 bp, human
ggttcgtcatcgagacggcg

SEQ ID NO: 85244 - DNA, 20 bp, human
gcacgcggtgccgcccaccc

SEQ ID NO: 85245 - DNA, 20 bp, human
gccggacaccgcggctaagg

SEQ ID NO: 85246 - DNA, 20 bp, human
gtcgggccccctaagatcaa

SEQ ID NO: 85247 - DNA, 20 bp, human
gccccctaagatcaacggag

SEQ ID NO: 85248 - DNA, 20 bp, human
gtcccagcacattcttggat

SEQ ID NO: 85249 - DNA, 20 bp, human
gtcaggcgtacgggattctg

SEQ ID NO: 85250 - DNA, 20 bp, human
ggatgtggacagccacggct

SEQ ID NO: 85251 - DNA, 20 bp, human
ggctgatacgctctgacacg

SEQ ID NO: 85252 - DNA, 20 bp, human
gctgtggatgtggacagcca

SEQ ID NO: 85253 - DNA, 20 bp, human
ggggatcttgagcccctctg

SEQ ID NO: 85254 - DNA, 20 bp, human
gcaccttctggttctggaga

SEQ ID NO: 85255 - DNA, 20 bp, human
gagccctctccagaaccaga

SEQ ID NO: 85256 - DNA, 20 bp, human
gccaggacgcacgagagcag

SEQ ID NO: 85257 - DNA, 20 bp, human
gacgcacgagagcagaggag

SEQ ID NO: 85258 - DNA, 20 bp, human
gcacgctcgcccggaatgtg

SEQ ID NO: 85259 - DNA, 20 bp, human
gctccccgacgggccccctg

SEQ ID NO: 85260 - DNA, 20 bp, human
ggtgcgtggaagctcgaaag

SEQ ID NO: 85261 - DNA, 20 bp, human
gcttcagcaagattggaccc

SEQ ID NO: 85262 - DNA, 20 bp, human
ggagaggacgcagctcgtag

SEQ ID NO: 85263 - DNA, 20 bp, human
gcgtctcggcgctcctgctc

SEQ ID NO: 85264 - DNA, 20 bp, human
gtgcttccccggaggaccgg

SEQ ID NO: 85265 - DNA, 20 bp, human
gttgttactctacgttccgg

SEQ ID NO: 85266 - DNA, 20 bp, human
gggaggcgtctacactgagg

SEQ ID NO: 85267 - DNA, 20 bp, human
ggggtggactccgtagatgg

SEQ ID NO: 85268 - DNA, 20 bp, human
gacccggagctccaagacag

SEQ ID NO: 85269 - DNA, 20 bp, human
gagaggaggcgtctacactg

SEQ ID NO: 85270 - DNA, 20 bp, human
ggtctgcacggagagtggaa

SEQ ID NO: 85271 - DNA, 20 bp, human
ggaagagcccgggagagcgt

SEQ ID NO: 85272 - DNA, 20 bp, human
gactgaactacccccatcta

SEQ ID NO: 85273 - DNA, 20 bp, human
ggcccagcgggccgtcccat

SEQ ID NO: 85274 - DNA, 20 bp, human
gggagctccaagacaggggt

SEQ ID NO: 85275 - DNA, 20 bp, human
gtggccggaaacccaaaaaa

SEQ ID NO: 85276 - DNA, 20 bp, human
gcggagctgagggcagcggt

SEQ ID NO: 85277 - DNA, 20 bp, human
gggtgggtcccaagatcgag

SEQ ID NO: 85278 - DNA, 20 bp, human
gtccagggcgaggtaagggc

SEQ ID NO: 85279 - DNA, 20 bp, human
gccctgtggaccccaatccg

SEQ ID NO: 85280 - DNA, 20 bp, human
gccaaggcacccacacaaga

SEQ ID NO: 85281 - DNA, 20 bp, human
ggctgaggcggggccgtcca

SEQ ID NO: 85282 - DNA, 20 bp, human
gccttacctcgccctggact

SEQ ID NO: 85283 - DNA, 20 bp, human
gtcgcgctccgggtcctctc

SEQ ID NO: 85284 - DNA, 20 bp, human
gccgtgagcttgggcccctt

SEQ ID NO: 85285 - DNA, 20 bp, human
gaccagaggttcgacctcca

SEQ ID NO: 85286 - DNA, 20 bp, human
gtgatcgaccagatcgacag

SEQ ID NO: 85287 - DNA, 20 bp, human
gcgacagcggcaagtacccc

SEQ ID NO: 85288 - DNA, 20 bp, human
gcaacgggaagctccgccag

SEQ ID NO: 85289 - DNA, 20 bp, human
ggatctggtcgatcagccac

SEQ ID NO: 85290 - DNA, 20 bp, human
ggttctcccacaccagcccg

SEQ ID NO: 85291 - DNA, 20 bp, human
ggggcggccaaaggcttgag

SEQ ID NO: 85292 - DNA, 20 bp, human
ggcatgagcgcggtgagctg

SEQ ID NO: 85293 - DNA, 20 bp, human
gcttgcccgcgtgcttccag

SEQ ID NO: 85294 - DNA, 20 bp, human
gaagtaccccgggctggtgt

SEQ ID NO: 85295 - DNA, 20 bp, human
ggtacttgccgctgtcgatc

SEQ ID NO: 85296 - DNA, 20 bp, human
ggtgacccaggcggcggagt

SEQ ID NO: 85297 - DNA, 20 bp, human
gccagggagcaccggccggg

SEQ ID NO: 85298 - DNA, 20 bp, human
gcgggcggcgggatgaagac

SEQ ID NO: 85299 - DNA, 20 bp, human
gtcccgggaacccccattct

SEQ ID NO: 85300 - DNA, 20 bp, human
gcggcaggttggcggaccgg

SEQ ID NO: 85301 - DNA, 20 bp, human
gaggcgcaccgcagacaggt

SEQ ID NO: 85302 - DNA, 20 bp, human
gcccaggctgcgcctcccgc

SEQ ID NO: 85303 - DNA, 20 bp, human
gggcaagacgcggaagtgcc

SEQ ID NO: 85304 - DNA, 20 bp, human
ggcccggcaggttggcggac

SEQ ID NO: 85305 - DNA, 20 bp, human
gctggaaagcgagctcgggg

SEQ ID NO: 85306 - DNA, 20 bp, human
gcaccaacccaggagaggta

SEQ ID NO: 85307 - DNA, 20 bp, human
gctaactgctacctacccag

SEQ ID NO: 85308 - DNA, 20 bp, human
gggccttacctctcctgggt

SEQ ID NO: 85309 - DNA, 20 bp, human
gagttgggcaggtgaagggg

SEQ ID NO: 85310 - DNA, 20 bp, human
gatgtgtcggtcagcaagta

SEQ ID NO: 85311 - DNA, 20 bp, human
ggcagctcagaggcggcact

SEQ ID NO: 85312 - DNA, 20 bp, human
gccatcagaagtgaatgtgt

SEQ ID NO: 85313 - DNA, 20 bp, human
gtggcccaggggctgggacg

SEQ ID NO: 85314 - DNA, 20 bp, human
gaggcggggctcgtgcccct

SEQ ID NO: 85315 - DNA, 20 bp, human
ggggccggccttacctctcc

SEQ ID NO: 85316 - DNA, 20 bp, human
ggcctggctctacccaagta

SEQ ID NO: 85317 - DNA, 20 bp, human
gtaagggctggtgcgggacg

SEQ ID NO: 85318 - DNA, 20 bp, human
gacgtgagctcggcgcacct

SEQ ID NO: 85319 - DNA, 20 bp, human
ggcctagcgctacagaactg

SEQ ID NO: 85320 - DNA, 20 bp, human
gcccccaccgccgaagcgga

SEQ ID NO: 85321 - DNA, 20 bp, human
gcaagctggtccccagaagt

SEQ ID NO: 85322 - DNA, 20 bp, human
gggtcctaccccacccacgg

SEQ ID NO: 85323 - DNA, 20 bp, human
gcgtcaacaaccccactatc

SEQ ID NO: 85324 - DNA, 20 bp, human
gtccctacttgggtagagcc

SEQ ID NO: 85325 - DNA, 20 bp, human
gggacagattgagcaaaggt

SEQ ID NO: 85326 - DNA, 20 bp, human
ggaaagcgaaacctaaacag

SEQ ID NO: 85327 - DNA, 20 bp, human
gtgccaagagatccataccg

SEQ ID NO: 85328 - DNA, 20 bp, human
gggctctggcacccaggtac

SEQ ID NO: 85329 - DNA, 20 bp, human
gcataccgaggcagcgtcgg

SEQ ID NO: 85330 - DNA, 20 bp, human
gctcccggcctgcaccgcgt

SEQ ID NO: 85331 - DNA, 20 bp, human
gtccttggagagatcagcag

SEQ ID NO: 85332 - DNA, 20 bp, human
gcagcagcggctgctatgag

SEQ ID NO: 85333 - DNA, 20 bp, human
gatccataccgaggcagcgt

SEQ ID NO: 85334 - DNA, 20 bp, human
ggtgccagagccgccgggac

SEQ ID NO: 85335 - DNA, 20 bp, human
gacgaaacttcccgtcccgg

SEQ ID NO: 85336 - DNA, 20 bp, human
gcgagacggcggcaggacgg

SEQ ID NO: 85337 - DNA, 20 bp, human
gaacgcgggcggcgagacgg

SEQ ID NO: 85338 - DNA, 20 bp, human
gggagcgcggcagcaagcgt

SEQ ID NO: 85339 - DNA, 20 bp, human
gtaggcacagtgggcgggta

SEQ ID NO: 85340 - DNA, 20 bp, human
gcggcaggacggcggcaggt

SEQ ID NO: 85341 - DNA, 20 bp, human
ggcagcaagcgtgggaacgc

SEQ ID NO: 85342 - DNA, 20 bp, human
gcggcggcaggtaggcacag

SEQ ID NO: 85343 - DNA, 20 bp, human
ggcaagcgtgggaacgcggg

SEQ ID NO: 85344 - DNA, 20 bp, human
gaccggaccgcgcgggacac

SEQ ID NO: 85345 - DNA, 20 bp, human
gtggcgcatcgcctggagcg

SEQ ID NO: 85346 - DNA, 20 bp, human
gtgctgtccaggctgtcgca

SEQ ID NO: 85347 - DNA, 20 bp, human
gggtaagatcagccaaggat

SEQ ID NO: 85348 - DNA, 20 bp, human
ggccggccccaggagtaggt

SEQ ID NO: 85349 - DNA, 20 bp, human
gctgagagtgagactgacaa

SEQ ID NO: 85350 - DNA, 20 bp, human
gcccgagcatcagcagaggt

SEQ ID NO: 85351 - DNA, 20 bp, human
ggattcccgagcatcagcag

SEQ ID NO: 85352 - DNA, 20 bp, human
ggggtggggactgtagaaag

SEQ ID NO: 85353 - DNA, 20 bp, human
gctactcctggggccggcag

SEQ ID NO: 85354 - DNA, 20 bp, human
gactcaggtaagatcagcca

SEQ ID NO: 85355 - DNA, 20 bp, human
gcaccaggaacgatcaccaa

SEQ ID NO: 85356 - DNA, 20 bp, human
ggaaccatccagtattgact

SEQ ID NO: 85357 - DNA, 20 bp, human
gtaaagaagaggttcagttc

SEQ ID NO: 85358 - DNA, 20 bp, human
gatggacacataaaactagg

SEQ ID NO: 85359 - DNA, 20 bp, human
gaagactgccaagtcaatac

SEQ ID NO: 85360 - DNA, 20 bp, human
gtattgtacaaagttaggaa

SEQ ID NO: 85361 - DNA, 20 bp, human
gagcaaacaaattactcctc

SEQ ID NO: 85362 - DNA, 20 bp, human
gtacaacgaaatgatgctca

SEQ ID NO: 85363 - DNA, 20 bp, human
gtacctaattaactgcatgg

SEQ ID NO: 85364 - DNA, 20 bp, human
gcaatctggcagcgtcataa

SEQ ID NO: 85365 - DNA, 20 bp, human
gagttaattaggtagcccac

SEQ ID NO: 85366 - DNA, 20 bp, human
ggctttgccacagcaatcca

SEQ ID NO: 85367 - DNA, 20 bp, human
gttcaagccatggattgctg

SEQ ID NO: 85368 - DNA, 20 bp, human
ggacagatcgtgttattcag

SEQ ID NO: 85369 - DNA, 20 bp, human
gtagcaaggtaagaagctca

SEQ ID NO: 85370 - DNA, 20 bp, human
gcttaaaaccatacacagtg

SEQ ID NO: 85371 - DNA, 20 bp, human
gggatgattctagacactct

SEQ ID NO: 85372 - DNA, 20 bp, human
ggggttcctgggaaccacta

SEQ ID NO: 85373 - DNA, 20 bp, human
gagtgacttagtaaagaata

SEQ ID NO: 85374 - DNA, 20 bp, human
gaactcagataatggaacat

SEQ ID NO: 85375 - DNA, 20 bp, human
gatagccagccaatatagca

SEQ ID NO: 85376 - DNA, 20 bp, human
ggcccagcgagagagccctg

SEQ ID NO: 85377 - DNA, 20 bp, human
ggggaaggagatcctatcag

SEQ ID NO: 85378 - DNA, 20 bp, human
gatcagtggggagagtgtga

SEQ ID NO: 85379 - DNA, 20 bp, human
gagggcaggtgagtccccca

SEQ ID NO: 85380 - DNA, 20 bp, human
gagggcacacccaggatagg

SEQ ID NO: 85381 - DNA, 20 bp, human
gcccaccgcagaccatacta

SEQ ID NO: 85382 - DNA, 20 bp, human
gcgcagaccatactagggag

SEQ ID NO: 85383 - DNA, 20 bp, human
gataggaggctcagatctgg

SEQ ID NO: 85384 - DNA, 20 bp, human
gtgataatgggtcctagcaa

SEQ ID NO: 85385 - DNA, 20 bp, human
ggatctgagcctcctatcct

SEQ ID NO: 85386 - DNA, 20 bp, human
gtagacatggacctcagcac

SEQ ID NO: 85387 - DNA, 20 bp, human
gcagtagctgcacttctggg

SEQ ID NO: 85388 - DNA, 20 bp, human
ggtctggaccaagctagaca

SEQ ID NO: 85389 - DNA, 20 bp, human
gaaacacacctggtgcagaa

SEQ ID NO: 85390 - DNA, 20 bp, human
gcgggggcatgtagagagtg

SEQ ID NO: 85391 - DNA, 20 bp, human
ggagagttccgtgaagggaa

SEQ ID NO: 85392 - DNA, 20 bp, human
gctcaaactgagtcataatg

SEQ ID NO: 85393 - DNA, 20 bp, human
gtggtggagagttccgtgaa

SEQ ID NO: 85394 - DNA, 20 bp, human
gagacaaaatgttaacccca

SEQ ID NO: 85395 - DNA, 20 bp, human
gctgaggtccatgtctagct

SEQ ID NO: 85396 - DNA, 20 bp, human
ggagcaaaaagccgacccac

SEQ ID NO: 85397 - DNA, 20 bp, human
gcgactgcgctctctcccgt

SEQ ID NO: 85398 - DNA, 20 bp, human
gtgcgctctctcccgtgggt

SEQ ID NO: 85399 - DNA, 20 bp, human
ggagatgccgggacccgtcc

SEQ ID NO: 85400 - DNA, 20 bp, human
gactctgaaatcaggcgcgg

SEQ ID NO: 85401 - DNA, 20 bp, human
ggagcgcagtcggtggcagt

SEQ ID NO: 85402 - DNA, 20 bp, human
gagcctggccaacatgtggg

SEQ ID NO: 85403 - DNA, 20 bp, human
gtgggagagggagtgacgtc

SEQ ID NO: 85404 - DNA, 20 bp, human
gaacatgtggggggactctc

SEQ ID NO: 85405 - DNA, 20 bp, human
gacggaggccgaagaggcca

SEQ ID NO: 85406 - DNA, 20 bp, human
ggcgccgccgtctcactcgg

SEQ ID NO: 85407 - DNA, 20 bp, human
gtctcctccgagtgagacgg

SEQ ID NO: 85408 - DNA, 20 bp, human
gaccgcgccgccgtctcact

SEQ ID NO: 85409 - DNA, 20 bp, human
ggagccccaaccaaaacaag

SEQ ID NO: 85410 - DNA, 20 bp, human
gccgagatgggcccggatgg

SEQ ID NO: 85411 - DNA, 20 bp, human
ggctgcccggctgccgagcg

SEQ ID NO: 85412 - DNA, 20 bp, human
gacggcggcgcggtcggagg

SEQ ID NO: 85413 - DNA, 20 bp, human
gcaagggcgagaggggatgg

SEQ ID NO: 85414 - DNA, 20 bp, human
ggaggggacaagggcgagag

SEQ ID NO: 85415 - DNA, 20 bp, human
gctgcagaggacgcgcccgc

SEQ ID NO: 85416 - DNA, 20 bp, human
ggccgcgcgcgccttaggct

SEQ ID NO: 85417 - DNA, 20 bp, human
gcgatgtgttactcactgtg

SEQ ID NO: 85418 - DNA, 20 bp, human
gctgctgccaacggcgaccc

SEQ ID NO: 85419 - DNA, 20 bp, human
ggacgagcccgggtcgccgt

SEQ ID NO: 85420 - DNA, 20 bp, human
gggcggccgggcgcaagggt

SEQ ID NO: 85421 - DNA, 20 bp, human
ggcccgagggacgcgtgatc

SEQ ID NO: 85422 - DNA, 20 bp, human
ggccgggcgcaagggtggga

SEQ ID NO: 85423 - DNA, 20 bp, human
gcggggaccgcgacgagccc

SEQ ID NO: 85424 - DNA, 20 bp, human
ggcccgggcccggcgcccag

SEQ ID NO: 85425 - DNA, 20 bp, human
gccccaccgcctgggcccga

SEQ ID NO: 85426 - DNA, 20 bp, human
gctaagaggtgcagcagcgg

SEQ ID NO: 85427 - DNA, 20 bp, human
gcgcgagcggccaccagtag

SEQ ID NO: 85428 - DNA, 20 bp, human
ggagccagcgagcagatgca

SEQ ID NO: 85429 - DNA, 20 bp, human
gctggctcacggaaaagcac

SEQ ID NO: 85430 - DNA, 20 bp, human
gcgcgccgcggtggaatgag

SEQ ID NO: 85431 - DNA, 20 bp, human
gtgctaccggcgcaatggag

SEQ ID NO: 85432 - DNA, 20 bp, human
ggccgcggtggaatgagcgg

SEQ ID NO: 85433 - DNA, 20 bp, human
ggggttcccgaggaaagaag

SEQ ID NO: 85434 - DNA, 20 bp, human
ggaggaggacctgcccgtcg

SEQ ID NO: 85435 - DNA, 20 bp, human
gaagcgacaagaagactaag

SEQ ID NO: 85436 - DNA, 20 bp, human
ggtgctgggcatgtacgcgg

SEQ ID NO: 85437 - DNA, 20 bp, human
ggagaagaggctgagatccg

SEQ ID NO: 85438 - DNA, 20 bp, human
gcgggcgggccgggagatgg

SEQ ID NO: 85439 - DNA, 20 bp, human
ggccgggcgcctgcgagcac

SEQ ID NO: 85440 - DNA, 20 bp, human
ggcgtacatgcccagcaccg

SEQ ID NO: 85441 - DNA, 20 bp, human
ggcaggaaggcgctgtagtt

SEQ ID NO: 85442 - DNA, 20 bp, human
gtcctctgcccggtgctcgc

SEQ ID NO: 85443 - DNA, 20 bp, human
ggcctgcgagcaccgggcag

SEQ ID NO: 85444 - DNA, 20 bp, human
gccgcggcgctcaggtactg

SEQ ID NO: 85445 - DNA, 20 bp, human
gcccggtcggcccgacgagg

SEQ ID NO: 85446 - DNA, 20 bp, human
ggcagcagcgcggagccggt

SEQ ID NO: 85447 - DNA, 20 bp, human
gggccgccgagcccgggtag

SEQ ID NO: 85448 - DNA, 20 bp, human
gccgcgcccggttaccatgt

SEQ ID NO: 85449 - DNA, 20 bp, human
gcgtgaaggccgccgagccc

SEQ ID NO: 85450 - DNA, 20 bp, human
gccggccgggcgtggatgga

SEQ ID NO: 85451 - DNA, 20 bp, human
gcggcgttcagcccctaccc

SEQ ID NO: 85452 - DNA, 20 bp, human
gtacaggtagccctgcgggt

SEQ ID NO: 85453 - DNA, 20 bp, human
gatgtaggacgggaagccgg

SEQ ID NO: 85454 - DNA, 20 bp, human
ggtcggccgagtactgcagc

SEQ ID NO: 85455 - DNA, 20 bp, human
ggggagcccgctgcagtact

SEQ ID NO: 85456 - DNA, 20 bp, human
gctgcgccctgggctaagta

SEQ ID NO: 85457 - DNA, 20 bp, human
gggcagtgaggagcgaggag

SEQ ID NO: 85458 - DNA, 20 bp, human
ggctccggcggccgagagga

SEQ ID NO: 85459 - DNA, 20 bp, human
gagattggcggagattcccg

SEQ ID NO: 85460 - DNA, 20 bp, human
gcagcggaagcgatcctggg

SEQ ID NO: 85461 - DNA, 20 bp, human
ggagggagcgcggcgcagag

SEQ ID NO: 85462 - DNA, 20 bp, human
gcaaaagttgtggacactta

SEQ ID NO: 85463 - DNA, 20 bp, human
gaggtcaggtccgaacagat

SEQ ID NO: 85464 - DNA, 20 bp, human
ggtaaggcagccaaaagttg

SEQ ID NO: 85465 - DNA, 20 bp, human
gaagcagcggaagcgatcct

SEQ ID NO: 85466 - DNA, 20 bp, human
gccccctcggagccagtggt

SEQ ID NO: 85467 - DNA, 20 bp, human
gcgactccccggtgcgtccc

SEQ ID NO: 85468 - DNA, 20 bp, human
gctctggagagcctagcgac

SEQ ID NO: 85469 - DNA, 20 bp, human
gggccgcgggcccccatgga

SEQ ID NO: 85470 - DNA, 20 bp, human
gtcgcagcccgggacgcacc

SEQ ID NO: 85471 - DNA, 20 bp, human
gagagggccgcgggccccca

SEQ ID NO: 85472 - DNA, 20 bp, human
gcagcctcaggccgtaccca

SEQ ID NO: 85473 - DNA, 20 bp, human
ggattcaccgcttgtccctg

SEQ ID NO: 85474 - DNA, 20 bp, human
gggctgcgagctgctccccg

SEQ ID NO: 85475 - DNA, 20 bp, human
ggccgtacccagggagcaag

SEQ ID NO: 85476 - DNA, 20 bp, human
gaggcagtcgagccagcgta

SEQ ID NO: 85477 - DNA, 20 bp, human
gccagcgtagggcgagaacg

SEQ ID NO: 85478 - DNA, 20 bp, human
gcctcgctctttgcaccggg

SEQ ID NO: 85479 - DNA, 20 bp, human
gaccacgtacgaggagaagg

SEQ ID NO: 85480 - DNA, 20 bp, human
gccagaggagcggcggccca

SEQ ID NO: 85481 - DNA, 20 bp, human
gtacaagtagccctgcggat

SEQ ID NO: 85482 - DNA, 20 bp, human
gggccgagctcatccgtgcg

SEQ ID NO: 85483 - DNA, 20 bp, human
gtggccatgtcctatccgca

SEQ ID NO: 85484 - DNA, 20 bp, human
gctcgtacgtggtaagtgag

SEQ ID NO: 85485 - DNA, 20 bp, human
ggacgctggtgctgtacgcc

SEQ ID NO: 85486 - DNA, 20 bp, human
gcaggagtctgagtgaacag

SEQ ID NO: 85487 - DNA, 20 bp, human
gagtgaacagaggcgcgtgg

SEQ ID NO: 85488 - DNA, 20 bp, human
gcccggagcaagtgtgagtg

SEQ ID NO: 85489 - DNA, 20 bp, human
gacagaggcgcgtgggggag

SEQ ID NO: 85490 - DNA, 20 bp, human
gaggcgagaggcaaccgggg

SEQ ID NO: 85491 - DNA, 20 bp, human
ggctggggtgggcgaaggct

SEQ ID NO: 85492 - DNA, 20 bp, human
gcaaattacccgggagaagt

SEQ ID NO: 85493 - DNA, 20 bp, human
gaggaggcgagaggcaaccg

SEQ ID NO: 85494 - DNA, 20 bp, human
gcggggcctgcgcggctcag

SEQ ID NO: 85495 - DNA, 20 bp, human
ggtgagctccaggcgaaaag

SEQ ID NO: 85496 - DNA, 20 bp, human
ggcgggtcggagcgacgccg

SEQ ID NO: 85497 - DNA, 20 bp, human
ggtccgccccgtgcaagggg

SEQ ID NO: 85498 - DNA, 20 bp, human
gggccgttccggttaagcag

SEQ ID NO: 85499 - DNA, 20 bp, human
gcccgtgcaaggggaggtca

SEQ ID NO: 85500 - DNA, 20 bp, human
gacggccgaacagcgcaggc

SEQ ID NO: 85501 - DNA, 20 bp, human
gcgggccggaggggatcccg

SEQ ID NO: 85502 - DNA, 20 bp, human
gagaggctgaacgtgcccgg

SEQ ID NO: 85503 - DNA, 20 bp, human
ggcattgacgccacaagctt

SEQ ID NO: 85504 - DNA, 20 bp, human
gggcttgctagaggcacaga

SEQ ID NO: 85505 - DNA, 20 bp, human
gccgaaggaccgctgtgtcg

SEQ ID NO: 85506 - DNA, 20 bp, human
gtctcccccgtttctcaccc

SEQ ID NO: 85507 - DNA, 20 bp, human
ggagcgcctcacgctaaacc

SEQ ID NO: 85508 - DNA, 20 bp, human
gacggccgcgacgcagagag

SEQ ID NO: 85509 - DNA, 20 bp, human
ggttagggacgacccccagg

SEQ ID NO: 85510 - DNA, 20 bp, human
ggccgttagggacgaccccc

SEQ ID NO: 85511 - DNA, 20 bp, human
gcgaggggcggagcttgtgg

SEQ ID NO: 85512 - DNA, 20 bp, human
gccaggtaggaggccggacg

SEQ ID NO: 85513 - DNA, 20 bp, human
gcagacagttgcgtccaggt

SEQ ID NO: 85514 - DNA, 20 bp, human
gctggacgcaactgtctgtg

SEQ ID NO: 85515 - DNA, 20 bp, human
gtgggaggccgtccaggtgg

SEQ ID NO: 85516 - DNA, 20 bp, human
gtggggctttccgtctgagg

SEQ ID NO: 85517 - DNA, 20 bp, human
ggcgcaagccggcaagatgg

SEQ ID NO: 85518 - DNA, 20 bp, human
gcgagtcagggcaaagacgt

SEQ ID NO: 85519 - DNA, 20 bp, human
gcctcggcgtcgctctggac

SEQ ID NO: 85520 - DNA, 20 bp, human
ggacagacacacccccggag

SEQ ID NO: 85521 - DNA, 20 bp, human
gcaggcgcaagccggcaaga

SEQ ID NO: 85522 - DNA, 20 bp, human
gagcaagggaaagcgagtca

SEQ ID NO: 85523 - DNA, 20 bp, human
gctagctgcgcagaaccccg

SEQ ID NO: 85524 - DNA, 20 bp, human
ggctttccgtctgaggcggg

SEQ ID NO: 85525 - DNA, 20 bp, human
ggaagtcgccgcccgatgag

SEQ ID NO: 85526 - DNA, 20 bp, human
gacggcacaagctcctgtac

SEQ ID NO: 85527 - DNA, 20 bp, human
ggccgaagccggcggctgag

SEQ ID NO: 85528 - DNA, 20 bp, human
gccctgccggcgggatgtag

SEQ ID NO: 85529 - DNA, 20 bp, human
gatgtagaggacagacagga

SEQ ID NO: 85530 - DNA, 20 bp, human
ggtcacccctgagatcctca

SEQ ID NO: 85531 - DNA, 20 bp, human
ggggcgagctcctgtaccca

SEQ ID NO: 85532 - DNA, 20 bp, human
gcacacaggttcagagactg

SEQ ID NO: 85533 - DNA, 20 bp, human
gaggagggagcactgtccct

SEQ ID NO: 85534 - DNA, 20 bp, human
gcgggatgtagaggacagac

SEQ ID NO: 85535 - DNA, 20 bp, human
ggagcactgtccctgggtac

SEQ ID NO: 85536 - DNA, 20 bp, human
ggcagcctcgtgaacgtcca

SEQ ID NO: 85537 - DNA, 20 bp, human
ggccaggccactctcccggt

SEQ ID NO: 85538 - DNA, 20 bp, human
gaggtggtgtcggaaacaaa

SEQ ID NO: 85539 - DNA, 20 bp, human
ggtgtcggaaacaaagggca

SEQ ID NO: 85540 - DNA, 20 bp, human
gcacgggcagggtaaggcag

SEQ ID NO: 85541 - DNA, 20 bp, human
gagcaccgtggacgttcacg

SEQ ID NO: 85542 - DNA, 20 bp, human
ggtggccatggactgcgaga

SEQ ID NO: 85543 - DNA, 20 bp, human
gtggggccccaccgggagag

SEQ ID NO: 85544 - DNA, 20 bp, human
gaacatggctgggagccgtg

SEQ ID NO: 85545 - DNA, 20 bp, human
gacaagttcatccggcctga

SEQ ID NO: 85546 - DNA, 20 bp, human
gctggacccgtctgggaggt

SEQ ID NO: 85547 - DNA, 20 bp, human
ggtcttagctggacccgtct

SEQ ID NO: 85548 - DNA, 20 bp, human
gagcatacttcggatccccg

SEQ ID NO: 85549 - DNA, 20 bp, human
gttagctggacccgtctggg

SEQ ID NO: 85550 - DNA, 20 bp, human
gggcccctctagccccgtgg

SEQ ID NO: 85551 - DNA, 20 bp, human
ggcctaggaaaggaacatct

SEQ ID NO: 85552 - DNA, 20 bp, human
ggcagcccgccggacacctc

SEQ ID NO: 85553 - DNA, 20 bp, human
gttcacttccgtaagaggag

SEQ ID NO: 85554 - DNA, 20 bp, human
gccgtggtggtacaacgcga

SEQ ID NO: 85555 - DNA, 20 bp, human
gcacctggataagcatactt

SEQ ID NO: 85556 - DNA, 20 bp, human
ggctgcggcggcggcagact

SEQ ID NO: 85557 - DNA, 20 bp, human
ggccggcggagttggcggag

SEQ ID NO: 85558 - DNA, 20 bp, human
gggagtccaatttaagccgg

SEQ ID NO: 85559 - DNA, 20 bp, human
gagtaagcatgcaggcgtgg

SEQ ID NO: 85560 - DNA, 20 bp, human
gcaatttaagccggcggagt

SEQ ID NO: 85561 - DNA, 20 bp, human
gtggactcctagatccgcga

SEQ ID NO: 85562 - DNA, 20 bp, human
gagagctttggagggcacac

SEQ ID NO: 85563 - DNA, 20 bp, human
gacgcctgcatgcttactgt

SEQ ID NO: 85564 - DNA, 20 bp, human
ggaaccgacagtaagcatgc

SEQ ID NO: 85565 - DNA, 20 bp, human
ggccgcgccctcgcggatct

SEQ ID NO: 85566 - DNA, 20 bp, human
gcagggaagtgcagcctaga

SEQ ID NO: 85567 - DNA, 20 bp, human
gcctggcctttccttaccaa

SEQ ID NO: 85568 - DNA, 20 bp, human
ggagaaggagagcccacttc

SEQ ID NO: 85569 - DNA, 20 bp, human
gaaacgcaagattctagaga

SEQ ID NO: 85570 - DNA, 20 bp, human
gtcaggaataacagaagctg

SEQ ID NO: 85571 - DNA, 20 bp, human
gatctttataggttccatct

SEQ ID NO: 85572 - DNA, 20 bp, human
gtttgtcagaggttagaagg

SEQ ID NO: 85573 - DNA, 20 bp, human
gagtaaagatactcctgaag

SEQ ID NO: 85574 - DNA, 20 bp, human
ggaaaacgctcatttgtcag

SEQ ID NO: 85575 - DNA, 20 bp, human
gatgcaaagacccgcttcta

SEQ ID NO: 85576 - DNA, 20 bp, human
ggagatgtgcgcaaagtgtg

SEQ ID NO: 85577 - DNA, 20 bp, human
ggcgcaaagtgtgcggccag

SEQ ID NO: 85578 - DNA, 20 bp, human
ggttagttagcaaagagccg

SEQ ID NO: 85579 - DNA, 20 bp, human
gagccggctaggatgacttc

SEQ ID NO: 85580 - DNA, 20 bp, human
gttcaactccgcggggcagt

SEQ ID NO: 85581 - DNA, 20 bp, human
gactaactcctactgccccg

SEQ ID NO: 85582 - DNA, 20 bp, human
gtcgctccttcaactccgcg

SEQ ID NO: 85583 - DNA, 20 bp, human
gagcccgaagtcatcctagc

SEQ ID NO: 85584 - DNA, 20 bp, human
gctagctttgaaaaaccgaa

SEQ ID NO: 85585 - DNA, 20 bp, human
gggcaattaggtttgattta

SEQ ID NO: 85586 - DNA, 20 bp, human
ggggagaactctccactcgg

SEQ ID NO: 85587 - DNA, 20 bp, human
ggtcagctaggaacaggccg

SEQ ID NO: 85588 - DNA, 20 bp, human
gcattggccgggaagccagg

SEQ ID NO: 85589 - DNA, 20 bp, human
gagccaggcaggatgaagac

SEQ ID NO: 85590 - DNA, 20 bp, human
gcctggaaccatccactgag

SEQ ID NO: 85591 - DNA, 20 bp, human
gaggtcgcggtaggcacagt

SEQ ID NO: 85592 - DNA, 20 bp, human
ggcacaggcctgcacatcga

SEQ ID NO: 85593 - DNA, 20 bp, human
gacggattctaggtcgcggt

SEQ ID NO: 85594 - DNA, 20 bp, human
gcggcacggattctaggtcg

SEQ ID NO: 85595 - DNA, 20 bp, human
gggaggcctgttggacatag

SEQ ID NO: 85596 - DNA, 20 bp, human
ggagctagggagcgacagtc

SEQ ID NO: 85597 - DNA, 20 bp, human
ggaggctgtgaagatatggg

SEQ ID NO: 85598 - DNA, 20 bp, human
gtggcgggacaggcgcgtga

SEQ ID NO: 85599 - DNA, 20 bp, human
gcgctactcttgagcacggt

SEQ ID NO: 85600 - DNA, 20 bp, human
gggcggggcgggggagacta

SEQ ID NO: 85601 - DNA, 20 bp, human
gtgagaggctgtgaagatat

SEQ ID NO: 85602 - DNA, 20 bp, human
ggccacggagaccctcccca

SEQ ID NO: 85603 - DNA, 20 bp, human
gagatatggggggcagatat

SEQ ID NO: 85604 - DNA, 20 bp, human
gaagtagaccaagcaggagg

SEQ ID NO: 85605 - DNA, 20 bp, human
gttcagcgacgaggaggcgg

SEQ ID NO: 85606 - DNA, 20 bp, human
gggcgccgcggccacatctg

SEQ ID NO: 85607 - DNA, 20 bp, human
gcgcggcgccgcagctggag

SEQ ID NO: 85608 - DNA, 20 bp, human
gcgagcccccgagcgcacat

SEQ ID NO: 85609 - DNA, 20 bp, human
gcgcgcacggccctctccgg

SEQ ID NO: 85610 - DNA, 20 bp, human
gcctccccgcgcttctctgg

SEQ ID NO: 85611 - DNA, 20 bp, human
gagccgcgcacggccctctc

SEQ ID NO: 85612 - DNA, 20 bp, human
gagcggccgccagagaagcg

SEQ ID NO: 85613 - DNA, 20 bp, human
gcgccgccgccgcaccacgg

SEQ ID NO: 85614 - DNA, 20 bp, human
gggcggcggagacggagact

SEQ ID NO: 85615 - DNA, 20 bp, human
ggccgcgcgtctcaaaagga

SEQ ID NO: 85616 - DNA, 20 bp, human
ggcgggaccgggacacacac

SEQ ID NO: 85617 - DNA, 20 bp, human
gggtggccgacactccacgg

SEQ ID NO: 85618 - DNA, 20 bp, human
gtgaggtggccgacactcca

SEQ ID NO: 85619 - DNA, 20 bp, human
gtgcaggcgaggtccgctca

SEQ ID NO: 85620 - DNA, 20 bp, human
ggaccccccgatggagagag

SEQ ID NO: 85621 - DNA, 20 bp, human
gggcccctctctccatcggg

SEQ ID NO: 85622 - DNA, 20 bp, human
gcccggccaccgtggagtgt

SEQ ID NO: 85623 - DNA, 20 bp, human
gtcgcagaggtgagtggcgg

SEQ ID NO: 85624 - DNA, 20 bp, human
gagcctcacgaggctcgcag

SEQ ID NO: 85625 - DNA, 20 bp, human
gtggccccggctcctcgcgt

SEQ ID NO: 85626 - DNA, 20 bp, human
ggacgctcgggggaacatgg

SEQ ID NO: 85627 - DNA, 20 bp, human
ggcagacgctcgggggaaca

SEQ ID NO: 85628 - DNA, 20 bp, human
ggcgagtggctgagtccgaa

SEQ ID NO: 85629 - DNA, 20 bp, human
gtggggagcgcaaggaccgc

SEQ ID NO: 85630 - DNA, 20 bp, human
ggggcggctcggggcacctg

SEQ ID NO: 85631 - DNA, 20 bp, human
ggacccacctggatctgcaa

SEQ ID NO: 85632 - DNA, 20 bp, human
gtcggagctcgcagacgctc

SEQ ID NO: 85633 - DNA, 20 bp, human
gtccttgcgctccccaacag

SEQ ID NO: 85634 - DNA, 20 bp, human
gtgaggagcgcggcgaaggc

SEQ ID NO: 85635 - DNA, 20 bp, human
gcagccggctgggtgcgact

SEQ ID NO: 85636 - DNA, 20 bp, human
gccgcaagaggcctcagcgg

SEQ ID NO: 85637 - DNA, 20 bp, human
gtggccgtccgagagccgag

SEQ ID NO: 85638 - DNA, 20 bp, human
ggccctgggaagcccgcaag

SEQ ID NO: 85639 - DNA, 20 bp, human
gtccgagagccgagaggtga

SEQ ID NO: 85640 - DNA, 20 bp, human
gtggaggtgggcggcaacag

SEQ ID NO: 85641 - DNA, 20 bp, human
ggaccgggtggggaaatcaa

SEQ ID NO: 85642 - DNA, 20 bp, human
ggtgtccagccctaacgaaa

SEQ ID NO: 85643 - DNA, 20 bp, human
ggggtacccaaggccaaagg

SEQ ID NO: 85644 - DNA, 20 bp, human
gcgaaacggtaaccagccct

SEQ ID NO: 85645 - DNA, 20 bp, human
gaggccgggtttccgagacc

SEQ ID NO: 85646 - DNA, 20 bp, human
gcagccactgagacgatctg

SEQ ID NO: 85647 - DNA, 20 bp, human
gttcccacagatcgtctcag

SEQ ID NO: 85648 - DNA, 20 bp, human
ggagacgatctgtgggaagt

SEQ ID NO: 85649 - DNA, 20 bp, human
ggaagtaggcgatgttgtgg

SEQ ID NO: 85650 - DNA, 20 bp, human
gtgggaagtaggcgatgttg

SEQ ID NO: 85651 - DNA, 20 bp, human
ggtggctgcccgcatgctca

SEQ ID NO: 85652 - DNA, 20 bp, human
gggtcataccttgagcatgc

SEQ ID NO: 85653 - DNA, 20 bp, human
gctgcatgtcacacaggaac

SEQ ID NO: 85654 - DNA, 20 bp, human
gcttctcctgcatgtcacac

SEQ ID NO: 85655 - DNA, 20 bp, human
ggagttgggcctggacgcct

SEQ ID NO: 85656 - DNA, 20 bp, human
ggggacgatcccgacagcta

SEQ ID NO: 85657 - DNA, 20 bp, human
gccgagccgcgagggcagat

SEQ ID NO: 85658 - DNA, 20 bp, human
ggtagggtgtagctgatgag

SEQ ID NO: 85659 - DNA, 20 bp, human
gaggccctggagaggtaatg

SEQ ID NO: 85660 - DNA, 20 bp, human
ggggctccgacggctgaggg

SEQ ID NO: 85661 - DNA, 20 bp, human
gaggcgcccccctcagccgt

SEQ ID NO: 85662 - DNA, 20 bp, human
gcgaagggcagaccacggag

SEQ ID NO: 85663 - DNA, 20 bp, human
gctgtcgggatcgtcccctg

SEQ ID NO: 85664 - DNA, 20 bp, human
gagcaacagcggggctccga

SEQ ID NO: 85665 - DNA, 20 bp, human
gctgcggggcagcaacagcg

SEQ ID NO: 85666 - DNA, 20 bp, human
gctccgggccagaaaagacg

SEQ ID NO: 85667 - DNA, 20 bp, human
gggatggtgaaccctgaagt

SEQ ID NO: 85668 - DNA, 20 bp, human
gctcggggcaggaagactag

SEQ ID NO: 85669 - DNA, 20 bp, human
gccaaggaagacacacctcg

SEQ ID NO: 85670 - DNA, 20 bp, human
gggattcggttaggtgagtg

SEQ ID NO: 85671 - DNA, 20 bp, human
ggcagcagacaccgacttca

SEQ ID NO: 85672 - DNA, 20 bp, human
ggaagtgggggtcagaccgg

SEQ ID NO: 85673 - DNA, 20 bp, human
gctgcgccgcgggccctcga

SEQ ID NO: 85674 - DNA, 20 bp, human
ggggccagaaaagacggggt

SEQ ID NO: 85675 - DNA, 20 bp, human
gcagggttcaccatccaaaa

SEQ ID NO: 85676 - DNA, 20 bp, human
gtaaaggaccccacaaggaa

SEQ ID NO: 85677 - DNA, 20 bp, human
gcagcataaaggaccccaca

SEQ ID NO: 85678 - DNA, 20 bp, human
gactgggagaaacagcataa

SEQ ID NO: 85679 - DNA, 20 bp, human
gtcagtctgtctcaggagac

SEQ ID NO: 85680 - DNA, 20 bp, human
gggcctcttcagtctgtctc

SEQ ID NO: 85681 - DNA, 20 bp, human
ggctctagccagcctttagg

SEQ ID NO: 85682 - DNA, 20 bp, human
gggactgaattggccacctg

SEQ ID NO: 85683 - DNA, 20 bp, human
gctagccagcctttaggagg

SEQ ID NO: 85684 - DNA, 20 bp, human
gaggccctttctctctgact

SEQ ID NO: 85685 - DNA, 20 bp, human
ggtaaagcccaggactgaat

SEQ ID NO: 85686 - DNA, 20 bp, human
gcctgtccaagaaactccac

SEQ ID NO: 85687 - DNA, 20 bp, human
gagaagacgccgacgctcac

SEQ ID NO: 85688 - DNA, 20 bp, human
ggagttacggtgcatagtgt

SEQ ID NO: 85689 - DNA, 20 bp, human
gtatgcaccgtaactcggag

SEQ ID NO: 85690 - DNA, 20 bp, human
gacaccatggtgagtagggt

SEQ ID NO: 85691 - DNA, 20 bp, human
ggcaaaacatcagtgtctgt

SEQ ID NO: 85692 - DNA, 20 bp, human
gcttcagttcctgtgagcgt

SEQ ID NO: 85693 - DNA, 20 bp, human
ggaatcccctcgttacacca

SEQ ID NO: 85694 - DNA, 20 bp, human
gagttccttggtgtaacgag

SEQ ID NO: 85695 - DNA, 20 bp, human
gtaggtcccgctccgagtta

SEQ ID NO: 85696 - DNA, 20 bp, human
gtccacctggggcgctcatt

SEQ ID NO: 85697 - DNA, 20 bp, human
gtggggcgctcattcggtag

SEQ ID NO: 85698 - DNA, 20 bp, human
gcctgtccaagaaactccac

SEQ ID NO: 85699 - DNA, 20 bp, human
gagaagacgccgacgctcac

SEQ ID NO: 85700 - DNA, 20 bp, human
ggagttacggtgcatagtgt

SEQ ID NO: 85701 - DNA, 20 bp, human
gtatgcaccgtaactcggag

SEQ ID NO: 85702 - DNA, 20 bp, human
gacaccatggtgagtagggt

SEQ ID NO: 85703 - DNA, 20 bp, human
ggcaaaacatcagtgtctgt

SEQ ID NO: 85704 - DNA, 20 bp, human
gcttcagttcctgtgagcgt

SEQ ID NO: 85705 - DNA, 20 bp, human
ggaatcccctcgttacacca

SEQ ID NO: 85706 - DNA, 20 bp, human
gaccggcgcagagtcgactc

SEQ ID NO: 85707 - DNA, 20 bp, human
gtcggctggggcgggaacaa

SEQ ID NO: 85708 - DNA, 20 bp, human
gctctcgacgaagaactggg

SEQ ID NO: 85709 - DNA, 20 bp, human
gcaagcatgaccccgagccg

SEQ ID NO: 85710 - DNA, 20 bp, human
ggcggacagcgcgggctctc

SEQ ID NO: 85711 - DNA, 20 bp, human
gggcagggacggcctccgtg

SEQ ID NO: 85712 - DNA, 20 bp, human
gggtgaagcgcgtggacgtg

SEQ ID NO: 85713 - DNA, 20 bp, human
ggaccgcccggcaggtgccc

SEQ ID NO: 85714 - DNA, 20 bp, human
ggcctgagtcgactctgcgc

SEQ ID NO: 85715 - DNA, 20 bp, human
gtacggccccgaggccatcg

SEQ ID NO: 85716 - DNA, 20 bp, human
gggagtgggacgcgcggttc

SEQ ID NO: 85717 - DNA, 20 bp, human
gaaacccccgtgggcgaact

SEQ ID NO: 85718 - DNA, 20 bp, human
ggcctggggccactctccag

SEQ ID NO: 85719 - DNA, 20 bp, human
gcggctgccatcttagtcta

SEQ ID NO: 85720 - DNA, 20 bp, human
gctcagtccctagactaaga

SEQ ID NO: 85721 - DNA, 20 bp, human
gagtcccggtaaacccccgt

SEQ ID NO: 85722 - DNA, 20 bp, human
gggcgacgtggccctgtgag

SEQ ID NO: 85723 - DNA, 20 bp, human
gcagagccggtgtctgtcgg

SEQ ID NO: 85724 - DNA, 20 bp, human
gccgcgcccccgacagacac

SEQ ID NO: 85725 - DNA, 20 bp, human
ggggggtttaccgggactcg

SEQ ID NO: 85726 - DNA, 20 bp, human
ggaagagggcccaggagctc

SEQ ID NO: 85727 - DNA, 20 bp, human
ggtgcaagccctgcgaggag

SEQ ID NO: 85728 - DNA, 20 bp, human
ggtagctgggtcagaacctg

SEQ ID NO: 85729 - DNA, 20 bp, human
ggagggtaggtcaaactgta

SEQ ID NO: 85730 - DNA, 20 bp, human
gtgagggccgcagacttctt

SEQ ID NO: 85731 - DNA, 20 bp, human
gtcggaagggcagccctagt

SEQ ID NO: 85732 - DNA, 20 bp, human
ggcgaggagcggcgagaaga

SEQ ID NO: 85733 - DNA, 20 bp, human
gtgaggggctgccatggcgg

SEQ ID NO: 85734 - DNA, 20 bp, human
ggtgctgtcagggcttttga

SEQ ID NO: 85735 - DNA, 20 bp, human
gaggtccccgaaagccgcaa

SEQ ID NO: 85736 - DNA, 20 bp, human
gcttaggtggccttccgctc

SEQ ID NO: 85737 - DNA, 20 bp, human
gctggcggctgtcgcgacgg

SEQ ID NO: 85738 - DNA, 20 bp, human
gcgacagccgccagagcgga

SEQ ID NO: 85739 - DNA, 20 bp, human
gctggatctgtgcagggacg

SEQ ID NO: 85740 - DNA, 20 bp, human
ggctctggcggctgtcgcga

SEQ ID NO: 85741 - DNA, 20 bp, human
gacgctcacgtggcacgctc

SEQ ID NO: 85742 - DNA, 20 bp, human
gctgtcgcgacgggggttca

SEQ ID NO: 85743 - DNA, 20 bp, human
gggagacgttgataacgata

SEQ ID NO: 85744 - DNA, 20 bp, human
gtggcacctccaagagcaga

SEQ ID NO: 85745 - DNA, 20 bp, human
gctcacgtggcacgctcggg

SEQ ID NO: 85746 - DNA, 20 bp, human
ggcgtgcacgcgcgagtacg

SEQ ID NO: 85747 - DNA, 20 bp, human
gcccaagtccctcagcgggt

SEQ ID NO: 85748 - DNA, 20 bp, human
gtggatgagaagcctcacgg

SEQ ID NO: 85749 - DNA, 20 bp, human
gagcggcgcggtcgggtgag

SEQ ID NO: 85750 - DNA, 20 bp, human
ggctcactcacctgccgccg

SEQ ID NO: 85751 - DNA, 20 bp, human
ggctcacctacgctgcgcca

SEQ ID NO: 85752 - DNA, 20 bp, human
gagcctcacgggggtcggag

SEQ ID NO: 85753 - DNA, 20 bp, human
gaaacactctcaggcaaccc

SEQ ID NO: 85754 - DNA, 20 bp, human
gccaagagcgaaagcgacca

SEQ ID NO: 85755 - DNA, 20 bp, human
gacggcggggagctccctac

SEQ ID NO: 85756 - DNA, 20 bp, human
gggcacactcgctacaagat

SEQ ID NO: 85757 - DNA, 20 bp, human
gggtggagtgtggttaacca

SEQ ID NO: 85758 - DNA, 20 bp, human
gtatggatgatgaagtctgt

SEQ ID NO: 85759 - DNA, 20 bp, human
gtggttaaccagggtcagtg

SEQ ID NO: 85760 - DNA, 20 bp, human
gcaagattggttagtgatta

SEQ ID NO: 85761 - DNA, 20 bp, human
gaatactgagttctctgggg

SEQ ID NO: 85762 - DNA, 20 bp, human
gctgtgtcccctgagccaaa

SEQ ID NO: 85763 - DNA, 20 bp, human
gaaaatacacccagatgcag

SEQ ID NO: 85764 - DNA, 20 bp, human
ggtgtatagcagctggattt

SEQ ID NO: 85765 - DNA, 20 bp, human
gtcatcatacttctcttacc

SEQ ID NO: 85766 - DNA, 20 bp, human
gggcagaggactgggaaccg

SEQ ID NO: 85767 - DNA, 20 bp, human
ggcaggcgacagcgacccct

SEQ ID NO: 85768 - DNA, 20 bp, human
gggcgacagcgacccctggg

SEQ ID NO: 85769 - DNA, 20 bp, human
gagatcaccctctcaatgaa

SEQ ID NO: 85770 - DNA, 20 bp, human
gggagcagcctcagcgccag

SEQ ID NO: 85771 - DNA, 20 bp, human
gcgggccaaatcccctaagg

SEQ ID NO: 85772 - DNA, 20 bp, human
gctgggcgccgctgccactg

SEQ ID NO: 85773 - DNA, 20 bp, human
gaccgcggcagcgggataag

SEQ ID NO: 85774 - DNA, 20 bp, human
ggtactcaggccaggctacg

SEQ ID NO: 85775 - DNA, 20 bp, human
gagtccttcaccctaggagt

SEQ ID NO: 85776 - DNA, 20 bp, human
gtactggacagaaaccgatc

SEQ ID NO: 85777 - DNA, 20 bp, human
ggaacaggtgagtgacgaag

SEQ ID NO: 85778 - DNA, 20 bp, human
ggccagaggacttctcatac

SEQ ID NO: 85779 - DNA, 20 bp, human
gtcacctgtcaggaacacca

SEQ ID NO: 85780 - DNA, 20 bp, human
ggacagaaaccgatcaggca

SEQ ID NO: 85781 - DNA, 20 bp, human
gtaggttaggaagcgaacac

SEQ ID NO: 85782 - DNA, 20 bp, human
gtccagtatgagaagtcctc

SEQ ID NO: 85783 - DNA, 20 bp, human
gggggagttccatgcctgat

SEQ ID NO: 85784 - DNA, 20 bp, human
gttcaaacagtcatatgtga

SEQ ID NO: 85785 - DNA, 20 bp, human
gaaatcttacacaaggtcct

SEQ ID NO: 85786 - DNA, 20 bp, human
gcaggagggccaccagatct

SEQ ID NO: 85787 - DNA, 20 bp, human
gggctgggtccggtgtgcag

SEQ ID NO: 85788 - DNA, 20 bp, human
gtgggtccggtgtgcagcgg

SEQ ID NO: 85789 - DNA, 20 bp, human
gtgggccttggaggcaccta

SEQ ID NO: 85790 - DNA, 20 bp, human
ggactccgagaggcaagggg

SEQ ID NO: 85791 - DNA, 20 bp, human
gagcggcagcctcctcggcg

SEQ ID NO: 85792 - DNA, 20 bp, human
ggcacctaaggcgcccagga

SEQ ID NO: 85793 - DNA, 20 bp, human
gggcagccgtgcgggaaccc

SEQ ID NO: 85794 - DNA, 20 bp, human
ggcagctgaggtctgaccct

SEQ ID NO: 85795 - DNA, 20 bp, human
gtccatggcccgcggcacgg

SEQ ID NO: 85796 - DNA, 20 bp, human
gggtttgcagaggtttgcag

SEQ ID NO: 85797 - DNA, 20 bp, human
gcactctagaagctgtccag

SEQ ID NO: 85798 - DNA, 20 bp, human
gggagggtgcttaacagaca

SEQ ID NO: 85799 - DNA, 20 bp, human
gagttgcgctgggtttgcag

SEQ ID NO: 85800 - DNA, 20 bp, human
gaggcctgggatagcaggaa

SEQ ID NO: 85801 - DNA, 20 bp, human
ggcgggggagagaagccctc

SEQ ID NO: 85802 - DNA, 20 bp, human
gccatcctgggtctgaccgg

SEQ ID NO: 85803 - DNA, 20 bp, human
ggacagcttctagagtgtgc

SEQ ID NO: 85804 - DNA, 20 bp, human
gggacccgcgcggcttcctg

SEQ ID NO: 85805 - DNA, 20 bp, human
ggagggattgggcggaacta

SEQ ID NO: 85806 - DNA, 20 bp, human
gggctcaggtgaaggtataa

SEQ ID NO: 85807 - DNA, 20 bp, human
gagggcacatgtgggctgat

SEQ ID NO: 85808 - DNA, 20 bp, human
gataagggcagggcacatgt

SEQ ID NO: 85809 - DNA, 20 bp, human
ggtgtccactgcaagccctc

SEQ ID NO: 85810 - DNA, 20 bp, human
gtgcagtggacacaaagctc

SEQ ID NO: 85811 - DNA, 20 bp, human
gcatgggaggtgagccgtaa

SEQ ID NO: 85812 - DNA, 20 bp, human
gaggtgaaggtataagggca

SEQ ID NO: 85813 - DNA, 20 bp, human
gggtgaggccacccagaggg

SEQ ID NO: 85814 - DNA, 20 bp, human
gatagcccctggactcatgg

SEQ ID NO: 85815 - DNA, 20 bp, human
gccacaaggacagccatggg

SEQ ID NO: 85816 - DNA, 20 bp, human
gtgcgctccgtagcgctgat

SEQ ID NO: 85817 - DNA, 20 bp, human
gctactcggtcgccctccat

SEQ ID NO: 85818 - DNA, 20 bp, human
ggccgcgaagccgggatcga

SEQ ID NO: 85819 - DNA, 20 bp, human
ggtcgtctccgccttcaacc

SEQ ID NO: 85820 - DNA, 20 bp, human
gccgccggccgccaccatca

SEQ ID NO: 85821 - DNA, 20 bp, human
gcgcggccgggacaagctgg

SEQ ID NO: 85822 - DNA, 20 bp, human
gcgggtatccaggttgaagg

SEQ ID NO: 85823 - DNA, 20 bp, human
gggcgaccgagtagccgaag

SEQ ID NO: 85824 - DNA, 20 bp, human
gccgcgccgccggaggacac

SEQ ID NO: 85825 - DNA, 20 bp, human
gtaccaggaatcgggtatcc

SEQ ID NO: 85826 - DNA, 20 bp, human
ggcgccagcgggctaaagga

SEQ ID NO: 85827 - DNA, 20 bp, human
gatcgggcagggaatcccta

SEQ ID NO: 85828 - DNA, 20 bp, human
gaccggccgcccctacaacg

SEQ ID NO: 85829 - DNA, 20 bp, human
gccggctggcggcagaaacc

SEQ ID NO: 85830 - DNA, 20 bp, human
gtggcggcagaaaccgggag

SEQ ID NO: 85831 - DNA, 20 bp, human
gggtcgtgctgcacagccac

SEQ ID NO: 85832 - DNA, 20 bp, human
ggtccaactctactcaccat

SEQ ID NO: 85833 - DNA, 20 bp, human
gcgcgagcacccgaagctcc

SEQ ID NO: 85834 - DNA, 20 bp, human
ggctcgctggaaatctgcca

SEQ ID NO: 85835 - DNA, 20 bp, human
gtgtgcctgggggtcccgac

SEQ ID NO: 85836 - DNA, 20 bp, human
gcccccccccacgcccctta

SEQ ID NO: 85837 - DNA, 20 bp, human
ggccccaggacagggaagag

SEQ ID NO: 85838 - DNA, 20 bp, human
ggcccgcgctggagtaggga

SEQ ID NO: 85839 - DNA, 20 bp, human
gttaggaagcggctccgggt

SEQ ID NO: 85840 - DNA, 20 bp, human
gagtagggagggcaccgtgg

SEQ ID NO: 85841 - DNA, 20 bp, human
gagctgcacggcgtggagag

SEQ ID NO: 85842 - DNA, 20 bp, human
gcacggagctggagaagtct

SEQ ID NO: 85843 - DNA, 20 bp, human
gctctgggaggtttaggaag

SEQ ID NO: 85844 - DNA, 20 bp, human
gtgtcctggggccaccgacc

SEQ ID NO: 85845 - DNA, 20 bp, human
ggggaagagcgggcgctatg

SEQ ID NO: 85846 - DNA, 20 bp, human
ggaacaacgggctcattcag

SEQ ID NO: 85847 - DNA, 20 bp, human
gtccggccgctccccctcgc

SEQ ID NO: 85848 - DNA, 20 bp, human
gagagcgcgacccgtcccgg

SEQ ID NO: 85849 - DNA, 20 bp, human
gcggcccgggcgcgacccac

SEQ ID NO: 85850 - DNA, 20 bp, human
gactgcagcccgaggacaag

SEQ ID NO: 85851 - DNA, 20 bp, human
gtcgcgagctgcccgcgagg

SEQ ID NO: 85852 - DNA, 20 bp, human
ggcaggccggcgccccagtg

SEQ ID NO: 85853 - DNA, 20 bp, human
gccacgggccaactactccc

SEQ ID NO: 85854 - DNA, 20 bp, human
gacgggtcgcgctctccgtc

SEQ ID NO: 85855 - DNA, 20 bp, human
ggcgagtctccagagaacaa

SEQ ID NO: 85856 - DNA, 20 bp, human
ggttgtcctagccggtgctg

SEQ ID NO: 85857 - DNA, 20 bp, human
ggctcgggcatggcgactct

SEQ ID NO: 85858 - DNA, 20 bp, human
ggcagccccgaccccagagc

SEQ ID NO: 85859 - DNA, 20 bp, human
ggtcctagccggtgctgggg

SEQ ID NO: 85860 - DNA, 20 bp, human
gcgggcatggcgactctggg

SEQ ID NO: 85861 - DNA, 20 bp, human
ggctggcggggcgaacgtct

SEQ ID NO: 85862 - DNA, 20 bp, human
ggggtcggggctgcaactgc

SEQ ID NO: 85863 - DNA, 20 bp, human
gtggggagggggacgatctg

SEQ ID NO: 85864 - DNA, 20 bp, human
ggacgagcagggagccaaaa

SEQ ID NO: 85865 - DNA, 20 bp, human
gaaatcccggaggcccccca

SEQ ID NO: 85866 - DNA, 20 bp, human
ggactacaaccagaattcag

SEQ ID NO: 85867 - DNA, 20 bp, human
gacaaccagaattcagaggc

SEQ ID NO: 85868 - DNA, 20 bp, human
gaaagcttgaaccatgggag

SEQ ID NO: 85869 - DNA, 20 bp, human
gtagtcaaagcttgaaccat

SEQ ID NO: 85870 - DNA, 20 bp, human
ggctctgttgccagatgagg

SEQ ID NO: 85871 - DNA, 20 bp, human
gtgattgagggaattcagtg

SEQ ID NO: 85872 - DNA, 20 bp, human
gccttggagcttatgtccca

SEQ ID NO: 85873 - DNA, 20 bp, human
gtttgtatgagtggaagctg

SEQ ID NO: 85874 - DNA, 20 bp, human
ggttctcatggtgtgcatgt

SEQ ID NO: 85875 - DNA, 20 bp, human
gaaaatactgatctcaaagt

SEQ ID NO: 85876 - DNA, 20 bp, human
gcgccgggcactgtcaccac

SEQ ID NO: 85877 - DNA, 20 bp, human
ggcgcaccgacccgggacac

SEQ ID NO: 85878 - DNA, 20 bp, human
gctcccgggtcaggtcccag

SEQ ID NO: 85879 - DNA, 20 bp, human
ggcgccgagcgcaccgaccc

SEQ ID NO: 85880 - DNA, 20 bp, human
ggggagagggacgggacccc

SEQ ID NO: 85881 - DNA, 20 bp, human
gagctgcccgtgtcccgggt

SEQ ID NO: 85882 - DNA, 20 bp, human
ggagccgctgggacctgacc

SEQ ID NO: 85883 - DNA, 20 bp, human
gcagtgtacagcggccccaa

SEQ ID NO: 85884 - DNA, 20 bp, human
gagcagaggggcgcgatcag

SEQ ID NO: 85885 - DNA, 20 bp, human
ggcggcaggacggggatccc

SEQ ID NO: 85886 - DNA, 20 bp, human
ggcacaggggcggccccgag

SEQ ID NO: 85887 - DNA, 20 bp, human
gccgctcgcgcagacttctc

SEQ ID NO: 85888 - DNA, 20 bp, human
gctgaaggcgagcacagggg

SEQ ID NO: 85889 - DNA, 20 bp, human
gggcgtggaagagaccggaa

SEQ ID NO: 85890 - DNA, 20 bp, human
gcagggtcgcggagtcgggc

SEQ ID NO: 85891 - DNA, 20 bp, human
gctcgcgcagacttctcggg

SEQ ID NO: 85892 - DNA, 20 bp, human
ggaagagaccggaaaggcgg

SEQ ID NO: 85893 - DNA, 20 bp, human
gagacttctcgggcggactg

SEQ ID NO: 85894 - DNA, 20 bp, human
gacggccaggaagctccccg

SEQ ID NO: 85895 - DNA, 20 bp, human
ggcgcggacggcgggctgag

SEQ ID NO: 85896 - DNA, 20 bp, human
gacgtgcagtcaggacttgg

SEQ ID NO: 85897 - DNA, 20 bp, human
ggctgctcagggatgacctt

SEQ ID NO: 85898 - DNA, 20 bp, human
ggtgtgacctgaatgaagag

SEQ ID NO: 85899 - DNA, 20 bp, human
gctgactgcacgtagggaag

SEQ ID NO: 85900 - DNA, 20 bp, human
ggccacagaagccaccaggg

SEQ ID NO: 85901 - DNA, 20 bp, human
gcaccagggactccatgagt

SEQ ID NO: 85902 - DNA, 20 bp, human
gaaggtgctcaccctcccag

SEQ ID NO: 85903 - DNA, 20 bp, human
gcctacgtgcagtcaggact

SEQ ID NO: 85904 - DNA, 20 bp, human
gccctgagcagcgcgttgag

SEQ ID NO: 85905 - DNA, 20 bp, human
gtccctggtgtgggtgacag

SEQ ID NO: 85906 - DNA, 20 bp, human
gccagcaaggacccacagac

SEQ ID NO: 85907 - DNA, 20 bp, human
gagggtccagcccacaactg

SEQ ID NO: 85908 - DNA, 20 bp, human
gcctcgaagcagcgggtgag

SEQ ID NO: 85909 - DNA, 20 bp, human
gagtcttgctcggtgggtca

SEQ ID NO: 85910 - DNA, 20 bp, human
gagcgggtgagaggacttac

SEQ ID NO: 85911 - DNA, 20 bp, human
gcggctggttgtgtacgagc

SEQ ID NO: 85912 - DNA, 20 bp, human
gtcgtacacaaccagccgtg

SEQ ID NO: 85913 - DNA, 20 bp, human
gggagcagaggcggctgtgt

SEQ ID NO: 85914 - DNA, 20 bp, human
ggcccttcccaacaagcctg

SEQ ID NO: 85915 - DNA, 20 bp, human
ggagccggagtgtctctgtt

SEQ ID NO: 85916 - DNA, 20 bp, human
ggagaagggagcataagaag

SEQ ID NO: 85917 - DNA, 20 bp, human
ggcagcgtcaggaggcccgt

SEQ ID NO: 85918 - DNA, 20 bp, human
gccagcactcgagggacctg

SEQ ID NO: 85919 - DNA, 20 bp, human
gtttgctggcaacctagaca

SEQ ID NO: 85920 - DNA, 20 bp, human
gggttgccagcaaatcccac

SEQ ID NO: 85921 - DNA, 20 bp, human
gcgagggacctgtggcccca

SEQ ID NO: 85922 - DNA, 20 bp, human
gaccactgtaagaggccaaa

SEQ ID NO: 85923 - DNA, 20 bp, human
gggagcataagaaggggcag

SEQ ID NO: 85924 - DNA, 20 bp, human
gggaggcccgtgggatttgc

SEQ ID NO: 85925 - DNA, 20 bp, human
gggccaatcccacttttagg

SEQ ID NO: 85926 - DNA, 20 bp, human
gctggaaggaggtgaaccag

SEQ ID NO: 85927 - DNA, 20 bp, human
gtagagggcccagaatatgt

SEQ ID NO: 85928 - DNA, 20 bp, human
gatatgtaggagtcagtctg

SEQ ID NO: 85929 - DNA, 20 bp, human
gtaggagtcagtctggggag

SEQ ID NO: 85930 - DNA, 20 bp, human
gccttggaaaatagaaccgg

SEQ ID NO: 85931 - DNA, 20 bp, human
ggaggtgaaccaggggttgc

SEQ ID NO: 85932 - DNA, 20 bp, human
ggagaggcaaaggggatttg

SEQ ID NO: 85933 - DNA, 20 bp, human
gaccggaggcaaagtggaga

SEQ ID NO: 85934 - DNA, 20 bp, human
gtcagtctggggagaggcaa

SEQ ID NO: 85935 - DNA, 20 bp, human
gcatgaggagacggaggccc

SEQ ID NO: 85936 - DNA, 20 bp, human
gccctcggggccagagtact

SEQ ID NO: 85937 - DNA, 20 bp, human
gtgaggtgcggcgctcaccc

SEQ ID NO: 85938 - DNA, 20 bp, human
gccgctccacgcagcgtctg

SEQ ID NO: 85939 - DNA, 20 bp, human
gggcaggactgtccacgtct

SEQ ID NO: 85940 - DNA, 20 bp, human
gagcgaccgccagggacgag

SEQ ID NO: 85941 - DNA, 20 bp, human
ggccccgagggaagttactt

SEQ ID NO: 85942 - DNA, 20 bp, human
gcacgcagcgtctgaggctg

SEQ ID NO: 85943 - DNA, 20 bp, human
gctgaggctggggactgccg

SEQ ID NO: 85944 - DNA, 20 bp, human
gctagcccgggacagctccg

SEQ ID NO: 85945 - DNA, 20 bp, human
ggccgaagtaacttccctcg

SEQ ID NO: 85946 - DNA, 20 bp, human
gaggtactgaggaagcaagt

SEQ ID NO: 85947 - DNA, 20 bp, human
gctagtcatgaccaggacca

SEQ ID NO: 85948 - DNA, 20 bp, human
gaggagtgctgccctggtcc

SEQ ID NO: 85949 - DNA, 20 bp, human
gggtccagctcttcctgcaa

SEQ ID NO: 85950 - DNA, 20 bp, human
gcaactcgatagtggatggt

SEQ ID NO: 85951 - DNA, 20 bp, human
gtccaggctcacctgtgaac

SEQ ID NO: 85952 - DNA, 20 bp, human
ggcgctatgagagtgagtcc

SEQ ID NO: 85953 - DNA, 20 bp, human
ggagaactgcaactcgatag

SEQ ID NO: 85954 - DNA, 20 bp, human
ggagccagggccctgaactg

SEQ ID NO: 85955 - DNA, 20 bp, human
gtagcgcccgaggtgcacgt

SEQ ID NO: 85956 - DNA, 20 bp, human
gagaggcccagcgggagtcg

SEQ ID NO: 85957 - DNA, 20 bp, human
ggggagaccgcaggtgtcag

SEQ ID NO: 85958 - DNA, 20 bp, human
gcctgggcgctgtcacgtcg

SEQ ID NO: 85959 - DNA, 20 bp, human
ggccgcgcccgacacccggg

SEQ ID NO: 85960 - DNA, 20 bp, human
gaggcaccggacccgtccag

SEQ ID NO: 85961 - DNA, 20 bp, human
gggccggcgaccctcacgtt

SEQ ID NO: 85962 - DNA, 20 bp, human
gcaaggacagcagctcgcga

SEQ ID NO: 85963 - DNA, 20 bp, human
gcccgccgcgcccgacaccc

SEQ ID NO: 85964 - DNA, 20 bp, human
gagccgcgttccgaacgtga

SEQ ID NO: 85965 - DNA, 20 bp, human
ggagcgagagacaaaggcac

SEQ ID NO: 85966 - DNA, 20 bp, human
gagccgctgtcgccccggag

SEQ ID NO: 85967 - DNA, 20 bp, human
gcaaccccgaccctgagagg

SEQ ID NO: 85968 - DNA, 20 bp, human
gccggcggacgtgggcagga

SEQ ID NO: 85969 - DNA, 20 bp, human
ggcccagggtcaccagagta

SEQ ID NO: 85970 - DNA, 20 bp, human
ggtagctgcctgggcgccaa

SEQ ID NO: 85971 - DNA, 20 bp, human
ggcggacggccaggaaggat

SEQ ID NO: 85972 - DNA, 20 bp, human
gcgcctgcgcatagtcttgg

SEQ ID NO: 85973 - DNA, 20 bp, human
ggcgggaggcggccgaagcg

SEQ ID NO: 85974 - DNA, 20 bp, human
gggccgcctcccgcctctca

SEQ ID NO: 85975 - DNA, 20 bp, human
gtccttactctggtgaccct

SEQ ID NO: 85976 - DNA, 20 bp, human
gctgtcgtaacaaaggctgt

SEQ ID NO: 85977 - DNA, 20 bp, human
gagtagagacatggaagcgt

SEQ ID NO: 85978 - DNA, 20 bp, human
gggttgaatgattactgaaa

SEQ ID NO: 85979 - DNA, 20 bp, human
gatggaagattgggacccca

SEQ ID NO: 85980 - DNA, 20 bp, human
gactcagaccaattaaacta

SEQ ID NO: 85981 - DNA, 20 bp, human
gctaagaggtgttccccatt

SEQ ID NO: 85982 - DNA, 20 bp, human
gctctactctgtcgtaacaa

SEQ ID NO: 85983 - DNA, 20 bp, human
gccatgatgcacttaaggtg

SEQ ID NO: 85984 - DNA, 20 bp, human
gggaacacctcttagtctgg

SEQ ID NO: 85985 - DNA, 20 bp, human
gtggggactggtcagctggg

SEQ ID NO: 85986 - DNA, 20 bp, human
gagacaggagggcctaacac

SEQ ID NO: 85987 - DNA, 20 bp, human
gaggcgcagcaggttcacag

SEQ ID NO: 85988 - DNA, 20 bp, human
gggtgtgctggagtcctcgg

SEQ ID NO: 85989 - DNA, 20 bp, human
gggtttctagacgtgaccca

SEQ ID NO: 85990 - DNA, 20 bp, human
ggaggactccagcacaccga

SEQ ID NO: 85991 - DNA, 20 bp, human
gcgacccgcgcctccagctg

SEQ ID NO: 85992 - DNA, 20 bp, human
gcgcagcaggttcacagagg

SEQ ID NO: 85993 - DNA, 20 bp, human
gtgggcccacaagcccctag

SEQ ID NO: 85994 - DNA, 20 bp, human
gcccccagccgtccccctag

SEQ ID NO: 85995 - DNA, 20 bp, human
gggtcctggtgctccgggct

SEQ ID NO: 85996 - DNA, 20 bp, human
gggcggcggcgcccactgtg

SEQ ID NO: 85997 - DNA, 20 bp, human
ggctccgcccgccccacagt

SEQ ID NO: 85998 - DNA, 20 bp, human
gcaggagccaaggcgaggtg

SEQ ID NO: 85999 - DNA, 20 bp, human
ggcatctcgtccgcctcccg

SEQ ID NO: 86000 - DNA, 20 bp, human
gtgagccccgcgctcacccg

SEQ ID NO: 86001 - DNA, 20 bp, human
gcgtcgcgggtggtcctggt

SEQ ID NO: 86002 - DNA, 20 bp, human
gcctcccgctgcgggaaaag

SEQ ID NO: 86003 - DNA, 20 bp, human
ggcggcgcgcacggtgcggt

SEQ ID NO: 86004 - DNA, 20 bp, human
ggcagccccgggtgagcgcg

SEQ ID NO: 86005 - DNA, 20 bp, human
gtctcggaggacccgctccc

SEQ ID NO: 86006 - DNA, 20 bp, human
gcctggggaggagataccta

SEQ ID NO: 86007 - DNA, 20 bp, human
gtccgccaaaggaaacgcca

SEQ ID NO: 86008 - DNA, 20 bp, human
ggaacgcgccacattaatga

SEQ ID NO: 86009 - DNA, 20 bp, human
gagggactgacaaactacga

SEQ ID NO: 86010 - DNA, 20 bp, human
gggagaactcatggactgag

SEQ ID NO: 86011 - DNA, 20 bp, human
gtaaggttgacacacaggat

SEQ ID NO: 86012 - DNA, 20 bp, human
gctgggttcgttttattcag

SEQ ID NO: 86013 - DNA, 20 bp, human
ggttgagggtaccaagcgaa

SEQ ID NO: 86014 - DNA, 20 bp, human
gcgcgttcgtgtaaacccgt

SEQ ID NO: 86015 - DNA, 20 bp, human
gcatgccttggcgtttcctt

SEQ ID NO: 86016 - DNA, 20 bp, human
gccgtcctggacctacctcg

SEQ ID NO: 86017 - DNA, 20 bp, human
gctgcagccccatctcctag

SEQ ID NO: 86018 - DNA, 20 bp, human
ggggctgccgctaggagatg

SEQ ID NO: 86019 - DNA, 20 bp, human
gagcgagtccgccccgaggt

SEQ ID NO: 86020 - DNA, 20 bp, human
gtcctggacctacctcgggg

SEQ ID NO: 86021 - DNA, 20 bp, human
ggcgagcagggactgtccga

SEQ ID NO: 86022 - DNA, 20 bp, human
gagggagcgagtccgccccg

SEQ ID NO: 86023 - DNA, 20 bp, human
gagtggctggtagccctctg

SEQ ID NO: 86024 - DNA, 20 bp, human
gtccgccccgaggtaggtcc

SEQ ID NO: 86025 - DNA, 20 bp, human
gtgcagcgcgcgggcgagca

SEQ ID NO: 86026 - DNA, 20 bp, human
gcagcgggctgctccgggta

SEQ ID NO: 86027 - DNA, 20 bp, human
ggcgggcgggcgtctcggag

SEQ ID NO: 86028 - DNA, 20 bp, human
gcgtctcggagcccaagtcg

SEQ ID NO: 86029 - DNA, 20 bp, human
ggctgtacgcctgcctcctg

SEQ ID NO: 86030 - DNA, 20 bp, human
ggagcgcaggcggtgcctga

SEQ ID NO: 86031 - DNA, 20 bp, human
gagtgtgtcgccgctcggga

SEQ ID NO: 86032 - DNA, 20 bp, human
gcccagcgactggcccacca

SEQ ID NO: 86033 - DNA, 20 bp, human
gggcgacacactaggagtcc

SEQ ID NO: 86034 - DNA, 20 bp, human
gccaccagggagtgccccga

SEQ ID NO: 86035 - DNA, 20 bp, human
gcggggcccgcggcatggtg

SEQ ID NO: 86036 - DNA, 20 bp, human
gaaacagaggctacctggac

SEQ ID NO: 86037 - DNA, 20 bp, human
gcaaattacagacaaacacc

SEQ ID NO: 86038 - DNA, 20 bp, human
gattcactgtgggaactgcc

SEQ ID NO: 86039 - DNA, 20 bp, human
gctcagtcacaaaagagcaa

SEQ ID NO: 86040 - DNA, 20 bp, human
ggcaagaactgaaacgaatg

SEQ ID NO: 86041 - DNA, 20 bp, human
gataaatacaaaggttgcac

SEQ ID NO: 86042 - DNA, 20 bp, human
gtcctagaaatagaaagaac

SEQ ID NO: 86043 - DNA, 20 bp, human
ggaaggaatgatcacgtaca

SEQ ID NO: 86044 - DNA, 20 bp, human
gagtgaatgctctaggctta

SEQ ID NO: 86045 - DNA, 20 bp, human
ggttggtcttgtaacgctga

SEQ ID NO: 86046 - DNA, 20 bp, human
gcaaggactataccgaagta

SEQ ID NO: 86047 - DNA, 20 bp, human
gcacgcacctgtgagtacca

SEQ ID NO: 86048 - DNA, 20 bp, human
gggccagagcttgtaaggag

SEQ ID NO: 86049 - DNA, 20 bp, human
gtagcagctgggggtgatgt

SEQ ID NO: 86050 - DNA, 20 bp, human
gctcccagatcagtacacaa

SEQ ID NO: 86051 - DNA, 20 bp, human
gagctgaaggcagagcatta

SEQ ID NO: 86052 - DNA, 20 bp, human
gcctcagtgtcccaggacag

SEQ ID NO: 86053 - DNA, 20 bp, human
gctgatctgggagacggcag

SEQ ID NO: 86054 - DNA, 20 bp, human
ggcattagggatagcagctg

SEQ ID NO: 86055 - DNA, 20 bp, human
gaggaagaagtctgagctga

SEQ ID NO: 86056 - DNA, 20 bp, human
ggtgtcggcgggtgcttcta

SEQ ID NO: 86057 - DNA, 20 bp, human
gtcgggatgccagcaacagg

SEQ ID NO: 86058 - DNA, 20 bp, human
ggcagcgggcaaagacaagt

SEQ ID NO: 86059 - DNA, 20 bp, human
gggatgccagcaacaggggg

SEQ ID NO: 86060 - DNA, 20 bp, human
ggggtagccgggtgcactca

SEQ ID NO: 86061 - DNA, 20 bp, human
ggaggcgctccggtagcgtg

SEQ ID NO: 86062 - DNA, 20 bp, human
ggcgctccggtagcgtgggg

SEQ ID NO: 86063 - DNA, 20 bp, human
gtaacagctcggagcagcgt

SEQ ID NO: 86064 - DNA, 20 bp, human
ggcagcgtcctggctggcaa

SEQ ID NO: 86065 - DNA, 20 bp, human
gctcagggcagagagttgct

SEQ ID NO: 86066 - DNA, 20 bp, human
ggtgccaccagcagatggct

SEQ ID NO: 86067 - DNA, 20 bp, human
gtgcaagcctgggtgtccgt

SEQ ID NO: 86068 - DNA, 20 bp, human
gggctgggcagacggaccca

SEQ ID NO: 86069 - DNA, 20 bp, human
ggccccggacctgcaagcct

SEQ ID NO: 86070 - DNA, 20 bp, human
gcacccaggcttgcaggtcc

SEQ ID NO: 86071 - DNA, 20 bp, human
gacgctgtagatataaggag

SEQ ID NO: 86072 - DNA, 20 bp, human
gaatacacgctgtagatata

SEQ ID NO: 86073 - DNA, 20 bp, human
gaggtggggttcaccgaggg

SEQ ID NO: 86074 - DNA, 20 bp, human
ggagccctgccacataagca

SEQ ID NO: 86075 - DNA, 20 bp, human
gccgctgcccaaatcctcgc

SEQ ID NO: 86076 - DNA, 20 bp, human
gtggcaccgtccatgctcta

SEQ ID NO: 86077 - DNA, 20 bp, human
gcaggatgaggagagatacc

SEQ ID NO: 86078 - DNA, 20 bp, human
gcggtgccatggggcctcgg

SEQ ID NO: 86079 - DNA, 20 bp, human
gttgccaggactcttactca

SEQ ID NO: 86080 - DNA, 20 bp, human
gctgtagccgagcccagggc

SEQ ID NO: 86081 - DNA, 20 bp, human
gacaccgtgagtaagagtcc

SEQ ID NO: 86082 - DNA, 20 bp, human
gaagcccacagggcagaaat

SEQ ID NO: 86083 - DNA, 20 bp, human
gcagcaggagccttagagca

SEQ ID NO: 86084 - DNA, 20 bp, human
ggagcatggacggtgccatg

SEQ ID NO: 86085 - DNA, 20 bp, human
gctgcctgtagccgagccca

SEQ ID NO: 86086 - DNA, 20 bp, human
gtccccaaagcagatggtct

SEQ ID NO: 86087 - DNA, 20 bp, human
gcctactgaaccaagttcaa

SEQ ID NO: 86088 - DNA, 20 bp, human
gtaagtcaagatcaatgggc

SEQ ID NO: 86089 - DNA, 20 bp, human
gcaaagcaaaccattgggtt

SEQ ID NO: 86090 - DNA, 20 bp, human
gccaagctccccaaagcaga

SEQ ID NO: 86091 - DNA, 20 bp, human
gattctcaaagcaaaccatt

SEQ ID NO: 86092 - DNA, 20 bp, human
gtattggaatcgctattcaa

SEQ ID NO: 86093 - DNA, 20 bp, human
gccccagaccatctgctttg

SEQ ID NO: 86094 - DNA, 20 bp, human
gagctcagtaaatcatctat

SEQ ID NO: 86095 - DNA, 20 bp, human
gcatcagagcgtagcattta

SEQ ID NO: 86096 - DNA, 20 bp, human
ggcagagccaagatgagaca

SEQ ID NO: 86097 - DNA, 20 bp, human
gtggtggccctgtctcatct

SEQ ID NO: 86098 - DNA, 20 bp, human
ggggcttctcgggaagccag

SEQ ID NO: 86099 - DNA, 20 bp, human
gcagccgaaaggggcttctc

SEQ ID NO: 86100 - DNA, 20 bp, human
gtctgagtggagtgaagagg

SEQ ID NO: 86101 - DNA, 20 bp, human
gaggcctgagtattcagcga

SEQ ID NO: 86102 - DNA, 20 bp, human
gcaccccaagcagccgaaag

SEQ ID NO: 86103 - DNA, 20 bp, human
gtctggaaggaggcctaaag

SEQ ID NO: 86104 - DNA, 20 bp, human
ggcctctgagtggagtgaag

SEQ ID NO: 86105 - DNA, 20 bp, human
gcttcactgaggggcaatga

SEQ ID NO: 86106 - DNA, 20 bp, human
gctgctcccagatagacacg

SEQ ID NO: 86107 - DNA, 20 bp, human
gtggggtatcagcagtggta

SEQ ID NO: 86108 - DNA, 20 bp, human
ggaaggacgcagtcagggac

SEQ ID NO: 86109 - DNA, 20 bp, human
gtagggctctggcctcatga

SEQ ID NO: 86110 - DNA, 20 bp, human
gcatgagggtccaggagtgg

SEQ ID NO: 86111 - DNA, 20 bp, human
ggtcttcctcgtgtctatct

SEQ ID NO: 86112 - DNA, 20 bp, human
ggaagggccatggggtgagt

SEQ ID NO: 86113 - DNA, 20 bp, human
ggcagatgtgaagggccatg

SEQ ID NO: 86114 - DNA, 20 bp, human
gtgggagcagggagttgccg

SEQ ID NO: 86115 - DNA, 20 bp, human
ggaacttcagggcttctatg

SEQ ID NO: 86116 - DNA, 20 bp, human
ggaagcctcctggcagacac

SEQ ID NO: 86117 - DNA, 20 bp, human
gagagaacgcctgggaagtg

SEQ ID NO: 86118 - DNA, 20 bp, human
gctagaacctattcagaggg

SEQ ID NO: 86119 - DNA, 20 bp, human
gaggtacggacaggccttgg

SEQ ID NO: 86120 - DNA, 20 bp, human
gccgccaggcactaccccaa

SEQ ID NO: 86121 - DNA, 20 bp, human
ggtcgagttcagaagcctcc

SEQ ID NO: 86122 - DNA, 20 bp, human
gaggtgggagaataccagta

SEQ ID NO: 86123 - DNA, 20 bp, human
ggaggtcacttactaaaagg

SEQ ID NO: 86124 - DNA, 20 bp, human
gctttgctgcaggtacggac

SEQ ID NO: 86125 - DNA, 20 bp, human
gttcggcagtagtagtctgg

SEQ ID NO: 86126 - DNA, 20 bp, human
gcaggtcacagctcacagga

SEQ ID NO: 86127 - DNA, 20 bp, human
ggcaaggatgcagagatctc

SEQ ID NO: 86128 - DNA, 20 bp, human
ggaggctcagggacaaagag

SEQ ID NO: 86129 - DNA, 20 bp, human
gcagcaggtgagggtaccaa

SEQ ID NO: 86130 - DNA, 20 bp, human
gcgagctgctgctgaaagtg

SEQ ID NO: 86131 - DNA, 20 bp, human
ggacgccatggtccttctct

SEQ ID NO: 86132 - DNA, 20 bp, human
gccagaaatccgggctcata

SEQ ID NO: 86133 - DNA, 20 bp, human
gaaagcctagagaaggacca

SEQ ID NO: 86134 - DNA, 20 bp, human
gccagaaagctgatgccctg

SEQ ID NO: 86135 - DNA, 20 bp, human
gagcagggcaagggtcatgc

SEQ ID NO: 86136 - DNA, 20 bp, human
ggggacgctcggggacccgg

SEQ ID NO: 86137 - DNA, 20 bp, human
gccccgagagcgtcccgcag

SEQ ID NO: 86138 - DNA, 20 bp, human
gagacggtcgaagggggccc

SEQ ID NO: 86139 - DNA, 20 bp, human
gtctcccaggcccccaccag

SEQ ID NO: 86140 - DNA, 20 bp, human
gcctgggagacggtcgaagg

SEQ ID NO: 86141 - DNA, 20 bp, human
gcgcgggacgctcggggacc

SEQ ID NO: 86142 - DNA, 20 bp, human
gacacgctttgcagcgccca

SEQ ID NO: 86143 - DNA, 20 bp, human
gcgagggcgcgggacgctcg

SEQ ID NO: 86144 - DNA, 20 bp, human
gcccacagagagggacccct

SEQ ID NO: 86145 - DNA, 20 bp, human
ggctgcaaagcgtgtcccgc

SEQ ID NO: 86146 - DNA, 20 bp, human
gaacaacagatccaggccag

SEQ ID NO: 86147 - DNA, 20 bp, human
gcagaggtggcatcatgtct

SEQ ID NO: 86148 - DNA, 20 bp, human
gaacagatccaggccagagg

SEQ ID NO: 86149 - DNA, 20 bp, human
gaggtggcatcatgtctggg

SEQ ID NO: 86150 - DNA, 20 bp, human
gccaaggttaagacacagtt

SEQ ID NO: 86151 - DNA, 20 bp, human
gagatcgggctcagatcttc

SEQ ID NO: 86152 - DNA, 20 bp, human
gcatgtcaggtgctgcacca

SEQ ID NO: 86153 - DNA, 20 bp, human
gttgatgaagcggggacagg

SEQ ID NO: 86154 - DNA, 20 bp, human
gagagcaagggtttggagat

SEQ ID NO: 86155 - DNA, 20 bp, human
gagctagttccttcccagtg

SEQ ID NO: 86156 - DNA, 20 bp, human
gggcaaagaatgcaatgtgg

SEQ ID NO: 86157 - DNA, 20 bp, human
ggtacagtaaaagtaatcag

SEQ ID NO: 86158 - DNA, 20 bp, human
ggagcagtcaagaggtgaaa

SEQ ID NO: 86159 - DNA, 20 bp, human
gtgctaagaggtgatgccca

SEQ ID NO: 86160 - DNA, 20 bp, human
gtgatccagttcttgaaagg

SEQ ID NO: 86161 - DNA, 20 bp, human
gccccctgcaaggttatgtt

SEQ ID NO: 86162 - DNA, 20 bp, human
gttgaaaggtggtgcacctt

SEQ ID NO: 86163 - DNA, 20 bp, human
ggatagaaagataacgttga

SEQ ID NO: 86164 - DNA, 20 bp, human
gatagcataaaatagagcac

SEQ ID NO: 86165 - DNA, 20 bp, human
ggtgttaaccaaagccagcc

SEQ ID NO: 86166 - DNA, 20 bp, human
gtgcactctgttgagctcca

SEQ ID NO: 86167 - DNA, 20 bp, human
gacgctcctgatgtggaatg

SEQ ID NO: 86168 - DNA, 20 bp, human
gtctttgtaagactggacag

SEQ ID NO: 86169 - DNA, 20 bp, human
gggtgcagaaagctttatgg

SEQ ID NO: 86170 - DNA, 20 bp, human
gcgggatcctggtctctccc

SEQ ID NO: 86171 - DNA, 20 bp, human
gccggaagtcatccagctga

SEQ ID NO: 86172 - DNA, 20 bp, human
gtctcagctgcactttcctt

SEQ ID NO: 86173 - DNA, 20 bp, human
gagcccagtggggccaacca

SEQ ID NO: 86174 - DNA, 20 bp, human
gttctcatagcgaccaccag

SEQ ID NO: 86175 - DNA, 20 bp, human
gtggatgacttccgggatcc

SEQ ID NO: 86176 - DNA, 20 bp, human
gtgcagaggatcctgatgaa

SEQ ID NO: 86177 - DNA, 20 bp, human
gcttctctgtggccaccagt

SEQ ID NO: 86178 - DNA, 20 bp, human
gtcagctcctggcatctgta

SEQ ID NO: 86179 - DNA, 20 bp, human
gccaggccctgcacagcaga

SEQ ID NO: 86180 - DNA, 20 bp, human
gcctcctggaatatgcccca

SEQ ID NO: 86181 - DNA, 20 bp, human
ggtagtgttggacagccgtg

SEQ ID NO: 86182 - DNA, 20 bp, human
ggtaaatggcttctgagagt

SEQ ID NO: 86183 - DNA, 20 bp, human
gttcccttcctgtggacact

SEQ ID NO: 86184 - DNA, 20 bp, human
gggagcaatgatgccagctc

SEQ ID NO: 86185 - DNA, 20 bp, human
gacaagatgcacaaggtcac

SEQ ID NO: 86186 - DNA, 20 bp, human
gcacccaagtaggagagaag

SEQ ID NO: 86187 - DNA, 20 bp, human
gtctgctcacctatgagcag

SEQ ID NO: 86188 - DNA, 20 bp, human
gccgtgaatagaaaagccct

SEQ ID NO: 86189 - DNA, 20 bp, human
ggtgccacttctctcctact

SEQ ID NO: 86190 - DNA, 20 bp, human
gtcttccagcaagtatgtgt

SEQ ID NO: 86191 - DNA, 20 bp, human
ggtgtgcttttgacttccta

SEQ ID NO: 86192 - DNA, 20 bp, human
ggactccaacacatacttgc

SEQ ID NO: 86193 - DNA, 20 bp, human
ggacaacaccattcttggtg

SEQ ID NO: 86194 - DNA, 20 bp, human
gtggtagacaacaccattct

SEQ ID NO: 86195 - DNA, 20 bp, human
gattttctccgcaccaagaa

SEQ ID NO: 86196 - DNA, 20 bp, human
gccgcaaggagacagaaccg

SEQ ID NO: 86197 - DNA, 20 bp, human
gcgggaatgcagagtgacag

SEQ ID NO: 86198 - DNA, 20 bp, human
gctgctggaatcagcgtcct

SEQ ID NO: 86199 - DNA, 20 bp, human
gctgggctgcagactgcaag

SEQ ID NO: 86200 - DNA, 20 bp, human
gacaatgacaaggagtccca

SEQ ID NO: 86201 - DNA, 20 bp, human
gctactgcaagccgaggtct

SEQ ID NO: 86202 - DNA, 20 bp, human
gggtaacgtgtagggacctg

SEQ ID NO: 86203 - DNA, 20 bp, human
gtcacaccagctgtcctgga

SEQ ID NO: 86204 - DNA, 20 bp, human
gtcataagtatcccagacct

SEQ ID NO: 86205 - DNA, 20 bp, human
gagacagaaccgaggcgacc

SEQ ID NO: 86206 - DNA, 20 bp, human
gtcccggagcccggccgtag

SEQ ID NO: 86207 - DNA, 20 bp, human
ggtgacgttcaactccgctc

SEQ ID NO: 86208 - DNA, 20 bp, human
gagaggttcgggaagctccg

SEQ ID NO: 86209 - DNA, 20 bp, human
gagaggcggctactgcggta

SEQ ID NO: 86210 - DNA, 20 bp, human
gcgggcggctgaagaggttc

SEQ ID NO: 86211 - DNA, 20 bp, human
gctggggcgccctcgaaggg

SEQ ID NO: 86212 - DNA, 20 bp, human
ggaagtgcgtgtgctggaag

SEQ ID NO: 86213 - DNA, 20 bp, human
gagaaggacgagcccaagag

SEQ ID NO: 86214 - DNA, 20 bp, human
gagggctgcgcggactgcag

SEQ ID NO: 86215 - DNA, 20 bp, human
ggattgcagcctctacggcc

SEQ ID NO: 86216 - DNA, 20 bp, human
gtcctggatgagtgagacaa

SEQ ID NO: 86217 - DNA, 20 bp, human
ggcttcagaaggcaagacgg

SEQ ID NO: 86218 - DNA, 20 bp, human
gagtggagggaagaccccca

SEQ ID NO: 86219 - DNA, 20 bp, human
gctgaagtccgaagagtggg

SEQ ID NO: 86220 - DNA, 20 bp, human
gggaccctggcgagagtgga

SEQ ID NO: 86221 - DNA, 20 bp, human
gcctgcagagctcggagcgg

SEQ ID NO: 86222 - DNA, 20 bp, human
gaaggggaagacctgaagtg

SEQ ID NO: 86223 - DNA, 20 bp, human
ggagacaagggcagttcagg

SEQ ID NO: 86224 - DNA, 20 bp, human
ggctagggtgagagggtctg

SEQ ID NO: 86225 - DNA, 20 bp, human
ggccccctccccctataagg

SEQ ID NO: 86226 - DNA, 20 bp, human
ggggtaaccggggatcacca

SEQ ID NO: 86227 - DNA, 20 bp, human
gaggccgccatggtgatccc

SEQ ID NO: 86228 - DNA, 20 bp, human
gtaaccggggatcaccatgg

SEQ ID NO: 86229 - DNA, 20 bp, human
gcggctgtgtggaaaagctg

SEQ ID NO: 86230 - DNA, 20 bp, human
gcgggaggagggaagcacgt

SEQ ID NO: 86231 - DNA, 20 bp, human
gcaataggtgaccttcgggg

SEQ ID NO: 86232 - DNA, 20 bp, human
gcatggcggcctcattggtg

SEQ ID NO: 86233 - DNA, 20 bp, human
ggacgccaaggagttttcgg

SEQ ID NO: 86234 - DNA, 20 bp, human
gatcaccatggcggcctcat

SEQ ID NO: 86235 - DNA, 20 bp, human
gagcgtcccttaggcaggag

SEQ ID NO: 86236 - DNA, 20 bp, human
gcgctgcccgccgagaaggg

SEQ ID NO: 86237 - DNA, 20 bp, human
gccagctccgactcagactc

SEQ ID NO: 86238 - DNA, 20 bp, human
ggcccggctgggaacatcag

SEQ ID NO: 86239 - DNA, 20 bp, human
ggcgcgcgccgcgagcgagt

SEQ ID NO: 86240 - DNA, 20 bp, human
gcagccgggccgtaacccct

SEQ ID NO: 86241 - DNA, 20 bp, human
gcgagccacacgccctcagg

SEQ ID NO: 86242 - DNA, 20 bp, human
gcagagggcgaggacccggg

SEQ ID NO: 86243 - DNA, 20 bp, human
gcatcagagggcgaggaccc

SEQ ID NO: 86244 - DNA, 20 bp, human
gagtgggcacctcctcccgg

SEQ ID NO: 86245 - DNA, 20 bp, human
gtcgccgccgcgggctcaag

SEQ ID NO: 86246 - DNA, 20 bp, human
gccagtggaggagaccgacg

SEQ ID NO: 86247 - DNA, 20 bp, human
gggagaccgacgaggtggaa

SEQ ID NO: 86248 - DNA, 20 bp, human
gtcgctgctcgaggactcgg

SEQ ID NO: 86249 - DNA, 20 bp, human
ggaccgacgaggtggaaagg

SEQ ID NO: 86250 - DNA, 20 bp, human
gccatgcccgttgggccccc

SEQ ID NO: 86251 - DNA, 20 bp, human
gcgaagagcccgctgccggg

SEQ ID NO: 86252 - DNA, 20 bp, human
gcgggagagggactgcctcc

SEQ ID NO: 86253 - DNA, 20 bp, human
gcggcgcgccgcgggctggt

SEQ ID NO: 86254 - DNA, 20 bp, human
gcggggccgtctccagccgg

SEQ ID NO: 86255 - DNA, 20 bp, human
gacgaggtggaaaggcggcg

SEQ ID NO: 86256 - DNA, 20 bp, human
ggcgttttcagccccgggag

SEQ ID NO: 86257 - DNA, 20 bp, human
gccggagcagacactgacag

SEQ ID NO: 86258 - DNA, 20 bp, human
ggacaggggcagtatctcca

SEQ ID NO: 86259 - DNA, 20 bp, human
gggcccggcgatcccggcag

SEQ ID NO: 86260 - DNA, 20 bp, human
ggtatctccacggtcgaaaa

SEQ ID NO: 86261 - DNA, 20 bp, human
gcgaaacagggcaaaggggt

SEQ ID NO: 86262 - DNA, 20 bp, human
gtttggagggtgacatggag

SEQ ID NO: 86263 - DNA, 20 bp, human
ggtgtagactacatgcccag

SEQ ID NO: 86264 - DNA, 20 bp, human
gagtgagcggcccggaaggc

SEQ ID NO: 86265 - DNA, 20 bp, human
gcagaggcgcaaacctcgta

SEQ ID NO: 86266 - DNA, 20 bp, human
gtgccgtgggagcctgaacg

SEQ ID NO: 86267 - DNA, 20 bp, human
gcgtgggagcctgaacgagg

SEQ ID NO: 86268 - DNA, 20 bp, human
ggccagacaggtccagcctc

SEQ ID NO: 86269 - DNA, 20 bp, human
gcggccgaagcccgaaccga

SEQ ID NO: 86270 - DNA, 20 bp, human
gaagcccgaaccgaaggagc

SEQ ID NO: 86271 - DNA, 20 bp, human
gctcctcgggctgaaactgg

SEQ ID NO: 86272 - DNA, 20 bp, human
gcctccggacgcatctagaa

SEQ ID NO: 86273 - DNA, 20 bp, human
gtccggaggctggacctgtc

SEQ ID NO: 86274 - DNA, 20 bp, human
ggaatggagctggtcagagc

SEQ ID NO: 86275 - DNA, 20 bp, human
gcctgtgcggatcagtccaa

SEQ ID NO: 86276 - DNA, 20 bp, human
gcggacatgggattacccag

SEQ ID NO: 86277 - DNA, 20 bp, human
gtccccgggcaccaaggtag

SEQ ID NO: 86278 - DNA, 20 bp, human
ggccacatcagaccagaatg

SEQ ID NO: 86279 - DNA, 20 bp, human
ggaaagcgcacgccgagagg

SEQ ID NO: 86280 - DNA, 20 bp, human
gaagccacgcactagagtag

SEQ ID NO: 86281 - DNA, 20 bp, human
gcaaccacggagcgcaagag

SEQ ID NO: 86282 - DNA, 20 bp, human
gcgcacgccgagaggaggtg

SEQ ID NO: 86283 - DNA, 20 bp, human
gtgcgggcagttgttttggg

SEQ ID NO: 86284 - DNA, 20 bp, human
gcgtttcctcaagctcgctg

SEQ ID NO: 86285 - DNA, 20 bp, human
gggagctcgttccgttagga

SEQ ID NO: 86286 - DNA, 20 bp, human
ggcagggagtggacacggag

SEQ ID NO: 86287 - DNA, 20 bp, human
gcgcagcgggtcgcagagca

SEQ ID NO: 86288 - DNA, 20 bp, human
gagaagagggacgtccactg

SEQ ID NO: 86289 - DNA, 20 bp, human
gggaggaggagcaaaggtgt

SEQ ID NO: 86290 - DNA, 20 bp, human
gcacgatgtcccctatgtag

SEQ ID NO: 86291 - DNA, 20 bp, human
ggccccctcggtcccctcag

SEQ ID NO: 86292 - DNA, 20 bp, human
gtcccgccgggcggctgtga

SEQ ID NO: 86293 - DNA, 20 bp, human
gacgcggagggctcggtcaa

SEQ ID NO: 86294 - DNA, 20 bp, human
gtaagcgggagacgagggct

SEQ ID NO: 86295 - DNA, 20 bp, human
gtccagcttcctctacatag

SEQ ID NO: 86296 - DNA, 20 bp, human
gggcgggcgcgccaagacgt

SEQ ID NO: 86297 - DNA, 20 bp, human
gcgtccaggcctctatcggg

SEQ ID NO: 86298 - DNA, 20 bp, human
gagtgagccgagctcgagag

SEQ ID NO: 86299 - DNA, 20 bp, human
gcgcgtggccaagctcagtg

SEQ ID NO: 86300 - DNA, 20 bp, human
gacgcacgcagctggcacca

SEQ ID NO: 86301 - DNA, 20 bp, human
gctacgctgcaggtacgcgc

SEQ ID NO: 86302 - DNA, 20 bp, human
gtgagactagggggacgtcc

SEQ ID NO: 86303 - DNA, 20 bp, human
gccacgccctgggccccgga

SEQ ID NO: 86304 - DNA, 20 bp, human
gcccgctccttgagactagg

SEQ ID NO: 86305 - DNA, 20 bp, human
gcctgcagcgtagaaggagc

SEQ ID NO: 86306 - DNA, 20 bp, human
ggccgctgcaggccagaagg

SEQ ID NO: 86307 - DNA, 20 bp, human
gtgcggcccggcacttagag

SEQ ID NO: 86308 - DNA, 20 bp, human
gacgcggcgggaacaggatg

SEQ ID NO: 86309 - DNA, 20 bp, human
gcgggacgcatcccccgacg

SEQ ID NO: 86310 - DNA, 20 bp, human
gggagacaatacgcccgcct

SEQ ID NO: 86311 - DNA, 20 bp, human
gcctcctgcgccccctctgt

SEQ ID NO: 86312 - DNA, 20 bp, human
gcgggcgctcgctccagcca

SEQ ID NO: 86313 - DNA, 20 bp, human
gaacaggatgcgggaccgcg

SEQ ID NO: 86314 - DNA, 20 bp, human
gctgccctgggacttacgat

SEQ ID NO: 86315 - DNA, 20 bp, human
gaagccaatcgtaagtccca

SEQ ID NO: 86316 - DNA, 20 bp, human
gcgcgtgctgggggtcgtag

SEQ ID NO: 86317 - DNA, 20 bp, human
gccccagcacgcggctccga

SEQ ID NO: 86318 - DNA, 20 bp, human
gaaatgtacaaggtacctgg

SEQ ID NO: 86319 - DNA, 20 bp, human
gggatgtctcccgggaccca

SEQ ID NO: 86320 - DNA, 20 bp, human
gacagggctcctagagaggg

SEQ ID NO: 86321 - DNA, 20 bp, human
gcaagttccaaagggaggat

SEQ ID NO: 86322 - DNA, 20 bp, human
gcctgccgggaaaaaagcag

SEQ ID NO: 86323 - DNA, 20 bp, human
ggtccgagcgtctgaacgtc

SEQ ID NO: 86324 - DNA, 20 bp, human
gcaagggcccatcctacctc

SEQ ID NO: 86325 - DNA, 20 bp, human
gtatgaatggggggagggtc

SEQ ID NO: 86326 - DNA, 20 bp, human
ggcgaggccgcgccagctag

SEQ ID NO: 86327 - DNA, 20 bp, human
ggctagcggggaggaaatgc

SEQ ID NO: 86328 - DNA, 20 bp, human
ggggaggaaatgccggagtc

SEQ ID NO: 86329 - DNA, 20 bp, human
gctcgcctccccctcggaag

SEQ ID NO: 86330 - DNA, 20 bp, human
gcgcggcctcgcctccccct

SEQ ID NO: 86331 - DNA, 20 bp, human
gcgccgcggaggaggagacg

SEQ ID NO: 86332 - DNA, 20 bp, human
ggccgcgccagctagcgggg

SEQ ID NO: 86333 - DNA, 20 bp, human
gtcggaagaggaaactcccg

SEQ ID NO: 86334 - DNA, 20 bp, human
ggcggtggccgagcagccca

SEQ ID NO: 86335 - DNA, 20 bp, human
gcggagtctggagccgagcg

SEQ ID NO: 86336 - DNA, 20 bp, human
ggcttggttgctccgtagta

SEQ ID NO: 86337 - DNA, 20 bp, human
gggctccgggacggacagag

SEQ ID NO: 86338 - DNA, 20 bp, human
gcccgaggacgggaaggaca

SEQ ID NO: 86339 - DNA, 20 bp, human
gtccgtcccggagcccgctc

SEQ ID NO: 86340 - DNA, 20 bp, human
gctcgcgagccgccgtacta

SEQ ID NO: 86341 - DNA, 20 bp, human
gccgggacggacagagaggc

SEQ ID NO: 86342 - DNA, 20 bp, human
ggcgaggaagaatcccgagc

SEQ ID NO: 86343 - DNA, 20 bp, human
gcccgcccggagatgaggtg

SEQ ID NO: 86344 - DNA, 20 bp, human
gtggttgctccgtagtacgg

SEQ ID NO: 86345 - DNA, 20 bp, human
gagggcagcgaggtcagccc

SEQ ID NO: 86346 - DNA, 20 bp, human
gcccgggcagtttcgggctc

SEQ ID NO: 86347 - DNA, 20 bp, human
ggacgggtcctcgggagtac

SEQ ID NO: 86348 - DNA, 20 bp, human
ggcacggccgagcccgccag

SEQ ID NO: 86349 - DNA, 20 bp, human
gagccctgagcggctgtgac

SEQ ID NO: 86350 - DNA, 20 bp, human
gcccgagctaggcccctggc

SEQ ID NO: 86351 - DNA, 20 bp, human
gagcctgtcacagccgctca

SEQ ID NO: 86352 - DNA, 20 bp, human
gtacgcaacaggttcgcggg

SEQ ID NO: 86353 - DNA, 20 bp, human
ggccgggacagacgccgagg

SEQ ID NO: 86354 - DNA, 20 bp, human
ggcctccgcaggaagccggg

SEQ ID NO: 86355 - DNA, 20 bp, human
gcggccgccatgttgttgtg

SEQ ID NO: 86356 - DNA, 20 bp, human
gagagatggcgactgcgact

SEQ ID NO: 86357 - DNA, 20 bp, human
ggactgcgactcggctgctg

SEQ ID NO: 86358 - DNA, 20 bp, human
gaaacgaagccggcaagcgg

SEQ ID NO: 86359 - DNA, 20 bp, human
gagtactgctggaagtagag

SEQ ID NO: 86360 - DNA, 20 bp, human
ggcccgctgggaaacgaagc

SEQ ID NO: 86361 - DNA, 20 bp, human
ggcaaaagccaaggctgggt

SEQ ID NO: 86362 - DNA, 20 bp, human
ggagaggaggagtcgaggct

SEQ ID NO: 86363 - DNA, 20 bp, human
ggaccgtgggacagtactgc

SEQ ID NO: 86364 - DNA, 20 bp, human
ggtggcgtgtggcgagctgg

SEQ ID NO: 86365 - DNA, 20 bp, human
gagaggactggacccgaggt

SEQ ID NO: 86366 - DNA, 20 bp, human
ggtgtcggatggtagaacca

SEQ ID NO: 86367 - DNA, 20 bp, human
gctgtgagtctggtaagtgt

SEQ ID NO: 86368 - DNA, 20 bp, human
gacttaccagactcacagta

SEQ ID NO: 86369 - DNA, 20 bp, human
gggatggtagaaccagggtt

SEQ ID NO: 86370 - DNA, 20 bp, human
ggagtctggtaagtgtcgga

SEQ ID NO: 86371 - DNA, 20 bp, human
gttatggagggagaggttca

SEQ ID NO: 86372 - DNA, 20 bp, human
gcctccaacagcatacgatg

SEQ ID NO: 86373 - DNA, 20 bp, human
gtctgtgcagcatagccaaa

SEQ ID NO: 86374 - DNA, 20 bp, human
gcaacagcatacgatgtggt

SEQ ID NO: 86375 - DNA, 20 bp, human
ggttctgcacttctgtgcca

SEQ ID NO: 86376 - DNA, 20 bp, human
gggtcaagtagaaggacgag

SEQ ID NO: 86377 - DNA, 20 bp, human
ggtgcggcgcgagcggtcgg

SEQ ID NO: 86378 - DNA, 20 bp, human
ggaagcggtgtcctcatcag

SEQ ID NO: 86379 - DNA, 20 bp, human
gggcttcacgtcccagaggg

SEQ ID NO: 86380 - DNA, 20 bp, human
ggcggtgtcctcatcagggg

SEQ ID NO: 86381 - DNA, 20 bp, human
ggtctcccggtcgcgcgtgg

SEQ ID NO: 86382 - DNA, 20 bp, human
gccagtccgtggagactgaa

SEQ ID NO: 86383 - DNA, 20 bp, human
ggcgccggcggatgggaaga

SEQ ID NO: 86384 - DNA, 20 bp, human
gtcggtcgctcagagctgct

SEQ ID NO: 86385 - DNA, 20 bp, human
ggcgggcttcacgtcccaga

SEQ ID NO: 86386 - DNA, 20 bp, human
ggccgtacccggcaggctgg

SEQ ID NO: 86387 - DNA, 20 bp, human
gcttctaggaagtagaacgc

SEQ ID NO: 86388 - DNA, 20 bp, human
gccgcgacccggcccgagga

SEQ ID NO: 86389 - DNA, 20 bp, human
gggcgggcaggcatgcgagc

SEQ ID NO: 86390 - DNA, 20 bp, human
gcggcggaaaaggccgtacc

SEQ ID NO: 86391 - DNA, 20 bp, human
gagcgtcgaagctagaacgt

SEQ ID NO: 86392 - DNA, 20 bp, human
gatggcaggcggactctcag

SEQ ID NO: 86393 - DNA, 20 bp, human
gggtcacaccgcctggaagg

SEQ ID NO: 86394 - DNA, 20 bp, human
gcccgccagcctgccgggta

SEQ ID NO: 86395 - DNA, 20 bp, human
ggtctgcccacgaccctcaa

SEQ ID NO: 86396 - DNA, 20 bp, human
ggcagtgggcagggactaag

SEQ ID NO: 86397 - DNA, 20 bp, human
ggtctggagtctgacgtcac

SEQ ID NO: 86398 - DNA, 20 bp, human
ggatgatgagtgtgagtcaa

SEQ ID NO: 86399 - DNA, 20 bp, human
gaatggcagggcttatggag

SEQ ID NO: 86400 - DNA, 20 bp, human
gagtcaggaaatacatggtc

SEQ ID NO: 86401 - DNA, 20 bp, human
gtaagtcttcatccacccag

SEQ ID NO: 86402 - DNA, 20 bp, human
gttcatcccaggctggcagt

SEQ ID NO: 86403 - DNA, 20 bp, human
gccctgcccactgccagcct

SEQ ID NO: 86404 - DNA, 20 bp, human
ggagcttcggccctggttct

SEQ ID NO: 86405 - DNA, 20 bp, human
ggcgtgcacacttcccacac

SEQ ID NO: 86406 - DNA, 20 bp, human
gtacgtgagaagctcggagg

SEQ ID NO: 86407 - DNA, 20 bp, human
gccctacgtgagaagctcgg

SEQ ID NO: 86408 - DNA, 20 bp, human
gttcgacggggtctgagtca

SEQ ID NO: 86409 - DNA, 20 bp, human
gaggagttccttgtggagag

SEQ ID NO: 86410 - DNA, 20 bp, human
gggcccctacgtgagaagct

SEQ ID NO: 86411 - DNA, 20 bp, human
ggtgagaagctcggaggggg

SEQ ID NO: 86412 - DNA, 20 bp, human
gctaggtctagaggaccgca

SEQ ID NO: 86413 - DNA, 20 bp, human
gagcccggtccaggttctga

SEQ ID NO: 86414 - DNA, 20 bp, human
gtggtttcaggagttccttg

SEQ ID NO: 86415 - DNA, 20 bp, human
ggtctcgcttaagtgttagt

SEQ ID NO: 86416 - DNA, 20 bp, human
ggcggagcgcaggtgaccca

SEQ ID NO: 86417 - DNA, 20 bp, human
gagaccggcggaaagaagag

SEQ ID NO: 86418 - DNA, 20 bp, human
gcgggcttgggcgcccccgg

SEQ ID NO: 86419 - DNA, 20 bp, human
gaagcccgagagcagcagaa

SEQ ID NO: 86420 - DNA, 20 bp, human
gtaatgggtaactctctgaa

SEQ ID NO: 86421 - DNA, 20 bp, human
gcaccaaggggtcgcactgc

SEQ ID NO: 86422 - DNA, 20 bp, human
ggtgcgtgttgggagaaatt

SEQ ID NO: 86423 - DNA, 20 bp, human
gtgaaaggtaggagagacga

SEQ ID NO: 86424 - DNA, 20 bp, human
gaagcgactggggatgaggg

SEQ ID NO: 86425 - DNA, 20 bp, human
gtggaagcgactggggatga

SEQ ID NO: 86426 - DNA, 20 bp, human
gggtctcccacagtgacaag

SEQ ID NO: 86427 - DNA, 20 bp, human
ggggcttaaacggagaaggg

SEQ ID NO: 86428 - DNA, 20 bp, human
gctgcttgaacggcagatta

SEQ ID NO: 86429 - DNA, 20 bp, human
gcaggagcaggaataaccac

SEQ ID NO: 86430 - DNA, 20 bp, human
gtatccttcattctaggaga

SEQ ID NO: 86431 - DNA, 20 bp, human
gcagccttccatggagtcaa

SEQ ID NO: 86432 - DNA, 20 bp, human
gcgaagcctcttgtcactgt

SEQ ID NO: 86433 - DNA, 20 bp, human
gttcggccggggacttctga

SEQ ID NO: 86434 - DNA, 20 bp, human
gggcttcgggtgttgggtga

SEQ ID NO: 86435 - DNA, 20 bp, human
ggactattatccttcattct

SEQ ID NO: 86436 - DNA, 20 bp, human
gcgccgccgtcaggcacacc

SEQ ID NO: 86437 - DNA, 20 bp, human
gagcagggccatgcccgtcc

SEQ ID NO: 86438 - DNA, 20 bp, human
gcgggagaagctggaccaag

SEQ ID NO: 86439 - DNA, 20 bp, human
gtggcagtgcagacagccgt

SEQ ID NO: 86440 - DNA, 20 bp, human
ggtacagctgatccatcatc

SEQ ID NO: 86441 - DNA, 20 bp, human
ggaaataccctgagtcgtcg

SEQ ID NO: 86442 - DNA, 20 bp, human
gcacaccaggcacagcagca

SEQ ID NO: 86443 - DNA, 20 bp, human
gacagcagtgtaccagatga

SEQ ID NO: 86444 - DNA, 20 bp, human
gccccgccagcgagaccccg

SEQ ID NO: 86445 - DNA, 20 bp, human
gtgatggatcagctgtacca

SEQ ID NO: 86446 - DNA, 20 bp, human
ggcaccagcgcgaacagcag

SEQ ID NO: 86447 - DNA, 20 bp, human
gccttctccgagagccgggc

SEQ ID NO: 86448 - DNA, 20 bp, human
gggcgagcaggaggcttagg

SEQ ID NO: 86449 - DNA, 20 bp, human
gaggacccggagagcccgtc

SEQ ID NO: 86450 - DNA, 20 bp, human
ggctgccagacgggctctcc

SEQ ID NO: 86451 - DNA, 20 bp, human
gccggccgctgctgccagac

SEQ ID NO: 86452 - DNA, 20 bp, human
gagaaggaaagaaagccggg

SEQ ID NO: 86453 - DNA, 20 bp, human
gcgcgtcattgtgttacctg

SEQ ID NO: 86454 - DNA, 20 bp, human
ggcggcgtcccgagtgcccg

SEQ ID NO: 86455 - DNA, 20 bp, human
gaccagcctagctcgcgggc

SEQ ID NO: 86456 - DNA, 20 bp, human
ggtgcccgcccggcccctag

SEQ ID NO: 86457 - DNA, 20 bp, human
gctcgagggcttccgaacca

SEQ ID NO: 86458 - DNA, 20 bp, human
gaggtgcgcgggtgacgaat

SEQ ID NO: 86459 - DNA, 20 bp, human
ggagggcttccgaaccacgg

SEQ ID NO: 86460 - DNA, 20 bp, human
gcacaccgggccgcccctag

SEQ ID NO: 86461 - DNA, 20 bp, human
gccgccgcgcgcagcctcga

SEQ ID NO: 86462 - DNA, 20 bp, human
gctgcgggcgctcggagggc

SEQ ID NO: 86463 - DNA, 20 bp, human
gggtcgcggacggggcacac

SEQ ID NO: 86464 - DNA, 20 bp, human
gcgggtcgcgggggcaatgc

SEQ ID NO: 86465 - DNA, 20 bp, human
gctgctggcgctctgggtgc

SEQ ID NO: 86466 - DNA, 20 bp, human
ggggcgcaaatagggtcagt

SEQ ID NO: 86467 - DNA, 20 bp, human
gtgactcgggagcccacgca

SEQ ID NO: 86468 - DNA, 20 bp, human
gatcccctcaaggcaccggg

SEQ ID NO: 86469 - DNA, 20 bp, human
gaggcaccgggcggaacaag

SEQ ID NO: 86470 - DNA, 20 bp, human
gggctgcgggggcgcaaata

SEQ ID NO: 86471 - DNA, 20 bp, human
gcaagccccgcaggctccag

SEQ ID NO: 86472 - DNA, 20 bp, human
gcaccgggcggaacaagggg

SEQ ID NO: 86473 - DNA, 20 bp, human
ggcggggctggatcccctca

SEQ ID NO: 86474 - DNA, 20 bp, human
gagtgaggcgaggagcacgg

SEQ ID NO: 86475 - DNA, 20 bp, human
ggtgggctcccgccctgcgt

SEQ ID NO: 86476 - DNA, 20 bp, human
ggcagctccaggatactccg

SEQ ID NO: 86477 - DNA, 20 bp, human
gggcgaggacagccgggact

SEQ ID NO: 86478 - DNA, 20 bp, human
gcggcggccgcggagtatcc

SEQ ID NO: 86479 - DNA, 20 bp, human
ggcccaggcgcacacggaag

SEQ ID NO: 86480 - DNA, 20 bp, human
ggtgcgcgcgcccagggctg

SEQ ID NO: 86481 - DNA, 20 bp, human
gaagtggtgagtgtcaccgg

SEQ ID NO: 86482 - DNA, 20 bp, human
gggtcgcggcgaggacagcc

SEQ ID NO: 86483 - DNA, 20 bp, human
gccgcgcctccggccagtcc

SEQ ID NO: 86484 - DNA, 20 bp, human
gcccagcgtgcgcgcgccca

SEQ ID NO: 86485 - DNA, 20 bp, human
gcctaaggaccgaccaagag

SEQ ID NO: 86486 - DNA, 20 bp, human
ggcaggcgggaccaaaaggt

SEQ ID NO: 86487 - DNA, 20 bp, human
gcgccgagggaggccgttag

SEQ ID NO: 86488 - DNA, 20 bp, human
gcgccgctaacggcctccct

SEQ ID NO: 86489 - DNA, 20 bp, human
gaccggccgagaagccgaag

SEQ ID NO: 86490 - DNA, 20 bp, human
gagactgcaggccaaccggg

SEQ ID NO: 86491 - DNA, 20 bp, human
gcccagcctgtcagcgccga

SEQ ID NO: 86492 - DNA, 20 bp, human
gcccgcctgccccctgctag

SEQ ID NO: 86493 - DNA, 20 bp, human
gcgggaccaaaaggtaggaa

SEQ ID NO: 86494 - DNA, 20 bp, human
ggggggcaggcgggaccaaa

SEQ ID NO: 86495 - DNA, 20 bp, human
ggtttgctgccactagcagg

SEQ ID NO: 86496 - DNA, 20 bp, human
gacctagcgggcagggaccc

SEQ ID NO: 86497 - DNA, 20 bp, human
ggggaccctggactttcgaa

SEQ ID NO: 86498 - DNA, 20 bp, human
ggtgtctgggccgagccctg

SEQ ID NO: 86499 - DNA, 20 bp, human
gcgggaaggcctggagggta

SEQ ID NO: 86500 - DNA, 20 bp, human
ggccttcccggtccagacac

SEQ ID NO: 86501 - DNA, 20 bp, human
gctgcccgctaggtaagagc

SEQ ID NO: 86502 - DNA, 20 bp, human
gcagggtacccgaccatacc

SEQ ID NO: 86503 - DNA, 20 bp, human
gcagagaagcgagcgatcgg

SEQ ID NO: 86504 - DNA, 20 bp, human
gtggaccgggaaggcctgga

SEQ ID NO: 86505 - DNA, 20 bp, human
gatcgccagctcttacctag

SEQ ID NO: 86506 - DNA, 20 bp, human
gcggcggggcgggagtcgag

SEQ ID NO: 86507 - DNA, 20 bp, human
gctgaggtgggatgcgagag

SEQ ID NO: 86508 - DNA, 20 bp, human
ggacctggcggcaagggacg

SEQ ID NO: 86509 - DNA, 20 bp, human
ggaccgaggggcggacctgg

SEQ ID NO: 86510 - DNA, 20 bp, human
gtgggatgcgagagtggaag

SEQ ID NO: 86511 - DNA, 20 bp, human
gcggccgcctgcccggatcg

SEQ ID NO: 86512 - DNA, 20 bp, human
gcgtggacccggcgaccgag

SEQ ID NO: 86513 - DNA, 20 bp, human
gcggccatcgcgccccctct

SEQ ID NO: 86514 - DNA, 20 bp, human
gggcactggtggccgcgatc

SEQ ID NO: 86515 - DNA, 20 bp, human
ggaagggtgggggaccactg

SEQ ID NO: 86516 - DNA, 20 bp, human
ggctcaccccatcctccgag

SEQ ID NO: 86517 - DNA, 20 bp, human
gaccccatcctccgagaggg

SEQ ID NO: 86518 - DNA, 20 bp, human
gcgtgcctcagactagaagg

SEQ ID NO: 86519 - DNA, 20 bp, human
gccatcctccgagagggagg

SEQ ID NO: 86520 - DNA, 20 bp, human
ggagagggaggaggcccaac

SEQ ID NO: 86521 - DNA, 20 bp, human
ggtatcagcaatagaggcgg

SEQ ID NO: 86522 - DNA, 20 bp, human
gagagtatcagcaatagagg

SEQ ID NO: 86523 - DNA, 20 bp, human
gtggtgagtaggaaacagta

SEQ ID NO: 86524 - DNA, 20 bp, human
gactagagtatcagcaatag

SEQ ID NO: 86525 - DNA, 20 bp, human
gtcagcaatagaggcggcgg

SEQ ID NO: 86526 - DNA, 20 bp, human
ggcctcaccatgtccaagag

SEQ ID NO: 86527 - DNA, 20 bp, human
gaggagggagggacattcaa

SEQ ID NO: 86528 - DNA, 20 bp, human
gagggggatgcccaggggta

SEQ ID NO: 86529 - DNA, 20 bp, human
gtggtttgcggtcaccacca

SEQ ID NO: 86530 - DNA, 20 bp, human
gccctgcggcctcagatggg

SEQ ID NO: 86531 - DNA, 20 bp, human
ggggagacttgagggcctgt

SEQ ID NO: 86532 - DNA, 20 bp, human
ggcccctcttggacatggtg

SEQ ID NO: 86533 - DNA, 20 bp, human
gagccggagcaccctacccc

SEQ ID NO: 86534 - DNA, 20 bp, human
ggtaggcacaggtgccgtgg

SEQ ID NO: 86535 - DNA, 20 bp, human
gaggccctgcggcctcagat

SEQ ID NO: 86536 - DNA, 20 bp, human
gaggaggtcgagggtcccgg

SEQ ID NO: 86537 - DNA, 20 bp, human
ggagcggacgctgggagcaa

SEQ ID NO: 86538 - DNA, 20 bp, human
gaaaggagcagagagtcggg

SEQ ID NO: 86539 - DNA, 20 bp, human
gcaagggagcgcgaggtcgt

SEQ ID NO: 86540 - DNA, 20 bp, human
gtcccgccccagaagttcaa

SEQ ID NO: 86541 - DNA, 20 bp, human
ggctgctctgaggaggtcga

SEQ ID NO: 86542 - DNA, 20 bp, human
gtcagccagcgccccgtggg

SEQ ID NO: 86543 - DNA, 20 bp, human
gccgccgggtcctagcgagg

SEQ ID NO: 86544 - DNA, 20 bp, human
gctgctgctgcgctacctgg

SEQ ID NO: 86545 - DNA, 20 bp, human
gaggagggacggctctagat

SEQ ID NO: 86546 - DNA, 20 bp, human
ggagcgcagagccggagtcg

SEQ ID NO: 86547 - DNA, 20 bp, human
ggacagccgtcggaccccgg

SEQ ID NO: 86548 - DNA, 20 bp, human
gccctcagcaaccctcgaca

SEQ ID NO: 86549 - DNA, 20 bp, human
ggaggcggccaccgcgactc

SEQ ID NO: 86550 - DNA, 20 bp, human
gcctcgacatggcgctgagg

SEQ ID NO: 86551 - DNA, 20 bp, human
ggaccctagtctcccaacag

SEQ ID NO: 86552 - DNA, 20 bp, human
ggccatgtcgagggttgctg

SEQ ID NO: 86553 - DNA, 20 bp, human
gtgggactcgggcctggcta

SEQ ID NO: 86554 - DNA, 20 bp, human
gcccgtcccaggcagtgagt

SEQ ID NO: 86555 - DNA, 20 bp, human
gccggtccgggcgaggatag

SEQ ID NO: 86556 - DNA, 20 bp, human
ggcagaagagtcaactccag

SEQ ID NO: 86557 - DNA, 20 bp, human
ggaagagtcaactccagcgg

SEQ ID NO: 86558 - DNA, 20 bp, human
gggcggcagcaccacagcga

SEQ ID NO: 86559 - DNA, 20 bp, human
ggagtcaactccagcggcgg

SEQ ID NO: 86560 - DNA, 20 bp, human
gactcggcgagccctcgctg

SEQ ID NO: 86561 - DNA, 20 bp, human
gctctctctcattggttagg

SEQ ID NO: 86562 - DNA, 20 bp, human
gtggatagcctctctctcat

SEQ ID NO: 86563 - DNA, 20 bp, human
gaactacggatcagacacta

SEQ ID NO: 86564 - DNA, 20 bp, human
gtctgaatgatattcctctt

SEQ ID NO: 86565 - DNA, 20 bp, human
ggcagagtccatttaaagtt

SEQ ID NO: 86566 - DNA, 20 bp, human
gaggagagcgaggagccacc

SEQ ID NO: 86567 - DNA, 20 bp, human
ggagtccgcagcccccgaat

SEQ ID NO: 86568 - DNA, 20 bp, human
gggagccccggaatggccag

SEQ ID NO: 86569 - DNA, 20 bp, human
ggcggcgaggacgggacgga

SEQ ID NO: 86570 - DNA, 20 bp, human
ggcgcgtgcgagccccgagg

SEQ ID NO: 86571 - DNA, 20 bp, human
gtcgcagagccgacaccagg

SEQ ID NO: 86572 - DNA, 20 bp, human
gacgcgggctgcgaagtggt

SEQ ID NO: 86573 - DNA, 20 bp, human
gtcgagagcccccctggtgt

SEQ ID NO: 86574 - DNA, 20 bp, human
gcgatgaggtcggccagggt

SEQ ID NO: 86575 - DNA, 20 bp, human
gcgggcggggagccccggaa

SEQ ID NO: 86576 - DNA, 20 bp, human
gagcctgcgggagggacgct

SEQ ID NO: 86577 - DNA, 20 bp, human
gcgctcgagaaagcaggacg

SEQ ID NO: 86578 - DNA, 20 bp, human
gccgccagcgccccccgtcg

SEQ ID NO: 86579 - DNA, 20 bp, human
ggggaaagctcgaggtccct

SEQ ID NO: 86580 - DNA, 20 bp, human
gtcccggggcgggaaccaaa

SEQ ID NO: 86581 - DNA, 20 bp, human
ggctcggcggccgcgacggg

SEQ ID NO: 86582 - DNA, 20 bp, human
gacccaccgtgcagaaggtg

SEQ ID NO: 86583 - DNA, 20 bp, human
gcgccgagcgtccctcccgc

SEQ ID NO: 86584 - DNA, 20 bp, human
gtccctcccgcaggctgtgg

SEQ ID NO: 86585 - DNA, 20 bp, human
ggttcccgccccgggacggg

SEQ ID NO: 86586 - DNA, 20 bp, human
gagcccgcccggcgaacccg

SEQ ID NO: 86587 - DNA, 20 bp, human
gcggctgcgctcgctccagt

SEQ ID NO: 86588 - DNA, 20 bp, human
gccgggccaggcgagcccac

SEQ ID NO: 86589 - DNA, 20 bp, human
gagagggccggcggataagt

SEQ ID NO: 86590 - DNA, 20 bp, human
gttaaagatggccggagcgg

SEQ ID NO: 86591 - DNA, 20 bp, human
gtcgccgggcgggctccaga

SEQ ID NO: 86592 - DNA, 20 bp, human
ggctccagaggggagccggt

SEQ ID NO: 86593 - DNA, 20 bp, human
ggctcgctccagtcggcgag

SEQ ID NO: 86594 - DNA, 20 bp, human
gtttttaaagatggccggag

SEQ ID NO: 86595 - DNA, 20 bp, human
gggtgcctagccccccggcc

SEQ ID NO: 86596 - DNA, 20 bp, human
gtcgagaagcactagatcag

SEQ ID NO: 86597 - DNA, 20 bp, human
gagcactagatcagcggatc

SEQ ID NO: 86598 - DNA, 20 bp, human
gttggcgaccactcacccat

SEQ ID NO: 86599 - DNA, 20 bp, human
gtcgctgtggcccggatgtt

SEQ ID NO: 86600 - DNA, 20 bp, human
gggagccgccgagctcgctg

SEQ ID NO: 86601 - DNA, 20 bp, human
gcgcaacgggctactagggg

SEQ ID NO: 86602 - DNA, 20 bp, human
ggtccgcaacgggctactag

SEQ ID NO: 86603 - DNA, 20 bp, human
gcgggccacagcgagctcgg

SEQ ID NO: 86604 - DNA, 20 bp, human
ggagtggtcgccaagatccc

SEQ ID NO: 86605 - DNA, 20 bp, human
gaaaccttcaggcggcccat

SEQ ID NO: 86606 - DNA, 20 bp, human
gcacgcagacagagtacagt

SEQ ID NO: 86607 - DNA, 20 bp, human
gtgcagcggcgtcattgtat

SEQ ID NO: 86608 - DNA, 20 bp, human
ggctttctccagctgatgga

SEQ ID NO: 86609 - DNA, 20 bp, human
gatctcagaaatccacaaca

SEQ ID NO: 86610 - DNA, 20 bp, human
gtttagtcttcaaaaatcac

SEQ ID NO: 86611 - DNA, 20 bp, human
gttatcctgacccagatcgg

SEQ ID NO: 86612 - DNA, 20 bp, human
gttagggcacactgagagaa

SEQ ID NO: 86613 - DNA, 20 bp, human
gtttctgagctcacttgcag

SEQ ID NO: 86614 - DNA, 20 bp, human
gtgctcgttggagacttgtt

SEQ ID NO: 86615 - DNA, 20 bp, human
gcaagtactcgttctcattt

SEQ ID NO: 86616 - DNA, 20 bp, human
gctgcagaggaactctccag

SEQ ID NO: 86617 - DNA, 20 bp, human
gctgctacggacctacggtg

SEQ ID NO: 86618 - DNA, 20 bp, human
gtagagaggggcaccaggga

SEQ ID NO: 86619 - DNA, 20 bp, human
gtcgccgacagccacttccg

SEQ ID NO: 86620 - DNA, 20 bp, human
gagccacttccgaggcctgg

SEQ ID NO: 86621 - DNA, 20 bp, human
gcgcctagagaggggcacca

SEQ ID NO: 86622 - DNA, 20 bp, human
gccacgtctcctgaaatgaa

SEQ ID NO: 86623 - DNA, 20 bp, human
gcactccaaaccgtctgcag

SEQ ID NO: 86624 - DNA, 20 bp, human
gagttcctctgcagacggtt

SEQ ID NO: 86625 - DNA, 20 bp, human
gcggtccatgccatctccct

SEQ ID NO: 86626 - DNA, 20 bp, human
gggctgcgccgaggtcgtag

SEQ ID NO: 86627 - DNA, 20 bp, human
gggctgtcaaggctcatggg

SEQ ID NO: 86628 - DNA, 20 bp, human
gtgacagccaggtcccctag

SEQ ID NO: 86629 - DNA, 20 bp, human
gagacgggcggccacagcac

SEQ ID NO: 86630 - DNA, 20 bp, human
gcaaaggagtcagggacgac

SEQ ID NO: 86631 - DNA, 20 bp, human
gccgccgcccaaaggagtca

SEQ ID NO: 86632 - DNA, 20 bp, human
gtgggcggcgggtcccctag

SEQ ID NO: 86633 - DNA, 20 bp, human
gagcgcccgggacctcgtag

SEQ ID NO: 86634 - DNA, 20 bp, human
ggtcgtccgccagagcagac

SEQ ID NO: 86635 - DNA, 20 bp, human
gggtggctctaggaacgacg

SEQ ID NO: 86636 - DNA, 20 bp, human
gtccaaagccgcctccgcca

SEQ ID NO: 86637 - DNA, 20 bp, human
ggcgcgcgaacacgggagaa

SEQ ID NO: 86638 - DNA, 20 bp, human
gcgctcgggttgctcttctg

SEQ ID NO: 86639 - DNA, 20 bp, human
gcgcgggagcgcgcgaacac

SEQ ID NO: 86640 - DNA, 20 bp, human
gtctcgtaactcgctccgca

SEQ ID NO: 86641 - DNA, 20 bp, human
ggaattcccggccgctgcaa

SEQ ID NO: 86642 - DNA, 20 bp, human
gggccgctgcaaggggtgag

SEQ ID NO: 86643 - DNA, 20 bp, human
gagcgagttacgagaattcc

SEQ ID NO: 86644 - DNA, 20 bp, human
gacaagggagttgaggtcgg

SEQ ID NO: 86645 - DNA, 20 bp, human
gggaagagccagggaccatt

SEQ ID NO: 86646 - DNA, 20 bp, human
gctcaggagcaggaatgatg

SEQ ID NO: 86647 - DNA, 20 bp, human
gccctaacaggtcaagtcca

SEQ ID NO: 86648 - DNA, 20 bp, human
gcagggagcaaccaggtcca

SEQ ID NO: 86649 - DNA, 20 bp, human
ggccatgagactgagtcctc

SEQ ID NO: 86650 - DNA, 20 bp, human
gggccccaggtagagaccag

SEQ ID NO: 86651 - DNA, 20 bp, human
gcctgttagggtccttgtgg

SEQ ID NO: 86652 - DNA, 20 bp, human
gctgagtcagaggagcatgg

SEQ ID NO: 86653 - DNA, 20 bp, human
gtggagggcctcatccacca

SEQ ID NO: 86654 - DNA, 20 bp, human
gctccaggcaactgagtcag

SEQ ID NO: 86655 - DNA, 20 bp, human
gggtccagggcagtgctgga

SEQ ID NO: 86656 - DNA, 20 bp, human
gtccaaagccgcctccgcca

SEQ ID NO: 86657 - DNA, 20 bp, human
ggcgcgcgaacacgggagaa

SEQ ID NO: 86658 - DNA, 20 bp, human
gcgctcgggttgctcttctg

SEQ ID NO: 86659 - DNA, 20 bp, human
gcgcgggagcgcgcgaacac

SEQ ID NO: 86660 - DNA, 20 bp, human
gtctcgtaactcgctccgca

SEQ ID NO: 86661 - DNA, 20 bp, human
ggaattcccggccgctgcaa

SEQ ID NO: 86662 - DNA, 20 bp, human
gggccgctgcaaggggtgag

SEQ ID NO: 86663 - DNA, 20 bp, human
gagcgagttacgagaattcc

SEQ ID NO: 86664 - DNA, 20 bp, human
gacaagggagttgaggtcgg

SEQ ID NO: 86665 - DNA, 20 bp, human
gggaagagccagggaccatt

SEQ ID NO: 86666 - DNA, 20 bp, human
gctcaggagcaggaatgatg

SEQ ID NO: 86667 - DNA, 20 bp, human
gccctaacaggtcaagtcca

SEQ ID NO: 86668 - DNA, 20 bp, human
gcagggagcaaccaggtcca

SEQ ID NO: 86669 - DNA, 20 bp, human
ggccatgagactgagtcctc

SEQ ID NO: 86670 - DNA, 20 bp, human
gggccccaggtagagaccag

SEQ ID NO: 86671 - DNA, 20 bp, human
gcctgttagggtccttgtgg

SEQ ID NO: 86672 - DNA, 20 bp, human
gctgagtcagaggagcatgg

SEQ ID NO: 86673 - DNA, 20 bp, human
gtggagggcctcatccacca

SEQ ID NO: 86674 - DNA, 20 bp, human
gctccaggcaactgagtcag

SEQ ID NO: 86675 - DNA, 20 bp, human
gggtccagggcagtgctgga

SEQ ID NO: 86676 - DNA, 20 bp, human
gaaggcgtacctggaaagaa

SEQ ID NO: 86677 - DNA, 20 bp, human
gagagtggccggggacggac

SEQ ID NO: 86678 - DNA, 20 bp, human
gtagtggccgggcccagcac

SEQ ID NO: 86679 - DNA, 20 bp, human
gaggatgacgggcctgacga

SEQ ID NO: 86680 - DNA, 20 bp, human
gccatgagcctgccgccctc

SEQ ID NO: 86681 - DNA, 20 bp, human
ggaggaggagcgctgcacgg

SEQ ID NO: 86682 - DNA, 20 bp, human
gaactccgcgtaggtgaggt

SEQ ID NO: 86683 - DNA, 20 bp, human
gtgctgcacgaactccgcgt

SEQ ID NO: 86684 - DNA, 20 bp, human
ggcgcgagcaaccgcgacgc

SEQ ID NO: 86685 - DNA, 20 bp, human
gggcctgacgaaggcgtacc

SEQ ID NO: 86686 - DNA, 20 bp, human
ggccggccggcgcactaaga

SEQ ID NO: 86687 - DNA, 20 bp, human
ggccgacgtcagcagtcgaa

SEQ ID NO: 86688 - DNA, 20 bp, human
gccacgagggacgtaaacat

SEQ ID NO: 86689 - DNA, 20 bp, human
gcaacattgtggcgatgctg

SEQ ID NO: 86690 - DNA, 20 bp, human
gtccagcgcgaacgacatgg

SEQ ID NO: 86691 - DNA, 20 bp, human
ggccattcgactgctgacgt

SEQ ID NO: 86692 - DNA, 20 bp, human
gggcgcagagtttaggagac

SEQ ID NO: 86693 - DNA, 20 bp, human
gggagacgggttcatcagtc

SEQ ID NO: 86694 - DNA, 20 bp, human
gcagtcgaatggcaacattg

SEQ ID NO: 86695 - DNA, 20 bp, human
gacgggttcatcagtcaggc

SEQ ID NO: 86696 - DNA, 20 bp, human
ggggccccaccgtacccgag

SEQ ID NO: 86697 - DNA, 20 bp, human
gtgcccccgaggcccccgcg

SEQ ID NO: 86698 - DNA, 20 bp, human
gggcagccctccatcccctc

SEQ ID NO: 86699 - DNA, 20 bp, human
gaggagacaactccggtcag

SEQ ID NO: 86700 - DNA, 20 bp, human
gcgccagcggcgagcagtcc

SEQ ID NO: 86701 - DNA, 20 bp, human
ggcccgcacggcccagttgg

SEQ ID NO: 86702 - DNA, 20 bp, human
gcccgcccgcacggcccagt

SEQ ID NO: 86703 - DNA, 20 bp, human
ggcggaggaggagacaactc

SEQ ID NO: 86704 - DNA, 20 bp, human
gtggcggccggctgcggtga

SEQ ID NO: 86705 - DNA, 20 bp, human
gccggcccctgcccgaggga

SEQ ID NO: 86706 - DNA, 20 bp, human
gagagccgccgcccaggaag

SEQ ID NO: 86707 - DNA, 20 bp, human
gcggctctgggctccgagtg

SEQ ID NO: 86708 - DNA, 20 bp, human
ggggcaacaccgcgctgact

SEQ ID NO: 86709 - DNA, 20 bp, human
ggtttccgcatccccttcct

SEQ ID NO: 86710 - DNA, 20 bp, human
gccccgtccctaggtaacca

SEQ ID NO: 86711 - DNA, 20 bp, human
gctggctcggtggagcggag

SEQ ID NO: 86712 - DNA, 20 bp, human
gtccggcgcgcggggatcac

SEQ ID NO: 86713 - DNA, 20 bp, human
gcatggtcacctagcaacag

SEQ ID NO: 86714 - DNA, 20 bp, human
gaacccctggctcggtggag

SEQ ID NO: 86715 - DNA, 20 bp, human
gccctatcacctagagacag

SEQ ID NO: 86716 - DNA, 20 bp, human
gaaggtccgctcgggaacct

SEQ ID NO: 86717 - DNA, 20 bp, human
gagggccagggcgagtactc

SEQ ID NO: 86718 - DNA, 20 bp, human
gtggtcgcacggcttcgagg

SEQ ID NO: 86719 - DNA, 20 bp, human
gtggcggcggcaaaagagga

SEQ ID NO: 86720 - DNA, 20 bp, human
gagcagctgaaggtccgctc

SEQ ID NO: 86721 - DNA, 20 bp, human
gggcaagtggatgtaccggg

SEQ ID NO: 86722 - DNA, 20 bp, human
gggcgcagggcaagcggcac

SEQ ID NO: 86723 - DNA, 20 bp, human
gggcggtgcccggctcacgt

SEQ ID NO: 86724 - DNA, 20 bp, human
ggcatctgcacggggcccaa

SEQ ID NO: 86725 - DNA, 20 bp, human
gcttccgcccgtcattcggg

SEQ ID NO: 86726 - DNA, 20 bp, human
gaggacggggaggttgtcag

SEQ ID NO: 86727 - DNA, 20 bp, human
ggacagccccgcacacccac

SEQ ID NO: 86728 - DNA, 20 bp, human
gactcctccagtgccctcgg

SEQ ID NO: 86729 - DNA, 20 bp, human
ggaggggaaattcccctcgg

SEQ ID NO: 86730 - DNA, 20 bp, human
gggtgcagtggtgagtctgg

SEQ ID NO: 86731 - DNA, 20 bp, human
gggcgggggctgccaccgag

SEQ ID NO: 86732 - DNA, 20 bp, human
gggaattcagcctccggcgg

SEQ ID NO: 86733 - DNA, 20 bp, human
ggcgggaattcagcctccgg

SEQ ID NO: 86734 - DNA, 20 bp, human
gccctctgcacccacgctgg

SEQ ID NO: 86735 - DNA, 20 bp, human
ggactccaccagccagagca

SEQ ID NO: 86736 - DNA, 20 bp, human
gagcagcagcagcaatgcgg

SEQ ID NO: 86737 - DNA, 20 bp, human
gagacgctggtcaggctccg

SEQ ID NO: 86738 - DNA, 20 bp, human
gctcccgctggagacaggac

SEQ ID NO: 86739 - DNA, 20 bp, human
ggctggagacaggaccggag

SEQ ID NO: 86740 - DNA, 20 bp, human
gtccgcggcgcagctcgaaa

SEQ ID NO: 86741 - DNA, 20 bp, human
gagcaatgcggcggctcggg

SEQ ID NO: 86742 - DNA, 20 bp, human
gggagcgcgagacgctggtc

SEQ ID NO: 86743 - DNA, 20 bp, human
gcggcgagagggcccctcgc

SEQ ID NO: 86744 - DNA, 20 bp, human
gagcagcaatgcggcggctc

SEQ ID NO: 86745 - DNA, 20 bp, human
gagacaggaccggaggggag

SEQ ID NO: 86746 - DNA, 20 bp, human
gaacccttcggtgagggagg

SEQ ID NO: 86747 - DNA, 20 bp, human
gggcaggctactcaccatgt

SEQ ID NO: 86748 - DNA, 20 bp, human
gggcgaggtagtggcaaggg

SEQ ID NO: 86749 - DNA, 20 bp, human
gctccccggcacagcatcca

SEQ ID NO: 86750 - DNA, 20 bp, human
gcagagacgccgaagaaccg

SEQ ID NO: 86751 - DNA, 20 bp, human
gagctgggagctggatgcaa

SEQ ID NO: 86752 - DNA, 20 bp, human
ggctaacccttcggtgaggg

SEQ ID NO: 86753 - DNA, 20 bp, human
ggggtgggtagagaaggata

SEQ ID NO: 86754 - DNA, 20 bp, human
ggggagggggctctcaagag

SEQ ID NO: 86755 - DNA, 20 bp, human
gggggagatcggaccaaggt

SEQ ID NO: 86756 - DNA, 20 bp, human
gcgggtgagcagggtgagta

SEQ ID NO: 86757 - DNA, 20 bp, human
ggggtcgcgcgggaagcaca

SEQ ID NO: 86758 - DNA, 20 bp, human
gagtggccggcacttccggc

SEQ ID NO: 86759 - DNA, 20 bp, human
ggcggctgctccgggtgagc

SEQ ID NO: 86760 - DNA, 20 bp, human
ggagagcgcccgcacccatc

SEQ ID NO: 86761 - DNA, 20 bp, human
gccccagggtccccgtttgt

SEQ ID NO: 86762 - DNA, 20 bp, human
gagaaaaaaaagtctcggtc

SEQ ID NO: 86763 - DNA, 20 bp, human
gaaggcgacgaggcgcggac

SEQ ID NO: 86764 - DNA, 20 bp, human
gggaagcgcaggaagggtcc

SEQ ID NO: 86765 - DNA, 20 bp, human
ggcgctctccggtccctggt

SEQ ID NO: 86766 - DNA, 20 bp, human
gtggggagcagcgggatccg

SEQ ID NO: 86767 - DNA, 20 bp, human
gtcctgaccgtcatcagcaa

SEQ ID NO: 86768 - DNA, 20 bp, human
gactcacaggactactacgt

SEQ ID NO: 86769 - DNA, 20 bp, human
ggtgcaggtgcgggacgggt

SEQ ID NO: 86770 - DNA, 20 bp, human
gcaggaggccaactgcgcct

SEQ ID NO: 86771 - DNA, 20 bp, human
ggcagcgggatccggggatg

SEQ ID NO: 86772 - DNA, 20 bp, human
ggcctttgctgatgacggtc

SEQ ID NO: 86773 - DNA, 20 bp, human
ggcacacagatgcggacaga

SEQ ID NO: 86774 - DNA, 20 bp, human
gctagagcattaggcagggt

SEQ ID NO: 86775 - DNA, 20 bp, human
gagaaagattaatagttcag

SEQ ID NO: 86776 - DNA, 20 bp, human
gctgcagaagaaggtgaaag

SEQ ID NO: 86777 - DNA, 20 bp, human
ggactgccgcgcgatagtca

SEQ ID NO: 86778 - DNA, 20 bp, human
gcgatagtcagggagctgtg

SEQ ID NO: 86779 - DNA, 20 bp, human
ggtcctggttgcaagagagg

SEQ ID NO: 86780 - DNA, 20 bp, human
gcagggagctgtgcgggtcc

SEQ ID NO: 86781 - DNA, 20 bp, human
ggagcctaggagtcaaggac

SEQ ID NO: 86782 - DNA, 20 bp, human
gcagctccctgactatcgcg

SEQ ID NO: 86783 - DNA, 20 bp, human
gtaacttatacgggcagtag

SEQ ID NO: 86784 - DNA, 20 bp, human
ggcctttctttaacttatac

SEQ ID NO: 86785 - DNA, 20 bp, human
gccagcccgggaggggatca

SEQ ID NO: 86786 - DNA, 20 bp, human
ggcgggtaagcgaggctcgg

SEQ ID NO: 86787 - DNA, 20 bp, human
ggaacagagttagtgggaca

SEQ ID NO: 86788 - DNA, 20 bp, human
ggctcgggggtaaggaagtg

SEQ ID NO: 86789 - DNA, 20 bp, human
ggtggacaggacggaggatg

SEQ ID NO: 86790 - DNA, 20 bp, human
gagccttgtggacaggacgg

SEQ ID NO: 86791 - DNA, 20 bp, human
gagggtggccccgtgatgga

SEQ ID NO: 86792 - DNA, 20 bp, human
gcctatgggaacagagttag

SEQ ID NO: 86793 - DNA, 20 bp, human
gagcggctggcgggtaagcg

SEQ ID NO: 86794 - DNA, 20 bp, human
gtgttcccataggacagatg

SEQ ID NO: 86795 - DNA, 20 bp, human
gtaagcgaggctcgggggta

SEQ ID NO: 86796 - DNA, 20 bp, human
gggaagactataagccccag

SEQ ID NO: 86797 - DNA, 20 bp, human
gcggaggtgagcgggcgcta

SEQ ID NO: 86798 - DNA, 20 bp, human
gagccccgtggaggatcctc

SEQ ID NO: 86799 - DNA, 20 bp, human
gcagccatctagccccgtgg

SEQ ID NO: 86800 - DNA, 20 bp, human
gaggcgaggcgccaccgacg

SEQ ID NO: 86801 - DNA, 20 bp, human
ggcgcccgaggatcctccac

SEQ ID NO: 86802 - DNA, 20 bp, human
ggagcaaccagcagaggtgg

SEQ ID NO: 86803 - DNA, 20 bp, human
gcggggcccggtgttcccgg

SEQ ID NO: 86804 - DNA, 20 bp, human
gcgaacgcccccgggaacac

SEQ ID NO: 86805 - DNA, 20 bp, human
ggtcgcacctgtcggaacag

SEQ ID NO: 86806 - DNA, 20 bp, human
gagcagggctctcctcccgg

SEQ ID NO: 86807 - DNA, 20 bp, human
gtgcgtcttaggcttctcca

SEQ ID NO: 86808 - DNA, 20 bp, human
gtgtggctgaagcagcgagg

SEQ ID NO: 86809 - DNA, 20 bp, human
gggtaaagaccagaaggcgg

SEQ ID NO: 86810 - DNA, 20 bp, human
gcacggcggtaaagaccaga

SEQ ID NO: 86811 - DNA, 20 bp, human
ggaagcctaagacgcaggaa

SEQ ID NO: 86812 - DNA, 20 bp, human
gagtggaggtgcgcggagtc

SEQ ID NO: 86813 - DNA, 20 bp, human
gtgggaggaccggagacaag

SEQ ID NO: 86814 - DNA, 20 bp, human
gtgacagcggcggaaagcag

SEQ ID NO: 86815 - DNA, 20 bp, human
ggagtgtggctgaagcagcg

SEQ ID NO: 86816 - DNA, 20 bp, human
ggcggctgggaccttgagag

SEQ ID NO: 86817 - DNA, 20 bp, human
gcaacctggccgacccctac

SEQ ID NO: 86818 - DNA, 20 bp, human
ggcgccagagagggcgacgg

SEQ ID NO: 86819 - DNA, 20 bp, human
gcagctccctgctggctccg

SEQ ID NO: 86820 - DNA, 20 bp, human
ggcgctttgagactccggta

SEQ ID NO: 86821 - DNA, 20 bp, human
gcccagtccggtcaccgcag

SEQ ID NO: 86822 - DNA, 20 bp, human
gttgagactccggtaggggt

SEQ ID NO: 86823 - DNA, 20 bp, human
gatgagtcgtcgtggtagaa

SEQ ID NO: 86824 - DNA, 20 bp, human
gcccaggcgctttgagactc

SEQ ID NO: 86825 - DNA, 20 bp, human
ggggctcgggaagcctgaca

SEQ ID NO: 86826 - DNA, 20 bp, human
gccccggggaacaagcggcc

SEQ ID NO: 86827 - DNA, 20 bp, human
ggggcgccccggggaacaag

SEQ ID NO: 86828 - DNA, 20 bp, human
gaggagccgccgccagtgga

SEQ ID NO: 86829 - DNA, 20 bp, human
gatgaggcgctcgagctcgg

SEQ ID NO: 86830 - DNA, 20 bp, human
ggctcgcctctcccgacctg

SEQ ID NO: 86831 - DNA, 20 bp, human
gagcctgagtgagcaggtgg

SEQ ID NO: 86832 - DNA, 20 bp, human
gaggcgagcaggccgtcggg

SEQ ID NO: 86833 - DNA, 20 bp, human
gccagcgcggcaccccccga

SEQ ID NO: 86834 - DNA, 20 bp, human
gagaggaactgtgagctcgt

SEQ ID NO: 86835 - DNA, 20 bp, human
gcccgttggactggatgatg

SEQ ID NO: 86836 - DNA, 20 bp, human
gcagcccagggcgagagtca

SEQ ID NO: 86837 - DNA, 20 bp, human
ggtgagcgcacggagtccag

SEQ ID NO: 86838 - DNA, 20 bp, human
gagtctcccccgccagccca

SEQ ID NO: 86839 - DNA, 20 bp, human
gtgctgccttggccagagtc

SEQ ID NO: 86840 - DNA, 20 bp, human
ggcctcgtcgatactacctg

SEQ ID NO: 86841 - DNA, 20 bp, human
ggccgcaggtagtatcgacg

SEQ ID NO: 86842 - DNA, 20 bp, human
ggagcgccaccctgcaccgg

SEQ ID NO: 86843 - DNA, 20 bp, human
gtgagctcggcgtggtcggg

SEQ ID NO: 86844 - DNA, 20 bp, human
gaactgagctcggcgtggtc

SEQ ID NO: 86845 - DNA, 20 bp, human
gcagcgaactgagctcggcg

SEQ ID NO: 86846 - DNA, 20 bp, human
gcgcctaggcgtccacccag

SEQ ID NO: 86847 - DNA, 20 bp, human
gggccagcggggaagatgag

SEQ ID NO: 86848 - DNA, 20 bp, human
gtagaccagatccagagcgg

SEQ ID NO: 86849 - DNA, 20 bp, human
ggagaaactgacgaatccac

SEQ ID NO: 86850 - DNA, 20 bp, human
gagcggcctcaccgcaccca

SEQ ID NO: 86851 - DNA, 20 bp, human
gtcctgaaggaggtgaccgg

SEQ ID NO: 86852 - DNA, 20 bp, human
gcagagcgggggcaattacg

SEQ ID NO: 86853 - DNA, 20 bp, human
gggtgaggccgctgggacag

SEQ ID NO: 86854 - DNA, 20 bp, human
gcctgctacgggcagaatca

SEQ ID NO: 86855 - DNA, 20 bp, human
gcgatcccgcgccctgggtg

SEQ ID NO: 86856 - DNA, 20 bp, human
gcgccggggctgcactgctg

SEQ ID NO: 86857 - DNA, 20 bp, human
gcagcgccgccggctgatcc

SEQ ID NO: 86858 - DNA, 20 bp, human
gggaagccaggatcagccgg

SEQ ID NO: 86859 - DNA, 20 bp, human
gccgcggcgtgggcgcaccg

SEQ ID NO: 86860 - DNA, 20 bp, human
ggaactttccggctcagtcg

SEQ ID NO: 86861 - DNA, 20 bp, human
gtctggctggcggcctccag

SEQ ID NO: 86862 - DNA, 20 bp, human
ggcagacgccgcgactgagc

SEQ ID NO: 86863 - DNA, 20 bp, human
gcaccatggctgcgggtcga

SEQ ID NO: 86864 - DNA, 20 bp, human
gagggtccggccggagttga

SEQ ID NO: 86865 - DNA, 20 bp, human
gtcggcgaggagggtccggc

SEQ ID NO: 86866 - DNA, 20 bp, human
gcaccagtcctcccacacag

SEQ ID NO: 86867 - DNA, 20 bp, human
gggaccgcttctgggaccag

SEQ ID NO: 86868 - DNA, 20 bp, human
gctgggaccagtggtatctc

SEQ ID NO: 86869 - DNA, 20 bp, human
gtgaaggatgagttcagggt

SEQ ID NO: 86870 - DNA, 20 bp, human
ggccggtttcacagcaacaa

SEQ ID NO: 86871 - DNA, 20 bp, human
gttgctgtgaaaccggctcc

SEQ ID NO: 86872 - DNA, 20 bp, human
gtcctgcagtaagaagctgg

SEQ ID NO: 86873 - DNA, 20 bp, human
gtccggcctcctcgagtcag

SEQ ID NO: 86874 - DNA, 20 bp, human
gtgctccggctgctggatcg

SEQ ID NO: 86875 - DNA, 20 bp, human
gggcctcctcgagtcagcgg

SEQ ID NO: 86876 - DNA, 20 bp, human
gcggccgaaggtgagtgacg

SEQ ID NO: 86877 - DNA, 20 bp, human
gccgccgcgtcactcacctt

SEQ ID NO: 86878 - DNA, 20 bp, human
gccgagctccgggtccgcgg

SEQ ID NO: 86879 - DNA, 20 bp, human
gagggcccagaggcatccga

SEQ ID NO: 86880 - DNA, 20 bp, human
gctccgggacaacctcgccg

SEQ ID NO: 86881 - DNA, 20 bp, human
gtccgccccgggctagggaa

SEQ ID NO: 86882 - DNA, 20 bp, human
gctcgtgcgggtgaacccgg

SEQ ID NO: 86883 - DNA, 20 bp, human
gctagcccggggcggaacgg

SEQ ID NO: 86884 - DNA, 20 bp, human
gcggagagccgcttcagaga

SEQ ID NO: 86885 - DNA, 20 bp, human
gcggagcagcgagaaagttc

SEQ ID NO: 86886 - DNA, 20 bp, human
gcggagcgcgcaaggcgagt

SEQ ID NO: 86887 - DNA, 20 bp, human
ggagccaagacaggagaaac

SEQ ID NO: 86888 - DNA, 20 bp, human
gtgggcacagaaggtggagt

SEQ ID NO: 86889 - DNA, 20 bp, human
ggccgccttcccgccgtctg

SEQ ID NO: 86890 - DNA, 20 bp, human
gggcacgaggaatcgatggg

SEQ ID NO: 86891 - DNA, 20 bp, human
gtccgcggccatgccccaga

SEQ ID NO: 86892 - DNA, 20 bp, human
gcatgccccagacggcggga

SEQ ID NO: 86893 - DNA, 20 bp, human
gccagcgaggtcgtgtccca

SEQ ID NO: 86894 - DNA, 20 bp, human
gtactgggaggaatcgatgg

SEQ ID NO: 86895 - DNA, 20 bp, human
ggggggacagtgcggggaga

SEQ ID NO: 86896 - DNA, 20 bp, human
gtccccggacttcgaggggg

SEQ ID NO: 86897 - DNA, 20 bp, human
gcccgcagtgagctcccgaa

SEQ ID NO: 86898 - DNA, 20 bp, human
gcagtccccggacttcgagg

SEQ ID NO: 86899 - DNA, 20 bp, human
gcccgaatccacccacccag

SEQ ID NO: 86900 - DNA, 20 bp, human
gcccccggacccgcagacaa

SEQ ID NO: 86901 - DNA, 20 bp, human
gctcccgaagggcgagaggg

SEQ ID NO: 86902 - DNA, 20 bp, human
gagcttgcggggacacggat

SEQ ID NO: 86903 - DNA, 20 bp, human
gtgggtgtgggagcgtgtca

SEQ ID NO: 86904 - DNA, 20 bp, human
gggatgggggacccctgggt

SEQ ID NO: 86905 - DNA, 20 bp, human
gacccgcagacaatgggtag

SEQ ID NO: 86906 - DNA, 20 bp, human
gggcagctaggcgcacaccc

SEQ ID NO: 86907 - DNA, 20 bp, human
gagcgccggggccaacactc

SEQ ID NO: 86908 - DNA, 20 bp, human
gcggagcgcacgcaacctcc

SEQ ID NO: 86909 - DNA, 20 bp, human
gctagcgaaggcggggactc

SEQ ID NO: 86910 - DNA, 20 bp, human
ggggcgcggagagccaatct

SEQ ID NO: 86911 - DNA, 20 bp, human
ggctcgggctgcccaaaggt

SEQ ID NO: 86912 - DNA, 20 bp, human
ggcggggactcgggcgctgt

SEQ ID NO: 86913 - DNA, 20 bp, human
gccgcagctcgccaaggtaa

SEQ ID NO: 86914 - DNA, 20 bp, human
gccctgcgcgacccgagtgt

SEQ ID NO: 86915 - DNA, 20 bp, human
ggcggtgggtgtgcccgcag

SEQ ID NO: 86916 - DNA, 20 bp, human
gccccccgcccggaaagtca

SEQ ID NO: 86917 - DNA, 20 bp, human
gccgccgcggcgagacgagt

SEQ ID NO: 86918 - DNA, 20 bp, human
gagacgagtcggcttcgcta

SEQ ID NO: 86919 - DNA, 20 bp, human
gccggctcggcgagcggtgg

SEQ ID NO: 86920 - DNA, 20 bp, human
gccgcttcagattaaagggg

SEQ ID NO: 86921 - DNA, 20 bp, human
ggaaaagctggcgaacgagg

SEQ ID NO: 86922 - DNA, 20 bp, human
gcggtgctcggttctcccgc

SEQ ID NO: 86923 - DNA, 20 bp, human
gaacgaggcggcagctcctg

SEQ ID NO: 86924 - DNA, 20 bp, human
gggattcagccccacaaaat

SEQ ID NO: 86925 - DNA, 20 bp, human
ggcagggtagaaaaatcccc

SEQ ID NO: 86926 - DNA, 20 bp, human
gcgggcggactgttaaaccg

SEQ ID NO: 86927 - DNA, 20 bp, human
ggcggactgttaaaccgcgg

SEQ ID NO: 86928 - DNA, 20 bp, human
gcgctgcccgcagctccgtg

SEQ ID NO: 86929 - DNA, 20 bp, human
gcgagtggccggcgtctcag

SEQ ID NO: 86930 - DNA, 20 bp, human
ggcccactgctcccagaccg

SEQ ID NO: 86931 - DNA, 20 bp, human
ggcagcccagaggattcggg

SEQ ID NO: 86932 - DNA, 20 bp, human
gtgcgggtcaggcgaccgac

SEQ ID NO: 86933 - DNA, 20 bp, human
gcagctccgtgcggctcggg

SEQ ID NO: 86934 - DNA, 20 bp, human
gcacggccggaccgaaggtg

SEQ ID NO: 86935 - DNA, 20 bp, human
gacgggatcgcgctctaggg

SEQ ID NO: 86936 - DNA, 20 bp, human
gcgagcggcgcggcagagtg

SEQ ID NO: 86937 - DNA, 20 bp, human
ggccactagagaagggcgag

SEQ ID NO: 86938 - DNA, 20 bp, human
gcgctggcgccactagagaa

SEQ ID NO: 86939 - DNA, 20 bp, human
gagctcctgaggtaagatgg

SEQ ID NO: 86940 - DNA, 20 bp, human
gcggcgcagcgcagctcctg

SEQ ID NO: 86941 - DNA, 20 bp, human
gggagggacacgctaaaggg

SEQ ID NO: 86942 - DNA, 20 bp, human
ggccgctcgcccttctctag

SEQ ID NO: 86943 - DNA, 20 bp, human
ggccctccccaagtctccac

SEQ ID NO: 86944 - DNA, 20 bp, human
gcgcagctcctgaggtaaga

SEQ ID NO: 86945 - DNA, 20 bp, human
gcccaaccgcaagagcttag

SEQ ID NO: 86946 - DNA, 20 bp, human
ggcgcgcggccgtaagaccg

SEQ ID NO: 86947 - DNA, 20 bp, human
gccgcgggtgagagcagcgt

SEQ ID NO: 86948 - DNA, 20 bp, human
ggagcagcgttggcttcgag

SEQ ID NO: 86949 - DNA, 20 bp, human
gacggcccatctaggagaca

SEQ ID NO: 86950 - DNA, 20 bp, human
ggcgttggcttcgaggggag

SEQ ID NO: 86951 - DNA, 20 bp, human
ggctagggacgcctcactgg

SEQ ID NO: 86952 - DNA, 20 bp, human
gagcaaaccgcccaggaccc

SEQ ID NO: 86953 - DNA, 20 bp, human
gaccacggccgcgatcccca

SEQ ID NO: 86954 - DNA, 20 bp, human
gtcctagatgggccgtgtgg

SEQ ID NO: 86955 - DNA, 20 bp, human
gcgtcacggaggcccagacg

SEQ ID NO: 86956 - DNA, 20 bp, human
gccttcttgccggctctcgt

SEQ ID NO: 86957 - DNA, 20 bp, human
gctgcgtggagcgcaacgag

SEQ ID NO: 86958 - DNA, 20 bp, human
gagggcccgacccaaaagta

SEQ ID NO: 86959 - DNA, 20 bp, human
gcgacgctcatcctgcacgg

SEQ ID NO: 86960 - DNA, 20 bp, human
gtagagttaagagactgtgg

SEQ ID NO: 86961 - DNA, 20 bp, human
gagagccggcaagaaggccc

SEQ ID NO: 86962 - DNA, 20 bp, human
ggcccgacccaaaagtaagg

SEQ ID NO: 86963 - DNA, 20 bp, human
ggctcgcccagctccgtcac

SEQ ID NO: 86964 - DNA, 20 bp, human
gcgcacatgctgagacgtgg

SEQ ID NO: 86965 - DNA, 20 bp, human
gcggccgccatcttcccgga

SEQ ID NO: 86966 - DNA, 20 bp, human
gcctcccccgcagcggagag

SEQ ID NO: 86967 - DNA, 20 bp, human
gcccagccctagggccgcat

SEQ ID NO: 86968 - DNA, 20 bp, human
ggcctgggaaggttccgcca

SEQ ID NO: 86969 - DNA, 20 bp, human
ggcagcagcgcgccagtcag

SEQ ID NO: 86970 - DNA, 20 bp, human
ggcgccgctctccgctgcgg

SEQ ID NO: 86971 - DNA, 20 bp, human
gcaaagctctggctgcggag

SEQ ID NO: 86972 - DNA, 20 bp, human
ggcggcgccgctctccgctg

SEQ ID NO: 86973 - DNA, 20 bp, human
gggttgcccatgcggcccta

SEQ ID NO: 86974 - DNA, 20 bp, human
ggctcttgccccagaggtat

SEQ ID NO: 86975 - DNA, 20 bp, human
ggaggaaggcgcaagtccgg

SEQ ID NO: 86976 - DNA, 20 bp, human
gcccatccgcggtccgagag

SEQ ID NO: 86977 - DNA, 20 bp, human
gcgactaccagagcccgaga

SEQ ID NO: 86978 - DNA, 20 bp, human
gctcctgccgtgctccgggg

SEQ ID NO: 86979 - DNA, 20 bp, human
ggacatgccgccccggagca

SEQ ID NO: 86980 - DNA, 20 bp, human
gggcccctagcacccatccg

SEQ ID NO: 86981 - DNA, 20 bp, human
gcaggcgcccgagcccccgg

SEQ ID NO: 86982 - DNA, 20 bp, human
ggaccgcggatgggtgctag

SEQ ID NO: 86983 - DNA, 20 bp, human
ggcacggccgaaggaccggg

SEQ ID NO: 86984 - DNA, 20 bp, human
gggcggcggcgcctgacact

SEQ ID NO: 86985 - DNA, 20 bp, human
gggcgacaagagcacttccg

SEQ ID NO: 86986 - DNA, 20 bp, human
ggcgggactaaggaacctga

SEQ ID NO: 86987 - DNA, 20 bp, human
gtggcacttgtgactgaagg

SEQ ID NO: 86988 - DNA, 20 bp, human
ggccagggtcggctactggg

SEQ ID NO: 86989 - DNA, 20 bp, human
ggaagtgacgtctcccagag

SEQ ID NO: 86990 - DNA, 20 bp, human
gagctgctccgagaggtaca

SEQ ID NO: 86991 - DNA, 20 bp, human
ggggccggaagtggcagtgg

SEQ ID NO: 86992 - DNA, 20 bp, human
gtggcgtgagtgacgttggg

SEQ ID NO: 86993 - DNA, 20 bp, human
ggacagcgcgacgccagggt

SEQ ID NO: 86994 - DNA, 20 bp, human
gagttcaggtcgtggaaggg

SEQ ID NO: 86995 - DNA, 20 bp, human
gcccagggggagataatcga

SEQ ID NO: 86996 - DNA, 20 bp, human
ggagatgccccaaactgaca

SEQ ID NO: 86997 - DNA, 20 bp, human
ggagctcactgtctccaaga

SEQ ID NO: 86998 - DNA, 20 bp, human
gccctcggctacttaccggg

SEQ ID NO: 86999 - DNA, 20 bp, human
gcctggcgcagagcagcggg

SEQ ID NO: 87000 - DNA, 20 bp, human
gaaggacagccgagatcccg

SEQ ID NO: 87001 - DNA, 20 bp, human
gtggcggccgtgtcagtttg

SEQ ID NO: 87002 - DNA, 20 bp, human
ggcccggccggcgggatcgg

SEQ ID NO: 87003 - DNA, 20 bp, human
ggcgcgccccgagggagagc

SEQ ID NO: 87004 - DNA, 20 bp, human
gggcccctcggctacttacc

SEQ ID NO: 87005 - DNA, 20 bp, human
gacagtgagctccagccggg

SEQ ID NO: 87006 - DNA, 20 bp, human
ggcccctcggcagggctcta

SEQ ID NO: 87007 - DNA, 20 bp, human
gtgtcaacgacaacaacagg

SEQ ID NO: 87008 - DNA, 20 bp, human
gacagggggacacaaaatgg

SEQ ID NO: 87009 - DNA, 20 bp, human
gacaacagggggacacaaaa

SEQ ID NO: 87010 - DNA, 20 bp, human
gttcccagggggaggagact

SEQ ID NO: 87011 - DNA, 20 bp, human
ggccgctgcctgagaaactg

SEQ ID NO: 87012 - DNA, 20 bp, human
gccctgagcgtgacggtagg

SEQ ID NO: 87013 - DNA, 20 bp, human
ggacactgattacagcccaa

SEQ ID NO: 87014 - DNA, 20 bp, human
gcggggttcggggagtcgga

SEQ ID NO: 87015 - DNA, 20 bp, human
gtcggcagggctctagggca

SEQ ID NO: 87016 - DNA, 20 bp, human
gagggatcgtccgcaggatt

SEQ ID NO: 87017 - DNA, 20 bp, human
gactgatacagaggccgcca

SEQ ID NO: 87018 - DNA, 20 bp, human
gctctgcttgcctggatcgg

SEQ ID NO: 87019 - DNA, 20 bp, human
gtgtatcagtcccaatcctg

SEQ ID NO: 87020 - DNA, 20 bp, human
gggcactagggatcgtccgc

SEQ ID NO: 87021 - DNA, 20 bp, human
gaccgttgagcccaaacagg

SEQ ID NO: 87022 - DNA, 20 bp, human
gggcgtggccaactgcgtca

SEQ ID NO: 87023 - DNA, 20 bp, human
ggctccagacgctgagaggc

SEQ ID NO: 87024 - DNA, 20 bp, human
gaattggtcgctgaaacgtc

SEQ ID NO: 87025 - DNA, 20 bp, human
gcgtctggaagcatattgat

SEQ ID NO: 87026 - DNA, 20 bp, human
ggttgcggcggggacttcag

SEQ ID NO: 87027 - DNA, 20 bp, human
gacttcccttcccgcgatgg

SEQ ID NO: 87028 - DNA, 20 bp, human
ggcacagggagctgctgcgg

SEQ ID NO: 87029 - DNA, 20 bp, human
gaaaccagccgggttgtggg

SEQ ID NO: 87030 - DNA, 20 bp, human
ggggacttcaggggtcgcgg

SEQ ID NO: 87031 - DNA, 20 bp, human
gtgtgccgccatcgcgggaa

SEQ ID NO: 87032 - DNA, 20 bp, human
ggcctgagcggtgggtttgt

SEQ ID NO: 87033 - DNA, 20 bp, human
ggtcacttcccttcccgcga

SEQ ID NO: 87034 - DNA, 20 bp, human
gcagtgaggccaagatccgg

SEQ ID NO: 87035 - DNA, 20 bp, human
ggctccctgtgccgccatcg

SEQ ID NO: 87036 - DNA, 20 bp, human
ggcttgcccaggtcagacag

SEQ ID NO: 87037 - DNA, 20 bp, human
gctgcaggagaaggagtccc

SEQ ID NO: 87038 - DNA, 20 bp, human
gtcaggatgtaaaagacgaa

SEQ ID NO: 87039 - DNA, 20 bp, human
ggcagtagaaagaggaactt

SEQ ID NO: 87040 - DNA, 20 bp, human
gggttctgacagtaaatcta

SEQ ID NO: 87041 - DNA, 20 bp, human
gctgccggtccacctcagtc

SEQ ID NO: 87042 - DNA, 20 bp, human
gcatcctgactgaggtggac

SEQ ID NO: 87043 - DNA, 20 bp, human
gcaggtgctcagggccgctg

SEQ ID NO: 87044 - DNA, 20 bp, human
gaatctagggttgaggaggg

SEQ ID NO: 87045 - DNA, 20 bp, human
gaggagaaggagtccccgga

SEQ ID NO: 87046 - DNA, 20 bp, human
ggagtcgccgaggtcgtccc

SEQ ID NO: 87047 - DNA, 20 bp, human
gggacctaggacctcagctc

SEQ ID NO: 87048 - DNA, 20 bp, human
gtgacaggattcctcaggta

SEQ ID NO: 87049 - DNA, 20 bp, human
gccggtgccggggacgacct

SEQ ID NO: 87050 - DNA, 20 bp, human
gccgcctgacaggattcctc

SEQ ID NO: 87051 - DNA, 20 bp, human
gcagagtgaaaactcacctg

SEQ ID NO: 87052 - DNA, 20 bp, human
ggcacaggcaggctcacgga

SEQ ID NO: 87053 - DNA, 20 bp, human
gaggacctcagctcaggcac

SEQ ID NO: 87054 - DNA, 20 bp, human
gattggcggagtggagatcc

SEQ ID NO: 87055 - DNA, 20 bp, human
gcgtgagcggagagcaaagt

SEQ ID NO: 87056 - DNA, 20 bp, human
gcagcgatgcggtccagatg

SEQ ID NO: 87057 - DNA, 20 bp, human
gcgcgagctaacggactcgg

SEQ ID NO: 87058 - DNA, 20 bp, human
ggtccagatggggtgcgggt

SEQ ID NO: 87059 - DNA, 20 bp, human
gagcaacctgcgagggtcag

SEQ ID NO: 87060 - DNA, 20 bp, human
gcccactgccggagacgcca

SEQ ID NO: 87061 - DNA, 20 bp, human
gatgcggtccagatggggtg

SEQ ID NO: 87062 - DNA, 20 bp, human
gcgtcgcgagctaacggact

SEQ ID NO: 87063 - DNA, 20 bp, human
gccgggcacattcagcgatg

SEQ ID NO: 87064 - DNA, 20 bp, human
ggacgtgcgtgaaaaggcgg

SEQ ID NO: 87065 - DNA, 20 bp, human
gtacccagaaggcgcaggtc

SEQ ID NO: 87066 - DNA, 20 bp, human
ggccgcggggcagcacgccg

SEQ ID NO: 87067 - DNA, 20 bp, human
gggagggaaggcacgacctg

SEQ ID NO: 87068 - DNA, 20 bp, human
gctgtcgccgcgcggactga

SEQ ID NO: 87069 - DNA, 20 bp, human
gagctctaggcagtccgcag

SEQ ID NO: 87070 - DNA, 20 bp, human
gtccataggcaccgcgtgaa

SEQ ID NO: 87071 - DNA, 20 bp, human
gccgcgcggactgaaggcgc

SEQ ID NO: 87072 - DNA, 20 bp, human
gggaaggcggtcgcgcgggt

SEQ ID NO: 87073 - DNA, 20 bp, human
ggccgagcggggccaagccg

SEQ ID NO: 87074 - DNA, 20 bp, human
gacgcgtgacaggagcattc

SEQ ID NO: 87075 - DNA, 20 bp, human
gtccgccacaactactctgg

SEQ ID NO: 87076 - DNA, 20 bp, human
gcagcggccaatcaaggcag

SEQ ID NO: 87077 - DNA, 20 bp, human
ggtcaagcagcggccaatca

SEQ ID NO: 87078 - DNA, 20 bp, human
gggagaccccgcgagcatat

SEQ ID NO: 87079 - DNA, 20 bp, human
ggggccacgtgagggatatc

SEQ ID NO: 87080 - DNA, 20 bp, human
gtgtgaacggaggactagag

SEQ ID NO: 87081 - DNA, 20 bp, human
gagggtcggttgtcaagcag

SEQ ID NO: 87082 - DNA, 20 bp, human
gccgcagctgcaggtggagt

SEQ ID NO: 87083 - DNA, 20 bp, human
ggaaggacaggtaatgaata

SEQ ID NO: 87084 - DNA, 20 bp, human
gtatgggaaagggcagtaac

SEQ ID NO: 87085 - DNA, 20 bp, human
ggcaggggatggaggcaagt

SEQ ID NO: 87086 - DNA, 20 bp, human
gcggcagcgctgccgggtcc

SEQ ID NO: 87087 - DNA, 20 bp, human
ggaaggacagaacgagtgtg

SEQ ID NO: 87088 - DNA, 20 bp, human
ggagtcgacagctgcacctg

SEQ ID NO: 87089 - DNA, 20 bp, human
ggccgggcctaggcgctctg

SEQ ID NO: 87090 - DNA, 20 bp, human
gggtcgtcagcgccgaggct

SEQ ID NO: 87091 - DNA, 20 bp, human
gggtccctgcggggagagtc

SEQ ID NO: 87092 - DNA, 20 bp, human
gcggctcggcagtcacttac

SEQ ID NO: 87093 - DNA, 20 bp, human
ggaggacccgtcggaaaata

SEQ ID NO: 87094 - DNA, 20 bp, human
gggctggagtagccctgcca

SEQ ID NO: 87095 - DNA, 20 bp, human
ggcgctggtcgtcagcgccg

SEQ ID NO: 87096 - DNA, 20 bp, human
gagtcctcaggacggagcag

SEQ ID NO: 87097 - DNA, 20 bp, human
gctctcagaagtcctcagga

SEQ ID NO: 87098 - DNA, 20 bp, human
gaccaaggcgcggacagact

SEQ ID NO: 87099 - DNA, 20 bp, human
gcgaggtcggagccgaccag

SEQ ID NO: 87100 - DNA, 20 bp, human
gtggcagggccggagacact

SEQ ID NO: 87101 - DNA, 20 bp, human
ggcccaaagtgccacggtgg

SEQ ID NO: 87102 - DNA, 20 bp, human
gcccccggcccaaagtgcca

SEQ ID NO: 87103 - DNA, 20 bp, human
gccgcgaggccgagtgtctc

SEQ ID NO: 87104 - DNA, 20 bp, human
gggaggctacttggtagcag

SEQ ID NO: 87105 - DNA, 20 bp, human
gcggcgggcgtccctcgggt

SEQ ID NO: 87106 - DNA, 20 bp, human
gggagactggcggaactgag

SEQ ID NO: 87107 - DNA, 20 bp, human
ggactggcggaactgagcgg

SEQ ID NO: 87108 - DNA, 20 bp, human
ggccaccaaccggagactgg

SEQ ID NO: 87109 - DNA, 20 bp, human
ggggccgcggaggacacaac

SEQ ID NO: 87110 - DNA, 20 bp, human
gagttccgccagtctccggt

SEQ ID NO: 87111 - DNA, 20 bp, human
ggtccagtcggccagccagg

SEQ ID NO: 87112 - DNA, 20 bp, human
gcgatcgccgagaccccggc

SEQ ID NO: 87113 - DNA, 20 bp, human
gacacaacaggtagagccgg

SEQ ID NO: 87114 - DNA, 20 bp, human
gcgaactcacggccaccaac

SEQ ID NO: 87115 - DNA, 20 bp, human
gtcgcaggttggtcacctcc

SEQ ID NO: 87116 - DNA, 20 bp, human
gtccgcgcggcctggagagg

SEQ ID NO: 87117 - DNA, 20 bp, human
ggaggagccgcggcgaggta

SEQ ID NO: 87118 - DNA, 20 bp, human
gggtccgccctacctcgccg

SEQ ID NO: 87119 - DNA, 20 bp, human
gagagcggcagtaggcggga

SEQ ID NO: 87120 - DNA, 20 bp, human
gccgcgcggagccagcgctc

SEQ ID NO: 87121 - DNA, 20 bp, human
gcccccacgcggcctcccgg

SEQ ID NO: 87122 - DNA, 20 bp, human
ggacgcgcagccaggcgggt

SEQ ID NO: 87123 - DNA, 20 bp, human
gcggcgagagcggcagtagg

SEQ ID NO: 87124 - DNA, 20 bp, human
gacccgcagcggggcgtggg

SEQ ID NO: 87125 - DNA, 20 bp, human
ggagccgcggcgaggtaggg

SEQ ID NO: 87126 - DNA, 20 bp, human
gtggcttggacgctaccgtg

SEQ ID NO: 87127 - DNA, 20 bp, human
gcactcgctgggccacgacc

SEQ ID NO: 87128 - DNA, 20 bp, human
gtagcgtccaagccaggtcg

SEQ ID NO: 87129 - DNA, 20 bp, human
gcgctggccgccctgccaca

SEQ ID NO: 87130 - DNA, 20 bp, human
gcggccagcgggcctgactg

SEQ ID NO: 87131 - DNA, 20 bp, human
gacgctaccgtgtggcaggg

SEQ ID NO: 87132 - DNA, 20 bp, human
gtggacgctaccgtgtggca

SEQ ID NO: 87133 - DNA, 20 bp, human
gcttacagtctagcgacgga

SEQ ID NO: 87134 - DNA, 20 bp, human
gaggttccgggaagacaacc

SEQ ID NO: 87135 - DNA, 20 bp, human
gtaagcacaacaaaggtaag

SEQ ID NO: 87136 - DNA, 20 bp, human
gtccaggggagccccagagt

SEQ ID NO: 87137 - DNA, 20 bp, human
gaggggagccccagagttgg

SEQ ID NO: 87138 - DNA, 20 bp, human
gacgtcgcgcaggccgaagg

SEQ ID NO: 87139 - DNA, 20 bp, human
gcagaccctggtgcaggtgt

SEQ ID NO: 87140 - DNA, 20 bp, human
ggtctgtggaccccgtgcca

SEQ ID NO: 87141 - DNA, 20 bp, human
gcggccagctcgccatggca

SEQ ID NO: 87142 - DNA, 20 bp, human
gccgtcgcagatgaagagcg

SEQ ID NO: 87143 - DNA, 20 bp, human
gtcgcgcaggccgaaggcgg

SEQ ID NO: 87144 - DNA, 20 bp, human
gttggtggctggctaaccca

SEQ ID NO: 87145 - DNA, 20 bp, human
ggcacggggtccacagaccc

SEQ ID NO: 87146 - DNA, 20 bp, human
gggacggaccaagcgaggga

SEQ ID NO: 87147 - DNA, 20 bp, human
gcgctggacggaccaagcga

SEQ ID NO: 87148 - DNA, 20 bp, human
gaggggaaaccggaaggaag

SEQ ID NO: 87149 - DNA, 20 bp, human
gggtgcgaggggaaaccgga

SEQ ID NO: 87150 - DNA, 20 bp, human
gaaccggaaggaagaggcgg

SEQ ID NO: 87151 - DNA, 20 bp, human
gccggagctccgccgccctg

SEQ ID NO: 87152 - DNA, 20 bp, human
gctccgcctccggccgagga

SEQ ID NO: 87153 - DNA, 20 bp, human
ggccggaaacgcccagctag

SEQ ID NO: 87154 - DNA, 20 bp, human
gggccctgaggagcgtgcgg

SEQ ID NO: 87155 - DNA, 20 bp, human
gcgccgccctccgcaccccg

SEQ ID NO: 87156 - DNA, 20 bp, human
ggccatcaggcccgagatag

SEQ ID NO: 87157 - DNA, 20 bp, human
gggcaccaagcagaaccgtt

SEQ ID NO: 87158 - DNA, 20 bp, human
gtcgggagcgtactgtgtga

SEQ ID NO: 87159 - DNA, 20 bp, human
gctgaccccgcctggatccg

SEQ ID NO: 87160 - DNA, 20 bp, human
gccctccgaaggccgagcag

SEQ ID NO: 87161 - DNA, 20 bp, human
gcaatagcaaaacagcacct

SEQ ID NO: 87162 - DNA, 20 bp, human
gcttaggctgatgcggatgg

SEQ ID NO: 87163 - DNA, 20 bp, human
gtagtgctctagcccaggct

SEQ ID NO: 87164 - DNA, 20 bp, human
ggtaggctgctgctaagggt

SEQ ID NO: 87165 - DNA, 20 bp, human
gctccctgcctccagaggac

SEQ ID NO: 87166 - DNA, 20 bp, human
ggatagcgtcagggacatca

SEQ ID NO: 87167 - DNA, 20 bp, human
ggtcagggacatcatggata

SEQ ID NO: 87168 - DNA, 20 bp, human
ggagcaaagtgggtccagat

SEQ ID NO: 87169 - DNA, 20 bp, human
gatggatagggccaggacta

SEQ ID NO: 87170 - DNA, 20 bp, human
gcctgaaggaggcccacaac

SEQ ID NO: 87171 - DNA, 20 bp, human
gcaactgtccaactcaggga

SEQ ID NO: 87172 - DNA, 20 bp, human
gctgggttcgttatccccag

SEQ ID NO: 87173 - DNA, 20 bp, human
ggggataacgaacccagatt

SEQ ID NO: 87174 - DNA, 20 bp, human
gttcacttccaacctgaagg

SEQ ID NO: 87175 - DNA, 20 bp, human
gtggttaaaggatagcgtca

SEQ ID NO: 87176 - DNA, 20 bp, human
gctgtgaaggcgagcagacg

SEQ ID NO: 87177 - DNA, 20 bp, human
ggaagccgctactgcagcgt

SEQ ID NO: 87178 - DNA, 20 bp, human
gtgaaaaaggccgaaactgt

SEQ ID NO: 87179 - DNA, 20 bp, human
gggcgagcagacgcggagaa

SEQ ID NO: 87180 - DNA, 20 bp, human
ggcgtacaggcgctccacgt

SEQ ID NO: 87181 - DNA, 20 bp, human
ggtcgcccacgctgcagtag

SEQ ID NO: 87182 - DNA, 20 bp, human
gagacgcggagaaaggacgc

SEQ ID NO: 87183 - DNA, 20 bp, human
gacgctgcaggacccggctc

SEQ ID NO: 87184 - DNA, 20 bp, human
gcagcgtgggcgacaatgct

SEQ ID NO: 87185 - DNA, 20 bp, human
gtgggagcggtagttctcct

SEQ ID NO: 87186 - DNA, 20 bp, human
ggtcctgtgagggcgagcgg

SEQ ID NO: 87187 - DNA, 20 bp, human
gatcgccagcgcggcagtgg

SEQ ID NO: 87188 - DNA, 20 bp, human
gcgcgtcctggaacagactg

SEQ ID NO: 87189 - DNA, 20 bp, human
gtgaaaaaggccgaaaccga

SEQ ID NO: 87190 - DNA, 20 bp, human
gcgggcgctgacggcgagaa

SEQ ID NO: 87191 - DNA, 20 bp, human
gacccgctggcttgcagccg

SEQ ID NO: 87192 - DNA, 20 bp, human
gcctagcgggatcgccagcg

SEQ ID NO: 87193 - DNA, 20 bp, human
ggaggcctcaccgcgggata

SEQ ID NO: 87194 - DNA, 20 bp, human
gtgggagcagtagttctccc

SEQ ID NO: 87195 - DNA, 20 bp, human
gagggcttggaaatcctctt

SEQ ID NO: 87196 - DNA, 20 bp, human
gcatcgagaaatggccgcgt

SEQ ID NO: 87197 - DNA, 20 bp, human
gcgcgctcgcagcccaggag

SEQ ID NO: 87198 - DNA, 20 bp, human
gccgcgcagacgcctctcct

SEQ ID NO: 87199 - DNA, 20 bp, human
gggactccgccgagagccga

SEQ ID NO: 87200 - DNA, 20 bp, human
ggagggcggagcgcgatcgg

SEQ ID NO: 87201 - DNA, 20 bp, human
gaatggccgcgtcggcaggt

SEQ ID NO: 87202 - DNA, 20 bp, human
gcgtcggcaggtgggtcgtg

SEQ ID NO: 87203 - DNA, 20 bp, human
gatcggcggaacaagttcaa

SEQ ID NO: 87204 - DNA, 20 bp, human
gagggaagctcgaacaacgg

SEQ ID NO: 87205 - DNA, 20 bp, human
gggtcgtgtggtggccaggg

SEQ ID NO: 87206 - DNA, 20 bp, human
gcgactcccactcgactccc

SEQ ID NO: 87207 - DNA, 20 bp, human
gccgagcccgggagtcgagt

SEQ ID NO: 87208 - DNA, 20 bp, human
gccgagagtgaccggagtca

SEQ ID NO: 87209 - DNA, 20 bp, human
gagagtgaccggagtcacgg

SEQ ID NO: 87210 - DNA, 20 bp, human
gcggcaggcccgagagtgac

SEQ ID NO: 87211 - DNA, 20 bp, human
gcgggaagcggcggagactt

SEQ ID NO: 87212 - DNA, 20 bp, human
gcagcgccgggaccccgcgg

SEQ ID NO: 87213 - DNA, 20 bp, human
ggcctcggcctaccccgccc

SEQ ID NO: 87214 - DNA, 20 bp, human
gctaagggccgcggccgtgg

SEQ ID NO: 87215 - DNA, 20 bp, human
ggacatcctagttcagacgg

SEQ ID NO: 87216 - DNA, 20 bp, human
gtcggacgagtggaccaggg

SEQ ID NO: 87217 - DNA, 20 bp, human
ggcgtcggacgagtggacca

SEQ ID NO: 87218 - DNA, 20 bp, human
gcgcccagaaatggaccgag

SEQ ID NO: 87219 - DNA, 20 bp, human
gtcggagcttcgagagaggg

SEQ ID NO: 87220 - DNA, 20 bp, human
gtggcaaccggtgagaatgg

SEQ ID NO: 87221 - DNA, 20 bp, human
gggacctcgccaaggctacg

SEQ ID NO: 87222 - DNA, 20 bp, human
gtggagcagggtgcgtgcgg

SEQ ID NO: 87223 - DNA, 20 bp, human
ggcgattgtccaactgagag

SEQ ID NO: 87224 - DNA, 20 bp, human
ggtccgctcggtccatttct

SEQ ID NO: 87225 - DNA, 20 bp, human
gccctgcaccggagagagga

SEQ ID NO: 87226 - DNA, 20 bp, human
gggatggtctccatatgtga

SEQ ID NO: 87227 - DNA, 20 bp, human
gagaggggccatactaaaag

SEQ ID NO: 87228 - DNA, 20 bp, human
ggcccctctgccatcacata

SEQ ID NO: 87229 - DNA, 20 bp, human
gctggttgagtcgaagtctg

SEQ ID NO: 87230 - DNA, 20 bp, human
gagcttgggaaggaacgtca

SEQ ID NO: 87231 - DNA, 20 bp, human
gagctcacagcaggcagtga

SEQ ID NO: 87232 - DNA, 20 bp, human
gtgaggtaaggtacaccaat

SEQ ID NO: 87233 - DNA, 20 bp, human
ggggagattctccccagcaa

SEQ ID NO: 87234 - DNA, 20 bp, human
gatccattctaggggagcca

SEQ ID NO: 87235 - DNA, 20 bp, human
gcgaagtctgtggcatagcc

SEQ ID NO: 87236 - DNA, 20 bp, human
gggctctgcagtcccgcggg

SEQ ID NO: 87237 - DNA, 20 bp, human
gagccggctctgcagtcccg

SEQ ID NO: 87238 - DNA, 20 bp, human
gcccagaccggggagatcaa

SEQ ID NO: 87239 - DNA, 20 bp, human
ggccggcagaaccccggcag

SEQ ID NO: 87240 - DNA, 20 bp, human
gccgagcagacggcagtggt

SEQ ID NO: 87241 - DNA, 20 bp, human
gcctaggttacggccagcgc

SEQ ID NO: 87242 - DNA, 20 bp, human
ggcttgggctgagtccgcgg

SEQ ID NO: 87243 - DNA, 20 bp, human
gagacggcagtggtcggcaa

SEQ ID NO: 87244 - DNA, 20 bp, human
gcgggcggccagccgggagc

SEQ ID NO: 87245 - DNA, 20 bp, human
gggtaggacctgaaccactt

SEQ ID NO: 87246 - DNA, 20 bp, human
gccctgccgaggagatgtga

SEQ ID NO: 87247 - DNA, 20 bp, human
gctcttgggggagaaatcag

SEQ ID NO: 87248 - DNA, 20 bp, human
gctgcccagaagaggcaagg

SEQ ID NO: 87249 - DNA, 20 bp, human
gagcaacctggatcaaccca

SEQ ID NO: 87250 - DNA, 20 bp, human
gagggagcaagactcaggct

SEQ ID NO: 87251 - DNA, 20 bp, human
gggcctccctctgagccggg

SEQ ID NO: 87252 - DNA, 20 bp, human
gtattctgtgctccctgccg

SEQ ID NO: 87253 - DNA, 20 bp, human
gcgcctgcctagctgcgagg

SEQ ID NO: 87254 - DNA, 20 bp, human
gaaaatccctcacatctcct

SEQ ID NO: 87255 - DNA, 20 bp, human
gcagcctccttgcctcttct

SEQ ID NO: 87256 - DNA, 20 bp, human
gcgcccgcggccggcagtga

SEQ ID NO: 87257 - DNA, 20 bp, human
gagacccagacagagcatcg

SEQ ID NO: 87258 - DNA, 20 bp, human
ggggcggcagcggctcgtag

SEQ ID NO: 87259 - DNA, 20 bp, human
gcccacacgctggtgaacca

SEQ ID NO: 87260 - DNA, 20 bp, human
gcggcgagcgcagaaggctg

SEQ ID NO: 87261 - DNA, 20 bp, human
gcgggcaccacggtcatgtc

SEQ ID NO: 87262 - DNA, 20 bp, human
ggctccagcaggtggtcccc

SEQ ID NO: 87263 - DNA, 20 bp, human
ggaggggccccgcctcaagg

SEQ ID NO: 87264 - DNA, 20 bp, human
gagcgcgaggaggagcgacc

SEQ ID NO: 87265 - DNA, 20 bp, human
gctccaccatcggccacctc

SEQ ID NO: 87266 - DNA, 20 bp, human
gcagctgttgcagcttgagg

SEQ ID NO: 87267 - DNA, 20 bp, human
gtatcgggaatgtgacagaa

SEQ ID NO: 87268 - DNA, 20 bp, human
gtggaggctccaaatatcca

SEQ ID NO: 87269 - DNA, 20 bp, human
gagccaaaataagaaggtag

SEQ ID NO: 87270 - DNA, 20 bp, human
gaaccgaggtctggaggcga

SEQ ID NO: 87271 - DNA, 20 bp, human
gtggagcgggaaccgaggtc

SEQ ID NO: 87272 - DNA, 20 bp, human
gagtcttggggtcttctctg

SEQ ID NO: 87273 - DNA, 20 bp, human
gagagcgcgttcgcggccag

SEQ ID NO: 87274 - DNA, 20 bp, human
gagcgggaaccgaggtctgg

SEQ ID NO: 87275 - DNA, 20 bp, human
gtacttaccgttccccggcg

SEQ ID NO: 87276 - DNA, 20 bp, human
gcgcggcgcgcagagagacg

SEQ ID NO: 87277 - DNA, 20 bp, human
gcaaggagccggcgccaaag

SEQ ID NO: 87278 - DNA, 20 bp, human
ggagctccagtgtcccccga

SEQ ID NO: 87279 - DNA, 20 bp, human
gagcgcggcgcagccagaga

SEQ ID NO: 87280 - DNA, 20 bp, human
ggcccgcggagcgtgagtag

SEQ ID NO: 87281 - DNA, 20 bp, human
gtggcaccgccgttctccag

SEQ ID NO: 87282 - DNA, 20 bp, human
gtccatggcgcgggagcaga

SEQ ID NO: 87283 - DNA, 20 bp, human
ggaaggttgcatctgctgga

SEQ ID NO: 87284 - DNA, 20 bp, human
gcgcgggagccggtcagctg

SEQ ID NO: 87285 - DNA, 20 bp, human
gcgagggtggaggccaagcg

SEQ ID NO: 87286 - DNA, 20 bp, human
ggaagccttgagccgtgggg

SEQ ID NO: 87287 - DNA, 20 bp, human
ggatgcccggaaccgcacac

SEQ ID NO: 87288 - DNA, 20 bp, human
gcccagcggtgcctgagacc

SEQ ID NO: 87289 - DNA, 20 bp, human
gccgggtgctagagcttact

SEQ ID NO: 87290 - DNA, 20 bp, human
gtctggcgcttcggtaccag

SEQ ID NO: 87291 - DNA, 20 bp, human
gcgcgtggcttcgcccccag

SEQ ID NO: 87292 - DNA, 20 bp, human
gcagcgaagccttgagccgt

SEQ ID NO: 87293 - DNA, 20 bp, human
ggaggtgggtccccgcgctc

SEQ ID NO: 87294 - DNA, 20 bp, human
gggctgcccgaaaagacgcg

SEQ ID NO: 87295 - DNA, 20 bp, human
gacacaggcgcgtgtgaaat

SEQ ID NO: 87296 - DNA, 20 bp, human
ggggcgtcggggccacacgt

SEQ ID NO: 87297 - DNA, 20 bp, human
ggcgcggcctgagagctctc

SEQ ID NO: 87298 - DNA, 20 bp, human
gatgaccagcacggagacta

SEQ ID NO: 87299 - DNA, 20 bp, human
gcacgcctgcgcgaggacga

SEQ ID NO: 87300 - DNA, 20 bp, human
gcgacccgcgaaccgacgtg

SEQ ID NO: 87301 - DNA, 20 bp, human
gcttccaggaagacgtcgag

SEQ ID NO: 87302 - DNA, 20 bp, human
ggccgcgcccagcccgtaga

SEQ ID NO: 87303 - DNA, 20 bp, human
ggacaccggacaccgggctg

SEQ ID NO: 87304 - DNA, 20 bp, human
gccgcagccgcccaccggac

SEQ ID NO: 87305 - DNA, 20 bp, human
ggctcgcagcagccgcacgg

SEQ ID NO: 87306 - DNA, 20 bp, human
gccgctccgggaggacgtgg

SEQ ID NO: 87307 - DNA, 20 bp, human
gcatcctgcctgtggtccag

SEQ ID NO: 87308 - DNA, 20 bp, human
gccagcatcccctggaccac

SEQ ID NO: 87309 - DNA, 20 bp, human
gtgcagtggagacagtccat

SEQ ID NO: 87310 - DNA, 20 bp, human
gtggagaccaccagtccgag

SEQ ID NO: 87311 - DNA, 20 bp, human
gatgctggcggcgcatcttg

SEQ ID NO: 87312 - DNA, 20 bp, human
gccttcgcggagccggtccg

SEQ ID NO: 87313 - DNA, 20 bp, human
ggcagatttggtctgagtct

SEQ ID NO: 87314 - DNA, 20 bp, human
gttgctgtaacaaatcggga

SEQ ID NO: 87315 - DNA, 20 bp, human
gtcgagccaagcccacaaag

SEQ ID NO: 87316 - DNA, 20 bp, human
gggacagaggtggccccaca

SEQ ID NO: 87317 - DNA, 20 bp, human
gacgggaacgaccggagaca

SEQ ID NO: 87318 - DNA, 20 bp, human
ggagcactcaggggaacgcc

SEQ ID NO: 87319 - DNA, 20 bp, human
gctccctcaacatcatccca

SEQ ID NO: 87320 - DNA, 20 bp, human
gtgagggagacgccggaaga

SEQ ID NO: 87321 - DNA, 20 bp, human
gccattttccgagcactcag

SEQ ID NO: 87322 - DNA, 20 bp, human
gacagcacccaacaggaagt

SEQ ID NO: 87323 - DNA, 20 bp, human
ggctgcaccaacttcctgtt

SEQ ID NO: 87324 - DNA, 20 bp, human
gatgatgttgagggagacgc

SEQ ID NO: 87325 - DNA, 20 bp, human
gcacatggctctccatcttc

SEQ ID NO: 87326 - DNA, 20 bp, human
gaggagctagcgggattcgg

SEQ ID NO: 87327 - DNA, 20 bp, human
gcagggcgggaaggaagatc

SEQ ID NO: 87328 - DNA, 20 bp, human
ggggggcgctaaagtcgcag

SEQ ID NO: 87329 - DNA, 20 bp, human
gagggcgaggctgctaggac

SEQ ID NO: 87330 - DNA, 20 bp, human
ggaatcccgctagctcctgc

SEQ ID NO: 87331 - DNA, 20 bp, human
ggaacagcagcgccccggtg

SEQ ID NO: 87332 - DNA, 20 bp, human
gcggcggaggcagggacgca

SEQ ID NO: 87333 - DNA, 20 bp, human
ggtcagggatgcgagctgaa

SEQ ID NO: 87334 - DNA, 20 bp, human
ggatggggaagaggtgcacc

SEQ ID NO: 87335 - DNA, 20 bp, human
gaagaggtgcaccgggaaga

SEQ ID NO: 87336 - DNA, 20 bp, human
gagcccagcgggtcccgcag

SEQ ID NO: 87337 - DNA, 20 bp, human
gtcggaggataaggacccag

SEQ ID NO: 87338 - DNA, 20 bp, human
gcccgagggctgacgaccgg

SEQ ID NO: 87339 - DNA, 20 bp, human
ggcagcggttcgcgctgaag

SEQ ID NO: 87340 - DNA, 20 bp, human
gggagccgccaggcaggatc

SEQ ID NO: 87341 - DNA, 20 bp, human
ggaaccccggcagagcggga

SEQ ID NO: 87342 - DNA, 20 bp, human
gcggctgcgaaggttctgct

SEQ ID NO: 87343 - DNA, 20 bp, human
ggggctccgaggggacggga

SEQ ID NO: 87344 - DNA, 20 bp, human
ggatgaggtaaaggtctcgg

SEQ ID NO: 87345 - DNA, 20 bp, human
gggcgtagtggggcgaaccc

SEQ ID NO: 87346 - DNA, 20 bp, human
ggggcgagatcaacaagtcg

SEQ ID NO: 87347 - DNA, 20 bp, human
gctccgggcgctccgaagtg

SEQ ID NO: 87348 - DNA, 20 bp, human
gggagcccgagcagaccaac

SEQ ID NO: 87349 - DNA, 20 bp, human
ggacagaatagcagcgagcg

SEQ ID NO: 87350 - DNA, 20 bp, human
gtgcatggggacacggacag

SEQ ID NO: 87351 - DNA, 20 bp, human
gcaggaggcggccgccctgg

SEQ ID NO: 87352 - DNA, 20 bp, human
gggcgtacggccttccgtgg

SEQ ID NO: 87353 - DNA, 20 bp, human
gtcggcctgttggtctgctc

SEQ ID NO: 87354 - DNA, 20 bp, human
gccgggcaggcaactcgccc

SEQ ID NO: 87355 - DNA, 20 bp, human
ggctattctgtcccgcactt

SEQ ID NO: 87356 - DNA, 20 bp, human
gccggccgagcgcacagctc

SEQ ID NO: 87357 - DNA, 20 bp, human
gcccagcgagcggcaactcc

SEQ ID NO: 87358 - DNA, 20 bp, human
ggtaggaaggctcagaggaa

SEQ ID NO: 87359 - DNA, 20 bp, human
gctctagtaggaaggctcag

SEQ ID NO: 87360 - DNA, 20 bp, human
gcgagcggcaactcccgggc

SEQ ID NO: 87361 - DNA, 20 bp, human
gagccggcagcgcaccgccg

SEQ ID NO: 87362 - DNA, 20 bp, human
gacagagaggagggtctccc

SEQ ID NO: 87363 - DNA, 20 bp, human
gaagcgagccgcgccagccc

SEQ ID NO: 87364 - DNA, 20 bp, human
gagaccgtgaaccagagtca

SEQ ID NO: 87365 - DNA, 20 bp, human
gacgccggggctctgcctcg

SEQ ID NO: 87366 - DNA, 20 bp, human
ggcgcgaacgagcaggcgac

SEQ ID NO: 87367 - DNA, 20 bp, human
gtggcgggccccctgggcag

SEQ ID NO: 87368 - DNA, 20 bp, human
gtgagcccgggctcgagctg

SEQ ID NO: 87369 - DNA, 20 bp, human
gtgtgcccgtgtccggagag

SEQ ID NO: 87370 - DNA, 20 bp, human
gaagtccgagcgcagcccag

SEQ ID NO: 87371 - DNA, 20 bp, human
ggcggaccgcgcgaacgagc

SEQ ID NO: 87372 - DNA, 20 bp, human
gcccgccgctctccggacac

SEQ ID NO: 87373 - DNA, 20 bp, human
ggccgcacgagcaacacccc

SEQ ID NO: 87374 - DNA, 20 bp, human
gccctgggcaggggcacccg

SEQ ID NO: 87375 - DNA, 20 bp, human
ggcctgcccgaagcgaggag

SEQ ID NO: 87376 - DNA, 20 bp, human
ggcgcgtagcgggacgagta

SEQ ID NO: 87377 - DNA, 20 bp, human
ggtgcgcgaagacgccgggg

SEQ ID NO: 87378 - DNA, 20 bp, human
gacgcgggtcatagtcgaag

SEQ ID NO: 87379 - DNA, 20 bp, human
gtcagaagagcggggcggga

SEQ ID NO: 87380 - DNA, 20 bp, human
gggatgtgcgcgaagacgcc

SEQ ID NO: 87381 - DNA, 20 bp, human
ggcccgtgcggtagtagttc

SEQ ID NO: 87382 - DNA, 20 bp, human
gtcatagtcgaagtggctgt

SEQ ID NO: 87383 - DNA, 20 bp, human
gccgccaggccggccatccg

SEQ ID NO: 87384 - DNA, 20 bp, human
gcgtcggcgctgttgtccag

SEQ ID NO: 87385 - DNA, 20 bp, human
ggcgtcctgtgcctccccgc

SEQ ID NO: 87386 - DNA, 20 bp, human
gggagaagggcggctcacct

SEQ ID NO: 87387 - DNA, 20 bp, human
gggctcaggaaagagtgggt

SEQ ID NO: 87388 - DNA, 20 bp, human
gacagggctcaggaaagagt

SEQ ID NO: 87389 - DNA, 20 bp, human
gcgagtggacgaggttctct

SEQ ID NO: 87390 - DNA, 20 bp, human
gaccccagcgcccagggaag

SEQ ID NO: 87391 - DNA, 20 bp, human
ggtttctcgtcggagaaggg

SEQ ID NO: 87392 - DNA, 20 bp, human
gcaggaaagagtgggtgggt

SEQ ID NO: 87393 - DNA, 20 bp, human
gcctgtgcttcggatggcgg

SEQ ID NO: 87394 - DNA, 20 bp, human
gcctgcgcgatggtgactct

SEQ ID NO: 87395 - DNA, 20 bp, human
gagccctgtgcttcggatgg

SEQ ID NO: 87396 - DNA, 20 bp, human
gcgagctcctcctcaaacag

SEQ ID NO: 87397 - DNA, 20 bp, human
gcacgtacgcgaagactccc

SEQ ID NO: 87398 - DNA, 20 bp, human
gaggaggagctcggcttctg

SEQ ID NO: 87399 - DNA, 20 bp, human
gcagggtgcgcagcgtcgag

SEQ ID NO: 87400 - DNA, 20 bp, human
ggtccttccgcgggcgccag

SEQ ID NO: 87401 - DNA, 20 bp, human
ggcaagatcgtgatcaacgt

SEQ ID NO: 87402 - DNA, 20 bp, human
gctgctgcttgctggccccc

SEQ ID NO: 87403 - DNA, 20 bp, human
ggccccctggcgcccgcgga

SEQ ID NO: 87404 - DNA, 20 bp, human
gctgcgtctcgtccttccgc

SEQ ID NO: 87405 - DNA, 20 bp, human
gtgcgggcccctgtttgagg

SEQ ID NO: 87406 - DNA, 20 bp, human
gagccacaggtggcagtcgg

SEQ ID NO: 87407 - DNA, 20 bp, human
gtcgcgacggcagccacagg

SEQ ID NO: 87408 - DNA, 20 bp, human
gcacaggtggcagtcggggg

SEQ ID NO: 87409 - DNA, 20 bp, human
ggggaggcgacaggtcgcga

SEQ ID NO: 87410 - DNA, 20 bp, human
ggcgcagccacaacatgcgt

SEQ ID NO: 87411 - DNA, 20 bp, human
ggcgaaggctcagggtccgg

SEQ ID NO: 87412 - DNA, 20 bp, human
gaggtcgcgacggcagccac

SEQ ID NO: 87413 - DNA, 20 bp, human
ggacatcaccgccggaggag

SEQ ID NO: 87414 - DNA, 20 bp, human
ggggtggctgtaattggtaa

SEQ ID NO: 87415 - DNA, 20 bp, human
gacgggggacttgggatcca

SEQ ID NO: 87416 - DNA, 20 bp, human
ggggagaccatgagccccta

SEQ ID NO: 87417 - DNA, 20 bp, human
gggaggaaaaggcgccactg

SEQ ID NO: 87418 - DNA, 20 bp, human
ggcgcaggacgccccgtctg

SEQ ID NO: 87419 - DNA, 20 bp, human
gccggtgggctggggcccta

SEQ ID NO: 87420 - DNA, 20 bp, human
gcgcagcgctgcgcccggtc

SEQ ID NO: 87421 - DNA, 20 bp, human
gaggcgccactggggcgtgg

SEQ ID NO: 87422 - DNA, 20 bp, human
gggcggggccccggaggaaa

SEQ ID NO: 87423 - DNA, 20 bp, human
ggcgcgaggtggcatagggg

SEQ ID NO: 87424 - DNA, 20 bp, human
ggcgggcgcgaggtggcata

SEQ ID NO: 87425 - DNA, 20 bp, human
gcataggggagggggcgcct

SEQ ID NO: 87426 - DNA, 20 bp, human
gtctcccggcaagctcagag

SEQ ID NO: 87427 - DNA, 20 bp, human
gaggagcagcaacagcggtg

SEQ ID NO: 87428 - DNA, 20 bp, human
gcagacctgcccccaacggt

SEQ ID NO: 87429 - DNA, 20 bp, human
ggaaggctgggtcccaccgt

SEQ ID NO: 87430 - DNA, 20 bp, human
gggacgccccgagagagagg

SEQ ID NO: 87431 - DNA, 20 bp, human
gggagttgggtgtgtctcca

SEQ ID NO: 87432 - DNA, 20 bp, human
gggctgggtcccaccgttgg

SEQ ID NO: 87433 - DNA, 20 bp, human
gggcaggagacgccgggaga

SEQ ID NO: 87434 - DNA, 20 bp, human
ggaagctggcaggagacgcc

SEQ ID NO: 87435 - DNA, 20 bp, human
gggagacgccgggagaaggc

SEQ ID NO: 87436 - DNA, 20 bp, human
gccgccacgcaggttaggaa

SEQ ID NO: 87437 - DNA, 20 bp, human
ggtgcacccggaaagggaag

SEQ ID NO: 87438 - DNA, 20 bp, human
ggtcaagccgagggaaaggc

SEQ ID NO: 87439 - DNA, 20 bp, human
gacgccccgccacgcaggtt

SEQ ID NO: 87440 - DNA, 20 bp, human
gctcgccgtgcacccggaaa

SEQ ID NO: 87441 - DNA, 20 bp, human
gcggagaaaggtcaagccga

SEQ ID NO: 87442 - DNA, 20 bp, human
gctagtgcgatcaataaata

SEQ ID NO: 87443 - DNA, 20 bp, human
gcagtggccccgcagtaagt

SEQ ID NO: 87444 - DNA, 20 bp, human
gggctctcgtccgagcgcgg

SEQ ID NO: 87445 - DNA, 20 bp, human
gaatacagcccgaggagtag

SEQ ID NO: 87446 - DNA, 20 bp, human
ggcacccgccgagggaagac

SEQ ID NO: 87447 - DNA, 20 bp, human
gcgaaccgaccgagcgaggg

SEQ ID NO: 87448 - DNA, 20 bp, human
gccggcggtgtgtctaccag

SEQ ID NO: 87449 - DNA, 20 bp, human
gctcggcgggtgccagagac

SEQ ID NO: 87450 - DNA, 20 bp, human
gccattggcctgtcttccct

SEQ ID NO: 87451 - DNA, 20 bp, human
ggccaggcgctggggttcgg

SEQ ID NO: 87452 - DNA, 20 bp, human
gcagccggagcaacaggcgt

SEQ ID NO: 87453 - DNA, 20 bp, human
ggagtgggagggtgccgcgt

SEQ ID NO: 87454 - DNA, 20 bp, human
gagccttcgccacctgtctc

SEQ ID NO: 87455 - DNA, 20 bp, human
ggccaatggaaagagggcag

SEQ ID NO: 87456 - DNA, 20 bp, human
gacactaccggatcctccga

SEQ ID NO: 87457 - DNA, 20 bp, human
gtgagaaccatcaccctcgg

SEQ ID NO: 87458 - DNA, 20 bp, human
gcttgactgggatacactac

SEQ ID NO: 87459 - DNA, 20 bp, human
gtgcacacaggaccttggtg

SEQ ID NO: 87460 - DNA, 20 bp, human
gccatcaccctcggaggatc

SEQ ID NO: 87461 - DNA, 20 bp, human
gtagcacggtcgagaggagt

SEQ ID NO: 87462 - DNA, 20 bp, human
ggaggtctggccttctggat

SEQ ID NO: 87463 - DNA, 20 bp, human
gtgcccacctcctaaaatga

SEQ ID NO: 87464 - DNA, 20 bp, human
gggtggacagccatcaccat

SEQ ID NO: 87465 - DNA, 20 bp, human
gcctacagagcagcagttag

SEQ ID NO: 87466 - DNA, 20 bp, human
ggcggtagcacccagctctc

SEQ ID NO: 87467 - DNA, 20 bp, human
gctcgacgagcttacgggag

SEQ ID NO: 87468 - DNA, 20 bp, human
gcacctcgcggcccacgaaa

SEQ ID NO: 87469 - DNA, 20 bp, human
gctctccggcgagcgcgcag

SEQ ID NO: 87470 - DNA, 20 bp, human
ggcttgcgccgagcacgaat

SEQ ID NO: 87471 - DNA, 20 bp, human
gcccagggatgagcgagatg

SEQ ID NO: 87472 - DNA, 20 bp, human
gagcacgaatgggccccggg

SEQ ID NO: 87473 - DNA, 20 bp, human
ggtgcagctcgagcaacagg

SEQ ID NO: 87474 - DNA, 20 bp, human
ggatgaggcgaaccctggaa

SEQ ID NO: 87475 - DNA, 20 bp, human
gcgtaagctcgtcgaggcca

SEQ ID NO: 87476 - DNA, 20 bp, human
gcatcacctgggcctataaa

SEQ ID NO: 87477 - DNA, 20 bp, human
ggcagttgcaagggcttaga

SEQ ID NO: 87478 - DNA, 20 bp, human
gcgttagcgagctctcttct

SEQ ID NO: 87479 - DNA, 20 bp, human
gttagatggttgtaaggtga

SEQ ID NO: 87480 - DNA, 20 bp, human
ggaggattcatggtaaacgt

SEQ ID NO: 87481 - DNA, 20 bp, human
gaagggcttagatggttgta

SEQ ID NO: 87482 - DNA, 20 bp, human
gacttacctatgcagtgtgt

SEQ ID NO: 87483 - DNA, 20 bp, human
gtaaggtgaaggtgcccagc

SEQ ID NO: 87484 - DNA, 20 bp, human
gtagatcgctcacatcacct

SEQ ID NO: 87485 - DNA, 20 bp, human
gttgcagactgcagttgcaa

SEQ ID NO: 87486 - DNA, 20 bp, human
gaagcccagagctagaaagc

SEQ ID NO: 87487 - DNA, 20 bp, human
ggatgtctctggacacatct

SEQ ID NO: 87488 - DNA, 20 bp, human
ggggatctcagtattgactt

SEQ ID NO: 87489 - DNA, 20 bp, human
ggacgcagcacatacagtga

SEQ ID NO: 87490 - DNA, 20 bp, human
ggatggagcttgggacgact

SEQ ID NO: 87491 - DNA, 20 bp, human
gagggagggaaatctcaatc

SEQ ID NO: 87492 - DNA, 20 bp, human
gacatcctgaagaggctcgg

SEQ ID NO: 87493 - DNA, 20 bp, human
ggtccagagacatcctgaag

SEQ ID NO: 87494 - DNA, 20 bp, human
gtgctcatagcaagccttga

SEQ ID NO: 87495 - DNA, 20 bp, human
gggttttaactgacagggag

SEQ ID NO: 87496 - DNA, 20 bp, human
ggcacccgcggagtggaacg

SEQ ID NO: 87497 - DNA, 20 bp, human
gcacggcgccctctgaccga

SEQ ID NO: 87498 - DNA, 20 bp, human
gagccagagagcgcgctggg

SEQ ID NO: 87499 - DNA, 20 bp, human
gtgatcgtggagcagcatgt

SEQ ID NO: 87500 - DNA, 20 bp, human
gaagggagccgagcgcgggt

SEQ ID NO: 87501 - DNA, 20 bp, human
gcagccccgttccactccgc

SEQ ID NO: 87502 - DNA, 20 bp, human
gcgccccgtctggaaaccgt

SEQ ID NO: 87503 - DNA, 20 bp, human
ggccgtggcccttggaaggg

SEQ ID NO: 87504 - DNA, 20 bp, human
ggagcgcgctgggcggtgct

SEQ ID NO: 87505 - DNA, 20 bp, human
gcagcgcgctctctggctct

SEQ ID NO: 87506 - DNA, 20 bp, human
gtagccttgctgacttacca

SEQ ID NO: 87507 - DNA, 20 bp, human
gtgacaagagtgagctatga

SEQ ID NO: 87508 - DNA, 20 bp, human
ggaagcccgggaaggttcac

SEQ ID NO: 87509 - DNA, 20 bp, human
gcagagcagaagaaccctct

SEQ ID NO: 87510 - DNA, 20 bp, human
gagggttcttctgctctgtc

SEQ ID NO: 87511 - DNA, 20 bp, human
gctcttggactggacgattt

SEQ ID NO: 87512 - DNA, 20 bp, human
gcagccttggtaagtcagca

SEQ ID NO: 87513 - DNA, 20 bp, human
gtatatcccaactgcagcag

SEQ ID NO: 87514 - DNA, 20 bp, human
gtgggacaaactgtcagcct

SEQ ID NO: 87515 - DNA, 20 bp, human
gtttcccagtgaaccttccc

SEQ ID NO: 87516 - DNA, 20 bp, human
ggcacccgccggacccccag

SEQ ID NO: 87517 - DNA, 20 bp, human
ggtgtgcagagagcgaactt

SEQ ID NO: 87518 - DNA, 20 bp, human
gacctcgagcacctcgcgga

SEQ ID NO: 87519 - DNA, 20 bp, human
ggcacacctcgagcacctcg

SEQ ID NO: 87520 - DNA, 20 bp, human
ggccgtccgcgaggtgctcg

SEQ ID NO: 87521 - DNA, 20 bp, human
gagcacctcgcggacggcgt

SEQ ID NO: 87522 - DNA, 20 bp, human
ggcgcgcggggaggatggac

SEQ ID NO: 87523 - DNA, 20 bp, human
gcccgagatcagcgcacggg

SEQ ID NO: 87524 - DNA, 20 bp, human
ggggagcggggtctcctcgt

SEQ ID NO: 87525 - DNA, 20 bp, human
gctccccgagatcagcgcac

SEQ ID NO: 87526 - DNA, 20 bp, human
gggggaggccagggcgacag

SEQ ID NO: 87527 - DNA, 20 bp, human
ggccagggcgacagaggact

SEQ ID NO: 87528 - DNA, 20 bp, human
gccacgccgccacgcaccag

SEQ ID NO: 87529 - DNA, 20 bp, human
ggcggccgtggctccgaggg

SEQ ID NO: 87530 - DNA, 20 bp, human
gaggactcgggagtcaccgc

SEQ ID NO: 87531 - DNA, 20 bp, human
gctcggagcccggcggggac

SEQ ID NO: 87532 - DNA, 20 bp, human
gtacggccaaggtgcgggtc

SEQ ID NO: 87533 - DNA, 20 bp, human
ggtcctcgccccggacccgt

SEQ ID NO: 87534 - DNA, 20 bp, human
gcgcatcccggtgacccctt

SEQ ID NO: 87535 - DNA, 20 bp, human
gacgccgcgacgggaacttg

SEQ ID NO: 87536 - DNA, 20 bp, human
gcacgcgcagcaggtcgtcg

SEQ ID NO: 87537 - DNA, 20 bp, human
ggtgacggccacgaaggaca

SEQ ID NO: 87538 - DNA, 20 bp, human
gccagtaggccagctcgtcg

SEQ ID NO: 87539 - DNA, 20 bp, human
gcggcatggtgctcaggcag

SEQ ID NO: 87540 - DNA, 20 bp, human
ggcctactggggcatcgacg

SEQ ID NO: 87541 - DNA, 20 bp, human
ggatgtccggcatggtgctc

SEQ ID NO: 87542 - DNA, 20 bp, human
gggtggacaacccgcactcg

SEQ ID NO: 87543 - DNA, 20 bp, human
gagccgcccccgaggtccca

SEQ ID NO: 87544 - DNA, 20 bp, human
gacggccgtgacggccacga

SEQ ID NO: 87545 - DNA, 20 bp, human
gcgcgcgccctgggacctcg

SEQ ID NO: 87546 - DNA, 20 bp, human
gcctgcggccgcgaatccgg

SEQ ID NO: 87547 - DNA, 20 bp, human
ggcctctcgcctctggacgg

SEQ ID NO: 87548 - DNA, 20 bp, human
gccgctgcgcccgaaggtca

SEQ ID NO: 87549 - DNA, 20 bp, human
gctcgggccgaaagtccccc

SEQ ID NO: 87550 - DNA, 20 bp, human
ggcgctcccccgtcagccac

SEQ ID NO: 87551 - DNA, 20 bp, human
ggccgccgtccagaggcgag

SEQ ID NO: 87552 - DNA, 20 bp, human
gcgcagggagcgccggagac

SEQ ID NO: 87553 - DNA, 20 bp, human
gctccctgcggccgcgaatc

SEQ ID NO: 87554 - DNA, 20 bp, human
ggcaaagtgagcgggttcgg

SEQ ID NO: 87555 - DNA, 20 bp, human
gggacccccgggccagcgga

SEQ ID NO: 87556 - DNA, 20 bp, human
gtatgagagatgagggtctg

SEQ ID NO: 87557 - DNA, 20 bp, human
gtccttctggagcacgggaa

SEQ ID NO: 87558 - DNA, 20 bp, human
gctcatctctcataaggaaa

SEQ ID NO: 87559 - DNA, 20 bp, human
gtgacgctgttagacatcct

SEQ ID NO: 87560 - DNA, 20 bp, human
gagccctgggggattgaggt

SEQ ID NO: 87561 - DNA, 20 bp, human
gttactgcttgctgtagggt

SEQ ID NO: 87562 - DNA, 20 bp, human
ggaggcacgggaagaaagat

SEQ ID NO: 87563 - DNA, 20 bp, human
gaaggtgagttaaactggag

SEQ ID NO: 87564 - DNA, 20 bp, human
gatctcttggtgcccaggga

SEQ ID NO: 87565 - DNA, 20 bp, human
gtggtttctggaggaggcac

SEQ ID NO: 87566 - DNA, 20 bp, human
gaggcgcgaagagggcgcga

SEQ ID NO: 87567 - DNA, 20 bp, human
gtaacaggagagctcttctg

SEQ ID NO: 87568 - DNA, 20 bp, human
ggccgcggcgcgggcaccca

SEQ ID NO: 87569 - DNA, 20 bp, human
gcgcgagggtagcagccaga

SEQ ID NO: 87570 - DNA, 20 bp, human
gcttggagataagaccgaga

SEQ ID NO: 87571 - DNA, 20 bp, human
gcggcggggatccgcaggca

SEQ ID NO: 87572 - DNA, 20 bp, human
gagggagggaggcgcgaaga

SEQ ID NO: 87573 - DNA, 20 bp, human
ggaccgagagggcgctagaa

SEQ ID NO: 87574 - DNA, 20 bp, human
ggcgcccggcggggatccgc

SEQ ID NO: 87575 - DNA, 20 bp, human
ggatccccgccgggcgcatg

SEQ ID NO: 87576 - DNA, 20 bp, human
gtgagggccagagtgagtgg

SEQ ID NO: 87577 - DNA, 20 bp, human
gcgacgtggcccctccgcac

SEQ ID NO: 87578 - DNA, 20 bp, human
gaccggcatcctgagcccat

SEQ ID NO: 87579 - DNA, 20 bp, human
ggcggctcgggcagcgcctg

SEQ ID NO: 87580 - DNA, 20 bp, human
gtcaggatgccggtgcggag

SEQ ID NO: 87581 - DNA, 20 bp, human
gggccgcggaagggttaatg

SEQ ID NO: 87582 - DNA, 20 bp, human
gccgcggccaagccgagcac

SEQ ID NO: 87583 - DNA, 20 bp, human
gggcatcctgagcccatggg

SEQ ID NO: 87584 - DNA, 20 bp, human
ggctcggcccggccgcggaa

SEQ ID NO: 87585 - DNA, 20 bp, human
gcgcggccaagactggactg

SEQ ID NO: 87586 - DNA, 20 bp, human
gtcaccctggcagtaagcgt

SEQ ID NO: 87587 - DNA, 20 bp, human
gctggcgggcgggcagagca

SEQ ID NO: 87588 - DNA, 20 bp, human
gtgccggccccagaaagaag

SEQ ID NO: 87589 - DNA, 20 bp, human
ggcctcgtggcccaggaggt

SEQ ID NO: 87590 - DNA, 20 bp, human
gaggcaggtggctggcccaa

SEQ ID NO: 87591 - DNA, 20 bp, human
ggccatgggcagctcgagcc

SEQ ID NO: 87592 - DNA, 20 bp, human
gggcagcagggcccacgcca

SEQ ID NO: 87593 - DNA, 20 bp, human
gcgggaaggcgagcaggaca

SEQ ID NO: 87594 - DNA, 20 bp, human
gacctacctcctgggccacg

SEQ ID NO: 87595 - DNA, 20 bp, human
gagcccaggctgcacccccg

SEQ ID NO: 87596 - DNA, 20 bp, human
gtcgcgtgtcggctgcgggt

SEQ ID NO: 87597 - DNA, 20 bp, human
gggcgccgagcgaagccgag

SEQ ID NO: 87598 - DNA, 20 bp, human
gcggcggcccgggtgcaagt

SEQ ID NO: 87599 - DNA, 20 bp, human
gctctcagcacctcccgccg

SEQ ID NO: 87600 - DNA, 20 bp, human
ggcttctccccgacagacgg

SEQ ID NO: 87601 - DNA, 20 bp, human
gggccgccggaccctcgcca

SEQ ID NO: 87602 - DNA, 20 bp, human
ggcggcagcggctcgcgtgt

SEQ ID NO: 87603 - DNA, 20 bp, human
gccctagcgcagccgtcggg

SEQ ID NO: 87604 - DNA, 20 bp, human
gatgcgcagaccgggatccg

SEQ ID NO: 87605 - DNA, 20 bp, human
gggcagctccctccgtctgt

SEQ ID NO: 87606 - DNA, 20 bp, human
ggcgacacccgcacccctct

SEQ ID NO: 87607 - DNA, 20 bp, human
gctccccgagagacacgcgt

SEQ ID NO: 87608 - DNA, 20 bp, human
ggcagcggcagtaagaggga

SEQ ID NO: 87609 - DNA, 20 bp, human
gggcccacgcgtgtctctcg

SEQ ID NO: 87610 - DNA, 20 bp, human
gcgcgtgggccgctcccctc

SEQ ID NO: 87611 - DNA, 20 bp, human
gggccatgccggtcatgaag

SEQ ID NO: 87612 - DNA, 20 bp, human
gccgccacgtggccccacac

SEQ ID NO: 87613 - DNA, 20 bp, human
gctctcggggagagaattcg

SEQ ID NO: 87614 - DNA, 20 bp, human
ggctacggggttcggagcag

SEQ ID NO: 87615 - DNA, 20 bp, human
gctggacatggtgagacccg

SEQ ID NO: 87616 - DNA, 20 bp, human
ggccacagtctgggcagcgg

SEQ ID NO: 87617 - DNA, 20 bp, human
ggagcagcggccaggatccg

SEQ ID NO: 87618 - DNA, 20 bp, human
ggtgcggcaccgccacagtc

SEQ ID NO: 87619 - DNA, 20 bp, human
gtaaatgaaaccaccaggta

SEQ ID NO: 87620 - DNA, 20 bp, human
gagttcccgagccccgtgtg

SEQ ID NO: 87621 - DNA, 20 bp, human
gcatggtagtagcgctcccc

SEQ ID NO: 87622 - DNA, 20 bp, human
gtgcaggcagccttacctgg

SEQ ID NO: 87623 - DNA, 20 bp, human
gtcccatccctctcccaagg

SEQ ID NO: 87624 - DNA, 20 bp, human
gggatgcaggcagccttacc

SEQ ID NO: 87625 - DNA, 20 bp, human
ggcgcgtgtgggcgggatgg

SEQ ID NO: 87626 - DNA, 20 bp, human
gcgacgtggcccctgcggac

SEQ ID NO: 87627 - DNA, 20 bp, human
gcgggagccagtggcgcctg

SEQ ID NO: 87628 - DNA, 20 bp, human
gcgaggacagacggagacgc

SEQ ID NO: 87629 - DNA, 20 bp, human
gcctcatccgcgtcctccag

SEQ ID NO: 87630 - DNA, 20 bp, human
gggccgcggccgaaagatgc

SEQ ID NO: 87631 - DNA, 20 bp, human
ggagaagcctctggaggacg

SEQ ID NO: 87632 - DNA, 20 bp, human
gcctggttccgtgaaagggg

SEQ ID NO: 87633 - DNA, 20 bp, human
gggggcaccaaggaaacagc

SEQ ID NO: 87634 - DNA, 20 bp, human
gaaggactcagagaagcctc

SEQ ID NO: 87635 - DNA, 20 bp, human
ggttcgaacttggggcacca

SEQ ID NO: 87636 - DNA, 20 bp, human
ggtgcgaggccccctccgga

SEQ ID NO: 87637 - DNA, 20 bp, human
gtccggtgcgaggccccctc

SEQ ID NO: 87638 - DNA, 20 bp, human
gccccaaaccctctcacccg

SEQ ID NO: 87639 - DNA, 20 bp, human
gaggccccctccggaaggtg

SEQ ID NO: 87640 - DNA, 20 bp, human
ggacgccaagtgcactaaca

SEQ ID NO: 87641 - DNA, 20 bp, human
gcggactgccgcgggtgaga

SEQ ID NO: 87642 - DNA, 20 bp, human
gttcccctcaccttccggag

SEQ ID NO: 87643 - DNA, 20 bp, human
gcaggctctgtcaacttaag

SEQ ID NO: 87644 - DNA, 20 bp, human
gtggggagaccggcaactcc

SEQ ID NO: 87645 - DNA, 20 bp, human
ggcttccaaggtggggagac

SEQ ID NO: 87646 - DNA, 20 bp, human
gcgggctcggggagcgctct

SEQ ID NO: 87647 - DNA, 20 bp, human
ggccgagcaggggaagtgga

SEQ ID NO: 87648 - DNA, 20 bp, human
ggagaaggggaacctgatga

SEQ ID NO: 87649 - DNA, 20 bp, human
gctggtgcaaaagggaaggt

SEQ ID NO: 87650 - DNA, 20 bp, human
ggctcctcctgccacagccg

SEQ ID NO: 87651 - DNA, 20 bp, human
gacctgatgacggcagggaa

SEQ ID NO: 87652 - DNA, 20 bp, human
ggggggacccggcctgacgg

SEQ ID NO: 87653 - DNA, 20 bp, human
gaccccagagacgtcggtca

SEQ ID NO: 87654 - DNA, 20 bp, human
gctgacggcggggccgagca

SEQ ID NO: 87655 - DNA, 20 bp, human
ggttccagccgccccggctg

SEQ ID NO: 87656 - DNA, 20 bp, human
gtggtattcagcaagcgtgg

SEQ ID NO: 87657 - DNA, 20 bp, human
gctgcctggcactggacacg

SEQ ID NO: 87658 - DNA, 20 bp, human
gctcggggcgagagtcggag

SEQ ID NO: 87659 - DNA, 20 bp, human
gtggaggagagaaaagcgcc

SEQ ID NO: 87660 - DNA, 20 bp, human
gcagcgctcggggcgagagt

SEQ ID NO: 87661 - DNA, 20 bp, human
ggcatgtgcggggctgaaga

SEQ ID NO: 87662 - DNA, 20 bp, human
ggcacccccaagcccagaca

SEQ ID NO: 87663 - DNA, 20 bp, human
ggaacagagcccggaccgcg

SEQ ID NO: 87664 - DNA, 20 bp, human
gtggccccgtgtccagtgcc

SEQ ID NO: 87665 - DNA, 20 bp, human
gtggctcggcagcctcggcc

SEQ ID NO: 87666 - DNA, 20 bp, human
gcaggtgagcgcagagccgg

SEQ ID NO: 87667 - DNA, 20 bp, human
ggggtctgaggtctacccgg

SEQ ID NO: 87668 - DNA, 20 bp, human
ggtctgggcggcaggacact

SEQ ID NO: 87669 - DNA, 20 bp, human
gcagcaggtgagcgcagagc

SEQ ID NO: 87670 - DNA, 20 bp, human
ggaggtctacccggaggtcc

SEQ ID NO: 87671 - DNA, 20 bp, human
gggagagaggcagctcggct

SEQ ID NO: 87672 - DNA, 20 bp, human
gataagagtgcctgggaatg

SEQ ID NO: 87673 - DNA, 20 bp, human
ggcactcttatggccggtct

SEQ ID NO: 87674 - DNA, 20 bp, human
ggctcctacgaccagctcac

SEQ ID NO: 87675 - DNA, 20 bp, human
gtcggagaggcggaagggtc

SEQ ID NO: 87676 - DNA, 20 bp, human
gtgcctccgaggcagcgcgt

SEQ ID NO: 87677 - DNA, 20 bp, human
gggagcggcgatggaggctg

SEQ ID NO: 87678 - DNA, 20 bp, human
gagcccgcacggcctctcgg

SEQ ID NO: 87679 - DNA, 20 bp, human
gtccatgccctggatgccca

SEQ ID NO: 87680 - DNA, 20 bp, human
ggcgcggcggccactccggg

SEQ ID NO: 87681 - DNA, 20 bp, human
gtaggcgcggcggccactcc

SEQ ID NO: 87682 - DNA, 20 bp, human
ggaggcagcgcgtgggcgag

SEQ ID NO: 87683 - DNA, 20 bp, human
gtagtcccaggaagccccag

SEQ ID NO: 87684 - DNA, 20 bp, human
gaagccggtgtgctcaccag

SEQ ID NO: 87685 - DNA, 20 bp, human
gcgcctccgccgcagaccag

SEQ ID NO: 87686 - DNA, 20 bp, human
gtactctgggatggacatga

SEQ ID NO: 87687 - DNA, 20 bp, human
gaaggctactgctggagaaa

SEQ ID NO: 87688 - DNA, 20 bp, human
gttcatggtcagctaggtca

SEQ ID NO: 87689 - DNA, 20 bp, human
gtgagaagtgctcctctgcc

SEQ ID NO: 87690 - DNA, 20 bp, human
gacctagctgaccatgaact

SEQ ID NO: 87691 - DNA, 20 bp, human
gtgtcttaggtgaatgtaag

SEQ ID NO: 87692 - DNA, 20 bp, human
ggaagcaggtttagaaggta

SEQ ID NO: 87693 - DNA, 20 bp, human
gaagccaggtttttcagggt

SEQ ID NO: 87694 - DNA, 20 bp, human
gtggctttacaaagaaagcc

SEQ ID NO: 87695 - DNA, 20 bp, human
gccattaaactacattaaga

SEQ ID NO: 87696 - DNA, 20 bp, human
gggtggcagagatgtatgta

SEQ ID NO: 87697 - DNA, 20 bp, human
gagggctgcggagtgaccca

SEQ ID NO: 87698 - DNA, 20 bp, human
gtgctaggtgagggtacccg

SEQ ID NO: 87699 - DNA, 20 bp, human
gtgccaccaaaagaagactt

SEQ ID NO: 87700 - DNA, 20 bp, human
gcttgctcacatcgagaatc

SEQ ID NO: 87701 - DNA, 20 bp, human
gctcttgcatcaaaggtgca

SEQ ID NO: 87702 - DNA, 20 bp, human
ggatggaaacggcttggcag

SEQ ID NO: 87703 - DNA, 20 bp, human
gcttaaagatggaaacggct

SEQ ID NO: 87704 - DNA, 20 bp, human
gcttgtctgtccactcctgg

SEQ ID NO: 87705 - DNA, 20 bp, human
ggatttgaggcggggaaaag

SEQ ID NO: 87706 - DNA, 20 bp, human
gcggagctgggatcagataa

SEQ ID NO: 87707 - DNA, 20 bp, human
gcgggacagatggacggacg

SEQ ID NO: 87708 - DNA, 20 bp, human
ggggccaggactcttaaacc

SEQ ID NO: 87709 - DNA, 20 bp, human
gtaggagcagagctgtgcga

SEQ ID NO: 87710 - DNA, 20 bp, human
gacagatggacggacggggc

SEQ ID NO: 87711 - DNA, 20 bp, human
gaggcaggggaacaagacgg

SEQ ID NO: 87712 - DNA, 20 bp, human
gcaactgctggtctgcccag

SEQ ID NO: 87713 - DNA, 20 bp, human
gggagtaacctgtccatatg

SEQ ID NO: 87714 - DNA, 20 bp, human
gcccgatgccccctcccact

SEQ ID NO: 87715 - DNA, 20 bp, human
ggctccgggtttaagagtcc

SEQ ID NO: 87716 - DNA, 20 bp, human
gaccgacctgggctaggcag

SEQ ID NO: 87717 - DNA, 20 bp, human
ggctaggcaggggtctagga

SEQ ID NO: 87718 - DNA, 20 bp, human
gcgcacctggaggagagacg

SEQ ID NO: 87719 - DNA, 20 bp, human
ggcggagaccgacctgggct

SEQ ID NO: 87720 - DNA, 20 bp, human
ggggtggagtaggacatagg

SEQ ID NO: 87721 - DNA, 20 bp, human
gaggcaggggtctaggacgg

SEQ ID NO: 87722 - DNA, 20 bp, human
ggtctaggacggcgggaggg

SEQ ID NO: 87723 - DNA, 20 bp, human
gcagagaacgcaggatccca

SEQ ID NO: 87724 - DNA, 20 bp, human
gctagacccctgcctagccc

SEQ ID NO: 87725 - DNA, 20 bp, human
gggcgcacgaggagaggaac

SEQ ID NO: 87726 - DNA, 20 bp, human
gccgacccgtggctggacca

SEQ ID NO: 87727 - DNA, 20 bp, human
ggctccgcgcctcgctccac

SEQ ID NO: 87728 - DNA, 20 bp, human
gtggcgtcggtccctcggtc

SEQ ID NO: 87729 - DNA, 20 bp, human
gccgatgtctcaccaaggga

SEQ ID NO: 87730 - DNA, 20 bp, human
ggggggcgctccatgccgag

SEQ ID NO: 87731 - DNA, 20 bp, human
gacggggagcgaggaatgga

SEQ ID NO: 87732 - DNA, 20 bp, human
gtcctccgatgtctcaccaa

SEQ ID NO: 87733 - DNA, 20 bp, human
gcagctgccggggccaggaa

SEQ ID NO: 87734 - DNA, 20 bp, human
ggcgtcctccaagctccggg

SEQ ID NO: 87735 - DNA, 20 bp, human
ggcagagaagacgcgcccct

SEQ ID NO: 87736 - DNA, 20 bp, human
gtgggtcagcctttatgcca

SEQ ID NO: 87737 - DNA, 20 bp, human
gtatgccaaggtaggtctta

SEQ ID NO: 87738 - DNA, 20 bp, human
gtcagcctttatgccaaggt

SEQ ID NO: 87739 - DNA, 20 bp, human
gagtagaggataaaggcctt

SEQ ID NO: 87740 - DNA, 20 bp, human
ggtaggttctcttcttggac

SEQ ID NO: 87741 - DNA, 20 bp, human
gtattacaatatatcagtag

SEQ ID NO: 87742 - DNA, 20 bp, human
gatctacaagtctagtttgt

SEQ ID NO: 87743 - DNA, 20 bp, human
gtccagtaatacattcaata

SEQ ID NO: 87744 - DNA, 20 bp, human
gatttccttaagacctacct

SEQ ID NO: 87745 - DNA, 20 bp, human
gtctttccttatgggaaaca

SEQ ID NO: 87746 - DNA, 20 bp, human
gacagggaccaagcaggaca

SEQ ID NO: 87747 - DNA, 20 bp, human
ggacaaagagatgcagagat

SEQ ID NO: 87748 - DNA, 20 bp, human
gggacagagacctagatgga

SEQ ID NO: 87749 - DNA, 20 bp, human
gtgggactggaggatttcga

SEQ ID NO: 87750 - DNA, 20 bp, human
gagtgctcttgagaagactg

SEQ ID NO: 87751 - DNA, 20 bp, human
ggtcccacctcagccccgtg

SEQ ID NO: 87752 - DNA, 20 bp, human
ggccaggagaatccaccccc

SEQ ID NO: 87753 - DNA, 20 bp, human
ggtgccccaagaaaaagtac

SEQ ID NO: 87754 - DNA, 20 bp, human
ggctgagagacctgcgacaa

SEQ ID NO: 87755 - DNA, 20 bp, human
gtccatataaaggagataca

SEQ ID NO: 87756 - DNA, 20 bp, human
gaccagcacaggattctagt

SEQ ID NO: 87757 - DNA, 20 bp, human
gtctagtgggcatccagtcc

SEQ ID NO: 87758 - DNA, 20 bp, human
gtgcagactcctggctggat

SEQ ID NO: 87759 - DNA, 20 bp, human
gaagagtgcagactcctggc

SEQ ID NO: 87760 - DNA, 20 bp, human
gactgaagagtgcagactcc

SEQ ID NO: 87761 - DNA, 20 bp, human
gaggttgccttgggaaagat

SEQ ID NO: 87762 - DNA, 20 bp, human
ggacgcccgtgcttatctgg

SEQ ID NO: 87763 - DNA, 20 bp, human
gggcgcttatgttaactctg

SEQ ID NO: 87764 - DNA, 20 bp, human
gtttcccaaggcaacctgtc

SEQ ID NO: 87765 - DNA, 20 bp, human
gccgtaaggcgaaacctcgc

SEQ ID NO: 87766 - DNA, 20 bp, human
gctgtggggagagtgaataa

SEQ ID NO: 87767 - DNA, 20 bp, human
gagctcatagattctctgtg

SEQ ID NO: 87768 - DNA, 20 bp, human
gcatacaggatgcaaaaatc

SEQ ID NO: 87769 - DNA, 20 bp, human
gtatgttcataagtgcatac

SEQ ID NO: 87770 - DNA, 20 bp, human
gcaaatataatagcaggcaa

SEQ ID NO: 87771 - DNA, 20 bp, human
gctctgagctttttaagagg

SEQ ID NO: 87772 - DNA, 20 bp, human
gcattgcagaatactccatg

SEQ ID NO: 87773 - DNA, 20 bp, human
gttatccaagtgctttaagt

SEQ ID NO: 87774 - DNA, 20 bp, human
ggttaaaagtagtctcacat

SEQ ID NO: 87775 - DNA, 20 bp, human
gtgagctaggtgctttcagc

SEQ ID NO: 87776 - DNA, 20 bp, human
gccgacccgtggctggacca

SEQ ID NO: 87777 - DNA, 20 bp, human
ggctccgcgcctcgctccac

SEQ ID NO: 87778 - DNA, 20 bp, human
gtggcgtcggtccctcggtc

SEQ ID NO: 87779 - DNA, 20 bp, human
gccgatgtctcaccaaggga

SEQ ID NO: 87780 - DNA, 20 bp, human
ggggggcgctccatgccgag

SEQ ID NO: 87781 - DNA, 20 bp, human
gacggggagcgaggaatgga

SEQ ID NO: 87782 - DNA, 20 bp, human
gtcctccgatgtctcaccaa

SEQ ID NO: 87783 - DNA, 20 bp, human
gcagctgccggggccaggaa

SEQ ID NO: 87784 - DNA, 20 bp, human
ggcgtcctccaagctccggg

SEQ ID NO: 87785 - DNA, 20 bp, human
ggcagagaagacgcgcccct

SEQ ID NO: 87786 - DNA, 20 bp, human
gctgcgccagcaacaggtaa

SEQ ID NO: 87787 - DNA, 20 bp, human
ggtgcgctctgcaatatcct

SEQ ID NO: 87788 - DNA, 20 bp, human
gagaggcatgtaagatccag

SEQ ID NO: 87789 - DNA, 20 bp, human
gatactgggtttggaggcaa

SEQ ID NO: 87790 - DNA, 20 bp, human
gccagctgtagcgagatact

SEQ ID NO: 87791 - DNA, 20 bp, human
gggctgggtcttgggaattc

SEQ ID NO: 87792 - DNA, 20 bp, human
gacaccggcagcgagcgaaa

SEQ ID NO: 87793 - DNA, 20 bp, human
ggtgcgcacacaaactatat

SEQ ID NO: 87794 - DNA, 20 bp, human
ggaccgcctcaaaagagccc

SEQ ID NO: 87795 - DNA, 20 bp, human
gtcgctgccggtgtgtcctg

SEQ ID NO: 87796 - DNA, 20 bp, human
ggtctggtccaggcaggtaa

SEQ ID NO: 87797 - DNA, 20 bp, human
ggtgcagacataatacgaag

SEQ ID NO: 87798 - DNA, 20 bp, human
gcagcgcggtgccctcaggg

SEQ ID NO: 87799 - DNA, 20 bp, human
gggcgtgtagttaccgacgt

SEQ ID NO: 87800 - DNA, 20 bp, human
gccctccggcggaccctcaa

SEQ ID NO: 87801 - DNA, 20 bp, human
gaagctccgcacctccctga

SEQ ID NO: 87802 - DNA, 20 bp, human
ggtggtacaccaggaaaagt

SEQ ID NO: 87803 - DNA, 20 bp, human
gtcgagacggaggccaccat

SEQ ID NO: 87804 - DNA, 20 bp, human
gtcttaggcagccagcgagt

SEQ ID NO: 87805 - DNA, 20 bp, human
ggaagaggtccgagaggtag

SEQ ID NO: 87806 - DNA, 20 bp, human
gagcgcggcggagaccccgg

SEQ ID NO: 87807 - DNA, 20 bp, human
gagcggggccgcaggaggca

SEQ ID NO: 87808 - DNA, 20 bp, human
gcaggagcgggtgacagcga

SEQ ID NO: 87809 - DNA, 20 bp, human
gcggggcagcgctgaaagtt

SEQ ID NO: 87810 - DNA, 20 bp, human
gagagacgcgagagcggtcg

SEQ ID NO: 87811 - DNA, 20 bp, human
ggacgatgctgacgccgagg

SEQ ID NO: 87812 - DNA, 20 bp, human
ggacgcgagagcggtcgggg

SEQ ID NO: 87813 - DNA, 20 bp, human
gcccgacgatgctgacgccg

SEQ ID NO: 87814 - DNA, 20 bp, human
gggtctgcgcgtgggtcttg

SEQ ID NO: 87815 - DNA, 20 bp, human
gcggagaccccgcgggcaga

SEQ ID NO: 87816 - DNA, 20 bp, human
gccagctcgcgggttctgga

SEQ ID NO: 87817 - DNA, 20 bp, human
gccctgttgtggggtcctgt

SEQ ID NO: 87818 - DNA, 20 bp, human
gcatttgtaccagggacgga

SEQ ID NO: 87819 - DNA, 20 bp, human
gcctcaggtgtccatcacct

SEQ ID NO: 87820 - DNA, 20 bp, human
ggctgggctcccaacgcaca

SEQ ID NO: 87821 - DNA, 20 bp, human
gagggcaggatgacaccctc

SEQ ID NO: 87822 - DNA, 20 bp, human
gtgggcagcaggctttcaca

SEQ ID NO: 87823 - DNA, 20 bp, human
gcacttctggcactagacca

SEQ ID NO: 87824 - DNA, 20 bp, human
gacagggaacctgctagact

SEQ ID NO: 87825 - DNA, 20 bp, human
gaagcctgctgcccaggtga

SEQ ID NO: 87826 - DNA, 20 bp, human
gccggttaggagaaaagtgg

SEQ ID NO: 87827 - DNA, 20 bp, human
gtccccggttaggagaaaag

SEQ ID NO: 87828 - DNA, 20 bp, human
gaagtggggaaagataagag

SEQ ID NO: 87829 - DNA, 20 bp, human
gtacctggctgcggacgggg

SEQ ID NO: 87830 - DNA, 20 bp, human
gcggccagagggagccagtc

SEQ ID NO: 87831 - DNA, 20 bp, human
gcacgacggatggcgaggga

SEQ ID NO: 87832 - DNA, 20 bp, human
gtcagcaccgagaggctgtt

SEQ ID NO: 87833 - DNA, 20 bp, human
gggagcagccgcgagcagaa

SEQ ID NO: 87834 - DNA, 20 bp, human
gggtgcggccgtctccggac

SEQ ID NO: 87835 - DNA, 20 bp, human
gtggccgagcgcggagagca

SEQ ID NO: 87836 - DNA, 20 bp, human
gggccggagggacaaattgg

SEQ ID NO: 87837 - DNA, 20 bp, human
gtgctggcgcgcgggaccag

SEQ ID NO: 87838 - DNA, 20 bp, human
gccaggccggagggacaaat

SEQ ID NO: 87839 - DNA, 20 bp, human
gagagttaaaaaggttcctg

SEQ ID NO: 87840 - DNA, 20 bp, human
gtaaacgcagggagggctag

SEQ ID NO: 87841 - DNA, 20 bp, human
gcgcagggagggctagagga

SEQ ID NO: 87842 - DNA, 20 bp, human
gcgccagcatgggagagcga

SEQ ID NO: 87843 - DNA, 20 bp, human
gttgggggctgcgtgtccta

SEQ ID NO: 87844 - DNA, 20 bp, human
gcaggggccgcccaggccgg

SEQ ID NO: 87845 - DNA, 20 bp, human
gctgaatctaaacgcaggga

SEQ ID NO: 87846 - DNA, 20 bp, human
gcccccacgggccccccgaa

SEQ ID NO: 87847 - DNA, 20 bp, human
gcacgggccccccgaagggt

SEQ ID NO: 87848 - DNA, 20 bp, human
gtgtagcggcagctctgact

SEQ ID NO: 87849 - DNA, 20 bp, human
gctgtttctcctaaatgtag

SEQ ID NO: 87850 - DNA, 20 bp, human
gagagagctggggagtaagg

SEQ ID NO: 87851 - DNA, 20 bp, human
gtgcggctcccacccttcgg

SEQ ID NO: 87852 - DNA, 20 bp, human
gcagagctgccgctacattt

SEQ ID NO: 87853 - DNA, 20 bp, human
ggtccttgatcttgagatag

SEQ ID NO: 87854 - DNA, 20 bp, human
gactcaggaagacaggatgt

SEQ ID NO: 87855 - DNA, 20 bp, human
gttggaggaactgaaattct

SEQ ID NO: 87856 - DNA, 20 bp, human
ggtgcgtgcgcctggtggag

SEQ ID NO: 87857 - DNA, 20 bp, human
gagatgctgcagtccctggc

SEQ ID NO: 87858 - DNA, 20 bp, human
ggcgcaggataccctacctg

SEQ ID NO: 87859 - DNA, 20 bp, human
gacgcacgagctgccggcca

SEQ ID NO: 87860 - DNA, 20 bp, human
ggccgaagcaccaggccgag

SEQ ID NO: 87861 - DNA, 20 bp, human
gggcgcagcaggtcctcata

SEQ ID NO: 87862 - DNA, 20 bp, human
ggtgctggcgaagaagagcg

SEQ ID NO: 87863 - DNA, 20 bp, human
gccgggatggcgaaaggtgg

SEQ ID NO: 87864 - DNA, 20 bp, human
gaggcgcacgcacgagctgc

SEQ ID NO: 87865 - DNA, 20 bp, human
gcgccggggccggggtgtgt

SEQ ID NO: 87866 - DNA, 20 bp, human
gtgtgcgcacacgccttcgg

SEQ ID NO: 87867 - DNA, 20 bp, human
gtaggggctgcgcagcctga

SEQ ID NO: 87868 - DNA, 20 bp, human
ggaactgggatcctaaaggt

SEQ ID NO: 87869 - DNA, 20 bp, human
gggcgagggcagccaaaagt

SEQ ID NO: 87870 - DNA, 20 bp, human
gagcggtgccggcaggttag

SEQ ID NO: 87871 - DNA, 20 bp, human
gttgcttcgttgcccagaag

SEQ ID NO: 87872 - DNA, 20 bp, human
gtcctccacgagccagtcca

SEQ ID NO: 87873 - DNA, 20 bp, human
gccaagaaaacaggtgaact

SEQ ID NO: 87874 - DNA, 20 bp, human
ggctgcgcagcctgaaggct

SEQ ID NO: 87875 - DNA, 20 bp, human
gttgttggactgctaaaccg

SEQ ID NO: 87876 - DNA, 20 bp, human
gcggagccgagccgagtccg

SEQ ID NO: 87877 - DNA, 20 bp, human
gaggagcgcttccccggact

SEQ ID NO: 87878 - DNA, 20 bp, human
ggctctgggaaggcgacgag

SEQ ID NO: 87879 - DNA, 20 bp, human
gctctgtccgggctctggga

SEQ ID NO: 87880 - DNA, 20 bp, human
gcagaggagcgcccctgccc

SEQ ID NO: 87881 - DNA, 20 bp, human
gtgtggcctgagcgccgggg

SEQ ID NO: 87882 - DNA, 20 bp, human
gcgcgagtcccgtggcccag

SEQ ID NO: 87883 - DNA, 20 bp, human
ggcgtggagagagcccccgg

SEQ ID NO: 87884 - DNA, 20 bp, human
gggcgtcggcttcagagcct

SEQ ID NO: 87885 - DNA, 20 bp, human
gctccagccgaagagccgcc

SEQ ID NO: 87886 - DNA, 20 bp, human
gccgagtggcctcctcgtag

SEQ ID NO: 87887 - DNA, 20 bp, human
ggaagccgcgcagctcgtcg

SEQ ID NO: 87888 - DNA, 20 bp, human
ggccacaggagctaccgagg

SEQ ID NO: 87889 - DNA, 20 bp, human
gtccagcgcggagaagacgg

SEQ ID NO: 87890 - DNA, 20 bp, human
gggcgccacaggagctaccg

SEQ ID NO: 87891 - DNA, 20 bp, human
gtaggagtcaaggaggacgt

SEQ ID NO: 87892 - DNA, 20 bp, human
ggccgcctcggtagctcctg

SEQ ID NO: 87893 - DNA, 20 bp, human
gacgaggaggccactcgggc

SEQ ID NO: 87894 - DNA, 20 bp, human
gggcctgcgggagagcccgg

SEQ ID NO: 87895 - DNA, 20 bp, human
gttcctccgccactacgagg

SEQ ID NO: 87896 - DNA, 20 bp, human
gaggtgggaccgaaacccag

SEQ ID NO: 87897 - DNA, 20 bp, human
gagggaggcgaaggagatga

SEQ ID NO: 87898 - DNA, 20 bp, human
gccgggcacacggagcaggt

SEQ ID NO: 87899 - DNA, 20 bp, human
gaggggggcaaaggagacca

SEQ ID NO: 87900 - DNA, 20 bp, human
gcccaccagcaggtaacaca

SEQ ID NO: 87901 - DNA, 20 bp, human
gagctccattcagcagaggg

SEQ ID NO: 87902 - DNA, 20 bp, human
gccggggccggggcgccatg

SEQ ID NO: 87903 - DNA, 20 bp, human
gaggcgccccgggacggctg

SEQ ID NO: 87904 - DNA, 20 bp, human
gaaaggagaccagggagacg

SEQ ID NO: 87905 - DNA, 20 bp, human
gagcccacgcaggcagggac

SEQ ID NO: 87906 - DNA, 20 bp, human
gtctagcagctggaagatag

SEQ ID NO: 87907 - DNA, 20 bp, human
gagcagcaggtagcagacat

SEQ ID NO: 87908 - DNA, 20 bp, human
ggtgaggagtaagcacctag

SEQ ID NO: 87909 - DNA, 20 bp, human
gcggccgagagagcccactg

SEQ ID NO: 87910 - DNA, 20 bp, human
gacacctgtgccgaggagga

SEQ ID NO: 87911 - DNA, 20 bp, human
gtcaagggtgaagacgctgg

SEQ ID NO: 87912 - DNA, 20 bp, human
gactctgtccaggccccagt

SEQ ID NO: 87913 - DNA, 20 bp, human
gcctcggcacaggtgtctgg

SEQ ID NO: 87914 - DNA, 20 bp, human
gggggtcttacagccttcaa

SEQ ID NO: 87915 - DNA, 20 bp, human
gtgtggccaggaccctgcca

SEQ ID NO: 87916 - DNA, 20 bp, human
gggagcggtggactaggacc

SEQ ID NO: 87917 - DNA, 20 bp, human
gcggtggactaggacccggt

SEQ ID NO: 87918 - DNA, 20 bp, human
gggactaggacccggtggga

SEQ ID NO: 87919 - DNA, 20 bp, human
gtgcgagaggagatacgagc

SEQ ID NO: 87920 - DNA, 20 bp, human
gaacaggaaacacctgacca

SEQ ID NO: 87921 - DNA, 20 bp, human
gcctcctccccggcgaaacc

SEQ ID NO: 87922 - DNA, 20 bp, human
gagcgggccgcggggtgtac

SEQ ID NO: 87923 - DNA, 20 bp, human
gtcctgttcagggaaacgtc

SEQ ID NO: 87924 - DNA, 20 bp, human
ggctcgcggtcggtacatag

SEQ ID NO: 87925 - DNA, 20 bp, human
gcgcagacgcgggcacaacg

SEQ ID NO: 87926 - DNA, 20 bp, human
ggtaggtcaccagaaagcag

SEQ ID NO: 87927 - DNA, 20 bp, human
gggagactaactgcctctca

SEQ ID NO: 87928 - DNA, 20 bp, human
ggcctctgggcagcatctcc

SEQ ID NO: 87929 - DNA, 20 bp, human
gagggacgatggaggtctcg

SEQ ID NO: 87930 - DNA, 20 bp, human
gtaggtgcctcacctggaca

SEQ ID NO: 87931 - DNA, 20 bp, human
gccaggcatgaggaggatcc

SEQ ID NO: 87932 - DNA, 20 bp, human
gacagcacccaccagggcgt

SEQ ID NO: 87933 - DNA, 20 bp, human
gccagacccagcctcctaga

SEQ ID NO: 87934 - DNA, 20 bp, human
ggaggtctcggggcaccccc

SEQ ID NO: 87935 - DNA, 20 bp, human
ggaactgcagtgaaacaggt

SEQ ID NO: 87936 - DNA, 20 bp, human
ggacaggagcgagccgggaa

SEQ ID NO: 87937 - DNA, 20 bp, human
ggcgaggcggaggccaagtt

SEQ ID NO: 87938 - DNA, 20 bp, human
gggggtgtgtggcacggtcc

SEQ ID NO: 87939 - DNA, 20 bp, human
gaagaggagggagttccgaa

SEQ ID NO: 87940 - DNA, 20 bp, human
gggaaggaggggacaccggc

SEQ ID NO: 87941 - DNA, 20 bp, human
gacgaaatcgcgggaaggag

SEQ ID NO: 87942 - DNA, 20 bp, human
gcgggccagcgagcagcccg

SEQ ID NO: 87943 - DNA, 20 bp, human
ggagggaaacgagccggcaa

SEQ ID NO: 87944 - DNA, 20 bp, human
gttacaaggtggggagagcg

SEQ ID NO: 87945 - DNA, 20 bp, human
gaggggcgacaggagcgagc

SEQ ID NO: 87946 - DNA, 20 bp, human
gatgccccaggccgcctccg

SEQ ID NO: 87947 - DNA, 20 bp, human
gggagcccgagctgatcgag

SEQ ID NO: 87948 - DNA, 20 bp, human
gcccggcgagccgttaccga

SEQ ID NO: 87949 - DNA, 20 bp, human
gcccgggcgggacgatgaag

SEQ ID NO: 87950 - DNA, 20 bp, human
ggcgagcgcagccatgcccc

SEQ ID NO: 87951 - DNA, 20 bp, human
gggcgagccgttaccgatgg

SEQ ID NO: 87952 - DNA, 20 bp, human
gtccagcgcgtcgaagaccg

SEQ ID NO: 87953 - DNA, 20 bp, human
gactgcacgccggccttgtg

SEQ ID NO: 87954 - DNA, 20 bp, human
gcgagctgatcgagcggcag

SEQ ID NO: 87955 - DNA, 20 bp, human
ggccggccccggacgactcc

SEQ ID NO: 87956 - DNA, 20 bp, human
gtccgcggcccagtcggcac

SEQ ID NO: 87957 - DNA, 20 bp, human
gcgaggccgtgctggaaccc

SEQ ID NO: 87958 - DNA, 20 bp, human
gtgaggcccgggttccagca

SEQ ID NO: 87959 - DNA, 20 bp, human
gcttactgtcggccccgctg

SEQ ID NO: 87960 - DNA, 20 bp, human
gggggctccgcgggacaaag

SEQ ID NO: 87961 - DNA, 20 bp, human
gcccattaccggatcgggaa

SEQ ID NO: 87962 - DNA, 20 bp, human
ggcgcccacgcgcgagaggt

SEQ ID NO: 87963 - DNA, 20 bp, human
ggacaggcaccacgctaatc

SEQ ID NO: 87964 - DNA, 20 bp, human
gctggcccgtctctccggac

SEQ ID NO: 87965 - DNA, 20 bp, human
gggcctcgccggtgccgact

SEQ ID NO: 87966 - DNA, 20 bp, human
ggcatactgctagtggcgcg

SEQ ID NO: 87967 - DNA, 20 bp, human
gccgcggatgcgtaaggagc

SEQ ID NO: 87968 - DNA, 20 bp, human
gtaaggagcgggaagaacac

SEQ ID NO: 87969 - DNA, 20 bp, human
ggcgcggcgcatactgctag

SEQ ID NO: 87970 - DNA, 20 bp, human
gagtgctggaggagccacac

SEQ ID NO: 87971 - DNA, 20 bp, human
gcctggaccgcggatgcgta

SEQ ID NO: 87972 - DNA, 20 bp, human
gagagggccccggtccacca

SEQ ID NO: 87973 - DNA, 20 bp, human
gtgatggccgaggtgagcag

SEQ ID NO: 87974 - DNA, 20 bp, human
ggctggtgttcgcccacccc

SEQ ID NO: 87975 - DNA, 20 bp, human
gcgggagccatggtggaccg

SEQ ID NO: 87976 - DNA, 20 bp, human
ggcacgctgatcaccaccgt

SEQ ID NO: 87977 - DNA, 20 bp, human
gtgaggcgcttacgtaccca

SEQ ID NO: 87978 - DNA, 20 bp, human
gtaggtgccagacggtccgg

SEQ ID NO: 87979 - DNA, 20 bp, human
ggccgcgcctgtagcactcc

SEQ ID NO: 87980 - DNA, 20 bp, human
gcccccgcctccggaccgtc

SEQ ID NO: 87981 - DNA, 20 bp, human
gggcgcttacgtacccacgg

SEQ ID NO: 87982 - DNA, 20 bp, human
gacgtcagcggggccaccca

SEQ ID NO: 87983 - DNA, 20 bp, human
gtaagcgcctcaccgcaagg

SEQ ID NO: 87984 - DNA, 20 bp, human
gtccgggagtgctacaggcg

SEQ ID NO: 87985 - DNA, 20 bp, human
ggcagaggcgaagtcccagg

SEQ ID NO: 87986 - DNA, 20 bp, human
gaaggccctggtcccgatac

SEQ ID NO: 87987 - DNA, 20 bp, human
gcagcaagtgggccacaacc

SEQ ID NO: 87988 - DNA, 20 bp, human
gagaggccatggctccctgg

SEQ ID NO: 87989 - DNA, 20 bp, human
gcacaaccaggagcccgtat

SEQ ID NO: 87990 - DNA, 20 bp, human
gggagcccgtatcgggacca

SEQ ID NO: 87991 - DNA, 20 bp, human
ggaactggcggctccacctc

SEQ ID NO: 87992 - DNA, 20 bp, human
gagttcccacagcaccccag

SEQ ID NO: 87993 - DNA, 20 bp, human
gcaccccagcggcctgccat

SEQ ID NO: 87994 - DNA, 20 bp, human
gacagggcctgggctccatc

SEQ ID NO: 87995 - DNA, 20 bp, human
ggctcttccagagctccggg

SEQ ID NO: 87996 - DNA, 20 bp, human
gcgcgcccagcccttaccta

SEQ ID NO: 87997 - DNA, 20 bp, human
gtcgagggcgtcgaacacgg

SEQ ID NO: 87998 - DNA, 20 bp, human
ggcccagcccttacctatgg

SEQ ID NO: 87999 - DNA, 20 bp, human
gcttgctggcggccatgaag

SEQ ID NO: 88000 - DNA, 20 bp, human
ggactcgagggcgtcgaaca

SEQ ID NO: 88001 - DNA, 20 bp, human
gcctccccggactcctcccg

SEQ ID NO: 88002 - DNA, 20 bp, human
gcccgaagggtgaggctcgg

SEQ ID NO: 88003 - DNA, 20 bp, human
gtacaacttggaggcggcgg

SEQ ID NO: 88004 - DNA, 20 bp, human
gcatcagcagcgaggactac

SEQ ID NO: 88005 - DNA, 20 bp, human
ggccgcctccaagttgtaag

SEQ ID NO: 88006 - DNA, 20 bp, human
gggcagcagtagcagcaata

SEQ ID NO: 88007 - DNA, 20 bp, human
gcggggccaacgcatgtggt

SEQ ID NO: 88008 - DNA, 20 bp, human
ggtggcagcacacggtccac

SEQ ID NO: 88009 - DNA, 20 bp, human
gccgtgtgctgccactgcgg

SEQ ID NO: 88010 - DNA, 20 bp, human
gggaggaggaggacgcgtct

SEQ ID NO: 88011 - DNA, 20 bp, human
gcttcgtcttgcccccgcag

SEQ ID NO: 88012 - DNA, 20 bp, human
gcagccggggccaacgcatg

SEQ ID NO: 88013 - DNA, 20 bp, human
ggttggccccggctgtcgca

SEQ ID NO: 88014 - DNA, 20 bp, human
gccagagcaagatgatgaag

SEQ ID NO: 88015 - DNA, 20 bp, human
ggaaagcccaccacatgcgt

SEQ ID NO: 88016 - DNA, 20 bp, human
gcaatgctggcacttgtcac

SEQ ID NO: 88017 - DNA, 20 bp, human
gaggacagccccgagaggaa

SEQ ID NO: 88018 - DNA, 20 bp, human
gcttgtcaccggtagagagg

SEQ ID NO: 88019 - DNA, 20 bp, human
gccagaaggacagccccgag

SEQ ID NO: 88020 - DNA, 20 bp, human
ggcacttgtcaccggtagag

SEQ ID NO: 88021 - DNA, 20 bp, human
ggcctccccgcccgtctcca

SEQ ID NO: 88022 - DNA, 20 bp, human
ggggaaagcagcctgccacg

SEQ ID NO: 88023 - DNA, 20 bp, human
ggcttccctggagacgggcg

SEQ ID NO: 88024 - DNA, 20 bp, human
gtctgctgctcaagacccac

SEQ ID NO: 88025 - DNA, 20 bp, human
gactgggacctagagggcca

SEQ ID NO: 88026 - DNA, 20 bp, human
ggtcgtctcatgagacccag

SEQ ID NO: 88027 - DNA, 20 bp, human
ggcgtactgcatacttggat

SEQ ID NO: 88028 - DNA, 20 bp, human
gatgagacccaggggcatgt

SEQ ID NO: 88029 - DNA, 20 bp, human
gagcggcgagtggtgtgaga

SEQ ID NO: 88030 - DNA, 20 bp, human
gcaagagcgtactgcatact

SEQ ID NO: 88031 - DNA, 20 bp, human
gattggtgatacacaaagag

SEQ ID NO: 88032 - DNA, 20 bp, human
gttctttccaacatgcccct

SEQ ID NO: 88033 - DNA, 20 bp, human
gctataaagtcaggagtgga

SEQ ID NO: 88034 - DNA, 20 bp, human
gagagcaacaaagcggcgag

SEQ ID NO: 88035 - DNA, 20 bp, human
gacatgaggacttgtgagaa

SEQ ID NO: 88036 - DNA, 20 bp, human
gtggaaatctgatccagtgc

SEQ ID NO: 88037 - DNA, 20 bp, human
ggaaggacaataggagtgac

SEQ ID NO: 88038 - DNA, 20 bp, human
ggaaacagcatgcctatcat

SEQ ID NO: 88039 - DNA, 20 bp, human
ggcctggagccagtttgtcc

SEQ ID NO: 88040 - DNA, 20 bp, human
gaagatgtgacaactaccgg

SEQ ID NO: 88041 - DNA, 20 bp, human
gtttaaagcgtgcaggaggt

SEQ ID NO: 88042 - DNA, 20 bp, human
gatgcttgaaattagttatc

SEQ ID NO: 88043 - DNA, 20 bp, human
gcagtatgaagcagctttaa

SEQ ID NO: 88044 - DNA, 20 bp, human
gggatttattagcctatgat

SEQ ID NO: 88045 - DNA, 20 bp, human
gtccaggacaaactggctcc

SEQ ID NO: 88046 - DNA, 20 bp, human
ggcaagggtcaggaggcgac

SEQ ID NO: 88047 - DNA, 20 bp, human
gctggctctttcatatctga

SEQ ID NO: 88048 - DNA, 20 bp, human
gcagagtacagaagcaggta

SEQ ID NO: 88049 - DNA, 20 bp, human
ggcagtggaagcccaaaacg

SEQ ID NO: 88050 - DNA, 20 bp, human
gagggatcacaacgaagaag

SEQ ID NO: 88051 - DNA, 20 bp, human
gggtgaagaaaaaggattaa

SEQ ID NO: 88052 - DNA, 20 bp, human
gactgacagaaagtcagcag

SEQ ID NO: 88053 - DNA, 20 bp, human
gctgcttctgtactctgcac

SEQ ID NO: 88054 - DNA, 20 bp, human
gcagcaggaactgagagcaa

SEQ ID NO: 88055 - DNA, 20 bp, human
ggtccaatgcctctccctgt

SEQ ID NO: 88056 - DNA, 20 bp, human
ggcgatggcgaagctccggg

SEQ ID NO: 88057 - DNA, 20 bp, human
ggccagccgccgagagtggg

SEQ ID NO: 88058 - DNA, 20 bp, human
gaggccagcgacgcccccgg

SEQ ID NO: 88059 - DNA, 20 bp, human
gcctgtggcgccgactgcag

SEQ ID NO: 88060 - DNA, 20 bp, human
ggggcgagtcagcggagtag

SEQ ID NO: 88061 - DNA, 20 bp, human
gagagacacccgacgagagg

SEQ ID NO: 88062 - DNA, 20 bp, human
gggagcgcgcgagaacaaag

SEQ ID NO: 88063 - DNA, 20 bp, human
gcgccatcgccccccactct

SEQ ID NO: 88064 - DNA, 20 bp, human
gcgggtggcttacgagtaca

SEQ ID NO: 88065 - DNA, 20 bp, human
gcagagagacacccgacgag

SEQ ID NO: 88066 - DNA, 20 bp, human
gacgcctgcaccctcctcag

SEQ ID NO: 88067 - DNA, 20 bp, human
gtgcggcggccgactccggc

SEQ ID NO: 88068 - DNA, 20 bp, human
ggccacaacgcaaggagaaa

SEQ ID NO: 88069 - DNA, 20 bp, human
ggccactcaccggccggagt

SEQ ID NO: 88070 - DNA, 20 bp, human
gcgaagacaagtgcacggcc

SEQ ID NO: 88071 - DNA, 20 bp, human
ggcagggactccggctgcgg

SEQ ID NO: 88072 - DNA, 20 bp, human
gttgtcttcgcgctcgggca

SEQ ID NO: 88073 - DNA, 20 bp, human
ggccaggctgcgcagtagga

SEQ ID NO: 88074 - DNA, 20 bp, human
ggccgactccggccggtgag

SEQ ID NO: 88075 - DNA, 20 bp, human
gcaagtgcacggccgggcaa

SEQ ID NO: 88076 - DNA, 20 bp, human
gctgcagggagaccaagcgg

SEQ ID NO: 88077 - DNA, 20 bp, human
gagcaggacgagcccgacag

SEQ ID NO: 88078 - DNA, 20 bp, human
gtactgctgccggagcgcac

SEQ ID NO: 88079 - DNA, 20 bp, human
gcaatggggtttccatgtca

SEQ ID NO: 88080 - DNA, 20 bp, human
gccgcgctggaactgcaatg

SEQ ID NO: 88081 - DNA, 20 bp, human
ggaggaggtgcgggtccgga

SEQ ID NO: 88082 - DNA, 20 bp, human
ggcacctcctcgccgctgtc

SEQ ID NO: 88083 - DNA, 20 bp, human
gcgcaccagcagccggccag

SEQ ID NO: 88084 - DNA, 20 bp, human
gggcgcagctgttgcaccgg

SEQ ID NO: 88085 - DNA, 20 bp, human
gcagccatgccagtgcgctc

SEQ ID NO: 88086 - DNA, 20 bp, human
ggctgcagcgagggtcccag

SEQ ID NO: 88087 - DNA, 20 bp, human
gggtcctctaggagcgtgtg

SEQ ID NO: 88088 - DNA, 20 bp, human
gtctcaggaggtggtcctct

SEQ ID NO: 88089 - DNA, 20 bp, human
gtggcctcacacgctcctag

SEQ ID NO: 88090 - DNA, 20 bp, human
gaaagaactctctcaggagg

SEQ ID NO: 88091 - DNA, 20 bp, human
gggggtgaaagaactctctc

SEQ ID NO: 88092 - DNA, 20 bp, human
ggtgcccctgtccatcctct

SEQ ID NO: 88093 - DNA, 20 bp, human
gcgaagctattgagccagcg

SEQ ID NO: 88094 - DNA, 20 bp, human
ggggcacttccatgactcgg

SEQ ID NO: 88095 - DNA, 20 bp, human
gggcttgcttcggttctctg

SEQ ID NO: 88096 - DNA, 20 bp, human
gcactggtgctggcaggaac

SEQ ID NO: 88097 - DNA, 20 bp, human
gcccacctcgcagcacgcac

SEQ ID NO: 88098 - DNA, 20 bp, human
gctggagcaggagaagtctc

SEQ ID NO: 88099 - DNA, 20 bp, human
gggtcgtcagcctgctctgc

SEQ ID NO: 88100 - DNA, 20 bp, human
gggccgtcaccactccccag

SEQ ID NO: 88101 - DNA, 20 bp, human
gccctgtgcgtgctgcgagg

SEQ ID NO: 88102 - DNA, 20 bp, human
gagcaggagaagtctctggc

SEQ ID NO: 88103 - DNA, 20 bp, human
gccactccccagagggcaca

SEQ ID NO: 88104 - DNA, 20 bp, human
gagagatgctgtggttcggg

SEQ ID NO: 88105 - DNA, 20 bp, human
gggcagccactgtggcttgc

SEQ ID NO: 88106 - DNA, 20 bp, human
gtggcgcgcacccacgtcca

SEQ ID NO: 88107 - DNA, 20 bp, human
gtagacgcggccctggacgt

SEQ ID NO: 88108 - DNA, 20 bp, human
ggtgggtgcgcgccaacacc

SEQ ID NO: 88109 - DNA, 20 bp, human
gggtgcgcgccaacaccggg

SEQ ID NO: 88110 - DNA, 20 bp, human
gcaaggtcggaggcaactgg

SEQ ID NO: 88111 - DNA, 20 bp, human
ggccggtggcgatactcaca

SEQ ID NO: 88112 - DNA, 20 bp, human
gggaggccgcggccataacg

SEQ ID NO: 88113 - DNA, 20 bp, human
gcgccagctccagcgagaag

SEQ ID NO: 88114 - DNA, 20 bp, human
gccagccggtgggacgctcg

SEQ ID NO: 88115 - DNA, 20 bp, human
ggcagcgaaggcgagcgccc

SEQ ID NO: 88116 - DNA, 20 bp, human
gaggtgcgcgcggagcgagg

SEQ ID NO: 88117 - DNA, 20 bp, human
ggggagccgcatggccgagg

SEQ ID NO: 88118 - DNA, 20 bp, human
gtggtgcagaagtcgcgcaa

SEQ ID NO: 88119 - DNA, 20 bp, human
gcccaagcccggcaggagtg

SEQ ID NO: 88120 - DNA, 20 bp, human
gtgcagaagtcgcgcaacgg

SEQ ID NO: 88121 - DNA, 20 bp, human
ggcgggcaggaaggattccg

SEQ ID NO: 88122 - DNA, 20 bp, human
ggggagtgctgggccgagac

SEQ ID NO: 88123 - DNA, 20 bp, human
gcccccatggcgacccccat

SEQ ID NO: 88124 - DNA, 20 bp, human
gagaaggcgttgcgcttggg

SEQ ID NO: 88125 - DNA, 20 bp, human
ggctgaaggtgggcttcgtg

SEQ ID NO: 88126 - DNA, 20 bp, human
gcaaaggcgggccccctggg

SEQ ID NO: 88127 - DNA, 20 bp, human
gtggaaccggcgctccgggg

SEQ ID NO: 88128 - DNA, 20 bp, human
gcccagagcagcagcggaga

SEQ ID NO: 88129 - DNA, 20 bp, human
gcgacgaggagcggaaagtg

SEQ ID NO: 88130 - DNA, 20 bp, human
ggggctcaaggcgcgcaggg

SEQ ID NO: 88131 - DNA, 20 bp, human
ggcctggaaccggcgctccg

SEQ ID NO: 88132 - DNA, 20 bp, human
gtgggaagaaggggcgctcg

SEQ ID NO: 88133 - DNA, 20 bp, human
gcggcgggggcgaggcagat

SEQ ID NO: 88134 - DNA, 20 bp, human
gtcatggcattggagttccc

SEQ ID NO: 88135 - DNA, 20 bp, human
ggaggcgctagggcgcgcgg

SEQ ID NO: 88136 - DNA, 20 bp, human
ggagcgcgtaataagagagt

SEQ ID NO: 88137 - DNA, 20 bp, human
gcccgcttccccggcgactg

SEQ ID NO: 88138 - DNA, 20 bp, human
gcggccgtgcagagcgaaca

SEQ ID NO: 88139 - DNA, 20 bp, human
ggtaataagagagttggagt

SEQ ID NO: 88140 - DNA, 20 bp, human
gagagcagccccagtcgccg

SEQ ID NO: 88141 - DNA, 20 bp, human
gcactgacctcccgcttccc

SEQ ID NO: 88142 - DNA, 20 bp, human
ggcgggcgctcggagcctgg

SEQ ID NO: 88143 - DNA, 20 bp, human
gtcgcctttccacctgccac

SEQ ID NO: 88144 - DNA, 20 bp, human
ggggccagaggggcgacccg

SEQ ID NO: 88145 - DNA, 20 bp, human
ggcccgggcacggtccgggg

SEQ ID NO: 88146 - DNA, 20 bp, human
ggcgccggcgggtttcaagg

SEQ ID NO: 88147 - DNA, 20 bp, human
gaggaagccggcggccgacg

SEQ ID NO: 88148 - DNA, 20 bp, human
gtgggtgaagagcggcgcag

SEQ ID NO: 88149 - DNA, 20 bp, human
gggcagcggcatgaaggatg

SEQ ID NO: 88150 - DNA, 20 bp, human
gcgccaccacgcgggaggag

SEQ ID NO: 88151 - DNA, 20 bp, human
gcagcgacgtagcagcggga

SEQ ID NO: 88152 - DNA, 20 bp, human
gggctactcgtgtaagagag

SEQ ID NO: 88153 - DNA, 20 bp, human
gctgcagcgggcatagcagg

SEQ ID NO: 88154 - DNA, 20 bp, human
ggaactcgcgcctcggagag

SEQ ID NO: 88155 - DNA, 20 bp, human
gaggatgtggagtccggccg

SEQ ID NO: 88156 - DNA, 20 bp, human
ggtggaagtaaggtcatctg

SEQ ID NO: 88157 - DNA, 20 bp, human
ggagggaagaatgagtagtc

SEQ ID NO: 88158 - DNA, 20 bp, human
gggtaagaaggtctttgtgg

SEQ ID NO: 88159 - DNA, 20 bp, human
gtcttggctgtagcaggtat

SEQ ID NO: 88160 - DNA, 20 bp, human
gcttcagcgccgacctggaa

SEQ ID NO: 88161 - DNA, 20 bp, human
gagaatgagtagtcaggaac

SEQ ID NO: 88162 - DNA, 20 bp, human
gacactggaaaaccaggtca

SEQ ID NO: 88163 - DNA, 20 bp, human
gttccctcacttcaaactag

SEQ ID NO: 88164 - DNA, 20 bp, human
gtagcctctagtttgaagtg

SEQ ID NO: 88165 - DNA, 20 bp, human
gagggaagatattcacgaca

SEQ ID NO: 88166 - DNA, 20 bp, human
gcctccggcagcgatcgatg

SEQ ID NO: 88167 - DNA, 20 bp, human
ggagccacgtccctccccaa

SEQ ID NO: 88168 - DNA, 20 bp, human
gggaggtgccaccacaggta

SEQ ID NO: 88169 - DNA, 20 bp, human
gggaggccccttacctgtgg

SEQ ID NO: 88170 - DNA, 20 bp, human
gccttcagccgcgggggact

SEQ ID NO: 88171 - DNA, 20 bp, human
gggtcccgggcagccagagt

SEQ ID NO: 88172 - DNA, 20 bp, human
gatgcggccttcagccgcgg

SEQ ID NO: 88173 - DNA, 20 bp, human
gccctacaccaaccctgcca

SEQ ID NO: 88174 - DNA, 20 bp, human
gggtgctcaaaataagtgtg

SEQ ID NO: 88175 - DNA, 20 bp, human
gcgagaccgagtatagccag

SEQ ID NO: 88176 - DNA, 20 bp, human
gccggagctgagatacgcac

SEQ ID NO: 88177 - DNA, 20 bp, human
ggcgcccaccgagacccctg

SEQ ID NO: 88178 - DNA, 20 bp, human
gaacccgcgggcgagcatcg

SEQ ID NO: 88179 - DNA, 20 bp, human
gctccggtcccgcctgtctg

SEQ ID NO: 88180 - DNA, 20 bp, human
ggcatgctgaccttgtccat

SEQ ID NO: 88181 - DNA, 20 bp, human
gcgggccgcgggaatgaggg

SEQ ID NO: 88182 - DNA, 20 bp, human
gggtcagcatgcagccccct

SEQ ID NO: 88183 - DNA, 20 bp, human
gccaccccaggggtctcggt

SEQ ID NO: 88184 - DNA, 20 bp, human
gccgggcctgcccatggaca

SEQ ID NO: 88185 - DNA, 20 bp, human
gcgcggctctgagcgcccag

SEQ ID NO: 88186 - DNA, 20 bp, human
gcctggaccacaggagactg

SEQ ID NO: 88187 - DNA, 20 bp, human
ggcgggaccgacggacagac

SEQ ID NO: 88188 - DNA, 20 bp, human
gctgcagggatcaggcctcg

SEQ ID NO: 88189 - DNA, 20 bp, human
gcgccgtcgctggagcccta

SEQ ID NO: 88190 - DNA, 20 bp, human
gtcgatgagccgaagaaagg

SEQ ID NO: 88191 - DNA, 20 bp, human
gtctagcggggcgggaccga

SEQ ID NO: 88192 - DNA, 20 bp, human
gcgtcggccggtctgtccgt

SEQ ID NO: 88193 - DNA, 20 bp, human
ggaactgcgggctgttgaag

SEQ ID NO: 88194 - DNA, 20 bp, human
gcgcaacaggcggagcctta

SEQ ID NO: 88195 - DNA, 20 bp, human
gctgcggccgtagaccctcg

SEQ ID NO: 88196 - DNA, 20 bp, human
ggctggcaccaacaagatcg

SEQ ID NO: 88197 - DNA, 20 bp, human
gtgccgcgctcgccgtccga

SEQ ID NO: 88198 - DNA, 20 bp, human
gccccactccccccacgtag

SEQ ID NO: 88199 - DNA, 20 bp, human
gagcccgtgaggctcctcgg

SEQ ID NO: 88200 - DNA, 20 bp, human
ggccgagcgctcccgcagga

SEQ ID NO: 88201 - DNA, 20 bp, human
gcccacgtaggggctgaaca

SEQ ID NO: 88202 - DNA, 20 bp, human
gtcgccgtccgagggcaagg

SEQ ID NO: 88203 - DNA, 20 bp, human
gtcggggctcctgtgggaca

SEQ ID NO: 88204 - DNA, 20 bp, human
ggctgtggtgggcttaggag

SEQ ID NO: 88205 - DNA, 20 bp, human
ggcgctcccgcaggatggcg

SEQ ID NO: 88206 - DNA, 20 bp, human
gcagcagcaggtcccggaag

SEQ ID NO: 88207 - DNA, 20 bp, human
gcccgcccggtgggtcgcgg

SEQ ID NO: 88208 - DNA, 20 bp, human
gggacgcagaagtttcggag

SEQ ID NO: 88209 - DNA, 20 bp, human
ggcggccaccgcgacccacc

SEQ ID NO: 88210 - DNA, 20 bp, human
gccgcccgcccggtgggtcg

SEQ ID NO: 88211 - DNA, 20 bp, human
gcagggggaagcatcttctc

SEQ ID NO: 88212 - DNA, 20 bp, human
gctcgggagggggtctccgg

SEQ ID NO: 88213 - DNA, 20 bp, human
gagcggtagcgcggcggcaa

SEQ ID NO: 88214 - DNA, 20 bp, human
gtccagaacgacgacaggta

SEQ ID NO: 88215 - DNA, 20 bp, human
gcccggaagcggtagcgcgg

SEQ ID NO: 88216 - DNA, 20 bp, human
gtattgcggagtacagggag

SEQ ID NO: 88217 - DNA, 20 bp, human
gagacgctgtggccgagaga

SEQ ID NO: 88218 - DNA, 20 bp, human
gctgtggccgagagagggat

SEQ ID NO: 88219 - DNA, 20 bp, human
ggaggactaacaagacgctg

SEQ ID NO: 88220 - DNA, 20 bp, human
gtgtataaggctggtatcag

SEQ ID NO: 88221 - DNA, 20 bp, human
gcgacgacaggtgagtggtg

SEQ ID NO: 88222 - DNA, 20 bp, human
gctcgaaacctgtacctggg

SEQ ID NO: 88223 - DNA, 20 bp, human
ggaaaatattgcggagtaca

SEQ ID NO: 88224 - DNA, 20 bp, human
gagagagggagactaggctg

SEQ ID NO: 88225 - DNA, 20 bp, human
gataactgttgctatagata

SEQ ID NO: 88226 - DNA, 20 bp, human
gcacagagggatccctaaca

SEQ ID NO: 88227 - DNA, 20 bp, human
gccactgaagaaggtcacaa

SEQ ID NO: 88228 - DNA, 20 bp, human
gacggcgtcatcaaatgacc

SEQ ID NO: 88229 - DNA, 20 bp, human
gtggcttaccaccctttctg

SEQ ID NO: 88230 - DNA, 20 bp, human
gatagcctggtgcctcagaa

SEQ ID NO: 88231 - DNA, 20 bp, human
gttctgaggcctgaagagac

SEQ ID NO: 88232 - DNA, 20 bp, human
gctcttctctctcccatcac

SEQ ID NO: 88233 - DNA, 20 bp, human
ggggtggtaagccagacctc

SEQ ID NO: 88234 - DNA, 20 bp, human
gcatctctgacttcacacag

SEQ ID NO: 88235 - DNA, 20 bp, human
gaagctacgaaatgaaactt

SEQ ID NO: 88236 - DNA, 20 bp, human
gtgactcgaccggtccagga

SEQ ID NO: 88237 - DNA, 20 bp, human
gggtctgactcgaccggtcc

SEQ ID NO: 88238 - DNA, 20 bp, human
gacgaggtggaccctcgaca

SEQ ID NO: 88239 - DNA, 20 bp, human
gacgtgaggtctgactcgac

SEQ ID NO: 88240 - DNA, 20 bp, human
gggtggaccctcgacagggt

SEQ ID NO: 88241 - DNA, 20 bp, human
gacctcacgtgtagactaag

SEQ ID NO: 88242 - DNA, 20 bp, human
ggctctccgggaaacttgta

SEQ ID NO: 88243 - DNA, 20 bp, human
gcagcttccaggggccccgt

SEQ ID NO: 88244 - DNA, 20 bp, human
gcaccccgagtccaacaggt

SEQ ID NO: 88245 - DNA, 20 bp, human
gcagtgggtcactaagaact

SEQ ID NO: 88246 - DNA, 20 bp, human
gctgcccaggacctgagaag

SEQ ID NO: 88247 - DNA, 20 bp, human
ggaccagtggaaggacgacc

SEQ ID NO: 88248 - DNA, 20 bp, human
gcccggaccagcacagctag

SEQ ID NO: 88249 - DNA, 20 bp, human
gacatcgaggaagacgaaga

SEQ ID NO: 88250 - DNA, 20 bp, human
gtgagaaggggcagctccgg

SEQ ID NO: 88251 - DNA, 20 bp, human
gggaacacgacggagaatga

SEQ ID NO: 88252 - DNA, 20 bp, human
ggactgcgttcagaccctgc

SEQ ID NO: 88253 - DNA, 20 bp, human
gtgccaggtcgtccttccac

SEQ ID NO: 88254 - DNA, 20 bp, human
gggggctcagacattgccac

SEQ ID NO: 88255 - DNA, 20 bp, human
gccacgctgaatgtgaacgt

SEQ ID NO: 88256 - DNA, 20 bp, human
gcccccgaggtgcaggagaa

SEQ ID NO: 88257 - DNA, 20 bp, human
gaggagaagggacagcgcag

SEQ ID NO: 88258 - DNA, 20 bp, human
gagggaggcgcgcgaacctc

SEQ ID NO: 88259 - DNA, 20 bp, human
ggagctagcatggccggggt

SEQ ID NO: 88260 - DNA, 20 bp, human
gggcggagctagcatggccg

SEQ ID NO: 88261 - DNA, 20 bp, human
gggcgcgcgaacctcaggca

SEQ ID NO: 88262 - DNA, 20 bp, human
ggccagggcccccgaggtgc

SEQ ID NO: 88263 - DNA, 20 bp, human
ggagcgaggcggagctagca

SEQ ID NO: 88264 - DNA, 20 bp, human
gctcaggccgggctgatagg

SEQ ID NO: 88265 - DNA, 20 bp, human
ggcaggacaggcgggaatgg

SEQ ID NO: 88266 - DNA, 20 bp, human
gctcgggagagagccctcag

SEQ ID NO: 88267 - DNA, 20 bp, human
gagctagtgtgcgaattcag

SEQ ID NO: 88268 - DNA, 20 bp, human
gcacaggagggaaagcgtcc

SEQ ID NO: 88269 - DNA, 20 bp, human
ggggagccactggggaatct

SEQ ID NO: 88270 - DNA, 20 bp, human
gaggagggaaagcgtcctgg

SEQ ID NO: 88271 - DNA, 20 bp, human
gtgtgcagcctagggttgag

SEQ ID NO: 88272 - DNA, 20 bp, human
gggcgtggccctgacacgga

SEQ ID NO: 88273 - DNA, 20 bp, human
gaggtgtgagaggtgacgag

SEQ ID NO: 88274 - DNA, 20 bp, human
gctcagagggcatgtggaca

SEQ ID NO: 88275 - DNA, 20 bp, human
gtatccttaagggccacctg

SEQ ID NO: 88276 - DNA, 20 bp, human
gtggcagagagacggcaata

SEQ ID NO: 88277 - DNA, 20 bp, human
gcgtctctctgccagtcctc

SEQ ID NO: 88278 - DNA, 20 bp, human
gtggcgagaatgcctggcag

SEQ ID NO: 88279 - DNA, 20 bp, human
gcccggggcgccagcagtcg

SEQ ID NO: 88280 - DNA, 20 bp, human
gcaggaggtgcagataacgg

SEQ ID NO: 88281 - DNA, 20 bp, human
ggcaatatggcgagaatgcc

SEQ ID NO: 88282 - DNA, 20 bp, human
ggaggaggacgagatccagg

SEQ ID NO: 88283 - DNA, 20 bp, human
gatccaggaggtgcagataa

SEQ ID NO: 88284 - DNA, 20 bp, human
gtactgcagcgcgggcgagg

SEQ ID NO: 88285 - DNA, 20 bp, human
ggaggaggaggacgagatcc

SEQ ID NO: 88286 - DNA, 20 bp, human
gtccaaacccggactgagag

SEQ ID NO: 88287 - DNA, 20 bp, human
gccctaccatgaaaagtcgg

SEQ ID NO: 88288 - DNA, 20 bp, human
gccctcaacccctagtccat

SEQ ID NO: 88289 - DNA, 20 bp, human
gtgaggggcagtcacgatag

SEQ ID NO: 88290 - DNA, 20 bp, human
gatgaaaagtcggaggacgc

SEQ ID NO: 88291 - DNA, 20 bp, human
gggcagtcacgatagtggag

SEQ ID NO: 88292 - DNA, 20 bp, human
gggcggtgcccatggactag

SEQ ID NO: 88293 - DNA, 20 bp, human
gcctccctaccatgaaaagt

SEQ ID NO: 88294 - DNA, 20 bp, human
ggctttgggtggagaattag

SEQ ID NO: 88295 - DNA, 20 bp, human
ggcctctctcagtccgggtt

SEQ ID NO: 88296 - DNA, 20 bp, human
ggcggctgcggcgacaccca

SEQ ID NO: 88297 - DNA, 20 bp, human
gcccttaggccacttcctgg

SEQ ID NO: 88298 - DNA, 20 bp, human
ggagaggacctcagcggctg

SEQ ID NO: 88299 - DNA, 20 bp, human
gggccgggtcccgaaactcc

SEQ ID NO: 88300 - DNA, 20 bp, human
gccgggctgggagtgtccga

SEQ ID NO: 88301 - DNA, 20 bp, human
ggagtgtccgagggctctga

SEQ ID NO: 88302 - DNA, 20 bp, human
gggatggcctccgagacccc

SEQ ID NO: 88303 - DNA, 20 bp, human
gctccccggcggatacaagg

SEQ ID NO: 88304 - DNA, 20 bp, human
gtggctggactcgtccacgg

SEQ ID NO: 88305 - DNA, 20 bp, human
gggtcagcgacacccctctg

SEQ ID NO: 88306 - DNA, 20 bp, human
gggagcgcactggaactcaa

SEQ ID NO: 88307 - DNA, 20 bp, human
gtccgcgcggctctaggagg

SEQ ID NO: 88308 - DNA, 20 bp, human
ggccacggcaccagagcagg

SEQ ID NO: 88309 - DNA, 20 bp, human
gcagcgcgcgggccgcgacc

SEQ ID NO: 88310 - DNA, 20 bp, human
gagctggcccgggacagcaa

SEQ ID NO: 88311 - DNA, 20 bp, human
gtaccgggcgaggggaggtg

SEQ ID NO: 88312 - DNA, 20 bp, human
ggcgcggctctaggaggtgg

SEQ ID NO: 88313 - DNA, 20 bp, human
gcggcgctgcacggtggtgt

SEQ ID NO: 88314 - DNA, 20 bp, human
gaactcaagggggcgcacag

SEQ ID NO: 88315 - DNA, 20 bp, human
gccacgatgtcggggaagag

SEQ ID NO: 88316 - DNA, 20 bp, human
gccgatgccggaggtacgag

SEQ ID NO: 88317 - DNA, 20 bp, human
ggggtggtgcgagcgagatg

SEQ ID NO: 88318 - DNA, 20 bp, human
gcggtcttgcagagtagctg

SEQ ID NO: 88319 - DNA, 20 bp, human
gggccaggctcgagacccga

SEQ ID NO: 88320 - DNA, 20 bp, human
gctggggtgggggcacggta

SEQ ID NO: 88321 - DNA, 20 bp, human
gaggtgctgaccgatgccgg

SEQ ID NO: 88322 - DNA, 20 bp, human
ggtcagcggcttgagaccgt

SEQ ID NO: 88323 - DNA, 20 bp, human
gcccggcgccggcttccggg

SEQ ID NO: 88324 - DNA, 20 bp, human
gcggccggcccccagccctt

SEQ ID NO: 88325 - DNA, 20 bp, human
gccggtggtgagagactgcg

SEQ ID NO: 88326 - DNA, 20 bp, human
ggccggtggggaagagacaa

SEQ ID NO: 88327 - DNA, 20 bp, human
ggcgcagtggagcggccagt

SEQ ID NO: 88328 - DNA, 20 bp, human
ggcctgggccggggggactg

SEQ ID NO: 88329 - DNA, 20 bp, human
gaaagacccaatgtagaggg

SEQ ID NO: 88330 - DNA, 20 bp, human
gggcccaagtgatctgcatg

SEQ ID NO: 88331 - DNA, 20 bp, human
ggtcgtgggctaggacaagc

SEQ ID NO: 88332 - DNA, 20 bp, human
ggacagcgcgccagaagcag

SEQ ID NO: 88333 - DNA, 20 bp, human
gtgggctaggacaagccggt

SEQ ID NO: 88334 - DNA, 20 bp, human
gctggccgagctggttggat

SEQ ID NO: 88335 - DNA, 20 bp, human
gcgaccagcccgaggtgaag

SEQ ID NO: 88336 - DNA, 20 bp, human
gcgacccgcgcagcgagcat

SEQ ID NO: 88337 - DNA, 20 bp, human
gtgcgcccggcgcccgagac

SEQ ID NO: 88338 - DNA, 20 bp, human
gcccgcgcagcgagcatagg

SEQ ID NO: 88339 - DNA, 20 bp, human
gggcgctcggcccagaacag

SEQ ID NO: 88340 - DNA, 20 bp, human
gccacgcagctgccggtctc

SEQ ID NO: 88341 - DNA, 20 bp, human
gagtaactccaggacgagac

SEQ ID NO: 88342 - DNA, 20 bp, human
gggtcgctccggtctcgtcc

SEQ ID NO: 88343 - DNA, 20 bp, human
ggcccagcagagggacaaag

SEQ ID NO: 88344 - DNA, 20 bp, human
gctcgctgcgcgggtcgctc

SEQ ID NO: 88345 - DNA, 20 bp, human
gtaggcggcgaagctgcgcc

SEQ ID NO: 88346 - DNA, 20 bp, human
ggccctgatgagaggaggtt

SEQ ID NO: 88347 - DNA, 20 bp, human
gcgcagcgcagagatgccgg

SEQ ID NO: 88348 - DNA, 20 bp, human
gcacagttcccagtgcagtt

SEQ ID NO: 88349 - DNA, 20 bp, human
ggctccgccgccagagaagc

SEQ ID NO: 88350 - DNA, 20 bp, human
ggcgcagagatgccggcggg

SEQ ID NO: 88351 - DNA, 20 bp, human
gacccaacctcctctcatca

SEQ ID NO: 88352 - DNA, 20 bp, human
gcaacgcagcgcagagatgc

SEQ ID NO: 88353 - DNA, 20 bp, human
gggagccccgggccccccgc

SEQ ID NO: 88354 - DNA, 20 bp, human
gacagcatccgaactgcact

SEQ ID NO: 88355 - DNA, 20 bp, human
gaggtagccaccccacctgc

SEQ ID NO: 88356 - DNA, 20 bp, human
gtcggaccgggtgaggcccc

SEQ ID NO: 88357 - DNA, 20 bp, human
gggcccgacagccccgcgtc

SEQ ID NO: 88358 - DNA, 20 bp, human
gaaggagaggccccgatccg

SEQ ID NO: 88359 - DNA, 20 bp, human
ggcggctggagagcttctaa

SEQ ID NO: 88360 - DNA, 20 bp, human
ggacgccgcggccggcgatg

SEQ ID NO: 88361 - DNA, 20 bp, human
ggaggtgggtctggtagtga

SEQ ID NO: 88362 - DNA, 20 bp, human
gccgcggccggcgatgagga

SEQ ID NO: 88363 - DNA, 20 bp, human
gcggcctccatcctcatcgc

SEQ ID NO: 88364 - DNA, 20 bp, human
ggaggaggatgcagacgccg

SEQ ID NO: 88365 - DNA, 20 bp, human
gtccacagccccaaaggaga

SEQ ID NO: 88366 - DNA, 20 bp, human
gtccaggccgcggaagaccg

SEQ ID NO: 88367 - DNA, 20 bp, human
ggcgggccgcaggtcagtct

SEQ ID NO: 88368 - DNA, 20 bp, human
gtccgccccgcggcgtccgg

SEQ ID NO: 88369 - DNA, 20 bp, human
ggcccgccagaccctcggcg

SEQ ID NO: 88370 - DNA, 20 bp, human
gggcggccgcgccgagggtc

SEQ ID NO: 88371 - DNA, 20 bp, human
ggagccagaaagccccgcca

SEQ ID NO: 88372 - DNA, 20 bp, human
gcctcagaaagtctgaggag

SEQ ID NO: 88373 - DNA, 20 bp, human
gatcataggaatgcactctg

SEQ ID NO: 88374 - DNA, 20 bp, human
gcggctcttccgcaccgggg

SEQ ID NO: 88375 - DNA, 20 bp, human
gcggcctggagaccccaaat

SEQ ID NO: 88376 - DNA, 20 bp, human
gtggagccgcgaccatggta

SEQ ID NO: 88377 - DNA, 20 bp, human
ggcgtggggacagaactcta

SEQ ID NO: 88378 - DNA, 20 bp, human
gcagagcgggctccgtacca

SEQ ID NO: 88379 - DNA, 20 bp, human
ggggctccgtaccatggtcg

SEQ ID NO: 88380 - DNA, 20 bp, human
ggctgctggagccgcgacca

SEQ ID NO: 88381 - DNA, 20 bp, human
gtacggagcccgctctggcg

SEQ ID NO: 88382 - DNA, 20 bp, human
gcttgtgacccggccaataa

SEQ ID NO: 88383 - DNA, 20 bp, human
gggggagctccagatctgaa

SEQ ID NO: 88384 - DNA, 20 bp, human
ggcaccaaagcggcgaatgg

SEQ ID NO: 88385 - DNA, 20 bp, human
gggcgccaaaagcaccaaag

SEQ ID NO: 88386 - DNA, 20 bp, human
gaggcccctgcgagtagtgt

SEQ ID NO: 88387 - DNA, 20 bp, human
gagcgtgtctcaggactctg

SEQ ID NO: 88388 - DNA, 20 bp, human
gccgatctacgagaaaccag

SEQ ID NO: 88389 - DNA, 20 bp, human
gctgcagctggacccggcga

SEQ ID NO: 88390 - DNA, 20 bp, human
gcccgggccttcgaaccccc

SEQ ID NO: 88391 - DNA, 20 bp, human
gcagctggacccggcgatgg

SEQ ID NO: 88392 - DNA, 20 bp, human
gcaaggtgtgccccgccctc

SEQ ID NO: 88393 - DNA, 20 bp, human
gcctgtgaggagcgtgtctc

SEQ ID NO: 88394 - DNA, 20 bp, human
gcggcctaaggtctgtctgg

SEQ ID NO: 88395 - DNA, 20 bp, human
gcccctgcgagtagtgtggg

SEQ ID NO: 88396 - DNA, 20 bp, human
gctgggcgcgaggaacctgt

SEQ ID NO: 88397 - DNA, 20 bp, human
ggacgctgcgcccaggtggt

SEQ ID NO: 88398 - DNA, 20 bp, human
gcggcgggatgaaccacccg

SEQ ID NO: 88399 - DNA, 20 bp, human
ggctgcggcacagccggtcc

SEQ ID NO: 88400 - DNA, 20 bp, human
gcgccgcgctgtcccgctcg

SEQ ID NO: 88401 - DNA, 20 bp, human
ggcacagccggtcccggctg

SEQ ID NO: 88402 - DNA, 20 bp, human
gggttctcgccattcctctc

SEQ ID NO: 88403 - DNA, 20 bp, human
ggggagcgacgagtaagtgg

SEQ ID NO: 88404 - DNA, 20 bp, human
gggcggattccagccccgag

SEQ ID NO: 88405 - DNA, 20 bp, human
ggggctggaatccgcccggg

SEQ ID NO: 88406 - DNA, 20 bp, human
ggggagaggctgcagagcga

SEQ ID NO: 88407 - DNA, 20 bp, human
ggagcgaggtgagccgaagt

SEQ ID NO: 88408 - DNA, 20 bp, human
gaggcgggatctctaggtgg

SEQ ID NO: 88409 - DNA, 20 bp, human
ggtgggcagagctcttagag

SEQ ID NO: 88410 - DNA, 20 bp, human
gaagctgcgctggccgctcg

SEQ ID NO: 88411 - DNA, 20 bp, human
gtaatgagggtcgggactgt

SEQ ID NO: 88412 - DNA, 20 bp, human
gcgcggggctcggggactac

SEQ ID NO: 88413 - DNA, 20 bp, human
gacttgtcaggtcggagtgg

SEQ ID NO: 88414 - DNA, 20 bp, human
gcagcgcagctttgcgaggg

SEQ ID NO: 88415 - DNA, 20 bp, human
gaaggagaggcgggatctct

SEQ ID NO: 88416 - DNA, 20 bp, human
gcccggccgccgggaaggtg

SEQ ID NO: 88417 - DNA, 20 bp, human
gcgtcggtggcagcggagca

SEQ ID NO: 88418 - DNA, 20 bp, human
gcggtccccgtcgacaccaa

SEQ ID NO: 88419 - DNA, 20 bp, human
gtccccgtcgacaccaaagg

SEQ ID NO: 88420 - DNA, 20 bp, human
gccaaaggaggaggccgcca

SEQ ID NO: 88421 - DNA, 20 bp, human
gccgagagtcgcaggaacga

SEQ ID NO: 88422 - DNA, 20 bp, human
gtggaggccgcgaaaggtgg

SEQ ID NO: 88423 - DNA, 20 bp, human
gaacggtgacccctcctccc

SEQ ID NO: 88424 - DNA, 20 bp, human
gcaagcctggaggggaacgt

SEQ ID NO: 88425 - DNA, 20 bp, human
gcaggaacgagggcgagcgt

SEQ ID NO: 88426 - DNA, 20 bp, human
gccaggctggggctgaataa

SEQ ID NO: 88427 - DNA, 20 bp, human
ggaggaagtgaaatccaggt

SEQ ID NO: 88428 - DNA, 20 bp, human
gcagctcaagggactggcag

SEQ ID NO: 88429 - DNA, 20 bp, human
ggaataaaggcgtgcttgtg

SEQ ID NO: 88430 - DNA, 20 bp, human
gggcagaggaagtgaaatcc

SEQ ID NO: 88431 - DNA, 20 bp, human
gcactgatgaccctcaacgt

SEQ ID NO: 88432 - DNA, 20 bp, human
gttcagccccagcctggtga

SEQ ID NO: 88433 - DNA, 20 bp, human
gttctttcagctcaagggac

SEQ ID NO: 88434 - DNA, 20 bp, human
ggcctggaagatactgatca

SEQ ID NO: 88435 - DNA, 20 bp, human
ggagaacttctattgcccga

SEQ ID NO: 88436 - DNA, 20 bp, human
gcgtgcggaggagacttcag

SEQ ID NO: 88437 - DNA, 20 bp, human
gagtgggtccgactcaacgt

SEQ ID NO: 88438 - DNA, 20 bp, human
ggacaaggtgagggcctcac

SEQ ID NO: 88439 - DNA, 20 bp, human
gcagggtctgccgagtggtg

SEQ ID NO: 88440 - DNA, 20 bp, human
gcgcaacagctcccttccac

SEQ ID NO: 88441 - DNA, 20 bp, human
ggggatcggcctggcataag

SEQ ID NO: 88442 - DNA, 20 bp, human
gtctaccagggcggacctgt

SEQ ID NO: 88443 - DNA, 20 bp, human
gccggcccggggcggcatcg

SEQ ID NO: 88444 - DNA, 20 bp, human
gcggggcgggcgctctacca

SEQ ID NO: 88445 - DNA, 20 bp, human
gaaaagccggacgcttccgg

SEQ ID NO: 88446 - DNA, 20 bp, human
gagccccactcactgcgcgg

SEQ ID NO: 88447 - DNA, 20 bp, human
ggagcgcgggcgccccctaa

SEQ ID NO: 88448 - DNA, 20 bp, human
gcgcaacccgacccggccag

SEQ ID NO: 88449 - DNA, 20 bp, human
ggccagccccactcactgcg

SEQ ID NO: 88450 - DNA, 20 bp, human
ggccgccgccgcgcagtgag

SEQ ID NO: 88451 - DNA, 20 bp, human
gcagcgaagggcggcccgga

SEQ ID NO: 88452 - DNA, 20 bp, human
gccgggccgggagatgcccg

SEQ ID NO: 88453 - DNA, 20 bp, human
gctggcggggcagcagcgaa

SEQ ID NO: 88454 - DNA, 20 bp, human
gtgctccgggcccggacgag

SEQ ID NO: 88455 - DNA, 20 bp, human
ggcggggctgaggaggatct

SEQ ID NO: 88456 - DNA, 20 bp, human
gtcgcccgcttcgcccgggt

SEQ ID NO: 88457 - DNA, 20 bp, human
gcagacctacccgggcgaag

SEQ ID NO: 88458 - DNA, 20 bp, human
ggcggagcccagacctaccc

SEQ ID NO: 88459 - DNA, 20 bp, human
gagcggcctggacggaaggt

SEQ ID NO: 88460 - DNA, 20 bp, human
ggctgacggagacggaatgt

SEQ ID NO: 88461 - DNA, 20 bp, human
ggacgctgcttcggagccag

SEQ ID NO: 88462 - DNA, 20 bp, human
gggctccgaagcagcgtctg

SEQ ID NO: 88463 - DNA, 20 bp, human
gaagcgggcgagcggtggtt

SEQ ID NO: 88464 - DNA, 20 bp, human
gccccggaaagcgctggtat

SEQ ID NO: 88465 - DNA, 20 bp, human
gcggctggcgctggagatcc

SEQ ID NO: 88466 - DNA, 20 bp, human
gtgcggcggcggcaatggag

SEQ ID NO: 88467 - DNA, 20 bp, human
gtagtggagctgaacgtagg

SEQ ID NO: 88468 - DNA, 20 bp, human
gggcgcccgagctccatcgg

SEQ ID NO: 88469 - DNA, 20 bp, human
gagacttgcgagaggctcta

SEQ ID NO: 88470 - DNA, 20 bp, human
ggagaggagctccgccggtg

SEQ ID NO: 88471 - DNA, 20 bp, human
ggttcagctccactacttca

SEQ ID NO: 88472 - DNA, 20 bp, human
gtgaaggacacgggcagcgg

SEQ ID NO: 88473 - DNA, 20 bp, human
gtgctggccaaagtactgtc

SEQ ID NO: 88474 - DNA, 20 bp, human
gcgcgagagaggagctccgc

SEQ ID NO: 88475 - DNA, 20 bp, human
gaggagctccgccggtgcgg

SEQ ID NO: 88476 - DNA, 20 bp, human
gggctgaggagcctaggggc

SEQ ID NO: 88477 - DNA, 20 bp, human
gaccggccgaaccttgggtg

SEQ ID NO: 88478 - DNA, 20 bp, human
gggaggaccggccgaacctt

SEQ ID NO: 88479 - DNA, 20 bp, human
gctgtcccacacccaaggtt

SEQ ID NO: 88480 - DNA, 20 bp, human
gaggcaggctgaggagccta

SEQ ID NO: 88481 - DNA, 20 bp, human
gtcgggcacgggggtcctga

SEQ ID NO: 88482 - DNA, 20 bp, human
gagggcaggctcgggcacgg

SEQ ID NO: 88483 - DNA, 20 bp, human
gggcgctcggggacagcaca

SEQ ID NO: 88484 - DNA, 20 bp, human
gaccaagcatccgggagacc

SEQ ID NO: 88485 - DNA, 20 bp, human
gcggcctcctcccgaccctc

SEQ ID NO: 88486 - DNA, 20 bp, human
gctcccaaatgatgctccag

SEQ ID NO: 88487 - DNA, 20 bp, human
gcaaatgatgctccagtggc

SEQ ID NO: 88488 - DNA, 20 bp, human
gttgggagcgaatccgtctc

SEQ ID NO: 88489 - DNA, 20 bp, human
gcgggacagcagaacgccag

SEQ ID NO: 88490 - DNA, 20 bp, human
gcgccgagaccggcggagaa

SEQ ID NO: 88491 - DNA, 20 bp, human
gcccggagaagagcgaaata

SEQ ID NO: 88492 - DNA, 20 bp, human
gaggttccagccaaggtgta

SEQ ID NO: 88493 - DNA, 20 bp, human
gatcccctcgccctacacct

SEQ ID NO: 88494 - DNA, 20 bp, human
gcttgagttgctcctgccac

SEQ ID NO: 88495 - DNA, 20 bp, human
ggccccggcgcgcccaggtg

SEQ ID NO: 88496 - DNA, 20 bp, human
ggcgggaggcggcgcatggt

SEQ ID NO: 88497 - DNA, 20 bp, human
gggtcggcggggcacaactg

SEQ ID NO: 88498 - DNA, 20 bp, human
ggctgaccagacccaaaaag

SEQ ID NO: 88499 - DNA, 20 bp, human
gcaactgcggtccagctccg

SEQ ID NO: 88500 - DNA, 20 bp, human
gggcggctggacactacctg

SEQ ID NO: 88501 - DNA, 20 bp, human
gggaggcggcgcatggtcgg

SEQ ID NO: 88502 - DNA, 20 bp, human
gctgcaggcggtcaactcgg

SEQ ID NO: 88503 - DNA, 20 bp, human
ggctccgcggcggcgaggag

SEQ ID NO: 88504 - DNA, 20 bp, human
gctgcggtccagctccgcgg

SEQ ID NO: 88505 - DNA, 20 bp, human
ggcgctgaccagcacctccg

SEQ ID NO: 88506 - DNA, 20 bp, human
gggagaggtctcccaggaat

SEQ ID NO: 88507 - DNA, 20 bp, human
gctctcaccggcgcacgagc

SEQ ID NO: 88508 - DNA, 20 bp, human
gccggagcggagcgcaccta

SEQ ID NO: 88509 - DNA, 20 bp, human
gactttgggagggggagcaa

SEQ ID NO: 88510 - DNA, 20 bp, human
ggcagtctggacctgaggtg

SEQ ID NO: 88511 - DNA, 20 bp, human
gatgcacccccgccagtctg

SEQ ID NO: 88512 - DNA, 20 bp, human
gtagccatgaggcctagtct

SEQ ID NO: 88513 - DNA, 20 bp, human
gaagggtttgggggcactag

SEQ ID NO: 88514 - DNA, 20 bp, human
gctcccgcagtctggacctg

SEQ ID NO: 88515 - DNA, 20 bp, human
gcctcccaaagtcccctccc

SEQ ID NO: 88516 - DNA, 20 bp, human
gggcggcccctgagaggaag

SEQ ID NO: 88517 - DNA, 20 bp, human
gggaggcggcggcccctgag

SEQ ID NO: 88518 - DNA, 20 bp, human
gcttcgccgcttcctctcag

SEQ ID NO: 88519 - DNA, 20 bp, human
gacgggtgcccggacccggg

SEQ ID NO: 88520 - DNA, 20 bp, human
ggcctgcgggccctcggggt

SEQ ID NO: 88521 - DNA, 20 bp, human
gggacccccacgggagatcc

SEQ ID NO: 88522 - DNA, 20 bp, human
gcacgtccctggccacgtcg

SEQ ID NO: 88523 - DNA, 20 bp, human
gcggccgggatctcccgtgg

SEQ ID NO: 88524 - DNA, 20 bp, human
gggtcccgcgctgcgacacc

SEQ ID NO: 88525 - DNA, 20 bp, human
ggtcagccggaaaatgttca

SEQ ID NO: 88526 - DNA, 20 bp, human
gcgcccggccaagagtgcgt

SEQ ID NO: 88527 - DNA, 20 bp, human
ggtgcgatcgcggagctgtg

SEQ ID NO: 88528 - DNA, 20 bp, human
ggacccctcgagatgatggg

SEQ ID NO: 88529 - DNA, 20 bp, human
ggaggacccctcgagatgat

SEQ ID NO: 88530 - DNA, 20 bp, human
gctggggcacctagagaccg

SEQ ID NO: 88531 - DNA, 20 bp, human
ggtctccggccccggtctct

SEQ ID NO: 88532 - DNA, 20 bp, human
gccggccaagagtgcgtggg

SEQ ID NO: 88533 - DNA, 20 bp, human
gcacagacgccccctcaggt

SEQ ID NO: 88534 - DNA, 20 bp, human
gggaggtccaagtgctgcaa

SEQ ID NO: 88535 - DNA, 20 bp, human
gtgacactgccaacctgagg

SEQ ID NO: 88536 - DNA, 20 bp, human
ggcgcgggcagcgtgaagcg

SEQ ID NO: 88537 - DNA, 20 bp, human
ggcgcgtgcgtacgcgacgg

SEQ ID NO: 88538 - DNA, 20 bp, human
gaatagcagagactccggag

SEQ ID NO: 88539 - DNA, 20 bp, human
ggcgcaagcgggcgaaggta

SEQ ID NO: 88540 - DNA, 20 bp, human
gacagagcgagcggccccta

SEQ ID NO: 88541 - DNA, 20 bp, human
gactggaatagcagagactc

SEQ ID NO: 88542 - DNA, 20 bp, human
gagacccaggcacgacagta

SEQ ID NO: 88543 - DNA, 20 bp, human
gcacggagcgacagagcgag

SEQ ID NO: 88544 - DNA, 20 bp, human
gcgcagggcccaagacccgg

SEQ ID NO: 88545 - DNA, 20 bp, human
gctggtgccgagcttccccg

SEQ ID NO: 88546 - DNA, 20 bp, human
ggcgcgccgcgcgcacagga

SEQ ID NO: 88547 - DNA, 20 bp, human
ggagaggcgcccgcagtcca

SEQ ID NO: 88548 - DNA, 20 bp, human
gggtcacgccgtgacagggg

SEQ ID NO: 88549 - DNA, 20 bp, human
gcggcggccgagaagaggct

SEQ ID NO: 88550 - DNA, 20 bp, human
gagcgcaaaggtgagccccg

SEQ ID NO: 88551 - DNA, 20 bp, human
gaggcgcccgcagtccaggg

SEQ ID NO: 88552 - DNA, 20 bp, human
gcccgggtcacgccgtgaca

SEQ ID NO: 88553 - DNA, 20 bp, human
gagaggtgccgggagtctcg

SEQ ID NO: 88554 - DNA, 20 bp, human
ggtgacaggggcggaagcgg

SEQ ID NO: 88555 - DNA, 20 bp, human
gcggagaagcaactgccccg

SEQ ID NO: 88556 - DNA, 20 bp, human
gtctgacgggttcaaaatgg

SEQ ID NO: 88557 - DNA, 20 bp, human
ggtgtatgtgagagtctgac

SEQ ID NO: 88558 - DNA, 20 bp, human
gagcggctcctcctgtgtga

SEQ ID NO: 88559 - DNA, 20 bp, human
ggacgggttcaaaatggcgg

SEQ ID NO: 88560 - DNA, 20 bp, human
gggtgttgtttccctcacac

SEQ ID NO: 88561 - DNA, 20 bp, human
ggagtctgacgggttcaaaa

SEQ ID NO: 88562 - DNA, 20 bp, human
gtggtcgcctgcgggagcag

SEQ ID NO: 88563 - DNA, 20 bp, human
gcgcggagccagacctgagg

SEQ ID NO: 88564 - DNA, 20 bp, human
ggcggccgatcagctgagac

SEQ ID NO: 88565 - DNA, 20 bp, human
gtctcggagcaccttcccag

SEQ ID NO: 88566 - DNA, 20 bp, human
gtggagggccgagttgcagg

SEQ ID NO: 88567 - DNA, 20 bp, human
gagctctgcacacaactccc

SEQ ID NO: 88568 - DNA, 20 bp, human
gtctgcacacaactcccggg

SEQ ID NO: 88569 - DNA, 20 bp, human
ggggcgcatcccggagatgg

SEQ ID NO: 88570 - DNA, 20 bp, human
gagactctaagcctcacaag

SEQ ID NO: 88571 - DNA, 20 bp, human
gaacggatctgcctaagtgt

SEQ ID NO: 88572 - DNA, 20 bp, human
gaactctcctaaaaaaatgg

SEQ ID NO: 88573 - DNA, 20 bp, human
gggcggcccgaggaggtatg

SEQ ID NO: 88574 - DNA, 20 bp, human
ggcgcccgccgcctgcaact

SEQ ID NO: 88575 - DNA, 20 bp, human
ggcgtcgacgtcataatccc

SEQ ID NO: 88576 - DNA, 20 bp, human
gctcccggcactcaaagatg

SEQ ID NO: 88577 - DNA, 20 bp, human
ggcaatgagggcaggaacgg

SEQ ID NO: 88578 - DNA, 20 bp, human
gggtcagctgcggactgcaa

SEQ ID NO: 88579 - DNA, 20 bp, human
ggggcgcatcccggagatgg

SEQ ID NO: 88580 - DNA, 20 bp, human
gtggagggccgagttgcagg

SEQ ID NO: 88581 - DNA, 20 bp, human
gtgccgggagtttaaaagtt

SEQ ID NO: 88582 - DNA, 20 bp, human
gagctctgcacacaactccc

SEQ ID NO: 88583 - DNA, 20 bp, human
gtctgcacacaactcccggg

SEQ ID NO: 88584 - DNA, 20 bp, human
gaaagttaggcagtccttat

SEQ ID NO: 88585 - DNA, 20 bp, human
gtggcgggtccgcaaatggg

SEQ ID NO: 88586 - DNA, 20 bp, human
gcgcctccctgagtcaccgg

SEQ ID NO: 88587 - DNA, 20 bp, human
gtgccgccggtgactcaggg

SEQ ID NO: 88588 - DNA, 20 bp, human
gggctgccgccggtgactca

SEQ ID NO: 88589 - DNA, 20 bp, human
ggctaggcggctggaaacgg

SEQ ID NO: 88590 - DNA, 20 bp, human
ggtcagcgctggagtcggct

SEQ ID NO: 88591 - DNA, 20 bp, human
gtcggctaggcggctggaaa

SEQ ID NO: 88592 - DNA, 20 bp, human
gaccaagtcagcgctggagt

SEQ ID NO: 88593 - DNA, 20 bp, human
ggctcacgctcggagaaagt

SEQ ID NO: 88594 - DNA, 20 bp, human
gtcctggtgggacacagcac

SEQ ID NO: 88595 - DNA, 20 bp, human
ggccaaacttgggagagcga

SEQ ID NO: 88596 - DNA, 20 bp, human
ggggcggatcgggcgcttgg

SEQ ID NO: 88597 - DNA, 20 bp, human
gagcagccgcttgcccaccg

SEQ ID NO: 88598 - DNA, 20 bp, human
gcggccgcgggtggtgcgga

SEQ ID NO: 88599 - DNA, 20 bp, human
gcactcaccgctaggtcctg

SEQ ID NO: 88600 - DNA, 20 bp, human
gacgcggcggcctccccggt

SEQ ID NO: 88601 - DNA, 20 bp, human
gagcggcgagcggagatccg

SEQ ID NO: 88602 - DNA, 20 bp, human
gcggatcgggcgcttggcgg

SEQ ID NO: 88603 - DNA, 20 bp, human
gcccctcacaaaggcccccg

SEQ ID NO: 88604 - DNA, 20 bp, human
gggaggccttgcgggcggat

SEQ ID NO: 88605 - DNA, 20 bp, human
gctcacaaaggcccccgggg

SEQ ID NO: 88606 - DNA, 20 bp, human
gcccgcgagcatcactccaa

SEQ ID NO: 88607 - DNA, 20 bp, human
gaagcagtaggatcggccag

SEQ ID NO: 88608 - DNA, 20 bp, human
gcagatgccgactttagagg

SEQ ID NO: 88609 - DNA, 20 bp, human
gacagcccaaagccccgcca

SEQ ID NO: 88610 - DNA, 20 bp, human
gcgcctgctggaaaagcagt

SEQ ID NO: 88611 - DNA, 20 bp, human
ggctggaaaagcagtaggat

SEQ ID NO: 88612 - DNA, 20 bp, human
gagggtgcgggagtccgagg

SEQ ID NO: 88613 - DNA, 20 bp, human
ggctgtaggtgagaactata

SEQ ID NO: 88614 - DNA, 20 bp, human
ggccgaacctgtgcgcggtg

SEQ ID NO: 88615 - DNA, 20 bp, human
gtcggggacggtggggagca

SEQ ID NO: 88616 - DNA, 20 bp, human
gccctccgcaagcgctcgcg

SEQ ID NO: 88617 - DNA, 20 bp, human
gtcggtcgccagcaaccgag

SEQ ID NO: 88618 - DNA, 20 bp, human
ggcacaaaagatgacagcgt

SEQ ID NO: 88619 - DNA, 20 bp, human
gccctcggcgtcgcaccccc

SEQ ID NO: 88620 - DNA, 20 bp, human
gcggcgtgcgcggcccggtc

SEQ ID NO: 88621 - DNA, 20 bp, human
ggcccccgcccgaaaaccag

SEQ ID NO: 88622 - DNA, 20 bp, human
ggcctgggggtgcgacgccg

SEQ ID NO: 88623 - DNA, 20 bp, human
ggcgccgctgctcccggacc

SEQ ID NO: 88624 - DNA, 20 bp, human
gctcaggtgagcccacgggg

SEQ ID NO: 88625 - DNA, 20 bp, human
gggcctgggcctcgagtccc

SEQ ID NO: 88626 - DNA, 20 bp, human
ggaacagctgtcacctagtg

SEQ ID NO: 88627 - DNA, 20 bp, human
ggcgctcctctgccccaagg

SEQ ID NO: 88628 - DNA, 20 bp, human
ggagcgcgggtaccgaacct

SEQ ID NO: 88629 - DNA, 20 bp, human
gaaggaggcgaccccgactc

SEQ ID NO: 88630 - DNA, 20 bp, human
ggaggcgcggcgcagtgatc

SEQ ID NO: 88631 - DNA, 20 bp, human
ggggtaccgaacctcggtaa

SEQ ID NO: 88632 - DNA, 20 bp, human
gcccgctccggcccttaccg

SEQ ID NO: 88633 - DNA, 20 bp, human
ggcgcggcgcagtgatcggg

SEQ ID NO: 88634 - DNA, 20 bp, human
gtccggcccttaccgaggtt

SEQ ID NO: 88635 - DNA, 20 bp, human
gagtgccgggaagacctctc

SEQ ID NO: 88636 - DNA, 20 bp, human
gtcggcgtaacggcactaag

SEQ ID NO: 88637 - DNA, 20 bp, human
ggaagtggaagtcggcgtaa

SEQ ID NO: 88638 - DNA, 20 bp, human
gggatggaagcaggagtcgt

SEQ ID NO: 88639 - DNA, 20 bp, human
ggcgtaacggcactaagggg

SEQ ID NO: 88640 - DNA, 20 bp, human
gcggctagcgggagagagcg

SEQ ID NO: 88641 - DNA, 20 bp, human
gcagtggccgaagtggaagt

SEQ ID NO: 88642 - DNA, 20 bp, human
gcaatccgcagtggccgaag

SEQ ID NO: 88643 - DNA, 20 bp, human
ggcaaccacgatctttacaa

SEQ ID NO: 88644 - DNA, 20 bp, human
gacgtggtgtcggctacccg

SEQ ID NO: 88645 - DNA, 20 bp, human
gtaccggaatgaaggagtct

SEQ ID NO: 88646 - DNA, 20 bp, human
gagaggacacccaagaacgt

SEQ ID NO: 88647 - DNA, 20 bp, human
gctagagtggagtccccctg

SEQ ID NO: 88648 - DNA, 20 bp, human
gcatcaagctggccttgcca

SEQ ID NO: 88649 - DNA, 20 bp, human
gtagatgcctgagagttctg

SEQ ID NO: 88650 - DNA, 20 bp, human
gcccaaggcgcacatcaagc

SEQ ID NO: 88651 - DNA, 20 bp, human
gctgaggaaactcacagagc

SEQ ID NO: 88652 - DNA, 20 bp, human
gcaggctttctgactcccca

SEQ ID NO: 88653 - DNA, 20 bp, human
ggccagcttgatgtgcgcct

SEQ ID NO: 88654 - DNA, 20 bp, human
gaaaagtatactgactagag

SEQ ID NO: 88655 - DNA, 20 bp, human
gcagctgactcccacgttct

SEQ ID NO: 88656 - DNA, 20 bp, human
ggaaaagtcctgaacctcag

SEQ ID NO: 88657 - DNA, 20 bp, human
gtcacagactgaggtacctt

SEQ ID NO: 88658 - DNA, 20 bp, human
gtcagtctgtgaagagagag

SEQ ID NO: 88659 - DNA, 20 bp, human
gtaaagctaaacccagtgta

SEQ ID NO: 88660 - DNA, 20 bp, human
gcagactgaggtaccttggg

SEQ ID NO: 88661 - DNA, 20 bp, human
gagaaacaataacaaacggg

SEQ ID NO: 88662 - DNA, 20 bp, human
gggcctttggcggagaaaac

SEQ ID NO: 88663 - DNA, 20 bp, human
gccaactcggctcaaagacg

SEQ ID NO: 88664 - DNA, 20 bp, human
ggggaggaggaagcgattct

SEQ ID NO: 88665 - DNA, 20 bp, human
gtgcggccgataaagctgag

SEQ ID NO: 88666 - DNA, 20 bp, human
ggcaagggcgaggcgaaggt

SEQ ID NO: 88667 - DNA, 20 bp, human
gtccgagacccgtgcagacg

SEQ ID NO: 88668 - DNA, 20 bp, human
ggcacgggtctcggaccgag

SEQ ID NO: 88669 - DNA, 20 bp, human
gatcaccgcaggctgggcaa

SEQ ID NO: 88670 - DNA, 20 bp, human
gcagccacgagctggatccg

SEQ ID NO: 88671 - DNA, 20 bp, human
ggcctcaactccgaccttct

SEQ ID NO: 88672 - DNA, 20 bp, human
ggctcgagccgcgtctgcac

SEQ ID NO: 88673 - DNA, 20 bp, human
gggcagccccaaacttgacg

SEQ ID NO: 88674 - DNA, 20 bp, human
gcgaagaccgggcactcggg

SEQ ID NO: 88675 - DNA, 20 bp, human
ggaagacgggggcttctcca

SEQ ID NO: 88676 - DNA, 20 bp, human
gggcgaaggctgcggtagtg

SEQ ID NO: 88677 - DNA, 20 bp, human
ggaggtaactgtggtggcga

SEQ ID NO: 88678 - DNA, 20 bp, human
gcgctgacaaaccaagatgg

SEQ ID NO: 88679 - DNA, 20 bp, human
gggcccatcgcagagaaatc

SEQ ID NO: 88680 - DNA, 20 bp, human
gttgcctcggcttcaaacag

SEQ ID NO: 88681 - DNA, 20 bp, human
gggaggctaggccctaagcg

SEQ ID NO: 88682 - DNA, 20 bp, human
gccagctaggctcgaacacc

SEQ ID NO: 88683 - DNA, 20 bp, human
ggtttgggaggtaactgtgg

SEQ ID NO: 88684 - DNA, 20 bp, human
ggatgtagccaagagggtct

SEQ ID NO: 88685 - DNA, 20 bp, human
gcggcgccatgagtccttaa

SEQ ID NO: 88686 - DNA, 20 bp, human
gcagggcccggaggtcaaga

SEQ ID NO: 88687 - DNA, 20 bp, human
gccagctaggctcaaaaacc

SEQ ID NO: 88688 - DNA, 20 bp, human
gagctgcttaccaatcgtca

SEQ ID NO: 88689 - DNA, 20 bp, human
gacgattggtaagcagctac

SEQ ID NO: 88690 - DNA, 20 bp, human
gggcccatagcagagaagtc

SEQ ID NO: 88691 - DNA, 20 bp, human
gaactaggatccctgacgat

SEQ ID NO: 88692 - DNA, 20 bp, human
ggccccaacgttcaaaccaa

SEQ ID NO: 88693 - DNA, 20 bp, human
ggcctttggtttgaacgttg

SEQ ID NO: 88694 - DNA, 20 bp, human
gcgtaccacactgcagggcc

SEQ ID NO: 88695 - DNA, 20 bp, human
gatcgatccgcggagtgaga

SEQ ID NO: 88696 - DNA, 20 bp, human
ggagccgaccgggcgagtga

SEQ ID NO: 88697 - DNA, 20 bp, human
ggagcactgaggggattcgt

SEQ ID NO: 88698 - DNA, 20 bp, human
gcggggctggggagcactga

SEQ ID NO: 88699 - DNA, 20 bp, human
gtcatcaccgaaagcggcgg

SEQ ID NO: 88700 - DNA, 20 bp, human
gtcctcatcaccgaaagcgg

SEQ ID NO: 88701 - DNA, 20 bp, human
gcggcggactggacaggtac

SEQ ID NO: 88702 - DNA, 20 bp, human
gggcgctcggcggactggac

SEQ ID NO: 88703 - DNA, 20 bp, human
gggtcccgcgcgcagattgg

SEQ ID NO: 88704 - DNA, 20 bp, human
ggaggaggcggcgataaagt

SEQ ID NO: 88705 - DNA, 20 bp, human
gaacgcggcggcggtgaagg

SEQ ID NO: 88706 - DNA, 20 bp, human
ggaggcagggcaagagtcag

SEQ ID NO: 88707 - DNA, 20 bp, human
gtccaggtggcagggatagg

SEQ ID NO: 88708 - DNA, 20 bp, human
ggagggggtgaggaaggtcc

SEQ ID NO: 88709 - DNA, 20 bp, human
gcaagagtcaggggtacaag

SEQ ID NO: 88710 - DNA, 20 bp, human
ggggtggtggggggcgtaag

SEQ ID NO: 88711 - DNA, 20 bp, human
gagtcaggggtacaagaggt

SEQ ID NO: 88712 - DNA, 20 bp, human
gcaggccggacccttcaacc

SEQ ID NO: 88713 - DNA, 20 bp, human
gtacttctggccagataggg

SEQ ID NO: 88714 - DNA, 20 bp, human
gagtcggaaaccgttcttgg

SEQ ID NO: 88715 - DNA, 20 bp, human
gtggtggggggcgtaagagg

SEQ ID NO: 88716 - DNA, 20 bp, human
gggcaactcgagccaccctc

SEQ ID NO: 88717 - DNA, 20 bp, human
ggcacagcagcccgccgtaa

SEQ ID NO: 88718 - DNA, 20 bp, human
ggctggttgcctaaaagcag

SEQ ID NO: 88719 - DNA, 20 bp, human
gtgcgtcgtgatcagacgag

SEQ ID NO: 88720 - DNA, 20 bp, human
ggcgtgagggcaggccctta

SEQ ID NO: 88721 - DNA, 20 bp, human
gatactcctatgctagcctc

SEQ ID NO: 88722 - DNA, 20 bp, human
ggcgccttggaaaaccccga

SEQ ID NO: 88723 - DNA, 20 bp, human
gcgagtcttcgccagcccaa

SEQ ID NO: 88724 - DNA, 20 bp, human
ggagggcaggcccttacggc

SEQ ID NO: 88725 - DNA, 20 bp, human
ggcggttcttggcgtcgcgt

SEQ ID NO: 88726 - DNA, 20 bp, human
gcgggagagcggtcaatgtg

SEQ ID NO: 88727 - DNA, 20 bp, human
gtgatgcccggcgcaggcag

SEQ ID NO: 88728 - DNA, 20 bp, human
gggcgcggaggtggaactcg

SEQ ID NO: 88729 - DNA, 20 bp, human
gcagacaggtcgggtgaggg

SEQ ID NO: 88730 - DNA, 20 bp, human
gccggtaggagaggatatcc

SEQ ID NO: 88731 - DNA, 20 bp, human
gctgccagacggactttctg

SEQ ID NO: 88732 - DNA, 20 bp, human
gcgcaagtgatgcccggcgc

SEQ ID NO: 88733 - DNA, 20 bp, human
gtctagagaaggaggcgcgg

SEQ ID NO: 88734 - DNA, 20 bp, human
gaggcagacaggtcgggtga

SEQ ID NO: 88735 - DNA, 20 bp, human
ggcggcgcgcaagtgatgcc

SEQ ID NO: 88736 - DNA, 20 bp, human
gcgcgggccggtaagtcggg

SEQ ID NO: 88737 - DNA, 20 bp, human
gcacgctctccggccctagg

SEQ ID NO: 88738 - DNA, 20 bp, human
gacgaaggccacgaggaagg

SEQ ID NO: 88739 - DNA, 20 bp, human
gagcagccacagaacccctg

SEQ ID NO: 88740 - DNA, 20 bp, human
gggcctggaaaaagggacgt

SEQ ID NO: 88741 - DNA, 20 bp, human
gctgcccggggcgcatgtgg

SEQ ID NO: 88742 - DNA, 20 bp, human
gagcacgaaggccacgagga

SEQ ID NO: 88743 - DNA, 20 bp, human
gcgcgacgcacagggacggg

SEQ ID NO: 88744 - DNA, 20 bp, human
ggccggccgcagggttcccg

SEQ ID NO: 88745 - DNA, 20 bp, human
gggccggagagcgtgcgacg

SEQ ID NO: 88746 - DNA, 20 bp, human
ggccctggcctcaggcggta

SEQ ID NO: 88747 - DNA, 20 bp, human
ggctgggcgacagcaggcgt

SEQ ID NO: 88748 - DNA, 20 bp, human
gtggagccgaggccccccga

SEQ ID NO: 88749 - DNA, 20 bp, human
ggtcccctacagccaaggta

SEQ ID NO: 88750 - DNA, 20 bp, human
gagccgaggccccccgacgg

SEQ ID NO: 88751 - DNA, 20 bp, human
gcaccccgagggacccccta

SEQ ID NO: 88752 - DNA, 20 bp, human
gctcgggacgcccgaaaagg

SEQ ID NO: 88753 - DNA, 20 bp, human
ggtcctggcggggaactcgg

SEQ ID NO: 88754 - DNA, 20 bp, human
gccccaggtcgcctccgtag

SEQ ID NO: 88755 - DNA, 20 bp, human
gcgaggccccccgacggcgg

SEQ ID NO: 88756 - DNA, 20 bp, human
gctggaggggagggaatgta

SEQ ID NO: 88757 - DNA, 20 bp, human
ggaaggtggggaccaaagtg

SEQ ID NO: 88758 - DNA, 20 bp, human
ggttccttgatcctggagaa

SEQ ID NO: 88759 - DNA, 20 bp, human
gggagctgattcggaggact

SEQ ID NO: 88760 - DNA, 20 bp, human
gaccttcctgaagtgagtgg

SEQ ID NO: 88761 - DNA, 20 bp, human
gatcaaggaactggggcggg

SEQ ID NO: 88762 - DNA, 20 bp, human
gtgccccttctccaggatca

SEQ ID NO: 88763 - DNA, 20 bp, human
gaaagtcctgcccccactgg

SEQ ID NO: 88764 - DNA, 20 bp, human
gcgccccagttccttgatcc

SEQ ID NO: 88765 - DNA, 20 bp, human
ggcttacagagtagaaaggt

SEQ ID NO: 88766 - DNA, 20 bp, human
gcccatacctgggatagcca

SEQ ID NO: 88767 - DNA, 20 bp, human
ggactgtgtaggtctcaggg

SEQ ID NO: 88768 - DNA, 20 bp, human
gcactctgtaagggtaggta

SEQ ID NO: 88769 - DNA, 20 bp, human
gggtatgggtcactctgtaa

SEQ ID NO: 88770 - DNA, 20 bp, human
gtagccagggtggaagaatg

SEQ ID NO: 88771 - DNA, 20 bp, human
gtgggtcactctgtaagggt

SEQ ID NO: 88772 - DNA, 20 bp, human
ggagggaccggacacagctc

SEQ ID NO: 88773 - DNA, 20 bp, human
gacacctgtcggcccctctt

SEQ ID NO: 88774 - DNA, 20 bp, human
gcttccaccctggctatccc

SEQ ID NO: 88775 - DNA, 20 bp, human
gtcgatccaagctgtatctg

SEQ ID NO: 88776 - DNA, 20 bp, human
gcatggtgactgggacgagt

SEQ ID NO: 88777 - DNA, 20 bp, human
gagtggaaacaatagatcaa

SEQ ID NO: 88778 - DNA, 20 bp, human
gactgagacacaggactcaa

SEQ ID NO: 88779 - DNA, 20 bp, human
gcaaaggtgttcatggtgac

SEQ ID NO: 88780 - DNA, 20 bp, human
gtcaacggtgtattcctgga

SEQ ID NO: 88781 - DNA, 20 bp, human
gtacttattcaacagacgca

SEQ ID NO: 88782 - DNA, 20 bp, human
gaatagatcaaaggtgttca

SEQ ID NO: 88783 - DNA, 20 bp, human
gaagcagtgaccaatagaaa

SEQ ID NO: 88784 - DNA, 20 bp, human
gttctgaagccctgtcaaag

SEQ ID NO: 88785 - DNA, 20 bp, human
gggattgcagaacgctgctc

SEQ ID NO: 88786 - DNA, 20 bp, human
ggcgcacccgacccttccag

SEQ ID NO: 88787 - DNA, 20 bp, human
gctgggccactccctgagta

SEQ ID NO: 88788 - DNA, 20 bp, human
gggagacagcggtacctcct

SEQ ID NO: 88789 - DNA, 20 bp, human
gagatgaagacccaccagat

SEQ ID NO: 88790 - DNA, 20 bp, human
gcgagttcgagaccacaggg

SEQ ID NO: 88791 - DNA, 20 bp, human
ggccgccgccgccctactca

SEQ ID NO: 88792 - DNA, 20 bp, human
gcgcgctcgagcggaagtgg

SEQ ID NO: 88793 - DNA, 20 bp, human
gaggcgcgctcgagcggaag

SEQ ID NO: 88794 - DNA, 20 bp, human
ggtaggaatgaaggaggtga

SEQ ID NO: 88795 - DNA, 20 bp, human
gccgggacccctggaagggt

SEQ ID NO: 88796 - DNA, 20 bp, human
ggacttggaaaagcgaggaa

SEQ ID NO: 88797 - DNA, 20 bp, human
gcccacctgattcagaatag

SEQ ID NO: 88798 - DNA, 20 bp, human
ggaaaagcgaggaagggcct

SEQ ID NO: 88799 - DNA, 20 bp, human
gaggggaaagtctaacaaac

SEQ ID NO: 88800 - DNA, 20 bp, human
gtaggctctgtccttaaaaa

SEQ ID NO: 88801 - DNA, 20 bp, human
gcagatgaaggaggggacgt

SEQ ID NO: 88802 - DNA, 20 bp, human
gcaaaagacttggaaaagcg

SEQ ID NO: 88803 - DNA, 20 bp, human
gaaagggttgtccttaataa

SEQ ID NO: 88804 - DNA, 20 bp, human
ggggagcacagcatggccgt

SEQ ID NO: 88805 - DNA, 20 bp, human
gttttttttgagactcgaga

SEQ ID NO: 88806 - DNA, 20 bp, human
ggcctgcgcgggtagcagag

SEQ ID NO: 88807 - DNA, 20 bp, human
gagaggctgtgagggaccgg

SEQ ID NO: 88808 - DNA, 20 bp, human
gcggtgagtggaccaagaag

SEQ ID NO: 88809 - DNA, 20 bp, human
gggtgaccgagcacctccac

SEQ ID NO: 88810 - DNA, 20 bp, human
gctgctacccgcgcaggccg

SEQ ID NO: 88811 - DNA, 20 bp, human
ggaacgcagccagaatatgt

SEQ ID NO: 88812 - DNA, 20 bp, human
gcaagacccccgggagccac

SEQ ID NO: 88813 - DNA, 20 bp, human
gggtagcagagaggctgtga

SEQ ID NO: 88814 - DNA, 20 bp, human
gggtagttcgccttgaggtt

SEQ ID NO: 88815 - DNA, 20 bp, human
gagctgggagactagaaccg

SEQ ID NO: 88816 - DNA, 20 bp, human
gttctccgcggagaaaccca

SEQ ID NO: 88817 - DNA, 20 bp, human
gaccggctcatgcgcgcggc

SEQ ID NO: 88818 - DNA, 20 bp, human
gctcgctgggtcgctcgggt

SEQ ID NO: 88819 - DNA, 20 bp, human
ggagagcaccggaaatgagg

SEQ ID NO: 88820 - DNA, 20 bp, human
gcccgagcggcggttggcgg

SEQ ID NO: 88821 - DNA, 20 bp, human
gctctctcgctgggtcgctc

SEQ ID NO: 88822 - DNA, 20 bp, human
gccttctcggccatgagttc

SEQ ID NO: 88823 - DNA, 20 bp, human
gagagagagcaccggaaatg

SEQ ID NO: 88824 - DNA, 20 bp, human
ggtctgacgcaccgaggggt

SEQ ID NO: 88825 - DNA, 20 bp, human
gcggcgtctgacgcaccgag

SEQ ID NO: 88826 - DNA, 20 bp, human
gcgagcgagggacgacggaa

SEQ ID NO: 88827 - DNA, 20 bp, human
gctgcgcgagcgagggacga

SEQ ID NO: 88828 - DNA, 20 bp, human
gatcaagccgcgggtgagat

SEQ ID NO: 88829 - DNA, 20 bp, human
gcggctgcctatctcacccg

SEQ ID NO: 88830 - DNA, 20 bp, human
gtcacccgcggcttgattag

SEQ ID NO: 88831 - DNA, 20 bp, human
gctaaggcgagcatcttcag

SEQ ID NO: 88832 - DNA, 20 bp, human
ggacgacggaagggacgggc

SEQ ID NO: 88833 - DNA, 20 bp, human
gggtttgtgcccatctgtgg

SEQ ID NO: 88834 - DNA, 20 bp, human
gcggggctctgcgcgagcga

SEQ ID NO: 88835 - DNA, 20 bp, human
gctgcctgcgtccgagcgag

SEQ ID NO: 88836 - DNA, 20 bp, human
ggcgcccctgaggcagtcca

SEQ ID NO: 88837 - DNA, 20 bp, human
gtacctgcccgagctgatgg

SEQ ID NO: 88838 - DNA, 20 bp, human
gggcgtgcaggtcgcagctg

SEQ ID NO: 88839 - DNA, 20 bp, human
gccctgcgcctggtgaacca

SEQ ID NO: 88840 - DNA, 20 bp, human
gcggcggccggcgagcatgg

SEQ ID NO: 88841 - DNA, 20 bp, human
gtcgccgtggactgcctcag

SEQ ID NO: 88842 - DNA, 20 bp, human
gcgcctggtgaaccaaggtg

SEQ ID NO: 88843 - DNA, 20 bp, human
ggcggtcggccggaaggcgg

SEQ ID NO: 88844 - DNA, 20 bp, human
ggccggcgctgggtactcgg

SEQ ID NO: 88845 - DNA, 20 bp, human
ggcggtggctcagagtgcgc

SEQ ID NO: 88846 - DNA, 20 bp, human
gggacacgcgaggtacagct

SEQ ID NO: 88847 - DNA, 20 bp, human
gcgaccgcgggcttcaggca

SEQ ID NO: 88848 - DNA, 20 bp, human
gacctcgcgtgtcccgggtc

SEQ ID NO: 88849 - DNA, 20 bp, human
gggactcggagataaggtag

SEQ ID NO: 88850 - DNA, 20 bp, human
gaggcagggctgcagatgcg

SEQ ID NO: 88851 - DNA, 20 bp, human
gaggaggagctcccacgcgg

SEQ ID NO: 88852 - DNA, 20 bp, human
gctgacaagcgaggaaacta

SEQ ID NO: 88853 - DNA, 20 bp, human
gctggtggacaagtacccta

SEQ ID NO: 88854 - DNA, 20 bp, human
gtaaggaggactcggagata

SEQ ID NO: 88855 - DNA, 20 bp, human
gtggaggaggagctcccacg

SEQ ID NO: 88856 - DNA, 20 bp, human
gggccagaaggagtctcctg

SEQ ID NO: 88857 - DNA, 20 bp, human
gcccccagcccaggggacaa

SEQ ID NO: 88858 - DNA, 20 bp, human
gaaggacgaatcctcagcag

SEQ ID NO: 88859 - DNA, 20 bp, human
gcccgctgggtgaggaaccc

SEQ ID NO: 88860 - DNA, 20 bp, human
ggggcagggggcccgaatct

SEQ ID NO: 88861 - DNA, 20 bp, human
gcgtgcgatgtggacaagag

SEQ ID NO: 88862 - DNA, 20 bp, human
gtcccgggttcctcacccag

SEQ ID NO: 88863 - DNA, 20 bp, human
ggacaagagaggtccccgct

SEQ ID NO: 88864 - DNA, 20 bp, human
gggcactctgaagcttctta

SEQ ID NO: 88865 - DNA, 20 bp, human
gcagggggcccgaatctggg

SEQ ID NO: 88866 - DNA, 20 bp, human
gggcggcggcggctcaacgc

SEQ ID NO: 88867 - DNA, 20 bp, human
ggcggctcaacgcgggaaca

SEQ ID NO: 88868 - DNA, 20 bp, human
gaacaaggcctcgctccaca

SEQ ID NO: 88869 - DNA, 20 bp, human
gggccgtcgcggggtcacgt

SEQ ID NO: 88870 - DNA, 20 bp, human
gagagtgctccgcggccgtg

SEQ ID NO: 88871 - DNA, 20 bp, human
ggcctcgagtgggatcccaa

SEQ ID NO: 88872 - DNA, 20 bp, human
gcccctcgtcgtcctcccag

SEQ ID NO: 88873 - DNA, 20 bp, human
ggccgctgggaggacgacga

SEQ ID NO: 88874 - DNA, 20 bp, human
gctcccgctgcgcctcgagt

SEQ ID NO: 88875 - DNA, 20 bp, human
ggcccctctcagccacccgg

SEQ ID NO: 88876 - DNA, 20 bp, human
gtgtctcggtcccacgtgtg

SEQ ID NO: 88877 - DNA, 20 bp, human
gaagtcgggaaggtctctcg

SEQ ID NO: 88878 - DNA, 20 bp, human
gaccgagacagctcgcgcag

SEQ ID NO: 88879 - DNA, 20 bp, human
ggtgagtgtggcaggctcag

SEQ ID NO: 88880 - DNA, 20 bp, human
gccacactcaccgcacacgt

SEQ ID NO: 88881 - DNA, 20 bp, human
gcaaggaagcggaagcggag

SEQ ID NO: 88882 - DNA, 20 bp, human
gcggaagcggagaggcggtc

SEQ ID NO: 88883 - DNA, 20 bp, human
gtccgctgcgcgagctgtct

SEQ ID NO: 88884 - DNA, 20 bp, human
gcagcggtcgctcttgggag

SEQ ID NO: 88885 - DNA, 20 bp, human
gcaaggcaaggaagcggaag

SEQ ID NO: 88886 - DNA, 20 bp, human
gtgctacgatggaagttaaa

SEQ ID NO: 88887 - DNA, 20 bp, human
gggattaggattaaaatagt

SEQ ID NO: 88888 - DNA, 20 bp, human
gaacagccaaacacccacat

SEQ ID NO: 88889 - DNA, 20 bp, human
gtcataagccaaatacgttt

SEQ ID NO: 88890 - DNA, 20 bp, human
gttacaatactgacacctga

SEQ ID NO: 88891 - DNA, 20 bp, human
gaactagtgtgaataaaatg

SEQ ID NO: 88892 - DNA, 20 bp, human
gacagatttcataaaaatag

SEQ ID NO: 88893 - DNA, 20 bp, human
gacttccatcgtagcaactc

SEQ ID NO: 88894 - DNA, 20 bp, human
ggaaattgcaagaatgattg

SEQ ID NO: 88895 - DNA, 20 bp, human
gaaggagtctttcatgaata

SEQ ID NO: 88896 - DNA, 20 bp, human
ggccagacctggctcggggt

SEQ ID NO: 88897 - DNA, 20 bp, human
gcctaccggcagctggagta

SEQ ID NO: 88898 - DNA, 20 bp, human
ggttgtgcctgtgacatcag

SEQ ID NO: 88899 - DNA, 20 bp, human
gagtgcagaggcaaccaaaa

SEQ ID NO: 88900 - DNA, 20 bp, human
gacacgccagacctggctcg

SEQ ID NO: 88901 - DNA, 20 bp, human
gcccggggcgctgtcagacg

SEQ ID NO: 88902 - DNA, 20 bp, human
ggtccacatgaactcctcgg

SEQ ID NO: 88903 - DNA, 20 bp, human
gcccttcaaagcgctcctac

SEQ ID NO: 88904 - DNA, 20 bp, human
gcagcgccccgggccctgga

SEQ ID NO: 88905 - DNA, 20 bp, human
gactcctcggaggtcggcgg

SEQ ID NO: 88906 - DNA, 20 bp, human
gtgagggttcccggccgcgc

SEQ ID NO: 88907 - DNA, 20 bp, human
gctgaggccaggaactgaat

SEQ ID NO: 88908 - DNA, 20 bp, human
gggaactgaataggagtgtg

SEQ ID NO: 88909 - DNA, 20 bp, human
ggcgtgaggcagagtgggta

SEQ ID NO: 88910 - DNA, 20 bp, human
gtggcgaaagggacatgcag

SEQ ID NO: 88911 - DNA, 20 bp, human
gaggaaggggcctggttcag

SEQ ID NO: 88912 - DNA, 20 bp, human
gtgctgcgcggatccggcgt

SEQ ID NO: 88913 - DNA, 20 bp, human
ggatccgcgcagcaccgccg

SEQ ID NO: 88914 - DNA, 20 bp, human
gtcggggcccggcatggcgg

SEQ ID NO: 88915 - DNA, 20 bp, human
gtgcctcacgcgcctcagta

SEQ ID NO: 88916 - DNA, 20 bp, human
gctagaagaggaagtcgcag

SEQ ID NO: 88917 - DNA, 20 bp, human
gcagccaccactgtgaagag

SEQ ID NO: 88918 - DNA, 20 bp, human
gttgtccagtgaaacaccct

SEQ ID NO: 88919 - DNA, 20 bp, human
ggggccaggcggctactccc

SEQ ID NO: 88920 - DNA, 20 bp, human
ggaactgacttcccagccga

SEQ ID NO: 88921 - DNA, 20 bp, human
gcagtgaaacaccctcggct

SEQ ID NO: 88922 - DNA, 20 bp, human
ggaaccaagcacctttctgg

SEQ ID NO: 88923 - DNA, 20 bp, human
ggaaactgatgtcgaattag

SEQ ID NO: 88924 - DNA, 20 bp, human
gagaccaatataaactgtgg

SEQ ID NO: 88925 - DNA, 20 bp, human
gagacgccagaggtccccct

SEQ ID NO: 88926 - DNA, 20 bp, human
ggcccgcccccactccagtt

SEQ ID NO: 88927 - DNA, 20 bp, human
ggccgggttagagccaagga

SEQ ID NO: 88928 - DNA, 20 bp, human
gaagcgcgagaccaaccctt

SEQ ID NO: 88929 - DNA, 20 bp, human
gagaccaacccttgggacag

SEQ ID NO: 88930 - DNA, 20 bp, human
gtagccgctgtcccaagggt

SEQ ID NO: 88931 - DNA, 20 bp, human
gtcgggtactcggccactcg

SEQ ID NO: 88932 - DNA, 20 bp, human
gtcggccactcggggcatcg

SEQ ID NO: 88933 - DNA, 20 bp, human
ggccactcggggcatcgcgg

SEQ ID NO: 88934 - DNA, 20 bp, human
gtggtgctggcagcgacatg

SEQ ID NO: 88935 - DNA, 20 bp, human
gtttctagccgctgtcccaa

SEQ ID NO: 88936 - DNA, 20 bp, human
gcctaggcacgacagacctg

SEQ ID NO: 88937 - DNA, 20 bp, human
ggaggaggggacgtgaagtg

SEQ ID NO: 88938 - DNA, 20 bp, human
gtggctgcggcccccggagg

SEQ ID NO: 88939 - DNA, 20 bp, human
ggagttgccagtaacggaca

SEQ ID NO: 88940 - DNA, 20 bp, human
gttcacgtcccctcctccgg

SEQ ID NO: 88941 - DNA, 20 bp, human
ggttactggcaactctaagg

SEQ ID NO: 88942 - DNA, 20 bp, human
gccgcagccatgtccgttac

SEQ ID NO: 88943 - DNA, 20 bp, human
gcccacaatggaccaatcca

SEQ ID NO: 88944 - DNA, 20 bp, human
ggaggggacgtgaagtgagg

SEQ ID NO: 88945 - DNA, 20 bp, human
ggcctcgaaataaatactca

SEQ ID NO: 88946 - DNA, 20 bp, human
ggtcctgctctgggtgactc

SEQ ID NO: 88947 - DNA, 20 bp, human
gccgggtgctgcacagaatc

SEQ ID NO: 88948 - DNA, 20 bp, human
gagtgtgtgagcaagaagcc

SEQ ID NO: 88949 - DNA, 20 bp, human
gacctggctggcagctaccc

SEQ ID NO: 88950 - DNA, 20 bp, human
gagctatggatgccccatca

SEQ ID NO: 88951 - DNA, 20 bp, human
gcacctccctcaaagcgggg

SEQ ID NO: 88952 - DNA, 20 bp, human
gggtgactcgggcacctggc

SEQ ID NO: 88953 - DNA, 20 bp, human
gggcagctacccaggcacac

SEQ ID NO: 88954 - DNA, 20 bp, human
gcacctgtgcatggaaaccc

SEQ ID NO: 88955 - DNA, 20 bp, human
gccttggcagggtatcccct

SEQ ID NO: 88956 - DNA, 20 bp, human
gtgaccgcctggggagtcag

SEQ ID NO: 88957 - DNA, 20 bp, human
gccgggactgcggatagaag

SEQ ID NO: 88958 - DNA, 20 bp, human
gcgcagtcccggacctggag

SEQ ID NO: 88959 - DNA, 20 bp, human
gtctgacccgctccaggtcc

SEQ ID NO: 88960 - DNA, 20 bp, human
gggaccgccgccttgaggga

SEQ ID NO: 88961 - DNA, 20 bp, human
gctatccgcagtcccggacc

SEQ ID NO: 88962 - DNA, 20 bp, human
ggagtcaggggcggaagtcg

SEQ ID NO: 88963 - DNA, 20 bp, human
gcacccctccctcaaggcgg

SEQ ID NO: 88964 - DNA, 20 bp, human
gccgcctggggagtcagggg

SEQ ID NO: 88965 - DNA, 20 bp, human
gtcgcgtgcagcctggatgg

SEQ ID NO: 88966 - DNA, 20 bp, human
gctgggagccgccgcggagt

SEQ ID NO: 88967 - DNA, 20 bp, human
ggcgcgggaatggagctcgg

SEQ ID NO: 88968 - DNA, 20 bp, human
ggtgatgcgctacacccggg

SEQ ID NO: 88969 - DNA, 20 bp, human
gtacacccgggcggcgacag

SEQ ID NO: 88970 - DNA, 20 bp, human
gcgggtgatgcgctacaccc

SEQ ID NO: 88971 - DNA, 20 bp, human
gatagaagccgcagcccagg

SEQ ID NO: 88972 - DNA, 20 bp, human
gctgcctgaggagagcaggt

SEQ ID NO: 88973 - DNA, 20 bp, human
gggaggcacctgcggccggt

SEQ ID NO: 88974 - DNA, 20 bp, human
gtccccggagccggaagtgg

SEQ ID NO: 88975 - DNA, 20 bp, human
ggtcttgaggacgacggctg

SEQ ID NO: 88976 - DNA, 20 bp, human
gtcgcgagcgcctagcacag

SEQ ID NO: 88977 - DNA, 20 bp, human
ggccctcgcaggatcggacg

SEQ ID NO: 88978 - DNA, 20 bp, human
gaaagtcgaactgctcacaa

SEQ ID NO: 88979 - DNA, 20 bp, human
ggtcgaactgctcacaacgg

SEQ ID NO: 88980 - DNA, 20 bp, human
gtgagagaaggtacagacac

SEQ ID NO: 88981 - DNA, 20 bp, human
gaccgcaacgcagcctcggg

SEQ ID NO: 88982 - DNA, 20 bp, human
ggagagtgccgattgagaga

SEQ ID NO: 88983 - DNA, 20 bp, human
gaggtacttacccctcccga

SEQ ID NO: 88984 - DNA, 20 bp, human
gtagcatcccccagtttggg

SEQ ID NO: 88985 - DNA, 20 bp, human
gggccgctaggagcgagtca

SEQ ID NO: 88986 - DNA, 20 bp, human
gcccagccaaacccgagcgg

SEQ ID NO: 88987 - DNA, 20 bp, human
gctgggtaaacgccgcgcgt

SEQ ID NO: 88988 - DNA, 20 bp, human
gtcacccagccaaacccgag

SEQ ID NO: 88989 - DNA, 20 bp, human
ggcccggagccgcgcgaggg

SEQ ID NO: 88990 - DNA, 20 bp, human
gggagggaggagagctaccg

SEQ ID NO: 88991 - DNA, 20 bp, human
gaccgggagcgcggtggcca

SEQ ID NO: 88992 - DNA, 20 bp, human
gggctccgggcagcgttccg

SEQ ID NO: 88993 - DNA, 20 bp, human
ggagcgaccctaagatacct

SEQ ID NO: 88994 - DNA, 20 bp, human
gccagaacactgcgcctggg

SEQ ID NO: 88995 - DNA, 20 bp, human
gggtcgctcagagcagtgtc

SEQ ID NO: 88996 - DNA, 20 bp, human
gcggccccagcgccactccg

SEQ ID NO: 88997 - DNA, 20 bp, human
gctggccccggagccatcag

SEQ ID NO: 88998 - DNA, 20 bp, human
gtggccccggagccccacgg

SEQ ID NO: 88999 - DNA, 20 bp, human
ggccccggagccatcaacag

SEQ ID NO: 89000 - DNA, 20 bp, human
gggtcagcccaagggagaca

SEQ ID NO: 89001 - DNA, 20 bp, human
ggccgccgccgctttacgta

SEQ ID NO: 89002 - DNA, 20 bp, human
gtgcgccttacgtaaagcgg

SEQ ID NO: 89003 - DNA, 20 bp, human
gttacgtaaggcgcaggcca

SEQ ID NO: 89004 - DNA, 20 bp, human
ggccccggagccatcagcgg

SEQ ID NO: 89005 - DNA, 20 bp, human
ggcctgcgccttacgtaaag

SEQ ID NO: 89006 - DNA, 20 bp, human
ggccagagcgagctagacaa

SEQ ID NO: 89007 - DNA, 20 bp, human
gggcttcggagaatagaacg

SEQ ID NO: 89008 - DNA, 20 bp, human
gttcggagaatagaacgcgg

SEQ ID NO: 89009 - DNA, 20 bp, human
gtcgctctggccggcgctgt

SEQ ID NO: 89010 - DNA, 20 bp, human
gtagaacgcggcggtagcga

SEQ ID NO: 89011 - DNA, 20 bp, human
gtggccggcgctgtgggcag

SEQ ID NO: 89012 - DNA, 20 bp, human
gtacagctgggtcagtgacg

SEQ ID NO: 89013 - DNA, 20 bp, human
ggcgctcggccggctgtcag

SEQ ID NO: 89014 - DNA, 20 bp, human
gtccggccagcgtcactcct

SEQ ID NO: 89015 - DNA, 20 bp, human
ggccgtgccgatgggtgcag

SEQ ID NO: 89016 - DNA, 20 bp, human
gagggccagcagcaacgcat

SEQ ID NO: 89017 - DNA, 20 bp, human
gagcaaggttgcacccccgg

SEQ ID NO: 89018 - DNA, 20 bp, human
gacgacgaggaggaacaagt

SEQ ID NO: 89019 - DNA, 20 bp, human
gggacggcgagtgatgctca

SEQ ID NO: 89020 - DNA, 20 bp, human
gcgcgtcgccgtggtaaccg

SEQ ID NO: 89021 - DNA, 20 bp, human
gcggaaaggcgctgaatcac

SEQ ID NO: 89022 - DNA, 20 bp, human
gagcctgcagaagctgccgc

SEQ ID NO: 89023 - DNA, 20 bp, human
ggaagtagataccgtacctg

SEQ ID NO: 89024 - DNA, 20 bp, human
gaggaaagagggcagccagt

SEQ ID NO: 89025 - DNA, 20 bp, human
gcggtgggcggggatccccc

SEQ ID NO: 89026 - DNA, 20 bp, human
gctgccaggccgaggaccat

SEQ ID NO: 89027 - DNA, 20 bp, human
gcagcctccctggacagcga

SEQ ID NO: 89028 - DNA, 20 bp, human
ggagaggtagctgtccgggt

SEQ ID NO: 89029 - DNA, 20 bp, human
gcctccctggacagcgacgg

SEQ ID NO: 89030 - DNA, 20 bp, human
gaggctgcagaggtcgaagg

SEQ ID NO: 89031 - DNA, 20 bp, human
gactaggctgcagaggtcga

SEQ ID NO: 89032 - DNA, 20 bp, human
ggcgggacgggcgatgtcag

SEQ ID NO: 89033 - DNA, 20 bp, human
gcccaggcccgagagaagcg

SEQ ID NO: 89034 - DNA, 20 bp, human
ggtagtgcgggctccccacc

SEQ ID NO: 89035 - DNA, 20 bp, human
gacggcagcgccccgaaccc

SEQ ID NO: 89036 - DNA, 20 bp, human
gcgccgggctttgcgggcgc

SEQ ID NO: 89037 - DNA, 20 bp, human
gggcgtcctccacagcgggc

SEQ ID NO: 89038 - DNA, 20 bp, human
gggtgtacacagccggtcca

SEQ ID NO: 89039 - DNA, 20 bp, human
gagcccggcgtcctccacag

SEQ ID NO: 89040 - DNA, 20 bp, human
ggtacacagccggtccaagg

SEQ ID NO: 89041 - DNA, 20 bp, human
gccagcgcaccgccttggac

SEQ ID NO: 89042 - DNA, 20 bp, human
gccggggcgcgtcgcaggtg

SEQ ID NO: 89043 - DNA, 20 bp, human
gcgctcccggaagcccgcgg

SEQ ID NO: 89044 - DNA, 20 bp, human
gacccgctcccggaagcccg

SEQ ID NO: 89045 - DNA, 20 bp, human
gacaccggaagttacgtctc

SEQ ID NO: 89046 - DNA, 20 bp, human
gccgccagccgaggctcagt

SEQ ID NO: 89047 - DNA, 20 bp, human
gctgtccaaaggaagagacg

SEQ ID NO: 89048 - DNA, 20 bp, human
gaggtctgcggctgtcacgt

SEQ ID NO: 89049 - DNA, 20 bp, human
ggggaaacacgcctgtccaa

SEQ ID NO: 89050 - DNA, 20 bp, human
ggtccgcgccgagtgaacgg

SEQ ID NO: 89051 - DNA, 20 bp, human
gagcggcagcggctccgcag

SEQ ID NO: 89052 - DNA, 20 bp, human
ggttggctgggcccgacctg

SEQ ID NO: 89053 - DNA, 20 bp, human
gccgagtcgcgagctcgcgg

SEQ ID NO: 89054 - DNA, 20 bp, human
ggcgggcctctgacctgagt

SEQ ID NO: 89055 - DNA, 20 bp, human
ggccggagcgcccttttccg

SEQ ID NO: 89056 - DNA, 20 bp, human
gggtctgtagagagctatgc

SEQ ID NO: 89057 - DNA, 20 bp, human
gggctggcgcggtgcatcgt

SEQ ID NO: 89058 - DNA, 20 bp, human
gggacagagcaggaatcctc

SEQ ID NO: 89059 - DNA, 20 bp, human
ggtcgcaagccgcaaaccag

SEQ ID NO: 89060 - DNA, 20 bp, human
ggcggcactcagacttaacg

SEQ ID NO: 89061 - DNA, 20 bp, human
gagcgttcggtacgcagtct

SEQ ID NO: 89062 - DNA, 20 bp, human
gtcatgaactggaatgtaag

SEQ ID NO: 89063 - DNA, 20 bp, human
gcttaacgcggccataaacg

SEQ ID NO: 89064 - DNA, 20 bp, human
gtcagctgcgccaacgactc

SEQ ID NO: 89065 - DNA, 20 bp, human
gttgcgacgttggacatccc

SEQ ID NO: 89066 - DNA, 20 bp, human
gtactgctctgtggaatggt

SEQ ID NO: 89067 - DNA, 20 bp, human
gaaagtggtgaaggtttcaa

SEQ ID NO: 89068 - DNA, 20 bp, human
gattatggcaggatacaaag

SEQ ID NO: 89069 - DNA, 20 bp, human
ggtctgggcttaaaaacagt

SEQ ID NO: 89070 - DNA, 20 bp, human
ggtactgtcagtccacagtt

SEQ ID NO: 89071 - DNA, 20 bp, human
gccagtggtcgagcatccat

SEQ ID NO: 89072 - DNA, 20 bp, human
gacactggggagaaatccta

SEQ ID NO: 89073 - DNA, 20 bp, human
gagggtggatttcccaactg

SEQ ID NO: 89074 - DNA, 20 bp, human
gacttgtcagtactgctctg

SEQ ID NO: 89075 - DNA, 20 bp, human
gtccactgctaattgaccag

SEQ ID NO: 89076 - DNA, 20 bp, human
gtcctggagggccccaccag

SEQ ID NO: 89077 - DNA, 20 bp, human
ggtgcggaagcggaagtgaa

SEQ ID NO: 89078 - DNA, 20 bp, human
gtgccctcgaaggggaacag

SEQ ID NO: 89079 - DNA, 20 bp, human
ggagccaaatgccctcgaag

SEQ ID NO: 89080 - DNA, 20 bp, human
gtgaagggtgcgcttggcgg

SEQ ID NO: 89081 - DNA, 20 bp, human
gccctgtctgacccctggtg

SEQ ID NO: 89082 - DNA, 20 bp, human
gcgccgctgttccccttcga

SEQ ID NO: 89083 - DNA, 20 bp, human
ggtagtgaatggacccgaaa

SEQ ID NO: 89084 - DNA, 20 bp, human
gcggcgggagctgcggagtc

SEQ ID NO: 89085 - DNA, 20 bp, human
gaagtgaagggtgcgcttgg

SEQ ID NO: 89086 - DNA, 20 bp, human
ggaaccggcgccgtcagact

SEQ ID NO: 89087 - DNA, 20 bp, human
gggcggaccgggcagcgaac

SEQ ID NO: 89088 - DNA, 20 bp, human
gccgcccgcggtgagaggtg

SEQ ID NO: 89089 - DNA, 20 bp, human
gctctcaccgcgggcggacc

SEQ ID NO: 89090 - DNA, 20 bp, human
gccgcagcagccgagtctga

SEQ ID NO: 89091 - DNA, 20 bp, human
gcgggagcccacgggcggag

SEQ ID NO: 89092 - DNA, 20 bp, human
gaaggtcgccgggagcccac

SEQ ID NO: 89093 - DNA, 20 bp, human
ggagggtgcaaggaccccgg

SEQ ID NO: 89094 - DNA, 20 bp, human
gaaaggacccggctgctcgc

SEQ ID NO: 89095 - DNA, 20 bp, human
gtcgctgcccggtccgcccg

SEQ ID NO: 89096 - DNA, 20 bp, human
gcgccgcctctagggatgga

SEQ ID NO: 89097 - DNA, 20 bp, human
gcaccgtccatccctagagg

SEQ ID NO: 89098 - DNA, 20 bp, human
gtaacagcccgacctcccgg

SEQ ID NO: 89099 - DNA, 20 bp, human
gtgggcccctccgggaggtc

SEQ ID NO: 89100 - DNA, 20 bp, human
gcccggaaccgccgcctcta

SEQ ID NO: 89101 - DNA, 20 bp, human
ggaataacagcccgacctcc

SEQ ID NO: 89102 - DNA, 20 bp, human
gaagcgcggtcgggagggat

SEQ ID NO: 89103 - DNA, 20 bp, human
ggagtgtctgtgggcccctc

SEQ ID NO: 89104 - DNA, 20 bp, human
gcggttccgggagctcgaac

SEQ ID NO: 89105 - DNA, 20 bp, human
gtcgtgggagtgcaatcgtc

SEQ ID NO: 89106 - DNA, 20 bp, human
gggcgttctggagatacgta

SEQ ID NO: 89107 - DNA, 20 bp, human
gccgagacccgcaccgtcgt

SEQ ID NO: 89108 - DNA, 20 bp, human
gcccaaccccagagctggta

SEQ ID NO: 89109 - DNA, 20 bp, human
gaggggtgtgtaagactctg

SEQ ID NO: 89110 - DNA, 20 bp, human
gcccctccagatgcaatcgt

SEQ ID NO: 89111 - DNA, 20 bp, human
gtgtcagattacacccacga

SEQ ID NO: 89112 - DNA, 20 bp, human
gcaagtcccacacttaagga

SEQ ID NO: 89113 - DNA, 20 bp, human
gtccgacgattgcatctgga

SEQ ID NO: 89114 - DNA, 20 bp, human
ggaagtgggtgttgacctgc

SEQ ID NO: 89115 - DNA, 20 bp, human
gattacacccacgacggtgc

SEQ ID NO: 89116 - DNA, 20 bp, human
gctactgggaggcgggcaac

SEQ ID NO: 89117 - DNA, 20 bp, human
ggcaacgggggcccccaaca

SEQ ID NO: 89118 - DNA, 20 bp, human
ggtgaggcgcggctactggg

SEQ ID NO: 89119 - DNA, 20 bp, human
gagggtgaggcgcggctact

SEQ ID NO: 89120 - DNA, 20 bp, human
gctcccggctcatagctcca

SEQ ID NO: 89121 - DNA, 20 bp, human
gtgggccccacgcagcgacc

SEQ ID NO: 89122 - DNA, 20 bp, human
ggcctcaccctaggccaggt

SEQ ID NO: 89123 - DNA, 20 bp, human
gggaagcgcggccttgttgg

SEQ ID NO: 89124 - DNA, 20 bp, human
ggagcaggcggctaagatgc

SEQ ID NO: 89125 - DNA, 20 bp, human
gggcccccgtaaagcctaga

SEQ ID NO: 89126 - DNA, 20 bp, human
ggcggcgtggtggagaatag

SEQ ID NO: 89127 - DNA, 20 bp, human
gccgcgccaggccttcggaa

SEQ ID NO: 89128 - DNA, 20 bp, human
gggccgcgggtctgtcggag

SEQ ID NO: 89129 - DNA, 20 bp, human
gggaacaaaaggctccgcta

SEQ ID NO: 89130 - DNA, 20 bp, human
gaggctccgctagggtcggg

SEQ ID NO: 89131 - DNA, 20 bp, human
gaaaaggctccgctagggtc

SEQ ID NO: 89132 - DNA, 20 bp, human
ggcgtggtggagaatagagg

SEQ ID NO: 89133 - DNA, 20 bp, human
ggcagcggccgcgggtctgt

SEQ ID NO: 89134 - DNA, 20 bp, human
ggcgctgtagctgcaaaaca

SEQ ID NO: 89135 - DNA, 20 bp, human
gacttctggctgggaacaaa

SEQ ID NO: 89136 - DNA, 20 bp, human
gtcgccagggtggtaatacc

SEQ ID NO: 89137 - DNA, 20 bp, human
gcttgctagatcagcaccgg

SEQ ID NO: 89138 - DNA, 20 bp, human
gctggtgcagagcttgagtc

SEQ ID NO: 89139 - DNA, 20 bp, human
gtgagtctggccagcgggtc

SEQ ID NO: 89140 - DNA, 20 bp, human
ggccagcccgagaagtgagt

SEQ ID NO: 89141 - DNA, 20 bp, human
gagagcttgagtctggccag

SEQ ID NO: 89142 - DNA, 20 bp, human
gtagcaagagcctgacccgc

SEQ ID NO: 89143 - DNA, 20 bp, human
ggatcattggtagagaaact

SEQ ID NO: 89144 - DNA, 20 bp, human
gagcaccggaggtggaagac

SEQ ID NO: 89145 - DNA, 20 bp, human
gcgagtttcctatctcccat

SEQ ID NO: 89146 - DNA, 20 bp, human
gccagcccgtagctactgga

SEQ ID NO: 89147 - DNA, 20 bp, human
gagctactggaaggtacaca

SEQ ID NO: 89148 - DNA, 20 bp, human
gcggcggagcggctacgtca

SEQ ID NO: 89149 - DNA, 20 bp, human
gtactggaaggtacacacgg

SEQ ID NO: 89150 - DNA, 20 bp, human
gagcgctgctgggcaccgta

SEQ ID NO: 89151 - DNA, 20 bp, human
gcggagcggctacgtcacgg

SEQ ID NO: 89152 - DNA, 20 bp, human
gggcgctcgcgaaaaacctg

SEQ ID NO: 89153 - DNA, 20 bp, human
gtccaccagcccgtagctac

SEQ ID NO: 89154 - DNA, 20 bp, human
gagcaggataaggagggtaa

SEQ ID NO: 89155 - DNA, 20 bp, human
gccgcccggggctcaggtaa

SEQ ID NO: 89156 - DNA, 20 bp, human
gagggacatggtaaaaacgg

SEQ ID NO: 89157 - DNA, 20 bp, human
gcactggaagccgagaggag

SEQ ID NO: 89158 - DNA, 20 bp, human
gcagaggccgagtccgtcac

SEQ ID NO: 89159 - DNA, 20 bp, human
gggagaggacagctggttgt

SEQ ID NO: 89160 - DNA, 20 bp, human
gcccagaggttgacagagga

SEQ ID NO: 89161 - DNA, 20 bp, human
gctctgggcgaacccccacc

SEQ ID NO: 89162 - DNA, 20 bp, human
ggtcctacagataaaactca

SEQ ID NO: 89163 - DNA, 20 bp, human
gtacgagacgatggaaacgg

SEQ ID NO: 89164 - DNA, 20 bp, human
gctacagataaaactcaggg

SEQ ID NO: 89165 - DNA, 20 bp, human
gcctaaaaggctgttgcgag

SEQ ID NO: 89166 - DNA, 20 bp, human
ggcccgaggacgtacgtcat

SEQ ID NO: 89167 - DNA, 20 bp, human
gggacgtacgtcatcggcga

SEQ ID NO: 89168 - DNA, 20 bp, human
ggaagggcgtgcccaatgga

SEQ ID NO: 89169 - DNA, 20 bp, human
gcatcggcgacggctcccgc

SEQ ID NO: 89170 - DNA, 20 bp, human
gccaccggacgcccagccgg

SEQ ID NO: 89171 - DNA, 20 bp, human
gctgggtgcttggtacacgg

SEQ ID NO: 89172 - DNA, 20 bp, human
gggtggccggtgtagcagag

SEQ ID NO: 89173 - DNA, 20 bp, human
gctgccttcggggagttcag

SEQ ID NO: 89174 - DNA, 20 bp, human
gcgctcccgctctgctacac

SEQ ID NO: 89175 - DNA, 20 bp, human
gaccccgccttaatagtggg

SEQ ID NO: 89176 - DNA, 20 bp, human
gtagtcggatagttggcggg

SEQ ID NO: 89177 - DNA, 20 bp, human
ggcgggtggttgagtagaag

SEQ ID NO: 89178 - DNA, 20 bp, human
gcggggagcgcgacacatcc

SEQ ID NO: 89179 - DNA, 20 bp, human
ggaggtggtagtcggatagt

SEQ ID NO: 89180 - DNA, 20 bp, human
ggaagcggtcgccatgtccg

SEQ ID NO: 89181 - DNA, 20 bp, human
ggggcggaagtgacgagagg

SEQ ID NO: 89182 - DNA, 20 bp, human
gatcctggagctggcgggta

SEQ ID NO: 89183 - DNA, 20 bp, human
gagggccggcggggatccga

SEQ ID NO: 89184 - DNA, 20 bp, human
gagtgacgagaggtggtagt

SEQ ID NO: 89185 - DNA, 20 bp, human
gggcatcggagcgagcactg

SEQ ID NO: 89186 - DNA, 20 bp, human
gtggggcgccagcgagctag

SEQ ID NO: 89187 - DNA, 20 bp, human
ggagcgagcccagcggcgca

SEQ ID NO: 89188 - DNA, 20 bp, human
gagcgcggcgagcaacggag

SEQ ID NO: 89189 - DNA, 20 bp, human
gggaacagaggccatcccag

SEQ ID NO: 89190 - DNA, 20 bp, human
gcgcgcgccacacaaagcgg

SEQ ID NO: 89191 - DNA, 20 bp, human
gcccgtacagctggagagcg

SEQ ID NO: 89192 - DNA, 20 bp, human
gtgaggacgaccaggtgaca

SEQ ID NO: 89193 - DNA, 20 bp, human
gaaaggctccagggcgcgag

SEQ ID NO: 89194 - DNA, 20 bp, human
gtctataagagggcgagggg

SEQ ID NO: 89195 - DNA, 20 bp, human
gccagctgtacggggcagag

SEQ ID NO: 89196 - DNA, 20 bp, human
gggaggaagacagggtaccc

SEQ ID NO: 89197 - DNA, 20 bp, human
gacggcgacgcgcacagagg

SEQ ID NO: 89198 - DNA, 20 bp, human
ggagacgccgaatgagaccc

SEQ ID NO: 89199 - DNA, 20 bp, human
gacccagatgcagggacggt

SEQ ID NO: 89200 - DNA, 20 bp, human
gcggccgcgctcctccgcta

SEQ ID NO: 89201 - DNA, 20 bp, human
ggcgacggcgacgcgcacag

SEQ ID NO: 89202 - DNA, 20 bp, human
gacacccggacggactgaca

SEQ ID NO: 89203 - DNA, 20 bp, human
gctcgcggcgcaggctaaga

SEQ ID NO: 89204 - DNA, 20 bp, human
gaccgaggccgcagacctcg

SEQ ID NO: 89205 - DNA, 20 bp, human
gcgcggggcgcacagaaaca

SEQ ID NO: 89206 - DNA, 20 bp, human
ggctgggagcatgggctctc

SEQ ID NO: 89207 - DNA, 20 bp, human
gcgaaagcggtgcagacggg

SEQ ID NO: 89208 - DNA, 20 bp, human
ggcttggggcacagacgcag

SEQ ID NO: 89209 - DNA, 20 bp, human
gcatgctgcaagggccaggg

SEQ ID NO: 89210 - DNA, 20 bp, human
ggccggaagctggcgtactc

SEQ ID NO: 89211 - DNA, 20 bp, human
gctgctctcggtgtacatgt

SEQ ID NO: 89212 - DNA, 20 bp, human
gcatggagaaatgggctccc

SEQ ID NO: 89213 - DNA, 20 bp, human
gcagcgaaagcggtgcagac

SEQ ID NO: 89214 - DNA, 20 bp, human
ggaggaaggtgagtgacccc

SEQ ID NO: 89215 - DNA, 20 bp, human
gcgtactccggcagcgaaag

SEQ ID NO: 89216 - DNA, 20 bp, human
gccgggcgagacccattcgg

SEQ ID NO: 89217 - DNA, 20 bp, human
ggtgcacagaggtccccgtg

SEQ ID NO: 89218 - DNA, 20 bp, human
ggacgagcgagcaagagcta

SEQ ID NO: 89219 - DNA, 20 bp, human
ggcgagcaagagctacggtt

SEQ ID NO: 89220 - DNA, 20 bp, human
gcaagagctacggttgggaa

SEQ ID NO: 89221 - DNA, 20 bp, human
ggcctgaggcagctctggct

SEQ ID NO: 89222 - DNA, 20 bp, human
gtccccgtggggctagcaaa

SEQ ID NO: 89223 - DNA, 20 bp, human
gcgggtccatccgtgcacag

SEQ ID NO: 89224 - DNA, 20 bp, human
gtgcccaccgggcccggcgg

SEQ ID NO: 89225 - DNA, 20 bp, human
ggcgcgacgcagtccagtca

SEQ ID NO: 89226 - DNA, 20 bp, human
ggcgcggaattcagaggcag

SEQ ID NO: 89227 - DNA, 20 bp, human
ggtcatgtgactccagaacc

SEQ ID NO: 89228 - DNA, 20 bp, human
ggcgggtccaccagttgtca

SEQ ID NO: 89229 - DNA, 20 bp, human
gctttcccggaaggtctgtg

SEQ ID NO: 89230 - DNA, 20 bp, human
gctgttaccctgacaactgg

SEQ ID NO: 89231 - DNA, 20 bp, human
gcgcgggttcgggaattgga

SEQ ID NO: 89232 - DNA, 20 bp, human
gcagaccttccgggaaagcg

SEQ ID NO: 89233 - DNA, 20 bp, human
gggtgttactctgcacgatg

SEQ ID NO: 89234 - DNA, 20 bp, human
gtgaagcacggcctcgacca

SEQ ID NO: 89235 - DNA, 20 bp, human
gaattccgcgctttcccgga

SEQ ID NO: 89236 - DNA, 20 bp, human
ggcgcagacctggactcggg

SEQ ID NO: 89237 - DNA, 20 bp, human
gtgagcgcagacctggactc

SEQ ID NO: 89238 - DNA, 20 bp, human
gatccgcggggtgcaaccct

SEQ ID NO: 89239 - DNA, 20 bp, human
gtgactctggagcctaccgg

SEQ ID NO: 89240 - DNA, 20 bp, human
gcgcccagggttgcaccccg

SEQ ID NO: 89241 - DNA, 20 bp, human
gaaccctgggcgcggaatcc

SEQ ID NO: 89242 - DNA, 20 bp, human
gcagacctggactcgggcgg

SEQ ID NO: 89243 - DNA, 20 bp, human
gctgctctgtccaccaggtg

SEQ ID NO: 89244 - DNA, 20 bp, human
ggaaagtcgctccatccgcg

SEQ ID NO: 89245 - DNA, 20 bp, human
ggcggcggaaaaggtgtgtg
